United States Patent 7,691,997 (FUNCTIONAL AND HYPERFUNCTIONAL SIRNA) - sequence listing, part 7

SEQ ID NO: 247811 - RNA, 19 nt, Homo sapiens
aacauuggcuuccacauca

SEQ ID NO: 247812 - RNA, 19 nt, Homo sapiens
cugaacacguuaucacuug

SEQ ID NO: 247813 - RNA, 19 nt, Homo sapiens
gagaaucgcuugaaaacag

SEQ ID NO: 247814 - RNA, 19 nt, Homo sapiens
aaugaacugugucaaguau

SEQ ID NO: 247815 - RNA, 19 nt, Homo sapiens
gccaagauucaggaaauua

SEQ ID NO: 247816 - RNA, 19 nt, Homo sapiens
gaaacacgccugugaucca

SEQ ID NO: 247817 - RNA, 19 nt, Homo sapiens
gugauucauuccauaucua

SEQ ID NO: 247818 - RNA, 19 nt, Homo sapiens
gaaacaaauaccugacugu

SEQ ID NO: 247819 - RNA, 19 nt, Homo sapiens
gaagaaacuaaucaaacug

SEQ ID NO: 247820 - RNA, 19 nt, Homo sapiens
gcaaacaugaccuuucaag

SEQ ID NO: 247821 - RNA, 19 nt, Homo sapiens
gggauuauacauaugcaaa

SEQ ID NO: 247822 - RNA, 19 nt, Homo sapiens
gaaagucugaacacguuau

SEQ ID NO: 247823 - RNA, 19 nt, Homo sapiens
cgggagauauuucaaacau

SEQ ID NO: 247824 - RNA, 19 nt, Homo sapiens
cuuaaaccuucuuccagua

SEQ ID NO: 247825 - RNA, 19 nt, Homo sapiens
gagguugacucauuuacac

SEQ ID NO: 247826 - RNA, 19 nt, Homo sapiens
cagcacuacuuacgucaug

SEQ ID NO: 247827 - RNA, 19 nt, Homo sapiens
agaaguacauuuagaagcu

SEQ ID NO: 247828 - RNA, 19 nt, Homo sapiens
ggaaagucugaacacguua

SEQ ID NO: 247829 - RNA, 19 nt, Homo sapiens
ucaauuaugucuucuuucc

SEQ ID NO: 247830 - RNA, 19 nt, Homo sapiens
gcucucccguuugucauuu

SEQ ID NO: 247831 - RNA, 19 nt, Homo sapiens
cacaguaucuacccuuaca

SEQ ID NO: 247832 - RNA, 19 nt, Homo sapiens
gcaccguggcuaaggauga

SEQ ID NO: 247833 - RNA, 19 nt, Homo sapiens
ucaccggacuugcauugga

SEQ ID NO: 247834 - RNA, 19 nt, Homo sapiens
uuagaucccuuagugauuc

SEQ ID NO: 247835 - RNA, 19 nt, Homo sapiens
gucagaauauuacuaguac

SEQ ID NO: 247836 - RNA, 19 nt, Homo sapiens
agauaaggcaauagugaua

SEQ ID NO: 247837 - RNA, 19 nt, Homo sapiens
ggaaaacacuucaaaugcu

SEQ ID NO: 247838 - RNA, 19 nt, Homo sapiens
gauuauccacugauuuaug

SEQ ID NO: 247839 - RNA, 19 nt, Homo sapiens
guuaagaacugugcaaaua

SEQ ID NO: 247840 - RNA, 19 nt, Homo sapiens
guaauaaagucucccuuaa

SEQ ID NO: 247841 - RNA, 19 nt, Homo sapiens
ggcgagagcugcaaaguuu

SEQ ID NO: 247842 - RNA, 19 nt, Homo sapiens
gcaaguagcugggauuaca

SEQ ID NO: 247843 - RNA, 19 nt, Homo sapiens
gaacuacuguguaucuguu

SEQ ID NO: 247844 - RNA, 19 nt, Homo sapiens
ggacagcccucagcaguug

SEQ ID NO: 247845 - RNA, 19 nt, Homo sapiens
gaagagccaucgaaguuuc

SEQ ID NO: 247846 - RNA, 19 nt, Homo sapiens
gagcugcaaaguuuaauua

SEQ ID NO: 247847 - RNA, 19 nt, Homo sapiens
aaaccugaaugccauauuu

SEQ ID NO: 247848 - RNA, 19 nt, Homo sapiens
cgaggacagugacgacuua

SEQ ID NO: 247849 - RNA, 19 nt, Homo sapiens
agaagaaagugugggauua

SEQ ID NO: 247850 - RNA, 19 nt, Homo sapiens
caccaugccuagcaaauuu

SEQ ID NO: 247851 - RNA, 19 nt, Homo sapiens
ggaggaaacugugguguuc

SEQ ID NO: 247852 - RNA, 19 nt, Homo sapiens
aaacaugaguggaaauuuc

SEQ ID NO: 247853 - RNA, 19 nt, Homo sapiens
ugauuuaucucucgucauu

SEQ ID NO: 247854 - RNA, 19 nt, Homo sapiens
gaggaagaauuacaguuug

SEQ ID NO: 247855 - RNA, 19 nt, Homo sapiens
gggaagagccaucgaaguu

SEQ ID NO: 247856 - RNA, 19 nt, Homo sapiens
ggacagugacgacuuagaa

SEQ ID NO: 247857 - RNA, 19 nt, Homo sapiens
ggaaauuucaccuauauca

SEQ ID NO: 247858 - RNA, 19 nt, Homo sapiens
caucuuaucaugggaauua

SEQ ID NO: 247859 - RNA, 19 nt, Homo sapiens
ggugaaauuuccaucuauu

SEQ ID NO: 247860 - RNA, 19 nt, Homo sapiens
auaaugagaugacuccaaa

SEQ ID NO: 247861 - RNA, 19 nt, Homo sapiens
guggaaauuucaccuauau

SEQ ID NO: 247862 - RNA, 19 nt, Homo sapiens
gcaaauaccacaagaucau

SEQ ID NO: 247863 - RNA, 19 nt, Homo sapiens
acacugaaauggauugguu

SEQ ID NO: 247864 - RNA, 19 nt, Homo sapiens
cagagggaauuguuaagaa

SEQ ID NO: 247865 - RNA, 19 nt, Homo sapiens
ucagugcauuguuuacaua

SEQ ID NO: 247866 - RNA, 19 nt, Homo sapiens
cauaugauucgccugauua

SEQ ID NO: 247867 - RNA, 19 nt, Homo sapiens
ccaggacccuaugauauuu

SEQ ID NO: 247868 - RNA, 19 nt, Homo sapiens
gaaugaacuuggacagaca

SEQ ID NO: 247869 - RNA, 19 nt, Homo sapiens
ggaaggaggaggaaacugu

SEQ ID NO: 247870 - RNA, 19 nt, Homo sapiens
gaaagugugggauuauaau

SEQ ID NO: 247871 - RNA, 19 nt, Homo sapiens
gaagaaagugugggauuau

SEQ ID NO: 247872 - RNA, 19 nt, Homo sapiens
gaaauagccuccccaaagu

SEQ ID NO: 247873 - RNA, 19 nt, Homo sapiens
ggaaucagaaucagcagaa

SEQ ID NO: 247874 - RNA, 19 nt, Homo sapiens
gaguggaaauuucaccuau

SEQ ID NO: 247875 - RNA, 19 nt, Homo sapiens
gaguaaaccagaagauuug

SEQ ID NO: 247876 - RNA, 19 nt, Homo sapiens
caccuuuccuuuacacuaa

SEQ ID NO: 247877 - RNA, 19 nt, Homo sapiens
gcuaucgucucaucuggaa

SEQ ID NO: 247878 - RNA, 19 nt, Homo sapiens
aaacagucguccugccuaa

SEQ ID NO: 247879 - RNA, 19 nt, Homo sapiens
ggaaacaugaguggaaauu

SEQ ID NO: 247880 - RNA, 19 nt, Homo sapiens
gcauaaacccgaaauaaaa

SEQ ID NO: 247881 - RNA, 19 nt, Homo sapiens
ugaguaaaccagaagauuu

SEQ ID NO: 247882 - RNA, 19 nt, Homo sapiens
cagaggauccugauaaugu

SEQ ID NO: 247883 - RNA, 19 nt, Homo sapiens
gcugcaaaguuuaauuaga

SEQ ID NO: 247884 - RNA, 19 nt, Homo sapiens
ugaggaagaauuacaguuu

SEQ ID NO: 247885 - RNA, 19 nt, Homo sapiens
cauccugucuccugcaauu

SEQ ID NO: 247886 - RNA, 19 nt, Homo sapiens
ggaagagccaucgaaguuu

SEQ ID NO: 247887 - RNA, 19 nt, Homo sapiens
gugcauuguuuacauauuc

SEQ ID NO: 247888 - RNA, 19 nt, Homo sapiens
gaaacaugaguggaaauuu

SEQ ID NO: 247889 - RNA, 19 nt, Homo sapiens
caccagaguuugagauugu

SEQ ID NO: 247890 - RNA, 19 nt, Homo sapiens
gaaacugugguguuccuuu

SEQ ID NO: 247891 - RNA, 19 nt, Homo sapiens
aagaaagugugggauuaua

SEQ ID NO: 247892 - RNA, 19 nt, Homo sapiens
ucaccuauaucauugacaa

SEQ ID NO: 247893 - RNA, 19 nt, Homo sapiens
ucagaucacuuaauuuggu

SEQ ID NO: 247894 - RNA, 19 nt, Homo sapiens
gggcagaauuaccuucaau

SEQ ID NO: 247895 - RNA, 19 nt, Homo sapiens
gaugaaagugauagcgaua

SEQ ID NO: 247896 - RNA, 19 nt, Homo sapiens
auucacaggugcagucaua

SEQ ID NO: 247897 - RNA, 19 nt, Homo sapiens
gaggaauaauuacuguguu

SEQ ID NO: 247898 - RNA, 19 nt, Homo sapiens
gcacagugaugagcaagca

SEQ ID NO: 247899 - RNA, 19 nt, Homo sapiens
caugugcaccuuuccuuua

SEQ ID NO: 247900 - RNA, 19 nt, Homo sapiens
gaagcauaaacccgaaaua

SEQ ID NO: 247901 - RNA, 19 nt, Homo sapiens
gcagaauuaccuucaaugu

SEQ ID NO: 247902 - RNA, 19 nt, Homo sapiens
gcgcaauggugugaucuug

SEQ ID NO: 247903 - RNA, 19 nt, Homo sapiens
gcaccuuuccuuuacacua

SEQ ID NO: 247904 - RNA, 19 nt, Homo sapiens
ggaggaauaauuacugugu

SEQ ID NO: 247905 - RNA, 19 nt, Homo sapiens
gcacacacgaggccuaugu

SEQ ID NO: 247906 - RNA, 19 nt, Homo sapiens
caagauaucauugcgaaau

SEQ ID NO: 247907 - RNA, 19 nt, Homo sapiens
gacaucaccuaugcacauu

SEQ ID NO: 247908 - RNA, 19 nt, Homo sapiens
aagcauaaacccgaaauaa

SEQ ID NO: 247909 - RNA, 19 nt, Homo sapiens
guauaucagccucguguuu

SEQ ID NO: 247910 - RNA, 19 nt, Homo sapiens
gaaggugguuaagaacugu

SEQ ID NO: 247911 - RNA, 19 nt, Homo sapiens
ugagaugacuccaaaacua

SEQ ID NO: 247912 - RNA, 19 nt, Homo sapiens
gaugagcaagcaguaauaa

SEQ ID NO: 247913 - RNA, 19 nt, Homo sapiens
gaaauuuccgguccaucuu

SEQ ID NO: 247914 - RNA, 19 nt, Homo sapiens
gcacuuucaagauaucauu

SEQ ID NO: 247915 - RNA, 19 nt, Homo sapiens
uaccuucaauguggacuua

SEQ ID NO: 247916 - RNA, 19 nt, Homo sapiens
aaacugugguguuccuuuc

SEQ ID NO: 247917 - RNA, 19 nt, Homo sapiens
cagcugauauggacucucu

SEQ ID NO: 247918 - RNA, 19 nt, Homo sapiens
gagcaagcaguaauaaagu

SEQ ID NO: 247919 - RNA, 19 nt, Homo sapiens
ucacuuaauuugguucuca

SEQ ID NO: 247920 - RNA, 19 nt, Homo sapiens
ggaauuguuaagaagcaua

SEQ ID NO: 247921 - RNA, 19 nt, Homo sapiens
cgagagcugcaaaguuuaa

SEQ ID NO: 247922 - RNA, 19 nt, Homo sapiens
ggacagacaagcaccuaca

SEQ ID NO: 247923 - RNA, 19 nt, Homo sapiens
gaauuuugaucaccuaaug

SEQ ID NO: 247924 - RNA, 19 nt, Homo sapiens
aguaauaaagucucccuua

SEQ ID NO: 247925 - RNA, 19 nt, Homo sapiens
aaaggaaacaugaguggaa

SEQ ID NO: 247926 - RNA, 19 nt, Homo sapiens
ucauaugauucgccugauu

SEQ ID NO: 247927 - RNA, 19 nt, Homo sapiens
ugaaacuccugagcucaaa

SEQ ID NO: 247928 - RNA, 19 nt, Homo sapiens
aguuugagauuguugguuu

SEQ ID NO: 247929 - RNA, 19 nt, Homo sapiens
ugaaggugguuaagaacug

SEQ ID NO: 247930 - RNA, 19 nt, Homo sapiens
gcaccuacaggguucuuug

SEQ ID NO: 247931 - RNA, 19 nt, Homo sapiens
ggaugguuauauaaugaga

SEQ ID NO: 247932 - RNA, 19 nt, Homo sapiens
agaaagugugggauuauaa

SEQ ID NO: 247933 - RNA, 19 nt, Homo sapiens
ccuauaucauugacaaguu

SEQ ID NO: 247934 - RNA, 19 nt, Homo sapiens
caucuauuguugaggaaga

SEQ ID NO: 247935 - RNA, 19 nt, Homo sapiens
aaucaugaguaaaccagaa

SEQ ID NO: 247936 - RNA, 19 nt, Homo sapiens
ugacuaauacagaaaggaa

SEQ ID NO: 247937 - RNA, 19 nt, Homo sapiens
ccugugauauuucugugaa

SEQ ID NO: 247938 - RNA, 19 nt, Homo sapiens
ggagcgcaauggugugauc

SEQ ID NO: 247939 - RNA, 19 nt, Homo sapiens
cagaacaucuuugcuauuu

SEQ ID NO: 247940 - RNA, 19 nt, Homo sapiens
ccaaauugcucuccuguug

SEQ ID NO: 247941 - RNA, 19 nt, Homo sapiens
ggaaugagacuauuguuga

SEQ ID NO: 247942 - RNA, 19 nt, Homo sapiens
gcuaaugucuaucaucaga

SEQ ID NO: 247943 - RNA, 19 nt, Homo sapiens
gaaaggacacuagaagauu

SEQ ID NO: 247944 - RNA, 19 nt, Homo sapiens
aaaggacacuagaagauuu

SEQ ID NO: 247945 - RNA, 19 nt, Homo sapiens
caacaagugucuccuccaa

SEQ ID NO: 247946 - RNA, 19 nt, Homo sapiens
uuaagugacugauggcuaa

SEQ ID NO: 247947 - RNA, 19 nt, Homo sapiens
gcuaauguacugcaaauga

SEQ ID NO: 247948 - RNA, 19 nt, Homo sapiens
caacuugcuuggauuccua

SEQ ID NO: 247949 - RNA, 19 nt, Homo sapiens
ugacaucccugaggagauu

SEQ ID NO: 247950 - RNA, 19 nt, Homo sapiens
gaacaucuuugcuauuuuc

SEQ ID NO: 247951 - RNA, 19 nt, Homo sapiens
cuacaaagaagcagcaauu

SEQ ID NO: 247952 - RNA, 19 nt, Homo sapiens
uaaaccaucugaagacagu

SEQ ID NO: 247953 - RNA, 19 nt, Homo sapiens
ucuaugagaugcuccagaa

SEQ ID NO: 247954 - RNA, 19 nt, Homo sapiens
cuaauguacugcaaaugaa

SEQ ID NO: 247955 - RNA, 19 nt, Homo sapiens
gaagacaguccuggaagaa

SEQ ID NO: 247956 - RNA, 19 nt, Homo sapiens
gauaaaccaucugaagaca

SEQ ID NO: 247957 - RNA, 19 nt, Homo sapiens
acaagugucuccuccaaau

SEQ ID NO: 247958 - RNA, 19 nt, Homo sapiens
gcaaaugaaaggacacuag

SEQ ID NO: 247959 - RNA, 19 nt, Homo sapiens
gaaugagacuauuguugag

SEQ ID NO: 247960 - RNA, 19 nt, Homo sapiens
ugaaugggaggcuugaaua

SEQ ID NO: 247961 - RNA, 19 nt, Homo sapiens
ugaagacaguccuggaaga

SEQ ID NO: 247962 - RNA, 19 nt, Homo sapiens
gcauugaccaucuaugaga

SEQ ID NO: 247963 - RNA, 19 nt, Homo sapiens
uugagaaccuccuggcuaa

SEQ ID NO: 247964 - RNA, 19 nt, Homo sapiens
caaaugaaaggacacuaga

SEQ ID NO: 247965 - RNA, 19 nt, Homo sapiens
cuacagcucuuuccaugag

SEQ ID NO: 247966 - RNA, 19 nt, Homo sapiens
gcuacaacuugcuuggauu

SEQ ID NO: 247967 - RNA, 19 nt, Homo sapiens
gcagaugcuguuuaaguga

SEQ ID NO: 247968 - RNA, 19 nt, Homo sapiens
uggcuaaugucuaucauca

SEQ ID NO: 247969 - RNA, 19 nt, Homo sapiens
ugaaaggacacuagaagau

SEQ ID NO: 247970 - RNA, 19 nt, Homo sapiens
augggaggauucugcauua

SEQ ID NO: 247971 - RNA, 19 nt, Homo sapiens
uugcuuggauuccuacaaa

SEQ ID NO: 247972 - RNA, 19 nt, Homo sapiens
gaccauagucagaguggaa

SEQ ID NO: 247973 - RNA, 19 nt, Homo sapiens
ccuccuggcuaaugucuau

SEQ ID NO: 247974 - RNA, 19 nt, Homo sapiens
caaagaagcagcaauuuuc

SEQ ID NO: 247975 - RNA, 19 nt, Homo sapiens
gagaaccuccuggcuaaug

SEQ ID NO: 247976 - RNA, 19 nt, Homo sapiens
aaauugcucuccuguugug

SEQ ID NO: 247977 - RNA, 19 nt, Homo sapiens
cuaaggaacuuuuacuuca

SEQ ID NO: 247978 - RNA, 19 nt, Homo sapiens
ggacuggacaauugcuuca

SEQ ID NO: 247979 - RNA, 19 nt, Homo sapiens
ggaggauucugcauuaccu

SEQ ID NO: 247980 - RNA, 19 nt, Homo sapiens
uccagaacaucuuugcuau

SEQ ID NO: 247981 - RNA, 19 nt, Homo sapiens
aggacaggaugaacuuuga

SEQ ID NO: 247982 - RNA, 19 nt, Homo sapiens
ucaaggacaggaugaacuu

SEQ ID NO: 247983 - RNA, 19 nt, Homo sapiens
uggcuaauguacugcaaau

SEQ ID NO: 247984 - RNA, 19 nt, Homo sapiens
ccagaacaucuuugcuauu

SEQ ID NO: 247985 - RNA, 19 nt, Homo sapiens
cagaagcuccuguggcaau

SEQ ID NO: 247986 - RNA, 19 nt, Homo sapiens
ucacugugccuggaccaua

SEQ ID NO: 247987 - RNA, 19 nt, Homo sapiens
acugauggcuaauguacug

SEQ ID NO: 247988 - RNA, 19 nt, Homo sapiens
caagugucuccuccaaauu

SEQ ID NO: 247989 - RNA, 19 nt, Homo sapiens
cgaaacugaagaucuccua

SEQ ID NO: 247990 - RNA, 19 nt, Homo sapiens
agacaguccuggaagaaaa

SEQ ID NO: 247991 - RNA, 19 nt, Homo sapiens
aagcuccuguggcaauuga

SEQ ID NO: 247992 - RNA, 19 nt, Homo sapiens
caaauugcucuccuguugu

SEQ ID NO: 247993 - RNA, 19 nt, Homo sapiens
gauggcuaauguacugcaa

SEQ ID NO: 247994 - RNA, 19 nt, Homo sapiens
gcuuggauuccuacaaaga

SEQ ID NO: 247995 - RNA, 19 nt, Homo sapiens
gauucugcauuaccugaag

SEQ ID NO: 247996 - RNA, 19 nt, Homo sapiens
gcuggaaugagacuauugu

SEQ ID NO: 247997 - RNA, 19 nt, Homo sapiens
gcagcaauuuucaguguca

SEQ ID NO: 247998 - RNA, 19 nt, Homo sapiens
ugacugauggcuaauguac

SEQ ID NO: 247999 - RNA, 19 nt, Homo sapiens
uaugggaggauucugcauu

SEQ ID NO: 248000 - RNA, 19 nt, Homo sapiens
agaaccuccuggcuaaugu

SEQ ID NO: 248001 - RNA, 19 nt, Homo sapiens
cuccagaacaucuuugcua

SEQ ID NO: 248002 - RNA, 19 nt, Homo sapiens
uaugagaugcuccagaaca

SEQ ID NO: 248003 - RNA, 19 nt, Homo sapiens
uacaaagaagcagcaauuu

SEQ ID NO: 248004 - RNA, 19 nt, Homo sapiens
agaagcuccuguggcaauu

SEQ ID NO: 248005 - RNA, 19 nt, Homo sapiens
augagacuauuguugagaa

SEQ ID NO: 248006 - RNA, 19 nt, Homo sapiens
uggaaugagacuauuguug

SEQ ID NO: 248007 - RNA, 19 nt, Homo sapiens
caucuuugcuauuuucaga

SEQ ID NO: 248008 - RNA, 19 nt, Homo sapiens
aagugucuccuccaaauug

SEQ ID NO: 248009 - RNA, 19 nt, Homo sapiens
agucagaguggaaauccua

SEQ ID NO: 248010 - RNA, 19 nt, Homo sapiens
gauauuaugggaggauucu

SEQ ID NO: 248011 - RNA, 19 nt, Homo sapiens
acaaagaagcagcaauuuu

SEQ ID NO: 248012 - RNA, 19 nt, Homo sapiens
agcacuggcuggaaugaga

SEQ ID NO: 248013 - RNA, 19 nt, Homo sapiens
aaaugaaaggacacuagaa

SEQ ID NO: 248014 - RNA, 19 nt, Homo sapiens
gagcuacaacuugcuugga

SEQ ID NO: 248015 - RNA, 19 nt, Homo sapiens
gcucuccuguugugcuucu

SEQ ID NO: 248016 - RNA, 19 nt, Homo sapiens
auuaacagacuuacagguu

SEQ ID NO: 248017 - RNA, 19 nt, Homo sapiens
gaagcuccuguggcaauug

SEQ ID NO: 248018 - RNA, 19 nt, Homo sapiens
cuguugugcuucuccacua

SEQ ID NO: 248019 - RNA, 19 nt, Homo sapiens
caaggacaggaugaacuuu

SEQ ID NO: 248020 - RNA, 19 nt, Homo sapiens
aaugaaaggacacuagaag

SEQ ID NO: 248021 - RNA, 19 nt, Homo sapiens
cucugggacuggacaauug

SEQ ID NO: 248022 - RNA, 19 nt, Homo sapiens
cacugugccuggaccauag

SEQ ID NO: 248023 - RNA, 19 nt, Homo sapiens
ggauucugcauuaccugaa

SEQ ID NO: 248024 - RNA, 19 nt, Homo sapiens
cuacaacuugcuuggauuc

SEQ ID NO: 248025 - RNA, 19 nt, Homo sapiens
ccacuacagcucuuuccau

SEQ ID NO: 248026 - RNA, 19 nt, Homo sapiens
gaaacgagaugacuucgaa

SEQ ID NO: 248027 - RNA, 19 nt, Homo sapiens
ucgaaaagcugacuaauua

SEQ ID NO: 248028 - RNA, 19 nt, Homo sapiens
caacuucuuuggcuuaauu

SEQ ID NO: 248029 - RNA, 19 nt, Homo sapiens
agacagaacuugaaugugu

SEQ ID NO: 248030 - RNA, 19 nt, Homo sapiens
guacccaaauggaaaguaa

SEQ ID NO: 248031 - RNA, 19 nt, Homo sapiens
ggagucagaugcuguuuca

SEQ ID NO: 248032 - RNA, 19 nt, Homo sapiens
gaagagaaagaucaguuaa

SEQ ID NO: 248033 - RNA, 19 nt, Homo sapiens
gagccaaauugucuccuuu

SEQ ID NO: 248034 - RNA, 19 nt, Homo sapiens
gaucagcuauuagaagaga

SEQ ID NO: 248035 - RNA, 19 nt, Homo sapiens
gaacuacugauuucaacuu

SEQ ID NO: 248036 - RNA, 19 nt, Homo sapiens
gaagagcaucccaguaaug

SEQ ID NO: 248037 - RNA, 19 nt, Homo sapiens
cggaaacgaugaaauauac

SEQ ID NO: 248038 - RNA, 19 nt, Homo sapiens
gauacaagaacuacugauu

SEQ ID NO: 248039 - RNA, 19 nt, Homo sapiens
ggaaaguaacucauuuguu

SEQ ID NO: 248040 - RNA, 19 nt, Homo sapiens
aggcaaggcuaugugauua

SEQ ID NO: 248041 - RNA, 19 nt, Homo sapiens
gcaaagcaauacaugaacu

SEQ ID NO: 248042 - RNA, 19 nt, Homo sapiens
uacaagaacuacugauuuc

SEQ ID NO: 248043 - RNA, 19 nt, Homo sapiens
ucgaagagcaucccaguaa

SEQ ID NO: 248044 - RNA, 19 nt, Homo sapiens
aaucugagccagugcuuua

SEQ ID NO: 248045 - RNA, 19 nt, Homo sapiens
uguccugccugcaauauuu

SEQ ID NO: 248046 - RNA, 19 nt, Homo sapiens
aaagaucaguuaaguccuu

SEQ ID NO: 248047 - RNA, 19 nt, Homo sapiens
agagaaagaucaguuaagu

SEQ ID NO: 248048 - RNA, 19 nt, Homo sapiens
aagaucagcuauuagaaga

SEQ ID NO: 248049 - RNA, 19 nt, Homo sapiens
gagcaucccaguaaugguu

SEQ ID NO: 248050 - RNA, 19 nt, Homo sapiens
gaaagaggagagugacaga

SEQ ID NO: 248051 - RNA, 19 nt, Homo sapiens
ucccauggguuguguguuu

SEQ ID NO: 248052 - RNA, 19 nt, Homo sapiens
gcaaggcuaugugauuaca

SEQ ID NO: 248053 - RNA, 19 nt, Homo sapiens
ucucggaaacgaugaaaua

SEQ ID NO: 248054 - RNA, 19 nt, Homo sapiens
uuucagcucugcaucguuu

SEQ ID NO: 248055 - RNA, 19 nt, Homo sapiens
agaagagaaagaucaguua

SEQ ID NO: 248056 - RNA, 19 nt, Homo sapiens
gcagaaaaccuuaagaaau

SEQ ID NO: 248057 - RNA, 19 nt, Homo sapiens
caagaacuacugauuucaa

SEQ ID NO: 248058 - RNA, 19 nt, Homo sapiens
cuacugauuucaacuucuu

SEQ ID NO: 248059 - RNA, 19 nt, Homo sapiens
gaugauacaaugaacacuu

SEQ ID NO: 248060 - RNA, 19 nt, Homo sapiens
cgaagagcaucccaguaau

SEQ ID NO: 248061 - RNA, 19 nt, Homo sapiens
cuaauuauucgguaacuga

SEQ ID NO: 248062 - RNA, 19 nt, Homo sapiens
ggacccauauguaaaagaa

SEQ ID NO: 248063 - RNA, 19 nt, Homo sapiens
uggguucucuuggcuguua

SEQ ID NO: 248064 - RNA, 19 nt, Homo sapiens
gcagccaaccuaagcaaga

SEQ ID NO: 248065 - RNA, 19 nt, Homo sapiens
gcggauaauggaacucuuu

SEQ ID NO: 248066 - RNA, 19 nt, Homo sapiens
gccuggugcuuccaaauau

SEQ ID NO: 248067 - RNA, 19 nt, Homo sapiens
auucagauguagcggauaa

SEQ ID NO: 248068 - RNA, 19 nt, Homo sapiens
ccaaauggaaaguaacuca

SEQ ID NO: 248069 - RNA, 19 nt, Homo sapiens
caacgcaaagcaauacaug

SEQ ID NO: 248070 - RNA, 19 nt, Homo sapiens
ucagacagaacuugaaugu

SEQ ID NO: 248071 - RNA, 19 nt, Homo sapiens
aaagaaacgagaugacuuc

SEQ ID NO: 248072 - RNA, 19 nt, Homo sapiens
gaccagagcauccaaaaga

SEQ ID NO: 248073 - RNA, 19 nt, Homo sapiens
gccaaauugucuccuuuua

SEQ ID NO: 248074 - RNA, 19 nt, Homo sapiens
ucggaaacgaugaaauaua

SEQ ID NO: 248075 - RNA, 19 nt, Homo sapiens
caucaaggaagacaugaau

SEQ ID NO: 248076 - RNA, 19 nt, Homo sapiens
gcaggucauucagauguag

SEQ ID NO: 248077 - RNA, 19 nt, Homo sapiens
uagaagagaaagaucaguu

SEQ ID NO: 248078 - RNA, 19 nt, Homo sapiens
uuaauucucucggaaacga

SEQ ID NO: 248079 - RNA, 19 nt, Homo sapiens
gcuauuagaagagaaagau

SEQ ID NO: 248080 - RNA, 19 nt, Homo sapiens
aagaggagagugacagaaa

SEQ ID NO: 248081 - RNA, 19 nt, Homo sapiens
gccaggacccauauguaaa

SEQ ID NO: 248082 - RNA, 19 nt, Homo sapiens
ugccaggacccauauguaa

SEQ ID NO: 248083 - RNA, 19 nt, Homo sapiens
guguuuauuucacuugaug

SEQ ID NO: 248084 - RNA, 19 nt, Homo sapiens
caaauugucuccuuuuacu

SEQ ID NO: 248085 - RNA, 19 nt, Homo sapiens
ugacuguacccaaauggaa

SEQ ID NO: 248086 - RNA, 19 nt, Homo sapiens
gugcuuuaauggcauguca

SEQ ID NO: 248087 - RNA, 19 nt, Homo sapiens
gaacugucgccagcagcua

SEQ ID NO: 248088 - RNA, 19 nt, Homo sapiens
gaccaucaaggaagacaug

SEQ ID NO: 248089 - RNA, 19 nt, Homo sapiens
uggagaccaucaaggaaga

SEQ ID NO: 248090 - RNA, 19 nt, Homo sapiens
cccauggguuguguguuua

SEQ ID NO: 248091 - RNA, 19 nt, Homo sapiens
acgcaaagcaauacaugaa

SEQ ID NO: 248092 - RNA, 19 nt, Homo sapiens
gaauaaaguguaaguucac

SEQ ID NO: 248093 - RNA, 19 nt, Homo sapiens
uaggcaaggcuaugugauu

SEQ ID NO: 248094 - RNA, 19 nt, Homo sapiens
gagaaagaucaguuaaguc

SEQ ID NO: 248095 - RNA, 19 nt, Homo sapiens
gacuguacccaaauggaaa

SEQ ID NO: 248096 - RNA, 19 nt, Homo sapiens
ccuggugcuuccaaauauu

SEQ ID NO: 248097 - RNA, 19 nt, Homo sapiens
cagccaaccuaagcaagau

SEQ ID NO: 248098 - RNA, 19 nt, Homo sapiens
uggguuguguguuuauuuc

SEQ ID NO: 248099 - RNA, 19 nt, Homo sapiens
gcuuaauucucucggaaac

SEQ ID NO: 248100 - RNA, 19 nt, Homo sapiens
uuucaacuucuuuggcuua

SEQ ID NO: 248101 - RNA, 19 nt, Homo sapiens
ucacuugaugauacaauga

SEQ ID NO: 248102 - RNA, 19 nt, Homo sapiens
ugccugcaauauuugaauu

SEQ ID NO: 248103 - RNA, 19 nt, Homo sapiens
ugccuggugcuuccaaaua

SEQ ID NO: 248104 - RNA, 19 nt, Homo sapiens
aagaucaguuaaguccuuu

SEQ ID NO: 248105 - RNA, 19 nt, Homo sapiens
gaauguccaacgcaaagca

SEQ ID NO: 248106 - RNA, 19 nt, Homo sapiens
uucgguaacugacuugaau

SEQ ID NO: 248107 - RNA, 19 nt, Homo sapiens
cugacuaauuauucgguaa

SEQ ID NO: 248108 - RNA, 19 nt, Homo sapiens
aauaaugcagagccaaauu

SEQ ID NO: 248109 - RNA, 19 nt, Homo sapiens
agauguagcggauaaugga

SEQ ID NO: 248110 - RNA, 19 nt, Homo sapiens
aaaagaagcagaaaaccuu

SEQ ID NO: 248111 - RNA, 19 nt, Homo sapiens
aaagcugacuaauuauucg

SEQ ID NO: 248112 - RNA, 19 nt, Homo sapiens
ggaaacgaugaaauauaca

SEQ ID NO: 248113 - RNA, 19 nt, Homo sapiens
cugagccagugcuuuaaug

SEQ ID NO: 248114 - RNA, 19 nt, Homo sapiens
cauggguuguguguuuauu

SEQ ID NO: 248115 - RNA, 19 nt, Homo sapiens
caagaucccauggguugug

SEQ ID NO: 248116 - RNA, 19 nt, Homo sapiens
cugucucacuuaauccuuu

SEQ ID NO: 248117 - RNA, 19 nt, Homo sapiens
guuacugccaggacccaua

SEQ ID NO: 248118 - RNA, 19 nt, Homo sapiens
cuuuggaccugaucagcuu

SEQ ID NO: 248119 - RNA, 19 nt, Homo sapiens
uaaugcagagccaaauugu

SEQ ID NO: 248120 - RNA, 19 nt, Homo sapiens
auaaugcagagccaaauug

SEQ ID NO: 248121 - RNA, 19 nt, Homo sapiens
gcuuuaauggcaugucaga

SEQ ID NO: 248122 - RNA, 19 nt, Homo sapiens
guguguuuauuucacuuga

SEQ ID NO: 248123 - RNA, 19 nt, Homo sapiens
gugauuacaaggcuuuauc

SEQ ID NO: 248124 - RNA, 19 nt, Homo sapiens
gaucaguuaaguccuuugg

SEQ ID NO: 248125 - RNA, 19 nt, Homo sapiens
aaaggagucagaugcuguu

SEQ ID NO: 248126 - RNA, 19 nt, Homo sapiens
gaaacuaccuguuacauua

SEQ ID NO: 248127 - RNA, 19 nt, Homo sapiens
gaagugagauccaguauaa

SEQ ID NO: 248128 - RNA, 19 nt, Homo sapiens
guaaagaacuaugguguua

SEQ ID NO: 248129 - RNA, 19 nt, Homo sapiens
cagcauggcucuccucuuu

SEQ ID NO: 248130 - RNA, 19 nt, Homo sapiens
ggaaucacauagcuccuua

SEQ ID NO: 248131 - RNA, 19 nt, Homo sapiens
gaaggagucuuacaugugu

SEQ ID NO: 248132 - RNA, 19 nt, Homo sapiens
gaacuaugguguuaagaau

SEQ ID NO: 248133 - RNA, 19 nt, Homo sapiens
ucacauagcuccuuaucug

SEQ ID NO: 248134 - RNA, 19 nt, Homo sapiens
gguaaagaguccuugauug

SEQ ID NO: 248135 - RNA, 19 nt, Homo sapiens
gaaaggaggagaagcaaau

SEQ ID NO: 248136 - RNA, 19 nt, Homo sapiens
uaacagaaguggugacuac

SEQ ID NO: 248137 - RNA, 19 nt, Homo sapiens
gaacauacagaagaacuuu

SEQ ID NO: 248138 - RNA, 19 nt, Homo sapiens
uaacggaacauauccagua

SEQ ID NO: 248139 - RNA, 19 nt, Homo sapiens
caaauggagugacuuagug

SEQ ID NO: 248140 - RNA, 19 nt, Homo sapiens
caacagaagauuccaaaga

SEQ ID NO: 248141 - RNA, 19 nt, Homo sapiens
gacaaaaccugaaucaaaa

SEQ ID NO: 248142 - RNA, 19 nt, Homo sapiens
gaaauuguucugagaguga

SEQ ID NO: 248143 - RNA, 19 nt, Homo sapiens
agagaguucuucaccuuua

SEQ ID NO: 248144 - RNA, 19 nt, Homo sapiens
uaacaugaacccuaucgua

SEQ ID NO: 248145 - RNA, 19 nt, Homo sapiens
caugaacccuaucguauau

SEQ ID NO: 248146 - RNA, 19 nt, Homo sapiens
gcaucaauauuucucauca

SEQ ID NO: 248147 - RNA, 19 nt, Homo sapiens
gagaguucuucaccuuuaa

SEQ ID NO: 248148 - RNA, 19 nt, Homo sapiens
cagaaguggugacuacuga

SEQ ID NO: 248149 - RNA, 19 nt, Homo sapiens
aacagaagauuccaaagaa

SEQ ID NO: 248150 - RNA, 19 nt, Homo sapiens
caagagcucauaaccguaa

SEQ ID NO: 248151 - RNA, 19 nt, Homo sapiens
gaugauagcgguaaagagu

SEQ ID NO: 248152 - RNA, 19 nt, Homo sapiens
gaaaugguuuugauacuga

SEQ ID NO: 248153 - RNA, 19 nt, Homo sapiens
aaagaguccuugauugguu

SEQ ID NO: 248154 - RNA, 19 nt, Homo sapiens
ggaagugagauccaguaua

SEQ ID NO: 248155 - RNA, 19 nt, Homo sapiens
ugacauauuucacccuuca

SEQ ID NO: 248156 - RNA, 19 nt, Homo sapiens
gcucauaaccguaauaaaa

SEQ ID NO: 248157 - RNA, 19 nt, Homo sapiens
cagaaggagucuuacaugu

SEQ ID NO: 248158 - RNA, 19 nt, Homo sapiens
gcagaaggagucuuacaug

SEQ ID NO: 248159 - RNA, 19 nt, Homo sapiens
gaggagaagcaaaucauga

SEQ ID NO: 248160 - RNA, 19 nt, Homo sapiens
guaaagaguccuugauugg

SEQ ID NO: 248161 - RNA, 19 nt, Homo sapiens
guacuguguuucagcagaa

SEQ ID NO: 248162 - RNA, 19 nt, Homo sapiens
ccaguuagcgauuccagua

SEQ ID NO: 248163 - RNA, 19 nt, Homo sapiens
gaaccuuuacauccagaua

SEQ ID NO: 248164 - RNA, 19 nt, Homo sapiens
gaaggacaagagcucauaa

SEQ ID NO: 248165 - RNA, 19 nt, Homo sapiens
gcagccaucugacuccaau

SEQ ID NO: 248166 - RNA, 19 nt, Homo sapiens
gagauucagugccaguuag

SEQ ID NO: 248167 - RNA, 19 nt, Homo sapiens
gcagaaggaagaugauugu

SEQ ID NO: 248168 - RNA, 19 nt, Homo sapiens
ccuauaacaugaacccuau

SEQ ID NO: 248169 - RNA, 19 nt, Homo sapiens
ucguaucacuccagaaauu

SEQ ID NO: 248170 - RNA, 19 nt, Homo sapiens
ccguagagguaaagaacua

SEQ ID NO: 248171 - RNA, 19 nt, Homo sapiens
caugagaucagcuaaguug

SEQ ID NO: 248172 - RNA, 19 nt, Homo sapiens
agagagaguucuucaccuu

SEQ ID NO: 248173 - RNA, 19 nt, Homo sapiens
aaagaacuaugguguuaag

SEQ ID NO: 248174 - RNA, 19 nt, Homo sapiens
ugacuuaguguacaugaaa

SEQ ID NO: 248175 - RNA, 19 nt, Homo sapiens
aagaguccuugauugguua

SEQ ID NO: 248176 - RNA, 19 nt, Homo sapiens
aaaaggagguggucuguga

SEQ ID NO: 248177 - RNA, 19 nt, Homo sapiens
uaucacucaucacgucaua

SEQ ID NO: 248178 - RNA, 19 nt, Homo sapiens
gcauggcucuccucuuucu

SEQ ID NO: 248179 - RNA, 19 nt, Homo sapiens
ugaacccuaucguauauug

SEQ ID NO: 248180 - RNA, 19 nt, Homo sapiens
guaaguuuaugcauacagu

SEQ ID NO: 248181 - RNA, 19 nt, Homo sapiens
ggagugacuuaguguacau

SEQ ID NO: 248182 - RNA, 19 nt, Homo sapiens
cgaaacuaccuguuacauu

SEQ ID NO: 248183 - RNA, 19 nt, Homo sapiens
gcaggaagucgauuaugau

SEQ ID NO: 248184 - RNA, 19 nt, Homo sapiens
ugguauagcauauguguuu

SEQ ID NO: 248185 - RNA, 19 nt, Homo sapiens
aagaggauguguggcauuu

SEQ ID NO: 248186 - RNA, 19 nt, Homo sapiens
ccaaagaauuuucaugaga

SEQ ID NO: 248187 - RNA, 19 nt, Homo sapiens
gagcucauaaccguaauaa

SEQ ID NO: 248188 - RNA, 19 nt, Homo sapiens
uauccucacugaauucuca

SEQ ID NO: 248189 - RNA, 19 nt, Homo sapiens
uaaacuggauaucagaaag

SEQ ID NO: 248190 - RNA, 19 nt, Homo sapiens
gcuuuaaacucguaucacu

SEQ ID NO: 248191 - RNA, 19 nt, Homo sapiens
gagagaguucuucaccuuu

SEQ ID NO: 248192 - RNA, 19 nt, Homo sapiens
acaugaacccuaucguaua

SEQ ID NO: 248193 - RNA, 19 nt, Homo sapiens
ugauaaaccacaugugcua

SEQ ID NO: 248194 - RNA, 19 nt, Homo sapiens
ccaacuaauguuacaauug

SEQ ID NO: 248195 - RNA, 19 nt, Homo sapiens
agcaggaagucgauuauga

SEQ ID NO: 248196 - RNA, 19 nt, Homo sapiens
gguaaagaacuaugguguu

SEQ ID NO: 248197 - RNA, 19 nt, Homo sapiens
cgagauucagugccaguua

SEQ ID NO: 248198 - RNA, 19 nt, Homo sapiens
agaaugaacggaagugaga

SEQ ID NO: 248199 - RNA, 19 nt, Homo sapiens
acuaugguguuaagaauuc

SEQ ID NO: 248200 - RNA, 19 nt, Homo sapiens
agaagaauuugcuguaugc

SEQ ID NO: 248201 - RNA, 19 nt, Homo sapiens
caauagagagagagaguuc

SEQ ID NO: 248202 - RNA, 19 nt, Homo sapiens
agacaaaaccugaaucaaa

SEQ ID NO: 248203 - RNA, 19 nt, Homo sapiens
agaaggaagaugauuguga

SEQ ID NO: 248204 - RNA, 19 nt, Homo sapiens
gaaacauuacaguuagaga

SEQ ID NO: 248205 - RNA, 19 nt, Homo sapiens
ccaaauggagugacuuagu

SEQ ID NO: 248206 - RNA, 19 nt, Homo sapiens
gcaucgcuuuaaacucgua

SEQ ID NO: 248207 - RNA, 19 nt, Homo sapiens
ucacgcagaaggaagauga

SEQ ID NO: 248208 - RNA, 19 nt, Homo sapiens
caauguguaugugagaaug

SEQ ID NO: 248209 - RNA, 19 nt, Homo sapiens
ccaccuccuuugguuauga

SEQ ID NO: 248210 - RNA, 19 nt, Homo sapiens
guucuucaccuuuaaguag

SEQ ID NO: 248211 - RNA, 19 nt, Homo sapiens
ggaacauacagaagaacuu

SEQ ID NO: 248212 - RNA, 19 nt, Homo sapiens
gugcuuagccugguauuca

SEQ ID NO: 248213 - RNA, 19 nt, Homo sapiens
gaaucugccuaugcaaagu

SEQ ID NO: 248214 - RNA, 19 nt, Homo sapiens
gcauauguguuuuguaagu

SEQ ID NO: 248215 - RNA, 19 nt, Homo sapiens
ggaccuuuguagccacuuc

SEQ ID NO: 248216 - RNA, 19 nt, Homo sapiens
gguuauagaccaacagaag

SEQ ID NO: 248217 - RNA, 19 nt, Homo sapiens
uaaaccacaugugcuagug

SEQ ID NO: 248218 - RNA, 19 nt, Homo sapiens
cgaagacaauccaggaaaa

SEQ ID NO: 248219 - RNA, 19 nt, Homo sapiens
gugcuacuuuagagacaaa

SEQ ID NO: 248220 - RNA, 19 nt, Homo sapiens
ggaggagaagcaaaucaug

SEQ ID NO: 248221 - RNA, 19 nt, Homo sapiens
caccuaaacuggauaucag

SEQ ID NO: 248222 - RNA, 19 nt, Homo sapiens
gaucucagaaauuguaucu

SEQ ID NO: 248223 - RNA, 19 nt, Homo sapiens
uaaguaguaaccagucuga

SEQ ID NO: 248224 - RNA, 19 nt, Homo sapiens
ugaauucucaguacugugu

SEQ ID NO: 248225 - RNA, 19 nt, Homo sapiens
aaccaaauggagugacuua

SEQ ID NO: 248226 - RNA, 19 nt, Homo sapiens
caacauaucuugcuacgaa

SEQ ID NO: 248227 - RNA, 19 nt, Homo sapiens
auagaggccugauuaaaua

SEQ ID NO: 248228 - RNA, 19 nt, Homo sapiens
aagcaaacauuucgacuaa

SEQ ID NO: 248229 - RNA, 19 nt, Homo sapiens
caucggagcugcuagaguu

SEQ ID NO: 248230 - RNA, 19 nt, Homo sapiens
gcaaacauuucgacuaaag

SEQ ID NO: 248231 - RNA, 19 nt, Homo sapiens
aaauauagaggccugauua

SEQ ID NO: 248232 - RNA, 19 nt, Homo sapiens
caacucagcccaucuuaga

SEQ ID NO: 248233 - RNA, 19 nt, Homo sapiens
gcacgaggccuguugucua

SEQ ID NO: 248234 - RNA, 19 nt, Homo sapiens
ggcauguaauugcuuguua

SEQ ID NO: 248235 - RNA, 19 nt, Homo sapiens
uuaaauacaccgacaguaa

SEQ ID NO: 248236 - RNA, 19 nt, Homo sapiens
ugacacaucucugauacuu

SEQ ID NO: 248237 - RNA, 19 nt, Homo sapiens
uaaauacaccgacaguaaa

SEQ ID NO: 248238 - RNA, 19 nt, Homo sapiens
ggauuucaaugucacucua

SEQ ID NO: 248239 - RNA, 19 nt, Homo sapiens
ggauaugacacaucucuga

SEQ ID NO: 248240 - RNA, 19 nt, Homo sapiens
cauuacagauagaagagua

SEQ ID NO: 248241 - RNA, 19 nt, Homo sapiens
gaagcaacuccauuucauu

SEQ ID NO: 248242 - RNA, 19 nt, Homo sapiens
guuauuauguccauuacug

SEQ ID NO: 248243 - RNA, 19 nt, Homo sapiens
gcacaacugcuuuggaaca

SEQ ID NO: 248244 - RNA, 19 nt, Homo sapiens
gacaaugccuugguuucaa

SEQ ID NO: 248245 - RNA, 19 nt, Homo sapiens
ccaauggauuucaauguca

SEQ ID NO: 248246 - RNA, 19 nt, Homo sapiens
gagaguugaaagcuuaaua

SEQ ID NO: 248247 - RNA, 19 nt, Homo sapiens
ggggagaguugaaagcuua

SEQ ID NO: 248248 - RNA, 19 nt, Homo sapiens
uauagaggccugauuaaau

SEQ ID NO: 248249 - RNA, 19 nt, Homo sapiens
gaaauauagaggccugauu

SEQ ID NO: 248250 - RNA, 19 nt, Homo sapiens
ccaguggcccugagcaaua

SEQ ID NO: 248251 - RNA, 19 nt, Homo sapiens
gcauguaauugcuuguuag

SEQ ID NO: 248252 - RNA, 19 nt, Homo sapiens
ggacagcucaccaaaggau

SEQ ID NO: 248253 - RNA, 19 nt, Homo sapiens
ccaagcaucccauuacaga

SEQ ID NO: 248254 - RNA, 19 nt, Homo sapiens
gauuguauagugcauguuu

SEQ ID NO: 248255 - RNA, 19 nt, Homo sapiens
gaucacagcaacagagugu

SEQ ID NO: 248256 - RNA, 19 nt, Homo sapiens
acacaucucugauacuuuu

SEQ ID NO: 248257 - RNA, 19 nt, Homo sapiens
aagcaucccauuacagaua

SEQ ID NO: 248258 - RNA, 19 nt, Homo sapiens
aggcuucucuuaaacacua

SEQ ID NO: 248259 - RNA, 19 nt, Homo sapiens
gauguucuccaaacgcuuu

SEQ ID NO: 248260 - RNA, 19 nt, Homo sapiens
aggcacaacugcuuuggaa

SEQ ID NO: 248261 - RNA, 19 nt, Homo sapiens
agaagcaacuccauuucau

SEQ ID NO: 248262 - RNA, 19 nt, Homo sapiens
ucagcaggcuucccaaugg

SEQ ID NO: 248263 - RNA, 19 nt, Homo sapiens
ccuccagaguguacuguuu

SEQ ID NO: 248264 - RNA, 19 nt, Homo sapiens
aaauggauaugacacaucu

SEQ ID NO: 248265 - RNA, 19 nt, Homo sapiens
aaggacagcucaccaaagg

SEQ ID NO: 248266 - RNA, 19 nt, Homo sapiens
aaagcaaacauuucgacua

SEQ ID NO: 248267 - RNA, 19 nt, Homo sapiens
gcaacagagugugacuuca

SEQ ID NO: 248268 - RNA, 19 nt, Homo sapiens
agaguucugucuggacuuu

SEQ ID NO: 248269 - RNA, 19 nt, Homo sapiens
gcauuuaagcaacauaucu

SEQ ID NO: 248270 - RNA, 19 nt, Homo sapiens
ccauuucauuggauaacuu

SEQ ID NO: 248271 - RNA, 19 nt, Homo sapiens
gaaggcucccucaucauca

SEQ ID NO: 248272 - RNA, 19 nt, Homo sapiens
uccauggugugcuggcuua

SEQ ID NO: 248273 - RNA, 19 nt, Homo sapiens
gaguggcccuucauguaca

SEQ ID NO: 248274 - RNA, 19 nt, Homo sapiens
acggagauaucccaggaaa

SEQ ID NO: 248275 - RNA, 19 nt, Homo sapiens
aagcaacuccauuucauug

SEQ ID NO: 248276 - RNA, 19 nt, Homo sapiens
cagaagcaacuccauuuca

SEQ ID NO: 248277 - RNA, 19 nt, Homo sapiens
uaugacacaucucugauac

SEQ ID NO: 248278 - RNA, 19 nt, Homo sapiens
caccaagcaucccauuaca

SEQ ID NO: 248279 - RNA, 19 nt, Homo sapiens
uuucaacacuaucggaaug

SEQ ID NO: 248280 - RNA, 19 nt, Homo sapiens
guucacggccgacaucaug

SEQ ID NO: 248281 - RNA, 19 nt, Homo sapiens
ggagauaucccaggaaaau

SEQ ID NO: 248282 - RNA, 19 nt, Homo sapiens
ccaccaagcaucccauuac

SEQ ID NO: 248283 - RNA, 19 nt, Homo sapiens
cagguucuccucucccuuu

SEQ ID NO: 248284 - RNA, 19 nt, Homo sapiens
gaguugaaagcuuaauaug

SEQ ID NO: 248285 - RNA, 19 nt, Homo sapiens
cccaauggauuucaauguc

SEQ ID NO: 248286 - RNA, 19 nt, Homo sapiens
gggcgaauccucgaauugu

SEQ ID NO: 248287 - RNA, 19 nt, Homo sapiens
agagaccaguauucccuuu

SEQ ID NO: 248288 - RNA, 19 nt, Homo sapiens
gacaaggacagcucaccaa

SEQ ID NO: 248289 - RNA, 19 nt, Homo sapiens
caacacuaucggaauguga

SEQ ID NO: 248290 - RNA, 19 nt, Homo sapiens
ugacaaugccuugguuuca

SEQ ID NO: 248291 - RNA, 19 nt, Homo sapiens
cagcaggcuucccaaugga

SEQ ID NO: 248292 - RNA, 19 nt, Homo sapiens
ggcgaauccucgaauugug

SEQ ID NO: 248293 - RNA, 19 nt, Homo sapiens
ccucagcacccgaagauuc

SEQ ID NO: 248294 - RNA, 19 nt, Homo sapiens
gggugacaaugccuugguu

SEQ ID NO: 248295 - RNA, 19 nt, Homo sapiens
gauaugacacaucucugau

SEQ ID NO: 248296 - RNA, 19 nt, Homo sapiens
cacaacugcuuuggaacaa

SEQ ID NO: 248297 - RNA, 19 nt, Homo sapiens
cacgaggccuguugucuac

SEQ ID NO: 248298 - RNA, 19 nt, Homo sapiens
ggaaaaggagcaagaagau

SEQ ID NO: 248299 - RNA, 19 nt, Homo sapiens
gggcauuuaagcaacauau

SEQ ID NO: 248300 - RNA, 19 nt, Homo sapiens
gcaggcuucccaauggauu

SEQ ID NO: 248301 - RNA, 19 nt, Homo sapiens
aagauuguauagugcaugu

SEQ ID NO: 248302 - RNA, 19 nt, Homo sapiens
cugauuaaauacugguuuc

SEQ ID NO: 248303 - RNA, 19 nt, Homo sapiens
cgaauugugcgaucaagca

SEQ ID NO: 248304 - RNA, 19 nt, Homo sapiens
aauauagaggccugauuaa

SEQ ID NO: 248305 - RNA, 19 nt, Homo sapiens
cuccagaguguacuguuua

SEQ ID NO: 248306 - RNA, 19 nt, Homo sapiens
ugccuugguuucaacacua

SEQ ID NO: 248307 - RNA, 19 nt, Homo sapiens
acaaggacagcucaccaaa

SEQ ID NO: 248308 - RNA, 19 nt, Homo sapiens
uuaaaacccuccagagugu

SEQ ID NO: 248309 - RNA, 19 nt, Homo sapiens
ggugaauuguacacagauc

SEQ ID NO: 248310 - RNA, 19 nt, Homo sapiens
aaauacaccgacaguaaau

SEQ ID NO: 248311 - RNA, 19 nt, Homo sapiens
gaggccugauuaaauacug

SEQ ID NO: 248312 - RNA, 19 nt, Homo sapiens
agauaucccaggaaaauua

SEQ ID NO: 248313 - RNA, 19 nt, Homo sapiens
cagcaagucauccugaucu

SEQ ID NO: 248314 - RNA, 19 nt, Homo sapiens
agaaggcucccucaucauc

SEQ ID NO: 248315 - RNA, 19 nt, Homo sapiens
caaggacagcucaccaaag

SEQ ID NO: 248316 - RNA, 19 nt, Homo sapiens
uuccugguccugaaauaua

SEQ ID NO: 248317 - RNA, 19 nt, Homo sapiens
gaauccaacaggucaaagg

SEQ ID NO: 248318 - RNA, 19 nt, Homo sapiens
ggugacaaugccuugguuu

SEQ ID NO: 248319 - RNA, 19 nt, Homo sapiens
auaugacacaucucugaua

SEQ ID NO: 248320 - RNA, 19 nt, Homo sapiens
auauagaggccugauuaaa

SEQ ID NO: 248321 - RNA, 19 nt, Homo sapiens
uuuagagucgggcauuuaa

SEQ ID NO: 248322 - RNA, 19 nt, Homo sapiens
ucagaagcaacuccauuuc

SEQ ID NO: 248323 - RNA, 19 nt, Homo sapiens
caguggcccugagcaauag

SEQ ID NO: 248324 - RNA, 19 nt, Homo sapiens
gccuugguuucaacacuau

SEQ ID NO: 248325 - RNA, 19 nt, Homo sapiens
gcacccgagaggagaguug

SEQ ID NO: 248326 - RNA, 19 nt, Homo sapiens
caagaaagacugagaagua

SEQ ID NO: 248327 - RNA, 19 nt, Homo sapiens
gaauggaaaucaugaaauc

SEQ ID NO: 248328 - RNA, 19 nt, Homo sapiens
caacaaacaugcaagaaag

SEQ ID NO: 248329 - RNA, 19 nt, Homo sapiens
gguccaagguuaagccaua

SEQ ID NO: 248330 - RNA, 19 nt, Homo sapiens
gaaguuuacuggaguuuag

SEQ ID NO: 248331 - RNA, 19 nt, Homo sapiens
aaccauguguuuccuauua

SEQ ID NO: 248332 - RNA, 19 nt, Homo sapiens
caagcaaugucuucagaaa

SEQ ID NO: 248333 - RNA, 19 nt, Homo sapiens
acagagaaauguucagaaa

SEQ ID NO: 248334 - RNA, 19 nt, Homo sapiens
ugacacagcugaaguuuac

SEQ ID NO: 248335 - RNA, 19 nt, Homo sapiens
gaccugggcucaucuugaa

SEQ ID NO: 248336 - RNA, 19 nt, Homo sapiens
gggccugacuuccuacaua

SEQ ID NO: 248337 - RNA, 19 nt, Homo sapiens
caugaaauccuuguucuua

SEQ ID NO: 248338 - RNA, 19 nt, Homo sapiens
ggagaacacacaaaugaaa

SEQ ID NO: 248339 - RNA, 19 nt, Homo sapiens
gugugugucugauuauuua

SEQ ID NO: 248340 - RNA, 19 nt, Homo sapiens
aagaaagacugagaaguaa

SEQ ID NO: 248341 - RNA, 19 nt, Homo sapiens
gaaguugucagaauggaaa

SEQ ID NO: 248342 - RNA, 19 nt, Homo sapiens
uguagugugugucugauua

SEQ ID NO: 248343 - RNA, 19 nt, Homo sapiens
agacugagaaguaaagaua

SEQ ID NO: 248344 - RNA, 19 nt, Homo sapiens
gaaaguacagagaaauguu

SEQ ID NO: 248345 - RNA, 19 nt, Homo sapiens
gaacaugacccuccuagac

SEQ ID NO: 248346 - RNA, 19 nt, Homo sapiens
ggccugacuuccuacauaa

SEQ ID NO: 248347 - RNA, 19 nt, Homo sapiens
gaggcuagaauaaggguua

SEQ ID NO: 248348 - RNA, 19 nt, Homo sapiens
gggcaucagucccuaagau

SEQ ID NO: 248349 - RNA, 19 nt, Homo sapiens
gaaagacugagaaguaaag

SEQ ID NO: 248350 - RNA, 19 nt, Homo sapiens
ugaaauccuuguucuuauc

SEQ ID NO: 248351 - RNA, 19 nt, Homo sapiens
uagcugaagucuaaugcaa

SEQ ID NO: 248352 - RNA, 19 nt, Homo sapiens
ucaacaaacaugcaagaaa

SEQ ID NO: 248353 - RNA, 19 nt, Homo sapiens
ucagaaccauggccuacuu

SEQ ID NO: 248354 - RNA, 19 nt, Homo sapiens
gaaacugaaaguacagaga

SEQ ID NO: 248355 - RNA, 19 nt, Homo sapiens
gaaauccuuguucuuauca

SEQ ID NO: 248356 - RNA, 19 nt, Homo sapiens
gcauucauuuguauugaca

SEQ ID NO: 248357 - RNA, 19 nt, Homo sapiens
ugguaaaccugaagcaaau

SEQ ID NO: 248358 - RNA, 19 nt, Homo sapiens
uacaagcaaugucuucaga

SEQ ID NO: 248359 - RNA, 19 nt, Homo sapiens
ccauguguuuccuauuaaa

SEQ ID NO: 248360 - RNA, 19 nt, Homo sapiens
aaacugaaaguacagagaa

SEQ ID NO: 248361 - RNA, 19 nt, Homo sapiens
ccauaucccagcucaguaa

SEQ ID NO: 248362 - RNA, 19 nt, Homo sapiens
guacagagaaauguucaga

SEQ ID NO: 248363 - RNA, 19 nt, Homo sapiens
caaaacauguucagcuuuc

SEQ ID NO: 248364 - RNA, 19 nt, Homo sapiens
cagaauggaaaucaugaaa

SEQ ID NO: 248365 - RNA, 19 nt, Homo sapiens
gcagguagugggagaagga

SEQ ID NO: 248366 - RNA, 19 nt, Homo sapiens
cauaaaguaaggaggguaa

SEQ ID NO: 248367 - RNA, 19 nt, Homo sapiens
gaaaucaugaaauccuugu

SEQ ID NO: 248368 - RNA, 19 nt, Homo sapiens
ugaaagagaagaaauacag

SEQ ID NO: 248369 - RNA, 19 nt, Homo sapiens
auauaacacuugcacaugu

SEQ ID NO: 248370 - RNA, 19 nt, Homo sapiens
gugucuaccugaaagagaa

SEQ ID NO: 248371 - RNA, 19 nt, Homo sapiens
gaccagcuauagcccuguu

SEQ ID NO: 248372 - RNA, 19 nt, Homo sapiens
cauguucagcuuuccauuu

SEQ ID NO: 248373 - RNA, 19 nt, Homo sapiens
gaauuaguucugcaaauac

SEQ ID NO: 248374 - RNA, 19 nt, Homo sapiens
cggcuuuaaucacagaauu

SEQ ID NO: 248375 - RNA, 19 nt, Homo sapiens
uuacuggaguuuagcugaa

SEQ ID NO: 248376 - RNA, 19 nt, Homo sapiens
guaaaccugaagcaaauau

SEQ ID NO: 248377 - RNA, 19 nt, Homo sapiens
uauaacacuugcacaugug

SEQ ID NO: 248378 - RNA, 19 nt, Homo sapiens
gggagaacacacaaaugaa

SEQ ID NO: 248379 - RNA, 19 nt, Homo sapiens
gcugaagucuaaugcaaaa

SEQ ID NO: 248380 - RNA, 19 nt, Homo sapiens
gcugaaguuuacuggaguu

SEQ ID NO: 248381 - RNA, 19 nt, Homo sapiens
gucccuaagauguuauuua

SEQ ID NO: 248382 - RNA, 19 nt, Homo sapiens
ccugggaaguugucagaau

SEQ ID NO: 248383 - RNA, 19 nt, Homo sapiens
gaauccgugucuaccugaa

SEQ ID NO: 248384 - RNA, 19 nt, Homo sapiens
gcauacaagcaaugucuuc

SEQ ID NO: 248385 - RNA, 19 nt, Homo sapiens
agggagaacacacaaauga

SEQ ID NO: 248386 - RNA, 19 nt, Homo sapiens
acucuuauuucggcuuuaa

SEQ ID NO: 248387 - RNA, 19 nt, Homo sapiens
agacucuuauuucggcuuu

SEQ ID NO: 248388 - RNA, 19 nt, Homo sapiens
acugagaaguaaagauaga

SEQ ID NO: 248389 - RNA, 19 nt, Homo sapiens
guucuuaucaacaaacaug

SEQ ID NO: 248390 - RNA, 19 nt, Homo sapiens
ggaaguugucagaauggaa

SEQ ID NO: 248391 - RNA, 19 nt, Homo sapiens
cuauagcccuguuggaucu

SEQ ID NO: 248392 - RNA, 19 nt, Homo sapiens
ugucaugucuguccuccau

SEQ ID NO: 248393 - RNA, 19 nt, Homo sapiens
uauuucggcuuuaaucaca

SEQ ID NO: 248394 - RNA, 19 nt, Homo sapiens
gcaagaaagacugagaagu

SEQ ID NO: 248395 - RNA, 19 nt, Homo sapiens
gguagugggagaaggagaa

SEQ ID NO: 248396 - RNA, 19 nt, Homo sapiens
cagaaccauggccuacuua

SEQ ID NO: 248397 - RNA, 19 nt, Homo sapiens
cuagugaugaccagcuaua

SEQ ID NO: 248398 - RNA, 19 nt, Homo sapiens
gauuguugucauccucuua

SEQ ID NO: 248399 - RNA, 19 nt, Homo sapiens
ggaguuuagcugaagucua

SEQ ID NO: 248400 - RNA, 19 nt, Homo sapiens
gacugugccugggaaguug

SEQ ID NO: 248401 - RNA, 19 nt, Homo sapiens
cgacugugccugggaaguu

SEQ ID NO: 248402 - RNA, 19 nt, Homo sapiens
uaaaagccaugcauacaag

SEQ ID NO: 248403 - RNA, 19 nt, Homo sapiens
cagcuuuccauuugguuaa

SEQ ID NO: 248404 - RNA, 19 nt, Homo sapiens
gcuuuaaucacagaauuga

SEQ ID NO: 248405 - RNA, 19 nt, Homo sapiens
ggaacaugacccuccuaga

SEQ ID NO: 248406 - RNA, 19 nt, Homo sapiens
gcagaucuucagccucuuc

SEQ ID NO: 248407 - RNA, 19 nt, Homo sapiens
ugaaguuuacuggaguuua

SEQ ID NO: 248408 - RNA, 19 nt, Homo sapiens
gguaaaccugaagcaaaua

SEQ ID NO: 248409 - RNA, 19 nt, Homo sapiens
cauauaacacuugcacaug

SEQ ID NO: 248410 - RNA, 19 nt, Homo sapiens
auagagaccugggcucauc

SEQ ID NO: 248411 - RNA, 19 nt, Homo sapiens
uaucaacaaacaugcaaga

SEQ ID NO: 248412 - RNA, 19 nt, Homo sapiens
uggaaaucaugaaauccuu

SEQ ID NO: 248413 - RNA, 19 nt, Homo sapiens
gggaaguugucagaaugga

SEQ ID NO: 248414 - RNA, 19 nt, Homo sapiens
cugggaaguugucagaaug

SEQ ID NO: 248415 - RNA, 19 nt, Homo sapiens
ucugcugccuggaacauga

SEQ ID NO: 248416 - RNA, 19 nt, Homo sapiens
auguucagcuuuccauuug

SEQ ID NO: 248417 - RNA, 19 nt, Homo sapiens
cugaauuaguucugcaaau

SEQ ID NO: 248418 - RNA, 19 nt, Homo sapiens
ccauauaacacuugcacau

SEQ ID NO: 248419 - RNA, 19 nt, Homo sapiens
gcccugcacugaccuugag

SEQ ID NO: 248420 - RNA, 19 nt, Homo sapiens
aauggaggcuagaauaagg

SEQ ID NO: 248421 - RNA, 19 nt, Homo sapiens
cccaauggcccuccuguuc

SEQ ID NO: 248422 - RNA, 19 nt, Homo sapiens
gagaaauguucagaaaaug

SEQ ID NO: 248423 - RNA, 19 nt, Homo sapiens
guucagcuuuccauuuggu

SEQ ID NO: 248424 - RNA, 19 nt, Homo sapiens
caucuugaaaugauucuca

SEQ ID NO: 248425 - RNA, 19 nt, Homo sapiens
aaaccugaagcaaauauag

SEQ ID NO: 248426 - RNA, 19 nt, Homo sapiens
gaagaugcaucaauugaaa

SEQ ID NO: 248427 - RNA, 19 nt, Homo sapiens
gaaagacacuacuguuauu

SEQ ID NO: 248428 - RNA, 19 nt, Homo sapiens
gagaauagcugcuggugaa

SEQ ID NO: 248429 - RNA, 19 nt, Homo sapiens
gaagauuucucguuucgaa

SEQ ID NO: 248430 - RNA, 19 nt, Homo sapiens
gaacgcauguauauugauu

SEQ ID NO: 248431 - RNA, 19 nt, Homo sapiens
gagaaagacacuacuguua

SEQ ID NO: 248432 - RNA, 19 nt, Homo sapiens
gaccagaaguccuugauga

SEQ ID NO: 248433 - RNA, 19 nt, Homo sapiens
cauaucagcucucuucuug

SEQ ID NO: 248434 - RNA, 19 nt, Homo sapiens
ggaaggaacucaagaagac

SEQ ID NO: 248435 - RNA, 19 nt, Homo sapiens
ggugaguucugauuauuaa

SEQ ID NO: 248436 - RNA, 19 nt, Homo sapiens
gagcagauguuggagaauu

SEQ ID NO: 248437 - RNA, 19 nt, Homo sapiens
ggcaacagauggaaauaaa

SEQ ID NO: 248438 - RNA, 19 nt, Homo sapiens
gagaaugacuuuaacugau

SEQ ID NO: 248439 - RNA, 19 nt, Homo sapiens
gagagcagauguuggagaa

SEQ ID NO: 248440 - RNA, 19 nt, Homo sapiens
cgaugaagauuucucguuu

SEQ ID NO: 248441 - RNA, 19 nt, Homo sapiens
cuucaaagcucgaaccaaa

SEQ ID NO: 248442 - RNA, 19 nt, Homo sapiens
caagagaaagggauuaauu

SEQ ID NO: 248443 - RNA, 19 nt, Homo sapiens
agaagcaaaugucgagaua

SEQ ID NO: 248444 - RNA, 19 nt, Homo sapiens
acucaacucuggaauguuu

SEQ ID NO: 248445 - RNA, 19 nt, Homo sapiens
gacuuuaacugauagcauu

SEQ ID NO: 248446 - RNA, 19 nt, Homo sapiens
ggagaaugacuuuaacuga

SEQ ID NO: 248447 - RNA, 19 nt, Homo sapiens
gcacuucucuuugaauugg

SEQ ID NO: 248448 - RNA, 19 nt, Homo sapiens
ugacauuacugaacuauac

SEQ ID NO: 248449 - RNA, 19 nt, Homo sapiens
ugaauuggccagaggaaua

SEQ ID NO: 248450 - RNA, 19 nt, Homo sapiens
uagcaucuguucuuuguau

SEQ ID NO: 248451 - RNA, 19 nt, Homo sapiens
aaccaaagcuagaagcaaa

SEQ ID NO: 248452 - RNA, 19 nt, Homo sapiens
aagaagaccuagaguacaa

SEQ ID NO: 248453 - RNA, 19 nt, Homo sapiens
gauaagagagcagauguug

SEQ ID NO: 248454 - RNA, 19 nt, Homo sapiens
cuaauacagugcuucauau

SEQ ID NO: 248455 - RNA, 19 nt, Homo sapiens
ccacagaugacauuacuga

SEQ ID NO: 248456 - RNA, 19 nt, Homo sapiens
uaagagagcagauguugga

SEQ ID NO: 248457 - RNA, 19 nt, Homo sapiens
cgaaaggcauuuauauaac

SEQ ID NO: 248458 - RNA, 19 nt, Homo sapiens
guuagcaucuguucuuugu

SEQ ID NO: 248459 - RNA, 19 nt, Homo sapiens
ccagaggaauagagaguga

SEQ ID NO: 248460 - RNA, 19 nt, Homo sapiens
cagaaaccauuaaauuugg

SEQ ID NO: 248461 - RNA, 19 nt, Homo sapiens
caacagauggaaauaaaca

SEQ ID NO: 248462 - RNA, 19 nt, Homo sapiens
ccuaauacagugcuucaua

SEQ ID NO: 248463 - RNA, 19 nt, Homo sapiens
aagcagcucuugaagguau

SEQ ID NO: 248464 - RNA, 19 nt, Homo sapiens
gaugaagauuucucguuuc

SEQ ID NO: 248465 - RNA, 19 nt, Homo sapiens
uaaggagguucuuggauca

SEQ ID NO: 248466 - RNA, 19 nt, Homo sapiens
acacaccuaugacaccuuu

SEQ ID NO: 248467 - RNA, 19 nt, Homo sapiens
gcccuggaauugaaaguga

SEQ ID NO: 248468 - RNA, 19 nt, Homo sapiens
gcugggcccuggaauugaa

SEQ ID NO: 248469 - RNA, 19 nt, Homo sapiens
gaccauaugcccaaucaau

SEQ ID NO: 248470 - RNA, 19 nt, Homo sapiens
gauaagagugcgaagacaa

SEQ ID NO: 248471 - RNA, 19 nt, Homo sapiens
guacccacuugcagucaaa

SEQ ID NO: 248472 - RNA, 19 nt, Homo sapiens
gaaagcagcggucaguuuu

SEQ ID NO: 248473 - RNA, 19 nt, Homo sapiens
ggacacuacugcugaccau

SEQ ID NO: 248474 - RNA, 19 nt, Homo sapiens
gaaugacuuuaacugauag

SEQ ID NO: 248475 - RNA, 19 nt, Homo sapiens
uauauugauugcuggguaa

SEQ ID NO: 248476 - RNA, 19 nt, Homo sapiens
agaaagacacuacuguuau

SEQ ID NO: 248477 - RNA, 19 nt, Homo sapiens
gcaaaugucgagauaagag

SEQ ID NO: 248478 - RNA, 19 nt, Homo sapiens
aagcaaaugucgagauaag

SEQ ID NO: 248479 - RNA, 19 nt, Homo sapiens
gcagguggccagcaucgaa

SEQ ID NO: 248480 - RNA, 19 nt, Homo sapiens
ccugaacgcauguauauug

SEQ ID NO: 248481 - RNA, 19 nt, Homo sapiens
uaucagcucucuucuugca

SEQ ID NO: 248482 - RNA, 19 nt, Homo sapiens
uaaauccuaucucaaagag

SEQ ID NO: 248483 - RNA, 19 nt, Homo sapiens
ggaccaauccuaaagaaaa

SEQ ID NO: 248484 - RNA, 19 nt, Homo sapiens
gaccuaacccuggauaaga

SEQ ID NO: 248485 - RNA, 19 nt, Homo sapiens
guacaagagaaagggauua

SEQ ID NO: 248486 - RNA, 19 nt, Homo sapiens
agaaagcagcggucaguuu

SEQ ID NO: 248487 - RNA, 19 nt, Homo sapiens
ccauaugcccaaucaauga

SEQ ID NO: 248488 - RNA, 19 nt, Homo sapiens
aaaaugcacuggcuucaaa

SEQ ID NO: 248489 - RNA, 19 nt, Homo sapiens
gaccuagaguacaagagaa

SEQ ID NO: 248490 - RNA, 19 nt, Homo sapiens
cagagaaacauguaucguu

SEQ ID NO: 248491 - RNA, 19 nt, Homo sapiens
gccgaagacucgccucuca

SEQ ID NO: 248492 - RNA, 19 nt, Homo sapiens
gggaugcaguacccacuug

SEQ ID NO: 248493 - RNA, 19 nt, Homo sapiens
ugagaugcauuuccauaag

SEQ ID NO: 248494 - RNA, 19 nt, Homo sapiens
cacuaaauccuaucucaaa

SEQ ID NO: 248495 - RNA, 19 nt, Homo sapiens
caacuugcuuugguguuug

SEQ ID NO: 248496 - RNA, 19 nt, Homo sapiens
gcacagacgcacgaguaaa

SEQ ID NO: 248497 - RNA, 19 nt, Homo sapiens
gagauaagagagcagaugu

SEQ ID NO: 248498 - RNA, 19 nt, Homo sapiens
gaaccaaagcuagaagcaa

SEQ ID NO: 248499 - RNA, 19 nt, Homo sapiens
ccaaaguggacaagagaaa

SEQ ID NO: 248500 - RNA, 19 nt, Homo sapiens
gaagacauggaguccuuga

SEQ ID NO: 248501 - RNA, 19 nt, Homo sapiens
cagaugacauuacugaacu

SEQ ID NO: 248502 - RNA, 19 nt, Homo sapiens
ugugaugggucagcuagua

SEQ ID NO: 248503 - RNA, 19 nt, Homo sapiens
gaauugaaagugaagagau

SEQ ID NO: 248504 - RNA, 19 nt, Homo sapiens
gguguuugcuguuuuauug

SEQ ID NO: 248505 - RNA, 19 nt, Homo sapiens
ccacgaugccgaagaacaa

SEQ ID NO: 248506 - RNA, 19 nt, Homo sapiens
ucaagaagaccuagaguac

SEQ ID NO: 248507 - RNA, 19 nt, Homo sapiens
gaagcaaaugucgagauaa

SEQ ID NO: 248508 - RNA, 19 nt, Homo sapiens
cuucucgacucuguuguua

SEQ ID NO: 248509 - RNA, 19 nt, Homo sapiens
uuacugaacuauacucaac

SEQ ID NO: 248510 - RNA, 19 nt, Homo sapiens
agagaaagggauuaauuga

SEQ ID NO: 248511 - RNA, 19 nt, Homo sapiens
cauuaaauuugguccugaa

SEQ ID NO: 248512 - RNA, 19 nt, Homo sapiens
uggcacuucucuuugaauu

SEQ ID NO: 248513 - RNA, 19 nt, Homo sapiens
ggauaagagugcgaagaca

SEQ ID NO: 248514 - RNA, 19 nt, Homo sapiens
cugaacgcauguauauuga

SEQ ID NO: 248515 - RNA, 19 nt, Homo sapiens
guccugaacgcauguauau

SEQ ID NO: 248516 - RNA, 19 nt, Homo sapiens
gagaugcauuuccauaagc

SEQ ID NO: 248517 - RNA, 19 nt, Homo sapiens
ccgcacagacgcacgagua

SEQ ID NO: 248518 - RNA, 19 nt, Homo sapiens
auacucaacucuggaaugu

SEQ ID NO: 248519 - RNA, 19 nt, Homo sapiens
ugaagaugcaucaauugaa

SEQ ID NO: 248520 - RNA, 19 nt, Homo sapiens
caucuguucuuuguauuca

SEQ ID NO: 248521 - RNA, 19 nt, Homo sapiens
aagagaaagggauuaauug

SEQ ID NO: 248522 - RNA, 19 nt, Homo sapiens
gaacucaagaagaccuaga

SEQ ID NO: 248523 - RNA, 19 nt, Homo sapiens
uaacucugcagccuucaaa

SEQ ID NO: 248524 - RNA, 19 nt, Homo sapiens
gggccaaaguggacaagag

SEQ ID NO: 248525 - RNA, 19 nt, Homo sapiens
gcuuugguguuugcuguuu

SEQ ID NO: 248526 - RNA, 19 nt, Homo sapiens
ggaagaggaugaugaacaa

SEQ ID NO: 248527 - RNA, 19 nt, Homo sapiens
gagcauagguugucugcaa

SEQ ID NO: 248528 - RNA, 19 nt, Homo sapiens
gcaagcgucuagaucauuu

SEQ ID NO: 248529 - RNA, 19 nt, Homo sapiens
gaacaacucugcugaaaau

SEQ ID NO: 248530 - RNA, 19 nt, Homo sapiens
gauaucagcuuagaagaga

SEQ ID NO: 248531 - RNA, 19 nt, Homo sapiens
cuucagagguggauugaua

SEQ ID NO: 248532 - RNA, 19 nt, Homo sapiens
gaaggcugccgaaauguua

SEQ ID NO: 248533 - RNA, 19 nt, Homo sapiens
gagaaauggcucuguauaa

SEQ ID NO: 248534 - RNA, 19 nt, Homo sapiens
ugagaaggcugccgaaaug

SEQ ID NO: 248535 - RNA, 19 nt, Homo sapiens
ucggaaauauggagcauua

SEQ ID NO: 248536 - RNA, 19 nt, Homo sapiens
aaauaaagauccugagaga

SEQ ID NO: 248537 - RNA, 19 nt, Homo sapiens
gcugagaaauggcucugua

SEQ ID NO: 248538 - RNA, 19 nt, Homo sapiens
ggaaaguggucaagcagau

SEQ ID NO: 248539 - RNA, 19 nt, Homo sapiens
ucaguaaagugucaaguga

SEQ ID NO: 248540 - RNA, 19 nt, Homo sapiens
cgagaacacuuuauaaacu

SEQ ID NO: 248541 - RNA, 19 nt, Homo sapiens
gaaaucugcuguggaaagu

SEQ ID NO: 248542 - RNA, 19 nt, Homo sapiens
agaaauggcucuguauaau

SEQ ID NO: 248543 - RNA, 19 nt, Homo sapiens
aaugaaaucugcuguggaa

SEQ ID NO: 248544 - RNA, 19 nt, Homo sapiens
ggaaaagagugcugagaaa

SEQ ID NO: 248545 - RNA, 19 nt, Homo sapiens
gaugcuaaaucuugcuuug

SEQ ID NO: 248546 - RNA, 19 nt, Homo sapiens
ggaaauaaagauccugaga

SEQ ID NO: 248547 - RNA, 19 nt, Homo sapiens
gagcauugaccaggaaaua

SEQ ID NO: 248548 - RNA, 19 nt, Homo sapiens
auaaagauccugagagaaa

SEQ ID NO: 248549 - RNA, 19 nt, Homo sapiens
gcauugaccaggaaauaaa

SEQ ID NO: 248550 - RNA, 19 nt, Homo sapiens
uaucgcagcucgacuuguu

SEQ ID NO: 248551 - RNA, 19 nt, Homo sapiens
gauacaagcagaagaagga

SEQ ID NO: 248552 - RNA, 19 nt, Homo sapiens
gaaauggcucuguauaauc

SEQ ID NO: 248553 - RNA, 19 nt, Homo sapiens
ggcaucaacuucuaacuca

SEQ ID NO: 248554 - RNA, 19 nt, Homo sapiens
ggaggaagaggaugaugaa

SEQ ID NO: 248555 - RNA, 19 nt, Homo sapiens
uagaagagauugagagcau

SEQ ID NO: 248556 - RNA, 19 nt, Homo sapiens
ggauugauaucagcuuaga

SEQ ID NO: 248557 - RNA, 19 nt, Homo sapiens
uagguugucugcaaugaaa

SEQ ID NO: 248558 - RNA, 19 nt, Homo sapiens
gcuuggaccuccuugagaa

SEQ ID NO: 248559 - RNA, 19 nt, Homo sapiens
caagagaggcaucaacuuc

SEQ ID NO: 248560 - RNA, 19 nt, Homo sapiens
gugauuaaguguguauuug

SEQ ID NO: 248561 - RNA, 19 nt, Homo sapiens
gaagagauugagagcauug

SEQ ID NO: 248562 - RNA, 19 nt, Homo sapiens
guggauugauaucagcuua

SEQ ID NO: 248563 - RNA, 19 nt, Homo sapiens
gcuaucauguggcagaguu

SEQ ID NO: 248564 - RNA, 19 nt, Homo sapiens
gcaacaggaagaacaagaa

SEQ ID NO: 248565 - RNA, 19 nt, Homo sapiens
gggcugaucuucccacaac

SEQ ID NO: 248566 - RNA, 19 nt, Homo sapiens
ccaagucugccaacuauga

SEQ ID NO: 248567 - RNA, 19 nt, Homo sapiens
caacuaugacggugaguga

SEQ ID NO: 248568 - RNA, 19 nt, Homo sapiens
agaaggaguuggagcauag

SEQ ID NO: 248569 - RNA, 19 nt, Homo sapiens
gcucgagaacacuuuauaa

SEQ ID NO: 248570 - RNA, 19 nt, Homo sapiens
caaggagcccucaccauga

SEQ ID NO: 248571 - RNA, 19 nt, Homo sapiens
agagaggcaucaacuucua

SEQ ID NO: 248572 - RNA, 19 nt, Homo sapiens
ugagaaauggcucuguaua

SEQ ID NO: 248573 - RNA, 19 nt, Homo sapiens
aguaaagugucaagugauu

SEQ ID NO: 248574 - RNA, 19 nt, Homo sapiens
aaauggcucuguauaaucu

SEQ ID NO: 248575 - RNA, 19 nt, Homo sapiens
ugaaccagcagucuuguuu

SEQ ID NO: 248576 - RNA, 19 nt, Homo sapiens
guaaagugucaagugauua

SEQ ID NO: 248577 - RNA, 19 nt, Homo sapiens
guacaacgagggcaaagau

SEQ ID NO: 248578 - RNA, 19 nt, Homo sapiens
ccaauuccuccauggcuua

SEQ ID NO: 248579 - RNA, 19 nt, Homo sapiens
aaagagugcugagaaaugg

SEQ ID NO: 248580 - RNA, 19 nt, Homo sapiens
gcaucauccucaucauguu

SEQ ID NO: 248581 - RNA, 19 nt, Homo sapiens
caaggcagcaccagaggaa

SEQ ID NO: 248582 - RNA, 19 nt, Homo sapiens
gagcaacaucggaaauaug

SEQ ID NO: 248583 - RNA, 19 nt, Homo sapiens
gauaugaaccagcagucuu

SEQ ID NO: 248584 - RNA, 19 nt, Homo sapiens
acaacucccugccaaggaa

SEQ ID NO: 248585 - RNA, 19 nt, Homo sapiens
ugagcaacaucggaaauau

SEQ ID NO: 248586 - RNA, 19 nt, Homo sapiens
ucaaagacaggcuaaaaua

SEQ ID NO: 248587 - RNA, 19 nt, Homo sapiens
ugagagcauugaccaggaa

SEQ ID NO: 248588 - RNA, 19 nt, Homo sapiens
guucgugaauauuaucuuc

SEQ ID NO: 248589 - RNA, 19 nt, Homo sapiens
aagaaggaguuggagcaua

SEQ ID NO: 248590 - RNA, 19 nt, Homo sapiens
aaguagaaguggcgacuga

SEQ ID NO: 248591 - RNA, 19 nt, Homo sapiens
aaggagcccucaccaugaa

SEQ ID NO: 248592 - RNA, 19 nt, Homo sapiens
gucaagugauuaagugugu

SEQ ID NO: 248593 - RNA, 19 nt, Homo sapiens
cuucagcucuguacaacga

SEQ ID NO: 248594 - RNA, 19 nt, Homo sapiens
gagaggcaucaacuucuaa

SEQ ID NO: 248595 - RNA, 19 nt, Homo sapiens
acaggaagaacaagaagaa

SEQ ID NO: 248596 - RNA, 19 nt, Homo sapiens
uaaagauccugagagaaag

SEQ ID NO: 248597 - RNA, 19 nt, Homo sapiens
agagauacaagcagaagaa

SEQ ID NO: 248598 - RNA, 19 nt, Homo sapiens
gaaaaucacacugccaauu

SEQ ID NO: 248599 - RNA, 19 nt, Homo sapiens
uauuccagcuucuuaagug

SEQ ID NO: 248600 - RNA, 19 nt, Homo sapiens
guauuuguacccuagauga

SEQ ID NO: 248601 - RNA, 19 nt, Homo sapiens
gacagaacaugggcugauc

SEQ ID NO: 248602 - RNA, 19 nt, Homo sapiens
gacggugagugacugguau

SEQ ID NO: 248603 - RNA, 19 nt, Homo sapiens
cauagguugucugcaauga

SEQ ID NO: 248604 - RNA, 19 nt, Homo sapiens
uaacucagugccauugcua

SEQ ID NO: 248605 - RNA, 19 nt, Homo sapiens
ccagcaagcgucuagauca

SEQ ID NO: 248606 - RNA, 19 nt, Homo sapiens
ugaacaaacacuccacaga

SEQ ID NO: 248607 - RNA, 19 nt, Homo sapiens
agaggaugaugaacaaaca

SEQ ID NO: 248608 - RNA, 19 nt, Homo sapiens
gaaaguggucaagcagaug

SEQ ID NO: 248609 - RNA, 19 nt, Homo sapiens
gcuauggcaucucaaagac

SEQ ID NO: 248610 - RNA, 19 nt, Homo sapiens
cagcaagcgucuagaucau

SEQ ID NO: 248611 - RNA, 19 nt, Homo sapiens
caccagaggaauucagaaa

SEQ ID NO: 248612 - RNA, 19 nt, Homo sapiens
ccaccgaccugaaguaccu

SEQ ID NO: 248613 - RNA, 19 nt, Homo sapiens
guuguauuccagcuucuua

SEQ ID NO: 248614 - RNA, 19 nt, Homo sapiens
gagcuguucgaaacuggua

SEQ ID NO: 248615 - RNA, 19 nt, Homo sapiens
uauccaagucugccaacua

SEQ ID NO: 248616 - RNA, 19 nt, Homo sapiens
ggagcugguuauccaaguc

SEQ ID NO: 248617 - RNA, 19 nt, Homo sapiens
ggcaucauccucaucaugu

SEQ ID NO: 248618 - RNA, 19 nt, Homo sapiens
gaagaggaugaugaacaaa

SEQ ID NO: 248619 - RNA, 19 nt, Homo sapiens
augaacaacucugcugaaa

SEQ ID NO: 248620 - RNA, 19 nt, Homo sapiens
caagugauuaaguguguau

SEQ ID NO: 248621 - RNA, 19 nt, Homo sapiens
gcguguucgugaauauuau

SEQ ID NO: 248622 - RNA, 19 nt, Homo sapiens
ugagcguguucgugaauau

SEQ ID NO: 248623 - RNA, 19 nt, Homo sapiens
ugaaaucugcuguggaaag

SEQ ID NO: 248624 - RNA, 19 nt, Homo sapiens
gaaaagcagcucagcaaca

SEQ ID NO: 248625 - RNA, 19 nt, Homo sapiens
gaugagcguguucgugaau

SEQ ID NO: 248626 - RNA, 19 nt, Homo sapiens
ccaaauaacuggccaacua

SEQ ID NO: 248627 - RNA, 19 nt, Homo sapiens
ggagaaggcuuagaauaaa

SEQ ID NO: 248628 - RNA, 19 nt, Homo sapiens
gaacgucaauguuugugua

SEQ ID NO: 248629 - RNA, 19 nt, Homo sapiens
ugaaagagauggcuaacaa

SEQ ID NO: 248630 - RNA, 19 nt, Homo sapiens
ccaaugaaauacacaagua

SEQ ID NO: 248631 - RNA, 19 nt, Homo sapiens
uaaggaggcuggagaugua

SEQ ID NO: 248632 - RNA, 19 nt, Homo sapiens
agaaaucacuuccuugaaa

SEQ ID NO: 248633 - RNA, 19 nt, Homo sapiens
gguaauacgugaaagcaaa

SEQ ID NO: 248634 - RNA, 19 nt, Homo sapiens
uuagaaggcuccauuguuu

SEQ ID NO: 248635 - RNA, 19 nt, Homo sapiens
cagugaagcuauccaaaua

SEQ ID NO: 248636 - RNA, 19 nt, Homo sapiens
gaauugggauuacaucaug

SEQ ID NO: 248637 - RNA, 19 nt, Homo sapiens
gggagaaggcuuagaauaa

SEQ ID NO: 248638 - RNA, 19 nt, Homo sapiens
caagaaaguccacugguua

SEQ ID NO: 248639 - RNA, 19 nt, Homo sapiens
caggauauaucaaacagua

SEQ ID NO: 248640 - RNA, 19 nt, Homo sapiens
gcacugauguaaaguagga

SEQ ID NO: 248641 - RNA, 19 nt, Homo sapiens
ucaagagcauggagaauaa

SEQ ID NO: 248642 - RNA, 19 nt, Homo sapiens
ugacucagauuucauagaa

SEQ ID NO: 248643 - RNA, 19 nt, Homo sapiens
ggaaagugauccaaaauuu

SEQ ID NO: 248644 - RNA, 19 nt, Homo sapiens
gaaccucacugaaaacaua

SEQ ID NO: 248645 - RNA, 19 nt, Homo sapiens
gcccauguguucccucuua

SEQ ID NO: 248646 - RNA, 19 nt, Homo sapiens
uaaaggaaccucacugaaa

SEQ ID NO: 248647 - RNA, 19 nt, Homo sapiens
agaaaccucucacagauaa

SEQ ID NO: 248648 - RNA, 19 nt, Homo sapiens
gcaauguucuaaucacuau

SEQ ID NO: 248649 - RNA, 19 nt, Homo sapiens
gacagaguuucuccuaaua

SEQ ID NO: 248650 - RNA, 19 nt, Homo sapiens
ucacauggcuuuccaccaa

SEQ ID NO: 248651 - RNA, 19 nt, Homo sapiens
gagugucuaugacuuauuu

SEQ ID NO: 248652 - RNA, 19 nt, Homo sapiens
acacaaugauuccuucuuu

SEQ ID NO: 248653 - RNA, 19 nt, Homo sapiens
ugaccaagcugaaacucua

SEQ ID NO: 248654 - RNA, 19 nt, Homo sapiens
gaaaagaaaucacuuccuu

SEQ ID NO: 248655 - RNA, 19 nt, Homo sapiens
gcuagagugucauaauaaa

SEQ ID NO: 248656 - RNA, 19 nt, Homo sapiens
aaagaaaccucucacagau

SEQ ID NO: 248657 - RNA, 19 nt, Homo sapiens
aaacagauauucagcaagu

SEQ ID NO: 248658 - RNA, 19 nt, Homo sapiens
ugaccauacuggauacuua

SEQ ID NO: 248659 - RNA, 19 nt, Homo sapiens
gagaaauuguugaaagaga

SEQ ID NO: 248660 - RNA, 19 nt, Homo sapiens
gcacuugggagaaggcuua

SEQ ID NO: 248661 - RNA, 19 nt, Homo sapiens
cuaagugguuuaugaauug

SEQ ID NO: 248662 - RNA, 19 nt, Homo sapiens
gaguuaagauggagacaga

SEQ ID NO: 248663 - RNA, 19 nt, Homo sapiens
uaaagaaaccucucacaga

SEQ ID NO: 248664 - RNA, 19 nt, Homo sapiens
gggcaggaguuggaaauuu

SEQ ID NO: 248665 - RNA, 19 nt, Homo sapiens
uauaagaccuuccuguuag

SEQ ID NO: 248666 - RNA, 19 nt, Homo sapiens
gaacaguaaacauugguaa

SEQ ID NO: 248667 - RNA, 19 nt, Homo sapiens
uacccaggcuugauuauuu

SEQ ID NO: 248668 - RNA, 19 nt, Homo sapiens
caacccagcccuuauuauu

SEQ ID NO: 248669 - RNA, 19 nt, Homo sapiens
ggaauaaaguccucaaaau

SEQ ID NO: 248670 - RNA, 19 nt, Homo sapiens
acacacacauucacccuaa

SEQ ID NO: 248671 - RNA, 19 nt, Homo sapiens
ucaagaaaguccacugguu

SEQ ID NO: 248672 - RNA, 19 nt, Homo sapiens
uagcaguccugguuucuuu

SEQ ID NO: 248673 - RNA, 19 nt, Homo sapiens
guacauauuugcuuauugc

SEQ ID NO: 248674 - RNA, 19 nt, Homo sapiens
caaaaugacuugguucuuu

SEQ ID NO: 248675 - RNA, 19 nt, Homo sapiens
ugacauugcucucaacauc

SEQ ID NO: 248676 - RNA, 19 nt, Homo sapiens
uggcuagagugucauaaua

SEQ ID NO: 248677 - RNA, 19 nt, Homo sapiens
gcuagagauuggugaauug

SEQ ID NO: 248678 - RNA, 19 nt, Homo sapiens
ucaagaagcacaccaauuc

SEQ ID NO: 248679 - RNA, 19 nt, Homo sapiens
gaauuaccuuucacuuuca

SEQ ID NO: 248680 - RNA, 19 nt, Homo sapiens
gauuagagccugcgcaaug

SEQ ID NO: 248681 - RNA, 19 nt, Homo sapiens
caaauaccaugucagaucu

SEQ ID NO: 248682 - RNA, 19 nt, Homo sapiens
cugcucaacugaaauauga

SEQ ID NO: 248683 - RNA, 19 nt, Homo sapiens
gggaaauguuggaaaguau

SEQ ID NO: 248684 - RNA, 19 nt, Homo sapiens
gaggcaauuucaagauauu

SEQ ID NO: 248685 - RNA, 19 nt, Homo sapiens
agcugaaacucuagaauua

SEQ ID NO: 248686 - RNA, 19 nt, Homo sapiens
caacucgggcuguuuguuu

SEQ ID NO: 248687 - RNA, 19 nt, Homo sapiens
guugguagauugcuguuga

SEQ ID NO: 248688 - RNA, 19 nt, Homo sapiens
uuacaucugucuuaguuga

SEQ ID NO: 248689 - RNA, 19 nt, Homo sapiens
agacagaguuucuccuaau

SEQ ID NO: 248690 - RNA, 19 nt, Homo sapiens
ccacauagacucuuuaaaa

SEQ ID NO: 248691 - RNA, 19 nt, Homo sapiens
gaaaucacuuccuugaaaa

SEQ ID NO: 248692 - RNA, 19 nt, Homo sapiens
ugacuagaguuucaguuga

SEQ ID NO: 248693 - RNA, 19 nt, Homo sapiens
gaaacaagaacuacaggau

SEQ ID NO: 248694 - RNA, 19 nt, Homo sapiens
ggaaguacauuugaagaac

SEQ ID NO: 248695 - RNA, 19 nt, Homo sapiens
gaagcuauaaucagacuau

SEQ ID NO: 248696 - RNA, 19 nt, Homo sapiens
agcaguagcucucaugaaa

SEQ ID NO: 248697 - RNA, 19 nt, Homo sapiens
cagaaugacucagauuuca

SEQ ID NO: 248698 - RNA, 19 nt, Homo sapiens
gaaaagagagaaaggaaaa

SEQ ID NO: 248699 - RNA, 19 nt, Homo sapiens
gaauaucaauccuaaugac

SEQ ID NO: 248700 - RNA, 19 nt, Homo sapiens
ggaauaucaauccuaauga

SEQ ID NO: 248701 - RNA, 19 nt, Homo sapiens
cagcuuauauucaguuuac

SEQ ID NO: 248702 - RNA, 19 nt, Homo sapiens
aaagaaaucacuuccuuga

SEQ ID NO: 248703 - RNA, 19 nt, Homo sapiens
ggaggaaagcugaaagaug

SEQ ID NO: 248704 - RNA, 19 nt, Homo sapiens
uaacagcucaaucucuuaa

SEQ ID NO: 248705 - RNA, 19 nt, Homo sapiens
gaaaauguauggcuagagu

SEQ ID NO: 248706 - RNA, 19 nt, Homo sapiens
ccaaauaccaugucagauc

SEQ ID NO: 248707 - RNA, 19 nt, Homo sapiens
aaacaugaccuuccacaau

SEQ ID NO: 248708 - RNA, 19 nt, Homo sapiens
uuauaagaccuuccuguua

SEQ ID NO: 248709 - RNA, 19 nt, Homo sapiens
gaucuuauaggcaaauaga

SEQ ID NO: 248710 - RNA, 19 nt, Homo sapiens
guggugcuauuguuucuuu

SEQ ID NO: 248711 - RNA, 19 nt, Homo sapiens
ucaaauuucuguucucucu

SEQ ID NO: 248712 - RNA, 19 nt, Homo sapiens
gaugcaacugccaauauua

SEQ ID NO: 248713 - RNA, 19 nt, Homo sapiens
cuagucaccuuagaacuuu

SEQ ID NO: 248714 - RNA, 19 nt, Homo sapiens
gaugcaaggaauucuauaa

SEQ ID NO: 248715 - RNA, 19 nt, Homo sapiens
caacaucucccaucucucu

SEQ ID NO: 248716 - RNA, 19 nt, Homo sapiens
uaauugaccauacuggaua

SEQ ID NO: 248717 - RNA, 19 nt, Homo sapiens
ugacuuauuuccuucacuu

SEQ ID NO: 248718 - RNA, 19 nt, Homo sapiens
cagcaauccuguucaguca

SEQ ID NO: 248719 - RNA, 19 nt, Homo sapiens
gaagcuauccaaauaacug

SEQ ID NO: 248720 - RNA, 19 nt, Homo sapiens
gagaggaaacuguggaaug

SEQ ID NO: 248721 - RNA, 19 nt, Homo sapiens
gcauggguguuguauagau

SEQ ID NO: 248722 - RNA, 19 nt, Homo sapiens
agaaggaaguacauuugaa

SEQ ID NO: 248723 - RNA, 19 nt, Homo sapiens
gagagaagacugucagaag

SEQ ID NO: 248724 - RNA, 19 nt, Homo sapiens
ggaaauguuggaaaguauu

SEQ ID NO: 248725 - RNA, 19 nt, Homo sapiens
ggcauuuacugguuuauag

SEQ ID NO: 248726 - RNA, 19 nt, Homo sapiens
caacgaagcuucugugaug

SEQ ID NO: 248727 - RNA, 19 nt, Homo sapiens
ggaauaacauugcuucaga

SEQ ID NO: 248728 - RNA, 19 nt, Homo sapiens
ggccagaaauggagaauaa

SEQ ID NO: 248729 - RNA, 19 nt, Homo sapiens
gagagagccuccugugaaa

SEQ ID NO: 248730 - RNA, 19 nt, Homo sapiens
gaagcacccuuuaagaaug

SEQ ID NO: 248731 - RNA, 19 nt, Homo sapiens
uaacugacaugggccuuua

SEQ ID NO: 248732 - RNA, 19 nt, Homo sapiens
ugacaacacuuaauagcaa

SEQ ID NO: 248733 - RNA, 19 nt, Homo sapiens
cggaagagcuggagacaga

SEQ ID NO: 248734 - RNA, 19 nt, Homo sapiens
gcagacaccuacaacauca

SEQ ID NO: 248735 - RNA, 19 nt, Homo sapiens
ggagagaugucaugcaagu

SEQ ID NO: 248736 - RNA, 19 nt, Homo sapiens
ggugaaagaugaaccugaa

SEQ ID NO: 248737 - RNA, 19 nt, Homo sapiens
aaagugacguccugcauuu

SEQ ID NO: 248738 - RNA, 19 nt, Homo sapiens
ugaccaaucucaaggauau

SEQ ID NO: 248739 - RNA, 19 nt, Homo sapiens
gcuggaaacucuucuacaa

SEQ ID NO: 248740 - RNA, 19 nt, Homo sapiens
uuaagaaugucacagagua

SEQ ID NO: 248741 - RNA, 19 nt, Homo sapiens
aaacaaagaccauugauuc

SEQ ID NO: 248742 - RNA, 19 nt, Homo sapiens
ucaaggauauugggcuuua

SEQ ID NO: 248743 - RNA, 19 nt, Homo sapiens
gaaaggaagcggagagaug

SEQ ID NO: 248744 - RNA, 19 nt, Homo sapiens
caaagaccauugauucugu

SEQ ID NO: 248745 - RNA, 19 nt, Homo sapiens
ggagaauaauccaguccua

SEQ ID NO: 248746 - RNA, 19 nt, Homo sapiens
caaccugaguuacuacauu

SEQ ID NO: 248747 - RNA, 19 nt, Homo sapiens
gcuucugacuagauuauua

SEQ ID NO: 248748 - RNA, 19 nt, Homo sapiens
gaaccagucuccucacucu

SEQ ID NO: 248749 - RNA, 19 nt, Homo sapiens
cuucagagcuggagaacuu

SEQ ID NO: 248750 - RNA, 19 nt, Homo sapiens
gaaggucugugaggaagaa

SEQ ID NO: 248751 - RNA, 19 nt, Homo sapiens
ggaaacucuucuacaacua

SEQ ID NO: 248752 - RNA, 19 nt, Homo sapiens
gcagcugguugcuccauuu

SEQ ID NO: 248753 - RNA, 19 nt, Homo sapiens
gcggagagaugucaugcaa

SEQ ID NO: 248754 - RNA, 19 nt, Homo sapiens
gaaagugacguccugcauu

SEQ ID NO: 248755 - RNA, 19 nt, Homo sapiens
ggaagcacccuuuaagaau

SEQ ID NO: 248756 - RNA, 19 nt, Homo sapiens
gaaaccagaguggccauua

SEQ ID NO: 248757 - RNA, 19 nt, Homo sapiens
gaagaaucgcaucaucaua

SEQ ID NO: 248758 - RNA, 19 nt, Homo sapiens
gacaugaaauuuacaaagg

SEQ ID NO: 248759 - RNA, 19 nt, Homo sapiens
ucuaugagacagacuauua

SEQ ID NO: 248760 - RNA, 19 nt, Homo sapiens
ccaaggguguggugaaaga

SEQ ID NO: 248761 - RNA, 19 nt, Homo sapiens
gcacacaggucucauugcu

SEQ ID NO: 248762 - RNA, 19 nt, Homo sapiens
gaacuacacagcccggauu

SEQ ID NO: 248763 - RNA, 19 nt, Homo sapiens
ggaauggagugcuguaugc

SEQ ID NO: 248764 - RNA, 19 nt, Homo sapiens
cagaguacccuuucuuuga

SEQ ID NO: 248765 - RNA, 19 nt, Homo sapiens
caacagagcacuugagaac

SEQ ID NO: 248766 - RNA, 19 nt, Homo sapiens
ugacaugggccuuuaagaa

SEQ ID NO: 248767 - RNA, 19 nt, Homo sapiens
gauggagucuucaccacuu

SEQ ID NO: 248768 - RNA, 19 nt, Homo sapiens
aaaccagaguggccauuaa

SEQ ID NO: 248769 - RNA, 19 nt, Homo sapiens
ggacucaguacgccguuua

SEQ ID NO: 248770 - RNA, 19 nt, Homo sapiens
ggacaagccagacaacugu

SEQ ID NO: 248771 - RNA, 19 nt, Homo sapiens
gauggucuaugaaggaguu

SEQ ID NO: 248772 - RNA, 19 nt, Homo sapiens
aagaaucgcaucaucauaa

SEQ ID NO: 248773 - RNA, 19 nt, Homo sapiens
gacagacuauuaccggaaa

SEQ ID NO: 248774 - RNA, 19 nt, Homo sapiens
gagacacgcuggcgacaca

SEQ ID NO: 248775 - RNA, 19 nt, Homo sapiens
agaaggagcagaugacauu

SEQ ID NO: 248776 - RNA, 19 nt, Homo sapiens
gagaagaccaccaucaaca

SEQ ID NO: 248777 - RNA, 19 nt, Homo sapiens
ucagauggccggagagauu

SEQ ID NO: 248778 - RNA, 19 nt, Homo sapiens
caacacuggucaucaugga

SEQ ID NO: 248779 - RNA, 19 nt, Homo sapiens
aaauacggaucacaaguug

SEQ ID NO: 248780 - RNA, 19 nt, Homo sapiens
caccgugggucauuacaaa

SEQ ID NO: 248781 - RNA, 19 nt, Homo sapiens
ccucaaggauggagucuuc

SEQ ID NO: 248782 - RNA, 19 nt, Homo sapiens
gggagaagaucaccaugag

SEQ ID NO: 248783 - RNA, 19 nt, Homo sapiens
gcacaauuacugcuccaaa

SEQ ID NO: 248784 - RNA, 19 nt, Homo sapiens
agugagaucuuguacauuc

SEQ ID NO: 248785 - RNA, 19 nt, Homo sapiens
agaaggaggaggcugaaua

SEQ ID NO: 248786 - RNA, 19 nt, Homo sapiens
ggacaugaaauuuacaaag

SEQ ID NO: 248787 - RNA, 19 nt, Homo sapiens
gaucaucagcagcaucaaa

SEQ ID NO: 248788 - RNA, 19 nt, Homo sapiens
ggggcgaucucaaaaguua

SEQ ID NO: 248789 - RNA, 19 nt, Homo sapiens
gugggaggguuggugauua

SEQ ID NO: 248790 - RNA, 19 nt, Homo sapiens
agaccaccaucaacaauga

SEQ ID NO: 248791 - RNA, 19 nt, Homo sapiens
gaagaccaccaucaacaau

SEQ ID NO: 248792 - RNA, 19 nt, Homo sapiens
ucuccucucugcuucauaa

SEQ ID NO: 248793 - RNA, 19 nt, Homo sapiens
guccugacaugcuguuuga

SEQ ID NO: 248794 - RNA, 19 nt, Homo sapiens
ggaguucaauugucaccau

SEQ ID NO: 248795 - RNA, 19 nt, Homo sapiens
agagugagaucuuguacau

SEQ ID NO: 248796 - RNA, 19 nt, Homo sapiens
acagggaucucaucagcuu

SEQ ID NO: 248797 - RNA, 19 nt, Homo sapiens
gacaugcuguuugaacuga

SEQ ID NO: 248798 - RNA, 19 nt, Homo sapiens
caugguagccgaagauuuc

SEQ ID NO: 248799 - RNA, 19 nt, Homo sapiens
gacagaguacccuuucuuu

SEQ ID NO: 248800 - RNA, 19 nt, Homo sapiens
ucucauugcuucugacuag

SEQ ID NO: 248801 - RNA, 19 nt, Homo sapiens
gauccuguguucuucuaug

SEQ ID NO: 248802 - RNA, 19 nt, Homo sapiens
gaacugucauuucuaaccu

SEQ ID NO: 248803 - RNA, 19 nt, Homo sapiens
ucuagggacaugaaauuua

SEQ ID NO: 248804 - RNA, 19 nt, Homo sapiens
ugagcaagaugauucagau

SEQ ID NO: 248805 - RNA, 19 nt, Homo sapiens
gaaggaggaggcugaauac

SEQ ID NO: 248806 - RNA, 19 nt, Homo sapiens
gaaccuuaaugacaacacu

SEQ ID NO: 248807 - RNA, 19 nt, Homo sapiens
cucaucagcuucaccguuu

SEQ ID NO: 248808 - RNA, 19 nt, Homo sapiens
gaugaccaaucucaaggau

SEQ ID NO: 248809 - RNA, 19 nt, Homo sapiens
cagcuucucugcaguaaaa

SEQ ID NO: 248810 - RNA, 19 nt, Homo sapiens
gagaucaucagcagcauca

SEQ ID NO: 248811 - RNA, 19 nt, Homo sapiens
cgcaugugcuggcaguaua

SEQ ID NO: 248812 - RNA, 19 nt, Homo sapiens
cguuugggauggucuauga

SEQ ID NO: 248813 - RNA, 19 nt, Homo sapiens
ggagacagaguacccuuuc

SEQ ID NO: 248814 - RNA, 19 nt, Homo sapiens
cuagggacaugaaauuuac

SEQ ID NO: 248815 - RNA, 19 nt, Homo sapiens
guaccucaguggaucuuca

SEQ ID NO: 248816 - RNA, 19 nt, Homo sapiens
cagauccuguguucuucua

SEQ ID NO: 248817 - RNA, 19 nt, Homo sapiens
gagcagaguggauaacaag

SEQ ID NO: 248818 - RNA, 19 nt, Homo sapiens
ugcuuucaaucccaaauua

SEQ ID NO: 248819 - RNA, 19 nt, Homo sapiens
gaccauugauucuguuacu

SEQ ID NO: 248820 - RNA, 19 nt, Homo sapiens
ccaaggcuguuaccauuuu

SEQ ID NO: 248821 - RNA, 19 nt, Homo sapiens
gauccugaaucugugcaaa

SEQ ID NO: 248822 - RNA, 19 nt, Homo sapiens
aaaguuaucuccggucucu

SEQ ID NO: 248823 - RNA, 19 nt, Homo sapiens
gugagaggauugaguuucu

SEQ ID NO: 248824 - RNA, 19 nt, Homo sapiens
gcagaguggauaacaagga

SEQ ID NO: 248825 - RNA, 19 nt, Homo sapiens
ucuguuaccucuccacugu

SEQ ID NO: 248826 - RNA, 19 nt, Homo sapiens
gaaccaaaguggauuaauu

SEQ ID NO: 248827 - RNA, 19 nt, Homo sapiens
gcaaguucuuccaauauga

SEQ ID NO: 248828 - RNA, 19 nt, Homo sapiens
uacaacagcugaccucauu

SEQ ID NO: 248829 - RNA, 19 nt, Homo sapiens
caaaaucgauuggcuuuaa

SEQ ID NO: 248830 - RNA, 19 nt, Homo sapiens
caaaguggauuaauuacac

SEQ ID NO: 248831 - RNA, 19 nt, Homo sapiens
ggcaaguucuuccaauaug

SEQ ID NO: 248832 - RNA, 19 nt, Homo sapiens
gagcaaaacugccgcaagu

SEQ ID NO: 248833 - RNA, 19 nt, Homo sapiens
gggcaaguucuuccaauau

SEQ ID NO: 248834 - RNA, 19 nt, Homo sapiens
ugggcaaguucuuccaaua

SEQ ID NO: 248835 - RNA, 19 nt, Homo sapiens
caacagcugaccucauuuc

SEQ ID NO: 248836 - RNA, 19 nt, Homo sapiens
cgaccgugcuuccggacaa

SEQ ID NO: 248837 - RNA, 19 nt, Homo sapiens
uggauuaauuacacgcuuu

SEQ ID NO: 248838 - RNA, 19 nt, Homo sapiens
cgugcugcauugcugcuua

SEQ ID NO: 248839 - RNA, 19 nt, Homo sapiens
uuaauuacacgcuuucugu

SEQ ID NO: 248840 - RNA, 19 nt, Homo sapiens
ccaaaguggauuaauuaca

SEQ ID NO: 248841 - RNA, 19 nt, Homo sapiens
ucgcagccguggcaucguu

SEQ ID NO: 248842 - RNA, 19 nt, Homo sapiens
gccgaaccaaaguggauua

SEQ ID NO: 248843 - RNA, 19 nt, Homo sapiens
cuggagacguacugugcua

SEQ ID NO: 248844 - RNA, 19 nt, Homo sapiens
aauuacacgcuuucuguuu

SEQ ID NO: 248845 - RNA, 19 nt, Homo sapiens
uaauuacacgcuuucuguu

SEQ ID NO: 248846 - RNA, 19 nt, Homo sapiens
ggauuaauuacacgcuuuc

SEQ ID NO: 248847 - RNA, 19 nt, Homo sapiens
gugggcaaguucuuccaau

SEQ ID NO: 248848 - RNA, 19 nt, Homo sapiens
uggacaaucagacgaauuc

SEQ ID NO: 248849 - RNA, 19 nt, Homo sapiens
auuacacgcuuucuguuuc

SEQ ID NO: 248850 - RNA, 19 nt, Homo sapiens
gucacgugcucgccaagga

SEQ ID NO: 248851 - RNA, 19 nt, Homo sapiens
uuacacgcuuucuguuucu

SEQ ID NO: 248852 - RNA, 19 nt, Homo sapiens
ugaccucauuucccgauac

SEQ ID NO: 248853 - RNA, 19 nt, Homo sapiens
cacucugucucucccacua

SEQ ID NO: 248854 - RNA, 19 nt, Homo sapiens
gaauugaccuguacaaaga

SEQ ID NO: 248855 - RNA, 19 nt, Homo sapiens
gaucugagcuccuuaagug

SEQ ID NO: 248856 - RNA, 19 nt, Homo sapiens
ccacagagauuaccuggaa

SEQ ID NO: 248857 - RNA, 19 nt, Homo sapiens
augcgaagcuuucauauua

SEQ ID NO: 248858 - RNA, 19 nt, Homo sapiens
caaacaaccugcccaaaga

SEQ ID NO: 248859 - RNA, 19 nt, Homo sapiens
gggaaacagugauaaguaa

SEQ ID NO: 248860 - RNA, 19 nt, Homo sapiens
gcauaauuguccugaaaua

SEQ ID NO: 248861 - RNA, 19 nt, Homo sapiens
cugaagagcucaagaauug

SEQ ID NO: 248862 - RNA, 19 nt, Homo sapiens
gaaauugaguggauuacug

SEQ ID NO: 248863 - RNA, 19 nt, Homo sapiens
guggagagauggcauaauu

SEQ ID NO: 248864 - RNA, 19 nt, Homo sapiens
gaagugguuuccaucagua

SEQ ID NO: 248865 - RNA, 19 nt, Homo sapiens
ggagguucauccuauauuu

SEQ ID NO: 248866 - RNA, 19 nt, Homo sapiens
gagcggagguucauccuau

SEQ ID NO: 248867 - RNA, 19 nt, Homo sapiens
ggagugggcuucccugaau

SEQ ID NO: 248868 - RNA, 19 nt, Homo sapiens
gaccucaccuugauauauu

SEQ ID NO: 248869 - RNA, 19 nt, Homo sapiens
guacagagcacauuuguca

SEQ ID NO: 248870 - RNA, 19 nt, Homo sapiens
ggacaagcauuucaacuac

SEQ ID NO: 248871 - RNA, 19 nt, Homo sapiens
ggacaacugugaggugaaa

SEQ ID NO: 248872 - RNA, 19 nt, Homo sapiens
aaacagagaagaagcauuu

SEQ ID NO: 248873 - RNA, 19 nt, Homo sapiens
caaagaaguuggagugcaa

SEQ ID NO: 248874 - RNA, 19 nt, Homo sapiens
caggagaacggccauauua

SEQ ID NO: 248875 - RNA, 19 nt, Homo sapiens
uaaaggagacuucagauug

SEQ ID NO: 248876 - RNA, 19 nt, Homo sapiens
gaccaggcuugcucuauaa

SEQ ID NO: 248877 - RNA, 19 nt, Homo sapiens
gcagcaggaugucuccaua

SEQ ID NO: 248878 - RNA, 19 nt, Homo sapiens
ccugggaacuccugaauuu

SEQ ID NO: 248879 - RNA, 19 nt, Homo sapiens
gccaguaccucuucucuug

SEQ ID NO: 248880 - RNA, 19 nt, Homo sapiens
gcaaauucguccagaaaca

SEQ ID NO: 248881 - RNA, 19 nt, Homo sapiens
aauggaagcucuauuguug

SEQ ID NO: 248882 - RNA, 19 nt, Homo sapiens
cgaugaugcuucuauaauu

SEQ ID NO: 248883 - RNA, 19 nt, Homo sapiens
ccacagccaucuucuucua

SEQ ID NO: 248884 - RNA, 19 nt, Homo sapiens
gaggauaacuccaccuaca

SEQ ID NO: 248885 - RNA, 19 nt, Homo sapiens
gaacuugggucugaguaau

SEQ ID NO: 248886 - RNA, 19 nt, Homo sapiens
gaaagagaaaggaaacauu

SEQ ID NO: 248887 - RNA, 19 nt, Homo sapiens
gagcacauuugucaguauu

SEQ ID NO: 248888 - RNA, 19 nt, Homo sapiens
gaacuggucauuaaugugu

SEQ ID NO: 248889 - RNA, 19 nt, Homo sapiens
ccaagcaccuccaaccaaa

SEQ ID NO: 248890 - RNA, 19 nt, Homo sapiens
gcaggaagauaccacaauc

SEQ ID NO: 248891 - RNA, 19 nt, Homo sapiens
ggucucaucucuucagguu

SEQ ID NO: 248892 - RNA, 19 nt, Homo sapiens
guauaggucucaucucuuc

SEQ ID NO: 248893 - RNA, 19 nt, Homo sapiens
cagaguggcugauggaaga

SEQ ID NO: 248894 - RNA, 19 nt, Homo sapiens
gcagggauuucacaaagug

SEQ ID NO: 248895 - RNA, 19 nt, Homo sapiens
uggaggaaauacuacauua

SEQ ID NO: 248896 - RNA, 19 nt, Homo sapiens
guaaugcgaagcuuucaua

SEQ ID NO: 248897 - RNA, 19 nt, Homo sapiens
ccuauaaaguugagacaaa

SEQ ID NO: 248898 - RNA, 19 nt, Homo sapiens
ggaagaggcaggaaagcua

SEQ ID NO: 248899 - RNA, 19 nt, Homo sapiens
ggacacuucucuauucauc

SEQ ID NO: 248900 - RNA, 19 nt, Homo sapiens
gaguugaggugucagagaa

SEQ ID NO: 248901 - RNA, 19 nt, Homo sapiens
ggacaccuguuugaucuga

SEQ ID NO: 248902 - RNA, 19 nt, Homo sapiens
ucaaauuccugcaucaaga

SEQ ID NO: 248903 - RNA, 19 nt, Homo sapiens
agaccaggcuugcucuaua

SEQ ID NO: 248904 - RNA, 19 nt, Homo sapiens
gggaguguguggucaguuu

SEQ ID NO: 248905 - RNA, 19 nt, Homo sapiens
ggaaagugcaccaguguug

SEQ ID NO: 248906 - RNA, 19 nt, Homo sapiens
gaaacauucaacucucuua

SEQ ID NO: 248907 - RNA, 19 nt, Homo sapiens
gggaacuccugaauuugua

SEQ ID NO: 248908 - RNA, 19 nt, Homo sapiens
aagaaacccuugcugcuuu

SEQ ID NO: 248909 - RNA, 19 nt, Homo sapiens
gaaguuggagugcaaauuc

SEQ ID NO: 248910 - RNA, 19 nt, Homo sapiens
gacaugcacucucuucuuc

SEQ ID NO: 248911 - RNA, 19 nt, Homo sapiens
gcaaggauauaacgucucu

SEQ ID NO: 248912 - RNA, 19 nt, Homo sapiens
gcaccuacuucuucacaug

SEQ ID NO: 248913 - RNA, 19 nt, Homo sapiens
acagagggcugcauucgaa

SEQ ID NO: 248914 - RNA, 19 nt, Homo sapiens
gcaauccucucccuuacau

SEQ ID NO: 248915 - RNA, 19 nt, Homo sapiens
uaucaccucucacaaagaa

SEQ ID NO: 248916 - RNA, 19 nt, Homo sapiens
ggaauacgccuguguuaag

SEQ ID NO: 248917 - RNA, 19 nt, Homo sapiens
gaagaaacccuugcugcuu

SEQ ID NO: 248918 - RNA, 19 nt, Homo sapiens
gaaaggaagggcaggagaa

SEQ ID NO: 248919 - RNA, 19 nt, Homo sapiens
caacuuuccuccaucacaa

SEQ ID NO: 248920 - RNA, 19 nt, Homo sapiens
ggacauccagcaucauauu

SEQ ID NO: 248921 - RNA, 19 nt, Homo sapiens
gaagcucuauuguugacuu

SEQ ID NO: 248922 - RNA, 19 nt, Homo sapiens
ugacucagaagcuaacuua

SEQ ID NO: 248923 - RNA, 19 nt, Homo sapiens
acacuuacuuugaguuuga

SEQ ID NO: 248924 - RNA, 19 nt, Homo sapiens
gcaccaguguugagaacuu

SEQ ID NO: 248925 - RNA, 19 nt, Homo sapiens
caacugccgcuaugaaauu

SEQ ID NO: 248926 - RNA, 19 nt, Homo sapiens
gaggaagcaugaucucaau

SEQ ID NO: 248927 - RNA, 19 nt, Homo sapiens
acucaaaggugaauaagga

SEQ ID NO: 248928 - RNA, 19 nt, Homo sapiens
gggaacgccuaagcuguua

SEQ ID NO: 248929 - RNA, 19 nt, Homo sapiens
ccaccaggaucacguuuga

SEQ ID NO: 248930 - RNA, 19 nt, Homo sapiens
gcuaugaaauugaguggau

SEQ ID NO: 248931 - RNA, 19 nt, Homo sapiens
cauccagcaucauauuuaa

SEQ ID NO: 248932 - RNA, 19 nt, Homo sapiens
ggaggaaauacuacauuaa

SEQ ID NO: 248933 - RNA, 19 nt, Homo sapiens
gaauucaacacaacaguga

SEQ ID NO: 248934 - RNA, 19 nt, Homo sapiens
gacaauuacucagguuuga

SEQ ID NO: 248935 - RNA, 19 nt, Homo sapiens
gaaaggauaagaccaaguc

SEQ ID NO: 248936 - RNA, 19 nt, Homo sapiens
cagcugcacuuacuacuuc

SEQ ID NO: 248937 - RNA, 19 nt, Homo sapiens
gaagcugggugucauaggu

SEQ ID NO: 248938 - RNA, 19 nt, Homo sapiens
ggagucucguacuauauaa

SEQ ID NO: 248939 - RNA, 19 nt, Homo sapiens
gggcgaagcugugguguag

SEQ ID NO: 248940 - RNA, 19 nt, Homo sapiens
gaauggaagcucuauuguu

SEQ ID NO: 248941 - RNA, 19 nt, Homo sapiens
cucagaagcuaacuuauga

SEQ ID NO: 248942 - RNA, 19 nt, Homo sapiens
caacuuguaugaccugaag

SEQ ID NO: 248943 - RNA, 19 nt, Homo sapiens
gcagacagaccacauauac

SEQ ID NO: 248944 - RNA, 19 nt, Homo sapiens
gaaugcagcucaggguuuc

SEQ ID NO: 248945 - RNA, 19 nt, Homo sapiens
cgauaccucucaagucaaa

SEQ ID NO: 248946 - RNA, 19 nt, Homo sapiens
ggccacaagucuucaguga

SEQ ID NO: 248947 - RNA, 19 nt, Homo sapiens
caaugaaacuggauuacag

SEQ ID NO: 248948 - RNA, 19 nt, Homo sapiens
gaacaaggaggcuguaagg

SEQ ID NO: 248949 - RNA, 19 nt, Homo sapiens
guuaugaggcuuaugauga

SEQ ID NO: 248950 - RNA, 19 nt, Homo sapiens
auacguugauggcgacuua

SEQ ID NO: 248951 - RNA, 19 nt, Homo sapiens
aaaggagacuucagauugu

SEQ ID NO: 248952 - RNA, 19 nt, Homo sapiens
gcagccuccuucuggaaua

SEQ ID NO: 248953 - RNA, 19 nt, Homo sapiens
ugagaagacuuggaacuug

SEQ ID NO: 248954 - RNA, 19 nt, Homo sapiens
gaaccucucugggaacugu

SEQ ID NO: 248955 - RNA, 19 nt, Homo sapiens
ccaccuggcucaccuugug

SEQ ID NO: 248956 - RNA, 19 nt, Homo sapiens
gccuguggcuggaggguaa

SEQ ID NO: 248957 - RNA, 19 nt, Homo sapiens
gacuguggcugcccucuca

SEQ ID NO: 248958 - RNA, 19 nt, Homo sapiens
ucaaggcgcugcgggacuu

SEQ ID NO: 248959 - RNA, 19 nt, Homo sapiens
cagcugucaucaauuaaag

SEQ ID NO: 248960 - RNA, 19 nt, Homo sapiens
ccccagcugucaucaauua

SEQ ID NO: 248961 - RNA, 19 nt, Homo sapiens
gcguacaccuacaacaaca

SEQ ID NO: 248962 - RNA, 19 nt, Homo sapiens
caucaaggcaaacguguuc

SEQ ID NO: 248963 - RNA, 19 nt, Homo sapiens
caacguggcggucaugaac

SEQ ID NO: 248964 - RNA, 19 nt, Homo sapiens
cggaugagcucagcgucuu

SEQ ID NO: 248965 - RNA, 19 nt, Homo sapiens
ccagcugucaucaauuaaa

SEQ ID NO: 248966 - RNA, 19 nt, Homo sapiens
ggacuucgcccugcagaac

SEQ ID NO: 248967 - RNA, 19 nt, Homo sapiens
ggauggcccugaggaaagg

SEQ ID NO: 248968 - RNA, 19 nt, Homo sapiens
ccgcguacaccuacaacaa

SEQ ID NO: 248969 - RNA, 19 nt, Homo sapiens
ggaacugucuccggaaccu

SEQ ID NO: 248970 - RNA, 19 nt, Homo sapiens
guacaccuacaacaacauc

SEQ ID NO: 248971 - RNA, 19 nt, Homo sapiens
gucaucaauuaaaggcaaa

SEQ ID NO: 248972 - RNA, 19 nt, Homo sapiens
aaaggcaaaggcaaucgaa

SEQ ID NO: 248973 - RNA, 19 nt, Homo sapiens
acaacucacugcggaccuu

SEQ ID NO: 248974 - RNA, 19 nt, Homo sapiens
ggcuggacgucucgcacaa

SEQ ID NO: 248975 - RNA, 19 nt, Homo sapiens
gaaaccagaugaaauaaug

SEQ ID NO: 248976 - RNA, 19 nt, Homo sapiens
gaaauaagagagaguaguu

SEQ ID NO: 248977 - RNA, 19 nt, Homo sapiens
ugaaacacuucucaucaua

SEQ ID NO: 248978 - RNA, 19 nt, Homo sapiens
gaaggagcccugccgaaua

SEQ ID NO: 248979 - RNA, 19 nt, Homo sapiens
ucuagaacaugcacauuua

SEQ ID NO: 248980 - RNA, 19 nt, Homo sapiens
ggagacaucaggagaagaa

SEQ ID NO: 248981 - RNA, 19 nt, Homo sapiens
guaaguaauugcauuucug

SEQ ID NO: 248982 - RNA, 19 nt, Homo sapiens
ccagagagcacggagauaa

SEQ ID NO: 248983 - RNA, 19 nt, Homo sapiens
guuaaacacgugucgauaa

SEQ ID NO: 248984 - RNA, 19 nt, Homo sapiens
uaacuuguccuaugucaau

SEQ ID NO: 248985 - RNA, 19 nt, Homo sapiens
ccaacugccagauauauuu

SEQ ID NO: 248986 - RNA, 19 nt, Homo sapiens
gaaacacuucucaucauau

SEQ ID NO: 248987 - RNA, 19 nt, Homo sapiens
cuccauacauaacuugaua

SEQ ID NO: 248988 - RNA, 19 nt, Homo sapiens
ucugucacgugaaauauuu

SEQ ID NO: 248989 - RNA, 19 nt, Homo sapiens
uuaaacacgugucgauaau

SEQ ID NO: 248990 - RNA, 19 nt, Homo sapiens
uguccuaugucaauuugua

SEQ ID NO: 248991 - RNA, 19 nt, Homo sapiens
acugaaaccagaugaaaua

SEQ ID NO: 248992 - RNA, 19 nt, Homo sapiens
gacaucaggagaagaaauu

SEQ ID NO: 248993 - RNA, 19 nt, Homo sapiens
aaacacgugucgauaaugg

SEQ ID NO: 248994 - RNA, 19 nt, Homo sapiens
ggaaggagcccugccgaau

SEQ ID NO: 248995 - RNA, 19 nt, Homo sapiens
ccaaagcuccugcgucugu

SEQ ID NO: 248996 - RNA, 19 nt, Homo sapiens
gauguugccaccuguuaaa

SEQ ID NO: 248997 - RNA, 19 nt, Homo sapiens
aauguacacuggauauguu

SEQ ID NO: 248998 - RNA, 19 nt, Homo sapiens
aaacugaaaccagaugaaa

SEQ ID NO: 248999 - RNA, 19 nt, Homo sapiens
gcucgaaggcucuccaugu

SEQ ID NO: 249000 - RNA, 19 nt, Homo sapiens
cacuggauauguuguuaaa

SEQ ID NO: 249001 - RNA, 19 nt, Homo sapiens
ccuagaaaaugcaaaauga

SEQ ID NO: 249002 - RNA, 19 nt, Homo sapiens
aaggagcccugccgaauag

SEQ ID NO: 249003 - RNA, 19 nt, Homo sapiens
aaagcuaccuguggugaug

SEQ ID NO: 249004 - RNA, 19 nt, Homo sapiens
gcaacaagaauggauuuua

SEQ ID NO: 249005 - RNA, 19 nt, Homo sapiens
cugccaaacugcaacaaga

SEQ ID NO: 249006 - RNA, 19 nt, Homo sapiens
gcauuucugcucuuccaaa

SEQ ID NO: 249007 - RNA, 19 nt, Homo sapiens
aauguucugucacgugaaa

SEQ ID NO: 249008 - RNA, 19 nt, Homo sapiens
uacacuggauauguuguua

SEQ ID NO: 249009 - RNA, 19 nt, Homo sapiens
acagagucguagagaguuu

SEQ ID NO: 249010 - RNA, 19 nt, Homo sapiens
gugauguugccaccuguua

SEQ ID NO: 249011 - RNA, 19 nt, Homo sapiens
gcagacagugugagacauc

SEQ ID NO: 249012 - RNA, 19 nt, Homo sapiens
guacacuggauauguuguu

SEQ ID NO: 249013 - RNA, 19 nt, Homo sapiens
acacuucucaucauauugu

SEQ ID NO: 249014 - RNA, 19 nt, Homo sapiens
caaagcuccugcgucuguu

SEQ ID NO: 249015 - RNA, 19 nt, Homo sapiens
caggagacaucaggagaag

SEQ ID NO: 249016 - RNA, 19 nt, Homo sapiens
acauguguagggaaaguua

SEQ ID NO: 249017 - RNA, 19 nt, Homo sapiens
aauaacuuguccuauguca

SEQ ID NO: 249018 - RNA, 19 nt, Homo sapiens
ccaaacugcaacaagaaug

SEQ ID NO: 249019 - RNA, 19 nt, Homo sapiens
gggacgccaucaguaccua

SEQ ID NO: 249020 - RNA, 19 nt, Homo sapiens
caucacuugcccagaguuu

SEQ ID NO: 249021 - RNA, 19 nt, Homo sapiens
acuuguauauuccaccauu

SEQ ID NO: 249022 - RNA, 19 nt, Homo sapiens
cagcagacagugugagaca

SEQ ID NO: 249023 - RNA, 19 nt, Homo sapiens
caaacugcaacaagaaugg

SEQ ID NO: 249024 - RNA, 19 nt, Homo sapiens
ccaaggcacaggagacauc

SEQ ID NO: 249025 - RNA, 19 nt, Homo sapiens
uaauugcauuucugcucuu

SEQ ID NO: 249026 - RNA, 19 nt, Homo sapiens
ggagcccugccgaauagaa

SEQ ID NO: 249027 - RNA, 19 nt, Homo sapiens
gcccagagagcacggagau

SEQ ID NO: 249028 - RNA, 19 nt, Homo sapiens
cagagucguagagaguuua

SEQ ID NO: 249029 - RNA, 19 nt, Homo sapiens
acacuggauauguuguuaa

SEQ ID NO: 249030 - RNA, 19 nt, Homo sapiens
aaauguacacuggauaugu

SEQ ID NO: 249031 - RNA, 19 nt, Homo sapiens
gaccccaacugccagauau

SEQ ID NO: 249032 - RNA, 19 nt, Homo sapiens
acacgugucgauaauggaa

SEQ ID NO: 249033 - RNA, 19 nt, Homo sapiens
cuuguccuaugucaauuug

SEQ ID NO: 249034 - RNA, 19 nt, Homo sapiens
gccaaacugcaacaagaau

SEQ ID NO: 249035 - RNA, 19 nt, Homo sapiens
caucaggagaagaaauuuc

SEQ ID NO: 249036 - RNA, 19 nt, Homo sapiens
ugauguugccaccuguuaa

SEQ ID NO: 249037 - RNA, 19 nt, Homo sapiens
ccaccauucacauuugaug

SEQ ID NO: 249038 - RNA, 19 nt, Homo sapiens
cuagaacaugcacauuuau

SEQ ID NO: 249039 - RNA, 19 nt, Homo sapiens
ugaaggagcuggccguguu

SEQ ID NO: 249040 - RNA, 19 nt, Homo sapiens
ggugggugcuggaggauuu

SEQ ID NO: 249041 - RNA, 19 nt, Homo sapiens
ugucaucucuucuacaaug

SEQ ID NO: 249042 - RNA, 19 nt, Homo sapiens
caauggcgaugaccacuca

SEQ ID NO: 249043 - RNA, 19 nt, Homo sapiens
ggagcagguugcagacaau

SEQ ID NO: 249044 - RNA, 19 nt, Homo sapiens
ugacaagcauggccuguac

SEQ ID NO: 249045 - RNA, 19 nt, Homo sapiens
gggcaaggguggcaagcau

SEQ ID NO: 249046 - RNA, 19 nt, Homo sapiens
cgagggcacuugugagaag

SEQ ID NO: 249047 - RNA, 19 nt, Homo sapiens
aaggaggccugguggagaa

SEQ ID NO: 249048 - RNA, 19 nt, Homo sapiens
guucugacacacguauuua

SEQ ID NO: 249049 - RNA, 19 nt, Homo sapiens
ccaugcgccuuccggauga

SEQ ID NO: 249050 - RNA, 19 nt, Homo sapiens
ucugacacacguauuuaua

SEQ ID NO: 249051 - RNA, 19 nt, Homo sapiens
gcaaggguggcaagcauca

SEQ ID NO: 249052 - RNA, 19 nt, Homo sapiens
ccacaccugcuccuucuug

SEQ ID NO: 249053 - RNA, 19 nt, Homo sapiens
cggagcagguugcagacaa

SEQ ID NO: 249054 - RNA, 19 nt, Homo sapiens
agugucaucucuucuacaa

SEQ ID NO: 249055 - RNA, 19 nt, Homo sapiens
gaaccccugugucccuuuu

SEQ ID NO: 249056 - RNA, 19 nt, Homo sapiens
ucaagucggguaugaagga

SEQ ID NO: 249057 - RNA, 19 nt, Homo sapiens
acacccagcggaugcagua

SEQ ID NO: 249058 - RNA, 19 nt, Homo sapiens
ggggagugcugguguguga

SEQ ID NO: 249059 - RNA, 19 nt, Homo sapiens
ccucaaacagugcaagaug

SEQ ID NO: 249060 - RNA, 19 nt, Homo sapiens
ggcgagggcacuugugaga

SEQ ID NO: 249061 - RNA, 19 nt, Homo sapiens
cgagugucaucucuucuac

SEQ ID NO: 249062 - RNA, 19 nt, Homo sapiens
gaaggagcuggccguguuc

SEQ ID NO: 249063 - RNA, 19 nt, Homo sapiens
cucaaacagugcaagaugu

SEQ ID NO: 249064 - RNA, 19 nt, Homo sapiens
gagcugggguacagguuug

SEQ ID NO: 249065 - RNA, 19 nt, Homo sapiens
ccgagugucaucucuucua

SEQ ID NO: 249066 - RNA, 19 nt, Homo sapiens
agugcaagaugucucugaa

SEQ ID NO: 249067 - RNA, 19 nt, Homo sapiens
guggacagcaccaugaaca

SEQ ID NO: 249068 - RNA, 19 nt, Homo sapiens
gugacaagcauggccugua

SEQ ID NO: 249069 - RNA, 19 nt, Homo sapiens
gcauagagcucuccuugaa

SEQ ID NO: 249070 - RNA, 19 nt, Homo sapiens
agacgaagcuuauuucuga

SEQ ID NO: 249071 - RNA, 19 nt, Homo sapiens
ccacugacuuugugacuua

SEQ ID NO: 249072 - RNA, 19 nt, Homo sapiens
gaacuuagagucauucuca

SEQ ID NO: 249073 - RNA, 19 nt, Homo sapiens
caacauagccccaaauaua

SEQ ID NO: 249074 - RNA, 19 nt, Homo sapiens
gcuacagccucgauuuaua

SEQ ID NO: 249075 - RNA, 19 nt, Homo sapiens
caaccaagaagaauguuua

SEQ ID NO: 249076 - RNA, 19 nt, Homo sapiens
gcacaggcuuuaucgagaa

SEQ ID NO: 249077 - RNA, 19 nt, Homo sapiens
caagugaccuguacugcuu

SEQ ID NO: 249078 - RNA, 19 nt, Homo sapiens
gcacagauacccagaacuu

SEQ ID NO: 249079 - RNA, 19 nt, Homo sapiens
ucagaggcaucacaaguaa

SEQ ID NO: 249080 - RNA, 19 nt, Homo sapiens
caaguaaugucacaauucu

SEQ ID NO: 249081 - RNA, 19 nt, Homo sapiens
gcugguguguggauaagua

SEQ ID NO: 249082 - RNA, 19 nt, Homo sapiens
gaaagggcaugcuaaagac

SEQ ID NO: 249083 - RNA, 19 nt, Homo sapiens
caagaagaauguuuauguc

SEQ ID NO: 249084 - RNA, 19 nt, Homo sapiens
ccaagaagaauguuuaugu

SEQ ID NO: 249085 - RNA, 19 nt, Homo sapiens
caagaaagggcaugcuaaa

SEQ ID NO: 249086 - RNA, 19 nt, Homo sapiens
acacauauaugcagagaag

SEQ ID NO: 249087 - RNA, 19 nt, Homo sapiens
caacucaagacgaagcuua

SEQ ID NO: 249088 - RNA, 19 nt, Homo sapiens
gagaugcuauuugauacaa

SEQ ID NO: 249089 - RNA, 19 nt, Homo sapiens
uguuagagaugcuauuuga

SEQ ID NO: 249090 - RNA, 19 nt, Homo sapiens
gaggauaagcucuuuaaag

SEQ ID NO: 249091 - RNA, 19 nt, Homo sapiens
ggaaugcucaccacauguu

SEQ ID NO: 249092 - RNA, 19 nt, Homo sapiens
gaaauggaagacacacuga

SEQ ID NO: 249093 - RNA, 19 nt, Homo sapiens
agaaagggcaugcuaaaga

SEQ ID NO: 249094 - RNA, 19 nt, Homo sapiens
gagauucacccauguuugu

SEQ ID NO: 249095 - RNA, 19 nt, Homo sapiens
aggauaagcucuuuaaagg

SEQ ID NO: 249096 - RNA, 19 nt, Homo sapiens
guggaguccuacuuguuua

SEQ ID NO: 249097 - RNA, 19 nt, Homo sapiens
guggaucccucaaccaaga

SEQ ID NO: 249098 - RNA, 19 nt, Homo sapiens
gguggaguccuacuuguuu

SEQ ID NO: 249099 - RNA, 19 nt, Homo sapiens
aaaauaagguggaguccua

SEQ ID NO: 249100 - RNA, 19 nt, Homo sapiens
cagccucgauuuauauuuc

SEQ ID NO: 249101 - RNA, 19 nt, Homo sapiens
gcuacaaaguugacuacga

SEQ ID NO: 249102 - RNA, 19 nt, Homo sapiens
gaauguuuaugucuucaag

SEQ ID NO: 249103 - RNA, 19 nt, Homo sapiens
gagcacagcacccagacuu

SEQ ID NO: 249104 - RNA, 19 nt, Homo sapiens
gagcacagauacccagaac

SEQ ID NO: 249105 - RNA, 19 nt, Homo sapiens
caacuguggccaugacuga

SEQ ID NO: 249106 - RNA, 19 nt, Homo sapiens
gauaauccuagaugaaaug

SEQ ID NO: 249107 - RNA, 19 nt, Homo sapiens
cacaaguaaugucacaauu

SEQ ID NO: 249108 - RNA, 19 nt, Homo sapiens
gagaauaggaaaaccuuua

SEQ ID NO: 249109 - RNA, 19 nt, Homo sapiens
ggagcucaaauaugccuua

SEQ ID NO: 249110 - RNA, 19 nt, Homo sapiens
caccugaaguuccucaaug

SEQ ID NO: 249111 - RNA, 19 nt, Homo sapiens
aaguuugucuugcaaugua

SEQ ID NO: 249112 - RNA, 19 nt, Homo sapiens
gagagucagccuccacauu

SEQ ID NO: 249113 - RNA, 19 nt, Homo sapiens
aaaugccuaugguuucuuu

SEQ ID NO: 249114 - RNA, 19 nt, Homo sapiens
ggacacacgcugcauagag

SEQ ID NO: 249115 - RNA, 19 nt, Homo sapiens
ucaagaaagggcaugcuaa

SEQ ID NO: 249116 - RNA, 19 nt, Homo sapiens
gcacagcacccagacuuca

SEQ ID NO: 249117 - RNA, 19 nt, Homo sapiens
caucacaaguaaugucaca

SEQ ID NO: 249118 - RNA, 19 nt, Homo sapiens
gggagcacauagagauuca

SEQ ID NO: 249119 - RNA, 19 nt, Homo sapiens
gcacucugggaaccuauaa

SEQ ID NO: 249120 - RNA, 19 nt, Homo sapiens
ccaagcgggagacagaaua

SEQ ID NO: 249121 - RNA, 19 nt, Homo sapiens
ugagaaguuugucuugcaa

SEQ ID NO: 249122 - RNA, 19 nt, Homo sapiens
acauucugccuaccuauua

SEQ ID NO: 249123 - RNA, 19 nt, Homo sapiens
ucacacauauaugcagaga

SEQ ID NO: 249124 - RNA, 19 nt, Homo sapiens
gaacaggaaggaggaaugg

SEQ ID NO: 249125 - RNA, 19 nt, Homo sapiens
aggcaaagcuuuauuuuca

SEQ ID NO: 249126 - RNA, 19 nt, Homo sapiens
aagcuuauuucugaggaua

SEQ ID NO: 249127 - RNA, 19 nt, Homo sapiens
cuacagccucgauuuauau

SEQ ID NO: 249128 - RNA, 19 nt, Homo sapiens
gagucagccuccacauuca

SEQ ID NO: 249129 - RNA, 19 nt, Homo sapiens
ugacuuaggcggcuguguu

SEQ ID NO: 249130 - RNA, 19 nt, Homo sapiens
gagcucaaauaugccuuau

SEQ ID NO: 249131 - RNA, 19 nt, Homo sapiens
uaauguggagcucaaauau

SEQ ID NO: 249132 - RNA, 19 nt, Homo sapiens
uuaauguggagcucaaaua

SEQ ID NO: 249133 - RNA, 19 nt, Homo sapiens
cugccuaccuauuagcuuu

SEQ ID NO: 249134 - RNA, 19 nt, Homo sapiens
cauauaugcagagaagaua

SEQ ID NO: 249135 - RNA, 19 nt, Homo sapiens
uaagguggaguccuacuug

SEQ ID NO: 249136 - RNA, 19 nt, Homo sapiens
agaaguuugucuugcaaug

SEQ ID NO: 249137 - RNA, 19 nt, Homo sapiens
agccagcgcuacaaaguug

SEQ ID NO: 249138 - RNA, 19 nt, Homo sapiens
cauagagauucacccaugu

SEQ ID NO: 249139 - RNA, 19 nt, Homo sapiens
gacaagaagggauuuuaua

SEQ ID NO: 249140 - RNA, 19 nt, Homo sapiens
uagagaugcuauuugauac

SEQ ID NO: 249141 - RNA, 19 nt, Homo sapiens
gaaauguuagagaugcuau

SEQ ID NO: 249142 - RNA, 19 nt, Homo sapiens
aguaauaucagaacaggaa

SEQ ID NO: 249143 - RNA, 19 nt, Homo sapiens
gaagcuuauuucugaggau

SEQ ID NO: 249144 - RNA, 19 nt, Homo sapiens
uucaacaacucaagacgaa

SEQ ID NO: 249145 - RNA, 19 nt, Homo sapiens
gaaguuugucuugcaaugu

SEQ ID NO: 249146 - RNA, 19 nt, Homo sapiens
cauguuuguugaacuuaga

SEQ ID NO: 249147 - RNA, 19 nt, Homo sapiens
ucaagacgaagcuuauuuc

SEQ ID NO: 249148 - RNA, 19 nt, Homo sapiens
gaaggcccaggauggcuuu

SEQ ID NO: 249149 - RNA, 19 nt, Homo sapiens
ccuaugguuucuuugaaug

SEQ ID NO: 249150 - RNA, 19 nt, Homo sapiens
gccuaugguuucuuugaau

SEQ ID NO: 249151 - RNA, 19 nt, Homo sapiens
gacauucugccuaccuauu

SEQ ID NO: 249152 - RNA, 19 nt, Homo sapiens
gaugcuauuugauacaacu

SEQ ID NO: 249153 - RNA, 19 nt, Homo sapiens
ucacaaguaaugucacaau

SEQ ID NO: 249154 - RNA, 19 nt, Homo sapiens
ucuguggugucauuucuga

SEQ ID NO: 249155 - RNA, 19 nt, Homo sapiens
gguaaacuugagcaucuuu

SEQ ID NO: 249156 - RNA, 19 nt, Homo sapiens
gcuacagcaugcagagcaa

SEQ ID NO: 249157 - RNA, 19 nt, Homo sapiens
agagucagccuccacauuc

SEQ ID NO: 249158 - RNA, 19 nt, Homo sapiens
cggcuguguugccuaugua

SEQ ID NO: 249159 - RNA, 19 nt, Homo sapiens
aggaggacgugcacugcua

SEQ ID NO: 249160 - RNA, 19 nt, Homo sapiens
ggccaugacugaggaaagg

SEQ ID NO: 249161 - RNA, 19 nt, Homo sapiens
gcaaagcuuuauuuucauc

SEQ ID NO: 249162 - RNA, 19 nt, Homo sapiens
gccgccagcuccaggaaau

SEQ ID NO: 249163 - RNA, 19 nt, Homo sapiens
acaaguaaugucacaauuc

SEQ ID NO: 249164 - RNA, 19 nt, Homo sapiens
ccuauaaaggcagguauuu

SEQ ID NO: 249165 - RNA, 19 nt, Homo sapiens
ggaguccuacuuguuuaaa

SEQ ID NO: 249166 - RNA, 19 nt, Homo sapiens
gcggcuguguugccuaugu

SEQ ID NO: 249167 - RNA, 19 nt, Homo sapiens
gccgaccacugacuuugug

SEQ ID NO: 249168 - RNA, 19 nt, Homo sapiens
uaagcucuuuaaaggcaaa

SEQ ID NO: 249169 - RNA, 19 nt, Homo sapiens
ggacugagacuggcacuua

SEQ ID NO: 249170 - RNA, 19 nt, Homo sapiens
gguguucucuuugguguua

SEQ ID NO: 249171 - RNA, 19 nt, Homo sapiens
gaaugugccuaauggagaa

SEQ ID NO: 249172 - RNA, 19 nt, Homo sapiens
gaagaaagaaugcaagagu

SEQ ID NO: 249173 - RNA, 19 nt, Homo sapiens
gcauggagcuggcggagau

SEQ ID NO: 249174 - RNA, 19 nt, Homo sapiens
ggagaagacccacgugcua

SEQ ID NO: 249175 - RNA, 19 nt, Homo sapiens
ugacagcuuucgagaguga

SEQ ID NO: 249176 - RNA, 19 nt, Homo sapiens
guucaagccugugggagua

SEQ ID NO: 249177 - RNA, 19 nt, Homo sapiens
ucugagcccugguguguuu

SEQ ID NO: 249178 - RNA, 19 nt, Homo sapiens
ggacugaaugugccuaaug

SEQ ID NO: 249179 - RNA, 19 nt, Homo sapiens
gaucgaggccauccaggaa

SEQ ID NO: 249180 - RNA, 19 nt, Homo sapiens
ccagaaguuucccucaaau

SEQ ID NO: 249181 - RNA, 19 nt, Homo sapiens
gauggaaggagacuuagga

SEQ ID NO: 249182 - RNA, 19 nt, Homo sapiens
cccagaaguuucccucaaa

SEQ ID NO: 249183 - RNA, 19 nt, Homo sapiens
gcccagaaguuucccucaa

SEQ ID NO: 249184 - RNA, 19 nt, Homo sapiens
gaaggagacuuaggaaccu

SEQ ID NO: 249185 - RNA, 19 nt, Homo sapiens
caaaggaagacuugaagca

SEQ ID NO: 249186 - RNA, 19 nt, Homo sapiens
gacugaaugugccuaaugg

SEQ ID NO: 249187 - RNA, 19 nt, Homo sapiens
gaguggagucugagucuga

SEQ ID NO: 249188 - RNA, 19 nt, Homo sapiens
cggcacgccugcuaacuuc

SEQ ID NO: 249189 - RNA, 19 nt, Homo sapiens
gggaagaaagaaugcaaga

SEQ ID NO: 249190 - RNA, 19 nt, Homo sapiens
ggucugagcccuggugugu

SEQ ID NO: 249191 - RNA, 19 nt, Homo sapiens
gcaagaguggacugaaugu

SEQ ID NO: 249192 - RNA, 19 nt, Homo sapiens
gcaagaugaaggucaaugg

SEQ ID NO: 249193 - RNA, 19 nt, Homo sapiens
ggucacagccaugaaguca

SEQ ID NO: 249194 - RNA, 19 nt, Homo sapiens
cuggauggaaggagacuua

SEQ ID NO: 249195 - RNA, 19 nt, Homo sapiens
gcagucagggugggaagaa

SEQ ID NO: 249196 - RNA, 19 nt, Homo sapiens
ucacucauccagccaccua

SEQ ID NO: 249197 - RNA, 19 nt, Homo sapiens
ucaccgggaugaaccuauc

SEQ ID NO: 249198 - RNA, 19 nt, Homo sapiens
cuacgugccagcucuaguu

SEQ ID NO: 249199 - RNA, 19 nt, Homo sapiens
gacugagacuggcacuuag

SEQ ID NO: 249200 - RNA, 19 nt, Homo sapiens
ccagagggugggagccuaa

SEQ ID NO: 249201 - RNA, 19 nt, Homo sapiens
cguccuuccucucaagcua

SEQ ID NO: 249202 - RNA, 19 nt, Homo sapiens
acucauuccuucacucauc

SEQ ID NO: 249203 - RNA, 19 nt, Homo sapiens
gaaugcaagaguggacuga

SEQ ID NO: 249204 - RNA, 19 nt, Homo sapiens
guccagacccacucccaaa

SEQ ID NO: 249205 - RNA, 19 nt, Homo sapiens
auucugacuuccucugauu

SEQ ID NO: 249206 - RNA, 19 nt, Homo sapiens
guacuacgugccagcucua

SEQ ID NO: 249207 - RNA, 19 nt, Homo sapiens
ccagguccuuccuuuaggu

SEQ ID NO: 249208 - RNA, 19 nt, Homo sapiens
gagggugggagccuaagga

SEQ ID NO: 249209 - RNA, 19 nt, Homo sapiens
gugcguguguguguguuug

SEQ ID NO: 249210 - RNA, 19 nt, Homo sapiens
acauuucucugagcaguca

SEQ ID NO: 249211 - RNA, 19 nt, Homo sapiens
caucguccuuccucucaag

SEQ ID NO: 249212 - RNA, 19 nt, Homo sapiens
aguuggccaugaugucuuu

SEQ ID NO: 249213 - RNA, 19 nt, Homo sapiens
ucacucauuccuucacuca

SEQ ID NO: 249214 - RNA, 19 nt, Homo sapiens
cagaaguuucccucaaaug

SEQ ID NO: 249215 - RNA, 19 nt, Homo sapiens
ggcaaggcgugugcaugga

SEQ ID NO: 249216 - RNA, 19 nt, Homo sapiens
ggaagaaagaaugcaagag

SEQ ID NO: 249217 - RNA, 19 nt, Homo sapiens
augcaagaguggacugaau

SEQ ID NO: 249218 - RNA, 19 nt, Homo sapiens
caugaagucaccgggauga

SEQ ID NO: 249219 - RNA, 19 nt, Homo sapiens
gcguagaaccugcgaauuu

SEQ ID NO: 249220 - RNA, 19 nt, Homo sapiens
gcaaaggauucuacaagag

SEQ ID NO: 249221 - RNA, 19 nt, Homo sapiens
ggacgccacucauuucauc

SEQ ID NO: 249222 - RNA, 19 nt, Homo sapiens
cauccgaucucauuauuuc

SEQ ID NO: 249223 - RNA, 19 nt, Homo sapiens
caacgccucuuaccuguuc

SEQ ID NO: 249224 - RNA, 19 nt, Homo sapiens
gcagcaacguugagugaug

SEQ ID NO: 249225 - RNA, 19 nt, Homo sapiens
ccacucauuucaucucauu

SEQ ID NO: 249226 - RNA, 19 nt, Homo sapiens
gcugcgagcuggucaagga

SEQ ID NO: 249227 - RNA, 19 nt, Homo sapiens
gcuggugcguggacaagua

SEQ ID NO: 249228 - RNA, 19 nt, Homo sapiens
gaaaagagcuaggaaagag

SEQ ID NO: 249229 - RNA, 19 nt, Homo sapiens
gaagaaggaccgcagaaag

SEQ ID NO: 249230 - RNA, 19 nt, Homo sapiens
caaaggauucuacaagaga

SEQ ID NO: 249231 - RNA, 19 nt, Homo sapiens
agaaagcccucuccaugug

SEQ ID NO: 249232 - RNA, 19 nt, Homo sapiens
cgcaaaggauucuacaaga

SEQ ID NO: 249233 - RNA, 19 nt, Homo sapiens
uugcaaggcuuuaauucuu

SEQ ID NO: 249234 - RNA, 19 nt, Homo sapiens
aagaggagguggcaaagug

SEQ ID NO: 249235 - RNA, 19 nt, Homo sapiens
agaaagcagugcaaaccuu

SEQ ID NO: 249236 - RNA, 19 nt, Homo sapiens
gaaagcgggguguauuuua

SEQ ID NO: 249237 - RNA, 19 nt, Homo sapiens
cguagaaccugcgaauuuc

SEQ ID NO: 249238 - RNA, 19 nt, Homo sapiens
ccaccucucucuacauuuu

SEQ ID NO: 249239 - RNA, 19 nt, Homo sapiens
cagcagcaacguugaguga

SEQ ID NO: 249240 - RNA, 19 nt, Homo sapiens
cuguguaccugcccaauug

SEQ ID NO: 249241 - RNA, 19 nt, Homo sapiens
aagaaggaccgcagaaaga

SEQ ID NO: 249242 - RNA, 19 nt, Homo sapiens
aaagagguguuaggguuug

SEQ ID NO: 249243 - RNA, 19 nt, Homo sapiens
cauuucaucucauuuaagg

SEQ ID NO: 249244 - RNA, 19 nt, Homo sapiens
caagagaaagcagugcaaa

SEQ ID NO: 249245 - RNA, 19 nt, Homo sapiens
gcccaauugugaccgcaaa

SEQ ID NO: 249246 - RNA, 19 nt, Homo sapiens
gcgagcaagucaagaucga

SEQ ID NO: 249247 - RNA, 19 nt, Homo sapiens
cugaagcagugaagaagga

SEQ ID NO: 249248 - RNA, 19 nt, Homo sapiens
gcaagucaagaucgagaga

SEQ ID NO: 249249 - RNA, 19 nt, Homo sapiens
ggacaaguacgggaugaag

SEQ ID NO: 249250 - RNA, 19 nt, Homo sapiens
ugaagaaggaccgcagaaa

SEQ ID NO: 249251 - RNA, 19 nt, Homo sapiens
ccaggacgccacucauuuc

SEQ ID NO: 249252 - RNA, 19 nt, Homo sapiens
cuccaccucucucuacauu

SEQ ID NO: 249253 - RNA, 19 nt, Homo sapiens
gaagaggagguggcaaagu

SEQ ID NO: 249254 - RNA, 19 nt, Homo sapiens
ugcauccgaucucauuauu

SEQ ID NO: 249255 - RNA, 19 nt, Homo sapiens
agaaggaccgcagaaagaa

SEQ ID NO: 249256 - RNA, 19 nt, Homo sapiens
gcauccgaucucauuauuu

SEQ ID NO: 249257 - RNA, 19 nt, Homo sapiens
gaaggaccgcagaaagaag

SEQ ID NO: 249258 - RNA, 19 nt, Homo sapiens
aagagaagaugguguugcu

SEQ ID NO: 249259 - RNA, 19 nt, Homo sapiens
gcucuaccugccagaaauu

SEQ ID NO: 249260 - RNA, 19 nt, Homo sapiens
gagggcaccugcucuaccu

SEQ ID NO: 249261 - RNA, 19 nt, Homo sapiens
ucgaagaggagguggcaaa

SEQ ID NO: 249262 - RNA, 19 nt, Homo sapiens
gcuguguaccugcccaauu

SEQ ID NO: 249263 - RNA, 19 nt, Homo sapiens
aagucaagaucgagagaga

SEQ ID NO: 249264 - RNA, 19 nt, Homo sapiens
gcuaggaaagagcugcaaa

SEQ ID NO: 249265 - RNA, 19 nt, Homo sapiens
ccgcaaaggauucuacaag

SEQ ID NO: 249266 - RNA, 19 nt, Homo sapiens
cccaggacgccacucauuu

SEQ ID NO: 249267 - RNA, 19 nt, Homo sapiens
gcugacccaguccaaguuu

SEQ ID NO: 249268 - RNA, 19 nt, Homo sapiens
ggaaaagagcuaggaaaga

SEQ ID NO: 249269 - RNA, 19 nt, Homo sapiens
gagcccaccaccucugaga

SEQ ID NO: 249270 - RNA, 19 nt, Homo sapiens
caauugugaccgcaaagga

SEQ ID NO: 249271 - RNA, 19 nt, Homo sapiens
cugcagccaacgccucuua

SEQ ID NO: 249272 - RNA, 19 nt, Homo sapiens
gcccaccaccucugagaug

SEQ ID NO: 249273 - RNA, 19 nt, Homo sapiens
guggacaaguacgggauga

SEQ ID NO: 249274 - RNA, 19 nt, Homo sapiens
aaagagcuaccgcgagcaa

SEQ ID NO: 249275 - RNA, 19 nt, Homo sapiens
ggguuugccucaacgaaaa

SEQ ID NO: 249276 - RNA, 19 nt, Homo sapiens
acuaagagaagaugguguu

SEQ ID NO: 249277 - RNA, 19 nt, Homo sapiens
ucaucucauuuaagggaaa

SEQ ID NO: 249278 - RNA, 19 nt, Homo sapiens
gugaagaaggaccgcagaa

SEQ ID NO: 249279 - RNA, 19 nt, Homo sapiens
gcacaaacccugaccauga

SEQ ID NO: 249280 - RNA, 19 nt, Homo sapiens
guagacaucuggacucagu

SEQ ID NO: 249281 - RNA, 19 nt, Homo sapiens
gaacauggagcugucauca

SEQ ID NO: 249282 - RNA, 19 nt, Homo sapiens
gcagagaccaacagaggaa

SEQ ID NO: 249283 - RNA, 19 nt, Homo sapiens
ccucaccgcugguuggaaa

SEQ ID NO: 249284 - RNA, 19 nt, Homo sapiens
gagcugucaucacucaaca

SEQ ID NO: 249285 - RNA, 19 nt, Homo sapiens
gcugucaucacucaacaaa

SEQ ID NO: 249286 - RNA, 19 nt, Homo sapiens
ugcagcaacuccagacuga

SEQ ID NO: 249287 - RNA, 19 nt, Homo sapiens
acauggagcugucaucacu

SEQ ID NO: 249288 - RNA, 19 nt, Homo sapiens
cacaaacccugaccaugac

SEQ ID NO: 249289 - RNA, 19 nt, Homo sapiens
cacucuacgugcccaauug

SEQ ID NO: 249290 - RNA, 19 nt, Homo sapiens
gcccaauugugaccaucga

SEQ ID NO: 249291 - RNA, 19 nt, Homo sapiens
ggaacauggagcugucauc

SEQ ID NO: 249292 - RNA, 19 nt, Homo sapiens
ccguagacaucuggacuca

SEQ ID NO: 249293 - RNA, 19 nt, Homo sapiens
gaucacacaucaagacuau

SEQ ID NO: 249294 - RNA, 19 nt, Homo sapiens
gcuauaaaccuccagaaua

SEQ ID NO: 249295 - RNA, 19 nt, Homo sapiens
cuauaaaccuccagaauau

SEQ ID NO: 249296 - RNA, 19 nt, Homo sapiens
caucaagacuaucuacaaa

SEQ ID NO: 249297 - RNA, 19 nt, Homo sapiens
ccaauccacuaacacuuua

SEQ ID NO: 249298 - RNA, 19 nt, Homo sapiens
guugaugccuuacaugaaa

SEQ ID NO: 249299 - RNA, 19 nt, Homo sapiens
guucuugccuaauaaguuu

SEQ ID NO: 249300 - RNA, 19 nt, Homo sapiens
gcugguaucuccucuaagu

SEQ ID NO: 249301 - RNA, 19 nt, Homo sapiens
gcaugcauaucauuaaaca

SEQ ID NO: 249302 - RNA, 19 nt, Homo sapiens
uuauuagucugcaugguua

SEQ ID NO: 249303 - RNA, 19 nt, Homo sapiens
uaccuguucuugccuaaua

SEQ ID NO: 249304 - RNA, 19 nt, Homo sapiens
gugcugguaucuccucuaa

SEQ ID NO: 249305 - RNA, 19 nt, Homo sapiens
gggacaaccuggccauuca

SEQ ID NO: 249306 - RNA, 19 nt, Homo sapiens
gaauaugagugccaugcau

SEQ ID NO: 249307 - RNA, 19 nt, Homo sapiens
gaaggugccgagcuauaaa

SEQ ID NO: 249308 - RNA, 19 nt, Homo sapiens
gcugugaggucaucggaau

SEQ ID NO: 249309 - RNA, 19 nt, Homo sapiens
uacagugguugaugccuua

SEQ ID NO: 249310 - RNA, 19 nt, Homo sapiens
agucauggauaacuacauu

SEQ ID NO: 249311 - RNA, 19 nt, Homo sapiens
ugaaggugccgagcuauaa

SEQ ID NO: 249312 - RNA, 19 nt, Homo sapiens
auaacuacauuaccuguuc

SEQ ID NO: 249313 - RNA, 19 nt, Homo sapiens
gugaaggugccgagcuaua

SEQ ID NO: 249314 - RNA, 19 nt, Homo sapiens
gaaaagcaugcauaucauu

SEQ ID NO: 249315 - RNA, 19 nt, Homo sapiens
uuaauccaauccacuaaca

SEQ ID NO: 249316 - RNA, 19 nt, Homo sapiens
uuacaugaaauaccaguga

SEQ ID NO: 249317 - RNA, 19 nt, Homo sapiens
caagggcaccugcgagcaa

SEQ ID NO: 249318 - RNA, 19 nt, Homo sapiens
ugguaucuccucuaaguaa

SEQ ID NO: 249319 - RNA, 19 nt, Homo sapiens
caccuguccucaucuggaa

SEQ ID NO: 249320 - RNA, 19 nt, Homo sapiens
auaaagaucacacaucaag

SEQ ID NO: 249321 - RNA, 19 nt, Homo sapiens
gauaacuacauuaccuguu

SEQ ID NO: 249322 - RNA, 19 nt, Homo sapiens
uacaugaaauaccagugaa

SEQ ID NO: 249323 - RNA, 19 nt, Homo sapiens
aggacaggcuucagcauca

SEQ ID NO: 249324 - RNA, 19 nt, Homo sapiens
ugagugccaugcauccaau

SEQ ID NO: 249325 - RNA, 19 nt, Homo sapiens
ucacacaucaagacuaucu

SEQ ID NO: 249326 - RNA, 19 nt, Homo sapiens
uccaauccacuaacacuuu

SEQ ID NO: 249327 - RNA, 19 nt, Homo sapiens
uaacuacauuaccuguucu

SEQ ID NO: 249328 - RNA, 19 nt, Homo sapiens
gguaucuccucuaaguaag

SEQ ID NO: 249329 - RNA, 19 nt, Homo sapiens
aagaaaagcaugcauauca

SEQ ID NO: 249330 - RNA, 19 nt, Homo sapiens
gguugaugccuuacaugaa

SEQ ID NO: 249331 - RNA, 19 nt, Homo sapiens
uaaagaucacacaucaaga

SEQ ID NO: 249332 - RNA, 19 nt, Homo sapiens
ggacaggcuucagcaucag

SEQ ID NO: 249333 - RNA, 19 nt, Homo sapiens
gagcuauaaaccuccagaa

SEQ ID NO: 249334 - RNA, 19 nt, Homo sapiens
ggcauggagugcgugaaga

SEQ ID NO: 249335 - RNA, 19 nt, Homo sapiens
acaucaagacuaucuacaa

SEQ ID NO: 249336 - RNA, 19 nt, Homo sapiens
aggugaaggugccgagcua

SEQ ID NO: 249337 - RNA, 19 nt, Homo sapiens
gggcauggagugcgugaag

SEQ ID NO: 249338 - RNA, 19 nt, Homo sapiens
cagaagaaaagcaugcaua

SEQ ID NO: 249339 - RNA, 19 nt, Homo sapiens
aaagaucacacaucaagac

SEQ ID NO: 249340 - RNA, 19 nt, Homo sapiens
ugccuuacaugaaauacca

SEQ ID NO: 249341 - RNA, 19 nt, Homo sapiens
gcauggagugcgugaagag

SEQ ID NO: 249342 - RNA, 19 nt, Homo sapiens
ccucaucuggaacaaggua

SEQ ID NO: 249343 - RNA, 19 nt, Homo sapiens
gacaaccuggccauucaga

SEQ ID NO: 249344 - RNA, 19 nt, Homo sapiens
gagaauacuuugcuucaua

SEQ ID NO: 249345 - RNA, 19 nt, Homo sapiens
gaauauaacuccagaaucu

SEQ ID NO: 249346 - RNA, 19 nt, Homo sapiens
gaaaucagguguuuuaaga

SEQ ID NO: 249347 - RNA, 19 nt, Homo sapiens
gcauuaagguauuucgaaa

SEQ ID NO: 249348 - RNA, 19 nt, Homo sapiens
gggcagacccugugaauau

SEQ ID NO: 249349 - RNA, 19 nt, Homo sapiens
ccacacgaguuaccaauga

SEQ ID NO: 249350 - RNA, 19 nt, Homo sapiens
gaaagaaacccggauuugu

SEQ ID NO: 249351 - RNA, 19 nt, Homo sapiens
aagauuaguuggacaguuu

SEQ ID NO: 249352 - RNA, 19 nt, Homo sapiens
ggagaagagugucagaauc

SEQ ID NO: 249353 - RNA, 19 nt, Homo sapiens
ggccagaaauguauuguuc

SEQ ID NO: 249354 - RNA, 19 nt, Homo sapiens
ggcaagaaaugcagcaaga

SEQ ID NO: 249355 - RNA, 19 nt, Homo sapiens
gagaagagugucagaauca

SEQ ID NO: 249356 - RNA, 19 nt, Homo sapiens
gaaucagaaucauggagaa

SEQ ID NO: 249357 - RNA, 19 nt, Homo sapiens
ccagaaauguauuguucaa

SEQ ID NO: 249358 - RNA, 19 nt, Homo sapiens
gggcacaccuagacaaaca

SEQ ID NO: 249359 - RNA, 19 nt, Homo sapiens
ucaaagaccuguggaacug

SEQ ID NO: 249360 - RNA, 19 nt, Homo sapiens
guuugagugugaagaaaua

SEQ ID NO: 249361 - RNA, 19 nt, Homo sapiens
ggcagacccugugaauaua

SEQ ID NO: 249362 - RNA, 19 nt, Homo sapiens
acucuaaacugcaaacaga

SEQ ID NO: 249363 - RNA, 19 nt, Homo sapiens
gaggagcauuaagguauuu

SEQ ID NO: 249364 - RNA, 19 nt, Homo sapiens
gaccaggacugugaagaug

SEQ ID NO: 249365 - RNA, 19 nt, Homo sapiens
caacgaggacugcagcaaa

SEQ ID NO: 249366 - RNA, 19 nt, Homo sapiens
gcagcaagaccaagaaauc

SEQ ID NO: 249367 - RNA, 19 nt, Homo sapiens
gagguggaguugacgagaa

SEQ ID NO: 249368 - RNA, 19 nt, Homo sapiens
ggaaauguaauacuggaau

SEQ ID NO: 249369 - RNA, 19 nt, Homo sapiens
caucagugcacauguauug

SEQ ID NO: 249370 - RNA, 19 nt, Homo sapiens
aaagaaacccggauuugug

SEQ ID NO: 249371 - RNA, 19 nt, Homo sapiens
cagccacgauuggagaaua

SEQ ID NO: 249372 - RNA, 19 nt, Homo sapiens
gcagacccugugaauauaa

SEQ ID NO: 249373 - RNA, 19 nt, Homo sapiens
gcaaaugcaacuacaacug

SEQ ID NO: 249374 - RNA, 19 nt, Homo sapiens
acauguuacugcuucauuu

SEQ ID NO: 249375 - RNA, 19 nt, Homo sapiens
ugaggagcauuaagguauu

SEQ ID NO: 249376 - RNA, 19 nt, Homo sapiens
ggaaaaggcagcucacuga

SEQ ID NO: 249377 - RNA, 19 nt, Homo sapiens
ggagaauacuuugcuucau

SEQ ID NO: 249378 - RNA, 19 nt, Homo sapiens
ggugaugggacucauugua

SEQ ID NO: 249379 - RNA, 19 nt, Homo sapiens
aagcagcguuucccuucua

SEQ ID NO: 249380 - RNA, 19 nt, Homo sapiens
ugaaagaaacccggauuug

SEQ ID NO: 249381 - RNA, 19 nt, Homo sapiens
gaagagugucagaaucaga

SEQ ID NO: 249382 - RNA, 19 nt, Homo sapiens
gggagaagagugucagaau

SEQ ID NO: 249383 - RNA, 19 nt, Homo sapiens
cagcugaccaggacuguga

SEQ ID NO: 249384 - RNA, 19 nt, Homo sapiens
gcuggauguuugaguguga

SEQ ID NO: 249385 - RNA, 19 nt, Homo sapiens
uaagauuaguuggacaguu

SEQ ID NO: 249386 - RNA, 19 nt, Homo sapiens
agaauacuuugcuucauag

SEQ ID NO: 249387 - RNA, 19 nt, Homo sapiens
aaacaagggagaagagugu

SEQ ID NO: 249388 - RNA, 19 nt, Homo sapiens
ugaauugauugcaguugga

SEQ ID NO: 249389 - RNA, 19 nt, Homo sapiens
guaaacaucagugcacaug

SEQ ID NO: 249390 - RNA, 19 nt, Homo sapiens
cagcccaacuguaaacauc

SEQ ID NO: 249391 - RNA, 19 nt, Homo sapiens
ugaugggacucauuguaga

SEQ ID NO: 249392 - RNA, 19 nt, Homo sapiens
acagaaaucagguguuuua

SEQ ID NO: 249393 - RNA, 19 nt, Homo sapiens
guugaugacuuucuguuuu

SEQ ID NO: 249394 - RNA, 19 nt, Homo sapiens
gugaaagaaacccggauuu

SEQ ID NO: 249395 - RNA, 19 nt, Homo sapiens
gguaucuccacacgaguua

SEQ ID NO: 249396 - RNA, 19 nt, Homo sapiens
gugaauauaacuccagaau

SEQ ID NO: 249397 - RNA, 19 nt, Homo sapiens
aguauuggagcacauguua

SEQ ID NO: 249398 - RNA, 19 nt, Homo sapiens
ggagggaggggaaauguaa

SEQ ID NO: 249399 - RNA, 19 nt, Homo sapiens
uuggacaguuuaaagcuuu

SEQ ID NO: 249400 - RNA, 19 nt, Homo sapiens
gaagauggggagacauuuu

SEQ ID NO: 249401 - RNA, 19 nt, Homo sapiens
gauguuugagugugaagaa

SEQ ID NO: 249402 - RNA, 19 nt, Homo sapiens
aagaaacccggauuuguga

SEQ ID NO: 249403 - RNA, 19 nt, Homo sapiens
ugacgagaaacaaugaauu

SEQ ID NO: 249404 - RNA, 19 nt, Homo sapiens
ggaguugacgagaaacaau

SEQ ID NO: 249405 - RNA, 19 nt, Homo sapiens
aagccuugcucauucuuga

SEQ ID NO: 249406 - RNA, 19 nt, Homo sapiens
gaugggacucauuguagaa

SEQ ID NO: 249407 - RNA, 19 nt, Homo sapiens
gaugauccaguccugcaaa

SEQ ID NO: 249408 - RNA, 19 nt, Homo sapiens
gcgaggagugggucuguga

SEQ ID NO: 249409 - RNA, 19 nt, Homo sapiens
gggcugcauuccucugugu

SEQ ID NO: 249410 - RNA, 19 nt, Homo sapiens
ccaaggggcuggaaugcaa

SEQ ID NO: 249411 - RNA, 19 nt, Homo sapiens
ggggagacauuuuccaaga

SEQ ID NO: 249412 - RNA, 19 nt, Homo sapiens
uacuuacgcuggauguuug

SEQ ID NO: 249413 - RNA, 19 nt, Homo sapiens
uuacuuacgcuggauguuu

SEQ ID NO: 249414 - RNA, 19 nt, Homo sapiens
guuggacaguuuaaagcuu

SEQ ID NO: 249415 - RNA, 19 nt, Homo sapiens
gagcuuguggaguugauga

SEQ ID NO: 249416 - RNA, 19 nt, Homo sapiens
caacugcccgcaugccaau

SEQ ID NO: 249417 - RNA, 19 nt, Homo sapiens
ccucggcuggucaaaguua

SEQ ID NO: 249418 - RNA, 19 nt, Homo sapiens
cauauuuucucuaggcuuu

SEQ ID NO: 249419 - RNA, 19 nt, Homo sapiens
uuguggaguugaugacuuu

SEQ ID NO: 249420 - RNA, 19 nt, Homo sapiens
cagugcacauguauugaug

SEQ ID NO: 249421 - RNA, 19 nt, Homo sapiens
ccagucagguuuacuuacg

SEQ ID NO: 249422 - RNA, 19 nt, Homo sapiens
gcgccaagcagcucaacga

SEQ ID NO: 249423 - RNA, 19 nt, Homo sapiens
gauccaguccugcaaaugc

SEQ ID NO: 249424 - RNA, 19 nt, Homo sapiens
gaggggaaauguaauacug

SEQ ID NO: 249425 - RNA, 19 nt, Homo sapiens
guuuccagcccaacuguaa

SEQ ID NO: 249426 - RNA, 19 nt, Homo sapiens
gaucugcagagcucaguca

SEQ ID NO: 249427 - RNA, 19 nt, Homo sapiens
gugaugggacucauuguag

SEQ ID NO: 249428 - RNA, 19 nt, Homo sapiens
cgucacccuucuccacuug

SEQ ID NO: 249429 - RNA, 19 nt, Homo sapiens
gaauugauugcaguuggaa

SEQ ID NO: 249430 - RNA, 19 nt, Homo sapiens
gaguugacgagaaacaaug

SEQ ID NO: 249431 - RNA, 19 nt, Homo sapiens
gaagccuugcucauucuug

SEQ ID NO: 249432 - RNA, 19 nt, Homo sapiens
ucuaaacugcaaacagaaa

SEQ ID NO: 249433 - RNA, 19 nt, Homo sapiens
cuaaaugcuaccuggguuu

SEQ ID NO: 249434 - RNA, 19 nt, Homo sapiens
ugagugccgccuugugaaa

SEQ ID NO: 249435 - RNA, 19 nt, Homo sapiens
ccugagugccgccuuguga

SEQ ID NO: 249436 - RNA, 19 nt, Homo sapiens
guucuacagucguaaaaga

SEQ ID NO: 249437 - RNA, 19 nt, Homo sapiens
gacuuucuguuuucuguuu

SEQ ID NO: 249438 - RNA, 19 nt, Homo sapiens
uugaggagcauuaagguau

SEQ ID NO: 249439 - RNA, 19 nt, Homo sapiens
ggacucauuguagaaagga

SEQ ID NO: 249440 - RNA, 19 nt, Homo sapiens
ugaccaggacugugaagau

SEQ ID NO: 249441 - RNA, 19 nt, Homo sapiens
gauuaguuggacaguuuaa

SEQ ID NO: 249442 - RNA, 19 nt, Homo sapiens
gaguugaugacuuucuguu

SEQ ID NO: 249443 - RNA, 19 nt, Homo sapiens
cacgauuggagaauacuuu

SEQ ID NO: 249444 - RNA, 19 nt, Homo sapiens
gcaagaagaugcaguugga

SEQ ID NO: 249445 - RNA, 19 nt, Homo sapiens
ggaagucucuggccucuga

SEQ ID NO: 249446 - RNA, 19 nt, Homo sapiens
gaaagaacuugccaucauc

SEQ ID NO: 249447 - RNA, 19 nt, Homo sapiens
gaaacaaggcuuaaagguu

SEQ ID NO: 249448 - RNA, 19 nt, Homo sapiens
ugaagacccugguggagua

SEQ ID NO: 249449 - RNA, 19 nt, Homo sapiens
gaaacaagacugcgaaugg

SEQ ID NO: 249450 - RNA, 19 nt, Homo sapiens
cggcagcucuucccaguaa

SEQ ID NO: 249451 - RNA, 19 nt, Homo sapiens
guaccaacucuucuauuua

SEQ ID NO: 249452 - RNA, 19 nt, Homo sapiens
gauaacaccugcggcuuug

SEQ ID NO: 249453 - RNA, 19 nt, Homo sapiens
agaggaggcuggauaagaa

SEQ ID NO: 249454 - RNA, 19 nt, Homo sapiens
uguaccaacucuucuauuu

SEQ ID NO: 249455 - RNA, 19 nt, Homo sapiens
ugaagucacuccuccaaug

SEQ ID NO: 249456 - RNA, 19 nt, Homo sapiens
agaaagaacuugccaucau

SEQ ID NO: 249457 - RNA, 19 nt, Homo sapiens
gaagugcucuuuggcagau

SEQ ID NO: 249458 - RNA, 19 nt, Homo sapiens
ugauugcucuaaagaagua

SEQ ID NO: 249459 - RNA, 19 nt, Homo sapiens
gagaaccucagaugaugua

SEQ ID NO: 249460 - RNA, 19 nt, Homo sapiens
cagcagaaacuuccagaaa

SEQ ID NO: 249461 - RNA, 19 nt, Homo sapiens
uaagagaaccucagaugau

SEQ ID NO: 249462 - RNA, 19 nt, Homo sapiens
gaagaugcaguuggaguuu

SEQ ID NO: 249463 - RNA, 19 nt, Homo sapiens
gaaauacacccgcugacau

SEQ ID NO: 249464 - RNA, 19 nt, Homo sapiens
gcacggccuuugaguaucu

SEQ ID NO: 249465 - RNA, 19 nt, Homo sapiens
caacaggaaaggugaaguu

SEQ ID NO: 249466 - RNA, 19 nt, Homo sapiens
caacaucgccguggacaau

SEQ ID NO: 249467 - RNA, 19 nt, Homo sapiens
ccaaugaugucacuuacag

SEQ ID NO: 249468 - RNA, 19 nt, Homo sapiens
gcaccucucucuggcuuau

SEQ ID NO: 249469 - RNA, 19 nt, Homo sapiens
ggaaaggugaaguugguuu

SEQ ID NO: 249470 - RNA, 19 nt, Homo sapiens
gagcgacagugcccagaau

SEQ ID NO: 249471 - RNA, 19 nt, Homo sapiens
ggacaccucccagaaagaa

SEQ ID NO: 249472 - RNA, 19 nt, Homo sapiens
guacgaugcugcuaaugag

SEQ ID NO: 249473 - RNA, 19 nt, Homo sapiens
gcuggugacugcaguguuc

SEQ ID NO: 249474 - RNA, 19 nt, Homo sapiens
cauuugcgcugucucagaa

SEQ ID NO: 249475 - RNA, 19 nt, Homo sapiens
gaggaaacaggaaacaaga

SEQ ID NO: 249476 - RNA, 19 nt, Homo sapiens
ccacggaggaggacuuuga

SEQ ID NO: 249477 - RNA, 19 nt, Homo sapiens
gggaagaggagguucauca

SEQ ID NO: 249478 - RNA, 19 nt, Homo sapiens
caggaaaggugaaguuggu

SEQ ID NO: 249479 - RNA, 19 nt, Homo sapiens
gcucagcccguuaggauga

SEQ ID NO: 249480 - RNA, 19 nt, Homo sapiens
gauaagagagagaaaagua

SEQ ID NO: 249481 - RNA, 19 nt, Homo sapiens
gaagucacuccuccaaugu

SEQ ID NO: 249482 - RNA, 19 nt, Homo sapiens
gaaggaggccgugauacug

SEQ ID NO: 249483 - RNA, 19 nt, Homo sapiens
gauacuguccuucgucaga

SEQ ID NO: 249484 - RNA, 19 nt, Homo sapiens
cccagaauguugcagauau

SEQ ID NO: 249485 - RNA, 19 nt, Homo sapiens
gagcuuggaccgagagaau

SEQ ID NO: 249486 - RNA, 19 nt, Homo sapiens
aagagaaccucagaugaug

SEQ ID NO: 249487 - RNA, 19 nt, Homo sapiens
gaaguacgcacggccuuug

SEQ ID NO: 249488 - RNA, 19 nt, Homo sapiens
gaagggaagaggagguuca

SEQ ID NO: 249489 - RNA, 19 nt, Homo sapiens
gaaguccgccucgucaguu

SEQ ID NO: 249490 - RNA, 19 nt, Homo sapiens
aaauacacccgcugacauu

SEQ ID NO: 249491 - RNA, 19 nt, Homo sapiens
ucauagaagugcucuuugg

SEQ ID NO: 249492 - RNA, 19 nt, Homo sapiens
gcagaaacuuccagaaaag

SEQ ID NO: 249493 - RNA, 19 nt, Homo sapiens
gcuguggucucgccauaca

SEQ ID NO: 249494 - RNA, 19 nt, Homo sapiens
ccgcugacauucuucaaca

SEQ ID NO: 249495 - RNA, 19 nt, Homo sapiens
gcucuaaagaaguaucauu

SEQ ID NO: 249496 - RNA, 19 nt, Homo sapiens
ggaaguacgcacggccuuu

SEQ ID NO: 249497 - RNA, 19 nt, Homo sapiens
agacccugguggaguauuu

SEQ ID NO: 249498 - RNA, 19 nt, Homo sapiens
ugucaacaaccaugcauuu

SEQ ID NO: 249499 - RNA, 19 nt, Homo sapiens
cgucagauccaacaggaaa

SEQ ID NO: 249500 - RNA, 19 nt, Homo sapiens
agagaaggaggccgugaua

SEQ ID NO: 249501 - RNA, 19 nt, Homo sapiens
ccagaauguugcagauauc

SEQ ID NO: 249502 - RNA, 19 nt, Homo sapiens
ccugauugcucuaaagaag

SEQ ID NO: 249503 - RNA, 19 nt, Homo sapiens
ccgagagaauuccuacaga

SEQ ID NO: 249504 - RNA, 19 nt, Homo sapiens
ugauaacaccugcggcuuu

SEQ ID NO: 249505 - RNA, 19 nt, Homo sapiens
ggaaacaagacugcgaaug

SEQ ID NO: 249506 - RNA, 19 nt, Homo sapiens
ccacguggcggucaucugu

SEQ ID NO: 249507 - RNA, 19 nt, Homo sapiens
ccaccacagucucucacaa

SEQ ID NO: 249508 - RNA, 19 nt, Homo sapiens
gacagugcccagaauguug

SEQ ID NO: 249509 - RNA, 19 nt, Homo sapiens
gaauacccagggccucaaa

SEQ ID NO: 249510 - RNA, 19 nt, Homo sapiens
cagaggaggcuggauaaga

SEQ ID NO: 249511 - RNA, 19 nt, Homo sapiens
ggacauccggccacagauc

SEQ ID NO: 249512 - RNA, 19 nt, Homo sapiens
gaagccggcugggaagucu

SEQ ID NO: 249513 - RNA, 19 nt, Homo sapiens
aagaagcgguuucauuugc

SEQ ID NO: 249514 - RNA, 19 nt, Homo sapiens
aaagaagcgguuucauuug

SEQ ID NO: 249515 - RNA, 19 nt, Homo sapiens
gcugagaggaaacaggaaa

SEQ ID NO: 249516 - RNA, 19 nt, Homo sapiens
ggacuuugaggcccugguu

SEQ ID NO: 249517 - RNA, 19 nt, Homo sapiens
gacgauauugucccagaaa

SEQ ID NO: 249518 - RNA, 19 nt, Homo sapiens
gcugaggaccggaggauca

SEQ ID NO: 249519 - RNA, 19 nt, Homo sapiens
cgacagugcccagaauguu

SEQ ID NO: 249520 - RNA, 19 nt, Homo sapiens
cgacugugguugagaucau

SEQ ID NO: 249521 - RNA, 19 nt, Homo sapiens
uguuaaaacuugccaauga

SEQ ID NO: 249522 - RNA, 19 nt, Homo sapiens
ggaaacaggaaacaagacu

SEQ ID NO: 249523 - RNA, 19 nt, Homo sapiens
gagggaagaagcagcuaug

SEQ ID NO: 249524 - RNA, 19 nt, Homo sapiens
uuaagagaaccucagauga

SEQ ID NO: 249525 - RNA, 19 nt, Homo sapiens
ugagggugcugagaggaaa

SEQ ID NO: 249526 - RNA, 19 nt, Homo sapiens
uggauaagaagcugaguga

SEQ ID NO: 249527 - RNA, 19 nt, Homo sapiens
gaagaggagguucaucacu

SEQ ID NO: 249528 - RNA, 19 nt, Homo sapiens
gcugcggguccaccaaaua

SEQ ID NO: 249529 - RNA, 19 nt, Homo sapiens
gaaaacuauucccaugaga

SEQ ID NO: 249530 - RNA, 19 nt, Homo sapiens
gaaggagagggaagaagca

SEQ ID NO: 249531 - RNA, 19 nt, Homo sapiens
agaggagguucaucacugu

SEQ ID NO: 249532 - RNA, 19 nt, Homo sapiens
ugacgauauugucccagaa

SEQ ID NO: 249533 - RNA, 19 nt, Homo sapiens
ucacgguggccuuugauga

SEQ ID NO: 249534 - RNA, 19 nt, Homo sapiens
gagaggaaacaggaaacaa

SEQ ID NO: 249535 - RNA, 19 nt, Homo sapiens
cagcucagcccguuaggau

SEQ ID NO: 249536 - RNA, 19 nt, Homo sapiens
cugcagaggaggcuggaua

SEQ ID NO: 249537 - RNA, 19 nt, Homo sapiens
ugcuggagcuugagagaga

SEQ ID NO: 249538 - RNA, 19 nt, Homo sapiens
cagcuuuacuucuggugau

SEQ ID NO: 249539 - RNA, 19 nt, Homo sapiens
gaaaggugaaguugguuuu

SEQ ID NO: 249540 - RNA, 19 nt, Homo sapiens
gcuggccacugggaucuug

SEQ ID NO: 249541 - RNA, 19 nt, Homo sapiens
ugguugagaucauucuuca

SEQ ID NO: 249542 - RNA, 19 nt, Homo sapiens
ccagcaagaagaugcaguu

SEQ ID NO: 249543 - RNA, 19 nt, Homo sapiens
ggaguggagagccaagaug

SEQ ID NO: 249544 - RNA, 19 nt, Homo sapiens
gagagaaacauccgaauua

SEQ ID NO: 249545 - RNA, 19 nt, Homo sapiens
gaagugaagucaagaugaa

SEQ ID NO: 249546 - RNA, 19 nt, Homo sapiens
ccaagaagaugaaaggauu

SEQ ID NO: 249547 - RNA, 19 nt, Homo sapiens
gaauacaguuucuagcauu

SEQ ID NO: 249548 - RNA, 19 nt, Homo sapiens
ggacauaacagacuuggaa

SEQ ID NO: 249549 - RNA, 19 nt, Homo sapiens
ggagcuggauaaucagaua

SEQ ID NO: 249550 - RNA, 19 nt, Homo sapiens
gaucccaccucaccauuga

SEQ ID NO: 249551 - RNA, 19 nt, Homo sapiens
gaaaggauuguucuuguug

SEQ ID NO: 249552 - RNA, 19 nt, Homo sapiens
agaaacauccgaauuauug

SEQ ID NO: 249553 - RNA, 19 nt, Homo sapiens
agccagagcuuccgcauuu

SEQ ID NO: 249554 - RNA, 19 nt, Homo sapiens
ccagauuuguguaccauuu

SEQ ID NO: 249555 - RNA, 19 nt, Homo sapiens
gcauaaacauaggucaauu

SEQ ID NO: 249556 - RNA, 19 nt, Homo sapiens
gagguaugcucucuuagga

SEQ ID NO: 249557 - RNA, 19 nt, Homo sapiens
ggagagaaacauccgaauu

SEQ ID NO: 249558 - RNA, 19 nt, Homo sapiens
ggaauacaguuucuagcau

SEQ ID NO: 249559 - RNA, 19 nt, Homo sapiens
gguaugcucucuuaggaau

SEQ ID NO: 249560 - RNA, 19 nt, Homo sapiens
acagagaccugcuacacuu

SEQ ID NO: 249561 - RNA, 19 nt, Homo sapiens
gaagaugaaaggauuguuc

SEQ ID NO: 249562 - RNA, 19 nt, Homo sapiens
cagaagaagugaagucaag

SEQ ID NO: 249563 - RNA, 19 nt, Homo sapiens
ugaaaggauuguucuuguu

SEQ ID NO: 249564 - RNA, 19 nt, Homo sapiens
gagaaacauccgaauuauu

SEQ ID NO: 249565 - RNA, 19 nt, Homo sapiens
gaagacagugcuacagaga

SEQ ID NO: 249566 - RNA, 19 nt, Homo sapiens
aaguggagcuggauaauca

SEQ ID NO: 249567 - RNA, 19 nt, Homo sapiens
gaauuauuguuccucugaa

SEQ ID NO: 249568 - RNA, 19 nt, Homo sapiens
cugcuauccugacuaauuu

SEQ ID NO: 249569 - RNA, 19 nt, Homo sapiens
gaugaaaggauuguucuug

SEQ ID NO: 249570 - RNA, 19 nt, Homo sapiens
cauaaucagguuaguguaa

SEQ ID NO: 249571 - RNA, 19 nt, Homo sapiens
agagaaacauccgaauuau

SEQ ID NO: 249572 - RNA, 19 nt, Homo sapiens
gaaccagauuuguguacca

SEQ ID NO: 249573 - RNA, 19 nt, Homo sapiens
uauuaaggcuguucaugug

SEQ ID NO: 249574 - RNA, 19 nt, Homo sapiens
guaacugaaccuuaugaaa

SEQ ID NO: 249575 - RNA, 19 nt, Homo sapiens
ccauuugucugaccucugu

SEQ ID NO: 249576 - RNA, 19 nt, Homo sapiens
guagagaacauauaugcau

SEQ ID NO: 249577 - RNA, 19 nt, Homo sapiens
cgaauuauuguuccucuga

SEQ ID NO: 249578 - RNA, 19 nt, Homo sapiens
gaaagcccaagaagaugaa

SEQ ID NO: 249579 - RNA, 19 nt, Homo sapiens
gaagaagugaagucaagau

SEQ ID NO: 249580 - RNA, 19 nt, Homo sapiens
caauaucugugaugaagac

SEQ ID NO: 249581 - RNA, 19 nt, Homo sapiens
cagguuaguguaagaaauu

SEQ ID NO: 249582 - RNA, 19 nt, Homo sapiens
cugcuacacuuaugacaga

SEQ ID NO: 249583 - RNA, 19 nt, Homo sapiens
ugaaagcccaagaagauga

SEQ ID NO: 249584 - RNA, 19 nt, Homo sapiens
ugugaaagcccaagaagau

SEQ ID NO: 249585 - RNA, 19 nt, Homo sapiens
gaacaacagggagaauauc

SEQ ID NO: 249586 - RNA, 19 nt, Homo sapiens
aaaggauuguucuuguuga

SEQ ID NO: 249587 - RNA, 19 nt, Homo sapiens
gaugaagaaccauuugcuu

SEQ ID NO: 249588 - RNA, 19 nt, Homo sapiens
ucaagaugaagaaccauuu

SEQ ID NO: 249589 - RNA, 19 nt, Homo sapiens
gaagaaccauuugcuuuuc

SEQ ID NO: 249590 - RNA, 19 nt, Homo sapiens
caagaugaagaaccauuug

SEQ ID NO: 249591 - RNA, 19 nt, Homo sapiens
caugguacguauucucuag

SEQ ID NO: 249592 - RNA, 19 nt, Homo sapiens
gagaccugcuacacuuaug

SEQ ID NO: 249593 - RNA, 19 nt, Homo sapiens
ccauugagaaccagauuug

SEQ ID NO: 249594 - RNA, 19 nt, Homo sapiens
cggauuacuuccaggauca

SEQ ID NO: 249595 - RNA, 19 nt, Homo sapiens
gcuauccugacuaauuuaa

SEQ ID NO: 249596 - RNA, 19 nt, Homo sapiens
ccugcuauccugacuaauu

SEQ ID NO: 249597 - RNA, 19 nt, Homo sapiens
aaucagauaguuacugcua

SEQ ID NO: 249598 - RNA, 19 nt, Homo sapiens
gaaguggagcuggauaauc

SEQ ID NO: 249599 - RNA, 19 nt, Homo sapiens
cagaaguggagcuggauaa

SEQ ID NO: 249600 - RNA, 19 nt, Homo sapiens
ugaacaacagggagaauau

SEQ ID NO: 249601 - RNA, 19 nt, Homo sapiens
gaaacauccgaauuauugu

SEQ ID NO: 249602 - RNA, 19 nt, Homo sapiens
uaaucagguuaguguaaga

SEQ ID NO: 249603 - RNA, 19 nt, Homo sapiens
uggaaaacauguucuagaa

SEQ ID NO: 249604 - RNA, 19 nt, Homo sapiens
ugccugcuauccugacuaa

SEQ ID NO: 249605 - RNA, 19 nt, Homo sapiens
gagcaauaucugugaugaa

SEQ ID NO: 249606 - RNA, 19 nt, Homo sapiens
agagcaauaucugugauga

SEQ ID NO: 249607 - RNA, 19 nt, Homo sapiens
ugacaacaaauguaagugu

SEQ ID NO: 249608 - RNA, 19 nt, Homo sapiens
ucagguuaguguaagaaau

SEQ ID NO: 249609 - RNA, 19 nt, Homo sapiens
aaaaucaggagguguaaua

SEQ ID NO: 249610 - RNA, 19 nt, Homo sapiens
ucucuuaggaauacaguuu

SEQ ID NO: 249611 - RNA, 19 nt, Homo sapiens
cagagaccugcuacacuua

SEQ ID NO: 249612 - RNA, 19 nt, Homo sapiens
cuggauaaucagauaguua

SEQ ID NO: 249613 - RNA, 19 nt, Homo sapiens
uuaucaugcucaccugaaa

SEQ ID NO: 249614 - RNA, 19 nt, Homo sapiens
caagaagaugaaaggauug

SEQ ID NO: 249615 - RNA, 19 nt, Homo sapiens
gcuggauaaucagauaguu

SEQ ID NO: 249616 - RNA, 19 nt, Homo sapiens
aaacaaggggagaaaauaa

SEQ ID NO: 249617 - RNA, 19 nt, Homo sapiens
gcaauaucugugaugaaga

SEQ ID NO: 249618 - RNA, 19 nt, Homo sapiens
augaaaggauuguucuugu

SEQ ID NO: 249619 - RNA, 19 nt, Homo sapiens
agaagugaagucaagauga

SEQ ID NO: 249620 - RNA, 19 nt, Homo sapiens
augaagaaccauuugcuuu

SEQ ID NO: 249621 - RNA, 19 nt, Homo sapiens
agucugagcaauuaaauag

SEQ ID NO: 249622 - RNA, 19 nt, Homo sapiens
aaucaggagguguaauaaa

SEQ ID NO: 249623 - RNA, 19 nt, Homo sapiens
gauaaucagauaguuacug

SEQ ID NO: 249624 - RNA, 19 nt, Homo sapiens
aaaaugugauccuacagaa

SEQ ID NO: 249625 - RNA, 19 nt, Homo sapiens
uaaacaaggggagaaaaua

SEQ ID NO: 249626 - RNA, 19 nt, Homo sapiens
ugaagaaccauuugcuuuu

SEQ ID NO: 249627 - RNA, 19 nt, Homo sapiens
uuauuaaggcuguucaugu

SEQ ID NO: 249628 - RNA, 19 nt, Homo sapiens
gagccagagcuuccgcauu

SEQ ID NO: 249629 - RNA, 19 nt, Homo sapiens
agcaauaucugugaugaag

SEQ ID NO: 249630 - RNA, 19 nt, Homo sapiens
uguauuucaugguacguau

SEQ ID NO: 249631 - RNA, 19 nt, Homo sapiens
cagaugauacagacuucuu

SEQ ID NO: 249632 - RNA, 19 nt, Homo sapiens
cauaacagacuuggaagca

SEQ ID NO: 249633 - RNA, 19 nt, Homo sapiens
gauucagaaaguuagcaua

SEQ ID NO: 249634 - RNA, 19 nt, Homo sapiens
cugaacaacagggagaaua

SEQ ID NO: 249635 - RNA, 19 nt, Homo sapiens
uguaagugugcccggauua

SEQ ID NO: 249636 - RNA, 19 nt, Homo sapiens
agcaggagcuggcgucucu

SEQ ID NO: 249637 - RNA, 19 nt, Homo sapiens
gagaaccagauuuguguac

SEQ ID NO: 249638 - RNA, 19 nt, Homo sapiens
aaugugauccuacagaagu

SEQ ID NO: 249639 - RNA, 19 nt, Homo sapiens
gugaagucaagaugaagaa

SEQ ID NO: 249640 - RNA, 19 nt, Homo sapiens
aagcagaugauacagacuu

SEQ ID NO: 249641 - RNA, 19 nt, Homo sapiens
gcugacugcauagcucuuu

SEQ ID NO: 249642 - RNA, 19 nt, Homo sapiens
cagaaacaagugcuacaca

SEQ ID NO: 249643 - RNA, 19 nt, Homo sapiens
gacagaaacaagugcuaca

SEQ ID NO: 249644 - RNA, 19 nt, Homo sapiens
ccaguaaacccuaaauaaa

SEQ ID NO: 249645 - RNA, 19 nt, Homo sapiens
uaaauacccucuuugucaa

SEQ ID NO: 249646 - RNA, 19 nt, Homo sapiens
ggacccagcucaccguuuu

SEQ ID NO: 249647 - RNA, 19 nt, Homo sapiens
auaaauacccucuuuguca

SEQ ID NO: 249648 - RNA, 19 nt, Homo sapiens
ccaaacagagcaacaacaa

SEQ ID NO: 249649 - RNA, 19 nt, Homo sapiens
ggguuucaauccaagcaua

SEQ ID NO: 249650 - RNA, 19 nt, Homo sapiens
aaacagagcaacaacaagu

SEQ ID NO: 249651 - RNA, 19 nt, Homo sapiens
cccaguaaacccuaaauaa

SEQ ID NO: 249652 - RNA, 19 nt, Homo sapiens
caguggaggucccgcagaa

SEQ ID NO: 249653 - RNA, 19 nt, Homo sapiens
gcaagucaggccacaagga

SEQ ID NO: 249654 - RNA, 19 nt, Homo sapiens
ugcagaauguucauagguu

SEQ ID NO: 249655 - RNA, 19 nt, Homo sapiens
ugaccacgcccuccaaaca

SEQ ID NO: 249656 - RNA, 19 nt, Homo sapiens
gaccagggcaccacucucu

SEQ ID NO: 249657 - RNA, 19 nt, Homo sapiens
gaugaccacgcccuccaaa

SEQ ID NO: 249658 - RNA, 19 nt, Homo sapiens
ggaggucccgcagaagcua

SEQ ID NO: 249659 - RNA, 19 nt, Homo sapiens
ggagcaccguggagaagac

SEQ ID NO: 249660 - RNA, 19 nt, Homo sapiens
gguuucaauccaagcauaa

SEQ ID NO: 249661 - RNA, 19 nt, Homo sapiens
gagcccacacugcaaguca

SEQ ID NO: 249662 - RNA, 19 nt, Homo sapiens
auaacucagugacgcaugu

SEQ ID NO: 249663 - RNA, 19 nt, Homo sapiens
aauccaagcauaacucagu

SEQ ID NO: 249664 - RNA, 19 nt, Homo sapiens
ucuugacggugaccuggaa

SEQ ID NO: 249665 - RNA, 19 nt, Homo sapiens
ccaguaaacccuaaauaaa

SEQ ID NO: 249666 - RNA, 19 nt, Homo sapiens
uaaauacccucuuugucaa

SEQ ID NO: 249667 - RNA, 19 nt, Homo sapiens
auaaauacccucuuuguca

SEQ ID NO: 249668 - RNA, 19 nt, Homo sapiens
ccaaacagagcaacaacaa

SEQ ID NO: 249669 - RNA, 19 nt, Homo sapiens
aaacagagcaacaacaagu

SEQ ID NO: 249670 - RNA, 19 nt, Homo sapiens
cccaguaaacccuaaauaa

SEQ ID NO: 249671 - RNA, 19 nt, Homo sapiens
caguggaggucccgcagaa

SEQ ID NO: 249672 - RNA, 19 nt, Homo sapiens
gcaagucaggccacaagga

SEQ ID NO: 249673 - RNA, 19 nt, Homo sapiens
ugcagaauguucauagguu

SEQ ID NO: 249674 - RNA, 19 nt, Homo sapiens
ugaccacgcccuccaaaca

SEQ ID NO: 249675 - RNA, 19 nt, Homo sapiens
gaccagggcaccacucucu

SEQ ID NO: 249676 - RNA, 19 nt, Homo sapiens
gaugaccacgcccuccaaa

SEQ ID NO: 249677 - RNA, 19 nt, Homo sapiens
ggaggucccgcagaagcua

SEQ ID NO: 249678 - RNA, 19 nt, Homo sapiens
ggagcaccguggagaagac

SEQ ID NO: 249679 - RNA, 19 nt, Homo sapiens
gagcccacacugcaaguca

SEQ ID NO: 249680 - RNA, 19 nt, Homo sapiens
ucuugacggugaccuggaa

SEQ ID NO: 249681 - RNA, 19 nt, Homo sapiens
ggaauuacguucugaauga

SEQ ID NO: 249682 - RNA, 19 nt, Homo sapiens
ggaaugaccuuugcucuaa

SEQ ID NO: 249683 - RNA, 19 nt, Homo sapiens
gaacucagcugacuuccuu

SEQ ID NO: 249684 - RNA, 19 nt, Homo sapiens
gcaagaaccuguccagcaa

SEQ ID NO: 249685 - RNA, 19 nt, Homo sapiens
cacaagaccuuccaaguuu

SEQ ID NO: 249686 - RNA, 19 nt, Homo sapiens
gcuaucagguugucucuaa

SEQ ID NO: 249687 - RNA, 19 nt, Homo sapiens
gauagaagagacugaaaua

SEQ ID NO: 249688 - RNA, 19 nt, Homo sapiens
gaaauagcauccagugaca

SEQ ID NO: 249689 - RNA, 19 nt, Homo sapiens
gguaugacaucgauaguga

SEQ ID NO: 249690 - RNA, 19 nt, Homo sapiens
gcagcucacuuucuaauca

SEQ ID NO: 249691 - RNA, 19 nt, Homo sapiens
agacaaaccacuucaauuu

SEQ ID NO: 249692 - RNA, 19 nt, Homo sapiens
gcacagggaccuacaguug

SEQ ID NO: 249693 - RNA, 19 nt, Homo sapiens
ccgaguaucucauccagua

SEQ ID NO: 249694 - RNA, 19 nt, Homo sapiens
uuacaaagauggaagugaa

SEQ ID NO: 249695 - RNA, 19 nt, Homo sapiens
uaagaaaggagaagacaaa

SEQ ID NO: 249696 - RNA, 19 nt, Homo sapiens
ccaguaaaguucuagaguu

SEQ ID NO: 249697 - RNA, 19 nt, Homo sapiens
gauacauucugcacaaaga

SEQ ID NO: 249698 - RNA, 19 nt, Homo sapiens
uauagagguucacuccuua

SEQ ID NO: 249699 - RNA, 19 nt, Homo sapiens
ccacaagaccuuccaaguu

SEQ ID NO: 249700 - RNA, 19 nt, Homo sapiens
gaaagagaaacauuccaaa

SEQ ID NO: 249701 - RNA, 19 nt, Homo sapiens
gcaaguuccugcugcugaa

SEQ ID NO: 249702 - RNA, 19 nt, Homo sapiens
cuauaaauccaaccaguua

SEQ ID NO: 249703 - RNA, 19 nt, Homo sapiens
ccaccaugcugaagacauu

SEQ ID NO: 249704 - RNA, 19 nt, Homo sapiens
gggagaacaucacgcuuug

SEQ ID NO: 249705 - RNA, 19 nt, Homo sapiens
gaaaaggcauuggaaacua

SEQ ID NO: 249706 - RNA, 19 nt, Homo sapiens
gagacuucaucaucaguaa

SEQ ID NO: 249707 - RNA, 19 nt, Homo sapiens
ggaagaaagagaaacauuc

SEQ ID NO: 249708 - RNA, 19 nt, Homo sapiens
caguaaaguucuagaguug

SEQ ID NO: 249709 - RNA, 19 nt, Homo sapiens
aaauaugacucuucagugu

SEQ ID NO: 249710 - RNA, 19 nt, Homo sapiens
gaaaggagaagacaaacca

SEQ ID NO: 249711 - RNA, 19 nt, Homo sapiens
ggaagagaccagaccauug

SEQ ID NO: 249712 - RNA, 19 nt, Homo sapiens
augcagagccuguggauua

SEQ ID NO: 249713 - RNA, 19 nt, Homo sapiens
guaaaguucuagaguugga

SEQ ID NO: 249714 - RNA, 19 nt, Homo sapiens
gaauuacguucugaaugaa

SEQ ID NO: 249715 - RNA, 19 nt, Homo sapiens
ggaaugggaagaaagagaa

SEQ ID NO: 249716 - RNA, 19 nt, Homo sapiens
caaguuucauuccuuauag

SEQ ID NO: 249717 - RNA, 19 nt, Homo sapiens
gcgcaugaaauucuauuaa

SEQ ID NO: 249718 - RNA, 19 nt, Homo sapiens
caaagauggaagugaaaua

SEQ ID NO: 249719 - RNA, 19 nt, Homo sapiens
gaaccuguccagcaacuug

SEQ ID NO: 249720 - RNA, 19 nt, Homo sapiens
cagcaucgaugacaacaca

SEQ ID NO: 249721 - RNA, 19 nt, Homo sapiens
aauuacagcugccgauauu

SEQ ID NO: 249722 - RNA, 19 nt, Homo sapiens
ggauaaagacgaaggcaau

SEQ ID NO: 249723 - RNA, 19 nt, Homo sapiens
gggccaaucuauggaauga

SEQ ID NO: 249724 - RNA, 19 nt, Homo sapiens
ggucaaagcccaguaaagu

SEQ ID NO: 249725 - RNA, 19 nt, Homo sapiens
ggugagauguuuccugaag

SEQ ID NO: 249726 - RNA, 19 nt, Homo sapiens
agaagcaccucagcaguuu

SEQ ID NO: 249727 - RNA, 19 nt, Homo sapiens
gagcuuaugguuguagaua

SEQ ID NO: 249728 - RNA, 19 nt, Homo sapiens
cuuccuggguguaauguua

SEQ ID NO: 249729 - RNA, 19 nt, Homo sapiens
ugaagaguguaaccaagaa

SEQ ID NO: 249730 - RNA, 19 nt, Homo sapiens
gaagagaccagaccauugc

SEQ ID NO: 249731 - RNA, 19 nt, Homo sapiens
gcucaggagugcacuguag

SEQ ID NO: 249732 - RNA, 19 nt, Homo sapiens
ugaagacucugggaucuau

SEQ ID NO: 249733 - RNA, 19 nt, Homo sapiens
gggaggagauggcuguauc

SEQ ID NO: 249734 - RNA, 19 nt, Homo sapiens
cagguugucucuaaucaug

SEQ ID NO: 249735 - RNA, 19 nt, Homo sapiens
ccaaaugggucagaaugug

SEQ ID NO: 249736 - RNA, 19 nt, Homo sapiens
ccaaguuucauuccuuaua

SEQ ID NO: 249737 - RNA, 19 nt, Homo sapiens
ggaauuacagcugccgaua

SEQ ID NO: 249738 - RNA, 19 nt, Homo sapiens
gcuguuccuuggucucuaa

SEQ ID NO: 249739 - RNA, 19 nt, Homo sapiens
gguuugcucuguauaagga

SEQ ID NO: 249740 - RNA, 19 nt, Homo sapiens
caacuccggugcaaaggau

SEQ ID NO: 249741 - RNA, 19 nt, Homo sapiens
uaggauacauucugcacaa

SEQ ID NO: 249742 - RNA, 19 nt, Homo sapiens
ucuagaacaugauggagaa

SEQ ID NO: 249743 - RNA, 19 nt, Homo sapiens
gaauuacagcugccgauau

SEQ ID NO: 249744 - RNA, 19 nt, Homo sapiens
cagcauaugagcuuuauuc

SEQ ID NO: 249745 - RNA, 19 nt, Homo sapiens
gaccuacaguugcagcuau

SEQ ID NO: 249746 - RNA, 19 nt, Homo sapiens
gagacaggcuggucaaagc

SEQ ID NO: 249747 - RNA, 19 nt, Homo sapiens
ucacuguacugauuuacug

SEQ ID NO: 249748 - RNA, 19 nt, Homo sapiens
aaacggagacuucaucauc

SEQ ID NO: 249749 - RNA, 19 nt, Homo sapiens
ccaagauacuggacauuac

SEQ ID NO: 249750 - RNA, 19 nt, Homo sapiens
ugaggcaaauuucuucuuc

SEQ ID NO: 249751 - RNA, 19 nt, Homo sapiens
uaaugaggguugaagacuu

SEQ ID NO: 249752 - RNA, 19 nt, Homo sapiens
gaaugaccuuugcucuaau

SEQ ID NO: 249753 - RNA, 19 nt, Homo sapiens
ccaguuacccugcaaguca

SEQ ID NO: 249754 - RNA, 19 nt, Homo sapiens
ucaacaacguagaaggaaa

SEQ ID NO: 249755 - RNA, 19 nt, Homo sapiens
ucaggagccuuuagagcaa

SEQ ID NO: 249756 - RNA, 19 nt, Homo sapiens
ccuaagccaugguuguuug

SEQ ID NO: 249757 - RNA, 19 nt, Homo sapiens
cugccgauauuaugacuuu

SEQ ID NO: 249758 - RNA, 19 nt, Homo sapiens
cgcuggagcuugucauaaa

SEQ ID NO: 249759 - RNA, 19 nt, Homo sapiens
ugaaugaagcuaucagguu

SEQ ID NO: 249760 - RNA, 19 nt, Homo sapiens
ggagacuucaucaucagua

SEQ ID NO: 249761 - RNA, 19 nt, Homo sapiens
gggaagaaagagaaacauu

SEQ ID NO: 249762 - RNA, 19 nt, Homo sapiens
ugacaacacaucauucuuc

SEQ ID NO: 249763 - RNA, 19 nt, Homo sapiens
caaaugggucagaauguga

SEQ ID NO: 249764 - RNA, 19 nt, Homo sapiens
gagcuuuccucuccucucu

SEQ ID NO: 249765 - RNA, 19 nt, Homo sapiens
cauguucccuuacaguuuc

SEQ ID NO: 249766 - RNA, 19 nt, Homo sapiens
uagaagagacugaaauagu

SEQ ID NO: 249767 - RNA, 19 nt, Homo sapiens
gcacucauauccagaugcu

SEQ ID NO: 249768 - RNA, 19 nt, Homo sapiens
ucagagaccuauaaaucca

SEQ ID NO: 249769 - RNA, 19 nt, Homo sapiens
agacacaaaugaccuggau

SEQ ID NO: 249770 - RNA, 19 nt, Homo sapiens
ccagcaccauguucaaguu

SEQ ID NO: 249771 - RNA, 19 nt, Homo sapiens
gaacuauagcuguaucuac

SEQ ID NO: 249772 - RNA, 19 nt, Homo sapiens
caucauggcaccuggagaa

SEQ ID NO: 249773 - RNA, 19 nt, Homo sapiens
agaacaugauggagaagaa

SEQ ID NO: 249774 - RNA, 19 nt, Homo sapiens
gcauaugagcuuuauucuu

SEQ ID NO: 249775 - RNA, 19 nt, Homo sapiens
gauccgcccuucccacaag

SEQ ID NO: 249776 - RNA, 19 nt, Homo sapiens
aaugaggguugaagacuug

SEQ ID NO: 249777 - RNA, 19 nt, Homo sapiens
ucaaagcccaguaaaguuc

SEQ ID NO: 249778 - RNA, 19 nt, Homo sapiens
gggaacauuguccgaagua

SEQ ID NO: 249779 - RNA, 19 nt, Homo sapiens
ggacucuacucccuuugca

SEQ ID NO: 249780 - RNA, 19 nt, Homo sapiens
guagugcuguggauaaggu

SEQ ID NO: 249781 - RNA, 19 nt, Homo sapiens
ggaaauguguugacaauau

SEQ ID NO: 249782 - RNA, 19 nt, Homo sapiens
gaagacaguuccuccauug

SEQ ID NO: 249783 - RNA, 19 nt, Homo sapiens
gaaccaacacuaacauaua

SEQ ID NO: 249784 - RNA, 19 nt, Homo sapiens
ugaagaagcuaaauccuuu

SEQ ID NO: 249785 - RNA, 19 nt, Homo sapiens
gaccagagcuacugacuau

SEQ ID NO: 249786 - RNA, 19 nt, Homo sapiens
cuacauguuugucaucuua

SEQ ID NO: 249787 - RNA, 19 nt, Homo sapiens
aaacuucccucuucagaaa

SEQ ID NO: 249788 - RNA, 19 nt, Homo sapiens
gcacacaccuucuucuaca

SEQ ID NO: 249789 - RNA, 19 nt, Homo sapiens
ccucacggcugcugcauua

SEQ ID NO: 249790 - RNA, 19 nt, Homo sapiens
ggagaccuguaaucauaua

SEQ ID NO: 249791 - RNA, 19 nt, Homo sapiens
ugggagaccuguaaucaua

SEQ ID NO: 249792 - RNA, 19 nt, Homo sapiens
gaccuaggauuucaugauu

SEQ ID NO: 249793 - RNA, 19 nt, Homo sapiens
guaagaggaucaagacuuc

SEQ ID NO: 249794 - RNA, 19 nt, Homo sapiens
ggagcacaaucaacaaauu

SEQ ID NO: 249795 - RNA, 19 nt, Homo sapiens
gagagggagucauuucauu

SEQ ID NO: 249796 - RNA, 19 nt, Homo sapiens
gccaggagcugccaaguau

SEQ ID NO: 249797 - RNA, 19 nt, Homo sapiens
gaagagacgguugaguuua

SEQ ID NO: 249798 - RNA, 19 nt, Homo sapiens
gcaaaggggugaauaaaug

SEQ ID NO: 249799 - RNA, 19 nt, Homo sapiens
caagcaaacuucccucuuc

SEQ ID NO: 249800 - RNA, 19 nt, Homo sapiens
guacugagccuuguaauuc

SEQ ID NO: 249801 - RNA, 19 nt, Homo sapiens
ggaugaagcagugaaauuu

SEQ ID NO: 249802 - RNA, 19 nt, Homo sapiens
uaucagcuaugccaucuuu

SEQ ID NO: 249803 - RNA, 19 nt, Homo sapiens
gaucaucugucucugaauc

SEQ ID NO: 249804 - RNA, 19 nt, Homo sapiens
gaacacaacuacagcuacu

SEQ ID NO: 249805 - RNA, 19 nt, Homo sapiens
gggcauauccuacagaaga

SEQ ID NO: 249806 - RNA, 19 nt, Homo sapiens
ugagaccacuguuaucaaa

SEQ ID NO: 249807 - RNA, 19 nt, Homo sapiens
gaaacucugcauucuagua

SEQ ID NO: 249808 - RNA, 19 nt, Homo sapiens
cauccaagcuuaccuucaa

SEQ ID NO: 249809 - RNA, 19 nt, Homo sapiens
cagaaaagauggcucauuu

SEQ ID NO: 249810 - RNA, 19 nt, Homo sapiens
ggaauguaaucaauguuuc

SEQ ID NO: 249811 - RNA, 19 nt, Homo sapiens
aagagacgguugaguuuaa

SEQ ID NO: 249812 - RNA, 19 nt, Homo sapiens
gaaacucacggcacuaaga

SEQ ID NO: 249813 - RNA, 19 nt, Homo sapiens
gaaauccuucuaucaugua

SEQ ID NO: 249814 - RNA, 19 nt, Homo sapiens
gcuaugccaucuuucacua

SEQ ID NO: 249815 - RNA, 19 nt, Homo sapiens
ggcaaagcacgaaauguua

SEQ ID NO: 249816 - RNA, 19 nt, Homo sapiens
ccacagaccuaggauuuca

SEQ ID NO: 249817 - RNA, 19 nt, Homo sapiens
caaguauucugccaauuca

SEQ ID NO: 249818 - RNA, 19 nt, Homo sapiens
ugaaggagaugccugagau

SEQ ID NO: 249819 - RNA, 19 nt, Homo sapiens
ugacaugggugcuuauaag

SEQ ID NO: 249820 - RNA, 19 nt, Homo sapiens
ggccaaaguuccagacaug

SEQ ID NO: 249821 - RNA, 19 nt, Homo sapiens
auugaaggcucauauguaa

SEQ ID NO: 249822 - RNA, 19 nt, Homo sapiens
caaaauggagggaauaaua

SEQ ID NO: 249823 - RNA, 19 nt, Homo sapiens
gcaaauuaaggcauaagaa

SEQ ID NO: 249824 - RNA, 19 nt, Homo sapiens
gaucaucaaauacgaauuc

SEQ ID NO: 249825 - RNA, 19 nt, Homo sapiens
ugaggugauuuaugccuua

SEQ ID NO: 249826 - RNA, 19 nt, Homo sapiens
guacuugggagaccuguaa

SEQ ID NO: 249827 - RNA, 19 nt, Homo sapiens
gcaaagcacgaaauguuau

SEQ ID NO: 249828 - RNA, 19 nt, Homo sapiens
gaaugacgcccucaaucaa

SEQ ID NO: 249829 - RNA, 19 nt, Homo sapiens
acaacuacagcuacuauua

SEQ ID NO: 249830 - RNA, 19 nt, Homo sapiens
caaacucugaggugauuua

SEQ ID NO: 249831 - RNA, 19 nt, Homo sapiens
ccaggcauccuccacaaua

SEQ ID NO: 249832 - RNA, 19 nt, Homo sapiens
caaaguuccagacauguuu

SEQ ID NO: 249833 - RNA, 19 nt, Homo sapiens
cgaguugaaugaacauaga

SEQ ID NO: 249834 - RNA, 19 nt, Homo sapiens
uaggaaauguguugacaau

SEQ ID NO: 249835 - RNA, 19 nt, Homo sapiens
ggaaccaacacuaacauau

SEQ ID NO: 249836 - RNA, 19 nt, Homo sapiens
gaaggagaugccugagaua

SEQ ID NO: 249837 - RNA, 19 nt, Homo sapiens
gaucagaccauaauguuac

SEQ ID NO: 249838 - RNA, 19 nt, Homo sapiens
uuacagaugggcaaauuaa

SEQ ID NO: 249839 - RNA, 19 nt, Homo sapiens
agacacaccuugggcauau

SEQ ID NO: 249840 - RNA, 19 nt, Homo sapiens
gacaauauucagaagagua

SEQ ID NO: 249841 - RNA, 19 nt, Homo sapiens
gaaggcaaagcacgaaaug

SEQ ID NO: 249842 - RNA, 19 nt, Homo sapiens
caauagcaguugaaacaag

SEQ ID NO: 249843 - RNA, 19 nt, Homo sapiens
cacaauagcaguugaaaca

SEQ ID NO: 249844 - RNA, 19 nt, Homo sapiens
ugagcaaugugaaauacaa

SEQ ID NO: 249845 - RNA, 19 nt, Homo sapiens
caaucugugucucugagua

SEQ ID NO: 249846 - RNA, 19 nt, Homo sapiens
gaaccaaaucaauaacuuc

SEQ ID NO: 249847 - RNA, 19 nt, Homo sapiens
gcaaacuucccucuucaga

SEQ ID NO: 249848 - RNA, 19 nt, Homo sapiens
ccacaaagcaagacuacug

SEQ ID NO: 249849 - RNA, 19 nt, Homo sapiens
guaugugacugcccaagau

SEQ ID NO: 249850 - RNA, 19 nt, Homo sapiens
gaauaucugcaaacaacaa

SEQ ID NO: 249851 - RNA, 19 nt, Homo sapiens
uggaauaucugcaaacaac

SEQ ID NO: 249852 - RNA, 19 nt, Homo sapiens
guacauuaauuaccuugag

SEQ ID NO: 249853 - RNA, 19 nt, Homo sapiens
acaagaagccacagaccua

SEQ ID NO: 249854 - RNA, 19 nt, Homo sapiens
caugggugcuuauaaguca

SEQ ID NO: 249855 - RNA, 19 nt, Homo sapiens
gcugaggccuuacgcauac

SEQ ID NO: 249856 - RNA, 19 nt, Homo sapiens
cagcaaagaagucaagaug

SEQ ID NO: 249857 - RNA, 19 nt, Homo sapiens
aaauaccacuguucucuuc

SEQ ID NO: 249858 - RNA, 19 nt, Homo sapiens
gaccaggcauccuccacaa

SEQ ID NO: 249859 - RNA, 19 nt, Homo sapiens
caucaaauacgaauucauc

SEQ ID NO: 249860 - RNA, 19 nt, Homo sapiens
auaaauuccucuccaaauc

SEQ ID NO: 249861 - RNA, 19 nt, Homo sapiens
caacuacagcuacuauuag

SEQ ID NO: 249862 - RNA, 19 nt, Homo sapiens
ccaaguauucugccaauuc

SEQ ID NO: 249863 - RNA, 19 nt, Homo sapiens
caacaaaauucucugacaa

SEQ ID NO: 249864 - RNA, 19 nt, Homo sapiens
agaccaaccuccucuucuu

SEQ ID NO: 249865 - RNA, 19 nt, Homo sapiens
gaugaagcagugaaauuug

SEQ ID NO: 249866 - RNA, 19 nt, Homo sapiens
ucuaaaacauccaagcuua

SEQ ID NO: 249867 - RNA, 19 nt, Homo sapiens
agaagacaguuccuccauu

SEQ ID NO: 249868 - RNA, 19 nt, Homo sapiens
aaauuccucuccaaaucua

SEQ ID NO: 249869 - RNA, 19 nt, Homo sapiens
agugauugauagaguguua

SEQ ID NO: 249870 - RNA, 19 nt, Homo sapiens
uauuacagaugggcaaauu

SEQ ID NO: 249871 - RNA, 19 nt, Homo sapiens
ugaaugacgcccucaauca

SEQ ID NO: 249872 - RNA, 19 nt, Homo sapiens
gaaaucaucaagccuaggu

SEQ ID NO: 249873 - RNA, 19 nt, Homo sapiens
uugaagaccugaagaacug

SEQ ID NO: 249874 - RNA, 19 nt, Homo sapiens
ccacuguucucuucucuac

SEQ ID NO: 249875 - RNA, 19 nt, Homo sapiens
uaauugguccgaucuuuga

SEQ ID NO: 249876 - RNA, 19 nt, Homo sapiens
guaauugguccgaucuuug

SEQ ID NO: 249877 - RNA, 19 nt, Homo sapiens
aggaaacucugcauucuag

SEQ ID NO: 249878 - RNA, 19 nt, Homo sapiens
ccuaggauuucaugauuuc

SEQ ID NO: 249879 - RNA, 19 nt, Homo sapiens
aagaagagacgguugaguu

SEQ ID NO: 249880 - RNA, 19 nt, Homo sapiens
acugaauucuucccuguaa

SEQ ID NO: 249881 - RNA, 19 nt, Homo sapiens
gugaaaugauggcuuauua

SEQ ID NO: 249882 - RNA, 19 nt, Homo sapiens
gagcaaauaucauacuguu

SEQ ID NO: 249883 - RNA, 19 nt, Homo sapiens
ggacuggugugcucucuuu

SEQ ID NO: 249884 - RNA, 19 nt, Homo sapiens
ccagugaaaugauggcuua

SEQ ID NO: 249885 - RNA, 19 nt, Homo sapiens
gaggaugacuuguucuuug

SEQ ID NO: 249886 - RNA, 19 nt, Homo sapiens
gcaaauaucauacuguuca

SEQ ID NO: 249887 - RNA, 19 nt, Homo sapiens
uaagaaacccucugucauu

SEQ ID NO: 249888 - RNA, 19 nt, Homo sapiens
ccgcuucccuauuuauuua

SEQ ID NO: 249889 - RNA, 19 nt, Homo sapiens
auaacaagcuggaauuuga

SEQ ID NO: 249890 - RNA, 19 nt, Homo sapiens
ggugaugucugguccauau

SEQ ID NO: 249891 - RNA, 19 nt, Homo sapiens
gcaaccgcuucccuauuua

SEQ ID NO: 249892 - RNA, 19 nt, Homo sapiens
gcaaugaggaugacuuguu

SEQ ID NO: 249893 - RNA, 19 nt, Homo sapiens
acagucagcucucuccuuu

SEQ ID NO: 249894 - RNA, 19 nt, Homo sapiens
gaaaugauggcuuauuaca

SEQ ID NO: 249895 - RNA, 19 nt, Homo sapiens
uaccugagcucgccaguga

SEQ ID NO: 249896 - RNA, 19 nt, Homo sapiens
ggacuuuccuguugucuac

SEQ ID NO: 249897 - RNA, 19 nt, Homo sapiens
ggugugcucucuuuaaauc

SEQ ID NO: 249898 - RNA, 19 nt, Homo sapiens
caaugaggaugacuuguuc

SEQ ID NO: 249899 - RNA, 19 nt, Homo sapiens
caauuugugucuuccuaaa

SEQ ID NO: 249900 - RNA, 19 nt, Homo sapiens
gagaagaaaguaaugacaa

SEQ ID NO: 249901 - RNA, 19 nt, Homo sapiens
gaaagggaacagaaagguu

SEQ ID NO: 249902 - RNA, 19 nt, Homo sapiens
cagcaccucucaagcagaa

SEQ ID NO: 249903 - RNA, 19 nt, Homo sapiens
caagugguguucuccaugu

SEQ ID NO: 249904 - RNA, 19 nt, Homo sapiens
gacaggauauggagcaaca

SEQ ID NO: 249905 - RNA, 19 nt, Homo sapiens
agcaaccgcuucccuauuu

SEQ ID NO: 249906 - RNA, 19 nt, Homo sapiens
gcugauggcccuaaacaga

SEQ ID NO: 249907 - RNA, 19 nt, Homo sapiens
aaugauggcuuauuacagu

SEQ ID NO: 249908 - RNA, 19 nt, Homo sapiens
gaaaagcgauuugucuuca

SEQ ID NO: 249909 - RNA, 19 nt, Homo sapiens
gucauucgcucccacauuc

SEQ ID NO: 249910 - RNA, 19 nt, Homo sapiens
aaagggaacagaaagguuu

SEQ ID NO: 249911 - RNA, 19 nt, Homo sapiens
guacaaggagaagaaagua

SEQ ID NO: 249912 - RNA, 19 nt, Homo sapiens
gcaccuguacgaucacuga

SEQ ID NO: 249913 - RNA, 19 nt, Homo sapiens
gagcaaccgcuucccuauu

SEQ ID NO: 249914 - RNA, 19 nt, Homo sapiens
gcaauuugugucuuccuaa

SEQ ID NO: 249915 - RNA, 19 nt, Homo sapiens
uaacugacuucaccaugca

SEQ ID NO: 249916 - RNA, 19 nt, Homo sapiens
ucaauaacaagcuggaauu

SEQ ID NO: 249917 - RNA, 19 nt, Homo sapiens
gaaaccacggccacauuug

SEQ ID NO: 249918 - RNA, 19 nt, Homo sapiens
cgaugcaccuguacgauca

SEQ ID NO: 249919 - RNA, 19 nt, Homo sapiens
caaugguucugaaauaaac

SEQ ID NO: 249920 - RNA, 19 nt, Homo sapiens
ggucuaauuuauucaaagg

SEQ ID NO: 249921 - RNA, 19 nt, Homo sapiens
gcagaaagggaacagaaag

SEQ ID NO: 249922 - RNA, 19 nt, Homo sapiens
ccaaagaagaagauggaaa

SEQ ID NO: 249923 - RNA, 19 nt, Homo sapiens
guaccuguccugcguguug

SEQ ID NO: 249924 - RNA, 19 nt, Homo sapiens
ggauauggagcaacaagug

SEQ ID NO: 249925 - RNA, 19 nt, Homo sapiens
gaugucugguccauaugaa

SEQ ID NO: 249926 - RNA, 19 nt, Homo sapiens
gaccugagcaccuucuuuc

SEQ ID NO: 249927 - RNA, 19 nt, Homo sapiens
agaaugaccugagcaccuu

SEQ ID NO: 249928 - RNA, 19 nt, Homo sapiens
agucagcucucuccuuuca

SEQ ID NO: 249929 - RNA, 19 nt, Homo sapiens
ugacuucaccaugcaauuu

SEQ ID NO: 249930 - RNA, 19 nt, Homo sapiens
gaugauaagcccacucuac

SEQ ID NO: 249931 - RNA, 19 nt, Homo sapiens
aagaaacccucugucauuc

SEQ ID NO: 249932 - RNA, 19 nt, Homo sapiens
caauaacaagcuggaauuu

SEQ ID NO: 249933 - RNA, 19 nt, Homo sapiens
caaagaagaagauggaaaa

SEQ ID NO: 249934 - RNA, 19 nt, Homo sapiens
ggagaagaaaguaaugaca

SEQ ID NO: 249935 - RNA, 19 nt, Homo sapiens
gcucagauuauuuaaaugg

SEQ ID NO: 249936 - RNA, 19 nt, Homo sapiens
gcucgccagugaaaugaug

SEQ ID NO: 249937 - RNA, 19 nt, Homo sapiens
caccucuccuacucacuua

SEQ ID NO: 249938 - RNA, 19 nt, Homo sapiens
gccaggauauaacugacuu

SEQ ID NO: 249939 - RNA, 19 nt, Homo sapiens
aggaugacuuguucuuuga

SEQ ID NO: 249940 - RNA, 19 nt, Homo sapiens
gcacgaugcaccuguacga

SEQ ID NO: 249941 - RNA, 19 nt, Homo sapiens
agaaaccacggccacauuu

SEQ ID NO: 249942 - RNA, 19 nt, Homo sapiens
cagaaaccacggccacauu

SEQ ID NO: 249943 - RNA, 19 nt, Homo sapiens
caugggauaacgaggcuua

SEQ ID NO: 249944 - RNA, 19 nt, Homo sapiens
guccuuuaauuaagacuga

SEQ ID NO: 249945 - RNA, 19 nt, Homo sapiens
cuggugugcucucuuuaaa

SEQ ID NO: 249946 - RNA, 19 nt, Homo sapiens
ugaagcugauggcccuaaa

SEQ ID NO: 249947 - RNA, 19 nt, Homo sapiens
gcccuaaacagaugaagug

SEQ ID NO: 249948 - RNA, 19 nt, Homo sapiens
gaugacuuguucuuugaag

SEQ ID NO: 249949 - RNA, 19 nt, Homo sapiens
gcuauagccuggacuuucc

SEQ ID NO: 249950 - RNA, 19 nt, Homo sapiens
caucagcaccucucaagca

SEQ ID NO: 249951 - RNA, 19 nt, Homo sapiens
cuucauugcucaagugucu

SEQ ID NO: 249952 - RNA, 19 nt, Homo sapiens
cuacaccaaugcccaacug

SEQ ID NO: 249953 - RNA, 19 nt, Homo sapiens
ggcagaaagggaacagaaa

SEQ ID NO: 249954 - RNA, 19 nt, Homo sapiens
uggacaagcugaggaagau

SEQ ID NO: 249955 - RNA, 19 nt, Homo sapiens
ucuaagaaacccucuguca

SEQ ID NO: 249956 - RNA, 19 nt, Homo sapiens
ccaugcaauuugugucuuc

SEQ ID NO: 249957 - RNA, 19 nt, Homo sapiens
ggagaguguagaucccaaa

SEQ ID NO: 249958 - RNA, 19 nt, Homo sapiens
acaaggagaagaaaguaau

SEQ ID NO: 249959 - RNA, 19 nt, Homo sapiens
ugauggcccuaaacagaug

SEQ ID NO: 249960 - RNA, 19 nt, Homo sapiens
caaccgcuucccuauuuau

SEQ ID NO: 249961 - RNA, 19 nt, Homo sapiens
gagcucgccagugaaauga

SEQ ID NO: 249962 - RNA, 19 nt, Homo sapiens
ccuguugucuacaccaaug

SEQ ID NO: 249963 - RNA, 19 nt, Homo sapiens
agagagcuguacccagaga

SEQ ID NO: 249964 - RNA, 19 nt, Homo sapiens
caaggagaagaaaguaaug

SEQ ID NO: 249965 - RNA, 19 nt, Homo sapiens
aaucuucauugcucaagug

SEQ ID NO: 249966 - RNA, 19 nt, Homo sapiens
agccuggacuuuccuguug

SEQ ID NO: 249967 - RNA, 19 nt, Homo sapiens
cagagaguccugugcugaa

SEQ ID NO: 249968 - RNA, 19 nt, Homo sapiens
aagcagccauggcagaagu

SEQ ID NO: 249969 - RNA, 19 nt, Homo sapiens
agaguccugugcugaaugu

SEQ ID NO: 249970 - RNA, 19 nt, Homo sapiens
uguccugcguguugaaaga

SEQ ID NO: 249971 - RNA, 19 nt, Homo sapiens
ugcaauuugugucuuccua

SEQ ID NO: 249972 - RNA, 19 nt, Homo sapiens
ugugcucucuuuaaaucaa

SEQ ID NO: 249973 - RNA, 19 nt, Homo sapiens
cuaagaaacccucugucau

SEQ ID NO: 249974 - RNA, 19 nt, Homo sapiens
guacaucagcaccucucaa

SEQ ID NO: 249975 - RNA, 19 nt, Homo sapiens
cuucuuucccuucaucuuu

SEQ ID NO: 249976 - RNA, 19 nt, Homo sapiens
ggccacauuugguucuaag

SEQ ID NO: 249977 - RNA, 19 nt, Homo sapiens
ucucucaccucuccuacuc

SEQ ID NO: 249978 - RNA, 19 nt, Homo sapiens
cacagaccuuccaggagaa

SEQ ID NO: 249979 - RNA, 19 nt, Homo sapiens
gacuucaccaugcaauuug

SEQ ID NO: 249980 - RNA, 19 nt, Homo sapiens
gaagauggaaaagcgauuu

SEQ ID NO: 249981 - RNA, 19 nt, Homo sapiens
ggacaagaaucaauggaua

SEQ ID NO: 249982 - RNA, 19 nt, Homo sapiens
gaacaagccuccaggauuc

SEQ ID NO: 249983 - RNA, 19 nt, Homo sapiens
ggacuugugugcccuuaua

SEQ ID NO: 249984 - RNA, 19 nt, Homo sapiens
gaacacaaaggcacuauaa

SEQ ID NO: 249985 - RNA, 19 nt, Homo sapiens
gaacuuccuuugacuuauu

SEQ ID NO: 249986 - RNA, 19 nt, Homo sapiens
ggaggaagauccaaacaga

SEQ ID NO: 249987 - RNA, 19 nt, Homo sapiens
gaagacacauuccuaguuc

SEQ ID NO: 249988 - RNA, 19 nt, Homo sapiens
gggccuagcuuucauuuga

SEQ ID NO: 249989 - RNA, 19 nt, Homo sapiens
gaagaagaguuugcaaaug

SEQ ID NO: 249990 - RNA, 19 nt, Homo sapiens
uaagaaagcaagccaauuu

SEQ ID NO: 249991 - RNA, 19 nt, Homo sapiens
uagagaaagugaccuauuu

SEQ ID NO: 249992 - RNA, 19 nt, Homo sapiens
caauugaucuguaauguca

SEQ ID NO: 249993 - RNA, 19 nt, Homo sapiens
gcagggaugucacgucuug

SEQ ID NO: 249994 - RNA, 19 nt, Homo sapiens
ggauauaagcuguucauuu

SEQ ID NO: 249995 - RNA, 19 nt, Homo sapiens
gcaaaccucuacuucuuga

SEQ ID NO: 249996 - RNA, 19 nt, Homo sapiens
guucgucccuguccucuua

SEQ ID NO: 249997 - RNA, 19 nt, Homo sapiens
ggaauugauccacuucuua

SEQ ID NO: 249998 - RNA, 19 nt, Homo sapiens
uuucauagcucuacugauu

SEQ ID NO: 249999 - RNA, 19 nt, Homo sapiens
gaagaaagggcaagaagga

SEQ ID NO: 250000 - RNA, 19 nt, Homo sapiens
gaagggagacauauucuug

SEQ ID NO: 250001 - RNA, 19 nt, Homo sapiens
uaaaugcccucucugaaug

SEQ ID NO: 250002 - RNA, 19 nt, Homo sapiens
gaaugagccuaacuuaugu

SEQ ID NO: 250003 - RNA, 19 nt, Homo sapiens
ucucuugccuuucuuauuu

SEQ ID NO: 250004 - RNA, 19 nt, Homo sapiens
gcaaauagccauguauaau

SEQ ID NO: 250005 - RNA, 19 nt, Homo sapiens
gaauugauccacuucuuaa

SEQ ID NO: 250006 - RNA, 19 nt, Homo sapiens
gaacuauacuugucaugca

SEQ ID NO: 250007 - RNA, 19 nt, Homo sapiens
gacaaggccuucuccaaga

SEQ ID NO: 250008 - RNA, 19 nt, Homo sapiens
gagcaaauagccauguaua

SEQ ID NO: 250009 - RNA, 19 nt, Homo sapiens
cagcauauauccaguuaau

SEQ ID NO: 250010 - RNA, 19 nt, Homo sapiens
gaaguggaaugggucagua

SEQ ID NO: 250011 - RNA, 19 nt, Homo sapiens
ggagaaugagccuaacuua

SEQ ID NO: 250012 - RNA, 19 nt, Homo sapiens
ggaaauagccaccgucuac

SEQ ID NO: 250013 - RNA, 19 nt, Homo sapiens
ucacagugcuuaauauauc

SEQ ID NO: 250014 - RNA, 19 nt, Homo sapiens
aauggcagcuggaauuuaa

SEQ ID NO: 250015 - RNA, 19 nt, Homo sapiens
gagaggugcugcaggcaaa

SEQ ID NO: 250016 - RNA, 19 nt, Homo sapiens
uaacccaaaugaacacaaa

SEQ ID NO: 250017 - RNA, 19 nt, Homo sapiens
gaccaagaauuacaaguag

SEQ ID NO: 250018 - RNA, 19 nt, Homo sapiens
caaauagccauguauaaug

SEQ ID NO: 250019 - RNA, 19 nt, Homo sapiens
ggagaggacuuuugguuuu

SEQ ID NO: 250020 - RNA, 19 nt, Homo sapiens
ggaguacccucaucacagu

SEQ ID NO: 250021 - RNA, 19 nt, Homo sapiens
ggaaaauccugcaaacaaa

SEQ ID NO: 250022 - RNA, 19 nt, Homo sapiens
aaacuuagguuagugacaa

SEQ ID NO: 250023 - RNA, 19 nt, Homo sapiens
guagagggcuugggaagau

SEQ ID NO: 250024 - RNA, 19 nt, Homo sapiens
agaaugagccuaacuuaug

SEQ ID NO: 250025 - RNA, 19 nt, Homo sapiens
gcagggaauugauccacuu

SEQ ID NO: 250026 - RNA, 19 nt, Homo sapiens
acagaaaagugcaaaguua

SEQ ID NO: 250027 - RNA, 19 nt, Homo sapiens
ugaccaagaauuacaagua

SEQ ID NO: 250028 - RNA, 19 nt, Homo sapiens
caauaaaugcccucucuga

SEQ ID NO: 250029 - RNA, 19 nt, Homo sapiens
ggucaguaauugaugaaga

SEQ ID NO: 250030 - RNA, 19 nt, Homo sapiens
gcacguuugugagaagaaa

SEQ ID NO: 250031 - RNA, 19 nt, Homo sapiens
uggaauugcugcucucuga

SEQ ID NO: 250032 - RNA, 19 nt, Homo sapiens
uaucggaaauugaaaguag

SEQ ID NO: 250033 - RNA, 19 nt, Homo sapiens
ggaggaagaagacacauuc

SEQ ID NO: 250034 - RNA, 19 nt, Homo sapiens
gacaagaaucaauggauaa

SEQ ID NO: 250035 - RNA, 19 nt, Homo sapiens
gaauggcagcuggaauuua

SEQ ID NO: 250036 - RNA, 19 nt, Homo sapiens
cagaguucauggaauguaa

SEQ ID NO: 250037 - RNA, 19 nt, Homo sapiens
aaagaugcccuaaguguug

SEQ ID NO: 250038 - RNA, 19 nt, Homo sapiens
gaagugaccgagucuagga

SEQ ID NO: 250039 - RNA, 19 nt, Homo sapiens
gggaauugauccacuucuu

SEQ ID NO: 250040 - RNA, 19 nt, Homo sapiens
gcaagacaccuguaucuac

SEQ ID NO: 250041 - RNA, 19 nt, Homo sapiens
ccaagaagaauaugaaagu

SEQ ID NO: 250042 - RNA, 19 nt, Homo sapiens
ggaagaaugucagguacca

SEQ ID NO: 250043 - RNA, 19 nt, Homo sapiens
caucacagugcuuaauaua

SEQ ID NO: 250044 - RNA, 19 nt, Homo sapiens
ggaaugggucaguaauuga

SEQ ID NO: 250045 - RNA, 19 nt, Homo sapiens
gagaaugagccuaacuuau

SEQ ID NO: 250046 - RNA, 19 nt, Homo sapiens
gaggcaaacauuucuuaaa

SEQ ID NO: 250047 - RNA, 19 nt, Homo sapiens
ggaccacagucugcaaaga

SEQ ID NO: 250048 - RNA, 19 nt, Homo sapiens
cagaagcacaugauuggua

SEQ ID NO: 250049 - RNA, 19 nt, Homo sapiens
cagcaugcaucacggauca

SEQ ID NO: 250050 - RNA, 19 nt, Homo sapiens
gugaacuuccuuugacuua

SEQ ID NO: 250051 - RNA, 19 nt, Homo sapiens
gaaagggcaagaaggaaau

SEQ ID NO: 250052 - RNA, 19 nt, Homo sapiens
gcauggagacagcgaacua

SEQ ID NO: 250053 - RNA, 19 nt, Homo sapiens
ccagggcacuucagaguag

SEQ ID NO: 250054 - RNA, 19 nt, Homo sapiens
aggagaaacugcaaagaga

SEQ ID NO: 250055 - RNA, 19 nt, Homo sapiens
guuaauauauccagucacu

SEQ ID NO: 250056 - RNA, 19 nt, Homo sapiens
uggaaugggucaguaauug

SEQ ID NO: 250057 - RNA, 19 nt, Homo sapiens
gagcccagcuaaugagaca

SEQ ID NO: 250058 - RNA, 19 nt, Homo sapiens
cuacagauggcuuaguuaa

SEQ ID NO: 250059 - RNA, 19 nt, Homo sapiens
gacggucaccuucaucuaa

SEQ ID NO: 250060 - RNA, 19 nt, Homo sapiens
caagaagaauaugaaagug

SEQ ID NO: 250061 - RNA, 19 nt, Homo sapiens
gaucaauagacuguacuua

SEQ ID NO: 250062 - RNA, 19 nt, Homo sapiens
gcaccaaauucauguacag

SEQ ID NO: 250063 - RNA, 19 nt, Homo sapiens
uagaauggcagcuggaauu

SEQ ID NO: 250064 - RNA, 19 nt, Homo sapiens
ugaugaugaccaagaauua

SEQ ID NO: 250065 - RNA, 19 nt, Homo sapiens
ccaaauuccaaacuucuaa

SEQ ID NO: 250066 - RNA, 19 nt, Homo sapiens
ggacuugagccuccauuuc

SEQ ID NO: 250067 - RNA, 19 nt, Homo sapiens
gaggaagggagacauauuc

SEQ ID NO: 250068 - RNA, 19 nt, Homo sapiens
uggaagggaugacuacguu

SEQ ID NO: 250069 - RNA, 19 nt, Homo sapiens
ucacuaauuuccagaagca

SEQ ID NO: 250070 - RNA, 19 nt, Homo sapiens
aagaagaguuugcaaaugc

SEQ ID NO: 250071 - RNA, 19 nt, Homo sapiens
uaggaggccuucucgcauu

SEQ ID NO: 250072 - RNA, 19 nt, Homo sapiens
uguuugaacugccaagaaa

SEQ ID NO: 250073 - RNA, 19 nt, Homo sapiens
ugagugacauugcuuacug

SEQ ID NO: 250074 - RNA, 19 nt, Homo sapiens
uugcaaaccucuacuucuu

SEQ ID NO: 250075 - RNA, 19 nt, Homo sapiens
caggauucaucaacacaaa

SEQ ID NO: 250076 - RNA, 19 nt, Homo sapiens
ugaagaagaguuugcaaau

SEQ ID NO: 250077 - RNA, 19 nt, Homo sapiens
ggacacaagcacaguuuua

SEQ ID NO: 250078 - RNA, 19 nt, Homo sapiens
gacaccaaauuccaaacuu

SEQ ID NO: 250079 - RNA, 19 nt, Homo sapiens
gcaggagaauugcuugaac

SEQ ID NO: 250080 - RNA, 19 nt, Homo sapiens
aagacaagguucuggaaga

SEQ ID NO: 250081 - RNA, 19 nt, Homo sapiens
gaacaaaccaugucucaaa

SEQ ID NO: 250082 - RNA, 19 nt, Homo sapiens
gaaauauacuugcuccaaa

SEQ ID NO: 250083 - RNA, 19 nt, Homo sapiens
guacaaagcugugaaggaa

SEQ ID NO: 250084 - RNA, 19 nt, Homo sapiens
aaagacagcuguuucaauu

SEQ ID NO: 250085 - RNA, 19 nt, Homo sapiens
caaaccaugucucaaauuu

SEQ ID NO: 250086 - RNA, 19 nt, Homo sapiens
ugaaagaaaucuccuaaug

SEQ ID NO: 250087 - RNA, 19 nt, Homo sapiens
gaaacaagaacucagauuu

SEQ ID NO: 250088 - RNA, 19 nt, Homo sapiens
ggaagaagaagaauuugua

SEQ ID NO: 250089 - RNA, 19 nt, Homo sapiens
ggacguacguuucaucuca

SEQ ID NO: 250090 - RNA, 19 nt, Homo sapiens
gcaaagugaugccucagaa

SEQ ID NO: 250091 - RNA, 19 nt, Homo sapiens
gaucaucaccuaagaacua

SEQ ID NO: 250092 - RNA, 19 nt, Homo sapiens
ccucagugcucaacuauuu

SEQ ID NO: 250093 - RNA, 19 nt, Homo sapiens
ggagcagccuuuccuauga

SEQ ID NO: 250094 - RNA, 19 nt, Homo sapiens
gaagauggccaauagagaa

SEQ ID NO: 250095 - RNA, 19 nt, Homo sapiens
caacuauaccugcauguua

SEQ ID NO: 250096 - RNA, 19 nt, Homo sapiens
gcaaagacuuguucaaugc

SEQ ID NO: 250097 - RNA, 19 nt, Homo sapiens
ucaagaaaguuaccucuga

SEQ ID NO: 250098 - RNA, 19 nt, Homo sapiens
ggucaugaguuuccgagua

SEQ ID NO: 250099 - RNA, 19 nt, Homo sapiens
gaggaucacuuguccaaau

SEQ ID NO: 250100 - RNA, 19 nt, Homo sapiens
ggacuugucuucuauacca

SEQ ID NO: 250101 - RNA, 19 nt, Homo sapiens
uaaaggacuugucuucuau

SEQ ID NO: 250102 - RNA, 19 nt, Homo sapiens
ggaauagucuagucaccaa

SEQ ID NO: 250103 - RNA, 19 nt, Homo sapiens
uuaaaggacuugucuucua

SEQ ID NO: 250104 - RNA, 19 nt, Homo sapiens
caucucagguaauuuauga

SEQ ID NO: 250105 - RNA, 19 nt, Homo sapiens
ucuauuaacccuucacuua

SEQ ID NO: 250106 - RNA, 19 nt, Homo sapiens
gaacugugauauauagagu

SEQ ID NO: 250107 - RNA, 19 nt, Homo sapiens
ccagauaagcuuugaauau

SEQ ID NO: 250108 - RNA, 19 nt, Homo sapiens
ggcaaagacuuguucaaug

SEQ ID NO: 250109 - RNA, 19 nt, Homo sapiens
gaacagaagaugaaacaag

SEQ ID NO: 250110 - RNA, 19 nt, Homo sapiens
caagagaauuuguuucaag

SEQ ID NO: 250111 - RNA, 19 nt, Homo sapiens
acaauuacucccucuauua

SEQ ID NO: 250112 - RNA, 19 nt, Homo sapiens
gcagacacauuuagaaacu

SEQ ID NO: 250113 - RNA, 19 nt, Homo sapiens
aaagaaaucuccuaauggu

SEQ ID NO: 250114 - RNA, 19 nt, Homo sapiens
gaaagaaaucuccuaaugg

SEQ ID NO: 250115 - RNA, 19 nt, Homo sapiens
ggucuaagccucccaauag

SEQ ID NO: 250116 - RNA, 19 nt, Homo sapiens
agaaagaugugcugugguu

SEQ ID NO: 250117 - RNA, 19 nt, Homo sapiens
guaaaugaaucuugguauc

SEQ ID NO: 250118 - RNA, 19 nt, Homo sapiens
gagcagggccucucguauu

SEQ ID NO: 250119 - RNA, 19 nt, Homo sapiens
gaucacuuguccaaaugua

SEQ ID NO: 250120 - RNA, 19 nt, Homo sapiens
caaugacacuggcaacuau

SEQ ID NO: 250121 - RNA, 19 nt, Homo sapiens
ccuaagaacuagaacauca

SEQ ID NO: 250122 - RNA, 19 nt, Homo sapiens
gauacaagcugugcaucuu

SEQ ID NO: 250123 - RNA, 19 nt, Homo sapiens
ccucucagcuucccaagaa

SEQ ID NO: 250124 - RNA, 19 nt, Homo sapiens
uaaggaacacuacauauug

SEQ ID NO: 250125 - RNA, 19 nt, Homo sapiens
gaacaagaacaaaccaugu

SEQ ID NO: 250126 - RNA, 19 nt, Homo sapiens
gaaugaauuuggauacaag

SEQ ID NO: 250127 - RNA, 19 nt, Homo sapiens
caauuacucccucuauuaa

SEQ ID NO: 250128 - RNA, 19 nt, Homo sapiens
uaaccucagugcucaacua

SEQ ID NO: 250129 - RNA, 19 nt, Homo sapiens
agaagucacugucaaugaa

SEQ ID NO: 250130 - RNA, 19 nt, Homo sapiens
ccacuuaggaugauacaaa

SEQ ID NO: 250131 - RNA, 19 nt, Homo sapiens
gagcagccuuuccuaugaa

SEQ ID NO: 250132 - RNA, 19 nt, Homo sapiens
gaaagugccagcuccaaga

SEQ ID NO: 250133 - RNA, 19 nt, Homo sapiens
gcaagagaauuuguuucaa

SEQ ID NO: 250134 - RNA, 19 nt, Homo sapiens
uauuugaacuguugaguga

SEQ ID NO: 250135 - RNA, 19 nt, Homo sapiens
gaaaggcaucgucauguga

SEQ ID NO: 250136 - RNA, 19 nt, Homo sapiens
cuauugaugucaccauuaa

SEQ ID NO: 250137 - RNA, 19 nt, Homo sapiens
ccaggacucugacuguaaa

SEQ ID NO: 250138 - RNA, 19 nt, Homo sapiens
caucgggcauuaauugauu

SEQ ID NO: 250139 - RNA, 19 nt, Homo sapiens
auacauauccacacacaua

SEQ ID NO: 250140 - RNA, 19 nt, Homo sapiens
ccucaucucagguaauuua

SEQ ID NO: 250141 - RNA, 19 nt, Homo sapiens
ggcauuaauugauuuccua

SEQ ID NO: 250142 - RNA, 19 nt, Homo sapiens
gaugagacuuugagcuuca

SEQ ID NO: 250143 - RNA, 19 nt, Homo sapiens
ggaacuggcuugugguuuu

SEQ ID NO: 250144 - RNA, 19 nt, Homo sapiens
ggaaauauacuugcuccaa

SEQ ID NO: 250145 - RNA, 19 nt, Homo sapiens
gagaagucacugucaauga

SEQ ID NO: 250146 - RNA, 19 nt, Homo sapiens
caaauaagucaguaugaga

SEQ ID NO: 250147 - RNA, 19 nt, Homo sapiens
caacaucaacgucauuuua

SEQ ID NO: 250148 - RNA, 19 nt, Homo sapiens
gagaaugaauuuggauaca

SEQ ID NO: 250149 - RNA, 19 nt, Homo sapiens
caagaaaggcaucgucaug

SEQ ID NO: 250150 - RNA, 19 nt, Homo sapiens
guauauaaauccacaugca

SEQ ID NO: 250151 - RNA, 19 nt, Homo sapiens
gauaaucaaggccuacauu

SEQ ID NO: 250152 - RNA, 19 nt, Homo sapiens
uggaacagaugaaaccauu

SEQ ID NO: 250153 - RNA, 19 nt, Homo sapiens
ccaaaggaccauucucuug

SEQ ID NO: 250154 - RNA, 19 nt, Homo sapiens
guguguauguguauguaua

SEQ ID NO: 250155 - RNA, 19 nt, Homo sapiens
agaaagauaucaucaacgu

SEQ ID NO: 250156 - RNA, 19 nt, Homo sapiens
ccuagaagccucacucuug

SEQ ID NO: 250157 - RNA, 19 nt, Homo sapiens
gcagacgccuccugguugu

SEQ ID NO: 250158 - RNA, 19 nt, Homo sapiens
cagccaaggugaagcagaa

SEQ ID NO: 250159 - RNA, 19 nt, Homo sapiens
gugcauaaacuguauauag

SEQ ID NO: 250160 - RNA, 19 nt, Homo sapiens
aacagaagaugaaacaaga

SEQ ID NO: 250161 - RNA, 19 nt, Homo sapiens
gagaggagcuacucauucc

SEQ ID NO: 250162 - RNA, 19 nt, Homo sapiens
ggcccacucuccucaauga

SEQ ID NO: 250163 - RNA, 19 nt, Homo sapiens
gcaaacagggaauagucua

SEQ ID NO: 250164 - RNA, 19 nt, Homo sapiens
gaaacuaagcuauguuaac

SEQ ID NO: 250165 - RNA, 19 nt, Homo sapiens
uauaucgcauugcucauuu

SEQ ID NO: 250166 - RNA, 19 nt, Homo sapiens
uccagucaauuccugauua

SEQ ID NO: 250167 - RNA, 19 nt, Homo sapiens
gaaggaaacgaaggugaaa

SEQ ID NO: 250168 - RNA, 19 nt, Homo sapiens
ggcuagagaugguccuauu

SEQ ID NO: 250169 - RNA, 19 nt, Homo sapiens
ggaccauucucuugccaau

SEQ ID NO: 250170 - RNA, 19 nt, Homo sapiens
agugauaguugucauaguu

SEQ ID NO: 250171 - RNA, 19 nt, Homo sapiens
uaaccuugcuaaugugaau

SEQ ID NO: 250172 - RNA, 19 nt, Homo sapiens
cccaauagggauaaauuua

SEQ ID NO: 250173 - RNA, 19 nt, Homo sapiens
gaacagaugaaaccauuuu

SEQ ID NO: 250174 - RNA, 19 nt, Homo sapiens
gaugaaacaagaacucaga

SEQ ID NO: 250175 - RNA, 19 nt, Homo sapiens
guuguuacauauccagaaa

SEQ ID NO: 250176 - RNA, 19 nt, Homo sapiens
aacuauaccugcauguuaa

SEQ ID NO: 250177 - RNA, 19 nt, Homo sapiens
gaaucuugguauccuguga

SEQ ID NO: 250178 - RNA, 19 nt, Homo sapiens
guucuugccuucccuaagu

SEQ ID NO: 250179 - RNA, 19 nt, Homo sapiens
ccacacacauacauuacau

SEQ ID NO: 250180 - RNA, 19 nt, Homo sapiens
ucuuauaucuccacaaaca

SEQ ID NO: 250181 - RNA, 19 nt, Homo sapiens
aaagacagcuguuucaauu

SEQ ID NO: 250182 - RNA, 19 nt, Homo sapiens
gaaacaagaacucagauuu

SEQ ID NO: 250183 - RNA, 19 nt, Homo sapiens
ggacguacguuucaucuca

SEQ ID NO: 250184 - RNA, 19 nt, Homo sapiens
gcaaagugaugccucagaa

SEQ ID NO: 250185 - RNA, 19 nt, Homo sapiens
gaucaucaccuaagaacua

SEQ ID NO: 250186 - RNA, 19 nt, Homo sapiens
caacuauaccugcauguua

SEQ ID NO: 250187 - RNA, 19 nt, Homo sapiens
ucaagaaaguuaccucuga

SEQ ID NO: 250188 - RNA, 19 nt, Homo sapiens
gaggaucacuuguccaaau

SEQ ID NO: 250189 - RNA, 19 nt, Homo sapiens
ucucucagcuccaaauuaa

SEQ ID NO: 250190 - RNA, 19 nt, Homo sapiens
gaacagaagaugaaacaag

SEQ ID NO: 250191 - RNA, 19 nt, Homo sapiens
agaaagaugugcugugguu

SEQ ID NO: 250192 - RNA, 19 nt, Homo sapiens
gaucacuuguccaaaugua

SEQ ID NO: 250193 - RNA, 19 nt, Homo sapiens
caaugacacuggcaacuau

SEQ ID NO: 250194 - RNA, 19 nt, Homo sapiens
cagaagugcugcuccuaaa

SEQ ID NO: 250195 - RNA, 19 nt, Homo sapiens
gaaagggaauuauauaccu

SEQ ID NO: 250196 - RNA, 19 nt, Homo sapiens
ccucucagcuucccaagaa

SEQ ID NO: 250197 - RNA, 19 nt, Homo sapiens
uaaggaacacuacauauug

SEQ ID NO: 250198 - RNA, 19 nt, Homo sapiens
ccuaagaacuagaacauca

SEQ ID NO: 250199 - RNA, 19 nt, Homo sapiens
gcaacuaauuaagguauug

SEQ ID NO: 250200 - RNA, 19 nt, Homo sapiens
uagcagccauccaauugua

SEQ ID NO: 250201 - RNA, 19 nt, Homo sapiens
cuauugaugucaccauuaa

SEQ ID NO: 250202 - RNA, 19 nt, Homo sapiens
ccaggacucugacuguaaa

SEQ ID NO: 250203 - RNA, 19 nt, Homo sapiens
gaaaggcaucgucauguga

SEQ ID NO: 250204 - RNA, 19 nt, Homo sapiens
ccuaagacuuucggaauuu

SEQ ID NO: 250205 - RNA, 19 nt, Homo sapiens
aaggagagauugagaacaa

SEQ ID NO: 250206 - RNA, 19 nt, Homo sapiens
gguaauagaugcggucagu

SEQ ID NO: 250207 - RNA, 19 nt, Homo sapiens
agcauuaucuguaguugua

SEQ ID NO: 250208 - RNA, 19 nt, Homo sapiens
caagaaaggcaucgucaug

SEQ ID NO: 250209 - RNA, 19 nt, Homo sapiens
ccaauuguaugcaacuaau

SEQ ID NO: 250210 - RNA, 19 nt, Homo sapiens
guacagugagacacaauuu

SEQ ID NO: 250211 - RNA, 19 nt, Homo sapiens
cagccaaggugaagcagaa

SEQ ID NO: 250212 - RNA, 19 nt, Homo sapiens
gugcauaaacuguauauag

SEQ ID NO: 250213 - RNA, 19 nt, Homo sapiens
ccuagaagccucacucuug

SEQ ID NO: 250214 - RNA, 19 nt, Homo sapiens
aacagaagaugaaacaaga

SEQ ID NO: 250215 - RNA, 19 nt, Homo sapiens
gagaggagcuacucauucc

SEQ ID NO: 250216 - RNA, 19 nt, Homo sapiens
ggcccacucuccucaauga

SEQ ID NO: 250217 - RNA, 19 nt, Homo sapiens
caucuaacccauaguaaug

SEQ ID NO: 250218 - RNA, 19 nt, Homo sapiens
gaugaaacaagaacucaga

SEQ ID NO: 250219 - RNA, 19 nt, Homo sapiens
guuguuacauauccagaaa

SEQ ID NO: 250220 - RNA, 19 nt, Homo sapiens
aacuauaccugcauguuaa

SEQ ID NO: 250221 - RNA, 19 nt, Homo sapiens
uaauagaugcggucaguga

SEQ ID NO: 250222 - RNA, 19 nt, Homo sapiens
ggagaggagcuacucauuc

SEQ ID NO: 250223 - RNA, 19 nt, Homo sapiens
gaagcauuaucuguaguug

SEQ ID NO: 250224 - RNA, 19 nt, Homo sapiens
gagcuacucauucccugua

SEQ ID NO: 250225 - RNA, 19 nt, Homo sapiens
gacucugacuguaaaggua

SEQ ID NO: 250226 - RNA, 19 nt, Homo sapiens
uuauaaagccuucuuguca

SEQ ID NO: 250227 - RNA, 19 nt, Homo sapiens
auucaaagcuaccaaagau

SEQ ID NO: 250228 - RNA, 19 nt, Homo sapiens
ucaaaccgacuaucacuug

SEQ ID NO: 250229 - RNA, 19 nt, Homo sapiens
gaaacucccagugcauaaa

SEQ ID NO: 250230 - RNA, 19 nt, Homo sapiens
gccuuacucugaucuggua

SEQ ID NO: 250231 - RNA, 19 nt, Homo sapiens
caaaggcgaaguugccaaa

SEQ ID NO: 250232 - RNA, 19 nt, Homo sapiens
ccgagaaccgcauuaguaa

SEQ ID NO: 250233 - RNA, 19 nt, Homo sapiens
caaaggaugacacuucugu

SEQ ID NO: 250234 - RNA, 19 nt, Homo sapiens
uuagaagcauuaucuguag

SEQ ID NO: 250235 - RNA, 19 nt, Homo sapiens
gaccuaagacuuucggaau

SEQ ID NO: 250236 - RNA, 19 nt, Homo sapiens
cgacgugaguacagugaga

SEQ ID NO: 250237 - RNA, 19 nt, Homo sapiens
guaccguaaugcccaaaug

SEQ ID NO: 250238 - RNA, 19 nt, Homo sapiens
agaaaggcaucgucaugug

SEQ ID NO: 250239 - RNA, 19 nt, Homo sapiens
cccgagaaccgcauuagua

SEQ ID NO: 250240 - RNA, 19 nt, Homo sapiens
gaccuugaggagccaauua

SEQ ID NO: 250241 - RNA, 19 nt, Homo sapiens
gaagaugaaacaagaacuc

SEQ ID NO: 250242 - RNA, 19 nt, Homo sapiens
gaugucaccauuaacgaaa

SEQ ID NO: 250243 - RNA, 19 nt, Homo sapiens
gacuaucacuugguauaug

SEQ ID NO: 250244 - RNA, 19 nt, Homo sapiens
acucugaucugguauugga

SEQ ID NO: 250245 - RNA, 19 nt, Homo sapiens
guaugcaacuaauuaaggu

SEQ ID NO: 250246 - RNA, 19 nt, Homo sapiens
ugcaucaucugaccuaaga

SEQ ID NO: 250247 - RNA, 19 nt, Homo sapiens
uagaugcggucagugauga

SEQ ID NO: 250248 - RNA, 19 nt, Homo sapiens
caccaggacucugacugua

SEQ ID NO: 250249 - RNA, 19 nt, Homo sapiens
cuugguauaugggcuguua

SEQ ID NO: 250250 - RNA, 19 nt, Homo sapiens
gcauucagaggaucacuug

SEQ ID NO: 250251 - RNA, 19 nt, Homo sapiens
guagagccacauauuguug

SEQ ID NO: 250252 - RNA, 19 nt, Homo sapiens
ucaaagcuaccaaagauag

SEQ ID NO: 250253 - RNA, 19 nt, Homo sapiens
gauauuguuaguaccguaa

SEQ ID NO: 250254 - RNA, 19 nt, Homo sapiens
cuaaugaucauguggucua

SEQ ID NO: 250255 - RNA, 19 nt, Homo sapiens
gagaaccgcauuaguaagg

SEQ ID NO: 250256 - RNA, 19 nt, Homo sapiens
gaggcaaauccaaguguuu

SEQ ID NO: 250257 - RNA, 19 nt, Homo sapiens
aauagcagccauccaauug

SEQ ID NO: 250258 - RNA, 19 nt, Homo sapiens
uaauagcagccauccaauu

SEQ ID NO: 250259 - RNA, 19 nt, Homo sapiens
gcaucuaacccauaguaau

SEQ ID NO: 250260 - RNA, 19 nt, Homo sapiens
gcaacuauaccugcauguu

SEQ ID NO: 250261 - RNA, 19 nt, Homo sapiens
caucugaccuaagacuuuc

SEQ ID NO: 250262 - RNA, 19 nt, Homo sapiens
ggagagauugagaacaaga

SEQ ID NO: 250263 - RNA, 19 nt, Homo sapiens
gaagcagaaagguaauaga

SEQ ID NO: 250264 - RNA, 19 nt, Homo sapiens
ccucauugccuuaauuuca

SEQ ID NO: 250265 - RNA, 19 nt, Homo sapiens
ucaaugacacuggcaacua

SEQ ID NO: 250266 - RNA, 19 nt, Homo sapiens
ucagaagugcugcuccuaa

SEQ ID NO: 250267 - RNA, 19 nt, Homo sapiens
auaaagccuucuugucaga

SEQ ID NO: 250268 - RNA, 19 nt, Homo sapiens
aaucauucaugguagaguu

SEQ ID NO: 250269 - RNA, 19 nt, Homo sapiens
gguagagccacauauuguu

SEQ ID NO: 250270 - RNA, 19 nt, Homo sapiens
gacggcaucuaacccauag

SEQ ID NO: 250271 - RNA, 19 nt, Homo sapiens
gcauuaguaaggagaaaga

SEQ ID NO: 250272 - RNA, 19 nt, Homo sapiens
aaccgacuaucacuuggua

SEQ ID NO: 250273 - RNA, 19 nt, Homo sapiens
cagcuggccuuacucugau

SEQ ID NO: 250274 - RNA, 19 nt, Homo sapiens
ugaggcaaauccaaguguu

SEQ ID NO: 250275 - RNA, 19 nt, Homo sapiens
caaauaacagaaagggaau

SEQ ID NO: 250276 - RNA, 19 nt, Homo sapiens
ugguagaguuuaagaguca

SEQ ID NO: 250277 - RNA, 19 nt, Homo sapiens
cgacggcaucuaacccaua

SEQ ID NO: 250278 - RNA, 19 nt, Homo sapiens
ccaaagcagccaaggugaa

SEQ ID NO: 250279 - RNA, 19 nt, Homo sapiens
uauggaauccugcaaagug

SEQ ID NO: 250280 - RNA, 19 nt, Homo sapiens
cggcaucuaacccauagua

SEQ ID NO: 250281 - RNA, 19 nt, Homo sapiens
gaaaugauggugaaaguaa

SEQ ID NO: 250282 - RNA, 19 nt, Homo sapiens
gcacaaagcccuuccaugu

SEQ ID NO: 250283 - RNA, 19 nt, Homo sapiens
ggaauaaauugcuccuuga

SEQ ID NO: 250284 - RNA, 19 nt, Homo sapiens
gggagaggcugaggacuua

SEQ ID NO: 250285 - RNA, 19 nt, Homo sapiens
gcgaaugaaugcuguauau

SEQ ID NO: 250286 - RNA, 19 nt, Homo sapiens
cagaagaccuccuguccua

SEQ ID NO: 250287 - RNA, 19 nt, Homo sapiens
ggagagcccuucauuugga

SEQ ID NO: 250288 - RNA, 19 nt, Homo sapiens
gcaggaaacaugacucgua

SEQ ID NO: 250289 - RNA, 19 nt, Homo sapiens
ggaaacaugacucguauau

SEQ ID NO: 250290 - RNA, 19 nt, Homo sapiens
gaaugaaugcuguauaugu

SEQ ID NO: 250291 - RNA, 19 nt, Homo sapiens
gcaccuagccucgcucuug

SEQ ID NO: 250292 - RNA, 19 nt, Homo sapiens
caggaaacaugacucguau

SEQ ID NO: 250293 - RNA, 19 nt, Homo sapiens
gcacugaggaccagccauu

SEQ ID NO: 250294 - RNA, 19 nt, Homo sapiens
ucacugaccugagcgagaa

SEQ ID NO: 250295 - RNA, 19 nt, Homo sapiens
gcaaggaccaaaugucaau

SEQ ID NO: 250296 - RNA, 19 nt, Homo sapiens
gacaagcgcuucgccuuca

SEQ ID NO: 250297 - RNA, 19 nt, Homo sapiens
gaagaccuccuguccuaug

SEQ ID NO: 250298 - RNA, 19 nt, Homo sapiens
gaggaacaaccaacuaguu

SEQ ID NO: 250299 - RNA, 19 nt, Homo sapiens
gugaaaugauggugaaagu

SEQ ID NO: 250300 - RNA, 19 nt, Homo sapiens
ucagaaggcgucacaagaa

SEQ ID NO: 250301 - RNA, 19 nt, Homo sapiens
gcugaggacuuaaaauauu

SEQ ID NO: 250302 - RNA, 19 nt, Homo sapiens
gcccuucauuuggagauua

SEQ ID NO: 250303 - RNA, 19 nt, Homo sapiens
gaugcaagccuucagaauc

SEQ ID NO: 250304 - RNA, 19 nt, Homo sapiens
gcagguacucagcgaauga

SEQ ID NO: 250305 - RNA, 19 nt, Homo sapiens
gaacagaaagcaggacaag

SEQ ID NO: 250306 - RNA, 19 nt, Homo sapiens
uaaauugcuccuugacauu

SEQ ID NO: 250307 - RNA, 19 nt, Homo sapiens
gcaguacuuuaccuccuau

SEQ ID NO: 250308 - RNA, 19 nt, Homo sapiens
uauguugggugcaaaguuc

SEQ ID NO: 250309 - RNA, 19 nt, Homo sapiens
cuuggagacuuguaugaaa

SEQ ID NO: 250310 - RNA, 19 nt, Homo sapiens
gaccugagcgagaacagaa

SEQ ID NO: 250311 - RNA, 19 nt, Homo sapiens
auaaauugcuccuugacau

SEQ ID NO: 250312 - RNA, 19 nt, Homo sapiens
uacuuuaccuccuaucaga

SEQ ID NO: 250313 - RNA, 19 nt, Homo sapiens
gagaggcugaggacuuaaa

SEQ ID NO: 250314 - RNA, 19 nt, Homo sapiens
gaauggucuuucuaaugug

SEQ ID NO: 250315 - RNA, 19 nt, Homo sapiens
gaaacaugacucguauaug

SEQ ID NO: 250316 - RNA, 19 nt, Homo sapiens
ugaguuagagucuggaaga

SEQ ID NO: 250317 - RNA, 19 nt, Homo sapiens
caagaugcaagccuucaga

SEQ ID NO: 250318 - RNA, 19 nt, Homo sapiens
gcacuuggagacuuguaug

SEQ ID NO: 250319 - RNA, 19 nt, Homo sapiens
ugugaugucccaacuugua

SEQ ID NO: 250320 - RNA, 19 nt, Homo sapiens
uagaugugguacccauuga

SEQ ID NO: 250321 - RNA, 19 nt, Homo sapiens
gagaaaauccagcaagaug

SEQ ID NO: 250322 - RNA, 19 nt, Homo sapiens
gggagaaaauccagcaaga

SEQ ID NO: 250323 - RNA, 19 nt, Homo sapiens
cagaaggcgucacaagaac

SEQ ID NO: 250324 - RNA, 19 nt, Homo sapiens
ggaggcaguuaacaucacu

SEQ ID NO: 250325 - RNA, 19 nt, Homo sapiens
guacucagcgaaugaaugc

SEQ ID NO: 250326 - RNA, 19 nt, Homo sapiens
ugaaaugauggugaaagua

SEQ ID NO: 250327 - RNA, 19 nt, Homo sapiens
gaaaagaccaguccaugag

SEQ ID NO: 250328 - RNA, 19 nt, Homo sapiens
ccaugucgccucugcauuc

SEQ ID NO: 250329 - RNA, 19 nt, Homo sapiens
ugucaagucuggugaugag

SEQ ID NO: 250330 - RNA, 19 nt, Homo sapiens
uuugugaugucccaacuug

SEQ ID NO: 250331 - RNA, 19 nt, Homo sapiens
caugcugccuccagaaugg

SEQ ID NO: 250332 - RNA, 19 nt, Homo sapiens
augcaagccuucagaaucu

SEQ ID NO: 250333 - RNA, 19 nt, Homo sapiens
agaugugccuguccugugu

SEQ ID NO: 250334 - RNA, 19 nt, Homo sapiens
ugacuucagcucuguuuua

SEQ ID NO: 250335 - RNA, 19 nt, Homo sapiens
ugcaguacuuuaccuccua

SEQ ID NO: 250336 - RNA, 19 nt, Homo sapiens
gugaugucccaacuuguaa

SEQ ID NO: 250337 - RNA, 19 nt, Homo sapiens
ucagcucuguuuuacaaua

SEQ ID NO: 250338 - RNA, 19 nt, Homo sapiens
ggagacuuguaugaaagau

SEQ ID NO: 250339 - RNA, 19 nt, Homo sapiens
ggauccaucaggccacuug

SEQ ID NO: 250340 - RNA, 19 nt, Homo sapiens
gcuggaggcaguuaacauc

SEQ ID NO: 250341 - RNA, 19 nt, Homo sapiens
ggucaccaaauucuacuuc

SEQ ID NO: 250342 - RNA, 19 nt, Homo sapiens
aagaccuccuguccuauga

SEQ ID NO: 250343 - RNA, 19 nt, Homo sapiens
gaauaaauugcuccuugac

SEQ ID NO: 250344 - RNA, 19 nt, Homo sapiens
uuugugaaaugauggugaa

SEQ ID NO: 250345 - RNA, 19 nt, Homo sapiens
gauagaugugguacccauu

SEQ ID NO: 250346 - RNA, 19 nt, Homo sapiens
gguacucagcgaaugaaug

SEQ ID NO: 250347 - RNA, 19 nt, Homo sapiens
aaauugcuccuugacauug

SEQ ID NO: 250348 - RNA, 19 nt, Homo sapiens
uaccuccuaucagaaguuu

SEQ ID NO: 250349 - RNA, 19 nt, Homo sapiens
ucaccaaauucuacuucca

SEQ ID NO: 250350 - RNA, 19 nt, Homo sapiens
cagcucuguuuuacaauaa

SEQ ID NO: 250351 - RNA, 19 nt, Homo sapiens
cuucagcucuguuuuacaa

SEQ ID NO: 250352 - RNA, 19 nt, Homo sapiens
ggcagguacucagcgaaug

SEQ ID NO: 250353 - RNA, 19 nt, Homo sapiens
guagagcuucuggcacuug

SEQ ID NO: 250354 - RNA, 19 nt, Homo sapiens
aaaugauggugaaaguaag

SEQ ID NO: 250355 - RNA, 19 nt, Homo sapiens
aauggucuuucuaaugugu

SEQ ID NO: 250356 - RNA, 19 nt, Homo sapiens
cgaaugaaugcuguauaug

SEQ ID NO: 250357 - RNA, 19 nt, Homo sapiens
uugcaaggaccaaauguca

SEQ ID NO: 250358 - RNA, 19 nt, Homo sapiens
gaaucugggauguuaacca

SEQ ID NO: 250359 - RNA, 19 nt, Homo sapiens
caugucgccucugcauuca

SEQ ID NO: 250360 - RNA, 19 nt, Homo sapiens
ccuucuaucugaggaacaa

SEQ ID NO: 250361 - RNA, 19 nt, Homo sapiens
gaaaugauggugaaaguaa

SEQ ID NO: 250362 - RNA, 19 nt, Homo sapiens
gcacaaagcccuuccaugu

SEQ ID NO: 250363 - RNA, 19 nt, Homo sapiens
ggaauaaauugcuccuuga

SEQ ID NO: 250364 - RNA, 19 nt, Homo sapiens
gggagaggcugaggacuua

SEQ ID NO: 250365 - RNA, 19 nt, Homo sapiens
gcgaaugaaugcuguauau

SEQ ID NO: 250366 - RNA, 19 nt, Homo sapiens
cagaagaccuccuguccua

SEQ ID NO: 250367 - RNA, 19 nt, Homo sapiens
ggagagcccuucauuugga

SEQ ID NO: 250368 - RNA, 19 nt, Homo sapiens
gcaggaaacaugacucgua

SEQ ID NO: 250369 - RNA, 19 nt, Homo sapiens
ggaaacaugacucguauau

SEQ ID NO: 250370 - RNA, 19 nt, Homo sapiens
gaaugaaugcuguauaugu

SEQ ID NO: 250371 - RNA, 19 nt, Homo sapiens
ggcuuuagcugacuuguau

SEQ ID NO: 250372 - RNA, 19 nt, Homo sapiens
gcaccuagccucgcucuug

SEQ ID NO: 250373 - RNA, 19 nt, Homo sapiens
caggaaacaugacucguau

SEQ ID NO: 250374 - RNA, 19 nt, Homo sapiens
gcacugaggaccagccauu

SEQ ID NO: 250375 - RNA, 19 nt, Homo sapiens
ugacuuguaugaagaagga

SEQ ID NO: 250376 - RNA, 19 nt, Homo sapiens
ucacugaccugagcgagaa

SEQ ID NO: 250377 - RNA, 19 nt, Homo sapiens
gcaaggaccaaaugucaau

SEQ ID NO: 250378 - RNA, 19 nt, Homo sapiens
agacaaugcugacucaaag

SEQ ID NO: 250379 - RNA, 19 nt, Homo sapiens
gaagaccuccuguccuaug

SEQ ID NO: 250380 - RNA, 19 nt, Homo sapiens
gacaagcgcuucgccuuca

SEQ ID NO: 250381 - RNA, 19 nt, Homo sapiens
gaggaacaaccaacuaguu

SEQ ID NO: 250382 - RNA, 19 nt, Homo sapiens
ugaagacaaugcugacuca

SEQ ID NO: 250383 - RNA, 19 nt, Homo sapiens
gugaaaugauggugaaagu

SEQ ID NO: 250384 - RNA, 19 nt, Homo sapiens
ucagaaggcgucacaagaa

SEQ ID NO: 250385 - RNA, 19 nt, Homo sapiens
gcugaggacuuaaaauauu

SEQ ID NO: 250386 - RNA, 19 nt, Homo sapiens
gcccuucauuuggagauua

SEQ ID NO: 250387 - RNA, 19 nt, Homo sapiens
gaugcaagccuucagaauc

SEQ ID NO: 250388 - RNA, 19 nt, Homo sapiens
uagcugacuuguaugaaga

SEQ ID NO: 250389 - RNA, 19 nt, Homo sapiens
gcagguacucagcgaauga

SEQ ID NO: 250390 - RNA, 19 nt, Homo sapiens
gaacagaaagcaggacaag

SEQ ID NO: 250391 - RNA, 19 nt, Homo sapiens
uaaauugcuccuugacauu

SEQ ID NO: 250392 - RNA, 19 nt, Homo sapiens
gcaguacuuuaccuccuau

SEQ ID NO: 250393 - RNA, 19 nt, Homo sapiens
uauguugggugcaaaguuc

SEQ ID NO: 250394 - RNA, 19 nt, Homo sapiens
cuuggagacuuguaugaaa

SEQ ID NO: 250395 - RNA, 19 nt, Homo sapiens
aggagaaggugaagacaau

SEQ ID NO: 250396 - RNA, 19 nt, Homo sapiens
gaccugagcgagaacagaa

SEQ ID NO: 250397 - RNA, 19 nt, Homo sapiens
auaaauugcuccuugacau

SEQ ID NO: 250398 - RNA, 19 nt, Homo sapiens
uacuuuaccuccuaucaga

SEQ ID NO: 250399 - RNA, 19 nt, Homo sapiens
gagaggcugaggacuuaaa

SEQ ID NO: 250400 - RNA, 19 nt, Homo sapiens
gaauggucuuucuaaugug

SEQ ID NO: 250401 - RNA, 19 nt, Homo sapiens
gaaacaugacucguauaug

SEQ ID NO: 250402 - RNA, 19 nt, Homo sapiens
gaggagaaggugaagacaa

SEQ ID NO: 250403 - RNA, 19 nt, Homo sapiens
ugaguuagagucuggaaga

SEQ ID NO: 250404 - RNA, 19 nt, Homo sapiens
caagaugcaagccuucaga

SEQ ID NO: 250405 - RNA, 19 nt, Homo sapiens
gcacuuggagacuuguaug

SEQ ID NO: 250406 - RNA, 19 nt, Homo sapiens
ugugaugucccaacuugua

SEQ ID NO: 250407 - RNA, 19 nt, Homo sapiens
uagaugugguacccauuga

SEQ ID NO: 250408 - RNA, 19 nt, Homo sapiens
cagaaggcgucacaagaac

SEQ ID NO: 250409 - RNA, 19 nt, Homo sapiens
ggaggcaguuaacaucacu

SEQ ID NO: 250410 - RNA, 19 nt, Homo sapiens
gagaaaauccagcaagaug

SEQ ID NO: 250411 - RNA, 19 nt, Homo sapiens
gggagaaaauccagcaaga

SEQ ID NO: 250412 - RNA, 19 nt, Homo sapiens
guacucagcgaaugaaugc

SEQ ID NO: 250413 - RNA, 19 nt, Homo sapiens
ugaaaugauggugaaagua

SEQ ID NO: 250414 - RNA, 19 nt, Homo sapiens
gaaaagaccaguccaugag

SEQ ID NO: 250415 - RNA, 19 nt, Homo sapiens
ccaugucgccucugcauuc

SEQ ID NO: 250416 - RNA, 19 nt, Homo sapiens
ugucaagucuggugaugag

SEQ ID NO: 250417 - RNA, 19 nt, Homo sapiens
uuugugaugucccaacuug

SEQ ID NO: 250418 - RNA, 19 nt, Homo sapiens
caugcugccuccagaaugg

SEQ ID NO: 250419 - RNA, 19 nt, Homo sapiens
agaugugccuguccugugu

SEQ ID NO: 250420 - RNA, 19 nt, Homo sapiens
augcaagccuucagaaucu

SEQ ID NO: 250421 - RNA, 19 nt, Homo sapiens
ugacuucagcucuguuuua

SEQ ID NO: 250422 - RNA, 19 nt, Homo sapiens
ugcaguacuuuaccuccua

SEQ ID NO: 250423 - RNA, 19 nt, Homo sapiens
gugaugucccaacuuguaa

SEQ ID NO: 250424 - RNA, 19 nt, Homo sapiens
ucagcucuguuuuacaaua

SEQ ID NO: 250425 - RNA, 19 nt, Homo sapiens
aagacaaugcugacucaaa

SEQ ID NO: 250426 - RNA, 19 nt, Homo sapiens
ggagacuuguaugaaagau

SEQ ID NO: 250427 - RNA, 19 nt, Homo sapiens
uuagcugacuuguaugaag

SEQ ID NO: 250428 - RNA, 19 nt, Homo sapiens
ggauccaucaggccacuug

SEQ ID NO: 250429 - RNA, 19 nt, Homo sapiens
gcuggaggcaguuaacauc

SEQ ID NO: 250430 - RNA, 19 nt, Homo sapiens
aagaccuccuguccuauga

SEQ ID NO: 250431 - RNA, 19 nt, Homo sapiens
ggucaccaaauucuacuuc

SEQ ID NO: 250432 - RNA, 19 nt, Homo sapiens
gaauaaauugcuccuugac

SEQ ID NO: 250433 - RNA, 19 nt, Homo sapiens
uuugugaaaugauggugaa

SEQ ID NO: 250434 - RNA, 19 nt, Homo sapiens
gauagaugugguacccauu

SEQ ID NO: 250435 - RNA, 19 nt, Homo sapiens
gguacucagcgaaugaaug

SEQ ID NO: 250436 - RNA, 19 nt, Homo sapiens
aaauugcuccuugacauug

SEQ ID NO: 250437 - RNA, 19 nt, Homo sapiens
uaccuccuaucagaaguuu

SEQ ID NO: 250438 - RNA, 19 nt, Homo sapiens
ucaccaaauucuacuucca

SEQ ID NO: 250439 - RNA, 19 nt, Homo sapiens
cagcucuguuuuacaauaa

SEQ ID NO: 250440 - RNA, 19 nt, Homo sapiens
cuucagcucuguuuuacaa

SEQ ID NO: 250441 - RNA, 19 nt, Homo sapiens
ggcagguacucagcgaaug

SEQ ID NO: 250442 - RNA, 19 nt, Homo sapiens
guagagcuucuggcacuug

SEQ ID NO: 250443 - RNA, 19 nt, Homo sapiens
aaaugauggugaaaguaag

SEQ ID NO: 250444 - RNA, 19 nt, Homo sapiens
aauggucuuucuaaugugu

SEQ ID NO: 250445 - RNA, 19 nt, Homo sapiens
cgaaugaaugcuguauaug

SEQ ID NO: 250446 - RNA, 19 nt, Homo sapiens
gagaaggugaagacaaugc

SEQ ID NO: 250447 - RNA, 19 nt, Homo sapiens
gaaucugggauguuaacca

SEQ ID NO: 250448 - RNA, 19 nt, Homo sapiens
ccuucuaucugaggaacaa

SEQ ID NO: 250449 - RNA, 19 nt, Homo sapiens
ggagaaggugaagacaaug

SEQ ID NO: 250450 - RNA, 19 nt, Homo sapiens
caugucgccucugcauuca

SEQ ID NO: 250451 - RNA, 19 nt, Homo sapiens
uugcaaggaccaaauguca

SEQ ID NO: 250452 - RNA, 19 nt, Homo sapiens
gaaaugauggugaaaguaa

SEQ ID NO: 250453 - RNA, 19 nt, Homo sapiens
gcacaaagcccuuccaugu

SEQ ID NO: 250454 - RNA, 19 nt, Homo sapiens
ggaauaaauugcuccuuga

SEQ ID NO: 250455 - RNA, 19 nt, Homo sapiens
gggagaggcugaggacuua

SEQ ID NO: 250456 - RNA, 19 nt, Homo sapiens
gcgaaugaaugcuguauau

SEQ ID NO: 250457 - RNA, 19 nt, Homo sapiens
ggagagcccuucauuugga

SEQ ID NO: 250458 - RNA, 19 nt, Homo sapiens
gcaggaaacaugacucgua

SEQ ID NO: 250459 - RNA, 19 nt, Homo sapiens
ggaaacaugacucguauau

SEQ ID NO: 250460 - RNA, 19 nt, Homo sapiens
gaaugaaugcuguauaugu

SEQ ID NO: 250461 - RNA, 19 nt, Homo sapiens
gcaccuagccucgcucuug

SEQ ID NO: 250462 - RNA, 19 nt, Homo sapiens
caggaaacaugacucguau

SEQ ID NO: 250463 - RNA, 19 nt, Homo sapiens
gcacugaggaccagccauu

SEQ ID NO: 250464 - RNA, 19 nt, Homo sapiens
ucacugaccugagcgagaa

SEQ ID NO: 250465 - RNA, 19 nt, Homo sapiens
gcaaggaccaaaugucaau

SEQ ID NO: 250466 - RNA, 19 nt, Homo sapiens
gcagucaccuaaucacucu

SEQ ID NO: 250467 - RNA, 19 nt, Homo sapiens
gacaagcgcuucgccuuca

SEQ ID NO: 250468 - RNA, 19 nt, Homo sapiens
gaggaacaaccaacuaguu

SEQ ID NO: 250469 - RNA, 19 nt, Homo sapiens
gugaaaugauggugaaagu

SEQ ID NO: 250470 - RNA, 19 nt, Homo sapiens
ucagaaggcgucacaagaa

SEQ ID NO: 250471 - RNA, 19 nt, Homo sapiens
gcugaggacuuaaaauauu

SEQ ID NO: 250472 - RNA, 19 nt, Homo sapiens
gcccuucauuuggagauua

SEQ ID NO: 250473 - RNA, 19 nt, Homo sapiens
gaugcaagccuucagaauc

SEQ ID NO: 250474 - RNA, 19 nt, Homo sapiens
gcagguacucagcgaauga

SEQ ID NO: 250475 - RNA, 19 nt, Homo sapiens
gaacagaaagcaggacaag

SEQ ID NO: 250476 - RNA, 19 nt, Homo sapiens
uaaauugcuccuugacauu

SEQ ID NO: 250477 - RNA, 19 nt, Homo sapiens
gcaguacuuuaccuccuau

SEQ ID NO: 250478 - RNA, 19 nt, Homo sapiens
uauguugggugcaaaguuc

SEQ ID NO: 250479 - RNA, 19 nt, Homo sapiens
cuuggagacuuguaugaaa

SEQ ID NO: 250480 - RNA, 19 nt, Homo sapiens
gaccugagcgagaacagaa

SEQ ID NO: 250481 - RNA, 19 nt, Homo sapiens
auaaauugcuccuugacau

SEQ ID NO: 250482 - RNA, 19 nt, Homo sapiens
uacuuuaccuccuaucaga

SEQ ID NO: 250483 - RNA, 19 nt, Homo sapiens
gagaggcugaggacuuaaa

SEQ ID NO: 250484 - RNA, 19 nt, Homo sapiens
gaauggucuuucuaaugug

SEQ ID NO: 250485 - RNA, 19 nt, Homo sapiens
gaaacaugacucguauaug

SEQ ID NO: 250486 - RNA, 19 nt, Homo sapiens
caagaugcaagccuucaga

SEQ ID NO: 250487 - RNA, 19 nt, Homo sapiens
gcacuuggagacuuguaug

SEQ ID NO: 250488 - RNA, 19 nt, Homo sapiens
ugugaugucccaacuugua

SEQ ID NO: 250489 - RNA, 19 nt, Homo sapiens
uagaugugguacccauuga

SEQ ID NO: 250490 - RNA, 19 nt, Homo sapiens
cagaaggcgucacaagaac

SEQ ID NO: 250491 - RNA, 19 nt, Homo sapiens
ggaggcaguuaacaucacu

SEQ ID NO: 250492 - RNA, 19 nt, Homo sapiens
gagaaaauccagcaagaug

SEQ ID NO: 250493 - RNA, 19 nt, Homo sapiens
gggagaaaauccagcaaga

SEQ ID NO: 250494 - RNA, 19 nt, Homo sapiens
guacucagcgaaugaaugc

SEQ ID NO: 250495 - RNA, 19 nt, Homo sapiens
ugaaaugauggugaaagua

SEQ ID NO: 250496 - RNA, 19 nt, Homo sapiens
gaaaagaccaguccaugag

SEQ ID NO: 250497 - RNA, 19 nt, Homo sapiens
ccaugucgccucugcauuc

SEQ ID NO: 250498 - RNA, 19 nt, Homo sapiens
ugucaagucuggugaugag

SEQ ID NO: 250499 - RNA, 19 nt, Homo sapiens
uuugugaugucccaacuug

SEQ ID NO: 250500 - RNA, 19 nt, Homo sapiens
caugcugccuccagaaugg

SEQ ID NO: 250501 - RNA, 19 nt, Homo sapiens
agaugugccuguccugugu

SEQ ID NO: 250502 - RNA, 19 nt, Homo sapiens
augcaagccuucagaaucu

SEQ ID NO: 250503 - RNA, 19 nt, Homo sapiens
ugacuucagcucuguuuua

SEQ ID NO: 250504 - RNA, 19 nt, Homo sapiens
ugcaguacuuuaccuccua

SEQ ID NO: 250505 - RNA, 19 nt, Homo sapiens
gugaugucccaacuuguaa

SEQ ID NO: 250506 - RNA, 19 nt, Homo sapiens
uaaucacucuccuccucuu

SEQ ID NO: 250507 - RNA, 19 nt, Homo sapiens
ucagcucuguuuuacaaua

SEQ ID NO: 250508 - RNA, 19 nt, Homo sapiens
ggagacuuguaugaaagau

SEQ ID NO: 250509 - RNA, 19 nt, Homo sapiens
ggauccaucaggccacuug

SEQ ID NO: 250510 - RNA, 19 nt, Homo sapiens
gcuggaggcaguuaacauc

SEQ ID NO: 250511 - RNA, 19 nt, Homo sapiens
ggucaccaaauucuacuuc

SEQ ID NO: 250512 - RNA, 19 nt, Homo sapiens
gcagucacagaauggaaau

SEQ ID NO: 250513 - RNA, 19 nt, Homo sapiens
gaauaaauugcuccuugac

SEQ ID NO: 250514 - RNA, 19 nt, Homo sapiens
uuugugaaaugauggugaa

SEQ ID NO: 250515 - RNA, 19 nt, Homo sapiens
gauagaugugguacccauu

SEQ ID NO: 250516 - RNA, 19 nt, Homo sapiens
gguacucagcgaaugaaug

SEQ ID NO: 250517 - RNA, 19 nt, Homo sapiens
aaauugcuccuugacauug

SEQ ID NO: 250518 - RNA, 19 nt, Homo sapiens
uaccuccuaucagaaguuu

SEQ ID NO: 250519 - RNA, 19 nt, Homo sapiens
ggccuccgcagucaccuaa

SEQ ID NO: 250520 - RNA, 19 nt, Homo sapiens
ucaccaaauucuacuucca

SEQ ID NO: 250521 - RNA, 19 nt, Homo sapiens
cagcucuguuuuacaauaa

SEQ ID NO: 250522 - RNA, 19 nt, Homo sapiens
cuucagcucuguuuuacaa

SEQ ID NO: 250523 - RNA, 19 nt, Homo sapiens
ggcagguacucagcgaaug

SEQ ID NO: 250524 - RNA, 19 nt, Homo sapiens
guagagcuucuggcacuug

SEQ ID NO: 250525 - RNA, 19 nt, Homo sapiens
aaaugauggugaaaguaag

SEQ ID NO: 250526 - RNA, 19 nt, Homo sapiens
aauggucuuucuaaugugu

SEQ ID NO: 250527 - RNA, 19 nt, Homo sapiens
ccuccgcagucaccuaauc

SEQ ID NO: 250528 - RNA, 19 nt, Homo sapiens
cgaaugaaugcuguauaug

SEQ ID NO: 250529 - RNA, 19 nt, Homo sapiens
gaaucugggauguuaacca

SEQ ID NO: 250530 - RNA, 19 nt, Homo sapiens
uugcaaggaccaaauguca

SEQ ID NO: 250531 - RNA, 19 nt, Homo sapiens
ccuucuaucugaggaacaa

SEQ ID NO: 250532 - RNA, 19 nt, Homo sapiens
uugcugcagucacagaaug

SEQ ID NO: 250533 - RNA, 19 nt, Homo sapiens
caugucgccucugcauuca

SEQ ID NO: 250534 - RNA, 19 nt, Homo sapiens
caagauaacugcauaagua

SEQ ID NO: 250535 - RNA, 19 nt, Homo sapiens
gaaaugauggugaaaguaa

SEQ ID NO: 250536 - RNA, 19 nt, Homo sapiens
gcacaaagcccuuccaugu

SEQ ID NO: 250537 - RNA, 19 nt, Homo sapiens
ggaauaaauugcuccuuga

SEQ ID NO: 250538 - RNA, 19 nt, Homo sapiens
gggagaggcugaggacuua

SEQ ID NO: 250539 - RNA, 19 nt, Homo sapiens
gcgaaugaaugcuguauau

SEQ ID NO: 250540 - RNA, 19 nt, Homo sapiens
cagaagaccuccuguccua

SEQ ID NO: 250541 - RNA, 19 nt, Homo sapiens
ggagagcccuucauuugga

SEQ ID NO: 250542 - RNA, 19 nt, Homo sapiens
gcaggaaacaugacucgua

SEQ ID NO: 250543 - RNA, 19 nt, Homo sapiens
ggaaacaugacucguauau

SEQ ID NO: 250544 - RNA, 19 nt, Homo sapiens
auucauagcuaacccauaa

SEQ ID NO: 250545 - RNA, 19 nt, Homo sapiens
gaaugaaugcuguauaugu

SEQ ID NO: 250546 - RNA, 19 nt, Homo sapiens
gcaccuagccucgcucuug

SEQ ID NO: 250547 - RNA, 19 nt, Homo sapiens
caggaaacaugacucguau

SEQ ID NO: 250548 - RNA, 19 nt, Homo sapiens
gcacugaggaccagccauu

SEQ ID NO: 250549 - RNA, 19 nt, Homo sapiens
ucacugaccugagcgagaa

SEQ ID NO: 250550 - RNA, 19 nt, Homo sapiens
gauaacugcauaaguaaug

SEQ ID NO: 250551 - RNA, 19 nt, Homo sapiens
gcaaggaccaaaugucaau

SEQ ID NO: 250552 - RNA, 19 nt, Homo sapiens
gcaagcauguaccgcugaa

SEQ ID NO: 250553 - RNA, 19 nt, Homo sapiens
gaagaccuccuguccuaug

SEQ ID NO: 250554 - RNA, 19 nt, Homo sapiens
gacaagcgcuucgccuuca

SEQ ID NO: 250555 - RNA, 19 nt, Homo sapiens
gaggaacaaccaacuaguu

SEQ ID NO: 250556 - RNA, 19 nt, Homo sapiens
gugaaaugauggugaaagu

SEQ ID NO: 250557 - RNA, 19 nt, Homo sapiens
ucagaaggcgucacaagaa

SEQ ID NO: 250558 - RNA, 19 nt, Homo sapiens
cagaaaggauucacaagac

SEQ ID NO: 250559 - RNA, 19 nt, Homo sapiens
gcugaggacuuaaaauauu

SEQ ID NO: 250560 - RNA, 19 nt, Homo sapiens
gcccuucauuuggagauua

SEQ ID NO: 250561 - RNA, 19 nt, Homo sapiens
gaugcaagccuucagaauc

SEQ ID NO: 250562 - RNA, 19 nt, Homo sapiens
ucagaaaggauucacaaga

SEQ ID NO: 250563 - RNA, 19 nt, Homo sapiens
gcagguacucagcgaauga

SEQ ID NO: 250564 - RNA, 19 nt, Homo sapiens
gaacagaaagcaggacaag

SEQ ID NO: 250565 - RNA, 19 nt, Homo sapiens
uaaauugcuccuugacauu

SEQ ID NO: 250566 - RNA, 19 nt, Homo sapiens
gcaguacuuuaccuccuau

SEQ ID NO: 250567 - RNA, 19 nt, Homo sapiens
cagugcagauucauagcua

SEQ ID NO: 250568 - RNA, 19 nt, Homo sapiens
uauguugggugcaaaguuc

SEQ ID NO: 250569 - RNA, 19 nt, Homo sapiens
cuuggagacuuguaugaaa

SEQ ID NO: 250570 - RNA, 19 nt, Homo sapiens
gaccugagcgagaacagaa

SEQ ID NO: 250571 - RNA, 19 nt, Homo sapiens
aacacaagauaacugcaua

SEQ ID NO: 250572 - RNA, 19 nt, Homo sapiens
auaaauugcuccuugacau

SEQ ID NO: 250573 - RNA, 19 nt, Homo sapiens
uacuuuaccuccuaucaga

SEQ ID NO: 250574 - RNA, 19 nt, Homo sapiens
gagaggcugaggacuuaaa

SEQ ID NO: 250575 - RNA, 19 nt, Homo sapiens
gaauggucuuucuaaugug

SEQ ID NO: 250576 - RNA, 19 nt, Homo sapiens
gaaacaugacucguauaug

SEQ ID NO: 250577 - RNA, 19 nt, Homo sapiens
ugaguuagagucuggaaga

SEQ ID NO: 250578 - RNA, 19 nt, Homo sapiens
caagaugcaagccuucaga

SEQ ID NO: 250579 - RNA, 19 nt, Homo sapiens
gcacuuggagacuuguaug

SEQ ID NO: 250580 - RNA, 19 nt, Homo sapiens
ugugaugucccaacuugua

SEQ ID NO: 250581 - RNA, 19 nt, Homo sapiens
uagaugugguacccauuga

SEQ ID NO: 250582 - RNA, 19 nt, Homo sapiens
cagaaggcgucacaagaac

SEQ ID NO: 250583 - RNA, 19 nt, Homo sapiens
ggaggcaguuaacaucacu

SEQ ID NO: 250584 - RNA, 19 nt, Homo sapiens
gagaaaauccagcaagaug

SEQ ID NO: 250585 - RNA, 19 nt, Homo sapiens
gggagaaaauccagcaaga

SEQ ID NO: 250586 - RNA, 19 nt, Homo sapiens
gacuuucagugcagauuca

SEQ ID NO: 250587 - RNA, 19 nt, Homo sapiens
guacucagcgaaugaaugc

SEQ ID NO: 250588 - RNA, 19 nt, Homo sapiens
ugaaaugauggugaaagua

SEQ ID NO: 250589 - RNA, 19 nt, Homo sapiens
gaaaagaccaguccaugag

SEQ ID NO: 250590 - RNA, 19 nt, Homo sapiens
ccaugucgccucugcauuc

SEQ ID NO: 250591 - RNA, 19 nt, Homo sapiens
ugucaagucuggugaugag

SEQ ID NO: 250592 - RNA, 19 nt, Homo sapiens
uuugugaugucccaacuug

SEQ ID NO: 250593 - RNA, 19 nt, Homo sapiens
caugcugccuccagaaugg

SEQ ID NO: 250594 - RNA, 19 nt, Homo sapiens
ggcaagagcaagcauguac

SEQ ID NO: 250595 - RNA, 19 nt, Homo sapiens
agaugugccuguccugugu

SEQ ID NO: 250596 - RNA, 19 nt, Homo sapiens
augcaagccuucagaaucu

SEQ ID NO: 250597 - RNA, 19 nt, Homo sapiens
ugacuucagcucuguuuua

SEQ ID NO: 250598 - RNA, 19 nt, Homo sapiens
ugcaguacuuuaccuccua

SEQ ID NO: 250599 - RNA, 19 nt, Homo sapiens
gugaugucccaacuuguaa

SEQ ID NO: 250600 - RNA, 19 nt, Homo sapiens
ucagcucuguuuuacaaua

SEQ ID NO: 250601 - RNA, 19 nt, Homo sapiens
ggagacuuguaugaaagau

SEQ ID NO: 250602 - RNA, 19 nt, Homo sapiens
ggauccaucaggccacuug

SEQ ID NO: 250603 - RNA, 19 nt, Homo sapiens
acacaagauaacugcauaa

SEQ ID NO: 250604 - RNA, 19 nt, Homo sapiens
gcuggaggcaguuaacauc

SEQ ID NO: 250605 - RNA, 19 nt, Homo sapiens
aagaccuccuguccuauga

SEQ ID NO: 250606 - RNA, 19 nt, Homo sapiens
ggucaccaaauucuacuuc

SEQ ID NO: 250607 - RNA, 19 nt, Homo sapiens
ccucagaaaggauucacaa

SEQ ID NO: 250608 - RNA, 19 nt, Homo sapiens
gaauaaauugcuccuugac

SEQ ID NO: 250609 - RNA, 19 nt, Homo sapiens
uuugugaaaugauggugaa

SEQ ID NO: 250610 - RNA, 19 nt, Homo sapiens
gccaagaaggcaagagcaa

SEQ ID NO: 250611 - RNA, 19 nt, Homo sapiens
gauagaugugguacccauu

SEQ ID NO: 250612 - RNA, 19 nt, Homo sapiens
gguacucagcgaaugaaug

SEQ ID NO: 250613 - RNA, 19 nt, Homo sapiens
aaauugcuccuugacauug

SEQ ID NO: 250614 - RNA, 19 nt, Homo sapiens
uaccuccuaucagaaguuu

SEQ ID NO: 250615 - RNA, 19 nt, Homo sapiens
ucaccaaauucuacuucca

SEQ ID NO: 250616 - RNA, 19 nt, Homo sapiens
cagcucuguuuuacaauaa

SEQ ID NO: 250617 - RNA, 19 nt, Homo sapiens
aaacacaagauaacugcau

SEQ ID NO: 250618 - RNA, 19 nt, Homo sapiens
cuucagcucuguuuuacaa

SEQ ID NO: 250619 - RNA, 19 nt, Homo sapiens
ggcagguacucagcgaaug

SEQ ID NO: 250620 - RNA, 19 nt, Homo sapiens
guagagcuucuggcacuug

SEQ ID NO: 250621 - RNA, 19 nt, Homo sapiens
aaaugauggugaaaguaag

SEQ ID NO: 250622 - RNA, 19 nt, Homo sapiens
aauggucuuucuaaugugu

SEQ ID NO: 250623 - RNA, 19 nt, Homo sapiens
cgaaugaaugcuguauaug

SEQ ID NO: 250624 - RNA, 19 nt, Homo sapiens
caucuuggaaggcucugaa

SEQ ID NO: 250625 - RNA, 19 nt, Homo sapiens
caugucgccucugcauuca

SEQ ID NO: 250626 - RNA, 19 nt, Homo sapiens
uugcaaggaccaaauguca

SEQ ID NO: 250627 - RNA, 19 nt, Homo sapiens
ccuucuaucugaggaacaa

SEQ ID NO: 250628 - RNA, 19 nt, Homo sapiens
gaaucugggauguuaacca

SEQ ID NO: 250629 - RNA, 19 nt, Homo sapiens
ccacagaacugaaacaucu

SEQ ID NO: 250630 - RNA, 19 nt, Homo sapiens
gaacuaaagggaucugaaa

SEQ ID NO: 250631 - RNA, 19 nt, Homo sapiens
ggaggaagugcuaaauuua

SEQ ID NO: 250632 - RNA, 19 nt, Homo sapiens
gaacagauggauuaccuuu

SEQ ID NO: 250633 - RNA, 19 nt, Homo sapiens
ccaggaugcucacauuuaa

SEQ ID NO: 250634 - RNA, 19 nt, Homo sapiens
uaucaggccuucuauuuau

SEQ ID NO: 250635 - RNA, 19 nt, Homo sapiens
ggaugcaacuccugucuug

SEQ ID NO: 250636 - RNA, 19 nt, Homo sapiens
cagcaaccauuguagaauu

SEQ ID NO: 250637 - RNA, 19 nt, Homo sapiens
uggaggaagugcuaaauuu

SEQ ID NO: 250638 - RNA, 19 nt, Homo sapiens
uaaauugcaucucuuguuc

SEQ ID NO: 250639 - RNA, 19 nt, Homo sapiens
aaagggaucugaaacaaca

SEQ ID NO: 250640 - RNA, 19 nt, Homo sapiens
cauaucaggccuucuauuu

SEQ ID NO: 250641 - RNA, 19 nt, Homo sapiens
aaacauaucaggccuucua

SEQ ID NO: 250642 - RNA, 19 nt, Homo sapiens
caacuccugucuugcauug

SEQ ID NO: 250643 - RNA, 19 nt, Homo sapiens
cuauguagauugguuagua

SEQ ID NO: 250644 - RNA, 19 nt, Homo sapiens
guucaagaguucccuauca

SEQ ID NO: 250645 - RNA, 19 nt, Homo sapiens
ugaauaugcugaugagaca

SEQ ID NO: 250646 - RNA, 19 nt, Homo sapiens
cuaaagggaucugaaacaa

SEQ ID NO: 250647 - RNA, 19 nt, Homo sapiens
ucaccaggaugcucacauu

SEQ ID NO: 250648 - RNA, 19 nt, Homo sapiens
caaagagggauuucaccua

SEQ ID NO: 250649 - RNA, 19 nt, Homo sapiens
gaugagacagcaaccauug

SEQ ID NO: 250650 - RNA, 19 nt, Homo sapiens
aaucagcaauaucaacgua

SEQ ID NO: 250651 - RNA, 19 nt, Homo sapiens
gaaggccacagaacugaaa

SEQ ID NO: 250652 - RNA, 19 nt, Homo sapiens
gauuucaccuacauccauu

SEQ ID NO: 250653 - RNA, 19 nt, Homo sapiens
ccaaagagucaucagaaga

SEQ ID NO: 250654 - RNA, 19 nt, Homo sapiens
gaugcucacauuuaaguuu

SEQ ID NO: 250655 - RNA, 19 nt, Homo sapiens
gggcuaauguaacaaagag

SEQ ID NO: 250656 - RNA, 19 nt, Homo sapiens
cuacauccauucagucagu

SEQ ID NO: 250657 - RNA, 19 nt, Homo sapiens
caagaaggccacagaacug

SEQ ID NO: 250658 - RNA, 19 nt, Homo sapiens
caacuccugccacaaugua

SEQ ID NO: 250659 - RNA, 19 nt, Homo sapiens
ugagacagcaaccauugua

SEQ ID NO: 250660 - RNA, 19 nt, Homo sapiens
caacguaauaguucuggaa

SEQ ID NO: 250661 - RNA, 19 nt, Homo sapiens
gacagcaaccauuguagaa

SEQ ID NO: 250662 - RNA, 19 nt, Homo sapiens
ucaccuaagugugggcuaa

SEQ ID NO: 250663 - RNA, 19 nt, Homo sapiens
caguauaaauugcaucucu

SEQ ID NO: 250664 - RNA, 19 nt, Homo sapiens
ucaccuacauccauucagu

SEQ ID NO: 250665 - RNA, 19 nt, Homo sapiens
gcauuuacugcuggauuua

SEQ ID NO: 250666 - RNA, 19 nt, Homo sapiens
cuaucacucucuuuaauca

SEQ ID NO: 250667 - RNA, 19 nt, Homo sapiens
uugaauguaugguuugcua

SEQ ID NO: 250668 - RNA, 19 nt, Homo sapiens
ggaacuaaagggaucugaa

SEQ ID NO: 250669 - RNA, 19 nt, Homo sapiens
ggacuuaaucagcaauauc

SEQ ID NO: 250670 - RNA, 19 nt, Homo sapiens
gacuuaaucagcaauauca

SEQ ID NO: 250671 - RNA, 19 nt, Homo sapiens
guauaaauugcaucucuug

SEQ ID NO: 250672 - RNA, 19 nt, Homo sapiens
gaaauuccaaagagucauc

SEQ ID NO: 250673 - RNA, 19 nt, Homo sapiens
caaagagucaucagaagag

SEQ ID NO: 250674 - RNA, 19 nt, Homo sapiens
caggccuucuauuuauuua

SEQ ID NO: 250675 - RNA, 19 nt, Homo sapiens
ucagcaauaucaacguaau

SEQ ID NO: 250676 - RNA, 19 nt, Homo sapiens
uaagugugggcuaauguaa

SEQ ID NO: 250677 - RNA, 19 nt, Homo sapiens
ucuagaagaagaacucaaa

SEQ ID NO: 250678 - RNA, 19 nt, Homo sapiens
uuacaagaaucccaaacuc

SEQ ID NO: 250679 - RNA, 19 nt, Homo sapiens
auaucaggccuucuauuua

SEQ ID NO: 250680 - RNA, 19 nt, Homo sapiens
gaaacaucuucagugucua

SEQ ID NO: 250681 - RNA, 19 nt, Homo sapiens
gguuugcuaccuauuguaa

SEQ ID NO: 250682 - RNA, 19 nt, Homo sapiens
cagcaauaucaacguaaua

SEQ ID NO: 250683 - RNA, 19 nt, Homo sapiens
ugucaaagcaucaucucaa

SEQ ID NO: 250684 - RNA, 19 nt, Homo sapiens
acagauggauuaccuuuug

SEQ ID NO: 250685 - RNA, 19 nt, Homo sapiens
ccaagaaggccacagaacu

SEQ ID NO: 250686 - RNA, 19 nt, Homo sapiens
aaacagugcaccuacuuca

SEQ ID NO: 250687 - RNA, 19 nt, Homo sapiens
ccagggacuuaaucagcaa

SEQ ID NO: 250688 - RNA, 19 nt, Homo sapiens
agcaaccauuguagaauuu

SEQ ID NO: 250689 - RNA, 19 nt, Homo sapiens
uaacaaagagggauuucac

SEQ ID NO: 250690 - RNA, 19 nt, Homo sapiens
gggacuuaaucagcaauau

SEQ ID NO: 250691 - RNA, 19 nt, Homo sapiens
accaggaugcucacauuua

SEQ ID NO: 250692 - RNA, 19 nt, Homo sapiens
agcuacaacuggagcauuu

SEQ ID NO: 250693 - RNA, 19 nt, Homo sapiens
ucaggccuucuauuuauuu

SEQ ID NO: 250694 - RNA, 19 nt, Homo sapiens
cuaagugugggcuaaugua

SEQ ID NO: 250695 - RNA, 19 nt, Homo sapiens
ccucaacuccugccacaau

SEQ ID NO: 250696 - RNA, 19 nt, Homo sapiens
ucacucucuuuaaucacua

SEQ ID NO: 250697 - RNA, 19 nt, Homo sapiens
cccuaucacucucuuuaau

SEQ ID NO: 250698 - RNA, 19 nt, Homo sapiens
agacagcaaccauuguaga

SEQ ID NO: 250699 - RNA, 19 nt, Homo sapiens
gcaauaucaacguaauagu

SEQ ID NO: 250700 - RNA, 19 nt, Homo sapiens
cugcuggauuuacagauga

SEQ ID NO: 250701 - RNA, 19 nt, Homo sapiens
gcuacaacuggagcauuua

SEQ ID NO: 250702 - RNA, 19 nt, Homo sapiens
agugugggcuaauguaaca

SEQ ID NO: 250703 - RNA, 19 nt, Homo sapiens
aauugcaucucuuguucaa

SEQ ID NO: 250704 - RNA, 19 nt, Homo sapiens
agagggauuucaccuacau

SEQ ID NO: 250705 - RNA, 19 nt, Homo sapiens
uuuaaucacuacucacagu

SEQ ID NO: 250706 - RNA, 19 nt, Homo sapiens
cagaugauuuugaauggaa

SEQ ID NO: 250707 - RNA, 19 nt, Homo sapiens
ucucuuuaaucacuacuca

SEQ ID NO: 250708 - RNA, 19 nt, Homo sapiens
caaagcaucaucucaacac

SEQ ID NO: 250709 - RNA, 19 nt, Homo sapiens
gucaaagcaucaucucaac

SEQ ID NO: 250710 - RNA, 19 nt, Homo sapiens
gaaaacacagcuacaacug

SEQ ID NO: 250711 - RNA, 19 nt, Homo sapiens
acaaacagugcaccuacuu

SEQ ID NO: 250712 - RNA, 19 nt, Homo sapiens
uguaugguuugcuaccuau

SEQ ID NO: 250713 - RNA, 19 nt, Homo sapiens
caaacagugcaccuacuuc

SEQ ID NO: 250714 - RNA, 19 nt, Homo sapiens
aaacaucuucagugucuag

SEQ ID NO: 250715 - RNA, 19 nt, Homo sapiens
uacaagaaucccaaacuca

SEQ ID NO: 250716 - RNA, 19 nt, Homo sapiens
ccuaggggcucuaaaaugg

SEQ ID NO: 250717 - RNA, 19 nt, Homo sapiens
agagucaucagaagaggaa

SEQ ID NO: 250718 - RNA, 19 nt, Homo sapiens
guaacaaagagggauuuca

SEQ ID NO: 250719 - RNA, 19 nt, Homo sapiens
uccaaagagucaucagaag

SEQ ID NO: 250720 - RNA, 19 nt, Homo sapiens
cugaacagauggauuaccu

SEQ ID NO: 250721 - RNA, 19 nt, Homo sapiens
caccaggaugcucacauuu

SEQ ID NO: 250722 - RNA, 19 nt, Homo sapiens
gcucuaaaaugguuucacu

SEQ ID NO: 250723 - RNA, 19 nt, Homo sapiens
gcuaccuauuguaacuauu

SEQ ID NO: 250724 - RNA, 19 nt, Homo sapiens
gagacagcaaccauuguag

SEQ ID NO: 250725 - RNA, 19 nt, Homo sapiens
gugugaauaugcugaugag

SEQ ID NO: 250726 - RNA, 19 nt, Homo sapiens
ucaggaagauggauucaua

SEQ ID NO: 250727 - RNA, 19 nt, Homo sapiens
caagacacaucccuacaaa

SEQ ID NO: 250728 - RNA, 19 nt, Homo sapiens
gcucaauccucuaagcuaa

SEQ ID NO: 250729 - RNA, 19 nt, Homo sapiens
gcacuaauuugauguuuac

SEQ ID NO: 250730 - RNA, 19 nt, Homo sapiens
gcacuaacguaaauacaca

SEQ ID NO: 250731 - RNA, 19 nt, Homo sapiens
gcaaaucaaugcguacguu

SEQ ID NO: 250732 - RNA, 19 nt, Homo sapiens
ugaaugauacccugaauuu

SEQ ID NO: 250733 - RNA, 19 nt, Homo sapiens
gaaccauguugaacuguga

SEQ ID NO: 250734 - RNA, 19 nt, Homo sapiens
ggaacucucuccacccuau

SEQ ID NO: 250735 - RNA, 19 nt, Homo sapiens
gaacacaacgaaacaagug

SEQ ID NO: 250736 - RNA, 19 nt, Homo sapiens
gcauacgccuguaguccua

SEQ ID NO: 250737 - RNA, 19 nt, Homo sapiens
aaucaaaggugcuaaaugg

SEQ ID NO: 250738 - RNA, 19 nt, Homo sapiens
caagaacucugggcugcua

SEQ ID NO: 250739 - RNA, 19 nt, Homo sapiens
auacagggcucuacacaga

SEQ ID NO: 250740 - RNA, 19 nt, Homo sapiens
cagaggccauggcagaaua

SEQ ID NO: 250741 - RNA, 19 nt, Homo sapiens
cuagaacucuccaucuuau

SEQ ID NO: 250742 - RNA, 19 nt, Homo sapiens
gaacagacaacagaaguca

SEQ ID NO: 250743 - RNA, 19 nt, Homo sapiens
ccacagagagaauuuauca

SEQ ID NO: 250744 - RNA, 19 nt, Homo sapiens
uauaugcucuguacaggaa

SEQ ID NO: 250745 - RNA, 19 nt, Homo sapiens
ucaaagccauggccuacaa

SEQ ID NO: 250746 - RNA, 19 nt, Homo sapiens
gcucugaagucacaucaca

SEQ ID NO: 250747 - RNA, 19 nt, Homo sapiens
guaagaagccgggaacaga

SEQ ID NO: 250748 - RNA, 19 nt, Homo sapiens
gcaagacacaucccuacaa

SEQ ID NO: 250749 - RNA, 19 nt, Homo sapiens
gcaaggaaggaaagaaaga

SEQ ID NO: 250750 - RNA, 19 nt, Homo sapiens
gaauuuggccugcacuaau

SEQ ID NO: 250751 - RNA, 19 nt, Homo sapiens
aggcagagaaucauacuua

SEQ ID NO: 250752 - RNA, 19 nt, Homo sapiens
gaaagaaggaagugaagag

SEQ ID NO: 250753 - RNA, 19 nt, Homo sapiens
cagaauaaucuuuggguaa

SEQ ID NO: 250754 - RNA, 19 nt, Homo sapiens
ggagacauccguugugcuu

SEQ ID NO: 250755 - RNA, 19 nt, Homo sapiens
gcagaugguuuauuaucag

SEQ ID NO: 250756 - RNA, 19 nt, Homo sapiens
guuacuaauuggccucuuu

SEQ ID NO: 250757 - RNA, 19 nt, Homo sapiens
ucaugaagcccaagugaaa

SEQ ID NO: 250758 - RNA, 19 nt, Homo sapiens
gaacugugaaugcaagaga

SEQ ID NO: 250759 - RNA, 19 nt, Homo sapiens
gaaagaaagaaggaaguga

SEQ ID NO: 250760 - RNA, 19 nt, Homo sapiens
ggaacagaaggaugaauga

SEQ ID NO: 250761 - RNA, 19 nt, Homo sapiens
ggcagaugguuuauuauca

SEQ ID NO: 250762 - RNA, 19 nt, Homo sapiens
gagaaagaccuccgcuuca

SEQ ID NO: 250763 - RNA, 19 nt, Homo sapiens
gcuacccacuucuaaauag

SEQ ID NO: 250764 - RNA, 19 nt, Homo sapiens
ggacugcucacguucauca

SEQ ID NO: 250765 - RNA, 19 nt, Homo sapiens
ggauugcuaugaaugauac

SEQ ID NO: 250766 - RNA, 19 nt, Homo sapiens
gaaaucaaaggugcuaaau

SEQ ID NO: 250767 - RNA, 19 nt, Homo sapiens
ggaaggaaagaaagaagga

SEQ ID NO: 250768 - RNA, 19 nt, Homo sapiens
guucaggagucccaaggaa

SEQ ID NO: 250769 - RNA, 19 nt, Homo sapiens
aagcaugaaugguauggaa

SEQ ID NO: 250770 - RNA, 19 nt, Homo sapiens
guggcaaccuugucucuau

SEQ ID NO: 250771 - RNA, 19 nt, Homo sapiens
gaaccuccaccaugggaaa

SEQ ID NO: 250772 - RNA, 19 nt, Homo sapiens
gaaggaaccauguugaacu

SEQ ID NO: 250773 - RNA, 19 nt, Homo sapiens
ggacacacaaggugcaaau

SEQ ID NO: 250774 - RNA, 19 nt, Homo sapiens
gaagaacaaucuagaaaac

SEQ ID NO: 250775 - RNA, 19 nt, Homo sapiens
ggagacagaggaagaguag

SEQ ID NO: 250776 - RNA, 19 nt, Homo sapiens
guucgaggcugcagucagu

SEQ ID NO: 250777 - RNA, 19 nt, Homo sapiens
aaagggauccguacauuca

SEQ ID NO: 250778 - RNA, 19 nt, Homo sapiens
gaggaagaguagaagaaca

SEQ ID NO: 250779 - RNA, 19 nt, Homo sapiens
gagagcgucugcaaaauga

SEQ ID NO: 250780 - RNA, 19 nt, Homo sapiens
gaagccacagagagaauuu

SEQ ID NO: 250781 - RNA, 19 nt, Homo sapiens
gaacagaaagaaaggaaaa

SEQ ID NO: 250782 - RNA, 19 nt, Homo sapiens
ucacacugguagaacguaa

SEQ ID NO: 250783 - RNA, 19 nt, Homo sapiens
aaagaaagaaggaagugaa

SEQ ID NO: 250784 - RNA, 19 nt, Homo sapiens
ucaaauacagacagaaaug

SEQ ID NO: 250785 - RNA, 19 nt, Homo sapiens
ggccugcacuaauuugaug

SEQ ID NO: 250786 - RNA, 19 nt, Homo sapiens
caaggaaggaaccauguug

SEQ ID NO: 250787 - RNA, 19 nt, Homo sapiens
gaaaugcaaaguccaaugc

SEQ ID NO: 250788 - RNA, 19 nt, Homo sapiens
gaaaggaaaaccacagaaa

SEQ ID NO: 250789 - RNA, 19 nt, Homo sapiens
ccguucacguugccuaaua

SEQ ID NO: 250790 - RNA, 19 nt, Homo sapiens
agaacucuccaucuuauuu

SEQ ID NO: 250791 - RNA, 19 nt, Homo sapiens
gagaaucauacuuagcaaa

SEQ ID NO: 250792 - RNA, 19 nt, Homo sapiens
aaacauccuucaagaacuc

SEQ ID NO: 250793 - RNA, 19 nt, Homo sapiens
ucacguugccuaauaaaca

SEQ ID NO: 250794 - RNA, 19 nt, Homo sapiens
uaacguaaauacacaacac

SEQ ID NO: 250795 - RNA, 19 nt, Homo sapiens
cacuagaacucuccaucuu

SEQ ID NO: 250796 - RNA, 19 nt, Homo sapiens
gagcgcuacccacuucuaa

SEQ ID NO: 250797 - RNA, 19 nt, Homo sapiens
uggaagcucugaagucaca

SEQ ID NO: 250798 - RNA, 19 nt, Homo sapiens
agacagaggaagaguagaa

SEQ ID NO: 250799 - RNA, 19 nt, Homo sapiens
gagagaauuuaucauuucg

SEQ ID NO: 250800 - RNA, 19 nt, Homo sapiens
ggaaagaaagaaggaagug

SEQ ID NO: 250801 - RNA, 19 nt, Homo sapiens
caaaucaaugcguacguuu

SEQ ID NO: 250802 - RNA, 19 nt, Homo sapiens
cacacaaggugcaaaucaa

SEQ ID NO: 250803 - RNA, 19 nt, Homo sapiens
gguuuacauucaucucauu

SEQ ID NO: 250804 - RNA, 19 nt, Homo sapiens
gcaauuucgccguugaaga

SEQ ID NO: 250805 - RNA, 19 nt, Homo sapiens
gaaauggagaccagucagu

SEQ ID NO: 250806 - RNA, 19 nt, Homo sapiens
ggcuggaugugguggcaua

SEQ ID NO: 250807 - RNA, 19 nt, Homo sapiens
guacguuuccugagaagug

SEQ ID NO: 250808 - RNA, 19 nt, Homo sapiens
guuaguuucuuugggauug

SEQ ID NO: 250809 - RNA, 19 nt, Homo sapiens
cagcauagcaagacacauc

SEQ ID NO: 250810 - RNA, 19 nt, Homo sapiens
gaaugauacccugaauuug

SEQ ID NO: 250811 - RNA, 19 nt, Homo sapiens
gggauugcuaugaaugaua

SEQ ID NO: 250812 - RNA, 19 nt, Homo sapiens
auucauaccugcugaugug

SEQ ID NO: 250813 - RNA, 19 nt, Homo sapiens
gaacucucuccacccuaua

SEQ ID NO: 250814 - RNA, 19 nt, Homo sapiens
gggcagaugguuuauuauc

SEQ ID NO: 250815 - RNA, 19 nt, Homo sapiens
agagguuuccgcagaauaa

SEQ ID NO: 250816 - RNA, 19 nt, Homo sapiens
gagagguuuccgcagaaua

SEQ ID NO: 250817 - RNA, 19 nt, Homo sapiens
uuacuaauuggccucuuua

SEQ ID NO: 250818 - RNA, 19 nt, Homo sapiens
gcgcuacccacuucuaaau

SEQ ID NO: 250819 - RNA, 19 nt, Homo sapiens
ugaaaucaaaggugcuaaa

SEQ ID NO: 250820 - RNA, 19 nt, Homo sapiens
cagaggaagaguagaagaa

SEQ ID NO: 250821 - RNA, 19 nt, Homo sapiens
cauaugcacaggugaaaug

SEQ ID NO: 250822 - RNA, 19 nt, Homo sapiens
aaaugaagccacagagaga

SEQ ID NO: 250823 - RNA, 19 nt, Homo sapiens
cagagaaucauacuuagca

SEQ ID NO: 250824 - RNA, 19 nt, Homo sapiens
ccaaacccaugaggcaaug

SEQ ID NO: 250825 - RNA, 19 nt, Homo sapiens
ggccauggcagaauaaucu

SEQ ID NO: 250826 - RNA, 19 nt, Homo sapiens
ggagaaagaggcccuguua

SEQ ID NO: 250827 - RNA, 19 nt, Homo sapiens
gaacacugaugccuacuug

SEQ ID NO: 250828 - RNA, 19 nt, Homo sapiens
gggcagggccucauuauuu

SEQ ID NO: 250829 - RNA, 19 nt, Homo sapiens
gcaagucggucuccuuauc

SEQ ID NO: 250830 - RNA, 19 nt, Homo sapiens
gaauggcacuucccaguuc

SEQ ID NO: 250831 - RNA, 19 nt, Homo sapiens
ugaagaagguccugaagug

SEQ ID NO: 250832 - RNA, 19 nt, Homo sapiens
gaggagacguccagaagug

SEQ ID NO: 250833 - RNA, 19 nt, Homo sapiens
gcaccaagcucuguccaau

SEQ ID NO: 250834 - RNA, 19 nt, Homo sapiens
ccaacucccucguuaauca

SEQ ID NO: 250835 - RNA, 19 nt, Homo sapiens
agaagguccugaaguguaa

SEQ ID NO: 250836 - RNA, 19 nt, Homo sapiens
aaacuucccugacucuuca

SEQ ID NO: 250837 - RNA, 19 nt, Homo sapiens
cacaggaucccacgaauuu

SEQ ID NO: 250838 - RNA, 19 nt, Homo sapiens
ggccugaacuagccaauca

SEQ ID NO: 250839 - RNA, 19 nt, Homo sapiens
gaauuuaggcucagaagca

SEQ ID NO: 250840 - RNA, 19 nt, Homo sapiens
ggccauggcugaagaaggu

SEQ ID NO: 250841 - RNA, 19 nt, Homo sapiens
gagccaacaucuccugugu

SEQ ID NO: 250842 - RNA, 19 nt, Homo sapiens
cauaggguccugaauguuu

SEQ ID NO: 250843 - RNA, 19 nt, Homo sapiens
gaacuagccaaucagauca

SEQ ID NO: 250844 - RNA, 19 nt, Homo sapiens
gggaugaccugcugcucuu

SEQ ID NO: 250845 - RNA, 19 nt, Homo sapiens
gugcuuggcugcuguaucu

SEQ ID NO: 250846 - RNA, 19 nt, Homo sapiens
gccauaggguccugaaugu

SEQ ID NO: 250847 - RNA, 19 nt, Homo sapiens
uguaccaucuuugugauua

SEQ ID NO: 250848 - RNA, 19 nt, Homo sapiens
gagggcugcugaccauuug

SEQ ID NO: 250849 - RNA, 19 nt, Homo sapiens
gcacuucccaguucacaug

SEQ ID NO: 250850 - RNA, 19 nt, Homo sapiens
caacauaagcugggaaauc

SEQ ID NO: 250851 - RNA, 19 nt, Homo sapiens
ucacagacccacaagagaa

SEQ ID NO: 250852 - RNA, 19 nt, Homo sapiens
ccugagaucucgccacuag

SEQ ID NO: 250853 - RNA, 19 nt, Homo sapiens
guauuugccuucuccacuu

SEQ ID NO: 250854 - RNA, 19 nt, Homo sapiens
aaagacaccuggaguucga

SEQ ID NO: 250855 - RNA, 19 nt, Homo sapiens
acccacagaugcaacauaa

SEQ ID NO: 250856 - RNA, 19 nt, Homo sapiens
ggauuccuguugccuuuau

SEQ ID NO: 250857 - RNA, 19 nt, Homo sapiens
cagagucccgugcccauua

SEQ ID NO: 250858 - RNA, 19 nt, Homo sapiens
ccaagccucccacuacuuu

SEQ ID NO: 250859 - RNA, 19 nt, Homo sapiens
ggaagcacugccucccuua

SEQ ID NO: 250860 - RNA, 19 nt, Homo sapiens
agacggcgguggaaccaaa

SEQ ID NO: 250861 - RNA, 19 nt, Homo sapiens
gccaacaucuccugugucu

SEQ ID NO: 250862 - RNA, 19 nt, Homo sapiens
ugagagggcugcugaccau

SEQ ID NO: 250863 - RNA, 19 nt, Homo sapiens
gacaagcguugagccacua

SEQ ID NO: 250864 - RNA, 19 nt, Homo sapiens
gaagcacugccucccuuaa

SEQ ID NO: 250865 - RNA, 19 nt, Homo sapiens
ucaucuaggugacaaacuu

SEQ ID NO: 250866 - RNA, 19 nt, Homo sapiens
cuacuaauccucucugcaa

SEQ ID NO: 250867 - RNA, 19 nt, Homo sapiens
agucucaccuccugccaua

SEQ ID NO: 250868 - RNA, 19 nt, Homo sapiens
gaagaagguccugaagugu

SEQ ID NO: 250869 - RNA, 19 nt, Homo sapiens
guaccaucuuugugauuau

SEQ ID NO: 250870 - RNA, 19 nt, Homo sapiens
gccaggaacuguguguguu

SEQ ID NO: 250871 - RNA, 19 nt, Homo sapiens
acacuugguccauccauuu

SEQ ID NO: 250872 - RNA, 19 nt, Homo sapiens
ugagaucucgccacuagaa

SEQ ID NO: 250873 - RNA, 19 nt, Homo sapiens
aagaagguccugaagugua

SEQ ID NO: 250874 - RNA, 19 nt, Homo sapiens
accaagcucuguccaauca

SEQ ID NO: 250875 - RNA, 19 nt, Homo sapiens
aacauaagcugggaaaucu

SEQ ID NO: 250876 - RNA, 19 nt, Homo sapiens
aaaauaaacuccccuuucu

SEQ ID NO: 250877 - RNA, 19 nt, Homo sapiens
caacucacuugguguagac

SEQ ID NO: 250878 - RNA, 19 nt, Homo sapiens
gcucugaccagcagccuau

SEQ ID NO: 250879 - RNA, 19 nt, Homo sapiens
uacccuggaugaacgaauu

SEQ ID NO: 250880 - RNA, 19 nt, Homo sapiens
cuuggcugcuguaucuuua

SEQ ID NO: 250881 - RNA, 19 nt, Homo sapiens
ccagggagggagucaguuu

SEQ ID NO: 250882 - RNA, 19 nt, Homo sapiens
ucacaugcuucuacaacuc

SEQ ID NO: 250883 - RNA, 19 nt, Homo sapiens
ugagaaccuucgccugaug

SEQ ID NO: 250884 - RNA, 19 nt, Homo sapiens
ugaacuagccaaucagauc

SEQ ID NO: 250885 - RNA, 19 nt, Homo sapiens
cgccugacauucacacaga

SEQ ID NO: 250886 - RNA, 19 nt, Homo sapiens
ggcagggccucauuauuuu

SEQ ID NO: 250887 - RNA, 19 nt, Homo sapiens
ccacuucuugggaggguua

SEQ ID NO: 250888 - RNA, 19 nt, Homo sapiens
gcagaucacguugcaaugg

SEQ ID NO: 250889 - RNA, 19 nt, Homo sapiens
ucacaggaucccacgaauu

SEQ ID NO: 250890 - RNA, 19 nt, Homo sapiens
cugcaagucggucuccuua

SEQ ID NO: 250891 - RNA, 19 nt, Homo sapiens
ccacuaagcagaggaccuu

SEQ ID NO: 250892 - RNA, 19 nt, Homo sapiens
cgucguauacccuggauga

SEQ ID NO: 250893 - RNA, 19 nt, Homo sapiens
gcacugccucccuuaaucu

SEQ ID NO: 250894 - RNA, 19 nt, Homo sapiens
caaacuucccugacucuuc

SEQ ID NO: 250895 - RNA, 19 nt, Homo sapiens
gugacaaacuucccugacu

SEQ ID NO: 250896 - RNA, 19 nt, Homo sapiens
ccacgaauuuaggcucaga

SEQ ID NO: 250897 - RNA, 19 nt, Homo sapiens
uuaguguacuugcugauca

SEQ ID NO: 250898 - RNA, 19 nt, Homo sapiens
ugaaagacaccuggaguuc

SEQ ID NO: 250899 - RNA, 19 nt, Homo sapiens
gauuccuguugccuuuaua

SEQ ID NO: 250900 - RNA, 19 nt, Homo sapiens
guccagaaguggcucucuu

SEQ ID NO: 250901 - RNA, 19 nt, Homo sapiens
gguggaaccaaaccuguga

SEQ ID NO: 250902 - RNA, 19 nt, Homo sapiens
caaaauaaacuccccuuuc

SEQ ID NO: 250903 - RNA, 19 nt, Homo sapiens
uauuugccuucuccacuuu

SEQ ID NO: 250904 - RNA, 19 nt, Homo sapiens
ggaggagacguccagaagu

SEQ ID NO: 250905 - RNA, 19 nt, Homo sapiens
ugaauggcacuucccaguu

SEQ ID NO: 250906 - RNA, 19 nt, Homo sapiens
gccagguguacuuuacuua

SEQ ID NO: 250907 - RNA, 19 nt, Homo sapiens
gacccacagaugcaacaua

SEQ ID NO: 250908 - RNA, 19 nt, Homo sapiens
cugaucaacugcaggaaca

SEQ ID NO: 250909 - RNA, 19 nt, Homo sapiens
agacacccaguaugaguuu

SEQ ID NO: 250910 - RNA, 19 nt, Homo sapiens
ucaagcagaagcaggaaug

SEQ ID NO: 250911 - RNA, 19 nt, Homo sapiens
cuggaugaacgaauuaauu

SEQ ID NO: 250912 - RNA, 19 nt, Homo sapiens
ccaaguaagggcacagauc

SEQ ID NO: 250913 - RNA, 19 nt, Homo sapiens
gcuuggcugcuguaucuuu

SEQ ID NO: 250914 - RNA, 19 nt, Homo sapiens
cuccagcccugcagcuauu

SEQ ID NO: 250915 - RNA, 19 nt, Homo sapiens
guguguaccaucuuuguga

SEQ ID NO: 250916 - RNA, 19 nt, Homo sapiens
cuaggcagaucacguugca

SEQ ID NO: 250917 - RNA, 19 nt, Homo sapiens
gcagagucccgugcccauu

SEQ ID NO: 250918 - RNA, 19 nt, Homo sapiens
gcugcuguaucuuuaaugc

SEQ ID NO: 250919 - RNA, 19 nt, Homo sapiens
ggacauccccuucugcaau

SEQ ID NO: 250920 - RNA, 19 nt, Homo sapiens
gaguucagggcccuuaaug

SEQ ID NO: 250921 - RNA, 19 nt, Homo sapiens
ggaguucagggcccuuaau

SEQ ID NO: 250922 - RNA, 19 nt, Homo sapiens
ccacagaugcaacauaagc

SEQ ID NO: 250923 - RNA, 19 nt, Homo sapiens
gagcccgcauccuuaagca

SEQ ID NO: 250924 - RNA, 19 nt, Homo sapiens
agagggcugcugaccauuu

SEQ ID NO: 250925 - RNA, 19 nt, Homo sapiens
acagggcagggccucauua

SEQ ID NO: 250926 - RNA, 19 nt, Homo sapiens
gaacugaacuggaacaaca

SEQ ID NO: 250927 - RNA, 19 nt, Homo sapiens
gaacucggauaaugauaaa

SEQ ID NO: 250928 - RNA, 19 nt, Homo sapiens
guacuaacuuuccuucauu

SEQ ID NO: 250929 - RNA, 19 nt, Homo sapiens
gaaccuaacacuucacaaa

SEQ ID NO: 250930 - RNA, 19 nt, Homo sapiens
uagaggaucuuguuacuga

SEQ ID NO: 250931 - RNA, 19 nt, Homo sapiens
caccacagcugauuucuuc

SEQ ID NO: 250932 - RNA, 19 nt, Homo sapiens
gaaccuagaggaucuuguu

SEQ ID NO: 250933 - RNA, 19 nt, Homo sapiens
gagaauccuuuccuguuug

SEQ ID NO: 250934 - RNA, 19 nt, Homo sapiens
cagcuggacugaacaauca

SEQ ID NO: 250935 - RNA, 19 nt, Homo sapiens
agagaauccuuuccuguuu

SEQ ID NO: 250936 - RNA, 19 nt, Homo sapiens
ucccagagguucaguguuu

SEQ ID NO: 250937 - RNA, 19 nt, Homo sapiens
ccagagaaccuaacacuuc

SEQ ID NO: 250938 - RNA, 19 nt, Homo sapiens
gaccacagcuggacugaac

SEQ ID NO: 250939 - RNA, 19 nt, Homo sapiens
uacaagaacucggauaaug

SEQ ID NO: 250940 - RNA, 19 nt, Homo sapiens
caaccucacucugcauuau

SEQ ID NO: 250941 - RNA, 19 nt, Homo sapiens
gccacuaucuauucucuga

SEQ ID NO: 250942 - RNA, 19 nt, Homo sapiens
gaagacaccacagcugauu

SEQ ID NO: 250943 - RNA, 19 nt, Homo sapiens
gaaccgaugagaaauaaag

SEQ ID NO: 250944 - RNA, 19 nt, Homo sapiens
gaacuggaacaacagauuc

SEQ ID NO: 250945 - RNA, 19 nt, Homo sapiens
gguacuaacuuuccuucau

SEQ ID NO: 250946 - RNA, 19 nt, Homo sapiens
cagagaaccuaacacuuca

SEQ ID NO: 250947 - RNA, 19 nt, Homo sapiens
ugaagaaccuagaggaucu

SEQ ID NO: 250948 - RNA, 19 nt, Homo sapiens
gguacaagaacucggauaa

SEQ ID NO: 250949 - RNA, 19 nt, Homo sapiens
gggcugaacacgacaauuc

SEQ ID NO: 250950 - RNA, 19 nt, Homo sapiens
uaacuuuccuucauucaac

SEQ ID NO: 250951 - RNA, 19 nt, Homo sapiens
gcucagcauuggagugaau

SEQ ID NO: 250952 - RNA, 19 nt, Homo sapiens
ucaguggauuauagacaua

SEQ ID NO: 250953 - RNA, 19 nt, Homo sapiens
gaacaacagauucuugaac

SEQ ID NO: 250954 - RNA, 19 nt, Homo sapiens
gaagccaucauuaccauuc

SEQ ID NO: 250955 - RNA, 19 nt, Homo sapiens
gagcaagcgccauguugaa

SEQ ID NO: 250956 - RNA, 19 nt, Homo sapiens
cugaaccgaugagaaauaa

SEQ ID NO: 250957 - RNA, 19 nt, Homo sapiens
ggagacaggccacacagau

SEQ ID NO: 250958 - RNA, 19 nt, Homo sapiens
acaagaacucggauaauga

SEQ ID NO: 250959 - RNA, 19 nt, Homo sapiens
gagauccaccucuaccaaa

SEQ ID NO: 250960 - RNA, 19 nt, Homo sapiens
ugaccacuaugcccacuga

SEQ ID NO: 250961 - RNA, 19 nt, Homo sapiens
ccaccucuaccaaacauuu

SEQ ID NO: 250962 - RNA, 19 nt, Homo sapiens
ggagauccaccucuaccaa

SEQ ID NO: 250963 - RNA, 19 nt, Homo sapiens
caagaacucggauaaugau

SEQ ID NO: 250964 - RNA, 19 nt, Homo sapiens
caucuacccuccgauuguu

SEQ ID NO: 250965 - RNA, 19 nt, Homo sapiens
ccgaugagaaauaaaguuu

SEQ ID NO: 250966 - RNA, 19 nt, Homo sapiens
cauguugaagccaucauua

SEQ ID NO: 250967 - RNA, 19 nt, Homo sapiens
ggaacaacagauucuugaa

SEQ ID NO: 250968 - RNA, 19 nt, Homo sapiens
aaaaggagauccaccucua

SEQ ID NO: 250969 - RNA, 19 nt, Homo sapiens
cacuguggcugauuuggaa

SEQ ID NO: 250970 - RNA, 19 nt, Homo sapiens
gaauucccacccugaagaa

SEQ ID NO: 250971 - RNA, 19 nt, Homo sapiens
ucacaucccucuuauuccu

SEQ ID NO: 250972 - RNA, 19 nt, Homo sapiens
gagugaaucccagcuagaa

SEQ ID NO: 250973 - RNA, 19 nt, Homo sapiens
cgaauucccacccugaaga

SEQ ID NO: 250974 - RNA, 19 nt, Homo sapiens
gaauggagccacccaaucc

SEQ ID NO: 250975 - RNA, 19 nt, Homo sapiens
ccauucacaucccucuuau

SEQ ID NO: 250976 - RNA, 19 nt, Homo sapiens
gugcagccacuaucuauuc

SEQ ID NO: 250977 - RNA, 19 nt, Homo sapiens
agaacucggauaaugauaa

SEQ ID NO: 250978 - RNA, 19 nt, Homo sapiens
ccugaaccgaugagaaaua

SEQ ID NO: 250979 - RNA, 19 nt, Homo sapiens
gacucugccucgucaguga

SEQ ID NO: 250980 - RNA, 19 nt, Homo sapiens
gagacaggccacacagaug

SEQ ID NO: 250981 - RNA, 19 nt, Homo sapiens
guacaagaacucggauaau

SEQ ID NO: 250982 - RNA, 19 nt, Homo sapiens
ucacucugcauuauuggua

SEQ ID NO: 250983 - RNA, 19 nt, Homo sapiens
gcagccagacuacagugaa

SEQ ID NO: 250984 - RNA, 19 nt, Homo sapiens
aagagaauccuuuccuguu

SEQ ID NO: 250985 - RNA, 19 nt, Homo sapiens
gagcaauacuucaaaagag

SEQ ID NO: 250986 - RNA, 19 nt, Homo sapiens
ccuaacacuucacaaacug

SEQ ID NO: 250987 - RNA, 19 nt, Homo sapiens
ccacacagaugcuaaaacu

SEQ ID NO: 250988 - RNA, 19 nt, Homo sapiens
ugaauaccacgggaacuuu

SEQ ID NO: 250989 - RNA, 19 nt, Homo sapiens
gauuaucagccuucucugu

SEQ ID NO: 250990 - RNA, 19 nt, Homo sapiens
ugaacuggaacaacagauu

SEQ ID NO: 250991 - RNA, 19 nt, Homo sapiens
ccuguagcccuaaguggua

SEQ ID NO: 250992 - RNA, 19 nt, Homo sapiens
ccuagaggaucuuguuacu

SEQ ID NO: 250993 - RNA, 19 nt, Homo sapiens
agcuagaacugaacuggaa

SEQ ID NO: 250994 - RNA, 19 nt, Homo sapiens
aaucccagcuagaacugaa

SEQ ID NO: 250995 - RNA, 19 nt, Homo sapiens
augauaaaguccagaagug

SEQ ID NO: 250996 - RNA, 19 nt, Homo sapiens
uacaugaauugcacuugga

SEQ ID NO: 250997 - RNA, 19 nt, Homo sapiens
aggaucuuguuacugaaua

SEQ ID NO: 250998 - RNA, 19 nt, Homo sapiens
uggaacaacagauucuuga

SEQ ID NO: 250999 - RNA, 19 nt, Homo sapiens
ccaaccucacucugcauua

SEQ ID NO: 251000 - RNA, 19 nt, Homo sapiens
guaagcaccccuucauuug

SEQ ID NO: 251001 - RNA, 19 nt, Homo sapiens
gaggaucuuguuacugaau

SEQ ID NO: 251002 - RNA, 19 nt, Homo sapiens
gcauuggaagccgugguua

SEQ ID NO: 251003 - RNA, 19 nt, Homo sapiens
ggagcaauacuucaaaaga

SEQ ID NO: 251004 - RNA, 19 nt, Homo sapiens
cagccacuaucuauucucu

SEQ ID NO: 251005 - RNA, 19 nt, Homo sapiens
ccaccugcgucucauacuc

SEQ ID NO: 251006 - RNA, 19 nt, Homo sapiens
agagcaagcgccauguuga

SEQ ID NO: 251007 - RNA, 19 nt, Homo sapiens
gagaaccuaacacuucaca

SEQ ID NO: 251008 - RNA, 19 nt, Homo sapiens
auucacaucccucuuauuc

SEQ ID NO: 251009 - RNA, 19 nt, Homo sapiens
accauucacaucccucuua

SEQ ID NO: 251010 - RNA, 19 nt, Homo sapiens
ccacagcuggacugaacaa

SEQ ID NO: 251011 - RNA, 19 nt, Homo sapiens
caucauuaccauucacauc

SEQ ID NO: 251012 - RNA, 19 nt, Homo sapiens
ccaucuacccuccgauugu

SEQ ID NO: 251013 - RNA, 19 nt, Homo sapiens
ggaucuuguuacugaauac

SEQ ID NO: 251014 - RNA, 19 nt, Homo sapiens
ggggagcaauacuucaaaa

SEQ ID NO: 251015 - RNA, 19 nt, Homo sapiens
uaguguggaugggcagaaa

SEQ ID NO: 251016 - RNA, 19 nt, Homo sapiens
agacaccacagcugauuuc

SEQ ID NO: 251017 - RNA, 19 nt, Homo sapiens
gagguucaguguuuugugu

SEQ ID NO: 251018 - RNA, 19 nt, Homo sapiens
uuccugaaccgaugagaaa

SEQ ID NO: 251019 - RNA, 19 nt, Homo sapiens
cacuugagaauuacccuuu

SEQ ID NO: 251020 - RNA, 19 nt, Homo sapiens
ggccuggaguggugugucu

SEQ ID NO: 251021 - RNA, 19 nt, Homo sapiens
gaauaccacgggaacuuuu

SEQ ID NO: 251022 - RNA, 19 nt, Homo sapiens
cguguucggagccgcuuua

SEQ ID NO: 251023 - RNA, 19 nt, Homo sapiens
cacuaucuauucucugaag

SEQ ID NO: 251024 - RNA, 19 nt, Homo sapiens
uguggcugauuuggaauuu

SEQ ID NO: 251025 - RNA, 19 nt, Homo sapiens
cugcauuauugguacaaga

SEQ ID NO: 251026 - RNA, 19 nt, Homo sapiens
ggaggaaacugacguucua

SEQ ID NO: 251027 - RNA, 19 nt, Homo sapiens
aaacugacguucuaucuga

SEQ ID NO: 251028 - RNA, 19 nt, Homo sapiens
gcucuaacaugaucgauga

SEQ ID NO: 251029 - RNA, 19 nt, Homo sapiens
gcaauugagagcauucuua

SEQ ID NO: 251030 - RNA, 19 nt, Homo sapiens
ggucaucucucacacauuc

SEQ ID NO: 251031 - RNA, 19 nt, Homo sapiens
agaauaaacuagacucuga

SEQ ID NO: 251032 - RNA, 19 nt, Homo sapiens
gggagcauguucauuugua

SEQ ID NO: 251033 - RNA, 19 nt, Homo sapiens
ccagaagcauuucaccuuu

SEQ ID NO: 251034 - RNA, 19 nt, Homo sapiens
ggccaaaccuggaggcauu

SEQ ID NO: 251035 - RNA, 19 nt, Homo sapiens
uaacugcucuaacaugauc

SEQ ID NO: 251036 - RNA, 19 nt, Homo sapiens
caauugagagcauucuuaa

SEQ ID NO: 251037 - RNA, 19 nt, Homo sapiens
cuagggaugugugagaaua

SEQ ID NO: 251038 - RNA, 19 nt, Homo sapiens
caaggacggugacuggaau

SEQ ID NO: 251039 - RNA, 19 nt, Homo sapiens
gacggugacuggaaugaau

SEQ ID NO: 251040 - RNA, 19 nt, Homo sapiens
ggagugugaacuguauuua

SEQ ID NO: 251041 - RNA, 19 nt, Homo sapiens
gaauaaacuagacucugaa

SEQ ID NO: 251042 - RNA, 19 nt, Homo sapiens
gaacgcaucagcaauugag

SEQ ID NO: 251043 - RNA, 19 nt, Homo sapiens
ggaaacugacguucuaucu

SEQ ID NO: 251044 - RNA, 19 nt, Homo sapiens
cgacauccaauccauauca

SEQ ID NO: 251045 - RNA, 19 nt, Homo sapiens
ccacgaaggaccagaacaa

SEQ ID NO: 251046 - RNA, 19 nt, Homo sapiens
acagaacgcaucagcaauu

SEQ ID NO: 251047 - RNA, 19 nt, Homo sapiens
gcagccaccuuugccuuug

SEQ ID NO: 251048 - RNA, 19 nt, Homo sapiens
cagaacgcaucagcaauug

SEQ ID NO: 251049 - RNA, 19 nt, Homo sapiens
caagacauucugauggaaa

SEQ ID NO: 251050 - RNA, 19 nt, Homo sapiens
gaagaccaagacauucuga

SEQ ID NO: 251051 - RNA, 19 nt, Homo sapiens
uuuauugccuggaguguga

SEQ ID NO: 251052 - RNA, 19 nt, Homo sapiens
gaaacugacguucuaucug

SEQ ID NO: 251053 - RNA, 19 nt, Homo sapiens
ggacuucaacaaccucaau

SEQ ID NO: 251054 - RNA, 19 nt, Homo sapiens
gacauccaauccauaucaa

SEQ ID NO: 251055 - RNA, 19 nt, Homo sapiens
caucagcaauugagagcau

SEQ ID NO: 251056 - RNA, 19 nt, Homo sapiens
acaacgcccuugaagacaa

SEQ ID NO: 251057 - RNA, 19 nt, Homo sapiens
uuacagaacgcaucagcaa

SEQ ID NO: 251058 - RNA, 19 nt, Homo sapiens
ccaagacauucugauggaa

SEQ ID NO: 251059 - RNA, 19 nt, Homo sapiens
cuaacaugaucgaugaaau

SEQ ID NO: 251060 - RNA, 19 nt, Homo sapiens
ggacuccaagcucccauga

SEQ ID NO: 251061 - RNA, 19 nt, Homo sapiens
gagugugaacuguauuuau

SEQ ID NO: 251062 - RNA, 19 nt, Homo sapiens
ggagcauguucauuuguac

SEQ ID NO: 251063 - RNA, 19 nt, Homo sapiens
ccuggagugugaacuguau

SEQ ID NO: 251064 - RNA, 19 nt, Homo sapiens
gaugugugagaauaaacua

SEQ ID NO: 251065 - RNA, 19 nt, Homo sapiens
ugaaaccucugggucaucu

SEQ ID NO: 251066 - RNA, 19 nt, Homo sapiens
gaccagaacaagacagagu

SEQ ID NO: 251067 - RNA, 19 nt, Homo sapiens
ggacggugacuggaaugaa

SEQ ID NO: 251068 - RNA, 19 nt, Homo sapiens
agacaacgcccuugaagac

SEQ ID NO: 251069 - RNA, 19 nt, Homo sapiens
ucauuuguaccucgaguuu

SEQ ID NO: 251070 - RNA, 19 nt, Homo sapiens
uugaagacaagcuggguua

SEQ ID NO: 251071 - RNA, 19 nt, Homo sapiens
ugaaaacccuugagaaugc

SEQ ID NO: 251072 - RNA, 19 nt, Homo sapiens
gggaagaccaagacauucu

SEQ ID NO: 251073 - RNA, 19 nt, Homo sapiens
ucaaggacggugacuggaa

SEQ ID NO: 251074 - RNA, 19 nt, Homo sapiens
accaagacauucugaugga

SEQ ID NO: 251075 - RNA, 19 nt, Homo sapiens
cgaaggaccagaacaagac

SEQ ID NO: 251076 - RNA, 19 nt, Homo sapiens
aagacaagcuggguuaacu

SEQ ID NO: 251077 - RNA, 19 nt, Homo sapiens
ggaagaccaagacauucug

SEQ ID NO: 251078 - RNA, 19 nt, Homo sapiens
ugucaagaguuuacagaac

SEQ ID NO: 251079 - RNA, 19 nt, Homo sapiens
gaagacaagcuggguuaac

SEQ ID NO: 251080 - RNA, 19 nt, Homo sapiens
cagaagcauuucaccuuuu

SEQ ID NO: 251081 - RNA, 19 nt, Homo sapiens
uccaggaccagaagcauuu

SEQ ID NO: 251082 - RNA, 19 nt, Homo sapiens
gcacccacgcgacauccaa

SEQ ID NO: 251083 - RNA, 19 nt, Homo sapiens
gaaggaccagaacaagaca

SEQ ID NO: 251084 - RNA, 19 nt, Homo sapiens
agaccaagacauucugaug

SEQ ID NO: 251085 - RNA, 19 nt, Homo sapiens
cagacaacgcccuugaaga

SEQ ID NO: 251086 - RNA, 19 nt, Homo sapiens
agaaugcgcaggcucaaca

SEQ ID NO: 251087 - RNA, 19 nt, Homo sapiens
ccagacaacgcccuugaag

SEQ ID NO: 251088 - RNA, 19 nt, Homo sapiens
agggaugugugagaauaaa

SEQ ID NO: 251089 - RNA, 19 nt, Homo sapiens
acacauuccaggaccagaa

SEQ ID NO: 251090 - RNA, 19 nt, Homo sapiens
uuuaucccauugagacuau

SEQ ID NO: 251091 - RNA, 19 nt, Homo sapiens
ugccuuugcuggacuucaa

SEQ ID NO: 251092 - RNA, 19 nt, Homo sapiens
gcucccauuuggccuugug

SEQ ID NO: 251093 - RNA, 19 nt, Homo sapiens
aggcucaacagacgacuuu

SEQ ID NO: 251094 - RNA, 19 nt, Homo sapiens
gcacuuugaucuccauuua

SEQ ID NO: 251095 - RNA, 19 nt, Homo sapiens
ggagaugccuguguaauuu

SEQ ID NO: 251096 - RNA, 19 nt, Homo sapiens
caacaugacugcaaagugu

SEQ ID NO: 251097 - RNA, 19 nt, Homo sapiens
gaagguaucuggugaugca

SEQ ID NO: 251098 - RNA, 19 nt, Homo sapiens
gcuaugagcuucagauaca

SEQ ID NO: 251099 - RNA, 19 nt, Homo sapiens
ggaaagaguguaugaauuc

SEQ ID NO: 251100 - RNA, 19 nt, Homo sapiens
gggaaagaguguaugaauu

SEQ ID NO: 251101 - RNA, 19 nt, Homo sapiens
ggaagaagaacagaacuuu

SEQ ID NO: 251102 - RNA, 19 nt, Homo sapiens
gcaauuuccuuaugugaag

SEQ ID NO: 251103 - RNA, 19 nt, Homo sapiens
uaagacacauuccuuuaug

SEQ ID NO: 251104 - RNA, 19 nt, Homo sapiens
acagaaaugugaccgauau

SEQ ID NO: 251105 - RNA, 19 nt, Homo sapiens
ccgcaucccucacaugaaa

SEQ ID NO: 251106 - RNA, 19 nt, Homo sapiens
caacaggcgucaacaguac

SEQ ID NO: 251107 - RNA, 19 nt, Homo sapiens
caugggagaugccugugua

SEQ ID NO: 251108 - RNA, 19 nt, Homo sapiens
gaccuuaacagaaauguga

SEQ ID NO: 251109 - RNA, 19 nt, Homo sapiens
ccugggaccuuaacagaaa

SEQ ID NO: 251110 - RNA, 19 nt, Homo sapiens
gauccaaacccaccaauca

SEQ ID NO: 251111 - RNA, 19 nt, Homo sapiens
gaacaggucagagacagaa

SEQ ID NO: 251112 - RNA, 19 nt, Homo sapiens
uaugugaagugaccaacua

SEQ ID NO: 251113 - RNA, 19 nt, Homo sapiens
gaagaagaacagaacuuug

SEQ ID NO: 251114 - RNA, 19 nt, Homo sapiens
gggagaugccuguguaauu

SEQ ID NO: 251115 - RNA, 19 nt, Homo sapiens
guaauaagacacauuccuu

SEQ ID NO: 251116 - RNA, 19 nt, Homo sapiens
gggaagauaucagaaacau

SEQ ID NO: 251117 - RNA, 19 nt, Homo sapiens
gaaagaguguaugaauucu

SEQ ID NO: 251118 - RNA, 19 nt, Homo sapiens
ucacagaacaggucagaga

SEQ ID NO: 251119 - RNA, 19 nt, Homo sapiens
ggagcaauuuccuuaugug

SEQ ID NO: 251120 - RNA, 19 nt, Homo sapiens
caguugaccugggaccuua

SEQ ID NO: 251121 - RNA, 19 nt, Homo sapiens
ucacgaaccuaaggaugaa

SEQ ID NO: 251122 - RNA, 19 nt, Homo sapiens
cagauaaguuugucgucuu

SEQ ID NO: 251123 - RNA, 19 nt, Homo sapiens
uaaagacgccgacuauucu

SEQ ID NO: 251124 - RNA, 19 nt, Homo sapiens
ccaacaggcgucaacagua

SEQ ID NO: 251125 - RNA, 19 nt, Homo sapiens
gaaaugugaccgauaucga

SEQ ID NO: 251126 - RNA, 19 nt, Homo sapiens
ccaccaaucacgaaccuaa

SEQ ID NO: 251127 - RNA, 19 nt, Homo sapiens
acagaacuuuguguguuua

SEQ ID NO: 251128 - RNA, 19 nt, Homo sapiens
agauaaguuugucgucuuu

SEQ ID NO: 251129 - RNA, 19 nt, Homo sapiens
uuaaagacgccgacuauuc

SEQ ID NO: 251130 - RNA, 19 nt, Homo sapiens
ugaccgauaucgagugugu

SEQ ID NO: 251131 - RNA, 19 nt, Homo sapiens
gaagaacagaacuuugugu

SEQ ID NO: 251132 - RNA, 19 nt, Homo sapiens
ccacacagcacuuugaucu

SEQ ID NO: 251133 - RNA, 19 nt, Homo sapiens
gagcaauuuccuuauguga

SEQ ID NO: 251134 - RNA, 19 nt, Homo sapiens
gaagcugccaggaagaaga

SEQ ID NO: 251135 - RNA, 19 nt, Homo sapiens
aggagugucuggugacuga

SEQ ID NO: 251136 - RNA, 19 nt, Homo sapiens
gagaaugcagccuguaauc

SEQ ID NO: 251137 - RNA, 19 nt, Homo sapiens
ggauucaugacguggauuu

SEQ ID NO: 251138 - RNA, 19 nt, Homo sapiens
aagcaaaggcucagcaguu

SEQ ID NO: 251139 - RNA, 19 nt, Homo sapiens
guuuggagcaauuuccuua

SEQ ID NO: 251140 - RNA, 19 nt, Homo sapiens
cgauaucgaguguguuaaa

SEQ ID NO: 251141 - RNA, 19 nt, Homo sapiens
gaaccacgaaggcuguuuc

SEQ ID NO: 251142 - RNA, 19 nt, Homo sapiens
aagaagaacagaacuuugu

SEQ ID NO: 251143 - RNA, 19 nt, Homo sapiens
gagcgcagccuucgguauc

SEQ ID NO: 251144 - RNA, 19 nt, Homo sapiens
gauaucgaguguguuaaag

SEQ ID NO: 251145 - RNA, 19 nt, Homo sapiens
gaccugggaccuuaacaga

SEQ ID NO: 251146 - RNA, 19 nt, Homo sapiens
gcaaaggcucagcaguuga

SEQ ID NO: 251147 - RNA, 19 nt, Homo sapiens
aaacgaaggaagauccaaa

SEQ ID NO: 251148 - RNA, 19 nt, Homo sapiens
cagaucuucucaacuggaa

SEQ ID NO: 251149 - RNA, 19 nt, Homo sapiens
cagaaccuccuuccagcua

SEQ ID NO: 251150 - RNA, 19 nt, Homo sapiens
cacccaacaugacugcaaa

SEQ ID NO: 251151 - RNA, 19 nt, Homo sapiens
ggaggagggcgcaaacaca

SEQ ID NO: 251152 - RNA, 19 nt, Homo sapiens
ugacugcaaaguguaauaa

SEQ ID NO: 251153 - RNA, 19 nt, Homo sapiens
uaucagaaacauccuagga

SEQ ID NO: 251154 - RNA, 19 nt, Homo sapiens
gaagauccaaacccaccaa

SEQ ID NO: 251155 - RNA, 19 nt, Homo sapiens
gagcugcguucccgauggu

SEQ ID NO: 251156 - RNA, 19 nt, Homo sapiens
caacaguacgagugucuuc

SEQ ID NO: 251157 - RNA, 19 nt, Homo sapiens
aaguacaggucgugcagaa

SEQ ID NO: 251158 - RNA, 19 nt, Homo sapiens
acugcaaaguguaauaaga

SEQ ID NO: 251159 - RNA, 19 nt, Homo sapiens
agcaaaggcucagcaguug

SEQ ID NO: 251160 - RNA, 19 nt, Homo sapiens
caaauuucgcuaugagcuu

SEQ ID NO: 251161 - RNA, 19 nt, Homo sapiens
aaucgcaaauuucgcuaug

SEQ ID NO: 251162 - RNA, 19 nt, Homo sapiens
gaaccuccuuccagcuacu

SEQ ID NO: 251163 - RNA, 19 nt, Homo sapiens
gaaugcagccuguaaucac

SEQ ID NO: 251164 - RNA, 19 nt, Homo sapiens
aagagaaugcagccuguaa

SEQ ID NO: 251165 - RNA, 19 nt, Homo sapiens
uggagcaauuuccuuaugu

SEQ ID NO: 251166 - RNA, 19 nt, Homo sapiens
uggauccucuucccugaga

SEQ ID NO: 251167 - RNA, 19 nt, Homo sapiens
guacaggucgugcagaaaa

SEQ ID NO: 251168 - RNA, 19 nt, Homo sapiens
cgggaaagaguguaugaau

SEQ ID NO: 251169 - RNA, 19 nt, Homo sapiens
gcaggugcggagaaucuga

SEQ ID NO: 251170 - RNA, 19 nt, Homo sapiens
uaucgaguguguuaaagac

SEQ ID NO: 251171 - RNA, 19 nt, Homo sapiens
gcaguugaccugggaccuu

SEQ ID NO: 251172 - RNA, 19 nt, Homo sapiens
gagaugccuguguaauuuc

SEQ ID NO: 251173 - RNA, 19 nt, Homo sapiens
cuccagcgguucucaaagu

SEQ ID NO: 251174 - RNA, 19 nt, Homo sapiens
gggcaggugcggagaaucu

SEQ ID NO: 251175 - RNA, 19 nt, Homo sapiens
uguuaaagacgccgacuau

SEQ ID NO: 251176 - RNA, 19 nt, Homo sapiens
caaacccaccaaucacgaa

SEQ ID NO: 251177 - RNA, 19 nt, Homo sapiens
ucgcaaauuucgcuaugag

SEQ ID NO: 251178 - RNA, 19 nt, Homo sapiens
ugagaagucauuucaaucg

SEQ ID NO: 251179 - RNA, 19 nt, Homo sapiens
acuuugaucuccauuuaag

SEQ ID NO: 251180 - RNA, 19 nt, Homo sapiens
accgauaucgaguguguua

SEQ ID NO: 251181 - RNA, 19 nt, Homo sapiens
gccaacaggcgucaacagu

SEQ ID NO: 251182 - RNA, 19 nt, Homo sapiens
uuggagcaauuuccuuaug

SEQ ID NO: 251183 - RNA, 19 nt, Homo sapiens
ggaggagugucuggugacu

SEQ ID NO: 251184 - RNA, 19 nt, Homo sapiens
ccacugccagauccuuauu

SEQ ID NO: 251185 - RNA, 19 nt, Homo sapiens
uuuaugcacuggaaaauga

SEQ ID NO: 251186 - RNA, 19 nt, Homo sapiens
ccaacaugacugcaaagug

SEQ ID NO: 251187 - RNA, 19 nt, Homo sapiens
gcucagggaacacguaucg

SEQ ID NO: 251188 - RNA, 19 nt, Homo sapiens
gaugcucagggaacacgua

SEQ ID NO: 251189 - RNA, 19 nt, Homo sapiens
cagcgcacacgggaagaua

SEQ ID NO: 251190 - RNA, 19 nt, Homo sapiens
gcaucccucacaugaaaga

SEQ ID NO: 251191 - RNA, 19 nt, Homo sapiens
gaaccuaaggaugaaagca

SEQ ID NO: 251192 - RNA, 19 nt, Homo sapiens
ccaggaagaagaacagaac

SEQ ID NO: 251193 - RNA, 19 nt, Homo sapiens
ggagcgcagccuucgguau

SEQ ID NO: 251194 - RNA, 19 nt, Homo sapiens
gaacacaacugagaaggaa

SEQ ID NO: 251195 - RNA, 19 nt, Homo sapiens
gaagagaggugcugauugg

SEQ ID NO: 251196 - RNA, 19 nt, Homo sapiens
gcaaaucgacaccuauuaa

SEQ ID NO: 251197 - RNA, 19 nt, Homo sapiens
caagugcgauaucaccuua

SEQ ID NO: 251198 - RNA, 19 nt, Homo sapiens
uaaagacgaucaugagaga

SEQ ID NO: 251199 - RNA, 19 nt, Homo sapiens
ggacacaagugcgauauca

SEQ ID NO: 251200 - RNA, 19 nt, Homo sapiens
ugaaacggcucgacaggaa

SEQ ID NO: 251201 - RNA, 19 nt, Homo sapiens
acaagcagcugauccgauu

SEQ ID NO: 251202 - RNA, 19 nt, Homo sapiens
gaccguaacagacaucuuu

SEQ ID NO: 251203 - RNA, 19 nt, Homo sapiens
gaaggaagccaaccagagu

SEQ ID NO: 251204 - RNA, 19 nt, Homo sapiens
ccaagugacugacaaucug

SEQ ID NO: 251205 - RNA, 19 nt, Homo sapiens
ugucagcauugcaucguua

SEQ ID NO: 251206 - RNA, 19 nt, Homo sapiens
ggaagagaggugcugauug

SEQ ID NO: 251207 - RNA, 19 nt, Homo sapiens
aagagcaaauuauggugua

SEQ ID NO: 251208 - RNA, 19 nt, Homo sapiens
gaucaugagagagaaauau

SEQ ID NO: 251209 - RNA, 19 nt, Homo sapiens
gagagaaauauucaaagug

SEQ ID NO: 251210 - RNA, 19 nt, Homo sapiens
gaaaggcuaaagacgauca

SEQ ID NO: 251211 - RNA, 19 nt, Homo sapiens
guuagcuucuccugauaaa

SEQ ID NO: 251212 - RNA, 19 nt, Homo sapiens
ucaaaguguucgagcugaa

SEQ ID NO: 251213 - RNA, 19 nt, Homo sapiens
uggaaaggcuaaagacgau

SEQ ID NO: 251214 - RNA, 19 nt, Homo sapiens
gaauuccuguccugugaag

SEQ ID NO: 251215 - RNA, 19 nt, Homo sapiens
ccaagaacacaacugagaa

SEQ ID NO: 251216 - RNA, 19 nt, Homo sapiens
gcaccgaguugaccguaac

SEQ ID NO: 251217 - RNA, 19 nt, Homo sapiens
caaaucgacaccuauuaau

SEQ ID NO: 251218 - RNA, 19 nt, Homo sapiens
gcuaaagacgaucaugaga

SEQ ID NO: 251219 - RNA, 19 nt, Homo sapiens
gccccaagcugauaagauu

SEQ ID NO: 251220 - RNA, 19 nt, Homo sapiens
uugaauuccuguccuguga

SEQ ID NO: 251221 - RNA, 19 nt, Homo sapiens
ugacugacaaucuggugua

SEQ ID NO: 251222 - RNA, 19 nt, Homo sapiens
cuaaagagcaaauuauggu

SEQ ID NO: 251223 - RNA, 19 nt, Homo sapiens
acaaucugguguaacgaaa

SEQ ID NO: 251224 - RNA, 19 nt, Homo sapiens
cuauuggucugauuucaca

SEQ ID NO: 251225 - RNA, 19 nt, Homo sapiens
gacaaucugguguaacgaa

SEQ ID NO: 251226 - RNA, 19 nt, Homo sapiens
gacugacaaucugguguaa

SEQ ID NO: 251227 - RNA, 19 nt, Homo sapiens
ugauuucacaggaacauuu

SEQ ID NO: 251228 - RNA, 19 nt, Homo sapiens
caugagagagaaauauuca

SEQ ID NO: 251229 - RNA, 19 nt, Homo sapiens
agauaucuuugucagcauu

SEQ ID NO: 251230 - RNA, 19 nt, Homo sapiens
gagagagaaauauucaaag

SEQ ID NO: 251231 - RNA, 19 nt, Homo sapiens
gcugauccgauuccugaaa

SEQ ID NO: 251232 - RNA, 19 nt, Homo sapiens
gcaugugccggcaacuuug

SEQ ID NO: 251233 - RNA, 19 nt, Homo sapiens
caagaacacaacugagaag

SEQ ID NO: 251234 - RNA, 19 nt, Homo sapiens
gaguugaccguaacagaca

SEQ ID NO: 251235 - RNA, 19 nt, Homo sapiens
aaaucgacaccuauuaaug

SEQ ID NO: 251236 - RNA, 19 nt, Homo sapiens
cauugucacugcaaaucga

SEQ ID NO: 251237 - RNA, 19 nt, Homo sapiens
gagauaucuuugucagcau

SEQ ID NO: 251238 - RNA, 19 nt, Homo sapiens
aaaguguucgagcugaaua

SEQ ID NO: 251239 - RNA, 19 nt, Homo sapiens
aaucgacaccuauuaaugg

SEQ ID NO: 251240 - RNA, 19 nt, Homo sapiens
ccuccaagaacacaacuga

SEQ ID NO: 251241 - RNA, 19 nt, Homo sapiens
cccaagcugauaagauuaa

SEQ ID NO: 251242 - RNA, 19 nt, Homo sapiens
uccaagaacacaacugaga

SEQ ID NO: 251243 - RNA, 19 nt, Homo sapiens
agagcaaauuaugguguaa

SEQ ID NO: 251244 - RNA, 19 nt, Homo sapiens
ugcaaaucgacaccuauua

SEQ ID NO: 251245 - RNA, 19 nt, Homo sapiens
uguucgagcugaauauuuu

SEQ ID NO: 251246 - RNA, 19 nt, Homo sapiens
uuccuaugcugaaacuuug

SEQ ID NO: 251247 - RNA, 19 nt, Homo sapiens
uagcuucuccugauaaacu

SEQ ID NO: 251248 - RNA, 19 nt, Homo sapiens
ucguuagcuucuccugaua

SEQ ID NO: 251249 - RNA, 19 nt, Homo sapiens
uggaagagaggugcugauu

SEQ ID NO: 251250 - RNA, 19 nt, Homo sapiens
ccaagcugauaagauuaau

SEQ ID NO: 251251 - RNA, 19 nt, Homo sapiens
gaagccaaccagaguacgu

SEQ ID NO: 251252 - RNA, 19 nt, Homo sapiens
uguaauuuccuaugcugaa

SEQ ID NO: 251253 - RNA, 19 nt, Homo sapiens
cacugcaaaucgacaccua

SEQ ID NO: 251254 - RNA, 19 nt, Homo sapiens
caaaguguucgagcugaau

SEQ ID NO: 251255 - RNA, 19 nt, Homo sapiens
agacgaucaugagagagaa

SEQ ID NO: 251256 - RNA, 19 nt, Homo sapiens
uuggaaaacuucuuggaaa

SEQ ID NO: 251257 - RNA, 19 nt, Homo sapiens
cuacagccaccaugagaag

SEQ ID NO: 251258 - RNA, 19 nt, Homo sapiens
cugcaaaucgacaccuauu

SEQ ID NO: 251259 - RNA, 19 nt, Homo sapiens
guguucgagcugaauauuu

SEQ ID NO: 251260 - RNA, 19 nt, Homo sapiens
aagacgaucaugagagaga

SEQ ID NO: 251261 - RNA, 19 nt, Homo sapiens
gaacacaacugagaaggaa

SEQ ID NO: 251262 - RNA, 19 nt, Homo sapiens
gaagagaggugcugauugg

SEQ ID NO: 251263 - RNA, 19 nt, Homo sapiens
gcaaaucgacaccuauuaa

SEQ ID NO: 251264 - RNA, 19 nt, Homo sapiens
caagugcgauaucaccuua

SEQ ID NO: 251265 - RNA, 19 nt, Homo sapiens
uaaagacgaucaugagaga

SEQ ID NO: 251266 - RNA, 19 nt, Homo sapiens
ggacacaagugcgauauca

SEQ ID NO: 251267 - RNA, 19 nt, Homo sapiens
ugaaacggcucgacaggaa

SEQ ID NO: 251268 - RNA, 19 nt, Homo sapiens
acaagcagcugauccgauu

SEQ ID NO: 251269 - RNA, 19 nt, Homo sapiens
gaaggaagccaaccagagu

SEQ ID NO: 251270 - RNA, 19 nt, Homo sapiens
ccaagugacugacaaucug

SEQ ID NO: 251271 - RNA, 19 nt, Homo sapiens
cagaagaacacaacugaga

SEQ ID NO: 251272 - RNA, 19 nt, Homo sapiens
ugucagcauugcaucguua

SEQ ID NO: 251273 - RNA, 19 nt, Homo sapiens
ggaagagaggugcugauug

SEQ ID NO: 251274 - RNA, 19 nt, Homo sapiens
aagagcaaauuauggugua

SEQ ID NO: 251275 - RNA, 19 nt, Homo sapiens
gaucaugagagagaaauau

SEQ ID NO: 251276 - RNA, 19 nt, Homo sapiens
gaagaacacaacugagaag

SEQ ID NO: 251277 - RNA, 19 nt, Homo sapiens
gagagaaauauucaaagug

SEQ ID NO: 251278 - RNA, 19 nt, Homo sapiens
gaaaggcuaaagacgauca

SEQ ID NO: 251279 - RNA, 19 nt, Homo sapiens
guuagcuucuccugauaaa

SEQ ID NO: 251280 - RNA, 19 nt, Homo sapiens
ucaaaguguucgagcugaa

SEQ ID NO: 251281 - RNA, 19 nt, Homo sapiens
uggaaaggcuaaagacgau

SEQ ID NO: 251282 - RNA, 19 nt, Homo sapiens
gaauuccuguccugugaag

SEQ ID NO: 251283 - RNA, 19 nt, Homo sapiens
caaaucgacaccuauuaau

SEQ ID NO: 251284 - RNA, 19 nt, Homo sapiens
gcuaaagacgaucaugaga

SEQ ID NO: 251285 - RNA, 19 nt, Homo sapiens
gccccaagcugauaagauu

SEQ ID NO: 251286 - RNA, 19 nt, Homo sapiens
uugaauuccuguccuguga

SEQ ID NO: 251287 - RNA, 19 nt, Homo sapiens
ugacugacaaucuggugua

SEQ ID NO: 251288 - RNA, 19 nt, Homo sapiens
cuaaagagcaaauuauggu

SEQ ID NO: 251289 - RNA, 19 nt, Homo sapiens
acaaucugguguaacgaaa

SEQ ID NO: 251290 - RNA, 19 nt, Homo sapiens
gacaaucugguguaacgaa

SEQ ID NO: 251291 - RNA, 19 nt, Homo sapiens
cuauuggucugauuucaca

SEQ ID NO: 251292 - RNA, 19 nt, Homo sapiens
gacugacaaucugguguaa

SEQ ID NO: 251293 - RNA, 19 nt, Homo sapiens
ugauuucacaggaacauuu

SEQ ID NO: 251294 - RNA, 19 nt, Homo sapiens
caugagagagaaauauuca

SEQ ID NO: 251295 - RNA, 19 nt, Homo sapiens
ucacagagcagaagaacac

SEQ ID NO: 251296 - RNA, 19 nt, Homo sapiens
gagcagaagaacacaacug

SEQ ID NO: 251297 - RNA, 19 nt, Homo sapiens
agauaucuuugucagcauu

SEQ ID NO: 251298 - RNA, 19 nt, Homo sapiens
gagagagaaauauucaaag

SEQ ID NO: 251299 - RNA, 19 nt, Homo sapiens
gcugauccgauuccugaaa

SEQ ID NO: 251300 - RNA, 19 nt, Homo sapiens
agaagaacacaacugagaa

SEQ ID NO: 251301 - RNA, 19 nt, Homo sapiens
gcaugugccggcaacuuug

SEQ ID NO: 251302 - RNA, 19 nt, Homo sapiens
aaaucgacaccuauuaaug

SEQ ID NO: 251303 - RNA, 19 nt, Homo sapiens
cauugucacugcaaaucga

SEQ ID NO: 251304 - RNA, 19 nt, Homo sapiens
gagauaucuuugucagcau

SEQ ID NO: 251305 - RNA, 19 nt, Homo sapiens
aaaguguucgagcugaaua

SEQ ID NO: 251306 - RNA, 19 nt, Homo sapiens
aaucgacaccuauuaaugg

SEQ ID NO: 251307 - RNA, 19 nt, Homo sapiens
cccaagcugauaagauuaa

SEQ ID NO: 251308 - RNA, 19 nt, Homo sapiens
ugcaaaucgacaccuauua

SEQ ID NO: 251309 - RNA, 19 nt, Homo sapiens
agagcaaauuaugguguaa

SEQ ID NO: 251310 - RNA, 19 nt, Homo sapiens
uguucgagcugaauauuuu

SEQ ID NO: 251311 - RNA, 19 nt, Homo sapiens
uuccuaugcugaaacuuug

SEQ ID NO: 251312 - RNA, 19 nt, Homo sapiens
uagcuucuccugauaaacu

SEQ ID NO: 251313 - RNA, 19 nt, Homo sapiens
ucguuagcuucuccugaua

SEQ ID NO: 251314 - RNA, 19 nt, Homo sapiens
uggaagagaggugcugauu

SEQ ID NO: 251315 - RNA, 19 nt, Homo sapiens
ccaagcugauaagauuaau

SEQ ID NO: 251316 - RNA, 19 nt, Homo sapiens
gaagccaaccagaguacgu

SEQ ID NO: 251317 - RNA, 19 nt, Homo sapiens
uguaauuuccuaugcugaa

SEQ ID NO: 251318 - RNA, 19 nt, Homo sapiens
cacugcaaaucgacaccua

SEQ ID NO: 251319 - RNA, 19 nt, Homo sapiens
caaaguguucgagcugaau

SEQ ID NO: 251320 - RNA, 19 nt, Homo sapiens
agacgaucaugagagagaa

SEQ ID NO: 251321 - RNA, 19 nt, Homo sapiens
uuggaaaacuucuuggaaa

SEQ ID NO: 251322 - RNA, 19 nt, Homo sapiens
cuacagccaccaugagaag

SEQ ID NO: 251323 - RNA, 19 nt, Homo sapiens
cugcaaaucgacaccuauu

SEQ ID NO: 251324 - RNA, 19 nt, Homo sapiens
guguucgagcugaauauuu

SEQ ID NO: 251325 - RNA, 19 nt, Homo sapiens
aagacgaucaugagagaga

SEQ ID NO: 251326 - RNA, 19 nt, Homo sapiens
ggaaaucgaugagaaauug

SEQ ID NO: 251327 - RNA, 19 nt, Homo sapiens
uaacagagcuuccuuaggu

SEQ ID NO: 251328 - RNA, 19 nt, Homo sapiens
ucaccaagauuaagaaaga

SEQ ID NO: 251329 - RNA, 19 nt, Homo sapiens
gaagaaccaugguaugaag

SEQ ID NO: 251330 - RNA, 19 nt, Homo sapiens
acacacagcuggaagaaau

SEQ ID NO: 251331 - RNA, 19 nt, Homo sapiens
gguauaagccuuuccaaga

SEQ ID NO: 251332 - RNA, 19 nt, Homo sapiens
uagaggugcucauucauuu

SEQ ID NO: 251333 - RNA, 19 nt, Homo sapiens
ucacaaggcugccaaagag

SEQ ID NO: 251334 - RNA, 19 nt, Homo sapiens
gcgcgcagauaauuaaaga

SEQ ID NO: 251335 - RNA, 19 nt, Homo sapiens
ggaaguagaacccgagaug

SEQ ID NO: 251336 - RNA, 19 nt, Homo sapiens
uaacgugaccuaccuagaa

SEQ ID NO: 251337 - RNA, 19 nt, Homo sapiens
uggaagaaaucauagagaa

SEQ ID NO: 251338 - RNA, 19 nt, Homo sapiens
gaaaugccaccuccuggaa

SEQ ID NO: 251339 - RNA, 19 nt, Homo sapiens
gcgcagauaauuaaagauu

SEQ ID NO: 251340 - RNA, 19 nt, Homo sapiens
gaguaaugcucgucugugu

SEQ ID NO: 251341 - RNA, 19 nt, Homo sapiens
aaagggagcuucugugcau

SEQ ID NO: 251342 - RNA, 19 nt, Homo sapiens
gaggugcucauucauuuaa

SEQ ID NO: 251343 - RNA, 19 nt, Homo sapiens
ccaguuacccugcauguug

SEQ ID NO: 251344 - RNA, 19 nt, Homo sapiens
ccagagaaauguggguuug

SEQ ID NO: 251345 - RNA, 19 nt, Homo sapiens
uuaguuucaucaccuguua

SEQ ID NO: 251346 - RNA, 19 nt, Homo sapiens
gcagcagacugucccuguu

SEQ ID NO: 251347 - RNA, 19 nt, Homo sapiens
gaaacuaacacagccauca

SEQ ID NO: 251348 - RNA, 19 nt, Homo sapiens
ccaaguggcacaacuccua

SEQ ID NO: 251349 - RNA, 19 nt, Homo sapiens
gcgggcagaucacuugaga

SEQ ID NO: 251350 - RNA, 19 nt, Homo sapiens
gccuagaggugcucauuca

SEQ ID NO: 251351 - RNA, 19 nt, Homo sapiens
guauaagccuuuccaagac

SEQ ID NO: 251352 - RNA, 19 nt, Homo sapiens
ccuaugcagucaacauuug

SEQ ID NO: 251353 - RNA, 19 nt, Homo sapiens
gcaguggcauugucuacuc

SEQ ID NO: 251354 - RNA, 19 nt, Homo sapiens
ggucagugcggauaacuau

SEQ ID NO: 251355 - RNA, 19 nt, Homo sapiens
caucaccuguuaucugugu

SEQ ID NO: 251356 - RNA, 19 nt, Homo sapiens
gaugaggacuagggcuuau

SEQ ID NO: 251357 - RNA, 19 nt, Homo sapiens
gaagaguaaauccucauca

SEQ ID NO: 251358 - RNA, 19 nt, Homo sapiens
gucaacauuuggagugaaa

SEQ ID NO: 251359 - RNA, 19 nt, Homo sapiens
guauaaucaucucaccuau

SEQ ID NO: 251360 - RNA, 19 nt, Homo sapiens
acacguguaucccugagaa

SEQ ID NO: 251361 - RNA, 19 nt, Homo sapiens
gucaagggguguucaguua

SEQ ID NO: 251362 - RNA, 19 nt, Homo sapiens
cgucagcguuuccugcauu

SEQ ID NO: 251363 - RNA, 19 nt, Homo sapiens
gaaucuauaacgugaccua

SEQ ID NO: 251364 - RNA, 19 nt, Homo sapiens
ugaggagaguggaacagaa

SEQ ID NO: 251365 - RNA, 19 nt, Homo sapiens
gggcuccuguucccuguga

SEQ ID NO: 251366 - RNA, 19 nt, Homo sapiens
ccuauaaucccagcacuuu

SEQ ID NO: 251367 - RNA, 19 nt, Homo sapiens
gucagcaucaccaagauua

SEQ ID NO: 251368 - RNA, 19 nt, Homo sapiens
ggcaagcucugggaacaug

SEQ ID NO: 251369 - RNA, 19 nt, Homo sapiens
guaaugcucgucugugugu

SEQ ID NO: 251370 - RNA, 19 nt, Homo sapiens
gagcaacagaggacaugaa

SEQ ID NO: 251371 - RNA, 19 nt, Homo sapiens
acacagccaucaagggaau

SEQ ID NO: 251372 - RNA, 19 nt, Homo sapiens
ccacaucccaugagaguag

SEQ ID NO: 251373 - RNA, 19 nt, Homo sapiens
cgugguggcucaugccuau

SEQ ID NO: 251374 - RNA, 19 nt, Homo sapiens
agaauugucuuaccaagcu

SEQ ID NO: 251375 - RNA, 19 nt, Homo sapiens
ccaccugcgucuccgacua

SEQ ID NO: 251376 - RNA, 19 nt, Homo sapiens
aggcauaaggcaccaguua

SEQ ID NO: 251377 - RNA, 19 nt, Homo sapiens
ggaggaggagguagaggaa

SEQ ID NO: 251378 - RNA, 19 nt, Homo sapiens
ggaagaaaucauagagaag

SEQ ID NO: 251379 - RNA, 19 nt, Homo sapiens
gaaaucgaugagaaauuga

SEQ ID NO: 251380 - RNA, 19 nt, Homo sapiens
gggaaaucgaugagaaauu

SEQ ID NO: 251381 - RNA, 19 nt, Homo sapiens
auaaucaucucaccuaugc

SEQ ID NO: 251382 - RNA, 19 nt, Homo sapiens
gggguggaguuuuguauaa

SEQ ID NO: 251383 - RNA, 19 nt, Homo sapiens
gacuaaagcagggacaauu

SEQ ID NO: 251384 - RNA, 19 nt, Homo sapiens
acacugggcugcagagacu

SEQ ID NO: 251385 - RNA, 19 nt, Homo sapiens
aaagaauggugggaucaga

SEQ ID NO: 251386 - RNA, 19 nt, Homo sapiens
gaacagaagggguggaguu

SEQ ID NO: 251387 - RNA, 19 nt, Homo sapiens
gcagacugucccuguugua

SEQ ID NO: 251388 - RNA, 19 nt, Homo sapiens
ggccugggcucagugcuau

SEQ ID NO: 251389 - RNA, 19 nt, Homo sapiens
uguauaaucaucucaccua

SEQ ID NO: 251390 - RNA, 19 nt, Homo sapiens
cagaagggguggaguuuug

SEQ ID NO: 251391 - RNA, 19 nt, Homo sapiens
gaaguacgagugcucacau

SEQ ID NO: 251392 - RNA, 19 nt, Homo sapiens
gagcagcagggaugacuuc

SEQ ID NO: 251393 - RNA, 19 nt, Homo sapiens
uacaugagcaucucuacuu

SEQ ID NO: 251394 - RNA, 19 nt, Homo sapiens
acaugagcaucucuacuug

SEQ ID NO: 251395 - RNA, 19 nt, Homo sapiens
cuaaagcagggacaauuug

SEQ ID NO: 251396 - RNA, 19 nt, Homo sapiens
cuagaggugcucauucauu

SEQ ID NO: 251397 - RNA, 19 nt, Homo sapiens
ccugacaauuaccuguaua

SEQ ID NO: 251398 - RNA, 19 nt, Homo sapiens
ugaagaaccaugguaugaa

SEQ ID NO: 251399 - RNA, 19 nt, Homo sapiens
caaaagacuugaagaacca

SEQ ID NO: 251400 - RNA, 19 nt, Homo sapiens
aagaguaaauccucaucau

SEQ ID NO: 251401 - RNA, 19 nt, Homo sapiens
ugacaguucacaccaaugu

SEQ ID NO: 251402 - RNA, 19 nt, Homo sapiens
gcccagcgagcaugugaaa

SEQ ID NO: 251403 - RNA, 19 nt, Homo sapiens
cuugggaaaucgaugagaa

SEQ ID NO: 251404 - RNA, 19 nt, Homo sapiens
cauacaugagggucucuua

SEQ ID NO: 251405 - RNA, 19 nt, Homo sapiens
gcagauccuccgccgaaau

SEQ ID NO: 251406 - RNA, 19 nt, Homo sapiens
ccagacagcaggcauaagg

SEQ ID NO: 251407 - RNA, 19 nt, Homo sapiens
gcagaaucccggcugucaa

SEQ ID NO: 251408 - RNA, 19 nt, Homo sapiens
aggagaggcugguuacaag

SEQ ID NO: 251409 - RNA, 19 nt, Homo sapiens
aggaggagguagaggaaga

SEQ ID NO: 251410 - RNA, 19 nt, Homo sapiens
gauguguggaguuguuuga

SEQ ID NO: 251411 - RNA, 19 nt, Homo sapiens
ggugcgauguguggaguug

SEQ ID NO: 251412 - RNA, 19 nt, Homo sapiens
caucucaccuaugcaguca

SEQ ID NO: 251413 - RNA, 19 nt, Homo sapiens
gaggagaguggaacagaag

SEQ ID NO: 251414 - RNA, 19 nt, Homo sapiens
acuaaagcagggacaauuu

SEQ ID NO: 251415 - RNA, 19 nt, Homo sapiens
aaacuaacacagccaucaa

SEQ ID NO: 251416 - RNA, 19 nt, Homo sapiens
gacugucccuguuguaacu

SEQ ID NO: 251417 - RNA, 19 nt, Homo sapiens
ggugcucauucauuuaaca

SEQ ID NO: 251418 - RNA, 19 nt, Homo sapiens
agccgagccuagaaacuaa

SEQ ID NO: 251419 - RNA, 19 nt, Homo sapiens
aagccgagccuagaaacua

SEQ ID NO: 251420 - RNA, 19 nt, Homo sapiens
gagggucucuuaggugcau

SEQ ID NO: 251421 - RNA, 19 nt, Homo sapiens
ccagacaaccugacuugca

SEQ ID NO: 251422 - RNA, 19 nt, Homo sapiens
acagcuggaagaaaucaua

SEQ ID NO: 251423 - RNA, 19 nt, Homo sapiens
cagcagacugucccuguug

SEQ ID NO: 251424 - RNA, 19 nt, Homo sapiens
guaaauccucaucauccuu

SEQ ID NO: 251425 - RNA, 19 nt, Homo sapiens
caggagaggcugguuacaa

SEQ ID NO: 251426 - RNA, 19 nt, Homo sapiens
gaagaaagacggagaguaa

SEQ ID NO: 251427 - RNA, 19 nt, Homo sapiens
ccacagaaauucccacaag

SEQ ID NO: 251428 - RNA, 19 nt, Homo sapiens
gagaguaaaccaauuccua

SEQ ID NO: 251429 - RNA, 19 nt, Homo sapiens
gaaagagucaggccuuaau

SEQ ID NO: 251430 - RNA, 19 nt, Homo sapiens
ucagauaucagaaucauug

SEQ ID NO: 251431 - RNA, 19 nt, Homo sapiens
gaaugagggccaagaaaga

SEQ ID NO: 251432 - RNA, 19 nt, Homo sapiens
caagugcauuggugaaaga

SEQ ID NO: 251433 - RNA, 19 nt, Homo sapiens
gcacugcuuucuacucauc

SEQ ID NO: 251434 - RNA, 19 nt, Homo sapiens
guaaauauuucaggcauac

SEQ ID NO: 251435 - RNA, 19 nt, Homo sapiens
uagacuaccugcaagaguu

SEQ ID NO: 251436 - RNA, 19 nt, Homo sapiens
uaaaccaauuccuagacua

SEQ ID NO: 251437 - RNA, 19 nt, Homo sapiens
gagaaugagggccaagaaa

SEQ ID NO: 251438 - RNA, 19 nt, Homo sapiens
aagaaagagucaggccuua

SEQ ID NO: 251439 - RNA, 19 nt, Homo sapiens
ucaucgaacucugcugaua

SEQ ID NO: 251440 - RNA, 19 nt, Homo sapiens
gaaauucccacaagugcau

SEQ ID NO: 251441 - RNA, 19 nt, Homo sapiens
caaugagacucugaggauu

SEQ ID NO: 251442 - RNA, 19 nt, Homo sapiens
ccaaugagacucugaggau

SEQ ID NO: 251443 - RNA, 19 nt, Homo sapiens
guaaaccaauuccuagacu

SEQ ID NO: 251444 - RNA, 19 nt, Homo sapiens
gaacguuucagagccauga

SEQ ID NO: 251445 - RNA, 19 nt, Homo sapiens
gacggagaguaaaccaauu

SEQ ID NO: 251446 - RNA, 19 nt, Homo sapiens
gauaucagaaucauugaag

SEQ ID NO: 251447 - RNA, 19 nt, Homo sapiens
caacugugcacugaagaaa

SEQ ID NO: 251448 - RNA, 19 nt, Homo sapiens
ucagagggaaaguaaauau

SEQ ID NO: 251449 - RNA, 19 nt, Homo sapiens
uggcacugcuuucuacuca

SEQ ID NO: 251450 - RNA, 19 nt, Homo sapiens
gcugauagccaaugagacu

SEQ ID NO: 251451 - RNA, 19 nt, Homo sapiens
gaguaaaccaauuccuaga

SEQ ID NO: 251452 - RNA, 19 nt, Homo sapiens
ggccuuaauuuucaguaua

SEQ ID NO: 251453 - RNA, 19 nt, Homo sapiens
cagagggaaaguaaauauu

SEQ ID NO: 251454 - RNA, 19 nt, Homo sapiens
ggaggagaaggacauuuua

SEQ ID NO: 251455 - RNA, 19 nt, Homo sapiens
aagagucaggccuuaauuu

SEQ ID NO: 251456 - RNA, 19 nt, Homo sapiens
gccaaaggcaaacgcagaa

SEQ ID NO: 251457 - RNA, 19 nt, Homo sapiens
caccaacugugcacugaag

SEQ ID NO: 251458 - RNA, 19 nt, Homo sapiens
aaagagucaggccuuaauu

SEQ ID NO: 251459 - RNA, 19 nt, Homo sapiens
acugugcacugaagaaauc

SEQ ID NO: 251460 - RNA, 19 nt, Homo sapiens
cacagaaauucccacaagu

SEQ ID NO: 251461 - RNA, 19 nt, Homo sapiens
ccacaagugcauuggugaa

SEQ ID NO: 251462 - RNA, 19 nt, Homo sapiens
agaaagagucaggccuuaa

SEQ ID NO: 251463 - RNA, 19 nt, Homo sapiens
agacggagaguaaaccaau

SEQ ID NO: 251464 - RNA, 19 nt, Homo sapiens
guggaaagacuauucaaaa

SEQ ID NO: 251465 - RNA, 19 nt, Homo sapiens
uaggcacacuggagaguca

SEQ ID NO: 251466 - RNA, 19 nt, Homo sapiens
acagaaauucccacaagug

SEQ ID NO: 251467 - RNA, 19 nt, Homo sapiens
ggauuccuguuccuguaca

SEQ ID NO: 251468 - RNA, 19 nt, Homo sapiens
caggcauacugacacuuug

SEQ ID NO: 251469 - RNA, 19 nt, Homo sapiens
ggagcugccuacguguaug

SEQ ID NO: 251470 - RNA, 19 nt, Homo sapiens
acugacacuuugccagaaa

SEQ ID NO: 251471 - RNA, 19 nt, Homo sapiens
ugagaaugagggccaagaa

SEQ ID NO: 251472 - RNA, 19 nt, Homo sapiens
gaguggauaauagaaaguu

SEQ ID NO: 251473 - RNA, 19 nt, Homo sapiens
agaguuucuugguguaaug

SEQ ID NO: 251474 - RNA, 19 nt, Homo sapiens
cuucagagggaaaguaaau

SEQ ID NO: 251475 - RNA, 19 nt, Homo sapiens
agaaugagggccaagaaag

SEQ ID NO: 251476 - RNA, 19 nt, Homo sapiens
guggauaauagaaaguuga

SEQ ID NO: 251477 - RNA, 19 nt, Homo sapiens
agaagaaagacggagagua

SEQ ID NO: 251478 - RNA, 19 nt, Homo sapiens
aaaguguggagaagaaaga

SEQ ID NO: 251479 - RNA, 19 nt, Homo sapiens
caucgaacucugcugauag

SEQ ID NO: 251480 - RNA, 19 nt, Homo sapiens
ccaacugugcacugaagaa

SEQ ID NO: 251481 - RNA, 19 nt, Homo sapiens
agacuaccugcaagaguuu

SEQ ID NO: 251482 - RNA, 19 nt, Homo sapiens
gcauuugaguuugcuagcu

SEQ ID NO: 251483 - RNA, 19 nt, Homo sapiens
acaagugcauuggugaaag

SEQ ID NO: 251484 - RNA, 19 nt, Homo sapiens
uguggaaagacuauucaaa

SEQ ID NO: 251485 - RNA, 19 nt, Homo sapiens
gaaagacggagaguaaacc

SEQ ID NO: 251486 - RNA, 19 nt, Homo sapiens
cacaagugcauuggugaaa

SEQ ID NO: 251487 - RNA, 19 nt, Homo sapiens
gaagucaucuguuauauag

SEQ ID NO: 251488 - RNA, 19 nt, Homo sapiens
gcaaaggaauguuaaucua

SEQ ID NO: 251489 - RNA, 19 nt, Homo sapiens
uaagagguguucagaauuu

SEQ ID NO: 251490 - RNA, 19 nt, Homo sapiens
guacaaauccuccuccaua

SEQ ID NO: 251491 - RNA, 19 nt, Homo sapiens
gaauggauauuugcagaua

SEQ ID NO: 251492 - RNA, 19 nt, Homo sapiens
gcuaagagguguucagaau

SEQ ID NO: 251493 - RNA, 19 nt, Homo sapiens
gaaguuuccugucauguuc

SEQ ID NO: 251494 - RNA, 19 nt, Homo sapiens
gagagauucuuucguuuga

SEQ ID NO: 251495 - RNA, 19 nt, Homo sapiens
cagaaucacugaaagcaaa

SEQ ID NO: 251496 - RNA, 19 nt, Homo sapiens
cauguucacucaucuuuaa

SEQ ID NO: 251497 - RNA, 19 nt, Homo sapiens
gaagacaauuauucacguu

SEQ ID NO: 251498 - RNA, 19 nt, Homo sapiens
caucguggcgcauguauua

SEQ ID NO: 251499 - RNA, 19 nt, Homo sapiens
gaugcuggcucuuggcuaa

SEQ ID NO: 251500 - RNA, 19 nt, Homo sapiens
gaaaccaaauccugaucaa

SEQ ID NO: 251501 - RNA, 19 nt, Homo sapiens
caagagcaaaggaauguua

SEQ ID NO: 251502 - RNA, 19 nt, Homo sapiens
gaagaaccgccucuaaguu

SEQ ID NO: 251503 - RNA, 19 nt, Homo sapiens
uaaguacgauguucaagug

SEQ ID NO: 251504 - RNA, 19 nt, Homo sapiens
gaaaauaaacgcuccaaaa

SEQ ID NO: 251505 - RNA, 19 nt, Homo sapiens
ccauuaaaguuacugguuu

SEQ ID NO: 251506 - RNA, 19 nt, Homo sapiens
gcagggaaguugacucauc

SEQ ID NO: 251507 - RNA, 19 nt, Homo sapiens
gaguggagccaaccuauuu

SEQ ID NO: 251508 - RNA, 19 nt, Homo sapiens
gaaaccagaaucacugaaa

SEQ ID NO: 251509 - RNA, 19 nt, Homo sapiens
gcagaacgaccacucacua

SEQ ID NO: 251510 - RNA, 19 nt, Homo sapiens
gagcaaaccaacucugaaa

SEQ ID NO: 251511 - RNA, 19 nt, Homo sapiens
gcaaccaucugcuucaucu

SEQ ID NO: 251512 - RNA, 19 nt, Homo sapiens
gagagugguuugucauugu

SEQ ID NO: 251513 - RNA, 19 nt, Homo sapiens
caaauaaauccuccacuga

SEQ ID NO: 251514 - RNA, 19 nt, Homo sapiens
gcaaaccaacucugaaaga

SEQ ID NO: 251515 - RNA, 19 nt, Homo sapiens
caaguuguuuccaccaauu

SEQ ID NO: 251516 - RNA, 19 nt, Homo sapiens
ucacgccauugaucaaaua

SEQ ID NO: 251517 - RNA, 19 nt, Homo sapiens
ccacaaacacuacagaaga

SEQ ID NO: 251518 - RNA, 19 nt, Homo sapiens
ccuggaaccucaauuguga

SEQ ID NO: 251519 - RNA, 19 nt, Homo sapiens
aagaaccgccucuaaguua

SEQ ID NO: 251520 - RNA, 19 nt, Homo sapiens
gagccaaccuauuuaugug

SEQ ID NO: 251521 - RNA, 19 nt, Homo sapiens
gaacucgucucucuaucca

SEQ ID NO: 251522 - RNA, 19 nt, Homo sapiens
ugaaggaacucgucucucu

SEQ ID NO: 251523 - RNA, 19 nt, Homo sapiens
gaagagagcaaaccaacuc

SEQ ID NO: 251524 - RNA, 19 nt, Homo sapiens
gaagaugacuaugaaacca

SEQ ID NO: 251525 - RNA, 19 nt, Homo sapiens
gaaagcaaauguguaacca

SEQ ID NO: 251526 - RNA, 19 nt, Homo sapiens
ugacuuacuuccugaugaa

SEQ ID NO: 251527 - RNA, 19 nt, Homo sapiens
ccagugagacggaaauuga

SEQ ID NO: 251528 - RNA, 19 nt, Homo sapiens
gcagggcucuggagugagu

SEQ ID NO: 251529 - RNA, 19 nt, Homo sapiens
gaaauugaagucaucuguu

SEQ ID NO: 251530 - RNA, 19 nt, Homo sapiens
gaaugucacagcagagauu

SEQ ID NO: 251531 - RNA, 19 nt, Homo sapiens
ccuggaggauucuguguuu

SEQ ID NO: 251532 - RNA, 19 nt, Homo sapiens
uuaauucucucgcuuaucu

SEQ ID NO: 251533 - RNA, 19 nt, Homo sapiens
guacgauguucaagugaga

SEQ ID NO: 251534 - RNA, 19 nt, Homo sapiens
uacaaggaauggauauuug

SEQ ID NO: 251535 - RNA, 19 nt, Homo sapiens
ccaggcacauugagcauug

SEQ ID NO: 251536 - RNA, 19 nt, Homo sapiens
ggaaauugaagucaucugu

SEQ ID NO: 251537 - RNA, 19 nt, Homo sapiens
gggaaaugaugaacacaag

SEQ ID NO: 251538 - RNA, 19 nt, Homo sapiens
ggagccaaccuauuuaugu

SEQ ID NO: 251539 - RNA, 19 nt, Homo sapiens
agaaaccagugucugcuuu

SEQ ID NO: 251540 - RNA, 19 nt, Homo sapiens
ccugucaauuucaccauua

SEQ ID NO: 251541 - RNA, 19 nt, Homo sapiens
caauuuaccugcgaagcaa

SEQ ID NO: 251542 - RNA, 19 nt, Homo sapiens
gaaggaacucgucucucua

SEQ ID NO: 251543 - RNA, 19 nt, Homo sapiens
cuacagaagacaauuauuc

SEQ ID NO: 251544 - RNA, 19 nt, Homo sapiens
gagauucuuucguuugaca

SEQ ID NO: 251545 - RNA, 19 nt, Homo sapiens
gaacgaccacucacuacug

SEQ ID NO: 251546 - RNA, 19 nt, Homo sapiens
gauacugcaagcugacuua

SEQ ID NO: 251547 - RNA, 19 nt, Homo sapiens
gaaccgccucuaaguuaaa

SEQ ID NO: 251548 - RNA, 19 nt, Homo sapiens
cugccaaucuuugcaauuu

SEQ ID NO: 251549 - RNA, 19 nt, Homo sapiens
ccaaugcauucaucucaau

SEQ ID NO: 251550 - RNA, 19 nt, Homo sapiens
acaagaggaucgucuguag

SEQ ID NO: 251551 - RNA, 19 nt, Homo sapiens
uuacagccgugaugaugaa

SEQ ID NO: 251552 - RNA, 19 nt, Homo sapiens
ggagugaaccaugaacuug

SEQ ID NO: 251553 - RNA, 19 nt, Homo sapiens
ggaccauccugcagaacga

SEQ ID NO: 251554 - RNA, 19 nt, Homo sapiens
gcuaccaucugaggaagaa

SEQ ID NO: 251555 - RNA, 19 nt, Homo sapiens
ccaaaucgccucaccuaca

SEQ ID NO: 251556 - RNA, 19 nt, Homo sapiens
caaaagaagaugacuauga

SEQ ID NO: 251557 - RNA, 19 nt, Homo sapiens
aauaaacgcuccaaaagaa

SEQ ID NO: 251558 - RNA, 19 nt, Homo sapiens
gaacaagaggaucgucugu

SEQ ID NO: 251559 - RNA, 19 nt, Homo sapiens
aaauaaauccuccacugaa

SEQ ID NO: 251560 - RNA, 19 nt, Homo sapiens
aaauaucgcaugcugguuu

SEQ ID NO: 251561 - RNA, 19 nt, Homo sapiens
uguuuaagcugccaauugu

SEQ ID NO: 251562 - RNA, 19 nt, Homo sapiens
uaacguccagcuguauuua

SEQ ID NO: 251563 - RNA, 19 nt, Homo sapiens
caaaucgccucaccuacag

SEQ ID NO: 251564 - RNA, 19 nt, Homo sapiens
uuaggcaacacucaauuua

SEQ ID NO: 251565 - RNA, 19 nt, Homo sapiens
aauaaauccuccacugaau

SEQ ID NO: 251566 - RNA, 19 nt, Homo sapiens
cauuaaaguuacugguuug

SEQ ID NO: 251567 - RNA, 19 nt, Homo sapiens
ugacagcaguuugguuguu

SEQ ID NO: 251568 - RNA, 19 nt, Homo sapiens
uacaaauccuccuccauau

SEQ ID NO: 251569 - RNA, 19 nt, Homo sapiens
gacagcaguuugguuguug

SEQ ID NO: 251570 - RNA, 19 nt, Homo sapiens
gaauuuaggcaacacucaa

SEQ ID NO: 251571 - RNA, 19 nt, Homo sapiens
cgccauugaucaaauaaau

SEQ ID NO: 251572 - RNA, 19 nt, Homo sapiens
acacuacagaagacaauua

SEQ ID NO: 251573 - RNA, 19 nt, Homo sapiens
caaaggaauguuaaucuag

SEQ ID NO: 251574 - RNA, 19 nt, Homo sapiens
agaaccgccucuaaguuaa

SEQ ID NO: 251575 - RNA, 19 nt, Homo sapiens
gagagagugguuugucauu

SEQ ID NO: 251576 - RNA, 19 nt, Homo sapiens
gaucaagagcaaaggaaug

SEQ ID NO: 251577 - RNA, 19 nt, Homo sapiens
ggaaaccaaauccugauca

SEQ ID NO: 251578 - RNA, 19 nt, Homo sapiens
gauaagguucguucucaau

SEQ ID NO: 251579 - RNA, 19 nt, Homo sapiens
ugaagaaugccaagaauac

SEQ ID NO: 251580 - RNA, 19 nt, Homo sapiens
caucuucuguugaguacug

SEQ ID NO: 251581 - RNA, 19 nt, Homo sapiens
gaaccaugaacuuggauuc

SEQ ID NO: 251582 - RNA, 19 nt, Homo sapiens
caguugcucuguacaaauc

SEQ ID NO: 251583 - RNA, 19 nt, Homo sapiens
gaccaaugcauucaucuca

SEQ ID NO: 251584 - RNA, 19 nt, Homo sapiens
agacaagacaguuaucaga

SEQ ID NO: 251585 - RNA, 19 nt, Homo sapiens
gaagaaugccaagaauaca

SEQ ID NO: 251586 - RNA, 19 nt, Homo sapiens
gagcaaaggaauguuaauc

SEQ ID NO: 251587 - RNA, 19 nt, Homo sapiens
gcaaaggaauguuaaucua

SEQ ID NO: 251588 - RNA, 19 nt, Homo sapiens
guacaaauccuccuccaua

SEQ ID NO: 251589 - RNA, 19 nt, Homo sapiens
gaauggauauuugcagaua

SEQ ID NO: 251590 - RNA, 19 nt, Homo sapiens
gaaguuuccugucauguuc

SEQ ID NO: 251591 - RNA, 19 nt, Homo sapiens
gagagauucuuucguuuga

SEQ ID NO: 251592 - RNA, 19 nt, Homo sapiens
guacaauaguggaauagaa

SEQ ID NO: 251593 - RNA, 19 nt, Homo sapiens
ccucaaggguaacaucuua

SEQ ID NO: 251594 - RNA, 19 nt, Homo sapiens
cagaaucacugaaagcaaa

SEQ ID NO: 251595 - RNA, 19 nt, Homo sapiens
cauguucacucaucuuuaa

SEQ ID NO: 251596 - RNA, 19 nt, Homo sapiens
gaagacaauuauucacguu

SEQ ID NO: 251597 - RNA, 19 nt, Homo sapiens
caucguggcgcauguauua

SEQ ID NO: 251598 - RNA, 19 nt, Homo sapiens
ggaauagauuugccaugaa

SEQ ID NO: 251599 - RNA, 19 nt, Homo sapiens
gaaaccaaauccugaucaa

SEQ ID NO: 251600 - RNA, 19 nt, Homo sapiens
gaauagauuugccaugaag

SEQ ID NO: 251601 - RNA, 19 nt, Homo sapiens
caagagcaaaggaauguua

SEQ ID NO: 251602 - RNA, 19 nt, Homo sapiens
gaagaaccgccucuaaguu

SEQ ID NO: 251603 - RNA, 19 nt, Homo sapiens
uaaguacgauguucaagug

SEQ ID NO: 251604 - RNA, 19 nt, Homo sapiens
gaaaauaaacgcuccaaaa

SEQ ID NO: 251605 - RNA, 19 nt, Homo sapiens
ccauuaaaguuacugguuu

SEQ ID NO: 251606 - RNA, 19 nt, Homo sapiens
gaguggagccaaccuauuu

SEQ ID NO: 251607 - RNA, 19 nt, Homo sapiens
gaaaccagaaucacugaaa

SEQ ID NO: 251608 - RNA, 19 nt, Homo sapiens
gcagaacgaccacucacua

SEQ ID NO: 251609 - RNA, 19 nt, Homo sapiens
gagcaaaccaacucugaaa

SEQ ID NO: 251610 - RNA, 19 nt, Homo sapiens
uaauagagauccugugucu

SEQ ID NO: 251611 - RNA, 19 nt, Homo sapiens
gggaagaaauaauagagau

SEQ ID NO: 251612 - RNA, 19 nt, Homo sapiens
caaauaaauccuccacuga

SEQ ID NO: 251613 - RNA, 19 nt, Homo sapiens
gcaaaccaacucugaaaga

SEQ ID NO: 251614 - RNA, 19 nt, Homo sapiens
ucacgccauugaucaaaua

SEQ ID NO: 251615 - RNA, 19 nt, Homo sapiens
ccacaaacacuacagaaga

SEQ ID NO: 251616 - RNA, 19 nt, Homo sapiens
ccuggaaccucaauuguga

SEQ ID NO: 251617 - RNA, 19 nt, Homo sapiens
aagaaccgccucuaaguua

SEQ ID NO: 251618 - RNA, 19 nt, Homo sapiens
gagccaaccuauuuaugug

SEQ ID NO: 251619 - RNA, 19 nt, Homo sapiens
gaacucgucucucuaucca

SEQ ID NO: 251620 - RNA, 19 nt, Homo sapiens
ugaaggaacucgucucucu

SEQ ID NO: 251621 - RNA, 19 nt, Homo sapiens
gaagagagcaaaccaacuc

SEQ ID NO: 251622 - RNA, 19 nt, Homo sapiens
gaagaugacuaugaaacca

SEQ ID NO: 251623 - RNA, 19 nt, Homo sapiens
gaaagcaaauguguaacca

SEQ ID NO: 251624 - RNA, 19 nt, Homo sapiens
ugacuuacuuccugaugaa

SEQ ID NO: 251625 - RNA, 19 nt, Homo sapiens
gcugugggaagaaauaaua

SEQ ID NO: 251626 - RNA, 19 nt, Homo sapiens
gcagggcucuggagugagu

SEQ ID NO: 251627 - RNA, 19 nt, Homo sapiens
gaaugucacagcagagauu

SEQ ID NO: 251628 - RNA, 19 nt, Homo sapiens
aggaauagauuugccauga

SEQ ID NO: 251629 - RNA, 19 nt, Homo sapiens
guacgauguucaagugaga

SEQ ID NO: 251630 - RNA, 19 nt, Homo sapiens
uacaaggaauggauauuug

SEQ ID NO: 251631 - RNA, 19 nt, Homo sapiens
ccaggcacauugagcauug

SEQ ID NO: 251632 - RNA, 19 nt, Homo sapiens
ggagccaaccuauuuaugu

SEQ ID NO: 251633 - RNA, 19 nt, Homo sapiens
agaaaccagugucugcuuu

SEQ ID NO: 251634 - RNA, 19 nt, Homo sapiens
ccugucaauuucaccauua

SEQ ID NO: 251635 - RNA, 19 nt, Homo sapiens
ugucuaggcuucucauuag

SEQ ID NO: 251636 - RNA, 19 nt, Homo sapiens
gaaggaacucgucucucua

SEQ ID NO: 251637 - RNA, 19 nt, Homo sapiens
cuacagaagacaauuauuc

SEQ ID NO: 251638 - RNA, 19 nt, Homo sapiens
gaacgaccacucacuacug

SEQ ID NO: 251639 - RNA, 19 nt, Homo sapiens
gauacugcaagcugacuua

SEQ ID NO: 251640 - RNA, 19 nt, Homo sapiens
gaaccgccucuaaguuaaa

SEQ ID NO: 251641 - RNA, 19 nt, Homo sapiens
gagauucuuucguuugaca

SEQ ID NO: 251642 - RNA, 19 nt, Homo sapiens
cuauuuauguggguaagua

SEQ ID NO: 251643 - RNA, 19 nt, Homo sapiens
ccaaugcauucaucucaau

SEQ ID NO: 251644 - RNA, 19 nt, Homo sapiens
acaagaggaucgucuguag

SEQ ID NO: 251645 - RNA, 19 nt, Homo sapiens
uuacagccgugaugaugaa

SEQ ID NO: 251646 - RNA, 19 nt, Homo sapiens
ggaccauccugcagaacga

SEQ ID NO: 251647 - RNA, 19 nt, Homo sapiens
caaaagaagaugacuauga

SEQ ID NO: 251648 - RNA, 19 nt, Homo sapiens
aauaaacgcuccaaaagaa

SEQ ID NO: 251649 - RNA, 19 nt, Homo sapiens
gaacaagaggaucgucugu

SEQ ID NO: 251650 - RNA, 19 nt, Homo sapiens
aaauaaauccuccacugaa

SEQ ID NO: 251651 - RNA, 19 nt, Homo sapiens
aaauaucgcaugcugguuu

SEQ ID NO: 251652 - RNA, 19 nt, Homo sapiens
caagcugugggaagaaaua

SEQ ID NO: 251653 - RNA, 19 nt, Homo sapiens
ccaugaagccagugaaguu

SEQ ID NO: 251654 - RNA, 19 nt, Homo sapiens
aauaaauccuccacugaau

SEQ ID NO: 251655 - RNA, 19 nt, Homo sapiens
ugacagcaguuugguuguu

SEQ ID NO: 251656 - RNA, 19 nt, Homo sapiens
cauuaaaguuacugguuug

SEQ ID NO: 251657 - RNA, 19 nt, Homo sapiens
uacaaauccuccuccauau

SEQ ID NO: 251658 - RNA, 19 nt, Homo sapiens
gacagcaguuugguuguug

SEQ ID NO: 251659 - RNA, 19 nt, Homo sapiens
cgccauugaucaaauaaau

SEQ ID NO: 251660 - RNA, 19 nt, Homo sapiens
acacuacagaagacaauua

SEQ ID NO: 251661 - RNA, 19 nt, Homo sapiens
caaaggaauguuaaucuag

SEQ ID NO: 251662 - RNA, 19 nt, Homo sapiens
agaaccgccucuaaguuaa

SEQ ID NO: 251663 - RNA, 19 nt, Homo sapiens
gaucaagagcaaaggaaug

SEQ ID NO: 251664 - RNA, 19 nt, Homo sapiens
ggaaaccaaauccugauca

SEQ ID NO: 251665 - RNA, 19 nt, Homo sapiens
gauaagguucguucucaau

SEQ ID NO: 251666 - RNA, 19 nt, Homo sapiens
ugaagaaugccaagaauac

SEQ ID NO: 251667 - RNA, 19 nt, Homo sapiens
caucuucuguugaguacug

SEQ ID NO: 251668 - RNA, 19 nt, Homo sapiens
gugucuaggcuucucauua

SEQ ID NO: 251669 - RNA, 19 nt, Homo sapiens
gaccaaugcauucaucuca

SEQ ID NO: 251670 - RNA, 19 nt, Homo sapiens
gaagaaugccaagaauaca

SEQ ID NO: 251671 - RNA, 19 nt, Homo sapiens
gagcaaaggaauguuaauc

SEQ ID NO: 251672 - RNA, 19 nt, Homo sapiens
caguugcucuguacaaauc

SEQ ID NO: 251673 - RNA, 19 nt, Homo sapiens
agacaagacaguuaucaga

SEQ ID NO: 251674 - RNA, 19 nt, Homo sapiens
cgagagauucuuucguuug

SEQ ID NO: 251675 - RNA, 19 nt, Homo sapiens
gguuucauaucucuauugu

SEQ ID NO: 251676 - RNA, 19 nt, Homo sapiens
gaaagagagugaaaaugca

SEQ ID NO: 251677 - RNA, 19 nt, Homo sapiens
acugaaagcaaauguguaa

SEQ ID NO: 251678 - RNA, 19 nt, Homo sapiens
aaccaaauccugaucaaga

SEQ ID NO: 251679 - RNA, 19 nt, Homo sapiens
agauugaaguuuccuguca

SEQ ID NO: 251680 - RNA, 19 nt, Homo sapiens
cagccgugaugaugaaaga

SEQ ID NO: 251681 - RNA, 19 nt, Homo sapiens
caagugagagcagcaguga

SEQ ID NO: 251682 - RNA, 19 nt, Homo sapiens
gcccuuugaucagcuguuu

SEQ ID NO: 251683 - RNA, 19 nt, Homo sapiens
gcaaauguguaaccauccu

SEQ ID NO: 251684 - RNA, 19 nt, Homo sapiens
guucagcuccugcacaguu

SEQ ID NO: 251685 - RNA, 19 nt, Homo sapiens
acugcaagcugacuuacuu

SEQ ID NO: 251686 - RNA, 19 nt, Homo sapiens
ccuccuccauauuugcuua

SEQ ID NO: 251687 - RNA, 19 nt, Homo sapiens
gcaaaggaauguuaaucua

SEQ ID NO: 251688 - RNA, 19 nt, Homo sapiens
guacaaauccuccuccaua

SEQ ID NO: 251689 - RNA, 19 nt, Homo sapiens
gaauggauauuugcagaua

SEQ ID NO: 251690 - RNA, 19 nt, Homo sapiens
ggagauaacauccagcuuu

SEQ ID NO: 251691 - RNA, 19 nt, Homo sapiens
gaaguuuccugucauguuc

SEQ ID NO: 251692 - RNA, 19 nt, Homo sapiens
gagagauucuuucguuuga

SEQ ID NO: 251693 - RNA, 19 nt, Homo sapiens
cagaaucacugaaagcaaa

SEQ ID NO: 251694 - RNA, 19 nt, Homo sapiens
cauguucacucaucuuuaa

SEQ ID NO: 251695 - RNA, 19 nt, Homo sapiens
gaagacaauuauucacguu

SEQ ID NO: 251696 - RNA, 19 nt, Homo sapiens
caucguggcgcauguauua

SEQ ID NO: 251697 - RNA, 19 nt, Homo sapiens
gaaaccaaauccugaucaa

SEQ ID NO: 251698 - RNA, 19 nt, Homo sapiens
gagauaacauccagcuuuc

SEQ ID NO: 251699 - RNA, 19 nt, Homo sapiens
caagagcaaaggaauguua

SEQ ID NO: 251700 - RNA, 19 nt, Homo sapiens
gaagaaccgccucuaaguu

SEQ ID NO: 251701 - RNA, 19 nt, Homo sapiens
uaaguacgauguucaagug

SEQ ID NO: 251702 - RNA, 19 nt, Homo sapiens
gaaaauaaacgcuccaaaa

SEQ ID NO: 251703 - RNA, 19 nt, Homo sapiens
ccauuaaaguuacugguuu

SEQ ID NO: 251704 - RNA, 19 nt, Homo sapiens
gaguggagccaaccuauuu

SEQ ID NO: 251705 - RNA, 19 nt, Homo sapiens
gaaaccagaaucacugaaa

SEQ ID NO: 251706 - RNA, 19 nt, Homo sapiens
gcagaacgaccacucacua

SEQ ID NO: 251707 - RNA, 19 nt, Homo sapiens
gagcaaaccaacucugaaa

SEQ ID NO: 251708 - RNA, 19 nt, Homo sapiens
caaauaaauccuccacuga

SEQ ID NO: 251709 - RNA, 19 nt, Homo sapiens
gcaaaccaacucugaaaga

SEQ ID NO: 251710 - RNA, 19 nt, Homo sapiens
ucacgccauugaucaaaua

SEQ ID NO: 251711 - RNA, 19 nt, Homo sapiens
ccacaaacacuacagaaga

SEQ ID NO: 251712 - RNA, 19 nt, Homo sapiens
ccuggaaccucaauuguga

SEQ ID NO: 251713 - RNA, 19 nt, Homo sapiens
aagaaccgccucuaaguua

SEQ ID NO: 251714 - RNA, 19 nt, Homo sapiens
gagccaaccuauuuaugug

SEQ ID NO: 251715 - RNA, 19 nt, Homo sapiens
gaacucgucucucuaucca

SEQ ID NO: 251716 - RNA, 19 nt, Homo sapiens
ugaaggaacucgucucucu

SEQ ID NO: 251717 - RNA, 19 nt, Homo sapiens
gaagaugacuaugaaacca

SEQ ID NO: 251718 - RNA, 19 nt, Homo sapiens
gaagagagcaaaccaacuc

SEQ ID NO: 251719 - RNA, 19 nt, Homo sapiens
gaaagcaaauguguaacca

SEQ ID NO: 251720 - RNA, 19 nt, Homo sapiens
ugacuuacuuccugaugaa

SEQ ID NO: 251721 - RNA, 19 nt, Homo sapiens
gcagggcucuggagugagu

SEQ ID NO: 251722 - RNA, 19 nt, Homo sapiens
gaaugucacagcagagauu

SEQ ID NO: 251723 - RNA, 19 nt, Homo sapiens
ccacaccguaucugaaaua

SEQ ID NO: 251724 - RNA, 19 nt, Homo sapiens
guacgauguucaagugaga

SEQ ID NO: 251725 - RNA, 19 nt, Homo sapiens
uacaaggaauggauauuug

SEQ ID NO: 251726 - RNA, 19 nt, Homo sapiens
ccaggcacauugagcauug

SEQ ID NO: 251727 - RNA, 19 nt, Homo sapiens
ggagccaaccuauuuaugu

SEQ ID NO: 251728 - RNA, 19 nt, Homo sapiens
agaaaccagugucugcuuu

SEQ ID NO: 251729 - RNA, 19 nt, Homo sapiens
ccugucaauuucaccauua

SEQ ID NO: 251730 - RNA, 19 nt, Homo sapiens
gaaggaacucgucucucua

SEQ ID NO: 251731 - RNA, 19 nt, Homo sapiens
cuacagaagacaauuauuc

SEQ ID NO: 251732 - RNA, 19 nt, Homo sapiens
gaacgaccacucacuacug

SEQ ID NO: 251733 - RNA, 19 nt, Homo sapiens
gauacugcaagcugacuua

SEQ ID NO: 251734 - RNA, 19 nt, Homo sapiens
gaaccgccucuaaguuaaa

SEQ ID NO: 251735 - RNA, 19 nt, Homo sapiens
gagauucuuucguuugaca

SEQ ID NO: 251736 - RNA, 19 nt, Homo sapiens
caccguaucugaaauaaaa

SEQ ID NO: 251737 - RNA, 19 nt, Homo sapiens
ccaaugcauucaucucaau

SEQ ID NO: 251738 - RNA, 19 nt, Homo sapiens
acaagaggaucgucuguag

SEQ ID NO: 251739 - RNA, 19 nt, Homo sapiens
uuacagccgugaugaugaa

SEQ ID NO: 251740 - RNA, 19 nt, Homo sapiens
ggaccauccugcagaacga

SEQ ID NO: 251741 - RNA, 19 nt, Homo sapiens
caaaagaagaugacuauga

SEQ ID NO: 251742 - RNA, 19 nt, Homo sapiens
aauaaacgcuccaaaagaa

SEQ ID NO: 251743 - RNA, 19 nt, Homo sapiens
gaacaagaggaucgucugu

SEQ ID NO: 251744 - RNA, 19 nt, Homo sapiens
aaauaaauccuccacugaa

SEQ ID NO: 251745 - RNA, 19 nt, Homo sapiens
aaauaucgcaugcugguuu

SEQ ID NO: 251746 - RNA, 19 nt, Homo sapiens
aauaaauccuccacugaau

SEQ ID NO: 251747 - RNA, 19 nt, Homo sapiens
cauuaaaguuacugguuug

SEQ ID NO: 251748 - RNA, 19 nt, Homo sapiens
uacaaauccuccuccauau

SEQ ID NO: 251749 - RNA, 19 nt, Homo sapiens
ugacagcaguuugguuguu

SEQ ID NO: 251750 - RNA, 19 nt, Homo sapiens
cgccauugaucaaauaaau

SEQ ID NO: 251751 - RNA, 19 nt, Homo sapiens
acacuacagaagacaauua

SEQ ID NO: 251752 - RNA, 19 nt, Homo sapiens
caaaggaauguuaaucuag

SEQ ID NO: 251753 - RNA, 19 nt, Homo sapiens
gacagcaguuugguuguug

SEQ ID NO: 251754 - RNA, 19 nt, Homo sapiens
agaaccgccucuaaguuaa

SEQ ID NO: 251755 - RNA, 19 nt, Homo sapiens
gaucaagagcaaaggaaug

SEQ ID NO: 251756 - RNA, 19 nt, Homo sapiens
ggaaaccaaauccugauca

SEQ ID NO: 251757 - RNA, 19 nt, Homo sapiens
gauaagguucguucucaau

SEQ ID NO: 251758 - RNA, 19 nt, Homo sapiens
ugaagaaugccaagaauac

SEQ ID NO: 251759 - RNA, 19 nt, Homo sapiens
caucuucuguugaguacug

SEQ ID NO: 251760 - RNA, 19 nt, Homo sapiens
gaccaaugcauucaucuca

SEQ ID NO: 251761 - RNA, 19 nt, Homo sapiens
gaagaaugccaagaauaca

SEQ ID NO: 251762 - RNA, 19 nt, Homo sapiens
cgagagauucuuucguuug

SEQ ID NO: 251763 - RNA, 19 nt, Homo sapiens
gagcaaaggaauguuaauc

SEQ ID NO: 251764 - RNA, 19 nt, Homo sapiens
agacaagacaguuaucaga

SEQ ID NO: 251765 - RNA, 19 nt, Homo sapiens
caguugcucuguacaaauc

SEQ ID NO: 251766 - RNA, 19 nt, Homo sapiens
caagauaaaggagauaaca

SEQ ID NO: 251767 - RNA, 19 nt, Homo sapiens
acugaaagcaaauguguaa

SEQ ID NO: 251768 - RNA, 19 nt, Homo sapiens
aaccaaauccugaucaaga

SEQ ID NO: 251769 - RNA, 19 nt, Homo sapiens
gaaagagagugaaaaugca

SEQ ID NO: 251770 - RNA, 19 nt, Homo sapiens
agauugaaguuuccuguca

SEQ ID NO: 251771 - RNA, 19 nt, Homo sapiens
cagccgugaugaugaaaga

SEQ ID NO: 251772 - RNA, 19 nt, Homo sapiens
caagugagagcagcaguga

SEQ ID NO: 251773 - RNA, 19 nt, Homo sapiens
gcccuuugaucagcuguuu

SEQ ID NO: 251774 - RNA, 19 nt, Homo sapiens
guucagcuccugcacaguu

SEQ ID NO: 251775 - RNA, 19 nt, Homo sapiens
ccuccuccauauuugcuua

SEQ ID NO: 251776 - RNA, 19 nt, Homo sapiens
gcaaauguguaaccauccu

SEQ ID NO: 251777 - RNA, 19 nt, Homo sapiens
acugcaagcugacuuacuu

SEQ ID NO: 251778 - RNA, 19 nt, Homo sapiens
ugaagaaccgccucuaagu

SEQ ID NO: 251779 - RNA, 19 nt, Homo sapiens
aggcagggcucuggaguga

SEQ ID NO: 251780 - RNA, 19 nt, Homo sapiens
ccauugcuuugauuaugaa

SEQ ID NO: 251781 - RNA, 19 nt, Homo sapiens
uaaauccuccacugaaugu

SEQ ID NO: 251782 - RNA, 19 nt, Homo sapiens
ggcuugcggugcuuguuaa

SEQ ID NO: 251783 - RNA, 19 nt, Homo sapiens
uuaaggucauaccaaguuu

SEQ ID NO: 251784 - RNA, 19 nt, Homo sapiens
gacaggcuacagauuguuu

SEQ ID NO: 251785 - RNA, 19 nt, Homo sapiens
uagacaggcuacagauugu

SEQ ID NO: 251786 - RNA, 19 nt, Homo sapiens
gacaagacaguuaucagau

SEQ ID NO: 251787 - RNA, 19 nt, Homo sapiens
gaagucaucuguuauauag

SEQ ID NO: 251788 - RNA, 19 nt, Homo sapiens
gcaaaggaauguuaaucua

SEQ ID NO: 251789 - RNA, 19 nt, Homo sapiens
uaagagguguucagaauuu

SEQ ID NO: 251790 - RNA, 19 nt, Homo sapiens
guacaaauccuccuccaua

SEQ ID NO: 251791 - RNA, 19 nt, Homo sapiens
gaauggauauuugcagaua

SEQ ID NO: 251792 - RNA, 19 nt, Homo sapiens
gcuaagagguguucagaau

SEQ ID NO: 251793 - RNA, 19 nt, Homo sapiens
gagagauucuuucguuuga

SEQ ID NO: 251794 - RNA, 19 nt, Homo sapiens
cagaaucacugaaagcaaa

SEQ ID NO: 251795 - RNA, 19 nt, Homo sapiens
gaagacaauuauucacguu

SEQ ID NO: 251796 - RNA, 19 nt, Homo sapiens
caucguggcgcauguauua

SEQ ID NO: 251797 - RNA, 19 nt, Homo sapiens
gaugcuggcucuuggcuaa

SEQ ID NO: 251798 - RNA, 19 nt, Homo sapiens
gaaaccaaauccugaucaa

SEQ ID NO: 251799 - RNA, 19 nt, Homo sapiens
caagagcaaaggaauguua

SEQ ID NO: 251800 - RNA, 19 nt, Homo sapiens
gaagaaccgccucuaaguu

SEQ ID NO: 251801 - RNA, 19 nt, Homo sapiens
uaaguacgauguucaagug

SEQ ID NO: 251802 - RNA, 19 nt, Homo sapiens
gaaaauaaacgcuccaaaa

SEQ ID NO: 251803 - RNA, 19 nt, Homo sapiens
ccauuaaaguuacugguuu

SEQ ID NO: 251804 - RNA, 19 nt, Homo sapiens
gcagggaaguugacucauc

SEQ ID NO: 251805 - RNA, 19 nt, Homo sapiens
gaguggagccaaccuauuu

SEQ ID NO: 251806 - RNA, 19 nt, Homo sapiens
gaaaccagaaucacugaaa

SEQ ID NO: 251807 - RNA, 19 nt, Homo sapiens
gcagaacgaccacucacua

SEQ ID NO: 251808 - RNA, 19 nt, Homo sapiens
gagcaaaccaacucugaaa

SEQ ID NO: 251809 - RNA, 19 nt, Homo sapiens
gcaaccaucugcuucaucu

SEQ ID NO: 251810 - RNA, 19 nt, Homo sapiens
gagagugguuugucauugu

SEQ ID NO: 251811 - RNA, 19 nt, Homo sapiens
caaauaaauccuccacuga

SEQ ID NO: 251812 - RNA, 19 nt, Homo sapiens
gcaaaccaacucugaaaga

SEQ ID NO: 251813 - RNA, 19 nt, Homo sapiens
caaguuguuuccaccaauu

SEQ ID NO: 251814 - RNA, 19 nt, Homo sapiens
ucacgccauugaucaaaua

SEQ ID NO: 251815 - RNA, 19 nt, Homo sapiens
ccacaaacacuacagaaga

SEQ ID NO: 251816 - RNA, 19 nt, Homo sapiens
ccuggaaccucaauuguga

SEQ ID NO: 251817 - RNA, 19 nt, Homo sapiens
aagaaccgccucuaaguua

SEQ ID NO: 251818 - RNA, 19 nt, Homo sapiens
gagccaaccuauuuaugug

SEQ ID NO: 251819 - RNA, 19 nt, Homo sapiens
gaacucgucucucuaucca

SEQ ID NO: 251820 - RNA, 19 nt, Homo sapiens
ugaaggaacucgucucucu

SEQ ID NO: 251821 - RNA, 19 nt, Homo sapiens
gaagagagcaaaccaacuc

SEQ ID NO: 251822 - RNA, 19 nt, Homo sapiens
gaagaugacuaugaaacca

SEQ ID NO: 251823 - RNA, 19 nt, Homo sapiens
gaaagcaaauguguaacca

SEQ ID NO: 251824 - RNA, 19 nt, Homo sapiens
ugacuuacuuccugaugaa

SEQ ID NO: 251825 - RNA, 19 nt, Homo sapiens
ccagugagacggaaauuga

SEQ ID NO: 251826 - RNA, 19 nt, Homo sapiens
gcagggcucuggagugagu

SEQ ID NO: 251827 - RNA, 19 nt, Homo sapiens
gaaauugaagucaucuguu

SEQ ID NO: 251828 - RNA, 19 nt, Homo sapiens
gaaugucacagcagagauu

SEQ ID NO: 251829 - RNA, 19 nt, Homo sapiens
ccuggaggauucuguguuu

SEQ ID NO: 251830 - RNA, 19 nt, Homo sapiens
uuaauucucucgcuuaucu

SEQ ID NO: 251831 - RNA, 19 nt, Homo sapiens
guacgauguucaagugaga

SEQ ID NO: 251832 - RNA, 19 nt, Homo sapiens
uacaaggaauggauauuug

SEQ ID NO: 251833 - RNA, 19 nt, Homo sapiens
ccaggcacauugagcauug

SEQ ID NO: 251834 - RNA, 19 nt, Homo sapiens
ggaaauugaagucaucugu

SEQ ID NO: 251835 - RNA, 19 nt, Homo sapiens
gggaaaugaugaacacaag

SEQ ID NO: 251836 - RNA, 19 nt, Homo sapiens
ggagccaaccuauuuaugu

SEQ ID NO: 251837 - RNA, 19 nt, Homo sapiens
agaaaccagugucugcuuu

SEQ ID NO: 251838 - RNA, 19 nt, Homo sapiens
ccugucaauuucaccauua

SEQ ID NO: 251839 - RNA, 19 nt, Homo sapiens
caauuuaccugcgaagcaa

SEQ ID NO: 251840 - RNA, 19 nt, Homo sapiens
gaaggaacucgucucucua

SEQ ID NO: 251841 - RNA, 19 nt, Homo sapiens
cuacagaagacaauuauuc

SEQ ID NO: 251842 - RNA, 19 nt, Homo sapiens
gaacgaccacucacuacug

SEQ ID NO: 251843 - RNA, 19 nt, Homo sapiens
gauacugcaagcugacuua

SEQ ID NO: 251844 - RNA, 19 nt, Homo sapiens
gagauucuuucguuugaca

SEQ ID NO: 251845 - RNA, 19 nt, Homo sapiens
gaaccgccucuaaguuaaa

SEQ ID NO: 251846 - RNA, 19 nt, Homo sapiens
cugccaaucuuugcaauuu

SEQ ID NO: 251847 - RNA, 19 nt, Homo sapiens
ccaaugcauucaucucaau

SEQ ID NO: 251848 - RNA, 19 nt, Homo sapiens
acaagaggaucgucuguag

SEQ ID NO: 251849 - RNA, 19 nt, Homo sapiens
uuacagccgugaugaugaa

SEQ ID NO: 251850 - RNA, 19 nt, Homo sapiens
ggagugaaccaugaacuug

SEQ ID NO: 251851 - RNA, 19 nt, Homo sapiens
ggaccauccugcagaacga

SEQ ID NO: 251852 - RNA, 19 nt, Homo sapiens
gcuaccaucugaggaagaa

SEQ ID NO: 251853 - RNA, 19 nt, Homo sapiens
ccaaaucgccucaccuaca

SEQ ID NO: 251854 - RNA, 19 nt, Homo sapiens
caaaagaagaugacuauga

SEQ ID NO: 251855 - RNA, 19 nt, Homo sapiens
aauaaacgcuccaaaagaa

SEQ ID NO: 251856 - RNA, 19 nt, Homo sapiens
gaacaagaggaucgucugu

SEQ ID NO: 251857 - RNA, 19 nt, Homo sapiens
aaauaaauccuccacugaa

SEQ ID NO: 251858 - RNA, 19 nt, Homo sapiens
aaauaucgcaugcugguuu

SEQ ID NO: 251859 - RNA, 19 nt, Homo sapiens
uguuuaagcugccaauugu

SEQ ID NO: 251860 - RNA, 19 nt, Homo sapiens
uaacguccagcuguauuua

SEQ ID NO: 251861 - RNA, 19 nt, Homo sapiens
caaaucgccucaccuacag

SEQ ID NO: 251862 - RNA, 19 nt, Homo sapiens
uuaggcaacacucaauuua

SEQ ID NO: 251863 - RNA, 19 nt, Homo sapiens
aauaaauccuccacugaau

SEQ ID NO: 251864 - RNA, 19 nt, Homo sapiens
ugacagcaguuugguuguu

SEQ ID NO: 251865 - RNA, 19 nt, Homo sapiens
cauuaaaguuacugguuug

SEQ ID NO: 251866 - RNA, 19 nt, Homo sapiens
uacaaauccuccuccauau

SEQ ID NO: 251867 - RNA, 19 nt, Homo sapiens
gacagcaguuugguuguug

SEQ ID NO: 251868 - RNA, 19 nt, Homo sapiens
gaauuuaggcaacacucaa

SEQ ID NO: 251869 - RNA, 19 nt, Homo sapiens
cgccauugaucaaauaaau

SEQ ID NO: 251870 - RNA, 19 nt, Homo sapiens
acacuacagaagacaauua

SEQ ID NO: 251871 - RNA, 19 nt, Homo sapiens
caaaggaauguuaaucuag

SEQ ID NO: 251872 - RNA, 19 nt, Homo sapiens
agaaccgccucuaaguuaa

SEQ ID NO: 251873 - RNA, 19 nt, Homo sapiens
gagagagugguuugucauu

SEQ ID NO: 251874 - RNA, 19 nt, Homo sapiens
gaucaagagcaaaggaaug

SEQ ID NO: 251875 - RNA, 19 nt, Homo sapiens
ggaaaccaaauccugauca

SEQ ID NO: 251876 - RNA, 19 nt, Homo sapiens
gauaagguucguucucaau

SEQ ID NO: 251877 - RNA, 19 nt, Homo sapiens
ugaagaaugccaagaauac

SEQ ID NO: 251878 - RNA, 19 nt, Homo sapiens
caucuucuguugaguacug

SEQ ID NO: 251879 - RNA, 19 nt, Homo sapiens
gaaccaugaacuuggauuc

SEQ ID NO: 251880 - RNA, 19 nt, Homo sapiens
agacaagacaguuaucaga

SEQ ID NO: 251881 - RNA, 19 nt, Homo sapiens
gaccaaugcauucaucuca

SEQ ID NO: 251882 - RNA, 19 nt, Homo sapiens
cgagagauucuuucguuug

SEQ ID NO: 251883 - RNA, 19 nt, Homo sapiens
gaagaaugccaagaauaca

SEQ ID NO: 251884 - RNA, 19 nt, Homo sapiens
caguugcucuguacaaauc

SEQ ID NO: 251885 - RNA, 19 nt, Homo sapiens
gagcaaaggaauguuaauc

SEQ ID NO: 251886 - RNA, 19 nt, Homo sapiens
gacggaaauugaagucauc

SEQ ID NO: 251887 - RNA, 19 nt, Homo sapiens
gcaaaggaauguuaaucua

SEQ ID NO: 251888 - RNA, 19 nt, Homo sapiens
guacaaauccuccuccaua

SEQ ID NO: 251889 - RNA, 19 nt, Homo sapiens
gaauggauauuugcagaua

SEQ ID NO: 251890 - RNA, 19 nt, Homo sapiens
gagagauucuuucguuuga

SEQ ID NO: 251891 - RNA, 19 nt, Homo sapiens
guacaauaguggaauagaa

SEQ ID NO: 251892 - RNA, 19 nt, Homo sapiens
ccucaaggguaacaucuua

SEQ ID NO: 251893 - RNA, 19 nt, Homo sapiens
cagaaucacugaaagcaaa

SEQ ID NO: 251894 - RNA, 19 nt, Homo sapiens
gaagacaauuauucacguu

SEQ ID NO: 251895 - RNA, 19 nt, Homo sapiens
caucguggcgcauguauua

SEQ ID NO: 251896 - RNA, 19 nt, Homo sapiens
ggaauagauuugccaugaa

SEQ ID NO: 251897 - RNA, 19 nt, Homo sapiens
gaaaccaaauccugaucaa

SEQ ID NO: 251898 - RNA, 19 nt, Homo sapiens
gaauagauuugccaugaag

SEQ ID NO: 251899 - RNA, 19 nt, Homo sapiens
caagagcaaaggaauguua

SEQ ID NO: 251900 - RNA, 19 nt, Homo sapiens
gaagaaccgccucuaaguu

SEQ ID NO: 251901 - RNA, 19 nt, Homo sapiens
uaaguacgauguucaagug

SEQ ID NO: 251902 - RNA, 19 nt, Homo sapiens
gaaaauaaacgcuccaaaa

SEQ ID NO: 251903 - RNA, 19 nt, Homo sapiens
ccauuaaaguuacugguuu

SEQ ID NO: 251904 - RNA, 19 nt, Homo sapiens
gaguggagccaaccuauuu

SEQ ID NO: 251905 - RNA, 19 nt, Homo sapiens
gaaaccagaaucacugaaa

SEQ ID NO: 251906 - RNA, 19 nt, Homo sapiens
gcagaacgaccacucacua

SEQ ID NO: 251907 - RNA, 19 nt, Homo sapiens
gagcaaaccaacucugaaa

SEQ ID NO: 251908 - RNA, 19 nt, Homo sapiens
uaauagagauccugugucu

SEQ ID NO: 251909 - RNA, 19 nt, Homo sapiens
gggaagaaauaauagagau

SEQ ID NO: 251910 - RNA, 19 nt, Homo sapiens
caaauaaauccuccacuga

SEQ ID NO: 251911 - RNA, 19 nt, Homo sapiens
gcaaaccaacucugaaaga

SEQ ID NO: 251912 - RNA, 19 nt, Homo sapiens
ucacgccauugaucaaaua

SEQ ID NO: 251913 - RNA, 19 nt, Homo sapiens
ccacaaacacuacagaaga

SEQ ID NO: 251914 - RNA, 19 nt, Homo sapiens
ccuggaaccucaauuguga

SEQ ID NO: 251915 - RNA, 19 nt, Homo sapiens
aagaaccgccucuaaguua

SEQ ID NO: 251916 - RNA, 19 nt, Homo sapiens
gagccaaccuauuuaugug

SEQ ID NO: 251917 - RNA, 19 nt, Homo sapiens
gaacucgucucucuaucca

SEQ ID NO: 251918 - RNA, 19 nt, Homo sapiens
ugaaggaacucgucucucu

SEQ ID NO: 251919 - RNA, 19 nt, Homo sapiens
gaagagagcaaaccaacuc

SEQ ID NO: 251920 - RNA, 19 nt, Homo sapiens
gaagaugacuaugaaacca

SEQ ID NO: 251921 - RNA, 19 nt, Homo sapiens
gaaagcaaauguguaacca

SEQ ID NO: 251922 - RNA, 19 nt, Homo sapiens
ugacuuacuuccugaugaa

SEQ ID NO: 251923 - RNA, 19 nt, Homo sapiens
gcugugggaagaaauaaua

SEQ ID NO: 251924 - RNA, 19 nt, Homo sapiens
gcagggcucuggagugagu

SEQ ID NO: 251925 - RNA, 19 nt, Homo sapiens
gaaugucacagcagagauu

SEQ ID NO: 251926 - RNA, 19 nt, Homo sapiens
aggaauagauuugccauga

SEQ ID NO: 251927 - RNA, 19 nt, Homo sapiens
guacgauguucaagugaga

SEQ ID NO: 251928 - RNA, 19 nt, Homo sapiens
uacaaggaauggauauuug

SEQ ID NO: 251929 - RNA, 19 nt, Homo sapiens
ccaggcacauugagcauug

SEQ ID NO: 251930 - RNA, 19 nt, Homo sapiens
ggagccaaccuauuuaugu

SEQ ID NO: 251931 - RNA, 19 nt, Homo sapiens
agaaaccagugucugcuuu

SEQ ID NO: 251932 - RNA, 19 nt, Homo sapiens
ccugucaauuucaccauua

SEQ ID NO: 251933 - RNA, 19 nt, Homo sapiens
ugucuaggcuucucauuag

SEQ ID NO: 251934 - RNA, 19 nt, Homo sapiens
gaaggaacucgucucucua

SEQ ID NO: 251935 - RNA, 19 nt, Homo sapiens
cuacagaagacaauuauuc

SEQ ID NO: 251936 - RNA, 19 nt, Homo sapiens
gaacgaccacucacuacug

SEQ ID NO: 251937 - RNA, 19 nt, Homo sapiens
gauacugcaagcugacuua

SEQ ID NO: 251938 - RNA, 19 nt, Homo sapiens
gaaccgccucuaaguuaaa

SEQ ID NO: 251939 - RNA, 19 nt, Homo sapiens
gagauucuuucguuugaca

SEQ ID NO: 251940 - RNA, 19 nt, Homo sapiens
cuauuuauguggguaagua

SEQ ID NO: 251941 - RNA, 19 nt, Homo sapiens
ccaaugcauucaucucaau

SEQ ID NO: 251942 - RNA, 19 nt, Homo sapiens
acaagaggaucgucuguag

SEQ ID NO: 251943 - RNA, 19 nt, Homo sapiens
uuacagccgugaugaugaa

SEQ ID NO: 251944 - RNA, 19 nt, Homo sapiens
ggaccauccugcagaacga

SEQ ID NO: 251945 - RNA, 19 nt, Homo sapiens
caaaagaagaugacuauga

SEQ ID NO: 251946 - RNA, 19 nt, Homo sapiens
aauaaacgcuccaaaagaa

SEQ ID NO: 251947 - RNA, 19 nt, Homo sapiens
gaacaagaggaucgucugu

SEQ ID NO: 251948 - RNA, 19 nt, Homo sapiens
aaauaaauccuccacugaa

SEQ ID NO: 251949 - RNA, 19 nt, Homo sapiens
aaauaucgcaugcugguuu

SEQ ID NO: 251950 - RNA, 19 nt, Homo sapiens
caagcugugggaagaaaua

SEQ ID NO: 251951 - RNA, 19 nt, Homo sapiens
ccaugaagccagugaaguu

SEQ ID NO: 251952 - RNA, 19 nt, Homo sapiens
ugacagcaguuugguuguu

SEQ ID NO: 251953 - RNA, 19 nt, Homo sapiens
aauaaauccuccacugaau

SEQ ID NO: 251954 - RNA, 19 nt, Homo sapiens
cauuaaaguuacugguuug

SEQ ID NO: 251955 - RNA, 19 nt, Homo sapiens
uacaaauccuccuccauau

SEQ ID NO: 251956 - RNA, 19 nt, Homo sapiens
gacagcaguuugguuguug

SEQ ID NO: 251957 - RNA, 19 nt, Homo sapiens
cgccauugaucaaauaaau

SEQ ID NO: 251958 - RNA, 19 nt, Homo sapiens
acacuacagaagacaauua

SEQ ID NO: 251959 - RNA, 19 nt, Homo sapiens
caaaggaauguuaaucuag

SEQ ID NO: 251960 - RNA, 19 nt, Homo sapiens
agaaccgccucuaaguuaa

SEQ ID NO: 251961 - RNA, 19 nt, Homo sapiens
gaucaagagcaaaggaaug

SEQ ID NO: 251962 - RNA, 19 nt, Homo sapiens
ggaaaccaaauccugauca

SEQ ID NO: 251963 - RNA, 19 nt, Homo sapiens
gauaagguucguucucaau

SEQ ID NO: 251964 - RNA, 19 nt, Homo sapiens
ugaagaaugccaagaauac

SEQ ID NO: 251965 - RNA, 19 nt, Homo sapiens
caucuucuguugaguacug

SEQ ID NO: 251966 - RNA, 19 nt, Homo sapiens
gugucuaggcuucucauua

SEQ ID NO: 251967 - RNA, 19 nt, Homo sapiens
cgagagauucuuucguuug

SEQ ID NO: 251968 - RNA, 19 nt, Homo sapiens
gaccaaugcauucaucuca

SEQ ID NO: 251969 - RNA, 19 nt, Homo sapiens
agacaagacaguuaucaga

SEQ ID NO: 251970 - RNA, 19 nt, Homo sapiens
gaagaaugccaagaauaca

SEQ ID NO: 251971 - RNA, 19 nt, Homo sapiens
caguugcucuguacaaauc

SEQ ID NO: 251972 - RNA, 19 nt, Homo sapiens
gagcaaaggaauguuaauc

SEQ ID NO: 251973 - RNA, 19 nt, Homo sapiens
gguuucauaucucuauugu

SEQ ID NO: 251974 - RNA, 19 nt, Homo sapiens
acugaaagcaaauguguaa

SEQ ID NO: 251975 - RNA, 19 nt, Homo sapiens
gaaagagagugaaaaugca

SEQ ID NO: 251976 - RNA, 19 nt, Homo sapiens
aaccaaauccugaucaaga

SEQ ID NO: 251977 - RNA, 19 nt, Homo sapiens
gacaggauaugaucaucgu

SEQ ID NO: 251978 - RNA, 19 nt, Homo sapiens
cagccgugaugaugaaaga

SEQ ID NO: 251979 - RNA, 19 nt, Homo sapiens
caagugagagcagcaguga

SEQ ID NO: 251980 - RNA, 19 nt, Homo sapiens
gcccuuugaucagcuguuu

SEQ ID NO: 251981 - RNA, 19 nt, Homo sapiens
gcaaauguguaaccauccu

SEQ ID NO: 251982 - RNA, 19 nt, Homo sapiens
ccuccuccauauuugcuua

SEQ ID NO: 251983 - RNA, 19 nt, Homo sapiens
guucagcuccugcacaguu

SEQ ID NO: 251984 - RNA, 19 nt, Homo sapiens
acugcaagcugacuuacuu

SEQ ID NO: 251985 - RNA, 19 nt, Homo sapiens
ugaagaaccgccucuaagu

SEQ ID NO: 251986 - RNA, 19 nt, Homo sapiens
aggcagggcucuggaguga

SEQ ID NO: 251987 - RNA, 19 nt, Homo sapiens
gcaaaggaauguuaaucua

SEQ ID NO: 251988 - RNA, 19 nt, Homo sapiens
guacaaauccuccuccaua

SEQ ID NO: 251989 - RNA, 19 nt, Homo sapiens
gaauggauauuugcagaua

SEQ ID NO: 251990 - RNA, 19 nt, Homo sapiens
ggagauaacauccagcuuu

SEQ ID NO: 251991 - RNA, 19 nt, Homo sapiens
gagagauucuuucguuuga

SEQ ID NO: 251992 - RNA, 19 nt, Homo sapiens
cagaaucacugaaagcaaa

SEQ ID NO: 251993 - RNA, 19 nt, Homo sapiens
gaagacaauuauucacguu

SEQ ID NO: 251994 - RNA, 19 nt, Homo sapiens
caucguggcgcauguauua

SEQ ID NO: 251995 - RNA, 19 nt, Homo sapiens
gaaaccaaauccugaucaa

SEQ ID NO: 251996 - RNA, 19 nt, Homo sapiens
gagauaacauccagcuuuc

SEQ ID NO: 251997 - RNA, 19 nt, Homo sapiens
caagagcaaaggaauguua

SEQ ID NO: 251998 - RNA, 19 nt, Homo sapiens
gaagaaccgccucuaaguu

SEQ ID NO: 251999 - RNA, 19 nt, Homo sapiens
uaaguacgauguucaagug

SEQ ID NO: 252000 - RNA, 19 nt, Homo sapiens
gaaaauaaacgcuccaaaa

SEQ ID NO: 252001 - RNA, 19 nt, Homo sapiens
ccauuaaaguuacugguuu

SEQ ID NO: 252002 - RNA, 19 nt, Homo sapiens
gaguggagccaaccuauuu

SEQ ID NO: 252003 - RNA, 19 nt, Homo sapiens
gaaaccagaaucacugaaa

SEQ ID NO: 252004 - RNA, 19 nt, Homo sapiens
gcagaacgaccacucacua

SEQ ID NO: 252005 - RNA, 19 nt, Homo sapiens
gagcaaaccaacucugaaa

SEQ ID NO: 252006 - RNA, 19 nt, Homo sapiens
caaauaaauccuccacuga

SEQ ID NO: 252007 - RNA, 19 nt, Homo sapiens
gcaaaccaacucugaaaga

SEQ ID NO: 252008 - RNA, 19 nt, Homo sapiens
ucacgccauugaucaaaua

SEQ ID NO: 252009 - RNA, 19 nt, Homo sapiens
ccacaaacacuacagaaga

SEQ ID NO: 252010 - RNA, 19 nt, Homo sapiens
ccuggaaccucaauuguga

SEQ ID NO: 252011 - RNA, 19 nt, Homo sapiens
aagaaccgccucuaaguua

SEQ ID NO: 252012 - RNA, 19 nt, Homo sapiens
gagccaaccuauuuaugug

SEQ ID NO: 252013 - RNA, 19 nt, Homo sapiens
gaacucgucucucuaucca

SEQ ID NO: 252014 - RNA, 19 nt, Homo sapiens
ugaaggaacucgucucucu

SEQ ID NO: 252015 - RNA, 19 nt, Homo sapiens
gaagagagcaaaccaacuc

SEQ ID NO: 252016 - RNA, 19 nt, Homo sapiens
gaagaugacuaugaaacca

SEQ ID NO: 252017 - RNA, 19 nt, Homo sapiens
gaaagcaaauguguaacca

SEQ ID NO: 252018 - RNA, 19 nt, Homo sapiens
ugacuuacuuccugaugaa

SEQ ID NO: 252019 - RNA, 19 nt, Homo sapiens
gcagggcucuggagugagu

SEQ ID NO: 252020 - RNA, 19 nt, Homo sapiens
gaaugucacagcagagauu

SEQ ID NO: 252021 - RNA, 19 nt, Homo sapiens
ccacaccguaucugaaaua

SEQ ID NO: 252022 - RNA, 19 nt, Homo sapiens
guacgauguucaagugaga

SEQ ID NO: 252023 - RNA, 19 nt, Homo sapiens
uacaaggaauggauauuug

SEQ ID NO: 252024 - RNA, 19 nt, Homo sapiens
ccaggcacauugagcauug

SEQ ID NO: 252025 - RNA, 19 nt, Homo sapiens
ggagccaaccuauuuaugu

SEQ ID NO: 252026 - RNA, 19 nt, Homo sapiens
agaaaccagugucugcuuu

SEQ ID NO: 252027 - RNA, 19 nt, Homo sapiens
ccugucaauuucaccauua

SEQ ID NO: 252028 - RNA, 19 nt, Homo sapiens
gaaggaacucgucucucua

SEQ ID NO: 252029 - RNA, 19 nt, Homo sapiens
cuacagaagacaauuauuc

SEQ ID NO: 252030 - RNA, 19 nt, Homo sapiens
gaacgaccacucacuacug

SEQ ID NO: 252031 - RNA, 19 nt, Homo sapiens
gauacugcaagcugacuua

SEQ ID NO: 252032 - RNA, 19 nt, Homo sapiens
gaaccgccucuaaguuaaa

SEQ ID NO: 252033 - RNA, 19 nt, Homo sapiens
gagauucuuucguuugaca

SEQ ID NO: 252034 - RNA, 19 nt, Homo sapiens
caccguaucugaaauaaaa

SEQ ID NO: 252035 - RNA, 19 nt, Homo sapiens
ccaaugcauucaucucaau

SEQ ID NO: 252036 - RNA, 19 nt, Homo sapiens
acaagaggaucgucuguag

SEQ ID NO: 252037 - RNA, 19 nt, Homo sapiens
uuacagccgugaugaugaa

SEQ ID NO: 252038 - RNA, 19 nt, Homo sapiens
ggaccauccugcagaacga

SEQ ID NO: 252039 - RNA, 19 nt, Homo sapiens
caaaagaagaugacuauga

SEQ ID NO: 252040 - RNA, 19 nt, Homo sapiens
aauaaacgcuccaaaagaa

SEQ ID NO: 252041 - RNA, 19 nt, Homo sapiens
gaacaagaggaucgucugu

SEQ ID NO: 252042 - RNA, 19 nt, Homo sapiens
aaauaaauccuccacugaa

SEQ ID NO: 252043 - RNA, 19 nt, Homo sapiens
aaauaucgcaugcugguuu

SEQ ID NO: 252044 - RNA, 19 nt, Homo sapiens
aauaaauccuccacugaau

SEQ ID NO: 252045 - RNA, 19 nt, Homo sapiens
cauuaaaguuacugguuug

SEQ ID NO: 252046 - RNA, 19 nt, Homo sapiens
uacaaauccuccuccauau

SEQ ID NO: 252047 - RNA, 19 nt, Homo sapiens
ugacagcaguuugguuguu

SEQ ID NO: 252048 - RNA, 19 nt, Homo sapiens
cgccauugaucaaauaaau

SEQ ID NO: 252049 - RNA, 19 nt, Homo sapiens
acacuacagaagacaauua

SEQ ID NO: 252050 - RNA, 19 nt, Homo sapiens
caaaggaauguuaaucuag

SEQ ID NO: 252051 - RNA, 19 nt, Homo sapiens
agaaccgccucuaaguuaa

SEQ ID NO: 252052 - RNA, 19 nt, Homo sapiens
gacagcaguuugguuguug

SEQ ID NO: 252053 - RNA, 19 nt, Homo sapiens
gaucaagagcaaaggaaug

SEQ ID NO: 252054 - RNA, 19 nt, Homo sapiens
ggaaaccaaauccugauca

SEQ ID NO: 252055 - RNA, 19 nt, Homo sapiens
gauaagguucguucucaau

SEQ ID NO: 252056 - RNA, 19 nt, Homo sapiens
ugaagaaugccaagaauac

SEQ ID NO: 252057 - RNA, 19 nt, Homo sapiens
caucuucuguugaguacug

SEQ ID NO: 252058 - RNA, 19 nt, Homo sapiens
agacaagacaguuaucaga

SEQ ID NO: 252059 - RNA, 19 nt, Homo sapiens
gaccaaugcauucaucuca

SEQ ID NO: 252060 - RNA, 19 nt, Homo sapiens
gaagaaugccaagaauaca

SEQ ID NO: 252061 - RNA, 19 nt, Homo sapiens
cgagagauucuuucguuug

SEQ ID NO: 252062 - RNA, 19 nt, Homo sapiens
gagcaaaggaauguuaauc

SEQ ID NO: 252063 - RNA, 19 nt, Homo sapiens
caguugcucuguacaaauc

SEQ ID NO: 252064 - RNA, 19 nt, Homo sapiens
caagauaaaggagauaaca

SEQ ID NO: 252065 - RNA, 19 nt, Homo sapiens
gaaagagagugaaaaugca

SEQ ID NO: 252066 - RNA, 19 nt, Homo sapiens
acugaaagcaaauguguaa

SEQ ID NO: 252067 - RNA, 19 nt, Homo sapiens
aaccaaauccugaucaaga

SEQ ID NO: 252068 - RNA, 19 nt, Homo sapiens
gacaggauaugaucaucgu

SEQ ID NO: 252069 - RNA, 19 nt, Homo sapiens
cagccgugaugaugaaaga

SEQ ID NO: 252070 - RNA, 19 nt, Homo sapiens
caagugagagcagcaguga

SEQ ID NO: 252071 - RNA, 19 nt, Homo sapiens
gcccuuugaucagcuguuu

SEQ ID NO: 252072 - RNA, 19 nt, Homo sapiens
gcaaauguguaaccauccu

SEQ ID NO: 252073 - RNA, 19 nt, Homo sapiens
guucagcuccugcacaguu

SEQ ID NO: 252074 - RNA, 19 nt, Homo sapiens
acugcaagcugacuuacuu

SEQ ID NO: 252075 - RNA, 19 nt, Homo sapiens
ccuccuccauauuugcuua

SEQ ID NO: 252076 - RNA, 19 nt, Homo sapiens
ugaagaaccgccucuaagu

SEQ ID NO: 252077 - RNA, 19 nt, Homo sapiens
aggcagggcucuggaguga

SEQ ID NO: 252078 - RNA, 19 nt, Homo sapiens
gacaagacaguuaucagau

SEQ ID NO: 252079 - RNA, 19 nt, Homo sapiens
ccauugcuuugauuaugaa

SEQ ID NO: 252080 - RNA, 19 nt, Homo sapiens
uaaauccuccacugaaugu

SEQ ID NO: 252081 - RNA, 19 nt, Homo sapiens
ggcuugcggugcuuguuaa

SEQ ID NO: 252082 - RNA, 19 nt, Homo sapiens
uuaaggucauaccaaguuu

SEQ ID NO: 252083 - RNA, 19 nt, Homo sapiens
aaagugcacccagagauaa

SEQ ID NO: 252084 - RNA, 19 nt, Homo sapiens
ugaaggaagcugccugaga

SEQ ID NO: 252085 - RNA, 19 nt, Homo sapiens
cugaggacacgcaguauuu

SEQ ID NO: 252086 - RNA, 19 nt, Homo sapiens
aaaccagaaucacugaaag

SEQ ID NO: 252087 - RNA, 19 nt, Homo sapiens
gcacagaacuuauguuguu

SEQ ID NO: 252088 - RNA, 19 nt, Homo sapiens
gaaaguggcuaugcaguuu

SEQ ID NO: 252089 - RNA, 19 nt, Homo sapiens
caaagaaucuagaugcaau

SEQ ID NO: 252090 - RNA, 19 nt, Homo sapiens
gaauauccuuuguuucaga

SEQ ID NO: 252091 - RNA, 19 nt, Homo sapiens
gaagcugaguuaauuuaug

SEQ ID NO: 252092 - RNA, 19 nt, Homo sapiens
cagaacagauuugagagua

SEQ ID NO: 252093 - RNA, 19 nt, Homo sapiens
ggagaagauuccaaagaug

SEQ ID NO: 252094 - RNA, 19 nt, Homo sapiens
gaacagauuugagaguagu

SEQ ID NO: 252095 - RNA, 19 nt, Homo sapiens
uaacaagaguaacaugugu

SEQ ID NO: 252096 - RNA, 19 nt, Homo sapiens
gaaaggagacauguaacaa

SEQ ID NO: 252097 - RNA, 19 nt, Homo sapiens
ugagaaaggagacauguaa

SEQ ID NO: 252098 - RNA, 19 nt, Homo sapiens
gaacgaauugacaaacaaa

SEQ ID NO: 252099 - RNA, 19 nt, Homo sapiens
aggcuuaccucaaauaaau

SEQ ID NO: 252100 - RNA, 19 nt, Homo sapiens
ggaaaguggcuaugcaguu

SEQ ID NO: 252101 - RNA, 19 nt, Homo sapiens
ccacugggcacagaacuua

SEQ ID NO: 252102 - RNA, 19 nt, Homo sapiens
gugaagcugaguuaauuua

SEQ ID NO: 252103 - RNA, 19 nt, Homo sapiens
ggagacauguaacaagagu

SEQ ID NO: 252104 - RNA, 19 nt, Homo sapiens
gagaagauuccaaagaugu

SEQ ID NO: 252105 - RNA, 19 nt, Homo sapiens
cuuggaaaguguaggcuua

SEQ ID NO: 252106 - RNA, 19 nt, Homo sapiens
gaaucuagaugcaauaacc

SEQ ID NO: 252107 - RNA, 19 nt, Homo sapiens
aaggagacauguaacaaga

SEQ ID NO: 252108 - RNA, 19 nt, Homo sapiens
gggcacagaacuuauguug

SEQ ID NO: 252109 - RNA, 19 nt, Homo sapiens
uuucagagccagaucauuu

SEQ ID NO: 252110 - RNA, 19 nt, Homo sapiens
cagaacgaauugacaaaca

SEQ ID NO: 252111 - RNA, 19 nt, Homo sapiens
aguguaggcuuaccucaaa

SEQ ID NO: 252112 - RNA, 19 nt, Homo sapiens
gcaaagaaucuagaugcaa

SEQ ID NO: 252113 - RNA, 19 nt, Homo sapiens
ccacucaccucuucagaac

SEQ ID NO: 252114 - RNA, 19 nt, Homo sapiens
aggagaagauuccaaagau

SEQ ID NO: 252115 - RNA, 19 nt, Homo sapiens
agacauguaacaagaguaa

SEQ ID NO: 252116 - RNA, 19 nt, Homo sapiens
gacagccacucaccucuuc

SEQ ID NO: 252117 - RNA, 19 nt, Homo sapiens
agagccagaucauuucuug

SEQ ID NO: 252118 - RNA, 19 nt, Homo sapiens
caaaaguccugauccaguu

SEQ ID NO: 252119 - RNA, 19 nt, Homo sapiens
uagaguaccuccagaacag

SEQ ID NO: 252120 - RNA, 19 nt, Homo sapiens
agaacgaauugacaaacaa

SEQ ID NO: 252121 - RNA, 19 nt, Homo sapiens
aagaguaacaugugugaaa

SEQ ID NO: 252122 - RNA, 19 nt, Homo sapiens
gcccagcuaugaacuccuu

SEQ ID NO: 252123 - RNA, 19 nt, Homo sapiens
guaacaagaguaacaugug

SEQ ID NO: 252124 - RNA, 19 nt, Homo sapiens
caaagaggcacuggcagaa

SEQ ID NO: 252125 - RNA, 19 nt, Homo sapiens
caaacaaauucgguacauc

SEQ ID NO: 252126 - RNA, 19 nt, Homo sapiens
ggcaaagaaucuagaugca

SEQ ID NO: 252127 - RNA, 19 nt, Homo sapiens
caggagaagauuccaaaga

SEQ ID NO: 252128 - RNA, 19 nt, Homo sapiens
gcaguuugaauauccuuug

SEQ ID NO: 252129 - RNA, 19 nt, Homo sapiens
caccucagauuguuguugu

SEQ ID NO: 252130 - RNA, 19 nt, Homo sapiens
guaggcuuaccucaaauaa

SEQ ID NO: 252131 - RNA, 19 nt, Homo sapiens
ccacacagacagccacuca

SEQ ID NO: 252132 - RNA, 19 nt, Homo sapiens
gcuaugcaguuugaauauc

SEQ ID NO: 252133 - RNA, 19 nt, Homo sapiens
ccucagauuguuguuguua

SEQ ID NO: 252134 - RNA, 19 nt, Homo sapiens
gccagaucauuucuuggaa

SEQ ID NO: 252135 - RNA, 19 nt, Homo sapiens
aauaugugaagcugaguua

SEQ ID NO: 252136 - RNA, 19 nt, Homo sapiens
gcaugggcaccucagauug

SEQ ID NO: 252137 - RNA, 19 nt, Homo sapiens
aaccugaaccuuccaaaga

SEQ ID NO: 252138 - RNA, 19 nt, Homo sapiens
acaaacaaauucgguacau

SEQ ID NO: 252139 - RNA, 19 nt, Homo sapiens
uggcuaugcaguuugaaua

SEQ ID NO: 252140 - RNA, 19 nt, Homo sapiens
aaucaucacuggucuuuug

SEQ ID NO: 252141 - RNA, 19 nt, Homo sapiens
augugaagcugaguuaauu

SEQ ID NO: 252142 - RNA, 19 nt, Homo sapiens
ugacaacucaucucauucu

SEQ ID NO: 252143 - RNA, 19 nt, Homo sapiens
ccagagcugugcagaugag

SEQ ID NO: 252144 - RNA, 19 nt, Homo sapiens
agccagagcugugcagaug

SEQ ID NO: 252145 - RNA, 19 nt, Homo sapiens
ucacuggucuuuuggaguu

SEQ ID NO: 252146 - RNA, 19 nt, Homo sapiens
agaagauuccaaagaugua

SEQ ID NO: 252147 - RNA, 19 nt, Homo sapiens
ugagggcucuucggcaaau

SEQ ID NO: 252148 - RNA, 19 nt, Homo sapiens
ugcaggacaugacaacuca

SEQ ID NO: 252149 - RNA, 19 nt, Homo sapiens
guacaaaaguccugaucca

SEQ ID NO: 252150 - RNA, 19 nt, Homo sapiens
guaccuccagaacagauuu

SEQ ID NO: 252151 - RNA, 19 nt, Homo sapiens
gaagauuccaaagauguag

SEQ ID NO: 252152 - RNA, 19 nt, Homo sapiens
agacuugccuggugaaaau

SEQ ID NO: 252153 - RNA, 19 nt, Homo sapiens
ccugaaccuuccaaagaug

SEQ ID NO: 252154 - RNA, 19 nt, Homo sapiens
acaagaguaacauguguga

SEQ ID NO: 252155 - RNA, 19 nt, Homo sapiens
aguaccacuugaaacauuu

SEQ ID NO: 252156 - RNA, 19 nt, Homo sapiens
acucaccucuucagaacga

SEQ ID NO: 252157 - RNA, 19 nt, Homo sapiens
gagcugugcagaugaguac

SEQ ID NO: 252158 - RNA, 19 nt, Homo sapiens
gagcccaccgggaacgaaa

SEQ ID NO: 252159 - RNA, 19 nt, Homo sapiens
gcagaugaguacaaaaguc

SEQ ID NO: 252160 - RNA, 19 nt, Homo sapiens
agaacagauuugagaguag

SEQ ID NO: 252161 - RNA, 19 nt, Homo sapiens
agaaaggagacauguaaca

SEQ ID NO: 252162 - RNA, 19 nt, Homo sapiens
agaguaacaugugugaaag

SEQ ID NO: 252163 - RNA, 19 nt, Homo sapiens
uaugugaagcugaguuaau

SEQ ID NO: 252164 - RNA, 19 nt, Homo sapiens
gcaccucagauuguuguug

SEQ ID NO: 252165 - RNA, 19 nt, Homo sapiens
gacaacucaucucauucug

SEQ ID NO: 252166 - RNA, 19 nt, Homo sapiens
uccaggagcccagcuauga

SEQ ID NO: 252167 - RNA, 19 nt, Homo sapiens
ugagaguagugaggaacaa

SEQ ID NO: 252168 - RNA, 19 nt, Homo sapiens
aaguggcuaugcaguuuga

SEQ ID NO: 252169 - RNA, 19 nt, Homo sapiens
gauucaaugaggagacuug

SEQ ID NO: 252170 - RNA, 19 nt, Homo sapiens
caaccugaaccuuccaaag

SEQ ID NO: 252171 - RNA, 19 nt, Homo sapiens
aaagaggcacuggcagaaa

SEQ ID NO: 252172 - RNA, 19 nt, Homo sapiens
ccaggagcccagcuaugaa

SEQ ID NO: 252173 - RNA, 19 nt, Homo sapiens
uguaggcuuaccucaaaua

SEQ ID NO: 252174 - RNA, 19 nt, Homo sapiens
caguuugaauauccuuugu

SEQ ID NO: 252175 - RNA, 19 nt, Homo sapiens
aauggaaaguggcuaugca

SEQ ID NO: 252176 - RNA, 19 nt, Homo sapiens
gccacucaccucuucagaa

SEQ ID NO: 252177 - RNA, 19 nt, Homo sapiens
caugggcaccucagauugu

SEQ ID NO: 252178 - RNA, 19 nt, Homo sapiens
gacaaacaaauucgguaca

SEQ ID NO: 252179 - RNA, 19 nt, Homo sapiens
aaaggagacauguaacaag

SEQ ID NO: 252180 - RNA, 19 nt, Homo sapiens
ccaccgggaacgaaagaga

SEQ ID NO: 252181 - RNA, 19 nt, Homo sapiens
gggcucuucggcaaaugua

SEQ ID NO: 252182 - RNA, 19 nt, Homo sapiens
ugauccaguuccugcagaa

SEQ ID NO: 252183 - RNA, 19 nt, Homo sapiens
cuccagaacagauuugaga

SEQ ID NO: 252184 - RNA, 19 nt, Homo sapiens
ggcuaugcaguuugaauau

SEQ ID NO: 252185 - RNA, 19 nt, Homo sapiens
aagaggcacuggcagaaaa

SEQ ID NO: 252186 - RNA, 19 nt, Homo sapiens
cucagauuguuguuguuaa

SEQ ID NO: 252187 - RNA, 19 nt, Homo sapiens
gaacucaucuuucuacaga

SEQ ID NO: 252188 - RNA, 19 nt, Homo sapiens
gaaguucuccugccaguua

SEQ ID NO: 252189 - RNA, 19 nt, Homo sapiens
agacagcucuuucuacaua

SEQ ID NO: 252190 - RNA, 19 nt, Homo sapiens
caacauggauggucaagga

SEQ ID NO: 252191 - RNA, 19 nt, Homo sapiens
gaagagaaccauaucaaga

SEQ ID NO: 252192 - RNA, 19 nt, Homo sapiens
gaagcucucuccucccuuu

SEQ ID NO: 252193 - RNA, 19 nt, Homo sapiens
ggagacagcucuuucuaca

SEQ ID NO: 252194 - RNA, 19 nt, Homo sapiens
ccacgacucuggaaacuau

SEQ ID NO: 252195 - RNA, 19 nt, Homo sapiens
gacaaaggcugugcucuug

SEQ ID NO: 252196 - RNA, 19 nt, Homo sapiens
caagugcccuuagcaaauu

SEQ ID NO: 252197 - RNA, 19 nt, Homo sapiens
gcgaguuccucaaauguuu

SEQ ID NO: 252198 - RNA, 19 nt, Homo sapiens
ucaaggaccuccagcauca

SEQ ID NO: 252199 - RNA, 19 nt, Homo sapiens
ggagacagcgugacucuga

SEQ ID NO: 252200 - RNA, 19 nt, Homo sapiens
ucaaagacauucacaacau

SEQ ID NO: 252201 - RNA, 19 nt, Homo sapiens
ucacugccaugccagcuua

SEQ ID NO: 252202 - RNA, 19 nt, Homo sapiens
ggaagacaaugccacuguu

SEQ ID NO: 252203 - RNA, 19 nt, Homo sapiens
aaaccucccuuuccaaaug

SEQ ID NO: 252204 - RNA, 19 nt, Homo sapiens
caaagacauucacaacaug

SEQ ID NO: 252205 - RNA, 19 nt, Homo sapiens
gaacuugggccacugugaa

SEQ ID NO: 252206 - RNA, 19 nt, Homo sapiens
gcaggaggaucacuugagu

SEQ ID NO: 252207 - RNA, 19 nt, Homo sapiens
cagcaaaacucaaaccuuu

SEQ ID NO: 252208 - RNA, 19 nt, Homo sapiens
aaaccaauguucucucuuc

SEQ ID NO: 252209 - RNA, 19 nt, Homo sapiens
gccuaaaugugaaugauga

SEQ ID NO: 252210 - RNA, 19 nt, Homo sapiens
gaagcaccauaacuuuguu

SEQ ID NO: 252211 - RNA, 19 nt, Homo sapiens
uaaggaagacaaugugaaa

SEQ ID NO: 252212 - RNA, 19 nt, Homo sapiens
ggcauuugcugaauacaga

SEQ ID NO: 252213 - RNA, 19 nt, Homo sapiens
ucagcaauguuguuuguga

SEQ ID NO: 252214 - RNA, 19 nt, Homo sapiens
ggaacgcuccucugcauug

SEQ ID NO: 252215 - RNA, 19 nt, Homo sapiens
ggaagcaccauaacuuugu

SEQ ID NO: 252216 - RNA, 19 nt, Homo sapiens
gggaagauaauauuaagga

SEQ ID NO: 252217 - RNA, 19 nt, Homo sapiens
gagggugagugggugaaua

SEQ ID NO: 252218 - RNA, 19 nt, Homo sapiens
ccacggagcccuuaugaca

SEQ ID NO: 252219 - RNA, 19 nt, Homo sapiens
caacaccucugcacaagcu

SEQ ID NO: 252220 - RNA, 19 nt, Homo sapiens
guaacuagggaagauaaua

SEQ ID NO: 252221 - RNA, 19 nt, Homo sapiens
gugagugggugaauaauac

SEQ ID NO: 252222 - RNA, 19 nt, Homo sapiens
ucacugccguggccagaaa

SEQ ID NO: 252223 - RNA, 19 nt, Homo sapiens
ccuaggcauuugcugaaua

SEQ ID NO: 252224 - RNA, 19 nt, Homo sapiens
ggugagugggugaauaaua

SEQ ID NO: 252225 - RNA, 19 nt, Homo sapiens
gcacuuacuacuaauaaag

SEQ ID NO: 252226 - RNA, 19 nt, Homo sapiens
ugcaggcacuuacuacuaa

SEQ ID NO: 252227 - RNA, 19 nt, Homo sapiens
gaagucgcacugacacuga

SEQ ID NO: 252228 - RNA, 19 nt, Homo sapiens
gugaggaaguuucagaaca

SEQ ID NO: 252229 - RNA, 19 nt, Homo sapiens
cgacaaaggcugugcucuu

SEQ ID NO: 252230 - RNA, 19 nt, Homo sapiens
gcugaacggucaaagacau

SEQ ID NO: 252231 - RNA, 19 nt, Homo sapiens
ccucagcaauguuguuugu

SEQ ID NO: 252232 - RNA, 19 nt, Homo sapiens
ccaagugcccuuagcaaau

SEQ ID NO: 252233 - RNA, 19 nt, Homo sapiens
caaaggcugugcucuuggu

SEQ ID NO: 252234 - RNA, 19 nt, Homo sapiens
gggaagcaccauaacuuug

SEQ ID NO: 252235 - RNA, 19 nt, Homo sapiens
aaaugagccuggcaagaau

SEQ ID NO: 252236 - RNA, 19 nt, Homo sapiens
ucaaaccucccuuuccaaa

SEQ ID NO: 252237 - RNA, 19 nt, Homo sapiens
gaagacaaugccacuguuc

SEQ ID NO: 252238 - RNA, 19 nt, Homo sapiens
gagaucagccugggcaaug

SEQ ID NO: 252239 - RNA, 19 nt, Homo sapiens
ggguagagccggaagacaa

SEQ ID NO: 252240 - RNA, 19 nt, Homo sapiens
ccaaaugcccagcuuaaag

SEQ ID NO: 252241 - RNA, 19 nt, Homo sapiens
gaaaaccaauguucucucu

SEQ ID NO: 252242 - RNA, 19 nt, Homo sapiens
gugggugaauaauacagua

SEQ ID NO: 252243 - RNA, 19 nt, Homo sapiens
gguagagugugccugaagu

SEQ ID NO: 252244 - RNA, 19 nt, Homo sapiens
ggaagacaaugugaaaaga

SEQ ID NO: 252245 - RNA, 19 nt, Homo sapiens
ggggacggcuuuuacuuaa

SEQ ID NO: 252246 - RNA, 19 nt, Homo sapiens
gugaagagaaccauaucaa

SEQ ID NO: 252247 - RNA, 19 nt, Homo sapiens
gggcacgccuuggacagaa

SEQ ID NO: 252248 - RNA, 19 nt, Homo sapiens
ggagggagacagcucuuuc

SEQ ID NO: 252249 - RNA, 19 nt, Homo sapiens
gcagugagccgagauugca

SEQ ID NO: 252250 - RNA, 19 nt, Homo sapiens
gggcuucugccauuucuga

SEQ ID NO: 252251 - RNA, 19 nt, Homo sapiens
agggagggcuucugccauu

SEQ ID NO: 252252 - RNA, 19 nt, Homo sapiens
gguuugagcucagauaucg

SEQ ID NO: 252253 - RNA, 19 nt, Homo sapiens
caggagccgugccaguauu

SEQ ID NO: 252254 - RNA, 19 nt, Homo sapiens
guccagaaguuugagauca

SEQ ID NO: 252255 - RNA, 19 nt, Homo sapiens
gggagggcuucugccauuu

SEQ ID NO: 252256 - RNA, 19 nt, Homo sapiens
caaaugcccagcuuaaagg

SEQ ID NO: 252257 - RNA, 19 nt, Homo sapiens
ggcacuuacuacuaauaaa

SEQ ID NO: 252258 - RNA, 19 nt, Homo sapiens
ggucaaagacauucacaac

SEQ ID NO: 252259 - RNA, 19 nt, Homo sapiens
ugaggaaguuucagaacag

SEQ ID NO: 252260 - RNA, 19 nt, Homo sapiens
gaggugggaggaucucuug

SEQ ID NO: 252261 - RNA, 19 nt, Homo sapiens
gcaggcacuuacuacuaau

SEQ ID NO: 252262 - RNA, 19 nt, Homo sapiens
ucaggguuguggaaucuug

SEQ ID NO: 252263 - RNA, 19 nt, Homo sapiens
ggucgaggcaggaggauca

SEQ ID NO: 252264 - RNA, 19 nt, Homo sapiens
gauaaaaccccaucucuac

SEQ ID NO: 252265 - RNA, 19 nt, Homo sapiens
gcaacugcauuggcuuugg

SEQ ID NO: 252266 - RNA, 19 nt, Homo sapiens
ccuuaugacaucagcaaua

SEQ ID NO: 252267 - RNA, 19 nt, Homo sapiens
cuacuaauaaagacgauga

SEQ ID NO: 252268 - RNA, 19 nt, Homo sapiens
ggugacagagcaagugaga

SEQ ID NO: 252269 - RNA, 19 nt, Homo sapiens
caccauaacuuuguuuagc

SEQ ID NO: 252270 - RNA, 19 nt, Homo sapiens
ggguaacuagggaagauaa

SEQ ID NO: 252271 - RNA, 19 nt, Homo sapiens
auacagaggcaacugcauu

SEQ ID NO: 252272 - RNA, 19 nt, Homo sapiens
cguuucaucuuccaacuca

SEQ ID NO: 252273 - RNA, 19 nt, Homo sapiens
gcugcgggcucugaaggaa

SEQ ID NO: 252274 - RNA, 19 nt, Homo sapiens
gcaccauaacuuuguuuag

SEQ ID NO: 252275 - RNA, 19 nt, Homo sapiens
gcucucuccucccuuucuu

SEQ ID NO: 252276 - RNA, 19 nt, Homo sapiens
gcccuuagcaaauucuguu

SEQ ID NO: 252277 - RNA, 19 nt, Homo sapiens
gaacgcuccucugcauugc

SEQ ID NO: 252278 - RNA, 19 nt, Homo sapiens
gaggaaguuucagaacagu

SEQ ID NO: 252279 - RNA, 19 nt, Homo sapiens
cagccugggcaaugugaua

SEQ ID NO: 252280 - RNA, 19 nt, Homo sapiens
ccacaaaggagagcuagca

SEQ ID NO: 252281 - RNA, 19 nt, Homo sapiens
gggaucacagccucugaaa

SEQ ID NO: 252282 - RNA, 19 nt, Homo sapiens
gaggcgugcugaccagucu

SEQ ID NO: 252283 - RNA, 19 nt, Homo sapiens
uuucaaaccucccuuucca

SEQ ID NO: 252284 - RNA, 19 nt, Homo sapiens
gguagagccggaagacaau

SEQ ID NO: 252285 - RNA, 19 nt, Homo sapiens
gaacggucaaagacauuca

SEQ ID NO: 252286 - RNA, 19 nt, Homo sapiens
gggagcaaguucagcaaaa

SEQ ID NO: 252287 - RNA, 19 nt, Homo sapiens
gccagaagaucuacaauua

SEQ ID NO: 252288 - RNA, 19 nt, Homo sapiens
gagacaaacuucacuuuaa

SEQ ID NO: 252289 - RNA, 19 nt, Homo sapiens
ggaacugucuaguaucuua

SEQ ID NO: 252290 - RNA, 19 nt, Homo sapiens
gggaaucuguaaagaaaua

SEQ ID NO: 252291 - RNA, 19 nt, Homo sapiens
ggagugcuguucugcuuua

SEQ ID NO: 252292 - RNA, 19 nt, Homo sapiens
caguaaaucucacaaauga

SEQ ID NO: 252293 - RNA, 19 nt, Homo sapiens
aaacacaucuggccuaaug

SEQ ID NO: 252294 - RNA, 19 nt, Homo sapiens
caagugggaucaccuauga

SEQ ID NO: 252295 - RNA, 19 nt, Homo sapiens
ggagcaauauacuaucaua

SEQ ID NO: 252296 - RNA, 19 nt, Homo sapiens
gaucaaauguauucagaug

SEQ ID NO: 252297 - RNA, 19 nt, Homo sapiens
ggagacaaacuucacuuua

SEQ ID NO: 252298 - RNA, 19 nt, Homo sapiens
uaucugggauucuacuuua

SEQ ID NO: 252299 - RNA, 19 nt, Homo sapiens
gaaggaugguccagaauuc

SEQ ID NO: 252300 - RNA, 19 nt, Homo sapiens
gaauauacauuguccucuu

SEQ ID NO: 252301 - RNA, 19 nt, Homo sapiens
aaacgaagcugucuuagag

SEQ ID NO: 252302 - RNA, 19 nt, Homo sapiens
cagaauggauuuaucagaa

SEQ ID NO: 252303 - RNA, 19 nt, Homo sapiens
cagaggaacugucuaguau

SEQ ID NO: 252304 - RNA, 19 nt, Homo sapiens
guccagauauuucacauuu

SEQ ID NO: 252305 - RNA, 19 nt, Homo sapiens
gaacuuagcagagagcaaa

SEQ ID NO: 252306 - RNA, 19 nt, Homo sapiens
gugcuguucugcuuuaaua

SEQ ID NO: 252307 - RNA, 19 nt, Homo sapiens
gaaaugaaacugcugugaa

SEQ ID NO: 252308 - RNA, 19 nt, Homo sapiens
caaaucagaugcagcuguu

SEQ ID NO: 252309 - RNA, 19 nt, Homo sapiens
ggaagacauugccuccuuu

SEQ ID NO: 252310 - RNA, 19 nt, Homo sapiens
ggacacagcagugguauug

SEQ ID NO: 252311 - RNA, 19 nt, Homo sapiens
gacaguaaaucucacaaau

SEQ ID NO: 252312 - RNA, 19 nt, Homo sapiens
gaugaucauuugcccuuaa

SEQ ID NO: 252313 - RNA, 19 nt, Homo sapiens
gaacugcagucagcaugaa

SEQ ID NO: 252314 - RNA, 19 nt, Homo sapiens
cuaauuacauugucuggaa

SEQ ID NO: 252315 - RNA, 19 nt, Homo sapiens
cagaagaucuacaauuagu

SEQ ID NO: 252316 - RNA, 19 nt, Homo sapiens
cagaauauguguuuaggau

SEQ ID NO: 252317 - RNA, 19 nt, Homo sapiens
uccaagaccuuaaaccuuu

SEQ ID NO: 252318 - RNA, 19 nt, Homo sapiens
ggaaauauccgcgcaagau

SEQ ID NO: 252319 - RNA, 19 nt, Homo sapiens
cacaugagcuauuuccauu

SEQ ID NO: 252320 - RNA, 19 nt, Homo sapiens
gaaggacacagcaguggua

SEQ ID NO: 252321 - RNA, 19 nt, Homo sapiens
caauuucacugauguaagu

SEQ ID NO: 252322 - RNA, 19 nt, Homo sapiens
aagggaaucuguaaagaaa

SEQ ID NO: 252323 - RNA, 19 nt, Homo sapiens
ccaaagaugccucaacuug

SEQ ID NO: 252324 - RNA, 19 nt, Homo sapiens
caaagcaaguuucaucagu

SEQ ID NO: 252325 - RNA, 19 nt, Homo sapiens
ggaaggaugguccagaauu

SEQ ID NO: 252326 - RNA, 19 nt, Homo sapiens
gggaucaccuaugaagaua

SEQ ID NO: 252327 - RNA, 19 nt, Homo sapiens
aaaugaaacugcugugaau

SEQ ID NO: 252328 - RNA, 19 nt, Homo sapiens
aaagaugccucaacuugga

SEQ ID NO: 252329 - RNA, 19 nt, Homo sapiens
gaccaaagaugccucaacu

SEQ ID NO: 252330 - RNA, 19 nt, Homo sapiens
ccaauccgccacauaauuu

SEQ ID NO: 252331 - RNA, 19 nt, Homo sapiens
aaaguuugcucaaggagaa

SEQ ID NO: 252332 - RNA, 19 nt, Homo sapiens
ccacacagaauauacauug

SEQ ID NO: 252333 - RNA, 19 nt, Homo sapiens
gaggaacugucuaguaucu

SEQ ID NO: 252334 - RNA, 19 nt, Homo sapiens
gauccuguauauaaaguga

SEQ ID NO: 252335 - RNA, 19 nt, Homo sapiens
cagcaguaccuauaaagua

SEQ ID NO: 252336 - RNA, 19 nt, Homo sapiens
guagaaagauuugaaacag

SEQ ID NO: 252337 - RNA, 19 nt, Homo sapiens
cuccuucacuuacuaauuu

SEQ ID NO: 252338 - RNA, 19 nt, Homo sapiens
guauucagauggcaauuuc

SEQ ID NO: 252339 - RNA, 19 nt, Homo sapiens
aggaagcccugaauccaua

SEQ ID NO: 252340 - RNA, 19 nt, Homo sapiens
ggaccaacccaaguauuaa

SEQ ID NO: 252341 - RNA, 19 nt, Homo sapiens
uaauuucacugcaguuugu

SEQ ID NO: 252342 - RNA, 19 nt, Homo sapiens
ggacaaguagaaagauuug

SEQ ID NO: 252343 - RNA, 19 nt, Homo sapiens
uaagcgagaccuaauuaaa

SEQ ID NO: 252344 - RNA, 19 nt, Homo sapiens
agucgugccuguuugcuua

SEQ ID NO: 252345 - RNA, 19 nt, Homo sapiens
ccucaugcacuguugauua

SEQ ID NO: 252346 - RNA, 19 nt, Homo sapiens
gaaauagaagcaaaugaca

SEQ ID NO: 252347 - RNA, 19 nt, Homo sapiens
ucaaaucccuacuccuuca

SEQ ID NO: 252348 - RNA, 19 nt, Homo sapiens
guaaaucucacaaaugauc

SEQ ID NO: 252349 - RNA, 19 nt, Homo sapiens
guacaacucguguggaaga

SEQ ID NO: 252350 - RNA, 19 nt, Homo sapiens
cuagauccaugugguuaua

SEQ ID NO: 252351 - RNA, 19 nt, Homo sapiens
gcauggaggcugcgacuga

SEQ ID NO: 252352 - RNA, 19 nt, Homo sapiens
ggaaauagaagcaaaugac

SEQ ID NO: 252353 - RNA, 19 nt, Homo sapiens
aauaagcgagaccuaauua

SEQ ID NO: 252354 - RNA, 19 nt, Homo sapiens
ccaagggaaucuguaaaga

SEQ ID NO: 252355 - RNA, 19 nt, Homo sapiens
ccaaguauuaagaguguua

SEQ ID NO: 252356 - RNA, 19 nt, Homo sapiens
ucggacagcuugaacagaa

SEQ ID NO: 252357 - RNA, 19 nt, Homo sapiens
agcaugacauuuagaagua

SEQ ID NO: 252358 - RNA, 19 nt, Homo sapiens
gaaauauccgcgcaagaug

SEQ ID NO: 252359 - RNA, 19 nt, Homo sapiens
caagggaaucuguaaagaa

SEQ ID NO: 252360 - RNA, 19 nt, Homo sapiens
caauauaggaccaaagaug

SEQ ID NO: 252361 - RNA, 19 nt, Homo sapiens
ucagcucacuugcaacauu

SEQ ID NO: 252362 - RNA, 19 nt, Homo sapiens
agugucaccuuuacagaua

SEQ ID NO: 252363 - RNA, 19 nt, Homo sapiens
ugaauccaguccagauauu

SEQ ID NO: 252364 - RNA, 19 nt, Homo sapiens
ucagaggaacugucuagua

SEQ ID NO: 252365 - RNA, 19 nt, Homo sapiens
gaauguuuauggaaucaca

SEQ ID NO: 252366 - RNA, 19 nt, Homo sapiens
agcaguaccuauaaaguaa

SEQ ID NO: 252367 - RNA, 19 nt, Homo sapiens
ggucaaagcaaguuucauc

SEQ ID NO: 252368 - RNA, 19 nt, Homo sapiens
uguaauggaucuuaaagca

SEQ ID NO: 252369 - RNA, 19 nt, Homo sapiens
gagugaaacccaauggaaa

SEQ ID NO: 252370 - RNA, 19 nt, Homo sapiens
acacacaaguuugcugauu

SEQ ID NO: 252371 - RNA, 19 nt, Homo sapiens
cuaaggagcaauauacuau

SEQ ID NO: 252372 - RNA, 19 nt, Homo sapiens
cagaucauauuucacaauc

SEQ ID NO: 252373 - RNA, 19 nt, Homo sapiens
gaaaggucaaagcaaguuu

SEQ ID NO: 252374 - RNA, 19 nt, Homo sapiens
ggaaaugaaacugcuguga

SEQ ID NO: 252375 - RNA, 19 nt, Homo sapiens
gaaaucuuguuggcaaauc

SEQ ID NO: 252376 - RNA, 19 nt, Homo sapiens
ggaagaaaaugagguguga

SEQ ID NO: 252377 - RNA, 19 nt, Homo sapiens
gauucuacuuuaagcacua

SEQ ID NO: 252378 - RNA, 19 nt, Homo sapiens
guagauggcggugauggua

SEQ ID NO: 252379 - RNA, 19 nt, Homo sapiens
ugaaaucauuggaccuguu

SEQ ID NO: 252380 - RNA, 19 nt, Homo sapiens
gauggcaauuucacugaug

SEQ ID NO: 252381 - RNA, 19 nt, Homo sapiens
ccaaguuucugguauaaaa

SEQ ID NO: 252382 - RNA, 19 nt, Homo sapiens
aagguuacaucagaucaua

SEQ ID NO: 252383 - RNA, 19 nt, Homo sapiens
gaucauauuucacaauccu

SEQ ID NO: 252384 - RNA, 19 nt, Homo sapiens
gaaaucauuggaccuguuc

SEQ ID NO: 252385 - RNA, 19 nt, Homo sapiens
uaacaugcuuuggguggaa

SEQ ID NO: 252386 - RNA, 19 nt, Homo sapiens
caucuaaagcaccaaguuu

SEQ ID NO: 252387 - RNA, 19 nt, Homo sapiens
gccagaagaucuacaauua

SEQ ID NO: 252388 - RNA, 19 nt, Homo sapiens
gagacaaacuucacuuuaa

SEQ ID NO: 252389 - RNA, 19 nt, Homo sapiens
ggaacugucuaguaucuua

SEQ ID NO: 252390 - RNA, 19 nt, Homo sapiens
gggaaucuguaaagaaaua

SEQ ID NO: 252391 - RNA, 19 nt, Homo sapiens
ggagugcuguucugcuuua

SEQ ID NO: 252392 - RNA, 19 nt, Homo sapiens
caguaaaucucacaaauga

SEQ ID NO: 252393 - RNA, 19 nt, Homo sapiens
aaacacaucuggccuaaug

SEQ ID NO: 252394 - RNA, 19 nt, Homo sapiens
caagugggaucaccuauga

SEQ ID NO: 252395 - RNA, 19 nt, Homo sapiens
ggagcaauauacuaucaua

SEQ ID NO: 252396 - RNA, 19 nt, Homo sapiens
gaucaaauguauucagaug

SEQ ID NO: 252397 - RNA, 19 nt, Homo sapiens
ggagacaaacuucacuuua

SEQ ID NO: 252398 - RNA, 19 nt, Homo sapiens
uaucugggauucuacuuua

SEQ ID NO: 252399 - RNA, 19 nt, Homo sapiens
gaaggaugguccagaauuc

SEQ ID NO: 252400 - RNA, 19 nt, Homo sapiens
gaauauacauuguccucuu

SEQ ID NO: 252401 - RNA, 19 nt, Homo sapiens
aaacgaagcugucuuagag

SEQ ID NO: 252402 - RNA, 19 nt, Homo sapiens
cagaauggauuuaucagaa

SEQ ID NO: 252403 - RNA, 19 nt, Homo sapiens
cagaggaacugucuaguau

SEQ ID NO: 252404 - RNA, 19 nt, Homo sapiens
guccagauauuucacauuu

SEQ ID NO: 252405 - RNA, 19 nt, Homo sapiens
gaacuuagcagagagcaaa

SEQ ID NO: 252406 - RNA, 19 nt, Homo sapiens
gugcuguucugcuuuaaua

SEQ ID NO: 252407 - RNA, 19 nt, Homo sapiens
gaaaugaaacugcugugaa

SEQ ID NO: 252408 - RNA, 19 nt, Homo sapiens
caaaucagaugcagcuguu

SEQ ID NO: 252409 - RNA, 19 nt, Homo sapiens
ggacacagcagugguauug

SEQ ID NO: 252410 - RNA, 19 nt, Homo sapiens
gacaguaaaucucacaaau

SEQ ID NO: 252411 - RNA, 19 nt, Homo sapiens
gaugaucauuugcccuuaa

SEQ ID NO: 252412 - RNA, 19 nt, Homo sapiens
gaacugcagucagcaugaa

SEQ ID NO: 252413 - RNA, 19 nt, Homo sapiens
cuaauuacauugucuggaa

SEQ ID NO: 252414 - RNA, 19 nt, Homo sapiens
cagaagaucuacaauuagu

SEQ ID NO: 252415 - RNA, 19 nt, Homo sapiens
cagaauauguguuuaggau

SEQ ID NO: 252416 - RNA, 19 nt, Homo sapiens
uccaagaccuuaaaccuuu

SEQ ID NO: 252417 - RNA, 19 nt, Homo sapiens
ggaaauauccgcgcaagau

SEQ ID NO: 252418 - RNA, 19 nt, Homo sapiens
cacaugagcuauuuccauu

SEQ ID NO: 252419 - RNA, 19 nt, Homo sapiens
gaaggacacagcaguggua

SEQ ID NO: 252420 - RNA, 19 nt, Homo sapiens
caauuucacugauguaagu

SEQ ID NO: 252421 - RNA, 19 nt, Homo sapiens
aagggaaucuguaaagaaa

SEQ ID NO: 252422 - RNA, 19 nt, Homo sapiens
ccaaagaugccucaacuug

SEQ ID NO: 252423 - RNA, 19 nt, Homo sapiens
caaagcaaguuucaucagu

SEQ ID NO: 252424 - RNA, 19 nt, Homo sapiens
ggaaggaugguccagaauu

SEQ ID NO: 252425 - RNA, 19 nt, Homo sapiens
gggaucaccuaugaagaua

SEQ ID NO: 252426 - RNA, 19 nt, Homo sapiens
aaaugaaacugcugugaau

SEQ ID NO: 252427 - RNA, 19 nt, Homo sapiens
aaagaugccucaacuugga

SEQ ID NO: 252428 - RNA, 19 nt, Homo sapiens
gaccaaagaugccucaacu

SEQ ID NO: 252429 - RNA, 19 nt, Homo sapiens
ccaauccgccacauaauuu

SEQ ID NO: 252430 - RNA, 19 nt, Homo sapiens
aaaguuugcucaaggagaa

SEQ ID NO: 252431 - RNA, 19 nt, Homo sapiens
ccacacagaauauacauug

SEQ ID NO: 252432 - RNA, 19 nt, Homo sapiens
gaggaacugucuaguaucu

SEQ ID NO: 252433 - RNA, 19 nt, Homo sapiens
gauccuguauauaaaguga

SEQ ID NO: 252434 - RNA, 19 nt, Homo sapiens
cagcaguaccuauaaagua

SEQ ID NO: 252435 - RNA, 19 nt, Homo sapiens
guagaaagauuugaaacag

SEQ ID NO: 252436 - RNA, 19 nt, Homo sapiens
cuccuucacuuacuaauuu

SEQ ID NO: 252437 - RNA, 19 nt, Homo sapiens
guauucagauggcaauuuc

SEQ ID NO: 252438 - RNA, 19 nt, Homo sapiens
aggaagcccugaauccaua

SEQ ID NO: 252439 - RNA, 19 nt, Homo sapiens
ggaccaacccaaguauuaa

SEQ ID NO: 252440 - RNA, 19 nt, Homo sapiens
uaauuucacugcaguuugu

SEQ ID NO: 252441 - RNA, 19 nt, Homo sapiens
ggacaaguagaaagauuug

SEQ ID NO: 252442 - RNA, 19 nt, Homo sapiens
uaagcgagaccuaauuaaa

SEQ ID NO: 252443 - RNA, 19 nt, Homo sapiens
agucgugccuguuugcuua

SEQ ID NO: 252444 - RNA, 19 nt, Homo sapiens
ccucaugcacuguugauua

SEQ ID NO: 252445 - RNA, 19 nt, Homo sapiens
gaaauagaagcaaaugaca

SEQ ID NO: 252446 - RNA, 19 nt, Homo sapiens
ucaaaucccuacuccuuca

SEQ ID NO: 252447 - RNA, 19 nt, Homo sapiens
guaaaucucacaaaugauc

SEQ ID NO: 252448 - RNA, 19 nt, Homo sapiens
cuagauccaugugguuaua

SEQ ID NO: 252449 - RNA, 19 nt, Homo sapiens
gcauggaggcugcgacuga

SEQ ID NO: 252450 - RNA, 19 nt, Homo sapiens
ggaaauagaagcaaaugac

SEQ ID NO: 252451 - RNA, 19 nt, Homo sapiens
aauaagcgagaccuaauua

SEQ ID NO: 252452 - RNA, 19 nt, Homo sapiens
ccaagggaaucuguaaaga

SEQ ID NO: 252453 - RNA, 19 nt, Homo sapiens
ccaaguauuaagaguguua

SEQ ID NO: 252454 - RNA, 19 nt, Homo sapiens
ucggacagcuugaacagaa

SEQ ID NO: 252455 - RNA, 19 nt, Homo sapiens
agcaugacauuuagaagua

SEQ ID NO: 252456 - RNA, 19 nt, Homo sapiens
caagggaaucuguaaagaa

SEQ ID NO: 252457 - RNA, 19 nt, Homo sapiens
gaaauauccgcgcaagaug

SEQ ID NO: 252458 - RNA, 19 nt, Homo sapiens
caauauaggaccaaagaug

SEQ ID NO: 252459 - RNA, 19 nt, Homo sapiens
ucagcucacuugcaacauu

SEQ ID NO: 252460 - RNA, 19 nt, Homo sapiens
agugucaccuuuacagaua

SEQ ID NO: 252461 - RNA, 19 nt, Homo sapiens
ugaauccaguccagauauu

SEQ ID NO: 252462 - RNA, 19 nt, Homo sapiens
ucagaggaacugucuagua

SEQ ID NO: 252463 - RNA, 19 nt, Homo sapiens
gaauguuuauggaaucaca

SEQ ID NO: 252464 - RNA, 19 nt, Homo sapiens
agcaguaccuauaaaguaa

SEQ ID NO: 252465 - RNA, 19 nt, Homo sapiens
ggucaaagcaaguuucauc

SEQ ID NO: 252466 - RNA, 19 nt, Homo sapiens
uguaauggaucuuaaagca

SEQ ID NO: 252467 - RNA, 19 nt, Homo sapiens
gagugaaacccaauggaaa

SEQ ID NO: 252468 - RNA, 19 nt, Homo sapiens
acacacaaguuugcugauu

SEQ ID NO: 252469 - RNA, 19 nt, Homo sapiens
cuaaggagcaauauacuau

SEQ ID NO: 252470 - RNA, 19 nt, Homo sapiens
cagaucauauuucacaauc

SEQ ID NO: 252471 - RNA, 19 nt, Homo sapiens
gaaaggucaaagcaaguuu

SEQ ID NO: 252472 - RNA, 19 nt, Homo sapiens
ggaaaugaaacugcuguga

SEQ ID NO: 252473 - RNA, 19 nt, Homo sapiens
gaaaucuuguuggcaaauc

SEQ ID NO: 252474 - RNA, 19 nt, Homo sapiens
ggaagaaaaugagguguga

SEQ ID NO: 252475 - RNA, 19 nt, Homo sapiens
gauucuacuuuaagcacua

SEQ ID NO: 252476 - RNA, 19 nt, Homo sapiens
guagauggcggugauggua

SEQ ID NO: 252477 - RNA, 19 nt, Homo sapiens
ugaaaucauuggaccuguu

SEQ ID NO: 252478 - RNA, 19 nt, Homo sapiens
gauggcaauuucacugaug

SEQ ID NO: 252479 - RNA, 19 nt, Homo sapiens
gaucaccuaugaagauaac

SEQ ID NO: 252480 - RNA, 19 nt, Homo sapiens
aagguuacaucagaucaua

SEQ ID NO: 252481 - RNA, 19 nt, Homo sapiens
gaucauauuucacaauccu

SEQ ID NO: 252482 - RNA, 19 nt, Homo sapiens
gaaaucauuggaccuguuc

SEQ ID NO: 252483 - RNA, 19 nt, Homo sapiens
uaacaugcuuuggguggaa

SEQ ID NO: 252484 - RNA, 19 nt, Homo sapiens
uggaccaacccaaguauua

SEQ ID NO: 252485 - RNA, 19 nt, Homo sapiens
gaacugucuaguaucuuaa

SEQ ID NO: 252486 - RNA, 19 nt, Homo sapiens
cacacaaguuugcugauug

SEQ ID NO: 252487 - RNA, 19 nt, Homo sapiens
gcaauugccugaauaauga

SEQ ID NO: 252488 - RNA, 19 nt, Homo sapiens
ccaagaaucuaucugcuua

SEQ ID NO: 252489 - RNA, 19 nt, Homo sapiens
gguaucaguugcaauaaua

SEQ ID NO: 252490 - RNA, 19 nt, Homo sapiens
gaacugcacuggccagguu

SEQ ID NO: 252491 - RNA, 19 nt, Homo sapiens
guaaagauggcaaacaaua

SEQ ID NO: 252492 - RNA, 19 nt, Homo sapiens
gaauacauuucuccuuuga

SEQ ID NO: 252493 - RNA, 19 nt, Homo sapiens
ggaauacauuucuccuuug

SEQ ID NO: 252494 - RNA, 19 nt, Homo sapiens
uaagguaucaguugcaaua

SEQ ID NO: 252495 - RNA, 19 nt, Homo sapiens
gaauagcacuggugauuuu

SEQ ID NO: 252496 - RNA, 19 nt, Homo sapiens
agacauaucugugaugcua

SEQ ID NO: 252497 - RNA, 19 nt, Homo sapiens
ggaaccagcugcagagauc

SEQ ID NO: 252498 - RNA, 19 nt, Homo sapiens
ggucagcaucgaucaauua

SEQ ID NO: 252499 - RNA, 19 nt, Homo sapiens
uggaauacauuucuccuuu

SEQ ID NO: 252500 - RNA, 19 nt, Homo sapiens
guacugaguuacauuguca

SEQ ID NO: 252501 - RNA, 19 nt, Homo sapiens
uaaguaagcaacagcauaa

SEQ ID NO: 252502 - RNA, 19 nt, Homo sapiens
gguagcaauugccugaaua

SEQ ID NO: 252503 - RNA, 19 nt, Homo sapiens
gaaucuaucugcuuaugca

SEQ ID NO: 252504 - RNA, 19 nt, Homo sapiens
gacaauccauguaagguau

SEQ ID NO: 252505 - RNA, 19 nt, Homo sapiens
uaacacagugccuucaaua

SEQ ID NO: 252506 - RNA, 19 nt, Homo sapiens
gaagauuccaugcugauga

SEQ ID NO: 252507 - RNA, 19 nt, Homo sapiens
gagaauaagagagucauaa

SEQ ID NO: 252508 - RNA, 19 nt, Homo sapiens
gauaaugccggugagaaua

SEQ ID NO: 252509 - RNA, 19 nt, Homo sapiens
cauacagcauuacaaauug

SEQ ID NO: 252510 - RNA, 19 nt, Homo sapiens
gauugaaccugcagaccaa

SEQ ID NO: 252511 - RNA, 19 nt, Homo sapiens
gaucaucugggaagucuuu

SEQ ID NO: 252512 - RNA, 19 nt, Homo sapiens
gauuagggcauuugagaaa

SEQ ID NO: 252513 - RNA, 19 nt, Homo sapiens
gcacuaaagaacacugaaa

SEQ ID NO: 252514 - RNA, 19 nt, Homo sapiens
ugaaagaaauugguagcaa

SEQ ID NO: 252515 - RNA, 19 nt, Homo sapiens
cacagugccuucaauaaau

SEQ ID NO: 252516 - RNA, 19 nt, Homo sapiens
gcaauaauacuucucaaac

SEQ ID NO: 252517 - RNA, 19 nt, Homo sapiens
uacaaacaauggaaacuga

SEQ ID NO: 252518 - RNA, 19 nt, Homo sapiens
aaaccuuaguacugaguua

SEQ ID NO: 252519 - RNA, 19 nt, Homo sapiens
acacagugccuucaauaaa

SEQ ID NO: 252520 - RNA, 19 nt, Homo sapiens
cuaaagagacuauuacaag

SEQ ID NO: 252521 - RNA, 19 nt, Homo sapiens
ugacuuguguuuccuaaag

SEQ ID NO: 252522 - RNA, 19 nt, Homo sapiens
ggacagcaugaaagaaauu

SEQ ID NO: 252523 - RNA, 19 nt, Homo sapiens
cauaacaagguccaagaua

SEQ ID NO: 252524 - RNA, 19 nt, Homo sapiens
gagacuauuacaagagaua

SEQ ID NO: 252525 - RNA, 19 nt, Homo sapiens
caaaguagaaacugaaagu

SEQ ID NO: 252526 - RNA, 19 nt, Homo sapiens
guaacacagugccuucaau

SEQ ID NO: 252527 - RNA, 19 nt, Homo sapiens
guaagcaacagcauaacaa

SEQ ID NO: 252528 - RNA, 19 nt, Homo sapiens
guaagacaauccauguaag

SEQ ID NO: 252529 - RNA, 19 nt, Homo sapiens
gcagaccaagcgcaaagua

SEQ ID NO: 252530 - RNA, 19 nt, Homo sapiens
ggauaaugccggugagaau

SEQ ID NO: 252531 - RNA, 19 nt, Homo sapiens
gcaauuugggagauauauu

SEQ ID NO: 252532 - RNA, 19 nt, Homo sapiens
gcaaacaauaugagagugu

SEQ ID NO: 252533 - RNA, 19 nt, Homo sapiens
caagauaccuaaaagagau

SEQ ID NO: 252534 - RNA, 19 nt, Homo sapiens
uguaagacaauccauguaa

SEQ ID NO: 252535 - RNA, 19 nt, Homo sapiens
aagagagucauaaaccuua

SEQ ID NO: 252536 - RNA, 19 nt, Homo sapiens
aagagacuauuacaagaga

SEQ ID NO: 252537 - RNA, 19 nt, Homo sapiens
gaaggcacaacaauacugu

SEQ ID NO: 252538 - RNA, 19 nt, Homo sapiens
gauauugaagguaaagaug

SEQ ID NO: 252539 - RNA, 19 nt, Homo sapiens
guagcaauugccugaauaa

SEQ ID NO: 252540 - RNA, 19 nt, Homo sapiens
aaagauggcaaacaauaug

SEQ ID NO: 252541 - RNA, 19 nt, Homo sapiens
uaagagagucauaaaccuu

SEQ ID NO: 252542 - RNA, 19 nt, Homo sapiens
ucagaaggcacaacaauac

SEQ ID NO: 252543 - RNA, 19 nt, Homo sapiens
gcucgcaaguugaggcaau

SEQ ID NO: 252544 - RNA, 19 nt, Homo sapiens
agguaaagauggcaaacaa

SEQ ID NO: 252545 - RNA, 19 nt, Homo sapiens
gagccacgccguagugugu

SEQ ID NO: 252546 - RNA, 19 nt, Homo sapiens
aguagaaacugaaaguaca

SEQ ID NO: 252547 - RNA, 19 nt, Homo sapiens
gcgcaaaguagaaacugaa

SEQ ID NO: 252548 - RNA, 19 nt, Homo sapiens
uuaaguaagcaacagcaua

SEQ ID NO: 252549 - RNA, 19 nt, Homo sapiens
gaauaagagagucauaaac

SEQ ID NO: 252550 - RNA, 19 nt, Homo sapiens
gugcacacauuaacaacuc

SEQ ID NO: 252551 - RNA, 19 nt, Homo sapiens
agacaauccauguaaggua

SEQ ID NO: 252552 - RNA, 19 nt, Homo sapiens
gaagcccaaccaacaaaga

SEQ ID NO: 252553 - RNA, 19 nt, Homo sapiens
gagaucacccugcccaaca

SEQ ID NO: 252554 - RNA, 19 nt, Homo sapiens
cugaugaucccaaagauug

SEQ ID NO: 252555 - RNA, 19 nt, Homo sapiens
acagugccuucaauaaaug

SEQ ID NO: 252556 - RNA, 19 nt, Homo sapiens
gccaaggcguugagagauc

SEQ ID NO: 252557 - RNA, 19 nt, Homo sapiens
ccaaggcguugagagauca

SEQ ID NO: 252558 - RNA, 19 nt, Homo sapiens
gaauuccucugguccucau

SEQ ID NO: 252559 - RNA, 19 nt, Homo sapiens
gcacuggccagguuaaagg

SEQ ID NO: 252560 - RNA, 19 nt, Homo sapiens
aaguugaggcaauuucuua

SEQ ID NO: 252561 - RNA, 19 nt, Homo sapiens
cuacggaaguuauggaaaa

SEQ ID NO: 252562 - RNA, 19 nt, Homo sapiens
auaacaagguccaagauac

SEQ ID NO: 252563 - RNA, 19 nt, Homo sapiens
agagagucauaaaccuuaa

SEQ ID NO: 252564 - RNA, 19 nt, Homo sapiens
uaacaacucaugguucuag

SEQ ID NO: 252565 - RNA, 19 nt, Homo sapiens
ggauuagggcauuugagaa

SEQ ID NO: 252566 - RNA, 19 nt, Homo sapiens
gaguggcaauauagaaaca

SEQ ID NO: 252567 - RNA, 19 nt, Homo sapiens
gaucuccacuuauuaaaag

SEQ ID NO: 252568 - RNA, 19 nt, Homo sapiens
gaccaagcgcaaaguagaa

SEQ ID NO: 252569 - RNA, 19 nt, Homo sapiens
caauaauacuucucaaacc

SEQ ID NO: 252570 - RNA, 19 nt, Homo sapiens
acccagaauugcuuugauu

SEQ ID NO: 252571 - RNA, 19 nt, Homo sapiens
ggaagucuuuuacccagaa

SEQ ID NO: 252572 - RNA, 19 nt, Homo sapiens
caucugauugugauauuga

SEQ ID NO: 252573 - RNA, 19 nt, Homo sapiens
ccugauccuuguucuguug

SEQ ID NO: 252574 - RNA, 19 nt, Homo sapiens
aagaaucuaucugcuuaug

SEQ ID NO: 252575 - RNA, 19 nt, Homo sapiens
gaaugacuuguguuuccua

SEQ ID NO: 252576 - RNA, 19 nt, Homo sapiens
ugaauagcacuggugauuu

SEQ ID NO: 252577 - RNA, 19 nt, Homo sapiens
caauaugagaguguucuaa

SEQ ID NO: 252578 - RNA, 19 nt, Homo sapiens
uggcuuccgugcacacauu

SEQ ID NO: 252579 - RNA, 19 nt, Homo sapiens
ggagauguuuuagaguuaa

SEQ ID NO: 252580 - RNA, 19 nt, Homo sapiens
cuucugugcuggagauguu

SEQ ID NO: 252581 - RNA, 19 nt, Homo sapiens
gcugaugaucccaaagauu

SEQ ID NO: 252582 - RNA, 19 nt, Homo sapiens
ugaaugcuccagucaacaa

SEQ ID NO: 252583 - RNA, 19 nt, Homo sapiens
gacuuguguuuccuaaaga

SEQ ID NO: 252584 - RNA, 19 nt, Homo sapiens
uaucugugaugcuaauaag

SEQ ID NO: 252585 - RNA, 19 nt, Homo sapiens
gcauaacaagguccaagau

SEQ ID NO: 252586 - RNA, 19 nt, Homo sapiens
ggagagaggggauaaugaa

SEQ ID NO: 252587 - RNA, 19 nt, Homo sapiens
ggaaggagccaaugacuuu

SEQ ID NO: 252588 - RNA, 19 nt, Homo sapiens
gaaaguggcuaugcucaaa

SEQ ID NO: 252589 - RNA, 19 nt, Homo sapiens
gcaagauucugaaacauug

SEQ ID NO: 252590 - RNA, 19 nt, Homo sapiens
gaagagagcaugagaggaa

SEQ ID NO: 252591 - RNA, 19 nt, Homo sapiens
gagaugaaguggaagguuu

SEQ ID NO: 252592 - RNA, 19 nt, Homo sapiens
ggaaaaggaugaaaacaaa

SEQ ID NO: 252593 - RNA, 19 nt, Homo sapiens
ucaccaaucuggaauuuga

SEQ ID NO: 252594 - RNA, 19 nt, Homo sapiens
gagguaaagugccugaauu

SEQ ID NO: 252595 - RNA, 19 nt, Homo sapiens
caucuuggccuguguguua

SEQ ID NO: 252596 - RNA, 19 nt, Homo sapiens
ggaaagagcaauauaugug

SEQ ID NO: 252597 - RNA, 19 nt, Homo sapiens
gcagcaauguaugagauua

SEQ ID NO: 252598 - RNA, 19 nt, Homo sapiens
ggaaaugauugaggaguga

SEQ ID NO: 252599 - RNA, 19 nt, Homo sapiens
gaacuccagagaucaauaa

SEQ ID NO: 252600 - RNA, 19 nt, Homo sapiens
ggaaagaaugaaagaguaa

SEQ ID NO: 252601 - RNA, 19 nt, Homo sapiens
gggaucaaaucaagaagaa

SEQ ID NO: 252602 - RNA, 19 nt, Homo sapiens
ggacgcaugugaauuuauc

SEQ ID NO: 252603 - RNA, 19 nt, Homo sapiens
gauccuaucuuacuaacca

SEQ ID NO: 252604 - RNA, 19 nt, Homo sapiens
gagcgacaaagaugauuua

SEQ ID NO: 252605 - RNA, 19 nt, Homo sapiens
ccaaugauucagcuauuua

SEQ ID NO: 252606 - RNA, 19 nt, Homo sapiens
ggauuaagccuaucguaug

SEQ ID NO: 252607 - RNA, 19 nt, Homo sapiens
gaaugggccucauguguac

SEQ ID NO: 252608 - RNA, 19 nt, Homo sapiens
caauauaugugugaagguu

SEQ ID NO: 252609 - RNA, 19 nt, Homo sapiens
caacaugagucaagagcau

SEQ ID NO: 252610 - RNA, 19 nt, Homo sapiens
gcacagagaagacaaaauu

SEQ ID NO: 252611 - RNA, 19 nt, Homo sapiens
gauggauccuaucuuacua

SEQ ID NO: 252612 - RNA, 19 nt, Homo sapiens
caacaucaccaaucuggaa

SEQ ID NO: 252613 - RNA, 19 nt, Homo sapiens
gaaagagcaauauaugugu

SEQ ID NO: 252614 - RNA, 19 nt, Homo sapiens
caucuacucucucucucua

SEQ ID NO: 252615 - RNA, 19 nt, Homo sapiens
aaagggaagucuagaguuc

SEQ ID NO: 252616 - RNA, 19 nt, Homo sapiens
ggaaacuacaagagauaua

SEQ ID NO: 252617 - RNA, 19 nt, Homo sapiens
caucaccaaucuggaauuu

SEQ ID NO: 252618 - RNA, 19 nt, Homo sapiens
gguuuaaggugacccaaug

SEQ ID NO: 252619 - RNA, 19 nt, Homo sapiens
gaaugaaagaguaaaggaa

SEQ ID NO: 252620 - RNA, 19 nt, Homo sapiens
aggaaagaaugaaagagua

SEQ ID NO: 252621 - RNA, 19 nt, Homo sapiens
uuacuaaccaucagcauuu

SEQ ID NO: 252622 - RNA, 19 nt, Homo sapiens
cuccagagaucaauaauag

SEQ ID NO: 252623 - RNA, 19 nt, Homo sapiens
ugacacuccugcagagaaa

SEQ ID NO: 252624 - RNA, 19 nt, Homo sapiens
caaaaccagugaaguguaa

SEQ ID NO: 252625 - RNA, 19 nt, Homo sapiens
gauuaagccuaucguaugg

SEQ ID NO: 252626 - RNA, 19 nt, Homo sapiens
gaaagaguaaaggaaauga

SEQ ID NO: 252627 - RNA, 19 nt, Homo sapiens
augcagaacuggaugacua

SEQ ID NO: 252628 - RNA, 19 nt, Homo sapiens
ucacacaucuacucucucu

SEQ ID NO: 252629 - RNA, 19 nt, Homo sapiens
gcucacacaucuacucucu

SEQ ID NO: 252630 - RNA, 19 nt, Homo sapiens
gauuuggucacaagguuua

SEQ ID NO: 252631 - RNA, 19 nt, Homo sapiens
uaagaagacucuggaacau

SEQ ID NO: 252632 - RNA, 19 nt, Homo sapiens
cuucagaacuccagagauc

SEQ ID NO: 252633 - RNA, 19 nt, Homo sapiens
gaauuuauccagcacaaag

SEQ ID NO: 252634 - RNA, 19 nt, Homo sapiens
gaguaaaggaaaugauuga

SEQ ID NO: 252635 - RNA, 19 nt, Homo sapiens
gaggaaagaaugaaagagu

SEQ ID NO: 252636 - RNA, 19 nt, Homo sapiens
agaaugggccucaugugua

SEQ ID NO: 252637 - RNA, 19 nt, Homo sapiens
gcaagaaugggccucaugu

SEQ ID NO: 252638 - RNA, 19 nt, Homo sapiens
ucaggaaacuacaagagau

SEQ ID NO: 252639 - RNA, 19 nt, Homo sapiens
caaauggacgcaugugaau

SEQ ID NO: 252640 - RNA, 19 nt, Homo sapiens
caaaucaagaagaagcaua

SEQ ID NO: 252641 - RNA, 19 nt, Homo sapiens
guaagaaacccagacugaa

SEQ ID NO: 252642 - RNA, 19 nt, Homo sapiens
aaucuggaauccugacauu

SEQ ID NO: 252643 - RNA, 19 nt, Homo sapiens
agaagacucuggaacaucu

SEQ ID NO: 252644 - RNA, 19 nt, Homo sapiens
uaaggugacccaaugauuc

SEQ ID NO: 252645 - RNA, 19 nt, Homo sapiens
gaaacccagacugaacuua

SEQ ID NO: 252646 - RNA, 19 nt, Homo sapiens
ccagugaaguguaagaaac

SEQ ID NO: 252647 - RNA, 19 nt, Homo sapiens
agaacuggaugacuacuca

SEQ ID NO: 252648 - RNA, 19 nt, Homo sapiens
gcaggaagagagcaugaga

SEQ ID NO: 252649 - RNA, 19 nt, Homo sapiens
cuacacagucugcaagauu

SEQ ID NO: 252650 - RNA, 19 nt, Homo sapiens
ggucagcccauucuuacuu

SEQ ID NO: 252651 - RNA, 19 nt, Homo sapiens
caagaagaagcauauguca

SEQ ID NO: 252652 - RNA, 19 nt, Homo sapiens
gcagggagaguggcaagaa

SEQ ID NO: 252653 - RNA, 19 nt, Homo sapiens
aauggacgcaugugaauuu

SEQ ID NO: 252654 - RNA, 19 nt, Homo sapiens
ggugacauuuaauacauca

SEQ ID NO: 252655 - RNA, 19 nt, Homo sapiens
guggugacauuuaauacau

SEQ ID NO: 252656 - RNA, 19 nt, Homo sapiens
ugaccugagugucgucuau

SEQ ID NO: 252657 - RNA, 19 nt, Homo sapiens
caggaaacuacaagagaua

SEQ ID NO: 252658 - RNA, 19 nt, Homo sapiens
ggagguaaagugccugaau

SEQ ID NO: 252659 - RNA, 19 nt, Homo sapiens
uguaagaaacccagacuga

SEQ ID NO: 252660 - RNA, 19 nt, Homo sapiens
ggaugacauucaagcuaga

SEQ ID NO: 252661 - RNA, 19 nt, Homo sapiens
ggaagaugcagaacuggau

SEQ ID NO: 252662 - RNA, 19 nt, Homo sapiens
gcgacaaagaugauuuaaa

SEQ ID NO: 252663 - RNA, 19 nt, Homo sapiens
aagcauaugucaccauguc

SEQ ID NO: 252664 - RNA, 19 nt, Homo sapiens
cagggucagcccauucuua

SEQ ID NO: 252665 - RNA, 19 nt, Homo sapiens
ggaaugucagugcauguga

SEQ ID NO: 252666 - RNA, 19 nt, Homo sapiens
cccaaugauucagcuauuu

SEQ ID NO: 252667 - RNA, 19 nt, Homo sapiens
gugaauuuauccagcacaa

SEQ ID NO: 252668 - RNA, 19 nt, Homo sapiens
acaaauggacgcaugugaa

SEQ ID NO: 252669 - RNA, 19 nt, Homo sapiens
agaccuaaccacuauaguu

SEQ ID NO: 252670 - RNA, 19 nt, Homo sapiens
gaauggaucgcagcacuca

SEQ ID NO: 252671 - RNA, 19 nt, Homo sapiens
ucugcaagauucugaaaca

SEQ ID NO: 252672 - RNA, 19 nt, Homo sapiens
uaggguggaugacauucaa

SEQ ID NO: 252673 - RNA, 19 nt, Homo sapiens
cagcaauguaugagauuaa

SEQ ID NO: 252674 - RNA, 19 nt, Homo sapiens
cggcagcaauguaugagau

SEQ ID NO: 252675 - RNA, 19 nt, Homo sapiens
uaagaaacccagacugaac

SEQ ID NO: 252676 - RNA, 19 nt, Homo sapiens
ucuggaauccugacauuga

SEQ ID NO: 252677 - RNA, 19 nt, Homo sapiens
gacuuuguggugacauuua

SEQ ID NO: 252678 - RNA, 19 nt, Homo sapiens
ggauuuggucacaagguuu

SEQ ID NO: 252679 - RNA, 19 nt, Homo sapiens
gcuucuaccauguggauuu

SEQ ID NO: 252680 - RNA, 19 nt, Homo sapiens
caacugcccaucugaggau

SEQ ID NO: 252681 - RNA, 19 nt, Homo sapiens
caacuagaagaaucugaga

SEQ ID NO: 252682 - RNA, 19 nt, Homo sapiens
uuaaaggcuucuggaguga

SEQ ID NO: 252683 - RNA, 19 nt, Homo sapiens
uacacagucugcaagauuc

SEQ ID NO: 252684 - RNA, 19 nt, Homo sapiens
gagauucaucccucacaug

SEQ ID NO: 252685 - RNA, 19 nt, Homo sapiens
uaauacaucacacuugcaa

SEQ ID NO: 252686 - RNA, 19 nt, Homo sapiens
cucuuacucucauucauuu

SEQ ID NO: 252687 - RNA, 19 nt, Homo sapiens
gagaauauccgaacuuuaa

SEQ ID NO: 252688 - RNA, 19 nt, Homo sapiens
guagugcuguguugaauua

SEQ ID NO: 252689 - RNA, 19 nt, Homo sapiens
caagauuccugguuaaauu

SEQ ID NO: 252690 - RNA, 19 nt, Homo sapiens
gaagagggcugagaauuca

SEQ ID NO: 252691 - RNA, 19 nt, Homo sapiens
gcuagaaugugauauuuga

SEQ ID NO: 252692 - RNA, 19 nt, Homo sapiens
gaacugagagugauugaga

SEQ ID NO: 252693 - RNA, 19 nt, Homo sapiens
gcacaaacuuucagagaca

SEQ ID NO: 252694 - RNA, 19 nt, Homo sapiens
aauacaagauuccugguua

SEQ ID NO: 252695 - RNA, 19 nt, Homo sapiens
gaaggaaccaucucacugu

SEQ ID NO: 252696 - RNA, 19 nt, Homo sapiens
gccaaggagugcuaaagaa

SEQ ID NO: 252697 - RNA, 19 nt, Homo sapiens
gaagaaaccaccggaagga

SEQ ID NO: 252698 - RNA, 19 nt, Homo sapiens
gaauggguuugcuagaaug

SEQ ID NO: 252699 - RNA, 19 nt, Homo sapiens
caaaucuacuucaacacuu

SEQ ID NO: 252700 - RNA, 19 nt, Homo sapiens
caugaaauauccagaacau

SEQ ID NO: 252701 - RNA, 19 nt, Homo sapiens
cuucaacacuucauguauu

SEQ ID NO: 252702 - RNA, 19 nt, Homo sapiens
aagcaaaucuacuucaaca

SEQ ID NO: 252703 - RNA, 19 nt, Homo sapiens
ucaaagaacugagagugau

SEQ ID NO: 252704 - RNA, 19 nt, Homo sapiens
gacaagagccaggaagaaa

SEQ ID NO: 252705 - RNA, 19 nt, Homo sapiens
guaaagcuuucugauggaa

SEQ ID NO: 252706 - RNA, 19 nt, Homo sapiens
ugaauggguuugcuagaau

SEQ ID NO: 252707 - RNA, 19 nt, Homo sapiens
aagagaauauccgaacuuu

SEQ ID NO: 252708 - RNA, 19 nt, Homo sapiens
ucaagcaaaucuacuucaa

SEQ ID NO: 252709 - RNA, 19 nt, Homo sapiens
gcauaaagacauacuccaa

SEQ ID NO: 252710 - RNA, 19 nt, Homo sapiens
ggacaagagccaggaagaa

SEQ ID NO: 252711 - RNA, 19 nt, Homo sapiens
gaagaugccagugaaacuu

SEQ ID NO: 252712 - RNA, 19 nt, Homo sapiens
uuuaugugcucuccaaauu

SEQ ID NO: 252713 - RNA, 19 nt, Homo sapiens
uguguugaauuacggaaua

SEQ ID NO: 252714 - RNA, 19 nt, Homo sapiens
ugaaauauccagaacauac

SEQ ID NO: 252715 - RNA, 19 nt, Homo sapiens
ccacagucaauauuaguaa

SEQ ID NO: 252716 - RNA, 19 nt, Homo sapiens
auacaagauuccugguuaa

SEQ ID NO: 252717 - RNA, 19 nt, Homo sapiens
gcaaaucuacuucaacacu

SEQ ID NO: 252718 - RNA, 19 nt, Homo sapiens
cauaaagacauacuccaaa

SEQ ID NO: 252719 - RNA, 19 nt, Homo sapiens
guaauuucuugcugguuga

SEQ ID NO: 252720 - RNA, 19 nt, Homo sapiens
cagcagagcacacaagcuu

SEQ ID NO: 252721 - RNA, 19 nt, Homo sapiens
cuugguuucuccuuuauuu

SEQ ID NO: 252722 - RNA, 19 nt, Homo sapiens
agacauacuccaaaccuuu

SEQ ID NO: 252723 - RNA, 19 nt, Homo sapiens
gaauugaauggguuugcua

SEQ ID NO: 252724 - RNA, 19 nt, Homo sapiens
ugaagagggcugagaauuc

SEQ ID NO: 252725 - RNA, 19 nt, Homo sapiens
gucagugcauaaagacaua

SEQ ID NO: 252726 - RNA, 19 nt, Homo sapiens
gcacgggagaauauacaaa

SEQ ID NO: 252727 - RNA, 19 nt, Homo sapiens
caagagaauauccgaacuu

SEQ ID NO: 252728 - RNA, 19 nt, Homo sapiens
gccaagggccaagagaaua

SEQ ID NO: 252729 - RNA, 19 nt, Homo sapiens
cagaugcaauacaagauuc

SEQ ID NO: 252730 - RNA, 19 nt, Homo sapiens
guguaaacaugacuuccaa

SEQ ID NO: 252731 - RNA, 19 nt, Homo sapiens
ggacauguggaagcacuuu

SEQ ID NO: 252732 - RNA, 19 nt, Homo sapiens
ugccuugguuucuccuuua

SEQ ID NO: 252733 - RNA, 19 nt, Homo sapiens
uggcaacccuagucugcua

SEQ ID NO: 252734 - RNA, 19 nt, Homo sapiens
gaaacuucaagcaaaucua

SEQ ID NO: 252735 - RNA, 19 nt, Homo sapiens
cagugaagaugccagugaa

SEQ ID NO: 252736 - RNA, 19 nt, Homo sapiens
gcagaggguuguggagaag

SEQ ID NO: 252737 - RNA, 19 nt, Homo sapiens
ggaccacacugcgccaaca

SEQ ID NO: 252738 - RNA, 19 nt, Homo sapiens
ccagaugcaauacaagauu

SEQ ID NO: 252739 - RNA, 19 nt, Homo sapiens
guuguaggguugccagaug

SEQ ID NO: 252740 - RNA, 19 nt, Homo sapiens
caaagaacugagagugauu

SEQ ID NO: 252741 - RNA, 19 nt, Homo sapiens
acgggagaauauacaaaua

SEQ ID NO: 252742 - RNA, 19 nt, Homo sapiens
gaaauauccagaacauacu

SEQ ID NO: 252743 - RNA, 19 nt, Homo sapiens
acacaagcuucuaggacaa

SEQ ID NO: 252744 - RNA, 19 nt, Homo sapiens
aaagcuuucugauggaaga

SEQ ID NO: 252745 - RNA, 19 nt, Homo sapiens
aaacuccacagucaauauu

SEQ ID NO: 252746 - RNA, 19 nt, Homo sapiens
ccaagggccaagagaauau

SEQ ID NO: 252747 - RNA, 19 nt, Homo sapiens
ccaagaaucagugaagaug

SEQ ID NO: 252748 - RNA, 19 nt, Homo sapiens
agaugucagugcauaaaga

SEQ ID NO: 252749 - RNA, 19 nt, Homo sapiens
gguuucuccuuuauuucua

SEQ ID NO: 252750 - RNA, 19 nt, Homo sapiens
gugccuugguuucuccuuu

SEQ ID NO: 252751 - RNA, 19 nt, Homo sapiens
uugaauggguuugcuagaa

SEQ ID NO: 252752 - RNA, 19 nt, Homo sapiens
gauuccugguuaaauuuga

SEQ ID NO: 252753 - RNA, 19 nt, Homo sapiens
aaggagugcuaaagaacuu

SEQ ID NO: 252754 - RNA, 19 nt, Homo sapiens
gggagaauauacaaauagc

SEQ ID NO: 252755 - RNA, 19 nt, Homo sapiens
agucaaauuuagcuggaaa

SEQ ID NO: 252756 - RNA, 19 nt, Homo sapiens
ggaauugaauggguuugcu

SEQ ID NO: 252757 - RNA, 19 nt, Homo sapiens
ccauaaggcacaaacuuuc

SEQ ID NO: 252758 - RNA, 19 nt, Homo sapiens
uaugugcucuccaaauuuu

SEQ ID NO: 252759 - RNA, 19 nt, Homo sapiens
gauacucccagucuuguca

SEQ ID NO: 252760 - RNA, 19 nt, Homo sapiens
gccaccaucuuaccucaca

SEQ ID NO: 252761 - RNA, 19 nt, Homo sapiens
aaaucuacuucaacacuuc

SEQ ID NO: 252762 - RNA, 19 nt, Homo sapiens
gggcugagaauucauaaaa

SEQ ID NO: 252763 - RNA, 19 nt, Homo sapiens
gccaacacagaaauuauug

SEQ ID NO: 252764 - RNA, 19 nt, Homo sapiens
uggguuugcuagaauguga

SEQ ID NO: 252765 - RNA, 19 nt, Homo sapiens
gcagagcacacaagcuucu

SEQ ID NO: 252766 - RNA, 19 nt, Homo sapiens
caauacaagauuccugguu

SEQ ID NO: 252767 - RNA, 19 nt, Homo sapiens
caacacuucauguauugug

SEQ ID NO: 252768 - RNA, 19 nt, Homo sapiens
acacugcgccaacacagaa

SEQ ID NO: 252769 - RNA, 19 nt, Homo sapiens
auaaagacauacuccaaac

SEQ ID NO: 252770 - RNA, 19 nt, Homo sapiens
uucaacacuucauguauug

SEQ ID NO: 252771 - RNA, 19 nt, Homo sapiens
ucagugaagaugccaguga

SEQ ID NO: 252772 - RNA, 19 nt, Homo sapiens
guguugaauuacggaauaa

SEQ ID NO: 252773 - RNA, 19 nt, Homo sapiens
gacauguggaagcacuuua

SEQ ID NO: 252774 - RNA, 19 nt, Homo sapiens
ccaagagaauauccgaacu

SEQ ID NO: 252775 - RNA, 19 nt, Homo sapiens
uguaaagcuuucugaugga

SEQ ID NO: 252776 - RNA, 19 nt, Homo sapiens
cgccaacacagaaauuauu

SEQ ID NO: 252777 - RNA, 19 nt, Homo sapiens
cauaaggcacaaacuuuca

SEQ ID NO: 252778 - RNA, 19 nt, Homo sapiens
guuccacugugccuugguu

SEQ ID NO: 252779 - RNA, 19 nt, Homo sapiens
agagaauauccgaacuuua

SEQ ID NO: 252780 - RNA, 19 nt, Homo sapiens
agaggguuguggagaaguu

SEQ ID NO: 252781 - RNA, 19 nt, Homo sapiens
gcgccaacacagaaauuau

SEQ ID NO: 252782 - RNA, 19 nt, Homo sapiens
gacauacuccaaaccuuuc

SEQ ID NO: 252783 - RNA, 19 nt, Homo sapiens
acuuagaugucagugcaua

SEQ ID NO: 252784 - RNA, 19 nt, Homo sapiens
uagccaggauccacaaguc

SEQ ID NO: 252785 - RNA, 19 nt, Homo sapiens
ccaucucacuguguguaaa

SEQ ID NO: 252786 - RNA, 19 nt, Homo sapiens
ucucugugguauccaagaa

SEQ ID NO: 252787 - RNA, 19 nt, Homo sapiens
gaggacaugucaaauauua

SEQ ID NO: 252788 - RNA, 19 nt, Homo sapiens
gaagaggacaugucaaaua

SEQ ID NO: 252789 - RNA, 19 nt, Homo sapiens
ggaaguaucuugguuguga

SEQ ID NO: 252790 - RNA, 19 nt, Homo sapiens
ccacugagauucugggauu

SEQ ID NO: 252791 - RNA, 19 nt, Homo sapiens
cccacuaacuggcuaauua

SEQ ID NO: 252792 - RNA, 19 nt, Homo sapiens
gcuaugagguccugggaaa

SEQ ID NO: 252793 - RNA, 19 nt, Homo sapiens
aggcagauguuccuaauaa

SEQ ID NO: 252794 - RNA, 19 nt, Homo sapiens
ucaguuagaucaaaccauu

SEQ ID NO: 252795 - RNA, 19 nt, Homo sapiens
ccuacuaaaugcucaauaa

SEQ ID NO: 252796 - RNA, 19 nt, Homo sapiens
gauccugccucacaccuuu

SEQ ID NO: 252797 - RNA, 19 nt, Homo sapiens
cugaggagcuguugaggua

SEQ ID NO: 252798 - RNA, 19 nt, Homo sapiens
guuaggaacuggugucuuc

SEQ ID NO: 252799 - RNA, 19 nt, Homo sapiens
aaccaucgaugaaggaaua

SEQ ID NO: 252800 - RNA, 19 nt, Homo sapiens
caaaugcuuuccaugaguu

SEQ ID NO: 252801 - RNA, 19 nt, Homo sapiens
gcaggcagauguuccuaau

SEQ ID NO: 252802 - RNA, 19 nt, Homo sapiens
ggugguggaugaacaaaga

SEQ ID NO: 252803 - RNA, 19 nt, Homo sapiens
gugaggagcuggaaacaca

SEQ ID NO: 252804 - RNA, 19 nt, Homo sapiens
aggaauaucucuucucaga

SEQ ID NO: 252805 - RNA, 19 nt, Homo sapiens
aagaggacaugucaaauau

SEQ ID NO: 252806 - RNA, 19 nt, Homo sapiens
gaucaaaccauugcugaaa

SEQ ID NO: 252807 - RNA, 19 nt, Homo sapiens
gaaacgaagcaccaucauu

SEQ ID NO: 252808 - RNA, 19 nt, Homo sapiens
gcaccuccauggaaacgaa

SEQ ID NO: 252809 - RNA, 19 nt, Homo sapiens
gcaucaguguggaccguua

SEQ ID NO: 252810 - RNA, 19 nt, Homo sapiens
caagugcccucuagcuguu

SEQ ID NO: 252811 - RNA, 19 nt, Homo sapiens
ccagaucuaugccacaaga

SEQ ID NO: 252812 - RNA, 19 nt, Homo sapiens
aaacgaagcaccaucauuc

SEQ ID NO: 252813 - RNA, 19 nt, Homo sapiens
caaggugaauggcuggauu

SEQ ID NO: 252814 - RNA, 19 nt, Homo sapiens
gggcagcaccuccuaagaa

SEQ ID NO: 252815 - RNA, 19 nt, Homo sapiens
gacauuagaugagagaaca

SEQ ID NO: 252816 - RNA, 19 nt, Homo sapiens
ggacaugucaaauauuaca

SEQ ID NO: 252817 - RNA, 19 nt, Homo sapiens
gaaacucccuggugaugcu

SEQ ID NO: 252818 - RNA, 19 nt, Homo sapiens
gcaucagcaucccuagaaa

SEQ ID NO: 252819 - RNA, 19 nt, Homo sapiens
guccucaucuuccugcuuu

SEQ ID NO: 252820 - RNA, 19 nt, Homo sapiens
ccaaaugcuuuccaugagu

SEQ ID NO: 252821 - RNA, 19 nt, Homo sapiens
ucacaucuuuaacccacua

SEQ ID NO: 252822 - RNA, 19 nt, Homo sapiens
agcaucaucuucuggguua

SEQ ID NO: 252823 - RNA, 19 nt, Homo sapiens
gcaccaucauucccguuga

SEQ ID NO: 252824 - RNA, 19 nt, Homo sapiens
gcuugucccuguggaagua

SEQ ID NO: 252825 - RNA, 19 nt, Homo sapiens
gcagauguuccuaauaaag

SEQ ID NO: 252826 - RNA, 19 nt, Homo sapiens
acaaagagaaagaggguuu

SEQ ID NO: 252827 - RNA, 19 nt, Homo sapiens
ggccggugcuucaguuaga

SEQ ID NO: 252828 - RNA, 19 nt, Homo sapiens
ggucaaguuuguuugucuu

SEQ ID NO: 252829 - RNA, 19 nt, Homo sapiens
uauuacagauccacagaug

SEQ ID NO: 252830 - RNA, 19 nt, Homo sapiens
ggcagauguuccuaauaaa

SEQ ID NO: 252831 - RNA, 19 nt, Homo sapiens
cgccauggauuccucaaga

SEQ ID NO: 252832 - RNA, 19 nt, Homo sapiens
gacugcagcuccuacuguu

SEQ ID NO: 252833 - RNA, 19 nt, Homo sapiens
gcccugaccuugcccaucu

SEQ ID NO: 252834 - RNA, 19 nt, Homo sapiens
gcaccucucuggguugaag

SEQ ID NO: 252835 - RNA, 19 nt, Homo sapiens
gaaaugacacagcaaaaug

SEQ ID NO: 252836 - RNA, 19 nt, Homo sapiens
gugcuucaguuagaucaaa

SEQ ID NO: 252837 - RNA, 19 nt, Homo sapiens
gaagcuguguccucaugag

SEQ ID NO: 252838 - RNA, 19 nt, Homo sapiens
ucucagaaggaaagaauaa

SEQ ID NO: 252839 - RNA, 19 nt, Homo sapiens
gcuguuaagucacucugau

SEQ ID NO: 252840 - RNA, 19 nt, Homo sapiens
ggcuuuaacuccugcuaga

SEQ ID NO: 252841 - RNA, 19 nt, Homo sapiens
auucugggauuucuccaua

SEQ ID NO: 252842 - RNA, 19 nt, Homo sapiens
gccuggagccuacuaaaug

SEQ ID NO: 252843 - RNA, 19 nt, Homo sapiens
agagaaagaggguuuggaa

SEQ ID NO: 252844 - RNA, 19 nt, Homo sapiens
aaccauugcugaaacugaa

SEQ ID NO: 252845 - RNA, 19 nt, Homo sapiens
gaacgucacaucuuuaacc

SEQ ID NO: 252846 - RNA, 19 nt, Homo sapiens
ccuguaugcuagaaacuga

SEQ ID NO: 252847 - RNA, 19 nt, Homo sapiens
ggcagcaccuccuaagaag

SEQ ID NO: 252848 - RNA, 19 nt, Homo sapiens
ggaugaacaaagagaaaga

SEQ ID NO: 252849 - RNA, 19 nt, Homo sapiens
ccaguccaguuugcuauga

SEQ ID NO: 252850 - RNA, 19 nt, Homo sapiens
gcaugccaccugcagauga

SEQ ID NO: 252851 - RNA, 19 nt, Homo sapiens
gaggugagcaucaucuucu

SEQ ID NO: 252852 - RNA, 19 nt, Homo sapiens
cugaagaggacaugucaaa

SEQ ID NO: 252853 - RNA, 19 nt, Homo sapiens
guugaacgucacaucuuua

SEQ ID NO: 252854 - RNA, 19 nt, Homo sapiens
ucccugcccuucuuccuuu

SEQ ID NO: 252855 - RNA, 19 nt, Homo sapiens
caugccaccugcagaugaa

SEQ ID NO: 252856 - RNA, 19 nt, Homo sapiens
guggaaguaucuugguugu

SEQ ID NO: 252857 - RNA, 19 nt, Homo sapiens
ccuaauaaagcuucuguuc

SEQ ID NO: 252858 - RNA, 19 nt, Homo sapiens
uaauuagcauggccacauc

SEQ ID NO: 252859 - RNA, 19 nt, Homo sapiens
caccaucauucccguugaa

SEQ ID NO: 252860 - RNA, 19 nt, Homo sapiens
aaacaauuccaguccaguu

SEQ ID NO: 252861 - RNA, 19 nt, Homo sapiens
caccugcagaugaagauua

SEQ ID NO: 252862 - RNA, 19 nt, Homo sapiens
cagaagcaccgagccauga

SEQ ID NO: 252863 - RNA, 19 nt, Homo sapiens
guaucuugguugugacaga

SEQ ID NO: 252864 - RNA, 19 nt, Homo sapiens
ucaagauccuggcuaugca

SEQ ID NO: 252865 - RNA, 19 nt, Homo sapiens
cugaagcuguguccucaug

SEQ ID NO: 252866 - RNA, 19 nt, Homo sapiens
ccucacaccuuuggcuuca

SEQ ID NO: 252867 - RNA, 19 nt, Homo sapiens
ucaaaccauugcugaaacu

SEQ ID NO: 252868 - RNA, 19 nt, Homo sapiens
ucacaccuuuggcuucauc

SEQ ID NO: 252869 - RNA, 19 nt, Homo sapiens
gccauggauuccucaagau

SEQ ID NO: 252870 - RNA, 19 nt, Homo sapiens
gcuguuggccugcaucagu

SEQ ID NO: 252871 - RNA, 19 nt, Homo sapiens
caucgccuaugcccuagug

SEQ ID NO: 252872 - RNA, 19 nt, Homo sapiens
cccucuagcuguuaaguca

SEQ ID NO: 252873 - RNA, 19 nt, Homo sapiens
ggugugugcagcauuguug

SEQ ID NO: 252874 - RNA, 19 nt, Homo sapiens
aagggugugugcagcauug

SEQ ID NO: 252875 - RNA, 19 nt, Homo sapiens
uuaagucacucugaucucu

SEQ ID NO: 252876 - RNA, 19 nt, Homo sapiens
caaguauguugugaucauc

SEQ ID NO: 252877 - RNA, 19 nt, Homo sapiens
ggcuguuccugcaguagaa

SEQ ID NO: 252878 - RNA, 19 nt, Homo sapiens
caucaucuacgccuucauc

SEQ ID NO: 252879 - RNA, 19 nt, Homo sapiens
caaaauggcggaugguguu

SEQ ID NO: 252880 - RNA, 19 nt, Homo sapiens
cccaaaugcuuuccaugag

SEQ ID NO: 252881 - RNA, 19 nt, Homo sapiens
aagucacucugaucucuga

SEQ ID NO: 252882 - RNA, 19 nt, Homo sapiens
gaugugggauuuugaugau

SEQ ID NO: 252883 - RNA, 19 nt, Homo sapiens
guggaugaacaaagagaaa

SEQ ID NO: 252884 - RNA, 19 nt, Homo sapiens
ggccacaccaaccuucuga

SEQ ID NO: 252885 - RNA, 19 nt, Homo sapiens
gagguuguguguggaaggu

SEQ ID NO: 252886 - RNA, 19 nt, Homo sapiens
gucaucguguuaccuccua

SEQ ID NO: 252887 - RNA, 19 nt, Homo sapiens
gaacagccaugcaaccaaa

SEQ ID NO: 252888 - RNA, 19 nt, Homo sapiens
caaacaagauacccacuga

SEQ ID NO: 252889 - RNA, 19 nt, Homo sapiens
gaacaacaaguguccauau

SEQ ID NO: 252890 - RNA, 19 nt, Homo sapiens
ggcaagauaugaagaugaa

SEQ ID NO: 252891 - RNA, 19 nt, Homo sapiens
gcaacgcgcugacauuucu

SEQ ID NO: 252892 - RNA, 19 nt, Homo sapiens
gcgcugacauuucugaaga

SEQ ID NO: 252893 - RNA, 19 nt, Homo sapiens
gacaucaacuuccucauca

SEQ ID NO: 252894 - RNA, 19 nt, Homo sapiens
caacaaguguccauauuuu

SEQ ID NO: 252895 - RNA, 19 nt, Homo sapiens
ucaacaagaugcaggaaga

SEQ ID NO: 252896 - RNA, 19 nt, Homo sapiens
gugcuaaugugaccaguug

SEQ ID NO: 252897 - RNA, 19 nt, Homo sapiens
gaugagaggcaagauauga

SEQ ID NO: 252898 - RNA, 19 nt, Homo sapiens
ggacaucaacuuccucauc

SEQ ID NO: 252899 - RNA, 19 nt, Homo sapiens
ugacauuucugaagagucu

SEQ ID NO: 252900 - RNA, 19 nt, Homo sapiens
gggaugagaggcaagauau

SEQ ID NO: 252901 - RNA, 19 nt, Homo sapiens
gaccaguugucucuguuug

SEQ ID NO: 252902 - RNA, 19 nt, Homo sapiens
aacaacaaguguccauauu

SEQ ID NO: 252903 - RNA, 19 nt, Homo sapiens
acaacaaguguccauauuu

SEQ ID NO: 252904 - RNA, 19 nt, Homo sapiens
caguugaaguacuaaagaa

SEQ ID NO: 252905 - RNA, 19 nt, Homo sapiens
caagauacccacugauuuu

SEQ ID NO: 252906 - RNA, 19 nt, Homo sapiens
ucaacuuccucaucaacaa

SEQ ID NO: 252907 - RNA, 19 nt, Homo sapiens
cuaaaucaguaucaguugu

SEQ ID NO: 252908 - RNA, 19 nt, Homo sapiens
acaagauacccacugauuu

SEQ ID NO: 252909 - RNA, 19 nt, Homo sapiens
agaccaugcuucagugaga

SEQ ID NO: 252910 - RNA, 19 nt, Homo sapiens
gaggcaagauaugaagaug

SEQ ID NO: 252911 - RNA, 19 nt, Homo sapiens
ugucucagaugaccaauac

SEQ ID NO: 252912 - RNA, 19 nt, Homo sapiens
gaaaagaugagagggauga

SEQ ID NO: 252913 - RNA, 19 nt, Homo sapiens
ccaccaugcaaacaagaua

SEQ ID NO: 252914 - RNA, 19 nt, Homo sapiens
gaaguacuaaagaacaaca

SEQ ID NO: 252915 - RNA, 19 nt, Homo sapiens
aacaagauacccacugauu

SEQ ID NO: 252916 - RNA, 19 nt, Homo sapiens
uaaaucaguaucaguugug

SEQ ID NO: 252917 - RNA, 19 nt, Homo sapiens
guaagcuacucuaaaucag

SEQ ID NO: 252918 - RNA, 19 nt, Homo sapiens
gauccuggacaucaacuuc

SEQ ID NO: 252919 - RNA, 19 nt, Homo sapiens
guacuaaagaacaacaagu

SEQ ID NO: 252920 - RNA, 19 nt, Homo sapiens
ucaguugaaguacuaaaga

SEQ ID NO: 252921 - RNA, 19 nt, Homo sapiens
guuugggcauucccucuga

SEQ ID NO: 252922 - RNA, 19 nt, Homo sapiens
gagaggcaagauaugaaga

SEQ ID NO: 252923 - RNA, 19 nt, Homo sapiens
aaaucaguaucaguuguga

SEQ ID NO: 252924 - RNA, 19 nt, Homo sapiens
ggaugagaggcaagauaug

SEQ ID NO: 252925 - RNA, 19 nt, Homo sapiens
gugaccaguugucucuguu

SEQ ID NO: 252926 - RNA, 19 nt, Homo sapiens
guugaaguacuaaagaaca

SEQ ID NO: 252927 - RNA, 19 nt, Homo sapiens
caccagaccaugcuucagu

SEQ ID NO: 252928 - RNA, 19 nt, Homo sapiens
gcugacauuucugaagagu

SEQ ID NO: 252929 - RNA, 19 nt, Homo sapiens
gaccaauaccaccaugcaa

SEQ ID NO: 252930 - RNA, 19 nt, Homo sapiens
aggcaacgcgcugacauuu

SEQ ID NO: 252931 - RNA, 19 nt, Homo sapiens
caacaagaugcaggaagau

SEQ ID NO: 252932 - RNA, 19 nt, Homo sapiens
gcaggcaacgcgcugacau

SEQ ID NO: 252933 - RNA, 19 nt, Homo sapiens
uaagcuacucuaaaucagu

SEQ ID NO: 252934 - RNA, 19 nt, Homo sapiens
ccaauaccaccaugcaaac

SEQ ID NO: 252935 - RNA, 19 nt, Homo sapiens
accaauaccaccaugcaaa

SEQ ID NO: 252936 - RNA, 19 nt, Homo sapiens
gaaguacucauacauguua

SEQ ID NO: 252937 - RNA, 19 nt, Homo sapiens
gaacaaauuuacagagaca

SEQ ID NO: 252938 - RNA, 19 nt, Homo sapiens
gaaauaagccagacaucaa

SEQ ID NO: 252939 - RNA, 19 nt, Homo sapiens
gcacaggguuuauguuuag

SEQ ID NO: 252940 - RNA, 19 nt, Homo sapiens
gaaagcagaacagugauua

SEQ ID NO: 252941 - RNA, 19 nt, Homo sapiens
gaaacccugucucuacuaa

SEQ ID NO: 252942 - RNA, 19 nt, Homo sapiens
ccacuaaauugacacuuaa

SEQ ID NO: 252943 - RNA, 19 nt, Homo sapiens
gccacuaaauugacacuua

SEQ ID NO: 252944 - RNA, 19 nt, Homo sapiens
ggaauugacccacaagaaa

SEQ ID NO: 252945 - RNA, 19 nt, Homo sapiens
gcagggacuugaacccaua

SEQ ID NO: 252946 - RNA, 19 nt, Homo sapiens
gaagguggauagacaaauc

SEQ ID NO: 252947 - RNA, 19 nt, Homo sapiens
ucuaagaccuccugccuaa

SEQ ID NO: 252948 - RNA, 19 nt, Homo sapiens
agacaaaucuccaccuuca

SEQ ID NO: 252949 - RNA, 19 nt, Homo sapiens
cauagcagcuuauucacaa

SEQ ID NO: 252950 - RNA, 19 nt, Homo sapiens
cagauaaacaguagugaua

SEQ ID NO: 252951 - RNA, 19 nt, Homo sapiens
caugggaagugacgguuua

SEQ ID NO: 252952 - RNA, 19 nt, Homo sapiens
ggacgaaccuugaaaacuu

SEQ ID NO: 252953 - RNA, 19 nt, Homo sapiens
ggcacaggguuuauguuua

SEQ ID NO: 252954 - RNA, 19 nt, Homo sapiens
gacagaagguggauagaca

SEQ ID NO: 252955 - RNA, 19 nt, Homo sapiens
uaggauggcuaguaucaaa

SEQ ID NO: 252956 - RNA, 19 nt, Homo sapiens
caacccaggucagaaguuu

SEQ ID NO: 252957 - RNA, 19 nt, Homo sapiens
ggacuugaacccauauuug

SEQ ID NO: 252958 - RNA, 19 nt, Homo sapiens
uauggcagcuuuccucaaa

SEQ ID NO: 252959 - RNA, 19 nt, Homo sapiens
agacagcucugcauacuca

SEQ ID NO: 252960 - RNA, 19 nt, Homo sapiens
cagcaggccuuccuuuguu

SEQ ID NO: 252961 - RNA, 19 nt, Homo sapiens
gaaggaccgucuacucauc

SEQ ID NO: 252962 - RNA, 19 nt, Homo sapiens
cagaaucccuggaaaucaa

SEQ ID NO: 252963 - RNA, 19 nt, Homo sapiens
ggucacagcugcucuucug

SEQ ID NO: 252964 - RNA, 19 nt, Homo sapiens
gugaacaaauuuacagaga

SEQ ID NO: 252965 - RNA, 19 nt, Homo sapiens
gacauagaauuaacacaug

SEQ ID NO: 252966 - RNA, 19 nt, Homo sapiens
ccucaaaacuucagacaua

SEQ ID NO: 252967 - RNA, 19 nt, Homo sapiens
caauauucauagcagcuua

SEQ ID NO: 252968 - RNA, 19 nt, Homo sapiens
ggauuuaaguuuaccucaa

SEQ ID NO: 252969 - RNA, 19 nt, Homo sapiens
ucaagguuguuucaucuuu

SEQ ID NO: 252970 - RNA, 19 nt, Homo sapiens
gcaucaguguggaccguua

SEQ ID NO: 252971 - RNA, 19 nt, Homo sapiens
gauaaacaguagugauagu

SEQ ID NO: 252972 - RNA, 19 nt, Homo sapiens
gggcacaggguuuauguuu

SEQ ID NO: 252973 - RNA, 19 nt, Homo sapiens
acagaaagcagaacaguga

SEQ ID NO: 252974 - RNA, 19 nt, Homo sapiens
caaggugaauggcuggauu

SEQ ID NO: 252975 - RNA, 19 nt, Homo sapiens
gaaccaccugccuauauuu

SEQ ID NO: 252976 - RNA, 19 nt, Homo sapiens
gaauugacccacaagaaau

SEQ ID NO: 252977 - RNA, 19 nt, Homo sapiens
guacugagagugaacaaau

SEQ ID NO: 252978 - RNA, 19 nt, Homo sapiens
agccagacaucaacagaua

SEQ ID NO: 252979 - RNA, 19 nt, Homo sapiens
caacccaaauguucaucaa

SEQ ID NO: 252980 - RNA, 19 nt, Homo sapiens
ccucaagauucuagcuaua

SEQ ID NO: 252981 - RNA, 19 nt, Homo sapiens
ugacagcuuugaagauuuc

SEQ ID NO: 252982 - RNA, 19 nt, Homo sapiens
cagucaggauuuaaguuua

SEQ ID NO: 252983 - RNA, 19 nt, Homo sapiens
agaaccaccugccuauauu

SEQ ID NO: 252984 - RNA, 19 nt, Homo sapiens
ggaagugacgguuuaaugg

SEQ ID NO: 252985 - RNA, 19 nt, Homo sapiens
gaaguuucaucgucaaggu

SEQ ID NO: 252986 - RNA, 19 nt, Homo sapiens
auauguaccuaacgaagua

SEQ ID NO: 252987 - RNA, 19 nt, Homo sapiens
gaaugaauggcuaagcaaa

SEQ ID NO: 252988 - RNA, 19 nt, Homo sapiens
gaggacaugggcaacaaua

SEQ ID NO: 252989 - RNA, 19 nt, Homo sapiens
gaaacucccucgugaugcu

SEQ ID NO: 252990 - RNA, 19 nt, Homo sapiens
caacacggacgaaccuuga

SEQ ID NO: 252991 - RNA, 19 nt, Homo sapiens
gauccugcaauuccacuua

SEQ ID NO: 252992 - RNA, 19 nt, Homo sapiens
ggacaugggcaacaauaca

SEQ ID NO: 252993 - RNA, 19 nt, Homo sapiens
cauuaucuaugcccuggua

SEQ ID NO: 252994 - RNA, 19 nt, Homo sapiens
ucauuaggauggcuaguau

SEQ ID NO: 252995 - RNA, 19 nt, Homo sapiens
ggguuuauguuuaggaugu

SEQ ID NO: 252996 - RNA, 19 nt, Homo sapiens
gaagcaacccaaauguuca

SEQ ID NO: 252997 - RNA, 19 nt, Homo sapiens
gccacguucuuacuaguuu

SEQ ID NO: 252998 - RNA, 19 nt, Homo sapiens
ccagucaggauuuaaguuu

SEQ ID NO: 252999 - RNA, 19 nt, Homo sapiens
gcagugagccgagauugug

SEQ ID NO: 253000 - RNA, 19 nt, Homo sapiens
gaugggagaaucacuugaa

SEQ ID NO: 253001 - RNA, 19 nt, Homo sapiens
gccauggacuccucaagau

SEQ ID NO: 253002 - RNA, 19 nt, Homo sapiens
guaccgcaaugugacuuaa

SEQ ID NO: 253003 - RNA, 19 nt, Homo sapiens
aaacaguagugauaguugu

SEQ ID NO: 253004 - RNA, 19 nt, Homo sapiens
gacaucaacagauaaauag

SEQ ID NO: 253005 - RNA, 19 nt, Homo sapiens
gcagaagcaacccaaaugu

SEQ ID NO: 253006 - RNA, 19 nt, Homo sapiens
ggugaagaucuuaguaauu

SEQ ID NO: 253007 - RNA, 19 nt, Homo sapiens
gacuuaaugccacuaaauu

SEQ ID NO: 253008 - RNA, 19 nt, Homo sapiens
gggaagugacgguuuaaug

SEQ ID NO: 253009 - RNA, 19 nt, Homo sapiens
cauggagagugacagcuuu

SEQ ID NO: 253010 - RNA, 19 nt, Homo sapiens
gaaaugaaagcagggacuu

SEQ ID NO: 253011 - RNA, 19 nt, Homo sapiens
ggaggccacguucuuacua

SEQ ID NO: 253012 - RNA, 19 nt, Homo sapiens
aaagaggaaugaaguacuc

SEQ ID NO: 253013 - RNA, 19 nt, Homo sapiens
cagcucugcauacucauua

SEQ ID NO: 253014 - RNA, 19 nt, Homo sapiens
ggcacucuauguucuaaga

SEQ ID NO: 253015 - RNA, 19 nt, Homo sapiens
gcccugaccuugcccaucu

SEQ ID NO: 253016 - RNA, 19 nt, Homo sapiens
gaaaggugaagaucuuagu

SEQ ID NO: 253017 - RNA, 19 nt, Homo sapiens
agugacagcuuugaagauu

SEQ ID NO: 253018 - RNA, 19 nt, Homo sapiens
cuacuuggucaaauucaua

SEQ ID NO: 253019 - RNA, 19 nt, Homo sapiens
gugacagcuuugaagauuu

SEQ ID NO: 253020 - RNA, 19 nt, Homo sapiens
uagaaccaccugccuauau

SEQ ID NO: 253021 - RNA, 19 nt, Homo sapiens
gcagauaaacaguagugau

SEQ ID NO: 253022 - RNA, 19 nt, Homo sapiens
ccagacaucaacagauaaa

SEQ ID NO: 253023 - RNA, 19 nt, Homo sapiens
cuggaaaggugaagaucuu

SEQ ID NO: 253024 - RNA, 19 nt, Homo sapiens
gguggccacuccaauaaca

SEQ ID NO: 253025 - RNA, 19 nt, Homo sapiens
gcuagaaccaccugccuau

SEQ ID NO: 253026 - RNA, 19 nt, Homo sapiens
gaaagaggaaugaaguacu

SEQ ID NO: 253027 - RNA, 19 nt, Homo sapiens
uauaggaauugacccacaa

SEQ ID NO: 253028 - RNA, 19 nt, Homo sapiens
gagaugggagaaucacuug

SEQ ID NO: 253029 - RNA, 19 nt, Homo sapiens
cccuggaaaucaacaagua

SEQ ID NO: 253030 - RNA, 19 nt, Homo sapiens
ugaaauaagccagacauca

SEQ ID NO: 253031 - RNA, 19 nt, Homo sapiens
acccaaauguucaucaaug

SEQ ID NO: 253032 - RNA, 19 nt, Homo sapiens
gcccauggcacucuauguu

SEQ ID NO: 253033 - RNA, 19 nt, Homo sapiens
ggagagugacagcuuugaa

SEQ ID NO: 253034 - RNA, 19 nt, Homo sapiens
gcgacccagucaggauuua

SEQ ID NO: 253035 - RNA, 19 nt, Homo sapiens
caccaaggcugauuaaacc

SEQ ID NO: 253036 - RNA, 19 nt, Homo sapiens
gcaguuaucuccugaauca

SEQ ID NO: 253037 - RNA, 19 nt, Homo sapiens
gcuaugagcuggccuucaa

SEQ ID NO: 253038 - RNA, 19 nt, Homo sapiens
guaaugcgcuugugguuuc

SEQ ID NO: 253039 - RNA, 19 nt, Homo sapiens
gcacagggaucacauuguc

SEQ ID NO: 253040 - RNA, 19 nt, Homo sapiens
gcaccuuucuagagauuaa

SEQ ID NO: 253041 - RNA, 19 nt, Homo sapiens
ccacugcacugcucacuug

SEQ ID NO: 253042 - RNA, 19 nt, Homo sapiens
ugaccuggcuuauacuuga

SEQ ID NO: 253043 - RNA, 19 nt, Homo sapiens
ggacaagggccaaggucua

SEQ ID NO: 253044 - RNA, 19 nt, Homo sapiens
cagcuguucugcccucaua

SEQ ID NO: 253045 - RNA, 19 nt, Homo sapiens
cgaccuaccuccuguucaa

SEQ ID NO: 253046 - RNA, 19 nt, Homo sapiens
gcauguugcucccuucugu

SEQ ID NO: 253047 - RNA, 19 nt, Homo sapiens
ugaccacacuucucagcua

SEQ ID NO: 253048 - RNA, 19 nt, Homo sapiens
ugaggcaccuuucuagaga

SEQ ID NO: 253049 - RNA, 19 nt, Homo sapiens
ccacacuucucagcuauga

SEQ ID NO: 253050 - RNA, 19 nt, Homo sapiens
gcaaagcucacgucaccaa

SEQ ID NO: 253051 - RNA, 19 nt, Homo sapiens
gagcuggacccuggcuuua

SEQ ID NO: 253052 - RNA, 19 nt, Homo sapiens
ccaacaacauucucaggau

SEQ ID NO: 253053 - RNA, 19 nt, Homo sapiens
ccaaugaccacacuucuca

SEQ ID NO: 253054 - RNA, 19 nt, Homo sapiens
gaccacacuucucagcuau

SEQ ID NO: 253055 - RNA, 19 nt, Homo sapiens
ucaccugccucaccaacaa

SEQ ID NO: 253056 - RNA, 19 nt, Homo sapiens
agacugaaccuccugagaa

SEQ ID NO: 253057 - RNA, 19 nt, Homo sapiens
ccuguggccuuucuuguga

SEQ ID NO: 253058 - RNA, 19 nt, Homo sapiens
ucucagcccucccaggaaa

SEQ ID NO: 253059 - RNA, 19 nt, Homo sapiens
gcuccuggcggcacacaua

SEQ ID NO: 253060 - RNA, 19 nt, Homo sapiens
auaguugggugacaaauca

SEQ ID NO: 253061 - RNA, 19 nt, Homo sapiens
uacagacgcuugccuaucu

SEQ ID NO: 253062 - RNA, 19 nt, Homo sapiens
gcuggacccuggcuuuauc

SEQ ID NO: 253063 - RNA, 19 nt, Homo sapiens
gacugaaccuccugagaag

SEQ ID NO: 253064 - RNA, 19 nt, Homo sapiens
ccagaugcaucauguccau

SEQ ID NO: 253065 - RNA, 19 nt, Homo sapiens
guagaggaggagcguuaua

SEQ ID NO: 253066 - RNA, 19 nt, Homo sapiens
caaguucuuccuuccauug

SEQ ID NO: 253067 - RNA, 19 nt, Homo sapiens
gagacaaggcccucugauc

SEQ ID NO: 253068 - RNA, 19 nt, Homo sapiens
ggagccagccugugugcuu

SEQ ID NO: 253069 - RNA, 19 nt, Homo sapiens
gcuggaccuuggagaguga

SEQ ID NO: 253070 - RNA, 19 nt, Homo sapiens
acuggaggaugauguggua

SEQ ID NO: 253071 - RNA, 19 nt, Homo sapiens
gugugaaccugucgugcaa

SEQ ID NO: 253072 - RNA, 19 nt, Homo sapiens
agagauaguugggugacaa

SEQ ID NO: 253073 - RNA, 19 nt, Homo sapiens
gagauaguugggugacaaa

SEQ ID NO: 253074 - RNA, 19 nt, Homo sapiens
gaccuggcuuauacuugaa

SEQ ID NO: 253075 - RNA, 19 nt, Homo sapiens
uuacugaggcaccuuucua

SEQ ID NO: 253076 - RNA, 19 nt, Homo sapiens
uggccacacuggaggauga

SEQ ID NO: 253077 - RNA, 19 nt, Homo sapiens
acaauuucaccaucacuuu

SEQ ID NO: 253078 - RNA, 19 nt, Homo sapiens
cuggagcccuugucugaga

SEQ ID NO: 253079 - RNA, 19 nt, Homo sapiens
ggaggaugaugugguagag

SEQ ID NO: 253080 - RNA, 19 nt, Homo sapiens
gauaguugggugacaaauc

SEQ ID NO: 253081 - RNA, 19 nt, Homo sapiens
ggaccuccagggcauguug

SEQ ID NO: 253082 - RNA, 19 nt, Homo sapiens
gaguggagccagccugugu

SEQ ID NO: 253083 - RNA, 19 nt, Homo sapiens
caagggccaaggucuagaa

SEQ ID NO: 253084 - RNA, 19 nt, Homo sapiens
gaaccugucgugcaaagcu

SEQ ID NO: 253085 - RNA, 19 nt, Homo sapiens
ggaugccucagacuuguga

SEQ ID NO: 253086 - RNA, 19 nt, Homo sapiens
gagacugaaccuccugaga

SEQ ID NO: 253087 - RNA, 19 nt, Homo sapiens
cagcacagggaucacauug

SEQ ID NO: 253088 - RNA, 19 nt, Homo sapiens
gagccaaugaccacacuuc

SEQ ID NO: 253089 - RNA, 19 nt, Homo sapiens
cgugccaucugacaauuuc

SEQ ID NO: 253090 - RNA, 19 nt, Homo sapiens
cacaaguucuuccuuccau

SEQ ID NO: 253091 - RNA, 19 nt, Homo sapiens
gacaauuucaccaucacuu

SEQ ID NO: 253092 - RNA, 19 nt, Homo sapiens
gcucgugccaucugacaau

SEQ ID NO: 253093 - RNA, 19 nt, Homo sapiens
acaaguucuuccuuccauu

SEQ ID NO: 253094 - RNA, 19 nt, Homo sapiens
aaaauggacugaaguuucu

SEQ ID NO: 253095 - RNA, 19 nt, Homo sapiens
ggagacccagcaaggaguu

SEQ ID NO: 253096 - RNA, 19 nt, Homo sapiens
guacagacgcuugccuauc

SEQ ID NO: 253097 - RNA, 19 nt, Homo sapiens
gcuugugguuucagaugug

SEQ ID NO: 253098 - RNA, 19 nt, Homo sapiens
gaaggacaagggccaaggu

SEQ ID NO: 253099 - RNA, 19 nt, Homo sapiens
agaugcaucauguccauuu

SEQ ID NO: 253100 - RNA, 19 nt, Homo sapiens
ugguagaggaggagcguua

SEQ ID NO: 253101 - RNA, 19 nt, Homo sapiens
gacaagggccaaggucuag

SEQ ID NO: 253102 - RNA, 19 nt, Homo sapiens
gugaaccugucgugcaaag

SEQ ID NO: 253103 - RNA, 19 nt, Homo sapiens
caauuucaccaucacuuuc

SEQ ID NO: 253104 - RNA, 19 nt, Homo sapiens
ucugacaauuucaccauca

SEQ ID NO: 253105 - RNA, 19 nt, Homo sapiens
ggggugaccuggcuuauac

SEQ ID NO: 253106 - RNA, 19 nt, Homo sapiens
gaggcaccuuucuagagau

SEQ ID NO: 253107 - RNA, 19 nt, Homo sapiens
gucccugacucgccagaug

SEQ ID NO: 253108 - RNA, 19 nt, Homo sapiens
gcgcguccuuggaaaucug

SEQ ID NO: 253109 - RNA, 19 nt, Homo sapiens
gcagugcucgugccaucug

SEQ ID NO: 253110 - RNA, 19 nt, Homo sapiens
gggcuugauggcuguuaaa

SEQ ID NO: 253111 - RNA, 19 nt, Homo sapiens
aggcaccuuucuagagauu

SEQ ID NO: 253112 - RNA, 19 nt, Homo sapiens
aagcucacgucaccaacug

SEQ ID NO: 253113 - RNA, 19 nt, Homo sapiens
ggaaaauggacugaaguuu

SEQ ID NO: 253114 - RNA, 19 nt, Homo sapiens
gcgcuugugguuucagaug

SEQ ID NO: 253115 - RNA, 19 nt, Homo sapiens
gcaucaguccugccuugga

SEQ ID NO: 253116 - RNA, 19 nt, Homo sapiens
gcagagcaacaucaguucu

SEQ ID NO: 253117 - RNA, 19 nt, Homo sapiens
gcccaguggacacagguaa

SEQ ID NO: 253118 - RNA, 19 nt, Homo sapiens
cugcaguuaucuccugaau

SEQ ID NO: 253119 - RNA, 19 nt, Homo sapiens
gaggaggagcguuauacag

SEQ ID NO: 253120 - RNA, 19 nt, Homo sapiens
ugagcuggacccuggcuuu

SEQ ID NO: 253121 - RNA, 19 nt, Homo sapiens
ugaugggacugggcagaug

SEQ ID NO: 253122 - RNA, 19 nt, Homo sapiens
gguacagacgcuugccuau

SEQ ID NO: 253123 - RNA, 19 nt, Homo sapiens
auccugaccuggagcauca

SEQ ID NO: 253124 - RNA, 19 nt, Homo sapiens
cauugucccuuuucuuuau

SEQ ID NO: 253125 - RNA, 19 nt, Homo sapiens
uuccuuccauugucccuuu

SEQ ID NO: 253126 - RNA, 19 nt, Homo sapiens
gaaagaagcccaauauuau

SEQ ID NO: 253127 - RNA, 19 nt, Homo sapiens
gcagugagcugauaucaug

SEQ ID NO: 253128 - RNA, 19 nt, Homo sapiens
uuacugagcuucucuguga

SEQ ID NO: 253129 - RNA, 19 nt, Homo sapiens
uuaauaagcuccaagagaa

SEQ ID NO: 253130 - RNA, 19 nt, Homo sapiens
guggccagcuuguuauuua

SEQ ID NO: 253131 - RNA, 19 nt, Homo sapiens
gaagaaugccuuuaauaag

SEQ ID NO: 253132 - RNA, 19 nt, Homo sapiens
gaaccaagacccagacauc

SEQ ID NO: 253133 - RNA, 19 nt, Homo sapiens
ugaccucccucuaauuuau

SEQ ID NO: 253134 - RNA, 19 nt, Homo sapiens
gugaagaaugccuuuaaua

SEQ ID NO: 253135 - RNA, 19 nt, Homo sapiens
gacacacuaugguauuuga

SEQ ID NO: 253136 - RNA, 19 nt, Homo sapiens
gagaaaggcaucuacaaag

SEQ ID NO: 253137 - RNA, 19 nt, Homo sapiens
ggugaagaaugccuuuaau

SEQ ID NO: 253138 - RNA, 19 nt, Homo sapiens
ugucugagaugauccaguu

SEQ ID NO: 253139 - RNA, 19 nt, Homo sapiens
uggaggacuuuaaggguua

SEQ ID NO: 253140 - RNA, 19 nt, Homo sapiens
cauagaagccuacaugaca

SEQ ID NO: 253141 - RNA, 19 nt, Homo sapiens
gaacagcugcacccacuuc

SEQ ID NO: 253142 - RNA, 19 nt, Homo sapiens
ugagugaguuugacaucuu

SEQ ID NO: 253143 - RNA, 19 nt, Homo sapiens
cuacggcgcugucaucgau

SEQ ID NO: 253144 - RNA, 19 nt, Homo sapiens
gagcuucucugugaacgau

SEQ ID NO: 253145 - RNA, 19 nt, Homo sapiens
caaccugccuaacaugcuu

SEQ ID NO: 253146 - RNA, 19 nt, Homo sapiens
cuacauagaagccuacaug

SEQ ID NO: 253147 - RNA, 19 nt, Homo sapiens
ucagcagagugaagacuuu

SEQ ID NO: 253148 - RNA, 19 nt, Homo sapiens
agagaaaggcaucuacaaa

SEQ ID NO: 253149 - RNA, 19 nt, Homo sapiens
cccaaccacuucauucuug

SEQ ID NO: 253150 - RNA, 19 nt, Homo sapiens
gugacacacuaugguauuu

SEQ ID NO: 253151 - RNA, 19 nt, Homo sapiens
auacgaaacugagacauca

SEQ ID NO: 253152 - RNA, 19 nt, Homo sapiens
aagaaugccuuuaauaagc

SEQ ID NO: 253153 - RNA, 19 nt, Homo sapiens
aggaucagcuggacaacuu

SEQ ID NO: 253154 - RNA, 19 nt, Homo sapiens
gaaaccccgucucuacuaa

SEQ ID NO: 253155 - RNA, 19 nt, Homo sapiens
ccaaccacuucauucuuga

SEQ ID NO: 253156 - RNA, 19 nt, Homo sapiens
gcuucucugugaacgauuu

SEQ ID NO: 253157 - RNA, 19 nt, Homo sapiens
caaugaagauacgaaacug

SEQ ID NO: 253158 - RNA, 19 nt, Homo sapiens
acaaagccaugagugaguu

SEQ ID NO: 253159 - RNA, 19 nt, Homo sapiens
uuguuugucugucuucaua

SEQ ID NO: 253160 - RNA, 19 nt, Homo sapiens
ccugaccucccucuaauuu

SEQ ID NO: 253161 - RNA, 19 nt, Homo sapiens
aagccuacaugacaaugaa

SEQ ID NO: 253162 - RNA, 19 nt, Homo sapiens
gaagccuacaugacaauga

SEQ ID NO: 253163 - RNA, 19 nt, Homo sapiens
gauacgaaacugagacauc

SEQ ID NO: 253164 - RNA, 19 nt, Homo sapiens
cuacaugacaaugaagaua

SEQ ID NO: 253165 - RNA, 19 nt, Homo sapiens
uaacaugcuucgagaucuc

SEQ ID NO: 253166 - RNA, 19 nt, Homo sapiens
gaacccaggagauggaagu

SEQ ID NO: 253167 - RNA, 19 nt, Homo sapiens
ggccagcuuguuauuuaua

SEQ ID NO: 253168 - RNA, 19 nt, Homo sapiens
cuugagaaaccuuauugua

SEQ ID NO: 253169 - RNA, 19 nt, Homo sapiens
gagugaguuugacaucuuc

SEQ ID NO: 253170 - RNA, 19 nt, Homo sapiens
agaaaggcaucuacaaagc

SEQ ID NO: 253171 - RNA, 19 nt, Homo sapiens
ggugacacacuaugguauu

SEQ ID NO: 253172 - RNA, 19 nt, Homo sapiens
ugacaaugaagauacgaaa

SEQ ID NO: 253173 - RNA, 19 nt, Homo sapiens
ugaaggaucagcuggacaa

SEQ ID NO: 253174 - RNA, 19 nt, Homo sapiens
agacagacuugcaaaagaa

SEQ ID NO: 253175 - RNA, 19 nt, Homo sapiens
caagagaaaggcaucuaca

SEQ ID NO: 253176 - RNA, 19 nt, Homo sapiens
uaauaagcuccaagagaaa

SEQ ID NO: 253177 - RNA, 19 nt, Homo sapiens
gcaccuguaaucccagcua

SEQ ID NO: 253178 - RNA, 19 nt, Homo sapiens
uccauagggugacacacua

SEQ ID NO: 253179 - RNA, 19 nt, Homo sapiens
caucuucaucaacuacaua

SEQ ID NO: 253180 - RNA, 19 nt, Homo sapiens
uuaauucaccuuccagugu

SEQ ID NO: 253181 - RNA, 19 nt, Homo sapiens
auagaagccuacaugacaa

SEQ ID NO: 253182 - RNA, 19 nt, Homo sapiens
gcaggugaagaaugccuuu

SEQ ID NO: 253183 - RNA, 19 nt, Homo sapiens
gcgcugucaucgauuucuu

SEQ ID NO: 253184 - RNA, 19 nt, Homo sapiens
cuucaucaacuacauagaa

SEQ ID NO: 253185 - RNA, 19 nt, Homo sapiens
uuacauuguuugucugucu

SEQ ID NO: 253186 - RNA, 19 nt, Homo sapiens
ccuguaaucccagcacuuu

SEQ ID NO: 253187 - RNA, 19 nt, Homo sapiens
gaguuugacaucuucauca

SEQ ID NO: 253188 - RNA, 19 nt, Homo sapiens
gagaaaccuuauuguaccu

SEQ ID NO: 253189 - RNA, 19 nt, Homo sapiens
uuuaauaagcuccaagaga

SEQ ID NO: 253190 - RNA, 19 nt, Homo sapiens
gagauggaaguugcaguga

SEQ ID NO: 253191 - RNA, 19 nt, Homo sapiens
ggagccccuuugaugauua

SEQ ID NO: 253192 - RNA, 19 nt, Homo sapiens
ucccugaccucccucuaau

SEQ ID NO: 253193 - RNA, 19 nt, Homo sapiens
cuaugguauuugaguguuu

SEQ ID NO: 253194 - RNA, 19 nt, Homo sapiens
aaccaaaccacaagacaga

SEQ ID NO: 253195 - RNA, 19 nt, Homo sapiens
gaaguugcagugagcugau

SEQ ID NO: 253196 - RNA, 19 nt, Homo sapiens
ugaggcggguggaucacuu

SEQ ID NO: 253197 - RNA, 19 nt, Homo sapiens
uggagcaggugaagaaugc

SEQ ID NO: 253198 - RNA, 19 nt, Homo sapiens
caucaaggcgcaugugaac

SEQ ID NO: 253199 - RNA, 19 nt, Homo sapiens
ccucuaauuuaucuugucu

SEQ ID NO: 253200 - RNA, 19 nt, Homo sapiens
ccaagacccagacaucaag

SEQ ID NO: 253201 - RNA, 19 nt, Homo sapiens
gaucuggggcucugggaua

SEQ ID NO: 253202 - RNA, 19 nt, Homo sapiens
ucaggguggcgacucuaua

SEQ ID NO: 253203 - RNA, 19 nt, Homo sapiens
gagaugccuucagcagagu

SEQ ID NO: 253204 - RNA, 19 nt, Homo sapiens
gguggcgacucuauagacu

SEQ ID NO: 253205 - RNA, 19 nt, Homo sapiens
ucaaggcgcaugugaacuc

SEQ ID NO: 253206 - RNA, 19 nt, Homo sapiens
caaagccaugagugaguuu

SEQ ID NO: 253207 - RNA, 19 nt, Homo sapiens
agaaugccuuuaauaagcu

SEQ ID NO: 253208 - RNA, 19 nt, Homo sapiens
aauuagaggucuccaaaau

SEQ ID NO: 253209 - RNA, 19 nt, Homo sapiens
ucuacaaagccaugaguga

SEQ ID NO: 253210 - RNA, 19 nt, Homo sapiens
cugagaugauccaguuuua

SEQ ID NO: 253211 - RNA, 19 nt, Homo sapiens
ccguggagcaggugaagaa

SEQ ID NO: 253212 - RNA, 19 nt, Homo sapiens
ucacuugaggucaggaguu

SEQ ID NO: 253213 - RNA, 19 nt, Homo sapiens
caaaccacaagacagacuu

SEQ ID NO: 253214 - RNA, 19 nt, Homo sapiens
aagagaaaggcaucuacaa

SEQ ID NO: 253215 - RNA, 19 nt, Homo sapiens
aaguugcagugagcugaua

SEQ ID NO: 253216 - RNA, 19 nt, Homo sapiens
uugagaaaccuuauuguac

SEQ ID NO: 253217 - RNA, 19 nt, Homo sapiens
acaaugaagauacgaaacu

SEQ ID NO: 253218 - RNA, 19 nt, Homo sapiens
cacuugaggucaggaguuc

SEQ ID NO: 253219 - RNA, 19 nt, Homo sapiens
uggccagcuuguuauuuau

SEQ ID NO: 253220 - RNA, 19 nt, Homo sapiens
ggauuccccuaaccucauu

SEQ ID NO: 253221 - RNA, 19 nt, Homo sapiens
ccuaacaugcuucgagauc

SEQ ID NO: 253222 - RNA, 19 nt, Homo sapiens
uggcgacucuauagacucu

SEQ ID NO: 253223 - RNA, 19 nt, Homo sapiens
cuaacaugcuucgagaucu

SEQ ID NO: 253224 - RNA, 19 nt, Homo sapiens
gcacugaccuguucuguug

SEQ ID NO: 253225 - RNA, 19 nt, Homo sapiens
gaaagaagcuacccagugu

SEQ ID NO: 253226 - RNA, 19 nt, Homo sapiens
gaaaguaccugcuaugaag

SEQ ID NO: 253227 - RNA, 19 nt, Homo sapiens
acacaaagcucugucaaua

SEQ ID NO: 253228 - RNA, 19 nt, Homo sapiens
gaaacaggauccucuagaa

SEQ ID NO: 253229 - RNA, 19 nt, Homo sapiens
ggagaugccugguugauga

SEQ ID NO: 253230 - RNA, 19 nt, Homo sapiens
uggaagaucuuaagguaua

SEQ ID NO: 253231 - RNA, 19 nt, Homo sapiens
ggucauaacucagcccuuu

SEQ ID NO: 253232 - RNA, 19 nt, Homo sapiens
ggacacccaucccaaauca

SEQ ID NO: 253233 - RNA, 19 nt, Homo sapiens
ccacucacauccucacuuu

SEQ ID NO: 253234 - RNA, 19 nt, Homo sapiens
gcugacaacuuccagagaa

SEQ ID NO: 253235 - RNA, 19 nt, Homo sapiens
gcacccaucugcaaauauc

SEQ ID NO: 253236 - RNA, 19 nt, Homo sapiens
gaagagaaggcaaccaaga

SEQ ID NO: 253237 - RNA, 19 nt, Homo sapiens
ugacugacuugucuaauuc

SEQ ID NO: 253238 - RNA, 19 nt, Homo sapiens
gugaaagaauucuggauau

SEQ ID NO: 253239 - RNA, 19 nt, Homo sapiens
gccagacccuguccuauga

SEQ ID NO: 253240 - RNA, 19 nt, Homo sapiens
ggaaauggguaugaaugug

SEQ ID NO: 253241 - RNA, 19 nt, Homo sapiens
ucaaacacaucauaaugga

SEQ ID NO: 253242 - RNA, 19 nt, Homo sapiens
gaagugacucugacaguug

SEQ ID NO: 253243 - RNA, 19 nt, Homo sapiens
cuacagacccagaggauaa

SEQ ID NO: 253244 - RNA, 19 nt, Homo sapiens
gcagugaccugggaauauc

SEQ ID NO: 253245 - RNA, 19 nt, Homo sapiens
gaaucgcccuugacagaug

SEQ ID NO: 253246 - RNA, 19 nt, Homo sapiens
gaggaagaaucgcccuuga

SEQ ID NO: 253247 - RNA, 19 nt, Homo sapiens
gcagaauaaugacugacuu

SEQ ID NO: 253248 - RNA, 19 nt, Homo sapiens
acaaagcucugucaauaag

SEQ ID NO: 253249 - RNA, 19 nt, Homo sapiens
gucaauaagugauacaugu

SEQ ID NO: 253250 - RNA, 19 nt, Homo sapiens
acccagaccucccugcuua

SEQ ID NO: 253251 - RNA, 19 nt, Homo sapiens
gaccagaugugcugaagag

SEQ ID NO: 253252 - RNA, 19 nt, Homo sapiens
ggaagaaucgcccuugaca

SEQ ID NO: 253253 - RNA, 19 nt, Homo sapiens
acuggaagaucuuaaggua

SEQ ID NO: 253254 - RNA, 19 nt, Homo sapiens
ggacuagccacuugucaga

SEQ ID NO: 253255 - RNA, 19 nt, Homo sapiens
ugacaguggcauugacuua

SEQ ID NO: 253256 - RNA, 19 nt, Homo sapiens
ggaauagaguccuggaacu

SEQ ID NO: 253257 - RNA, 19 nt, Homo sapiens
gaaauucuagcucugacuu

SEQ ID NO: 253258 - RNA, 19 nt, Homo sapiens
ggaacuccaucuccaacug

SEQ ID NO: 253259 - RNA, 19 nt, Homo sapiens
gaacacaaagcucugucaa

SEQ ID NO: 253260 - RNA, 19 nt, Homo sapiens
gguaugaccuuggagaagu

SEQ ID NO: 253261 - RNA, 19 nt, Homo sapiens
gaaagaauucuggauaucu

SEQ ID NO: 253262 - RNA, 19 nt, Homo sapiens
ggacucugccuucaaacaa

SEQ ID NO: 253263 - RNA, 19 nt, Homo sapiens
aggaagggcuguaggaaug

SEQ ID NO: 253264 - RNA, 19 nt, Homo sapiens
gaaccuagagauccacaau

SEQ ID NO: 253265 - RNA, 19 nt, Homo sapiens
aauaaugacugacuugucu

SEQ ID NO: 253266 - RNA, 19 nt, Homo sapiens
ugaagugacucugacaguu

SEQ ID NO: 253267 - RNA, 19 nt, Homo sapiens
ggccaagggcuauuugaaa

SEQ ID NO: 253268 - RNA, 19 nt, Homo sapiens
gaggaaauggguaugaaug

SEQ ID NO: 253269 - RNA, 19 nt, Homo sapiens
uuccucaucugcagaauaa

SEQ ID NO: 253270 - RNA, 19 nt, Homo sapiens
gcucugacuuugcuguuuc

SEQ ID NO: 253271 - RNA, 19 nt, Homo sapiens
acucuuuccuguaucauaa

SEQ ID NO: 253272 - RNA, 19 nt, Homo sapiens
guguucagcugugugauuu

SEQ ID NO: 253273 - RNA, 19 nt, Homo sapiens
gaaccagcccacugaggaa

SEQ ID NO: 253274 - RNA, 19 nt, Homo sapiens
ugaaagaauucuggauauc

SEQ ID NO: 253275 - RNA, 19 nt, Homo sapiens
caacgucaucaucuucuuu

SEQ ID NO: 253276 - RNA, 19 nt, Homo sapiens
ccgcaaaugacacauauga

SEQ ID NO: 253277 - RNA, 19 nt, Homo sapiens
gacucugccuucaaacaaa

SEQ ID NO: 253278 - RNA, 19 nt, Homo sapiens
ucucccaucugugaaauaa

SEQ ID NO: 253279 - RNA, 19 nt, Homo sapiens
gcuaauguccagcuacaga

SEQ ID NO: 253280 - RNA, 19 nt, Homo sapiens
ggaagaucuuaagguauau

SEQ ID NO: 253281 - RNA, 19 nt, Homo sapiens
aaacaggauccucuagaaa

SEQ ID NO: 253282 - RNA, 19 nt, Homo sapiens
gccaagggcuauuugaaac

SEQ ID NO: 253283 - RNA, 19 nt, Homo sapiens
cagaugugcugaagagaag

SEQ ID NO: 253284 - RNA, 19 nt, Homo sapiens
ccuaaccucuggagaagug

SEQ ID NO: 253285 - RNA, 19 nt, Homo sapiens
gauccacaauggcuucauc

SEQ ID NO: 253286 - RNA, 19 nt, Homo sapiens
ugaaaguaccugcuaugaa

SEQ ID NO: 253287 - RNA, 19 nt, Homo sapiens
acaggauccucuagaaaug

SEQ ID NO: 253288 - RNA, 19 nt, Homo sapiens
aagaaucgcccuugacaga

SEQ ID NO: 253289 - RNA, 19 nt, Homo sapiens
cacaaagcucugucaauaa

SEQ ID NO: 253290 - RNA, 19 nt, Homo sapiens
gagccucaguuuccucauc

SEQ ID NO: 253291 - RNA, 19 nt, Homo sapiens
ccuguaucauaaaggauua

SEQ ID NO: 253292 - RNA, 19 nt, Homo sapiens
ggaggccugugcuuguguu

SEQ ID NO: 253293 - RNA, 19 nt, Homo sapiens
gagcuuugcccaugaccuu

SEQ ID NO: 253294 - RNA, 19 nt, Homo sapiens
aaagcucugucaauaagug

SEQ ID NO: 253295 - RNA, 19 nt, Homo sapiens
gugagguucugcugaggaa

SEQ ID NO: 253296 - RNA, 19 nt, Homo sapiens
gaauaaugacugacuuguc

SEQ ID NO: 253297 - RNA, 19 nt, Homo sapiens
ccagugguaugaccuugga

SEQ ID NO: 253298 - RNA, 19 nt, Homo sapiens
gaacuagugcaggguaugu

SEQ ID NO: 253299 - RNA, 19 nt, Homo sapiens
caucaucuucuuugccuuu

SEQ ID NO: 253300 - RNA, 19 nt, Homo sapiens
guaugaaugugccuugaac

SEQ ID NO: 253301 - RNA, 19 nt, Homo sapiens
aaagaauucuggauaucuc

SEQ ID NO: 253302 - RNA, 19 nt, Homo sapiens
uggcacccaucugcaaaua

SEQ ID NO: 253303 - RNA, 19 nt, Homo sapiens
gaagggcuguaggaaugga

SEQ ID NO: 253304 - RNA, 19 nt, Homo sapiens
gaggaagggcuguaggaau

SEQ ID NO: 253305 - RNA, 19 nt, Homo sapiens
gaccuucucccuccuagga

SEQ ID NO: 253306 - RNA, 19 nt, Homo sapiens
gaacuccaucuccaacugu

SEQ ID NO: 253307 - RNA, 19 nt, Homo sapiens
ccagaugugcugaagagaa

SEQ ID NO: 253308 - RNA, 19 nt, Homo sapiens
cagcacagacaguggcuuu

SEQ ID NO: 253309 - RNA, 19 nt, Homo sapiens
ucacacacaagaaaguaaa

SEQ ID NO: 253310 - RNA, 19 nt, Homo sapiens
acacucaaacacaucauaa

SEQ ID NO: 253311 - RNA, 19 nt, Homo sapiens
ggguggcacugaccuguuc

SEQ ID NO: 253312 - RNA, 19 nt, Homo sapiens
ccaguguccugcucuucaa

SEQ ID NO: 253313 - RNA, 19 nt, Homo sapiens
gcucugucaauaagugaua

SEQ ID NO: 253314 - RNA, 19 nt, Homo sapiens
augacugacuugucuaauu

SEQ ID NO: 253315 - RNA, 19 nt, Homo sapiens
agugaaagaauucuggaua

SEQ ID NO: 253316 - RNA, 19 nt, Homo sapiens
gaggcuaacagauccaaug

SEQ ID NO: 253317 - RNA, 19 nt, Homo sapiens
ccaucuugcugacaacuuc

SEQ ID NO: 253318 - RNA, 19 nt, Homo sapiens
gacacucaaacacaucaua

SEQ ID NO: 253319 - RNA, 19 nt, Homo sapiens
ggaggaagggcuguaggaa

SEQ ID NO: 253320 - RNA, 19 nt, Homo sapiens
gaggaggccaacucacuga

SEQ ID NO: 253321 - RNA, 19 nt, Homo sapiens
agccaucccugcagacuga

SEQ ID NO: 253322 - RNA, 19 nt, Homo sapiens
gcaggaggaggccaacuca

SEQ ID NO: 253323 - RNA, 19 nt, Homo sapiens
ugaaacaggauccucuaga

SEQ ID NO: 253324 - RNA, 19 nt, Homo sapiens
ggaacucacugccuuauaa

SEQ ID NO: 253325 - RNA, 19 nt, Homo sapiens
ggacuuauaaugugcaaua

SEQ ID NO: 253326 - RNA, 19 nt, Homo sapiens
gaauaagaauggagauguu

SEQ ID NO: 253327 - RNA, 19 nt, Homo sapiens
gaaacccagucucuacuaa

SEQ ID NO: 253328 - RNA, 19 nt, Homo sapiens
ggagugagccugucuguga

SEQ ID NO: 253329 - RNA, 19 nt, Homo sapiens
ucucaagucuuuccaagua

SEQ ID NO: 253330 - RNA, 19 nt, Homo sapiens
guaacauucuaccagauua

SEQ ID NO: 253331 - RNA, 19 nt, Homo sapiens
gcaaacaacccaugacgaa

SEQ ID NO: 253332 - RNA, 19 nt, Homo sapiens
gaacaaagcuggggaaugg

SEQ ID NO: 253333 - RNA, 19 nt, Homo sapiens
gaccacaccuugagaguca

SEQ ID NO: 253334 - RNA, 19 nt, Homo sapiens
ccagagagcuacauuuuaa

SEQ ID NO: 253335 - RNA, 19 nt, Homo sapiens
ggaaugugauuucucaagu

SEQ ID NO: 253336 - RNA, 19 nt, Homo sapiens
gcucaguaccuaaguuaua

SEQ ID NO: 253337 - RNA, 19 nt, Homo sapiens
gggcugaauuugcagauga

SEQ ID NO: 253338 - RNA, 19 nt, Homo sapiens
uaaaggcugucuuggcaaa

SEQ ID NO: 253339 - RNA, 19 nt, Homo sapiens
aaacuuggacuaugaagaa

SEQ ID NO: 253340 - RNA, 19 nt, Homo sapiens
gauuauggauggacugauc

SEQ ID NO: 253341 - RNA, 19 nt, Homo sapiens
gaacucacugccuuauaaa

SEQ ID NO: 253342 - RNA, 19 nt, Homo sapiens
gacggaaugugauuucuca

SEQ ID NO: 253343 - RNA, 19 nt, Homo sapiens
ugaagaauguguauaacuc

SEQ ID NO: 253344 - RNA, 19 nt, Homo sapiens
gagaaugaauacgaaacuu

SEQ ID NO: 253345 - RNA, 19 nt, Homo sapiens
uggauggacugaucugaaa

SEQ ID NO: 253346 - RNA, 19 nt, Homo sapiens
guguauaacucauggacuu

SEQ ID NO: 253347 - RNA, 19 nt, Homo sapiens
uagaaguacuugcugauuc

SEQ ID NO: 253348 - RNA, 19 nt, Homo sapiens
ugugauuucucaagucuuu

SEQ ID NO: 253349 - RNA, 19 nt, Homo sapiens
ggaauaagaauggagaugu

SEQ ID NO: 253350 - RNA, 19 nt, Homo sapiens
gaaugugauuucucaaguc

SEQ ID NO: 253351 - RNA, 19 nt, Homo sapiens
guuauaggauauuccaaga

SEQ ID NO: 253352 - RNA, 19 nt, Homo sapiens
caucauaacacacuucugu

SEQ ID NO: 253353 - RNA, 19 nt, Homo sapiens
ggacuaugaagaaugugua

SEQ ID NO: 253354 - RNA, 19 nt, Homo sapiens
uacgaaacuuggacuauga

SEQ ID NO: 253355 - RNA, 19 nt, Homo sapiens
gaaguuggccacugagagu

SEQ ID NO: 253356 - RNA, 19 nt, Homo sapiens
aguacuugcugauucuuua

SEQ ID NO: 253357 - RNA, 19 nt, Homo sapiens
gaagaauguguauaacuca

SEQ ID NO: 253358 - RNA, 19 nt, Homo sapiens
cacagcaccugaaagaguu

SEQ ID NO: 253359 - RNA, 19 nt, Homo sapiens
gcaggagaauugcaugaac

SEQ ID NO: 253360 - RNA, 19 nt, Homo sapiens
gagccugucugugagcaaa

SEQ ID NO: 253361 - RNA, 19 nt, Homo sapiens
cagcucaguaccuaaguua

SEQ ID NO: 253362 - RNA, 19 nt, Homo sapiens
gaaacuuggacuaugaaga

SEQ ID NO: 253363 - RNA, 19 nt, Homo sapiens
gcucacgccuguaauacca

SEQ ID NO: 253364 - RNA, 19 nt, Homo sapiens
uaagugucauugcagaaga

SEQ ID NO: 253365 - RNA, 19 nt, Homo sapiens
caagcuaagugucauugca

SEQ ID NO: 253366 - RNA, 19 nt, Homo sapiens
gugagaaacagaaauacuu

SEQ ID NO: 253367 - RNA, 19 nt, Homo sapiens
ugauggcgcaugccuauaa

SEQ ID NO: 253368 - RNA, 19 nt, Homo sapiens
ccacagcaccugaaagagu

SEQ ID NO: 253369 - RNA, 19 nt, Homo sapiens
uuucacagcucaguaccua

SEQ ID NO: 253370 - RNA, 19 nt, Homo sapiens
gaauacgaaacuuggacua

SEQ ID NO: 253371 - RNA, 19 nt, Homo sapiens
guggaugacaccauuauug

SEQ ID NO: 253372 - RNA, 19 nt, Homo sapiens
aauacuaccuugacggaau

SEQ ID NO: 253373 - RNA, 19 nt, Homo sapiens
cagccugggugacaaagug

SEQ ID NO: 253374 - RNA, 19 nt, Homo sapiens
cuuauaaugugcaauacug

SEQ ID NO: 253375 - RNA, 19 nt, Homo sapiens
guagaaguacuugcugauu

SEQ ID NO: 253376 - RNA, 19 nt, Homo sapiens
ggguaaacaucaccuucug

SEQ ID NO: 253377 - RNA, 19 nt, Homo sapiens
ucaagucuuuccaaguaug

SEQ ID NO: 253378 - RNA, 19 nt, Homo sapiens
gauggcgcaugccuauaau

SEQ ID NO: 253379 - RNA, 19 nt, Homo sapiens
caaguucgaggguuucuuc

SEQ ID NO: 253380 - RNA, 19 nt, Homo sapiens
auacgaaacuuggacuaug

SEQ ID NO: 253381 - RNA, 19 nt, Homo sapiens
gcacagugacguacuccau

SEQ ID NO: 253382 - RNA, 19 nt, Homo sapiens
ggauauuccaagauaaaug

SEQ ID NO: 253383 - RNA, 19 nt, Homo sapiens
guaauaccagcaccuuaga

SEQ ID NO: 253384 - RNA, 19 nt, Homo sapiens
gggaacucacugccuuaua

SEQ ID NO: 253385 - RNA, 19 nt, Homo sapiens
caaacaacccaugacgaaa

SEQ ID NO: 253386 - RNA, 19 nt, Homo sapiens
uuacauaugcguuucuuag

SEQ ID NO: 253387 - RNA, 19 nt, Homo sapiens
acucauggacuuauaaugu

SEQ ID NO: 253388 - RNA, 19 nt, Homo sapiens
gaggcaggcggaucacuug

SEQ ID NO: 253389 - RNA, 19 nt, Homo sapiens
uggaaugcaaguagaagua

SEQ ID NO: 253390 - RNA, 19 nt, Homo sapiens
ugaaacccagucucuacua

SEQ ID NO: 253391 - RNA, 19 nt, Homo sapiens
uguggugcguuuacaagaa

SEQ ID NO: 253392 - RNA, 19 nt, Homo sapiens
caaggguggucagcucaau

SEQ ID NO: 253393 - RNA, 19 nt, Homo sapiens
gauauuccaagauaaaugc

SEQ ID NO: 253394 - RNA, 19 nt, Homo sapiens
ggugaaacccagucucuac

SEQ ID NO: 253395 - RNA, 19 nt, Homo sapiens
agaaugaauacgaaacuug

SEQ ID NO: 253396 - RNA, 19 nt, Homo sapiens
ggaugacaccauuauugga

SEQ ID NO: 253397 - RNA, 19 nt, Homo sapiens
ccaccagagagcuacauuu

SEQ ID NO: 253398 - RNA, 19 nt, Homo sapiens
aaacagggccgagcacagu

SEQ ID NO: 253399 - RNA, 19 nt, Homo sapiens
gcguuuacaagaagacaaa

SEQ ID NO: 253400 - RNA, 19 nt, Homo sapiens
aaacccagucucuacuaaa

SEQ ID NO: 253401 - RNA, 19 nt, Homo sapiens
guggcucacgccuguaaua

SEQ ID NO: 253402 - RNA, 19 nt, Homo sapiens
aaacaacccaugacgaaac

SEQ ID NO: 253403 - RNA, 19 nt, Homo sapiens
gagccauggacaacuuauu

SEQ ID NO: 253404 - RNA, 19 nt, Homo sapiens
cuuggacuaugaagaaugu

SEQ ID NO: 253405 - RNA, 19 nt, Homo sapiens
ccccuaaaauugagaauga

SEQ ID NO: 253406 - RNA, 19 nt, Homo sapiens
gcugauucuuuacauaugc

SEQ ID NO: 253407 - RNA, 19 nt, Homo sapiens
gagcauucagacuggguaa

SEQ ID NO: 253408 - RNA, 19 nt, Homo sapiens
uggauucuuugcaguacuu

SEQ ID NO: 253409 - RNA, 19 nt, Homo sapiens
gguggucagcucaaugcua

SEQ ID NO: 253410 - RNA, 19 nt, Homo sapiens
cucauggacuuauaaugug

SEQ ID NO: 253411 - RNA, 19 nt, Homo sapiens
uguaacauucuaccagauu

SEQ ID NO: 253412 - RNA, 19 nt, Homo sapiens
uaagaauggagauguuaca

SEQ ID NO: 253413 - RNA, 19 nt, Homo sapiens
gccuugcuguggugcguuu

SEQ ID NO: 253414 - RNA, 19 nt, Homo sapiens
cuugcugauucuuuacaua

SEQ ID NO: 253415 - RNA, 19 nt, Homo sapiens
auacuaccuugacggaaug

SEQ ID NO: 253416 - RNA, 19 nt, Homo sapiens
cuacacagagcacggacuu

SEQ ID NO: 253417 - RNA, 19 nt, Homo sapiens
aaaauuagcuaggcaugau

SEQ ID NO: 253418 - RNA, 19 nt, Homo sapiens
uguaauaccagcaccuuag

SEQ ID NO: 253419 - RNA, 19 nt, Homo sapiens
gcuaagugucauugcagaa

SEQ ID NO: 253420 - RNA, 19 nt, Homo sapiens
acagcucaguaccuaaguu

SEQ ID NO: 253421 - RNA, 19 nt, Homo sapiens
guggugcguuuacaagaag

SEQ ID NO: 253422 - RNA, 19 nt, Homo sapiens
ccucauggccucggucuuc

SEQ ID NO: 253423 - RNA, 19 nt, Homo sapiens
gcaugaauacuaccuugac

SEQ ID NO: 253424 - RNA, 19 nt, Homo sapiens
gcaaaacccugucucaaaa

SEQ ID NO: 253425 - RNA, 19 nt, Homo sapiens
ccauaggucuucaauaaau

SEQ ID NO: 253426 - RNA, 19 nt, Homo sapiens
acccauaggucuucaauaa

SEQ ID NO: 253427 - RNA, 19 nt, Homo sapiens
gaaacaaucuagauaucca

SEQ ID NO: 253428 - RNA, 19 nt, Homo sapiens
gaacagggaauuaaaugug

SEQ ID NO: 253429 - RNA, 19 nt, Homo sapiens
ggaauuaaaugugucauac

SEQ ID NO: 253430 - RNA, 19 nt, Homo sapiens
ggagagaggugggauugug

SEQ ID NO: 253431 - RNA, 19 nt, Homo sapiens
ucacugaaguccaagaguu

SEQ ID NO: 253432 - RNA, 19 nt, Homo sapiens
caucugugccuuauuuaua

SEQ ID NO: 253433 - RNA, 19 nt, Homo sapiens
ugaaacagcaggcuacaaa

SEQ ID NO: 253434 - RNA, 19 nt, Homo sapiens
gcaauuacuuuucauguug

SEQ ID NO: 253435 - RNA, 19 nt, Homo sapiens
caaagccagaucuuauuua

SEQ ID NO: 253436 - RNA, 19 nt, Homo sapiens
ggacgaagcgaguggauca

SEQ ID NO: 253437 - RNA, 19 nt, Homo sapiens
caccaugcccagcuaauua

SEQ ID NO: 253438 - RNA, 19 nt, Homo sapiens
gcaccaccaugcccagcua

SEQ ID NO: 253439 - RNA, 19 nt, Homo sapiens
gaaagggaagccuggguuu

SEQ ID NO: 253440 - RNA, 19 nt, Homo sapiens
gagaaaccuuugugagaca

SEQ ID NO: 253441 - RNA, 19 nt, Homo sapiens
gagcagggacugucauuca

SEQ ID NO: 253442 - RNA, 19 nt, Homo sapiens
gauggagucucgcucuguu

SEQ ID NO: 253443 - RNA, 19 nt, Homo sapiens
gaaauacgccaaaauguug

SEQ ID NO: 253444 - RNA, 19 nt, Homo sapiens
gaggcuugcuugggauaua

SEQ ID NO: 253445 - RNA, 19 nt, Homo sapiens
gagaacagggaauuaaaug

SEQ ID NO: 253446 - RNA, 19 nt, Homo sapiens
gaucaacaguacccguaug

SEQ ID NO: 253447 - RNA, 19 nt, Homo sapiens
ugucauacauauccacuug

SEQ ID NO: 253448 - RNA, 19 nt, Homo sapiens
ccaaagccagaucuuauuu

SEQ ID NO: 253449 - RNA, 19 nt, Homo sapiens
gcugaagacucggcuguga

SEQ ID NO: 253450 - RNA, 19 nt, Homo sapiens
gccaaaauguugacaauga

SEQ ID NO: 253451 - RNA, 19 nt, Homo sapiens
ggcaggaacauauauuauu

SEQ ID NO: 253452 - RNA, 19 nt, Homo sapiens
ucaagaugguucauuaugg

SEQ ID NO: 253453 - RNA, 19 nt, Homo sapiens
ccaaagugcugggauuaca

SEQ ID NO: 253454 - RNA, 19 nt, Homo sapiens
agacaggguuucaccaugu

SEQ ID NO: 253455 - RNA, 19 nt, Homo sapiens
gugagaaaccuuugugaga

SEQ ID NO: 253456 - RNA, 19 nt, Homo sapiens
gggaauuaaaugugucaua

SEQ ID NO: 253457 - RNA, 19 nt, Homo sapiens
ggacugcugcugcugaaga

SEQ ID NO: 253458 - RNA, 19 nt, Homo sapiens
aggucaagaugguucauua

SEQ ID NO: 253459 - RNA, 19 nt, Homo sapiens
caccacaccugacccauag

SEQ ID NO: 253460 - RNA, 19 nt, Homo sapiens
augcccagcuaauuauuua

SEQ ID NO: 253461 - RNA, 19 nt, Homo sapiens
ggaaauacgccaaaauguu

SEQ ID NO: 253462 - RNA, 19 nt, Homo sapiens
cuugggauauagaaagaua

SEQ ID NO: 253463 - RNA, 19 nt, Homo sapiens
ccaccacaccugacccaua

SEQ ID NO: 253464 - RNA, 19 nt, Homo sapiens
ccgauuagcugggaucaca

SEQ ID NO: 253465 - RNA, 19 nt, Homo sapiens
ggacaugaacuguguuugc

SEQ ID NO: 253466 - RNA, 19 nt, Homo sapiens
gggcugcaccugacacuug

SEQ ID NO: 253467 - RNA, 19 nt, Homo sapiens
gaauuucugccaugacugu

SEQ ID NO: 253468 - RNA, 19 nt, Homo sapiens
gauugugggugacuuuuaa

SEQ ID NO: 253469 - RNA, 19 nt, Homo sapiens
gacaggguuucaccauguu

SEQ ID NO: 253470 - RNA, 19 nt, Homo sapiens
cagagaacagggaauuaaa

SEQ ID NO: 253471 - RNA, 19 nt, Homo sapiens
acagagaacagggaauuaa

SEQ ID NO: 253472 - RNA, 19 nt, Homo sapiens
gacagagaacagggaauua

SEQ ID NO: 253473 - RNA, 19 nt, Homo sapiens
uaagcaacauggugcaucu

SEQ ID NO: 253474 - RNA, 19 nt, Homo sapiens
uggaaacaaucuagauauc

SEQ ID NO: 253475 - RNA, 19 nt, Homo sapiens
auagcaaacuggaaacaau

SEQ ID NO: 253476 - RNA, 19 nt, Homo sapiens
caccauagcaaacuggaaa

SEQ ID NO: 253477 - RNA, 19 nt, Homo sapiens
ugccucagccucccgauua

SEQ ID NO: 253478 - RNA, 19 nt, Homo sapiens
gggcaggaacauauauuau

SEQ ID NO: 253479 - RNA, 19 nt, Homo sapiens
ggacagggaaggguuaaag

SEQ ID NO: 253480 - RNA, 19 nt, Homo sapiens
gcaaacuggaaacaaucua

SEQ ID NO: 253481 - RNA, 19 nt, Homo sapiens
gcccagcuaauuauuuauu

SEQ ID NO: 253482 - RNA, 19 nt, Homo sapiens
agacagagaacagggaauu

SEQ ID NO: 253483 - RNA, 19 nt, Homo sapiens
uaaagggaaauacgccaaa

SEQ ID NO: 253484 - RNA, 19 nt, Homo sapiens
ggagugcagugaggcaauc

SEQ ID NO: 253485 - RNA, 19 nt, Homo sapiens
cauggugcaucuguggaua

SEQ ID NO: 253486 - RNA, 19 nt, Homo sapiens
caacagugaggguuaagca

SEQ ID NO: 253487 - RNA, 19 nt, Homo sapiens
caaucuagauauccaacag

SEQ ID NO: 253488 - RNA, 19 nt, Homo sapiens
gcugcaaggucaagauggu

SEQ ID NO: 253489 - RNA, 19 nt, Homo sapiens
gagaggcuugcuugggaua

SEQ ID NO: 253490 - RNA, 19 nt, Homo sapiens
gugcaucuguggauagaac

SEQ ID NO: 253491 - RNA, 19 nt, Homo sapiens
uauccaacagugaggguua

SEQ ID NO: 253492 - RNA, 19 nt, Homo sapiens
ggucaagaugguucauuau

SEQ ID NO: 253493 - RNA, 19 nt, Homo sapiens
uguguaugauugucuguau

SEQ ID NO: 253494 - RNA, 19 nt, Homo sapiens
gcauagggccuuuuguuug

SEQ ID NO: 253495 - RNA, 19 nt, Homo sapiens
gagggcgauuugucugaga

SEQ ID NO: 253496 - RNA, 19 nt, Homo sapiens
guguaugauugucuguauu

SEQ ID NO: 253497 - RNA, 19 nt, Homo sapiens
ccuguaauccuggcacuuu

SEQ ID NO: 253498 - RNA, 19 nt, Homo sapiens
ggcugcaccugacacuuga

SEQ ID NO: 253499 - RNA, 19 nt, Homo sapiens
ggcaaaacccugucucaaa

SEQ ID NO: 253500 - RNA, 19 nt, Homo sapiens
ccaccaugcccagcuaauu

SEQ ID NO: 253501 - RNA, 19 nt, Homo sapiens
gcacagcugagggacaaau

SEQ ID NO: 253502 - RNA, 19 nt, Homo sapiens
ugggcaggaacauauauua

SEQ ID NO: 253503 - RNA, 19 nt, Homo sapiens
cagggaggcuaaggagaga

SEQ ID NO: 253504 - RNA, 19 nt, Homo sapiens
cagugaggguuaagcaaca

SEQ ID NO: 253505 - RNA, 19 nt, Homo sapiens
aacagggaauuaaaugugu

SEQ ID NO: 253506 - RNA, 19 nt, Homo sapiens
cugcacagcugagggacaa

SEQ ID NO: 253507 - RNA, 19 nt, Homo sapiens
cugagccuguggccagaua

SEQ ID NO: 253508 - RNA, 19 nt, Homo sapiens
caaacuggaaacaaucuag

SEQ ID NO: 253509 - RNA, 19 nt, Homo sapiens
gucaagaugguucauuaug

SEQ ID NO: 253510 - RNA, 19 nt, Homo sapiens
ucauacauauccacuugag

SEQ ID NO: 253511 - RNA, 19 nt, Homo sapiens
uuucugccaugacugugua

SEQ ID NO: 253512 - RNA, 19 nt, Homo sapiens
agagaacagggaauuaaau

SEQ ID NO: 253513 - RNA, 19 nt, Homo sapiens
acuggaaacaaucuagaua

SEQ ID NO: 253514 - RNA, 19 nt, Homo sapiens
aaacuggaaacaaucuaga

SEQ ID NO: 253515 - RNA, 19 nt, Homo sapiens
cauagggccuuuuguuugu

SEQ ID NO: 253516 - RNA, 19 nt, Homo sapiens
ggaaacaaucuagauaucc

SEQ ID NO: 253517 - RNA, 19 nt, Homo sapiens
caugcccagcuaauuauuu

SEQ ID NO: 253518 - RNA, 19 nt, Homo sapiens
uccaaagccagaucuuauu

SEQ ID NO: 253519 - RNA, 19 nt, Homo sapiens
gcaaggucaagaugguuca

SEQ ID NO: 253520 - RNA, 19 nt, Homo sapiens
gcuggaugcuuggguaacu

SEQ ID NO: 253521 - RNA, 19 nt, Homo sapiens
ggcugcagcuccugauguc

SEQ ID NO: 253522 - RNA, 19 nt, Homo sapiens
caugcugugaucccaauuu

SEQ ID NO: 253523 - RNA, 19 nt, Homo sapiens
gaaacagcaggcuacaaaa

SEQ ID NO: 253524 - RNA, 19 nt, Homo sapiens
gaacauguauucucugcau

SEQ ID NO: 253525 - RNA, 19 nt, Homo sapiens
gcacacgccugcuggaugu

SEQ ID NO: 253526 - RNA, 19 nt, Homo sapiens
gaagaagacaguccuagga

SEQ ID NO: 253527 - RNA, 19 nt, Homo sapiens
gaacguguguaauguguac

SEQ ID NO: 253528 - RNA, 19 nt, Homo sapiens
gaucucagcuggaaguucu

SEQ ID NO: 253529 - RNA, 19 nt, Homo sapiens
gugcaggugugaauaaaga

SEQ ID NO: 253530 - RNA, 19 nt, Homo sapiens
gcagauuccaccuauaauu

SEQ ID NO: 253531 - RNA, 19 nt, Homo sapiens
gcacugggaccauaccaaa

SEQ ID NO: 253532 - RNA, 19 nt, Homo sapiens
caaggaacguguguaaugu

SEQ ID NO: 253533 - RNA, 19 nt, Homo sapiens
uagcugugcuggcgucuuu

SEQ ID NO: 253534 - RNA, 19 nt, Homo sapiens
gcucaaggaacguguguaa

SEQ ID NO: 253535 - RNA, 19 nt, Homo sapiens
gacaguagaucccuauggu

SEQ ID NO: 253536 - RNA, 19 nt, Homo sapiens
auaaggaaguucuuggaaa

SEQ ID NO: 253537 - RNA, 19 nt, Homo sapiens
ucaaggaacguguguaaug

SEQ ID NO: 253538 - RNA, 19 nt, Homo sapiens
gaauaaggaaguucuugga

SEQ ID NO: 253539 - RNA, 19 nt, Homo sapiens
uagagucaguaccagguua

SEQ ID NO: 253540 - RNA, 19 nt, Homo sapiens
gugagacccuguauuucaa

SEQ ID NO: 253541 - RNA, 19 nt, Homo sapiens
guucuuggccucagugauu

SEQ ID NO: 253542 - RNA, 19 nt, Homo sapiens
cggcagauuccaccuauaa

SEQ ID NO: 253543 - RNA, 19 nt, Homo sapiens
gaccauaccaaaggagaua

SEQ ID NO: 253544 - RNA, 19 nt, Homo sapiens
uggaggaggugaucacaga

SEQ ID NO: 253545 - RNA, 19 nt, Homo sapiens
uaaggaaguucuuggaaaa

SEQ ID NO: 253546 - RNA, 19 nt, Homo sapiens
ucugugagacccuguauuu

SEQ ID NO: 253547 - RNA, 19 nt, Homo sapiens
gcuuguaccucugauuuca

SEQ ID NO: 253548 - RNA, 19 nt, Homo sapiens
gaaaccaggcaggacagua

SEQ ID NO: 253549 - RNA, 19 nt, Homo sapiens
guagaucccuaugguugga

SEQ ID NO: 253550 - RNA, 19 nt, Homo sapiens
gguuggaucucagcuggaa

SEQ ID NO: 253551 - RNA, 19 nt, Homo sapiens
gccaguaccggauuaaugu

SEQ ID NO: 253552 - RNA, 19 nt, Homo sapiens
gccaagcagccgacuauga

SEQ ID NO: 253553 - RNA, 19 nt, Homo sapiens
cagggaacauguauucucu

SEQ ID NO: 253554 - RNA, 19 nt, Homo sapiens
gugcuuguaccucugauuu

SEQ ID NO: 253555 - RNA, 19 nt, Homo sapiens
cagauuccaccuauaauuc

SEQ ID NO: 253556 - RNA, 19 nt, Homo sapiens
caaauuugcagcugaaagg

SEQ ID NO: 253557 - RNA, 19 nt, Homo sapiens
caccuauaauucugucuug

SEQ ID NO: 253558 - RNA, 19 nt, Homo sapiens
gacccuggauggugcacuu

SEQ ID NO: 253559 - RNA, 19 nt, Homo sapiens
gcacugaugagggcaccua

SEQ ID NO: 253560 - RNA, 19 nt, Homo sapiens
gcagggaacauguauucuc

SEQ ID NO: 253561 - RNA, 19 nt, Homo sapiens
gcuggaaguucuguuugga

SEQ ID NO: 253562 - RNA, 19 nt, Homo sapiens
ucaaguuccguuugcagua

SEQ ID NO: 253563 - RNA, 19 nt, Homo sapiens
ugugagacccuguauuuca

SEQ ID NO: 253564 - RNA, 19 nt, Homo sapiens
ccagccagaucagcgguuu

SEQ ID NO: 253565 - RNA, 19 nt, Homo sapiens
ccaagcagccgacuaugag

SEQ ID NO: 253566 - RNA, 19 nt, Homo sapiens
ggacaguagaucccuaugg

SEQ ID NO: 253567 - RNA, 19 nt, Homo sapiens
caggagggcuucggcagau

SEQ ID NO: 253568 - RNA, 19 nt, Homo sapiens
ggagcccauuucugugaga

SEQ ID NO: 253569 - RNA, 19 nt, Homo sapiens
guuuggagcccauuucugu

SEQ ID NO: 253570 - RNA, 19 nt, Homo sapiens
caaguuccguuugcaguac

SEQ ID NO: 253571 - RNA, 19 nt, Homo sapiens
uggagccaguaccggauua

SEQ ID NO: 253572 - RNA, 19 nt, Homo sapiens
guugugcaggugugaauaa

SEQ ID NO: 253573 - RNA, 19 nt, Homo sapiens
gaguuggaguucugcucaa

SEQ ID NO: 253574 - RNA, 19 nt, Homo sapiens
uugcugguguggauagaaa

SEQ ID NO: 253575 - RNA, 19 nt, Homo sapiens
gaggaggugaucacagaug

SEQ ID NO: 253576 - RNA, 19 nt, Homo sapiens
gcaggugugaauaaagaga

SEQ ID NO: 253577 - RNA, 19 nt, Homo sapiens
ggaacguguguaaugugua

SEQ ID NO: 253578 - RNA, 19 nt, Homo sapiens
ucagcuggaaguucuguuu

SEQ ID NO: 253579 - RNA, 19 nt, Homo sapiens
cuuugggaauccuuucuuu

SEQ ID NO: 253580 - RNA, 19 nt, Homo sapiens
gagcuugcagagcaucuug

SEQ ID NO: 253581 - RNA, 19 nt, Homo sapiens
aaaccaggcaggacaguag

SEQ ID NO: 253582 - RNA, 19 nt, Homo sapiens
gcugggaucaccgagauga

SEQ ID NO: 253583 - RNA, 19 nt, Homo sapiens
gauuccaccuauaauucug

SEQ ID NO: 253584 - RNA, 19 nt, Homo sapiens
ggagggcuucggcagauuc

SEQ ID NO: 253585 - RNA, 19 nt, Homo sapiens
cccgcuaccucaccuccua

SEQ ID NO: 253586 - RNA, 19 nt, Homo sapiens
cagcugaaaggugcuugua

SEQ ID NO: 253587 - RNA, 19 nt, Homo sapiens
aauaaggaaguucuuggaa

SEQ ID NO: 253588 - RNA, 19 nt, Homo sapiens
ccacacccucggcuacuug

SEQ ID NO: 253589 - RNA, 19 nt, Homo sapiens
caucuguguccauguguga

SEQ ID NO: 253590 - RNA, 19 nt, Homo sapiens
aggaacguguguaaugugu

SEQ ID NO: 253591 - RNA, 19 nt, Homo sapiens
acucugggcuagggcauga

SEQ ID NO: 253592 - RNA, 19 nt, Homo sapiens
uccgagcacugggaccaua

SEQ ID NO: 253593 - RNA, 19 nt, Homo sapiens
gugaauaaagagaauaagg

SEQ ID NO: 253594 - RNA, 19 nt, Homo sapiens
gugaggcagggaacaugua

SEQ ID NO: 253595 - RNA, 19 nt, Homo sapiens
uaaugugacugaggugaac

SEQ ID NO: 253596 - RNA, 19 nt, Homo sapiens
aggcagacagcacugauga

SEQ ID NO: 253597 - RNA, 19 nt, Homo sapiens
ggaccauaccaaaggagau

SEQ ID NO: 253598 - RNA, 19 nt, Homo sapiens
guagagucaguaccagguu

SEQ ID NO: 253599 - RNA, 19 nt, Homo sapiens
ggagccaguaccggauuaa

SEQ ID NO: 253600 - RNA, 19 nt, Homo sapiens
ggugugaauaaagagaaua

SEQ ID NO: 253601 - RNA, 19 nt, Homo sapiens
aggcagggaacauguauuc

SEQ ID NO: 253602 - RNA, 19 nt, Homo sapiens
uuggaguucugcucaagga

SEQ ID NO: 253603 - RNA, 19 nt, Homo sapiens
ccaccuauaauucugucuu

SEQ ID NO: 253604 - RNA, 19 nt, Homo sapiens
cugcugggaucaccgagau

SEQ ID NO: 253605 - RNA, 19 nt, Homo sapiens
gcacacgccugcuggaugu

SEQ ID NO: 253606 - RNA, 19 nt, Homo sapiens
gaagaagacaguccuagga

SEQ ID NO: 253607 - RNA, 19 nt, Homo sapiens
gcacugggaccauaccaaa

SEQ ID NO: 253608 - RNA, 19 nt, Homo sapiens
uagcugugcuggcgucuuu

SEQ ID NO: 253609 - RNA, 19 nt, Homo sapiens
guaagugacugccauuggu

SEQ ID NO: 253610 - RNA, 19 nt, Homo sapiens
uagagucaguaccagguua

SEQ ID NO: 253611 - RNA, 19 nt, Homo sapiens
agacugagauaacccacaa

SEQ ID NO: 253612 - RNA, 19 nt, Homo sapiens
gaccauaccaaaggagaua

SEQ ID NO: 253613 - RNA, 19 nt, Homo sapiens
uggaggaggugaucacaga

SEQ ID NO: 253614 - RNA, 19 nt, Homo sapiens
ccugacccuuuacuaauaa

SEQ ID NO: 253615 - RNA, 19 nt, Homo sapiens
uccugacccuuuacuaaua

SEQ ID NO: 253616 - RNA, 19 nt, Homo sapiens
ccgcugaaccugucugauu

SEQ ID NO: 253617 - RNA, 19 nt, Homo sapiens
ccucacacaugcucugaug

SEQ ID NO: 253618 - RNA, 19 nt, Homo sapiens
gccaguaccggauuaaugu

SEQ ID NO: 253619 - RNA, 19 nt, Homo sapiens
gccaagcagccgacuauga

SEQ ID NO: 253620 - RNA, 19 nt, Homo sapiens
ccucugauccucacacaug

SEQ ID NO: 253621 - RNA, 19 nt, Homo sapiens
gacccuggauggugcacuu

SEQ ID NO: 253622 - RNA, 19 nt, Homo sapiens
gcacugaugagggcaccua

SEQ ID NO: 253623 - RNA, 19 nt, Homo sapiens
ucaaguuccguuugcagua

SEQ ID NO: 253624 - RNA, 19 nt, Homo sapiens
ccagccagaucagcgguuu

SEQ ID NO: 253625 - RNA, 19 nt, Homo sapiens
ccaagcagccgacuaugag

SEQ ID NO: 253626 - RNA, 19 nt, Homo sapiens
gcccauagaccacauucau

SEQ ID NO: 253627 - RNA, 19 nt, Homo sapiens
caaguuccguuugcaguac

SEQ ID NO: 253628 - RNA, 19 nt, Homo sapiens
uggagccaguaccggauua

SEQ ID NO: 253629 - RNA, 19 nt, Homo sapiens
ucuccugacccuuuacuaa

SEQ ID NO: 253630 - RNA, 19 nt, Homo sapiens
ccauagaccacauucaucu

SEQ ID NO: 253631 - RNA, 19 nt, Homo sapiens
gaggaggugaucacagaug

SEQ ID NO: 253632 - RNA, 19 nt, Homo sapiens
cgcugaaccugucugauuc

SEQ ID NO: 253633 - RNA, 19 nt, Homo sapiens
cuuugggaauccuuucuuu

SEQ ID NO: 253634 - RNA, 19 nt, Homo sapiens
gagcuugcagagcaucuug

SEQ ID NO: 253635 - RNA, 19 nt, Homo sapiens
gcugggaucaccgagauga

SEQ ID NO: 253636 - RNA, 19 nt, Homo sapiens
gguaagugacugccauugg

SEQ ID NO: 253637 - RNA, 19 nt, Homo sapiens
cccgcuaccucaccuccua

SEQ ID NO: 253638 - RNA, 19 nt, Homo sapiens
ccacacccucggcuacuug

SEQ ID NO: 253639 - RNA, 19 nt, Homo sapiens
acucugggcuagggcauga

SEQ ID NO: 253640 - RNA, 19 nt, Homo sapiens
uccgagcacugggaccaua

SEQ ID NO: 253641 - RNA, 19 nt, Homo sapiens
uaaugugacugaggugaac

SEQ ID NO: 253642 - RNA, 19 nt, Homo sapiens
aggcagacagcacugauga

SEQ ID NO: 253643 - RNA, 19 nt, Homo sapiens
ggaccauaccaaaggagau

SEQ ID NO: 253644 - RNA, 19 nt, Homo sapiens
guagagucaguaccagguu

SEQ ID NO: 253645 - RNA, 19 nt, Homo sapiens
ggagccaguaccggauuaa

SEQ ID NO: 253646 - RNA, 19 nt, Homo sapiens
cugcugggaucaccgagau

SEQ ID NO: 253647 - RNA, 19 nt, Homo sapiens
cagacaaacucuagaauuu

SEQ ID NO: 253648 - RNA, 19 nt, Homo sapiens
caucugagcuaacuuauau

SEQ ID NO: 253649 - RNA, 19 nt, Homo sapiens
gauaggauguggauuaaga

SEQ ID NO: 253650 - RNA, 19 nt, Homo sapiens
ggauguggauuaagaacua

SEQ ID NO: 253651 - RNA, 19 nt, Homo sapiens
gaaugagaguugccuaaau

SEQ ID NO: 253652 - RNA, 19 nt, Homo sapiens
cugaagagauugaucauga

SEQ ID NO: 253653 - RNA, 19 nt, Homo sapiens
gaaagcaucugagcuaacu

SEQ ID NO: 253654 - RNA, 19 nt, Homo sapiens
aaugagaguugccuaaauu

SEQ ID NO: 253655 - RNA, 19 nt, Homo sapiens
gggcaaauauuuauaagcu

SEQ ID NO: 253656 - RNA, 19 nt, Homo sapiens
gaggaaacuuugauaggau

SEQ ID NO: 253657 - RNA, 19 nt, Homo sapiens
gaaaugaggaaacuuugau

SEQ ID NO: 253658 - RNA, 19 nt, Homo sapiens
ggaggccuguuuaccauug

SEQ ID NO: 253659 - RNA, 19 nt, Homo sapiens
ucaagaccaugaaugcaaa

SEQ ID NO: 253660 - RNA, 19 nt, Homo sapiens
uaugaagacuugaagaugu

SEQ ID NO: 253661 - RNA, 19 nt, Homo sapiens
caugaaagcaucugagcua

SEQ ID NO: 253662 - RNA, 19 nt, Homo sapiens
ugaggaaacuuugauagga

SEQ ID NO: 253663 - RNA, 19 nt, Homo sapiens
gaccaugaaugcaaagcuu

SEQ ID NO: 253664 - RNA, 19 nt, Homo sapiens
ccgagaagcugauguagag

SEQ ID NO: 253665 - RNA, 19 nt, Homo sapiens
gaaacaaacauguaagcau

SEQ ID NO: 253666 - RNA, 19 nt, Homo sapiens
gaauuaaccaagaaugaga

SEQ ID NO: 253667 - RNA, 19 nt, Homo sapiens
uaaccaagaaugagaguug

SEQ ID NO: 253668 - RNA, 19 nt, Homo sapiens
ugaaugaauugcuaagaag

SEQ ID NO: 253669 - RNA, 19 nt, Homo sapiens
ugacauuuacuguggauaa

SEQ ID NO: 253670 - RNA, 19 nt, Homo sapiens
augcaaagcuucugaugga

SEQ ID NO: 253671 - RNA, 19 nt, Homo sapiens
ugaagagauugaucaugaa

SEQ ID NO: 253672 - RNA, 19 nt, Homo sapiens
ccagacaaacucuagaauu

SEQ ID NO: 253673 - RNA, 19 nt, Homo sapiens
agaccucuuucauaacuaa

SEQ ID NO: 253674 - RNA, 19 nt, Homo sapiens
gcaucugagcuaacuuaua

SEQ ID NO: 253675 - RNA, 19 nt, Homo sapiens
gcccugugccuuaguagua

SEQ ID NO: 253676 - RNA, 19 nt, Homo sapiens
gaaaauauccauccugaag

SEQ ID NO: 253677 - RNA, 19 nt, Homo sapiens
agagauugaucaugaagau

SEQ ID NO: 253678 - RNA, 19 nt, Homo sapiens
uaccucugaucaaguauuu

SEQ ID NO: 253679 - RNA, 19 nt, Homo sapiens
uuugauaggauguggauua

SEQ ID NO: 253680 - RNA, 19 nt, Homo sapiens
aagcaucugagcuaacuua

SEQ ID NO: 253681 - RNA, 19 nt, Homo sapiens
ggagacagaaagcaagaga

SEQ ID NO: 253682 - RNA, 19 nt, Homo sapiens
augaagacuugaagaugua

SEQ ID NO: 253683 - RNA, 19 nt, Homo sapiens
gaaagcaagagaccagagu

SEQ ID NO: 253684 - RNA, 19 nt, Homo sapiens
gaauugcuaagaagggaaa

SEQ ID NO: 253685 - RNA, 19 nt, Homo sapiens
ucaccgagaagcugaugua

SEQ ID NO: 253686 - RNA, 19 nt, Homo sapiens
gaagagauugaucaugaag

SEQ ID NO: 253687 - RNA, 19 nt, Homo sapiens
cuucaugcuuucagaauuc

SEQ ID NO: 253688 - RNA, 19 nt, Homo sapiens
ggaauuaaccaagaaugag

SEQ ID NO: 253689 - RNA, 19 nt, Homo sapiens
aaauauccauccugaaggu

SEQ ID NO: 253690 - RNA, 19 nt, Homo sapiens
uugauaggauguggauuaa

SEQ ID NO: 253691 - RNA, 19 nt, Homo sapiens
aagcugauguagagagaga

SEQ ID NO: 253692 - RNA, 19 nt, Homo sapiens
gaaugcaaagcuucugaug

SEQ ID NO: 253693 - RNA, 19 nt, Homo sapiens
ugaaaugaggaaacuuuga

SEQ ID NO: 253694 - RNA, 19 nt, Homo sapiens
ccuccaaaccguugucauu

SEQ ID NO: 253695 - RNA, 19 nt, Homo sapiens
caaaacaugcuggcaguua

SEQ ID NO: 253696 - RNA, 19 nt, Homo sapiens
gagaccucuuucauaacua

SEQ ID NO: 253697 - RNA, 19 nt, Homo sapiens
gaucaugaagauaucacaa

SEQ ID NO: 253698 - RNA, 19 nt, Homo sapiens
gagauugaucaugaagaua

SEQ ID NO: 253699 - RNA, 19 nt, Homo sapiens
agaagcugauguagagaga

SEQ ID NO: 253700 - RNA, 19 nt, Homo sapiens
ggaaacaaacauguaagca

SEQ ID NO: 253701 - RNA, 19 nt, Homo sapiens
agagagagacacagaagga

SEQ ID NO: 253702 - RNA, 19 nt, Homo sapiens
gaauucgggcagugacuau

SEQ ID NO: 253703 - RNA, 19 nt, Homo sapiens
aaacaugcuggcaguuauu

SEQ ID NO: 253704 - RNA, 19 nt, Homo sapiens
acacagaaggagacagaaa

SEQ ID NO: 253705 - RNA, 19 nt, Homo sapiens
agacacagaaggagacaga

SEQ ID NO: 253706 - RNA, 19 nt, Homo sapiens
guggaggccuguuuaccau

SEQ ID NO: 253707 - RNA, 19 nt, Homo sapiens
guagagagagacacagaag

SEQ ID NO: 253708 - RNA, 19 nt, Homo sapiens
gauugaucaugaagauauc

SEQ ID NO: 253709 - RNA, 19 nt, Homo sapiens
cuaucugaaugcuuccuaa

SEQ ID NO: 253710 - RNA, 19 nt, Homo sapiens
gagaguugccuaaauucca

SEQ ID NO: 253711 - RNA, 19 nt, Homo sapiens
uggaauuaaccaagaauga

SEQ ID NO: 253712 - RNA, 19 nt, Homo sapiens
ccagaaggccagacaaacu

SEQ ID NO: 253713 - RNA, 19 nt, Homo sapiens
agaaggagacagaaagcaa

SEQ ID NO: 253714 - RNA, 19 nt, Homo sapiens
ggccagacaaacucuagaa

SEQ ID NO: 253715 - RNA, 19 nt, Homo sapiens
gaaggccagacaaacucua

SEQ ID NO: 253716 - RNA, 19 nt, Homo sapiens
uguggaaacaaacauguaa

SEQ ID NO: 253717 - RNA, 19 nt, Homo sapiens
uaagcuauuucuguaccaa

SEQ ID NO: 253718 - RNA, 19 nt, Homo sapiens
ccgcacgugucaccgagaa

SEQ ID NO: 253719 - RNA, 19 nt, Homo sapiens
agaccagagucccgggaaa

SEQ ID NO: 253720 - RNA, 19 nt, Homo sapiens
uaaaaucaagcucugcaua

SEQ ID NO: 253721 - RNA, 19 nt, Homo sapiens
gcgccucgggacaauuaua

SEQ ID NO: 253722 - RNA, 19 nt, Homo sapiens
agaaugagaguugccuaaa

SEQ ID NO: 253723 - RNA, 19 nt, Homo sapiens
aagaaugagaguugccuaa

SEQ ID NO: 253724 - RNA, 19 nt, Homo sapiens
cuguuuaccauuggaauua

SEQ ID NO: 253725 - RNA, 19 nt, Homo sapiens
ucuucaugcuuucagaauu

SEQ ID NO: 253726 - RNA, 19 nt, Homo sapiens
aucaagcucugcauacuuc

SEQ ID NO: 253727 - RNA, 19 nt, Homo sapiens
ugccuaaauuccagagaga

SEQ ID NO: 253728 - RNA, 19 nt, Homo sapiens
aaaucaagcucugcauacu

SEQ ID NO: 253729 - RNA, 19 nt, Homo sapiens
uauccauccugaagguguu

SEQ ID NO: 253730 - RNA, 19 nt, Homo sapiens
cuauuucuguaccaaagug

SEQ ID NO: 253731 - RNA, 19 nt, Homo sapiens
gauguggauuaagaacuag

SEQ ID NO: 253732 - RNA, 19 nt, Homo sapiens
uguaccagguggaguucaa

SEQ ID NO: 253733 - RNA, 19 nt, Homo sapiens
augaaagcaucugagcuaa

SEQ ID NO: 253734 - RNA, 19 nt, Homo sapiens
uaucugaaugcuuccuaaa

SEQ ID NO: 253735 - RNA, 19 nt, Homo sapiens
cuccaaaccguugucauuu

SEQ ID NO: 253736 - RNA, 19 nt, Homo sapiens
aaaacaugcuggcaguuau

SEQ ID NO: 253737 - RNA, 19 nt, Homo sapiens
gccuuaguaguauuuauga

SEQ ID NO: 253738 - RNA, 19 nt, Homo sapiens
gugccuuaguaguauuuau

SEQ ID NO: 253739 - RNA, 19 nt, Homo sapiens
augauggcccugugccuua

SEQ ID NO: 253740 - RNA, 19 nt, Homo sapiens
caccucaguuuggccagaa

SEQ ID NO: 253741 - RNA, 19 nt, Homo sapiens
cagaaggccagacaaacuc

SEQ ID NO: 253742 - RNA, 19 nt, Homo sapiens
gaagaaagauguuuauguc

SEQ ID NO: 253743 - RNA, 19 nt, Homo sapiens
gcagacagaugcaaagaaa

SEQ ID NO: 253744 - RNA, 19 nt, Homo sapiens
ggaauuugguccacugaua

SEQ ID NO: 253745 - RNA, 19 nt, Homo sapiens
gaaagauguuuaugucgua

SEQ ID NO: 253746 - RNA, 19 nt, Homo sapiens
gaaugaaccugauacacaa

SEQ ID NO: 253747 - RNA, 19 nt, Homo sapiens
uggaaucccuuucucauua

SEQ ID NO: 253748 - RNA, 19 nt, Homo sapiens
gaugcgaggccaagaauua

SEQ ID NO: 253749 - RNA, 19 nt, Homo sapiens
gcaaaccuguugagaagau

SEQ ID NO: 253750 - RNA, 19 nt, Homo sapiens
caggauguauggaauguuu

SEQ ID NO: 253751 - RNA, 19 nt, Homo sapiens
uaugggaacugaagaaaga

SEQ ID NO: 253752 - RNA, 19 nt, Homo sapiens
gaugggaacgcaagagaua

SEQ ID NO: 253753 - RNA, 19 nt, Homo sapiens
gcagguggcuucuuaacag

SEQ ID NO: 253754 - RNA, 19 nt, Homo sapiens
ccagagcagugaggucuua

SEQ ID NO: 253755 - RNA, 19 nt, Homo sapiens
gacaaguaguuauggcuaa

SEQ ID NO: 253756 - RNA, 19 nt, Homo sapiens
gcaguuagguucugaucca

SEQ ID NO: 253757 - RNA, 19 nt, Homo sapiens
guacaccugucacaaagga

SEQ ID NO: 253758 - RNA, 19 nt, Homo sapiens
gaacugaagaaagauguuu

SEQ ID NO: 253759 - RNA, 19 nt, Homo sapiens
aauggcagguggcuucuua

SEQ ID NO: 253760 - RNA, 19 nt, Homo sapiens
aaaggaagauggaauuugg

SEQ ID NO: 253761 - RNA, 19 nt, Homo sapiens
acacaauuaugaccagaaa

SEQ ID NO: 253762 - RNA, 19 nt, Homo sapiens
ugaaccugauacacaauua

SEQ ID NO: 253763 - RNA, 19 nt, Homo sapiens
caagagauacuuacaugga

SEQ ID NO: 253764 - RNA, 19 nt, Homo sapiens
gcugguggcugacgacaau

SEQ ID NO: 253765 - RNA, 19 nt, Homo sapiens
gagagaggacaaguaguua

SEQ ID NO: 253766 - RNA, 19 nt, Homo sapiens
ggaauguuucauacucuua

SEQ ID NO: 253767 - RNA, 19 nt, Homo sapiens
caagagagaggacaaguag

SEQ ID NO: 253768 - RNA, 19 nt, Homo sapiens
uuaaagacacaacggaaua

SEQ ID NO: 253769 - RNA, 19 nt, Homo sapiens
gaggagagucugcccauug

SEQ ID NO: 253770 - RNA, 19 nt, Homo sapiens
cagccuaggugacagaaug

SEQ ID NO: 253771 - RNA, 19 nt, Homo sapiens
ggaaucccuuucucauuag

SEQ ID NO: 253772 - RNA, 19 nt, Homo sapiens
ggaacgcaagagauacuua

SEQ ID NO: 253773 - RNA, 19 nt, Homo sapiens
caggaucagucccuauuau

SEQ ID NO: 253774 - RNA, 19 nt, Homo sapiens
gaauuugguccacugauau

SEQ ID NO: 253775 - RNA, 19 nt, Homo sapiens
ggucuuaggcucuggcaaa

SEQ ID NO: 253776 - RNA, 19 nt, Homo sapiens
gaggaaaaguggaagauau

SEQ ID NO: 253777 - RNA, 19 nt, Homo sapiens
ggcaagagcaagagagaaa

SEQ ID NO: 253778 - RNA, 19 nt, Homo sapiens
cugaagccauuaaagaauu

SEQ ID NO: 253779 - RNA, 19 nt, Homo sapiens
uucacaagcucaaguauga

SEQ ID NO: 253780 - RNA, 19 nt, Homo sapiens
caaaggaggcgagguucua

SEQ ID NO: 253781 - RNA, 19 nt, Homo sapiens
ugaaugaaccugauacaca

SEQ ID NO: 253782 - RNA, 19 nt, Homo sapiens
uacuauagcucaucuugga

SEQ ID NO: 253783 - RNA, 19 nt, Homo sapiens
cgcaagagauacuuacaug

SEQ ID NO: 253784 - RNA, 19 nt, Homo sapiens
gcaaguacaucaguuuuau

SEQ ID NO: 253785 - RNA, 19 nt, Homo sapiens
gagaugguguugauaaagc

SEQ ID NO: 253786 - RNA, 19 nt, Homo sapiens
gggccuucaugcuauuuaa

SEQ ID NO: 253787 - RNA, 19 nt, Homo sapiens
gcccaggaccgcuacuaua

SEQ ID NO: 253788 - RNA, 19 nt, Homo sapiens
cagcugaagccauuaaaga

SEQ ID NO: 253789 - RNA, 19 nt, Homo sapiens
caacaaggaguaugaguac

SEQ ID NO: 253790 - RNA, 19 nt, Homo sapiens
ccaguacaccugucacaaa

SEQ ID NO: 253791 - RNA, 19 nt, Homo sapiens
gcuaaggacaugaaauugu

SEQ ID NO: 253792 - RNA, 19 nt, Homo sapiens
caggaagaaugcaguguuc

SEQ ID NO: 253793 - RNA, 19 nt, Homo sapiens
aagcaaggcugcaaguaca

SEQ ID NO: 253794 - RNA, 19 nt, Homo sapiens
ccacugauauuuuaaagga

SEQ ID NO: 253795 - RNA, 19 nt, Homo sapiens
gagaggacaaguaguuaug

SEQ ID NO: 253796 - RNA, 19 nt, Homo sapiens
acaggaggaugacacagaa

SEQ ID NO: 253797 - RNA, 19 nt, Homo sapiens
ucacaaaggaggcgagguu

SEQ ID NO: 253798 - RNA, 19 nt, Homo sapiens
agagauacuuacauggaaa

SEQ ID NO: 253799 - RNA, 19 nt, Homo sapiens
caucagggacaucaucaaa

SEQ ID NO: 253800 - RNA, 19 nt, Homo sapiens
gaaccugauacacaauuau

SEQ ID NO: 253801 - RNA, 19 nt, Homo sapiens
agagagaggacaaguaguu

SEQ ID NO: 253802 - RNA, 19 nt, Homo sapiens
uugagaagauccaggagaa

SEQ ID NO: 253803 - RNA, 19 nt, Homo sapiens
aagagauacuuacauggaa

SEQ ID NO: 253804 - RNA, 19 nt, Homo sapiens
caucugugcccugcaguua

SEQ ID NO: 253805 - RNA, 19 nt, Homo sapiens
uucugaggcugaacuaaua

SEQ ID NO: 253806 - RNA, 19 nt, Homo sapiens
ucaagagagaggacaagua

SEQ ID NO: 253807 - RNA, 19 nt, Homo sapiens
gaugcuaguucccaugucu

SEQ ID NO: 253808 - RNA, 19 nt, Homo sapiens
acaacaaggaguaugagua

SEQ ID NO: 253809 - RNA, 19 nt, Homo sapiens
uggcuaaggacaugaaauu

SEQ ID NO: 253810 - RNA, 19 nt, Homo sapiens
uggagaugguguugauaaa

SEQ ID NO: 253811 - RNA, 19 nt, Homo sapiens
aggagagucugcccauuga

SEQ ID NO: 253812 - RNA, 19 nt, Homo sapiens
ugacacagaaacaccguaa

SEQ ID NO: 253813 - RNA, 19 nt, Homo sapiens
gagaagauccaggagaaca

SEQ ID NO: 253814 - RNA, 19 nt, Homo sapiens
ucguagaauuggauuggua

SEQ ID NO: 253815 - RNA, 19 nt, Homo sapiens
guacaucaguuuuaugaca

SEQ ID NO: 253816 - RNA, 19 nt, Homo sapiens
gggacaacaaggaguauga

SEQ ID NO: 253817 - RNA, 19 nt, Homo sapiens
cccaggaggucaaggcuau

SEQ ID NO: 253818 - RNA, 19 nt, Homo sapiens
gcugaagccauuaaagaau

SEQ ID NO: 253819 - RNA, 19 nt, Homo sapiens
ugacaaugcaaaccuguug

SEQ ID NO: 253820 - RNA, 19 nt, Homo sapiens
gaacgcaagagauacuuac

SEQ ID NO: 253821 - RNA, 19 nt, Homo sapiens
gaucagucccuauuaugca

SEQ ID NO: 253822 - RNA, 19 nt, Homo sapiens
ggaaaaguggaagauauua

SEQ ID NO: 253823 - RNA, 19 nt, Homo sapiens
caguacaccugucacaaag

SEQ ID NO: 253824 - RNA, 19 nt, Homo sapiens
uaugugcgcucuguaaagu

SEQ ID NO: 253825 - RNA, 19 nt, Homo sapiens
ccaugaaggugcuacuuuu

SEQ ID NO: 253826 - RNA, 19 nt, Homo sapiens
uagcaugaaugaaccugau

SEQ ID NO: 253827 - RNA, 19 nt, Homo sapiens
augcaaaccuguugagaag

SEQ ID NO: 253828 - RNA, 19 nt, Homo sapiens
uaagaugcgaggccaagaa

SEQ ID NO: 253829 - RNA, 19 nt, Homo sapiens
cauccaagucaaagaguuu

SEQ ID NO: 253830 - RNA, 19 nt, Homo sapiens
uaauguaugugcgcucugu

SEQ ID NO: 253831 - RNA, 19 nt, Homo sapiens
acaugaaauugucagaaug

SEQ ID NO: 253832 - RNA, 19 nt, Homo sapiens
ucaggaucagucccuauua

SEQ ID NO: 253833 - RNA, 19 nt, Homo sapiens
guacuccacauuccuacuu

SEQ ID NO: 253834 - RNA, 19 nt, Homo sapiens
gcaaaacccugaccaucca

SEQ ID NO: 253835 - RNA, 19 nt, Homo sapiens
ugaagccauuaaagaauuc

SEQ ID NO: 253836 - RNA, 19 nt, Homo sapiens
gaagcagacagaugcaaag

SEQ ID NO: 253837 - RNA, 19 nt, Homo sapiens
gugauugugccacugcaua

SEQ ID NO: 253838 - RNA, 19 nt, Homo sapiens
cgugguggcucaugcuugu

SEQ ID NO: 253839 - RNA, 19 nt, Homo sapiens
accagcagcuucuucauca

SEQ ID NO: 253840 - RNA, 19 nt, Homo sapiens
ggaccagaaagaacccaaa

SEQ ID NO: 253841 - RNA, 19 nt, Homo sapiens
gaaaaucuggaaucccuuu

SEQ ID NO: 253842 - RNA, 19 nt, Homo sapiens
ggacugagccucucgagaa

SEQ ID NO: 253843 - RNA, 19 nt, Homo sapiens
ggaggucacuuaccgacua

SEQ ID NO: 253844 - RNA, 19 nt, Homo sapiens
ggaaaaguguuacuacauu

SEQ ID NO: 253845 - RNA, 19 nt, Homo sapiens
gccaagaugugaucguuga

SEQ ID NO: 253846 - RNA, 19 nt, Homo sapiens
gaaccaguggcucugaaua

SEQ ID NO: 253847 - RNA, 19 nt, Homo sapiens
ccgagaagcucaccuugug

SEQ ID NO: 253848 - RNA, 19 nt, Homo sapiens
ggauauccagugaucguua

SEQ ID NO: 253849 - RNA, 19 nt, Homo sapiens
gaagugcagguuucugauu

SEQ ID NO: 253850 - RNA, 19 nt, Homo sapiens
auacagaguuguccuugga

SEQ ID NO: 253851 - RNA, 19 nt, Homo sapiens
caacgggaccaccauguau

SEQ ID NO: 253852 - RNA, 19 nt, Homo sapiens
cuagggaccugagaugcua

SEQ ID NO: 253853 - RNA, 19 nt, Homo sapiens
ccacagagacccaaguuac

SEQ ID NO: 253854 - RNA, 19 nt, Homo sapiens
gcaucgaagugcagguuuc

SEQ ID NO: 253855 - RNA, 19 nt, Homo sapiens
guuacuacauuaccaucuu

SEQ ID NO: 253856 - RNA, 19 nt, Homo sapiens
acaucaagguguccaaguu

SEQ ID NO: 253857 - RNA, 19 nt, Homo sapiens
cugauuggcucaucuucuu

SEQ ID NO: 253858 - RNA, 19 nt, Homo sapiens
cuacgguccuguccaccua

SEQ ID NO: 253859 - RNA, 19 nt, Homo sapiens
gaaccagacguggcacauu

SEQ ID NO: 253860 - RNA, 19 nt, Homo sapiens
aagcucaccuuguggucua

SEQ ID NO: 253861 - RNA, 19 nt, Homo sapiens
gaaccagugagugcuguuu

SEQ ID NO: 253862 - RNA, 19 nt, Homo sapiens
ccaacgggaccaccaugua

SEQ ID NO: 253863 - RNA, 19 nt, Homo sapiens
ccaggaaccagacagagaa

SEQ ID NO: 253864 - RNA, 19 nt, Homo sapiens
aaccagacguggcacauuc

SEQ ID NO: 253865 - RNA, 19 nt, Homo sapiens
gauauccagugaucguuac

SEQ ID NO: 253866 - RNA, 19 nt, Homo sapiens
cggcuggaauggcaaccua

SEQ ID NO: 253867 - RNA, 19 nt, Homo sapiens
ugucugugcuguacacugu

SEQ ID NO: 253868 - RNA, 19 nt, Homo sapiens
ccaccaggcugcaguucuc

SEQ ID NO: 253869 - RNA, 19 nt, Homo sapiens
gaucaacccaguggacuuc

SEQ ID NO: 253870 - RNA, 19 nt, Homo sapiens
guuguccgcugccgagaug

SEQ ID NO: 253871 - RNA, 19 nt, Homo sapiens
aagugcagguuucugauug

SEQ ID NO: 253872 - RNA, 19 nt, Homo sapiens
caucaagguguccaaguug

SEQ ID NO: 253873 - RNA, 19 nt, Homo sapiens
uuccugcgguguugccuua

SEQ ID NO: 253874 - RNA, 19 nt, Homo sapiens
gcaaggccaagaugugauc

SEQ ID NO: 253875 - RNA, 19 nt, Homo sapiens
ggcccuggauacagaguug

SEQ ID NO: 253876 - RNA, 19 nt, Homo sapiens
ugaauguggcccaggaauu

SEQ ID NO: 253877 - RNA, 19 nt, Homo sapiens
gugcaaggccaagauguga

SEQ ID NO: 253878 - RNA, 19 nt, Homo sapiens
caucuccucgaaccaauuu

SEQ ID NO: 253879 - RNA, 19 nt, Homo sapiens
gacuacagcuccacaugcu

SEQ ID NO: 253880 - RNA, 19 nt, Homo sapiens
ggaaccagacagagaaguc

SEQ ID NO: 253881 - RNA, 19 nt, Homo sapiens
gagaugaagacagcaaaca

SEQ ID NO: 253882 - RNA, 19 nt, Homo sapiens
gccaggaaccagacagaga

SEQ ID NO: 253883 - RNA, 19 nt, Homo sapiens
gaaccaacgggaccaccau

SEQ ID NO: 253884 - RNA, 19 nt, Homo sapiens
gacugagccucucgagaag

SEQ ID NO: 253885 - RNA, 19 nt, Homo sapiens
gggcguccuuggcuaccuu

SEQ ID NO: 253886 - RNA, 19 nt, Homo sapiens
gacccaaguuacccucagu

SEQ ID NO: 253887 - RNA, 19 nt, Homo sapiens
ugaagaaucauagcuugga

SEQ ID NO: 253888 - RNA, 19 nt, Homo sapiens
cagcuggagucgagagucu

SEQ ID NO: 253889 - RNA, 19 nt, Homo sapiens
gcggaccucaggaugauga

SEQ ID NO: 253890 - RNA, 19 nt, Homo sapiens
ucgaagugcagguuucuga

SEQ ID NO: 253891 - RNA, 19 nt, Homo sapiens
ggaccucaggaugaugaua

SEQ ID NO: 253892 - RNA, 19 nt, Homo sapiens
ggaucaacccaguggacuu

SEQ ID NO: 253893 - RNA, 19 nt, Homo sapiens
ccaguggcucugaauauca

SEQ ID NO: 253894 - RNA, 19 nt, Homo sapiens
cagcagcccauggaaguug

SEQ ID NO: 253895 - RNA, 19 nt, Homo sapiens
gcccacagagacccaaguu

SEQ ID NO: 253896 - RNA, 19 nt, Homo sapiens
cgagugcuccuggcaguau

SEQ ID NO: 253897 - RNA, 19 nt, Homo sapiens
ggugcaaggccaagaugug

SEQ ID NO: 253898 - RNA, 19 nt, Homo sapiens
ccuguccaccuaccacuuu

SEQ ID NO: 253899 - RNA, 19 nt, Homo sapiens
gaccucaggaugaugauac

SEQ ID NO: 253900 - RNA, 19 nt, Homo sapiens
aggaggcccuggugguaga

SEQ ID NO: 253901 - RNA, 19 nt, Homo sapiens
cagcuccgccauugaguuc

SEQ ID NO: 253902 - RNA, 19 nt, Homo sapiens
aaccaguggcucugaauau

SEQ ID NO: 253903 - RNA, 19 nt, Homo sapiens
gaggucacuuaccgacuac

SEQ ID NO: 253904 - RNA, 19 nt, Homo sapiens
aggccaagaugugaucguu

SEQ ID NO: 253905 - RNA, 19 nt, Homo sapiens
gaugaauguggcccaggaa

SEQ ID NO: 253906 - RNA, 19 nt, Homo sapiens
ggaggucacuuaccgacua

SEQ ID NO: 253907 - RNA, 19 nt, Homo sapiens
caccauacccggcuaauuu

SEQ ID NO: 253908 - RNA, 19 nt, Homo sapiens
ccacacagauggcaugauc

SEQ ID NO: 253909 - RNA, 19 nt, Homo sapiens
guaaagcucucagcauugg

SEQ ID NO: 253910 - RNA, 19 nt, Homo sapiens
ggauauccagugaucguua

SEQ ID NO: 253911 - RNA, 19 nt, Homo sapiens
uaguagagauggaguuuca

SEQ ID NO: 253912 - RNA, 19 nt, Homo sapiens
cuguaaagcucucagcauu

SEQ ID NO: 253913 - RNA, 19 nt, Homo sapiens
gugaaauggugccuguaaa

SEQ ID NO: 253914 - RNA, 19 nt, Homo sapiens
gcaguugguacucaauaaa

SEQ ID NO: 253915 - RNA, 19 nt, Homo sapiens
acaggugucucucuacguu

SEQ ID NO: 253916 - RNA, 19 nt, Homo sapiens
ucaaagugcugggauuaca

SEQ ID NO: 253917 - RNA, 19 nt, Homo sapiens
cuagggaccugagaugcua

SEQ ID NO: 253918 - RNA, 19 nt, Homo sapiens
agacuggagugcaaucaug

SEQ ID NO: 253919 - RNA, 19 nt, Homo sapiens
acaucaagguguccaaguu

SEQ ID NO: 253920 - RNA, 19 nt, Homo sapiens
ccaaagugcuaggauuaca

SEQ ID NO: 253921 - RNA, 19 nt, Homo sapiens
caccucagccucuggagua

SEQ ID NO: 253922 - RNA, 19 nt, Homo sapiens
ccgaguagcugggauuaca

SEQ ID NO: 253923 - RNA, 19 nt, Homo sapiens
gaaccagacguggcacauu

SEQ ID NO: 253924 - RNA, 19 nt, Homo sapiens
ggucccauaucauagugaa

SEQ ID NO: 253925 - RNA, 19 nt, Homo sapiens
gaaccagugagugcuguuu

SEQ ID NO: 253926 - RNA, 19 nt, Homo sapiens
auaaacggcuguugcuauc

SEQ ID NO: 253927 - RNA, 19 nt, Homo sapiens
ucccaaagugcuaggauua

SEQ ID NO: 253928 - RNA, 19 nt, Homo sapiens
ccaggaaccagacagagaa

SEQ ID NO: 253929 - RNA, 19 nt, Homo sapiens
gaacuccugaccucaagug

SEQ ID NO: 253930 - RNA, 19 nt, Homo sapiens
aaccagacguggcacauuc

SEQ ID NO: 253931 - RNA, 19 nt, Homo sapiens
caaaguguugggauuauag

SEQ ID NO: 253932 - RNA, 19 nt, Homo sapiens
gauauccagugaucguuac

SEQ ID NO: 253933 - RNA, 19 nt, Homo sapiens
gaacuccugggcucaagug

SEQ ID NO: 253934 - RNA, 19 nt, Homo sapiens
ugucugugcuguacacugu

SEQ ID NO: 253935 - RNA, 19 nt, Homo sapiens
ccaccaggcugcaguucuc

SEQ ID NO: 253936 - RNA, 19 nt, Homo sapiens
ucucaaagugcugggauua

SEQ ID NO: 253937 - RNA, 19 nt, Homo sapiens
caccaugcccagccuaauu

SEQ ID NO: 253938 - RNA, 19 nt, Homo sapiens
aauaaacggcuguugcuau

SEQ ID NO: 253939 - RNA, 19 nt, Homo sapiens
ugcaguugguacucaauaa

SEQ ID NO: 253940 - RNA, 19 nt, Homo sapiens
caucaagguguccaaguug

SEQ ID NO: 253941 - RNA, 19 nt, Homo sapiens
uuccugcgguguugccuua

SEQ ID NO: 253942 - RNA, 19 nt, Homo sapiens
ugaauguggcccaggaauu

SEQ ID NO: 253943 - RNA, 19 nt, Homo sapiens
caucuccucgaaccaauuu

SEQ ID NO: 253944 - RNA, 19 nt, Homo sapiens
gacuacagcuccacaugcu

SEQ ID NO: 253945 - RNA, 19 nt, Homo sapiens
gcuagguucucagucuguu

SEQ ID NO: 253946 - RNA, 19 nt, Homo sapiens
ggaaccagacagagaaguc

SEQ ID NO: 253947 - RNA, 19 nt, Homo sapiens
caauaaacggcuguugcua

SEQ ID NO: 253948 - RNA, 19 nt, Homo sapiens
caccucagccucucaaagu

SEQ ID NO: 253949 - RNA, 19 nt, Homo sapiens
gccaggaaccagacagaga

SEQ ID NO: 253950 - RNA, 19 nt, Homo sapiens
gaaauggugccuguaaagc

SEQ ID NO: 253951 - RNA, 19 nt, Homo sapiens
ugaaauggugccuguaaag

SEQ ID NO: 253952 - RNA, 19 nt, Homo sapiens
gaacucccagacucaagug

SEQ ID NO: 253953 - RNA, 19 nt, Homo sapiens
cuccugaccucaagugauc

SEQ ID NO: 253954 - RNA, 19 nt, Homo sapiens
ggcaugaucucagcucacu

SEQ ID NO: 253955 - RNA, 19 nt, Homo sapiens
gcggaccucaggaugauga

SEQ ID NO: 253956 - RNA, 19 nt, Homo sapiens
ggaccucaggaugaugaua

SEQ ID NO: 253957 - RNA, 19 nt, Homo sapiens
agugaaauggugccuguaa

SEQ ID NO: 253958 - RNA, 19 nt, Homo sapiens
agccuggucccauaucaua

SEQ ID NO: 253959 - RNA, 19 nt, Homo sapiens
caagugauccacccaucuc

SEQ ID NO: 253960 - RNA, 19 nt, Homo sapiens
cuccugggcucaagugauc

SEQ ID NO: 253961 - RNA, 19 nt, Homo sapiens
gcuucagccucccgaguag

SEQ ID NO: 253962 - RNA, 19 nt, Homo sapiens
cagcagcccauggaaguug

SEQ ID NO: 253963 - RNA, 19 nt, Homo sapiens
cacuguggccgaccuacua

SEQ ID NO: 253964 - RNA, 19 nt, Homo sapiens
cgagugcuccuggcaguau

SEQ ID NO: 253965 - RNA, 19 nt, Homo sapiens
uguggccgaccuacuauuu

SEQ ID NO: 253966 - RNA, 19 nt, Homo sapiens
gaccucaggaugaugauac

SEQ ID NO: 253967 - RNA, 19 nt, Homo sapiens
cacaugcaguugguacuca

SEQ ID NO: 253968 - RNA, 19 nt, Homo sapiens
gcacaugcaguugguacuc

SEQ ID NO: 253969 - RNA, 19 nt, Homo sapiens
uguaaagcucucagcauug

SEQ ID NO: 253970 - RNA, 19 nt, Homo sapiens
caucuccaccucccaaagu

SEQ ID NO: 253971 - RNA, 19 nt, Homo sapiens
ccaccauacccggcuaauu

SEQ ID NO: 253972 - RNA, 19 nt, Homo sapiens
gaggucacuuaccgacuac

SEQ ID NO: 253973 - RNA, 19 nt, Homo sapiens
ucaauaaacggcuguugcu

SEQ ID NO: 253974 - RNA, 19 nt, Homo sapiens
uggcuuggcacaugcaguu

SEQ ID NO: 253975 - RNA, 19 nt, Homo sapiens
cuuccagauucaagagauu

SEQ ID NO: 253976 - RNA, 19 nt, Homo sapiens
gaugaauguggcccaggaa

SEQ ID NO: 253977 - RNA, 19 nt, Homo sapiens
caacagaacuuccugagau

SEQ ID NO: 253978 - RNA, 19 nt, Homo sapiens
aaacuggccuguaucaaua

SEQ ID NO: 253979 - RNA, 19 nt, Homo sapiens
ucacguggcuguugauuaa

SEQ ID NO: 253980 - RNA, 19 nt, Homo sapiens
ccucuaagcuacaucuuua

SEQ ID NO: 253981 - RNA, 19 nt, Homo sapiens
ggaaagccaugacacagaa

SEQ ID NO: 253982 - RNA, 19 nt, Homo sapiens
ccacagcucuuaguaguaa

SEQ ID NO: 253983 - RNA, 19 nt, Homo sapiens
gcacuugcgcuaagaaaua

SEQ ID NO: 253984 - RNA, 19 nt, Homo sapiens
gcuaguggcuacuguauug

SEQ ID NO: 253985 - RNA, 19 nt, Homo sapiens
ccuaguaacuuucuuggua

SEQ ID NO: 253986 - RNA, 19 nt, Homo sapiens
gcagaagucuaagaaugua

SEQ ID NO: 253987 - RNA, 19 nt, Homo sapiens
gcuaagaaauaucccauug

SEQ ID NO: 253988 - RNA, 19 nt, Homo sapiens
gagcagauguacccuuuau

SEQ ID NO: 253989 - RNA, 19 nt, Homo sapiens
uaucauaucuuggugcaua

SEQ ID NO: 253990 - RNA, 19 nt, Homo sapiens
uagcuugacugaggaauua

SEQ ID NO: 253991 - RNA, 19 nt, Homo sapiens
gaaauucccuacagagucu

SEQ ID NO: 253992 - RNA, 19 nt, Homo sapiens
caaccuaguucuauagaug

SEQ ID NO: 253993 - RNA, 19 nt, Homo sapiens
gcaccaagcauuugcauug

SEQ ID NO: 253994 - RNA, 19 nt, Homo sapiens
gcacaaagcaccacugagu

SEQ ID NO: 253995 - RNA, 19 nt, Homo sapiens
gcagauguacccuuuauug

SEQ ID NO: 253996 - RNA, 19 nt, Homo sapiens
gaaaugaggaggagaguag

SEQ ID NO: 253997 - RNA, 19 nt, Homo sapiens
cuacuuacccuccaacaua

SEQ ID NO: 253998 - RNA, 19 nt, Homo sapiens
gcagacaacugguggaucu

SEQ ID NO: 253999 - RNA, 19 nt, Homo sapiens
guagaaaccacagcucuua

SEQ ID NO: 254000 - RNA, 19 nt, Homo sapiens
caaugugucugcucugauu

SEQ ID NO: 254001 - RNA, 19 nt, Homo sapiens
guacaaguuugacagaaga

SEQ ID NO: 254002 - RNA, 19 nt, Homo sapiens
gcacauuggcuguuaauca

SEQ ID NO: 254003 - RNA, 19 nt, Homo sapiens
gcacaucucccuuucuguu

SEQ ID NO: 254004 - RNA, 19 nt, Homo sapiens
gaaaccacagcucuuagua

SEQ ID NO: 254005 - RNA, 19 nt, Homo sapiens
uaagaaauaucccauugca

SEQ ID NO: 254006 - RNA, 19 nt, Homo sapiens
ccaauuggauggcguuugu

SEQ ID NO: 254007 - RNA, 19 nt, Homo sapiens
cuacaucuguuaugaaauc

SEQ ID NO: 254008 - RNA, 19 nt, Homo sapiens
uaugagacaggcuuuauua

SEQ ID NO: 254009 - RNA, 19 nt, Homo sapiens
acacacaggucccucuaaa

SEQ ID NO: 254010 - RNA, 19 nt, Homo sapiens
ggaauaugguuaauguuac

SEQ ID NO: 254011 - RNA, 19 nt, Homo sapiens
agacacagcugcccuugga

SEQ ID NO: 254012 - RNA, 19 nt, Homo sapiens
gugagcagauguacccuuu

SEQ ID NO: 254013 - RNA, 19 nt, Homo sapiens
gacgagacacccacuuaua

SEQ ID NO: 254014 - RNA, 19 nt, Homo sapiens
gcagaucaguacuguucaa

SEQ ID NO: 254015 - RNA, 19 nt, Homo sapiens
ucagauaucggcccaguaa

SEQ ID NO: 254016 - RNA, 19 nt, Homo sapiens
ggcgacacguggaagaaua

SEQ ID NO: 254017 - RNA, 19 nt, Homo sapiens
ugaaucaccugaauccaau

SEQ ID NO: 254018 - RNA, 19 nt, Homo sapiens
caaggcugcuuucacuauu

SEQ ID NO: 254019 - RNA, 19 nt, Homo sapiens
ggaguucuauaccagaguu

SEQ ID NO: 254020 - RNA, 19 nt, Homo sapiens
gcagcuccauccuggguaa

SEQ ID NO: 254021 - RNA, 19 nt, Homo sapiens
ccaggucucugcaaacuca

SEQ ID NO: 254022 - RNA, 19 nt, Homo sapiens
gagacaggcuuuauuaucc

SEQ ID NO: 254023 - RNA, 19 nt, Homo sapiens
caaaucaaccuaguucuau

SEQ ID NO: 254024 - RNA, 19 nt, Homo sapiens
ggucaucagugaaguccuu

SEQ ID NO: 254025 - RNA, 19 nt, Homo sapiens
cuacugggauguuagaugu

SEQ ID NO: 254026 - RNA, 19 nt, Homo sapiens
caagguuacugcugucaau

SEQ ID NO: 254027 - RNA, 19 nt, Homo sapiens
caaacuggccuguaucaau

SEQ ID NO: 254028 - RNA, 19 nt, Homo sapiens
uaccagaguugauuguuga

SEQ ID NO: 254029 - RNA, 19 nt, Homo sapiens
ggaaggaacgggacuccaa

SEQ ID NO: 254030 - RNA, 19 nt, Homo sapiens
gacaacagauuucucuuuu

SEQ ID NO: 254031 - RNA, 19 nt, Homo sapiens
gaaagaucccucugcuguu

SEQ ID NO: 254032 - RNA, 19 nt, Homo sapiens
cagaagcaauguaaagaca

SEQ ID NO: 254033 - RNA, 19 nt, Homo sapiens
agacaaggcugcuuucacu

SEQ ID NO: 254034 - RNA, 19 nt, Homo sapiens
aaacaaaucaaccuaguuc

SEQ ID NO: 254035 - RNA, 19 nt, Homo sapiens
ggacugguacugcuuaauc

SEQ ID NO: 254036 - RNA, 19 nt, Homo sapiens
guaauggcauacagucuag

SEQ ID NO: 254037 - RNA, 19 nt, Homo sapiens
gacaacugguggaucugua

SEQ ID NO: 254038 - RNA, 19 nt, Homo sapiens
caaagugccacgucucuau

SEQ ID NO: 254039 - RNA, 19 nt, Homo sapiens
ucacuuccauccacauuca

SEQ ID NO: 254040 - RNA, 19 nt, Homo sapiens
cagaacagccucaaaauuu

SEQ ID NO: 254041 - RNA, 19 nt, Homo sapiens
gcaaugacuauuucuaaag

SEQ ID NO: 254042 - RNA, 19 nt, Homo sapiens
ccucagcucugugaaauuc

SEQ ID NO: 254043 - RNA, 19 nt, Homo sapiens
uuacuuggauccacuguca

SEQ ID NO: 254044 - RNA, 19 nt, Homo sapiens
uuccagagcugaacugaga

SEQ ID NO: 254045 - RNA, 19 nt, Homo sapiens
gauggcuccuagauuauug

SEQ ID NO: 254046 - RNA, 19 nt, Homo sapiens
cagcacaucucccuuucug

SEQ ID NO: 254047 - RNA, 19 nt, Homo sapiens
guuaugaaauccgugugua

SEQ ID NO: 254048 - RNA, 19 nt, Homo sapiens
aaagaucccucugcuguuc

SEQ ID NO: 254049 - RNA, 19 nt, Homo sapiens
cuaggcacauuggcuguua

SEQ ID NO: 254050 - RNA, 19 nt, Homo sapiens
cagcagaucaguacuguuc

SEQ ID NO: 254051 - RNA, 19 nt, Homo sapiens
ccacauuaaugccaucaca

SEQ ID NO: 254052 - RNA, 19 nt, Homo sapiens
ggacgagacacccacuuau

SEQ ID NO: 254053 - RNA, 19 nt, Homo sapiens
uggaauguguuuagcuuga

SEQ ID NO: 254054 - RNA, 19 nt, Homo sapiens
guuaaucacuuggaaugug

SEQ ID NO: 254055 - RNA, 19 nt, Homo sapiens
ccucugcuguucaggagua

SEQ ID NO: 254056 - RNA, 19 nt, Homo sapiens
ugaaacggcacauugacua

SEQ ID NO: 254057 - RNA, 19 nt, Homo sapiens
gcacaaacaccagaagaag

SEQ ID NO: 254058 - RNA, 19 nt, Homo sapiens
ccaaaggaagacaugauuu

SEQ ID NO: 254059 - RNA, 19 nt, Homo sapiens
agaacagccucaaaauuua

SEQ ID NO: 254060 - RNA, 19 nt, Homo sapiens
gauccacugucaauauuac

SEQ ID NO: 254061 - RNA, 19 nt, Homo sapiens
gcacauacuuuuagaggau

SEQ ID NO: 254062 - RNA, 19 nt, Homo sapiens
gacgguggagagagaauua

SEQ ID NO: 254063 - RNA, 19 nt, Homo sapiens
ggagucgacccuacaaugu

SEQ ID NO: 254064 - RNA, 19 nt, Homo sapiens
agacaacagauuucucuuu

SEQ ID NO: 254065 - RNA, 19 nt, Homo sapiens
ucuggaauaugguuaaugu

SEQ ID NO: 254066 - RNA, 19 nt, Homo sapiens
uugcagaagucuaagaaug

SEQ ID NO: 254067 - RNA, 19 nt, Homo sapiens
acaaaucaaccuaguucua

SEQ ID NO: 254068 - RNA, 19 nt, Homo sapiens
aaauuuaaaucgccacaca

SEQ ID NO: 254069 - RNA, 19 nt, Homo sapiens
cuaguaacuuucuugguau

SEQ ID NO: 254070 - RNA, 19 nt, Homo sapiens
aaagguguuuguucuccua

SEQ ID NO: 254071 - RNA, 19 nt, Homo sapiens
ucucugcccacucguauua

SEQ ID NO: 254072 - RNA, 19 nt, Homo sapiens
aagggaaguuggagugauu

SEQ ID NO: 254073 - RNA, 19 nt, Homo sapiens
gaggcgaugugacugugaa

SEQ ID NO: 254074 - RNA, 19 nt, Homo sapiens
gacaugauuugcuggaucu

SEQ ID NO: 254075 - RNA, 19 nt, Homo sapiens
ggauccacugucaauauua

SEQ ID NO: 254076 - RNA, 19 nt, Homo sapiens
uggauccacugucaauauu

SEQ ID NO: 254077 - RNA, 19 nt, Homo sapiens
gaccugcucuuacauuuaa

SEQ ID NO: 254078 - RNA, 19 nt, Homo sapiens
uaaaggaccugcucuuaca

SEQ ID NO: 254079 - RNA, 19 nt, Homo sapiens
ggucucagcugggcaguuu

SEQ ID NO: 254080 - RNA, 19 nt, Homo sapiens
agagcacacuguagcauua

SEQ ID NO: 254081 - RNA, 19 nt, Homo sapiens
aaauaaaguuggugacaga

SEQ ID NO: 254082 - RNA, 19 nt, Homo sapiens
caaguuguuucauugacua

SEQ ID NO: 254083 - RNA, 19 nt, Homo sapiens
ggaccugcucuuacauuua

SEQ ID NO: 254084 - RNA, 19 nt, Homo sapiens
aaacugaagccagaaauaa

SEQ ID NO: 254085 - RNA, 19 nt, Homo sapiens
caaacugaagccagaaaua

SEQ ID NO: 254086 - RNA, 19 nt, Homo sapiens
gaaagcaucauuauuugca

SEQ ID NO: 254087 - RNA, 19 nt, Homo sapiens
gcucucagccaacgaguaa

SEQ ID NO: 254088 - RNA, 19 nt, Homo sapiens
ucgaaagcaucauuauuug

SEQ ID NO: 254089 - RNA, 19 nt, Homo sapiens
gccaacgaguaauuuauug

SEQ ID NO: 254090 - RNA, 19 nt, Homo sapiens
ccucaauccucuccuguug

SEQ ID NO: 254091 - RNA, 19 nt, Homo sapiens
uaaaugaguguguuuguca

SEQ ID NO: 254092 - RNA, 19 nt, Homo sapiens
gagguggcccaguuuguaa

SEQ ID NO: 254093 - RNA, 19 nt, Homo sapiens
gaagccagaaauaaaguug

SEQ ID NO: 254094 - RNA, 19 nt, Homo sapiens
cuauugaaguugcagauuc

SEQ ID NO: 254095 - RNA, 19 nt, Homo sapiens
uguaaaggaccugcucuua

SEQ ID NO: 254096 - RNA, 19 nt, Homo sapiens
ccugacagcuggcauguac

SEQ ID NO: 254097 - RNA, 19 nt, Homo sapiens
caacugaaacuucgaaagc

SEQ ID NO: 254098 - RNA, 19 nt, Homo sapiens
gguaaaauuccuuagcuua

SEQ ID NO: 254099 - RNA, 19 nt, Homo sapiens
gcagugccaucgagaagac

SEQ ID NO: 254100 - RNA, 19 nt, Homo sapiens
cgagguggcccaguuugua

SEQ ID NO: 254101 - RNA, 19 nt, Homo sapiens
aaaucgagguggcccaguu

SEQ ID NO: 254102 - RNA, 19 nt, Homo sapiens
aaacuucgaaagcaucauu

SEQ ID NO: 254103 - RNA, 19 nt, Homo sapiens
guuguuucauugacuauca

SEQ ID NO: 254104 - RNA, 19 nt, Homo sapiens
gcccuggaaucccugauca

SEQ ID NO: 254105 - RNA, 19 nt, Homo sapiens
guacugugcagcccuggaa

SEQ ID NO: 254106 - RNA, 19 nt, Homo sapiens
ucagccaacgaguaauuua

SEQ ID NO: 254107 - RNA, 19 nt, Homo sapiens
gcaauggcagcaugguaug

SEQ ID NO: 254108 - RNA, 19 nt, Homo sapiens
uggaaucccugaucaacgu

SEQ ID NO: 254109 - RNA, 19 nt, Homo sapiens
acacuucuucuuggucuua

SEQ ID NO: 254110 - RNA, 19 nt, Homo sapiens
gaggagcuggucaacauca

SEQ ID NO: 254111 - RNA, 19 nt, Homo sapiens
gggacccacuucacacaca

SEQ ID NO: 254112 - RNA, 19 nt, Homo sapiens
ucaggcacacuucuucuug

SEQ ID NO: 254113 - RNA, 19 nt, Homo sapiens
gacagggacccacuucaca

SEQ ID NO: 254114 - RNA, 19 nt, Homo sapiens
ggacagggacccacuucac

SEQ ID NO: 254115 - RNA, 19 nt, Homo sapiens
aggaccugcucuuacauuu

SEQ ID NO: 254116 - RNA, 19 nt, Homo sapiens
uuaaaugaguguguuuguc

SEQ ID NO: 254117 - RNA, 19 nt, Homo sapiens
cagccaacgaguaauuuau

SEQ ID NO: 254118 - RNA, 19 nt, Homo sapiens
ucucagccaacgaguaauu

SEQ ID NO: 254119 - RNA, 19 nt, Homo sapiens
agaggaugcugagcggauu

SEQ ID NO: 254120 - RNA, 19 nt, Homo sapiens
aggagucccugguaauaag

SEQ ID NO: 254121 - RNA, 19 nt, Homo sapiens
gaaguugcagauucauuuu

SEQ ID NO: 254122 - RNA, 19 nt, Homo sapiens
cagcagcucaggcacacuu

SEQ ID NO: 254123 - RNA, 19 nt, Homo sapiens
gcaucauuauuugcagaga

SEQ ID NO: 254124 - RNA, 19 nt, Homo sapiens
agaaggcuccgcucugcaa

SEQ ID NO: 254125 - RNA, 19 nt, Homo sapiens
gaggggacauugaacaagu

SEQ ID NO: 254126 - RNA, 19 nt, Homo sapiens
ccaacgaguaauuuauugu

SEQ ID NO: 254127 - RNA, 19 nt, Homo sapiens
uagagcacacuguagcauu

SEQ ID NO: 254128 - RNA, 19 nt, Homo sapiens
cuucgaaagcaucauuauu

SEQ ID NO: 254129 - RNA, 19 nt, Homo sapiens
uggcccaguuuguaaagga

SEQ ID NO: 254130 - RNA, 19 nt, Homo sapiens
agaaauaaaguuggugaca

SEQ ID NO: 254131 - RNA, 19 nt, Homo sapiens
aacugaagccagaaauaaa

SEQ ID NO: 254132 - RNA, 19 nt, Homo sapiens
ggagccaaggguucagaga

SEQ ID NO: 254133 - RNA, 19 nt, Homo sapiens
ugacagcuggcauguacug

SEQ ID NO: 254134 - RNA, 19 nt, Homo sapiens
gaagaaagccucucaguga

SEQ ID NO: 254135 - RNA, 19 nt, Homo sapiens
gaauacaucuuguuucaug

SEQ ID NO: 254136 - RNA, 19 nt, Homo sapiens
gagaauacaucuuguuuca

SEQ ID NO: 254137 - RNA, 19 nt, Homo sapiens
gagaaacaaugacuaauuc

SEQ ID NO: 254138 - RNA, 19 nt, Homo sapiens
ccacaggucuuuauguuga

SEQ ID NO: 254139 - RNA, 19 nt, Homo sapiens
aaacagagaugagguggua

SEQ ID NO: 254140 - RNA, 19 nt, Homo sapiens
ggaaacucgucguucaaua

SEQ ID NO: 254141 - RNA, 19 nt, Homo sapiens
gguaggaacuugagaacuu

SEQ ID NO: 254142 - RNA, 19 nt, Homo sapiens
ccacaaugaugaccuauau

SEQ ID NO: 254143 - RNA, 19 nt, Homo sapiens
gaaaccuccucucuacuaa

SEQ ID NO: 254144 - RNA, 19 nt, Homo sapiens
gaaaaccucugcacaguaa

SEQ ID NO: 254145 - RNA, 19 nt, Homo sapiens
gaagggauaugugaaacaa

SEQ ID NO: 254146 - RNA, 19 nt, Homo sapiens
gaaacuacugcaccauuua

SEQ ID NO: 254147 - RNA, 19 nt, Homo sapiens
gaaccuauuucucuuucuu

SEQ ID NO: 254148 - RNA, 19 nt, Homo sapiens
gaacacagucagaauaaga

SEQ ID NO: 254149 - RNA, 19 nt, Homo sapiens
caagauggguccaggauuc

SEQ ID NO: 254150 - RNA, 19 nt, Homo sapiens
ugaagucucuaacaaugua

SEQ ID NO: 254151 - RNA, 19 nt, Homo sapiens
gaagaaguacgacaucuau

SEQ ID NO: 254152 - RNA, 19 nt, Homo sapiens
ugaagaggaugcugugaaa

SEQ ID NO: 254153 - RNA, 19 nt, Homo sapiens
uaaaauagcugagggaaaa

SEQ ID NO: 254154 - RNA, 19 nt, Homo sapiens
gaaauucccaacaaacauu

SEQ ID NO: 254155 - RNA, 19 nt, Homo sapiens
aauggcagauguaaaguua

SEQ ID NO: 254156 - RNA, 19 nt, Homo sapiens
aaacuugagucacaaagaa

SEQ ID NO: 254157 - RNA, 19 nt, Homo sapiens
gggagaauccacagaauuu

SEQ ID NO: 254158 - RNA, 19 nt, Homo sapiens
caaauaauggucaaggaua

SEQ ID NO: 254159 - RNA, 19 nt, Homo sapiens
gaaaacaucuuuagagaag

SEQ ID NO: 254160 - RNA, 19 nt, Homo sapiens
caucucagguuaaguguga

SEQ ID NO: 254161 - RNA, 19 nt, Homo sapiens
uaauuagcaucucagguua

SEQ ID NO: 254162 - RNA, 19 nt, Homo sapiens
gaggagcagaggauaauua

SEQ ID NO: 254163 - RNA, 19 nt, Homo sapiens
ugaggcaggugaauuguuu

SEQ ID NO: 254164 - RNA, 19 nt, Homo sapiens
ggaggaaaccgacucugua

SEQ ID NO: 254165 - RNA, 19 nt, Homo sapiens
caagaaaugaguauaggua

SEQ ID NO: 254166 - RNA, 19 nt, Homo sapiens
gggaauaccuguggugguu

SEQ ID NO: 254167 - RNA, 19 nt, Homo sapiens
ggagacagccguaguagau

SEQ ID NO: 254168 - RNA, 19 nt, Homo sapiens
ugaaacuacugcaccauuu

SEQ ID NO: 254169 - RNA, 19 nt, Homo sapiens
ugacugagcuucaaugcau

SEQ ID NO: 254170 - RNA, 19 nt, Homo sapiens
gaggugguaucuucacgua

SEQ ID NO: 254171 - RNA, 19 nt, Homo sapiens
ucacaaagaacauguagaa

SEQ ID NO: 254172 - RNA, 19 nt, Homo sapiens
caugaagucucuaacaaug

SEQ ID NO: 254173 - RNA, 19 nt, Homo sapiens
gaaaugaguauagguaaga

SEQ ID NO: 254174 - RNA, 19 nt, Homo sapiens
gaaaauagcuccggaaacu

SEQ ID NO: 254175 - RNA, 19 nt, Homo sapiens
gcacugaagggauauguga

SEQ ID NO: 254176 - RNA, 19 nt, Homo sapiens
guucaaacauuuaccaauc

SEQ ID NO: 254177 - RNA, 19 nt, Homo sapiens
gcagaugccuauuuuauga

SEQ ID NO: 254178 - RNA, 19 nt, Homo sapiens
cgacaaacaagauaagaaa

SEQ ID NO: 254179 - RNA, 19 nt, Homo sapiens
uaggaaagcuugaguaaaa

SEQ ID NO: 254180 - RNA, 19 nt, Homo sapiens
ggugaaaccuccucucuac

SEQ ID NO: 254181 - RNA, 19 nt, Homo sapiens
ucauaguacuccugcuuua

SEQ ID NO: 254182 - RNA, 19 nt, Homo sapiens
cgucgcaggugcaaucaua

SEQ ID NO: 254183 - RNA, 19 nt, Homo sapiens
aaagaaguaugggaaauga

SEQ ID NO: 254184 - RNA, 19 nt, Homo sapiens
ggugguaucuucacguaga

SEQ ID NO: 254185 - RNA, 19 nt, Homo sapiens
gaucuauacuugcuuugug

SEQ ID NO: 254186 - RNA, 19 nt, Homo sapiens
ggaagaaguacgacaucua

SEQ ID NO: 254187 - RNA, 19 nt, Homo sapiens
gcugugaaauucccaacaa

SEQ ID NO: 254188 - RNA, 19 nt, Homo sapiens
guaggaacuugagaacuuu

SEQ ID NO: 254189 - RNA, 19 nt, Homo sapiens
gcauugauauuugugcauu

SEQ ID NO: 254190 - RNA, 19 nt, Homo sapiens
ccucaguucuugccacuuu

SEQ ID NO: 254191 - RNA, 19 nt, Homo sapiens
uagagaaggccaauacuuu

SEQ ID NO: 254192 - RNA, 19 nt, Homo sapiens
acuauacucucuacuauug

SEQ ID NO: 254193 - RNA, 19 nt, Homo sapiens
ugaguaaucugagaaacaa

SEQ ID NO: 254194 - RNA, 19 nt, Homo sapiens
gaggauaauuagcaucuca

SEQ ID NO: 254195 - RNA, 19 nt, Homo sapiens
gaaccauguuuguggcuau

SEQ ID NO: 254196 - RNA, 19 nt, Homo sapiens
gaugauagugguggaguua

SEQ ID NO: 254197 - RNA, 19 nt, Homo sapiens
caaauuguagucuauggua

SEQ ID NO: 254198 - RNA, 19 nt, Homo sapiens
ggaaaccgacucuguagug

SEQ ID NO: 254199 - RNA, 19 nt, Homo sapiens
gaaacucgucguucaauag

SEQ ID NO: 254200 - RNA, 19 nt, Homo sapiens
ggaaauuaguaggcucauu

SEQ ID NO: 254201 - RNA, 19 nt, Homo sapiens
aaaggaaguuaugggaaua

SEQ ID NO: 254202 - RNA, 19 nt, Homo sapiens
gagcagaggauaauuagca

SEQ ID NO: 254203 - RNA, 19 nt, Homo sapiens
gaaacucagccaccuguga

SEQ ID NO: 254204 - RNA, 19 nt, Homo sapiens
agagaaauguggagaauac

SEQ ID NO: 254205 - RNA, 19 nt, Homo sapiens
ucucugccauaaaugauua

SEQ ID NO: 254206 - RNA, 19 nt, Homo sapiens
ccugagggaucuauacuug

SEQ ID NO: 254207 - RNA, 19 nt, Homo sapiens
uggcagauguaaaguuauu

SEQ ID NO: 254208 - RNA, 19 nt, Homo sapiens
ggagaagaguguggaguca

SEQ ID NO: 254209 - RNA, 19 nt, Homo sapiens
aaacauugaugcugacagu

SEQ ID NO: 254210 - RNA, 19 nt, Homo sapiens
cuauuuagauggccaugaa

SEQ ID NO: 254211 - RNA, 19 nt, Homo sapiens
aagaaacccucacucucua

SEQ ID NO: 254212 - RNA, 19 nt, Homo sapiens
ucacaccacugcacucuag

SEQ ID NO: 254213 - RNA, 19 nt, Homo sapiens
ugaaaccuccucucuacua

SEQ ID NO: 254214 - RNA, 19 nt, Homo sapiens
ccagcaggcuucaaacuag

SEQ ID NO: 254215 - RNA, 19 nt, Homo sapiens
agaagaguguggagucauu

SEQ ID NO: 254216 - RNA, 19 nt, Homo sapiens
uuuguuaucugggaacuua

SEQ ID NO: 254217 - RNA, 19 nt, Homo sapiens
aaaccauccuucaauauag

SEQ ID NO: 254218 - RNA, 19 nt, Homo sapiens
ugaccaaagugaaggauuc

SEQ ID NO: 254219 - RNA, 19 nt, Homo sapiens
gauaagaaacccucacucu

SEQ ID NO: 254220 - RNA, 19 nt, Homo sapiens
gaaguagaagucaauaaca

SEQ ID NO: 254221 - RNA, 19 nt, Homo sapiens
gacaauggcagauguaaag

SEQ ID NO: 254222 - RNA, 19 nt, Homo sapiens
uaagaaacccucacucucu

SEQ ID NO: 254223 - RNA, 19 nt, Homo sapiens
cagggauuguuucuguuua

SEQ ID NO: 254224 - RNA, 19 nt, Homo sapiens
guaggcucauuuacuguuu

SEQ ID NO: 254225 - RNA, 19 nt, Homo sapiens
gaauaccuguggugguugu

SEQ ID NO: 254226 - RNA, 19 nt, Homo sapiens
cagcucaaauuguagucua

SEQ ID NO: 254227 - RNA, 19 nt, Homo sapiens
gcaggugaauuguuugaac

SEQ ID NO: 254228 - RNA, 19 nt, Homo sapiens
ccacacaacauauccguau

SEQ ID NO: 254229 - RNA, 19 nt, Homo sapiens
cgacaucuaugagaagcaa

SEQ ID NO: 254230 - RNA, 19 nt, Homo sapiens
ugagagaaauguggagaau

SEQ ID NO: 254231 - RNA, 19 nt, Homo sapiens
gugagaauccagaauuuga

SEQ ID NO: 254232 - RNA, 19 nt, Homo sapiens
gcacaguaauauggacaug

SEQ ID NO: 254233 - RNA, 19 nt, Homo sapiens
ucaauaacagccaaacuga

SEQ ID NO: 254234 - RNA, 19 nt, Homo sapiens
ggaagaccaucauuacuaa

SEQ ID NO: 254235 - RNA, 19 nt, Homo sapiens
gggcuuggaucaugcauua

SEQ ID NO: 254236 - RNA, 19 nt, Homo sapiens
gaucagaaguucaaaguuc

SEQ ID NO: 254237 - RNA, 19 nt, Homo sapiens
ggccaaauguucaauauga

SEQ ID NO: 254238 - RNA, 19 nt, Homo sapiens
aaaugaaacccgacaauua

SEQ ID NO: 254239 - RNA, 19 nt, Homo sapiens
gcuaucggaugcuuauaua

SEQ ID NO: 254240 - RNA, 19 nt, Homo sapiens
gaaauuaagcugaaaugga

SEQ ID NO: 254241 - RNA, 19 nt, Homo sapiens
gugaagaccuaucgaagaa

SEQ ID NO: 254242 - RNA, 19 nt, Homo sapiens
gggcagaaacuacuuauug

SEQ ID NO: 254243 - RNA, 19 nt, Homo sapiens
gaugaaggcuauuugaagu

SEQ ID NO: 254244 - RNA, 19 nt, Homo sapiens
guuaauggaucaucagaga

SEQ ID NO: 254245 - RNA, 19 nt, Homo sapiens
guaagaagcaaagugaaua

SEQ ID NO: 254246 - RNA, 19 nt, Homo sapiens
ggaugcagauuucccuauu

SEQ ID NO: 254247 - RNA, 19 nt, Homo sapiens
ugugauacaugaagacuuu

SEQ ID NO: 254248 - RNA, 19 nt, Homo sapiens
gcaucagacuauaaagauu

SEQ ID NO: 254249 - RNA, 19 nt, Homo sapiens
gaugcagauuucccuauuu

SEQ ID NO: 254250 - RNA, 19 nt, Homo sapiens
ccuaucagauccaguuauu

SEQ ID NO: 254251 - RNA, 19 nt, Homo sapiens
guaguaagaagcaaaguga

SEQ ID NO: 254252 - RNA, 19 nt, Homo sapiens
gauaucaccacaaggaauu

SEQ ID NO: 254253 - RNA, 19 nt, Homo sapiens
caaaguuccugggcagaaa

SEQ ID NO: 254254 - RNA, 19 nt, Homo sapiens
gaacuaaaauaccgaaaca

SEQ ID NO: 254255 - RNA, 19 nt, Homo sapiens
caugaagacuuuccauauc

SEQ ID NO: 254256 - RNA, 19 nt, Homo sapiens
ggaggcaucagacuauaaa

SEQ ID NO: 254257 - RNA, 19 nt, Homo sapiens
gcauagguguacuucuuga

SEQ ID NO: 254258 - RNA, 19 nt, Homo sapiens
ccacaaggaauuccagaaa

SEQ ID NO: 254259 - RNA, 19 nt, Homo sapiens
ccauuugguuucaucuuaa

SEQ ID NO: 254260 - RNA, 19 nt, Homo sapiens
gagaggcaauaucaagguu

SEQ ID NO: 254261 - RNA, 19 nt, Homo sapiens
caagagacaugguauugac

SEQ ID NO: 254262 - RNA, 19 nt, Homo sapiens
caaaugaaacccgacaauu

SEQ ID NO: 254263 - RNA, 19 nt, Homo sapiens
gaaauggagcauaccuuug

SEQ ID NO: 254264 - RNA, 19 nt, Homo sapiens
uggcauagguguacuucuu

SEQ ID NO: 254265 - RNA, 19 nt, Homo sapiens
aaacauugguagugaaaca

SEQ ID NO: 254266 - RNA, 19 nt, Homo sapiens
gaagaccuaucgaagaaaa

SEQ ID NO: 254267 - RNA, 19 nt, Homo sapiens
ugaaauggagcauaccuuu

SEQ ID NO: 254268 - RNA, 19 nt, Homo sapiens
acaaauggaucagaaguuc

SEQ ID NO: 254269 - RNA, 19 nt, Homo sapiens
ggaaugcacaguggaauau

SEQ ID NO: 254270 - RNA, 19 nt, Homo sapiens
ggagagaggcaauaucaag

SEQ ID NO: 254271 - RNA, 19 nt, Homo sapiens
caugugaaauuaagcugaa

SEQ ID NO: 254272 - RNA, 19 nt, Homo sapiens
gcauuacaguguguugauu

SEQ ID NO: 254273 - RNA, 19 nt, Homo sapiens
gccauaaccuggucagaag

SEQ ID NO: 254274 - RNA, 19 nt, Homo sapiens
cuaacggucuuccggauga

SEQ ID NO: 254275 - RNA, 19 nt, Homo sapiens
gagaagaugauacuaccuu

SEQ ID NO: 254276 - RNA, 19 nt, Homo sapiens
aauauaggaugcagauuuc

SEQ ID NO: 254277 - RNA, 19 nt, Homo sapiens
gcgaagauacacacgcuuu

SEQ ID NO: 254278 - RNA, 19 nt, Homo sapiens
uggagugaguggagugaua

SEQ ID NO: 254279 - RNA, 19 nt, Homo sapiens
aaauugagaucagagaaga

SEQ ID NO: 254280 - RNA, 19 nt, Homo sapiens
gcagauuucccuauuugga

SEQ ID NO: 254281 - RNA, 19 nt, Homo sapiens
ggcaauauuuacucuguuc

SEQ ID NO: 254282 - RNA, 19 nt, Homo sapiens
uggaagaccaucauuacua

SEQ ID NO: 254283 - RNA, 19 nt, Homo sapiens
ugaguggagugauaaacaa

SEQ ID NO: 254284 - RNA, 19 nt, Homo sapiens
gaaauugagaucagagaag

SEQ ID NO: 254285 - RNA, 19 nt, Homo sapiens
uaucagauccaguuauuuc

SEQ ID NO: 254286 - RNA, 19 nt, Homo sapiens
ggcagaaacuacuuauugg

SEQ ID NO: 254287 - RNA, 19 nt, Homo sapiens
ggugaagaccuaucgaaga

SEQ ID NO: 254288 - RNA, 19 nt, Homo sapiens
ggagugaguggagugauaa

SEQ ID NO: 254289 - RNA, 19 nt, Homo sapiens
aaugaaacccgacaauuau

SEQ ID NO: 254290 - RNA, 19 nt, Homo sapiens
ggaugaaggcuauuugaag

SEQ ID NO: 254291 - RNA, 19 nt, Homo sapiens
gcaaugcacaaauggauca

SEQ ID NO: 254292 - RNA, 19 nt, Homo sapiens
uagguuaucucuauuugca

SEQ ID NO: 254293 - RNA, 19 nt, Homo sapiens
gcacaacauuuggcuguac

SEQ ID NO: 254294 - RNA, 19 nt, Homo sapiens
gaagaaaacuuugcuacgu

SEQ ID NO: 254295 - RNA, 19 nt, Homo sapiens
caucagagaacaagccuau

SEQ ID NO: 254296 - RNA, 19 nt, Homo sapiens
ugauaccaauuacaacuug

SEQ ID NO: 254297 - RNA, 19 nt, Homo sapiens
gcacaaauggaucagaagu

SEQ ID NO: 254298 - RNA, 19 nt, Homo sapiens
gaagauacacacgcuuuua

SEQ ID NO: 254299 - RNA, 19 nt, Homo sapiens
gaccaucauuacuaagaau

SEQ ID NO: 254300 - RNA, 19 nt, Homo sapiens
cacugucucuggaucauuu

SEQ ID NO: 254301 - RNA, 19 nt, Homo sapiens
ugaaacauacaccuugaaa

SEQ ID NO: 254302 - RNA, 19 nt, Homo sapiens
gcagaaacuacuuauugga

SEQ ID NO: 254303 - RNA, 19 nt, Homo sapiens
ccauggcaaugcacaaaug

SEQ ID NO: 254304 - RNA, 19 nt, Homo sapiens
aaugaaacauacaccuuga

SEQ ID NO: 254305 - RNA, 19 nt, Homo sapiens
gagaacaagccuaucagau

SEQ ID NO: 254306 - RNA, 19 nt, Homo sapiens
gguuaucucuauuugcaau

SEQ ID NO: 254307 - RNA, 19 nt, Homo sapiens
ugaagacuuuccauaucaa

SEQ ID NO: 254308 - RNA, 19 nt, Homo sapiens
cauuacaguguguugauua

SEQ ID NO: 254309 - RNA, 19 nt, Homo sapiens
gguaugagggcuuggauca

SEQ ID NO: 254310 - RNA, 19 nt, Homo sapiens
cugauaagcacaacauuug

SEQ ID NO: 254311 - RNA, 19 nt, Homo sapiens
cgaaacauugguagugaaa

SEQ ID NO: 254312 - RNA, 19 nt, Homo sapiens
gagacaugguauugacuca

SEQ ID NO: 254313 - RNA, 19 nt, Homo sapiens
caagguguuuugauuauga

SEQ ID NO: 254314 - RNA, 19 nt, Homo sapiens
agaacaagccuaucagauc

SEQ ID NO: 254315 - RNA, 19 nt, Homo sapiens
ucagagaacaagccuauca

SEQ ID NO: 254316 - RNA, 19 nt, Homo sapiens
caaggaauuccagaaacua

SEQ ID NO: 254317 - RNA, 19 nt, Homo sapiens
gaucuuaacaagggcauug

SEQ ID NO: 254318 - RNA, 19 nt, Homo sapiens
uugcucagaugacggaauu

SEQ ID NO: 254319 - RNA, 19 nt, Homo sapiens
gcauugaagcgaagauaca

SEQ ID NO: 254320 - RNA, 19 nt, Homo sapiens
augaagacuuuccauauca

SEQ ID NO: 254321 - RNA, 19 nt, Homo sapiens
acaugaagacuuuccauau

SEQ ID NO: 254322 - RNA, 19 nt, Homo sapiens
acaaggaauuccagaaacu

SEQ ID NO: 254323 - RNA, 19 nt, Homo sapiens
agaccaucauuacuaagaa

SEQ ID NO: 254324 - RNA, 19 nt, Homo sapiens
gcuauuugaagucgccaua

SEQ ID NO: 254325 - RNA, 19 nt, Homo sapiens
ccagcaagguguuuugauu

SEQ ID NO: 254326 - RNA, 19 nt, Homo sapiens
aagcugaaauggagcauac

SEQ ID NO: 254327 - RNA, 19 nt, Homo sapiens
gauccaguuauuucacuuu

SEQ ID NO: 254328 - RNA, 19 nt, Homo sapiens
ggaauuccagaaacuaaag

SEQ ID NO: 254329 - RNA, 19 nt, Homo sapiens
ggauaucaccacaaggaau

SEQ ID NO: 254330 - RNA, 19 nt, Homo sapiens
acucaacaguuuccaguca

SEQ ID NO: 254331 - RNA, 19 nt, Homo sapiens
cauaucaagagacauggua

SEQ ID NO: 254332 - RNA, 19 nt, Homo sapiens
gcucagaugacggaauuug

SEQ ID NO: 254333 - RNA, 19 nt, Homo sapiens
cuucagacaccgagauaaa

SEQ ID NO: 254334 - RNA, 19 nt, Homo sapiens
gcaaacagaggaagaauuu

SEQ ID NO: 254335 - RNA, 19 nt, Homo sapiens
gcacagaaaucaauguuag

SEQ ID NO: 254336 - RNA, 19 nt, Homo sapiens
gaugaacucuuagaaauga

SEQ ID NO: 254337 - RNA, 19 nt, Homo sapiens
cagaugaacucuuagaaau

SEQ ID NO: 254338 - RNA, 19 nt, Homo sapiens
gcaaugaagugcuuucucu

SEQ ID NO: 254339 - RNA, 19 nt, Homo sapiens
ggaagaauuuguuaucagu

SEQ ID NO: 254340 - RNA, 19 nt, Homo sapiens
uggaucagaugaacucuua

SEQ ID NO: 254341 - RNA, 19 nt, Homo sapiens
ggagcaauguuccaucaug

SEQ ID NO: 254342 - RNA, 19 nt, Homo sapiens
gaacuucucucagacuuac

SEQ ID NO: 254343 - RNA, 19 nt, Homo sapiens
gaaucuggaugcaaagaau

SEQ ID NO: 254344 - RNA, 19 nt, Homo sapiens
gaggaagaauuuguuauca

SEQ ID NO: 254345 - RNA, 19 nt, Homo sapiens
caacacuucuugauugcaa

SEQ ID NO: 254346 - RNA, 19 nt, Homo sapiens
aaaccacauuugagaagua

SEQ ID NO: 254347 - RNA, 19 nt, Homo sapiens
gaagaacuauaugugaauc

SEQ ID NO: 254348 - RNA, 19 nt, Homo sapiens
gagcaauguuccaucaugu

SEQ ID NO: 254349 - RNA, 19 nt, Homo sapiens
uaagggugauagucaaauu

SEQ ID NO: 254350 - RNA, 19 nt, Homo sapiens
cuacuuguguuuacuucua

SEQ ID NO: 254351 - RNA, 19 nt, Homo sapiens
caaagaaugugaggaacug

SEQ ID NO: 254352 - RNA, 19 nt, Homo sapiens
caacugggugaauguaaua

SEQ ID NO: 254353 - RNA, 19 nt, Homo sapiens
gcagauagccagcccauac

SEQ ID NO: 254354 - RNA, 19 nt, Homo sapiens
ugaauccucuucuuuauac

SEQ ID NO: 254355 - RNA, 19 nt, Homo sapiens
ucauugacuuccuuacuaa

SEQ ID NO: 254356 - RNA, 19 nt, Homo sapiens
gaagccaacugggugaaug

SEQ ID NO: 254357 - RNA, 19 nt, Homo sapiens
uuucaaaugugcugucaaa

SEQ ID NO: 254358 - RNA, 19 nt, Homo sapiens
gaauuucgaaaccacauuu

SEQ ID NO: 254359 - RNA, 19 nt, Homo sapiens
agccagcucuucuucaaua

SEQ ID NO: 254360 - RNA, 19 nt, Homo sapiens
acuaugaacuucucucaga

SEQ ID NO: 254361 - RNA, 19 nt, Homo sapiens
caaaguaacagcaaugaag

SEQ ID NO: 254362 - RNA, 19 nt, Homo sapiens
aaacaucacucugcugcuu

SEQ ID NO: 254363 - RNA, 19 nt, Homo sapiens
ggaguuacaaguuauuuca

SEQ ID NO: 254364 - RNA, 19 nt, Homo sapiens
ccacauuugagaaguauuu

SEQ ID NO: 254365 - RNA, 19 nt, Homo sapiens
gaugcaaguauucaugaua

SEQ ID NO: 254366 - RNA, 19 nt, Homo sapiens
gaaaccacauuugagaagu

SEQ ID NO: 254367 - RNA, 19 nt, Homo sapiens
cagacuuacuuuacucauu

SEQ ID NO: 254368 - RNA, 19 nt, Homo sapiens
guccggagaugcaaguauu

SEQ ID NO: 254369 - RNA, 19 nt, Homo sapiens
uaaugggaauguaacagaa

SEQ ID NO: 254370 - RNA, 19 nt, Homo sapiens
gggugaauguaauaaguga

SEQ ID NO: 254371 - RNA, 19 nt, Homo sapiens
guauuuccauccagugcua

SEQ ID NO: 254372 - RNA, 19 nt, Homo sapiens
gagaugcaaguauucauga

SEQ ID NO: 254373 - RNA, 19 nt, Homo sapiens
gugaauccucuucuuuaua

SEQ ID NO: 254374 - RNA, 19 nt, Homo sapiens
gaucagaugaacucuuaga

SEQ ID NO: 254375 - RNA, 19 nt, Homo sapiens
ccaacugggugaauguaau

SEQ ID NO: 254376 - RNA, 19 nt, Homo sapiens
ggugauagucaaauuaugu

SEQ ID NO: 254377 - RNA, 19 nt, Homo sapiens
ucagaugaacucuuagaaa

SEQ ID NO: 254378 - RNA, 19 nt, Homo sapiens
caaaugugcugucaaaaca

SEQ ID NO: 254379 - RNA, 19 nt, Homo sapiens
ggagaugcaaguauucaug

SEQ ID NO: 254380 - RNA, 19 nt, Homo sapiens
aaacagaggaagaauuugu

SEQ ID NO: 254381 - RNA, 19 nt, Homo sapiens
gagcacagaaaucaauguu

SEQ ID NO: 254382 - RNA, 19 nt, Homo sapiens
cucauugacuuccuuacua

SEQ ID NO: 254383 - RNA, 19 nt, Homo sapiens
gcaauguuccaucauguuc

SEQ ID NO: 254384 - RNA, 19 nt, Homo sapiens
gcaaaguaacagcaaugaa

SEQ ID NO: 254385 - RNA, 19 nt, Homo sapiens
gcauucaugucuucauuuu

SEQ ID NO: 254386 - RNA, 19 nt, Homo sapiens
guaaugagaauuucgaaac

SEQ ID NO: 254387 - RNA, 19 nt, Homo sapiens
ccucuucuuuauacuguaa

SEQ ID NO: 254388 - RNA, 19 nt, Homo sapiens
gaaaucaauguuagcagau

SEQ ID NO: 254389 - RNA, 19 nt, Homo sapiens
ugugaauccucuucuuuau

SEQ ID NO: 254390 - RNA, 19 nt, Homo sapiens
gaagcuggcauucaugucu

SEQ ID NO: 254391 - RNA, 19 nt, Homo sapiens
gugaggaacuggaggaaaa

SEQ ID NO: 254392 - RNA, 19 nt, Homo sapiens
ggauuuaccguggcuuuga

SEQ ID NO: 254393 - RNA, 19 nt, Homo sapiens
cagcucuucuucaauacuu

SEQ ID NO: 254394 - RNA, 19 nt, Homo sapiens
acagaggaagaauuuguua

SEQ ID NO: 254395 - RNA, 19 nt, Homo sapiens
ucacucugcugcuuagaca

SEQ ID NO: 254396 - RNA, 19 nt, Homo sapiens
uggcauucaugucuucauu

SEQ ID NO: 254397 - RNA, 19 nt, Homo sapiens
ucacauggagcacagaaau

SEQ ID NO: 254398 - RNA, 19 nt, Homo sapiens
gcaaagaaugugaggaacu

SEQ ID NO: 254399 - RNA, 19 nt, Homo sapiens
ugaagugcuuucucuugga

SEQ ID NO: 254400 - RNA, 19 nt, Homo sapiens
uaugugaauccucuucuuu

SEQ ID NO: 254401 - RNA, 19 nt, Homo sapiens
uccaauauauggccaugug

SEQ ID NO: 254402 - RNA, 19 nt, Homo sapiens
ccagugcuacuuguguuua

SEQ ID NO: 254403 - RNA, 19 nt, Homo sapiens
guuuaagggugauagucaa

SEQ ID NO: 254404 - RNA, 19 nt, Homo sapiens
uaacaaaacacucggcauu

SEQ ID NO: 254405 - RNA, 19 nt, Homo sapiens
gcagaguuuuguacauauu

SEQ ID NO: 254406 - RNA, 19 nt, Homo sapiens
uuacuaagcauagcaaaca

SEQ ID NO: 254407 - RNA, 19 nt, Homo sapiens
cuaaugggaauguaacaga

SEQ ID NO: 254408 - RNA, 19 nt, Homo sapiens
ugagaaguauuuccaucca

SEQ ID NO: 254409 - RNA, 19 nt, Homo sapiens
uaccaaugcugcaggucaa

SEQ ID NO: 254410 - RNA, 19 nt, Homo sapiens
ucacuugaguccggagaug

SEQ ID NO: 254411 - RNA, 19 nt, Homo sapiens
gaucuuauucaaucuaugc

SEQ ID NO: 254412 - RNA, 19 nt, Homo sapiens
gcucuucuucaauacuuaa

SEQ ID NO: 254413 - RNA, 19 nt, Homo sapiens
gucauugaguaauauagug

SEQ ID NO: 254414 - RNA, 19 nt, Homo sapiens
gcuacuuuauauacggaaa

SEQ ID NO: 254415 - RNA, 19 nt, Homo sapiens
auagccagcucuucuucaa

SEQ ID NO: 254416 - RNA, 19 nt, Homo sapiens
cgaaaccacauuugagaag

SEQ ID NO: 254417 - RNA, 19 nt, Homo sapiens
ugacuacuggcucucauug

SEQ ID NO: 254418 - RNA, 19 nt, Homo sapiens
ugaacuucucucagacuua

SEQ ID NO: 254419 - RNA, 19 nt, Homo sapiens
gaccuuggaucagaugaac

SEQ ID NO: 254420 - RNA, 19 nt, Homo sapiens
cauauuguccaaauguuca

SEQ ID NO: 254421 - RNA, 19 nt, Homo sapiens
gauggauggcugcuggaaa

SEQ ID NO: 254422 - RNA, 19 nt, Homo sapiens
gcucucauugacuuccuua

SEQ ID NO: 254423 - RNA, 19 nt, Homo sapiens
gggugauagucaaauuaug

SEQ ID NO: 254424 - RNA, 19 nt, Homo sapiens
agaggaagaauuuguuauc

SEQ ID NO: 254425 - RNA, 19 nt, Homo sapiens
cuucuucaauacuuaagga

SEQ ID NO: 254426 - RNA, 19 nt, Homo sapiens
aagggugauagucaaauua

SEQ ID NO: 254427 - RNA, 19 nt, Homo sapiens
uaccguggcuuugaguaau

SEQ ID NO: 254428 - RNA, 19 nt, Homo sapiens
aaugaagugcuuucucuug

SEQ ID NO: 254429 - RNA, 19 nt, Homo sapiens
gcucacugccuucgaaguc

SEQ ID NO: 254430 - RNA, 19 nt, Homo sapiens
caagaucguauuguauugu

SEQ ID NO: 254431 - RNA, 19 nt, Homo sapiens
gauuuaccguggcuuugag

SEQ ID NO: 254432 - RNA, 19 nt, Homo sapiens
acucugcugcuuagacaua

SEQ ID NO: 254433 - RNA, 19 nt, Homo sapiens
aacaguuugucuucuaaug

SEQ ID NO: 254434 - RNA, 19 nt, Homo sapiens
gcaaacagaggaagaauuu

SEQ ID NO: 254435 - RNA, 19 nt, Homo sapiens
gcacagaaaucaauguuag

SEQ ID NO: 254436 - RNA, 19 nt, Homo sapiens
gaugaacucuuagaaauga

SEQ ID NO: 254437 - RNA, 19 nt, Homo sapiens
guacagagcucggcuucuu

SEQ ID NO: 254438 - RNA, 19 nt, Homo sapiens
cagaugaacucuuagaaau

SEQ ID NO: 254439 - RNA, 19 nt, Homo sapiens
gcaaugaagugcuuucucu

SEQ ID NO: 254440 - RNA, 19 nt, Homo sapiens
ggaagaauuuguuaucagu

SEQ ID NO: 254441 - RNA, 19 nt, Homo sapiens
uggaucagaugaacucuua

SEQ ID NO: 254442 - RNA, 19 nt, Homo sapiens
gcagaucgcaggucccuuu

SEQ ID NO: 254443 - RNA, 19 nt, Homo sapiens
ggagcaauguuccaucaug

SEQ ID NO: 254444 - RNA, 19 nt, Homo sapiens
gaacuucucucagacuuac

SEQ ID NO: 254445 - RNA, 19 nt, Homo sapiens
gaaucuggaugcaaagaau

SEQ ID NO: 254446 - RNA, 19 nt, Homo sapiens
gaggaagaauuuguuauca

SEQ ID NO: 254447 - RNA, 19 nt, Homo sapiens
caacacuucuugauugcaa

SEQ ID NO: 254448 - RNA, 19 nt, Homo sapiens
aaaccacauuugagaagua

SEQ ID NO: 254449 - RNA, 19 nt, Homo sapiens
gaagaacuauaugugaauc

SEQ ID NO: 254450 - RNA, 19 nt, Homo sapiens
uaagggugauagucaaauu

SEQ ID NO: 254451 - RNA, 19 nt, Homo sapiens
cuacuuguguuuacuucua

SEQ ID NO: 254452 - RNA, 19 nt, Homo sapiens
gagcaauguuccaucaugu

SEQ ID NO: 254453 - RNA, 19 nt, Homo sapiens
aaacuuagccgcaacuuca

SEQ ID NO: 254454 - RNA, 19 nt, Homo sapiens
ccucccagcuccagcguua

SEQ ID NO: 254455 - RNA, 19 nt, Homo sapiens
caaagaaugugaggaacug

SEQ ID NO: 254456 - RNA, 19 nt, Homo sapiens
caacugggugaauguaaua

SEQ ID NO: 254457 - RNA, 19 nt, Homo sapiens
gcagauagccagcccauac

SEQ ID NO: 254458 - RNA, 19 nt, Homo sapiens
ugaauccucuucuuuauac

SEQ ID NO: 254459 - RNA, 19 nt, Homo sapiens
ucauugacuuccuuacuaa

SEQ ID NO: 254460 - RNA, 19 nt, Homo sapiens
gaagccaacugggugaaug

SEQ ID NO: 254461 - RNA, 19 nt, Homo sapiens
uuucaaaugugcugucaaa

SEQ ID NO: 254462 - RNA, 19 nt, Homo sapiens
gaauuucgaaaccacauuu

SEQ ID NO: 254463 - RNA, 19 nt, Homo sapiens
agccagcucuucuucaaua

SEQ ID NO: 254464 - RNA, 19 nt, Homo sapiens
acuaugaacuucucucaga

SEQ ID NO: 254465 - RNA, 19 nt, Homo sapiens
caaaguaacagcaaugaag

SEQ ID NO: 254466 - RNA, 19 nt, Homo sapiens
aaacaucacucugcugcuu

SEQ ID NO: 254467 - RNA, 19 nt, Homo sapiens
ggaguuacaaguuauuuca

SEQ ID NO: 254468 - RNA, 19 nt, Homo sapiens
ccacauuugagaaguauuu

SEQ ID NO: 254469 - RNA, 19 nt, Homo sapiens
gaugcaaguauucaugaua

SEQ ID NO: 254470 - RNA, 19 nt, Homo sapiens
gaaaccacauuugagaagu

SEQ ID NO: 254471 - RNA, 19 nt, Homo sapiens
cagacuuacuuuacucauu

SEQ ID NO: 254472 - RNA, 19 nt, Homo sapiens
guccggagaugcaaguauu

SEQ ID NO: 254473 - RNA, 19 nt, Homo sapiens
uaaugggaauguaacagaa

SEQ ID NO: 254474 - RNA, 19 nt, Homo sapiens
gggugaauguaauaaguga

SEQ ID NO: 254475 - RNA, 19 nt, Homo sapiens
guauuuccauccagugcua

SEQ ID NO: 254476 - RNA, 19 nt, Homo sapiens
ugaaagggcgauggaauuu

SEQ ID NO: 254477 - RNA, 19 nt, Homo sapiens
gagaugcaaguauucauga

SEQ ID NO: 254478 - RNA, 19 nt, Homo sapiens
gugaauccucuucuuuaua

SEQ ID NO: 254479 - RNA, 19 nt, Homo sapiens
gaucagaugaacucuuaga

SEQ ID NO: 254480 - RNA, 19 nt, Homo sapiens
ccaacugggugaauguaau

SEQ ID NO: 254481 - RNA, 19 nt, Homo sapiens
ggugauagucaaauuaugu

SEQ ID NO: 254482 - RNA, 19 nt, Homo sapiens
ucagaugaacucuuagaaa

SEQ ID NO: 254483 - RNA, 19 nt, Homo sapiens
caaaugugcugucaaaaca

SEQ ID NO: 254484 - RNA, 19 nt, Homo sapiens
ggagaugcaaguauucaug

SEQ ID NO: 254485 - RNA, 19 nt, Homo sapiens
aaacagaggaagaauuugu

SEQ ID NO: 254486 - RNA, 19 nt, Homo sapiens
gagcacagaaaucaauguu

SEQ ID NO: 254487 - RNA, 19 nt, Homo sapiens
cucauugacuuccuuacua

SEQ ID NO: 254488 - RNA, 19 nt, Homo sapiens
gcaaaguaacagcaaugaa

SEQ ID NO: 254489 - RNA, 19 nt, Homo sapiens
gcauucaugucuucauuuu

SEQ ID NO: 254490 - RNA, 19 nt, Homo sapiens
gcaauguuccaucauguuc

SEQ ID NO: 254491 - RNA, 19 nt, Homo sapiens
guaaugagaauuucgaaac

SEQ ID NO: 254492 - RNA, 19 nt, Homo sapiens
ccucuucuuuauacuguaa

SEQ ID NO: 254493 - RNA, 19 nt, Homo sapiens
gaaaucaauguuagcagau

SEQ ID NO: 254494 - RNA, 19 nt, Homo sapiens
ugugaauccucuucuuuau

SEQ ID NO: 254495 - RNA, 19 nt, Homo sapiens
gaagcuggcauucaugucu

SEQ ID NO: 254496 - RNA, 19 nt, Homo sapiens
gugaggaacuggaggaaaa

SEQ ID NO: 254497 - RNA, 19 nt, Homo sapiens
ggauuuaccguggcuuuga

SEQ ID NO: 254498 - RNA, 19 nt, Homo sapiens
cagcucuucuucaauacuu

SEQ ID NO: 254499 - RNA, 19 nt, Homo sapiens
acagaggaagaauuuguua

SEQ ID NO: 254500 - RNA, 19 nt, Homo sapiens
ucacucugcugcuuagaca

SEQ ID NO: 254501 - RNA, 19 nt, Homo sapiens
uggcauucaugucuucauu

SEQ ID NO: 254502 - RNA, 19 nt, Homo sapiens
ucacauggagcacagaaau

SEQ ID NO: 254503 - RNA, 19 nt, Homo sapiens
gcucaggaaggccaagaaa

SEQ ID NO: 254504 - RNA, 19 nt, Homo sapiens
gcaaagaaugugaggaacu

SEQ ID NO: 254505 - RNA, 19 nt, Homo sapiens
ugaagugcuuucucuugga

SEQ ID NO: 254506 - RNA, 19 nt, Homo sapiens
uaugugaauccucuucuuu

SEQ ID NO: 254507 - RNA, 19 nt, Homo sapiens
ccagugcuacuuguguuua

SEQ ID NO: 254508 - RNA, 19 nt, Homo sapiens
uccaauauauggccaugug

SEQ ID NO: 254509 - RNA, 19 nt, Homo sapiens
guuuaagggugauagucaa

SEQ ID NO: 254510 - RNA, 19 nt, Homo sapiens
uaacaaaacacucggcauu

SEQ ID NO: 254511 - RNA, 19 nt, Homo sapiens
gcagaguuuuguacauauu

SEQ ID NO: 254512 - RNA, 19 nt, Homo sapiens
uuacuaagcauagcaaaca

SEQ ID NO: 254513 - RNA, 19 nt, Homo sapiens
cuaaugggaauguaacaga

SEQ ID NO: 254514 - RNA, 19 nt, Homo sapiens
ugagaaguauuuccaucca

SEQ ID NO: 254515 - RNA, 19 nt, Homo sapiens
uaccaaugcugcaggucaa

SEQ ID NO: 254516 - RNA, 19 nt, Homo sapiens
ucacuugaguccggagaug

SEQ ID NO: 254517 - RNA, 19 nt, Homo sapiens
gaucuuauucaaucuaugc

SEQ ID NO: 254518 - RNA, 19 nt, Homo sapiens
gucauugaguaauauagug

SEQ ID NO: 254519 - RNA, 19 nt, Homo sapiens
gcuacuuuauauacggaaa

SEQ ID NO: 254520 - RNA, 19 nt, Homo sapiens
gcucuucuucaauacuuaa

SEQ ID NO: 254521 - RNA, 19 nt, Homo sapiens
cgaaaccacauuugagaag

SEQ ID NO: 254522 - RNA, 19 nt, Homo sapiens
auagccagcucuucuucaa

SEQ ID NO: 254523 - RNA, 19 nt, Homo sapiens
ugacuacuggcucucauug

SEQ ID NO: 254524 - RNA, 19 nt, Homo sapiens
ugaacuucucucagacuua

SEQ ID NO: 254525 - RNA, 19 nt, Homo sapiens
gaccuuggaucagaugaac

SEQ ID NO: 254526 - RNA, 19 nt, Homo sapiens
gcguuacccuccggucuau

SEQ ID NO: 254527 - RNA, 19 nt, Homo sapiens
cauauuguccaaauguuca

SEQ ID NO: 254528 - RNA, 19 nt, Homo sapiens
ccaagcugcggguuucuga

SEQ ID NO: 254529 - RNA, 19 nt, Homo sapiens
gauggauggcugcuggaaa

SEQ ID NO: 254530 - RNA, 19 nt, Homo sapiens
gcucucauugacuuccuua

SEQ ID NO: 254531 - RNA, 19 nt, Homo sapiens
gggugauagucaaauuaug

SEQ ID NO: 254532 - RNA, 19 nt, Homo sapiens
uugaaagggcgauggaauu

SEQ ID NO: 254533 - RNA, 19 nt, Homo sapiens
agaggaagaauuuguuauc

SEQ ID NO: 254534 - RNA, 19 nt, Homo sapiens
aaagguagguguucaauaa

SEQ ID NO: 254535 - RNA, 19 nt, Homo sapiens
gcaaacagaggaagaauuu

SEQ ID NO: 254536 - RNA, 19 nt, Homo sapiens
gaugaacucuuagaaauga

SEQ ID NO: 254537 - RNA, 19 nt, Homo sapiens
cuacuaaccuuccuccaua

SEQ ID NO: 254538 - RNA, 19 nt, Homo sapiens
uagaguagcuuaccuaaau

SEQ ID NO: 254539 - RNA, 19 nt, Homo sapiens
cagaugaacucuuagaaau

SEQ ID NO: 254540 - RNA, 19 nt, Homo sapiens
gcaaugaagugcuuucucu

SEQ ID NO: 254541 - RNA, 19 nt, Homo sapiens
ggaagaauuuguuaucagu

SEQ ID NO: 254542 - RNA, 19 nt, Homo sapiens
caaagcaccuaaccuauag

SEQ ID NO: 254543 - RNA, 19 nt, Homo sapiens
uggaucagaugaacucuua

SEQ ID NO: 254544 - RNA, 19 nt, Homo sapiens
gaucauacuuuacccuaga

SEQ ID NO: 254545 - RNA, 19 nt, Homo sapiens
ccaaagcaccuaaccuaua

SEQ ID NO: 254546 - RNA, 19 nt, Homo sapiens
ugaugcaucuguuaaguaa

SEQ ID NO: 254547 - RNA, 19 nt, Homo sapiens
gguagguguucaauaagua

SEQ ID NO: 254548 - RNA, 19 nt, Homo sapiens
gauuaaaggugaugcaucu

SEQ ID NO: 254549 - RNA, 19 nt, Homo sapiens
gaacuucucucagacuuac

SEQ ID NO: 254550 - RNA, 19 nt, Homo sapiens
gaaucuggaugcaaagaau

SEQ ID NO: 254551 - RNA, 19 nt, Homo sapiens
gaggaagaauuuguuauca

SEQ ID NO: 254552 - RNA, 19 nt, Homo sapiens
caacacuucuugauugcaa

SEQ ID NO: 254553 - RNA, 19 nt, Homo sapiens
aaaccacauuugagaagua

SEQ ID NO: 254554 - RNA, 19 nt, Homo sapiens
gaagaacuauaugugaauc

SEQ ID NO: 254555 - RNA, 19 nt, Homo sapiens
uaagggugauagucaaauu

SEQ ID NO: 254556 - RNA, 19 nt, Homo sapiens
cuacuuguguuuacuucua

SEQ ID NO: 254557 - RNA, 19 nt, Homo sapiens
uacccuagauuguauugua

SEQ ID NO: 254558 - RNA, 19 nt, Homo sapiens
caaagaaugugaggaacug

SEQ ID NO: 254559 - RNA, 19 nt, Homo sapiens
caacugggugaauguaaua

SEQ ID NO: 254560 - RNA, 19 nt, Homo sapiens
cagcuaauauacccaguug

SEQ ID NO: 254561 - RNA, 19 nt, Homo sapiens
ugaauccucuucuuuauac

SEQ ID NO: 254562 - RNA, 19 nt, Homo sapiens
ucauugacuuccuuacuaa

SEQ ID NO: 254563 - RNA, 19 nt, Homo sapiens
gaagccaacugggugaaug

SEQ ID NO: 254564 - RNA, 19 nt, Homo sapiens
uuucaaaugugcugucaaa

SEQ ID NO: 254565 - RNA, 19 nt, Homo sapiens
gcccaaagcaccuaaccua

SEQ ID NO: 254566 - RNA, 19 nt, Homo sapiens
gaauuucgaaaccacauuu

SEQ ID NO: 254567 - RNA, 19 nt, Homo sapiens
agccagcucuucuucaaua

SEQ ID NO: 254568 - RNA, 19 nt, Homo sapiens
acuaugaacuucucucaga

SEQ ID NO: 254569 - RNA, 19 nt, Homo sapiens
caaaguaacagcaaugaag

SEQ ID NO: 254570 - RNA, 19 nt, Homo sapiens
uaaaggugaugcaucuguu

SEQ ID NO: 254571 - RNA, 19 nt, Homo sapiens
aaacaucacucugcugcuu

SEQ ID NO: 254572 - RNA, 19 nt, Homo sapiens
ggaguuacaaguuauuuca

SEQ ID NO: 254573 - RNA, 19 nt, Homo sapiens
ccacauuugagaaguauuu

SEQ ID NO: 254574 - RNA, 19 nt, Homo sapiens
gaugcaaguauucaugaua

SEQ ID NO: 254575 - RNA, 19 nt, Homo sapiens
gaaaccacauuugagaagu

SEQ ID NO: 254576 - RNA, 19 nt, Homo sapiens
cagacuuacuuuacucauu

SEQ ID NO: 254577 - RNA, 19 nt, Homo sapiens
guccggagaugcaaguauu

SEQ ID NO: 254578 - RNA, 19 nt, Homo sapiens
uaaugggaauguaacagaa

SEQ ID NO: 254579 - RNA, 19 nt, Homo sapiens
gggugaauguaauaaguga

SEQ ID NO: 254580 - RNA, 19 nt, Homo sapiens
guauuuccauccagugcua

SEQ ID NO: 254581 - RNA, 19 nt, Homo sapiens
gagaugcaaguauucauga

SEQ ID NO: 254582 - RNA, 19 nt, Homo sapiens
gugaauccucuucuuuaua

SEQ ID NO: 254583 - RNA, 19 nt, Homo sapiens
gaucagaugaacucuuaga

SEQ ID NO: 254584 - RNA, 19 nt, Homo sapiens
ccaacugggugaauguaau

SEQ ID NO: 254585 - RNA, 19 nt, Homo sapiens
acuaaugccuucaugguau

SEQ ID NO: 254586 - RNA, 19 nt, Homo sapiens
uuaauucccucccuuucuu

SEQ ID NO: 254587 - RNA, 19 nt, Homo sapiens
ggugauagucaaauuaugu

SEQ ID NO: 254588 - RNA, 19 nt, Homo sapiens
ucagaugaacucuuagaaa

SEQ ID NO: 254589 - RNA, 19 nt, Homo sapiens
caaaugugcugucaaaaca

SEQ ID NO: 254590 - RNA, 19 nt, Homo sapiens
ggagaugcaaguauucaug

SEQ ID NO: 254591 - RNA, 19 nt, Homo sapiens
aaacagaggaagaauuugu

SEQ ID NO: 254592 - RNA, 19 nt, Homo sapiens
cucauugacuuccuuacua

SEQ ID NO: 254593 - RNA, 19 nt, Homo sapiens
gcaaaguaacagcaaugaa

SEQ ID NO: 254594 - RNA, 19 nt, Homo sapiens
gcauucaugucuucauuuu

SEQ ID NO: 254595 - RNA, 19 nt, Homo sapiens
ccuaaaugcuacuaaccuu

SEQ ID NO: 254596 - RNA, 19 nt, Homo sapiens
guaaugagaauuucgaaac

SEQ ID NO: 254597 - RNA, 19 nt, Homo sapiens
ccucuucuuuauacuguaa

SEQ ID NO: 254598 - RNA, 19 nt, Homo sapiens
ugugaauccucuucuuuau

SEQ ID NO: 254599 - RNA, 19 nt, Homo sapiens
cuccauaccauuauuguaa

SEQ ID NO: 254600 - RNA, 19 nt, Homo sapiens
cuaaugccuucaugguauu

SEQ ID NO: 254601 - RNA, 19 nt, Homo sapiens
gaagcuggcauucaugucu

SEQ ID NO: 254602 - RNA, 19 nt, Homo sapiens
gugaggaacuggaggaaaa

SEQ ID NO: 254603 - RNA, 19 nt, Homo sapiens
ggauuuaccguggcuuuga

SEQ ID NO: 254604 - RNA, 19 nt, Homo sapiens
cagcucuucuucaauacuu

SEQ ID NO: 254605 - RNA, 19 nt, Homo sapiens
acagaggaagaauuuguua

SEQ ID NO: 254606 - RNA, 19 nt, Homo sapiens
ucacucugcugcuuagaca

SEQ ID NO: 254607 - RNA, 19 nt, Homo sapiens
uggcauucaugucuucauu

SEQ ID NO: 254608 - RNA, 19 nt, Homo sapiens
ggugaugcaucuguuaagu

SEQ ID NO: 254609 - RNA, 19 nt, Homo sapiens
gcaaagaaugugaggaacu

SEQ ID NO: 254610 - RNA, 19 nt, Homo sapiens
aaaggugaugcaucuguua

SEQ ID NO: 254611 - RNA, 19 nt, Homo sapiens
ugaagugcuuucucuugga

SEQ ID NO: 254612 - RNA, 19 nt, Homo sapiens
gugaugcaucuguuaagua

SEQ ID NO: 254613 - RNA, 19 nt, Homo sapiens
guauuaauucccucccuuu

SEQ ID NO: 254614 - RNA, 19 nt, Homo sapiens
guaacuaauagagugcuua

SEQ ID NO: 254615 - RNA, 19 nt, Homo sapiens
uaugugaauccucuucuuu

SEQ ID NO: 254616 - RNA, 19 nt, Homo sapiens
gcugucauguacuugcuau

SEQ ID NO: 254617 - RNA, 19 nt, Homo sapiens
guauugggaaccauagauu

SEQ ID NO: 254618 - RNA, 19 nt, Homo sapiens
ccagugcuacuuguguuua

SEQ ID NO: 254619 - RNA, 19 nt, Homo sapiens
guuuaagggugauagucaa

SEQ ID NO: 254620 - RNA, 19 nt, Homo sapiens
uaacaaaacacucggcauu

SEQ ID NO: 254621 - RNA, 19 nt, Homo sapiens
gcagaguuuuguacauauu

SEQ ID NO: 254622 - RNA, 19 nt, Homo sapiens
uuacuaagcauagcaaaca

SEQ ID NO: 254623 - RNA, 19 nt, Homo sapiens
cuaaugggaauguaacaga

SEQ ID NO: 254624 - RNA, 19 nt, Homo sapiens
ugagaaguauuuccaucca

SEQ ID NO: 254625 - RNA, 19 nt, Homo sapiens
uaccaaugcugcaggucaa

SEQ ID NO: 254626 - RNA, 19 nt, Homo sapiens
ucacuugaguccggagaug

SEQ ID NO: 254627 - RNA, 19 nt, Homo sapiens
gaucuuauucaaucuaugc

SEQ ID NO: 254628 - RNA, 19 nt, Homo sapiens
uaaccuuccuccauaccau

SEQ ID NO: 254629 - RNA, 19 nt, Homo sapiens
gucauugaguaauauagug

SEQ ID NO: 254630 - RNA, 19 nt, Homo sapiens
gcuacuuuauauacggaaa

SEQ ID NO: 254631 - RNA, 19 nt, Homo sapiens
gcucuucuucaauacuuaa

SEQ ID NO: 254632 - RNA, 19 nt, Homo sapiens
cgaaaccacauuugagaag

SEQ ID NO: 254633 - RNA, 19 nt, Homo sapiens
auagccagcucuucuucaa

SEQ ID NO: 254634 - RNA, 19 nt, Homo sapiens
gaaggagccucucugcuuu

SEQ ID NO: 254635 - RNA, 19 nt, Homo sapiens
cagcagagaugaagacuug

SEQ ID NO: 254636 - RNA, 19 nt, Homo sapiens
gaauacaugugguaaugaa

SEQ ID NO: 254637 - RNA, 19 nt, Homo sapiens
ccaaagcucucugucaauu

SEQ ID NO: 254638 - RNA, 19 nt, Homo sapiens
gaagaaaacucaacucagu

SEQ ID NO: 254639 - RNA, 19 nt, Homo sapiens
aaacugcucucaccaccua

SEQ ID NO: 254640 - RNA, 19 nt, Homo sapiens
gacauuguaccuuguauaa

SEQ ID NO: 254641 - RNA, 19 nt, Homo sapiens
gcgccacccuccacaguaa

SEQ ID NO: 254642 - RNA, 19 nt, Homo sapiens
ccacagagauaagcaguca

SEQ ID NO: 254643 - RNA, 19 nt, Homo sapiens
gagauaagcagucaugagu

SEQ ID NO: 254644 - RNA, 19 nt, Homo sapiens
cagcgaauccucuccauug

SEQ ID NO: 254645 - RNA, 19 nt, Homo sapiens
ccagggagcgguacauuug

SEQ ID NO: 254646 - RNA, 19 nt, Homo sapiens
cagcugcucugcacacaug

SEQ ID NO: 254647 - RNA, 19 nt, Homo sapiens
caacacagcggccacaaca

SEQ ID NO: 254648 - RNA, 19 nt, Homo sapiens
caaagcucucugucaauua

SEQ ID NO: 254649 - RNA, 19 nt, Homo sapiens
ugaaggagccucucugcuu

SEQ ID NO: 254650 - RNA, 19 nt, Homo sapiens
gaaaccagcccagcuaagu

SEQ ID NO: 254651 - RNA, 19 nt, Homo sapiens
ggccagcguugaaauggaa

SEQ ID NO: 254652 - RNA, 19 nt, Homo sapiens
cauuguaccuuguauaaac

SEQ ID NO: 254653 - RNA, 19 nt, Homo sapiens
cgaauccucuccauugaag

SEQ ID NO: 254654 - RNA, 19 nt, Homo sapiens
uggaauacaugugguaaug

SEQ ID NO: 254655 - RNA, 19 nt, Homo sapiens
gaacaaggccacgaauguc

SEQ ID NO: 254656 - RNA, 19 nt, Homo sapiens
gaaggauucaggaagaaga

SEQ ID NO: 254657 - RNA, 19 nt, Homo sapiens
cacaggaaccacagagaua

SEQ ID NO: 254658 - RNA, 19 nt, Homo sapiens
uagagacccugcccugguu

SEQ ID NO: 254659 - RNA, 19 nt, Homo sapiens
gcucucaccaccuaugaaa

SEQ ID NO: 254660 - RNA, 19 nt, Homo sapiens
ugaacaaggccacgaaugu

SEQ ID NO: 254661 - RNA, 19 nt, Homo sapiens
ggaauacaugugguaauga

SEQ ID NO: 254662 - RNA, 19 nt, Homo sapiens
acccaaagcucucugucaa

SEQ ID NO: 254663 - RNA, 19 nt, Homo sapiens
uaaagacgacugagaagag

SEQ ID NO: 254664 - RNA, 19 nt, Homo sapiens
gagccucucugcuuuagcu

SEQ ID NO: 254665 - RNA, 19 nt, Homo sapiens
aaagcucucugucaauuac

SEQ ID NO: 254666 - RNA, 19 nt, Homo sapiens
caccaggccucucagaagu

SEQ ID NO: 254667 - RNA, 19 nt, Homo sapiens
caugcuaccucaagucaag

SEQ ID NO: 254668 - RNA, 19 nt, Homo sapiens
ucaacucagugccauuuua

SEQ ID NO: 254669 - RNA, 19 nt, Homo sapiens
ggaagacaccagcguuugg

SEQ ID NO: 254670 - RNA, 19 nt, Homo sapiens
gcagagaugaagacuugga

SEQ ID NO: 254671 - RNA, 19 nt, Homo sapiens
ugacauuguaccuuguaua

SEQ ID NO: 254672 - RNA, 19 nt, Homo sapiens
ccagcuaaguccggaguga

SEQ ID NO: 254673 - RNA, 19 nt, Homo sapiens
gggaaaccagcccagcuaa

SEQ ID NO: 254674 - RNA, 19 nt, Homo sapiens
gagcagguucuccgcauuc

SEQ ID NO: 254675 - RNA, 19 nt, Homo sapiens
agugugagcugccuggaau

SEQ ID NO: 254676 - RNA, 19 nt, Homo sapiens
gcgaauccucuccauugaa

SEQ ID NO: 254677 - RNA, 19 nt, Homo sapiens
uaccucaagucaaggcaaa

SEQ ID NO: 254678 - RNA, 19 nt, Homo sapiens
ucucccagcucaaacaaca

SEQ ID NO: 254679 - RNA, 19 nt, Homo sapiens
gggaagacaccagcguuug

SEQ ID NO: 254680 - RNA, 19 nt, Homo sapiens
gaaaagugacauacccaaa

SEQ ID NO: 254681 - RNA, 19 nt, Homo sapiens
ccacaggaaccacagagau

SEQ ID NO: 254682 - RNA, 19 nt, Homo sapiens
ugagcugccuggaauacau

SEQ ID NO: 254683 - RNA, 19 nt, Homo sapiens
acaggaaccacagagauaa

SEQ ID NO: 254684 - RNA, 19 nt, Homo sapiens
ggccacaacagcagcuauu

SEQ ID NO: 254685 - RNA, 19 nt, Homo sapiens
aaagugacauacccaaagc

SEQ ID NO: 254686 - RNA, 19 nt, Homo sapiens
cccagucucaaaugcauua

SEQ ID NO: 254687 - RNA, 19 nt, Homo sapiens
acaucugggucaagagcua

SEQ ID NO: 254688 - RNA, 19 nt, Homo sapiens
acagagauaagcagucaug

SEQ ID NO: 254689 - RNA, 19 nt, Homo sapiens
ggaaaccagcccagcuaag

SEQ ID NO: 254690 - RNA, 19 nt, Homo sapiens
gaccagcagcagagaugaa

SEQ ID NO: 254691 - RNA, 19 nt, Homo sapiens
acucugguuucaagcguaa

SEQ ID NO: 254692 - RNA, 19 nt, Homo sapiens
gagaugaagacuuggaaaa

SEQ ID NO: 254693 - RNA, 19 nt, Homo sapiens
gggaccagcagcagagaug

SEQ ID NO: 254694 - RNA, 19 nt, Homo sapiens
cuaaagacgacugagaaga

SEQ ID NO: 254695 - RNA, 19 nt, Homo sapiens
gcuaaagacgacugagaag

SEQ ID NO: 254696 - RNA, 19 nt, Homo sapiens
uagcuaaagacgacugaga

SEQ ID NO: 254697 - RNA, 19 nt, Homo sapiens
ucaccaggccucucagaag

SEQ ID NO: 254698 - RNA, 19 nt, Homo sapiens
cgacugagaagaggugcaa

SEQ ID NO: 254699 - RNA, 19 nt, Homo sapiens
ugagaagaggugcaaggaa

SEQ ID NO: 254700 - RNA, 19 nt, Homo sapiens
gagcugccuggaauacaug

SEQ ID NO: 254701 - RNA, 19 nt, Homo sapiens
aaggagccucucugcuuua

SEQ ID NO: 254702 - RNA, 19 nt, Homo sapiens
ggaccagcagcagagauga

SEQ ID NO: 254703 - RNA, 19 nt, Homo sapiens
agcgaauccucuccauuga

SEQ ID NO: 254704 - RNA, 19 nt, Homo sapiens
agucucaaaugcauuagag

SEQ ID NO: 254705 - RNA, 19 nt, Homo sapiens
gaugaagacuuggaaaacu

SEQ ID NO: 254706 - RNA, 19 nt, Homo sapiens
ugucucuccuggcaugcua

SEQ ID NO: 254707 - RNA, 19 nt, Homo sapiens
cuucaucucccagcucaaa

SEQ ID NO: 254708 - RNA, 19 nt, Homo sapiens
ggcaugcuaccucaaguca

SEQ ID NO: 254709 - RNA, 19 nt, Homo sapiens
gaaggagccucucugcuuu

SEQ ID NO: 254710 - RNA, 19 nt, Homo sapiens
cagcagagaugaagacuug

SEQ ID NO: 254711 - RNA, 19 nt, Homo sapiens
gaauacaugugguaaugaa

SEQ ID NO: 254712 - RNA, 19 nt, Homo sapiens
ccaaagcucucugucaauu

SEQ ID NO: 254713 - RNA, 19 nt, Homo sapiens
gaagaaaacucaacucagu

SEQ ID NO: 254714 - RNA, 19 nt, Homo sapiens
aaacugcucucaccaccua

SEQ ID NO: 254715 - RNA, 19 nt, Homo sapiens
gacauuguaccuuguauaa

SEQ ID NO: 254716 - RNA, 19 nt, Homo sapiens
gcgccacccuccacaguaa

SEQ ID NO: 254717 - RNA, 19 nt, Homo sapiens
ccacagagauaagcaguca

SEQ ID NO: 254718 - RNA, 19 nt, Homo sapiens
gagauaagcagucaugagu

SEQ ID NO: 254719 - RNA, 19 nt, Homo sapiens
cagcgaauccucuccauug

SEQ ID NO: 254720 - RNA, 19 nt, Homo sapiens
cagcugcucugcacacaug

SEQ ID NO: 254721 - RNA, 19 nt, Homo sapiens
caacacagcggccacaaca

SEQ ID NO: 254722 - RNA, 19 nt, Homo sapiens
ccagggagcgguacauuug

SEQ ID NO: 254723 - RNA, 19 nt, Homo sapiens
caaagcucucugucaauua

SEQ ID NO: 254724 - RNA, 19 nt, Homo sapiens
ugaaggagccucucugcuu

SEQ ID NO: 254725 - RNA, 19 nt, Homo sapiens
gaaaccagcccagcuaagu

SEQ ID NO: 254726 - RNA, 19 nt, Homo sapiens
ggccagcguugaaauggaa

SEQ ID NO: 254727 - RNA, 19 nt, Homo sapiens
cauuguaccuuguauaaac

SEQ ID NO: 254728 - RNA, 19 nt, Homo sapiens
agagagggcuggagagagu

SEQ ID NO: 254729 - RNA, 19 nt, Homo sapiens
cgaauccucuccauugaag

SEQ ID NO: 254730 - RNA, 19 nt, Homo sapiens
uggaauacaugugguaaug

SEQ ID NO: 254731 - RNA, 19 nt, Homo sapiens
gaacaaggccacgaauguc

SEQ ID NO: 254732 - RNA, 19 nt, Homo sapiens
gaaggauucaggaagaaga

SEQ ID NO: 254733 - RNA, 19 nt, Homo sapiens
cacaggaaccacagagaua

SEQ ID NO: 254734 - RNA, 19 nt, Homo sapiens
uagagacccugcccugguu

SEQ ID NO: 254735 - RNA, 19 nt, Homo sapiens
gcucucaccaccuaugaaa

SEQ ID NO: 254736 - RNA, 19 nt, Homo sapiens
ugaacaaggccacgaaugu

SEQ ID NO: 254737 - RNA, 19 nt, Homo sapiens
ggaauacaugugguaauga

SEQ ID NO: 254738 - RNA, 19 nt, Homo sapiens
gcagagagggcuggagaga

SEQ ID NO: 254739 - RNA, 19 nt, Homo sapiens
acccaaagcucucugucaa

SEQ ID NO: 254740 - RNA, 19 nt, Homo sapiens
uaaagacgacugagaagag

SEQ ID NO: 254741 - RNA, 19 nt, Homo sapiens
gagccucucugcuuuagcu

SEQ ID NO: 254742 - RNA, 19 nt, Homo sapiens
aaagcucucugucaauuac

SEQ ID NO: 254743 - RNA, 19 nt, Homo sapiens
caccaggccucucagaagu

SEQ ID NO: 254744 - RNA, 19 nt, Homo sapiens
caugcuaccucaagucaag

SEQ ID NO: 254745 - RNA, 19 nt, Homo sapiens
ucaacucagugccauuuua

SEQ ID NO: 254746 - RNA, 19 nt, Homo sapiens
ggaagacaccagcguuugg

SEQ ID NO: 254747 - RNA, 19 nt, Homo sapiens
gcagagaugaagacuugga

SEQ ID NO: 254748 - RNA, 19 nt, Homo sapiens
ugacauuguaccuuguaua

SEQ ID NO: 254749 - RNA, 19 nt, Homo sapiens
ccagcuaaguccggaguga

SEQ ID NO: 254750 - RNA, 19 nt, Homo sapiens
gggaaaccagcccagcuaa

SEQ ID NO: 254751 - RNA, 19 nt, Homo sapiens
gagcagguucuccgcauuc

SEQ ID NO: 254752 - RNA, 19 nt, Homo sapiens
agugugagcugccuggaau

SEQ ID NO: 254753 - RNA, 19 nt, Homo sapiens
gcgaauccucuccauugaa

SEQ ID NO: 254754 - RNA, 19 nt, Homo sapiens
uaccucaagucaaggcaaa

SEQ ID NO: 254755 - RNA, 19 nt, Homo sapiens
ucucccagcucaaacaaca

SEQ ID NO: 254756 - RNA, 19 nt, Homo sapiens
gggaagacaccagcguuug

SEQ ID NO: 254757 - RNA, 19 nt, Homo sapiens
gaaaagugacauacccaaa

SEQ ID NO: 254758 - RNA, 19 nt, Homo sapiens
ccacaggaaccacagagau

SEQ ID NO: 254759 - RNA, 19 nt, Homo sapiens
ugagcugccuggaauacau

SEQ ID NO: 254760 - RNA, 19 nt, Homo sapiens
acaggaaccacagagauaa

SEQ ID NO: 254761 - RNA, 19 nt, Homo sapiens
ggccacaacagcagcuauu

SEQ ID NO: 254762 - RNA, 19 nt, Homo sapiens
aaagugacauacccaaagc

SEQ ID NO: 254763 - RNA, 19 nt, Homo sapiens
acaucugggucaagagcua

SEQ ID NO: 254764 - RNA, 19 nt, Homo sapiens
cccagucucaaaugcauua

SEQ ID NO: 254765 - RNA, 19 nt, Homo sapiens
acagagauaagcagucaug

SEQ ID NO: 254766 - RNA, 19 nt, Homo sapiens
acucugguuucaagcguaa

SEQ ID NO: 254767 - RNA, 19 nt, Homo sapiens
ggaaaccagcccagcuaag

SEQ ID NO: 254768 - RNA, 19 nt, Homo sapiens
gaccagcagcagagaugaa

SEQ ID NO: 254769 - RNA, 19 nt, Homo sapiens
gagaugaagacuuggaaaa

SEQ ID NO: 254770 - RNA, 19 nt, Homo sapiens
gggaccagcagcagagaug

SEQ ID NO: 254771 - RNA, 19 nt, Homo sapiens
cuaaagacgacugagaaga

SEQ ID NO: 254772 - RNA, 19 nt, Homo sapiens
gcuaaagacgacugagaag

SEQ ID NO: 254773 - RNA, 19 nt, Homo sapiens
uagcuaaagacgacugaga

SEQ ID NO: 254774 - RNA, 19 nt, Homo sapiens
ucaccaggccucucagaag

SEQ ID NO: 254775 - RNA, 19 nt, Homo sapiens
cgacugagaagaggugcaa

SEQ ID NO: 254776 - RNA, 19 nt, Homo sapiens
ugacuuugcccacucucuu

SEQ ID NO: 254777 - RNA, 19 nt, Homo sapiens
ggagggagaccaggaaagc

SEQ ID NO: 254778 - RNA, 19 nt, Homo sapiens
ugagaagaggugcaaggaa

SEQ ID NO: 254779 - RNA, 19 nt, Homo sapiens
gagcugccuggaauacaug

SEQ ID NO: 254780 - RNA, 19 nt, Homo sapiens
aaggagccucucugcuuua

SEQ ID NO: 254781 - RNA, 19 nt, Homo sapiens
ggaccagcagcagagauga

SEQ ID NO: 254782 - RNA, 19 nt, Homo sapiens
agcgaauccucuccauuga

SEQ ID NO: 254783 - RNA, 19 nt, Homo sapiens
agucucaaaugcauuagag

SEQ ID NO: 254784 - RNA, 19 nt, Homo sapiens
gaugaagacuuggaaaacu

SEQ ID NO: 254785 - RNA, 19 nt, Homo sapiens
ugucucuccuggcaugcua

SEQ ID NO: 254786 - RNA, 19 nt, Homo sapiens
cgggcgaggucaaguggau

SEQ ID NO: 254787 - RNA, 19 nt, Homo sapiens
cuucaucucccagcucaaa

SEQ ID NO: 254788 - RNA, 19 nt, Homo sapiens
ggcaugcuaccucaaguca

SEQ ID NO: 254789 - RNA, 19 nt, Homo sapiens
gaacagugcuugccacaga

SEQ ID NO: 254790 - RNA, 19 nt, Homo sapiens
acacugagcugucauguuu

SEQ ID NO: 254791 - RNA, 19 nt, Homo sapiens
cgaaagacgugauucaauu

SEQ ID NO: 254792 - RNA, 19 nt, Homo sapiens
ggacacagaugaaacacaa

SEQ ID NO: 254793 - RNA, 19 nt, Homo sapiens
gaagcuuucugucuccuua

SEQ ID NO: 254794 - RNA, 19 nt, Homo sapiens
uaaaggaucuuaggcauga

SEQ ID NO: 254795 - RNA, 19 nt, Homo sapiens
gauuuacacuugaggcuua

SEQ ID NO: 254796 - RNA, 19 nt, Homo sapiens
gcaaugagguucuuuccau

SEQ ID NO: 254797 - RNA, 19 nt, Homo sapiens
agaaucagcuccuuugaaa

SEQ ID NO: 254798 - RNA, 19 nt, Homo sapiens
gcaaaugguucugcugaaa

SEQ ID NO: 254799 - RNA, 19 nt, Homo sapiens
ccagugagaugcauucuug

SEQ ID NO: 254800 - RNA, 19 nt, Homo sapiens
gaacuuggaggcaccauuu

SEQ ID NO: 254801 - RNA, 19 nt, Homo sapiens
gcagauauauuaagugacu

SEQ ID NO: 254802 - RNA, 19 nt, Homo sapiens
cgucuuaacucaccauaaa

SEQ ID NO: 254803 - RNA, 19 nt, Homo sapiens
ggacaggugugccgacaga

SEQ ID NO: 254804 - RNA, 19 nt, Homo sapiens
gaagcaacauuaaagcaau

SEQ ID NO: 254805 - RNA, 19 nt, Homo sapiens
aggcaugacuguagaauuu

SEQ ID NO: 254806 - RNA, 19 nt, Homo sapiens
gcaaugccauccucaaaca

SEQ ID NO: 254807 - RNA, 19 nt, Homo sapiens
gaacauaaucuaccaacga

SEQ ID NO: 254808 - RNA, 19 nt, Homo sapiens
gaagcugcaucuuguuuau

SEQ ID NO: 254809 - RNA, 19 nt, Homo sapiens
ggaaccagcguguauauga

SEQ ID NO: 254810 - RNA, 19 nt, Homo sapiens
ccagcaaacucuauucuau

SEQ ID NO: 254811 - RNA, 19 nt, Homo sapiens
ggccuacucuuccaucuuu

SEQ ID NO: 254812 - RNA, 19 nt, Homo sapiens
cagaugagguugcuagaga

SEQ ID NO: 254813 - RNA, 19 nt, Homo sapiens
agaauuggcugaacucaug

SEQ ID NO: 254814 - RNA, 19 nt, Homo sapiens
ccagggcucugaccaguuu

SEQ ID NO: 254815 - RNA, 19 nt, Homo sapiens
caucacagcuaacaauugu

SEQ ID NO: 254816 - RNA, 19 nt, Homo sapiens
cgccaaagcuugaaagguu

SEQ ID NO: 254817 - RNA, 19 nt, Homo sapiens
caugagaaguugauauaga

SEQ ID NO: 254818 - RNA, 19 nt, Homo sapiens
gcucacaucuuggcacauu

SEQ ID NO: 254819 - RNA, 19 nt, Homo sapiens
gcaagaagauccuaaaaca

SEQ ID NO: 254820 - RNA, 19 nt, Homo sapiens
caaaggagcagccucagaa

SEQ ID NO: 254821 - RNA, 19 nt, Homo sapiens
caauggcacucccaaaguu

SEQ ID NO: 254822 - RNA, 19 nt, Homo sapiens
ggacagggaugagcaugga

SEQ ID NO: 254823 - RNA, 19 nt, Homo sapiens
gcaaggaggccacgugaug

SEQ ID NO: 254824 - RNA, 19 nt, Homo sapiens
gcucaucucugucccacuu

SEQ ID NO: 254825 - RNA, 19 nt, Homo sapiens
agacaagccucucaccauu

SEQ ID NO: 254826 - RNA, 19 nt, Homo sapiens
ggaagggacuauucagaag

SEQ ID NO: 254827 - RNA, 19 nt, Homo sapiens
ggaggaaggugcuggucuu

SEQ ID NO: 254828 - RNA, 19 nt, Homo sapiens
gguuaucugucccagguua

SEQ ID NO: 254829 - RNA, 19 nt, Homo sapiens
gccaagggaugaaagagaa

SEQ ID NO: 254830 - RNA, 19 nt, Homo sapiens
gaagcaggcuacacugaca

SEQ ID NO: 254831 - RNA, 19 nt, Homo sapiens
uaacuuguuuggccuauuc

SEQ ID NO: 254832 - RNA, 19 nt, Homo sapiens
gaaggaaccagcguguaua

SEQ ID NO: 254833 - RNA, 19 nt, Homo sapiens
acaagccucucaccauuaa

SEQ ID NO: 254834 - RNA, 19 nt, Homo sapiens
gcuccuaaccuuccuguaa

SEQ ID NO: 254835 - RNA, 19 nt, Homo sapiens
gcacuuaaugaaugaauga

SEQ ID NO: 254836 - RNA, 19 nt, Homo sapiens
ugaaagagaagguggguuu

SEQ ID NO: 254837 - RNA, 19 nt, Homo sapiens
cagcagcacugugaagaaa

SEQ ID NO: 254838 - RNA, 19 nt, Homo sapiens
gguguuagcuaaaggaucu

SEQ ID NO: 254839 - RNA, 19 nt, Homo sapiens
caucugggcuccuaaccuu

SEQ ID NO: 254840 - RNA, 19 nt, Homo sapiens
gagcagaucuagaaaacaa

SEQ ID NO: 254841 - RNA, 19 nt, Homo sapiens
gcaauagaacagagaaaga

SEQ ID NO: 254842 - RNA, 19 nt, Homo sapiens
guggagccauguuaaugua

SEQ ID NO: 254843 - RNA, 19 nt, Homo sapiens
gauguuggcugggaacuca

SEQ ID NO: 254844 - RNA, 19 nt, Homo sapiens
gauacaaauugcagacugu

SEQ ID NO: 254845 - RNA, 19 nt, Homo sapiens
uaacacacagcucccauaa

SEQ ID NO: 254846 - RNA, 19 nt, Homo sapiens
gccaauaacacacagcuaa

SEQ ID NO: 254847 - RNA, 19 nt, Homo sapiens
gacaagccucucaccauua

SEQ ID NO: 254848 - RNA, 19 nt, Homo sapiens
ccagugauguuucuguaga

SEQ ID NO: 254849 - RNA, 19 nt, Homo sapiens
gauucacacugucugguuu

SEQ ID NO: 254850 - RNA, 19 nt, Homo sapiens
gcaguggccuucccuaaaa

SEQ ID NO: 254851 - RNA, 19 nt, Homo sapiens
gaaagacgugauucaauuc

SEQ ID NO: 254852 - RNA, 19 nt, Homo sapiens
gaugaaacacaaacaauag

SEQ ID NO: 254853 - RNA, 19 nt, Homo sapiens
gugauucgguggagacuau

SEQ ID NO: 254854 - RNA, 19 nt, Homo sapiens
ggcaucagcuggcgucaug

SEQ ID NO: 254855 - RNA, 19 nt, Homo sapiens
guaacugugucaugauuca

SEQ ID NO: 254856 - RNA, 19 nt, Homo sapiens
ggagcagccucagaacaaa

SEQ ID NO: 254857 - RNA, 19 nt, Homo sapiens
gcaauuagacggcauccau

SEQ ID NO: 254858 - RNA, 19 nt, Homo sapiens
gauuugggcuggaacagau

SEQ ID NO: 254859 - RNA, 19 nt, Homo sapiens
aacaaaagcucauccauuu

SEQ ID NO: 254860 - RNA, 19 nt, Homo sapiens
ggaagugaagaaucuguuu

SEQ ID NO: 254861 - RNA, 19 nt, Homo sapiens
gcacaacauuacagggaau

SEQ ID NO: 254862 - RNA, 19 nt, Homo sapiens
caccauacuccaucaguua

SEQ ID NO: 254863 - RNA, 19 nt, Homo sapiens
cugcuggccugaaugcuua

SEQ ID NO: 254864 - RNA, 19 nt, Homo sapiens
gagaaucagcuccuuugaa

SEQ ID NO: 254865 - RNA, 19 nt, Homo sapiens
ggagauagggaaagaaagu

SEQ ID NO: 254866 - RNA, 19 nt, Homo sapiens
gacaagcaauuagacaaga

SEQ ID NO: 254867 - RNA, 19 nt, Homo sapiens
gaaccagcguguauaugag

SEQ ID NO: 254868 - RNA, 19 nt, Homo sapiens
ugauggaccugucacgauu

SEQ ID NO: 254869 - RNA, 19 nt, Homo sapiens
caacacaggcugaggaauc

SEQ ID NO: 254870 - RNA, 19 nt, Homo sapiens
gccaaagcuugaaagguuu

SEQ ID NO: 254871 - RNA, 19 nt, Homo sapiens
aaagcuugcucacaucuug

SEQ ID NO: 254872 - RNA, 19 nt, Homo sapiens
uagggccacugaagauaua

SEQ ID NO: 254873 - RNA, 19 nt, Homo sapiens
ucagcucacuguucuauuc

SEQ ID NO: 254874 - RNA, 19 nt, Homo sapiens
ucauacaucuggccguuga

SEQ ID NO: 254875 - RNA, 19 nt, Homo sapiens
ucaacugccugacaaagga

SEQ ID NO: 254876 - RNA, 19 nt, Homo sapiens
ucacaucuuggcacauuua

SEQ ID NO: 254877 - RNA, 19 nt, Homo sapiens
ugaaaaggguguuagcuaa

SEQ ID NO: 254878 - RNA, 19 nt, Homo sapiens
ccacugaagauauaacuau

SEQ ID NO: 254879 - RNA, 19 nt, Homo sapiens
aaauacaguuugucacaug

SEQ ID NO: 254880 - RNA, 19 nt, Homo sapiens
gcagagaaucagcuccuuu

SEQ ID NO: 254881 - RNA, 19 nt, Homo sapiens
guaggaaucagcaagaaga

SEQ ID NO: 254882 - RNA, 19 nt, Homo sapiens
gaagggcaaugagguucuu

SEQ ID NO: 254883 - RNA, 19 nt, Homo sapiens
gauuggagauagggaaaga

SEQ ID NO: 254884 - RNA, 19 nt, Homo sapiens
gcacaaacucaccaucugu

SEQ ID NO: 254885 - RNA, 19 nt, Homo sapiens
ggagccauguuaauguaau

SEQ ID NO: 254886 - RNA, 19 nt, Homo sapiens
gacuauagcuuugauacca

SEQ ID NO: 254887 - RNA, 19 nt, Homo sapiens
ucacacguggucuuucuua

SEQ ID NO: 254888 - RNA, 19 nt, Homo sapiens
caacacucccuucccauga

SEQ ID NO: 254889 - RNA, 19 nt, Homo sapiens
gaacagugcuugccacaga

SEQ ID NO: 254890 - RNA, 19 nt, Homo sapiens
gaaauauccugaucccuuu

SEQ ID NO: 254891 - RNA, 19 nt, Homo sapiens
acacugagcugucauguuu

SEQ ID NO: 254892 - RNA, 19 nt, Homo sapiens
caagaucccuguaaauauu

SEQ ID NO: 254893 - RNA, 19 nt, Homo sapiens
cgaaagacgugauucaauu

SEQ ID NO: 254894 - RNA, 19 nt, Homo sapiens
ggacacagaugaaacacaa

SEQ ID NO: 254895 - RNA, 19 nt, Homo sapiens
gaagcuuucugucuccuua

SEQ ID NO: 254896 - RNA, 19 nt, Homo sapiens
uaaaggaucuuaggcauga

SEQ ID NO: 254897 - RNA, 19 nt, Homo sapiens
gauuuacacuugaggcuua

SEQ ID NO: 254898 - RNA, 19 nt, Homo sapiens
gcaaugagguucuuuccau

SEQ ID NO: 254899 - RNA, 19 nt, Homo sapiens
agaaucagcuccuuugaaa

SEQ ID NO: 254900 - RNA, 19 nt, Homo sapiens
gcaaaugguucugcugaaa

SEQ ID NO: 254901 - RNA, 19 nt, Homo sapiens
ccagugagaugcauucuug

SEQ ID NO: 254902 - RNA, 19 nt, Homo sapiens
gaacuuggaggcaccauuu

SEQ ID NO: 254903 - RNA, 19 nt, Homo sapiens
ggaggcaacuuuccuuguu

SEQ ID NO: 254904 - RNA, 19 nt, Homo sapiens
cuuaagagaugccucauuu

SEQ ID NO: 254905 - RNA, 19 nt, Homo sapiens
acaggaaggugaugaaauu

SEQ ID NO: 254906 - RNA, 19 nt, Homo sapiens
gcagauauauuaagugacu

SEQ ID NO: 254907 - RNA, 19 nt, Homo sapiens
cgucuuaacucaccauaaa

SEQ ID NO: 254908 - RNA, 19 nt, Homo sapiens
ggacaggugugccgacaga

SEQ ID NO: 254909 - RNA, 19 nt, Homo sapiens
ggaagucccucucucaaca

SEQ ID NO: 254910 - RNA, 19 nt, Homo sapiens
gaagcaacauuaaagcaau

SEQ ID NO: 254911 - RNA, 19 nt, Homo sapiens
aggcaugacuguagaauuu

SEQ ID NO: 254912 - RNA, 19 nt, Homo sapiens
gcaaugccauccucaaaca

SEQ ID NO: 254913 - RNA, 19 nt, Homo sapiens
gaacauaaucuaccaacga

SEQ ID NO: 254914 - RNA, 19 nt, Homo sapiens
gaagcugcaucuuguuuau

SEQ ID NO: 254915 - RNA, 19 nt, Homo sapiens
ggaaccagcguguauauga

SEQ ID NO: 254916 - RNA, 19 nt, Homo sapiens
ccagcaaacucuauucuau

SEQ ID NO: 254917 - RNA, 19 nt, Homo sapiens
ggccuacucuuccaucuuu

SEQ ID NO: 254918 - RNA, 19 nt, Homo sapiens
cagaugagguugcuagaga

SEQ ID NO: 254919 - RNA, 19 nt, Homo sapiens
agaauuggcugaacucaug

SEQ ID NO: 254920 - RNA, 19 nt, Homo sapiens
ccagggcucugaccaguuu

SEQ ID NO: 254921 - RNA, 19 nt, Homo sapiens
caucacagcuaacaauugu

SEQ ID NO: 254922 - RNA, 19 nt, Homo sapiens
gcaagaucccuguaaauau

SEQ ID NO: 254923 - RNA, 19 nt, Homo sapiens
cgccaaagcuugaaagguu

SEQ ID NO: 254924 - RNA, 19 nt, Homo sapiens
caugagaaguugauauaga

SEQ ID NO: 254925 - RNA, 19 nt, Homo sapiens
ggcaagaucccuguaaaua

SEQ ID NO: 254926 - RNA, 19 nt, Homo sapiens
gcucacaucuuggcacauu

SEQ ID NO: 254927 - RNA, 19 nt, Homo sapiens
gcaagaagauccuaaaaca

SEQ ID NO: 254928 - RNA, 19 nt, Homo sapiens
caauggcacucccaaaguu

SEQ ID NO: 254929 - RNA, 19 nt, Homo sapiens
guaacuuccuguuuccuaa

SEQ ID NO: 254930 - RNA, 19 nt, Homo sapiens
ggacagggaugagcaugga

SEQ ID NO: 254931 - RNA, 19 nt, Homo sapiens
gcaaggaggccacgugaug

SEQ ID NO: 254932 - RNA, 19 nt, Homo sapiens
gcucaucucugucccacuu

SEQ ID NO: 254933 - RNA, 19 nt, Homo sapiens
gcguggagcugccugauau

SEQ ID NO: 254934 - RNA, 19 nt, Homo sapiens
gaggcaagaucccuguaaa

SEQ ID NO: 254935 - RNA, 19 nt, Homo sapiens
agacaagccucucaccauu

SEQ ID NO: 254936 - RNA, 19 nt, Homo sapiens
ggaagggacuauucagaag

SEQ ID NO: 254937 - RNA, 19 nt, Homo sapiens
ggaggaaggugcuggucuu

SEQ ID NO: 254938 - RNA, 19 nt, Homo sapiens
gguuaucugucccagguua

SEQ ID NO: 254939 - RNA, 19 nt, Homo sapiens
gccaagggaugaaagagaa

SEQ ID NO: 254940 - RNA, 19 nt, Homo sapiens
gaacagcaacucaaagaag

SEQ ID NO: 254941 - RNA, 19 nt, Homo sapiens
gcucaauggugaaucaaug

SEQ ID NO: 254942 - RNA, 19 nt, Homo sapiens
gaagcaggcuacacugaca

SEQ ID NO: 254943 - RNA, 19 nt, Homo sapiens
uaacuuguuuggccuauuc

SEQ ID NO: 254944 - RNA, 19 nt, Homo sapiens
gaaggaaccagcguguaua

SEQ ID NO: 254945 - RNA, 19 nt, Homo sapiens
acaagccucucaccauuaa

SEQ ID NO: 254946 - RNA, 19 nt, Homo sapiens
gaugagaaauauccugauc

SEQ ID NO: 254947 - RNA, 19 nt, Homo sapiens
gcuccuaaccuuccuguaa

SEQ ID NO: 254948 - RNA, 19 nt, Homo sapiens
gcacuuaaugaaugaauga

SEQ ID NO: 254949 - RNA, 19 nt, Homo sapiens
ugaaagagaagguggguuu

SEQ ID NO: 254950 - RNA, 19 nt, Homo sapiens
cagcagcacugugaagaaa

SEQ ID NO: 254951 - RNA, 19 nt, Homo sapiens
gggacgagauuguggaaau

SEQ ID NO: 254952 - RNA, 19 nt, Homo sapiens
ggagcucaauggugaauca

SEQ ID NO: 254953 - RNA, 19 nt, Homo sapiens
cagcuucacuuccucuuug

SEQ ID NO: 254954 - RNA, 19 nt, Homo sapiens
gcaccgccaagcccaauua

SEQ ID NO: 254955 - RNA, 19 nt, Homo sapiens
ggaaggugaugaaauucug

SEQ ID NO: 254956 - RNA, 19 nt, Homo sapiens
gguguuagcuaaaggaucu

SEQ ID NO: 254957 - RNA, 19 nt, Homo sapiens
caucugggcuccuaaccuu

SEQ ID NO: 254958 - RNA, 19 nt, Homo sapiens
gagcagaucuagaaaacaa

SEQ ID NO: 254959 - RNA, 19 nt, Homo sapiens
gcaauagaacagagaaaga

SEQ ID NO: 254960 - RNA, 19 nt, Homo sapiens
guggagccauguuaaugua

SEQ ID NO: 254961 - RNA, 19 nt, Homo sapiens
gauguuggcugggaacuca

SEQ ID NO: 254962 - RNA, 19 nt, Homo sapiens
gauacaaauugcagacugu

SEQ ID NO: 254963 - RNA, 19 nt, Homo sapiens
uaacacacagcucccauaa

SEQ ID NO: 254964 - RNA, 19 nt, Homo sapiens
gccaauaacacacagcuaa

SEQ ID NO: 254965 - RNA, 19 nt, Homo sapiens
gacaagccucucaccauua

SEQ ID NO: 254966 - RNA, 19 nt, Homo sapiens
ccagugauguuucuguaga

SEQ ID NO: 254967 - RNA, 19 nt, Homo sapiens
ucaaugaagucuacacgau

SEQ ID NO: 254968 - RNA, 19 nt, Homo sapiens
ccuaaagccugccaccaaa

SEQ ID NO: 254969 - RNA, 19 nt, Homo sapiens
gauucacacugucugguuu

SEQ ID NO: 254970 - RNA, 19 nt, Homo sapiens
gcaguggccuucccuaaaa

SEQ ID NO: 254971 - RNA, 19 nt, Homo sapiens
gaaagacgugauucaauuc

SEQ ID NO: 254972 - RNA, 19 nt, Homo sapiens
gaugaaacacaaacaauag

SEQ ID NO: 254973 - RNA, 19 nt, Homo sapiens
gugauucgguggagacuau

SEQ ID NO: 254974 - RNA, 19 nt, Homo sapiens
ggcaucagcuggcgucaug

SEQ ID NO: 254975 - RNA, 19 nt, Homo sapiens
guaacugugucaugauuca

SEQ ID NO: 254976 - RNA, 19 nt, Homo sapiens
ggagcagccucagaacaaa

SEQ ID NO: 254977 - RNA, 19 nt, Homo sapiens
gcaauuagacggcauccau

SEQ ID NO: 254978 - RNA, 19 nt, Homo sapiens
gauuugggcuggaacagau

SEQ ID NO: 254979 - RNA, 19 nt, Homo sapiens
aacaaaagcucauccauuu

SEQ ID NO: 254980 - RNA, 19 nt, Homo sapiens
ggaagugaagaaucuguuu

SEQ ID NO: 254981 - RNA, 19 nt, Homo sapiens
gcacaacauuacagggaau

SEQ ID NO: 254982 - RNA, 19 nt, Homo sapiens
caccauacuccaucaguua

SEQ ID NO: 254983 - RNA, 19 nt, Homo sapiens
cugcuggccugaaugcuua

SEQ ID NO: 254984 - RNA, 19 nt, Homo sapiens
gagaaucagcuccuuugaa

SEQ ID NO: 254985 - RNA, 19 nt, Homo sapiens
ggagauagggaaagaaagu

SEQ ID NO: 254986 - RNA, 19 nt, Homo sapiens
gacaagcaauuagacaaga

SEQ ID NO: 254987 - RNA, 19 nt, Homo sapiens
gaaccagcguguauaugag

SEQ ID NO: 254988 - RNA, 19 nt, Homo sapiens
ugauggaccugucacgauu

SEQ ID NO: 254989 - RNA, 19 nt, Homo sapiens
gaaagaaacuccuguauau

SEQ ID NO: 254990 - RNA, 19 nt, Homo sapiens
ggacagagcuggugauaaa

SEQ ID NO: 254991 - RNA, 19 nt, Homo sapiens
ggaaucagcuuugcuagua

SEQ ID NO: 254992 - RNA, 19 nt, Homo sapiens
ggaaagaguucaagugucu

SEQ ID NO: 254993 - RNA, 19 nt, Homo sapiens
caaaggaccugugacauau

SEQ ID NO: 254994 - RNA, 19 nt, Homo sapiens
gaaagucugugcuugugaa

SEQ ID NO: 254995 - RNA, 19 nt, Homo sapiens
gcugguacauucugugaua

SEQ ID NO: 254996 - RNA, 19 nt, Homo sapiens
gagaccagcuaauuugauu

SEQ ID NO: 254997 - RNA, 19 nt, Homo sapiens
uaacagaacagacagauga

SEQ ID NO: 254998 - RNA, 19 nt, Homo sapiens
gauaauaacaggaaucaga

SEQ ID NO: 254999 - RNA, 19 nt, Homo sapiens
cagcuuugcuaguaucaua

SEQ ID NO: 255000 - RNA, 19 nt, Homo sapiens
uaaacaaggucaagaacug

SEQ ID NO: 255001 - RNA, 19 nt, Homo sapiens
ugacugcacuccaggguuu

SEQ ID NO: 255002 - RNA, 19 nt, Homo sapiens
gaaggaggaugugaacugu

SEQ ID NO: 255003 - RNA, 19 nt, Homo sapiens
acaaaggaccugugacaua

SEQ ID NO: 255004 - RNA, 19 nt, Homo sapiens
gagcagagugccugaguuu

SEQ ID NO: 255005 - RNA, 19 nt, Homo sapiens
uaccaaagccaauaaauga

SEQ ID NO: 255006 - RNA, 19 nt, Homo sapiens
ccucacaccuucugccuuu

SEQ ID NO: 255007 - RNA, 19 nt, Homo sapiens
guaaguacccgacuaaagu

SEQ ID NO: 255008 - RNA, 19 nt, Homo sapiens
agaaagaaacuccuguaua

SEQ ID NO: 255009 - RNA, 19 nt, Homo sapiens
gaugugaacugugaaaugg

SEQ ID NO: 255010 - RNA, 19 nt, Homo sapiens
gguacauucugugauaaua

SEQ ID NO: 255011 - RNA, 19 nt, Homo sapiens
gaguucaagugucuguaua

SEQ ID NO: 255012 - RNA, 19 nt, Homo sapiens
gcaguaaguacccgacuaa

SEQ ID NO: 255013 - RNA, 19 nt, Homo sapiens
gcagaaagaaacuccugua

SEQ ID NO: 255014 - RNA, 19 nt, Homo sapiens
gaucaucuccuucuuucuu

SEQ ID NO: 255015 - RNA, 19 nt, Homo sapiens
ggacaaaggaccugugaca

SEQ ID NO: 255016 - RNA, 19 nt, Homo sapiens
uaagccagguuacauucua

SEQ ID NO: 255017 - RNA, 19 nt, Homo sapiens
caaacaaccauuuaugaga

SEQ ID NO: 255018 - RNA, 19 nt, Homo sapiens
gaaaagaagcaaggaaaua

SEQ ID NO: 255019 - RNA, 19 nt, Homo sapiens
uaacagguuugagcuaguu

SEQ ID NO: 255020 - RNA, 19 nt, Homo sapiens
caccacaccugacuaacuu

SEQ ID NO: 255021 - RNA, 19 nt, Homo sapiens
cauaguagccacucuguug

SEQ ID NO: 255022 - RNA, 19 nt, Homo sapiens
gcagagugccugaguuuag

SEQ ID NO: 255023 - RNA, 19 nt, Homo sapiens
agaacaccauccuacauaa

SEQ ID NO: 255024 - RNA, 19 nt, Homo sapiens
caacacacguucuuuucua

SEQ ID NO: 255025 - RNA, 19 nt, Homo sapiens
gaaucagcuuugcuaguau

SEQ ID NO: 255026 - RNA, 19 nt, Homo sapiens
gccaauaaaugaacugcau

SEQ ID NO: 255027 - RNA, 19 nt, Homo sapiens
gaacaccauccuacauaau

SEQ ID NO: 255028 - RNA, 19 nt, Homo sapiens
ccaaagugcugggauuaca

SEQ ID NO: 255029 - RNA, 19 nt, Homo sapiens
uguacaggcuggucucaaa

SEQ ID NO: 255030 - RNA, 19 nt, Homo sapiens
ggcuguagcugccgauuuc

SEQ ID NO: 255031 - RNA, 19 nt, Homo sapiens
gaaacuccuguauauauuc

SEQ ID NO: 255032 - RNA, 19 nt, Homo sapiens
uaucauaccugugccagau

SEQ ID NO: 255033 - RNA, 19 nt, Homo sapiens
guccagugguccaacuaua

SEQ ID NO: 255034 - RNA, 19 nt, Homo sapiens
aagaacaccauccuacaua

SEQ ID NO: 255035 - RNA, 19 nt, Homo sapiens
gcaagaacaccauccuaca

SEQ ID NO: 255036 - RNA, 19 nt, Homo sapiens
acaaacuacucaagaggaa

SEQ ID NO: 255037 - RNA, 19 nt, Homo sapiens
ggacauuuaacgaucagaa

SEQ ID NO: 255038 - RNA, 19 nt, Homo sapiens
gauaccacuuaacagguuu

SEQ ID NO: 255039 - RNA, 19 nt, Homo sapiens
ucauaccugugccagauuu

SEQ ID NO: 255040 - RNA, 19 nt, Homo sapiens
ugguaaagauggcauuuca

SEQ ID NO: 255041 - RNA, 19 nt, Homo sapiens
gaagaaggaggaugugaac

SEQ ID NO: 255042 - RNA, 19 nt, Homo sapiens
cagcaugugugaacaggau

SEQ ID NO: 255043 - RNA, 19 nt, Homo sapiens
cguggguucugucauguaa

SEQ ID NO: 255044 - RNA, 19 nt, Homo sapiens
aaucaaugcagguuuguuu

SEQ ID NO: 255045 - RNA, 19 nt, Homo sapiens
gaggacagagcuggugaua

SEQ ID NO: 255046 - RNA, 19 nt, Homo sapiens
ucugggagcucaagugauc

SEQ ID NO: 255047 - RNA, 19 nt, Homo sapiens
cauccgcuaucacagcuuu

SEQ ID NO: 255048 - RNA, 19 nt, Homo sapiens
ggaugugaacugugaaaug

SEQ ID NO: 255049 - RNA, 19 nt, Homo sapiens
aggaggaugugaacuguga

SEQ ID NO: 255050 - RNA, 19 nt, Homo sapiens
ccguuucucuguuguuaaa

SEQ ID NO: 255051 - RNA, 19 nt, Homo sapiens
gccacgaggugcaguaagu

SEQ ID NO: 255052 - RNA, 19 nt, Homo sapiens
ucucaagagugacauuugu

SEQ ID NO: 255053 - RNA, 19 nt, Homo sapiens
ccaauaaaugaacugcaua

SEQ ID NO: 255054 - RNA, 19 nt, Homo sapiens
agauaccacuuaacagguu

SEQ ID NO: 255055 - RNA, 19 nt, Homo sapiens
ggaagucaauagggcuguu

SEQ ID NO: 255056 - RNA, 19 nt, Homo sapiens
ggaggaaguuuuggaaaga

SEQ ID NO: 255057 - RNA, 19 nt, Homo sapiens
acagacagaugaggacaga

SEQ ID NO: 255058 - RNA, 19 nt, Homo sapiens
ggaaagucugugcuuguga

SEQ ID NO: 255059 - RNA, 19 nt, Homo sapiens
caaaauaaugcaccacuuu

SEQ ID NO: 255060 - RNA, 19 nt, Homo sapiens
caagaacaccauccuacau

SEQ ID NO: 255061 - RNA, 19 nt, Homo sapiens
gaagcaaggaaauaugagu

SEQ ID NO: 255062 - RNA, 19 nt, Homo sapiens
gcaggauccuuguaguaac

SEQ ID NO: 255063 - RNA, 19 nt, Homo sapiens
ugugaacugugaaauggaa

SEQ ID NO: 255064 - RNA, 19 nt, Homo sapiens
caccagcaaugcagagugu

SEQ ID NO: 255065 - RNA, 19 nt, Homo sapiens
gaucucaagagugacauuu

SEQ ID NO: 255066 - RNA, 19 nt, Homo sapiens
aacaccauccuacauaaua

SEQ ID NO: 255067 - RNA, 19 nt, Homo sapiens
aagaagcaaggaaauauga

SEQ ID NO: 255068 - RNA, 19 nt, Homo sapiens
aaacuguucuuuggaugga

SEQ ID NO: 255069 - RNA, 19 nt, Homo sapiens
gacauuuaacgaucagaaa

SEQ ID NO: 255070 - RNA, 19 nt, Homo sapiens
ugugugaacaggauuguaa

SEQ ID NO: 255071 - RNA, 19 nt, Homo sapiens
ggaccaggaaggaguguuc

SEQ ID NO: 255072 - RNA, 19 nt, Homo sapiens
cagcgcagguggacaaagg

SEQ ID NO: 255073 - RNA, 19 nt, Homo sapiens
uaaguacccgacuaaaguu

SEQ ID NO: 255074 - RNA, 19 nt, Homo sapiens
ucaagagugacauuuguga

SEQ ID NO: 255075 - RNA, 19 nt, Homo sapiens
cagaaagaaacuccuguau

SEQ ID NO: 255076 - RNA, 19 nt, Homo sapiens
ggagagggacguggucugu

SEQ ID NO: 255077 - RNA, 19 nt, Homo sapiens
gacauaugcaggcagugua

SEQ ID NO: 255078 - RNA, 19 nt, Homo sapiens
caaagccaauaaaugaacu

SEQ ID NO: 255079 - RNA, 19 nt, Homo sapiens
guucaagugucuguauauc

SEQ ID NO: 255080 - RNA, 19 nt, Homo sapiens
gugcugggauuacagacau

SEQ ID NO: 255081 - RNA, 19 nt, Homo sapiens
ggucucaaacuccuagguu

SEQ ID NO: 255082 - RNA, 19 nt, Homo sapiens
agaagaagaaggaggaugu

SEQ ID NO: 255083 - RNA, 19 nt, Homo sapiens
gaucagaaacguggcaucu

SEQ ID NO: 255084 - RNA, 19 nt, Homo sapiens
aagccagguuacauucuaa

SEQ ID NO: 255085 - RNA, 19 nt, Homo sapiens
ugugagaccagcuaauuug

SEQ ID NO: 255086 - RNA, 19 nt, Homo sapiens
ucaagugucuguauauccu

SEQ ID NO: 255087 - RNA, 19 nt, Homo sapiens
aaacuccuagguucacuuu

SEQ ID NO: 255088 - RNA, 19 nt, Homo sapiens
gaggaugugaacugugaaa

SEQ ID NO: 255089 - RNA, 19 nt, Homo sapiens
ccaauuugcuucuuguuua

SEQ ID NO: 255090 - RNA, 19 nt, Homo sapiens
cuaacucucuguuccauua

SEQ ID NO: 255091 - RNA, 19 nt, Homo sapiens
aauuaaagcuucagaggua

SEQ ID NO: 255092 - RNA, 19 nt, Homo sapiens
aaacucagcucuucccuau

SEQ ID NO: 255093 - RNA, 19 nt, Homo sapiens
uaacauggcugaaaagaaa

SEQ ID NO: 255094 - RNA, 19 nt, Homo sapiens
gaauuaccuuucccucuuu

SEQ ID NO: 255095 - RNA, 19 nt, Homo sapiens
gaacauccauaaccggaau

SEQ ID NO: 255096 - RNA, 19 nt, Homo sapiens
gggaagaguuaugcaaauu

SEQ ID NO: 255097 - RNA, 19 nt, Homo sapiens
gauaugagaucugaauuac

SEQ ID NO: 255098 - RNA, 19 nt, Homo sapiens
ccagaguaguuucaaguuu

SEQ ID NO: 255099 - RNA, 19 nt, Homo sapiens
gaagaguuaugcaaauucu

SEQ ID NO: 255100 - RNA, 19 nt, Homo sapiens
gggccuggcuucugucuga

SEQ ID NO: 255101 - RNA, 19 nt, Homo sapiens
agacuacaauguccaguuu

SEQ ID NO: 255102 - RNA, 19 nt, Homo sapiens
ugaauuaccuuucccucuu

SEQ ID NO: 255103 - RNA, 19 nt, Homo sapiens
uaacaaugaccuggaaaua

SEQ ID NO: 255104 - RNA, 19 nt, Homo sapiens
uaaggcaguuuguccaauu

SEQ ID NO: 255105 - RNA, 19 nt, Homo sapiens
gaucaacagaccaacauuu

SEQ ID NO: 255106 - RNA, 19 nt, Homo sapiens
uaucaguucugccuaggua

SEQ ID NO: 255107 - RNA, 19 nt, Homo sapiens
caaauucuccuauaagcaa

SEQ ID NO: 255108 - RNA, 19 nt, Homo sapiens
acucagcucuucccuauug

SEQ ID NO: 255109 - RNA, 19 nt, Homo sapiens
cagaguaguuucaaguuuc

SEQ ID NO: 255110 - RNA, 19 nt, Homo sapiens
gaguaacaaugaccuggaa

SEQ ID NO: 255111 - RNA, 19 nt, Homo sapiens
gaaucacaaucccacgaaa

SEQ ID NO: 255112 - RNA, 19 nt, Homo sapiens
caaagcaguuagacuaugg

SEQ ID NO: 255113 - RNA, 19 nt, Homo sapiens
cacauucaauuccagagua

SEQ ID NO: 255114 - RNA, 19 nt, Homo sapiens
cuagguaaauguaagauag

SEQ ID NO: 255115 - RNA, 19 nt, Homo sapiens
gauaggaauagagcaaaua

SEQ ID NO: 255116 - RNA, 19 nt, Homo sapiens
gaaaaguucagcccaagua

SEQ ID NO: 255117 - RNA, 19 nt, Homo sapiens
ggcaugucauuauuaaaga

SEQ ID NO: 255118 - RNA, 19 nt, Homo sapiens
ggaauagagcaaauaagau

SEQ ID NO: 255119 - RNA, 19 nt, Homo sapiens
gcaauuuguugagguuuua

SEQ ID NO: 255120 - RNA, 19 nt, Homo sapiens
guaccaauuugcuucuugu

SEQ ID NO: 255121 - RNA, 19 nt, Homo sapiens
gauaauggcccugaggaau

SEQ ID NO: 255122 - RNA, 19 nt, Homo sapiens
gaacaccgacuaagguuuu

SEQ ID NO: 255123 - RNA, 19 nt, Homo sapiens
ggaagaguuaugcaaauuc

SEQ ID NO: 255124 - RNA, 19 nt, Homo sapiens
agagauacagcaagucuaa

SEQ ID NO: 255125 - RNA, 19 nt, Homo sapiens
ccaaagcaguuagacuaug

SEQ ID NO: 255126 - RNA, 19 nt, Homo sapiens
uuuaauaugcccugagaua

SEQ ID NO: 255127 - RNA, 19 nt, Homo sapiens
ggaaucacaaucccacgaa

SEQ ID NO: 255128 - RNA, 19 nt, Homo sapiens
uaugagaucugaauuaccu

SEQ ID NO: 255129 - RNA, 19 nt, Homo sapiens
ggcaguuuguccaauuaaa

SEQ ID NO: 255130 - RNA, 19 nt, Homo sapiens
uacaagagauacagcaagu

SEQ ID NO: 255131 - RNA, 19 nt, Homo sapiens
aaagcacuauuaucaguuc

SEQ ID NO: 255132 - RNA, 19 nt, Homo sapiens
aaggcaguuuguccaauua

SEQ ID NO: 255133 - RNA, 19 nt, Homo sapiens
ucaaagacagccucauuuc

SEQ ID NO: 255134 - RNA, 19 nt, Homo sapiens
ccaaaagguccucagauua

SEQ ID NO: 255135 - RNA, 19 nt, Homo sapiens
gaucaaggcaccacacaac

SEQ ID NO: 255136 - RNA, 19 nt, Homo sapiens
aggaauagagcaaauaaga

SEQ ID NO: 255137 - RNA, 19 nt, Homo sapiens
ggaacccucauccuucaaa

SEQ ID NO: 255138 - RNA, 19 nt, Homo sapiens
ugaggacccugagagauau

SEQ ID NO: 255139 - RNA, 19 nt, Homo sapiens
ccacacaacccagaaagga

SEQ ID NO: 255140 - RNA, 19 nt, Homo sapiens
uuucaaguuucacaucgua

SEQ ID NO: 255141 - RNA, 19 nt, Homo sapiens
gcaagucuaacucucuguu

SEQ ID NO: 255142 - RNA, 19 nt, Homo sapiens
ggacugugauggucaaccu

SEQ ID NO: 255143 - RNA, 19 nt, Homo sapiens
gcaccacacaacccagaaa

SEQ ID NO: 255144 - RNA, 19 nt, Homo sapiens
guuauaacauggcugaaaa

SEQ ID NO: 255145 - RNA, 19 nt, Homo sapiens
aggaagguuugacugagua

SEQ ID NO: 255146 - RNA, 19 nt, Homo sapiens
cauaaccggaauaccaaua

SEQ ID NO: 255147 - RNA, 19 nt, Homo sapiens
ccuagggccuggcuucugu

SEQ ID NO: 255148 - RNA, 19 nt, Homo sapiens
gaagaccucauugguguca

SEQ ID NO: 255149 - RNA, 19 nt, Homo sapiens
gcaaauucuccuauaagca

SEQ ID NO: 255150 - RNA, 19 nt, Homo sapiens
agaaggaagguuugacuga

SEQ ID NO: 255151 - RNA, 19 nt, Homo sapiens
gaacccucauccuucaaag

SEQ ID NO: 255152 - RNA, 19 nt, Homo sapiens
ucaaucacauucaauucca

SEQ ID NO: 255153 - RNA, 19 nt, Homo sapiens
gagaucaacagaccaacau

SEQ ID NO: 255154 - RNA, 19 nt, Homo sapiens
caggaugcccaaauucuga

SEQ ID NO: 255155 - RNA, 19 nt, Homo sapiens
acuauuagccaaugcugua

SEQ ID NO: 255156 - RNA, 19 nt, Homo sapiens
gauuucacaugccuucaag

SEQ ID NO: 255157 - RNA, 19 nt, Homo sapiens
gcaugucuuugaguaacaa

SEQ ID NO: 255158 - RNA, 19 nt, Homo sapiens
caagagauacagcaagucu

SEQ ID NO: 255159 - RNA, 19 nt, Homo sapiens
ucugagucuuuacaacaua

SEQ ID NO: 255160 - RNA, 19 nt, Homo sapiens
uuaauaugcccugagauaa

SEQ ID NO: 255161 - RNA, 19 nt, Homo sapiens
cacaugccuucaagacuga

SEQ ID NO: 255162 - RNA, 19 nt, Homo sapiens
uauaguauuuccuccucuu

SEQ ID NO: 255163 - RNA, 19 nt, Homo sapiens
gaauuaaauggcagugcaa

SEQ ID NO: 255164 - RNA, 19 nt, Homo sapiens
gaaggcaggaaucacaauc

SEQ ID NO: 255165 - RNA, 19 nt, Homo sapiens
caauuugcuucuuguuuac

SEQ ID NO: 255166 - RNA, 19 nt, Homo sapiens
uuucacaucguaaccauuu

SEQ ID NO: 255167 - RNA, 19 nt, Homo sapiens
gggcagaacgaacuuuaag

SEQ ID NO: 255168 - RNA, 19 nt, Homo sapiens
gacucaggcuuccuuugga

SEQ ID NO: 255169 - RNA, 19 nt, Homo sapiens
ccugaggaauggcauguca

SEQ ID NO: 255170 - RNA, 19 nt, Homo sapiens
ugauaggaauagagcaaau

SEQ ID NO: 255171 - RNA, 19 nt, Homo sapiens
acaaugaccuggaaauacc

SEQ ID NO: 255172 - RNA, 19 nt, Homo sapiens
guaacaaugaccuggaaau

SEQ ID NO: 255173 - RNA, 19 nt, Homo sapiens
gagauaacuuugggguaua

SEQ ID NO: 255174 - RNA, 19 nt, Homo sapiens
gcaguuuguccaauuaaag

SEQ ID NO: 255175 - RNA, 19 nt, Homo sapiens
cuucaaagacagccucauu

SEQ ID NO: 255176 - RNA, 19 nt, Homo sapiens
gagauaucccucugugauc

SEQ ID NO: 255177 - RNA, 19 nt, Homo sapiens
caaugaggacccugagaga

SEQ ID NO: 255178 - RNA, 19 nt, Homo sapiens
agaguaguuucaaguuuca

SEQ ID NO: 255179 - RNA, 19 nt, Homo sapiens
ugggaagaguuaugcaaau

SEQ ID NO: 255180 - RNA, 19 nt, Homo sapiens
augaggacccugagagaua

SEQ ID NO: 255181 - RNA, 19 nt, Homo sapiens
cgacuaagguuuucauacu

SEQ ID NO: 255182 - RNA, 19 nt, Homo sapiens
acaacauacggauauagua

SEQ ID NO: 255183 - RNA, 19 nt, Homo sapiens
gcaaaauuucugagucuuu

SEQ ID NO: 255184 - RNA, 19 nt, Homo sapiens
cccaaaagguccucagauu

SEQ ID NO: 255185 - RNA, 19 nt, Homo sapiens
aaaguucagcccaaguaaa

SEQ ID NO: 255186 - RNA, 19 nt, Homo sapiens
uaauggcccugaggaaugg

SEQ ID NO: 255187 - RNA, 19 nt, Homo sapiens
gacuaagguuuucauacua

SEQ ID NO: 255188 - RNA, 19 nt, Homo sapiens
uuagcaaacucagcucuuc

SEQ ID NO: 255189 - RNA, 19 nt, Homo sapiens
gaaaugaauccuccugaua

SEQ ID NO: 255190 - RNA, 19 nt, Homo sapiens
gacaauacgcuuuacuuua

SEQ ID NO: 255191 - RNA, 19 nt, Homo sapiens
gaaggauacuuucuagcuu

SEQ ID NO: 255192 - RNA, 19 nt, Homo sapiens
gagccgagauugcaccauu

SEQ ID NO: 255193 - RNA, 19 nt, Homo sapiens
gaaaccucaucucuacuaa

SEQ ID NO: 255194 - RNA, 19 nt, Homo sapiens
gauucugacuguagagaua

SEQ ID NO: 255195 - RNA, 19 nt, Homo sapiens
ggaaaugaauccuccugau

SEQ ID NO: 255196 - RNA, 19 nt, Homo sapiens
ggugaaaccucaucucuac

SEQ ID NO: 255197 - RNA, 19 nt, Homo sapiens
gacaucauauucuuucaga

SEQ ID NO: 255198 - RNA, 19 nt, Homo sapiens
ugaccaaguucucuucauu

SEQ ID NO: 255199 - RNA, 19 nt, Homo sapiens
gauggcugcugaaccagua

SEQ ID NO: 255200 - RNA, 19 nt, Homo sapiens
aaaugaauccuccugauaa

SEQ ID NO: 255201 - RNA, 19 nt, Homo sapiens
gaagacaauugcaucaacu

SEQ ID NO: 255202 - RNA, 19 nt, Homo sapiens
aaagauggcugcugaacca

SEQ ID NO: 255203 - RNA, 19 nt, Homo sapiens
gaucuauaauguucacugu

SEQ ID NO: 255204 - RNA, 19 nt, Homo sapiens
gauacuuucuagcuuguga

SEQ ID NO: 255205 - RNA, 19 nt, Homo sapiens
guaacuaucucugugaagu

SEQ ID NO: 255206 - RNA, 19 nt, Homo sapiens
uuggcaagcuugaaucuaa

SEQ ID NO: 255207 - RNA, 19 nt, Homo sapiens
ugacaauacgcuuuacuuu

SEQ ID NO: 255208 - RNA, 19 nt, Homo sapiens
ucuauaauguucacuguuc

SEQ ID NO: 255209 - RNA, 19 nt, Homo sapiens
uuucaacucucuccuguga

SEQ ID NO: 255210 - RNA, 19 nt, Homo sapiens
uugaagauaugacugauuc

SEQ ID NO: 255211 - RNA, 19 nt, Homo sapiens
gaaauuugaaugaccaagu

SEQ ID NO: 255212 - RNA, 19 nt, Homo sapiens
ugaaaccucaucucuacua

SEQ ID NO: 255213 - RNA, 19 nt, Homo sapiens
caucauauucuuucagaga

SEQ ID NO: 255214 - RNA, 19 nt, Homo sapiens
ggacagucagcaaggaauu

SEQ ID NO: 255215 - RNA, 19 nt, Homo sapiens
ccaaggaaaucggccucua

SEQ ID NO: 255216 - RNA, 19 nt, Homo sapiens
cuuuauagcugaagaugau

SEQ ID NO: 255217 - RNA, 19 nt, Homo sapiens
gacaauugcaucaacuuug

SEQ ID NO: 255218 - RNA, 19 nt, Homo sapiens
gcaaaacuccaucucaaaa

SEQ ID NO: 255219 - RNA, 19 nt, Homo sapiens
gcucuagccugggcaacaa

SEQ ID NO: 255220 - RNA, 19 nt, Homo sapiens
gaggucagguguucaagac

SEQ ID NO: 255221 - RNA, 19 nt, Homo sapiens
aaagauagccagccuagag

SEQ ID NO: 255222 - RNA, 19 nt, Homo sapiens
caaggaaaucggccucuau

SEQ ID NO: 255223 - RNA, 19 nt, Homo sapiens
gaccaaguucucuucauug

SEQ ID NO: 255224 - RNA, 19 nt, Homo sapiens
gauagccagccuagaggua

SEQ ID NO: 255225 - RNA, 19 nt, Homo sapiens
gaagauaugacugauucug

SEQ ID NO: 255226 - RNA, 19 nt, Homo sapiens
ucccaggacaugauaauaa

SEQ ID NO: 255227 - RNA, 19 nt, Homo sapiens
caacuuuguggcaaugaaa

SEQ ID NO: 255228 - RNA, 19 nt, Homo sapiens
guagaagacaauugcauca

SEQ ID NO: 255229 - RNA, 19 nt, Homo sapiens
gauaacaucaaggauacaa

SEQ ID NO: 255230 - RNA, 19 nt, Homo sapiens
gagguauggcuguaacuau

SEQ ID NO: 255231 - RNA, 19 nt, Homo sapiens
gcaucaacuuuguggcaau

SEQ ID NO: 255232 - RNA, 19 nt, Homo sapiens
gaauccuccugauaacauc

SEQ ID NO: 255233 - RNA, 19 nt, Homo sapiens
gaaugaccaaguucucuuc

SEQ ID NO: 255234 - RNA, 19 nt, Homo sapiens
uggcaagcuugaaucuaaa

SEQ ID NO: 255235 - RNA, 19 nt, Homo sapiens
cagcaaaacuccaucucaa

SEQ ID NO: 255236 - RNA, 19 nt, Homo sapiens
auacgaaggauacuuucua

SEQ ID NO: 255237 - RNA, 19 nt, Homo sapiens
accaaguucucuucauuga

SEQ ID NO: 255238 - RNA, 19 nt, Homo sapiens
cggccucuauuugaagaua

SEQ ID NO: 255239 - RNA, 19 nt, Homo sapiens
caucaacuuuguggcaaug

SEQ ID NO: 255240 - RNA, 19 nt, Homo sapiens
ucaacuuuguggcaaugaa

SEQ ID NO: 255241 - RNA, 19 nt, Homo sapiens
gcaagcuugaaucuaaauu

SEQ ID NO: 255242 - RNA, 19 nt, Homo sapiens
agacaauugcaucaacuuu

SEQ ID NO: 255243 - RNA, 19 nt, Homo sapiens
agaagacaauugcaucaac

SEQ ID NO: 255244 - RNA, 19 nt, Homo sapiens
cgaaggauacuuucuagcu

SEQ ID NO: 255245 - RNA, 19 nt, Homo sapiens
uacgaaggauacuuucuag

SEQ ID NO: 255246 - RNA, 19 nt, Homo sapiens
ugacugauucugacuguag

SEQ ID NO: 255247 - RNA, 19 nt, Homo sapiens
agaccagccugaccaacau

SEQ ID NO: 255248 - RNA, 19 nt, Homo sapiens
cccaggacaugauaauaag

SEQ ID NO: 255249 - RNA, 19 nt, Homo sapiens
gaaccaguagaagacaauu

SEQ ID NO: 255250 - RNA, 19 nt, Homo sapiens
aaaauuagcugaguguagu

SEQ ID NO: 255251 - RNA, 19 nt, Homo sapiens
ccagaggucagguguucaa

SEQ ID NO: 255252 - RNA, 19 nt, Homo sapiens
gcuguaacuaucucuguga

SEQ ID NO: 255253 - RNA, 19 nt, Homo sapiens
gccuagagguauggcugua

SEQ ID NO: 255254 - RNA, 19 nt, Homo sapiens
gacugauucugacuguaga

SEQ ID NO: 255255 - RNA, 19 nt, Homo sapiens
uaugacugauucugacugu

SEQ ID NO: 255256 - RNA, 19 nt, Homo sapiens
aaggaaaucggccucuauu

SEQ ID NO: 255257 - RNA, 19 nt, Homo sapiens
cuaucucugugaaguguga

SEQ ID NO: 255258 - RNA, 19 nt, Homo sapiens
aagauaugacugauucuga

SEQ ID NO: 255259 - RNA, 19 nt, Homo sapiens
gacaugauaauaagaugca

SEQ ID NO: 255260 - RNA, 19 nt, Homo sapiens
aaccucaucucuacuaaaa

SEQ ID NO: 255261 - RNA, 19 nt, Homo sapiens
ugaauccuccugauaacau

SEQ ID NO: 255262 - RNA, 19 nt, Homo sapiens
ucucuucauugaccaagga

SEQ ID NO: 255263 - RNA, 19 nt, Homo sapiens
cuauaauguucacuguuca

SEQ ID NO: 255264 - RNA, 19 nt, Homo sapiens
agguauggcuguaacuauc

SEQ ID NO: 255265 - RNA, 19 nt, Homo sapiens
ccccggaccauauuuauua

SEQ ID NO: 255266 - RNA, 19 nt, Homo sapiens
ugaaugaccaaguucucuu

SEQ ID NO: 255267 - RNA, 19 nt, Homo sapiens
aaucccagcuacucaagag

SEQ ID NO: 255268 - RNA, 19 nt, Homo sapiens
caggacaugauaauaagau

SEQ ID NO: 255269 - RNA, 19 nt, Homo sapiens
uaacuaucucugugaagug

SEQ ID NO: 255270 - RNA, 19 nt, Homo sapiens
aaaccucaucucuacuaaa

SEQ ID NO: 255271 - RNA, 19 nt, Homo sapiens
ccuguaaucccagcccuuu

SEQ ID NO: 255272 - RNA, 19 nt, Homo sapiens
gcaccccggaccauauuua

SEQ ID NO: 255273 - RNA, 19 nt, Homo sapiens
gacagucagcaaggaauug

SEQ ID NO: 255274 - RNA, 19 nt, Homo sapiens
cuagagguauggcuguaac

SEQ ID NO: 255275 - RNA, 19 nt, Homo sapiens
gccucuauuugaagauaug

SEQ ID NO: 255276 - RNA, 19 nt, Homo sapiens
ggccucuauuugaagauau

SEQ ID NO: 255277 - RNA, 19 nt, Homo sapiens
cacuugcacuccggaggua

SEQ ID NO: 255278 - RNA, 19 nt, Homo sapiens
cugcugaaccaguagaaga

SEQ ID NO: 255279 - RNA, 19 nt, Homo sapiens
aaugaauccuccugauaac

SEQ ID NO: 255280 - RNA, 19 nt, Homo sapiens
uagccagccuagagguaug

SEQ ID NO: 255281 - RNA, 19 nt, Homo sapiens
augaaaaccuggaaucaga

SEQ ID NO: 255282 - RNA, 19 nt, Homo sapiens
gcacuuaacuguucucuuu

SEQ ID NO: 255283 - RNA, 19 nt, Homo sapiens
gacaagggcuggcagaauu

SEQ ID NO: 255284 - RNA, 19 nt, Homo sapiens
gcggagacauguggaauua

SEQ ID NO: 255285 - RNA, 19 nt, Homo sapiens
ucacaucacuccauuucua

SEQ ID NO: 255286 - RNA, 19 nt, Homo sapiens
gcacaaacaucaagauaac

SEQ ID NO: 255287 - RNA, 19 nt, Homo sapiens
gcaaagaaacaacauaguu

SEQ ID NO: 255288 - RNA, 19 nt, Homo sapiens
ggagacauguggaauuaga

SEQ ID NO: 255289 - RNA, 19 nt, Homo sapiens
gagcugcacuuaacuguuc

SEQ ID NO: 255290 - RNA, 19 nt, Homo sapiens
caucugaccucaauuuaau

SEQ ID NO: 255291 - RNA, 19 nt, Homo sapiens
ggaccgcucucuucuagga

SEQ ID NO: 255292 - RNA, 19 nt, Homo sapiens
caacaccagcuaccaauaa

SEQ ID NO: 255293 - RNA, 19 nt, Homo sapiens
ucgaguaucugaugaagaa

SEQ ID NO: 255294 - RNA, 19 nt, Homo sapiens
acaaacagcucacccugaa

SEQ ID NO: 255295 - RNA, 19 nt, Homo sapiens
gagcacaaacaucaagaua

SEQ ID NO: 255296 - RNA, 19 nt, Homo sapiens
gaacaaaacccacacacaa

SEQ ID NO: 255297 - RNA, 19 nt, Homo sapiens
caaagccgccuuacuccua

SEQ ID NO: 255298 - RNA, 19 nt, Homo sapiens
gcacucacguggcaucagu

SEQ ID NO: 255299 - RNA, 19 nt, Homo sapiens
ggucaccucuguccaguca

SEQ ID NO: 255300 - RNA, 19 nt, Homo sapiens
ggauagacccagccucuga

SEQ ID NO: 255301 - RNA, 19 nt, Homo sapiens
cgggagagcuuuucuuuaa

SEQ ID NO: 255302 - RNA, 19 nt, Homo sapiens
uacgauggcucccgacaaa

SEQ ID NO: 255303 - RNA, 19 nt, Homo sapiens
uuuaauggcugacaacuca

SEQ ID NO: 255304 - RNA, 19 nt, Homo sapiens
ggaagucaaagugaaagua

SEQ ID NO: 255305 - RNA, 19 nt, Homo sapiens
cacaaucucucucugaauc

SEQ ID NO: 255306 - RNA, 19 nt, Homo sapiens
uaaaacaagucucggaauu

SEQ ID NO: 255307 - RNA, 19 nt, Homo sapiens
gagcuuuucuuuaacgaua

SEQ ID NO: 255308 - RNA, 19 nt, Homo sapiens
gagcugaagcggaucaaga

SEQ ID NO: 255309 - RNA, 19 nt, Homo sapiens
ugaagcggaucaagacaga

SEQ ID NO: 255310 - RNA, 19 nt, Homo sapiens
ucaccgagcugcacuuaac

SEQ ID NO: 255311 - RNA, 19 nt, Homo sapiens
gccacaaucucucucugaa

SEQ ID NO: 255312 - RNA, 19 nt, Homo sapiens
gaagucaaagugaaaguag

SEQ ID NO: 255313 - RNA, 19 nt, Homo sapiens
ggcgugcccugcuuuagaa

SEQ ID NO: 255314 - RNA, 19 nt, Homo sapiens
gagguguccuuucuuuaca

SEQ ID NO: 255315 - RNA, 19 nt, Homo sapiens
ugaacgggauuuauacaca

SEQ ID NO: 255316 - RNA, 19 nt, Homo sapiens
ggacaagggcuggcagaau

SEQ ID NO: 255317 - RNA, 19 nt, Homo sapiens
gagacagcccgaaggauga

SEQ ID NO: 255318 - RNA, 19 nt, Homo sapiens
uuaacgauaucaacucugu

SEQ ID NO: 255319 - RNA, 19 nt, Homo sapiens
gcaaaauuuuccacucuga

SEQ ID NO: 255320 - RNA, 19 nt, Homo sapiens
gggcaaagaaacaacauag

SEQ ID NO: 255321 - RNA, 19 nt, Homo sapiens
acagggaagucaaagugaa

SEQ ID NO: 255322 - RNA, 19 nt, Homo sapiens
ccacagggaagucaaagug

SEQ ID NO: 255323 - RNA, 19 nt, Homo sapiens
gcccgaaggaugauucaaa

SEQ ID NO: 255324 - RNA, 19 nt, Homo sapiens
aaacccagcuggccuuaac

SEQ ID NO: 255325 - RNA, 19 nt, Homo sapiens
ucaacucuguggugccaaa

SEQ ID NO: 255326 - RNA, 19 nt, Homo sapiens
ccaucaagccugucaccua

SEQ ID NO: 255327 - RNA, 19 nt, Homo sapiens
ucaauuuaauggcugacaa

SEQ ID NO: 255328 - RNA, 19 nt, Homo sapiens
gguguccuuucuuuacaaa

SEQ ID NO: 255329 - RNA, 19 nt, Homo sapiens
uuugagguguccuuucuuu

SEQ ID NO: 255330 - RNA, 19 nt, Homo sapiens
ccaucugaccucaauuuaa

SEQ ID NO: 255331 - RNA, 19 nt, Homo sapiens
ccauuucuacugagacuuu

SEQ ID NO: 255332 - RNA, 19 nt, Homo sapiens
ggaaaaggguguccagaac

SEQ ID NO: 255333 - RNA, 19 nt, Homo sapiens
gcgaguccuuugcacaugu

SEQ ID NO: 255334 - RNA, 19 nt, Homo sapiens
ccaggaagaaccaggcaaa

SEQ ID NO: 255335 - RNA, 19 nt, Homo sapiens
gccaucugaccucaauuua

SEQ ID NO: 255336 - RNA, 19 nt, Homo sapiens
caaggugggccgagugaug

SEQ ID NO: 255337 - RNA, 19 nt, Homo sapiens
gaacacguacacugucucu

SEQ ID NO: 255338 - RNA, 19 nt, Homo sapiens
gcgaacacguacacugucu

SEQ ID NO: 255339 - RNA, 19 nt, Homo sapiens
aacaccagcuaccaauaaa

SEQ ID NO: 255340 - RNA, 19 nt, Homo sapiens
guacaacaggcaccucuag

SEQ ID NO: 255341 - RNA, 19 nt, Homo sapiens
gauagacccagccucugaa

SEQ ID NO: 255342 - RNA, 19 nt, Homo sapiens
gcaggaggcgucugagucu

SEQ ID NO: 255343 - RNA, 19 nt, Homo sapiens
gaguucgaguaucugauga

SEQ ID NO: 255344 - RNA, 19 nt, Homo sapiens
cauuucacaucacuccauu

SEQ ID NO: 255345 - RNA, 19 nt, Homo sapiens
aaaaggguguccagaacua

SEQ ID NO: 255346 - RNA, 19 nt, Homo sapiens
ggucaacaccagcuaccaa

SEQ ID NO: 255347 - RNA, 19 nt, Homo sapiens
ccagucagccagucuuaau

SEQ ID NO: 255348 - RNA, 19 nt, Homo sapiens
gaacaggcuuuuaggaaac

SEQ ID NO: 255349 - RNA, 19 nt, Homo sapiens
cuacaggacugcggacaag

SEQ ID NO: 255350 - RNA, 19 nt, Homo sapiens
acgcgcagcugauaguuca

SEQ ID NO: 255351 - RNA, 19 nt, Homo sapiens
ucuggcaucugcacauuuc

SEQ ID NO: 255352 - RNA, 19 nt, Homo sapiens
cauguggaauuagaguauu

SEQ ID NO: 255353 - RNA, 19 nt, Homo sapiens
gguuggacuucaccucuca

SEQ ID NO: 255354 - RNA, 19 nt, Homo sapiens
ucaacaccagcuaccaaua

SEQ ID NO: 255355 - RNA, 19 nt, Homo sapiens
ugggaccgcucucuucuag

SEQ ID NO: 255356 - RNA, 19 nt, Homo sapiens
ucugcacauuuccguguua

SEQ ID NO: 255357 - RNA, 19 nt, Homo sapiens
cagcgaacacguacacugu

SEQ ID NO: 255358 - RNA, 19 nt, Homo sapiens
ucaauucgccacaaucucu

SEQ ID NO: 255359 - RNA, 19 nt, Homo sapiens
cugcugggcugagcuucua

SEQ ID NO: 255360 - RNA, 19 nt, Homo sapiens
gcagaggcccaggagaaug

SEQ ID NO: 255361 - RNA, 19 nt, Homo sapiens
agaacaggcuuuuaggaaa

SEQ ID NO: 255362 - RNA, 19 nt, Homo sapiens
cgaguucgaguaucugaug

SEQ ID NO: 255363 - RNA, 19 nt, Homo sapiens
cagggaagucaaagugaaa

SEQ ID NO: 255364 - RNA, 19 nt, Homo sapiens
caccauggcccaccucauc

SEQ ID NO: 255365 - RNA, 19 nt, Homo sapiens
cgaguccuuugcacauguu

SEQ ID NO: 255366 - RNA, 19 nt, Homo sapiens
acccugaacgggauuuaua

SEQ ID NO: 255367 - RNA, 19 nt, Homo sapiens
gaaccaucagcgcugcaaa

SEQ ID NO: 255368 - RNA, 19 nt, Homo sapiens
gacauguggaauuagagua

SEQ ID NO: 255369 - RNA, 19 nt, Homo sapiens
ggaccaggcaucgcugugu

SEQ ID NO: 255370 - RNA, 19 nt, Homo sapiens
gcgagggcaucgucauugc

SEQ ID NO: 255371 - RNA, 19 nt, Homo sapiens
gcgucugagucuccaguga

SEQ ID NO: 255372 - RNA, 19 nt, Homo sapiens
cccagccucugaaagcaaa

SEQ ID NO: 255373 - RNA, 19 nt, Homo sapiens
cccgaaggaugauucaaag

SEQ ID NO: 255374 - RNA, 19 nt, Homo sapiens
agaagcaggaggcgucuga

SEQ ID NO: 255375 - RNA, 19 nt, Homo sapiens
ccgcauggaaccuugagaa

SEQ ID NO: 255376 - RNA, 19 nt, Homo sapiens
ugagguguccuuucuuuac

SEQ ID NO: 255377 - RNA, 19 nt, Homo sapiens
ggaauuagaguauuuugag

SEQ ID NO: 255378 - RNA, 19 nt, Homo sapiens
gacggugaccauaguacaa

SEQ ID NO: 255379 - RNA, 19 nt, Homo sapiens
aggcagaggcccaggagaa

SEQ ID NO: 255380 - RNA, 19 nt, Homo sapiens
ccucugaaagcaaauuaau

SEQ ID NO: 255381 - RNA, 19 nt, Homo sapiens
gcgagaagagagagaagca

SEQ ID NO: 255382 - RNA, 19 nt, Homo sapiens
gaacaggcaucuauccuuu

SEQ ID NO: 255383 - RNA, 19 nt, Homo sapiens
caacgaaacuggcuuugaa

SEQ ID NO: 255384 - RNA, 19 nt, Homo sapiens
gaaacuggcuuugaaauca

SEQ ID NO: 255385 - RNA, 19 nt, Homo sapiens
guugaaauguugugaaaug

SEQ ID NO: 255386 - RNA, 19 nt, Homo sapiens
ccagcuaucuugcuucuga

SEQ ID NO: 255387 - RNA, 19 nt, Homo sapiens
gaagauagcaggaagaaaa

SEQ ID NO: 255388 - RNA, 19 nt, Homo sapiens
aaaguaaacuccauagaag

SEQ ID NO: 255389 - RNA, 19 nt, Homo sapiens
ggaccuggcucccaauucu

SEQ ID NO: 255390 - RNA, 19 nt, Homo sapiens
gaagaaggaaggagaggaa

SEQ ID NO: 255391 - RNA, 19 nt, Homo sapiens
gauaguaacaccuucagaa

SEQ ID NO: 255392 - RNA, 19 nt, Homo sapiens
ggaacaaagucguggaaag

SEQ ID NO: 255393 - RNA, 19 nt, Homo sapiens
caugguggcuuuaggaaga

SEQ ID NO: 255394 - RNA, 19 nt, Homo sapiens
gaagaagaaagcauggaaa

SEQ ID NO: 255395 - RNA, 19 nt, Homo sapiens
caacuaauacuuugcuguu

SEQ ID NO: 255396 - RNA, 19 nt, Homo sapiens
cuaucuugcuucugaaaua

SEQ ID NO: 255397 - RNA, 19 nt, Homo sapiens
gaagaaagcauggaaacuc

SEQ ID NO: 255398 - RNA, 19 nt, Homo sapiens
ggaagaagaaagcauggaa

SEQ ID NO: 255399 - RNA, 19 nt, Homo sapiens
auacuuugcuguugaaaug

SEQ ID NO: 255400 - RNA, 19 nt, Homo sapiens
gacauucccuucacuccuu

SEQ ID NO: 255401 - RNA, 19 nt, Homo sapiens
gaaggaaggagaggaagaa

SEQ ID NO: 255402 - RNA, 19 nt, Homo sapiens
uaccugggauggagugaua

SEQ ID NO: 255403 - RNA, 19 nt, Homo sapiens
gagcacaggauccuucuga

SEQ ID NO: 255404 - RNA, 19 nt, Homo sapiens
ccauuugacuucuauuugu

SEQ ID NO: 255405 - RNA, 19 nt, Homo sapiens
ccuaugccauccaucuaua

SEQ ID NO: 255406 - RNA, 19 nt, Homo sapiens
ucaaggagaggaagaagaa

SEQ ID NO: 255407 - RNA, 19 nt, Homo sapiens
ggagggugaugccagcuau

SEQ ID NO: 255408 - RNA, 19 nt, Homo sapiens
ggacauggucugcuauaca

SEQ ID NO: 255409 - RNA, 19 nt, Homo sapiens
ucaagauucugccaacguu

SEQ ID NO: 255410 - RNA, 19 nt, Homo sapiens
guugugaaauguuaagugu

SEQ ID NO: 255411 - RNA, 19 nt, Homo sapiens
ggaaggagaggaagaagag

SEQ ID NO: 255412 - RNA, 19 nt, Homo sapiens
acagugaagauucucauua

SEQ ID NO: 255413 - RNA, 19 nt, Homo sapiens
ccacauaucccauuugacu

SEQ ID NO: 255414 - RNA, 19 nt, Homo sapiens
uaccacauaucccauuuga

SEQ ID NO: 255415 - RNA, 19 nt, Homo sapiens
gcuucucaguccacaguua

SEQ ID NO: 255416 - RNA, 19 nt, Homo sapiens
uaaccaugcugaccaacga

SEQ ID NO: 255417 - RNA, 19 nt, Homo sapiens
cuacugggcuuuacauggu

SEQ ID NO: 255418 - RNA, 19 nt, Homo sapiens
gaacaaagucguggaaagc

SEQ ID NO: 255419 - RNA, 19 nt, Homo sapiens
aagaaagcauggaaacuca

SEQ ID NO: 255420 - RNA, 19 nt, Homo sapiens
gaugccagcuaucuugcuu

SEQ ID NO: 255421 - RNA, 19 nt, Homo sapiens
cugaaggacuugaggauuc

SEQ ID NO: 255422 - RNA, 19 nt, Homo sapiens
aauguuaagugucuggaaa

SEQ ID NO: 255423 - RNA, 19 nt, Homo sapiens
cuaauacuuugcuguugaa

SEQ ID NO: 255424 - RNA, 19 nt, Homo sapiens
uaccaacauuucuuccuaa

SEQ ID NO: 255425 - RNA, 19 nt, Homo sapiens
auaccaacauuucuuccua

SEQ ID NO: 255426 - RNA, 19 nt, Homo sapiens
gacauggucugcuauacag

SEQ ID NO: 255427 - RNA, 19 nt, Homo sapiens
acuaauacuuugcuguuga

SEQ ID NO: 255428 - RNA, 19 nt, Homo sapiens
cgacaggugggauccuaua

SEQ ID NO: 255429 - RNA, 19 nt, Homo sapiens
ggaagaagaggagaauaca

SEQ ID NO: 255430 - RNA, 19 nt, Homo sapiens
gaggauaccaacauuucuu

SEQ ID NO: 255431 - RNA, 19 nt, Homo sapiens
ggagugauaguaacaccuu

SEQ ID NO: 255432 - RNA, 19 nt, Homo sapiens
ccucucacaugguggcuuu

SEQ ID NO: 255433 - RNA, 19 nt, Homo sapiens
caacagugccacccaaucu

SEQ ID NO: 255434 - RNA, 19 nt, Homo sapiens
cagugaagauucucauuac

SEQ ID NO: 255435 - RNA, 19 nt, Homo sapiens
ccucuucaguugucugcua

SEQ ID NO: 255436 - RNA, 19 nt, Homo sapiens
ucucucaacuaauacuuug

SEQ ID NO: 255437 - RNA, 19 nt, Homo sapiens
gaagaaaaguaaacuccau

SEQ ID NO: 255438 - RNA, 19 nt, Homo sapiens
gugaagauucucauuacaa

SEQ ID NO: 255439 - RNA, 19 nt, Homo sapiens
gcaaauugaagaaguucga

SEQ ID NO: 255440 - RNA, 19 nt, Homo sapiens
gccagucucccauuuguga

SEQ ID NO: 255441 - RNA, 19 nt, Homo sapiens
gagccuaagcugccugcua

SEQ ID NO: 255442 - RNA, 19 nt, Homo sapiens
ggugaugccagcuaucuug

SEQ ID NO: 255443 - RNA, 19 nt, Homo sapiens
ugaagauucucauuacaac

SEQ ID NO: 255444 - RNA, 19 nt, Homo sapiens
gaaaaccccucucucaacu

SEQ ID NO: 255445 - RNA, 19 nt, Homo sapiens
aagaagaggagaauacaga

SEQ ID NO: 255446 - RNA, 19 nt, Homo sapiens
ugugaaauguuaagugucu

SEQ ID NO: 255447 - RNA, 19 nt, Homo sapiens
ccaacauuucuuccuaaua

SEQ ID NO: 255448 - RNA, 19 nt, Homo sapiens
ugacuucuauuugugugaa

SEQ ID NO: 255449 - RNA, 19 nt, Homo sapiens
agaggagaauacagaagaa

SEQ ID NO: 255450 - RNA, 19 nt, Homo sapiens
gaguggcaacuuuagagua

SEQ ID NO: 255451 - RNA, 19 nt, Homo sapiens
gccagcaccugaugaaacu

SEQ ID NO: 255452 - RNA, 19 nt, Homo sapiens
gggaagauagcaggaagaa

SEQ ID NO: 255453 - RNA, 19 nt, Homo sapiens
agaagaaccaccucaagga

SEQ ID NO: 255454 - RNA, 19 nt, Homo sapiens
agaaaaggcuuaugagaag

SEQ ID NO: 255455 - RNA, 19 nt, Homo sapiens
gccauuaugcugugaugaa

SEQ ID NO: 255456 - RNA, 19 nt, Homo sapiens
gcuuugaaaucaguucuuc

SEQ ID NO: 255457 - RNA, 19 nt, Homo sapiens
gaccaacgaaacuggcuuu

SEQ ID NO: 255458 - RNA, 19 nt, Homo sapiens
ggugcggccuccauuguuc

SEQ ID NO: 255459 - RNA, 19 nt, Homo sapiens
ggcuuuacauggugacaga

SEQ ID NO: 255460 - RNA, 19 nt, Homo sapiens
ggggaagacuggagccuaa

SEQ ID NO: 255461 - RNA, 19 nt, Homo sapiens
cuguugaaauguugugaaa

SEQ ID NO: 255462 - RNA, 19 nt, Homo sapiens
caagccagcaccugaugaa

SEQ ID NO: 255463 - RNA, 19 nt, Homo sapiens
uuaaaguucucaucagacu

SEQ ID NO: 255464 - RNA, 19 nt, Homo sapiens
aguuaaaguucucaucaga

SEQ ID NO: 255465 - RNA, 19 nt, Homo sapiens
gaagaggagaauacagaag

SEQ ID NO: 255466 - RNA, 19 nt, Homo sapiens
gagaggaagaagaggagaa

SEQ ID NO: 255467 - RNA, 19 nt, Homo sapiens
gagaagccaccagagaaga

SEQ ID NO: 255468 - RNA, 19 nt, Homo sapiens
ugugagaguggcaacuuua

SEQ ID NO: 255469 - RNA, 19 nt, Homo sapiens
cgaaacuggcuuugaaauc

SEQ ID NO: 255470 - RNA, 19 nt, Homo sapiens
gaccuaugccauccaucua

SEQ ID NO: 255471 - RNA, 19 nt, Homo sapiens
acacagucaugacccuaga

SEQ ID NO: 255472 - RNA, 19 nt, Homo sapiens
gagaguggcaacuuuagag

SEQ ID NO: 255473 - RNA, 19 nt, Homo sapiens
agacagccuuuggcccuaa

SEQ ID NO: 255474 - RNA, 19 nt, Homo sapiens
caggugggauccuauaaaa

SEQ ID NO: 255475 - RNA, 19 nt, Homo sapiens
uaucccauuugacuucuau

SEQ ID NO: 255476 - RNA, 19 nt, Homo sapiens
aagaggagaauacagaaga

SEQ ID NO: 255477 - RNA, 19 nt, Homo sapiens
uaugagaagccaccagaga

SEQ ID NO: 255478 - RNA, 19 nt, Homo sapiens
cagaaaaggcuuaugagaa

SEQ ID NO: 255479 - RNA, 19 nt, Homo sapiens
auaguaacaccuucagaaa

SEQ ID NO: 255480 - RNA, 19 nt, Homo sapiens
ucacaugguggcuuuagga

SEQ ID NO: 255481 - RNA, 19 nt, Homo sapiens
guccgaauccucucacaug

SEQ ID NO: 255482 - RNA, 19 nt, Homo sapiens
gacaagaguugaaguauug

SEQ ID NO: 255483 - RNA, 19 nt, Homo sapiens
gagaagaaauggagaaagu

SEQ ID NO: 255484 - RNA, 19 nt, Homo sapiens
gcaaagcauucuuccguuu

SEQ ID NO: 255485 - RNA, 19 nt, Homo sapiens
agaagaagauucagaagaa

SEQ ID NO: 255486 - RNA, 19 nt, Homo sapiens
gcacagaauucuagagaca

SEQ ID NO: 255487 - RNA, 19 nt, Homo sapiens
ccaaggaacucuaucacaa

SEQ ID NO: 255488 - RNA, 19 nt, Homo sapiens
aaacugugcuuccauuauu

SEQ ID NO: 255489 - RNA, 19 nt, Homo sapiens
gcugaagucuugugucauu

SEQ ID NO: 255490 - RNA, 19 nt, Homo sapiens
ggaacucuaucacaauuug

SEQ ID NO: 255491 - RNA, 19 nt, Homo sapiens
gaagaagauucagaagaaa

SEQ ID NO: 255492 - RNA, 19 nt, Homo sapiens
gagaaacgcuaucagucaa

SEQ ID NO: 255493 - RNA, 19 nt, Homo sapiens
cgacaagaguugaaguauu

SEQ ID NO: 255494 - RNA, 19 nt, Homo sapiens
ccaagaaaccaaagaauga

SEQ ID NO: 255495 - RNA, 19 nt, Homo sapiens
ccaacgggcugaagucuug

SEQ ID NO: 255496 - RNA, 19 nt, Homo sapiens
gaagaaauggagaaaguau

SEQ ID NO: 255497 - RNA, 19 nt, Homo sapiens
gaccgaaauuugcugcuaa

SEQ ID NO: 255498 - RNA, 19 nt, Homo sapiens
ucauggagcugaacgagaa

SEQ ID NO: 255499 - RNA, 19 nt, Homo sapiens
ggaccgaaauuugcugcua

SEQ ID NO: 255500 - RNA, 19 nt, Homo sapiens
ggagaaacgcuaucaguca

SEQ ID NO: 255501 - RNA, 19 nt, Homo sapiens
caccgcagcuugucugaaa

SEQ ID NO: 255502 - RNA, 19 nt, Homo sapiens
cagcaaagccugcaucugu

SEQ ID NO: 255503 - RNA, 19 nt, Homo sapiens
uuaaagagacagacaauga

SEQ ID NO: 255504 - RNA, 19 nt, Homo sapiens
gggcugaagucuuguguca

SEQ ID NO: 255505 - RNA, 19 nt, Homo sapiens
gaaaguauuagcuggagaa

SEQ ID NO: 255506 - RNA, 19 nt, Homo sapiens
caaagcauucuuccguuua

SEQ ID NO: 255507 - RNA, 19 nt, Homo sapiens
ggagguugauggcaauuca

SEQ ID NO: 255508 - RNA, 19 nt, Homo sapiens
aaacuuugauugcaugaug

SEQ ID NO: 255509 - RNA, 19 nt, Homo sapiens
gaagacaaguacgaaauac

SEQ ID NO: 255510 - RNA, 19 nt, Homo sapiens
gcaagaacccagucaugga

SEQ ID NO: 255511 - RNA, 19 nt, Homo sapiens
uaacuucucccgccucuug

SEQ ID NO: 255512 - RNA, 19 nt, Homo sapiens
gaacuugguccuauugaag

SEQ ID NO: 255513 - RNA, 19 nt, Homo sapiens
ggacuacaccguucagauc

SEQ ID NO: 255514 - RNA, 19 nt, Homo sapiens
gagaaagaaccgugauguu

SEQ ID NO: 255515 - RNA, 19 nt, Homo sapiens
uuaacaaacucccaaaucu

SEQ ID NO: 255516 - RNA, 19 nt, Homo sapiens
cgaaguggauggacagaag

SEQ ID NO: 255517 - RNA, 19 nt, Homo sapiens
ugacaaagcacggcaagaa

SEQ ID NO: 255518 - RNA, 19 nt, Homo sapiens
guuacuacaugauuuguuc

SEQ ID NO: 255519 - RNA, 19 nt, Homo sapiens
gaaugccggugcuggguau

SEQ ID NO: 255520 - RNA, 19 nt, Homo sapiens
caaccgcccuccuggacaa

SEQ ID NO: 255521 - RNA, 19 nt, Homo sapiens
caaaaugguuacuacauga

SEQ ID NO: 255522 - RNA, 19 nt, Homo sapiens
aaggaacucuaucacaauu

SEQ ID NO: 255523 - RNA, 19 nt, Homo sapiens
agaagacaaguacgaaaua

SEQ ID NO: 255524 - RNA, 19 nt, Homo sapiens
gcaggugcccuccuuggaa

SEQ ID NO: 255525 - RNA, 19 nt, Homo sapiens
caagaaacagacaggcuuu

SEQ ID NO: 255526 - RNA, 19 nt, Homo sapiens
uaacagaagacaaguacga

SEQ ID NO: 255527 - RNA, 19 nt, Homo sapiens
uguguugacuugcaagauu

SEQ ID NO: 255528 - RNA, 19 nt, Homo sapiens
ugcaugggauucuggauuu

SEQ ID NO: 255529 - RNA, 19 nt, Homo sapiens
cagcuugucugaaacucuu

SEQ ID NO: 255530 - RNA, 19 nt, Homo sapiens
gaagaggcgugggcucaag

SEQ ID NO: 255531 - RNA, 19 nt, Homo sapiens
agaagccacugaugcuauu

SEQ ID NO: 255532 - RNA, 19 nt, Homo sapiens
gcauuuaugacccuuguga

SEQ ID NO: 255533 - RNA, 19 nt, Homo sapiens
ggagaaagaaccgugaugu

SEQ ID NO: 255534 - RNA, 19 nt, Homo sapiens
acucuuagccugcagaauu

SEQ ID NO: 255535 - RNA, 19 nt, Homo sapiens
gaagucuugugucauugug

SEQ ID NO: 255536 - RNA, 19 nt, Homo sapiens
guguugacuugcaagauuu

SEQ ID NO: 255537 - RNA, 19 nt, Homo sapiens
caggugcccuccuuggaaa

SEQ ID NO: 255538 - RNA, 19 nt, Homo sapiens
gaaacagacaggcuuuaag

SEQ ID NO: 255539 - RNA, 19 nt, Homo sapiens
ugguuuagcuagagaguga

SEQ ID NO: 255540 - RNA, 19 nt, Homo sapiens
agaagaagaagauucagaa

SEQ ID NO: 255541 - RNA, 19 nt, Homo sapiens
gaacauguggggaauugua

SEQ ID NO: 255542 - RNA, 19 nt, Homo sapiens
uaucgugauuugccuuuga

SEQ ID NO: 255543 - RNA, 19 nt, Homo sapiens
cuuccaagaugcccaagaa

SEQ ID NO: 255544 - RNA, 19 nt, Homo sapiens
aaagcauucuuccguuuau

SEQ ID NO: 255545 - RNA, 19 nt, Homo sapiens
cugcaucuguguugacuug

SEQ ID NO: 255546 - RNA, 19 nt, Homo sapiens
gguagaugacgugaaauuu

SEQ ID NO: 255547 - RNA, 19 nt, Homo sapiens
ugaacuugguccuauugaa

SEQ ID NO: 255548 - RNA, 19 nt, Homo sapiens
caagaaaccaaagaaugaa

SEQ ID NO: 255549 - RNA, 19 nt, Homo sapiens
ugauuugccuuugaacuug

SEQ ID NO: 255550 - RNA, 19 nt, Homo sapiens
cugcagaauuuaagacaau

SEQ ID NO: 255551 - RNA, 19 nt, Homo sapiens
aaaguuugauuuccagaca

SEQ ID NO: 255552 - RNA, 19 nt, Homo sapiens
guucagaucccaccaagca

SEQ ID NO: 255553 - RNA, 19 nt, Homo sapiens
ggaaaauaguuauccugaa

SEQ ID NO: 255554 - RNA, 19 nt, Homo sapiens
caaggaacucuaucacaau

SEQ ID NO: 255555 - RNA, 19 nt, Homo sapiens
ggguagaugacgugaaauu

SEQ ID NO: 255556 - RNA, 19 nt, Homo sapiens
ggcgugggcucaaguacga

SEQ ID NO: 255557 - RNA, 19 nt, Homo sapiens
gagcuggugcugcugugua

SEQ ID NO: 255558 - RNA, 19 nt, Homo sapiens
caauacaugugaaaguaac

SEQ ID NO: 255559 - RNA, 19 nt, Homo sapiens
agugaacucucaaagguau

SEQ ID NO: 255560 - RNA, 19 nt, Homo sapiens
guauauugcgcugaauuaa

SEQ ID NO: 255561 - RNA, 19 nt, Homo sapiens
uguauauugcgcugaauua

SEQ ID NO: 255562 - RNA, 19 nt, Homo sapiens
uaacaaacucccaaaucug

SEQ ID NO: 255563 - RNA, 19 nt, Homo sapiens
cgacagcaggcuacaguga

SEQ ID NO: 255564 - RNA, 19 nt, Homo sapiens
cgacaagcgcuucgucaug

SEQ ID NO: 255565 - RNA, 19 nt, Homo sapiens
aguauuagcuggagaaacg

SEQ ID NO: 255566 - RNA, 19 nt, Homo sapiens
caaaagagccuccauuguc

SEQ ID NO: 255567 - RNA, 19 nt, Homo sapiens
gaagaagaagauucagaag

SEQ ID NO: 255568 - RNA, 19 nt, Homo sapiens
gacagcaacgggaagauau

SEQ ID NO: 255569 - RNA, 19 nt, Homo sapiens
cagaagacaaguacgaaau

SEQ ID NO: 255570 - RNA, 19 nt, Homo sapiens
uaacaccaaggaacucuau

SEQ ID NO: 255571 - RNA, 19 nt, Homo sapiens
gcaaagccugcaucugugu

SEQ ID NO: 255572 - RNA, 19 nt, Homo sapiens
cgacgaugcugcgauugug

SEQ ID NO: 255573 - RNA, 19 nt, Homo sapiens
ugucgacgaugcugcgauu

SEQ ID NO: 255574 - RNA, 19 nt, Homo sapiens
gagcaggcagaguccgaua

SEQ ID NO: 255575 - RNA, 19 nt, Homo sapiens
agaaacagacaggcuuuaa

SEQ ID NO: 255576 - RNA, 19 nt, Homo sapiens
aaaucugguugaugccuuu

SEQ ID NO: 255577 - RNA, 19 nt, Homo sapiens
gugauuugccuuugaacuu

SEQ ID NO: 255578 - RNA, 19 nt, Homo sapiens
caaaguguccgugcugugu

SEQ ID NO: 255579 - RNA, 19 nt, Homo sapiens
ccaugucuguggagguuga

SEQ ID NO: 255580 - RNA, 19 nt, Homo sapiens
uauccugaaugacguugaa

SEQ ID NO: 255581 - RNA, 19 nt, Homo sapiens
gccaacacacggagucauu

SEQ ID NO: 255582 - RNA, 19 nt, Homo sapiens
ggacuucccuuaacaguuu

SEQ ID NO: 255583 - RNA, 19 nt, Homo sapiens
gaauuaagcugaauguaga

SEQ ID NO: 255584 - RNA, 19 nt, Homo sapiens
cagcagaccucguguuuaa

SEQ ID NO: 255585 - RNA, 19 nt, Homo sapiens
gacaagaguugaaguauug

SEQ ID NO: 255586 - RNA, 19 nt, Homo sapiens
uaaacgagcuuucuguauu

SEQ ID NO: 255587 - RNA, 19 nt, Homo sapiens
gagaagaaauggagaaagu

SEQ ID NO: 255588 - RNA, 19 nt, Homo sapiens
ugagacaccuugaccaaua

SEQ ID NO: 255589 - RNA, 19 nt, Homo sapiens
gcaaagcauucuuccguuu

SEQ ID NO: 255590 - RNA, 19 nt, Homo sapiens
agaagaagauucagaagaa

SEQ ID NO: 255591 - RNA, 19 nt, Homo sapiens
ugaaagaggugaaagaaca

SEQ ID NO: 255592 - RNA, 19 nt, Homo sapiens
ccaaggaacucuaucacaa

SEQ ID NO: 255593 - RNA, 19 nt, Homo sapiens
ggcaacagcuggcuuguga

SEQ ID NO: 255594 - RNA, 19 nt, Homo sapiens
gcugaagucuugugucauu

SEQ ID NO: 255595 - RNA, 19 nt, Homo sapiens
ggaacucuaucacaauuug

SEQ ID NO: 255596 - RNA, 19 nt, Homo sapiens
gaacuaccaguacagauaa

SEQ ID NO: 255597 - RNA, 19 nt, Homo sapiens
gaagaagauucagaagaaa

SEQ ID NO: 255598 - RNA, 19 nt, Homo sapiens
caacacaggacuucccuua

SEQ ID NO: 255599 - RNA, 19 nt, Homo sapiens
cagaauaaauggagacuuc

SEQ ID NO: 255600 - RNA, 19 nt, Homo sapiens
aaacgagcuuucuguauuu

SEQ ID NO: 255601 - RNA, 19 nt, Homo sapiens
gcaacagacuacacgauug

SEQ ID NO: 255602 - RNA, 19 nt, Homo sapiens
gagaaacgcuaucagucaa

SEQ ID NO: 255603 - RNA, 19 nt, Homo sapiens
cgacaagaguugaaguauu

SEQ ID NO: 255604 - RNA, 19 nt, Homo sapiens
cuaaauaccuccaaacucu

SEQ ID NO: 255605 - RNA, 19 nt, Homo sapiens
ccaagaaaccaaagaauga

SEQ ID NO: 255606 - RNA, 19 nt, Homo sapiens
ccaacgggcugaagucuug

SEQ ID NO: 255607 - RNA, 19 nt, Homo sapiens
gaggaauucuuauuugugu

SEQ ID NO: 255608 - RNA, 19 nt, Homo sapiens
gaaaggcuauaaccaugga

SEQ ID NO: 255609 - RNA, 19 nt, Homo sapiens
agggauacgucauuuguua

SEQ ID NO: 255610 - RNA, 19 nt, Homo sapiens
ugucuucaaugguuuguua

SEQ ID NO: 255611 - RNA, 19 nt, Homo sapiens
gaagaaauggagaaaguau

SEQ ID NO: 255612 - RNA, 19 nt, Homo sapiens
gaccgaaauuugcugcuaa

SEQ ID NO: 255613 - RNA, 19 nt, Homo sapiens
gggcggagauuucuaccuu

SEQ ID NO: 255614 - RNA, 19 nt, Homo sapiens
ucauggagcugaacgagaa

SEQ ID NO: 255615 - RNA, 19 nt, Homo sapiens
guugggagcuucuggauuc

SEQ ID NO: 255616 - RNA, 19 nt, Homo sapiens
ccaccaaccuugcuugugu

SEQ ID NO: 255617 - RNA, 19 nt, Homo sapiens
gaagggauacgucauuugu

SEQ ID NO: 255618 - RNA, 19 nt, Homo sapiens
ggaccgaaauuugcugcua

SEQ ID NO: 255619 - RNA, 19 nt, Homo sapiens
ggagaaacgcuaucaguca

SEQ ID NO: 255620 - RNA, 19 nt, Homo sapiens
gggcugaagucuuguguca

SEQ ID NO: 255621 - RNA, 19 nt, Homo sapiens
gaaaguauuagcuggagaa

SEQ ID NO: 255622 - RNA, 19 nt, Homo sapiens
caaagcauucuuccguuua

SEQ ID NO: 255623 - RNA, 19 nt, Homo sapiens
ggagguugauggcaauuca

SEQ ID NO: 255624 - RNA, 19 nt, Homo sapiens
cuucauguguucauuguuu

SEQ ID NO: 255625 - RNA, 19 nt, Homo sapiens
gaagagguggccuggagua

SEQ ID NO: 255626 - RNA, 19 nt, Homo sapiens
gcagaaaggcuauaaccau

SEQ ID NO: 255627 - RNA, 19 nt, Homo sapiens
gaagacaaguacgaaauac

SEQ ID NO: 255628 - RNA, 19 nt, Homo sapiens
gcacgugccuggagagaac

SEQ ID NO: 255629 - RNA, 19 nt, Homo sapiens
caaccuugcuuguguaguc

SEQ ID NO: 255630 - RNA, 19 nt, Homo sapiens
gaauuuaguagagcuagua

SEQ ID NO: 255631 - RNA, 19 nt, Homo sapiens
agaagagacuccugugaga

SEQ ID NO: 255632 - RNA, 19 nt, Homo sapiens
gcagaggaggucccagaua

SEQ ID NO: 255633 - RNA, 19 nt, Homo sapiens
uaagcugaauguagacaaa

SEQ ID NO: 255634 - RNA, 19 nt, Homo sapiens
cagaagggauacgucauuu

SEQ ID NO: 255635 - RNA, 19 nt, Homo sapiens
ugaacuaccaguacagaua

SEQ ID NO: 255636 - RNA, 19 nt, Homo sapiens
gagacaccuugaccaauau

SEQ ID NO: 255637 - RNA, 19 nt, Homo sapiens
gacaccggguucaggaaua

SEQ ID NO: 255638 - RNA, 19 nt, Homo sapiens
aaauucaacuacaguggua

SEQ ID NO: 255639 - RNA, 19 nt, Homo sapiens
gcaagaacccagucaugga

SEQ ID NO: 255640 - RNA, 19 nt, Homo sapiens
caaggaggcuacucacagu

SEQ ID NO: 255641 - RNA, 19 nt, Homo sapiens
ggacuacaccguucagauc

SEQ ID NO: 255642 - RNA, 19 nt, Homo sapiens
ugacugggaugaaguugga

SEQ ID NO: 255643 - RNA, 19 nt, Homo sapiens
gaaagaagggcaacagacu

SEQ ID NO: 255644 - RNA, 19 nt, Homo sapiens
caacagcuggcuugugaaa

SEQ ID NO: 255645 - RNA, 19 nt, Homo sapiens
ccacacgucugcagagauc

SEQ ID NO: 255646 - RNA, 19 nt, Homo sapiens
gagagcaaauucaacuaca

SEQ ID NO: 255647 - RNA, 19 nt, Homo sapiens
cgaaguggauggacagaag

SEQ ID NO: 255648 - RNA, 19 nt, Homo sapiens
ugacaaagcacggcaagaa

SEQ ID NO: 255649 - RNA, 19 nt, Homo sapiens
acagcuggcuugugaaaug

SEQ ID NO: 255650 - RNA, 19 nt, Homo sapiens
guggauagaugccaaggau

SEQ ID NO: 255651 - RNA, 19 nt, Homo sapiens
gcaagcagaaaggcuauaa

SEQ ID NO: 255652 - RNA, 19 nt, Homo sapiens
gaaugccggugcuggguau

SEQ ID NO: 255653 - RNA, 19 nt, Homo sapiens
guucaggcuucuagacauu

SEQ ID NO: 255654 - RNA, 19 nt, Homo sapiens
caaccgcccuccuggacaa

SEQ ID NO: 255655 - RNA, 19 nt, Homo sapiens
ucuaacccaucccagaaua

SEQ ID NO: 255656 - RNA, 19 nt, Homo sapiens
gaugggauguguucauguc

SEQ ID NO: 255657 - RNA, 19 nt, Homo sapiens
aaggaacucuaucacaauu

SEQ ID NO: 255658 - RNA, 19 nt, Homo sapiens
cagaggaggucccagauac

SEQ ID NO: 255659 - RNA, 19 nt, Homo sapiens
caaggaccguguuugacuu

SEQ ID NO: 255660 - RNA, 19 nt, Homo sapiens
caucacaguuaacauguca

SEQ ID NO: 255661 - RNA, 19 nt, Homo sapiens
ggccugagacugcuggaua

SEQ ID NO: 255662 - RNA, 19 nt, Homo sapiens
gaaagaggugaaagaacaa

SEQ ID NO: 255663 - RNA, 19 nt, Homo sapiens
gaccugcccuaucaaaaua

SEQ ID NO: 255664 - RNA, 19 nt, Homo sapiens
gauggucccugguccuuag

SEQ ID NO: 255665 - RNA, 19 nt, Homo sapiens
agaagacaaguacgaaaua

SEQ ID NO: 255666 - RNA, 19 nt, Homo sapiens
ccagaacaguggcccauag

SEQ ID NO: 255667 - RNA, 19 nt, Homo sapiens
gggaacccaucacaaaaua

SEQ ID NO: 255668 - RNA, 19 nt, Homo sapiens
uaacagaagacaaguacga

SEQ ID NO: 255669 - RNA, 19 nt, Homo sapiens
ugagacugcuggauacaau

SEQ ID NO: 255670 - RNA, 19 nt, Homo sapiens
ggaggaggagcucugguuu

SEQ ID NO: 255671 - RNA, 19 nt, Homo sapiens
ugaauuaagcugaauguag

SEQ ID NO: 255672 - RNA, 19 nt, Homo sapiens
gaagaggcgugggcucaag

SEQ ID NO: 255673 - RNA, 19 nt, Homo sapiens
agaagccacugaugcuauu

SEQ ID NO: 255674 - RNA, 19 nt, Homo sapiens
gcauuuaugacccuuguga

SEQ ID NO: 255675 - RNA, 19 nt, Homo sapiens
gggauguguucauguccua

SEQ ID NO: 255676 - RNA, 19 nt, Homo sapiens
gguggaacauaacgcaguu

SEQ ID NO: 255677 - RNA, 19 nt, Homo sapiens
caacuacgagagcaaauuc

SEQ ID NO: 255678 - RNA, 19 nt, Homo sapiens
gaagucuugugucauugug

SEQ ID NO: 255679 - RNA, 19 nt, Homo sapiens
acacaggacuucccuuaac

SEQ ID NO: 255680 - RNA, 19 nt, Homo sapiens
caagaagagacuccuguga

SEQ ID NO: 255681 - RNA, 19 nt, Homo sapiens
caaacaaggaggcuacuca

SEQ ID NO: 255682 - RNA, 19 nt, Homo sapiens
gacaagaguugaaguauug

SEQ ID NO: 255683 - RNA, 19 nt, Homo sapiens
gagaagaaauggagaaagu

SEQ ID NO: 255684 - RNA, 19 nt, Homo sapiens
gcaaagcauucuuccguuu

SEQ ID NO: 255685 - RNA, 19 nt, Homo sapiens
agaagaagauucagaagaa

SEQ ID NO: 255686 - RNA, 19 nt, Homo sapiens
ccaaggaacucuaucacaa

SEQ ID NO: 255687 - RNA, 19 nt, Homo sapiens
aaacugugcuuccauuauu

SEQ ID NO: 255688 - RNA, 19 nt, Homo sapiens
gcugaagucuugugucauu

SEQ ID NO: 255689 - RNA, 19 nt, Homo sapiens
ggaacucuaucacaauuug

SEQ ID NO: 255690 - RNA, 19 nt, Homo sapiens
gaagaagauucagaagaaa

SEQ ID NO: 255691 - RNA, 19 nt, Homo sapiens
gagaaacgcuaucagucaa

SEQ ID NO: 255692 - RNA, 19 nt, Homo sapiens
cgacaagaguugaaguauu

SEQ ID NO: 255693 - RNA, 19 nt, Homo sapiens
ccaagaaaccaaagaauga

SEQ ID NO: 255694 - RNA, 19 nt, Homo sapiens
ccaacgggcugaagucuug

SEQ ID NO: 255695 - RNA, 19 nt, Homo sapiens
gaagaaauggagaaaguau

SEQ ID NO: 255696 - RNA, 19 nt, Homo sapiens
gaccgaaauuugcugcuaa

SEQ ID NO: 255697 - RNA, 19 nt, Homo sapiens
ucauggagcugaacgagaa

SEQ ID NO: 255698 - RNA, 19 nt, Homo sapiens
ggaccgaaauuugcugcua

SEQ ID NO: 255699 - RNA, 19 nt, Homo sapiens
ggagaaacgcuaucaguca

SEQ ID NO: 255700 - RNA, 19 nt, Homo sapiens
cagcaaagccugcaucugu

SEQ ID NO: 255701 - RNA, 19 nt, Homo sapiens
gggcugaagucuuguguca

SEQ ID NO: 255702 - RNA, 19 nt, Homo sapiens
gaaaguauuagcuggagaa

SEQ ID NO: 255703 - RNA, 19 nt, Homo sapiens
caaagcauucuuccguuua

SEQ ID NO: 255704 - RNA, 19 nt, Homo sapiens
ggagguugauggcaauuca

SEQ ID NO: 255705 - RNA, 19 nt, Homo sapiens
aaacuuugauugcaugaug

SEQ ID NO: 255706 - RNA, 19 nt, Homo sapiens
gaagacaaguacgaaauac

SEQ ID NO: 255707 - RNA, 19 nt, Homo sapiens
gcaagaacccagucaugga

SEQ ID NO: 255708 - RNA, 19 nt, Homo sapiens
uaacuucucccgccucuug

SEQ ID NO: 255709 - RNA, 19 nt, Homo sapiens
ggacuacaccguucagauc

SEQ ID NO: 255710 - RNA, 19 nt, Homo sapiens
gagaaagaaccgugauguu

SEQ ID NO: 255711 - RNA, 19 nt, Homo sapiens
uuaacaaacucccaaaucu

SEQ ID NO: 255712 - RNA, 19 nt, Homo sapiens
cgaaguggauggacagaag

SEQ ID NO: 255713 - RNA, 19 nt, Homo sapiens
ugacaaagcacggcaagaa

SEQ ID NO: 255714 - RNA, 19 nt, Homo sapiens
guuacuacaugauuuguuc

SEQ ID NO: 255715 - RNA, 19 nt, Homo sapiens
gaaugccggugcuggguau

SEQ ID NO: 255716 - RNA, 19 nt, Homo sapiens
caaccgcccuccuggacaa

SEQ ID NO: 255717 - RNA, 19 nt, Homo sapiens
caaaaugguuacuacauga

SEQ ID NO: 255718 - RNA, 19 nt, Homo sapiens
aaggaacucuaucacaauu

SEQ ID NO: 255719 - RNA, 19 nt, Homo sapiens
agaagacaaguacgaaaua

SEQ ID NO: 255720 - RNA, 19 nt, Homo sapiens
gcaggugcccuccuuggaa

SEQ ID NO: 255721 - RNA, 19 nt, Homo sapiens
caagaaacagacaggcuuu

SEQ ID NO: 255722 - RNA, 19 nt, Homo sapiens
uaacagaagacaaguacga

SEQ ID NO: 255723 - RNA, 19 nt, Homo sapiens
uguguugacuugcaagauu

SEQ ID NO: 255724 - RNA, 19 nt, Homo sapiens
ugcaugggauucuggauuu

SEQ ID NO: 255725 - RNA, 19 nt, Homo sapiens
gaagaggcgugggcucaag

SEQ ID NO: 255726 - RNA, 19 nt, Homo sapiens
agaagccacugaugcuauu

SEQ ID NO: 255727 - RNA, 19 nt, Homo sapiens
gcauuuaugacccuuguga

SEQ ID NO: 255728 - RNA, 19 nt, Homo sapiens
ggagaaagaaccgugaugu

SEQ ID NO: 255729 - RNA, 19 nt, Homo sapiens
gaagucuugugucauugug

SEQ ID NO: 255730 - RNA, 19 nt, Homo sapiens
guguugacuugcaagauuu

SEQ ID NO: 255731 - RNA, 19 nt, Homo sapiens
caggugcccuccuuggaaa

SEQ ID NO: 255732 - RNA, 19 nt, Homo sapiens
gaaacagacaggcuuuaag

SEQ ID NO: 255733 - RNA, 19 nt, Homo sapiens
ugguuuagcuagagaguga

SEQ ID NO: 255734 - RNA, 19 nt, Homo sapiens
agaagaagaagauucagaa

SEQ ID NO: 255735 - RNA, 19 nt, Homo sapiens
gaacauguggggaauugua

SEQ ID NO: 255736 - RNA, 19 nt, Homo sapiens
cuuccaagaugcccaagaa

SEQ ID NO: 255737 - RNA, 19 nt, Homo sapiens
aaagcauucuuccguuuau

SEQ ID NO: 255738 - RNA, 19 nt, Homo sapiens
cugcaucuguguugacuug

SEQ ID NO: 255739 - RNA, 19 nt, Homo sapiens
gguagaugacgugaaauuu

SEQ ID NO: 255740 - RNA, 19 nt, Homo sapiens
caagaaaccaaagaaugaa

SEQ ID NO: 255741 - RNA, 19 nt, Homo sapiens
guucagaucccaccaagca

SEQ ID NO: 255742 - RNA, 19 nt, Homo sapiens
aaaguuugauuuccagaca

SEQ ID NO: 255743 - RNA, 19 nt, Homo sapiens
ggaaaauaguuauccugaa

SEQ ID NO: 255744 - RNA, 19 nt, Homo sapiens
caaggaacucuaucacaau

SEQ ID NO: 255745 - RNA, 19 nt, Homo sapiens
ggguagaugacgugaaauu

SEQ ID NO: 255746 - RNA, 19 nt, Homo sapiens
ggcgugggcucaaguacga

SEQ ID NO: 255747 - RNA, 19 nt, Homo sapiens
gagcuggugcugcugugua

SEQ ID NO: 255748 - RNA, 19 nt, Homo sapiens
caauacaugugaaaguaac

SEQ ID NO: 255749 - RNA, 19 nt, Homo sapiens
agugaacucucaaagguau

SEQ ID NO: 255750 - RNA, 19 nt, Homo sapiens
guauauugcgcugaauuaa

SEQ ID NO: 255751 - RNA, 19 nt, Homo sapiens
uguauauugcgcugaauua

SEQ ID NO: 255752 - RNA, 19 nt, Homo sapiens
uaacaaacucccaaaucug

SEQ ID NO: 255753 - RNA, 19 nt, Homo sapiens
cgacaagcgcuucgucaug

SEQ ID NO: 255754 - RNA, 19 nt, Homo sapiens
aguauuagcuggagaaacg

SEQ ID NO: 255755 - RNA, 19 nt, Homo sapiens
caaaagagccuccauuguc

SEQ ID NO: 255756 - RNA, 19 nt, Homo sapiens
gaagaagaagauucagaag

SEQ ID NO: 255757 - RNA, 19 nt, Homo sapiens
gacagcaacgggaagauau

SEQ ID NO: 255758 - RNA, 19 nt, Homo sapiens
cagaagacaaguacgaaau

SEQ ID NO: 255759 - RNA, 19 nt, Homo sapiens
gcaaagccugcaucugugu

SEQ ID NO: 255760 - RNA, 19 nt, Homo sapiens
uaacaccaaggaacucuau

SEQ ID NO: 255761 - RNA, 19 nt, Homo sapiens
cgacgaugcugcgauugug

SEQ ID NO: 255762 - RNA, 19 nt, Homo sapiens
ugucgacgaugcugcgauu

SEQ ID NO: 255763 - RNA, 19 nt, Homo sapiens
gagcaggcagaguccgaua

SEQ ID NO: 255764 - RNA, 19 nt, Homo sapiens
agaaacagacaggcuuuaa

SEQ ID NO: 255765 - RNA, 19 nt, Homo sapiens
aaaucugguugaugccuuu

SEQ ID NO: 255766 - RNA, 19 nt, Homo sapiens
ccaugucuguggagguuga

SEQ ID NO: 255767 - RNA, 19 nt, Homo sapiens
uauccugaaugacguugaa

SEQ ID NO: 255768 - RNA, 19 nt, Homo sapiens
gccaacacacggagucauu

SEQ ID NO: 255769 - RNA, 19 nt, Homo sapiens
gaacucuaucacaauuuga

SEQ ID NO: 255770 - RNA, 19 nt, Homo sapiens
guagaugacgugaaauuuu

SEQ ID NO: 255771 - RNA, 19 nt, Homo sapiens
aaacagacaggcuuuaagg

SEQ ID NO: 255772 - RNA, 19 nt, Homo sapiens
aacugugcuuccauuauua

SEQ ID NO: 255773 - RNA, 19 nt, Homo sapiens
guuugggaaugcgauauuu

SEQ ID NO: 255774 - RNA, 19 nt, Homo sapiens
ccaccaagcaccaccuaug

SEQ ID NO: 255775 - RNA, 19 nt, Homo sapiens
agacagcaacgggaagaua

SEQ ID NO: 255776 - RNA, 19 nt, Homo sapiens
agacacuacagaagaagua

SEQ ID NO: 255777 - RNA, 19 nt, Homo sapiens
augcugcgauugugauaaa

SEQ ID NO: 255778 - RNA, 19 nt, Homo sapiens
acgaaauacugcaaucugu

SEQ ID NO: 255779 - RNA, 19 nt, Homo sapiens
uagaugacgugaaauuuug

SEQ ID NO: 255780 - RNA, 19 nt, Homo sapiens
gaaguauugauaacaccaa

SEQ ID NO: 255781 - RNA, 19 nt, Homo sapiens
uaccaugucuguggagguu

SEQ ID NO: 255782 - RNA, 19 nt, Homo sapiens
ggacaugacugcccgaauu

SEQ ID NO: 255783 - RNA, 19 nt, Homo sapiens
gaagaagccugaagacaca

SEQ ID NO: 255784 - RNA, 19 nt, Homo sapiens
gaacaaacacucuggcauu

SEQ ID NO: 255785 - RNA, 19 nt, Homo sapiens
ugacgaagcucaacgagaa

SEQ ID NO: 255786 - RNA, 19 nt, Homo sapiens
caaguucucuuuccaaugu

SEQ ID NO: 255787 - RNA, 19 nt, Homo sapiens
uaacaaguauggagagaug

SEQ ID NO: 255788 - RNA, 19 nt, Homo sapiens
gaaguuugcuuuggacaug

SEQ ID NO: 255789 - RNA, 19 nt, Homo sapiens
uacagaagcuauugcagua

SEQ ID NO: 255790 - RNA, 19 nt, Homo sapiens
cagcagacauguggaguuu

SEQ ID NO: 255791 - RNA, 19 nt, Homo sapiens
gaaauggaacccugaacaa

SEQ ID NO: 255792 - RNA, 19 nt, Homo sapiens
cagaggaccugguggcaaa

SEQ ID NO: 255793 - RNA, 19 nt, Homo sapiens
ccgaagcucugcagaagaa

SEQ ID NO: 255794 - RNA, 19 nt, Homo sapiens
gaauuagcauggcugaugu

SEQ ID NO: 255795 - RNA, 19 nt, Homo sapiens
gccagaaucucaaccguau

SEQ ID NO: 255796 - RNA, 19 nt, Homo sapiens
guacaaggcagacaucaau

SEQ ID NO: 255797 - RNA, 19 nt, Homo sapiens
uagcauggcugaugucaag

SEQ ID NO: 255798 - RNA, 19 nt, Homo sapiens
guaguguaaugauugauga

SEQ ID NO: 255799 - RNA, 19 nt, Homo sapiens
gcacggaucaauguaauga

SEQ ID NO: 255800 - RNA, 19 nt, Homo sapiens
uguguaagcucaugaagau

SEQ ID NO: 255801 - RNA, 19 nt, Homo sapiens
gacaugacugcccgaauua

SEQ ID NO: 255802 - RNA, 19 nt, Homo sapiens
uugcugaccucuccaauau

SEQ ID NO: 255803 - RNA, 19 nt, Homo sapiens
caauagccguaguguaaug

SEQ ID NO: 255804 - RNA, 19 nt, Homo sapiens
cucaauagccguaguguaa

SEQ ID NO: 255805 - RNA, 19 nt, Homo sapiens
guucgagacuggaguacaa

SEQ ID NO: 255806 - RNA, 19 nt, Homo sapiens
cagcaucuguaacaaguau

SEQ ID NO: 255807 - RNA, 19 nt, Homo sapiens
agacaucaaugcagugaau

SEQ ID NO: 255808 - RNA, 19 nt, Homo sapiens
gaaugaagacccugcaaag

SEQ ID NO: 255809 - RNA, 19 nt, Homo sapiens
ucaaacagcuuaacuuccu

SEQ ID NO: 255810 - RNA, 19 nt, Homo sapiens
gaagaugcaggacaaguag

SEQ ID NO: 255811 - RNA, 19 nt, Homo sapiens
augaagaucugcaugaaug

SEQ ID NO: 255812 - RNA, 19 nt, Homo sapiens
cagagaagaugggccagaa

SEQ ID NO: 255813 - RNA, 19 nt, Homo sapiens
gggcacggaucaauguaau

SEQ ID NO: 255814 - RNA, 19 nt, Homo sapiens
gcugaccucuccaauaugg

SEQ ID NO: 255815 - RNA, 19 nt, Homo sapiens
gcagacauguggaguuuug

SEQ ID NO: 255816 - RNA, 19 nt, Homo sapiens
agagaugccuguggacaaa

SEQ ID NO: 255817 - RNA, 19 nt, Homo sapiens
ucaaugcagugaaugaaca

SEQ ID NO: 255818 - RNA, 19 nt, Homo sapiens
cgaauuagcauggcugaug

SEQ ID NO: 255819 - RNA, 19 nt, Homo sapiens
agaagaugcaggacaagua

SEQ ID NO: 255820 - RNA, 19 nt, Homo sapiens
cgacccaaauuugacauga

SEQ ID NO: 255821 - RNA, 19 nt, Homo sapiens
guauggaucccucuacaau

SEQ ID NO: 255822 - RNA, 19 nt, Homo sapiens
gaagaucugcaugaaugaa

SEQ ID NO: 255823 - RNA, 19 nt, Homo sapiens
gagaagaugggccagaauc

SEQ ID NO: 255824 - RNA, 19 nt, Homo sapiens
cagaagcuauugcaguaca

SEQ ID NO: 255825 - RNA, 19 nt, Homo sapiens
caaacacucuggcauugac

SEQ ID NO: 255826 - RNA, 19 nt, Homo sapiens
gagagaugccuguggacaa

SEQ ID NO: 255827 - RNA, 19 nt, Homo sapiens
cugcaaagcgacccaaauu

SEQ ID NO: 255828 - RNA, 19 nt, Homo sapiens
gcccgagucccgaggauaa

SEQ ID NO: 255829 - RNA, 19 nt, Homo sapiens
gcucugcugugguugagau

SEQ ID NO: 255830 - RNA, 19 nt, Homo sapiens
acccaaauuugacaugauu

SEQ ID NO: 255831 - RNA, 19 nt, Homo sapiens
ggauaaagcuugggguuca

SEQ ID NO: 255832 - RNA, 19 nt, Homo sapiens
aacaaacacucuggcauug

SEQ ID NO: 255833 - RNA, 19 nt, Homo sapiens
gcagacaucaaugcaguga

SEQ ID NO: 255834 - RNA, 19 nt, Homo sapiens
gauauuguacagaagcuau

SEQ ID NO: 255835 - RNA, 19 nt, Homo sapiens
gacccaaauuugacaugau

SEQ ID NO: 255836 - RNA, 19 nt, Homo sapiens
ccacgacaugcacucaaua

SEQ ID NO: 255837 - RNA, 19 nt, Homo sapiens
uacaugaaggcaccaauuu

SEQ ID NO: 255838 - RNA, 19 nt, Homo sapiens
cgaaauggaacccugaaca

SEQ ID NO: 255839 - RNA, 19 nt, Homo sapiens
uugagaagaugcaggacaa

SEQ ID NO: 255840 - RNA, 19 nt, Homo sapiens
gucagcaucuguaacaagu

SEQ ID NO: 255841 - RNA, 19 nt, Homo sapiens
ugaaugaagacccugcaaa

SEQ ID NO: 255842 - RNA, 19 nt, Homo sapiens
gucaaguucucuuuccaau

SEQ ID NO: 255843 - RNA, 19 nt, Homo sapiens
gccguaguguaaugauuga

SEQ ID NO: 255844 - RNA, 19 nt, Homo sapiens
cuacaugaaggcaccaauu

SEQ ID NO: 255845 - RNA, 19 nt, Homo sapiens
gagacuggaguacaaggaa

SEQ ID NO: 255846 - RNA, 19 nt, Homo sapiens
aaauggaacccugaacaaa

SEQ ID NO: 255847 - RNA, 19 nt, Homo sapiens
ugaaugaacacgggaaugu

SEQ ID NO: 255848 - RNA, 19 nt, Homo sapiens
uggacaccgugauauugua

SEQ ID NO: 255849 - RNA, 19 nt, Homo sapiens
gcauggcugaugucaaguu

SEQ ID NO: 255850 - RNA, 19 nt, Homo sapiens
gcugugaaguuugcuuugg

SEQ ID NO: 255851 - RNA, 19 nt, Homo sapiens
auggaucccucuacaaugu

SEQ ID NO: 255852 - RNA, 19 nt, Homo sapiens
gaaugaacacgggaaugug

SEQ ID NO: 255853 - RNA, 19 nt, Homo sapiens
gaugucaaguucucuuucc

SEQ ID NO: 255854 - RNA, 19 nt, Homo sapiens
agucauggacaccgugaua

SEQ ID NO: 255855 - RNA, 19 nt, Homo sapiens
ucauggacaccgugauauu

SEQ ID NO: 255856 - RNA, 19 nt, Homo sapiens
ccaaauuugacaugauugu

SEQ ID NO: 255857 - RNA, 19 nt, Homo sapiens
cauggacaccgugauauug

SEQ ID NO: 255858 - RNA, 19 nt, Homo sapiens
auucaucugucgacugcua

SEQ ID NO: 255859 - RNA, 19 nt, Homo sapiens
uagccguaguguaaugauu

SEQ ID NO: 255860 - RNA, 19 nt, Homo sapiens
auauggagauuggaaugaa

SEQ ID NO: 255861 - RNA, 19 nt, Homo sapiens
acaaggacacauucuggaa

SEQ ID NO: 255862 - RNA, 19 nt, Homo sapiens
gauugugccuauccuugag

SEQ ID NO: 255863 - RNA, 19 nt, Homo sapiens
guaagcucaugaagaucug

SEQ ID NO: 255864 - RNA, 19 nt, Homo sapiens
gcccuugucagcaucugua

SEQ ID NO: 255865 - RNA, 19 nt, Homo sapiens
gagaagaugcaggacaagu

SEQ ID NO: 255866 - RNA, 19 nt, Homo sapiens
cacacuggaugccguaugg

SEQ ID NO: 255867 - RNA, 19 nt, Homo sapiens
auggaacccugaacaaaca

SEQ ID NO: 255868 - RNA, 19 nt, Homo sapiens
caucaaugcagugaaugaa

SEQ ID NO: 255869 - RNA, 19 nt, Homo sapiens
gcaguacaaggcagacauc

SEQ ID NO: 255870 - RNA, 19 nt, Homo sapiens
cauggcugaugucaaguuc

SEQ ID NO: 255871 - RNA, 19 nt, Homo sapiens
ugauugugccuauccuuga

SEQ ID NO: 255872 - RNA, 19 nt, Homo sapiens
accgugauauuguacagaa

SEQ ID NO: 255873 - RNA, 19 nt, Homo sapiens
gacacgggagguacccuuu

SEQ ID NO: 255874 - RNA, 19 nt, Homo sapiens
gcagaagaagccugaagac

SEQ ID NO: 255875 - RNA, 19 nt, Homo sapiens
caaggaagagcagggacuu

SEQ ID NO: 255876 - RNA, 19 nt, Homo sapiens
cuucaaacagcuuaacuuc

SEQ ID NO: 255877 - RNA, 19 nt, Homo sapiens
ugacaugauugugccuauc

SEQ ID NO: 255878 - RNA, 19 nt, Homo sapiens
cugcugugguugagauguu

SEQ ID NO: 255879 - RNA, 19 nt, Homo sapiens
ugcaaagcgacccaaauuu

SEQ ID NO: 255880 - RNA, 19 nt, Homo sapiens
cagaagaagccugaagaca

SEQ ID NO: 255881 - RNA, 19 nt, Homo sapiens
agaucugcaugaaugaaga

SEQ ID NO: 255882 - RNA, 19 nt, Homo sapiens
gaaaggauagcuaaagaaa

SEQ ID NO: 255883 - RNA, 19 nt, Homo sapiens
gcaccuggcccauuacaua

SEQ ID NO: 255884 - RNA, 19 nt, Homo sapiens
ucaauuggcuuugcuguaa

SEQ ID NO: 255885 - RNA, 19 nt, Homo sapiens
uauagcaccuggcccauua

SEQ ID NO: 255886 - RNA, 19 nt, Homo sapiens
ggagcuggcauuauuguua

SEQ ID NO: 255887 - RNA, 19 nt, Homo sapiens
guacauagauuuccuuuug

SEQ ID NO: 255888 - RNA, 19 nt, Homo sapiens
cgacgaagauuaauuaagg

SEQ ID NO: 255889 - RNA, 19 nt, Homo sapiens
caacuaacuuuguacauag

SEQ ID NO: 255890 - RNA, 19 nt, Homo sapiens
guaagaauguacuuuagga

SEQ ID NO: 255891 - RNA, 19 nt, Homo sapiens
gcuuuaaagucuuguguaa

SEQ ID NO: 255892 - RNA, 19 nt, Homo sapiens
aaagcacucucaucagaua

SEQ ID NO: 255893 - RNA, 19 nt, Homo sapiens
cagaaaggauagcuaaaga

SEQ ID NO: 255894 - RNA, 19 nt, Homo sapiens
aaacagacuacuagacuua

SEQ ID NO: 255895 - RNA, 19 nt, Homo sapiens
gcacguaaacagacuacua

SEQ ID NO: 255896 - RNA, 19 nt, Homo sapiens
guauauaggugcagagaca

SEQ ID NO: 255897 - RNA, 19 nt, Homo sapiens
aagacaagcuggagaggua

SEQ ID NO: 255898 - RNA, 19 nt, Homo sapiens
agacgacgaagauuaauua

SEQ ID NO: 255899 - RNA, 19 nt, Homo sapiens
cagauagcauggcuuauug

SEQ ID NO: 255900 - RNA, 19 nt, Homo sapiens
uuacauaucuaggcaacua

SEQ ID NO: 255901 - RNA, 19 nt, Homo sapiens
gugcagagacacccacuua

SEQ ID NO: 255902 - RNA, 19 nt, Homo sapiens
gaguugggcucuuccagaa

SEQ ID NO: 255903 - RNA, 19 nt, Homo sapiens
gauagaauuuggaguugug

SEQ ID NO: 255904 - RNA, 19 nt, Homo sapiens
gcuaaagaaauucagguua

SEQ ID NO: 255905 - RNA, 19 nt, Homo sapiens
gcagagacacccacuuaga

SEQ ID NO: 255906 - RNA, 19 nt, Homo sapiens
caucagauagcauggcuua

SEQ ID NO: 255907 - RNA, 19 nt, Homo sapiens
gaaaguuaacuguuuggaa

SEQ ID NO: 255908 - RNA, 19 nt, Homo sapiens
uguaugauaugcuugguuu

SEQ ID NO: 255909 - RNA, 19 nt, Homo sapiens
gguaguuugugaagcuaua

SEQ ID NO: 255910 - RNA, 19 nt, Homo sapiens
gggcauuucugcagugaau

SEQ ID NO: 255911 - RNA, 19 nt, Homo sapiens
ugcaggagcuggcauuauu

SEQ ID NO: 255912 - RNA, 19 nt, Homo sapiens
gaaacauacccaggaagua

SEQ ID NO: 255913 - RNA, 19 nt, Homo sapiens
gaauguacuuuaggaaaca

SEQ ID NO: 255914 - RNA, 19 nt, Homo sapiens
gcggagcagaugcauauua

SEQ ID NO: 255915 - RNA, 19 nt, Homo sapiens
ugauugugcuggcaaauau

SEQ ID NO: 255916 - RNA, 19 nt, Homo sapiens
gcaacgagacgacgaagau

SEQ ID NO: 255917 - RNA, 19 nt, Homo sapiens
uggcuuugcuguaaauaaa

SEQ ID NO: 255918 - RNA, 19 nt, Homo sapiens
gaagagacgagugcgguaa

SEQ ID NO: 255919 - RNA, 19 nt, Homo sapiens
cggagcagaugcauauuau

SEQ ID NO: 255920 - RNA, 19 nt, Homo sapiens
ggaaguacaguugauaaau

SEQ ID NO: 255921 - RNA, 19 nt, Homo sapiens
gaaaaguucuccaguugau

SEQ ID NO: 255922 - RNA, 19 nt, Homo sapiens
uaaacagacuacuagacuu

SEQ ID NO: 255923 - RNA, 19 nt, Homo sapiens
ggaaacauacccaggaagu

SEQ ID NO: 255924 - RNA, 19 nt, Homo sapiens
gguuugacugcuauaauua

SEQ ID NO: 255925 - RNA, 19 nt, Homo sapiens
ucagauagcauggcuuauu

SEQ ID NO: 255926 - RNA, 19 nt, Homo sapiens
gaacucagcauucuguacu

SEQ ID NO: 255927 - RNA, 19 nt, Homo sapiens
gguuauaccuuugcaacga

SEQ ID NO: 255928 - RNA, 19 nt, Homo sapiens
gcagaaaggauagcuaaag

SEQ ID NO: 255929 - RNA, 19 nt, Homo sapiens
gagcuggcauuauuguuac

SEQ ID NO: 255930 - RNA, 19 nt, Homo sapiens
aaaguucuccaguugauuu

SEQ ID NO: 255931 - RNA, 19 nt, Homo sapiens
gauuugaugucacgaagag

SEQ ID NO: 255932 - RNA, 19 nt, Homo sapiens
uguuacagguggaccauuu

SEQ ID NO: 255933 - RNA, 19 nt, Homo sapiens
ugcaguaacucuagcaaga

SEQ ID NO: 255934 - RNA, 19 nt, Homo sapiens
ggaguuguguacaguugug

SEQ ID NO: 255935 - RNA, 19 nt, Homo sapiens
guaaacagacuacuagacu

SEQ ID NO: 255936 - RNA, 19 nt, Homo sapiens
accaugccauuucacauua

SEQ ID NO: 255937 - RNA, 19 nt, Homo sapiens
cagagacacccacuuagaa

SEQ ID NO: 255938 - RNA, 19 nt, Homo sapiens
ugcaagaauugacauaaug

SEQ ID NO: 255939 - RNA, 19 nt, Homo sapiens
caucaauggauauguguuu

SEQ ID NO: 255940 - RNA, 19 nt, Homo sapiens
ggugacucaucaauggaua

SEQ ID NO: 255941 - RNA, 19 nt, Homo sapiens
cagauuuggugacucauca

SEQ ID NO: 255942 - RNA, 19 nt, Homo sapiens
cuggagagguaguuuguga

SEQ ID NO: 255943 - RNA, 19 nt, Homo sapiens
gauguacacugccagaaaa

SEQ ID NO: 255944 - RNA, 19 nt, Homo sapiens
uaggaaacauacccaggaa

SEQ ID NO: 255945 - RNA, 19 nt, Homo sapiens
caauuggcuuugcuguaaa

SEQ ID NO: 255946 - RNA, 19 nt, Homo sapiens
ugacugaguugggcucuuc

SEQ ID NO: 255947 - RNA, 19 nt, Homo sapiens
guugaucacauguacuuaa

SEQ ID NO: 255948 - RNA, 19 nt, Homo sapiens
gagacgacgaagauuaauu

SEQ ID NO: 255949 - RNA, 19 nt, Homo sapiens
ggcaggaaugcauggauua

SEQ ID NO: 255950 - RNA, 19 nt, Homo sapiens
gguggaccauuugauuuga

SEQ ID NO: 255951 - RNA, 19 nt, Homo sapiens
caugggauccggaguguug

SEQ ID NO: 255952 - RNA, 19 nt, Homo sapiens
gauauuaccaaaucucucu

SEQ ID NO: 255953 - RNA, 19 nt, Homo sapiens
gauggaacaacuaacuuug

SEQ ID NO: 255954 - RNA, 19 nt, Homo sapiens
gauuugcuuuaaagucuug

SEQ ID NO: 255955 - RNA, 19 nt, Homo sapiens
caccagagacugugagaau

SEQ ID NO: 255956 - RNA, 19 nt, Homo sapiens
cuacaaguuucacaacaag

SEQ ID NO: 255957 - RNA, 19 nt, Homo sapiens
agguuugacugcuauaauu

SEQ ID NO: 255958 - RNA, 19 nt, Homo sapiens
ggauuugcuuuaaagucuu

SEQ ID NO: 255959 - RNA, 19 nt, Homo sapiens
uggcaggaaugcauggauu

SEQ ID NO: 255960 - RNA, 19 nt, Homo sapiens
guauccaucucacaguuuc

SEQ ID NO: 255961 - RNA, 19 nt, Homo sapiens
caguuaaauugucuguuug

SEQ ID NO: 255962 - RNA, 19 nt, Homo sapiens
ccccugaaauuuugacuua

SEQ ID NO: 255963 - RNA, 19 nt, Homo sapiens
guacuuguucauagacauu

SEQ ID NO: 255964 - RNA, 19 nt, Homo sapiens
caggaaguacaguugauaa

SEQ ID NO: 255965 - RNA, 19 nt, Homo sapiens
gagguaguuugugaagcua

SEQ ID NO: 255966 - RNA, 19 nt, Homo sapiens
gcaggagcuggcauuauug

SEQ ID NO: 255967 - RNA, 19 nt, Homo sapiens
guacuguugaucacaugua

SEQ ID NO: 255968 - RNA, 19 nt, Homo sapiens
gggagugauuuuauuauug

SEQ ID NO: 255969 - RNA, 19 nt, Homo sapiens
guagguucguuugagcuuu

SEQ ID NO: 255970 - RNA, 19 nt, Homo sapiens
acagacuacuagacuuauu

SEQ ID NO: 255971 - RNA, 19 nt, Homo sapiens
uggauuugcuuuaaagucu

SEQ ID NO: 255972 - RNA, 19 nt, Homo sapiens
ggauuaugcaguaacucua

SEQ ID NO: 255973 - RNA, 19 nt, Homo sapiens
aacaucaacugaaauaguc

SEQ ID NO: 255974 - RNA, 19 nt, Homo sapiens
ccaggaaguacaguugaua

SEQ ID NO: 255975 - RNA, 19 nt, Homo sapiens
gcugaaaaguucuccaguu

SEQ ID NO: 255976 - RNA, 19 nt, Homo sapiens
cagguggaccauuugauuu

SEQ ID NO: 255977 - RNA, 19 nt, Homo sapiens
ugauggaacaacuaacuuu

SEQ ID NO: 255978 - RNA, 19 nt, Homo sapiens
ggucauugcucugcagaac

SEQ ID NO: 255979 - RNA, 19 nt, Homo sapiens
uuucugcagugaauacauu

SEQ ID NO: 255980 - RNA, 19 nt, Homo sapiens
agagacacccacuuagaaa

SEQ ID NO: 255981 - RNA, 19 nt, Homo sapiens
gcaggaaugcauggauuau

SEQ ID NO: 255982 - RNA, 19 nt, Homo sapiens
gcucauagcucaggccuua

SEQ ID NO: 255983 - RNA, 19 nt, Homo sapiens
ucaaaucuccugugaaaua

SEQ ID NO: 255984 - RNA, 19 nt, Homo sapiens
uaauaaggcuuuagaacug

SEQ ID NO: 255985 - RNA, 19 nt, Homo sapiens
acucaaaucuccugugaaa

SEQ ID NO: 255986 - RNA, 19 nt, Homo sapiens
aaacucaaaucuccuguga

SEQ ID NO: 255987 - RNA, 19 nt, Homo sapiens
caggacagaucaucagaaa

SEQ ID NO: 255988 - RNA, 19 nt, Homo sapiens
ucaaaggccuugguucuga

SEQ ID NO: 255989 - RNA, 19 nt, Homo sapiens
ggaugccuauuaccaguuu

SEQ ID NO: 255990 - RNA, 19 nt, Homo sapiens
cagaucaccuuguggaaga

SEQ ID NO: 255991 - RNA, 19 nt, Homo sapiens
cugcagaucuugugacaga

SEQ ID NO: 255992 - RNA, 19 nt, Homo sapiens
agaaacagaucaccuugug

SEQ ID NO: 255993 - RNA, 19 nt, Homo sapiens
gagcuugaauucggaguga

SEQ ID NO: 255994 - RNA, 19 nt, Homo sapiens
ggagauggcgaugcucaua

SEQ ID NO: 255995 - RNA, 19 nt, Homo sapiens
ccacagucaucaucagaga

SEQ ID NO: 255996 - RNA, 19 nt, Homo sapiens
gagagagguuuccuucaca

SEQ ID NO: 255997 - RNA, 19 nt, Homo sapiens
gugaguggcuggccuuuua

SEQ ID NO: 255998 - RNA, 19 nt, Homo sapiens
guaauaaggcuuuagaacu

SEQ ID NO: 255999 - RNA, 19 nt, Homo sapiens
gcagaucuugugacagaaa

SEQ ID NO: 256000 - RNA, 19 nt, Homo sapiens
gauuugguguuuagcuguu

SEQ ID NO: 256001 - RNA, 19 nt, Homo sapiens
caaaucuccugugaaauac

SEQ ID NO: 256002 - RNA, 19 nt, Homo sapiens
guuaguacguguucuucug

SEQ ID NO: 256003 - RNA, 19 nt, Homo sapiens
uacagacgauuaacuaugg

SEQ ID NO: 256004 - RNA, 19 nt, Homo sapiens
gcaauuuugugcacagauu

SEQ ID NO: 256005 - RNA, 19 nt, Homo sapiens
cgagagagguuuccuucac

SEQ ID NO: 256006 - RNA, 19 nt, Homo sapiens
ggacagaucaucagaaaag

SEQ ID NO: 256007 - RNA, 19 nt, Homo sapiens
gacagaaacagaucaccuu

SEQ ID NO: 256008 - RNA, 19 nt, Homo sapiens
gcgguuagcauuggauuug

SEQ ID NO: 256009 - RNA, 19 nt, Homo sapiens
aacaucagcugcagaucuu

SEQ ID NO: 256010 - RNA, 19 nt, Homo sapiens
guacuucagaaugcaauaa

SEQ ID NO: 256011 - RNA, 19 nt, Homo sapiens
uuagcuguuucucucuuua

SEQ ID NO: 256012 - RNA, 19 nt, Homo sapiens
gcuuuagaacugcugauaa

SEQ ID NO: 256013 - RNA, 19 nt, Homo sapiens
gcaggacagaucaucagaa

SEQ ID NO: 256014 - RNA, 19 nt, Homo sapiens
uggauuugcuguucgacaa

SEQ ID NO: 256015 - RNA, 19 nt, Homo sapiens
ugacugcggcugaggcaaa

SEQ ID NO: 256016 - RNA, 19 nt, Homo sapiens
ccuuacagacgauuaacua

SEQ ID NO: 256017 - RNA, 19 nt, Homo sapiens
gguaauaaggcuuuagaac

SEQ ID NO: 256018 - RNA, 19 nt, Homo sapiens
guuucucucuuuaaucuca

SEQ ID NO: 256019 - RNA, 19 nt, Homo sapiens
uaaaucgacgucucucuca

SEQ ID NO: 256020 - RNA, 19 nt, Homo sapiens
ggaguugucacgcuacagu

SEQ ID NO: 256021 - RNA, 19 nt, Homo sapiens
gcgggaugaugagaaguga

SEQ ID NO: 256022 - RNA, 19 nt, Homo sapiens
gauuugcuguucgacaaga

SEQ ID NO: 256023 - RNA, 19 nt, Homo sapiens
aaacaucagcugcagaucu

SEQ ID NO: 256024 - RNA, 19 nt, Homo sapiens
uuacagacgauuaacuaug

SEQ ID NO: 256025 - RNA, 19 nt, Homo sapiens
gcaucgugauagacacuuc

SEQ ID NO: 256026 - RNA, 19 nt, Homo sapiens
ucaccuuguggaagauuua

SEQ ID NO: 256027 - RNA, 19 nt, Homo sapiens
gagauggcgaugcucauag

SEQ ID NO: 256028 - RNA, 19 nt, Homo sapiens
gacggcaccugcaauuuug

SEQ ID NO: 256029 - RNA, 19 nt, Homo sapiens
cgacggcaccugcaauuuu

SEQ ID NO: 256030 - RNA, 19 nt, Homo sapiens
acagguucauugcagaaga

SEQ ID NO: 256031 - RNA, 19 nt, Homo sapiens
ugauaaagcggaucguucu

SEQ ID NO: 256032 - RNA, 19 nt, Homo sapiens
cagguaauaaggcuuuaga

SEQ ID NO: 256033 - RNA, 19 nt, Homo sapiens
gcuugaauucggagugauu

SEQ ID NO: 256034 - RNA, 19 nt, Homo sapiens
cugcgacccugaagcuguu

SEQ ID NO: 256035 - RNA, 19 nt, Homo sapiens
ccggaguacuucagaaugc

SEQ ID NO: 256036 - RNA, 19 nt, Homo sapiens
ucucagguaauaaggcuuu

SEQ ID NO: 256037 - RNA, 19 nt, Homo sapiens
guuuagcuguuucucucuu

SEQ ID NO: 256038 - RNA, 19 nt, Homo sapiens
cuguuucucucuuuaaucu

SEQ ID NO: 256039 - RNA, 19 nt, Homo sapiens
gacuguggcgguuagcauu

SEQ ID NO: 256040 - RNA, 19 nt, Homo sapiens
ggaguacuucagaaugcaa

SEQ ID NO: 256041 - RNA, 19 nt, Homo sapiens
ccuuguggaagauuuaauu

SEQ ID NO: 256042 - RNA, 19 nt, Homo sapiens
gcugauaaagcggaucguu

SEQ ID NO: 256043 - RNA, 19 nt, Homo sapiens
ggcuuuagaacugcugaua

SEQ ID NO: 256044 - RNA, 19 nt, Homo sapiens
caggcggcaucgugauaga

SEQ ID NO: 256045 - RNA, 19 nt, Homo sapiens
uagcuguuucucucuuuaa

SEQ ID NO: 256046 - RNA, 19 nt, Homo sapiens
uuuagcuguuucucucuuu

SEQ ID NO: 256047 - RNA, 19 nt, Homo sapiens
ucucaaaggccuugguucu

SEQ ID NO: 256048 - RNA, 19 nt, Homo sapiens
caacacggcugccaggaua

SEQ ID NO: 256049 - RNA, 19 nt, Homo sapiens
gcaccgaccugaagaagaa

SEQ ID NO: 256050 - RNA, 19 nt, Homo sapiens
ggaauucgguguaucagau

SEQ ID NO: 256051 - RNA, 19 nt, Homo sapiens
gacaaaggauccauucaga

SEQ ID NO: 256052 - RNA, 19 nt, Homo sapiens
gaucacaguugcgucauug

SEQ ID NO: 256053 - RNA, 19 nt, Homo sapiens
gcacaggcucccuccauaa

SEQ ID NO: 256054 - RNA, 19 nt, Homo sapiens
cuucugagcuccugaccua

SEQ ID NO: 256055 - RNA, 19 nt, Homo sapiens
gcacugcuguguacaaggu

SEQ ID NO: 256056 - RNA, 19 nt, Homo sapiens
gaagcugccuaucgucaau

SEQ ID NO: 256057 - RNA, 19 nt, Homo sapiens
gaaagaggcaaaugagauc

SEQ ID NO: 256058 - RNA, 19 nt, Homo sapiens
gggugcggcucaagaagua

SEQ ID NO: 256059 - RNA, 19 nt, Homo sapiens
gucgaaggcuuuaacuuug

SEQ ID NO: 256060 - RNA, 19 nt, Homo sapiens
ggcacaggcucccuccaua

SEQ ID NO: 256061 - RNA, 19 nt, Homo sapiens
gcgaguacuucuucucaga

SEQ ID NO: 256062 - RNA, 19 nt, Homo sapiens
gauguacccucgcugaauc

SEQ ID NO: 256063 - RNA, 19 nt, Homo sapiens
uccauggccugcacucuua

SEQ ID NO: 256064 - RNA, 19 nt, Homo sapiens
gccaagaaccugauugaug

SEQ ID NO: 256065 - RNA, 19 nt, Homo sapiens
gauuggaccucgcuacaca

SEQ ID NO: 256066 - RNA, 19 nt, Homo sapiens
ggccugcacucuuacgaaa

SEQ ID NO: 256067 - RNA, 19 nt, Homo sapiens
cuacaacgacuuccugauu

SEQ ID NO: 256068 - RNA, 19 nt, Homo sapiens
uguacaagguggcugagua

SEQ ID NO: 256069 - RNA, 19 nt, Homo sapiens
cauggugcauuacaucaaa

SEQ ID NO: 256070 - RNA, 19 nt, Homo sapiens
cagcaggugugacguugaa

SEQ ID NO: 256071 - RNA, 19 nt, Homo sapiens
ggaucacaguugcgucauu

SEQ ID NO: 256072 - RNA, 19 nt, Homo sapiens
caaaggauccauucagaag

SEQ ID NO: 256073 - RNA, 19 nt, Homo sapiens
guugcgucauuguguauua

SEQ ID NO: 256074 - RNA, 19 nt, Homo sapiens
guucgugcccuaccucaua

SEQ ID NO: 256075 - RNA, 19 nt, Homo sapiens
ccuccuggcuucuccugua

SEQ ID NO: 256076 - RNA, 19 nt, Homo sapiens
ggacaaaggauccauucag

SEQ ID NO: 256077 - RNA, 19 nt, Homo sapiens
acaccacccuccucaguga

SEQ ID NO: 256078 - RNA, 19 nt, Homo sapiens
aaggauccauucagaaguu

SEQ ID NO: 256079 - RNA, 19 nt, Homo sapiens
ccaagggaauucgguguau

SEQ ID NO: 256080 - RNA, 19 nt, Homo sapiens
agucgaaggcuuuaacuuu

SEQ ID NO: 256081 - RNA, 19 nt, Homo sapiens
gcagcagccagaaacgaua

SEQ ID NO: 256082 - RNA, 19 nt, Homo sapiens
guacaagguggcugaguau

SEQ ID NO: 256083 - RNA, 19 nt, Homo sapiens
ccucuggccuccaaggauu

SEQ ID NO: 256084 - RNA, 19 nt, Homo sapiens
ugaaagaggcaaaugagau

SEQ ID NO: 256085 - RNA, 19 nt, Homo sapiens
acaguugcgucauugugua

SEQ ID NO: 256086 - RNA, 19 nt, Homo sapiens
gagcagcagcagccagaaa

SEQ ID NO: 256087 - RNA, 19 nt, Homo sapiens
ugcauuacaucaaacagaa

SEQ ID NO: 256088 - RNA, 19 nt, Homo sapiens
uacaacgacuuccugauuc

SEQ ID NO: 256089 - RNA, 19 nt, Homo sapiens
ccagggcacugcuguguac

SEQ ID NO: 256090 - RNA, 19 nt, Homo sapiens
ccagucgacucccggauuc

SEQ ID NO: 256091 - RNA, 19 nt, Homo sapiens
ccucauagcaggcauccaa

SEQ ID NO: 256092 - RNA, 19 nt, Homo sapiens
agaucgccauggugcauua

SEQ ID NO: 256093 - RNA, 19 nt, Homo sapiens
gugaugacgccaaggauug

SEQ ID NO: 256094 - RNA, 19 nt, Homo sapiens
cgagacaucgacuuucuug

SEQ ID NO: 256095 - RNA, 19 nt, Homo sapiens
ggagguauuggguucauuc

SEQ ID NO: 256096 - RNA, 19 nt, Homo sapiens
cggaagaucacgcugaaga

SEQ ID NO: 256097 - RNA, 19 nt, Homo sapiens
gauucucccaggauucaua

SEQ ID NO: 256098 - RNA, 19 nt, Homo sapiens
gcuuuaacuuugcacacuu

SEQ ID NO: 256099 - RNA, 19 nt, Homo sapiens
guccuucgguccaugaugu

SEQ ID NO: 256100 - RNA, 19 nt, Homo sapiens
cagcagcccaggccaagaa

SEQ ID NO: 256101 - RNA, 19 nt, Homo sapiens
gcccugacccggaagauca

SEQ ID NO: 256102 - RNA, 19 nt, Homo sapiens
cccgugaggaugacaaaua

SEQ ID NO: 256103 - RNA, 19 nt, Homo sapiens
ggaagcugccuaucgucaa

SEQ ID NO: 256104 - RNA, 19 nt, Homo sapiens
ggugaugacgccaaggauu

SEQ ID NO: 256105 - RNA, 19 nt, Homo sapiens
gauugagggugguguccau

SEQ ID NO: 256106 - RNA, 19 nt, Homo sapiens
gggcaugggcucacuggau

SEQ ID NO: 256107 - RNA, 19 nt, Homo sapiens
gcucugaugggagguauug

SEQ ID NO: 256108 - RNA, 19 nt, Homo sapiens
acacuugggaucacaguug

SEQ ID NO: 256109 - RNA, 19 nt, Homo sapiens
gaaccgagucuaggcaucu

SEQ ID NO: 256110 - RNA, 19 nt, Homo sapiens
gcgcugccuuaggaucuuu

SEQ ID NO: 256111 - RNA, 19 nt, Homo sapiens
acaaaggauccauucagaa

SEQ ID NO: 256112 - RNA, 19 nt, Homo sapiens
gaggugaugacgccaagga

SEQ ID NO: 256113 - RNA, 19 nt, Homo sapiens
gggcacugcuguguacaag

SEQ ID NO: 256114 - RNA, 19 nt, Homo sapiens
caagggaauucgguguauc

SEQ ID NO: 256115 - RNA, 19 nt, Homo sapiens
agaaagggaagcugccuau

SEQ ID NO: 256116 - RNA, 19 nt, Homo sapiens
ggcuagccauggcggacua

SEQ ID NO: 256117 - RNA, 19 nt, Homo sapiens
gugcauuacaucaaacaga

SEQ ID NO: 256118 - RNA, 19 nt, Homo sapiens
aagggaagcugccuaucgu

SEQ ID NO: 256119 - RNA, 19 nt, Homo sapiens
ggagacugcccuggucaug

SEQ ID NO: 256120 - RNA, 19 nt, Homo sapiens
ccaaggauucccagaagca

SEQ ID NO: 256121 - RNA, 19 nt, Homo sapiens
ccacaccacccuccucagu

SEQ ID NO: 256122 - RNA, 19 nt, Homo sapiens
cccggaagaucacgcugaa

SEQ ID NO: 256123 - RNA, 19 nt, Homo sapiens
caggcucccuccauaacug

SEQ ID NO: 256124 - RNA, 19 nt, Homo sapiens
cgaaggcuuuaacuuugca

SEQ ID NO: 256125 - RNA, 19 nt, Homo sapiens
gaaccauuccucccuucuc

SEQ ID NO: 256126 - RNA, 19 nt, Homo sapiens
guccacagauuugcacuac

SEQ ID NO: 256127 - RNA, 19 nt, Homo sapiens
ccgugaggaugacaaauac

SEQ ID NO: 256128 - RNA, 19 nt, Homo sapiens
uaucuucaguggucuuacu

SEQ ID NO: 256129 - RNA, 19 nt, Homo sapiens
gcgucauuguguauuaaau

SEQ ID NO: 256130 - RNA, 19 nt, Homo sapiens
acaacgacuuccugauucu

SEQ ID NO: 256131 - RNA, 19 nt, Homo sapiens
gggagguauuggguucauu

SEQ ID NO: 256132 - RNA, 19 nt, Homo sapiens
uguaucagaucgccauggu

SEQ ID NO: 256133 - RNA, 19 nt, Homo sapiens
gggaauucgguguaucaga

SEQ ID NO: 256134 - RNA, 19 nt, Homo sapiens
caggugugacguugaaaga

SEQ ID NO: 256135 - RNA, 19 nt, Homo sapiens
ugccuuaggaucuuucuug

SEQ ID NO: 256136 - RNA, 19 nt, Homo sapiens
ucaggagagcucaaguuug

SEQ ID NO: 256137 - RNA, 19 nt, Homo sapiens
cucaggagagcucaaguuu

SEQ ID NO: 256138 - RNA, 19 nt, Homo sapiens
gcccgagagcccuagauug

SEQ ID NO: 256139 - RNA, 19 nt, Homo sapiens
gcaggugugacguugaaag

SEQ ID NO: 256140 - RNA, 19 nt, Homo sapiens
cccgagacaucgacuuucu

SEQ ID NO: 256141 - RNA, 19 nt, Homo sapiens
cuuuaacuuugcacacuug

SEQ ID NO: 256142 - RNA, 19 nt, Homo sapiens
guccauggccugcacucuu

SEQ ID NO: 256143 - RNA, 19 nt, Homo sapiens
cuccaaggauucccagaag

SEQ ID NO: 256144 - RNA, 19 nt, Homo sapiens
gaaagggaagcugccuauc

SEQ ID NO: 256145 - RNA, 19 nt, Homo sapiens
cccgagagcccuagauugg

SEQ ID NO: 256146 - RNA, 19 nt, Homo sapiens
ccaggacaaaggauccauu

SEQ ID NO: 256147 - RNA, 19 nt, Homo sapiens
gaauucgguguaucagauc

SEQ ID NO: 256148 - RNA, 19 nt, Homo sapiens
ggacagaccugaagaagaa

SEQ ID NO: 256149 - RNA, 19 nt, Homo sapiens
gaagagauaaugacaaaga

SEQ ID NO: 256150 - RNA, 19 nt, Homo sapiens
gaaaguugcccauuguaaa

SEQ ID NO: 256151 - RNA, 19 nt, Homo sapiens
gaaggaggcaaaugaaauu

SEQ ID NO: 256152 - RNA, 19 nt, Homo sapiens
ggaaagugaagaaauauga

SEQ ID NO: 256153 - RNA, 19 nt, Homo sapiens
ggauccggcuaaagaaaua

SEQ ID NO: 256154 - RNA, 19 nt, Homo sapiens
gcacggcgcuuugguguuc

SEQ ID NO: 256155 - RNA, 19 nt, Homo sapiens
cagcacaccuccucgguuu

SEQ ID NO: 256156 - RNA, 19 nt, Homo sapiens
caaauacccuaaucuccaa

SEQ ID NO: 256157 - RNA, 19 nt, Homo sapiens
ggaaaguugcccauuguaa

SEQ ID NO: 256158 - RNA, 19 nt, Homo sapiens
gagcuuaaguuugagaaga

SEQ ID NO: 256159 - RNA, 19 nt, Homo sapiens
ccacuagccuccaaagaug

SEQ ID NO: 256160 - RNA, 19 nt, Homo sapiens
uggaagagauaaugacaaa

SEQ ID NO: 256161 - RNA, 19 nt, Homo sapiens
caacagcaguguacaaggu

SEQ ID NO: 256162 - RNA, 19 nt, Homo sapiens
ucaaguacaucaaagacaa

SEQ ID NO: 256163 - RNA, 19 nt, Homo sapiens
aaagaaauaucgcgguaug

SEQ ID NO: 256164 - RNA, 19 nt, Homo sapiens
gaugggauccggcuaaaga

SEQ ID NO: 256165 - RNA, 19 nt, Homo sapiens
ucaaagaggaggaacauga

SEQ ID NO: 256166 - RNA, 19 nt, Homo sapiens
gagacggccucaccuacaa

SEQ ID NO: 256167 - RNA, 19 nt, Homo sapiens
ccaaagaugccaagaaaca

SEQ ID NO: 256168 - RNA, 19 nt, Homo sapiens
gaagaagaaucgggacuac

SEQ ID NO: 256169 - RNA, 19 nt, Homo sapiens
uguacaaggugucagagua

SEQ ID NO: 256170 - RNA, 19 nt, Homo sapiens
cuccaaagaugccaagaaa

SEQ ID NO: 256171 - RNA, 19 nt, Homo sapiens
aaaugaagaugaugagcuu

SEQ ID NO: 256172 - RNA, 19 nt, Homo sapiens
gccaagaaccucauugaug

SEQ ID NO: 256173 - RNA, 19 nt, Homo sapiens
ggaggcaaaugaaauucug

SEQ ID NO: 256174 - RNA, 19 nt, Homo sapiens
ccaaugaaguucggaaagu

SEQ ID NO: 256175 - RNA, 19 nt, Homo sapiens
aaagacaaauacccuaauc

SEQ ID NO: 256176 - RNA, 19 nt, Homo sapiens
ccacaacuguacaccugaa

SEQ ID NO: 256177 - RNA, 19 nt, Homo sapiens
caaagggucaauccacaaa

SEQ ID NO: 256178 - RNA, 19 nt, Homo sapiens
guacaaggugucagaguau

SEQ ID NO: 256179 - RNA, 19 nt, Homo sapiens
gagggaagacuugguggua

SEQ ID NO: 256180 - RNA, 19 nt, Homo sapiens
ucaaagacaaauacccuaa

SEQ ID NO: 256181 - RNA, 19 nt, Homo sapiens
cacagcagcucuucaacug

SEQ ID NO: 256182 - RNA, 19 nt, Homo sapiens
guacaucaaagacaaauac

SEQ ID NO: 256183 - RNA, 19 nt, Homo sapiens
ugacaaagagggaagacuu

SEQ ID NO: 256184 - RNA, 19 nt, Homo sapiens
caaugaaguucggaaagug

SEQ ID NO: 256185 - RNA, 19 nt, Homo sapiens
uucggaaagugaagaaaua

SEQ ID NO: 256186 - RNA, 19 nt, Homo sapiens
caacuguacaccugaauuc

SEQ ID NO: 256187 - RNA, 19 nt, Homo sapiens
uccauagccuccauucgua

SEQ ID NO: 256188 - RNA, 19 nt, Homo sapiens
aagggucaauccacaaauu

SEQ ID NO: 256189 - RNA, 19 nt, Homo sapiens
gaccugacuucugcucuga

SEQ ID NO: 256190 - RNA, 19 nt, Homo sapiens
gcagccagaacagauauuu

SEQ ID NO: 256191 - RNA, 19 nt, Homo sapiens
gaaucgggacuacccacua

SEQ ID NO: 256192 - RNA, 19 nt, Homo sapiens
aagggaaaguugcccauug

SEQ ID NO: 256193 - RNA, 19 nt, Homo sapiens
ugaaggaggcaaaugaaau

SEQ ID NO: 256194 - RNA, 19 nt, Homo sapiens
gaagggaaaguugcccauu

SEQ ID NO: 256195 - RNA, 19 nt, Homo sapiens
gaaauaugaacagggauuc

SEQ ID NO: 256196 - RNA, 19 nt, Homo sapiens
gacaaagagggaagacuug

SEQ ID NO: 256197 - RNA, 19 nt, Homo sapiens
ggagacggccucaccuaca

SEQ ID NO: 256198 - RNA, 19 nt, Homo sapiens
gcacagcagcucuucaacu

SEQ ID NO: 256199 - RNA, 19 nt, Homo sapiens
gagcuuguggccaucauug

SEQ ID NO: 256200 - RNA, 19 nt, Homo sapiens
ccugauugcuggcauccaa

SEQ ID NO: 256201 - RNA, 19 nt, Homo sapiens
aaaguugcccauuguaaau

SEQ ID NO: 256202 - RNA, 19 nt, Homo sapiens
cagcacagcagcucuucaa

SEQ ID NO: 256203 - RNA, 19 nt, Homo sapiens
gcagcaagaagggaaaguu

SEQ ID NO: 256204 - RNA, 19 nt, Homo sapiens
gggaaaguugcccauugua

SEQ ID NO: 256205 - RNA, 19 nt, Homo sapiens
caaaaugugggucauauug

SEQ ID NO: 256206 - RNA, 19 nt, Homo sapiens
caaagacaaauacccuaau

SEQ ID NO: 256207 - RNA, 19 nt, Homo sapiens
caaguacaucaaagacaaa

SEQ ID NO: 256208 - RNA, 19 nt, Homo sapiens
cagcaagaagggaaaguug

SEQ ID NO: 256209 - RNA, 19 nt, Homo sapiens
ugaagaagaaucgggacua

SEQ ID NO: 256210 - RNA, 19 nt, Homo sapiens
acaugacuguuucuuggaa

SEQ ID NO: 256211 - RNA, 19 nt, Homo sapiens
agaaauaugaacagggauu

SEQ ID NO: 256212 - RNA, 19 nt, Homo sapiens
gaaguucggaaagugaaga

SEQ ID NO: 256213 - RNA, 19 nt, Homo sapiens
ucagcagccagaacagaua

SEQ ID NO: 256214 - RNA, 19 nt, Homo sapiens
agggaaaguugcccauugu

SEQ ID NO: 256215 - RNA, 19 nt, Homo sapiens
cagugaagcugacaaaauc

SEQ ID NO: 256216 - RNA, 19 nt, Homo sapiens
gggauccggcuaaagaaau

SEQ ID NO: 256217 - RNA, 19 nt, Homo sapiens
gcgcuuacaggcgguauug

SEQ ID NO: 256218 - RNA, 19 nt, Homo sapiens
gaucaaguacaucaaagac

SEQ ID NO: 256219 - RNA, 19 nt, Homo sapiens
cauuggcacucaugaggau

SEQ ID NO: 256220 - RNA, 19 nt, Homo sapiens
aaucgggacuacccacuag

SEQ ID NO: 256221 - RNA, 19 nt, Homo sapiens
ugaagaugaugagcuugug

SEQ ID NO: 256222 - RNA, 19 nt, Homo sapiens
gcuuaaguuugagaagaga

SEQ ID NO: 256223 - RNA, 19 nt, Homo sapiens
ccgaugggauccggcuaaa

SEQ ID NO: 256224 - RNA, 19 nt, Homo sapiens
agacaaauacccuaaucuc

SEQ ID NO: 256225 - RNA, 19 nt, Homo sapiens
guucggaaagugaagaaau

SEQ ID NO: 256226 - RNA, 19 nt, Homo sapiens
cuggggagcuuaaguuuga

SEQ ID NO: 256227 - RNA, 19 nt, Homo sapiens
gggucaauccacaaauuug

SEQ ID NO: 256228 - RNA, 19 nt, Homo sapiens
gaguaugcacggcgcuuug

SEQ ID NO: 256229 - RNA, 19 nt, Homo sapiens
ccaagcaacagcaguguac

SEQ ID NO: 256230 - RNA, 19 nt, Homo sapiens
gaucgcgugcgggauguuu

SEQ ID NO: 256231 - RNA, 19 nt, Homo sapiens
ugaauuccaggccaaugaa

SEQ ID NO: 256232 - RNA, 19 nt, Homo sapiens
guccauagccuccauucgu

SEQ ID NO: 256233 - RNA, 19 nt, Homo sapiens
ccagaacagauauuucagu

SEQ ID NO: 256234 - RNA, 19 nt, Homo sapiens
cgguauggguucucucgau

SEQ ID NO: 256235 - RNA, 19 nt, Homo sapiens
ccuaaucuccaagucauug

SEQ ID NO: 256236 - RNA, 19 nt, Homo sapiens
ugacuucugcucugaccaa

SEQ ID NO: 256237 - RNA, 19 nt, Homo sapiens
ucacagcacagcagcucuu

SEQ ID NO: 256238 - RNA, 19 nt, Homo sapiens
ccucaccuacaaugacuuu

SEQ ID NO: 256239 - RNA, 19 nt, Homo sapiens
gaaguggcuccaucugcau

SEQ ID NO: 256240 - RNA, 19 nt, Homo sapiens
cacugaaggaggcaaauga

SEQ ID NO: 256241 - RNA, 19 nt, Homo sapiens
caaguccgagccaugaugu

SEQ ID NO: 256242 - RNA, 19 nt, Homo sapiens
ccaaguccgagccaugaug

SEQ ID NO: 256243 - RNA, 19 nt, Homo sapiens
uaaagaaauaucgcgguau

SEQ ID NO: 256244 - RNA, 19 nt, Homo sapiens
ugguguggauguagugguu

SEQ ID NO: 256245 - RNA, 19 nt, Homo sapiens
ggccucaccuacaaugacu

SEQ ID NO: 256246 - RNA, 19 nt, Homo sapiens
cccacuagccuccaaagau

SEQ ID NO: 256247 - RNA, 19 nt, Homo sapiens
caaagaggaggaacaugac

SEQ ID NO: 256248 - RNA, 19 nt, Homo sapiens
ccaaagauaucuccauuaa

SEQ ID NO: 256249 - RNA, 19 nt, Homo sapiens
uaaagaagaugcuauguug

SEQ ID NO: 256250 - RNA, 19 nt, Homo sapiens
gaagcaaacucuuuauaug

SEQ ID NO: 256251 - RNA, 19 nt, Homo sapiens
caagugaccuccugucuuu

SEQ ID NO: 256252 - RNA, 19 nt, Homo sapiens
uaucuacgauccaaucuua

SEQ ID NO: 256253 - RNA, 19 nt, Homo sapiens
gcaaagcacuagaggaaga

SEQ ID NO: 256254 - RNA, 19 nt, Homo sapiens
gaucaaggcaccacagaua

SEQ ID NO: 256255 - RNA, 19 nt, Homo sapiens
gggcgaaguuguacuauau

SEQ ID NO: 256256 - RNA, 19 nt, Homo sapiens
gcacacaccauauuucaaa

SEQ ID NO: 256257 - RNA, 19 nt, Homo sapiens
uaacagaggaugcuacuuu

SEQ ID NO: 256258 - RNA, 19 nt, Homo sapiens
ugaaauaucugcagagaag

SEQ ID NO: 256259 - RNA, 19 nt, Homo sapiens
gaaacuagaagagcuauuu

SEQ ID NO: 256260 - RNA, 19 nt, Homo sapiens
ggaagcauaucggaucuuu

SEQ ID NO: 256261 - RNA, 19 nt, Homo sapiens
gaucauuucuuggaggaua

SEQ ID NO: 256262 - RNA, 19 nt, Homo sapiens
ucaagcaucuucucucuga

SEQ ID NO: 256263 - RNA, 19 nt, Homo sapiens
ggaagcaaacucuuuauau

SEQ ID NO: 256264 - RNA, 19 nt, Homo sapiens
uaccagagcucagcgaaua

SEQ ID NO: 256265 - RNA, 19 nt, Homo sapiens
caagaugccuacaacagaa

SEQ ID NO: 256266 - RNA, 19 nt, Homo sapiens
ggagaagggcgaaguugua

SEQ ID NO: 256267 - RNA, 19 nt, Homo sapiens
cuaagucugugccguauaa

SEQ ID NO: 256268 - RNA, 19 nt, Homo sapiens
uuaagaaacuuccaggauu

SEQ ID NO: 256269 - RNA, 19 nt, Homo sapiens
gaauguauuuggaaacuag

SEQ ID NO: 256270 - RNA, 19 nt, Homo sapiens
caacuuacggccaucuuua

SEQ ID NO: 256271 - RNA, 19 nt, Homo sapiens
cagcuacucucucaacauu

SEQ ID NO: 256272 - RNA, 19 nt, Homo sapiens
ggagugugauugugaauag

SEQ ID NO: 256273 - RNA, 19 nt, Homo sapiens
gaggaagucuaucauggaa

SEQ ID NO: 256274 - RNA, 19 nt, Homo sapiens
ccacagagaugcaacuuac

SEQ ID NO: 256275 - RNA, 19 nt, Homo sapiens
gcaaucagcgaaacauauu

SEQ ID NO: 256276 - RNA, 19 nt, Homo sapiens
ucaaucaucugguaucaau

SEQ ID NO: 256277 - RNA, 19 nt, Homo sapiens
ccaagaagguuauccucaa

SEQ ID NO: 256278 - RNA, 19 nt, Homo sapiens
aaaccucaguauucaguua

SEQ ID NO: 256279 - RNA, 19 nt, Homo sapiens
gaauguauguaguguguag

SEQ ID NO: 256280 - RNA, 19 nt, Homo sapiens
uaagaaacuuccaggauuc

SEQ ID NO: 256281 - RNA, 19 nt, Homo sapiens
gaugaaauaucugcagaga

SEQ ID NO: 256282 - RNA, 19 nt, Homo sapiens
gaauuugcccaauguguaa

SEQ ID NO: 256283 - RNA, 19 nt, Homo sapiens
gaagggcgaaguuguacua

SEQ ID NO: 256284 - RNA, 19 nt, Homo sapiens
acacaaaccucaguauuca

SEQ ID NO: 256285 - RNA, 19 nt, Homo sapiens
gaagcuccaccuuucuuua

SEQ ID NO: 256286 - RNA, 19 nt, Homo sapiens
gcaaacucuuuauaugcua

SEQ ID NO: 256287 - RNA, 19 nt, Homo sapiens
aaucagagcugcccacauc

SEQ ID NO: 256288 - RNA, 19 nt, Homo sapiens
ggaaauagacagcuacucu

SEQ ID NO: 256289 - RNA, 19 nt, Homo sapiens
gccgagagcugguaguguu

SEQ ID NO: 256290 - RNA, 19 nt, Homo sapiens
ugucucagcuuuacaguau

SEQ ID NO: 256291 - RNA, 19 nt, Homo sapiens
gagcucagcgaauauguuu

SEQ ID NO: 256292 - RNA, 19 nt, Homo sapiens
gcgaaguuguacuauauga

SEQ ID NO: 256293 - RNA, 19 nt, Homo sapiens
uuuagggacugaacaauuu

SEQ ID NO: 256294 - RNA, 19 nt, Homo sapiens
gaugacagccgaucaagug

SEQ ID NO: 256295 - RNA, 19 nt, Homo sapiens
gaaaugaaacaacugaaag

SEQ ID NO: 256296 - RNA, 19 nt, Homo sapiens
ggauaccacuccugucuca

SEQ ID NO: 256297 - RNA, 19 nt, Homo sapiens
cagcaaagcacuagaggaa

SEQ ID NO: 256298 - RNA, 19 nt, Homo sapiens
caagaagguuauccucaau

SEQ ID NO: 256299 - RNA, 19 nt, Homo sapiens
gggaagcaaacucuuuaua

SEQ ID NO: 256300 - RNA, 19 nt, Homo sapiens
gaccguagaauaugaagaa

SEQ ID NO: 256301 - RNA, 19 nt, Homo sapiens
ccaacuggcucugggaauu

SEQ ID NO: 256302 - RNA, 19 nt, Homo sapiens
cagauacaauggccacuga

SEQ ID NO: 256303 - RNA, 19 nt, Homo sapiens
gaaguuguacuauaugaca

SEQ ID NO: 256304 - RNA, 19 nt, Homo sapiens
gaaacuuccaggauucaaa

SEQ ID NO: 256305 - RNA, 19 nt, Homo sapiens
caagaaaugaaacaacuga

SEQ ID NO: 256306 - RNA, 19 nt, Homo sapiens
cgaauuugcccaaugugua

SEQ ID NO: 256307 - RNA, 19 nt, Homo sapiens
gucagaagcuccaccuuuc

SEQ ID NO: 256308 - RNA, 19 nt, Homo sapiens
caacagaaagagaaacaga

SEQ ID NO: 256309 - RNA, 19 nt, Homo sapiens
guauauaugcuccacacua

SEQ ID NO: 256310 - RNA, 19 nt, Homo sapiens
ggagacaggcauauucaug

SEQ ID NO: 256311 - RNA, 19 nt, Homo sapiens
ugaaccagcugaucaagca

SEQ ID NO: 256312 - RNA, 19 nt, Homo sapiens
ggugaaaccauugucauuu

SEQ ID NO: 256313 - RNA, 19 nt, Homo sapiens
ugaaacaacugaaaguacu

SEQ ID NO: 256314 - RNA, 19 nt, Homo sapiens
ccucaguauucaguuauua

SEQ ID NO: 256315 - RNA, 19 nt, Homo sapiens
gccagaauguauuuggaaa

SEQ ID NO: 256316 - RNA, 19 nt, Homo sapiens
gaacgaacggacugaggaa

SEQ ID NO: 256317 - RNA, 19 nt, Homo sapiens
ggauuuaagcaacuugaaa

SEQ ID NO: 256318 - RNA, 19 nt, Homo sapiens
ccacuccugucucagcuuu

SEQ ID NO: 256319 - RNA, 19 nt, Homo sapiens
ggacaagcaaccagaaauc

SEQ ID NO: 256320 - RNA, 19 nt, Homo sapiens
gaugacacccuccucaaug

SEQ ID NO: 256321 - RNA, 19 nt, Homo sapiens
agaaucagcacacaccaua

SEQ ID NO: 256322 - RNA, 19 nt, Homo sapiens
aaccaaagauaucuccauu

SEQ ID NO: 256323 - RNA, 19 nt, Homo sapiens
ggauuuagaccaaagaaag

SEQ ID NO: 256324 - RNA, 19 nt, Homo sapiens
aaacacaaaccucaguauu

SEQ ID NO: 256325 - RNA, 19 nt, Homo sapiens
ucacagaucauuugcaaca

SEQ ID NO: 256326 - RNA, 19 nt, Homo sapiens
caagcaaccagaaaucuau

SEQ ID NO: 256327 - RNA, 19 nt, Homo sapiens
cagagaaguuucccugaca

SEQ ID NO: 256328 - RNA, 19 nt, Homo sapiens
ccauuaacauauaccauuc

SEQ ID NO: 256329 - RNA, 19 nt, Homo sapiens
gaaacgggagugugauugu

SEQ ID NO: 256330 - RNA, 19 nt, Homo sapiens
gcucagcgucucucuggua

SEQ ID NO: 256331 - RNA, 19 nt, Homo sapiens
agaaagagaaacagaauuc

SEQ ID NO: 256332 - RNA, 19 nt, Homo sapiens
ccacaggaauccaugaaac

SEQ ID NO: 256333 - RNA, 19 nt, Homo sapiens
uauccucaaucaucuggua

SEQ ID NO: 256334 - RNA, 19 nt, Homo sapiens
gcaagugaccuccugucuu

SEQ ID NO: 256335 - RNA, 19 nt, Homo sapiens
gcaacuuacggccaucuuu

SEQ ID NO: 256336 - RNA, 19 nt, Homo sapiens
ccaagaugccuacaacaga

SEQ ID NO: 256337 - RNA, 19 nt, Homo sapiens
cgcaacuacugcuuacaua

SEQ ID NO: 256338 - RNA, 19 nt, Homo sapiens
aaaugaaguuugcuaaguc

SEQ ID NO: 256339 - RNA, 19 nt, Homo sapiens
caucaagcaucuucucucu

SEQ ID NO: 256340 - RNA, 19 nt, Homo sapiens
guuauuaggcacacuaguu

SEQ ID NO: 256341 - RNA, 19 nt, Homo sapiens
auagacagcuacucucuca

SEQ ID NO: 256342 - RNA, 19 nt, Homo sapiens
uauauaugcuccacacuac

SEQ ID NO: 256343 - RNA, 19 nt, Homo sapiens
ucuaaacgcaugaauguau

SEQ ID NO: 256344 - RNA, 19 nt, Homo sapiens
gaaaauggagacaggcaua

SEQ ID NO: 256345 - RNA, 19 nt, Homo sapiens
auacuuaacuucagaaacg

SEQ ID NO: 256346 - RNA, 19 nt, Homo sapiens
ccaacaaaauugaaaguga

SEQ ID NO: 256347 - RNA, 19 nt, Homo sapiens
gaaacuaaagacauagaca

SEQ ID NO: 256348 - RNA, 19 nt, Homo sapiens
ggagguagauuaauaaagu

SEQ ID NO: 256349 - RNA, 19 nt, Homo sapiens
caaauggacuugagaguau

SEQ ID NO: 256350 - RNA, 19 nt, Homo sapiens
gucaugaaguccuuuauua

SEQ ID NO: 256351 - RNA, 19 nt, Homo sapiens
ccacgaugcugacuaagaa

SEQ ID NO: 256352 - RNA, 19 nt, Homo sapiens
cuaagaagcccgaggauaa

SEQ ID NO: 256353 - RNA, 19 nt, Homo sapiens
gcaaauggacuugagagua

SEQ ID NO: 256354 - RNA, 19 nt, Homo sapiens
gaugaggaaucaacaccua

SEQ ID NO: 256355 - RNA, 19 nt, Homo sapiens
ggauaacccuugaggaaca

SEQ ID NO: 256356 - RNA, 19 nt, Homo sapiens
caagaagacugccgaagag

SEQ ID NO: 256357 - RNA, 19 nt, Homo sapiens
ccacuggacuuggaggaua

SEQ ID NO: 256358 - RNA, 19 nt, Homo sapiens
gcaaagagccagagcugau

SEQ ID NO: 256359 - RNA, 19 nt, Homo sapiens
uagagaagcuggcuacagu

SEQ ID NO: 256360 - RNA, 19 nt, Homo sapiens
gagaggcuccugaauguug

SEQ ID NO: 256361 - RNA, 19 nt, Homo sapiens
agaagcagauugagcagaa

SEQ ID NO: 256362 - RNA, 19 nt, Homo sapiens
gaaguaugaggucugagua

SEQ ID NO: 256363 - RNA, 19 nt, Homo sapiens
ggacgaagguacuguucca

SEQ ID NO: 256364 - RNA, 19 nt, Homo sapiens
gcagaaguuugcucagauc

SEQ ID NO: 256365 - RNA, 19 nt, Homo sapiens
gcaaggacaguguagagaa

SEQ ID NO: 256366 - RNA, 19 nt, Homo sapiens
cgaagguacuguuccauca

SEQ ID NO: 256367 - RNA, 19 nt, Homo sapiens
agagggaacuggaggagaa

SEQ ID NO: 256368 - RNA, 19 nt, Homo sapiens
ccaagaagacugccgaaga

SEQ ID NO: 256369 - RNA, 19 nt, Homo sapiens
cagaagaaccgacggaaga

SEQ ID NO: 256370 - RNA, 19 nt, Homo sapiens
guggagcuccuuccuauuu

SEQ ID NO: 256371 - RNA, 19 nt, Homo sapiens
uuugggagguagauuaaua

SEQ ID NO: 256372 - RNA, 19 nt, Homo sapiens
ggacuuggaggauaucuuc

SEQ ID NO: 256373 - RNA, 19 nt, Homo sapiens
ccagagaauucagcaaaga

SEQ ID NO: 256374 - RNA, 19 nt, Homo sapiens
guauuuaugugcuggugaa

SEQ ID NO: 256375 - RNA, 19 nt, Homo sapiens
ucugcaacauggauaauaa

SEQ ID NO: 256376 - RNA, 19 nt, Homo sapiens
uuuaugugcuggugaagua

SEQ ID NO: 256377 - RNA, 19 nt, Homo sapiens
gagaagaagaagcagauug

SEQ ID NO: 256378 - RNA, 19 nt, Homo sapiens
agagacggauuucuuaugu

SEQ ID NO: 256379 - RNA, 19 nt, Homo sapiens
ggagcuaugugaccagaag

SEQ ID NO: 256380 - RNA, 19 nt, Homo sapiens
ugaaggaggagaagaagaa

SEQ ID NO: 256381 - RNA, 19 nt, Homo sapiens
agacggauuucuuauguuc

SEQ ID NO: 256382 - RNA, 19 nt, Homo sapiens
uaugaggucugaguagaaa

SEQ ID NO: 256383 - RNA, 19 nt, Homo sapiens
ggacuugagaguauuuaug

SEQ ID NO: 256384 - RNA, 19 nt, Homo sapiens
gacacggcccugccacuua

SEQ ID NO: 256385 - RNA, 19 nt, Homo sapiens
ggugaaguaugaggucuga

SEQ ID NO: 256386 - RNA, 19 nt, Homo sapiens
agaagaagaagcagauuga

SEQ ID NO: 256387 - RNA, 19 nt, Homo sapiens
ggaccuuucugcacacagu

SEQ ID NO: 256388 - RNA, 19 nt, Homo sapiens
ggaaucaacaccuaagaag

SEQ ID NO: 256389 - RNA, 19 nt, Homo sapiens
uuucuuauguucaggauga

SEQ ID NO: 256390 - RNA, 19 nt, Homo sapiens
gagacggauuucuuauguu

SEQ ID NO: 256391 - RNA, 19 nt, Homo sapiens
ggugcucccuguuuguaaa

SEQ ID NO: 256392 - RNA, 19 nt, Homo sapiens
ggaggaagcgcagcuacaa

SEQ ID NO: 256393 - RNA, 19 nt, Homo sapiens
gagaacaacggaaauaacu

SEQ ID NO: 256394 - RNA, 19 nt, Homo sapiens
caaggacaguguagagaag

SEQ ID NO: 256395 - RNA, 19 nt, Homo sapiens
gaagauggaggagguggaa

SEQ ID NO: 256396 - RNA, 19 nt, Homo sapiens
accagaagcucauggaguu

SEQ ID NO: 256397 - RNA, 19 nt, Homo sapiens
guauauaaacguccucugu

SEQ ID NO: 256398 - RNA, 19 nt, Homo sapiens
ggagcucuuuggaaccauu

SEQ ID NO: 256399 - RNA, 19 nt, Homo sapiens
gaacuggaggagaagaaga

SEQ ID NO: 256400 - RNA, 19 nt, Homo sapiens
gcagauugagcagaaguuu

SEQ ID NO: 256401 - RNA, 19 nt, Homo sapiens
ggaaccagaugcucaugac

SEQ ID NO: 256402 - RNA, 19 nt, Homo sapiens
acacggagauugccaacag

SEQ ID NO: 256403 - RNA, 19 nt, Homo sapiens
gaagucgaaggccaggaua

SEQ ID NO: 256404 - RNA, 19 nt, Homo sapiens
agaagaagaagaaggaaga

SEQ ID NO: 256405 - RNA, 19 nt, Homo sapiens
cagaggagaaggccaagaa

SEQ ID NO: 256406 - RNA, 19 nt, Homo sapiens
uggaggaggugaagcugaa

SEQ ID NO: 256407 - RNA, 19 nt, Homo sapiens
cggaagaagagacggauuu

SEQ ID NO: 256408 - RNA, 19 nt, Homo sapiens
uugaggaacacgucaguua

SEQ ID NO: 256409 - RNA, 19 nt, Homo sapiens
gcguuugggagguagauua

SEQ ID NO: 256410 - RNA, 19 nt, Homo sapiens
caccagagaauucagcaaa

SEQ ID NO: 256411 - RNA, 19 nt, Homo sapiens
ucauggaguuucucugcaa

SEQ ID NO: 256412 - RNA, 19 nt, Homo sapiens
caacaccuaagaagucgaa

SEQ ID NO: 256413 - RNA, 19 nt, Homo sapiens
gaaucaacaccuaagaagu

SEQ ID NO: 256414 - RNA, 19 nt, Homo sapiens
ggcauuggcugcaccuucu

SEQ ID NO: 256415 - RNA, 19 nt, Homo sapiens
ggaagaagagacggauuuc

SEQ ID NO: 256416 - RNA, 19 nt, Homo sapiens
gacuugagaguauuuaugu

SEQ ID NO: 256417 - RNA, 19 nt, Homo sapiens
gcaacauggauaauaagga

SEQ ID NO: 256418 - RNA, 19 nt, Homo sapiens
agccagaggucccugagaa

SEQ ID NO: 256419 - RNA, 19 nt, Homo sapiens
caugaaguccuuuauuaag

SEQ ID NO: 256420 - RNA, 19 nt, Homo sapiens
acacggcccugccacuuag

SEQ ID NO: 256421 - RNA, 19 nt, Homo sapiens
ccagcaaggcccugaaugu

SEQ ID NO: 256422 - RNA, 19 nt, Homo sapiens
acaagcaggccgugaguga

SEQ ID NO: 256423 - RNA, 19 nt, Homo sapiens
ucgccagccuuuccagauu

SEQ ID NO: 256424 - RNA, 19 nt, Homo sapiens
gcaggacgaagguacuguu

SEQ ID NO: 256425 - RNA, 19 nt, Homo sapiens
gggcuuggccagguguaua

SEQ ID NO: 256426 - RNA, 19 nt, Homo sapiens
cgucuaagcucaggauugc

SEQ ID NO: 256427 - RNA, 19 nt, Homo sapiens
guaugaggucugaguagaa

SEQ ID NO: 256428 - RNA, 19 nt, Homo sapiens
ccugagaacaacggaaaua

SEQ ID NO: 256429 - RNA, 19 nt, Homo sapiens
uggaggagaagaagaagaa

SEQ ID NO: 256430 - RNA, 19 nt, Homo sapiens
agacugagaaggccaagga

SEQ ID NO: 256431 - RNA, 19 nt, Homo sapiens
ggguggagcagaugaagga

SEQ ID NO: 256432 - RNA, 19 nt, Homo sapiens
gaagcugaagcgugaggaa

SEQ ID NO: 256433 - RNA, 19 nt, Homo sapiens
aaucaacaccuaagaaguc

SEQ ID NO: 256434 - RNA, 19 nt, Homo sapiens
agaagguuaucccgcagaa

SEQ ID NO: 256435 - RNA, 19 nt, Homo sapiens
agguggagcuccuuccuau

SEQ ID NO: 256436 - RNA, 19 nt, Homo sapiens
gaaaacagagaucccauca

SEQ ID NO: 256437 - RNA, 19 nt, Homo sapiens
gcagcgucaugaaguccuu

SEQ ID NO: 256438 - RNA, 19 nt, Homo sapiens
caagacggaccaagcagau

SEQ ID NO: 256439 - RNA, 19 nt, Homo sapiens
gaggaaucaacaccuaaga

SEQ ID NO: 256440 - RNA, 19 nt, Homo sapiens
cuggauaacccuugaggaa

SEQ ID NO: 256441 - RNA, 19 nt, Homo sapiens
gacgugcagucuccagcuu

SEQ ID NO: 256442 - RNA, 19 nt, Homo sapiens
uugcucagaucgacgagaa

SEQ ID NO: 256443 - RNA, 19 nt, Homo sapiens
cgucaugaaguccuuuauu

SEQ ID NO: 256444 - RNA, 19 nt, Homo sapiens
caaagagccagagcugaug

SEQ ID NO: 256445 - RNA, 19 nt, Homo sapiens
gcaggaggagcaagagaag

SEQ ID NO: 256446 - RNA, 19 nt, Homo sapiens
gcucagaucgacgagaaga

SEQ ID NO: 256447 - RNA, 19 nt, Homo sapiens
ggagaagaagaagcagauu

SEQ ID NO: 256448 - RNA, 19 nt, Homo sapiens
uaacagagccacaaacuaa

SEQ ID NO: 256449 - RNA, 19 nt, Homo sapiens
gagaaagaguugagaaguu

SEQ ID NO: 256450 - RNA, 19 nt, Homo sapiens
agaaagaguugagaaguua

SEQ ID NO: 256451 - RNA, 19 nt, Homo sapiens
ggagaaagcccuucaagug

SEQ ID NO: 256452 - RNA, 19 nt, Homo sapiens
gaaagcccuucaaguguuu

SEQ ID NO: 256453 - RNA, 19 nt, Homo sapiens
uaaaggcgcuguuggaaau

SEQ ID NO: 256454 - RNA, 19 nt, Homo sapiens
gaaauauugcuguuccuua

SEQ ID NO: 256455 - RNA, 19 nt, Homo sapiens
gaacuuccugugcucauua

SEQ ID NO: 256456 - RNA, 19 nt, Homo sapiens
gaacgggacacuuugcuaa

SEQ ID NO: 256457 - RNA, 19 nt, Homo sapiens
gggcaaaggucauggagau

SEQ ID NO: 256458 - RNA, 19 nt, Homo sapiens
guaaagaguaccauauuga

SEQ ID NO: 256459 - RNA, 19 nt, Homo sapiens
gaacuggaggcacugauuu

SEQ ID NO: 256460 - RNA, 19 nt, Homo sapiens
agagacaucuguaugcauu

SEQ ID NO: 256461 - RNA, 19 nt, Homo sapiens
gauggagacugcaguaaag

SEQ ID NO: 256462 - RNA, 19 nt, Homo sapiens
uauaaugacuggauguuca

SEQ ID NO: 256463 - RNA, 19 nt, Homo sapiens
agaaagcccuucaaguguu

SEQ ID NO: 256464 - RNA, 19 nt, Homo sapiens
gagaaagcccuucaagugu

SEQ ID NO: 256465 - RNA, 19 nt, Homo sapiens
gaaguacaacugagaaauc

SEQ ID NO: 256466 - RNA, 19 nt, Homo sapiens
gcaaucaaaguaauuccua

SEQ ID NO: 256467 - RNA, 19 nt, Homo sapiens
ggacaaucaguaaagagua

SEQ ID NO: 256468 - RNA, 19 nt, Homo sapiens
ugaaggaagguuaauguaa

SEQ ID NO: 256469 - RNA, 19 nt, Homo sapiens
cuaaacaucugccugaucu

SEQ ID NO: 256470 - RNA, 19 nt, Homo sapiens
ggagcagacuacaagaaug

SEQ ID NO: 256471 - RNA, 19 nt, Homo sapiens
gaaaacuccuggacaauca

SEQ ID NO: 256472 - RNA, 19 nt, Homo sapiens
ugaauuuccugaagacugu

SEQ ID NO: 256473 - RNA, 19 nt, Homo sapiens
uggaggcacugauuuaaug

SEQ ID NO: 256474 - RNA, 19 nt, Homo sapiens
gcaagaacgggacacuuug

SEQ ID NO: 256475 - RNA, 19 nt, Homo sapiens
agaauaagaccucugaaga

SEQ ID NO: 256476 - RNA, 19 nt, Homo sapiens
gggaagacccaaaggaguu

SEQ ID NO: 256477 - RNA, 19 nt, Homo sapiens
gccaagaaauauugcuguu

SEQ ID NO: 256478 - RNA, 19 nt, Homo sapiens
gcauugaucaucucacaga

SEQ ID NO: 256479 - RNA, 19 nt, Homo sapiens
gacuggauguucauugcua

SEQ ID NO: 256480 - RNA, 19 nt, Homo sapiens
guaagaaguacaacugaga

SEQ ID NO: 256481 - RNA, 19 nt, Homo sapiens
gaaagaguugagaaguuaa

SEQ ID NO: 256482 - RNA, 19 nt, Homo sapiens
ccauauugaugaagaagug

SEQ ID NO: 256483 - RNA, 19 nt, Homo sapiens
ucaguguucuucgcauaua

SEQ ID NO: 256484 - RNA, 19 nt, Homo sapiens
ggaacugccuccuauuuug

SEQ ID NO: 256485 - RNA, 19 nt, Homo sapiens
gaauaagaccucugaagac

SEQ ID NO: 256486 - RNA, 19 nt, Homo sapiens
cauagagucuggccagcuu

SEQ ID NO: 256487 - RNA, 19 nt, Homo sapiens
ggaacuggaggcacugauu

SEQ ID NO: 256488 - RNA, 19 nt, Homo sapiens
gagcuaccaucugcaaauc

SEQ ID NO: 256489 - RNA, 19 nt, Homo sapiens
ggacaugagaagauauaug

SEQ ID NO: 256490 - RNA, 19 nt, Homo sapiens
gcaucaccauggcauaugu

SEQ ID NO: 256491 - RNA, 19 nt, Homo sapiens
cagcauugaucaucucaca

SEQ ID NO: 256492 - RNA, 19 nt, Homo sapiens
acaucugccugaucucaua

SEQ ID NO: 256493 - RNA, 19 nt, Homo sapiens
ucaaguguuucaccaaauc

SEQ ID NO: 256494 - RNA, 19 nt, Homo sapiens
aguaaagaguaccauauug

SEQ ID NO: 256495 - RNA, 19 nt, Homo sapiens
gcaaaggucauggagaugu

SEQ ID NO: 256496 - RNA, 19 nt, Homo sapiens
gacaaucaguaaagaguac

SEQ ID NO: 256497 - RNA, 19 nt, Homo sapiens
guaccauauugaugaagaa

SEQ ID NO: 256498 - RNA, 19 nt, Homo sapiens
guaacagagccacaaacua

SEQ ID NO: 256499 - RNA, 19 nt, Homo sapiens
gagaauaagaccucugaag

SEQ ID NO: 256500 - RNA, 19 nt, Homo sapiens
gccacaaacuaauacuaug

SEQ ID NO: 256501 - RNA, 19 nt, Homo sapiens
acagagccacaaacuaaua

SEQ ID NO: 256502 - RNA, 19 nt, Homo sapiens
aagaguaccauauugauga

SEQ ID NO: 256503 - RNA, 19 nt, Homo sapiens
ggaagacccaaaggaguuu

SEQ ID NO: 256504 - RNA, 19 nt, Homo sapiens
ccugaagacuguaagaagu

SEQ ID NO: 256505 - RNA, 19 nt, Homo sapiens
ggagcuaccaucugcaaau

SEQ ID NO: 256506 - RNA, 19 nt, Homo sapiens
caguaaagaguaccauauu

SEQ ID NO: 256507 - RNA, 19 nt, Homo sapiens
cuucaaguguuucaccaaa

SEQ ID NO: 256508 - RNA, 19 nt, Homo sapiens
ucacagaccacaagucaca

SEQ ID NO: 256509 - RNA, 19 nt, Homo sapiens
aaauauugcuguuccuuac

SEQ ID NO: 256510 - RNA, 19 nt, Homo sapiens
ugcaaaucgugacuaagua

SEQ ID NO: 256511 - RNA, 19 nt, Homo sapiens
caggacaugagaagauaua

SEQ ID NO: 256512 - RNA, 19 nt, Homo sapiens
gaggagcagacuacaagaa

SEQ ID NO: 256513 - RNA, 19 nt, Homo sapiens
guucauugcuaaacaucug

SEQ ID NO: 256514 - RNA, 19 nt, Homo sapiens
gagccacaaacuaauacua

SEQ ID NO: 256515 - RNA, 19 nt, Homo sapiens
ggcacugauuuaaugaauu

SEQ ID NO: 256516 - RNA, 19 nt, Homo sapiens
gaggacaugcugcucaguu

SEQ ID NO: 256517 - RNA, 19 nt, Homo sapiens
guucuucgcauauauuugu

SEQ ID NO: 256518 - RNA, 19 nt, Homo sapiens
caaauccacgaucauguga

SEQ ID NO: 256519 - RNA, 19 nt, Homo sapiens
gagcagacuacaagaaugg

SEQ ID NO: 256520 - RNA, 19 nt, Homo sapiens
uaagaaguacaacugagaa

SEQ ID NO: 256521 - RNA, 19 nt, Homo sapiens
gacaugagaagauauaugc

SEQ ID NO: 256522 - RNA, 19 nt, Homo sapiens
ccaaauccacgaucaugug

SEQ ID NO: 256523 - RNA, 19 nt, Homo sapiens
gcuaaaggcgcuguuggaa

SEQ ID NO: 256524 - RNA, 19 nt, Homo sapiens
caaaggucauggagauguc

SEQ ID NO: 256525 - RNA, 19 nt, Homo sapiens
ggaaaacaacaaaagguaa

SEQ ID NO: 256526 - RNA, 19 nt, Homo sapiens
ccaacaagagcacauuuua

SEQ ID NO: 256527 - RNA, 19 nt, Homo sapiens
uaauguaacccaacaagag

SEQ ID NO: 256528 - RNA, 19 nt, Homo sapiens
uccaggacaugagaagaua

SEQ ID NO: 256529 - RNA, 19 nt, Homo sapiens
caaaagaccucaaaauacc

SEQ ID NO: 256530 - RNA, 19 nt, Homo sapiens
ugcaagaacgggacacuuu

SEQ ID NO: 256531 - RNA, 19 nt, Homo sapiens
agacugcaguaaaggauuc

SEQ ID NO: 256532 - RNA, 19 nt, Homo sapiens
aaacuggaacugccuccua

SEQ ID NO: 256533 - RNA, 19 nt, Homo sapiens
cagaggagcagacuacaag

SEQ ID NO: 256534 - RNA, 19 nt, Homo sapiens
gcaaaucgugacuaaguac

SEQ ID NO: 256535 - RNA, 19 nt, Homo sapiens
cuaaaggcgcuguuggaaa

SEQ ID NO: 256536 - RNA, 19 nt, Homo sapiens
ucaguaaagaguaccauau

SEQ ID NO: 256537 - RNA, 19 nt, Homo sapiens
gaauggcacacgcuaugga

SEQ ID NO: 256538 - RNA, 19 nt, Homo sapiens
uguaugcauuccugucauu

SEQ ID NO: 256539 - RNA, 19 nt, Homo sapiens
ggaggcacugauuuaauga

SEQ ID NO: 256540 - RNA, 19 nt, Homo sapiens
agaguaccauauugaugaa

SEQ ID NO: 256541 - RNA, 19 nt, Homo sapiens
ugauggagacugcaguaaa

SEQ ID NO: 256542 - RNA, 19 nt, Homo sapiens
caagccagcagccaaagga

SEQ ID NO: 256543 - RNA, 19 nt, Homo sapiens
gaggagcuaccaucugcaa

SEQ ID NO: 256544 - RNA, 19 nt, Homo sapiens
uuucaguguucuucgcaua

SEQ ID NO: 256545 - RNA, 19 nt, Homo sapiens
ucauggagauguccguaag

SEQ ID NO: 256546 - RNA, 19 nt, Homo sapiens
cugaagacuguaagaagua

SEQ ID NO: 256547 - RNA, 19 nt, Homo sapiens
uaaugaauuuccugaagac

SEQ ID NO: 256548 - RNA, 19 nt, Homo sapiens
ggaaauuacugcccacuug

SEQ ID NO: 256549 - RNA, 19 nt, Homo sapiens
caaaugaacuugcacuugu

SEQ ID NO: 256550 - RNA, 19 nt, Homo sapiens
ggacaaagcccuggagaaa

SEQ ID NO: 256551 - RNA, 19 nt, Homo sapiens
caaggaaccucaagucaug

SEQ ID NO: 256552 - RNA, 19 nt, Homo sapiens
gacaaagccuuaagcaaau

SEQ ID NO: 256553 - RNA, 19 nt, Homo sapiens
ggacuaaacucaaccuaac

SEQ ID NO: 256554 - RNA, 19 nt, Homo sapiens
gccaagaccuccaagaaga

SEQ ID NO: 256555 - RNA, 19 nt, Homo sapiens
agacaaagccuuaagcaaa

SEQ ID NO: 256556 - RNA, 19 nt, Homo sapiens
caauuuagacaaagccuua

SEQ ID NO: 256557 - RNA, 19 nt, Homo sapiens
gcaaauaaauacgugucaa

SEQ ID NO: 256558 - RNA, 19 nt, Homo sapiens
acaaagcccuggagaaauc

SEQ ID NO: 256559 - RNA, 19 nt, Homo sapiens
gcaaccaggucuccuaugg

SEQ ID NO: 256560 - RNA, 19 nt, Homo sapiens
uauaggaacuucauuagca

SEQ ID NO: 256561 - RNA, 19 nt, Homo sapiens
gccaugauguauauccaua

SEQ ID NO: 256562 - RNA, 19 nt, Homo sapiens
gaaaguggucuguggauca

SEQ ID NO: 256563 - RNA, 19 nt, Homo sapiens
uuacauugcugccuuuguu

SEQ ID NO: 256564 - RNA, 19 nt, Homo sapiens
aaacucaaccuaacacauu

SEQ ID NO: 256565 - RNA, 19 nt, Homo sapiens
caccagcaauuuagacaaa

SEQ ID NO: 256566 - RNA, 19 nt, Homo sapiens
agagagagguggcgaguuc

SEQ ID NO: 256567 - RNA, 19 nt, Homo sapiens
ccaguuuguuccucuagua

SEQ ID NO: 256568 - RNA, 19 nt, Homo sapiens
gcgcggauuuauagcagua

SEQ ID NO: 256569 - RNA, 19 nt, Homo sapiens
gaagugcagucagcagaug

SEQ ID NO: 256570 - RNA, 19 nt, Homo sapiens
uaaguggucuagucaagga

SEQ ID NO: 256571 - RNA, 19 nt, Homo sapiens
gaacccacguacugucugu

SEQ ID NO: 256572 - RNA, 19 nt, Homo sapiens
cgaggucagucaaggcuuu

SEQ ID NO: 256573 - RNA, 19 nt, Homo sapiens
gaaccucaagucaugcuuu

SEQ ID NO: 256574 - RNA, 19 nt, Homo sapiens
guguacccaucuuuaauuu

SEQ ID NO: 256575 - RNA, 19 nt, Homo sapiens
cauaguguacccaucuuua

SEQ ID NO: 256576 - RNA, 19 nt, Homo sapiens
uaucaccaaucauagugua

SEQ ID NO: 256577 - RNA, 19 nt, Homo sapiens
ggaguuuacuaauguuuac

SEQ ID NO: 256578 - RNA, 19 nt, Homo sapiens
ggaacuucauuagcauauu

SEQ ID NO: 256579 - RNA, 19 nt, Homo sapiens
gaaauuacugcccacuugu

SEQ ID NO: 256580 - RNA, 19 nt, Homo sapiens
guuuguuccucuaguagua

SEQ ID NO: 256581 - RNA, 19 nt, Homo sapiens
ggauggcagugauucuguu

SEQ ID NO: 256582 - RNA, 19 nt, Homo sapiens
uuacaaggcugcgcaguag

SEQ ID NO: 256583 - RNA, 19 nt, Homo sapiens
gggacuaaacucaaccuaa

SEQ ID NO: 256584 - RNA, 19 nt, Homo sapiens
gcacacccaaggagaagaa

SEQ ID NO: 256585 - RNA, 19 nt, Homo sapiens
gguggaggguggacgaguu

SEQ ID NO: 256586 - RNA, 19 nt, Homo sapiens
guagggaaacggaagaguu

SEQ ID NO: 256587 - RNA, 19 nt, Homo sapiens
ugaagcuaaugucacaauu

SEQ ID NO: 256588 - RNA, 19 nt, Homo sapiens
ccaaaugaacuugcacuug

SEQ ID NO: 256589 - RNA, 19 nt, Homo sapiens
auucaacacuuaagucuca

SEQ ID NO: 256590 - RNA, 19 nt, Homo sapiens
gcaaggaguguaaaaugua

SEQ ID NO: 256591 - RNA, 19 nt, Homo sapiens
acaaagccuuaagcaaauu

SEQ ID NO: 256592 - RNA, 19 nt, Homo sapiens
aacucaaccuaacacauua

SEQ ID NO: 256593 - RNA, 19 nt, Homo sapiens
uguuuccgcugucuucuuu

SEQ ID NO: 256594 - RNA, 19 nt, Homo sapiens
aaagagagggcuuacaaca

SEQ ID NO: 256595 - RNA, 19 nt, Homo sapiens
gagaagaccauggacaaag

SEQ ID NO: 256596 - RNA, 19 nt, Homo sapiens
ugguggagcugguggagaa

SEQ ID NO: 256597 - RNA, 19 nt, Homo sapiens
ucucuuaaguggucuaguc

SEQ ID NO: 256598 - RNA, 19 nt, Homo sapiens
gcguggggcucaaucauaa

SEQ ID NO: 256599 - RNA, 19 nt, Homo sapiens
caacgaacccacguacugu

SEQ ID NO: 256600 - RNA, 19 nt, Homo sapiens
gcgcuucagucgcgagaca

SEQ ID NO: 256601 - RNA, 19 nt, Homo sapiens
gaguugauuugaacgucuu

SEQ ID NO: 256602 - RNA, 19 nt, Homo sapiens
caaagccuuaagcaaauuu

SEQ ID NO: 256603 - RNA, 19 nt, Homo sapiens
uugcugccaugauguauau

SEQ ID NO: 256604 - RNA, 19 nt, Homo sapiens
ggucuguggaucagcauuu

SEQ ID NO: 256605 - RNA, 19 nt, Homo sapiens
gaaccauuccuuucauagg

SEQ ID NO: 256606 - RNA, 19 nt, Homo sapiens
ccaacgaacccacguacug

SEQ ID NO: 256607 - RNA, 19 nt, Homo sapiens
ccaagaccuccaagaagaa

SEQ ID NO: 256608 - RNA, 19 nt, Homo sapiens
guggacgaguugauuugaa

SEQ ID NO: 256609 - RNA, 19 nt, Homo sapiens
cggaguuuacuaauguuua

SEQ ID NO: 256610 - RNA, 19 nt, Homo sapiens
gacaaagcccuggagaaau

SEQ ID NO: 256611 - RNA, 19 nt, Homo sapiens
gggccuagcgcaauaacug

SEQ ID NO: 256612 - RNA, 19 nt, Homo sapiens
acaauucaguaacaaaggu

SEQ ID NO: 256613 - RNA, 19 nt, Homo sapiens
gcaguagggaaacggaaga

SEQ ID NO: 256614 - RNA, 19 nt, Homo sapiens
gauggcagugauucuguuu

SEQ ID NO: 256615 - RNA, 19 nt, Homo sapiens
uagggaaacggaagaguug

SEQ ID NO: 256616 - RNA, 19 nt, Homo sapiens
gaggguggacgaguugauu

SEQ ID NO: 256617 - RNA, 19 nt, Homo sapiens
ggaagugcagucagcagau

SEQ ID NO: 256618 - RNA, 19 nt, Homo sapiens
ucauagggauggcagugau

SEQ ID NO: 256619 - RNA, 19 nt, Homo sapiens
gcagcgaauuuuauaggaa

SEQ ID NO: 256620 - RNA, 19 nt, Homo sapiens
cgagaagaccauggacaaa

SEQ ID NO: 256621 - RNA, 19 nt, Homo sapiens
ggcggaugcugcacugugu

SEQ ID NO: 256622 - RNA, 19 nt, Homo sapiens
ucaaggaaccucaagucau

SEQ ID NO: 256623 - RNA, 19 nt, Homo sapiens
gcuuacaacagguaguuug

SEQ ID NO: 256624 - RNA, 19 nt, Homo sapiens
caaggaguguaaaauguau

SEQ ID NO: 256625 - RNA, 19 nt, Homo sapiens
gaugaucggcugcgacaac

SEQ ID NO: 256626 - RNA, 19 nt, Homo sapiens
gccuauaguaaauguguuu

SEQ ID NO: 256627 - RNA, 19 nt, Homo sapiens
ugaggugcaaggaguguaa

SEQ ID NO: 256628 - RNA, 19 nt, Homo sapiens
uuauuacauugcugccuuu

SEQ ID NO: 256629 - RNA, 19 nt, Homo sapiens
gggcuuacaacagguaguu

SEQ ID NO: 256630 - RNA, 19 nt, Homo sapiens
ggccaagaccuccaagaag

SEQ ID NO: 256631 - RNA, 19 nt, Homo sapiens
gcguggccguggaaacaga

SEQ ID NO: 256632 - RNA, 19 nt, Homo sapiens
auaguguacccaucuuuaa

SEQ ID NO: 256633 - RNA, 19 nt, Homo sapiens
uggguacacuucucuuaag

SEQ ID NO: 256634 - RNA, 19 nt, Homo sapiens
gaucagcauuuuagaaacu

SEQ ID NO: 256635 - RNA, 19 nt, Homo sapiens
uaacaagaaaguggucugu

SEQ ID NO: 256636 - RNA, 19 nt, Homo sapiens
agaagaccauggacaaagc

SEQ ID NO: 256637 - RNA, 19 nt, Homo sapiens
cguggaauguccuuaucau

SEQ ID NO: 256638 - RNA, 19 nt, Homo sapiens
cuuaaguggucuagucaag

SEQ ID NO: 256639 - RNA, 19 nt, Homo sapiens
caacgagaaccgugagaac

SEQ ID NO: 256640 - RNA, 19 nt, Homo sapiens
ugugauguccuucguggaa

SEQ ID NO: 256641 - RNA, 19 nt, Homo sapiens
cagcccaccaucuguuuga

SEQ ID NO: 256642 - RNA, 19 nt, Homo sapiens
guucagcccaccaucuguu

SEQ ID NO: 256643 - RNA, 19 nt, Homo sapiens
caaguucagcccaccaucu

SEQ ID NO: 256644 - RNA, 19 nt, Homo sapiens
guuucuugcugccaugaug

SEQ ID NO: 256645 - RNA, 19 nt, Homo sapiens
cagccuauaguaaaugugu

SEQ ID NO: 256646 - RNA, 19 nt, Homo sapiens
ugauguccuucguggaaug

SEQ ID NO: 256647 - RNA, 19 nt, Homo sapiens
ggacaaaauaaaccgugua

SEQ ID NO: 256648 - RNA, 19 nt, Homo sapiens
caagaaacguuaaaggaaa

SEQ ID NO: 256649 - RNA, 19 nt, Homo sapiens
gauaggaugugacaaugaa

SEQ ID NO: 256650 - RNA, 19 nt, Homo sapiens
gaaaugguauugcccaaag

SEQ ID NO: 256651 - RNA, 19 nt, Homo sapiens
gaacgagccucagauaaag

SEQ ID NO: 256652 - RNA, 19 nt, Homo sapiens
ggaaauugaugaugucuac

SEQ ID NO: 256653 - RNA, 19 nt, Homo sapiens
caacaaauaucaagaaacg

SEQ ID NO: 256654 - RNA, 19 nt, Homo sapiens
gaaccuacauacugcuuau

SEQ ID NO: 256655 - RNA, 19 nt, Homo sapiens
guaaaggccauccacauuu

SEQ ID NO: 256656 - RNA, 19 nt, Homo sapiens
ggacaacaaauaucaagaa

SEQ ID NO: 256657 - RNA, 19 nt, Homo sapiens
gauagaagaucgagguagu

SEQ ID NO: 256658 - RNA, 19 nt, Homo sapiens
ugaaagccgugauuuaugu

SEQ ID NO: 256659 - RNA, 19 nt, Homo sapiens
guguuucacuuaccuauaa

SEQ ID NO: 256660 - RNA, 19 nt, Homo sapiens
ucacuuaccuauaaaccaa

SEQ ID NO: 256661 - RNA, 19 nt, Homo sapiens
caagacaaauggaguuaca

SEQ ID NO: 256662 - RNA, 19 nt, Homo sapiens
uuacacaaaugcucgaauu

SEQ ID NO: 256663 - RNA, 19 nt, Homo sapiens
gaagaucgagguaguaaag

SEQ ID NO: 256664 - RNA, 19 nt, Homo sapiens
gaucagccaccuaaagaaa

SEQ ID NO: 256665 - RNA, 19 nt, Homo sapiens
ugaacgagccucagauaaa

SEQ ID NO: 256666 - RNA, 19 nt, Homo sapiens
cagagagcacuaauuaaua

SEQ ID NO: 256667 - RNA, 19 nt, Homo sapiens
ccagagagcacuaauuaau

SEQ ID NO: 256668 - RNA, 19 nt, Homo sapiens
gaacaguguccaauugaau

SEQ ID NO: 256669 - RNA, 19 nt, Homo sapiens
gcaaccaagugucuuaugg

SEQ ID NO: 256670 - RNA, 19 nt, Homo sapiens
ugcaauagauccuaaugaa

SEQ ID NO: 256671 - RNA, 19 nt, Homo sapiens
agagagcacuaauuaauag

SEQ ID NO: 256672 - RNA, 19 nt, Homo sapiens
gaugauaggaugugacaau

SEQ ID NO: 256673 - RNA, 19 nt, Homo sapiens
gguaaaugcauaagacuau

SEQ ID NO: 256674 - RNA, 19 nt, Homo sapiens
ucaagaaacguuaaaggaa

SEQ ID NO: 256675 - RNA, 19 nt, Homo sapiens
aaugaacaguguccaauug

SEQ ID NO: 256676 - RNA, 19 nt, Homo sapiens
ggacaaaaguacugaaaag

SEQ ID NO: 256677 - RNA, 19 nt, Homo sapiens
ccaagauccugcugaaagu

SEQ ID NO: 256678 - RNA, 19 nt, Homo sapiens
cuccagagagcacuaauua

SEQ ID NO: 256679 - RNA, 19 nt, Homo sapiens
gaaaaucgggcaagacaaa

SEQ ID NO: 256680 - RNA, 19 nt, Homo sapiens
ugcgagagcuggacaacaa

SEQ ID NO: 256681 - RNA, 19 nt, Homo sapiens
aagggaagcuucaccuguu

SEQ ID NO: 256682 - RNA, 19 nt, Homo sapiens
gagagcuggacaacaaaua

SEQ ID NO: 256683 - RNA, 19 nt, Homo sapiens
cuaaugaaccuacauacug

SEQ ID NO: 256684 - RNA, 19 nt, Homo sapiens
uaaaggccauccacauuuu

SEQ ID NO: 256685 - RNA, 19 nt, Homo sapiens
ugaacaguguccaauugaa

SEQ ID NO: 256686 - RNA, 19 nt, Homo sapiens
cagugaaagccgugauuua

SEQ ID NO: 256687 - RNA, 19 nt, Homo sapiens
caaaaguacugaaaagaca

SEQ ID NO: 256688 - RNA, 19 nt, Homo sapiens
ucacauggcaaaugggauu

SEQ ID NO: 256689 - RNA, 19 nt, Homo sapiens
ggaaaugguauugcccaaa

SEQ ID NO: 256690 - RNA, 19 nt, Homo sapiens
caaugaacaguguccaauu

SEQ ID NO: 256691 - RNA, 19 nt, Homo sapiens
ucacaguguuuccaagauc

SEQ ID NO: 256692 - RNA, 19 nt, Homo sapiens
uauaauccguuugcuuuca

SEQ ID NO: 256693 - RNA, 19 nt, Homo sapiens
gauaaagcaaagauggauu

SEQ ID NO: 256694 - RNA, 19 nt, Homo sapiens
aaaggaaauugaugauguc

SEQ ID NO: 256695 - RNA, 19 nt, Homo sapiens
gagaugauaggaugugaca

SEQ ID NO: 256696 - RNA, 19 nt, Homo sapiens
gaugaucagccaccuaaag

SEQ ID NO: 256697 - RNA, 19 nt, Homo sapiens
gauugaagacugugaugau

SEQ ID NO: 256698 - RNA, 19 nt, Homo sapiens
cacaaaugcucgaauuggu

SEQ ID NO: 256699 - RNA, 19 nt, Homo sapiens
gucaagaauugggagauga

SEQ ID NO: 256700 - RNA, 19 nt, Homo sapiens
gugcaggacuaccuugagu

SEQ ID NO: 256701 - RNA, 19 nt, Homo sapiens
uagaagaucgagguaguaa

SEQ ID NO: 256702 - RNA, 19 nt, Homo sapiens
gcggaucggcaggauguua

SEQ ID NO: 256703 - RNA, 19 nt, Homo sapiens
gugaaagccgugauuuaug

SEQ ID NO: 256704 - RNA, 19 nt, Homo sapiens
ggcaagacaaauggaguua

SEQ ID NO: 256705 - RNA, 19 nt, Homo sapiens
gcaggaaagggaagcuuca

SEQ ID NO: 256706 - RNA, 19 nt, Homo sapiens
gaaauccaagucagcaaag

SEQ ID NO: 256707 - RNA, 19 nt, Homo sapiens
gugaacgagccucagauaa

SEQ ID NO: 256708 - RNA, 19 nt, Homo sapiens
ggguaaaugcauaagacua

SEQ ID NO: 256709 - RNA, 19 nt, Homo sapiens
gggagaugauaggauguga

SEQ ID NO: 256710 - RNA, 19 nt, Homo sapiens
uaugcaaccaagugucuua

SEQ ID NO: 256711 - RNA, 19 nt, Homo sapiens
gggcaagacaaauggaguu

SEQ ID NO: 256712 - RNA, 19 nt, Homo sapiens
aguaaaggccauccacauu

SEQ ID NO: 256713 - RNA, 19 nt, Homo sapiens
gcaauagauccuaaugaac

SEQ ID NO: 256714 - RNA, 19 nt, Homo sapiens
ggauugaagacugugauga

SEQ ID NO: 256715 - RNA, 19 nt, Homo sapiens
gauuccagccaaccagaaa

SEQ ID NO: 256716 - RNA, 19 nt, Homo sapiens
uaggguaaaugcauaagac

SEQ ID NO: 256717 - RNA, 19 nt, Homo sapiens
agaaauccaagucagcaaa

SEQ ID NO: 256718 - RNA, 19 nt, Homo sapiens
gcaaaugggauugaagacu

SEQ ID NO: 256719 - RNA, 19 nt, Homo sapiens
agugaaagccgugauuuau

SEQ ID NO: 256720 - RNA, 19 nt, Homo sapiens
ccagugaaagccgugauuu

SEQ ID NO: 256721 - RNA, 19 nt, Homo sapiens
gagcuggacaacaaauauc

SEQ ID NO: 256722 - RNA, 19 nt, Homo sapiens
ucaagaauugggagaugaa

SEQ ID NO: 256723 - RNA, 19 nt, Homo sapiens
aagcuucaccuguugaguu

SEQ ID NO: 256724 - RNA, 19 nt, Homo sapiens
aaagugaacgagccucaga

SEQ ID NO: 256725 - RNA, 19 nt, Homo sapiens
caggggagauaaugagaaa

SEQ ID NO: 256726 - RNA, 19 nt, Homo sapiens
gauuuaaaccagaagaaac

SEQ ID NO: 256727 - RNA, 19 nt, Homo sapiens
gaaacguuaaaggaaauug

SEQ ID NO: 256728 - RNA, 19 nt, Homo sapiens
aaaugggauugaagacugu

SEQ ID NO: 256729 - RNA, 19 nt, Homo sapiens
cauggcaaaugggauugaa

SEQ ID NO: 256730 - RNA, 19 nt, Homo sapiens
cagauaaagcaaagaugga

SEQ ID NO: 256731 - RNA, 19 nt, Homo sapiens
gagccucagauaaagcaaa

SEQ ID NO: 256732 - RNA, 19 nt, Homo sapiens
gaaaacaauggacaaaagu

SEQ ID NO: 256733 - RNA, 19 nt, Homo sapiens
agaaaacaauggacaaaag

SEQ ID NO: 256734 - RNA, 19 nt, Homo sapiens
uggcaaaugggauugaaga

SEQ ID NO: 256735 - RNA, 19 nt, Homo sapiens
uuuccaagauccugcugaa

SEQ ID NO: 256736 - RNA, 19 nt, Homo sapiens
cguuaaaggaaauugauga

SEQ ID NO: 256737 - RNA, 19 nt, Homo sapiens
cuguugaguuugcaauaga

SEQ ID NO: 256738 - RNA, 19 nt, Homo sapiens
caaccagaaagaucuucaa

SEQ ID NO: 256739 - RNA, 19 nt, Homo sapiens
caagaauugggagaugaaa

SEQ ID NO: 256740 - RNA, 19 nt, Homo sapiens
ugaaccuacauacugcuua

SEQ ID NO: 256741 - RNA, 19 nt, Homo sapiens
agcuucaccuguugaguuu

SEQ ID NO: 256742 - RNA, 19 nt, Homo sapiens
agugaacgagccucagaua

SEQ ID NO: 256743 - RNA, 19 nt, Homo sapiens
gagaaaacaauggacaaaa

SEQ ID NO: 256744 - RNA, 19 nt, Homo sapiens
ugauaggaugugacaauga

SEQ ID NO: 256745 - RNA, 19 nt, Homo sapiens
cccacgacaugcagaggaa

SEQ ID NO: 256746 - RNA, 19 nt, Homo sapiens
ccuguugaguuugcaauag

SEQ ID NO: 256747 - RNA, 19 nt, Homo sapiens
aaauccaagucagcaaaga

SEQ ID NO: 256748 - RNA, 19 nt, Homo sapiens
ccacuucuaucucaauaaa

SEQ ID NO: 256749 - RNA, 19 nt, Homo sapiens
ggauggagguuacucuuuc

SEQ ID NO: 256750 - RNA, 19 nt, Homo sapiens
gcacagcagccuccaauag

SEQ ID NO: 256751 - RNA, 19 nt, Homo sapiens
ggagguuacucuuucaagu

SEQ ID NO: 256752 - RNA, 19 nt, Homo sapiens
gaaaggcagaguugggaaa

SEQ ID NO: 256753 - RNA, 19 nt, Homo sapiens
uaaagaacacagugcauau

SEQ ID NO: 256754 - RNA, 19 nt, Homo sapiens
gauggagguuacucuuuca

SEQ ID NO: 256755 - RNA, 19 nt, Homo sapiens
ccaguuucaucuuccacua

SEQ ID NO: 256756 - RNA, 19 nt, Homo sapiens
gaguagcacugaacaucuc

SEQ ID NO: 256757 - RNA, 19 nt, Homo sapiens
ugagggcccuguucuugga

SEQ ID NO: 256758 - RNA, 19 nt, Homo sapiens
auaaagaacacagugcaua

SEQ ID NO: 256759 - RNA, 19 nt, Homo sapiens
gcaccuacugcucuucuug

SEQ ID NO: 256760 - RNA, 19 nt, Homo sapiens
ggugagggcccuguucuug

SEQ ID NO: 256761 - RNA, 19 nt, Homo sapiens
gggaggaaaggcagaguug

SEQ ID NO: 256762 - RNA, 19 nt, Homo sapiens
gaugagaaggguagaagag

SEQ ID NO: 256763 - RNA, 19 nt, Homo sapiens
gggcacagcagccuccaau

SEQ ID NO: 256764 - RNA, 19 nt, Homo sapiens
aggcagaguugggaaauag

SEQ ID NO: 256765 - RNA, 19 nt, Homo sapiens
ggggaagacuggaugagaa

SEQ ID NO: 256766 - RNA, 19 nt, Homo sapiens
gcagaguugggaaauagau

SEQ ID NO: 256767 - RNA, 19 nt, Homo sapiens
ggccaccucugcucucucu

SEQ ID NO: 256768 - RNA, 19 nt, Homo sapiens
ccacuccucccuccuuuca

SEQ ID NO: 256769 - RNA, 19 nt, Homo sapiens
uggcugugcccaugucuuu

SEQ ID NO: 256770 - RNA, 19 nt, Homo sapiens
cguguacccucccaguuuc

SEQ ID NO: 256771 - RNA, 19 nt, Homo sapiens
aaggcagaguugggaaaua

SEQ ID NO: 256772 - RNA, 19 nt, Homo sapiens
cagaguagcacugaacauc

SEQ ID NO: 256773 - RNA, 19 nt, Homo sapiens
ggaugagaaggguagaaga

SEQ ID NO: 256774 - RNA, 19 nt, Homo sapiens
ccacagaguagcacugaac

SEQ ID NO: 256775 - RNA, 19 nt, Homo sapiens
aaagaacacagugcauaug

SEQ ID NO: 256776 - RNA, 19 nt, Homo sapiens
ucguguacccucccaguuu

SEQ ID NO: 256777 - RNA, 19 nt, Homo sapiens
cggauggagguuacucuuu

SEQ ID NO: 256778 - RNA, 19 nt, Homo sapiens
caacugccacagaguagca

SEQ ID NO: 256779 - RNA, 19 nt, Homo sapiens
cuacugucauggugguugu

SEQ ID NO: 256780 - RNA, 19 nt, Homo sapiens
gggaagacuggaugagaag

SEQ ID NO: 256781 - RNA, 19 nt, Homo sapiens
gggaacgguggaucgugua

SEQ ID NO: 256782 - RNA, 19 nt, Homo sapiens
cagcccagcccuacuccuu

SEQ ID NO: 256783 - RNA, 19 nt, Homo sapiens
gggcugcacaucccaccaa

SEQ ID NO: 256784 - RNA, 19 nt, Homo sapiens
caaggugagggcccuguuc

SEQ ID NO: 256785 - RNA, 19 nt, Homo sapiens
ggcugcacaucccaccaaa

SEQ ID NO: 256786 - RNA, 19 nt, Homo sapiens
gcacagaccuuuccucaug

SEQ ID NO: 256787 - RNA, 19 nt, Homo sapiens
aaacaaaccugaugaaaca

SEQ ID NO: 256788 - RNA, 19 nt, Homo sapiens
gaacggguauguggagaua

SEQ ID NO: 256789 - RNA, 19 nt, Homo sapiens
gaaggaagauguggaaauc

SEQ ID NO: 256790 - RNA, 19 nt, Homo sapiens
ggagaaugguguacccuuu

SEQ ID NO: 256791 - RNA, 19 nt, Homo sapiens
gcaagaagaagaagaaaga

SEQ ID NO: 256792 - RNA, 19 nt, Homo sapiens
ggagaggagugaacuguug

SEQ ID NO: 256793 - RNA, 19 nt, Homo sapiens
ugaaacagaugaaggaaga

SEQ ID NO: 256794 - RNA, 19 nt, Homo sapiens
ggagauagaggaugacauu

SEQ ID NO: 256795 - RNA, 19 nt, Homo sapiens
gagcagaccucggagauca

SEQ ID NO: 256796 - RNA, 19 nt, Homo sapiens
caacagucaucaaccacua

SEQ ID NO: 256797 - RNA, 19 nt, Homo sapiens
gauagaggaugacauugga

SEQ ID NO: 256798 - RNA, 19 nt, Homo sapiens
caacaucugcuguaagaaa

SEQ ID NO: 256799 - RNA, 19 nt, Homo sapiens
ugaaacagaugaaacagau

SEQ ID NO: 256800 - RNA, 19 nt, Homo sapiens
ggaaagggagcaagaguug

SEQ ID NO: 256801 - RNA, 19 nt, Homo sapiens
ccaaauagcaucuagaaag

SEQ ID NO: 256802 - RNA, 19 nt, Homo sapiens
gagaaugguguacccuuua

SEQ ID NO: 256803 - RNA, 19 nt, Homo sapiens
gcagaaaugaaugaacuua

SEQ ID NO: 256804 - RNA, 19 nt, Homo sapiens
gucaacaucugcuguaaga

SEQ ID NO: 256805 - RNA, 19 nt, Homo sapiens
uaaacaugcugcacuugaa

SEQ ID NO: 256806 - RNA, 19 nt, Homo sapiens
ggaaggagggcagaaauga

SEQ ID NO: 256807 - RNA, 19 nt, Homo sapiens
gaacuguugcucucugaaa

SEQ ID NO: 256808 - RNA, 19 nt, Homo sapiens
aaucugaucugcaguagug

SEQ ID NO: 256809 - RNA, 19 nt, Homo sapiens
ugacaucaguuguuuaaac

SEQ ID NO: 256810 - RNA, 19 nt, Homo sapiens
ggaaagggagaauggugua

SEQ ID NO: 256811 - RNA, 19 nt, Homo sapiens
gggcagaaaugaaugaacu

SEQ ID NO: 256812 - RNA, 19 nt, Homo sapiens
gagguucccuugugagcuu

SEQ ID NO: 256813 - RNA, 19 nt, Homo sapiens
gguguacccuuuauuucuu

SEQ ID NO: 256814 - RNA, 19 nt, Homo sapiens
ccucggagaucaucacguu

SEQ ID NO: 256815 - RNA, 19 nt, Homo sapiens
caaauagcaucuagaaagc

SEQ ID NO: 256816 - RNA, 19 nt, Homo sapiens
gacuagaacaacccaaaua

SEQ ID NO: 256817 - RNA, 19 nt, Homo sapiens
aaacaguucuuugucaguu

SEQ ID NO: 256818 - RNA, 19 nt, Homo sapiens
gcagugaagagacagauug

SEQ ID NO: 256819 - RNA, 19 nt, Homo sapiens
gcugagaggauuucuguug

SEQ ID NO: 256820 - RNA, 19 nt, Homo sapiens
gaaaucuuagccugccuua

SEQ ID NO: 256821 - RNA, 19 nt, Homo sapiens
gaaggagggcagaaaugaa

SEQ ID NO: 256822 - RNA, 19 nt, Homo sapiens
guacuaugaugauggucaa

SEQ ID NO: 256823 - RNA, 19 nt, Homo sapiens
caaaggauguacccaacuc

SEQ ID NO: 256824 - RNA, 19 nt, Homo sapiens
gagugugggugcucauaga

SEQ ID NO: 256825 - RNA, 19 nt, Homo sapiens
ggaagaggccgaggaagug

SEQ ID NO: 256826 - RNA, 19 nt, Homo sapiens
gaaaugaaugaacuuaugg

SEQ ID NO: 256827 - RNA, 19 nt, Homo sapiens
aaacagaugaaacagauga

SEQ ID NO: 256828 - RNA, 19 nt, Homo sapiens
ggauuucuguuggcaaguu

SEQ ID NO: 256829 - RNA, 19 nt, Homo sapiens
gaucagaaagcuucaugug

SEQ ID NO: 256830 - RNA, 19 nt, Homo sapiens
gaugaaggaagauguggaa

SEQ ID NO: 256831 - RNA, 19 nt, Homo sapiens
caacccaaauagcaucuag

SEQ ID NO: 256832 - RNA, 19 nt, Homo sapiens
ggugagugcccgagccaua

SEQ ID NO: 256833 - RNA, 19 nt, Homo sapiens
agaagaagaagaaagaaga

SEQ ID NO: 256834 - RNA, 19 nt, Homo sapiens
agaaagccaugaguuugaa

SEQ ID NO: 256835 - RNA, 19 nt, Homo sapiens
uagaaagccaugaguuuga

SEQ ID NO: 256836 - RNA, 19 nt, Homo sapiens
ucaaggacaucggcuggaa

SEQ ID NO: 256837 - RNA, 19 nt, Homo sapiens
caagaguuguccagagaag

SEQ ID NO: 256838 - RNA, 19 nt, Homo sapiens
gggaagaggccgaggaagu

SEQ ID NO: 256839 - RNA, 19 nt, Homo sapiens
ucuagaaagccaugaguuu

SEQ ID NO: 256840 - RNA, 19 nt, Homo sapiens
ggacuagaacaacccaaau

SEQ ID NO: 256841 - RNA, 19 nt, Homo sapiens
agaaugguguacccuuuau

SEQ ID NO: 256842 - RNA, 19 nt, Homo sapiens
ggucaaaacaucaucaaaa

SEQ ID NO: 256843 - RNA, 19 nt, Homo sapiens
ggcaggagcagaugaggaa

SEQ ID NO: 256844 - RNA, 19 nt, Homo sapiens
gaagacaguggcaaaauga

SEQ ID NO: 256845 - RNA, 19 nt, Homo sapiens
gggaaagggagcaagaguu

SEQ ID NO: 256846 - RNA, 19 nt, Homo sapiens
gacaucggcuggaaugacu

SEQ ID NO: 256847 - RNA, 19 nt, Homo sapiens
ggagggcagaaaugaauga

SEQ ID NO: 256848 - RNA, 19 nt, Homo sapiens
caucacaggcacuuuccua

SEQ ID NO: 256849 - RNA, 19 nt, Homo sapiens
gacaucaguuguuuaaacg

SEQ ID NO: 256850 - RNA, 19 nt, Homo sapiens
gaagaagaagaaagaagag

SEQ ID NO: 256851 - RNA, 19 nt, Homo sapiens
caacaggaccaggaccaaa

SEQ ID NO: 256852 - RNA, 19 nt, Homo sapiens
uagaacaacccaaauagca

SEQ ID NO: 256853 - RNA, 19 nt, Homo sapiens
ggagggaaagggagaaugg

SEQ ID NO: 256854 - RNA, 19 nt, Homo sapiens
caaaccugaugaaacagau

SEQ ID NO: 256855 - RNA, 19 nt, Homo sapiens
cagagaagacaguggcaaa

SEQ ID NO: 256856 - RNA, 19 nt, Homo sapiens
gaaacaguucuuugucagu

SEQ ID NO: 256857 - RNA, 19 nt, Homo sapiens
gaagagcaccuggcauguc

SEQ ID NO: 256858 - RNA, 19 nt, Homo sapiens
ccgaggaagugggcuuaaa

SEQ ID NO: 256859 - RNA, 19 nt, Homo sapiens
gaaagccaugaguuugaaa

SEQ ID NO: 256860 - RNA, 19 nt, Homo sapiens
gcaagaguuguccagagaa

SEQ ID NO: 256861 - RNA, 19 nt, Homo sapiens
caagagcucccuggacguu

SEQ ID NO: 256862 - RNA, 19 nt, Homo sapiens
gugaacuguugcucucuga

SEQ ID NO: 256863 - RNA, 19 nt, Homo sapiens
cuagaaagccaugaguuug

SEQ ID NO: 256864 - RNA, 19 nt, Homo sapiens
ucacuguccuuccacucaa

SEQ ID NO: 256865 - RNA, 19 nt, Homo sapiens
uggcaugucuucccugucu

SEQ ID NO: 256866 - RNA, 19 nt, Homo sapiens
acgcugcacuucgagauuu

SEQ ID NO: 256867 - RNA, 19 nt, Homo sapiens
ccaggaagacgcugcacuu

SEQ ID NO: 256868 - RNA, 19 nt, Homo sapiens
gccaggaugcccuugcuuu

SEQ ID NO: 256869 - RNA, 19 nt, Homo sapiens
aaugguguacccuuuauuu

SEQ ID NO: 256870 - RNA, 19 nt, Homo sapiens
uuaaacaugcugcacuuga

SEQ ID NO: 256871 - RNA, 19 nt, Homo sapiens
agcaagaguuguccagaga

SEQ ID NO: 256872 - RNA, 19 nt, Homo sapiens
guaguagacgcucggaaga

SEQ ID NO: 256873 - RNA, 19 nt, Homo sapiens
gaagaagagacccgauguc

SEQ ID NO: 256874 - RNA, 19 nt, Homo sapiens
ugaaggaagauguggaaau

SEQ ID NO: 256875 - RNA, 19 nt, Homo sapiens
gaagggcggaggugaaggu

SEQ ID NO: 256876 - RNA, 19 nt, Homo sapiens
gaaugguguacccuuuauu

SEQ ID NO: 256877 - RNA, 19 nt, Homo sapiens
gagaugaagcagugaagag

SEQ ID NO: 256878 - RNA, 19 nt, Homo sapiens
aaagaagggcggaggugaa

SEQ ID NO: 256879 - RNA, 19 nt, Homo sapiens
gauuucuguuggcaaguug

SEQ ID NO: 256880 - RNA, 19 nt, Homo sapiens
ugaugaaacagaugaaaca

SEQ ID NO: 256881 - RNA, 19 nt, Homo sapiens
ugugggugcucauagaguu

SEQ ID NO: 256882 - RNA, 19 nt, Homo sapiens
ccaggaugcccuugcuuug

SEQ ID NO: 256883 - RNA, 19 nt, Homo sapiens
gaagcacauuuuaaacaug

SEQ ID NO: 256884 - RNA, 19 nt, Homo sapiens
caucacguuugccgaguca

SEQ ID NO: 256885 - RNA, 19 nt, Homo sapiens
gaggaugacauuggaagga

SEQ ID NO: 256886 - RNA, 19 nt, Homo sapiens
gaaaugaaauccuuugcuu

SEQ ID NO: 256887 - RNA, 19 nt, Homo sapiens
caacugacaugaaauacuu

SEQ ID NO: 256888 - RNA, 19 nt, Homo sapiens
gaacgcacaugacauagca

SEQ ID NO: 256889 - RNA, 19 nt, Homo sapiens
ggugacaaauggcagcuua

SEQ ID NO: 256890 - RNA, 19 nt, Homo sapiens
ugaaauccuuugcuucuuu

SEQ ID NO: 256891 - RNA, 19 nt, Homo sapiens
gggcuaaauuugaugcuuu

SEQ ID NO: 256892 - RNA, 19 nt, Homo sapiens
ggacacaacccgucagaga

SEQ ID NO: 256893 - RNA, 19 nt, Homo sapiens
ggaaagagacccagaaagg

SEQ ID NO: 256894 - RNA, 19 nt, Homo sapiens
gucagaaacugccauuuga

SEQ ID NO: 256895 - RNA, 19 nt, Homo sapiens
gcaaauggaugcggugaca

SEQ ID NO: 256896 - RNA, 19 nt, Homo sapiens
gcaaugaccguuugacugu

SEQ ID NO: 256897 - RNA, 19 nt, Homo sapiens
ggcaacaguucuucauuga

SEQ ID NO: 256898 - RNA, 19 nt, Homo sapiens
cgugaacuaugcaauuuaa

SEQ ID NO: 256899 - RNA, 19 nt, Homo sapiens
gguaugaccuuuuaaguga

SEQ ID NO: 256900 - RNA, 19 nt, Homo sapiens
gaaagagacccagaaagga

SEQ ID NO: 256901 - RNA, 19 nt, Homo sapiens
caacaguucuucauugacu

SEQ ID NO: 256902 - RNA, 19 nt, Homo sapiens
cagcugauuugcagaaguu

SEQ ID NO: 256903 - RNA, 19 nt, Homo sapiens
cgagaacccucaacugaca

SEQ ID NO: 256904 - RNA, 19 nt, Homo sapiens
ggacgugcccaacaugauu

SEQ ID NO: 256905 - RNA, 19 nt, Homo sapiens
uggcauaccuucccacuca

SEQ ID NO: 256906 - RNA, 19 nt, Homo sapiens
gcacaugacauagcacuug

SEQ ID NO: 256907 - RNA, 19 nt, Homo sapiens
cgaacucgcucgcccucua

SEQ ID NO: 256908 - RNA, 19 nt, Homo sapiens
ggaaggcuuucagcugauu

SEQ ID NO: 256909 - RNA, 19 nt, Homo sapiens
gguggaacaugguggagaa

SEQ ID NO: 256910 - RNA, 19 nt, Homo sapiens
cacgugaacuaugcaauuu

SEQ ID NO: 256911 - RNA, 19 nt, Homo sapiens
gugaaaaucugaauuguuc

SEQ ID NO: 256912 - RNA, 19 nt, Homo sapiens
agacaacuuugccguguga

SEQ ID NO: 256913 - RNA, 19 nt, Homo sapiens
agacagagacgcagagaga

SEQ ID NO: 256914 - RNA, 19 nt, Homo sapiens
cagaaacugccauuugaaa

SEQ ID NO: 256915 - RNA, 19 nt, Homo sapiens
gaacuaugcaauuuaaagg

SEQ ID NO: 256916 - RNA, 19 nt, Homo sapiens
ggugcggccugagauauuu

SEQ ID NO: 256917 - RNA, 19 nt, Homo sapiens
ccugaacgcacaugacaua

SEQ ID NO: 256918 - RNA, 19 nt, Homo sapiens
ccucaacugacaugaaaua

SEQ ID NO: 256919 - RNA, 19 nt, Homo sapiens
ccacgugaacuaugcaauu

SEQ ID NO: 256920 - RNA, 19 nt, Homo sapiens
ccaagugccacgugaacua

SEQ ID NO: 256921 - RNA, 19 nt, Homo sapiens
gaaauccuuugcuucuuuu

SEQ ID NO: 256922 - RNA, 19 nt, Homo sapiens
ggaacaugguggagaagag

SEQ ID NO: 256923 - RNA, 19 nt, Homo sapiens
aggcaacaguucuucauug

SEQ ID NO: 256924 - RNA, 19 nt, Homo sapiens
aaugaccguuugacuguuu

SEQ ID NO: 256925 - RNA, 19 nt, Homo sapiens
cacagcagccuccaggaua

SEQ ID NO: 256926 - RNA, 19 nt, Homo sapiens
ggugaacuccugcugcauu

SEQ ID NO: 256927 - RNA, 19 nt, Homo sapiens
ggaaggugcgggucaaagu

SEQ ID NO: 256928 - RNA, 19 nt, Homo sapiens
uguuugcacugauuuaguu

SEQ ID NO: 256929 - RNA, 19 nt, Homo sapiens
ggucauccuugccaguugu

SEQ ID NO: 256930 - RNA, 19 nt, Homo sapiens
ccaccaagcugagcaccau

SEQ ID NO: 256931 - RNA, 19 nt, Homo sapiens
uuaguugcaugauuaguca

SEQ ID NO: 256932 - RNA, 19 nt, Homo sapiens
cgccuucgcuuccgucuca

SEQ ID NO: 256933 - RNA, 19 nt, Homo sapiens
gaaggugcgggucaaagug

SEQ ID NO: 256934 - RNA, 19 nt, Homo sapiens
gcaaccagaaccuguuugu

SEQ ID NO: 256935 - RNA, 19 nt, Homo sapiens
cagccuaguuggucuugga

SEQ ID NO: 256936 - RNA, 19 nt, Homo sapiens
uggaacgacuggaucauag

SEQ ID NO: 256937 - RNA, 19 nt, Homo sapiens
gaugagaccgcaggaggaa

SEQ ID NO: 256938 - RNA, 19 nt, Homo sapiens
gggccucugacaugacuua

SEQ ID NO: 256939 - RNA, 19 nt, Homo sapiens
ugacgcugcuuucgcuuca

SEQ ID NO: 256940 - RNA, 19 nt, Homo sapiens
acccucaacugacaugaaa

SEQ ID NO: 256941 - RNA, 19 nt, Homo sapiens
guacacggugggcugagua

SEQ ID NO: 256942 - RNA, 19 nt, Homo sapiens
gugaacuccugcugcauuc

SEQ ID NO: 256943 - RNA, 19 nt, Homo sapiens
gccuguggcuuuaccugaa

SEQ ID NO: 256944 - RNA, 19 nt, Homo sapiens
uugcagaaguugcccaugu

SEQ ID NO: 256945 - RNA, 19 nt, Homo sapiens
ggagguggcauucuugaac

SEQ ID NO: 256946 - RNA, 19 nt, Homo sapiens
gagguggcauucuugaacu

SEQ ID NO: 256947 - RNA, 19 nt, Homo sapiens
gcuugggccucugacauga

SEQ ID NO: 256948 - RNA, 19 nt, Homo sapiens
uggaugcggugacaaaugg

SEQ ID NO: 256949 - RNA, 19 nt, Homo sapiens
aaauggaugcggugacaaa

SEQ ID NO: 256950 - RNA, 19 nt, Homo sapiens
gaacgacuggaucauagca

SEQ ID NO: 256951 - RNA, 19 nt, Homo sapiens
caacgaaggcaaccagaac

SEQ ID NO: 256952 - RNA, 19 nt, Homo sapiens
caaccuagacgugcagugu

SEQ ID NO: 256953 - RNA, 19 nt, Homo sapiens
agucagaaacugccauuug

SEQ ID NO: 256954 - RNA, 19 nt, Homo sapiens
gagggaaagagacccagaa

SEQ ID NO: 256955 - RNA, 19 nt, Homo sapiens
caggauaccagcaaaugga

SEQ ID NO: 256956 - RNA, 19 nt, Homo sapiens
acauagcacuugccgaucu

SEQ ID NO: 256957 - RNA, 19 nt, Homo sapiens
caugugggcccaaccauca

SEQ ID NO: 256958 - RNA, 19 nt, Homo sapiens
gggaaggcuuucagcugau

SEQ ID NO: 256959 - RNA, 19 nt, Homo sapiens
cugauuuaguugcaugauu

SEQ ID NO: 256960 - RNA, 19 nt, Homo sapiens
ucagaaacugccauuugaa

SEQ ID NO: 256961 - RNA, 19 nt, Homo sapiens
gaacucgcucgcccucuag

SEQ ID NO: 256962 - RNA, 19 nt, Homo sapiens
gagcgagaacccucaacug

SEQ ID NO: 256963 - RNA, 19 nt, Homo sapiens
cuguugggcuguggagaua

SEQ ID NO: 256964 - RNA, 19 nt, Homo sapiens
ccuguggcuuuaccugaaa

SEQ ID NO: 256965 - RNA, 19 nt, Homo sapiens
gcaaucugugcccuucauu

SEQ ID NO: 256966 - RNA, 19 nt, Homo sapiens
cauccuugccaguuguaua

SEQ ID NO: 256967 - RNA, 19 nt, Homo sapiens
caaugaccguuugacuguu

SEQ ID NO: 256968 - RNA, 19 nt, Homo sapiens
gugaagcggcacaucuuga

SEQ ID NO: 256969 - RNA, 19 nt, Homo sapiens
cauagagcaaccagucaaa

SEQ ID NO: 256970 - RNA, 19 nt, Homo sapiens
gcaggcaacaguucuucau

SEQ ID NO: 256971 - RNA, 19 nt, Homo sapiens
cgacagcaggcaccgcauu

SEQ ID NO: 256972 - RNA, 19 nt, Homo sapiens
gaaggcuuucagcugauuu

SEQ ID NO: 256973 - RNA, 19 nt, Homo sapiens
ccaacgaaggcaaccagaa

SEQ ID NO: 256974 - RNA, 19 nt, Homo sapiens
ggugaagcggcacaucuug

SEQ ID NO: 256975 - RNA, 19 nt, Homo sapiens
gcgaaugauugcuuuuaau

SEQ ID NO: 256976 - RNA, 19 nt, Homo sapiens
caagugccacgugaacuau

SEQ ID NO: 256977 - RNA, 19 nt, Homo sapiens
cugaauuguucuaaaugga

SEQ ID NO: 256978 - RNA, 19 nt, Homo sapiens
ggagggagggagagaagag

SEQ ID NO: 256979 - RNA, 19 nt, Homo sapiens
ugaaacuccugcccuacgu

SEQ ID NO: 256980 - RNA, 19 nt, Homo sapiens
uugcaugauuagucagaaa

SEQ ID NO: 256981 - RNA, 19 nt, Homo sapiens
aaugaaauccuuugcuucu

SEQ ID NO: 256982 - RNA, 19 nt, Homo sapiens
ucugaauuguucuaaaugg

SEQ ID NO: 256983 - RNA, 19 nt, Homo sapiens
ccuccaggauaccagcaaa

SEQ ID NO: 256984 - RNA, 19 nt, Homo sapiens
gggugcggccugagauauu

SEQ ID NO: 256985 - RNA, 19 nt, Homo sapiens
ugagaccgcaggaggaaau

SEQ ID NO: 256986 - RNA, 19 nt, Homo sapiens
gaacaggaaugugaaauca

SEQ ID NO: 256987 - RNA, 19 nt, Homo sapiens
acccuuagcucaccuuuaa

SEQ ID NO: 256988 - RNA, 19 nt, Homo sapiens
gaaauuaccccaccuuuga

SEQ ID NO: 256989 - RNA, 19 nt, Homo sapiens
gccaugaacuucugcauag

SEQ ID NO: 256990 - RNA, 19 nt, Homo sapiens
gcaacauugucaagacuga

SEQ ID NO: 256991 - RNA, 19 nt, Homo sapiens
gaggucagggcauuucuua

SEQ ID NO: 256992 - RNA, 19 nt, Homo sapiens
gagaggcccuucuuuggau

SEQ ID NO: 256993 - RNA, 19 nt, Homo sapiens
gagcaucuuauggaaauua

SEQ ID NO: 256994 - RNA, 19 nt, Homo sapiens
caaggaggguccaggaugu

SEQ ID NO: 256995 - RNA, 19 nt, Homo sapiens
gugcagcucccuuccaaua

SEQ ID NO: 256996 - RNA, 19 nt, Homo sapiens
uugcauaccuucauccauu

SEQ ID NO: 256997 - RNA, 19 nt, Homo sapiens
gcaagucacugugccaucu

SEQ ID NO: 256998 - RNA, 19 nt, Homo sapiens
cccugucucugcucuauua

SEQ ID NO: 256999 - RNA, 19 nt, Homo sapiens
ccagagaggcccuucuuug

SEQ ID NO: 257000 - RNA, 19 nt, Homo sapiens
ggacaacagggaacaggaa

SEQ ID NO: 257001 - RNA, 19 nt, Homo sapiens
ugacuugccugagcucuau

SEQ ID NO: 257002 - RNA, 19 nt, Homo sapiens
ugucucugcucuauuauga

SEQ ID NO: 257003 - RNA, 19 nt, Homo sapiens
gaauguggacucccucuuc

SEQ ID NO: 257004 - RNA, 19 nt, Homo sapiens
gcaggccagucucauguuc

SEQ ID NO: 257005 - RNA, 19 nt, Homo sapiens
gugcuggguccacauaaua

SEQ ID NO: 257006 - RNA, 19 nt, Homo sapiens
ggucagggcauuucuuauc

SEQ ID NO: 257007 - RNA, 19 nt, Homo sapiens
caaaauagaggcuuaccua

SEQ ID NO: 257008 - RNA, 19 nt, Homo sapiens
gaaagugagaguccuugug

SEQ ID NO: 257009 - RNA, 19 nt, Homo sapiens
ucacuucuccucugauaga

SEQ ID NO: 257010 - RNA, 19 nt, Homo sapiens
acaggaaugugaaaucauc

SEQ ID NO: 257011 - RNA, 19 nt, Homo sapiens
ggaacaggaaugugaaauc

SEQ ID NO: 257012 - RNA, 19 nt, Homo sapiens
ugacagggacagcaacauu

SEQ ID NO: 257013 - RNA, 19 nt, Homo sapiens
caacagggaacaggaaugu

SEQ ID NO: 257014 - RNA, 19 nt, Homo sapiens
ccuuagcucaccuuuaaua

SEQ ID NO: 257015 - RNA, 19 nt, Homo sapiens
cugagcaucuuauggaaau

SEQ ID NO: 257016 - RNA, 19 nt, Homo sapiens
gaugugcugucgacaagag

SEQ ID NO: 257017 - RNA, 19 nt, Homo sapiens
uuucacuucuccucugaua

SEQ ID NO: 257018 - RNA, 19 nt, Homo sapiens
agagaagcaucuuggacaa

SEQ ID NO: 257019 - RNA, 19 nt, Homo sapiens
gaucacugcugcccaaaau

SEQ ID NO: 257020 - RNA, 19 nt, Homo sapiens
uagcucaccuuuaauagac

SEQ ID NO: 257021 - RNA, 19 nt, Homo sapiens
ccugaccacuacccucuuu

SEQ ID NO: 257022 - RNA, 19 nt, Homo sapiens
agacaggccucuccaccau

SEQ ID NO: 257023 - RNA, 19 nt, Homo sapiens
gcuauucugugucccuaca

SEQ ID NO: 257024 - RNA, 19 nt, Homo sapiens
gacagggacagcaacauug

SEQ ID NO: 257025 - RNA, 19 nt, Homo sapiens
aagaaaccuucaucuaaag

SEQ ID NO: 257026 - RNA, 19 nt, Homo sapiens
gagucuguauugcucaaga

SEQ ID NO: 257027 - RNA, 19 nt, Homo sapiens
aaugugaaaucaucagcuu

SEQ ID NO: 257028 - RNA, 19 nt, Homo sapiens
gaaaacacgccccuacaga

SEQ ID NO: 257029 - RNA, 19 nt, Homo sapiens
ugguauugcugccuccuuu

SEQ ID NO: 257030 - RNA, 19 nt, Homo sapiens
acagggaacaggaauguga

SEQ ID NO: 257031 - RNA, 19 nt, Homo sapiens
gggagcugcuucuugaucu

SEQ ID NO: 257032 - RNA, 19 nt, Homo sapiens
ccuguucccucucugucua

SEQ ID NO: 257033 - RNA, 19 nt, Homo sapiens
gcagugcucaaucuucuca

SEQ ID NO: 257034 - RNA, 19 nt, Homo sapiens
cccuggagcugguacuuga

SEQ ID NO: 257035 - RNA, 19 nt, Homo sapiens
caugccagcuggacacaca

SEQ ID NO: 257036 - RNA, 19 nt, Homo sapiens
ccugagcccugagucugua

SEQ ID NO: 257037 - RNA, 19 nt, Homo sapiens
gaacuacuaaagcucucuu

SEQ ID NO: 257038 - RNA, 19 nt, Homo sapiens
caggugaacuacuaaagcu

SEQ ID NO: 257039 - RNA, 19 nt, Homo sapiens
ccugagggcuacgccauga

SEQ ID NO: 257040 - RNA, 19 nt, Homo sapiens
aaaccuucaucuaaagcaa

SEQ ID NO: 257041 - RNA, 19 nt, Homo sapiens
agcgggagcugcuucuuga

SEQ ID NO: 257042 - RNA, 19 nt, Homo sapiens
ugcauaccuucauccauuu

SEQ ID NO: 257043 - RNA, 19 nt, Homo sapiens
cagagaggcccuucuuugg

SEQ ID NO: 257044 - RNA, 19 nt, Homo sapiens
guuagucuaugugugguau

SEQ ID NO: 257045 - RNA, 19 nt, Homo sapiens
gagcugcccauaggccuuu

SEQ ID NO: 257046 - RNA, 19 nt, Homo sapiens
gggcacuucuagaggacaa

SEQ ID NO: 257047 - RNA, 19 nt, Homo sapiens
gccuuucucuaugcccuua

SEQ ID NO: 257048 - RNA, 19 nt, Homo sapiens
ucucugcucuauuaugaca

SEQ ID NO: 257049 - RNA, 19 nt, Homo sapiens
ccuagggccugaagcucaa

SEQ ID NO: 257050 - RNA, 19 nt, Homo sapiens
ugugaaaucaucagcuuug

SEQ ID NO: 257051 - RNA, 19 nt, Homo sapiens
ggaaauuaccccaccuuug

SEQ ID NO: 257052 - RNA, 19 nt, Homo sapiens
agacugacauaccugacau

SEQ ID NO: 257053 - RNA, 19 nt, Homo sapiens
cagcaacauugucaagacu

SEQ ID NO: 257054 - RNA, 19 nt, Homo sapiens
acaggccucuccaccauca

SEQ ID NO: 257055 - RNA, 19 nt, Homo sapiens
gugucaugguucuguguaa

SEQ ID NO: 257056 - RNA, 19 nt, Homo sapiens
gaaaccuucaucuaaagca

SEQ ID NO: 257057 - RNA, 19 nt, Homo sapiens
gggugcaguuagucuaugu

SEQ ID NO: 257058 - RNA, 19 nt, Homo sapiens
cgccaugaacuucugcaua

SEQ ID NO: 257059 - RNA, 19 nt, Homo sapiens
cagcaggccagucucaugu

SEQ ID NO: 257060 - RNA, 19 nt, Homo sapiens
caccaaaguuuagaucacu

SEQ ID NO: 257061 - RNA, 19 nt, Homo sapiens
ggagcugcuucuugaucug

SEQ ID NO: 257062 - RNA, 19 nt, Homo sapiens
agagaggcccuucuuugga

SEQ ID NO: 257063 - RNA, 19 nt, Homo sapiens
ccaggcaaagacacccuua

SEQ ID NO: 257064 - RNA, 19 nt, Homo sapiens
cauaguccaucccgcuagu

SEQ ID NO: 257065 - RNA, 19 nt, Homo sapiens
gcuacgccaugaacuucug

SEQ ID NO: 257066 - RNA, 19 nt, Homo sapiens
gccagucucauguucuuug

SEQ ID NO: 257067 - RNA, 19 nt, Homo sapiens
guugagaccacagcuguug

SEQ ID NO: 257068 - RNA, 19 nt, Homo sapiens
gcuggacacacacuucuuc

SEQ ID NO: 257069 - RNA, 19 nt, Homo sapiens
gcagcucccuuccaauacc

SEQ ID NO: 257070 - RNA, 19 nt, Homo sapiens
ccagucucauguucuuugu

SEQ ID NO: 257071 - RNA, 19 nt, Homo sapiens
ucaccaaaguuuagaucac

SEQ ID NO: 257072 - RNA, 19 nt, Homo sapiens
cugcagugcucaaucuucu

SEQ ID NO: 257073 - RNA, 19 nt, Homo sapiens
gggcuacgccaugaacuuc

SEQ ID NO: 257074 - RNA, 19 nt, Homo sapiens
uuuguggacuuccgugaga

SEQ ID NO: 257075 - RNA, 19 nt, Homo sapiens
guaacuguggcuauucugu

SEQ ID NO: 257076 - RNA, 19 nt, Homo sapiens
acccagcgcccaacacuga

SEQ ID NO: 257077 - RNA, 19 nt, Homo sapiens
gaucuggccaagagaagca

SEQ ID NO: 257078 - RNA, 19 nt, Homo sapiens
guguaacuguggcuauucu

SEQ ID NO: 257079 - RNA, 19 nt, Homo sapiens
ggugucaugguucugugua

SEQ ID NO: 257080 - RNA, 19 nt, Homo sapiens
ugagcaaugccaucugguu

SEQ ID NO: 257081 - RNA, 19 nt, Homo sapiens
uuagcucaccuuuaauaga

SEQ ID NO: 257082 - RNA, 19 nt, Homo sapiens
ucagacccaucuccaacca

SEQ ID NO: 257083 - RNA, 19 nt, Homo sapiens
gacaacagggaacaggaau

SEQ ID NO: 257084 - RNA, 19 nt, Homo sapiens
acagcaacauugucaagac

SEQ ID NO: 257085 - RNA, 19 nt, Homo sapiens
guauugcugccuccuuuca

SEQ ID NO: 257086 - RNA, 19 nt, Homo sapiens
uaaggaaucuuucugcuuu

SEQ ID NO: 257087 - RNA, 19 nt, Homo sapiens
gagaagagaugucugaauc

SEQ ID NO: 257088 - RNA, 19 nt, Homo sapiens
uaaaugugcugaaugguuu

SEQ ID NO: 257089 - RNA, 19 nt, Homo sapiens
gaaagacuguacaaaguau

SEQ ID NO: 257090 - RNA, 19 nt, Homo sapiens
cgaaggccaucaagaauuu

SEQ ID NO: 257091 - RNA, 19 nt, Homo sapiens
gaaagcaguuagcaaggaa

SEQ ID NO: 257092 - RNA, 19 nt, Homo sapiens
guaggaagguuaauguuca

SEQ ID NO: 257093 - RNA, 19 nt, Homo sapiens
cuacugaggugcuauguuc

SEQ ID NO: 257094 - RNA, 19 nt, Homo sapiens
caaaucagcugcuacuacu

SEQ ID NO: 257095 - RNA, 19 nt, Homo sapiens
guacucuccuggaaauauu

SEQ ID NO: 257096 - RNA, 19 nt, Homo sapiens
gagguacucuccuggaaau

SEQ ID NO: 257097 - RNA, 19 nt, Homo sapiens
aauccaaggucuuuagaaa

SEQ ID NO: 257098 - RNA, 19 nt, Homo sapiens
ugaaagacuguacaaagua

SEQ ID NO: 257099 - RNA, 19 nt, Homo sapiens
gacccugcuucaaauauuu

SEQ ID NO: 257100 - RNA, 19 nt, Homo sapiens
gaagagaugucugaaucca

SEQ ID NO: 257101 - RNA, 19 nt, Homo sapiens
gaagguagaaauaucugaa

SEQ ID NO: 257102 - RNA, 19 nt, Homo sapiens
guucugacccugcuucaaa

SEQ ID NO: 257103 - RNA, 19 nt, Homo sapiens
gaagguuaauguucaucau

SEQ ID NO: 257104 - RNA, 19 nt, Homo sapiens
aaagaagggugagaagaga

SEQ ID NO: 257105 - RNA, 19 nt, Homo sapiens
ugacccugcuucaaauauu

SEQ ID NO: 257106 - RNA, 19 nt, Homo sapiens
auccuaagcuauucaguaa

SEQ ID NO: 257107 - RNA, 19 nt, Homo sapiens
caaaaucgaugcagugcuu

SEQ ID NO: 257108 - RNA, 19 nt, Homo sapiens
ugaaagcaguuagcaagga

SEQ ID NO: 257109 - RNA, 19 nt, Homo sapiens
agauaaaugugcugaaugg

SEQ ID NO: 257110 - RNA, 19 nt, Homo sapiens
acucuacccuggcacuaua

SEQ ID NO: 257111 - RNA, 19 nt, Homo sapiens
auacaggaagguagaaaua

SEQ ID NO: 257112 - RNA, 19 nt, Homo sapiens
agaaugcucuuuacuucau

SEQ ID NO: 257113 - RNA, 19 nt, Homo sapiens
gaggugcuauguucuuagu

SEQ ID NO: 257114 - RNA, 19 nt, Homo sapiens
cauccuaagcuauucagua

SEQ ID NO: 257115 - RNA, 19 nt, Homo sapiens
aaucgaaggccaucaagaa

SEQ ID NO: 257116 - RNA, 19 nt, Homo sapiens
ggugagaagagaugucuga

SEQ ID NO: 257117 - RNA, 19 nt, Homo sapiens
gauuugcugccuuaucuuu

SEQ ID NO: 257118 - RNA, 19 nt, Homo sapiens
caguguacauggaauaaca

SEQ ID NO: 257119 - RNA, 19 nt, Homo sapiens
acaggaagguagaaauauc

SEQ ID NO: 257120 - RNA, 19 nt, Homo sapiens
cuacauacaauuccaaaca

SEQ ID NO: 257121 - RNA, 19 nt, Homo sapiens
ggaguaccucucucuagaa

SEQ ID NO: 257122 - RNA, 19 nt, Homo sapiens
guucuuaguuugcaguuac

SEQ ID NO: 257123 - RNA, 19 nt, Homo sapiens
uucaguggcuaccuacaua

SEQ ID NO: 257124 - RNA, 19 nt, Homo sapiens
aggaguaccucucucuaga

SEQ ID NO: 257125 - RNA, 19 nt, Homo sapiens
auucugauuugcugccuua

SEQ ID NO: 257126 - RNA, 19 nt, Homo sapiens
guaaucaaccuguuaaucc

SEQ ID NO: 257127 - RNA, 19 nt, Homo sapiens
augaaagacuguacaaagu

SEQ ID NO: 257128 - RNA, 19 nt, Homo sapiens
cugaggugcuauguucuua

SEQ ID NO: 257129 - RNA, 19 nt, Homo sapiens
ccucaauugcuuagacaua

SEQ ID NO: 257130 - RNA, 19 nt, Homo sapiens
gaaggccaucaagaauuua

SEQ ID NO: 257131 - RNA, 19 nt, Homo sapiens
gacauuccucaauugcuua

SEQ ID NO: 257132 - RNA, 19 nt, Homo sapiens
aaauauuucccucaccuuu

SEQ ID NO: 257133 - RNA, 19 nt, Homo sapiens
caagccauaauuguucuua

SEQ ID NO: 257134 - RNA, 19 nt, Homo sapiens
uaaucaaccuguuaaucca

SEQ ID NO: 257135 - RNA, 19 nt, Homo sapiens
gaaugcucuuuacuucaug

SEQ ID NO: 257136 - RNA, 19 nt, Homo sapiens
ggaagguuaauguucauca

SEQ ID NO: 257137 - RNA, 19 nt, Homo sapiens
ggaagguagaaauaucuga

SEQ ID NO: 257138 - RNA, 19 nt, Homo sapiens
ccaaaucagcugcuacuac

SEQ ID NO: 257139 - RNA, 19 nt, Homo sapiens
gaaucgaaggccaucaaga

SEQ ID NO: 257140 - RNA, 19 nt, Homo sapiens
gaguaccucucucuagaac

SEQ ID NO: 257141 - RNA, 19 nt, Homo sapiens
guggcuaccuacauacaau

SEQ ID NO: 257142 - RNA, 19 nt, Homo sapiens
cucagaaucucaaauaacu

SEQ ID NO: 257143 - RNA, 19 nt, Homo sapiens
caaggaguaccucucucua

SEQ ID NO: 257144 - RNA, 19 nt, Homo sapiens
gguacucuccuggaaauau

SEQ ID NO: 257145 - RNA, 19 nt, Homo sapiens
aaacacauacaggaaggua

SEQ ID NO: 257146 - RNA, 19 nt, Homo sapiens
gggcccaaauucuuucagu

SEQ ID NO: 257147 - RNA, 19 nt, Homo sapiens
ggguuuaucagaauucuca

SEQ ID NO: 257148 - RNA, 19 nt, Homo sapiens
guacuaaggaaucuuucug

SEQ ID NO: 257149 - RNA, 19 nt, Homo sapiens
aaugaaagacuguacaaag

SEQ ID NO: 257150 - RNA, 19 nt, Homo sapiens
guaccugcaucagcauuag

SEQ ID NO: 257151 - RNA, 19 nt, Homo sapiens
aaagguaugcaaucaaauc

SEQ ID NO: 257152 - RNA, 19 nt, Homo sapiens
gccauaauuguucuuaguu

SEQ ID NO: 257153 - RNA, 19 nt, Homo sapiens
ucaagaauuuacugaaagc

SEQ ID NO: 257154 - RNA, 19 nt, Homo sapiens
cugauuugcugccuuaucu

SEQ ID NO: 257155 - RNA, 19 nt, Homo sapiens
acacauacaggaagguaga

SEQ ID NO: 257156 - RNA, 19 nt, Homo sapiens
cucaauugcuuagacauau

SEQ ID NO: 257157 - RNA, 19 nt, Homo sapiens
ucgaaggccaucaagaauu

SEQ ID NO: 257158 - RNA, 19 nt, Homo sapiens
auaaaugugcugaaugguu

SEQ ID NO: 257159 - RNA, 19 nt, Homo sapiens
ccaaggguacuaaggaauc

SEQ ID NO: 257160 - RNA, 19 nt, Homo sapiens
ucuagaaccguacgcugua

SEQ ID NO: 257161 - RNA, 19 nt, Homo sapiens
gacucuaaguggcauucaa

SEQ ID NO: 257162 - RNA, 19 nt, Homo sapiens
ucccaucacuucccuacau

SEQ ID NO: 257163 - RNA, 19 nt, Homo sapiens
caaggguacuaaggaaucu

SEQ ID NO: 257164 - RNA, 19 nt, Homo sapiens
cccuggcacuauaauguaa

SEQ ID NO: 257165 - RNA, 19 nt, Homo sapiens
ugucaagccauaauuguuc

SEQ ID NO: 257166 - RNA, 19 nt, Homo sapiens
cagaaucgaaggccaucaa

SEQ ID NO: 257167 - RNA, 19 nt, Homo sapiens
uugcuuagacauauucuga

SEQ ID NO: 257168 - RNA, 19 nt, Homo sapiens
uaucaaugaguaacaggaa

SEQ ID NO: 257169 - RNA, 19 nt, Homo sapiens
guugagaucauugcuacaa

SEQ ID NO: 257170 - RNA, 19 nt, Homo sapiens
cuaaggaaucuuucugcuu

SEQ ID NO: 257171 - RNA, 19 nt, Homo sapiens
acauacaauuccaaacaca

SEQ ID NO: 257172 - RNA, 19 nt, Homo sapiens
guucaucauccuaagcuau

SEQ ID NO: 257173 - RNA, 19 nt, Homo sapiens
guuaauguucaucauccua

SEQ ID NO: 257174 - RNA, 19 nt, Homo sapiens
uucccuacauggaguauau

SEQ ID NO: 257175 - RNA, 19 nt, Homo sapiens
ugagguacucuccuggaaa

SEQ ID NO: 257176 - RNA, 19 nt, Homo sapiens
guuaauccaaggucuuuag

SEQ ID NO: 257177 - RNA, 19 nt, Homo sapiens
gacauauucugagccuaca

SEQ ID NO: 257178 - RNA, 19 nt, Homo sapiens
ccucaccuuucccaucuuc

SEQ ID NO: 257179 - RNA, 19 nt, Homo sapiens
caauugcuuagacauauuc

SEQ ID NO: 257180 - RNA, 19 nt, Homo sapiens
caaauauuucccucaccuu

SEQ ID NO: 257181 - RNA, 19 nt, Homo sapiens
caaggauggaccacacaga

SEQ ID NO: 257182 - RNA, 19 nt, Homo sapiens
ugagaagagaugucugaau

SEQ ID NO: 257183 - RNA, 19 nt, Homo sapiens
agccauaauuguucuuagu

SEQ ID NO: 257184 - RNA, 19 nt, Homo sapiens
gaugcagugcuuccaagga

SEQ ID NO: 257185 - RNA, 19 nt, Homo sapiens
ccaucaagaauuuacugaa

SEQ ID NO: 257186 - RNA, 19 nt, Homo sapiens
gguagcaucugaagcauua

SEQ ID NO: 257187 - RNA, 19 nt, Homo sapiens
gcaaaguccucaaugguaa

SEQ ID NO: 257188 - RNA, 19 nt, Homo sapiens
ccaaugaguuuacuaauga

SEQ ID NO: 257189 - RNA, 19 nt, Homo sapiens
gaaagaaugcuuagaaaga

SEQ ID NO: 257190 - RNA, 19 nt, Homo sapiens
uaucaaagcugcauuguca

SEQ ID NO: 257191 - RNA, 19 nt, Homo sapiens
ggaagcggcuggagacauu

SEQ ID NO: 257192 - RNA, 19 nt, Homo sapiens
cagcagagcuucuuagcaa

SEQ ID NO: 257193 - RNA, 19 nt, Homo sapiens
ugagaaggcugcuaacauu

SEQ ID NO: 257194 - RNA, 19 nt, Homo sapiens
gaagauaccacauucaaau

SEQ ID NO: 257195 - RNA, 19 nt, Homo sapiens
guucagaaaugucagauau

SEQ ID NO: 257196 - RNA, 19 nt, Homo sapiens
uauaagagccuauguguug

SEQ ID NO: 257197 - RNA, 19 nt, Homo sapiens
guaacaagguagcaucuga

SEQ ID NO: 257198 - RNA, 19 nt, Homo sapiens
uguauaaacugaacuguga

SEQ ID NO: 257199 - RNA, 19 nt, Homo sapiens
agaaagaaauccagaaaca

SEQ ID NO: 257200 - RNA, 19 nt, Homo sapiens
gaacaagaaguuugcaguu

SEQ ID NO: 257201 - RNA, 19 nt, Homo sapiens
guguggagaucgcauauuu

SEQ ID NO: 257202 - RNA, 19 nt, Homo sapiens
aaagcaagguucagaaaug

SEQ ID NO: 257203 - RNA, 19 nt, Homo sapiens
ggagaagaauccaaugagu

SEQ ID NO: 257204 - RNA, 19 nt, Homo sapiens
gaauauggagaacaaguuu

SEQ ID NO: 257205 - RNA, 19 nt, Homo sapiens
ggaaaggacagugcuauug

SEQ ID NO: 257206 - RNA, 19 nt, Homo sapiens
acaagaaguuugcaguuga

SEQ ID NO: 257207 - RNA, 19 nt, Homo sapiens
caacaagggaggacucauu

SEQ ID NO: 257208 - RNA, 19 nt, Homo sapiens
gaaacagcagagcuucuua

SEQ ID NO: 257209 - RNA, 19 nt, Homo sapiens
caacaugcauucacuacag

SEQ ID NO: 257210 - RNA, 19 nt, Homo sapiens
aaacugaacugugaaacug

SEQ ID NO: 257211 - RNA, 19 nt, Homo sapiens
ggaagaaacagcagagcuu

SEQ ID NO: 257212 - RNA, 19 nt, Homo sapiens
agaagaauccaaugaguuu

SEQ ID NO: 257213 - RNA, 19 nt, Homo sapiens
gagaagaauccaaugaguu

SEQ ID NO: 257214 - RNA, 19 nt, Homo sapiens
ucaagacucuggcugaugu

SEQ ID NO: 257215 - RNA, 19 nt, Homo sapiens
gggaauaguagacuugaaa

SEQ ID NO: 257216 - RNA, 19 nt, Homo sapiens
gagccuauguguuguccaa

SEQ ID NO: 257217 - RNA, 19 nt, Homo sapiens
ggaccaacaugcauucacu

SEQ ID NO: 257218 - RNA, 19 nt, Homo sapiens
gaaaggacagugcuauugg

SEQ ID NO: 257219 - RNA, 19 nt, Homo sapiens
gaagaauccaaugaguuua

SEQ ID NO: 257220 - RNA, 19 nt, Homo sapiens
caagguagcaucugaagca

SEQ ID NO: 257221 - RNA, 19 nt, Homo sapiens
gaaaagaacaagaaguuug

SEQ ID NO: 257222 - RNA, 19 nt, Homo sapiens
ggauggcuuuguccuguug

SEQ ID NO: 257223 - RNA, 19 nt, Homo sapiens
agggaggacucauugcaua

SEQ ID NO: 257224 - RNA, 19 nt, Homo sapiens
agaagaaacggcagugaaa

SEQ ID NO: 257225 - RNA, 19 nt, Homo sapiens
ccucaaugguaacaaggua

SEQ ID NO: 257226 - RNA, 19 nt, Homo sapiens
ccagaaacagggcuugauu

SEQ ID NO: 257227 - RNA, 19 nt, Homo sapiens
gaauaguagacuugaaaga

SEQ ID NO: 257228 - RNA, 19 nt, Homo sapiens
gagaaaagaacaagaaguu

SEQ ID NO: 257229 - RNA, 19 nt, Homo sapiens
cagaagauaccacauucaa

SEQ ID NO: 257230 - RNA, 19 nt, Homo sapiens
uccaaugaguuuacuaaug

SEQ ID NO: 257231 - RNA, 19 nt, Homo sapiens
gcaagguucagaaauguca

SEQ ID NO: 257232 - RNA, 19 nt, Homo sapiens
gcagagacgcauaccuaga

SEQ ID NO: 257233 - RNA, 19 nt, Homo sapiens
cagaaacagggcuugauuu

SEQ ID NO: 257234 - RNA, 19 nt, Homo sapiens
gaaaagcaagguucagaaa

SEQ ID NO: 257235 - RNA, 19 nt, Homo sapiens
agaaacagggcuugauuug

SEQ ID NO: 257236 - RNA, 19 nt, Homo sapiens
agacuugaaagaaugcuua

SEQ ID NO: 257237 - RNA, 19 nt, Homo sapiens
aacagaauauggagaacaa

SEQ ID NO: 257238 - RNA, 19 nt, Homo sapiens
gagaaggcugcuaacauug

SEQ ID NO: 257239 - RNA, 19 nt, Homo sapiens
aacaagaaguuugcaguug

SEQ ID NO: 257240 - RNA, 19 nt, Homo sapiens
uaguagacuugaaagaaug

SEQ ID NO: 257241 - RNA, 19 nt, Homo sapiens
gaaacacacacuggaaaca

SEQ ID NO: 257242 - RNA, 19 nt, Homo sapiens
gguuaucucugucuuuuga

SEQ ID NO: 257243 - RNA, 19 nt, Homo sapiens
guuauaagagccuaugugu

SEQ ID NO: 257244 - RNA, 19 nt, Homo sapiens
gugaaacacacacuggaaa

SEQ ID NO: 257245 - RNA, 19 nt, Homo sapiens
cugcugacauuaaauccaa

SEQ ID NO: 257246 - RNA, 19 nt, Homo sapiens
uagccaggguuguucauca

SEQ ID NO: 257247 - RNA, 19 nt, Homo sapiens
uaacaagguagcaucugaa

SEQ ID NO: 257248 - RNA, 19 nt, Homo sapiens
cugcagagacgcauaccua

SEQ ID NO: 257249 - RNA, 19 nt, Homo sapiens
gaaagaaauccagaaacag

SEQ ID NO: 257250 - RNA, 19 nt, Homo sapiens
aagcaagguucagaaaugu

SEQ ID NO: 257251 - RNA, 19 nt, Homo sapiens
cagcucaccaucucuagaa

SEQ ID NO: 257252 - RNA, 19 nt, Homo sapiens
gggaaaagauuaccuugag

SEQ ID NO: 257253 - RNA, 19 nt, Homo sapiens
uagaagaaacggcagugaa

SEQ ID NO: 257254 - RNA, 19 nt, Homo sapiens
ccuguggacuucagugugu

SEQ ID NO: 257255 - RNA, 19 nt, Homo sapiens
aacauucaccuuccucuuu

SEQ ID NO: 257256 - RNA, 19 nt, Homo sapiens
cuugaaagaaugcuuagaa

SEQ ID NO: 257257 - RNA, 19 nt, Homo sapiens
caagaaguuugcaguugac

SEQ ID NO: 257258 - RNA, 19 nt, Homo sapiens
gaaacggcagugaaacaca

SEQ ID NO: 257259 - RNA, 19 nt, Homo sapiens
cguugacauuuacaucuuu

SEQ ID NO: 257260 - RNA, 19 nt, Homo sapiens
gacucuggcugauguacug

SEQ ID NO: 257261 - RNA, 19 nt, Homo sapiens
cuacagcucaccaucucua

SEQ ID NO: 257262 - RNA, 19 nt, Homo sapiens
gcagagcuucuuagcaaag

SEQ ID NO: 257263 - RNA, 19 nt, Homo sapiens
ucagaaaugucagauaucc

SEQ ID NO: 257264 - RNA, 19 nt, Homo sapiens
caaucaaccuuuuguguca

SEQ ID NO: 257265 - RNA, 19 nt, Homo sapiens
ggagucaucaaucaaccuu

SEQ ID NO: 257266 - RNA, 19 nt, Homo sapiens
aaaagguucugcugacauu

SEQ ID NO: 257267 - RNA, 19 nt, Homo sapiens
ccauagauucaacuuauca

SEQ ID NO: 257268 - RNA, 19 nt, Homo sapiens
cgguguaccuguauaaacu

SEQ ID NO: 257269 - RNA, 19 nt, Homo sapiens
gggcuugauuugccacagu

SEQ ID NO: 257270 - RNA, 19 nt, Homo sapiens
ccaaggccucguugacauu

SEQ ID NO: 257271 - RNA, 19 nt, Homo sapiens
aaaggagacuaucaaagcu

SEQ ID NO: 257272 - RNA, 19 nt, Homo sapiens
gaagaaacggcagugaaac

SEQ ID NO: 257273 - RNA, 19 nt, Homo sapiens
caccaucucuagaagaaac

SEQ ID NO: 257274 - RNA, 19 nt, Homo sapiens
ugaaagaaugcuuagaaag

SEQ ID NO: 257275 - RNA, 19 nt, Homo sapiens
ggaauaguagacuugaaag

SEQ ID NO: 257276 - RNA, 19 nt, Homo sapiens
gaccaacaugcauucacua

SEQ ID NO: 257277 - RNA, 19 nt, Homo sapiens
uuagcaaaguccucaaugg

SEQ ID NO: 257278 - RNA, 19 nt, Homo sapiens
guaccuguauaaacugaac

SEQ ID NO: 257279 - RNA, 19 nt, Homo sapiens
gcaccugcagagacgcaua

SEQ ID NO: 257280 - RNA, 19 nt, Homo sapiens
caagggaggacucauugca

SEQ ID NO: 257281 - RNA, 19 nt, Homo sapiens
agaagauaccacauucaaa

SEQ ID NO: 257282 - RNA, 19 nt, Homo sapiens
caaggccucguugacauuu

SEQ ID NO: 257283 - RNA, 19 nt, Homo sapiens
gcuauuggggccuuucuua

SEQ ID NO: 257284 - RNA, 19 nt, Homo sapiens
agcaaaguccucaauggua

SEQ ID NO: 257285 - RNA, 19 nt, Homo sapiens
gaaaagaaagagggagaaa

SEQ ID NO: 257286 - RNA, 19 nt, Homo sapiens
gaacgaggcuucuucuaca

SEQ ID NO: 257287 - RNA, 19 nt, Homo sapiens
gguggaagcucucuaccua

SEQ ID NO: 257288 - RNA, 19 nt, Homo sapiens
cgagagagauggaauaaag

SEQ ID NO: 257289 - RNA, 19 nt, Homo sapiens
gcacaucacuguccuucug

SEQ ID NO: 257290 - RNA, 19 nt, Homo sapiens
gaauaaagcccuugaacca

SEQ ID NO: 257291 - RNA, 19 nt, Homo sapiens
gaagcucucuaccuagugu

SEQ ID NO: 257292 - RNA, 19 nt, Homo sapiens
gcagaagcguggcauugug

SEQ ID NO: 257293 - RNA, 19 nt, Homo sapiens
gagaacuacugcaacuaga

SEQ ID NO: 257294 - RNA, 19 nt, Homo sapiens
ucuaccagcuggagaacua

SEQ ID NO: 257295 - RNA, 19 nt, Homo sapiens
ggagaacuacugcaacuag

SEQ ID NO: 257296 - RNA, 19 nt, Homo sapiens
ggaacgaggcuucuucuac

SEQ ID NO: 257297 - RNA, 19 nt, Homo sapiens
cagaagaggccaucaagca

SEQ ID NO: 257298 - RNA, 19 nt, Homo sapiens
ugacccagccgcagccuuu

SEQ ID NO: 257299 - RNA, 19 nt, Homo sapiens
uggaagcucucuaccuagu

SEQ ID NO: 257300 - RNA, 19 nt, Homo sapiens
gcaccgagagagauggaau

SEQ ID NO: 257301 - RNA, 19 nt, Homo sapiens
gauggaauaaagcccuuga

SEQ ID NO: 257302 - RNA, 19 nt, Homo sapiens
caucagaagaggccaucaa

SEQ ID NO: 257303 - RNA, 19 nt, Homo sapiens
ccaucaagcacaucacugu

SEQ ID NO: 257304 - RNA, 19 nt, Homo sapiens
guggaacaaugcuguacca

SEQ ID NO: 257305 - RNA, 19 nt, Homo sapiens
gaagcguggcauuguggaa

SEQ ID NO: 257306 - RNA, 19 nt, Homo sapiens
caccgagagagauggaaua

SEQ ID NO: 257307 - RNA, 19 nt, Homo sapiens
gggaacgaggcuucuucua

SEQ ID NO: 257308 - RNA, 19 nt, Homo sapiens
caucauagguugcauuuaa

SEQ ID NO: 257309 - RNA, 19 nt, Homo sapiens
gaacguucauugucaaaga

SEQ ID NO: 257310 - RNA, 19 nt, Homo sapiens
gcgguuaaauuccuacuuu

SEQ ID NO: 257311 - RNA, 19 nt, Homo sapiens
gaagagaccaagaaacauu

SEQ ID NO: 257312 - RNA, 19 nt, Homo sapiens
ugaccgaccuccaucagua

SEQ ID NO: 257313 - RNA, 19 nt, Homo sapiens
gaaccaacaauccuauauu

SEQ ID NO: 257314 - RNA, 19 nt, Homo sapiens
gaacgugaccuucaaaguc

SEQ ID NO: 257315 - RNA, 19 nt, Homo sapiens
gaugagaguucaagacgau

SEQ ID NO: 257316 - RNA, 19 nt, Homo sapiens
gaucgaaagccaaauaguu

SEQ ID NO: 257317 - RNA, 19 nt, Homo sapiens
gaauaagaacgucgacauu

SEQ ID NO: 257318 - RNA, 19 nt, Homo sapiens
ggaaaucgcgacggguuua

SEQ ID NO: 257319 - RNA, 19 nt, Homo sapiens
ccacaaacuugcacauaca

SEQ ID NO: 257320 - RNA, 19 nt, Homo sapiens
gaugauggauuuggacaug

SEQ ID NO: 257321 - RNA, 19 nt, Homo sapiens
ucaagacgauggaggauca

SEQ ID NO: 257322 - RNA, 19 nt, Homo sapiens
gugcaugcccggaagaaua

SEQ ID NO: 257323 - RNA, 19 nt, Homo sapiens
gcacagacggagaucauug

SEQ ID NO: 257324 - RNA, 19 nt, Homo sapiens
ccaagaaggccaugguauu

SEQ ID NO: 257325 - RNA, 19 nt, Homo sapiens
ucaaucagaugacacaagu

SEQ ID NO: 257326 - RNA, 19 nt, Homo sapiens
gccgagagguuuggcgaua

SEQ ID NO: 257327 - RNA, 19 nt, Homo sapiens
gccaaauugucacccagua

SEQ ID NO: 257328 - RNA, 19 nt, Homo sapiens
gagccuagagugcaucauu

SEQ ID NO: 257329 - RNA, 19 nt, Homo sapiens
gcuggcagauggaggagaa

SEQ ID NO: 257330 - RNA, 19 nt, Homo sapiens
acacuaaggucugcagaga

SEQ ID NO: 257331 - RNA, 19 nt, Homo sapiens
ggaaccaacaauccuauau

SEQ ID NO: 257332 - RNA, 19 nt, Homo sapiens
gaccgaggaucaagaagca

SEQ ID NO: 257333 - RNA, 19 nt, Homo sapiens
ggagguagucacccagaaa

SEQ ID NO: 257334 - RNA, 19 nt, Homo sapiens
gggaggagcuggcaaugcu

SEQ ID NO: 257335 - RNA, 19 nt, Homo sapiens
ucaucaacguggagaguuu

SEQ ID NO: 257336 - RNA, 19 nt, Homo sapiens
caagaaggccaugguauuc

SEQ ID NO: 257337 - RNA, 19 nt, Homo sapiens
gagagugaccguguaggua

SEQ ID NO: 257338 - RNA, 19 nt, Homo sapiens
uguaugaugucaaagauag

SEQ ID NO: 257339 - RNA, 19 nt, Homo sapiens
aaacaaaagugccagaaga

SEQ ID NO: 257340 - RNA, 19 nt, Homo sapiens
gaagaugcagccagagugu

SEQ ID NO: 257341 - RNA, 19 nt, Homo sapiens
gaucucagggaacaaugua

SEQ ID NO: 257342 - RNA, 19 nt, Homo sapiens
cuagaucgaaagccaaaua

SEQ ID NO: 257343 - RNA, 19 nt, Homo sapiens
ugaggaacgugaccuucaa

SEQ ID NO: 257344 - RNA, 19 nt, Homo sapiens
gacaugagccuugggauca

SEQ ID NO: 257345 - RNA, 19 nt, Homo sapiens
uaaagcaagcaguuugaaa

SEQ ID NO: 257346 - RNA, 19 nt, Homo sapiens
ggaauccgauccaaauacg

SEQ ID NO: 257347 - RNA, 19 nt, Homo sapiens
uagguugcauuuaacacua

SEQ ID NO: 257348 - RNA, 19 nt, Homo sapiens
uguccaggcuacucacuuu

SEQ ID NO: 257349 - RNA, 19 nt, Homo sapiens
ccaacaauccuauauuucu

SEQ ID NO: 257350 - RNA, 19 nt, Homo sapiens
ggcgauacgucuuuacaag

SEQ ID NO: 257351 - RNA, 19 nt, Homo sapiens
ucauuaagcugaggaacug

SEQ ID NO: 257352 - RNA, 19 nt, Homo sapiens
aaacccaagugaguuacua

SEQ ID NO: 257353 - RNA, 19 nt, Homo sapiens
ugaggaguguuguacauca

SEQ ID NO: 257354 - RNA, 19 nt, Homo sapiens
gagcuugacggaggcguua

SEQ ID NO: 257355 - RNA, 19 nt, Homo sapiens
caucugcggcuucaucauu

SEQ ID NO: 257356 - RNA, 19 nt, Homo sapiens
gcaguuugaaagcagauaa

SEQ ID NO: 257357 - RNA, 19 nt, Homo sapiens
ucagggaacaauguauuua

SEQ ID NO: 257358 - RNA, 19 nt, Homo sapiens
gguuaaauuccuacuuuga

SEQ ID NO: 257359 - RNA, 19 nt, Homo sapiens
gcacauacaaaggaugaga

SEQ ID NO: 257360 - RNA, 19 nt, Homo sapiens
agaccaucauccucacaua

SEQ ID NO: 257361 - RNA, 19 nt, Homo sapiens
gaaaucgcgacggguuuaa

SEQ ID NO: 257362 - RNA, 19 nt, Homo sapiens
gcaccagcaagaaagauug

SEQ ID NO: 257363 - RNA, 19 nt, Homo sapiens
agaagcacaucaucaccaa

SEQ ID NO: 257364 - RNA, 19 nt, Homo sapiens
gggagaaaguguggcugaa

SEQ ID NO: 257365 - RNA, 19 nt, Homo sapiens
gagggaaccaacaauccua

SEQ ID NO: 257366 - RNA, 19 nt, Homo sapiens
aagcaguauugccuucuuu

SEQ ID NO: 257367 - RNA, 19 nt, Homo sapiens
caggugaugcuuagaaaug

SEQ ID NO: 257368 - RNA, 19 nt, Homo sapiens
gaucaagaagcacaucauc

SEQ ID NO: 257369 - RNA, 19 nt, Homo sapiens
gaaccugaccgaccuccau

SEQ ID NO: 257370 - RNA, 19 nt, Homo sapiens
gcguggccaugaugaguga

SEQ ID NO: 257371 - RNA, 19 nt, Homo sapiens
ggagaaacagccgaucuuc

SEQ ID NO: 257372 - RNA, 19 nt, Homo sapiens
gcaagcuccuggccaacuc

SEQ ID NO: 257373 - RNA, 19 nt, Homo sapiens
auacaaaggaugagaguuc

SEQ ID NO: 257374 - RNA, 19 nt, Homo sapiens
ucgugaagcuccuacuaga

SEQ ID NO: 257375 - RNA, 19 nt, Homo sapiens
agagugaccguguagguaa

SEQ ID NO: 257376 - RNA, 19 nt, Homo sapiens
uaagcaguauugccuucuu

SEQ ID NO: 257377 - RNA, 19 nt, Homo sapiens
gggagguagucacccagaa

SEQ ID NO: 257378 - RNA, 19 nt, Homo sapiens
uacaagaagucaucaacgu

SEQ ID NO: 257379 - RNA, 19 nt, Homo sapiens
gauccaaauacgcuucauu

SEQ ID NO: 257380 - RNA, 19 nt, Homo sapiens
ugacggaggcguuaggaau

SEQ ID NO: 257381 - RNA, 19 nt, Homo sapiens
cuccaucgcuagaucgaaa

SEQ ID NO: 257382 - RNA, 19 nt, Homo sapiens
ggaacgugaccuucaaagu

SEQ ID NO: 257383 - RNA, 19 nt, Homo sapiens
gggagaaacagccgaucuu

SEQ ID NO: 257384 - RNA, 19 nt, Homo sapiens
agaggacacucgccaucuu

SEQ ID NO: 257385 - RNA, 19 nt, Homo sapiens
gauuuggacaugcuucuau

SEQ ID NO: 257386 - RNA, 19 nt, Homo sapiens
gcagauggaggagaaguca

SEQ ID NO: 257387 - RNA, 19 nt, Homo sapiens
gcagagagugaccguguag

SEQ ID NO: 257388 - RNA, 19 nt, Homo sapiens
ucuggaacguucauuguca

SEQ ID NO: 257389 - RNA, 19 nt, Homo sapiens
gggaaccaacaauccuaua

SEQ ID NO: 257390 - RNA, 19 nt, Homo sapiens
ucuguuccaucccuuuauu

SEQ ID NO: 257391 - RNA, 19 nt, Homo sapiens
gccagaugauggauuugga

SEQ ID NO: 257392 - RNA, 19 nt, Homo sapiens
gaggacacucgccaucuug

SEQ ID NO: 257393 - RNA, 19 nt, Homo sapiens
ccagaucaacacccugaaa

SEQ ID NO: 257394 - RNA, 19 nt, Homo sapiens
gaggaguguuguacaucau

SEQ ID NO: 257395 - RNA, 19 nt, Homo sapiens
ggugccaucugccgcaugu

SEQ ID NO: 257396 - RNA, 19 nt, Homo sapiens
uuaggaauccgauccaaau

SEQ ID NO: 257397 - RNA, 19 nt, Homo sapiens
acuaaggucugcagagagu

SEQ ID NO: 257398 - RNA, 19 nt, Homo sapiens
ccacaugguccgagagcaa

SEQ ID NO: 257399 - RNA, 19 nt, Homo sapiens
gccagcacuucccggguaa

SEQ ID NO: 257400 - RNA, 19 nt, Homo sapiens
aagucaaacucuccgugua

SEQ ID NO: 257401 - RNA, 19 nt, Homo sapiens
gcaguauugccuucuuuca

SEQ ID NO: 257402 - RNA, 19 nt, Homo sapiens
ucaaugagcagcagacacu

SEQ ID NO: 257403 - RNA, 19 nt, Homo sapiens
ggaguguuguacaucaucu

SEQ ID NO: 257404 - RNA, 19 nt, Homo sapiens
uugaagagaccaagaaaca

SEQ ID NO: 257405 - RNA, 19 nt, Homo sapiens
ggcaucauagguugcauuu

SEQ ID NO: 257406 - RNA, 19 nt, Homo sapiens
aguauugccuucuuucaag

SEQ ID NO: 257407 - RNA, 19 nt, Homo sapiens
gaggaacgugaccuucaaa

SEQ ID NO: 257408 - RNA, 19 nt, Homo sapiens
caucauagguugcauuuaa

SEQ ID NO: 257409 - RNA, 19 nt, Homo sapiens
gaacguucauugucaaaga

SEQ ID NO: 257410 - RNA, 19 nt, Homo sapiens
gcgguuaaauuccuacuuu

SEQ ID NO: 257411 - RNA, 19 nt, Homo sapiens
gaagagaccaagaaacauu

SEQ ID NO: 257412 - RNA, 19 nt, Homo sapiens
ugaccgaccuccaucagua

SEQ ID NO: 257413 - RNA, 19 nt, Homo sapiens
gaaccaacaauccuauauu

SEQ ID NO: 257414 - RNA, 19 nt, Homo sapiens
gaacgugaccuucaaaguc

SEQ ID NO: 257415 - RNA, 19 nt, Homo sapiens
gaugagaguucaagacgau

SEQ ID NO: 257416 - RNA, 19 nt, Homo sapiens
gaucgaaagccaaauaguu

SEQ ID NO: 257417 - RNA, 19 nt, Homo sapiens
gaauaagaacgucgacauu

SEQ ID NO: 257418 - RNA, 19 nt, Homo sapiens
ggaaaucgcgacggguuua

SEQ ID NO: 257419 - RNA, 19 nt, Homo sapiens
ccacaaacuugcacauaca

SEQ ID NO: 257420 - RNA, 19 nt, Homo sapiens
gaugauggauuuggacaug

SEQ ID NO: 257421 - RNA, 19 nt, Homo sapiens
gaacacacgguuuccucua

SEQ ID NO: 257422 - RNA, 19 nt, Homo sapiens
ucaagacgauggaggauca

SEQ ID NO: 257423 - RNA, 19 nt, Homo sapiens
gugcaugcccggaagaaua

SEQ ID NO: 257424 - RNA, 19 nt, Homo sapiens
gcacagacggagaucauug

SEQ ID NO: 257425 - RNA, 19 nt, Homo sapiens
ccaagaaggccaugguauu

SEQ ID NO: 257426 - RNA, 19 nt, Homo sapiens
cugaaggauugguuuauuu

SEQ ID NO: 257427 - RNA, 19 nt, Homo sapiens
ucaaucagaugacacaagu

SEQ ID NO: 257428 - RNA, 19 nt, Homo sapiens
gccgagagguuuggcgaua

SEQ ID NO: 257429 - RNA, 19 nt, Homo sapiens
ggguaccucuagugucaua

SEQ ID NO: 257430 - RNA, 19 nt, Homo sapiens
guggguaccucuaguguca

SEQ ID NO: 257431 - RNA, 19 nt, Homo sapiens
gccaaauugucacccagua

SEQ ID NO: 257432 - RNA, 19 nt, Homo sapiens
gagccuagagugcaucauu

SEQ ID NO: 257433 - RNA, 19 nt, Homo sapiens
gcuggcagauggaggagaa

SEQ ID NO: 257434 - RNA, 19 nt, Homo sapiens
acacuaaggucugcagaga

SEQ ID NO: 257435 - RNA, 19 nt, Homo sapiens
ggaaccaacaauccuauau

SEQ ID NO: 257436 - RNA, 19 nt, Homo sapiens
gaccgaggaucaagaagca

SEQ ID NO: 257437 - RNA, 19 nt, Homo sapiens
gggaggagcuggcaaugcu

SEQ ID NO: 257438 - RNA, 19 nt, Homo sapiens
ucaucaacguggagaguuu

SEQ ID NO: 257439 - RNA, 19 nt, Homo sapiens
caagaaggccaugguauuc

SEQ ID NO: 257440 - RNA, 19 nt, Homo sapiens
gagagugaccguguaggua

SEQ ID NO: 257441 - RNA, 19 nt, Homo sapiens
uguaugaugucaaagauag

SEQ ID NO: 257442 - RNA, 19 nt, Homo sapiens
uuaauucccugcagcugaa

SEQ ID NO: 257443 - RNA, 19 nt, Homo sapiens
gaagaugcagccagagugu

SEQ ID NO: 257444 - RNA, 19 nt, Homo sapiens
gaucucagggaacaaugua

SEQ ID NO: 257445 - RNA, 19 nt, Homo sapiens
guaccucuagugucauaua

SEQ ID NO: 257446 - RNA, 19 nt, Homo sapiens
cuagaucgaaagccaaaua

SEQ ID NO: 257447 - RNA, 19 nt, Homo sapiens
cgaagggacuuacggaaaa

SEQ ID NO: 257448 - RNA, 19 nt, Homo sapiens
ugaggaacgugaccuucaa

SEQ ID NO: 257449 - RNA, 19 nt, Homo sapiens
gacaugagccuugggauca

SEQ ID NO: 257450 - RNA, 19 nt, Homo sapiens
uaaagcaagcaguuugaaa

SEQ ID NO: 257451 - RNA, 19 nt, Homo sapiens
ggaauccgauccaaauacg

SEQ ID NO: 257452 - RNA, 19 nt, Homo sapiens
uagguugcauuuaacacua

SEQ ID NO: 257453 - RNA, 19 nt, Homo sapiens
uguccaggcuacucacuuu

SEQ ID NO: 257454 - RNA, 19 nt, Homo sapiens
ccaacaauccuauauuucu

SEQ ID NO: 257455 - RNA, 19 nt, Homo sapiens
ggcgauacgucuuuacaag

SEQ ID NO: 257456 - RNA, 19 nt, Homo sapiens
ucauuaagcugaggaacug

SEQ ID NO: 257457 - RNA, 19 nt, Homo sapiens
aaacccaagugaguuacua

SEQ ID NO: 257458 - RNA, 19 nt, Homo sapiens
ugaggaguguuguacauca

SEQ ID NO: 257459 - RNA, 19 nt, Homo sapiens
gagcuugacggaggcguua

SEQ ID NO: 257460 - RNA, 19 nt, Homo sapiens
caucugcggcuucaucauu

SEQ ID NO: 257461 - RNA, 19 nt, Homo sapiens
gcaguuugaaagcagauaa

SEQ ID NO: 257462 - RNA, 19 nt, Homo sapiens
ucagggaacaauguauuua

SEQ ID NO: 257463 - RNA, 19 nt, Homo sapiens
gguuaaauuccuacuuuga

SEQ ID NO: 257464 - RNA, 19 nt, Homo sapiens
gcacauacaaaggaugaga

SEQ ID NO: 257465 - RNA, 19 nt, Homo sapiens
agaccaucauccucacaua

SEQ ID NO: 257466 - RNA, 19 nt, Homo sapiens
gaaaucgcgacggguuuaa

SEQ ID NO: 257467 - RNA, 19 nt, Homo sapiens
gcaccagcaagaaagauug

SEQ ID NO: 257468 - RNA, 19 nt, Homo sapiens
gggagaaaguguggcugaa

SEQ ID NO: 257469 - RNA, 19 nt, Homo sapiens
agaagcacaucaucaccaa

SEQ ID NO: 257470 - RNA, 19 nt, Homo sapiens
gagggaaccaacaauccua

SEQ ID NO: 257471 - RNA, 19 nt, Homo sapiens
agacugaaggauugguuua

SEQ ID NO: 257472 - RNA, 19 nt, Homo sapiens
acacgguuuccucuaauua

SEQ ID NO: 257473 - RNA, 19 nt, Homo sapiens
aacacacgguuuccucuaa

SEQ ID NO: 257474 - RNA, 19 nt, Homo sapiens
ggaagucgcaaauaugcau

SEQ ID NO: 257475 - RNA, 19 nt, Homo sapiens
aagcaguauugccuucuuu

SEQ ID NO: 257476 - RNA, 19 nt, Homo sapiens
uguuggaagucgcaaauau

SEQ ID NO: 257477 - RNA, 19 nt, Homo sapiens
caggugaugcuuagaaaug

SEQ ID NO: 257478 - RNA, 19 nt, Homo sapiens
gaaccugaccgaccuccau

SEQ ID NO: 257479 - RNA, 19 nt, Homo sapiens
gaucaagaagcacaucauc

SEQ ID NO: 257480 - RNA, 19 nt, Homo sapiens
gcguggccaugaugaguga

SEQ ID NO: 257481 - RNA, 19 nt, Homo sapiens
ggagaaacagccgaucuuc

SEQ ID NO: 257482 - RNA, 19 nt, Homo sapiens
gcaagcuccuggccaacuc

SEQ ID NO: 257483 - RNA, 19 nt, Homo sapiens
auacaaaggaugagaguuc

SEQ ID NO: 257484 - RNA, 19 nt, Homo sapiens
ucgugaagcuccuacuaga

SEQ ID NO: 257485 - RNA, 19 nt, Homo sapiens
agagugaccguguagguaa

SEQ ID NO: 257486 - RNA, 19 nt, Homo sapiens
uaagcaguauugccuucuu

SEQ ID NO: 257487 - RNA, 19 nt, Homo sapiens
uacaagaagucaucaacgu

SEQ ID NO: 257488 - RNA, 19 nt, Homo sapiens
gauccaaauacgcuucauu

SEQ ID NO: 257489 - RNA, 19 nt, Homo sapiens
ugacggaggcguuaggaau

SEQ ID NO: 257490 - RNA, 19 nt, Homo sapiens
cuccaucgcuagaucgaaa

SEQ ID NO: 257491 - RNA, 19 nt, Homo sapiens
gauuuggacaugcuucuau

SEQ ID NO: 257492 - RNA, 19 nt, Homo sapiens
cagugaggguugucgaaga

SEQ ID NO: 257493 - RNA, 19 nt, Homo sapiens
ggaacgugaccuucaaagu

SEQ ID NO: 257494 - RNA, 19 nt, Homo sapiens
gggagaaacagccgaucuu

SEQ ID NO: 257495 - RNA, 19 nt, Homo sapiens
agaggacacucgccaucuu

SEQ ID NO: 257496 - RNA, 19 nt, Homo sapiens
gcagauggaggagaaguca

SEQ ID NO: 257497 - RNA, 19 nt, Homo sapiens
gcagagagugaccguguag

SEQ ID NO: 257498 - RNA, 19 nt, Homo sapiens
ucuggaacguucauuguca

SEQ ID NO: 257499 - RNA, 19 nt, Homo sapiens
gggaaccaacaauccuaua

SEQ ID NO: 257500 - RNA, 19 nt, Homo sapiens
acugaaggauugguuuauu

SEQ ID NO: 257501 - RNA, 19 nt, Homo sapiens
gagacugaaggauugguuu

SEQ ID NO: 257502 - RNA, 19 nt, Homo sapiens
ccgaagggacuuacggaaa

SEQ ID NO: 257503 - RNA, 19 nt, Homo sapiens
gccagaugauggauuugga

SEQ ID NO: 257504 - RNA, 19 nt, Homo sapiens
gaggacacucgccaucuug

SEQ ID NO: 257505 - RNA, 19 nt, Homo sapiens
ccagaucaacacccugaaa

SEQ ID NO: 257506 - RNA, 19 nt, Homo sapiens
gaggaguguuguacaucau

SEQ ID NO: 257507 - RNA, 19 nt, Homo sapiens
ggugccaucugccgcaugu

SEQ ID NO: 257508 - RNA, 19 nt, Homo sapiens
uaacaugggcuguauauaa

SEQ ID NO: 257509 - RNA, 19 nt, Homo sapiens
gaaauagccuaguuugcuu

SEQ ID NO: 257510 - RNA, 19 nt, Homo sapiens
aaagagaucuacucggaua

SEQ ID NO: 257511 - RNA, 19 nt, Homo sapiens
gaacuggcuucgggaauuu

SEQ ID NO: 257512 - RNA, 19 nt, Homo sapiens
gugaugcgaugaaagaaua

SEQ ID NO: 257513 - RNA, 19 nt, Homo sapiens
gcaccgcgcucuuggaguu

SEQ ID NO: 257514 - RNA, 19 nt, Homo sapiens
cgagaagguuuccuacuuu

SEQ ID NO: 257515 - RNA, 19 nt, Homo sapiens
uaacagggcucgagucuac

SEQ ID NO: 257516 - RNA, 19 nt, Homo sapiens
gaacuauugucgagugaug

SEQ ID NO: 257517 - RNA, 19 nt, Homo sapiens
gaagguuuccuacuuugua

SEQ ID NO: 257518 - RNA, 19 nt, Homo sapiens
ggaguugucugucuuuaag

SEQ ID NO: 257519 - RNA, 19 nt, Homo sapiens
ggagaaguuucgcagacua

SEQ ID NO: 257520 - RNA, 19 nt, Homo sapiens
gaucuacucggauaccuua

SEQ ID NO: 257521 - RNA, 19 nt, Homo sapiens
gagaagguuuccuacuuug

SEQ ID NO: 257522 - RNA, 19 nt, Homo sapiens
ggacaaguucgucaaagaa

SEQ ID NO: 257523 - RNA, 19 nt, Homo sapiens
gucauaaccuuguugcaaa

SEQ ID NO: 257524 - RNA, 19 nt, Homo sapiens
ggaagguuaugcuccaguu

SEQ ID NO: 257525 - RNA, 19 nt, Homo sapiens
aacaugggcuguauauaaa

SEQ ID NO: 257526 - RNA, 19 nt, Homo sapiens
cgaauacgcacucuugaaa

SEQ ID NO: 257527 - RNA, 19 nt, Homo sapiens
ggaagugaccggucugguu

SEQ ID NO: 257528 - RNA, 19 nt, Homo sapiens
gcuaagaaguauagaaagg

SEQ ID NO: 257529 - RNA, 19 nt, Homo sapiens
ggcauuagcuggguguuug

SEQ ID NO: 257530 - RNA, 19 nt, Homo sapiens
uagagagucuguugaugaa

SEQ ID NO: 257531 - RNA, 19 nt, Homo sapiens
gacaacgaccggaagguua

SEQ ID NO: 257532 - RNA, 19 nt, Homo sapiens
ugaccggucugguuccuaa

SEQ ID NO: 257533 - RNA, 19 nt, Homo sapiens
aaacaagcccuuccgugua

SEQ ID NO: 257534 - RNA, 19 nt, Homo sapiens
cagaaaaccugcagaagaa

SEQ ID NO: 257535 - RNA, 19 nt, Homo sapiens
gagugcaaauggucaagaa

SEQ ID NO: 257536 - RNA, 19 nt, Homo sapiens
gcacgcccaugcuggagaa

SEQ ID NO: 257537 - RNA, 19 nt, Homo sapiens
ccaaguauccuacguuaca

SEQ ID NO: 257538 - RNA, 19 nt, Homo sapiens
ucgagaagguuuccuacuu

SEQ ID NO: 257539 - RNA, 19 nt, Homo sapiens
caguuugacuuuaaagcua

SEQ ID NO: 257540 - RNA, 19 nt, Homo sapiens
cuaguuugcuuccaauaga

SEQ ID NO: 257541 - RNA, 19 nt, Homo sapiens
caugggagaaauagaaaua

SEQ ID NO: 257542 - RNA, 19 nt, Homo sapiens
caacccaugucauaaccuu

SEQ ID NO: 257543 - RNA, 19 nt, Homo sapiens
ugccaaguauccuacguua

SEQ ID NO: 257544 - RNA, 19 nt, Homo sapiens
gaagguuaugcuccaguua

SEQ ID NO: 257545 - RNA, 19 nt, Homo sapiens
aaaggucgcuggcaaagag

SEQ ID NO: 257546 - RNA, 19 nt, Homo sapiens
gcacuucacggcacuagga

SEQ ID NO: 257547 - RNA, 19 nt, Homo sapiens
ggacaacgaccggaagguu

SEQ ID NO: 257548 - RNA, 19 nt, Homo sapiens
gagagucuguugaugaaac

SEQ ID NO: 257549 - RNA, 19 nt, Homo sapiens
ccaaugaaguggugaagcu

SEQ ID NO: 257550 - RNA, 19 nt, Homo sapiens
gaccgaauacgcacucuug

SEQ ID NO: 257551 - RNA, 19 nt, Homo sapiens
cgagugaugcgaugaaaga

SEQ ID NO: 257552 - RNA, 19 nt, Homo sapiens
agcaguaaguacagcauua

SEQ ID NO: 257553 - RNA, 19 nt, Homo sapiens
agaacuggcuucgggaauu

SEQ ID NO: 257554 - RNA, 19 nt, Homo sapiens
cuaggaagcuuuuauuuuc

SEQ ID NO: 257555 - RNA, 19 nt, Homo sapiens
gaugaaacacaaauguaug

SEQ ID NO: 257556 - RNA, 19 nt, Homo sapiens
uaucaugggagaaauagaa

SEQ ID NO: 257557 - RNA, 19 nt, Homo sapiens
uauccuacguuacaacaau

SEQ ID NO: 257558 - RNA, 19 nt, Homo sapiens
gcacaggagagucccauca

SEQ ID NO: 257559 - RNA, 19 nt, Homo sapiens
gaaacucuucgacuacuuc

SEQ ID NO: 257560 - RNA, 19 nt, Homo sapiens
gcuacgugcuggacagaau

SEQ ID NO: 257561 - RNA, 19 nt, Homo sapiens
uuagagagucuguugauga

SEQ ID NO: 257562 - RNA, 19 nt, Homo sapiens
gaaggugauuagagagucu

SEQ ID NO: 257563 - RNA, 19 nt, Homo sapiens
auuagaaggugauuagaga

SEQ ID NO: 257564 - RNA, 19 nt, Homo sapiens
caacacacaaauucguaaa

SEQ ID NO: 257565 - RNA, 19 nt, Homo sapiens
ucuaccaguuugacuuuaa

SEQ ID NO: 257566 - RNA, 19 nt, Homo sapiens
ccagcuacccguacaguga

SEQ ID NO: 257567 - RNA, 19 nt, Homo sapiens
gccuuugacuuggugaaua

SEQ ID NO: 257568 - RNA, 19 nt, Homo sapiens
uggacaaguucgucaaaga

SEQ ID NO: 257569 - RNA, 19 nt, Homo sapiens
cuaccaguuugacuuuaaa

SEQ ID NO: 257570 - RNA, 19 nt, Homo sapiens
gauugcagacugugccuuu

SEQ ID NO: 257571 - RNA, 19 nt, Homo sapiens
guaaguacagcauuagaag

SEQ ID NO: 257572 - RNA, 19 nt, Homo sapiens
gaaguggugaagcucauau

SEQ ID NO: 257573 - RNA, 19 nt, Homo sapiens
agacugugccuuugacuug

SEQ ID NO: 257574 - RNA, 19 nt, Homo sapiens
gauuagagagucuguugau

SEQ ID NO: 257575 - RNA, 19 nt, Homo sapiens
gcucuucgacgacccagaa

SEQ ID NO: 257576 - RNA, 19 nt, Homo sapiens
gaaaggucgcuggcaaaga

SEQ ID NO: 257577 - RNA, 19 nt, Homo sapiens
caucuaccaguuugacuuu

SEQ ID NO: 257578 - RNA, 19 nt, Homo sapiens
caaguauccuacguuacaa

SEQ ID NO: 257579 - RNA, 19 nt, Homo sapiens
ggucggagagcgaggagaa

SEQ ID NO: 257580 - RNA, 19 nt, Homo sapiens
guuaugcuccaguuagaaa

SEQ ID NO: 257581 - RNA, 19 nt, Homo sapiens
uagccuaguuugcuuccaa

SEQ ID NO: 257582 - RNA, 19 nt, Homo sapiens
caaggaguugucugucuuu

SEQ ID NO: 257583 - RNA, 19 nt, Homo sapiens
ccuuugacuuggugaauau

SEQ ID NO: 257584 - RNA, 19 nt, Homo sapiens
ucauaaccuuguugcaaau

SEQ ID NO: 257585 - RNA, 19 nt, Homo sapiens
ggugagcaguacaugaaca

SEQ ID NO: 257586 - RNA, 19 nt, Homo sapiens
gugauuagagagucuguug

SEQ ID NO: 257587 - RNA, 19 nt, Homo sapiens
accguagacuucacaguuu

SEQ ID NO: 257588 - RNA, 19 nt, Homo sapiens
uguaugaacuggacaucuc

SEQ ID NO: 257589 - RNA, 19 nt, Homo sapiens
gguuuccuacuuuguauuu

SEQ ID NO: 257590 - RNA, 19 nt, Homo sapiens
gagucuaccuggaugaaaa

SEQ ID NO: 257591 - RNA, 19 nt, Homo sapiens
gccguucuucuguguaaua

SEQ ID NO: 257592 - RNA, 19 nt, Homo sapiens
cagcaaagagggucuguac

SEQ ID NO: 257593 - RNA, 19 nt, Homo sapiens
gaauacgcacucuugaaag

SEQ ID NO: 257594 - RNA, 19 nt, Homo sapiens
ggagagcgaggagaagguu

SEQ ID NO: 257595 - RNA, 19 nt, Homo sapiens
gcgaugaaagaauauaaca

SEQ ID NO: 257596 - RNA, 19 nt, Homo sapiens
gcacuaggaagcuuuuauu

SEQ ID NO: 257597 - RNA, 19 nt, Homo sapiens
uaccguagacuucacaguu

SEQ ID NO: 257598 - RNA, 19 nt, Homo sapiens
gugcuggacagaaucauug

SEQ ID NO: 257599 - RNA, 19 nt, Homo sapiens
ccaugaugcuuccaaucug

SEQ ID NO: 257600 - RNA, 19 nt, Homo sapiens
ccgugucgcugcugugguu

SEQ ID NO: 257601 - RNA, 19 nt, Homo sapiens
ggaccggggugaaggcauu

SEQ ID NO: 257602 - RNA, 19 nt, Homo sapiens
caacgugggcucgcucuuc

SEQ ID NO: 257603 - RNA, 19 nt, Homo sapiens
gauucgagaagguuuccua

SEQ ID NO: 257604 - RNA, 19 nt, Homo sapiens
gaauauccaucuuuuccau

SEQ ID NO: 257605 - RNA, 19 nt, Homo sapiens
gcaguaaguacagcauuag

SEQ ID NO: 257606 - RNA, 19 nt, Homo sapiens
aacuguacauuuccucauu

SEQ ID NO: 257607 - RNA, 19 nt, Homo sapiens
aaggaguugucugucuuua

SEQ ID NO: 257608 - RNA, 19 nt, Homo sapiens
ggaauugcguuuacacuua

SEQ ID NO: 257609 - RNA, 19 nt, Homo sapiens
caacauagcagaauuaaug

SEQ ID NO: 257610 - RNA, 19 nt, Homo sapiens
ggaaacugaucauuaagaa

SEQ ID NO: 257611 - RNA, 19 nt, Homo sapiens
gaaaucagcuccuauucuc

SEQ ID NO: 257612 - RNA, 19 nt, Homo sapiens
gaugauaaauucacuguuc

SEQ ID NO: 257613 - RNA, 19 nt, Homo sapiens
guuccaggcucuugaaaua

SEQ ID NO: 257614 - RNA, 19 nt, Homo sapiens
gggagaagcucuaugacuu

SEQ ID NO: 257615 - RNA, 19 nt, Homo sapiens
gagaauagaugggugaugu

SEQ ID NO: 257616 - RNA, 19 nt, Homo sapiens
gaaagggccuagcuucugu

SEQ ID NO: 257617 - RNA, 19 nt, Homo sapiens
cgacagggaugaaguacaa

SEQ ID NO: 257618 - RNA, 19 nt, Homo sapiens
aaacgcagcugcccaucua

SEQ ID NO: 257619 - RNA, 19 nt, Homo sapiens
gaagaucacguccugguuu

SEQ ID NO: 257620 - RNA, 19 nt, Homo sapiens
uuaaggccauccaagauua

SEQ ID NO: 257621 - RNA, 19 nt, Homo sapiens
ggugaugucuuuccuuaug

SEQ ID NO: 257622 - RNA, 19 nt, Homo sapiens
gcuaagugcuuuacgaaca

SEQ ID NO: 257623 - RNA, 19 nt, Homo sapiens
gaagucugcguaaccaaua

SEQ ID NO: 257624 - RNA, 19 nt, Homo sapiens
cagcaucacugaaaucauc

SEQ ID NO: 257625 - RNA, 19 nt, Homo sapiens
auagaugggugaugucuuu

SEQ ID NO: 257626 - RNA, 19 nt, Homo sapiens
ggaucuaccuggcuucuca

SEQ ID NO: 257627 - RNA, 19 nt, Homo sapiens
gaacugcagcgccgauuug

SEQ ID NO: 257628 - RNA, 19 nt, Homo sapiens
ugaauaaguuggugaucuu

SEQ ID NO: 257629 - RNA, 19 nt, Homo sapiens
uuaaggagcugaagagucu

SEQ ID NO: 257630 - RNA, 19 nt, Homo sapiens
gagaagcucuaugacuuug

SEQ ID NO: 257631 - RNA, 19 nt, Homo sapiens
ggagaagcucuaugacuuu

SEQ ID NO: 257632 - RNA, 19 nt, Homo sapiens
cugggaaacugaucauuaa

SEQ ID NO: 257633 - RNA, 19 nt, Homo sapiens
gcacgaggguccugagucu

SEQ ID NO: 257634 - RNA, 19 nt, Homo sapiens
cagaaaccaucauccagaa

SEQ ID NO: 257635 - RNA, 19 nt, Homo sapiens
gaauuaauguagggagcua

SEQ ID NO: 257636 - RNA, 19 nt, Homo sapiens
gaagcucuaugacuuugug

SEQ ID NO: 257637 - RNA, 19 nt, Homo sapiens
ucacgcaccucuucugguu

SEQ ID NO: 257638 - RNA, 19 nt, Homo sapiens
gcagugaagcccucaguga

SEQ ID NO: 257639 - RNA, 19 nt, Homo sapiens
ugacgaagcccgagauguu

SEQ ID NO: 257640 - RNA, 19 nt, Homo sapiens
ugggugaugucuuuccuua

SEQ ID NO: 257641 - RNA, 19 nt, Homo sapiens
ggaggaagaaaucacguuu

SEQ ID NO: 257642 - RNA, 19 nt, Homo sapiens
ugaagaaacugaccacacu

SEQ ID NO: 257643 - RNA, 19 nt, Homo sapiens
cuaccuggcuucucaguuc

SEQ ID NO: 257644 - RNA, 19 nt, Homo sapiens
gagacugacucgggacaaa

SEQ ID NO: 257645 - RNA, 19 nt, Homo sapiens
ccaggacucugaauuugug

SEQ ID NO: 257646 - RNA, 19 nt, Homo sapiens
ggccauccaagauuauuua

SEQ ID NO: 257647 - RNA, 19 nt, Homo sapiens
ccaagucccagaccaaauu

SEQ ID NO: 257648 - RNA, 19 nt, Homo sapiens
ggagucacuucccaguuug

SEQ ID NO: 257649 - RNA, 19 nt, Homo sapiens
gcccaggacucugaauuug

SEQ ID NO: 257650 - RNA, 19 nt, Homo sapiens
gaauugcguuuacacuuac

SEQ ID NO: 257651 - RNA, 19 nt, Homo sapiens
ggaaaucagcuccuauucu

SEQ ID NO: 257652 - RNA, 19 nt, Homo sapiens
cgagggagaagcucuauga

SEQ ID NO: 257653 - RNA, 19 nt, Homo sapiens
ugaagcccauuaucucuga

SEQ ID NO: 257654 - RNA, 19 nt, Homo sapiens
ccaaagcugaagcccauua

SEQ ID NO: 257655 - RNA, 19 nt, Homo sapiens
aggagucacuucccaguuu

SEQ ID NO: 257656 - RNA, 19 nt, Homo sapiens
ggacgacucugcggacuac

SEQ ID NO: 257657 - RNA, 19 nt, Homo sapiens
gaagacggagcgugaugaa

SEQ ID NO: 257658 - RNA, 19 nt, Homo sapiens
uaaauccaguggugugugu

SEQ ID NO: 257659 - RNA, 19 nt, Homo sapiens
ccauaucacccaagaaguu

SEQ ID NO: 257660 - RNA, 19 nt, Homo sapiens
gcauugcccuucgguuaga

SEQ ID NO: 257661 - RNA, 19 nt, Homo sapiens
gcaccuggaacauggguaa

SEQ ID NO: 257662 - RNA, 19 nt, Homo sapiens
cauccaagauuauuuaagc

SEQ ID NO: 257663 - RNA, 19 nt, Homo sapiens
ggaaggagcaggaaaucag

SEQ ID NO: 257664 - RNA, 19 nt, Homo sapiens
ggaaagggccuagcuucug

SEQ ID NO: 257665 - RNA, 19 nt, Homo sapiens
gggaaacugaucauuaaga

SEQ ID NO: 257666 - RNA, 19 nt, Homo sapiens
cguuuacacuuacagaauu

SEQ ID NO: 257667 - RNA, 19 nt, Homo sapiens
gagucuggguagcuuguuu

SEQ ID NO: 257668 - RNA, 19 nt, Homo sapiens
ggguggagauauagauaau

SEQ ID NO: 257669 - RNA, 19 nt, Homo sapiens
gaggguggagauauagaua

SEQ ID NO: 257670 - RNA, 19 nt, Homo sapiens
ccaaggacagauugaguuu

SEQ ID NO: 257671 - RNA, 19 nt, Homo sapiens
ggagggagcagaaggucuu

SEQ ID NO: 257672 - RNA, 19 nt, Homo sapiens
aaacucaggcgaaaccaaa

SEQ ID NO: 257673 - RNA, 19 nt, Homo sapiens
uaauaauaauggccacaug

SEQ ID NO: 257674 - RNA, 19 nt, Homo sapiens
ugacagcgacgaauccuau

SEQ ID NO: 257675 - RNA, 19 nt, Homo sapiens
ucugggaaacugaucauua

SEQ ID NO: 257676 - RNA, 19 nt, Homo sapiens
gaauucugcccaaugaaga

SEQ ID NO: 257677 - RNA, 19 nt, Homo sapiens
gaaguuuggugagacucuu

SEQ ID NO: 257678 - RNA, 19 nt, Homo sapiens
gaagcugagucccuuuaac

SEQ ID NO: 257679 - RNA, 19 nt, Homo sapiens
ggagcucuauggagaaguc

SEQ ID NO: 257680 - RNA, 19 nt, Homo sapiens
ccacacugcucugcaagga

SEQ ID NO: 257681 - RNA, 19 nt, Homo sapiens
ggaagucugcguaaccaau

SEQ ID NO: 257682 - RNA, 19 nt, Homo sapiens
caggugcuaugccacauug

SEQ ID NO: 257683 - RNA, 19 nt, Homo sapiens
gaagacaggcauugcaaac

SEQ ID NO: 257684 - RNA, 19 nt, Homo sapiens
caaagucgacguugagucu

SEQ ID NO: 257685 - RNA, 19 nt, Homo sapiens
cagcucugcuuccuugguu

SEQ ID NO: 257686 - RNA, 19 nt, Homo sapiens
ggaacugcagcgccgauuu

SEQ ID NO: 257687 - RNA, 19 nt, Homo sapiens
aaacggagaaggagaagau

SEQ ID NO: 257688 - RNA, 19 nt, Homo sapiens
ugaccacacugcucugcaa

SEQ ID NO: 257689 - RNA, 19 nt, Homo sapiens
uaugcaaggcuuuguguuu

SEQ ID NO: 257690 - RNA, 19 nt, Homo sapiens
ggaguugacaggccacuuc

SEQ ID NO: 257691 - RNA, 19 nt, Homo sapiens
gggagcugguggugaaguu

SEQ ID NO: 257692 - RNA, 19 nt, Homo sapiens
gacugacucgggacaaaua

SEQ ID NO: 257693 - RNA, 19 nt, Homo sapiens
cugagucccuuuaacauca

SEQ ID NO: 257694 - RNA, 19 nt, Homo sapiens
ugaagagucuggguagcuu

SEQ ID NO: 257695 - RNA, 19 nt, Homo sapiens
gacgaagcccgagauguuu

SEQ ID NO: 257696 - RNA, 19 nt, Homo sapiens
gcuccagcaucacugaaau

SEQ ID NO: 257697 - RNA, 19 nt, Homo sapiens
cugcauugcccuucgguua

SEQ ID NO: 257698 - RNA, 19 nt, Homo sapiens
cgagcugcuuggagaguuu

SEQ ID NO: 257699 - RNA, 19 nt, Homo sapiens
acaaauacgccuacaccaa

SEQ ID NO: 257700 - RNA, 19 nt, Homo sapiens
aaaucaagcagcagcagua

SEQ ID NO: 257701 - RNA, 19 nt, Homo sapiens
ugcaagaaaucaccagugu

SEQ ID NO: 257702 - RNA, 19 nt, Homo sapiens
aaacacucccugcaagaaa

SEQ ID NO: 257703 - RNA, 19 nt, Homo sapiens
caaacacucccugcaagaa

SEQ ID NO: 257704 - RNA, 19 nt, Homo sapiens
ggcuggagauccucaaaca

SEQ ID NO: 257705 - RNA, 19 nt, Homo sapiens
gacaugaucaccaucuuca

SEQ ID NO: 257706 - RNA, 19 nt, Homo sapiens
guucugaggacaaguucua

SEQ ID NO: 257707 - RNA, 19 nt, Homo sapiens
gccaagugcugugcuaagu

SEQ ID NO: 257708 - RNA, 19 nt, Homo sapiens
ggagagcaccuuaauauua

SEQ ID NO: 257709 - RNA, 19 nt, Homo sapiens
gagagcaccuuaauauuau

SEQ ID NO: 257710 - RNA, 19 nt, Homo sapiens
guaucucucugccuauuua

SEQ ID NO: 257711 - RNA, 19 nt, Homo sapiens
gcaaggacuucaucuuugu

SEQ ID NO: 257712 - RNA, 19 nt, Homo sapiens
ggcgugaugucuucaauaa

SEQ ID NO: 257713 - RNA, 19 nt, Homo sapiens
ccacgaagcugugaacuca

SEQ ID NO: 257714 - RNA, 19 nt, Homo sapiens
ucacacaccucuucugguu

SEQ ID NO: 257715 - RNA, 19 nt, Homo sapiens
caagcuggguguuguguuu

SEQ ID NO: 257716 - RNA, 19 nt, Homo sapiens
ucaaggagcuuacggaucu

SEQ ID NO: 257717 - RNA, 19 nt, Homo sapiens
caacaucaacuuccucaaa

SEQ ID NO: 257718 - RNA, 19 nt, Homo sapiens
ccaagaacagcuucaauaa

SEQ ID NO: 257719 - RNA, 19 nt, Homo sapiens
ggaccaaugugcccucaug

SEQ ID NO: 257720 - RNA, 19 nt, Homo sapiens
uaaagugccaguuugcuua

SEQ ID NO: 257721 - RNA, 19 nt, Homo sapiens
gaacaaaguggccauuaca

SEQ ID NO: 257722 - RNA, 19 nt, Homo sapiens
ucaauaacccugccuacua

SEQ ID NO: 257723 - RNA, 19 nt, Homo sapiens
gcgcaaggacuucaucuuu

SEQ ID NO: 257724 - RNA, 19 nt, Homo sapiens
aagaagagcuuugagaaug

SEQ ID NO: 257725 - RNA, 19 nt, Homo sapiens
guccggaaaugaaggaaua

SEQ ID NO: 257726 - RNA, 19 nt, Homo sapiens
cgugaugucuucaauaaau

SEQ ID NO: 257727 - RNA, 19 nt, Homo sapiens
cuaccugccuggaggaaua

SEQ ID NO: 257728 - RNA, 19 nt, Homo sapiens
gcaccaaguucuucaucga

SEQ ID NO: 257729 - RNA, 19 nt, Homo sapiens
caauaacccugccuacuac

SEQ ID NO: 257730 - RNA, 19 nt, Homo sapiens
gggcgucuccuucauguuu

SEQ ID NO: 257731 - RNA, 19 nt, Homo sapiens
agaagagcuuugagaauga

SEQ ID NO: 257732 - RNA, 19 nt, Homo sapiens
agaaagggcucucaaagac

SEQ ID NO: 257733 - RNA, 19 nt, Homo sapiens
agaagcaugugcacacgua

SEQ ID NO: 257734 - RNA, 19 nt, Homo sapiens
gccauaaagugccaguuug

SEQ ID NO: 257735 - RNA, 19 nt, Homo sapiens
gacaugaucucagucuuca

SEQ ID NO: 257736 - RNA, 19 nt, Homo sapiens
gcacacguaucgcauucug

SEQ ID NO: 257737 - RNA, 19 nt, Homo sapiens
ggacugcccucggacuaug

SEQ ID NO: 257738 - RNA, 19 nt, Homo sapiens
ggagacaggcaauaucaga

SEQ ID NO: 257739 - RNA, 19 nt, Homo sapiens
acacaccucuucugguuug

SEQ ID NO: 257740 - RNA, 19 nt, Homo sapiens
ucauuuggcuuugugaauu

SEQ ID NO: 257741 - RNA, 19 nt, Homo sapiens
gaaggucaguugccauggu

SEQ ID NO: 257742 - RNA, 19 nt, Homo sapiens
gaagagcuuugagaaugau

SEQ ID NO: 257743 - RNA, 19 nt, Homo sapiens
aaacucacaucaucugcaa

SEQ ID NO: 257744 - RNA, 19 nt, Homo sapiens
ggacucagcgcaaggacuu

SEQ ID NO: 257745 - RNA, 19 nt, Homo sapiens
gaggagggccuggugcaua

SEQ ID NO: 257746 - RNA, 19 nt, Homo sapiens
aaagggcucucaaagacuu

SEQ ID NO: 257747 - RNA, 19 nt, Homo sapiens
cccaagaacagcuucaaua

SEQ ID NO: 257748 - RNA, 19 nt, Homo sapiens
gaggagacaggcaauauca

SEQ ID NO: 257749 - RNA, 19 nt, Homo sapiens
gggagagcauccaggaaga

SEQ ID NO: 257750 - RNA, 19 nt, Homo sapiens
ccgcagccauccacacgua

SEQ ID NO: 257751 - RNA, 19 nt, Homo sapiens
gagggagagcaccuuaaua

SEQ ID NO: 257752 - RNA, 19 nt, Homo sapiens
ggagggagagcaccuuaau

SEQ ID NO: 257753 - RNA, 19 nt, Homo sapiens
gcagugacaacaucaacuu

SEQ ID NO: 257754 - RNA, 19 nt, Homo sapiens
caagaagagcuuugagaau

SEQ ID NO: 257755 - RNA, 19 nt, Homo sapiens
gaccaggccuacauugagu

SEQ ID NO: 257756 - RNA, 19 nt, Homo sapiens
ugacaucucucugcguuuc

SEQ ID NO: 257757 - RNA, 19 nt, Homo sapiens
gucaguacguccaguguga

SEQ ID NO: 257758 - RNA, 19 nt, Homo sapiens
caaucacuguggaauauca

SEQ ID NO: 257759 - RNA, 19 nt, Homo sapiens
ggacgagcccgacaugauc

SEQ ID NO: 257760 - RNA, 19 nt, Homo sapiens
cgcaaggacuucaucuuug

SEQ ID NO: 257761 - RNA, 19 nt, Homo sapiens
ccagagcagugacaacauc

SEQ ID NO: 257762 - RNA, 19 nt, Homo sapiens
caagaaagggcucucaaag

SEQ ID NO: 257763 - RNA, 19 nt, Homo sapiens
ccaagaaagggcucucaaa

SEQ ID NO: 257764 - RNA, 19 nt, Homo sapiens
ugucaggcauccagaagaa

SEQ ID NO: 257765 - RNA, 19 nt, Homo sapiens
gggacgaccuggaguuucu

SEQ ID NO: 257766 - RNA, 19 nt, Homo sapiens
cacaucaucugcaauucuu

SEQ ID NO: 257767 - RNA, 19 nt, Homo sapiens
gaacuacaucagcaggaaa

SEQ ID NO: 257768 - RNA, 19 nt, Homo sapiens
ccaguuugcuuaguucuca

SEQ ID NO: 257769 - RNA, 19 nt, Homo sapiens
aggagggccuggugcauaa

SEQ ID NO: 257770 - RNA, 19 nt, Homo sapiens
agagggagcuccugaacca

SEQ ID NO: 257771 - RNA, 19 nt, Homo sapiens
ggaaguguaccaccuccaa

SEQ ID NO: 257772 - RNA, 19 nt, Homo sapiens
gaacaugggaaguguacca

SEQ ID NO: 257773 - RNA, 19 nt, Homo sapiens
uguugcagcucaugaagaa

SEQ ID NO: 257774 - RNA, 19 nt, Homo sapiens
gggagagcaccuuaauauu

SEQ ID NO: 257775 - RNA, 19 nt, Homo sapiens
acaagaagagcuuugagaa

SEQ ID NO: 257776 - RNA, 19 nt, Homo sapiens
gaaguguaccaccuccaaa

SEQ ID NO: 257777 - RNA, 19 nt, Homo sapiens
cgaggacccugguuacucu

SEQ ID NO: 257778 - RNA, 19 nt, Homo sapiens
acagugagguggacaaggu

SEQ ID NO: 257779 - RNA, 19 nt, Homo sapiens
aagaacagcuucaauaacc

SEQ ID NO: 257780 - RNA, 19 nt, Homo sapiens
aagaaagggcucucaaaga

SEQ ID NO: 257781 - RNA, 19 nt, Homo sapiens
ggcgucuccuucauguuua

SEQ ID NO: 257782 - RNA, 19 nt, Homo sapiens
ugcaaucacuguggaauau

SEQ ID NO: 257783 - RNA, 19 nt, Homo sapiens
uagagagccuggugcugaa

SEQ ID NO: 257784 - RNA, 19 nt, Homo sapiens
gaaauccuacccugaaacu

SEQ ID NO: 257785 - RNA, 19 nt, Homo sapiens
agggagagcaccuuaauau

SEQ ID NO: 257786 - RNA, 19 nt, Homo sapiens
aaccaauucuggcugauau

SEQ ID NO: 257787 - RNA, 19 nt, Homo sapiens
ugaacuacaucagcaggaa

SEQ ID NO: 257788 - RNA, 19 nt, Homo sapiens
ccaaguucuucaucgaguu

SEQ ID NO: 257789 - RNA, 19 nt, Homo sapiens
gagcaucgaggccauugug

SEQ ID NO: 257790 - RNA, 19 nt, Homo sapiens
uggaaauccuacccugaaa

SEQ ID NO: 257791 - RNA, 19 nt, Homo sapiens
guggaaauccuacccugaa

SEQ ID NO: 257792 - RNA, 19 nt, Homo sapiens
gggagaagcacaaggucuu

SEQ ID NO: 257793 - RNA, 19 nt, Homo sapiens
cauuuggcuuugugaauug

SEQ ID NO: 257794 - RNA, 19 nt, Homo sapiens
gcgaguggcuggaccuacu

SEQ ID NO: 257795 - RNA, 19 nt, Homo sapiens
gaggugaagcuagauguga

SEQ ID NO: 257796 - RNA, 19 nt, Homo sapiens
gggagcuccugaaccagaa

SEQ ID NO: 257797 - RNA, 19 nt, Homo sapiens
gcaagccagccuucacaga

SEQ ID NO: 257798 - RNA, 19 nt, Homo sapiens
uaucagaggcuccaugaag

SEQ ID NO: 257799 - RNA, 19 nt, Homo sapiens
gugcacacguaucgcauuc

SEQ ID NO: 257800 - RNA, 19 nt, Homo sapiens
gaauacaagaagagcuuug

SEQ ID NO: 257801 - RNA, 19 nt, Homo sapiens
cauccugguucacaucgaa

SEQ ID NO: 257802 - RNA, 19 nt, Homo sapiens
ugggugaccugaccaagau

SEQ ID NO: 257803 - RNA, 19 nt, Homo sapiens
cagcacggcccaacaguuc

SEQ ID NO: 257804 - RNA, 19 nt, Homo sapiens
cgacaugaucucagucuuc

SEQ ID NO: 257805 - RNA, 19 nt, Homo sapiens
ggacuucaucuuugucagu

SEQ ID NO: 257806 - RNA, 19 nt, Homo sapiens
caguaucucucugccuauu

SEQ ID NO: 257807 - RNA, 19 nt, Homo sapiens
agaacaaaguggccauuac

SEQ ID NO: 257808 - RNA, 19 nt, Homo sapiens
gaacauaggacgacaguua

SEQ ID NO: 257809 - RNA, 19 nt, Homo sapiens
uaacaaacaugaaguaugg

SEQ ID NO: 257810 - RNA, 19 nt, Homo sapiens
caugaaguaugguguaaua

SEQ ID NO: 257811 - RNA, 19 nt, Homo sapiens
gguggcagcuucccaagua

SEQ ID NO: 257812 - RNA, 19 nt, Homo sapiens
gaaguaugguguaauagga

SEQ ID NO: 257813 - RNA, 19 nt, Homo sapiens
gguggagaaugaugacuua

SEQ ID NO: 257814 - RNA, 19 nt, Homo sapiens
guucuuggcucccuuguau

SEQ ID NO: 257815 - RNA, 19 nt, Homo sapiens
aaauagggcuguguuuaaa

SEQ ID NO: 257816 - RNA, 19 nt, Homo sapiens
guagguugauggugcuuaa

SEQ ID NO: 257817 - RNA, 19 nt, Homo sapiens
caaaggagguagguugaug

SEQ ID NO: 257818 - RNA, 19 nt, Homo sapiens
auagggagguggagaauga

SEQ ID NO: 257819 - RNA, 19 nt, Homo sapiens
ccacgccagugcuaaauug

SEQ ID NO: 257820 - RNA, 19 nt, Homo sapiens
caaguugccauauuucaaa

SEQ ID NO: 257821 - RNA, 19 nt, Homo sapiens
gacuguggauuaugacaaa

SEQ ID NO: 257822 - RNA, 19 nt, Homo sapiens
guacaaaugacuccuggaa

SEQ ID NO: 257823 - RNA, 19 nt, Homo sapiens
ccaaguauucgauuucauu

SEQ ID NO: 257824 - RNA, 19 nt, Homo sapiens
gaacuaagacucaauuacc

SEQ ID NO: 257825 - RNA, 19 nt, Homo sapiens
caaggaagauuuuggaaga

SEQ ID NO: 257826 - RNA, 19 nt, Homo sapiens
auaauggugucuaucagua

SEQ ID NO: 257827 - RNA, 19 nt, Homo sapiens
ggacgacaguuagcuaugg

SEQ ID NO: 257828 - RNA, 19 nt, Homo sapiens
ccacaaauuuaagagagaa

SEQ ID NO: 257829 - RNA, 19 nt, Homo sapiens
cgcaguuucucguguauaa

SEQ ID NO: 257830 - RNA, 19 nt, Homo sapiens
ggagaaccccacaaauuua

SEQ ID NO: 257831 - RNA, 19 nt, Homo sapiens
gaaaagccccauagugauu

SEQ ID NO: 257832 - RNA, 19 nt, Homo sapiens
ccagauuuccucuauauuc

SEQ ID NO: 257833 - RNA, 19 nt, Homo sapiens
ccauagugauugagucuuc

SEQ ID NO: 257834 - RNA, 19 nt, Homo sapiens
aaacaugaaguauggugua

SEQ ID NO: 257835 - RNA, 19 nt, Homo sapiens
acaaaugacuccuggaaaa

SEQ ID NO: 257836 - RNA, 19 nt, Homo sapiens
aauggugucuaucaguaua

SEQ ID NO: 257837 - RNA, 19 nt, Homo sapiens
cgauuucauucaugugauu

SEQ ID NO: 257838 - RNA, 19 nt, Homo sapiens
aaugaugacuuacccugaa

SEQ ID NO: 257839 - RNA, 19 nt, Homo sapiens
ugauggugcuuaacaaaca

SEQ ID NO: 257840 - RNA, 19 nt, Homo sapiens
gauuuccucuauauucguu

SEQ ID NO: 257841 - RNA, 19 nt, Homo sapiens
ggccuuugguggacauuug

SEQ ID NO: 257842 - RNA, 19 nt, Homo sapiens
gggagaugaucaacguuuc

SEQ ID NO: 257843 - RNA, 19 nt, Homo sapiens
gcuuaacaaacaugaagua

SEQ ID NO: 257844 - RNA, 19 nt, Homo sapiens
gggcugacuguacaaauga

SEQ ID NO: 257845 - RNA, 19 nt, Homo sapiens
cagcuguccuugacuuuag

SEQ ID NO: 257846 - RNA, 19 nt, Homo sapiens
ggccgugacuccuccuuuc

SEQ ID NO: 257847 - RNA, 19 nt, Homo sapiens
uuggcucccuuguauauuu

SEQ ID NO: 257848 - RNA, 19 nt, Homo sapiens
uaaccacgccagugcuaaa

SEQ ID NO: 257849 - RNA, 19 nt, Homo sapiens
acaguuagcuauggguguu

SEQ ID NO: 257850 - RNA, 19 nt, Homo sapiens
ccaggaagcgccucuugga

SEQ ID NO: 257851 - RNA, 19 nt, Homo sapiens
gguugauggugcuuaacaa

SEQ ID NO: 257852 - RNA, 19 nt, Homo sapiens
cgggcugacuguacaaaug

SEQ ID NO: 257853 - RNA, 19 nt, Homo sapiens
cccaacaccuggcaucauc

SEQ ID NO: 257854 - RNA, 19 nt, Homo sapiens
aaaauagggcuguguuuaa

SEQ ID NO: 257855 - RNA, 19 nt, Homo sapiens
gaauagggagguggagaau

SEQ ID NO: 257856 - RNA, 19 nt, Homo sapiens
gcuauggguguuccugaaa

SEQ ID NO: 257857 - RNA, 19 nt, Homo sapiens
ugugaccgaugcccagauu

SEQ ID NO: 257858 - RNA, 19 nt, Homo sapiens
ccagcuguccuugacuuua

SEQ ID NO: 257859 - RNA, 19 nt, Homo sapiens
aacaugaaguaugguguaa

SEQ ID NO: 257860 - RNA, 19 nt, Homo sapiens
guauucgauuucauucaug

SEQ ID NO: 257861 - RNA, 19 nt, Homo sapiens
cagauuuccucuauauucg

SEQ ID NO: 257862 - RNA, 19 nt, Homo sapiens
aaacaaguugccauauuuc

SEQ ID NO: 257863 - RNA, 19 nt, Homo sapiens
agaaugggccagugucaug

SEQ ID NO: 257864 - RNA, 19 nt, Homo sapiens
gagaaccccacaaauuuaa

SEQ ID NO: 257865 - RNA, 19 nt, Homo sapiens
guccagcuguccuugacuu

SEQ ID NO: 257866 - RNA, 19 nt, Homo sapiens
gauggugcuuaacaaacau

SEQ ID NO: 257867 - RNA, 19 nt, Homo sapiens
guauaauggugucuaucag

SEQ ID NO: 257868 - RNA, 19 nt, Homo sapiens
cggagaaccccacaaauuu

SEQ ID NO: 257869 - RNA, 19 nt, Homo sapiens
cuacgcugaucacgcaguu

SEQ ID NO: 257870 - RNA, 19 nt, Homo sapiens
gacuuuagcagcccuaucu

SEQ ID NO: 257871 - RNA, 19 nt, Homo sapiens
guugauggugcuuaacaaa

SEQ ID NO: 257872 - RNA, 19 nt, Homo sapiens
ucugugcccuggagcauuc

SEQ ID NO: 257873 - RNA, 19 nt, Homo sapiens
cgacagucaccucggagaa

SEQ ID NO: 257874 - RNA, 19 nt, Homo sapiens
uguauaauggugucuauca

SEQ ID NO: 257875 - RNA, 19 nt, Homo sapiens
caaguauucgauuucauuc

SEQ ID NO: 257876 - RNA, 19 nt, Homo sapiens
gggagguggagaaugauga

SEQ ID NO: 257877 - RNA, 19 nt, Homo sapiens
cguguauaauggugucuau

SEQ ID NO: 257878 - RNA, 19 nt, Homo sapiens
cuucccaaguauucgauuu

SEQ ID NO: 257879 - RNA, 19 nt, Homo sapiens
ccagauugcacgaccacuu

SEQ ID NO: 257880 - RNA, 19 nt, Homo sapiens
cccacaaauuuaagagaga

SEQ ID NO: 257881 - RNA, 19 nt, Homo sapiens
agaauagggagguggagaa

SEQ ID NO: 257882 - RNA, 19 nt, Homo sapiens
cugcagauccagaggaaug

SEQ ID NO: 257883 - RNA, 19 nt, Homo sapiens
acaaguugccauauuucaa

SEQ ID NO: 257884 - RNA, 19 nt, Homo sapiens
cugaaaagccccauaguga

SEQ ID NO: 257885 - RNA, 19 nt, Homo sapiens
caguuucucguguauaaug

SEQ ID NO: 257886 - RNA, 19 nt, Homo sapiens
uuuagcagcccuaucuuug

SEQ ID NO: 257887 - RNA, 19 nt, Homo sapiens
cagauugcacgaccacuuc

SEQ ID NO: 257888 - RNA, 19 nt, Homo sapiens
cgccagugcuaaauuggau

SEQ ID NO: 257889 - RNA, 19 nt, Homo sapiens
uuugaucguuccagaagug

SEQ ID NO: 257890 - RNA, 19 nt, Homo sapiens
uacaaaugacuccuggaaa

SEQ ID NO: 257891 - RNA, 19 nt, Homo sapiens
ugaaguaugguguaauagg

SEQ ID NO: 257892 - RNA, 19 nt, Homo sapiens
gugcuuaacaaacaugaag

SEQ ID NO: 257893 - RNA, 19 nt, Homo sapiens
caaauuuaagagagaaugg

SEQ ID NO: 257894 - RNA, 19 nt, Homo sapiens
cauagugauugagucuuca

SEQ ID NO: 257895 - RNA, 19 nt, Homo sapiens
gggaacauaggacgacagu

SEQ ID NO: 257896 - RNA, 19 nt, Homo sapiens
gaggaaugucacucucuuc

SEQ ID NO: 257897 - RNA, 19 nt, Homo sapiens
uaauggugucuaucaguau

SEQ ID NO: 257898 - RNA, 19 nt, Homo sapiens
gacccucugucccuacuga

SEQ ID NO: 257899 - RNA, 19 nt, Homo sapiens
agagaugcgugagaaguug

SEQ ID NO: 257900 - RNA, 19 nt, Homo sapiens
cagagaugcgugagaaguu

SEQ ID NO: 257901 - RNA, 19 nt, Homo sapiens
gugcggccaccacuucgua

SEQ ID NO: 257902 - RNA, 19 nt, Homo sapiens
ccagaccucucaccaucac

SEQ ID NO: 257903 - RNA, 19 nt, Homo sapiens
ccagagaugcgugagaagu

SEQ ID NO: 257904 - RNA, 19 nt, Homo sapiens
cagcaagucucuaaagaaa

SEQ ID NO: 257905 - RNA, 19 nt, Homo sapiens
gaaaacacuugcugucaua

SEQ ID NO: 257906 - RNA, 19 nt, Homo sapiens
ggacaagccuuagguacga

SEQ ID NO: 257907 - RNA, 19 nt, Homo sapiens
gcaagucucuaaagaaagg

SEQ ID NO: 257908 - RNA, 19 nt, Homo sapiens
ucacagauuugauccauuc

SEQ ID NO: 257909 - RNA, 19 nt, Homo sapiens
gaaguggacgucacagauu

SEQ ID NO: 257910 - RNA, 19 nt, Homo sapiens
ccaaagaaauggugucaac

SEQ ID NO: 257911 - RNA, 19 nt, Homo sapiens
gggcagccaucauugaaga

SEQ ID NO: 257912 - RNA, 19 nt, Homo sapiens
gaggguggcugcuggaauc

SEQ ID NO: 257913 - RNA, 19 nt, Homo sapiens
gaagggcagccaucauuga

SEQ ID NO: 257914 - RNA, 19 nt, Homo sapiens
gaagaaaccacugucugaa

SEQ ID NO: 257915 - RNA, 19 nt, Homo sapiens
caaagauggacaagccuua

SEQ ID NO: 257916 - RNA, 19 nt, Homo sapiens
gcagcaagucucuaaagaa

SEQ ID NO: 257917 - RNA, 19 nt, Homo sapiens
ucacugaugcccaauuaaa

SEQ ID NO: 257918 - RNA, 19 nt, Homo sapiens
aauaauacuuucccgcaaa

SEQ ID NO: 257919 - RNA, 19 nt, Homo sapiens
ugaagaaaccacugucuga

SEQ ID NO: 257920 - RNA, 19 nt, Homo sapiens
caucucauccauucucaua

SEQ ID NO: 257921 - RNA, 19 nt, Homo sapiens
guugugaaguaauuuguga

SEQ ID NO: 257922 - RNA, 19 nt, Homo sapiens
gguccuaucugccagcaau

SEQ ID NO: 257923 - RNA, 19 nt, Homo sapiens
guacauaguagaguaauca

SEQ ID NO: 257924 - RNA, 19 nt, Homo sapiens
ugaaguaauuugugacgau

SEQ ID NO: 257925 - RNA, 19 nt, Homo sapiens
gaugcccaauuaaaugauu

SEQ ID NO: 257926 - RNA, 19 nt, Homo sapiens
gauuugauccauucuguug

SEQ ID NO: 257927 - RNA, 19 nt, Homo sapiens
cauccauucucauauguau

SEQ ID NO: 257928 - RNA, 19 nt, Homo sapiens
ggacgucacagauuugauc

SEQ ID NO: 257929 - RNA, 19 nt, Homo sapiens
auucacugaugcccaauua

SEQ ID NO: 257930 - RNA, 19 nt, Homo sapiens
caccagagcugaagaaacc

SEQ ID NO: 257931 - RNA, 19 nt, Homo sapiens
ucucauccauucucauaug

SEQ ID NO: 257932 - RNA, 19 nt, Homo sapiens
uccauucuguugugaagua

SEQ ID NO: 257933 - RNA, 19 nt, Homo sapiens
ggacacaccagcacagucu

SEQ ID NO: 257934 - RNA, 19 nt, Homo sapiens
caacaacaaagauggacaa

SEQ ID NO: 257935 - RNA, 19 nt, Homo sapiens
gauccauucuguugugaag

SEQ ID NO: 257936 - RNA, 19 nt, Homo sapiens
ugagccaacuccuuagaga

SEQ ID NO: 257937 - RNA, 19 nt, Homo sapiens
cugcugagccaacuccuua

SEQ ID NO: 257938 - RNA, 19 nt, Homo sapiens
aaugacaaauucacugaug

SEQ ID NO: 257939 - RNA, 19 nt, Homo sapiens
ggacaucucauccauucuc

SEQ ID NO: 257940 - RNA, 19 nt, Homo sapiens
aaguggacgucacagauuu

SEQ ID NO: 257941 - RNA, 19 nt, Homo sapiens
gguacgacaucagaauuca

SEQ ID NO: 257942 - RNA, 19 nt, Homo sapiens
aacacuugcugucauauug

SEQ ID NO: 257943 - RNA, 19 nt, Homo sapiens
ggaaaacacuugcugucau

SEQ ID NO: 257944 - RNA, 19 nt, Homo sapiens
ucaaugacaaauucacuga

SEQ ID NO: 257945 - RNA, 19 nt, Homo sapiens
gauggacaagccuuaggua

SEQ ID NO: 257946 - RNA, 19 nt, Homo sapiens
gagaaguggacgucacaga

SEQ ID NO: 257947 - RNA, 19 nt, Homo sapiens
caaccuccaacaacaaaga

SEQ ID NO: 257948 - RNA, 19 nt, Homo sapiens
gcugagaacacccagaaca

SEQ ID NO: 257949 - RNA, 19 nt, Homo sapiens
gagccaacuccuuagagaa

SEQ ID NO: 257950 - RNA, 19 nt, Homo sapiens
gcagccaucauugaagaaa

SEQ ID NO: 257951 - RNA, 19 nt, Homo sapiens
aaacacuugcugucauauu

SEQ ID NO: 257952 - RNA, 19 nt, Homo sapiens
gacaucucauccauucuca

SEQ ID NO: 257953 - RNA, 19 nt, Homo sapiens
aaagaaaggcugagaacac

SEQ ID NO: 257954 - RNA, 19 nt, Homo sapiens
cugaagggcagccaucauu

SEQ ID NO: 257955 - RNA, 19 nt, Homo sapiens
gagcugaagaaaccacugu

SEQ ID NO: 257956 - RNA, 19 nt, Homo sapiens
uacagcagcaagucucuaa

SEQ ID NO: 257957 - RNA, 19 nt, Homo sapiens
cgucacagauuugauccau

SEQ ID NO: 257958 - RNA, 19 nt, Homo sapiens
uacgacaucagaauucauu

SEQ ID NO: 257959 - RNA, 19 nt, Homo sapiens
gugucaaccuccaacaaca

SEQ ID NO: 257960 - RNA, 19 nt, Homo sapiens
ugaagggcagccaucauug

SEQ ID NO: 257961 - RNA, 19 nt, Homo sapiens
agccaacuccuuagagaaa

SEQ ID NO: 257962 - RNA, 19 nt, Homo sapiens
agcagcaagucucuaaaga

SEQ ID NO: 257963 - RNA, 19 nt, Homo sapiens
uaaagaaaggcugagaaca

SEQ ID NO: 257964 - RNA, 19 nt, Homo sapiens
agaaguggacgucacagau

SEQ ID NO: 257965 - RNA, 19 nt, Homo sapiens
cagcagcaagucucuaaag

SEQ ID NO: 257966 - RNA, 19 nt, Homo sapiens
uagguacgacaucagaauu

SEQ ID NO: 257967 - RNA, 19 nt, Homo sapiens
cuaaagaaaggcugagaac

SEQ ID NO: 257968 - RNA, 19 nt, Homo sapiens
ccauucuguugugaaguaa

SEQ ID NO: 257969 - RNA, 19 nt, Homo sapiens
gucaaccuccaacaacaaa

SEQ ID NO: 257970 - RNA, 19 nt, Homo sapiens
ggaggguggcugcuggaau

SEQ ID NO: 257971 - RNA, 19 nt, Homo sapiens
gcugagccaacuccuuaga

SEQ ID NO: 257972 - RNA, 19 nt, Homo sapiens
aguaauuugugacgaugga

SEQ ID NO: 257973 - RNA, 19 nt, Homo sapiens
cugaugcccaauuaaauga

SEQ ID NO: 257974 - RNA, 19 nt, Homo sapiens
gaucaucuuuguugaggua

SEQ ID NO: 257975 - RNA, 19 nt, Homo sapiens
ucaguucccucuaaaugua

SEQ ID NO: 257976 - RNA, 19 nt, Homo sapiens
acagacaaccuaucauuua

SEQ ID NO: 257977 - RNA, 19 nt, Homo sapiens
aaagggaucugcuuaaagu

SEQ ID NO: 257978 - RNA, 19 nt, Homo sapiens
caauagaacuguuucaacu

SEQ ID NO: 257979 - RNA, 19 nt, Homo sapiens
caaaugccuugaacuguug

SEQ ID NO: 257980 - RNA, 19 nt, Homo sapiens
cgacagcucuuacuuuuaa

SEQ ID NO: 257981 - RNA, 19 nt, Homo sapiens
gacaaccuaucauuuauuc

SEQ ID NO: 257982 - RNA, 19 nt, Homo sapiens
acaaaugccuugaacuguu

SEQ ID NO: 257983 - RNA, 19 nt, Homo sapiens
acgauuagcuuuauuaugg

SEQ ID NO: 257984 - RNA, 19 nt, Homo sapiens
cuaaagggaucugcuuaaa

SEQ ID NO: 257985 - RNA, 19 nt, Homo sapiens
gaacuguugucugggauug

SEQ ID NO: 257986 - RNA, 19 nt, Homo sapiens
cagacaaccuaucauuuau

SEQ ID NO: 257987 - RNA, 19 nt, Homo sapiens
gacuaucaguucccucuaa

SEQ ID NO: 257988 - RNA, 19 nt, Homo sapiens
gaacuucccacacgauuag

SEQ ID NO: 257989 - RNA, 19 nt, Homo sapiens
cgaagaugcuguaguaacu

SEQ ID NO: 257990 - RNA, 19 nt, Homo sapiens
gaagggaguguuccgaaga

SEQ ID NO: 257991 - RNA, 19 nt, Homo sapiens
gagucagucucuuucugua

SEQ ID NO: 257992 - RNA, 19 nt, Homo sapiens
guacaaccgacagcucuua

SEQ ID NO: 257993 - RNA, 19 nt, Homo sapiens
uuccgaagaugcuguagua

SEQ ID NO: 257994 - RNA, 19 nt, Homo sapiens
gagagucguucgccagcaa

SEQ ID NO: 257995 - RNA, 19 nt, Homo sapiens
gaacuguuucaacuguaua

SEQ ID NO: 257996 - RNA, 19 nt, Homo sapiens
ccacaaaugccuugaacug

SEQ ID NO: 257997 - RNA, 19 nt, Homo sapiens
uauuauggcuugugaacug

SEQ ID NO: 257998 - RNA, 19 nt, Homo sapiens
aaucucugcucucuaugua

SEQ ID NO: 257999 - RNA, 19 nt, Homo sapiens
ccacacgauuagcuuuauu

SEQ ID NO: 258000 - RNA, 19 nt, Homo sapiens
auaccuaucugagugaauu

SEQ ID NO: 258001 - RNA, 19 nt, Homo sapiens
caacaggagucagucucuu

SEQ ID NO: 258002 - RNA, 19 nt, Homo sapiens
uuacagacaaccuaucauu

SEQ ID NO: 258003 - RNA, 19 nt, Homo sapiens
gagguaggacuaucaguuc

SEQ ID NO: 258004 - RNA, 19 nt, Homo sapiens
caaccuaucauuuauucug

SEQ ID NO: 258005 - RNA, 19 nt, Homo sapiens
gguuugaucaucuuuguug

SEQ ID NO: 258006 - RNA, 19 nt, Homo sapiens
ggagucagucucuuucugu

SEQ ID NO: 258007 - RNA, 19 nt, Homo sapiens
accaaucucugcucucuau

SEQ ID NO: 258008 - RNA, 19 nt, Homo sapiens
gacauuccacugugcguuu

SEQ ID NO: 258009 - RNA, 19 nt, Homo sapiens
uaucaguucccucuaaaug

SEQ ID NO: 258010 - RNA, 19 nt, Homo sapiens
gcuuggagacccacaaaga

SEQ ID NO: 258011 - RNA, 19 nt, Homo sapiens
uagaacuguuucaacugua

SEQ ID NO: 258012 - RNA, 19 nt, Homo sapiens
auagaacuguuucaacugu

SEQ ID NO: 258013 - RNA, 19 nt, Homo sapiens
ggagucuggcuuuaccuuu

SEQ ID NO: 258014 - RNA, 19 nt, Homo sapiens
cacacgauuagcuuuauua

SEQ ID NO: 258015 - RNA, 19 nt, Homo sapiens
ucucugcucucuauguaug

SEQ ID NO: 258016 - RNA, 19 nt, Homo sapiens
gcuuuauuauggcuuguga

SEQ ID NO: 258017 - RNA, 19 nt, Homo sapiens
agaacuguuucaacuguau

SEQ ID NO: 258018 - RNA, 19 nt, Homo sapiens
gcaaucucuuuucuacaua

SEQ ID NO: 258019 - RNA, 19 nt, Homo sapiens
caaccgacagcucuuacuu

SEQ ID NO: 258020 - RNA, 19 nt, Homo sapiens
ugaacuucccacacgauua

SEQ ID NO: 258021 - RNA, 19 nt, Homo sapiens
ugagguaggacuaucaguu

SEQ ID NO: 258022 - RNA, 19 nt, Homo sapiens
gcuaguauucgcuguguuc

SEQ ID NO: 258023 - RNA, 19 nt, Homo sapiens
aguauucgcuguguucaug

SEQ ID NO: 258024 - RNA, 19 nt, Homo sapiens
gggaucugcuuaaaguuuu

SEQ ID NO: 258025 - RNA, 19 nt, Homo sapiens
ucuaaagggaucugcuuaa

SEQ ID NO: 258026 - RNA, 19 nt, Homo sapiens
gugaacaaaucaaauugcu

SEQ ID NO: 258027 - RNA, 19 nt, Homo sapiens
gaaaagcuguacgcguuug

SEQ ID NO: 258028 - RNA, 19 nt, Homo sapiens
uacagacaaccuaucauuu

SEQ ID NO: 258029 - RNA, 19 nt, Homo sapiens
gagucuggcuuuaccuuuu

SEQ ID NO: 258030 - RNA, 19 nt, Homo sapiens
gugaauuacagacaaccua

SEQ ID NO: 258031 - RNA, 19 nt, Homo sapiens
uaaagggaucugcuuaaag

SEQ ID NO: 258032 - RNA, 19 nt, Homo sapiens
acuaucaguucccucuaaa

SEQ ID NO: 258033 - RNA, 19 nt, Homo sapiens
gcacgagaagcacaaguac

SEQ ID NO: 258034 - RNA, 19 nt, Homo sapiens
gucagucucuuucuguaca

SEQ ID NO: 258035 - RNA, 19 nt, Homo sapiens
uagaaagcuucaauagaac

SEQ ID NO: 258036 - RNA, 19 nt, Homo sapiens
cuaccaaucucugcucucu

SEQ ID NO: 258037 - RNA, 19 nt, Homo sapiens
gugaagcgcagcaagaagu

SEQ ID NO: 258038 - RNA, 19 nt, Homo sapiens
gaaagcuucaauagaacug

SEQ ID NO: 258039 - RNA, 19 nt, Homo sapiens
acgagaagcacaaguacuu

SEQ ID NO: 258040 - RNA, 19 nt, Homo sapiens
ggacuaucaguucccucua

SEQ ID NO: 258041 - RNA, 19 nt, Homo sapiens
gcaucgugcguguggagua

SEQ ID NO: 258042 - RNA, 19 nt, Homo sapiens
ugaauuacagacaaccuau

SEQ ID NO: 258043 - RNA, 19 nt, Homo sapiens
ccucuaaauguauauguug

SEQ ID NO: 258044 - RNA, 19 nt, Homo sapiens
gcaacaggagucagucucu

SEQ ID NO: 258045 - RNA, 19 nt, Homo sapiens
cugagugaauuacagacaa

SEQ ID NO: 258046 - RNA, 19 nt, Homo sapiens
guguuucacguaagacuuu

SEQ ID NO: 258047 - RNA, 19 nt, Homo sapiens
cugcuggagucuggcuuua

SEQ ID NO: 258048 - RNA, 19 nt, Homo sapiens
aagcuucaauagaacuguu

SEQ ID NO: 258049 - RNA, 19 nt, Homo sapiens
gaauuacagacaaccuauc

SEQ ID NO: 258050 - RNA, 19 nt, Homo sapiens
agggaucugcuuaaaguuu

SEQ ID NO: 258051 - RNA, 19 nt, Homo sapiens
gaagaugcuguaguaacug

SEQ ID NO: 258052 - RNA, 19 nt, Homo sapiens
ggccuuacgcggcacauca

SEQ ID NO: 258053 - RNA, 19 nt, Homo sapiens
caucuuuguugagguagga

SEQ ID NO: 258054 - RNA, 19 nt, Homo sapiens
gccucaguguuucacguaa

SEQ ID NO: 258055 - RNA, 19 nt, Homo sapiens
ucacugcgccaagaaguuc

SEQ ID NO: 258056 - RNA, 19 nt, Homo sapiens
caaucucugcucucuaugu

SEQ ID NO: 258057 - RNA, 19 nt, Homo sapiens
ucaauagaacuguuucaac

SEQ ID NO: 258058 - RNA, 19 nt, Homo sapiens
guuugaucaucuuuguuga

SEQ ID NO: 258059 - RNA, 19 nt, Homo sapiens
ccuaucauuuauucugcuu

SEQ ID NO: 258060 - RNA, 19 nt, Homo sapiens
ugagugaauuacagacaac

SEQ ID NO: 258061 - RNA, 19 nt, Homo sapiens
ugccaucacugcgccaaga

SEQ ID NO: 258062 - RNA, 19 nt, Homo sapiens
aagggaguguuccgaagau

SEQ ID NO: 258063 - RNA, 19 nt, Homo sapiens
ucccacacgauuagcuuua

SEQ ID NO: 258064 - RNA, 19 nt, Homo sapiens
aaccgacagcucuuacuuu

SEQ ID NO: 258065 - RNA, 19 nt, Homo sapiens
uuacgcggcacaucaacaa

SEQ ID NO: 258066 - RNA, 19 nt, Homo sapiens
aacaggagucagucucuuu

SEQ ID NO: 258067 - RNA, 19 nt, Homo sapiens
ggaagacguuugaggauua

SEQ ID NO: 258068 - RNA, 19 nt, Homo sapiens
gaacaaggcucccgagagu

SEQ ID NO: 258069 - RNA, 19 nt, Homo sapiens
ggagagaccuuggaaauug

SEQ ID NO: 258070 - RNA, 19 nt, Homo sapiens
ggacggaacccaccuauuu

SEQ ID NO: 258071 - RNA, 19 nt, Homo sapiens
gaucacgacuguucuuuaa

SEQ ID NO: 258072 - RNA, 19 nt, Homo sapiens
gaacgauguuggacucaua

SEQ ID NO: 258073 - RNA, 19 nt, Homo sapiens
ggaaagaaagcaccuguuu

SEQ ID NO: 258074 - RNA, 19 nt, Homo sapiens
gaauugcucugucaucgaa

SEQ ID NO: 258075 - RNA, 19 nt, Homo sapiens
gcagaggauuuaacuguga

SEQ ID NO: 258076 - RNA, 19 nt, Homo sapiens
gaaacgacauugcccugaa

SEQ ID NO: 258077 - RNA, 19 nt, Homo sapiens
gaaggacacuugcagauac

SEQ ID NO: 258078 - RNA, 19 nt, Homo sapiens
guucagagaucguuccuau

SEQ ID NO: 258079 - RNA, 19 nt, Homo sapiens
ggccagaggcugagaauaa

SEQ ID NO: 258080 - RNA, 19 nt, Homo sapiens
gaagaacaaugagcucugu

SEQ ID NO: 258081 - RNA, 19 nt, Homo sapiens
aaacgaggcccgaagauuu

SEQ ID NO: 258082 - RNA, 19 nt, Homo sapiens
acaaugagcucuguuacuu

SEQ ID NO: 258083 - RNA, 19 nt, Homo sapiens
ugcaugagcuggagaauug

SEQ ID NO: 258084 - RNA, 19 nt, Homo sapiens
gaaauuucaggguaucuaa

SEQ ID NO: 258085 - RNA, 19 nt, Homo sapiens
ggacggugguagacauuga

SEQ ID NO: 258086 - RNA, 19 nt, Homo sapiens
gugaggagcuggagaugga

SEQ ID NO: 258087 - RNA, 19 nt, Homo sapiens
aaacucuucuuccacuaua

SEQ ID NO: 258088 - RNA, 19 nt, Homo sapiens
gauccaaucucagugucua

SEQ ID NO: 258089 - RNA, 19 nt, Homo sapiens
gaagaaauuucaggguauc

SEQ ID NO: 258090 - RNA, 19 nt, Homo sapiens
ggaacaaaauuucgaaaga

SEQ ID NO: 258091 - RNA, 19 nt, Homo sapiens
cuacgugacagacuauuua

SEQ ID NO: 258092 - RNA, 19 nt, Homo sapiens
ccaagagugacaucauuua

SEQ ID NO: 258093 - RNA, 19 nt, Homo sapiens
ggccaagagugacaucauu

SEQ ID NO: 258094 - RNA, 19 nt, Homo sapiens
gaggagagaccuuggaaau

SEQ ID NO: 258095 - RNA, 19 nt, Homo sapiens
gaaguuacgucugauucga

SEQ ID NO: 258096 - RNA, 19 nt, Homo sapiens
gggcaacgacgguuucaaa

SEQ ID NO: 258097 - RNA, 19 nt, Homo sapiens
gaucguuccuauacauuuc

SEQ ID NO: 258098 - RNA, 19 nt, Homo sapiens
cagauacucuugauguuca

SEQ ID NO: 258099 - RNA, 19 nt, Homo sapiens
caugaaaucuuugagaaca

SEQ ID NO: 258100 - RNA, 19 nt, Homo sapiens
gacccaguaugccaucuuu

SEQ ID NO: 258101 - RNA, 19 nt, Homo sapiens
ggaucacgacuguucuuua

SEQ ID NO: 258102 - RNA, 19 nt, Homo sapiens
ccagagacaucuaugaaac

SEQ ID NO: 258103 - RNA, 19 nt, Homo sapiens
gaccagagacaucuaugaa

SEQ ID NO: 258104 - RNA, 19 nt, Homo sapiens
uaacucaucaucccagauu

SEQ ID NO: 258105 - RNA, 19 nt, Homo sapiens
ugucagaaauccacaagau

SEQ ID NO: 258106 - RNA, 19 nt, Homo sapiens
gcaucgagaagaacaauga

SEQ ID NO: 258107 - RNA, 19 nt, Homo sapiens
cgaaggacacuugcagaua

SEQ ID NO: 258108 - RNA, 19 nt, Homo sapiens
gaaugcugcuccuguccaa

SEQ ID NO: 258109 - RNA, 19 nt, Homo sapiens
gaaacucuucuuccacuau

SEQ ID NO: 258110 - RNA, 19 nt, Homo sapiens
ucaaggaacucggccucua

SEQ ID NO: 258111 - RNA, 19 nt, Homo sapiens
gcauggauauccggaacaa

SEQ ID NO: 258112 - RNA, 19 nt, Homo sapiens
caaccuuccuggagauugu

SEQ ID NO: 258113 - RNA, 19 nt, Homo sapiens
gaugaacgccggaccuaug

SEQ ID NO: 258114 - RNA, 19 nt, Homo sapiens
caagauggaagaaguuuca

SEQ ID NO: 258115 - RNA, 19 nt, Homo sapiens
accaaggccugucuaauga

SEQ ID NO: 258116 - RNA, 19 nt, Homo sapiens
gcaggucccuuggcgaugu

SEQ ID NO: 258117 - RNA, 19 nt, Homo sapiens
acggagaccugaagagcua

SEQ ID NO: 258118 - RNA, 19 nt, Homo sapiens
gcacaggccuuuugagaag

SEQ ID NO: 258119 - RNA, 19 nt, Homo sapiens
cauagucacugccagaaag

SEQ ID NO: 258120 - RNA, 19 nt, Homo sapiens
gggcagggguucccauuuu

SEQ ID NO: 258121 - RNA, 19 nt, Homo sapiens
ugucauggauggaggguau

SEQ ID NO: 258122 - RNA, 19 nt, Homo sapiens
ucagauggcggcagagauu

SEQ ID NO: 258123 - RNA, 19 nt, Homo sapiens
cgcaugaaaucuuugagaa

SEQ ID NO: 258124 - RNA, 19 nt, Homo sapiens
caaggcugaugacauuguu

SEQ ID NO: 258125 - RNA, 19 nt, Homo sapiens
gcacaaccagagugaguau

SEQ ID NO: 258126 - RNA, 19 nt, Homo sapiens
uggauuccguggaggauaa

SEQ ID NO: 258127 - RNA, 19 nt, Homo sapiens
cccagcagauggaaagaaa

SEQ ID NO: 258128 - RNA, 19 nt, Homo sapiens
uaccaaggccugucuaaug

SEQ ID NO: 258129 - RNA, 19 nt, Homo sapiens
gccagaggcugagaauaau

SEQ ID NO: 258130 - RNA, 19 nt, Homo sapiens
gaagaaguuucaggaacca

SEQ ID NO: 258131 - RNA, 19 nt, Homo sapiens
gguccaauccuuccuaaca

SEQ ID NO: 258132 - RNA, 19 nt, Homo sapiens
ucucuucaguguugugauu

SEQ ID NO: 258133 - RNA, 19 nt, Homo sapiens
gcuggauuauugccucaaa

SEQ ID NO: 258134 - RNA, 19 nt, Homo sapiens
caagagugacaucauuuau

SEQ ID NO: 258135 - RNA, 19 nt, Homo sapiens
gggaacuacuccuucuaug

SEQ ID NO: 258136 - RNA, 19 nt, Homo sapiens
cgagaugguucaccucaag

SEQ ID NO: 258137 - RNA, 19 nt, Homo sapiens
gaaagaaagcaccuguuuu

SEQ ID NO: 258138 - RNA, 19 nt, Homo sapiens
ucagagaucguuccuauac

SEQ ID NO: 258139 - RNA, 19 nt, Homo sapiens
guugaaauuugucauggau

SEQ ID NO: 258140 - RNA, 19 nt, Homo sapiens
uugagaagguggugaacaa

SEQ ID NO: 258141 - RNA, 19 nt, Homo sapiens
gcagauacucuugauguuc

SEQ ID NO: 258142 - RNA, 19 nt, Homo sapiens
gagagaccuuggaaauugg

SEQ ID NO: 258143 - RNA, 19 nt, Homo sapiens
ucacgacuguucuuuaacu

SEQ ID NO: 258144 - RNA, 19 nt, Homo sapiens
ucuaugaaacggauuacua

SEQ ID NO: 258145 - RNA, 19 nt, Homo sapiens
gcuuuacgcuucuucaaac

SEQ ID NO: 258146 - RNA, 19 nt, Homo sapiens
agaagguggugaacaagga

SEQ ID NO: 258147 - RNA, 19 nt, Homo sapiens
caaccucggccucauugaa

SEQ ID NO: 258148 - RNA, 19 nt, Homo sapiens
gaugaauuccagcaacuug

SEQ ID NO: 258149 - RNA, 19 nt, Homo sapiens
ugugacgcaugaaaucuuu

SEQ ID NO: 258150 - RNA, 19 nt, Homo sapiens
gccaagagugacaucauuu

SEQ ID NO: 258151 - RNA, 19 nt, Homo sapiens
ggaucaacccgacaacugu

SEQ ID NO: 258152 - RNA, 19 nt, Homo sapiens
agagaucguuccuauacau

SEQ ID NO: 258153 - RNA, 19 nt, Homo sapiens
ggaaugaccagagacaucu

SEQ ID NO: 258154 - RNA, 19 nt, Homo sapiens
gaagagcuaccuccguucu

SEQ ID NO: 258155 - RNA, 19 nt, Homo sapiens
agaaagaggcagccagaug

SEQ ID NO: 258156 - RNA, 19 nt, Homo sapiens
gaagacguuugaggauuac

SEQ ID NO: 258157 - RNA, 19 nt, Homo sapiens
ccaaagacagacucucaga

SEQ ID NO: 258158 - RNA, 19 nt, Homo sapiens
cagaggauuuaacugugaa

SEQ ID NO: 258159 - RNA, 19 nt, Homo sapiens
ucucacgacucuaccaugu

SEQ ID NO: 258160 - RNA, 19 nt, Homo sapiens
acaaggcucccgagaguga

SEQ ID NO: 258161 - RNA, 19 nt, Homo sapiens
aaagacagacucucagauc

SEQ ID NO: 258162 - RNA, 19 nt, Homo sapiens
ccacaagauggaagaaguu

SEQ ID NO: 258163 - RNA, 19 nt, Homo sapiens
ucuacaaccugaugaacau

SEQ ID NO: 258164 - RNA, 19 nt, Homo sapiens
aagguggacucguuugguu

SEQ ID NO: 258165 - RNA, 19 nt, Homo sapiens
gaaagccucuggaaaacuc

SEQ ID NO: 258166 - RNA, 19 nt, Homo sapiens
acgaggaacacaucccuua

SEQ ID NO: 258167 - RNA, 19 nt, Homo sapiens
gaacaugacuccagaagaa

SEQ ID NO: 258168 - RNA, 19 nt, Homo sapiens
gcagauaaauugaacauga

SEQ ID NO: 258169 - RNA, 19 nt, Homo sapiens
gcugaaagguggauuguaa

SEQ ID NO: 258170 - RNA, 19 nt, Homo sapiens
uaaauuaggucaugugguu

SEQ ID NO: 258171 - RNA, 19 nt, Homo sapiens
ggaaacaacauauuacgua

SEQ ID NO: 258172 - RNA, 19 nt, Homo sapiens
gcaggaauauuuagauaca

SEQ ID NO: 258173 - RNA, 19 nt, Homo sapiens
gagaagaaacuuaaucaga

SEQ ID NO: 258174 - RNA, 19 nt, Homo sapiens
ggaagaccuuacacgguua

SEQ ID NO: 258175 - RNA, 19 nt, Homo sapiens
gcuggccucugaaaucuua

SEQ ID NO: 258176 - RNA, 19 nt, Homo sapiens
aaucagugcuugugaauga

SEQ ID NO: 258177 - RNA, 19 nt, Homo sapiens
uuauugaccucuuccuuua

SEQ ID NO: 258178 - RNA, 19 nt, Homo sapiens
guaggaugcucuuugacua

SEQ ID NO: 258179 - RNA, 19 nt, Homo sapiens
cuacagcagucauaacaaa

SEQ ID NO: 258180 - RNA, 19 nt, Homo sapiens
aaaggucgcgauaauauua

SEQ ID NO: 258181 - RNA, 19 nt, Homo sapiens
ccaugaauauugagaagaa

SEQ ID NO: 258182 - RNA, 19 nt, Homo sapiens
gaaacagaaccaauuguga

SEQ ID NO: 258183 - RNA, 19 nt, Homo sapiens
caacagauagaaaugcuuu

SEQ ID NO: 258184 - RNA, 19 nt, Homo sapiens
gcccgucucuucauauuug

SEQ ID NO: 258185 - RNA, 19 nt, Homo sapiens
ccaaaggucgcgauaauau

SEQ ID NO: 258186 - RNA, 19 nt, Homo sapiens
gcagaaacagaaccaauug

SEQ ID NO: 258187 - RNA, 19 nt, Homo sapiens
uggcuugucuugaggauuu

SEQ ID NO: 258188 - RNA, 19 nt, Homo sapiens
caacaggagucuuacacau

SEQ ID NO: 258189 - RNA, 19 nt, Homo sapiens
gauacacucuacagauaug

SEQ ID NO: 258190 - RNA, 19 nt, Homo sapiens
ggaucggcaucuagucuuu

SEQ ID NO: 258191 - RNA, 19 nt, Homo sapiens
cagagaacauggcucauuc

SEQ ID NO: 258192 - RNA, 19 nt, Homo sapiens
gcagagaacauggcucauu

SEQ ID NO: 258193 - RNA, 19 nt, Homo sapiens
ggaaagcuggccucugaaa

SEQ ID NO: 258194 - RNA, 19 nt, Homo sapiens
gaaagguggauuguaaauu

SEQ ID NO: 258195 - RNA, 19 nt, Homo sapiens
acaggagucuuacacauau

SEQ ID NO: 258196 - RNA, 19 nt, Homo sapiens
uauaaagggugacuuacau

SEQ ID NO: 258197 - RNA, 19 nt, Homo sapiens
gagcagcagaauaucuuua

SEQ ID NO: 258198 - RNA, 19 nt, Homo sapiens
gaagauguuugaagaucca

SEQ ID NO: 258199 - RNA, 19 nt, Homo sapiens
aaacagaaccaauugugaa

SEQ ID NO: 258200 - RNA, 19 nt, Homo sapiens
gaauuucucucuguaaagg

SEQ ID NO: 258201 - RNA, 19 nt, Homo sapiens
ggggaaagcuggccucuga

SEQ ID NO: 258202 - RNA, 19 nt, Homo sapiens
uaaagggugacuuacauuu

SEQ ID NO: 258203 - RNA, 19 nt, Homo sapiens
uaucagccacaauaucuua

SEQ ID NO: 258204 - RNA, 19 nt, Homo sapiens
gauucuggcuucuacugaa

SEQ ID NO: 258205 - RNA, 19 nt, Homo sapiens
aauuggaccuucuuaguga

SEQ ID NO: 258206 - RNA, 19 nt, Homo sapiens
cauguuggcagauaaauug

SEQ ID NO: 258207 - RNA, 19 nt, Homo sapiens
aggcaggaauauuuagaua

SEQ ID NO: 258208 - RNA, 19 nt, Homo sapiens
ggucagaggcuccuaacug

SEQ ID NO: 258209 - RNA, 19 nt, Homo sapiens
ucacuggucucuguuuguu

SEQ ID NO: 258210 - RNA, 19 nt, Homo sapiens
guacgaaugugggaauuac

SEQ ID NO: 258211 - RNA, 19 nt, Homo sapiens
cuacagauaugcaaaauuc

SEQ ID NO: 258212 - RNA, 19 nt, Homo sapiens
gaagauccagaaacuacaa

SEQ ID NO: 258213 - RNA, 19 nt, Homo sapiens
gugaaucagugcuugugaa

SEQ ID NO: 258214 - RNA, 19 nt, Homo sapiens
gaaacagcuucaggcagaa

SEQ ID NO: 258215 - RNA, 19 nt, Homo sapiens
augccaagauugauucuaa

SEQ ID NO: 258216 - RNA, 19 nt, Homo sapiens
gaaccaauugugaagaugu

SEQ ID NO: 258217 - RNA, 19 nt, Homo sapiens
cagaaccaauugugaagau

SEQ ID NO: 258218 - RNA, 19 nt, Homo sapiens
uaaauuggaccuucuuagu

SEQ ID NO: 258219 - RNA, 19 nt, Homo sapiens
gugaagauguuugaagauc

SEQ ID NO: 258220 - RNA, 19 nt, Homo sapiens
ggcagaaacagaaccaauu

SEQ ID NO: 258221 - RNA, 19 nt, Homo sapiens
gaagaaccauaaagaaaag

SEQ ID NO: 258222 - RNA, 19 nt, Homo sapiens
uaacauguuggcagauaaa

SEQ ID NO: 258223 - RNA, 19 nt, Homo sapiens
uaucagcauuaacauguug

SEQ ID NO: 258224 - RNA, 19 nt, Homo sapiens
caaaggucgcgauaauauu

SEQ ID NO: 258225 - RNA, 19 nt, Homo sapiens
gaugguaggaugcucuuug

SEQ ID NO: 258226 - RNA, 19 nt, Homo sapiens
gaaacuacaaggcaaaugc

SEQ ID NO: 258227 - RNA, 19 nt, Homo sapiens
ugauauuccucaugcuuug

SEQ ID NO: 258228 - RNA, 19 nt, Homo sapiens
cugaagaaccauaaagaaa

SEQ ID NO: 258229 - RNA, 19 nt, Homo sapiens
aaaugcccgucucuucaua

SEQ ID NO: 258230 - RNA, 19 nt, Homo sapiens
gaaagcuggccucugaaau

SEQ ID NO: 258231 - RNA, 19 nt, Homo sapiens
gguaaauuggaccuucuua

SEQ ID NO: 258232 - RNA, 19 nt, Homo sapiens
auaaagacccaauuacaga

SEQ ID NO: 258233 - RNA, 19 nt, Homo sapiens
acacauucuucgcuauuug

SEQ ID NO: 258234 - RNA, 19 nt, Homo sapiens
gaagaccuuacacgguuaa

SEQ ID NO: 258235 - RNA, 19 nt, Homo sapiens
ucaagauucuggcuucuac

SEQ ID NO: 258236 - RNA, 19 nt, Homo sapiens
gauguuggccaugaauauu

SEQ ID NO: 258237 - RNA, 19 nt, Homo sapiens
aagacuggaugccaagauu

SEQ ID NO: 258238 - RNA, 19 nt, Homo sapiens
gaaaaugcccgucucuuca

SEQ ID NO: 258239 - RNA, 19 nt, Homo sapiens
gucaugugguuauggguaa

SEQ ID NO: 258240 - RNA, 19 nt, Homo sapiens
gaagcugaaagguggauug

SEQ ID NO: 258241 - RNA, 19 nt, Homo sapiens
guaucagcauuaacauguu

SEQ ID NO: 258242 - RNA, 19 nt, Homo sapiens
uaaagacccaauuacagaa

SEQ ID NO: 258243 - RNA, 19 nt, Homo sapiens
uuaacauguuggcagauaa

SEQ ID NO: 258244 - RNA, 19 nt, Homo sapiens
ugaaugacuucuucuuggu

SEQ ID NO: 258245 - RNA, 19 nt, Homo sapiens
gcugagggaaugugaauca

SEQ ID NO: 258246 - RNA, 19 nt, Homo sapiens
ccucugaaaucuuaaugca

SEQ ID NO: 258247 - RNA, 19 nt, Homo sapiens
caaggcaaaugcagucaac

SEQ ID NO: 258248 - RNA, 19 nt, Homo sapiens
uaacugggcaacucaagau

SEQ ID NO: 258249 - RNA, 19 nt, Homo sapiens
gcuugugaaugacuucuuc

SEQ ID NO: 258250 - RNA, 19 nt, Homo sapiens
cagcagucauaacaaacaa

SEQ ID NO: 258251 - RNA, 19 nt, Homo sapiens
ccacacauucuucgcuauu

SEQ ID NO: 258252 - RNA, 19 nt, Homo sapiens
cagccacaauaucuuaaug

SEQ ID NO: 258253 - RNA, 19 nt, Homo sapiens
gcaggucagaggcuccuaa

SEQ ID NO: 258254 - RNA, 19 nt, Homo sapiens
gcaagauggcggaguacga

SEQ ID NO: 258255 - RNA, 19 nt, Homo sapiens
caggagucuuacacauaua

SEQ ID NO: 258256 - RNA, 19 nt, Homo sapiens
aacaggagucuuacacaua

SEQ ID NO: 258257 - RNA, 19 nt, Homo sapiens
auucuucgcuauuugacua

SEQ ID NO: 258258 - RNA, 19 nt, Homo sapiens
gguagacuuugcuauggau

SEQ ID NO: 258259 - RNA, 19 nt, Homo sapiens
ccaccaguguaucagcauu

SEQ ID NO: 258260 - RNA, 19 nt, Homo sapiens
ggaaugugaaucagugcuu

SEQ ID NO: 258261 - RNA, 19 nt, Homo sapiens
uuauucaacaggagucuua

SEQ ID NO: 258262 - RNA, 19 nt, Homo sapiens
cacacauucuucgcuauuu

SEQ ID NO: 258263 - RNA, 19 nt, Homo sapiens
gaaaugcuuuaaguucacu

SEQ ID NO: 258264 - RNA, 19 nt, Homo sapiens
ucuuuccgcuucuugaauu

SEQ ID NO: 258265 - RNA, 19 nt, Homo sapiens
ggccaugaauauugagaag

SEQ ID NO: 258266 - RNA, 19 nt, Homo sapiens
caugguagacuuugcuaug

SEQ ID NO: 258267 - RNA, 19 nt, Homo sapiens
gaaaggaaauguuugaguu

SEQ ID NO: 258268 - RNA, 19 nt, Homo sapiens
gcacaucccugcccuccua

SEQ ID NO: 258269 - RNA, 19 nt, Homo sapiens
ucaaagaucccgugaaauu

SEQ ID NO: 258270 - RNA, 19 nt, Homo sapiens
ggagcuggcugucauguug

SEQ ID NO: 258271 - RNA, 19 nt, Homo sapiens
ccacgcagcuuuacaagga

SEQ ID NO: 258272 - RNA, 19 nt, Homo sapiens
caaagacaauggaaacugu

SEQ ID NO: 258273 - RNA, 19 nt, Homo sapiens
gcugucauguugaacuuga

SEQ ID NO: 258274 - RNA, 19 nt, Homo sapiens
aaagaucccgugaaauuga

SEQ ID NO: 258275 - RNA, 19 nt, Homo sapiens
gaaauugaugccaguggaa

SEQ ID NO: 258276 - RNA, 19 nt, Homo sapiens
caaagaucccgugaaauug

SEQ ID NO: 258277 - RNA, 19 nt, Homo sapiens
gaugaagucuaccaaagcu

SEQ ID NO: 258278 - RNA, 19 nt, Homo sapiens
guaccuuaaucugccauaa

SEQ ID NO: 258279 - RNA, 19 nt, Homo sapiens
ugccauaaagccauucuua

SEQ ID NO: 258280 - RNA, 19 nt, Homo sapiens
ccaaagcucacgcguggaa

SEQ ID NO: 258281 - RNA, 19 nt, Homo sapiens
cuugggaccuguuuagaga

SEQ ID NO: 258282 - RNA, 19 nt, Homo sapiens
aucaagaucugguuccaaa

SEQ ID NO: 258283 - RNA, 19 nt, Homo sapiens
ugcuagagcuggagaagga

SEQ ID NO: 258284 - RNA, 19 nt, Homo sapiens
gauacuggauuggcguugu

SEQ ID NO: 258285 - RNA, 19 nt, Homo sapiens
gagagacacaucaagaucu

SEQ ID NO: 258286 - RNA, 19 nt, Homo sapiens
uggaugaagucuaccaaag

SEQ ID NO: 258287 - RNA, 19 nt, Homo sapiens
ccauaaagccauucuuacu

SEQ ID NO: 258288 - RNA, 19 nt, Homo sapiens
agagacacaucaagaucug

SEQ ID NO: 258289 - RNA, 19 nt, Homo sapiens
ggguggagcuggcugucau

SEQ ID NO: 258290 - RNA, 19 nt, Homo sapiens
ggcgaccccuuuaaguuua

SEQ ID NO: 258291 - RNA, 19 nt, Homo sapiens
gaaggcucccuaacacaca

SEQ ID NO: 258292 - RNA, 19 nt, Homo sapiens
cgagagacacaucaagauc

SEQ ID NO: 258293 - RNA, 19 nt, Homo sapiens
cauaaagccauucuuacuc

SEQ ID NO: 258294 - RNA, 19 nt, Homo sapiens
aaucugccauaaagccauu

SEQ ID NO: 258295 - RNA, 19 nt, Homo sapiens
gaguuccuauucaacaagu

SEQ ID NO: 258296 - RNA, 19 nt, Homo sapiens
ccaguggaauacagugagu

SEQ ID NO: 258297 - RNA, 19 nt, Homo sapiens
ugaaaggaaauguuugagu

SEQ ID NO: 258298 - RNA, 19 nt, Homo sapiens
ucccauggaugaagucuac

SEQ ID NO: 258299 - RNA, 19 nt, Homo sapiens
aaagacaauggaaacugua

SEQ ID NO: 258300 - RNA, 19 nt, Homo sapiens
gaacggcgaggagcaguac

SEQ ID NO: 258301 - RNA, 19 nt, Homo sapiens
ggaugaagucuaccaaagc

SEQ ID NO: 258302 - RNA, 19 nt, Homo sapiens
uaccuuaaucugccauaaa

SEQ ID NO: 258303 - RNA, 19 nt, Homo sapiens
gggaaaacccgcucucuca

SEQ ID NO: 258304 - RNA, 19 nt, Homo sapiens
gggcgaccccuuuaaguuu

SEQ ID NO: 258305 - RNA, 19 nt, Homo sapiens
auacuggauuggcguuguu

SEQ ID NO: 258306 - RNA, 19 nt, Homo sapiens
cagcugccuuucccaugga

SEQ ID NO: 258307 - RNA, 19 nt, Homo sapiens
ucaaagacaauggaaacug

SEQ ID NO: 258308 - RNA, 19 nt, Homo sapiens
acagugaguccuccucuuc

SEQ ID NO: 258309 - RNA, 19 nt, Homo sapiens
gagcuggcugucauguuga

SEQ ID NO: 258310 - RNA, 19 nt, Homo sapiens
aaaaggaggaggacaagaa

SEQ ID NO: 258311 - RNA, 19 nt, Homo sapiens
uggcugucauguugaacuu

SEQ ID NO: 258312 - RNA, 19 nt, Homo sapiens
gccauaaagccauucuuac

SEQ ID NO: 258313 - RNA, 19 nt, Homo sapiens
accuuaaucugccauaaag

SEQ ID NO: 258314 - RNA, 19 nt, Homo sapiens
ccaccuugggaccuguuua

SEQ ID NO: 258315 - RNA, 19 nt, Homo sapiens
gaacauaggugugaauaau

SEQ ID NO: 258316 - RNA, 19 nt, Homo sapiens
gaacaccauugaacgauuu

SEQ ID NO: 258317 - RNA, 19 nt, Homo sapiens
ggaaguaguugguaacaug

SEQ ID NO: 258318 - RNA, 19 nt, Homo sapiens
gcaaugcaauggauucuga

SEQ ID NO: 258319 - RNA, 19 nt, Homo sapiens
guagaauucuccaguuuaa

SEQ ID NO: 258320 - RNA, 19 nt, Homo sapiens
ggacucaguugaaguuuau

SEQ ID NO: 258321 - RNA, 19 nt, Homo sapiens
ccacugaacugcauuggaa

SEQ ID NO: 258322 - RNA, 19 nt, Homo sapiens
caucagcaaugaaggaaua

SEQ ID NO: 258323 - RNA, 19 nt, Homo sapiens
gaaugcaaguaaggaauua

SEQ ID NO: 258324 - RNA, 19 nt, Homo sapiens
agagaaagccaaugaaaua

SEQ ID NO: 258325 - RNA, 19 nt, Homo sapiens
gugaagagcuuagcauuga

SEQ ID NO: 258326 - RNA, 19 nt, Homo sapiens
gaaguugccucaaugaaag

SEQ ID NO: 258327 - RNA, 19 nt, Homo sapiens
gaaagccaaugaaauagau

SEQ ID NO: 258328 - RNA, 19 nt, Homo sapiens
gcugugcuaugaaauauaa

SEQ ID NO: 258329 - RNA, 19 nt, Homo sapiens
guagacaacuccuauuuua

SEQ ID NO: 258330 - RNA, 19 nt, Homo sapiens
guagauaaaugacuaacga

SEQ ID NO: 258331 - RNA, 19 nt, Homo sapiens
gcaaagcaaacauagauuu

SEQ ID NO: 258332 - RNA, 19 nt, Homo sapiens
ccaauucgauucccuuuau

SEQ ID NO: 258333 - RNA, 19 nt, Homo sapiens
gccaugaucucuuggaauu

SEQ ID NO: 258334 - RNA, 19 nt, Homo sapiens
ucagauacauggacagaaa

SEQ ID NO: 258335 - RNA, 19 nt, Homo sapiens
ggacagaaauugguaacau

SEQ ID NO: 258336 - RNA, 19 nt, Homo sapiens
ccaaugaaauagauuccua

SEQ ID NO: 258337 - RNA, 19 nt, Homo sapiens
ucaauggucuucuguaugu

SEQ ID NO: 258338 - RNA, 19 nt, Homo sapiens
gaagaguuccuggcacuua

SEQ ID NO: 258339 - RNA, 19 nt, Homo sapiens
aaacacuucugaaagagua

SEQ ID NO: 258340 - RNA, 19 nt, Homo sapiens
caaauugccugccaugauc

SEQ ID NO: 258341 - RNA, 19 nt, Homo sapiens
gcaagaaaguaccuguaug

SEQ ID NO: 258342 - RNA, 19 nt, Homo sapiens
gaagaaagcaagaaaguac

SEQ ID NO: 258343 - RNA, 19 nt, Homo sapiens
aauaggagguucuuaguga

SEQ ID NO: 258344 - RNA, 19 nt, Homo sapiens
caaauagucccuuuagcua

SEQ ID NO: 258345 - RNA, 19 nt, Homo sapiens
auaaagagcucacacagau

SEQ ID NO: 258346 - RNA, 19 nt, Homo sapiens
gcaguggccucaugccuau

SEQ ID NO: 258347 - RNA, 19 nt, Homo sapiens
gcugugaaaugcaagguuu

SEQ ID NO: 258348 - RNA, 19 nt, Homo sapiens
gcuaugauccaguuacuaa

SEQ ID NO: 258349 - RNA, 19 nt, Homo sapiens
ugaauaauguccaggaguu

SEQ ID NO: 258350 - RNA, 19 nt, Homo sapiens
ggaacaccauugaacgauu

SEQ ID NO: 258351 - RNA, 19 nt, Homo sapiens
gaagcuuccuggcaaauag

SEQ ID NO: 258352 - RNA, 19 nt, Homo sapiens
acacagauuugccagguuu

SEQ ID NO: 258353 - RNA, 19 nt, Homo sapiens
ccauguauuugguagauaa

SEQ ID NO: 258354 - RNA, 19 nt, Homo sapiens
uaacagagcacaaggaaca

SEQ ID NO: 258355 - RNA, 19 nt, Homo sapiens
gcaacaguccuuuuaauua

SEQ ID NO: 258356 - RNA, 19 nt, Homo sapiens
gauaagacccucugauucu

SEQ ID NO: 258357 - RNA, 19 nt, Homo sapiens
ggaagaaagcaagaaagua

SEQ ID NO: 258358 - RNA, 19 nt, Homo sapiens
ucaauaagaugagaaaugg

SEQ ID NO: 258359 - RNA, 19 nt, Homo sapiens
ccacagagaaagccaauga

SEQ ID NO: 258360 - RNA, 19 nt, Homo sapiens
gaaaauaaaugggaaguag

SEQ ID NO: 258361 - RNA, 19 nt, Homo sapiens
ggacaacuguagcuucgau

SEQ ID NO: 258362 - RNA, 19 nt, Homo sapiens
gacagaaauugguaacaug

SEQ ID NO: 258363 - RNA, 19 nt, Homo sapiens
ucagauacuucuagauuuc

SEQ ID NO: 258364 - RNA, 19 nt, Homo sapiens
gaugagaaauggacagcau

SEQ ID NO: 258365 - RNA, 19 nt, Homo sapiens
gcaaguaaggaauuaauag

SEQ ID NO: 258366 - RNA, 19 nt, Homo sapiens
gcagagcccucagcugugu

SEQ ID NO: 258367 - RNA, 19 nt, Homo sapiens
gaaggaguauccgauuuua

SEQ ID NO: 258368 - RNA, 19 nt, Homo sapiens
uagaaggaguauccgauuu

SEQ ID NO: 258369 - RNA, 19 nt, Homo sapiens
guccaggaguugauuauug

SEQ ID NO: 258370 - RNA, 19 nt, Homo sapiens
gaaugaaagaguccucaaa

SEQ ID NO: 258371 - RNA, 19 nt, Homo sapiens
gggcguugcugugcuauga

SEQ ID NO: 258372 - RNA, 19 nt, Homo sapiens
ugaaugcuaugauccaguu

SEQ ID NO: 258373 - RNA, 19 nt, Homo sapiens
gcaaauagucccuuuagcu

SEQ ID NO: 258374 - RNA, 19 nt, Homo sapiens
ggacaaauugauccacuga

SEQ ID NO: 258375 - RNA, 19 nt, Homo sapiens
aaagagcucacacagauuu

SEQ ID NO: 258376 - RNA, 19 nt, Homo sapiens
ugcaaacacuucugaaaga

SEQ ID NO: 258377 - RNA, 19 nt, Homo sapiens
gcagacaugcuacaguuga

SEQ ID NO: 258378 - RNA, 19 nt, Homo sapiens
uaauuaaucuaccgucauc

SEQ ID NO: 258379 - RNA, 19 nt, Homo sapiens
ugaauaccaggucuucuua

SEQ ID NO: 258380 - RNA, 19 nt, Homo sapiens
cauuuaugcuguagaauuc

SEQ ID NO: 258381 - RNA, 19 nt, Homo sapiens
gugauaagacccucugauu

SEQ ID NO: 258382 - RNA, 19 nt, Homo sapiens
ugaaguugccucaaugaaa

SEQ ID NO: 258383 - RNA, 19 nt, Homo sapiens
ugcaauggauucugaaaga

SEQ ID NO: 258384 - RNA, 19 nt, Homo sapiens
gugaccagauguuguaaug

SEQ ID NO: 258385 - RNA, 19 nt, Homo sapiens
ccaaaucaauaagaugaga

SEQ ID NO: 258386 - RNA, 19 nt, Homo sapiens
gaucuuccagccaugauuu

SEQ ID NO: 258387 - RNA, 19 nt, Homo sapiens
gggauggucuacgcuauug

SEQ ID NO: 258388 - RNA, 19 nt, Homo sapiens
gaaaacaugugguggaagu

SEQ ID NO: 258389 - RNA, 19 nt, Homo sapiens
gcaauggauucugaaagau

SEQ ID NO: 258390 - RNA, 19 nt, Homo sapiens
gaaauugguaacaugauca

SEQ ID NO: 258391 - RNA, 19 nt, Homo sapiens
gcaaacacuucugaaagag

SEQ ID NO: 258392 - RNA, 19 nt, Homo sapiens
guaugcaccuagaaauuuc

SEQ ID NO: 258393 - RNA, 19 nt, Homo sapiens
gcccaaaucaauaagauga

SEQ ID NO: 258394 - RNA, 19 nt, Homo sapiens
gcuguagaauucuccaguu

SEQ ID NO: 258395 - RNA, 19 nt, Homo sapiens
ccaggaauuugagguugua

SEQ ID NO: 258396 - RNA, 19 nt, Homo sapiens
uuuauuaccuccucagaga

SEQ ID NO: 258397 - RNA, 19 nt, Homo sapiens
gcagugagccgagauugug

SEQ ID NO: 258398 - RNA, 19 nt, Homo sapiens
gaagugggcugggaguaac

SEQ ID NO: 258399 - RNA, 19 nt, Homo sapiens
ucuaugauccacuuucuaa

SEQ ID NO: 258400 - RNA, 19 nt, Homo sapiens
gaagcaggaaucuuucaga

SEQ ID NO: 258401 - RNA, 19 nt, Homo sapiens
acaauuauauccagagcau

SEQ ID NO: 258402 - RNA, 19 nt, Homo sapiens
caaugacacaguuuaaaga

SEQ ID NO: 258403 - RNA, 19 nt, Homo sapiens
gcagacaucuaagguucga

SEQ ID NO: 258404 - RNA, 19 nt, Homo sapiens
caucuuugcugugaauuuc

SEQ ID NO: 258405 - RNA, 19 nt, Homo sapiens
ccauuuaugcuguagaauu

SEQ ID NO: 258406 - RNA, 19 nt, Homo sapiens
ugagaauggauauggaaua

SEQ ID NO: 258407 - RNA, 19 nt, Homo sapiens
ggaauuugagguuguagug

SEQ ID NO: 258408 - RNA, 19 nt, Homo sapiens
uggacucaguugaaguuua

SEQ ID NO: 258409 - RNA, 19 nt, Homo sapiens
guuggaggauggaaugaga

SEQ ID NO: 258410 - RNA, 19 nt, Homo sapiens
gacugcaucuauucuguug

SEQ ID NO: 258411 - RNA, 19 nt, Homo sapiens
gagggauggucuacgcuau

SEQ ID NO: 258412 - RNA, 19 nt, Homo sapiens
gauuucauuuacacaggua

SEQ ID NO: 258413 - RNA, 19 nt, Homo sapiens
aaagaccucuauauucaca

SEQ ID NO: 258414 - RNA, 19 nt, Homo sapiens
gaaagaguccucaaaagau

SEQ ID NO: 258415 - RNA, 19 nt, Homo sapiens
cgaagaaagugaugaauuu

SEQ ID NO: 258416 - RNA, 19 nt, Homo sapiens
caagucagguuucauguaa

SEQ ID NO: 258417 - RNA, 19 nt, Homo sapiens
gaaguaggaggaucauuua

SEQ ID NO: 258418 - RNA, 19 nt, Homo sapiens
ugaaagaccugguggaaga

SEQ ID NO: 258419 - RNA, 19 nt, Homo sapiens
ggacuuugcuggcuacugu

SEQ ID NO: 258420 - RNA, 19 nt, Homo sapiens
gacagaagaugguccagaa

SEQ ID NO: 258421 - RNA, 19 nt, Homo sapiens
gcaauucaguuucuacauc

SEQ ID NO: 258422 - RNA, 19 nt, Homo sapiens
ugaagaggcugaaggagaa

SEQ ID NO: 258423 - RNA, 19 nt, Homo sapiens
gcaagacccuguuucaaaa

SEQ ID NO: 258424 - RNA, 19 nt, Homo sapiens
ugaaguaggaggaucauuu

SEQ ID NO: 258425 - RNA, 19 nt, Homo sapiens
gccagugucuucaggcuuu

SEQ ID NO: 258426 - RNA, 19 nt, Homo sapiens
ggaguggacugcagugaag

SEQ ID NO: 258427 - RNA, 19 nt, Homo sapiens
gcaagucagguuucaugua

SEQ ID NO: 258428 - RNA, 19 nt, Homo sapiens
ccaugcagaucuacaagaa

SEQ ID NO: 258429 - RNA, 19 nt, Homo sapiens
gagcagcuguccagguuuc

SEQ ID NO: 258430 - RNA, 19 nt, Homo sapiens
gcucuuugcccaucucuuu

SEQ ID NO: 258431 - RNA, 19 nt, Homo sapiens
ggucgaggcugcagugagu

SEQ ID NO: 258432 - RNA, 19 nt, Homo sapiens
guaggaggaucauuuaugc

SEQ ID NO: 258433 - RNA, 19 nt, Homo sapiens
caauucaguuucuacauca

SEQ ID NO: 258434 - RNA, 19 nt, Homo sapiens
aaacguauguucccuaaaa

SEQ ID NO: 258435 - RNA, 19 nt, Homo sapiens
ggaccaaguaucugaaaga

SEQ ID NO: 258436 - RNA, 19 nt, Homo sapiens
ucagagccaccgcagauua

SEQ ID NO: 258437 - RNA, 19 nt, Homo sapiens
ccaacguccuucuggauga

SEQ ID NO: 258438 - RNA, 19 nt, Homo sapiens
ugaggaggcuggcgcaugu

SEQ ID NO: 258439 - RNA, 19 nt, Homo sapiens
ccugcgagcuggccuaaug

SEQ ID NO: 258440 - RNA, 19 nt, Homo sapiens
gagcagcacccaccuccaa

SEQ ID NO: 258441 - RNA, 19 nt, Homo sapiens
cuauuagccuggcguggua

SEQ ID NO: 258442 - RNA, 19 nt, Homo sapiens
ggaagucaaaguucucaug

SEQ ID NO: 258443 - RNA, 19 nt, Homo sapiens
gaagcgagaauucugagau

SEQ ID NO: 258444 - RNA, 19 nt, Homo sapiens
ccuccuaccugcuuacaau

SEQ ID NO: 258445 - RNA, 19 nt, Homo sapiens
guaaccgaguguccucuug

SEQ ID NO: 258446 - RNA, 19 nt, Homo sapiens
gcagugagucaugauugua

SEQ ID NO: 258447 - RNA, 19 nt, Homo sapiens
aaggaaggcuggcaucauc

SEQ ID NO: 258448 - RNA, 19 nt, Homo sapiens
ccgaagaaagugaugaauu

SEQ ID NO: 258449 - RNA, 19 nt, Homo sapiens
caccgcagauuaucaucaa

SEQ ID NO: 258450 - RNA, 19 nt, Homo sapiens
gagcaagacccuguuucaa

SEQ ID NO: 258451 - RNA, 19 nt, Homo sapiens
ggacacggcaggagaaucg

SEQ ID NO: 258452 - RNA, 19 nt, Homo sapiens
gcgcccagcacuucuugua

SEQ ID NO: 258453 - RNA, 19 nt, Homo sapiens
gguuguccuugaguaauaa

SEQ ID NO: 258454 - RNA, 19 nt, Homo sapiens
uguaucacaugucuucaga

SEQ ID NO: 258455 - RNA, 19 nt, Homo sapiens
ggacauccuucuggguaca

SEQ ID NO: 258456 - RNA, 19 nt, Homo sapiens
cuaguuacccagacaguga

SEQ ID NO: 258457 - RNA, 19 nt, Homo sapiens
ucuaggcucugugggcaua

SEQ ID NO: 258458 - RNA, 19 nt, Homo sapiens
ccucauccauggagacauc

SEQ ID NO: 258459 - RNA, 19 nt, Homo sapiens
agguuguccuugaguaaua

SEQ ID NO: 258460 - RNA, 19 nt, Homo sapiens
agcaagacccuguuucaaa

SEQ ID NO: 258461 - RNA, 19 nt, Homo sapiens
ccuaccugcuuacaauuug

SEQ ID NO: 258462 - RNA, 19 nt, Homo sapiens
gcccaucucuuuggacagu

SEQ ID NO: 258463 - RNA, 19 nt, Homo sapiens
acagggaagggaaacauuu

SEQ ID NO: 258464 - RNA, 19 nt, Homo sapiens
ggucagagggcugugaaga

SEQ ID NO: 258465 - RNA, 19 nt, Homo sapiens
cuaaugugguggccugcaa

SEQ ID NO: 258466 - RNA, 19 nt, Homo sapiens
gcaaggaaggcuggcauca

SEQ ID NO: 258467 - RNA, 19 nt, Homo sapiens
acggacaccuucagcuuug

SEQ ID NO: 258468 - RNA, 19 nt, Homo sapiens
ccagguuguccuugaguaa

SEQ ID NO: 258469 - RNA, 19 nt, Homo sapiens
ucagaagcaagucagguuu

SEQ ID NO: 258470 - RNA, 19 nt, Homo sapiens
ccuguaaucccagcacuuu

SEQ ID NO: 258471 - RNA, 19 nt, Homo sapiens
gggcccuccuaccugcuua

SEQ ID NO: 258472 - RNA, 19 nt, Homo sapiens
gaccaaguaucugaaagac

SEQ ID NO: 258473 - RNA, 19 nt, Homo sapiens
gccaggaccaaguaucuga

SEQ ID NO: 258474 - RNA, 19 nt, Homo sapiens
agaagcaagucagguuuca

SEQ ID NO: 258475 - RNA, 19 nt, Homo sapiens
ggaaaagacauguaucaca

SEQ ID NO: 258476 - RNA, 19 nt, Homo sapiens
gacagggaagggaaacauu

SEQ ID NO: 258477 - RNA, 19 nt, Homo sapiens
ccagugucuucaggcuuua

SEQ ID NO: 258478 - RNA, 19 nt, Homo sapiens
aagcgagaauucugagauc

SEQ ID NO: 258479 - RNA, 19 nt, Homo sapiens
uagcaagaagcgagaauuc

SEQ ID NO: 258480 - RNA, 19 nt, Homo sapiens
guucaguccuagcaagaag

SEQ ID NO: 258481 - RNA, 19 nt, Homo sapiens
cccaaacauuguggacuuu

SEQ ID NO: 258482 - RNA, 19 nt, Homo sapiens
acccaaacauuguggacuu

SEQ ID NO: 258483 - RNA, 19 nt, Homo sapiens
cgucagagccaccgcagau

SEQ ID NO: 258484 - RNA, 19 nt, Homo sapiens
ccaucgccaugcagaucua

SEQ ID NO: 258485 - RNA, 19 nt, Homo sapiens
aagcaagucagguuucaug

SEQ ID NO: 258486 - RNA, 19 nt, Homo sapiens
cagagccaccgcagauuau

SEQ ID NO: 258487 - RNA, 19 nt, Homo sapiens
caagaguuccaacguccuu

SEQ ID NO: 258488 - RNA, 19 nt, Homo sapiens
auggagacaucaagaguuc

SEQ ID NO: 258489 - RNA, 19 nt, Homo sapiens
caugugccgcuucuacaaa

SEQ ID NO: 258490 - RNA, 19 nt, Homo sapiens
ggucaugugccgcuucuac

SEQ ID NO: 258491 - RNA, 19 nt, Homo sapiens
agaccuaguuacccagaca

SEQ ID NO: 258492 - RNA, 19 nt, Homo sapiens
caaauccggaagucaaagu

SEQ ID NO: 258493 - RNA, 19 nt, Homo sapiens
gcccgaagaaagugaugaa

SEQ ID NO: 258494 - RNA, 19 nt, Homo sapiens
gagccaccgcagauuauca

SEQ ID NO: 258495 - RNA, 19 nt, Homo sapiens
cacggacaccuucagcuuu

SEQ ID NO: 258496 - RNA, 19 nt, Homo sapiens
acacggacaccuucagcuu

SEQ ID NO: 258497 - RNA, 19 nt, Homo sapiens
cauggagacaucaagaguu

SEQ ID NO: 258498 - RNA, 19 nt, Homo sapiens
gagcucggccugguuccaa

SEQ ID NO: 258499 - RNA, 19 nt, Homo sapiens
agagcaagacccuguuuca

SEQ ID NO: 258500 - RNA, 19 nt, Homo sapiens
gaccagccagggcaacaug

SEQ ID NO: 258501 - RNA, 19 nt, Homo sapiens
cugagauccuccagaaagu

SEQ ID NO: 258502 - RNA, 19 nt, Homo sapiens
guaagucucaugguucagu

SEQ ID NO: 258503 - RNA, 19 nt, Homo sapiens
uuucgucacccaaacauug

SEQ ID NO: 258504 - RNA, 19 nt, Homo sapiens
ggagacaucaagaguucca

SEQ ID NO: 258505 - RNA, 19 nt, Homo sapiens
aguaggaggaucauuuaug

SEQ ID NO: 258506 - RNA, 19 nt, Homo sapiens
caaggaaggcuggcaucau

SEQ ID NO: 258507 - RNA, 19 nt, Homo sapiens
agaagaugguccagaagcu

SEQ ID NO: 258508 - RNA, 19 nt, Homo sapiens
caacguccuucuggaugag

SEQ ID NO: 258509 - RNA, 19 nt, Homo sapiens
uccagguuguccuugagua

SEQ ID NO: 258510 - RNA, 19 nt, Homo sapiens
cagaagcaagucagguuuc

SEQ ID NO: 258511 - RNA, 19 nt, Homo sapiens
gcagaaaaguugggagcau

SEQ ID NO: 258512 - RNA, 19 nt, Homo sapiens
cagugagucaugauuguau

SEQ ID NO: 258513 - RNA, 19 nt, Homo sapiens
ugcagugagucaugauugu

SEQ ID NO: 258514 - RNA, 19 nt, Homo sapiens
uggccacccugcacaaugg

SEQ ID NO: 258515 - RNA, 19 nt, Homo sapiens
gaaauuaccuguggauauu

SEQ ID NO: 258516 - RNA, 19 nt, Homo sapiens
gcacauuucuagaggaaua

SEQ ID NO: 258517 - RNA, 19 nt, Homo sapiens
caagauggcuacccagaua

SEQ ID NO: 258518 - RNA, 19 nt, Homo sapiens
gaacuugugucccuaaugu

SEQ ID NO: 258519 - RNA, 19 nt, Homo sapiens
caacugaagucaccuuuga

SEQ ID NO: 258520 - RNA, 19 nt, Homo sapiens
guaauuguguggauucuuu

SEQ ID NO: 258521 - RNA, 19 nt, Homo sapiens
cuaaggagcugauacuuga

SEQ ID NO: 258522 - RNA, 19 nt, Homo sapiens
gcaacagacuugaaugcua

SEQ ID NO: 258523 - RNA, 19 nt, Homo sapiens
ggaaagugcugucuuaaac

SEQ ID NO: 258524 - RNA, 19 nt, Homo sapiens
caagacagcucauauugau

SEQ ID NO: 258525 - RNA, 19 nt, Homo sapiens
ggauaugccuccagguuaa

SEQ ID NO: 258526 - RNA, 19 nt, Homo sapiens
gaaaguagaauccaaagga

SEQ ID NO: 258527 - RNA, 19 nt, Homo sapiens
ggaauaaugugaagccaau

SEQ ID NO: 258528 - RNA, 19 nt, Homo sapiens
gaaagggauuguucgugua

SEQ ID NO: 258529 - RNA, 19 nt, Homo sapiens
ucaagucacuggucuguuu

SEQ ID NO: 258530 - RNA, 19 nt, Homo sapiens
guuaugguguuuagacuua

SEQ ID NO: 258531 - RNA, 19 nt, Homo sapiens
ggaaaauccuuaaaccuua

SEQ ID NO: 258532 - RNA, 19 nt, Homo sapiens
gaagauggguuuauucacu

SEQ ID NO: 258533 - RNA, 19 nt, Homo sapiens
ccaaagagucuccaguuua

SEQ ID NO: 258534 - RNA, 19 nt, Homo sapiens
caacagagacugaauagau

SEQ ID NO: 258535 - RNA, 19 nt, Homo sapiens
ucagaaggauauugcuuua

SEQ ID NO: 258536 - RNA, 19 nt, Homo sapiens
caaggcagauggaauaaug

SEQ ID NO: 258537 - RNA, 19 nt, Homo sapiens
acagauagaugauaacaga

SEQ ID NO: 258538 - RNA, 19 nt, Homo sapiens
gcauaauguuucuggauuu

SEQ ID NO: 258539 - RNA, 19 nt, Homo sapiens
gauauucaauugcuggaaa

SEQ ID NO: 258540 - RNA, 19 nt, Homo sapiens
gcacgcggaucgaguuuga

SEQ ID NO: 258541 - RNA, 19 nt, Homo sapiens
guacgaaccuacaguuuua

SEQ ID NO: 258542 - RNA, 19 nt, Homo sapiens
ugauagagauggagaaguu

SEQ ID NO: 258543 - RNA, 19 nt, Homo sapiens
gggaaaugguugcuuuauu

SEQ ID NO: 258544 - RNA, 19 nt, Homo sapiens
gaaauaacagugacaaaca

SEQ ID NO: 258545 - RNA, 19 nt, Homo sapiens
agaaggaaaucaagacaaa

SEQ ID NO: 258546 - RNA, 19 nt, Homo sapiens
gagaggccaugagaaauuu

SEQ ID NO: 258547 - RNA, 19 nt, Homo sapiens
gaaagaaacgggaaauuac

SEQ ID NO: 258548 - RNA, 19 nt, Homo sapiens
gaauagaacacaguuugua

SEQ ID NO: 258549 - RNA, 19 nt, Homo sapiens
caaagagucuccaguuuac

SEQ ID NO: 258550 - RNA, 19 nt, Homo sapiens
agaaagaaacgggaaauua

SEQ ID NO: 258551 - RNA, 19 nt, Homo sapiens
caacaagcaaucaagauaa

SEQ ID NO: 258552 - RNA, 19 nt, Homo sapiens
ggucuggccucuucauuug

SEQ ID NO: 258553 - RNA, 19 nt, Homo sapiens
guauugaucuacuucugua

SEQ ID NO: 258554 - RNA, 19 nt, Homo sapiens
gaaaauaccagacucuuaa

SEQ ID NO: 258555 - RNA, 19 nt, Homo sapiens
gaaggauauugcuuuagaa

SEQ ID NO: 258556 - RNA, 19 nt, Homo sapiens
gaauugaccuccgccagaa

SEQ ID NO: 258557 - RNA, 19 nt, Homo sapiens
gaguaugaauucaggguaa

SEQ ID NO: 258558 - RNA, 19 nt, Homo sapiens
gagaaacaguugaguugug

SEQ ID NO: 258559 - RNA, 19 nt, Homo sapiens
uaacagcaaccuuaaacua

SEQ ID NO: 258560 - RNA, 19 nt, Homo sapiens
gcacauauucgauggagaa

SEQ ID NO: 258561 - RNA, 19 nt, Homo sapiens
ggaggguggucaacaaaga

SEQ ID NO: 258562 - RNA, 19 nt, Homo sapiens
gccaaagagucuccaguuu

SEQ ID NO: 258563 - RNA, 19 nt, Homo sapiens
gaaagaagagcgagagauc

SEQ ID NO: 258564 - RNA, 19 nt, Homo sapiens
aagagaggcuuacuucuga

SEQ ID NO: 258565 - RNA, 19 nt, Homo sapiens
gcccaaauauacucaagaa

SEQ ID NO: 258566 - RNA, 19 nt, Homo sapiens
ucacuggucuguuugcauu

SEQ ID NO: 258567 - RNA, 19 nt, Homo sapiens
ugaaagaaauggugaaugc

SEQ ID NO: 258568 - RNA, 19 nt, Homo sapiens
gaacagcacauuucuagag

SEQ ID NO: 258569 - RNA, 19 nt, Homo sapiens
ucucacaacucaagaaaga

SEQ ID NO: 258570 - RNA, 19 nt, Homo sapiens
cagcaaggcagauggaaua

SEQ ID NO: 258571 - RNA, 19 nt, Homo sapiens
gaaagucucguuccuguuc

SEQ ID NO: 258572 - RNA, 19 nt, Homo sapiens
uauaaccucuccuucauga

SEQ ID NO: 258573 - RNA, 19 nt, Homo sapiens
aaagugcugucuuaaacua

SEQ ID NO: 258574 - RNA, 19 nt, Homo sapiens
gaaauuagcaaugggaaau

SEQ ID NO: 258575 - RNA, 19 nt, Homo sapiens
agaaggauauugcuuuaga

SEQ ID NO: 258576 - RNA, 19 nt, Homo sapiens
gacaugugcucaccgauau

SEQ ID NO: 258577 - RNA, 19 nt, Homo sapiens
gaaagaauagaacacaguu

SEQ ID NO: 258578 - RNA, 19 nt, Homo sapiens
gaagugggaaguuuaauag

SEQ ID NO: 258579 - RNA, 19 nt, Homo sapiens
cacaguaacuccuaacaga

SEQ ID NO: 258580 - RNA, 19 nt, Homo sapiens
gaagguggcugcgguagca

SEQ ID NO: 258581 - RNA, 19 nt, Homo sapiens
aacagagacugaauagaua

SEQ ID NO: 258582 - RNA, 19 nt, Homo sapiens
guauguaacagcaaccuua

SEQ ID NO: 258583 - RNA, 19 nt, Homo sapiens
gaaccaaagauucuauguu

SEQ ID NO: 258584 - RNA, 19 nt, Homo sapiens
aaggauggguggcaagaua

SEQ ID NO: 258585 - RNA, 19 nt, Homo sapiens
gaagaugggccuuaugaag

SEQ ID NO: 258586 - RNA, 19 nt, Homo sapiens
gcuucacaauguuaaguua

SEQ ID NO: 258587 - RNA, 19 nt, Homo sapiens
uuagaagccugcauaaugu

SEQ ID NO: 258588 - RNA, 19 nt, Homo sapiens
uguguuagauugcuagauu

SEQ ID NO: 258589 - RNA, 19 nt, Homo sapiens
caaguuucauucucccuuu

SEQ ID NO: 258590 - RNA, 19 nt, Homo sapiens
gaugcuugcuuuauuagug

SEQ ID NO: 258591 - RNA, 19 nt, Homo sapiens
cuugaugcuugcuuuauua

SEQ ID NO: 258592 - RNA, 19 nt, Homo sapiens
ccaugaggcuaaacugauu

SEQ ID NO: 258593 - RNA, 19 nt, Homo sapiens
gggauaugccuccagguua

SEQ ID NO: 258594 - RNA, 19 nt, Homo sapiens
guacuaacuagcauuguaa

SEQ ID NO: 258595 - RNA, 19 nt, Homo sapiens
ugagucgaguguucuauuu

SEQ ID NO: 258596 - RNA, 19 nt, Homo sapiens
gagaagauggguuuauuca

SEQ ID NO: 258597 - RNA, 19 nt, Homo sapiens
guauaagacuacugaaucu

SEQ ID NO: 258598 - RNA, 19 nt, Homo sapiens
ucacaagacuaugccauug

SEQ ID NO: 258599 - RNA, 19 nt, Homo sapiens
gauaaacucccugaaccua

SEQ ID NO: 258600 - RNA, 19 nt, Homo sapiens
gcaaauggaauaaauacca

SEQ ID NO: 258601 - RNA, 19 nt, Homo sapiens
uaucauggaucugcaaaug

SEQ ID NO: 258602 - RNA, 19 nt, Homo sapiens
gguguuauguccugaguca

SEQ ID NO: 258603 - RNA, 19 nt, Homo sapiens
ucacaaaguggaacagaaa

SEQ ID NO: 258604 - RNA, 19 nt, Homo sapiens
gaugaagugggaaguuuaa

SEQ ID NO: 258605 - RNA, 19 nt, Homo sapiens
gagacgacaauguauguaa

SEQ ID NO: 258606 - RNA, 19 nt, Homo sapiens
cgaaauuccuacccugaug

SEQ ID NO: 258607 - RNA, 19 nt, Homo sapiens
gaagccaauucgucuuaau

SEQ ID NO: 258608 - RNA, 19 nt, Homo sapiens
gguauuguuucuaaagaug

SEQ ID NO: 258609 - RNA, 19 nt, Homo sapiens
aacggaaagugcugucuua

SEQ ID NO: 258610 - RNA, 19 nt, Homo sapiens
gcaggaaucccgagacauc

SEQ ID NO: 258611 - RNA, 19 nt, Homo sapiens
acacucaccugcacuaaca

SEQ ID NO: 258612 - RNA, 19 nt, Homo sapiens
guaaggauccggaaagaag

SEQ ID NO: 258613 - RNA, 19 nt, Homo sapiens
cagcaaggcgucucuuauu

SEQ ID NO: 258614 - RNA, 19 nt, Homo sapiens
ugaagugggaaguuuaaua

SEQ ID NO: 258615 - RNA, 19 nt, Homo sapiens
gaaaucaggugucccauuc

SEQ ID NO: 258616 - RNA, 19 nt, Homo sapiens
gaaaccggcuccugaaauc

SEQ ID NO: 258617 - RNA, 19 nt, Homo sapiens
uaagaaaggcugaggauga

SEQ ID NO: 258618 - RNA, 19 nt, Homo sapiens
caaacuugcucacccaaug

SEQ ID NO: 258619 - RNA, 19 nt, Homo sapiens
gucaagagcucuaaugucu

SEQ ID NO: 258620 - RNA, 19 nt, Homo sapiens
caagacaguuucacagcuu

SEQ ID NO: 258621 - RNA, 19 nt, Homo sapiens
gcucaucuguguccuguca

SEQ ID NO: 258622 - RNA, 19 nt, Homo sapiens
cagacgacguugacaauuc

SEQ ID NO: 258623 - RNA, 19 nt, Homo sapiens
ggaaaccggcuccugaaau

SEQ ID NO: 258624 - RNA, 19 nt, Homo sapiens
gaagcccgguuuaccugaa

SEQ ID NO: 258625 - RNA, 19 nt, Homo sapiens
cccaauggcucaucugugu

SEQ ID NO: 258626 - RNA, 19 nt, Homo sapiens
gcaccuccauuccuaagca

SEQ ID NO: 258627 - RNA, 19 nt, Homo sapiens
aagaaaggcugaggaugaa

SEQ ID NO: 258628 - RNA, 19 nt, Homo sapiens
aggcagaguugcagauuug

SEQ ID NO: 258629 - RNA, 19 nt, Homo sapiens
gggcuucugugcugcaaga

SEQ ID NO: 258630 - RNA, 19 nt, Homo sapiens
caucuucagcuguggaaua

SEQ ID NO: 258631 - RNA, 19 nt, Homo sapiens
ccacuucgucugauucaaa

SEQ ID NO: 258632 - RNA, 19 nt, Homo sapiens
caaagcgaguggacaucuu

SEQ ID NO: 258633 - RNA, 19 nt, Homo sapiens
gaccuuugcugacgucuac

SEQ ID NO: 258634 - RNA, 19 nt, Homo sapiens
ggcaaccgaugacuucaau

SEQ ID NO: 258635 - RNA, 19 nt, Homo sapiens
ggaagacgggcguggagaa

SEQ ID NO: 258636 - RNA, 19 nt, Homo sapiens
gacuuacuccucagugaua

SEQ ID NO: 258637 - RNA, 19 nt, Homo sapiens
gaguugcagauuugucuua

SEQ ID NO: 258638 - RNA, 19 nt, Homo sapiens
caaccgaugacuucaauca

SEQ ID NO: 258639 - RNA, 19 nt, Homo sapiens
gaaaggcugaggaugaaca

SEQ ID NO: 258640 - RNA, 19 nt, Homo sapiens
ggaaacagacgacguugac

SEQ ID NO: 258641 - RNA, 19 nt, Homo sapiens
uggagaacgugauggcaaa

SEQ ID NO: 258642 - RNA, 19 nt, Homo sapiens
caaaauacaccaugaugaa

SEQ ID NO: 258643 - RNA, 19 nt, Homo sapiens
uuuggcagcuucuguaaga

SEQ ID NO: 258644 - RNA, 19 nt, Homo sapiens
caggcagaguugcagauuu

SEQ ID NO: 258645 - RNA, 19 nt, Homo sapiens
accgaugacuucaaucaaa

SEQ ID NO: 258646 - RNA, 19 nt, Homo sapiens
ggacuucagcaccuccauu

SEQ ID NO: 258647 - RNA, 19 nt, Homo sapiens
aaacagacgacguugacaa

SEQ ID NO: 258648 - RNA, 19 nt, Homo sapiens
gguacaggcucuucuucca

SEQ ID NO: 258649 - RNA, 19 nt, Homo sapiens
ggacgucagccgcguaucu

SEQ ID NO: 258650 - RNA, 19 nt, Homo sapiens
ccuccuacgugaucacaga

SEQ ID NO: 258651 - RNA, 19 nt, Homo sapiens
ggacuuacuccucagugau

SEQ ID NO: 258652 - RNA, 19 nt, Homo sapiens
gccauggccugcuacaucu

SEQ ID NO: 258653 - RNA, 19 nt, Homo sapiens
ucuccagccuccugaagaa

SEQ ID NO: 258654 - RNA, 19 nt, Homo sapiens
cuucagcuguggaauagug

SEQ ID NO: 258655 - RNA, 19 nt, Homo sapiens
ugacccagcugcggaagau

SEQ ID NO: 258656 - RNA, 19 nt, Homo sapiens
gaugccuccuccuccauga

SEQ ID NO: 258657 - RNA, 19 nt, Homo sapiens
guacaggcucuucuuccaa

SEQ ID NO: 258658 - RNA, 19 nt, Homo sapiens
cgguuuaccugaaggacuu

SEQ ID NO: 258659 - RNA, 19 nt, Homo sapiens
aaauacaccaugaugaaga

SEQ ID NO: 258660 - RNA, 19 nt, Homo sapiens
uugcagauuugucuuagau

SEQ ID NO: 258661 - RNA, 19 nt, Homo sapiens
ccaggcaaccgaugacuuc

SEQ ID NO: 258662 - RNA, 19 nt, Homo sapiens
ucacgggcaucccugcaau

SEQ ID NO: 258663 - RNA, 19 nt, Homo sapiens
ugacaaagcgaguggacau

SEQ ID NO: 258664 - RNA, 19 nt, Homo sapiens
ugaaaucaggugucccauu

SEQ ID NO: 258665 - RNA, 19 nt, Homo sapiens
acaccaugaugaagacuca

SEQ ID NO: 258666 - RNA, 19 nt, Homo sapiens
ucuguguccugucaacaaa

SEQ ID NO: 258667 - RNA, 19 nt, Homo sapiens
ggcugaggaugaacaggaa

SEQ ID NO: 258668 - RNA, 19 nt, Homo sapiens
agaacgugauggcaaagga

SEQ ID NO: 258669 - RNA, 19 nt, Homo sapiens
gacaauuccagccuugaug

SEQ ID NO: 258670 - RNA, 19 nt, Homo sapiens
caacaaaaggucaaaauac

SEQ ID NO: 258671 - RNA, 19 nt, Homo sapiens
agaggaaacagacgacguu

SEQ ID NO: 258672 - RNA, 19 nt, Homo sapiens
ggcaaaugguucccuacag

SEQ ID NO: 258673 - RNA, 19 nt, Homo sapiens
aguccaggaucaaucgaaa

SEQ ID NO: 258674 - RNA, 19 nt, Homo sapiens
gaagaggggcagccuguga

SEQ ID NO: 258675 - RNA, 19 nt, Homo sapiens
gaucauccugaacuggaaa

SEQ ID NO: 258676 - RNA, 19 nt, Homo sapiens
aaucaaaaccgcaaaauca

SEQ ID NO: 258677 - RNA, 19 nt, Homo sapiens
gaggguacaggcucuucuu

SEQ ID NO: 258678 - RNA, 19 nt, Homo sapiens
ggaagaucaaguccaugga

SEQ ID NO: 258679 - RNA, 19 nt, Homo sapiens
uucagcaccuccauuccua

SEQ ID NO: 258680 - RNA, 19 nt, Homo sapiens
gacgaccugugccgcaaca

SEQ ID NO: 258681 - RNA, 19 nt, Homo sapiens
ucgcucugcuccaggaaga

SEQ ID NO: 258682 - RNA, 19 nt, Homo sapiens
ucccugcaauggauaacaa

SEQ ID NO: 258683 - RNA, 19 nt, Homo sapiens
ggaccuuugcugacgucua

SEQ ID NO: 258684 - RNA, 19 nt, Homo sapiens
gaggauggccaccuuucca

SEQ ID NO: 258685 - RNA, 19 nt, Homo sapiens
gcucugugccgucgaguac

SEQ ID NO: 258686 - RNA, 19 nt, Homo sapiens
gcccagaucauccugaacu

SEQ ID NO: 258687 - RNA, 19 nt, Homo sapiens
ccgaugacuucaaucaaaa

SEQ ID NO: 258688 - RNA, 19 nt, Homo sapiens
gacuucagcaccuccauuc

SEQ ID NO: 258689 - RNA, 19 nt, Homo sapiens
gaaacagacgacguugaca

SEQ ID NO: 258690 - RNA, 19 nt, Homo sapiens
gcaacgucaagagcucuaa

SEQ ID NO: 258691 - RNA, 19 nt, Homo sapiens
guugcagauuugucuuaga

SEQ ID NO: 258692 - RNA, 19 nt, Homo sapiens
ccagccuccugaagaagau

SEQ ID NO: 258693 - RNA, 19 nt, Homo sapiens
gaucagagguguacacuaa

SEQ ID NO: 258694 - RNA, 19 nt, Homo sapiens
gggcucaucuggauuaaua

SEQ ID NO: 258695 - RNA, 19 nt, Homo sapiens
gaaauuaccugaggacauc

SEQ ID NO: 258696 - RNA, 19 nt, Homo sapiens
ggacguguguaaauaugua

SEQ ID NO: 258697 - RNA, 19 nt, Homo sapiens
ucacagaucugaagaacau

SEQ ID NO: 258698 - RNA, 19 nt, Homo sapiens
ccagugaucuguacaacuu

SEQ ID NO: 258699 - RNA, 19 nt, Homo sapiens
ggcuagagaugcagauuaa

SEQ ID NO: 258700 - RNA, 19 nt, Homo sapiens
gcucuuggccuuugcauuu

SEQ ID NO: 258701 - RNA, 19 nt, Homo sapiens
aaaugaaucucguuccaaa

SEQ ID NO: 258702 - RNA, 19 nt, Homo sapiens
auaaggacguguguaaaua

SEQ ID NO: 258703 - RNA, 19 nt, Homo sapiens
ccugauaccuucucugaug

SEQ ID NO: 258704 - RNA, 19 nt, Homo sapiens
gcagauuaauuccaaccaa

SEQ ID NO: 258705 - RNA, 19 nt, Homo sapiens
cagauuaauuccaaccaaa

SEQ ID NO: 258706 - RNA, 19 nt, Homo sapiens
gcuccacucugccugauga

SEQ ID NO: 258707 - RNA, 19 nt, Homo sapiens
gaucuugccacauuucuga

SEQ ID NO: 258708 - RNA, 19 nt, Homo sapiens
ucacacaggccgauacaaa

SEQ ID NO: 258709 - RNA, 19 nt, Homo sapiens
ggaugaggaagggaaauua

SEQ ID NO: 258710 - RNA, 19 nt, Homo sapiens
ugaacucccugccagauau

SEQ ID NO: 258711 - RNA, 19 nt, Homo sapiens
gcugggacaucaacaagga

SEQ ID NO: 258712 - RNA, 19 nt, Homo sapiens
uauggagacuuuagcugua

SEQ ID NO: 258713 - RNA, 19 nt, Homo sapiens
ggaaaugucaucuaaccau

SEQ ID NO: 258714 - RNA, 19 nt, Homo sapiens
caaagccagugaaugugaa

SEQ ID NO: 258715 - RNA, 19 nt, Homo sapiens
gcacaucccaguggaaguu

SEQ ID NO: 258716 - RNA, 19 nt, Homo sapiens
cuagagaugcagauuaauu

SEQ ID NO: 258717 - RNA, 19 nt, Homo sapiens
cagcgugucuucacagauc

SEQ ID NO: 258718 - RNA, 19 nt, Homo sapiens
guaaggaggagccagaaau

SEQ ID NO: 258719 - RNA, 19 nt, Homo sapiens
cauaaggacguguguaaau

SEQ ID NO: 258720 - RNA, 19 nt, Homo sapiens
uaaggaggagccagaaauu

SEQ ID NO: 258721 - RNA, 19 nt, Homo sapiens
ccaaagccagugaauguga

SEQ ID NO: 258722 - RNA, 19 nt, Homo sapiens
ggaaauuaccugaggacau

SEQ ID NO: 258723 - RNA, 19 nt, Homo sapiens
gcucagcugugcgagugua

SEQ ID NO: 258724 - RNA, 19 nt, Homo sapiens
caaggaugccuguuuguuc

SEQ ID NO: 258725 - RNA, 19 nt, Homo sapiens
gagguguacacuaacauuu

SEQ ID NO: 258726 - RNA, 19 nt, Homo sapiens
cacagcagcuacacaguuc

SEQ ID NO: 258727 - RNA, 19 nt, Homo sapiens
aagcauggcugggacauca

SEQ ID NO: 258728 - RNA, 19 nt, Homo sapiens
ggaagaugagguucugaga

SEQ ID NO: 258729 - RNA, 19 nt, Homo sapiens
ccacagcagcuacacaguu

SEQ ID NO: 258730 - RNA, 19 nt, Homo sapiens
gcacuaaaugaaucucguu

SEQ ID NO: 258731 - RNA, 19 nt, Homo sapiens
gauauugggcugagucuac

SEQ ID NO: 258732 - RNA, 19 nt, Homo sapiens
ggacagcaccagugaucug

SEQ ID NO: 258733 - RNA, 19 nt, Homo sapiens
uaaggacguguguaaauau

SEQ ID NO: 258734 - RNA, 19 nt, Homo sapiens
ucagagguguacacuaaca

SEQ ID NO: 258735 - RNA, 19 nt, Homo sapiens
ugaaucucguuccaaagaa

SEQ ID NO: 258736 - RNA, 19 nt, Homo sapiens
ggagucagugucuggcuuu

SEQ ID NO: 258737 - RNA, 19 nt, Homo sapiens
gcccaccucugucuaugga

SEQ ID NO: 258738 - RNA, 19 nt, Homo sapiens
gaaaagaaagaaagucgaa

SEQ ID NO: 258739 - RNA, 19 nt, Homo sapiens
ucaccaagaaccagagaaa

SEQ ID NO: 258740 - RNA, 19 nt, Homo sapiens
accauuaagucauguguga

SEQ ID NO: 258741 - RNA, 19 nt, Homo sapiens
gcucaucuggauuaauaaa

SEQ ID NO: 258742 - RNA, 19 nt, Homo sapiens
gcccugauaccuucucuga

SEQ ID NO: 258743 - RNA, 19 nt, Homo sapiens
gagcugggccauucacaca

SEQ ID NO: 258744 - RNA, 19 nt, Homo sapiens
cuaaaugaaucucguucca

SEQ ID NO: 258745 - RNA, 19 nt, Homo sapiens
agaugcagauuaauuccaa

SEQ ID NO: 258746 - RNA, 19 nt, Homo sapiens
gcuaagagcaaggccaaga

SEQ ID NO: 258747 - RNA, 19 nt, Homo sapiens
ugaaagaccagagcaggaa

SEQ ID NO: 258748 - RNA, 19 nt, Homo sapiens
cuacaacagaugaggauga

SEQ ID NO: 258749 - RNA, 19 nt, Homo sapiens
ggccuuugcauuuauuuau

SEQ ID NO: 258750 - RNA, 19 nt, Homo sapiens
cuacccugcucccugcuuu

SEQ ID NO: 258751 - RNA, 19 nt, Homo sapiens
uagagaugcagauuaauuc

SEQ ID NO: 258752 - RNA, 19 nt, Homo sapiens
aggaggagccagaaauuga

SEQ ID NO: 258753 - RNA, 19 nt, Homo sapiens
gcaccagugaucuguacaa

SEQ ID NO: 258754 - RNA, 19 nt, Homo sapiens
ccucaacagccaaguguga

SEQ ID NO: 258755 - RNA, 19 nt, Homo sapiens
gugcagagaagcuggacuu

SEQ ID NO: 258756 - RNA, 19 nt, Homo sapiens
cagcaccagugaucuguac

SEQ ID NO: 258757 - RNA, 19 nt, Homo sapiens
aaagaaagaaagucgaagu

SEQ ID NO: 258758 - RNA, 19 nt, Homo sapiens
gccagugaaugugaaggaa

SEQ ID NO: 258759 - RNA, 19 nt, Homo sapiens
gacccuggcuagagaugca

SEQ ID NO: 258760 - RNA, 19 nt, Homo sapiens
uggcuagagaugcagauua

SEQ ID NO: 258761 - RNA, 19 nt, Homo sapiens
ugugagcgccuugguauga

SEQ ID NO: 258762 - RNA, 19 nt, Homo sapiens
aaggacguguguaaauaug

SEQ ID NO: 258763 - RNA, 19 nt, Homo sapiens
uaaaugaaucucguuccaa

SEQ ID NO: 258764 - RNA, 19 nt, Homo sapiens
caggcuacaugcaggacuu

SEQ ID NO: 258765 - RNA, 19 nt, Homo sapiens
uaauaaagaggagaugauc

SEQ ID NO: 258766 - RNA, 19 nt, Homo sapiens
ccagugaaugugaaggaaa

SEQ ID NO: 258767 - RNA, 19 nt, Homo sapiens
cagaaaagcauaacaccaa

SEQ ID NO: 258768 - RNA, 19 nt, Homo sapiens
guggauauggugcagagaa

SEQ ID NO: 258769 - RNA, 19 nt, Homo sapiens
ggacaucaugaagcucuug

SEQ ID NO: 258770 - RNA, 19 nt, Homo sapiens
gaugaggaagggaaauuac

SEQ ID NO: 258771 - RNA, 19 nt, Homo sapiens
gacguggaaggccaacuuu

SEQ ID NO: 258772 - RNA, 19 nt, Homo sapiens
caucuggauuaauaaagag

SEQ ID NO: 258773 - RNA, 19 nt, Homo sapiens
uuccaccucucaccaagaa

SEQ ID NO: 258774 - RNA, 19 nt, Homo sapiens
uuccaaagccagugaaugu

SEQ ID NO: 258775 - RNA, 19 nt, Homo sapiens
guacaacuuccagguguca

SEQ ID NO: 258776 - RNA, 19 nt, Homo sapiens
caucuaaccauuaagucau

SEQ ID NO: 258777 - RNA, 19 nt, Homo sapiens
cagugaaugugaaggaaac

SEQ ID NO: 258778 - RNA, 19 nt, Homo sapiens
ggauuaauaaagaggagau

SEQ ID NO: 258779 - RNA, 19 nt, Homo sapiens
gagccaacaugcccaucac

SEQ ID NO: 258780 - RNA, 19 nt, Homo sapiens
gcgccuugguaugacuuaa

SEQ ID NO: 258781 - RNA, 19 nt, Homo sapiens
gguguacacuaacauuucc

SEQ ID NO: 258782 - RNA, 19 nt, Homo sapiens
augagacccuggcuagaga

SEQ ID NO: 258783 - RNA, 19 nt, Homo sapiens
gcaucaugguggauauggu

SEQ ID NO: 258784 - RNA, 19 nt, Homo sapiens
gggaagggguaccuacuca

SEQ ID NO: 258785 - RNA, 19 nt, Homo sapiens
uaccugaggacaucaugaa

SEQ ID NO: 258786 - RNA, 19 nt, Homo sapiens
agagcaaggccaagaggaa

SEQ ID NO: 258787 - RNA, 19 nt, Homo sapiens
cucuuggccuuugcauuua

SEQ ID NO: 258788 - RNA, 19 nt, Homo sapiens
gaacucccugccagauauc

SEQ ID NO: 258789 - RNA, 19 nt, Homo sapiens
aagcgaaaauugcacuaaa

SEQ ID NO: 258790 - RNA, 19 nt, Homo sapiens
gcacuaagcgaaaauugca

SEQ ID NO: 258791 - RNA, 19 nt, Homo sapiens
gaguccagcccaccucugu

SEQ ID NO: 258792 - RNA, 19 nt, Homo sapiens
ccagcacugucgccaugug

SEQ ID NO: 258793 - RNA, 19 nt, Homo sapiens
gaaagaaaccaaagacaga

SEQ ID NO: 258794 - RNA, 19 nt, Homo sapiens
ucaaguggcuuaacaagga

SEQ ID NO: 258795 - RNA, 19 nt, Homo sapiens
gcaauccggugccuuacaa

SEQ ID NO: 258796 - RNA, 19 nt, Homo sapiens
gguccugacuucaacuaua

SEQ ID NO: 258797 - RNA, 19 nt, Homo sapiens
aaacauggaaggcgaauuu

SEQ ID NO: 258798 - RNA, 19 nt, Homo sapiens
uuaaagcacuuacagauag

SEQ ID NO: 258799 - RNA, 19 nt, Homo sapiens
gcaagaaccaguugaguca

SEQ ID NO: 258800 - RNA, 19 nt, Homo sapiens
gaaagcgaaacgacugaua

SEQ ID NO: 258801 - RNA, 19 nt, Homo sapiens
agauaaaccugaucccaaa

SEQ ID NO: 258802 - RNA, 19 nt, Homo sapiens
guccugacuucaacuauaa

SEQ ID NO: 258803 - RNA, 19 nt, Homo sapiens
gagauaaugugaacuagcu

SEQ ID NO: 258804 - RNA, 19 nt, Homo sapiens
gagaagaaggaaaugaauu

SEQ ID NO: 258805 - RNA, 19 nt, Homo sapiens
gaacaucauaguuguagga

SEQ ID NO: 258806 - RNA, 19 nt, Homo sapiens
cagauaggccuucuuguga

SEQ ID NO: 258807 - RNA, 19 nt, Homo sapiens
gaauuucucuacagauguc

SEQ ID NO: 258808 - RNA, 19 nt, Homo sapiens
ccucaaagcuuccauucca

SEQ ID NO: 258809 - RNA, 19 nt, Homo sapiens
gaacggacgagauaaugug

SEQ ID NO: 258810 - RNA, 19 nt, Homo sapiens
ccucagaacggacgagaua

SEQ ID NO: 258811 - RNA, 19 nt, Homo sapiens
ccagacauuugccaaguug

SEQ ID NO: 258812 - RNA, 19 nt, Homo sapiens
caacugacgggcuuucauu

SEQ ID NO: 258813 - RNA, 19 nt, Homo sapiens
ggaaggcgaauuucagaug

SEQ ID NO: 258814 - RNA, 19 nt, Homo sapiens
gcuacucacucaaguucaa

SEQ ID NO: 258815 - RNA, 19 nt, Homo sapiens
gacgagauaaugugaacua

SEQ ID NO: 258816 - RNA, 19 nt, Homo sapiens
ggacagcaacauugagaau

SEQ ID NO: 258817 - RNA, 19 nt, Homo sapiens
ugaauuccuugccugauau

SEQ ID NO: 258818 - RNA, 19 nt, Homo sapiens
caguggaggugcugcauug

SEQ ID NO: 258819 - RNA, 19 nt, Homo sapiens
cuucgucacuuccaacaaa

SEQ ID NO: 258820 - RNA, 19 nt, Homo sapiens
gcgaaacgacugauagugu

SEQ ID NO: 258821 - RNA, 19 nt, Homo sapiens
gaaaggaaagaaaccaaag

SEQ ID NO: 258822 - RNA, 19 nt, Homo sapiens
gggcucaaguggcuuaaca

SEQ ID NO: 258823 - RNA, 19 nt, Homo sapiens
acuuauaccuugcggaauu

SEQ ID NO: 258824 - RNA, 19 nt, Homo sapiens
cuucuaaucugcuaugcuu

SEQ ID NO: 258825 - RNA, 19 nt, Homo sapiens
ggacuccagcccauuggua

SEQ ID NO: 258826 - RNA, 19 nt, Homo sapiens
gaggaauauugaaggcaaa

SEQ ID NO: 258827 - RNA, 19 nt, Homo sapiens
ggagaagaaggaaaugaau

SEQ ID NO: 258828 - RNA, 19 nt, Homo sapiens
acagcaacauugagaauca

SEQ ID NO: 258829 - RNA, 19 nt, Homo sapiens
gauaguacggugaacauca

SEQ ID NO: 258830 - RNA, 19 nt, Homo sapiens
gcaccacucuuuagaaacc

SEQ ID NO: 258831 - RNA, 19 nt, Homo sapiens
uaucagcaguuguuauuac

SEQ ID NO: 258832 - RNA, 19 nt, Homo sapiens
gauaggccuucuugugauc

SEQ ID NO: 258833 - RNA, 19 nt, Homo sapiens
guaccuggagcuucucuuu

SEQ ID NO: 258834 - RNA, 19 nt, Homo sapiens
gcaaacaguaccucagcaa

SEQ ID NO: 258835 - RNA, 19 nt, Homo sapiens
uuaagcacaucaagcaaga

SEQ ID NO: 258836 - RNA, 19 nt, Homo sapiens
gggccagcgucaucaagaa

SEQ ID NO: 258837 - RNA, 19 nt, Homo sapiens
gcccagcgaugaagagagu

SEQ ID NO: 258838 - RNA, 19 nt, Homo sapiens
augaauuccuugccugaua

SEQ ID NO: 258839 - RNA, 19 nt, Homo sapiens
accuggagcuucucuuuaa

SEQ ID NO: 258840 - RNA, 19 nt, Homo sapiens
gggcuuucauuuccauuuc

SEQ ID NO: 258841 - RNA, 19 nt, Homo sapiens
cuuaaagcacuuacagaua

SEQ ID NO: 258842 - RNA, 19 nt, Homo sapiens
agagcaauccggugccuua

SEQ ID NO: 258843 - RNA, 19 nt, Homo sapiens
cagcaguuguuauuacauc

SEQ ID NO: 258844 - RNA, 19 nt, Homo sapiens
ccagcaagguggaguggau

SEQ ID NO: 258845 - RNA, 19 nt, Homo sapiens
gagcagccggucagcauga

SEQ ID NO: 258846 - RNA, 19 nt, Homo sapiens
caaguggcuuaacaaggaa

SEQ ID NO: 258847 - RNA, 19 nt, Homo sapiens
gccagacauuugccaaguu

SEQ ID NO: 258848 - RNA, 19 nt, Homo sapiens
ccaauccgccagacauuug

SEQ ID NO: 258849 - RNA, 19 nt, Homo sapiens
aaucugcuaugcuugaaug

SEQ ID NO: 258850 - RNA, 19 nt, Homo sapiens
uuacagauaggccuucuug

SEQ ID NO: 258851 - RNA, 19 nt, Homo sapiens
gagcucaucuagcaaucag

SEQ ID NO: 258852 - RNA, 19 nt, Homo sapiens
uggaguggaugccucagaa

SEQ ID NO: 258853 - RNA, 19 nt, Homo sapiens
uugcggaauuguauuggua

SEQ ID NO: 258854 - RNA, 19 nt, Homo sapiens
aggcagcacuagcgacauu

SEQ ID NO: 258855 - RNA, 19 nt, Homo sapiens
cacccuagcaacacuuaua

SEQ ID NO: 258856 - RNA, 19 nt, Homo sapiens
gcucuacccucugcagauc

SEQ ID NO: 258857 - RNA, 19 nt, Homo sapiens
uuguagaggugaccacuga

SEQ ID NO: 258858 - RNA, 19 nt, Homo sapiens
gcacaucaagcaagaacca

SEQ ID NO: 258859 - RNA, 19 nt, Homo sapiens
gaggagaagaaggaaauga

SEQ ID NO: 258860 - RNA, 19 nt, Homo sapiens
acagauaggccuucuugug

SEQ ID NO: 258861 - RNA, 19 nt, Homo sapiens
agacauuugccaaguugua

SEQ ID NO: 258862 - RNA, 19 nt, Homo sapiens
caucuggacagcaacauug

SEQ ID NO: 258863 - RNA, 19 nt, Homo sapiens
agacaaaguuaagcacauc

SEQ ID NO: 258864 - RNA, 19 nt, Homo sapiens
gaugcgccaugaauuccuu

SEQ ID NO: 258865 - RNA, 19 nt, Homo sapiens
ucagaugcgccaugaauuc

SEQ ID NO: 258866 - RNA, 19 nt, Homo sapiens
augcaccacucuuuagaaa

SEQ ID NO: 258867 - RNA, 19 nt, Homo sapiens
gagcagauaaacuccaaca

SEQ ID NO: 258868 - RNA, 19 nt, Homo sapiens
uuaugcaaauucccagauu

SEQ ID NO: 258869 - RNA, 19 nt, Homo sapiens
cuacagaugucccauuuuc

SEQ ID NO: 258870 - RNA, 19 nt, Homo sapiens
agacaaaucuaagggaaaa

SEQ ID NO: 258871 - RNA, 19 nt, Homo sapiens
aaacaguaccucagcaaca

SEQ ID NO: 258872 - RNA, 19 nt, Homo sapiens
ggcggaagaggaauauuga

SEQ ID NO: 258873 - RNA, 19 nt, Homo sapiens
uggaguaagugaucuuucu

SEQ ID NO: 258874 - RNA, 19 nt, Homo sapiens
agaaaccgggcaauccaua

SEQ ID NO: 258875 - RNA, 19 nt, Homo sapiens
gaugcaccacucuuuagaa

SEQ ID NO: 258876 - RNA, 19 nt, Homo sapiens
gcuucugcaccuuaucuua

SEQ ID NO: 258877 - RNA, 19 nt, Homo sapiens
gggcuacucacucaaguuc

SEQ ID NO: 258878 - RNA, 19 nt, Homo sapiens
agaaaggaaagaaaccaaa

SEQ ID NO: 258879 - RNA, 19 nt, Homo sapiens
caucaaccaggaguagaua

SEQ ID NO: 258880 - RNA, 19 nt, Homo sapiens
gggcaauccauacaggaaa

SEQ ID NO: 258881 - RNA, 19 nt, Homo sapiens
cucuacagaugucccauuu

SEQ ID NO: 258882 - RNA, 19 nt, Homo sapiens
cuucugcaccuuaucuuaa

SEQ ID NO: 258883 - RNA, 19 nt, Homo sapiens
aaugugaacuagcuggaau

SEQ ID NO: 258884 - RNA, 19 nt, Homo sapiens
caaguucaaggaccaacaa

SEQ ID NO: 258885 - RNA, 19 nt, Homo sapiens
ucccagggcuacucacuca

SEQ ID NO: 258886 - RNA, 19 nt, Homo sapiens
ucaaccaggaguagauaaa

SEQ ID NO: 258887 - RNA, 19 nt, Homo sapiens
gcaucaaccaggaguagau

SEQ ID NO: 258888 - RNA, 19 nt, Homo sapiens
aucaagagauugucaccaa

SEQ ID NO: 258889 - RNA, 19 nt, Homo sapiens
ggugaacaucauaguugua

SEQ ID NO: 258890 - RNA, 19 nt, Homo sapiens
aguaugcgguccugacuuc

SEQ ID NO: 258891 - RNA, 19 nt, Homo sapiens
aaaggaaagaaaccaaaga

SEQ ID NO: 258892 - RNA, 19 nt, Homo sapiens
ugaagaagucaaggauaaa

SEQ ID NO: 258893 - RNA, 19 nt, Homo sapiens
caaagaaggguugcguuua

SEQ ID NO: 258894 - RNA, 19 nt, Homo sapiens
aaagaaggguugcguuuag

SEQ ID NO: 258895 - RNA, 19 nt, Homo sapiens
caaggaaggaggcguguuu

SEQ ID NO: 258896 - RNA, 19 nt, Homo sapiens
aggaagacauucuggauga

SEQ ID NO: 258897 - RNA, 19 nt, Homo sapiens
cgaggccacuggugcauau

SEQ ID NO: 258898 - RNA, 19 nt, Homo sapiens
uaaacugguuccugcuaug

SEQ ID NO: 258899 - RNA, 19 nt, Homo sapiens
cccaccaccucaaccaaua

SEQ ID NO: 258900 - RNA, 19 nt, Homo sapiens
caaccuggaagaggaauuu

SEQ ID NO: 258901 - RNA, 19 nt, Homo sapiens
ggccacuggugcauauguu

SEQ ID NO: 258902 - RNA, 19 nt, Homo sapiens
uuguagaucugauuaccuu

SEQ ID NO: 258903 - RNA, 19 nt, Homo sapiens
agacauucuggaugaguua

SEQ ID NO: 258904 - RNA, 19 nt, Homo sapiens
ggaagacauucuggaugag

SEQ ID NO: 258905 - RNA, 19 nt, Homo sapiens
auaaacugguuccugcuau

SEQ ID NO: 258906 - RNA, 19 nt, Homo sapiens
gcuaugcccucugguucug

SEQ ID NO: 258907 - RNA, 19 nt, Homo sapiens
guagaucugauuaccuuca

SEQ ID NO: 258908 - RNA, 19 nt, Homo sapiens
gaagacauucuggaugagu

SEQ ID NO: 258909 - RNA, 19 nt, Homo sapiens
cauaaaaucuacgaguuug

SEQ ID NO: 258910 - RNA, 19 nt, Homo sapiens
ccaccaccucaaccaauaa

SEQ ID NO: 258911 - RNA, 19 nt, Homo sapiens
aagacauucuggaugaguu

SEQ ID NO: 258912 - RNA, 19 nt, Homo sapiens
augcacagcaggaggauuu

SEQ ID NO: 258913 - RNA, 19 nt, Homo sapiens
ggaaggaggcguguuugac

SEQ ID NO: 258914 - RNA, 19 nt, Homo sapiens
aaacugguuccugcuauga

SEQ ID NO: 258915 - RNA, 19 nt, Homo sapiens
gaccugcacauuuccaaca

SEQ ID NO: 258916 - RNA, 19 nt, Homo sapiens
gacccucacgacccacaua

SEQ ID NO: 258917 - RNA, 19 nt, Homo sapiens
gccccgaccuuccaucgua

SEQ ID NO: 258918 - RNA, 19 nt, Homo sapiens
gggaagagugggaguucga

SEQ ID NO: 258919 - RNA, 19 nt, Homo sapiens
cacauaaaaucuacgaguu

SEQ ID NO: 258920 - RNA, 19 nt, Homo sapiens
aauaaacugguuccugcua

SEQ ID NO: 258921 - RNA, 19 nt, Homo sapiens
aggccuaccugcaggacuu

SEQ ID NO: 258922 - RNA, 19 nt, Homo sapiens
ugagcuacgugaggcaugu

SEQ ID NO: 258923 - RNA, 19 nt, Homo sapiens
gcccuucauuguagaucug

SEQ ID NO: 258924 - RNA, 19 nt, Homo sapiens
ccucugagaacccacugaa

SEQ ID NO: 258925 - RNA, 19 nt, Homo sapiens
gaagaagccucacacguaa

SEQ ID NO: 258926 - RNA, 19 nt, Homo sapiens
cagaugagcuuauuucaaa

SEQ ID NO: 258927 - RNA, 19 nt, Homo sapiens
ccaauugacugcccucuua

SEQ ID NO: 258928 - RNA, 19 nt, Homo sapiens
ggagcacccugucuucuua

SEQ ID NO: 258929 - RNA, 19 nt, Homo sapiens
caucacagcucacguagaa

SEQ ID NO: 258930 - RNA, 19 nt, Homo sapiens
ggaaugaacuagcuaugga

SEQ ID NO: 258931 - RNA, 19 nt, Homo sapiens
gaacugcagugauguauac

SEQ ID NO: 258932 - RNA, 19 nt, Homo sapiens
gaaaugaaucuuugacuga

SEQ ID NO: 258933 - RNA, 19 nt, Homo sapiens
ugaacuagcuauggaaaua

SEQ ID NO: 258934 - RNA, 19 nt, Homo sapiens
gaacaagagcaaugacuuu

SEQ ID NO: 258935 - RNA, 19 nt, Homo sapiens
caauucagauccaguguaa

SEQ ID NO: 258936 - RNA, 19 nt, Homo sapiens
ggaaguaagauguaaauug

SEQ ID NO: 258937 - RNA, 19 nt, Homo sapiens
ugaagaagccucacacgua

SEQ ID NO: 258938 - RNA, 19 nt, Homo sapiens
aaacuugccuuucaguauu

SEQ ID NO: 258939 - RNA, 19 nt, Homo sapiens
gcagguagguauuaguguu

SEQ ID NO: 258940 - RNA, 19 nt, Homo sapiens
ugaaggaaaugaaucuuug

SEQ ID NO: 258941 - RNA, 19 nt, Homo sapiens
ccaacaaacuggagagaga

SEQ ID NO: 258942 - RNA, 19 nt, Homo sapiens
cauaagaaauguagcugaa

SEQ ID NO: 258943 - RNA, 19 nt, Homo sapiens
aaacccagcuagacuauug

SEQ ID NO: 258944 - RNA, 19 nt, Homo sapiens
caagugaccgacucauuua

SEQ ID NO: 258945 - RNA, 19 nt, Homo sapiens
ccaggugacucuaugcuuu

SEQ ID NO: 258946 - RNA, 19 nt, Homo sapiens
ggaaaucccguaccaaugu

SEQ ID NO: 258947 - RNA, 19 nt, Homo sapiens
ccaagcggaugcuccauuu

SEQ ID NO: 258948 - RNA, 19 nt, Homo sapiens
ugaggaacaugcauaagaa

SEQ ID NO: 258949 - RNA, 19 nt, Homo sapiens
gguaugaccuagggaauga

SEQ ID NO: 258950 - RNA, 19 nt, Homo sapiens
gcagugcucuuuguagcua

SEQ ID NO: 258951 - RNA, 19 nt, Homo sapiens
ugacagggccuuaaaauua

SEQ ID NO: 258952 - RNA, 19 nt, Homo sapiens
ccacacagcacuucaaaga

SEQ ID NO: 258953 - RNA, 19 nt, Homo sapiens
gggcuacgauuuaccagaa

SEQ ID NO: 258954 - RNA, 19 nt, Homo sapiens
cuacggaacugcacacuca

SEQ ID NO: 258955 - RNA, 19 nt, Homo sapiens
gaaggguggcuuugcauuu

SEQ ID NO: 258956 - RNA, 19 nt, Homo sapiens
ccaagugaccgacucauuu

SEQ ID NO: 258957 - RNA, 19 nt, Homo sapiens
aaauguagcugaaguagag

SEQ ID NO: 258958 - RNA, 19 nt, Homo sapiens
gaacaacugugggagucuu

SEQ ID NO: 258959 - RNA, 19 nt, Homo sapiens
uaacaguggagcugaauuu

SEQ ID NO: 258960 - RNA, 19 nt, Homo sapiens
ccaguaggguuugacauuu

SEQ ID NO: 258961 - RNA, 19 nt, Homo sapiens
gugccacgcuccucuguuu

SEQ ID NO: 258962 - RNA, 19 nt, Homo sapiens
gaugacugcuuguagguau

SEQ ID NO: 258963 - RNA, 19 nt, Homo sapiens
guucauugcucuccaguca

SEQ ID NO: 258964 - RNA, 19 nt, Homo sapiens
gaacuagcuauggaaauaa

SEQ ID NO: 258965 - RNA, 19 nt, Homo sapiens
guucagcgguugaggagaa

SEQ ID NO: 258966 - RNA, 19 nt, Homo sapiens
gcaaagaaagcucaucaca

SEQ ID NO: 258967 - RNA, 19 nt, Homo sapiens
uaagaaauguagcugaagu

SEQ ID NO: 258968 - RNA, 19 nt, Homo sapiens
gcuagacuauuggguauga

SEQ ID NO: 258969 - RNA, 19 nt, Homo sapiens
ccaaagaccuccacuugcu

SEQ ID NO: 258970 - RNA, 19 nt, Homo sapiens
gcaaugacuuugaggaacu

SEQ ID NO: 258971 - RNA, 19 nt, Homo sapiens
ggaauuggcaaacuagaau

SEQ ID NO: 258972 - RNA, 19 nt, Homo sapiens
gccacuaccuccuuuccua

SEQ ID NO: 258973 - RNA, 19 nt, Homo sapiens
ugagacagaugggacuuaa

SEQ ID NO: 258974 - RNA, 19 nt, Homo sapiens
aaagagcacugggucauau

SEQ ID NO: 258975 - RNA, 19 nt, Homo sapiens
ggccaacccuccuccaaug

SEQ ID NO: 258976 - RNA, 19 nt, Homo sapiens
ggaacaugcauaagaaaug

SEQ ID NO: 258977 - RNA, 19 nt, Homo sapiens
gaaguguugggauugguua

SEQ ID NO: 258978 - RNA, 19 nt, Homo sapiens
gcacuugucucaggacucu

SEQ ID NO: 258979 - RNA, 19 nt, Homo sapiens
uguaggagcugcaguucuu

SEQ ID NO: 258980 - RNA, 19 nt, Homo sapiens
ugacugcccucuuacuguu

SEQ ID NO: 258981 - RNA, 19 nt, Homo sapiens
ggagugcagugacacaauc

SEQ ID NO: 258982 - RNA, 19 nt, Homo sapiens
caucagcaauccagaagau

SEQ ID NO: 258983 - RNA, 19 nt, Homo sapiens
cccaaauucuccucucuaa

SEQ ID NO: 258984 - RNA, 19 nt, Homo sapiens
caacaagcaccuaguaagu

SEQ ID NO: 258985 - RNA, 19 nt, Homo sapiens
cuuaauacuugaacuguug

SEQ ID NO: 258986 - RNA, 19 nt, Homo sapiens
gcucaucacagcucacgua

SEQ ID NO: 258987 - RNA, 19 nt, Homo sapiens
gagcaaugacuuugaggaa

SEQ ID NO: 258988 - RNA, 19 nt, Homo sapiens
ccucaagcaguaauuaaua

SEQ ID NO: 258989 - RNA, 19 nt, Homo sapiens
gaaggaaaugaaucuuuga

SEQ ID NO: 258990 - RNA, 19 nt, Homo sapiens
gcagaugagcuuauuucaa

SEQ ID NO: 258991 - RNA, 19 nt, Homo sapiens
caagagcaaugacuuugag

SEQ ID NO: 258992 - RNA, 19 nt, Homo sapiens
auuaagaacugcuguuuca

SEQ ID NO: 258993 - RNA, 19 nt, Homo sapiens
gcagguggaucuccuugag

SEQ ID NO: 258994 - RNA, 19 nt, Homo sapiens
gauuugaggacuuguuaaa

SEQ ID NO: 258995 - RNA, 19 nt, Homo sapiens
cuauguguauguugacuuu

SEQ ID NO: 258996 - RNA, 19 nt, Homo sapiens
guaagugccugcuguaucc

SEQ ID NO: 258997 - RNA, 19 nt, Homo sapiens
ugcguuagcucucaaaugu

SEQ ID NO: 258998 - RNA, 19 nt, Homo sapiens
gaaauguagcugaaguaga

SEQ ID NO: 258999 - RNA, 19 nt, Homo sapiens
uaagggaagauaaagauga

SEQ ID NO: 259000 - RNA, 19 nt, Homo sapiens
caaauucuccucucuaaaa

SEQ ID NO: 259001 - RNA, 19 nt, Homo sapiens
ugguuaaggucuuuauuug

SEQ ID NO: 259002 - RNA, 19 nt, Homo sapiens
cagcuagacuauuggguau

SEQ ID NO: 259003 - RNA, 19 nt, Homo sapiens
uuugaggacuuguuaaaga

SEQ ID NO: 259004 - RNA, 19 nt, Homo sapiens
caugagcgcuacucuugga

SEQ ID NO: 259005 - RNA, 19 nt, Homo sapiens
ucagggaaguaagauguaa

SEQ ID NO: 259006 - RNA, 19 nt, Homo sapiens
ucaauugcuuugugacuuc

SEQ ID NO: 259007 - RNA, 19 nt, Homo sapiens
cacccugucuucuuaauuc

SEQ ID NO: 259008 - RNA, 19 nt, Homo sapiens
gaagcugucuuggaagucu

SEQ ID NO: 259009 - RNA, 19 nt, Homo sapiens
gagcuccacugccauguac

SEQ ID NO: 259010 - RNA, 19 nt, Homo sapiens
gagcacugaaacauuauuu

SEQ ID NO: 259011 - RNA, 19 nt, Homo sapiens
aaauguguguuccugcuuu

SEQ ID NO: 259012 - RNA, 19 nt, Homo sapiens
gaaguggagauuucaguuc

SEQ ID NO: 259013 - RNA, 19 nt, Homo sapiens
gggauugguuaaggucuuu

SEQ ID NO: 259014 - RNA, 19 nt, Homo sapiens
caagggcagguagguauua

SEQ ID NO: 259015 - RNA, 19 nt, Homo sapiens
gggaagauaaagaugauau

SEQ ID NO: 259016 - RNA, 19 nt, Homo sapiens
gaaaucccguaccaauguc

SEQ ID NO: 259017 - RNA, 19 nt, Homo sapiens
ccucuuggcuuuguugaug

SEQ ID NO: 259018 - RNA, 19 nt, Homo sapiens
auuaauaucuccuggaaca

SEQ ID NO: 259019 - RNA, 19 nt, Homo sapiens
uaaagagcacugggucaua

SEQ ID NO: 259020 - RNA, 19 nt, Homo sapiens
cccagcagguucacaacua

SEQ ID NO: 259021 - RNA, 19 nt, Homo sapiens
gaagauuugaggacuuguu

SEQ ID NO: 259022 - RNA, 19 nt, Homo sapiens
gacuucuucuucuuuguuu

SEQ ID NO: 259023 - RNA, 19 nt, Homo sapiens
aaagaccuccacuugcuua

SEQ ID NO: 259024 - RNA, 19 nt, Homo sapiens
gaucagccauggcgacacu

SEQ ID NO: 259025 - RNA, 19 nt, Homo sapiens
gcacuuagguaucauauca

SEQ ID NO: 259026 - RNA, 19 nt, Homo sapiens
agaagaagcucauuacugu

SEQ ID NO: 259027 - RNA, 19 nt, Homo sapiens
ccaagaaccuggagcagaa

SEQ ID NO: 259028 - RNA, 19 nt, Homo sapiens
ggacugauguggagaugug

SEQ ID NO: 259029 - RNA, 19 nt, Homo sapiens
gcacccagcuggcaugcaa

SEQ ID NO: 259030 - RNA, 19 nt, Homo sapiens
ucaaggagcuccaucacau

SEQ ID NO: 259031 - RNA, 19 nt, Homo sapiens
caugacacccuauucuuua

SEQ ID NO: 259032 - RNA, 19 nt, Homo sapiens
gaaccuggagcagaaauaa

SEQ ID NO: 259033 - RNA, 19 nt, Homo sapiens
gagaagaagcucauuacug

SEQ ID NO: 259034 - RNA, 19 nt, Homo sapiens
cgagagaagaagcucauua

SEQ ID NO: 259035 - RNA, 19 nt, Homo sapiens
ccaaggagacagggaaaua

SEQ ID NO: 259036 - RNA, 19 nt, Homo sapiens
gagcucauccuguuccaaa

SEQ ID NO: 259037 - RNA, 19 nt, Homo sapiens
gagaucuucuucugcuuug

SEQ ID NO: 259038 - RNA, 19 nt, Homo sapiens
agaauggccugaccgcaaa

SEQ ID NO: 259039 - RNA, 19 nt, Homo sapiens
gaagaagcucauuacugua

SEQ ID NO: 259040 - RNA, 19 nt, Homo sapiens
ucaaagaggaugucaagug

SEQ ID NO: 259041 - RNA, 19 nt, Homo sapiens
gagacucacuuccucaucu

SEQ ID NO: 259042 - RNA, 19 nt, Homo sapiens
ugaccgaccuggagaucaa

SEQ ID NO: 259043 - RNA, 19 nt, Homo sapiens
aggaagagcugcagaggau

SEQ ID NO: 259044 - RNA, 19 nt, Homo sapiens
gagaggaggaggaagaaga

SEQ ID NO: 259045 - RNA, 19 nt, Homo sapiens
gcccugauuucccugguuu

SEQ ID NO: 259046 - RNA, 19 nt, Homo sapiens
ugauuucccugguuugaga

SEQ ID NO: 259047 - RNA, 19 nt, Homo sapiens
cagcuggcaugcaauaaca

SEQ ID NO: 259048 - RNA, 19 nt, Homo sapiens
gagagaagaagcucauuac

SEQ ID NO: 259049 - RNA, 19 nt, Homo sapiens
ccauaagccuggagcaagu

SEQ ID NO: 259050 - RNA, 19 nt, Homo sapiens
gaagagcugcagaggaugu

SEQ ID NO: 259051 - RNA, 19 nt, Homo sapiens
ccucugagauaauaugagu

SEQ ID NO: 259052 - RNA, 19 nt, Homo sapiens
ccuguccucugagauaaua

SEQ ID NO: 259053 - RNA, 19 nt, Homo sapiens
gcugugcccuuaacaagag

SEQ ID NO: 259054 - RNA, 19 nt, Homo sapiens
ggaggaggaagaagaggaa

SEQ ID NO: 259055 - RNA, 19 nt, Homo sapiens
aaccugcgcugugcccuua

SEQ ID NO: 259056 - RNA, 19 nt, Homo sapiens
cauuuccucuggcaacaaa

SEQ ID NO: 259057 - RNA, 19 nt, Homo sapiens
ggagcaggccuugguguug

SEQ ID NO: 259058 - RNA, 19 nt, Homo sapiens
cgagaucuucuucugcuuu

SEQ ID NO: 259059 - RNA, 19 nt, Homo sapiens
ucaucucccuguccucuga

SEQ ID NO: 259060 - RNA, 19 nt, Homo sapiens
gguccuaccucuggguuuc

SEQ ID NO: 259061 - RNA, 19 nt, Homo sapiens
ggagaucaaguuucaguac

SEQ ID NO: 259062 - RNA, 19 nt, Homo sapiens
uacgaggucugcuccaaug

SEQ ID NO: 259063 - RNA, 19 nt, Homo sapiens
uaucauaucagaugcucaa

SEQ ID NO: 259064 - RNA, 19 nt, Homo sapiens
acaugacacccuauucuuu

SEQ ID NO: 259065 - RNA, 19 nt, Homo sapiens
ggacuuccgccucaucuac

SEQ ID NO: 259066 - RNA, 19 nt, Homo sapiens
gccaugagcagggaaagaa

SEQ ID NO: 259067 - RNA, 19 nt, Homo sapiens
ccacaugacacccuauucu

SEQ ID NO: 259068 - RNA, 19 nt, Homo sapiens
uuagguaucauaucagaug

SEQ ID NO: 259069 - RNA, 19 nt, Homo sapiens
caggagaggaggaggaaga

SEQ ID NO: 259070 - RNA, 19 nt, Homo sapiens
ccucagcccuacaagaucu

SEQ ID NO: 259071 - RNA, 19 nt, Homo sapiens
ccaagaaggagagggagaa

SEQ ID NO: 259072 - RNA, 19 nt, Homo sapiens
cgaccuggagaucaaguuu

SEQ ID NO: 259073 - RNA, 19 nt, Homo sapiens
ucugagauaauaugaguga

SEQ ID NO: 259074 - RNA, 19 nt, Homo sapiens
acccuauucuuuacucaaa

SEQ ID NO: 259075 - RNA, 19 nt, Homo sapiens
caccucagcccuacaagau

SEQ ID NO: 259076 - RNA, 19 nt, Homo sapiens
gagcacuuagguaucauau

SEQ ID NO: 259077 - RNA, 19 nt, Homo sapiens
caagaaggagagggagaaa

SEQ ID NO: 259078 - RNA, 19 nt, Homo sapiens
uaacaagagccgggacuuc

SEQ ID NO: 259079 - RNA, 19 nt, Homo sapiens
gccuggcucucgggaaauu

SEQ ID NO: 259080 - RNA, 19 nt, Homo sapiens
gaagcucauuacuguacag

SEQ ID NO: 259081 - RNA, 19 nt, Homo sapiens
caacggggaaaagaaauua

SEQ ID NO: 259082 - RNA, 19 nt, Homo sapiens
gacugcugcuggagauguu

SEQ ID NO: 259083 - RNA, 19 nt, Homo sapiens
ggaggaagaagaggaagag

SEQ ID NO: 259084 - RNA, 19 nt, Homo sapiens
gcgcugugcccuuaacaag

SEQ ID NO: 259085 - RNA, 19 nt, Homo sapiens
acuuagguaucauaucaga

SEQ ID NO: 259086 - RNA, 19 nt, Homo sapiens
ccaccacccuucgagaucu

SEQ ID NO: 259087 - RNA, 19 nt, Homo sapiens
caaacccagaccucaaaga

SEQ ID NO: 259088 - RNA, 19 nt, Homo sapiens
guacccagggcuucaaugg

SEQ ID NO: 259089 - RNA, 19 nt, Homo sapiens
agaaggagagggagaaagg

SEQ ID NO: 259090 - RNA, 19 nt, Homo sapiens
caaaagggccagaccaaca

SEQ ID NO: 259091 - RNA, 19 nt, Homo sapiens
ccaccucagcccuacaaga

SEQ ID NO: 259092 - RNA, 19 nt, Homo sapiens
cacaugacacccuauucuu

SEQ ID NO: 259093 - RNA, 19 nt, Homo sapiens
caagaaccuggagcagaaa

SEQ ID NO: 259094 - RNA, 19 nt, Homo sapiens
ggcccacucuugugauugc

SEQ ID NO: 259095 - RNA, 19 nt, Homo sapiens
caaggagacagggaaauac

SEQ ID NO: 259096 - RNA, 19 nt, Homo sapiens
ucccuguccucugagauaa

SEQ ID NO: 259097 - RNA, 19 nt, Homo sapiens
gcggacugauguggagaug

SEQ ID NO: 259098 - RNA, 19 nt, Homo sapiens
aagaagcucauuacuguac

SEQ ID NO: 259099 - RNA, 19 nt, Homo sapiens
ggagcagguggaacucuuc

SEQ ID NO: 259100 - RNA, 19 nt, Homo sapiens
ugccagaccugcugaucag

SEQ ID NO: 259101 - RNA, 19 nt, Homo sapiens
gacacccuauucuuuacuc

SEQ ID NO: 259102 - RNA, 19 nt, Homo sapiens
ggucaacggggaaaagaaa

SEQ ID NO: 259103 - RNA, 19 nt, Homo sapiens
gcacuuagguaucauauca

SEQ ID NO: 259104 - RNA, 19 nt, Homo sapiens
agaagaagcucauuacugu

SEQ ID NO: 259105 - RNA, 19 nt, Homo sapiens
ccaagaaccuggagcagaa

SEQ ID NO: 259106 - RNA, 19 nt, Homo sapiens
ggacugauguggagaugug

SEQ ID NO: 259107 - RNA, 19 nt, Homo sapiens
gcacccagcuggcaugcaa

SEQ ID NO: 259108 - RNA, 19 nt, Homo sapiens
ucaaggagcuccaucacau

SEQ ID NO: 259109 - RNA, 19 nt, Homo sapiens
gaaccuggagcagaaauaa

SEQ ID NO: 259110 - RNA, 19 nt, Homo sapiens
gagaagaagcucauuacug

SEQ ID NO: 259111 - RNA, 19 nt, Homo sapiens
cgagagaagaagcucauua

SEQ ID NO: 259112 - RNA, 19 nt, Homo sapiens
ccaaggagacagggaaaua

SEQ ID NO: 259113 - RNA, 19 nt, Homo sapiens
gagcucauccuguuccaaa

SEQ ID NO: 259114 - RNA, 19 nt, Homo sapiens
gagaucuucuucugcuuug

SEQ ID NO: 259115 - RNA, 19 nt, Homo sapiens
agaauggccugaccgcaaa

SEQ ID NO: 259116 - RNA, 19 nt, Homo sapiens
gaagaagcucauuacugua

SEQ ID NO: 259117 - RNA, 19 nt, Homo sapiens
gagacucacuuccucaucu

SEQ ID NO: 259118 - RNA, 19 nt, Homo sapiens
ugaccgaccuggagaucaa

SEQ ID NO: 259119 - RNA, 19 nt, Homo sapiens
aggaagagcugcagaggau

SEQ ID NO: 259120 - RNA, 19 nt, Homo sapiens
gagaggaggaggaagaaga

SEQ ID NO: 259121 - RNA, 19 nt, Homo sapiens
gcccugauuucccugguuu

SEQ ID NO: 259122 - RNA, 19 nt, Homo sapiens
ucacagaggaugucaagug

SEQ ID NO: 259123 - RNA, 19 nt, Homo sapiens
ugauuucccugguuugaga

SEQ ID NO: 259124 - RNA, 19 nt, Homo sapiens
cagcuggcaugcaauaaca

SEQ ID NO: 259125 - RNA, 19 nt, Homo sapiens
gagagaagaagcucauuac

SEQ ID NO: 259126 - RNA, 19 nt, Homo sapiens
ccauaagccuggagcaagu

SEQ ID NO: 259127 - RNA, 19 nt, Homo sapiens
gaagagcugcagaggaugu

SEQ ID NO: 259128 - RNA, 19 nt, Homo sapiens
ccucugagauaauaugagu

SEQ ID NO: 259129 - RNA, 19 nt, Homo sapiens
ccuguccucugagauaaua

SEQ ID NO: 259130 - RNA, 19 nt, Homo sapiens
gcugugcccuuaacaagag

SEQ ID NO: 259131 - RNA, 19 nt, Homo sapiens
ggaggaggaagaagaggaa

SEQ ID NO: 259132 - RNA, 19 nt, Homo sapiens
aaccugcgcugugcccuua

SEQ ID NO: 259133 - RNA, 19 nt, Homo sapiens
cauuuccucuggcaacaaa

SEQ ID NO: 259134 - RNA, 19 nt, Homo sapiens
ggagcaggccuugguguug

SEQ ID NO: 259135 - RNA, 19 nt, Homo sapiens
cgagaucuucuucugcuuu

SEQ ID NO: 259136 - RNA, 19 nt, Homo sapiens
ucaucucccuguccucuga

SEQ ID NO: 259137 - RNA, 19 nt, Homo sapiens
gguccuaccucuggguuuc

SEQ ID NO: 259138 - RNA, 19 nt, Homo sapiens
ggagaucaaguuucaguac

SEQ ID NO: 259139 - RNA, 19 nt, Homo sapiens
uacgaggucugcuccaaug

SEQ ID NO: 259140 - RNA, 19 nt, Homo sapiens
uaucauaucagaugcucaa

SEQ ID NO: 259141 - RNA, 19 nt, Homo sapiens
ggacuuccgccucaucuac

SEQ ID NO: 259142 - RNA, 19 nt, Homo sapiens
gccaugagcagggaaagaa

SEQ ID NO: 259143 - RNA, 19 nt, Homo sapiens
uuagguaucauaucagaug

SEQ ID NO: 259144 - RNA, 19 nt, Homo sapiens
caggagaggaggaggaaga

SEQ ID NO: 259145 - RNA, 19 nt, Homo sapiens
ccucagcccuacaagaucu

SEQ ID NO: 259146 - RNA, 19 nt, Homo sapiens
ccaagaaggagagggagaa

SEQ ID NO: 259147 - RNA, 19 nt, Homo sapiens
cgaccuggagaucaaguuu

SEQ ID NO: 259148 - RNA, 19 nt, Homo sapiens
ucugagauaauaugaguga

SEQ ID NO: 259149 - RNA, 19 nt, Homo sapiens
caccucagcccuacaagau

SEQ ID NO: 259150 - RNA, 19 nt, Homo sapiens
gagcacuuagguaucauau

SEQ ID NO: 259151 - RNA, 19 nt, Homo sapiens
caagaaggagagggagaaa

SEQ ID NO: 259152 - RNA, 19 nt, Homo sapiens
uaacaagagccgggacuuc

SEQ ID NO: 259153 - RNA, 19 nt, Homo sapiens
gccuggcucucgggaaauu

SEQ ID NO: 259154 - RNA, 19 nt, Homo sapiens
gaagcucauuacuguacag

SEQ ID NO: 259155 - RNA, 19 nt, Homo sapiens
gacugcugcuggagauguu

SEQ ID NO: 259156 - RNA, 19 nt, Homo sapiens
caacggggaaaagaaauua

SEQ ID NO: 259157 - RNA, 19 nt, Homo sapiens
ggaggaagaagaggaagag

SEQ ID NO: 259158 - RNA, 19 nt, Homo sapiens
gcgcugugcccuuaacaag

SEQ ID NO: 259159 - RNA, 19 nt, Homo sapiens
acuuagguaucauaucaga

SEQ ID NO: 259160 - RNA, 19 nt, Homo sapiens
ccaccacccuucgagaucu

SEQ ID NO: 259161 - RNA, 19 nt, Homo sapiens
caaacccagaccucaaaga

SEQ ID NO: 259162 - RNA, 19 nt, Homo sapiens
guacccagggcuucaaugg

SEQ ID NO: 259163 - RNA, 19 nt, Homo sapiens
agaaggagagggagaaagg

SEQ ID NO: 259164 - RNA, 19 nt, Homo sapiens
caaaagggccagaccaaca

SEQ ID NO: 259165 - RNA, 19 nt, Homo sapiens
ccaccucagcccuacaaga

SEQ ID NO: 259166 - RNA, 19 nt, Homo sapiens
caagaaccuggagcagaaa

SEQ ID NO: 259167 - RNA, 19 nt, Homo sapiens
ggcccacucuugugauugc

SEQ ID NO: 259168 - RNA, 19 nt, Homo sapiens
caaggagacagggaaauac

SEQ ID NO: 259169 - RNA, 19 nt, Homo sapiens
ucccuguccucugagauaa

SEQ ID NO: 259170 - RNA, 19 nt, Homo sapiens
ggucaacggggaaaagaaa

SEQ ID NO: 259171 - RNA, 19 nt, Homo sapiens
gcggacugauguggagaug

SEQ ID NO: 259172 - RNA, 19 nt, Homo sapiens
aagaagcucauuacuguac

SEQ ID NO: 259173 - RNA, 19 nt, Homo sapiens
ggagcagguggaacucuuc

SEQ ID NO: 259174 - RNA, 19 nt, Homo sapiens
ugccagaccugcugaucag

SEQ ID NO: 259175 - RNA, 19 nt, Homo sapiens
gaaauugcauccagcuuua

SEQ ID NO: 259176 - RNA, 19 nt, Homo sapiens
gaagauauaucaagugugu

SEQ ID NO: 259177 - RNA, 19 nt, Homo sapiens
gcauagcccucaacaagaa

SEQ ID NO: 259178 - RNA, 19 nt, Homo sapiens
gaucagcucucucccaaug

SEQ ID NO: 259179 - RNA, 19 nt, Homo sapiens
ccaaggaggugcccaugaa

SEQ ID NO: 259180 - RNA, 19 nt, Homo sapiens
gaucuucgcugcggacuug

SEQ ID NO: 259181 - RNA, 19 nt, Homo sapiens
ggaaaccauuggaaaggaa

SEQ ID NO: 259182 - RNA, 19 nt, Homo sapiens
ggucagcggucaugccauu

SEQ ID NO: 259183 - RNA, 19 nt, Homo sapiens
ugacugaccuggacaucaa

SEQ ID NO: 259184 - RNA, 19 nt, Homo sapiens
uaaacugccuggaacagaa

SEQ ID NO: 259185 - RNA, 19 nt, Homo sapiens
ucuaaacgcuuccagauuc

SEQ ID NO: 259186 - RNA, 19 nt, Homo sapiens
ggaaaggaaacucaucuug

SEQ ID NO: 259187 - RNA, 19 nt, Homo sapiens
gggaugagaaggauaauga

SEQ ID NO: 259188 - RNA, 19 nt, Homo sapiens
caucaaggauaacaucguu

SEQ ID NO: 259189 - RNA, 19 nt, Homo sapiens
gcagagaauucaaccugau

SEQ ID NO: 259190 - RNA, 19 nt, Homo sapiens
gagaucuacuuaugcuuug

SEQ ID NO: 259191 - RNA, 19 nt, Homo sapiens
ugaagaagaugaggaagau

SEQ ID NO: 259192 - RNA, 19 nt, Homo sapiens
gugaagauauaucaagugu

SEQ ID NO: 259193 - RNA, 19 nt, Homo sapiens
gaaggauaaugauguggau

SEQ ID NO: 259194 - RNA, 19 nt, Homo sapiens
aaaucacccuucagacuuu

SEQ ID NO: 259195 - RNA, 19 nt, Homo sapiens
aaaggaaacucaucuuggu

SEQ ID NO: 259196 - RNA, 19 nt, Homo sapiens
ggacagauugagcaaagaa

SEQ ID NO: 259197 - RNA, 19 nt, Homo sapiens
aaaguuuccucaagcacua

SEQ ID NO: 259198 - RNA, 19 nt, Homo sapiens
ggaaacucaucuugguuca

SEQ ID NO: 259199 - RNA, 19 nt, Homo sapiens
auaaugauguggaugaaga

SEQ ID NO: 259200 - RNA, 19 nt, Homo sapiens
gaauucaaccugauguaug

SEQ ID NO: 259201 - RNA, 19 nt, Homo sapiens
ugaacccagugaagauaua

SEQ ID NO: 259202 - RNA, 19 nt, Homo sapiens
ucaaugaccuucuucuacu

SEQ ID NO: 259203 - RNA, 19 nt, Homo sapiens
ugaaauugcauccagcuuu

SEQ ID NO: 259204 - RNA, 19 nt, Homo sapiens
ggauaaugauguggaugaa

SEQ ID NO: 259205 - RNA, 19 nt, Homo sapiens
gggcucaucuggcuacaca

SEQ ID NO: 259206 - RNA, 19 nt, Homo sapiens
cauaguagaaggagauuug

SEQ ID NO: 259207 - RNA, 19 nt, Homo sapiens
gagcauauuaccaaugaga

SEQ ID NO: 259208 - RNA, 19 nt, Homo sapiens
aauucaaccugauguauga

SEQ ID NO: 259209 - RNA, 19 nt, Homo sapiens
gggaaaccauuggaaagga

SEQ ID NO: 259210 - RNA, 19 nt, Homo sapiens
aaaagaaggucaagcuauu

SEQ ID NO: 259211 - RNA, 19 nt, Homo sapiens
guacuggucugggccaugu

SEQ ID NO: 259212 - RNA, 19 nt, Homo sapiens
ggaugaagaagaugaggaa

SEQ ID NO: 259213 - RNA, 19 nt, Homo sapiens
cagcuuugcuuccaaugug

SEQ ID NO: 259214 - RNA, 19 nt, Homo sapiens
cuccaaauaugccuagauu

SEQ ID NO: 259215 - RNA, 19 nt, Homo sapiens
cugagcauauuaccaauga

SEQ ID NO: 259216 - RNA, 19 nt, Homo sapiens
ugagaaggauaaugaugug

SEQ ID NO: 259217 - RNA, 19 nt, Homo sapiens
gcgcugugcucucaauaag

SEQ ID NO: 259218 - RNA, 19 nt, Homo sapiens
ugagaucuacuuaugcuuu

SEQ ID NO: 259219 - RNA, 19 nt, Homo sapiens
cagaagcuguucacuagca

SEQ ID NO: 259220 - RNA, 19 nt, Homo sapiens
ggaaagacaagccgacucu

SEQ ID NO: 259221 - RNA, 19 nt, Homo sapiens
ggccugggcuguagagaca

SEQ ID NO: 259222 - RNA, 19 nt, Homo sapiens
gaaaggacagauagagaag

SEQ ID NO: 259223 - RNA, 19 nt, Homo sapiens
ggacaucaaguuucaguac

SEQ ID NO: 259224 - RNA, 19 nt, Homo sapiens
gagaauucaaccugaugua

SEQ ID NO: 259225 - RNA, 19 nt, Homo sapiens
gaacggacucaaugaccuu

SEQ ID NO: 259226 - RNA, 19 nt, Homo sapiens
cguuugagaucuacuuaug

SEQ ID NO: 259227 - RNA, 19 nt, Homo sapiens
gagaagcagccaccguuug

SEQ ID NO: 259228 - RNA, 19 nt, Homo sapiens
ccccagggcucgaucauua

SEQ ID NO: 259229 - RNA, 19 nt, Homo sapiens
gaauccuucugcauuguuc

SEQ ID NO: 259230 - RNA, 19 nt, Homo sapiens
ggaguagugccugaaauug

SEQ ID NO: 259231 - RNA, 19 nt, Homo sapiens
ugaagagauuggaguagug

SEQ ID NO: 259232 - RNA, 19 nt, Homo sapiens
gcuucagauuuauugcuua

SEQ ID NO: 259233 - RNA, 19 nt, Homo sapiens
caaugaccuucuucuacuu

SEQ ID NO: 259234 - RNA, 19 nt, Homo sapiens
agcagaagcuguucacuag

SEQ ID NO: 259235 - RNA, 19 nt, Homo sapiens
ugauguggaugaagaagau

SEQ ID NO: 259236 - RNA, 19 nt, Homo sapiens
ucaauaagagcagagaauu

SEQ ID NO: 259237 - RNA, 19 nt, Homo sapiens
gugaagagauuggaguagu

SEQ ID NO: 259238 - RNA, 19 nt, Homo sapiens
uuucaaaucuccuaauggu

SEQ ID NO: 259239 - RNA, 19 nt, Homo sapiens
caucuugguucaggucauu

SEQ ID NO: 259240 - RNA, 19 nt, Homo sapiens
guggacagauugagcaaag

SEQ ID NO: 259241 - RNA, 19 nt, Homo sapiens
agaaaggacagauagagaa

SEQ ID NO: 259242 - RNA, 19 nt, Homo sapiens
cggcauagcccucaacaag

SEQ ID NO: 259243 - RNA, 19 nt, Homo sapiens
gaaaccauuggaaaggaaa

SEQ ID NO: 259244 - RNA, 19 nt, Homo sapiens
gaugagaaggauaaugaug

SEQ ID NO: 259245 - RNA, 19 nt, Homo sapiens
guuaaaguuuccucaagca

SEQ ID NO: 259246 - RNA, 19 nt, Homo sapiens
gcaagcugcuggacgucau

SEQ ID NO: 259247 - RNA, 19 nt, Homo sapiens
aagcagaagcuguucacua

SEQ ID NO: 259248 - RNA, 19 nt, Homo sapiens
cuauagcucuccagaacug

SEQ ID NO: 259249 - RNA, 19 nt, Homo sapiens
agaagcagccaccguuuga

SEQ ID NO: 259250 - RNA, 19 nt, Homo sapiens
cagaaaggacagauagaga

SEQ ID NO: 259251 - RNA, 19 nt, Homo sapiens
aaacauuccuuagcgaucu

SEQ ID NO: 259252 - RNA, 19 nt, Homo sapiens
gaaccugcagucccuacuu

SEQ ID NO: 259253 - RNA, 19 nt, Homo sapiens
caagccgacucuucagauc

SEQ ID NO: 259254 - RNA, 19 nt, Homo sapiens
ccaaugugaccuugaacaa

SEQ ID NO: 259255 - RNA, 19 nt, Homo sapiens
gauuuggccugggaguuug

SEQ ID NO: 259256 - RNA, 19 nt, Homo sapiens
caucuucuuccuucucuuu

SEQ ID NO: 259257 - RNA, 19 nt, Homo sapiens
ugccugcucuuccauauca

SEQ ID NO: 259258 - RNA, 19 nt, Homo sapiens
ucagcggucaugccauuua

SEQ ID NO: 259259 - RNA, 19 nt, Homo sapiens
aagaagaugaggaagauga

SEQ ID NO: 259260 - RNA, 19 nt, Homo sapiens
caauaagagcagagaauuc

SEQ ID NO: 259261 - RNA, 19 nt, Homo sapiens
aaagaaggucaagcuauuu

SEQ ID NO: 259262 - RNA, 19 nt, Homo sapiens
cagcggucaugccauuuau

SEQ ID NO: 259263 - RNA, 19 nt, Homo sapiens
gaagaugagcuggaucagu

SEQ ID NO: 259264 - RNA, 19 nt, Homo sapiens
ugaggaagaugagcuggau

SEQ ID NO: 259265 - RNA, 19 nt, Homo sapiens
cagugaagauauaucaagu

SEQ ID NO: 259266 - RNA, 19 nt, Homo sapiens
aauaagagcagagaauuca

SEQ ID NO: 259267 - RNA, 19 nt, Homo sapiens
ccaccagaaaggacagaua

SEQ ID NO: 259268 - RNA, 19 nt, Homo sapiens
ucucauugcccaccagaaa

SEQ ID NO: 259269 - RNA, 19 nt, Homo sapiens
ugaccuggacaucaaguuu

SEQ ID NO: 259270 - RNA, 19 nt, Homo sapiens
auacagcccuucuauagcu

SEQ ID NO: 259271 - RNA, 19 nt, Homo sapiens
caugaacccagugaagaua

SEQ ID NO: 259272 - RNA, 19 nt, Homo sapiens
cuucugcauuguucuugua

SEQ ID NO: 259273 - RNA, 19 nt, Homo sapiens
ugaccuucuucuacuugua

SEQ ID NO: 259274 - RNA, 19 nt, Homo sapiens
ggcauagcccucaacaaga

SEQ ID NO: 259275 - RNA, 19 nt, Homo sapiens
caacaccugugacuucaug

SEQ ID NO: 259276 - RNA, 19 nt, Homo sapiens
gaacccagucuaaugagaa

SEQ ID NO: 259277 - RNA, 19 nt, Homo sapiens
gcccuuaccuccccuguua

SEQ ID NO: 259278 - RNA, 19 nt, Homo sapiens
gagcugugcuggcgagaag

SEQ ID NO: 259279 - RNA, 19 nt, Homo sapiens
cuaaugagaacuccagaaa

SEQ ID NO: 259280 - RNA, 19 nt, Homo sapiens
ggccacaccugcagucaca

SEQ ID NO: 259281 - RNA, 19 nt, Homo sapiens
guucaacaccugugacuuc

SEQ ID NO: 259282 - RNA, 19 nt, Homo sapiens
aaugagaacuccagaaagc

SEQ ID NO: 259283 - RNA, 19 nt, Homo sapiens
ggacgugaccaucauguac

SEQ ID NO: 259284 - RNA, 19 nt, Homo sapiens
gagcugcacguuccuauac

SEQ ID NO: 259285 - RNA, 19 nt, Homo sapiens
cagcgucgguggcuacaag

SEQ ID NO: 259286 - RNA, 19 nt, Homo sapiens
gcgccaacagccucuauga

SEQ ID NO: 259287 - RNA, 19 nt, Homo sapiens
gcaagugcaagguguacug

SEQ ID NO: 259288 - RNA, 19 nt, Homo sapiens
ggugugucuucccuggaua

SEQ ID NO: 259289 - RNA, 19 nt, Homo sapiens
gggugugucuucccuggau

SEQ ID NO: 259290 - RNA, 19 nt, Homo sapiens
ccuggacacugguucaaca

SEQ ID NO: 259291 - RNA, 19 nt, Homo sapiens
agaacccagucuaaugaga

SEQ ID NO: 259292 - RNA, 19 nt, Homo sapiens
gcgcuggacgugaccauca

SEQ ID NO: 259293 - RNA, 19 nt, Homo sapiens
cagauccagucccaaccaa

SEQ ID NO: 259294 - RNA, 19 nt, Homo sapiens
acaccugaccgccaccuaa

SEQ ID NO: 259295 - RNA, 19 nt, Homo sapiens
caucgagugcuuccuuaug

SEQ ID NO: 259296 - RNA, 19 nt, Homo sapiens
cgagcugcacguuccuaua

SEQ ID NO: 259297 - RNA, 19 nt, Homo sapiens
cuucagagucuucuuccaa

SEQ ID NO: 259298 - RNA, 19 nt, Homo sapiens
gcagauccagucccaacca

SEQ ID NO: 259299 - RNA, 19 nt, Homo sapiens
gacgugaccaucauguaca

SEQ ID NO: 259300 - RNA, 19 nt, Homo sapiens
caacaccugugacuucaug

SEQ ID NO: 259301 - RNA, 19 nt, Homo sapiens
gaacccagucuaaugagaa

SEQ ID NO: 259302 - RNA, 19 nt, Homo sapiens
gcccuuaccuccccuguua

SEQ ID NO: 259303 - RNA, 19 nt, Homo sapiens
gagcugugcuggcgagaag

SEQ ID NO: 259304 - RNA, 19 nt, Homo sapiens
cuaaugagaacuccagaaa

SEQ ID NO: 259305 - RNA, 19 nt, Homo sapiens
ggccacaccugcagucaca

SEQ ID NO: 259306 - RNA, 19 nt, Homo sapiens
guucaacaccugugacuuc

SEQ ID NO: 259307 - RNA, 19 nt, Homo sapiens
aaugagaacuccagaaagc

SEQ ID NO: 259308 - RNA, 19 nt, Homo sapiens
ggacgugaccaucauguac

SEQ ID NO: 259309 - RNA, 19 nt, Homo sapiens
gagcugcacguuccuauac

SEQ ID NO: 259310 - RNA, 19 nt, Homo sapiens
cagcgucgguggcuacaag

SEQ ID NO: 259311 - RNA, 19 nt, Homo sapiens
gcgccaacagccucuauga

SEQ ID NO: 259312 - RNA, 19 nt, Homo sapiens
gcaagugcaagguguacug

SEQ ID NO: 259313 - RNA, 19 nt, Homo sapiens
ggugugucuucccuggaua

SEQ ID NO: 259314 - RNA, 19 nt, Homo sapiens
gggugugucuucccuggau

SEQ ID NO: 259315 - RNA, 19 nt, Homo sapiens
ccuggacacugguucaaca

SEQ ID NO: 259316 - RNA, 19 nt, Homo sapiens
agaacccagucuaaugaga

SEQ ID NO: 259317 - RNA, 19 nt, Homo sapiens
gcgcuggacgugaccauca

SEQ ID NO: 259318 - RNA, 19 nt, Homo sapiens
cagauccagucccaaccaa

SEQ ID NO: 259319 - RNA, 19 nt, Homo sapiens
acaccugaccgccaccuaa

SEQ ID NO: 259320 - RNA, 19 nt, Homo sapiens
caucgagugcuuccuuaug

SEQ ID NO: 259321 - RNA, 19 nt, Homo sapiens
cgagcugcacguuccuaua

SEQ ID NO: 259322 - RNA, 19 nt, Homo sapiens
cuucagagucuucuuccaa

SEQ ID NO: 259323 - RNA, 19 nt, Homo sapiens
gcagauccagucccaacca

SEQ ID NO: 259324 - RNA, 19 nt, Homo sapiens
gacgugaccaucauguaca

SEQ ID NO: 259325 - RNA, 19 nt, Homo sapiens
caacaccugugacuucaug

SEQ ID NO: 259326 - RNA, 19 nt, Homo sapiens
gaacccagucuaaugagaa

SEQ ID NO: 259327 - RNA, 19 nt, Homo sapiens
gcccuuaccuccccuguua

SEQ ID NO: 259328 - RNA, 19 nt, Homo sapiens
gagcugugcuggcgagaag

SEQ ID NO: 259329 - RNA, 19 nt, Homo sapiens
cuaaugagaacuccagaaa

SEQ ID NO: 259330 - RNA, 19 nt, Homo sapiens
ggccacaccugcagucaca

SEQ ID NO: 259331 - RNA, 19 nt, Homo sapiens
guucaacaccugugacuuc

SEQ ID NO: 259332 - RNA, 19 nt, Homo sapiens
aaugagaacuccagaaagc

SEQ ID NO: 259333 - RNA, 19 nt, Homo sapiens
ggacgugaccaucauguac

SEQ ID NO: 259334 - RNA, 19 nt, Homo sapiens
gagcugcacguuccuauac

SEQ ID NO: 259335 - RNA, 19 nt, Homo sapiens
cagcgucgguggcuacaag

SEQ ID NO: 259336 - RNA, 19 nt, Homo sapiens
gcgccaacagccucuauga

SEQ ID NO: 259337 - RNA, 19 nt, Homo sapiens
gcaagugcaagguguacug

SEQ ID NO: 259338 - RNA, 19 nt, Homo sapiens
ggugugucuucccuggaua

SEQ ID NO: 259339 - RNA, 19 nt, Homo sapiens
gggugugucuucccuggau

SEQ ID NO: 259340 - RNA, 19 nt, Homo sapiens
ccuggacacugguucaaca

SEQ ID NO: 259341 - RNA, 19 nt, Homo sapiens
agaacccagucuaaugaga

SEQ ID NO: 259342 - RNA, 19 nt, Homo sapiens
gcgcuggacgugaccauca

SEQ ID NO: 259343 - RNA, 19 nt, Homo sapiens
acaccugaccgccaccuaa

SEQ ID NO: 259344 - RNA, 19 nt, Homo sapiens
caucgagugcuuccuuaug

SEQ ID NO: 259345 - RNA, 19 nt, Homo sapiens
cgagcugcacguuccuaua

SEQ ID NO: 259346 - RNA, 19 nt, Homo sapiens
cuucagagucuucuuccaa

SEQ ID NO: 259347 - RNA, 19 nt, Homo sapiens
gacgugaccaucauguaca

SEQ ID NO: 259348 - RNA, 19 nt, Homo sapiens
caacaccugugacuucaug

SEQ ID NO: 259349 - RNA, 19 nt, Homo sapiens
gaacccagucuaaugagaa

SEQ ID NO: 259350 - RNA, 19 nt, Homo sapiens
uccgagagcugguggaauu

SEQ ID NO: 259351 - RNA, 19 nt, Homo sapiens
gcccuuaccuccccuguua

SEQ ID NO: 259352 - RNA, 19 nt, Homo sapiens
gagcugugcuggcgagaag

SEQ ID NO: 259353 - RNA, 19 nt, Homo sapiens
cuaaugagaacuccagaaa

SEQ ID NO: 259354 - RNA, 19 nt, Homo sapiens
ggccacaccugcagucaca

SEQ ID NO: 259355 - RNA, 19 nt, Homo sapiens
guucaacaccugugacuuc

SEQ ID NO: 259356 - RNA, 19 nt, Homo sapiens
aaugagaacuccagaaagc

SEQ ID NO: 259357 - RNA, 19 nt, Homo sapiens
ggacgugaccaucauguac

SEQ ID NO: 259358 - RNA, 19 nt, Homo sapiens
gagcugcacguuccuauac

SEQ ID NO: 259359 - RNA, 19 nt, Homo sapiens
cagcgucgguggcuacaag

SEQ ID NO: 259360 - RNA, 19 nt, Homo sapiens
gcgccaacagccucuauga

SEQ ID NO: 259361 - RNA, 19 nt, Homo sapiens
gcaagugcaagguguacug

SEQ ID NO: 259362 - RNA, 19 nt, Homo sapiens
ggugugucuucccuggaua

SEQ ID NO: 259363 - RNA, 19 nt, Homo sapiens
gggugugucuucccuggau

SEQ ID NO: 259364 - RNA, 19 nt, Homo sapiens
ccuggacacugguucaaca

SEQ ID NO: 259365 - RNA, 19 nt, Homo sapiens
agaacccagucuaaugaga

SEQ ID NO: 259366 - RNA, 19 nt, Homo sapiens
gcgcuggacgugaccauca

SEQ ID NO: 259367 - RNA, 19 nt, Homo sapiens
cagauccagucccaaccaa

SEQ ID NO: 259368 - RNA, 19 nt, Homo sapiens
caucgagugcuuccuuaug

SEQ ID NO: 259369 - RNA, 19 nt, Homo sapiens
cgagcugcacguuccuaua

SEQ ID NO: 259370 - RNA, 19 nt, Homo sapiens
gcagauccagucccaacca

SEQ ID NO: 259371 - RNA, 19 nt, Homo sapiens
gacgugaccaucauguaca

SEQ ID NO: 259372 - RNA, 19 nt, Homo sapiens
acaccugacagccaccuaa

SEQ ID NO: 259373 - RNA, 19 nt, Homo sapiens
caaagaaccugauugguau

SEQ ID NO: 259374 - RNA, 19 nt, Homo sapiens
ggacuuagcuggccacagu

SEQ ID NO: 259375 - RNA, 19 nt, Homo sapiens
gcacaaacgcuucuucgua

SEQ ID NO: 259376 - RNA, 19 nt, Homo sapiens
ccacagcucugcuuccuuu

SEQ ID NO: 259377 - RNA, 19 nt, Homo sapiens
gcccaaggauauuuaauuu

SEQ ID NO: 259378 - RNA, 19 nt, Homo sapiens
caauaggccauguuaauua

SEQ ID NO: 259379 - RNA, 19 nt, Homo sapiens
ggacaucacagcagaauga

SEQ ID NO: 259380 - RNA, 19 nt, Homo sapiens
gaucaucaaucccaucaga

SEQ ID NO: 259381 - RNA, 19 nt, Homo sapiens
cgacugagcugguauuugg

SEQ ID NO: 259382 - RNA, 19 nt, Homo sapiens
gaugugggauggagguaua

SEQ ID NO: 259383 - RNA, 19 nt, Homo sapiens
guaauugaauggaagcaaa

SEQ ID NO: 259384 - RNA, 19 nt, Homo sapiens
caaauccucuucuaacuca

SEQ ID NO: 259385 - RNA, 19 nt, Homo sapiens
acaaagaaccugauuggua

SEQ ID NO: 259386 - RNA, 19 nt, Homo sapiens
aaagaggucuggcaaguga

SEQ ID NO: 259387 - RNA, 19 nt, Homo sapiens
uaaaugaccucagcaaauc

SEQ ID NO: 259388 - RNA, 19 nt, Homo sapiens
ggauggagguauacaaugu

SEQ ID NO: 259389 - RNA, 19 nt, Homo sapiens
gguauacaauguucuguug

SEQ ID NO: 259390 - RNA, 19 nt, Homo sapiens
gcauaaacuucaucuucaa

SEQ ID NO: 259391 - RNA, 19 nt, Homo sapiens
gagcugaguuccuuauaag

SEQ ID NO: 259392 - RNA, 19 nt, Homo sapiens
cauagaugguucucaauug

SEQ ID NO: 259393 - RNA, 19 nt, Homo sapiens
gaauaaugagucugcauaa

SEQ ID NO: 259394 - RNA, 19 nt, Homo sapiens
gcacugaggaguacaugaa

SEQ ID NO: 259395 - RNA, 19 nt, Homo sapiens
ggagaauggucuuaacuac

SEQ ID NO: 259396 - RNA, 19 nt, Homo sapiens
ccaccacucucaugucuug

SEQ ID NO: 259397 - RNA, 19 nt, Homo sapiens
gacaauaggccauguuaau

SEQ ID NO: 259398 - RNA, 19 nt, Homo sapiens
cauauaaaccugauguuga

SEQ ID NO: 259399 - RNA, 19 nt, Homo sapiens
gagagcugcuucaacauca

SEQ ID NO: 259400 - RNA, 19 nt, Homo sapiens
ccaaggauauuuaauuugc

SEQ ID NO: 259401 - RNA, 19 nt, Homo sapiens
ugagcugaguuccuuauaa

SEQ ID NO: 259402 - RNA, 19 nt, Homo sapiens
ggaaagcuguggacaaacg

SEQ ID NO: 259403 - RNA, 19 nt, Homo sapiens
gcacugugacaccagaaua

SEQ ID NO: 259404 - RNA, 19 nt, Homo sapiens
gaauggucuuaacuacaua

SEQ ID NO: 259405 - RNA, 19 nt, Homo sapiens
uaagaaucauagugccaua

SEQ ID NO: 259406 - RNA, 19 nt, Homo sapiens
guacccagacucuaaauau

SEQ ID NO: 259407 - RNA, 19 nt, Homo sapiens
cccaauggcuacaugauga

SEQ ID NO: 259408 - RNA, 19 nt, Homo sapiens
gagcuaagcaacuauaucu

SEQ ID NO: 259409 - RNA, 19 nt, Homo sapiens
gaaccugauugguaucuac

SEQ ID NO: 259410 - RNA, 19 nt, Homo sapiens
gguuuacucucaaugcauu

SEQ ID NO: 259411 - RNA, 19 nt, Homo sapiens
agaauggucuuaacuacau

SEQ ID NO: 259412 - RNA, 19 nt, Homo sapiens
ccacggcgaucuagugcuu

SEQ ID NO: 259413 - RNA, 19 nt, Homo sapiens
ucaaagaggucuggcaagu

SEQ ID NO: 259414 - RNA, 19 nt, Homo sapiens
ggugauuccuucaauucaa

SEQ ID NO: 259415 - RNA, 19 nt, Homo sapiens
caaccagagugccaaagug

SEQ ID NO: 259416 - RNA, 19 nt, Homo sapiens
gcacaggugacuacaugaa

SEQ ID NO: 259417 - RNA, 19 nt, Homo sapiens
caucacagcagaaugaaga

SEQ ID NO: 259418 - RNA, 19 nt, Homo sapiens
gugauuccuucaauucaaa

SEQ ID NO: 259419 - RNA, 19 nt, Homo sapiens
gaugggugauuccuucaau

SEQ ID NO: 259420 - RNA, 19 nt, Homo sapiens
agaaggagaugggugauuc

SEQ ID NO: 259421 - RNA, 19 nt, Homo sapiens
gaagaggaaauuaaagucu

SEQ ID NO: 259422 - RNA, 19 nt, Homo sapiens
aaacaaggcuuaaaagagu

SEQ ID NO: 259423 - RNA, 19 nt, Homo sapiens
agaaugaagaccuaaauga

SEQ ID NO: 259424 - RNA, 19 nt, Homo sapiens
gcagaaugaagaccuaaau

SEQ ID NO: 259425 - RNA, 19 nt, Homo sapiens
cuacauagaccuggauuug

SEQ ID NO: 259426 - RNA, 19 nt, Homo sapiens
ggccaugagugaugaguuc

SEQ ID NO: 259427 - RNA, 19 nt, Homo sapiens
cuaaaugaccucagcaaau

SEQ ID NO: 259428 - RNA, 19 nt, Homo sapiens
gggugaaccucaguccuaa

SEQ ID NO: 259429 - RNA, 19 nt, Homo sapiens
caucagcaccuccgccuuu

SEQ ID NO: 259430 - RNA, 19 nt, Homo sapiens
guaccaggcucuccuacag

SEQ ID NO: 259431 - RNA, 19 nt, Homo sapiens
gcugaguuccuuauaagaa

SEQ ID NO: 259432 - RNA, 19 nt, Homo sapiens
guaaagaguggagcaaaug

SEQ ID NO: 259433 - RNA, 19 nt, Homo sapiens
uaaugagucugcauaaacu

SEQ ID NO: 259434 - RNA, 19 nt, Homo sapiens
aaagggcaguggagacuau

SEQ ID NO: 259435 - RNA, 19 nt, Homo sapiens
gaggagcuaagcaacuaua

SEQ ID NO: 259436 - RNA, 19 nt, Homo sapiens
agaauaaugagucugcaua

SEQ ID NO: 259437 - RNA, 19 nt, Homo sapiens
gcaacacagugcccuuugg

SEQ ID NO: 259438 - RNA, 19 nt, Homo sapiens
uggcugcucuccugacauu

SEQ ID NO: 259439 - RNA, 19 nt, Homo sapiens
uccauugcauguauuguaa

SEQ ID NO: 259440 - RNA, 19 nt, Homo sapiens
gaauggguuuacucucaau

SEQ ID NO: 259441 - RNA, 19 nt, Homo sapiens
uacccagacucuaaauauu

SEQ ID NO: 259442 - RNA, 19 nt, Homo sapiens
cagcaucaguuuccagaag

SEQ ID NO: 259443 - RNA, 19 nt, Homo sapiens
gucaaggacuucaaacagu

SEQ ID NO: 259444 - RNA, 19 nt, Homo sapiens
gagacuauaugcccaugag

SEQ ID NO: 259445 - RNA, 19 nt, Homo sapiens
cugcagaucuggauaaucg

SEQ ID NO: 259446 - RNA, 19 nt, Homo sapiens
aacuucaucuucaaccuua

SEQ ID NO: 259447 - RNA, 19 nt, Homo sapiens
ugcauaaacuucaucuuca

SEQ ID NO: 259448 - RNA, 19 nt, Homo sapiens
gaaugaagaccuaaaugac

SEQ ID NO: 259449 - RNA, 19 nt, Homo sapiens
guacgacaaagcaucauug

SEQ ID NO: 259450 - RNA, 19 nt, Homo sapiens
uguaagcuaugcugacaug

SEQ ID NO: 259451 - RNA, 19 nt, Homo sapiens
uggcuuccauugaggagua

SEQ ID NO: 259452 - RNA, 19 nt, Homo sapiens
acaauaggccauguuaauu

SEQ ID NO: 259453 - RNA, 19 nt, Homo sapiens
gaaucauagugccauagau

SEQ ID NO: 259454 - RNA, 19 nt, Homo sapiens
uguaaagaguggagcaaau

SEQ ID NO: 259455 - RNA, 19 nt, Homo sapiens
ccaccaccgugucaugaga

SEQ ID NO: 259456 - RNA, 19 nt, Homo sapiens
guacgaugcauccauuuca

SEQ ID NO: 259457 - RNA, 19 nt, Homo sapiens
gagaauggucuuaacuaca

SEQ ID NO: 259458 - RNA, 19 nt, Homo sapiens
aggaggagcuaagcaacua

SEQ ID NO: 259459 - RNA, 19 nt, Homo sapiens
gguucucaauuguauaguu

SEQ ID NO: 259460 - RNA, 19 nt, Homo sapiens
auacaaaacuguucacguu

SEQ ID NO: 259461 - RNA, 19 nt, Homo sapiens
gcaaauccucuucuaacuc

SEQ ID NO: 259462 - RNA, 19 nt, Homo sapiens
acauagaccuggauuuggu

SEQ ID NO: 259463 - RNA, 19 nt, Homo sapiens
cagcagcgaggaugugaaa

SEQ ID NO: 259464 - RNA, 19 nt, Homo sapiens
auggaaagcuguggacaaa

SEQ ID NO: 259465 - RNA, 19 nt, Homo sapiens
gucagucugucguccagua

SEQ ID NO: 259466 - RNA, 19 nt, Homo sapiens
caaugugggcguuuguaaa

SEQ ID NO: 259467 - RNA, 19 nt, Homo sapiens
ugaagaaggauauauuugg

SEQ ID NO: 259468 - RNA, 19 nt, Homo sapiens
aggcauagcuccgagacuu

SEQ ID NO: 259469 - RNA, 19 nt, Homo sapiens
ugaucagucuggcuacuug

SEQ ID NO: 259470 - RNA, 19 nt, Homo sapiens
gaaagggcaguggagacua

SEQ ID NO: 259471 - RNA, 19 nt, Homo sapiens
gaaacuguguacgacaaag

SEQ ID NO: 259472 - RNA, 19 nt, Homo sapiens
ccaaggagccagccaaacu

SEQ ID NO: 259473 - RNA, 19 nt, Homo sapiens
guaaaguggcucuauauuu

SEQ ID NO: 259474 - RNA, 19 nt, Homo sapiens
ugacuucacuugauaacaa

SEQ ID NO: 259475 - RNA, 19 nt, Homo sapiens
agggagagaucaccgauua

SEQ ID NO: 259476 - RNA, 19 nt, Homo sapiens
cgauggagcucuaucaaau

SEQ ID NO: 259477 - RNA, 19 nt, Homo sapiens
gggcaacgauggagcucua

SEQ ID NO: 259478 - RNA, 19 nt, Homo sapiens
acuagaggcuuucggcuuu

SEQ ID NO: 259479 - RNA, 19 nt, Homo sapiens
ggacaugagcggcuacaca

SEQ ID NO: 259480 - RNA, 19 nt, Homo sapiens
gacaugagcggcuacacaa

SEQ ID NO: 259481 - RNA, 19 nt, Homo sapiens
caaacuagaaacugaaaca

SEQ ID NO: 259482 - RNA, 19 nt, Homo sapiens
ggagagaucaccgauuaca

SEQ ID NO: 259483 - RNA, 19 nt, Homo sapiens
gugcugugcuguacgacaa

SEQ ID NO: 259484 - RNA, 19 nt, Homo sapiens
gacuucacuugauaacaaa

SEQ ID NO: 259485 - RNA, 19 nt, Homo sapiens
gagaucaccgauuacagaa

SEQ ID NO: 259486 - RNA, 19 nt, Homo sapiens
agagaucaccgauuacaga

SEQ ID NO: 259487 - RNA, 19 nt, Homo sapiens
gagaguggccuggcucguu

SEQ ID NO: 259488 - RNA, 19 nt, Homo sapiens
caacgauggagcucuauca

SEQ ID NO: 259489 - RNA, 19 nt, Homo sapiens
cacaagagcauccagaaca

SEQ ID NO: 259490 - RNA, 19 nt, Homo sapiens
gcacugaaagaggacauga

SEQ ID NO: 259491 - RNA, 19 nt, Homo sapiens
gauaacaaacuagaaacug

SEQ ID NO: 259492 - RNA, 19 nt, Homo sapiens
cgacuuccaggcacugaaa

SEQ ID NO: 259493 - RNA, 19 nt, Homo sapiens
ggccauggacugcgagaug

SEQ ID NO: 259494 - RNA, 19 nt, Homo sapiens
ccacggugcugugcuguac

SEQ ID NO: 259495 - RNA, 19 nt, Homo sapiens
uaguaaaguggcucuauau

SEQ ID NO: 259496 - RNA, 19 nt, Homo sapiens
cgcagggacuagaggcuuu

SEQ ID NO: 259497 - RNA, 19 nt, Homo sapiens
gauccugcagcuccugaaa

SEQ ID NO: 259498 - RNA, 19 nt, Homo sapiens
gauggagcucuaucaaauc

SEQ ID NO: 259499 - RNA, 19 nt, Homo sapiens
acaagagcauccagaacag

SEQ ID NO: 259500 - RNA, 19 nt, Homo sapiens
caugagcggcuacacaauc

SEQ ID NO: 259501 - RNA, 19 nt, Homo sapiens
gaagaugcgagggcaacga

SEQ ID NO: 259502 - RNA, 19 nt, Homo sapiens
gugaggugguggccaugga

SEQ ID NO: 259503 - RNA, 19 nt, Homo sapiens
gaugccggcuuggaguuag

SEQ ID NO: 259504 - RNA, 19 nt, Homo sapiens
gcagaggcaggcagcaucu

SEQ ID NO: 259505 - RNA, 19 nt, Homo sapiens
caacuaccuugcuuuugga

SEQ ID NO: 259506 - RNA, 19 nt, Homo sapiens
cgaugccggcuuggaguua

SEQ ID NO: 259507 - RNA, 19 nt, Homo sapiens
gagggagagaucaccgauu

SEQ ID NO: 259508 - RNA, 19 nt, Homo sapiens
aguaaaguggcucuauauu

SEQ ID NO: 259509 - RNA, 19 nt, Homo sapiens
ccaaagauguguauaguua

SEQ ID NO: 259510 - RNA, 19 nt, Homo sapiens
gaauggugcuguuucuaua

SEQ ID NO: 259511 - RNA, 19 nt, Homo sapiens
ggacugugcugaacgagaa

SEQ ID NO: 259512 - RNA, 19 nt, Homo sapiens
gagauuauaucagguugua

SEQ ID NO: 259513 - RNA, 19 nt, Homo sapiens
gagcugcauugguuugaua

SEQ ID NO: 259514 - RNA, 19 nt, Homo sapiens
gaucuuagaaguacugaaa

SEQ ID NO: 259515 - RNA, 19 nt, Homo sapiens
gagaaagugggaaauuaua

SEQ ID NO: 259516 - RNA, 19 nt, Homo sapiens
guacgguggucuuugaauu

SEQ ID NO: 259517 - RNA, 19 nt, Homo sapiens
ucaaggaucucaaagaaag

SEQ ID NO: 259518 - RNA, 19 nt, Homo sapiens
agaaaugaaugcuccauga

SEQ ID NO: 259519 - RNA, 19 nt, Homo sapiens
cagaugcgcucaugaagga

SEQ ID NO: 259520 - RNA, 19 nt, Homo sapiens
uggagaaagugggaaauua

SEQ ID NO: 259521 - RNA, 19 nt, Homo sapiens
gcuauucaaugaucuuaga

SEQ ID NO: 259522 - RNA, 19 nt, Homo sapiens
ggagaaagugggaaauuau

SEQ ID NO: 259523 - RNA, 19 nt, Homo sapiens
gaggaacauucauucugua

SEQ ID NO: 259524 - RNA, 19 nt, Homo sapiens
gcagugaaguagcaucaau

SEQ ID NO: 259525 - RNA, 19 nt, Homo sapiens
cgccauauguagaauuaua

SEQ ID NO: 259526 - RNA, 19 nt, Homo sapiens
gggaaaaccuacuguaaaa

SEQ ID NO: 259527 - RNA, 19 nt, Homo sapiens
ggacauuacucccucuuac

SEQ ID NO: 259528 - RNA, 19 nt, Homo sapiens
aaucaaagcgccauaugua

SEQ ID NO: 259529 - RNA, 19 nt, Homo sapiens
ugagauccauccuuuauca

SEQ ID NO: 259530 - RNA, 19 nt, Homo sapiens
gcaacacugugaagacaau

SEQ ID NO: 259531 - RNA, 19 nt, Homo sapiens
gaaaugaaugcuccaugaa

SEQ ID NO: 259532 - RNA, 19 nt, Homo sapiens
ccacaagcgucucgggauu

SEQ ID NO: 259533 - RNA, 19 nt, Homo sapiens
uccuguagcugguuuauuu

SEQ ID NO: 259534 - RNA, 19 nt, Homo sapiens
caguggaaguacaaaguua

SEQ ID NO: 259535 - RNA, 19 nt, Homo sapiens
gauccauccuuuaucaaga

SEQ ID NO: 259536 - RNA, 19 nt, Homo sapiens
ggccaauauuucccacuua

SEQ ID NO: 259537 - RNA, 19 nt, Homo sapiens
ucggaagacuugccacuuu

SEQ ID NO: 259538 - RNA, 19 nt, Homo sapiens
ucaaugaucuuagaaguac

SEQ ID NO: 259539 - RNA, 19 nt, Homo sapiens
ugaaaugugcggaguguaa

SEQ ID NO: 259540 - RNA, 19 nt, Homo sapiens
gaaaucaaagcgccauaug

SEQ ID NO: 259541 - RNA, 19 nt, Homo sapiens
gguggucuuugaauuauau

SEQ ID NO: 259542 - RNA, 19 nt, Homo sapiens
cguagaggauuuauauuca

SEQ ID NO: 259543 - RNA, 19 nt, Homo sapiens
cagcggcucuuucagcauu

SEQ ID NO: 259544 - RNA, 19 nt, Homo sapiens
ugaggaacauucauucugu

SEQ ID NO: 259545 - RNA, 19 nt, Homo sapiens
ggaccgggcucuaauucca

SEQ ID NO: 259546 - RNA, 19 nt, Homo sapiens
gagacacgacgguggcuua

SEQ ID NO: 259547 - RNA, 19 nt, Homo sapiens
agaagcagcugcacaccuu

SEQ ID NO: 259548 - RNA, 19 nt, Homo sapiens
cgagagcuguacaugcuuu

SEQ ID NO: 259549 - RNA, 19 nt, Homo sapiens
gacgagagcuguacaugcu

SEQ ID NO: 259550 - RNA, 19 nt, Homo sapiens
ucauuucacugcacaucua

SEQ ID NO: 259551 - RNA, 19 nt, Homo sapiens
ucaauguccucucaacuuc

SEQ ID NO: 259552 - RNA, 19 nt, Homo sapiens
guuguacgguggucuuuga

SEQ ID NO: 259553 - RNA, 19 nt, Homo sapiens
uguaucacaucgaguguuu

SEQ ID NO: 259554 - RNA, 19 nt, Homo sapiens
gaggauuuauauucaagga

SEQ ID NO: 259555 - RNA, 19 nt, Homo sapiens
gggaaauuauaaugucgaa

SEQ ID NO: 259556 - RNA, 19 nt, Homo sapiens
uagcaucaauguccucuca

SEQ ID NO: 259557 - RNA, 19 nt, Homo sapiens
ccagccaccuuggaaagua

SEQ ID NO: 259558 - RNA, 19 nt, Homo sapiens
gacaagaagcgaagcauca

SEQ ID NO: 259559 - RNA, 19 nt, Homo sapiens
ggaguguaaucaguauuug

SEQ ID NO: 259560 - RNA, 19 nt, Homo sapiens
caaagcgccauauguagaa

SEQ ID NO: 259561 - RNA, 19 nt, Homo sapiens
auucaaggaucucaaagaa

SEQ ID NO: 259562 - RNA, 19 nt, Homo sapiens
cuucaggacuauuucacua

SEQ ID NO: 259563 - RNA, 19 nt, Homo sapiens
uauaaagcauugcaacaag

SEQ ID NO: 259564 - RNA, 19 nt, Homo sapiens
gaucucaaagaaagcauuu

SEQ ID NO: 259565 - RNA, 19 nt, Homo sapiens
aaugaaugcuccaugaaau

SEQ ID NO: 259566 - RNA, 19 nt, Homo sapiens
gggccaauauuucccacuu

SEQ ID NO: 259567 - RNA, 19 nt, Homo sapiens
uucagcaacuggucaauuu

SEQ ID NO: 259568 - RNA, 19 nt, Homo sapiens
uaaauuggacuccuagauc

SEQ ID NO: 259569 - RNA, 19 nt, Homo sapiens
ucaaagcgccauauguaga

SEQ ID NO: 259570 - RNA, 19 nt, Homo sapiens
gccaauauuucccacuuag

SEQ ID NO: 259571 - RNA, 19 nt, Homo sapiens
gcuccaagguguaucacau

SEQ ID NO: 259572 - RNA, 19 nt, Homo sapiens
gaaaaccuacuguaaaaga

SEQ ID NO: 259573 - RNA, 19 nt, Homo sapiens
ccauuucacuguggacauu

SEQ ID NO: 259574 - RNA, 19 nt, Homo sapiens
uaacgacccagucaaugaa

SEQ ID NO: 259575 - RNA, 19 nt, Homo sapiens
ggaggaccgggcucuaauu

SEQ ID NO: 259576 - RNA, 19 nt, Homo sapiens
gauucacgaucaguauauu

SEQ ID NO: 259577 - RNA, 19 nt, Homo sapiens
ggaagguggagcugcauug

SEQ ID NO: 259578 - RNA, 19 nt, Homo sapiens
aaacaggagcuccagcaaa

SEQ ID NO: 259579 - RNA, 19 nt, Homo sapiens
gucauugccuugccaaaca

SEQ ID NO: 259580 - RNA, 19 nt, Homo sapiens
gaggguuucuccggauuug

SEQ ID NO: 259581 - RNA, 19 nt, Homo sapiens
augacaaggugauauggua

SEQ ID NO: 259582 - RNA, 19 nt, Homo sapiens
aaaugaaugcuccaugaaa

SEQ ID NO: 259583 - RNA, 19 nt, Homo sapiens
ggaacauucauucuguauu

SEQ ID NO: 259584 - RNA, 19 nt, Homo sapiens
ucaggacuauuucacuaau

SEQ ID NO: 259585 - RNA, 19 nt, Homo sapiens
ugaauggugcuguuucuau

SEQ ID NO: 259586 - RNA, 19 nt, Homo sapiens
uagcaacacugugaagaca

SEQ ID NO: 259587 - RNA, 19 nt, Homo sapiens
ccucucaacuuccagauac

SEQ ID NO: 259588 - RNA, 19 nt, Homo sapiens
gcagcagcccaaugacaaa

SEQ ID NO: 259589 - RNA, 19 nt, Homo sapiens
caugaaggagcaacuggua

SEQ ID NO: 259590 - RNA, 19 nt, Homo sapiens
uacgguggucuuugaauua

SEQ ID NO: 259591 - RNA, 19 nt, Homo sapiens
ugaaaugcacgaagucugu

SEQ ID NO: 259592 - RNA, 19 nt, Homo sapiens
caugguagccaguccuauu

SEQ ID NO: 259593 - RNA, 19 nt, Homo sapiens
gaaaugugcggaguguaau

SEQ ID NO: 259594 - RNA, 19 nt, Homo sapiens
gauuguguuugacuugugu

SEQ ID NO: 259595 - RNA, 19 nt, Homo sapiens
ggauuguguuugacuugug

SEQ ID NO: 259596 - RNA, 19 nt, Homo sapiens
cccaguauaugcuauucaa

SEQ ID NO: 259597 - RNA, 19 nt, Homo sapiens
uuaacgacccagucaauga

SEQ ID NO: 259598 - RNA, 19 nt, Homo sapiens
agcuguacaugcuuuguua

SEQ ID NO: 259599 - RNA, 19 nt, Homo sapiens
uuuguuugcugaagugaaa

SEQ ID NO: 259600 - RNA, 19 nt, Homo sapiens
cagauucacgaucaguaua

SEQ ID NO: 259601 - RNA, 19 nt, Homo sapiens
ucacugcacaucuagagaa

SEQ ID NO: 259602 - RNA, 19 nt, Homo sapiens
caguauaugcuauucaaug

SEQ ID NO: 259603 - RNA, 19 nt, Homo sapiens
gcaucaauguccucucaac

SEQ ID NO: 259604 - RNA, 19 nt, Homo sapiens
acauagaucagccugcuuu

SEQ ID NO: 259605 - RNA, 19 nt, Homo sapiens
gagcaacugguagagauga

SEQ ID NO: 259606 - RNA, 19 nt, Homo sapiens
ggccagaugcgcucaugaa

SEQ ID NO: 259607 - RNA, 19 nt, Homo sapiens
gugcggaguguaaucagua

SEQ ID NO: 259608 - RNA, 19 nt, Homo sapiens
guguuugacuugugucugu

SEQ ID NO: 259609 - RNA, 19 nt, Homo sapiens
gcaaagcgguugagggaaa

SEQ ID NO: 259610 - RNA, 19 nt, Homo sapiens
gcaacgagcugaccuucau

SEQ ID NO: 259611 - RNA, 19 nt, Homo sapiens
ugacuaggauagaauuuga

SEQ ID NO: 259612 - RNA, 19 nt, Homo sapiens
gccacaaucucaucucuga

SEQ ID NO: 259613 - RNA, 19 nt, Homo sapiens
gcagagaaauaaacagcau

SEQ ID NO: 259614 - RNA, 19 nt, Homo sapiens
gagaggaggaugggaagua

SEQ ID NO: 259615 - RNA, 19 nt, Homo sapiens
gggagcagcagagaaauaa

SEQ ID NO: 259616 - RNA, 19 nt, Homo sapiens
ggaauuccaggcacuguga

SEQ ID NO: 259617 - RNA, 19 nt, Homo sapiens
acaauguggucaucaucua

SEQ ID NO: 259618 - RNA, 19 nt, Homo sapiens
gauggcuuccuuccucuua

SEQ ID NO: 259619 - RNA, 19 nt, Homo sapiens
gaaccuguccucccuuucu

SEQ ID NO: 259620 - RNA, 19 nt, Homo sapiens
gcugggagguggucugaag

SEQ ID NO: 259621 - RNA, 19 nt, Homo sapiens
ccagauacccaguggcauu

SEQ ID NO: 259622 - RNA, 19 nt, Homo sapiens
gagggaaagggcugcuaua

SEQ ID NO: 259623 - RNA, 19 nt, Homo sapiens
caucugagacugaaaugug

SEQ ID NO: 259624 - RNA, 19 nt, Homo sapiens
gccaaagccuccuccucuu

SEQ ID NO: 259625 - RNA, 19 nt, Homo sapiens
ccucagugcccuccaauug

SEQ ID NO: 259626 - RNA, 19 nt, Homo sapiens
caaccucagugcccuccaa

SEQ ID NO: 259627 - RNA, 19 nt, Homo sapiens
auaaacagcauuucugaug

SEQ ID NO: 259628 - RNA, 19 nt, Homo sapiens
ggaggacaauguggucauc

SEQ ID NO: 259629 - RNA, 19 nt, Homo sapiens
ggagcgaccugcacaaccu

SEQ ID NO: 259630 - RNA, 19 nt, Homo sapiens
gaccucagccacaaucuca

SEQ ID NO: 259631 - RNA, 19 nt, Homo sapiens
uuuccuaccucuccuucua

SEQ ID NO: 259632 - RNA, 19 nt, Homo sapiens
aaucucaucucugacuuug

SEQ ID NO: 259633 - RNA, 19 nt, Homo sapiens
ccaguggcauuguggagau

SEQ ID NO: 259634 - RNA, 19 nt, Homo sapiens
cacaaccgcuugcacacau

SEQ ID NO: 259635 - RNA, 19 nt, Homo sapiens
gagcagcagagaaauaaac

SEQ ID NO: 259636 - RNA, 19 nt, Homo sapiens
uggaaccuguccucccuuu

SEQ ID NO: 259637 - RNA, 19 nt, Homo sapiens
ggacaauguggucaucauc

SEQ ID NO: 259638 - RNA, 19 nt, Homo sapiens
ccucuuccaucccgucuuc

SEQ ID NO: 259639 - RNA, 19 nt, Homo sapiens
gaauggagcuggggcuuag

SEQ ID NO: 259640 - RNA, 19 nt, Homo sapiens
gagcugggcagugcugaga

SEQ ID NO: 259641 - RNA, 19 nt, Homo sapiens
gauacccaguggcauugug

SEQ ID NO: 259642 - RNA, 19 nt, Homo sapiens
gcccuccaauugcucaaga

SEQ ID NO: 259643 - RNA, 19 nt, Homo sapiens
gccaaugugacuacacuga

SEQ ID NO: 259644 - RNA, 19 nt, Homo sapiens
gaccugcuccaaacuagug

SEQ ID NO: 259645 - RNA, 19 nt, Homo sapiens
ccaaagccuccuccucuuc

SEQ ID NO: 259646 - RNA, 19 nt, Homo sapiens
ucguguggcucaagacaug

SEQ ID NO: 259647 - RNA, 19 nt, Homo sapiens
aagccucagugguggaauu

SEQ ID NO: 259648 - RNA, 19 nt, Homo sapiens
gcgcagguuccauggcaaa

SEQ ID NO: 259649 - RNA, 19 nt, Homo sapiens
ggcaucguguggcucaaga

SEQ ID NO: 259650 - RNA, 19 nt, Homo sapiens
caaagcgguugagggaaag

SEQ ID NO: 259651 - RNA, 19 nt, Homo sapiens
caaucucaucucugacuuu

SEQ ID NO: 259652 - RNA, 19 nt, Homo sapiens
cuagaccugcuccaaacua

SEQ ID NO: 259653 - RNA, 19 nt, Homo sapiens
ggagcagcagagaaauaaa

SEQ ID NO: 259654 - RNA, 19 nt, Homo sapiens
ugggagcagcagagaaaua

SEQ ID NO: 259655 - RNA, 19 nt, Homo sapiens
cuugggagcagcagagaaa

SEQ ID NO: 259656 - RNA, 19 nt, Homo sapiens
agaggaggaugggaaguag

SEQ ID NO: 259657 - RNA, 19 nt, Homo sapiens
uagaccugcuccaaacuag

SEQ ID NO: 259658 - RNA, 19 nt, Homo sapiens
cuaccucuccuucuaaucu

SEQ ID NO: 259659 - RNA, 19 nt, Homo sapiens
caaagccuccuccucuucu

SEQ ID NO: 259660 - RNA, 19 nt, Homo sapiens
cagccacaaucucaucucu

SEQ ID NO: 259661 - RNA, 19 nt, Homo sapiens
guugucugcuccucugcaa

SEQ ID NO: 259662 - RNA, 19 nt, Homo sapiens
guagacaguggcugguaug

SEQ ID NO: 259663 - RNA, 19 nt, Homo sapiens
gacaauguggucaucaucu

SEQ ID NO: 259664 - RNA, 19 nt, Homo sapiens
ucagugcccuccaauugcu

SEQ ID NO: 259665 - RNA, 19 nt, Homo sapiens
aguagacaguggcugguau

SEQ ID NO: 259666 - RNA, 19 nt, Homo sapiens
gggcgacguccuaauccaa

SEQ ID NO: 259667 - RNA, 19 nt, Homo sapiens
ugccugugcucuccucuca

SEQ ID NO: 259668 - RNA, 19 nt, Homo sapiens
ugucccaccugcagaucaa

SEQ ID NO: 259669 - RNA, 19 nt, Homo sapiens
caaccgcuugcacacauug

SEQ ID NO: 259670 - RNA, 19 nt, Homo sapiens
ugcaaccucuauccuggaa

SEQ ID NO: 259671 - RNA, 19 nt, Homo sapiens
gugacuaggauagaauuug

SEQ ID NO: 259672 - RNA, 19 nt, Homo sapiens
acagcugccuggccaccaa

SEQ ID NO: 259673 - RNA, 19 nt, Homo sapiens
acaaucucaucucugacuu

SEQ ID NO: 259674 - RNA, 19 nt, Homo sapiens
ggaauggagcuggggcuua

SEQ ID NO: 259675 - RNA, 19 nt, Homo sapiens
cuucuagaccugcuccaaa

SEQ ID NO: 259676 - RNA, 19 nt, Homo sapiens
gcugcuauacgguugacaa

SEQ ID NO: 259677 - RNA, 19 nt, Homo sapiens
acaaccgcuugcacacauu

SEQ ID NO: 259678 - RNA, 19 nt, Homo sapiens
gcaguaaccuagugaauuu

SEQ ID NO: 259679 - RNA, 19 nt, Homo sapiens
gaaacgcccuugauacuaa

SEQ ID NO: 259680 - RNA, 19 nt, Homo sapiens
caacaagaaugcucagaua

SEQ ID NO: 259681 - RNA, 19 nt, Homo sapiens
aaacaaggcugauaauuug

SEQ ID NO: 259682 - RNA, 19 nt, Homo sapiens
uaacugagcuuagaguaua

SEQ ID NO: 259683 - RNA, 19 nt, Homo sapiens
ggaagagucuaccuguuua

SEQ ID NO: 259684 - RNA, 19 nt, Homo sapiens
gaacgggacuuucgcauca

SEQ ID NO: 259685 - RNA, 19 nt, Homo sapiens
gcacaacaguucucuucua

SEQ ID NO: 259686 - RNA, 19 nt, Homo sapiens
ggaaaccaccaccaaauua

SEQ ID NO: 259687 - RNA, 19 nt, Homo sapiens
ggacagaaaucacaguuca

SEQ ID NO: 259688 - RNA, 19 nt, Homo sapiens
gcagauuacucuucucaaa

SEQ ID NO: 259689 - RNA, 19 nt, Homo sapiens
ggaagugcuugauauguaa

SEQ ID NO: 259690 - RNA, 19 nt, Homo sapiens
caacauggauggcuuuaau

SEQ ID NO: 259691 - RNA, 19 nt, Homo sapiens
caagaaugcucagauaauu

SEQ ID NO: 259692 - RNA, 19 nt, Homo sapiens
ggauggcuauggagauuua

SEQ ID NO: 259693 - RNA, 19 nt, Homo sapiens
gaauugaacugcagaacug

SEQ ID NO: 259694 - RNA, 19 nt, Homo sapiens
ggacaaacaucuucuucug

SEQ ID NO: 259695 - RNA, 19 nt, Homo sapiens
caacaguucucuucuagga

SEQ ID NO: 259696 - RNA, 19 nt, Homo sapiens
acaaacaucuucuucugua

SEQ ID NO: 259697 - RNA, 19 nt, Homo sapiens
gagaugauuuggucagauu

SEQ ID NO: 259698 - RNA, 19 nt, Homo sapiens
gaacaaauuuucagcauug

SEQ ID NO: 259699 - RNA, 19 nt, Homo sapiens
gaucuggacuuccuauaau

SEQ ID NO: 259700 - RNA, 19 nt, Homo sapiens
cuacauaucuaaagcuuug

SEQ ID NO: 259701 - RNA, 19 nt, Homo sapiens
gaaaguaaugguaguugua

SEQ ID NO: 259702 - RNA, 19 nt, Homo sapiens
ggaaaacuguucucuuuaa

SEQ ID NO: 259703 - RNA, 19 nt, Homo sapiens
ggagaauacuuuguuaaug

SEQ ID NO: 259704 - RNA, 19 nt, Homo sapiens
caacucuggucacaaagua

SEQ ID NO: 259705 - RNA, 19 nt, Homo sapiens
guucaacucuggucacaaa

SEQ ID NO: 259706 - RNA, 19 nt, Homo sapiens
aaugaaaccugaugagaaa

SEQ ID NO: 259707 - RNA, 19 nt, Homo sapiens
gcagaaaucaacaccuaua

SEQ ID NO: 259708 - RNA, 19 nt, Homo sapiens
gcagaagaauaugguagua

SEQ ID NO: 259709 - RNA, 19 nt, Homo sapiens
uauagaagcuucauucaca

SEQ ID NO: 259710 - RNA, 19 nt, Homo sapiens
caaccuuccuccucccuua

SEQ ID NO: 259711 - RNA, 19 nt, Homo sapiens
aacaagaucuaccaacaua

SEQ ID NO: 259712 - RNA, 19 nt, Homo sapiens
gagaacaacaggugacuuu

SEQ ID NO: 259713 - RNA, 19 nt, Homo sapiens
gccaaggucuucaguauuc

SEQ ID NO: 259714 - RNA, 19 nt, Homo sapiens
gggaugcaguaaagaauuu

SEQ ID NO: 259715 - RNA, 19 nt, Homo sapiens
ccucauagauguugugguu

SEQ ID NO: 259716 - RNA, 19 nt, Homo sapiens
gcccagaguuuacauucua

SEQ ID NO: 259717 - RNA, 19 nt, Homo sapiens
gaggauggacuuugcauuu

SEQ ID NO: 259718 - RNA, 19 nt, Homo sapiens
guacaugagugaccuaaag

SEQ ID NO: 259719 - RNA, 19 nt, Homo sapiens
gaaaggugccugcagaaga

SEQ ID NO: 259720 - RNA, 19 nt, Homo sapiens
uaaauguccuguugaccua

SEQ ID NO: 259721 - RNA, 19 nt, Homo sapiens
aaagguagauccugagaug

SEQ ID NO: 259722 - RNA, 19 nt, Homo sapiens
caccagaaguuacagauga

SEQ ID NO: 259723 - RNA, 19 nt, Homo sapiens
ggaauguuaugggauguaa

SEQ ID NO: 259724 - RNA, 19 nt, Homo sapiens
gcagauaucaauccacuga

SEQ ID NO: 259725 - RNA, 19 nt, Homo sapiens
gcacaaaguauucccagaa

SEQ ID NO: 259726 - RNA, 19 nt, Homo sapiens
ugagugaccuaaagaaaga

SEQ ID NO: 259727 - RNA, 19 nt, Homo sapiens
gaaguggaagugcuugaua

SEQ ID NO: 259728 - RNA, 19 nt, Homo sapiens
caagaacaacccuuuauug

SEQ ID NO: 259729 - RNA, 19 nt, Homo sapiens
ucagaguccucauuauaaa

SEQ ID NO: 259730 - RNA, 19 nt, Homo sapiens
gggaaagucaucuguuuaa

SEQ ID NO: 259731 - RNA, 19 nt, Homo sapiens
uggaagugcuugauaugua

SEQ ID NO: 259732 - RNA, 19 nt, Homo sapiens
gcaaaguucagaccuacua

SEQ ID NO: 259733 - RNA, 19 nt, Homo sapiens
gagucuaccuguuuacuau

SEQ ID NO: 259734 - RNA, 19 nt, Homo sapiens
gacauuaggagaacaaauu

SEQ ID NO: 259735 - RNA, 19 nt, Homo sapiens
gcaauucaauaugcaagaa

SEQ ID NO: 259736 - RNA, 19 nt, Homo sapiens
acacaauccuccaagaauu

SEQ ID NO: 259737 - RNA, 19 nt, Homo sapiens
gcacaucauuuauauacag

SEQ ID NO: 259738 - RNA, 19 nt, Homo sapiens
gcccugcccuucccucaua

SEQ ID NO: 259739 - RNA, 19 nt, Homo sapiens
ucagaaacaugaaaugcuu

SEQ ID NO: 259740 - RNA, 19 nt, Homo sapiens
caacaggaguuauaauagg

SEQ ID NO: 259741 - RNA, 19 nt, Homo sapiens
agacaaggcuggugacauc

SEQ ID NO: 259742 - RNA, 19 nt, Homo sapiens
aaaggugccugcagaagaa

SEQ ID NO: 259743 - RNA, 19 nt, Homo sapiens
ggggaaaacuguucucuuu

SEQ ID NO: 259744 - RNA, 19 nt, Homo sapiens
caagaucuaccaacauaaa

SEQ ID NO: 259745 - RNA, 19 nt, Homo sapiens
gcacuauccgcacaaagua

SEQ ID NO: 259746 - RNA, 19 nt, Homo sapiens
gaaaagaacccacugaugu

SEQ ID NO: 259747 - RNA, 19 nt, Homo sapiens
gaacaacaggugacuuuua

SEQ ID NO: 259748 - RNA, 19 nt, Homo sapiens
guauauaacaucacacuug

SEQ ID NO: 259749 - RNA, 19 nt, Homo sapiens
gaaugggagauguguauaa

SEQ ID NO: 259750 - RNA, 19 nt, Homo sapiens
ucacuuuggucaacaagaa

SEQ ID NO: 259751 - RNA, 19 nt, Homo sapiens
gaaugagaauggcaauauc

SEQ ID NO: 259752 - RNA, 19 nt, Homo sapiens
gcagauggaccacacuuug

SEQ ID NO: 259753 - RNA, 19 nt, Homo sapiens
caguuuggaugaagaaauu

SEQ ID NO: 259754 - RNA, 19 nt, Homo sapiens
gaaguauaauugcuggaau

SEQ ID NO: 259755 - RNA, 19 nt, Homo sapiens
guucagaccuacuaagcaa

SEQ ID NO: 259756 - RNA, 19 nt, Homo sapiens
uaaacaagccuuugaccaa

SEQ ID NO: 259757 - RNA, 19 nt, Homo sapiens
ggaaagucaucuguuuaau

SEQ ID NO: 259758 - RNA, 19 nt, Homo sapiens
uauaauugcuggaauccuu

SEQ ID NO: 259759 - RNA, 19 nt, Homo sapiens
ggaguuauaauaggaagua

SEQ ID NO: 259760 - RNA, 19 nt, Homo sapiens
gcagugcagcaguuuauaa

SEQ ID NO: 259761 - RNA, 19 nt, Homo sapiens
gagcacaucauuuauauac

SEQ ID NO: 259762 - RNA, 19 nt, Homo sapiens
cacaaaguauucccagaaa

SEQ ID NO: 259763 - RNA, 19 nt, Homo sapiens
ugagaaacaccacccauuu

SEQ ID NO: 259764 - RNA, 19 nt, Homo sapiens
guuaugggauguaaacaau

SEQ ID NO: 259765 - RNA, 19 nt, Homo sapiens
gaaguaccaacaggaguua

SEQ ID NO: 259766 - RNA, 19 nt, Homo sapiens
ucaaggaggagacaacuuu

SEQ ID NO: 259767 - RNA, 19 nt, Homo sapiens
gacaauauacugagguuug

SEQ ID NO: 259768 - RNA, 19 nt, Homo sapiens
cuccagcgguccaaaguua

SEQ ID NO: 259769 - RNA, 19 nt, Homo sapiens
uaaugugacuaccagaauu

SEQ ID NO: 259770 - RNA, 19 nt, Homo sapiens
gcacuagcccugcccuuga

SEQ ID NO: 259771 - RNA, 19 nt, Homo sapiens
ucaaguggccauuguauau

SEQ ID NO: 259772 - RNA, 19 nt, Homo sapiens
guguauaaauguccuguug

SEQ ID NO: 259773 - RNA, 19 nt, Homo sapiens
gugcagcaguuuauaaauc

SEQ ID NO: 259774 - RNA, 19 nt, Homo sapiens
caacggguguguguucuga

SEQ ID NO: 259775 - RNA, 19 nt, Homo sapiens
gaacugcuuccuguaguaa

SEQ ID NO: 259776 - RNA, 19 nt, Homo sapiens
aaauuccucuccuguauga

SEQ ID NO: 259777 - RNA, 19 nt, Homo sapiens
caaagacuguggugaggau

SEQ ID NO: 259778 - RNA, 19 nt, Homo sapiens
ggaagaagaugaugaagag

SEQ ID NO: 259779 - RNA, 19 nt, Homo sapiens
gaagaagaacgcccagaua

SEQ ID NO: 259780 - RNA, 19 nt, Homo sapiens
caaguugccuccaagcuuu

SEQ ID NO: 259781 - RNA, 19 nt, Homo sapiens
ggacaagcguuacugugaa

SEQ ID NO: 259782 - RNA, 19 nt, Homo sapiens
gaaggccucuguccagcua

SEQ ID NO: 259783 - RNA, 19 nt, Homo sapiens
ccuaugagcuccacaacaa

SEQ ID NO: 259784 - RNA, 19 nt, Homo sapiens
gaagauggccagagcuuug

SEQ ID NO: 259785 - RNA, 19 nt, Homo sapiens
gaagaacgcccagauagga

SEQ ID NO: 259786 - RNA, 19 nt, Homo sapiens
caacauuccucagaagcua

SEQ ID NO: 259787 - RNA, 19 nt, Homo sapiens
cagaagcuaucccuaaaug

SEQ ID NO: 259788 - RNA, 19 nt, Homo sapiens
uggcggcuauuauuucuua

SEQ ID NO: 259789 - RNA, 19 nt, Homo sapiens
gcacaacauuccucagaag

SEQ ID NO: 259790 - RNA, 19 nt, Homo sapiens
gaugagacccgaaauguag

SEQ ID NO: 259791 - RNA, 19 nt, Homo sapiens
ucucaacacuacagaauau

SEQ ID NO: 259792 - RNA, 19 nt, Homo sapiens
gcacuggaacguccuagaa

SEQ ID NO: 259793 - RNA, 19 nt, Homo sapiens
ccaaccagguggcugugua

SEQ ID NO: 259794 - RNA, 19 nt, Homo sapiens
gcccguagguagcugcuuu

SEQ ID NO: 259795 - RNA, 19 nt, Homo sapiens
gggacaagcguuacuguga

SEQ ID NO: 259796 - RNA, 19 nt, Homo sapiens
gagaagacgcccguaggua

SEQ ID NO: 259797 - RNA, 19 nt, Homo sapiens
gaagagcuguguccuaccu

SEQ ID NO: 259798 - RNA, 19 nt, Homo sapiens
ggagagggccauuccaauc

SEQ ID NO: 259799 - RNA, 19 nt, Homo sapiens
guaaucagaagaaggagaa

SEQ ID NO: 259800 - RNA, 19 nt, Homo sapiens
gagcagauggcgucguauu

SEQ ID NO: 259801 - RNA, 19 nt, Homo sapiens
aauguaggcucccaaacuu

SEQ ID NO: 259802 - RNA, 19 nt, Homo sapiens
gagagacucaucuguaauc

SEQ ID NO: 259803 - RNA, 19 nt, Homo sapiens
gaucucaacacuacagaau

SEQ ID NO: 259804 - RNA, 19 nt, Homo sapiens
ccucagaagcuaucccuaa

SEQ ID NO: 259805 - RNA, 19 nt, Homo sapiens
cgaccgggauggcuacaau

SEQ ID NO: 259806 - RNA, 19 nt, Homo sapiens
ccugggagguuguggaaga

SEQ ID NO: 259807 - RNA, 19 nt, Homo sapiens
ccaggguggugcuguguga

SEQ ID NO: 259808 - RNA, 19 nt, Homo sapiens
ggcacaacauuccucagaa

SEQ ID NO: 259809 - RNA, 19 nt, Homo sapiens
caaaguggagcacaccuau

SEQ ID NO: 259810 - RNA, 19 nt, Homo sapiens
uguaggcucccaaacuuua

SEQ ID NO: 259811 - RNA, 19 nt, Homo sapiens
gggcacaacauuccucaga

SEQ ID NO: 259812 - RNA, 19 nt, Homo sapiens
gaggagagggccauuccaa

SEQ ID NO: 259813 - RNA, 19 nt, Homo sapiens
gggaagaugacguaugugu

SEQ ID NO: 259814 - RNA, 19 nt, Homo sapiens
cucagaagcuaucccuaaa

SEQ ID NO: 259815 - RNA, 19 nt, Homo sapiens
gagcucagccaguggugaa

SEQ ID NO: 259816 - RNA, 19 nt, Homo sapiens
gagccgcauuuacguggaa

SEQ ID NO: 259817 - RNA, 19 nt, Homo sapiens
ggugcagccuacacuauuc

SEQ ID NO: 259818 - RNA, 19 nt, Homo sapiens
ggaagauggccagagcuuu

SEQ ID NO: 259819 - RNA, 19 nt, Homo sapiens
gacaagcguuacugugaag

SEQ ID NO: 259820 - RNA, 19 nt, Homo sapiens
ggugguggcagcagaagaa

SEQ ID NO: 259821 - RNA, 19 nt, Homo sapiens
gcuccuggcggcuauuauu

SEQ ID NO: 259822 - RNA, 19 nt, Homo sapiens
cgaaauguaggcucccaaa

SEQ ID NO: 259823 - RNA, 19 nt, Homo sapiens
gugcucagccucaaugugu

SEQ ID NO: 259824 - RNA, 19 nt, Homo sapiens
cgggauggcuacaaugaca

SEQ ID NO: 259825 - RNA, 19 nt, Homo sapiens
gagcaagaacagccagaau

SEQ ID NO: 259826 - RNA, 19 nt, Homo sapiens
gauaggaaucgcgauguug

SEQ ID NO: 259827 - RNA, 19 nt, Homo sapiens
ugaugagacccgaaaugua

SEQ ID NO: 259828 - RNA, 19 nt, Homo sapiens
cccgugagcugcuucaaca

SEQ ID NO: 259829 - RNA, 19 nt, Homo sapiens
gagagggccauuccaaucu

SEQ ID NO: 259830 - RNA, 19 nt, Homo sapiens
agauaggaaucgcgauguu

SEQ ID NO: 259831 - RNA, 19 nt, Homo sapiens
ccaaaguggagcacaccua

SEQ ID NO: 259832 - RNA, 19 nt, Homo sapiens
gaacagccagaauccaaac

SEQ ID NO: 259833 - RNA, 19 nt, Homo sapiens
ccuccgaccugcucuacau

SEQ ID NO: 259834 - RNA, 19 nt, Homo sapiens
gcaagaacagccagaaucc

SEQ ID NO: 259835 - RNA, 19 nt, Homo sapiens
aagaagaacgcccagauag

SEQ ID NO: 259836 - RNA, 19 nt, Homo sapiens
ccguagacaucgaugacaa

SEQ ID NO: 259837 - RNA, 19 nt, Homo sapiens
gcagauggcgucguauuuu

SEQ ID NO: 259838 - RNA, 19 nt, Homo sapiens
agacugaggaggcugagaa

SEQ ID NO: 259839 - RNA, 19 nt, Homo sapiens
aaguggagcacaccuauga

SEQ ID NO: 259840 - RNA, 19 nt, Homo sapiens
gugaugagacccgaaaugu

SEQ ID NO: 259841 - RNA, 19 nt, Homo sapiens
cagaagaaggagaaugaga

SEQ ID NO: 259842 - RNA, 19 nt, Homo sapiens
ugaagaagaacgcccagau

SEQ ID NO: 259843 - RNA, 19 nt, Homo sapiens
gccagaauccaaacagcaa

SEQ ID NO: 259844 - RNA, 19 nt, Homo sapiens
aagaacagccagaauccaa

SEQ ID NO: 259845 - RNA, 19 nt, Homo sapiens
uggaagaagaugaugaaga

SEQ ID NO: 259846 - RNA, 19 nt, Homo sapiens
ggagcaagaacagccagaa

SEQ ID NO: 259847 - RNA, 19 nt, Homo sapiens
gcaaccccaugaagaagaa

SEQ ID NO: 259848 - RNA, 19 nt, Homo sapiens
ucuuugaccuccgugauga

SEQ ID NO: 259849 - RNA, 19 nt, Homo sapiens
gauggugcagccuacacua

SEQ ID NO: 259850 - RNA, 19 nt, Homo sapiens
cagcuggagcgacgucauu

SEQ ID NO: 259851 - RNA, 19 nt, Homo sapiens
caggauccaguucucguaa

SEQ ID NO: 259852 - RNA, 19 nt, Homo sapiens
agagggagcagaacagcuu

SEQ ID NO: 259853 - RNA, 19 nt, Homo sapiens
gcggauauuuucucgaguu

SEQ ID NO: 259854 - RNA, 19 nt, Homo sapiens
ggaagaggcuggggagucu

SEQ ID NO: 259855 - RNA, 19 nt, Homo sapiens
caccauggccuuccuucga

SEQ ID NO: 259856 - RNA, 19 nt, Homo sapiens
ccagcaacccagaguacuu

SEQ ID NO: 259857 - RNA, 19 nt, Homo sapiens
gcuuuggguuggagcuguu

SEQ ID NO: 259858 - RNA, 19 nt, Homo sapiens
acaaguugccuccaagcuu

SEQ ID NO: 259859 - RNA, 19 nt, Homo sapiens
agugugaccugcaggagau

SEQ ID NO: 259860 - RNA, 19 nt, Homo sapiens
gggagucuguguccuucca

SEQ ID NO: 259861 - RNA, 19 nt, Homo sapiens
cagcuacuggugcaagauu

SEQ ID NO: 259862 - RNA, 19 nt, Homo sapiens
ccugggagcgguggaaauu

SEQ ID NO: 259863 - RNA, 19 nt, Homo sapiens
caacacuacagaauauguc

SEQ ID NO: 259864 - RNA, 19 nt, Homo sapiens
gaacacccugagccgcauu

SEQ ID NO: 259865 - RNA, 19 nt, Homo sapiens
ccuggaagaagaugaugaa

SEQ ID NO: 259866 - RNA, 19 nt, Homo sapiens
uaugagcuccacaacaaug

SEQ ID NO: 259867 - RNA, 19 nt, Homo sapiens
gcagauacggagcaagaac

SEQ ID NO: 259868 - RNA, 19 nt, Homo sapiens
cugcagauacggagcaaga

SEQ ID NO: 259869 - RNA, 19 nt, Homo sapiens
gaggugccguagacaucga

SEQ ID NO: 259870 - RNA, 19 nt, Homo sapiens
ucagcuccguggucacuca

SEQ ID NO: 259871 - RNA, 19 nt, Homo sapiens
gaaauguaggcucccaaac

SEQ ID NO: 259872 - RNA, 19 nt, Homo sapiens
ggauccaguucucguaagc

SEQ ID NO: 259873 - RNA, 19 nt, Homo sapiens
ucaggauccaguucucgua

SEQ ID NO: 259874 - RNA, 19 nt, Homo sapiens
aaauguaggcucccaaacu

SEQ ID NO: 259875 - RNA, 19 nt, Homo sapiens
gggcuccuggcggcuauua

SEQ ID NO: 259876 - RNA, 19 nt, Homo sapiens
ucguuucccucccaacaga

SEQ ID NO: 259877 - RNA, 19 nt, Homo sapiens
ggagguuguggaagaagga

SEQ ID NO: 259878 - RNA, 19 nt, Homo sapiens
gaacuacucuuuaccuuug

SEQ ID NO: 259879 - RNA, 19 nt, Homo sapiens
ggaaacagcuacaugauuc

SEQ ID NO: 259880 - RNA, 19 nt, Homo sapiens
caaggaaaccucuauauug

SEQ ID NO: 259881 - RNA, 19 nt, Homo sapiens
gcagagacguccggaaauu

SEQ ID NO: 259882 - RNA, 19 nt, Homo sapiens
uggcagaccugaacaauga

SEQ ID NO: 259883 - RNA, 19 nt, Homo sapiens
gcaccuucaucgaggauua

SEQ ID NO: 259884 - RNA, 19 nt, Homo sapiens
ggacuuaucugaguauagu

SEQ ID NO: 259885 - RNA, 19 nt, Homo sapiens
ggacugugcuggugcauca

SEQ ID NO: 259886 - RNA, 19 nt, Homo sapiens
caaaggaacuagaaagaag

SEQ ID NO: 259887 - RNA, 19 nt, Homo sapiens
guaaaucaccggcuacaaa

SEQ ID NO: 259888 - RNA, 19 nt, Homo sapiens
caggauggauuucaggaua

SEQ ID NO: 259889 - RNA, 19 nt, Homo sapiens
ggagggagccgacacuuga

SEQ ID NO: 259890 - RNA, 19 nt, Homo sapiens
gcaaguggcugcuguaucc

SEQ ID NO: 259891 - RNA, 19 nt, Homo sapiens
gaaaggaaacagcuacaug

SEQ ID NO: 259892 - RNA, 19 nt, Homo sapiens
gcaaaggaacuagaaagaa

SEQ ID NO: 259893 - RNA, 19 nt, Homo sapiens
ccaaggaaaccucuauauu

SEQ ID NO: 259894 - RNA, 19 nt, Homo sapiens
gcacauacaccucgucaag

SEQ ID NO: 259895 - RNA, 19 nt, Homo sapiens
ggacaaccuccgugacaaa

SEQ ID NO: 259896 - RNA, 19 nt, Homo sapiens
gaacuucuacccagaccuu

SEQ ID NO: 259897 - RNA, 19 nt, Homo sapiens
gacccuggccaucacauua

SEQ ID NO: 259898 - RNA, 19 nt, Homo sapiens
ccagagagacccugcaaga

SEQ ID NO: 259899 - RNA, 19 nt, Homo sapiens
gcucagacccaacagcaaa

SEQ ID NO: 259900 - RNA, 19 nt, Homo sapiens
gacaaccuguggcccauga

SEQ ID NO: 259901 - RNA, 19 nt, Homo sapiens
gguaauccauggagagaag

SEQ ID NO: 259902 - RNA, 19 nt, Homo sapiens
ggauggauuucaggauauu

SEQ ID NO: 259903 - RNA, 19 nt, Homo sapiens
caaccuggauacccgauuc

SEQ ID NO: 259904 - RNA, 19 nt, Homo sapiens
gggugagucuggcaugaaa

SEQ ID NO: 259905 - RNA, 19 nt, Homo sapiens
guguacaucuaucacagua

SEQ ID NO: 259906 - RNA, 19 nt, Homo sapiens
gcaaaguguacaucuauca

SEQ ID NO: 259907 - RNA, 19 nt, Homo sapiens
gggcaaaguguacaucuau

SEQ ID NO: 259908 - RNA, 19 nt, Homo sapiens
aaggaaaccucuauauugg

SEQ ID NO: 259909 - RNA, 19 nt, Homo sapiens
aaaggaaacagcuacauga

SEQ ID NO: 259910 - RNA, 19 nt, Homo sapiens
gcaauagcaacacagacua

SEQ ID NO: 259911 - RNA, 19 nt, Homo sapiens
cagcagagacguccggaaa

SEQ ID NO: 259912 - RNA, 19 nt, Homo sapiens
ucacucugcugguggacua

SEQ ID NO: 259913 - RNA, 19 nt, Homo sapiens
ggauguggaugagaacuuc

SEQ ID NO: 259914 - RNA, 19 nt, Homo sapiens
gcgcaaggagugggacuua

SEQ ID NO: 259915 - RNA, 19 nt, Homo sapiens
gagcugugcuuugcuuaca

SEQ ID NO: 259916 - RNA, 19 nt, Homo sapiens
gcagauggauguggaugag

SEQ ID NO: 259917 - RNA, 19 nt, Homo sapiens
ggaccaaggaaaccucuau

SEQ ID NO: 259918 - RNA, 19 nt, Homo sapiens
gccuacaacuggaaaggaa

SEQ ID NO: 259919 - RNA, 19 nt, Homo sapiens
gaacaaagacaggcaaacg

SEQ ID NO: 259920 - RNA, 19 nt, Homo sapiens
ggaaaaggccccugcaaug

SEQ ID NO: 259921 - RNA, 19 nt, Homo sapiens
gggcagccuucgugucaga

SEQ ID NO: 259922 - RNA, 19 nt, Homo sapiens
ccaucuaugucuucaugaa

SEQ ID NO: 259923 - RNA, 19 nt, Homo sapiens
gagugggacuuaucugagu

SEQ ID NO: 259924 - RNA, 19 nt, Homo sapiens
acaacgagaugugcaauag

SEQ ID NO: 259925 - RNA, 19 nt, Homo sapiens
cagaggagaugccacuucu

SEQ ID NO: 259926 - RNA, 19 nt, Homo sapiens
acaccuggauccaucuuga

SEQ ID NO: 259927 - RNA, 19 nt, Homo sapiens
ccucucaaccucacucuuu

SEQ ID NO: 259928 - RNA, 19 nt, Homo sapiens
gcaaguggagcugugcuuu

SEQ ID NO: 259929 - RNA, 19 nt, Homo sapiens
gaccaaggaaaccucuaua

SEQ ID NO: 259930 - RNA, 19 nt, Homo sapiens
gcaaggagugggacuuauc

SEQ ID NO: 259931 - RNA, 19 nt, Homo sapiens
caacagcaaaggaacuaga

SEQ ID NO: 259932 - RNA, 19 nt, Homo sapiens
uggcugggcuacccuauuc

SEQ ID NO: 259933 - RNA, 19 nt, Homo sapiens
caauaaacagcucccaguu

SEQ ID NO: 259934 - RNA, 19 nt, Homo sapiens
ccagaaggcuugcuuuccu

SEQ ID NO: 259935 - RNA, 19 nt, Homo sapiens
ggccaccucuugugugcaa

SEQ ID NO: 259936 - RNA, 19 nt, Homo sapiens
gcacggccaccucuugugu

SEQ ID NO: 259937 - RNA, 19 nt, Homo sapiens
gcagguaggcagcuucauc

SEQ ID NO: 259938 - RNA, 19 nt, Homo sapiens
ggaguggcccuacgaaguc

SEQ ID NO: 259939 - RNA, 19 nt, Homo sapiens
ugucagagcagcagcagaa

SEQ ID NO: 259940 - RNA, 19 nt, Homo sapiens
agauggauguggaugagaa

SEQ ID NO: 259941 - RNA, 19 nt, Homo sapiens
caaccaggauggauuucag

SEQ ID NO: 259942 - RNA, 19 nt, Homo sapiens
gagaagcugaggcuaguuc

SEQ ID NO: 259943 - RNA, 19 nt, Homo sapiens
gagccgacacuugaaugua

SEQ ID NO: 259944 - RNA, 19 nt, Homo sapiens
ggcagacucgggaccaaua

SEQ ID NO: 259945 - RNA, 19 nt, Homo sapiens
gcacccugcccaccaagaa

SEQ ID NO: 259946 - RNA, 19 nt, Homo sapiens
ccuugugccuucuuuguau

SEQ ID NO: 259947 - RNA, 19 nt, Homo sapiens
agacagauguugggaggau

SEQ ID NO: 259948 - RNA, 19 nt, Homo sapiens
ggcagaaggcggagaugaa

SEQ ID NO: 259949 - RNA, 19 nt, Homo sapiens
gugguucucuguggacauu

SEQ ID NO: 259950 - RNA, 19 nt, Homo sapiens
ugaacuacucuuuaccuuu

SEQ ID NO: 259951 - RNA, 19 nt, Homo sapiens
caaccuccgugacaaacuc

SEQ ID NO: 259952 - RNA, 19 nt, Homo sapiens
ucacugcccacaaggauga

SEQ ID NO: 259953 - RNA, 19 nt, Homo sapiens
gcgaggcaaugaccuagag

SEQ ID NO: 259954 - RNA, 19 nt, Homo sapiens
cccaugggcuguguccuaa

SEQ ID NO: 259955 - RNA, 19 nt, Homo sapiens
gacagauguugggaggaua

SEQ ID NO: 259956 - RNA, 19 nt, Homo sapiens
gcgggauccuccacagaga

SEQ ID NO: 259957 - RNA, 19 nt, Homo sapiens
gcaggaaggaacaaagaca

SEQ ID NO: 259958 - RNA, 19 nt, Homo sapiens
gcauuccugugcccuagau

SEQ ID NO: 259959 - RNA, 19 nt, Homo sapiens
ugugggagcuccguuugaa

SEQ ID NO: 259960 - RNA, 19 nt, Homo sapiens
ccacggcaccgacauaugg

SEQ ID NO: 259961 - RNA, 19 nt, Homo sapiens
gaaacagcuacaugauuca

SEQ ID NO: 259962 - RNA, 19 nt, Homo sapiens
gauguugggaggauacaga

SEQ ID NO: 259963 - RNA, 19 nt, Homo sapiens
gaaaaggccccugcaaugu

SEQ ID NO: 259964 - RNA, 19 nt, Homo sapiens
gcugaccgacgacuacuga

SEQ ID NO: 259965 - RNA, 19 nt, Homo sapiens
ggacccagaggaccaagga

SEQ ID NO: 259966 - RNA, 19 nt, Homo sapiens
cagcaggaaggaacaaaga

SEQ ID NO: 259967 - RNA, 19 nt, Homo sapiens
acauacaccucgucaagag

SEQ ID NO: 259968 - RNA, 19 nt, Homo sapiens
gacccgcuauuaucagauc

SEQ ID NO: 259969 - RNA, 19 nt, Homo sapiens
gcagaaggcggagaugaag

SEQ ID NO: 259970 - RNA, 19 nt, Homo sapiens
uaaaucaccggcuacaaag

SEQ ID NO: 259971 - RNA, 19 nt, Homo sapiens
gcagugaguccgcugucuu

SEQ ID NO: 259972 - RNA, 19 nt, Homo sapiens
caaguggagcugugcuuug

SEQ ID NO: 259973 - RNA, 19 nt, Homo sapiens
cagcauuggugacaucaac

SEQ ID NO: 259974 - RNA, 19 nt, Homo sapiens
caccagagccgggaggaaa

SEQ ID NO: 259975 - RNA, 19 nt, Homo sapiens
gcagcaggcucaggcacau

SEQ ID NO: 259976 - RNA, 19 nt, Homo sapiens
uaucagaucaugcccaagu

SEQ ID NO: 259977 - RNA, 19 nt, Homo sapiens
gaccuuaucaacccucuca

SEQ ID NO: 259978 - RNA, 19 nt, Homo sapiens
gaacuacucuuuaccuuug

SEQ ID NO: 259979 - RNA, 19 nt, Homo sapiens
ggaaacagcuacaugauuc

SEQ ID NO: 259980 - RNA, 19 nt, Homo sapiens
caaggaaaccucuauauug

SEQ ID NO: 259981 - RNA, 19 nt, Homo sapiens
gcagagacguccggaaauu

SEQ ID NO: 259982 - RNA, 19 nt, Homo sapiens
uggcagaccugaacaauga

SEQ ID NO: 259983 - RNA, 19 nt, Homo sapiens
gcaccuucaucgaggauua

SEQ ID NO: 259984 - RNA, 19 nt, Homo sapiens
ggacuuaucugaguauagu

SEQ ID NO: 259985 - RNA, 19 nt, Homo sapiens
ggacugugcuggugcauca

SEQ ID NO: 259986 - RNA, 19 nt, Homo sapiens
caaaggaacuagaaagaag

SEQ ID NO: 259987 - RNA, 19 nt, Homo sapiens
guaaaucaccggcuacaaa

SEQ ID NO: 259988 - RNA, 19 nt, Homo sapiens
caggauggauuucaggaua

SEQ ID NO: 259989 - RNA, 19 nt, Homo sapiens
ggagggagccgacacuuga

SEQ ID NO: 259990 - RNA, 19 nt, Homo sapiens
gcaaguggcugcuguaucc

SEQ ID NO: 259991 - RNA, 19 nt, Homo sapiens
gaaaggaaacagcuacaug

SEQ ID NO: 259992 - RNA, 19 nt, Homo sapiens
gcaaaggaacuagaaagaa

SEQ ID NO: 259993 - RNA, 19 nt, Homo sapiens
ccaaggaaaccucuauauu

SEQ ID NO: 259994 - RNA, 19 nt, Homo sapiens
gcacauacaccucgucaag

SEQ ID NO: 259995 - RNA, 19 nt, Homo sapiens
ggacaaccuccgugacaaa

SEQ ID NO: 259996 - RNA, 19 nt, Homo sapiens
gaacuucuacccagaccuu

SEQ ID NO: 259997 - RNA, 19 nt, Homo sapiens
gacccuggccaucacauua

SEQ ID NO: 259998 - RNA, 19 nt, Homo sapiens
ccagagagacccugcaaga

SEQ ID NO: 259999 - RNA, 19 nt, Homo sapiens
gcucagacccaacagcaaa

SEQ ID NO: 260000 - RNA, 19 nt, Homo sapiens
gacaaccuguggcccauga

SEQ ID NO: 260001 - RNA, 19 nt, Homo sapiens
gguaauccauggagagaag

SEQ ID NO: 260002 - RNA, 19 nt, Homo sapiens
ggauggauuucaggauauu

SEQ ID NO: 260003 - RNA, 19 nt, Homo sapiens
caaccuggauacccgauuc

SEQ ID NO: 260004 - RNA, 19 nt, Homo sapiens
gggugagucuggcaugaaa

SEQ ID NO: 260005 - RNA, 19 nt, Homo sapiens
guguacaucuaucacagua

SEQ ID NO: 260006 - RNA, 19 nt, Homo sapiens
gcaaaguguacaucuauca

SEQ ID NO: 260007 - RNA, 19 nt, Homo sapiens
gggcaaaguguacaucuau

SEQ ID NO: 260008 - RNA, 19 nt, Homo sapiens
aaggaaaccucuauauugg

SEQ ID NO: 260009 - RNA, 19 nt, Homo sapiens
aaaggaaacagcuacauga

SEQ ID NO: 260010 - RNA, 19 nt, Homo sapiens
gcaauagcaacacagacua

SEQ ID NO: 260011 - RNA, 19 nt, Homo sapiens
cagcagagacguccggaaa

SEQ ID NO: 260012 - RNA, 19 nt, Homo sapiens
ucacucugcugguggacua

SEQ ID NO: 260013 - RNA, 19 nt, Homo sapiens
ggauguggaugagaacuuc

SEQ ID NO: 260014 - RNA, 19 nt, Homo sapiens
gcgcaaggagugggacuua

SEQ ID NO: 260015 - RNA, 19 nt, Homo sapiens
gagcugugcuuugcuuaca

SEQ ID NO: 260016 - RNA, 19 nt, Homo sapiens
gcagauggauguggaugag

SEQ ID NO: 260017 - RNA, 19 nt, Homo sapiens
ggaccaaggaaaccucuau

SEQ ID NO: 260018 - RNA, 19 nt, Homo sapiens
gccuacaacuggaaaggaa

SEQ ID NO: 260019 - RNA, 19 nt, Homo sapiens
gaacaaagacaggcaaacg

SEQ ID NO: 260020 - RNA, 19 nt, Homo sapiens
ggaaaaggccccugcaaug

SEQ ID NO: 260021 - RNA, 19 nt, Homo sapiens
gggcagccuucgugucaga

SEQ ID NO: 260022 - RNA, 19 nt, Homo sapiens
ccaucuaugucuucaugaa

SEQ ID NO: 260023 - RNA, 19 nt, Homo sapiens
gagugggacuuaucugagu

SEQ ID NO: 260024 - RNA, 19 nt, Homo sapiens
acaacgagaugugcaauag

SEQ ID NO: 260025 - RNA, 19 nt, Homo sapiens
cagaggagaugccacuucu

SEQ ID NO: 260026 - RNA, 19 nt, Homo sapiens
acaccuggauccaucuuga

SEQ ID NO: 260027 - RNA, 19 nt, Homo sapiens
ccucucaaccucacucuuu

SEQ ID NO: 260028 - RNA, 19 nt, Homo sapiens
gcaaguggagcugugcuuu

SEQ ID NO: 260029 - RNA, 19 nt, Homo sapiens
gaccaaggaaaccucuaua

SEQ ID NO: 260030 - RNA, 19 nt, Homo sapiens
gcaaggagugggacuuauc

SEQ ID NO: 260031 - RNA, 19 nt, Homo sapiens
caacagcaaaggaacuaga

SEQ ID NO: 260032 - RNA, 19 nt, Homo sapiens
uggcugggcuacccuauuc

SEQ ID NO: 260033 - RNA, 19 nt, Homo sapiens
caauaaacagcucccaguu

SEQ ID NO: 260034 - RNA, 19 nt, Homo sapiens
ccagaaggcuugcuuuccu

SEQ ID NO: 260035 - RNA, 19 nt, Homo sapiens
ggccaccucuugugugcaa

SEQ ID NO: 260036 - RNA, 19 nt, Homo sapiens
gcacggccaccucuugugu

SEQ ID NO: 260037 - RNA, 19 nt, Homo sapiens
gcagguaggcagcuucauc

SEQ ID NO: 260038 - RNA, 19 nt, Homo sapiens
ggaguggcccuacgaaguc

SEQ ID NO: 260039 - RNA, 19 nt, Homo sapiens
ugucagagcagcagcagaa

SEQ ID NO: 260040 - RNA, 19 nt, Homo sapiens
agauggauguggaugagaa

SEQ ID NO: 260041 - RNA, 19 nt, Homo sapiens
caaccaggauggauuucag

SEQ ID NO: 260042 - RNA, 19 nt, Homo sapiens
gagaagcugaggcuaguuc

SEQ ID NO: 260043 - RNA, 19 nt, Homo sapiens
gagccgacacuugaaugua

SEQ ID NO: 260044 - RNA, 19 nt, Homo sapiens
ggcagacucgggaccaaua

SEQ ID NO: 260045 - RNA, 19 nt, Homo sapiens
gcacccugcccaccaagaa

SEQ ID NO: 260046 - RNA, 19 nt, Homo sapiens
ccuugugccuucuuuguau

SEQ ID NO: 260047 - RNA, 19 nt, Homo sapiens
agacagauguugggaggau

SEQ ID NO: 260048 - RNA, 19 nt, Homo sapiens
gugguucucuguggacauu

SEQ ID NO: 260049 - RNA, 19 nt, Homo sapiens
ugaacuacucuuuaccuuu

SEQ ID NO: 260050 - RNA, 19 nt, Homo sapiens
caaccuccgugacaaacuc

SEQ ID NO: 260051 - RNA, 19 nt, Homo sapiens
ucacugcccacaaggauga

SEQ ID NO: 260052 - RNA, 19 nt, Homo sapiens
gcgaggcaaugaccuagag

SEQ ID NO: 260053 - RNA, 19 nt, Homo sapiens
cccaugggcuguguccuaa

SEQ ID NO: 260054 - RNA, 19 nt, Homo sapiens
gacagauguugggaggaua

SEQ ID NO: 260055 - RNA, 19 nt, Homo sapiens
gcgggauccuccacagaga

SEQ ID NO: 260056 - RNA, 19 nt, Homo sapiens
gcaggaaggaacaaagaca

SEQ ID NO: 260057 - RNA, 19 nt, Homo sapiens
gcauuccugugcccuagau

SEQ ID NO: 260058 - RNA, 19 nt, Homo sapiens
ugugggagcuccguuugaa

SEQ ID NO: 260059 - RNA, 19 nt, Homo sapiens
ccacggcaccgacauaugg

SEQ ID NO: 260060 - RNA, 19 nt, Homo sapiens
gaaacagcuacaugauuca

SEQ ID NO: 260061 - RNA, 19 nt, Homo sapiens
gauguugggaggauacaga

SEQ ID NO: 260062 - RNA, 19 nt, Homo sapiens
gaaaaggccccugcaaugu

SEQ ID NO: 260063 - RNA, 19 nt, Homo sapiens
ggacccagaggaccaagga

SEQ ID NO: 260064 - RNA, 19 nt, Homo sapiens
cagcaggaaggaacaaaga

SEQ ID NO: 260065 - RNA, 19 nt, Homo sapiens
acauacaccucgucaagag

SEQ ID NO: 260066 - RNA, 19 nt, Homo sapiens
gacccgcuauuaucagauc

SEQ ID NO: 260067 - RNA, 19 nt, Homo sapiens
uaaaucaccggcuacaaag

SEQ ID NO: 260068 - RNA, 19 nt, Homo sapiens
gcagugaguccgcugucuu

SEQ ID NO: 260069 - RNA, 19 nt, Homo sapiens
caaguggagcugugcuuug

SEQ ID NO: 260070 - RNA, 19 nt, Homo sapiens
cagcauuggugacaucaac

SEQ ID NO: 260071 - RNA, 19 nt, Homo sapiens
caccagagccgggaggaaa

SEQ ID NO: 260072 - RNA, 19 nt, Homo sapiens
gcagcaggcucaggcacau

SEQ ID NO: 260073 - RNA, 19 nt, Homo sapiens
uaucagaucaugcccaagu

SEQ ID NO: 260074 - RNA, 19 nt, Homo sapiens
gaccuuaucaacccucuca

SEQ ID NO: 260075 - RNA, 19 nt, Homo sapiens
gguucucuguggacauuga

SEQ ID NO: 260076 - RNA, 19 nt, Homo sapiens
cuccagaccucgcuuagca

SEQ ID NO: 260077 - RNA, 19 nt, Homo sapiens
guggagcugugcuuugcuu

SEQ ID NO: 260078 - RNA, 19 nt, Homo sapiens
gaacuuaacuuuccauguu

SEQ ID NO: 260079 - RNA, 19 nt, Homo sapiens
gacaagaccuguaguaauu

SEQ ID NO: 260080 - RNA, 19 nt, Homo sapiens
ggaguuauaucaacaguaa

SEQ ID NO: 260081 - RNA, 19 nt, Homo sapiens
caacuugacugcaguauug

SEQ ID NO: 260082 - RNA, 19 nt, Homo sapiens
gcauauauauucagcauug

SEQ ID NO: 260083 - RNA, 19 nt, Homo sapiens
uagaagaacugcaaaggua

SEQ ID NO: 260084 - RNA, 19 nt, Homo sapiens
gaacgaaauuugacugugu

SEQ ID NO: 260085 - RNA, 19 nt, Homo sapiens
gcaaggugcuauuuauauu

SEQ ID NO: 260086 - RNA, 19 nt, Homo sapiens
gcagauggcuucucagauc

SEQ ID NO: 260087 - RNA, 19 nt, Homo sapiens
gaucaucucucaaggauag

SEQ ID NO: 260088 - RNA, 19 nt, Homo sapiens
caaauaaacugugaaguca

SEQ ID NO: 260089 - RNA, 19 nt, Homo sapiens
gcauagaucuaacacuuug

SEQ ID NO: 260090 - RNA, 19 nt, Homo sapiens
gaauagccauaacgucuuu

SEQ ID NO: 260091 - RNA, 19 nt, Homo sapiens
gaaauaagagcaacagguu

SEQ ID NO: 260092 - RNA, 19 nt, Homo sapiens
cagagugacuguagcaaua

SEQ ID NO: 260093 - RNA, 19 nt, Homo sapiens
gagaaacacuaaagcauuc

SEQ ID NO: 260094 - RNA, 19 nt, Homo sapiens
uaucggagcuccacaagaa

SEQ ID NO: 260095 - RNA, 19 nt, Homo sapiens
gaagagacaguuggaguua

SEQ ID NO: 260096 - RNA, 19 nt, Homo sapiens
ugacaaauaugcugcaaga

SEQ ID NO: 260097 - RNA, 19 nt, Homo sapiens
gggcagagguucauuucaa

SEQ ID NO: 260098 - RNA, 19 nt, Homo sapiens
uuagagagcuguucccaaa

SEQ ID NO: 260099 - RNA, 19 nt, Homo sapiens
gaacacaucaagcauuuau

SEQ ID NO: 260100 - RNA, 19 nt, Homo sapiens
ucaaagagugugugcauua

SEQ ID NO: 260101 - RNA, 19 nt, Homo sapiens
gcaaauaaacugugaaguc

SEQ ID NO: 260102 - RNA, 19 nt, Homo sapiens
uagaacacaucaagcauuu

SEQ ID NO: 260103 - RNA, 19 nt, Homo sapiens
gauaaucucucagcuuuua

SEQ ID NO: 260104 - RNA, 19 nt, Homo sapiens
gugcauagaucuaacacuu

SEQ ID NO: 260105 - RNA, 19 nt, Homo sapiens
ggaaggaaguggguauaga

SEQ ID NO: 260106 - RNA, 19 nt, Homo sapiens
cagcagacuaugaauauua

SEQ ID NO: 260107 - RNA, 19 nt, Homo sapiens
gaaauuugacuguguugaa

SEQ ID NO: 260108 - RNA, 19 nt, Homo sapiens
gaacagaacugaguaaaag

SEQ ID NO: 260109 - RNA, 19 nt, Homo sapiens
agagacaguuggaguuaua

SEQ ID NO: 260110 - RNA, 19 nt, Homo sapiens
ugaaugcaauggaaacaaa

SEQ ID NO: 260111 - RNA, 19 nt, Homo sapiens
ugaaaugacuuccggaauc

SEQ ID NO: 260112 - RNA, 19 nt, Homo sapiens
ggaccauuaucacuuuaaa

SEQ ID NO: 260113 - RNA, 19 nt, Homo sapiens
gaaggaaguggguauagaa

SEQ ID NO: 260114 - RNA, 19 nt, Homo sapiens
gaaaugacuuccggaaucu

SEQ ID NO: 260115 - RNA, 19 nt, Homo sapiens
cuguugaucucauauguua

SEQ ID NO: 260116 - RNA, 19 nt, Homo sapiens
cagagaagcuaacuguaga

SEQ ID NO: 260117 - RNA, 19 nt, Homo sapiens
ggacaagaccuguaguaau

SEQ ID NO: 260118 - RNA, 19 nt, Homo sapiens
gcaaaucguuaaguauguu

SEQ ID NO: 260119 - RNA, 19 nt, Homo sapiens
gaaggaagaguguuugugu

SEQ ID NO: 260120 - RNA, 19 nt, Homo sapiens
ucacacagcuccgcuucua

SEQ ID NO: 260121 - RNA, 19 nt, Homo sapiens
guacacugguuugagcuua

SEQ ID NO: 260122 - RNA, 19 nt, Homo sapiens
caaacguuauuucaccaua

SEQ ID NO: 260123 - RNA, 19 nt, Homo sapiens
gaagaguguuuguguacau

SEQ ID NO: 260124 - RNA, 19 nt, Homo sapiens
ucgaaucgguuaaauguga

SEQ ID NO: 260125 - RNA, 19 nt, Homo sapiens
gaacauguacacugguuug

SEQ ID NO: 260126 - RNA, 19 nt, Homo sapiens
gagagcuguucccaaauuu

SEQ ID NO: 260127 - RNA, 19 nt, Homo sapiens
cucaugaucuugugacaua

SEQ ID NO: 260128 - RNA, 19 nt, Homo sapiens
acaaaucuauccuacaaga

SEQ ID NO: 260129 - RNA, 19 nt, Homo sapiens
ggaaauggacaaucuaaag

SEQ ID NO: 260130 - RNA, 19 nt, Homo sapiens
gaagcuaacuguagaacac

SEQ ID NO: 260131 - RNA, 19 nt, Homo sapiens
gaaacaaaccucguuggaa

SEQ ID NO: 260132 - RNA, 19 nt, Homo sapiens
ggagaaugccacuuugaaa

SEQ ID NO: 260133 - RNA, 19 nt, Homo sapiens
ugacaaugauggcuuugaa

SEQ ID NO: 260134 - RNA, 19 nt, Homo sapiens
gcagagaagcuaacuguag

SEQ ID NO: 260135 - RNA, 19 nt, Homo sapiens
aagaauagcuccguguuau

SEQ ID NO: 260136 - RNA, 19 nt, Homo sapiens
agagagcuguucccaaauu

SEQ ID NO: 260137 - RNA, 19 nt, Homo sapiens
agacucagguuguaguaaa

SEQ ID NO: 260138 - RNA, 19 nt, Homo sapiens
ggaaauaaugguaccaaau

SEQ ID NO: 260139 - RNA, 19 nt, Homo sapiens
caacuucauuuguguaugg

SEQ ID NO: 260140 - RNA, 19 nt, Homo sapiens
ccaccaagauucuauuucu

SEQ ID NO: 260141 - RNA, 19 nt, Homo sapiens
gaacagaaaggcagagucu

SEQ ID NO: 260142 - RNA, 19 nt, Homo sapiens
uaauggcuauguagaugua

SEQ ID NO: 260143 - RNA, 19 nt, Homo sapiens
gguaaggcauauauauuca

SEQ ID NO: 260144 - RNA, 19 nt, Homo sapiens
guaauaauacagccaaaga

SEQ ID NO: 260145 - RNA, 19 nt, Homo sapiens
cagcaaugauuacucuuug

SEQ ID NO: 260146 - RNA, 19 nt, Homo sapiens
caucaaagacccaaacguu

SEQ ID NO: 260147 - RNA, 19 nt, Homo sapiens
acaaauaugcugcaagauu

SEQ ID NO: 260148 - RNA, 19 nt, Homo sapiens
caacaugagcagauuggua

SEQ ID NO: 260149 - RNA, 19 nt, Homo sapiens
uggaaagacuuguuuggaa

SEQ ID NO: 260150 - RNA, 19 nt, Homo sapiens
uaacgucuuugucacuaaa

SEQ ID NO: 260151 - RNA, 19 nt, Homo sapiens
ucuaacgaguggaccauua

SEQ ID NO: 260152 - RNA, 19 nt, Homo sapiens
aaaguaagcccuugaagau

SEQ ID NO: 260153 - RNA, 19 nt, Homo sapiens
gcacaccuggauugcauua

SEQ ID NO: 260154 - RNA, 19 nt, Homo sapiens
gaagagaagcaaauaaacu

SEQ ID NO: 260155 - RNA, 19 nt, Homo sapiens
gaacugcaaagguaauaau

SEQ ID NO: 260156 - RNA, 19 nt, Homo sapiens
gggaaaaucucagcaauga

SEQ ID NO: 260157 - RNA, 19 nt, Homo sapiens
gcaaucgaaucgguuaaau

SEQ ID NO: 260158 - RNA, 19 nt, Homo sapiens
gaaggacuacaucaucaaa

SEQ ID NO: 260159 - RNA, 19 nt, Homo sapiens
gaacuaaacaaggaugaga

SEQ ID NO: 260160 - RNA, 19 nt, Homo sapiens
agauaacucuggcguggua

SEQ ID NO: 260161 - RNA, 19 nt, Homo sapiens
ggagcaaucgaaucgguua

SEQ ID NO: 260162 - RNA, 19 nt, Homo sapiens
gaauagcuccguguuauca

SEQ ID NO: 260163 - RNA, 19 nt, Homo sapiens
ggagaaccuuguggaaaga

SEQ ID NO: 260164 - RNA, 19 nt, Homo sapiens
gaggaaauggacaaucuaa

SEQ ID NO: 260165 - RNA, 19 nt, Homo sapiens
uugaauguguccuuguuua

SEQ ID NO: 260166 - RNA, 19 nt, Homo sapiens
uaaacgaaguacagaggaa

SEQ ID NO: 260167 - RNA, 19 nt, Homo sapiens
gaaguuccagguuacauug

SEQ ID NO: 260168 - RNA, 19 nt, Homo sapiens
gggaaucuauaguuaaucu

SEQ ID NO: 260169 - RNA, 19 nt, Homo sapiens
ggaaacaaaccucguugga

SEQ ID NO: 260170 - RNA, 19 nt, Homo sapiens
caaugcagauggcuucuca

SEQ ID NO: 260171 - RNA, 19 nt, Homo sapiens
gaagagagagacaaucagu

SEQ ID NO: 260172 - RNA, 19 nt, Homo sapiens
gguuugagcuuagugaaau

SEQ ID NO: 260173 - RNA, 19 nt, Homo sapiens
ggcagagguucauuucaaa

SEQ ID NO: 260174 - RNA, 19 nt, Homo sapiens
aguaagcccuugaagauau

SEQ ID NO: 260175 - RNA, 19 nt, Homo sapiens
uaucaacacuggcaauagu

SEQ ID NO: 260176 - RNA, 19 nt, Homo sapiens
ggauagauauuagcuuucu

SEQ ID NO: 260177 - RNA, 19 nt, Homo sapiens
gaaacgacucuacauguca

SEQ ID NO: 260178 - RNA, 19 nt, Homo sapiens
ugaaacaacuggaaagaua

SEQ ID NO: 260179 - RNA, 19 nt, Homo sapiens
caacaaagaacacuaacua

SEQ ID NO: 260180 - RNA, 19 nt, Homo sapiens
ggaaauccauucacaguuc

SEQ ID NO: 260181 - RNA, 19 nt, Homo sapiens
gcaagaaucucaacaacuc

SEQ ID NO: 260182 - RNA, 19 nt, Homo sapiens
ggacaaggcugugguauac

SEQ ID NO: 260183 - RNA, 19 nt, Homo sapiens
gcagugcuauucccaguaa

SEQ ID NO: 260184 - RNA, 19 nt, Homo sapiens
ucacaucgcucucaacuuc

SEQ ID NO: 260185 - RNA, 19 nt, Homo sapiens
gaaccucacuuacggcuau

SEQ ID NO: 260186 - RNA, 19 nt, Homo sapiens
gagaggagccuguggagua

SEQ ID NO: 260187 - RNA, 19 nt, Homo sapiens
ccaaagggaaccucacuua

SEQ ID NO: 260188 - RNA, 19 nt, Homo sapiens
ggacuuauuuaaacucugu

SEQ ID NO: 260189 - RNA, 19 nt, Homo sapiens
gggaacagauggccuccua

SEQ ID NO: 260190 - RNA, 19 nt, Homo sapiens
gacaaacucucgccgauuc

SEQ ID NO: 260191 - RNA, 19 nt, Homo sapiens
ggaaagauaacuaggaaau

SEQ ID NO: 260192 - RNA, 19 nt, Homo sapiens
gaaacaacuggaaagauaa

SEQ ID NO: 260193 - RNA, 19 nt, Homo sapiens
gaacccagacucagacauu

SEQ ID NO: 260194 - RNA, 19 nt, Homo sapiens
guacaaagcccugaagaug

SEQ ID NO: 260195 - RNA, 19 nt, Homo sapiens
caaagggccuggaguugga

SEQ ID NO: 260196 - RNA, 19 nt, Homo sapiens
ggaccaggauggcuacaau

SEQ ID NO: 260197 - RNA, 19 nt, Homo sapiens
gaagaugcccuaccgaauc

SEQ ID NO: 260198 - RNA, 19 nt, Homo sapiens
gggaguaguguuuguauuu

SEQ ID NO: 260199 - RNA, 19 nt, Homo sapiens
gaugacagcuaccuaggau

SEQ ID NO: 260200 - RNA, 19 nt, Homo sapiens
ggacccuuguuuacacaua

SEQ ID NO: 260201 - RNA, 19 nt, Homo sapiens
gcaagugcaauaaaucuga

SEQ ID NO: 260202 - RNA, 19 nt, Homo sapiens
ggacagaugccacaaggau

SEQ ID NO: 260203 - RNA, 19 nt, Homo sapiens
caggagggcugggcucuaa

SEQ ID NO: 260204 - RNA, 19 nt, Homo sapiens
acagauggccuccuacuuu

SEQ ID NO: 260205 - RNA, 19 nt, Homo sapiens
ccacugaccagaacuagaa

SEQ ID NO: 260206 - RNA, 19 nt, Homo sapiens
caggauggcuacaaugaug

SEQ ID NO: 260207 - RNA, 19 nt, Homo sapiens
ccaggcagauccaggacua

SEQ ID NO: 260208 - RNA, 19 nt, Homo sapiens
gucagcagcuccuauaugu

SEQ ID NO: 260209 - RNA, 19 nt, Homo sapiens
guaccugggugacaagaau

SEQ ID NO: 260210 - RNA, 19 nt, Homo sapiens
gcuccaaccugcaaagauc

SEQ ID NO: 260211 - RNA, 19 nt, Homo sapiens
cagcagcuccuauauguga

SEQ ID NO: 260212 - RNA, 19 nt, Homo sapiens
ggccagcccuacauuauca

SEQ ID NO: 260213 - RNA, 19 nt, Homo sapiens
ggaguaguguuuguauuuc

SEQ ID NO: 260214 - RNA, 19 nt, Homo sapiens
cagauggccuccuacuuug

SEQ ID NO: 260215 - RNA, 19 nt, Homo sapiens
gcagauccaggacuauauu

SEQ ID NO: 260216 - RNA, 19 nt, Homo sapiens
ggaaucagaacucaaaugg

SEQ ID NO: 260217 - RNA, 19 nt, Homo sapiens
gcuccuaggucuacucauc

SEQ ID NO: 260218 - RNA, 19 nt, Homo sapiens
gaacgagucagaauuucga

SEQ ID NO: 260219 - RNA, 19 nt, Homo sapiens
caaagaacacuaacuaugc

SEQ ID NO: 260220 - RNA, 19 nt, Homo sapiens
gagccaaagucugcaguug

SEQ ID NO: 260221 - RNA, 19 nt, Homo sapiens
ccugagcugugacuacuuu

SEQ ID NO: 260222 - RNA, 19 nt, Homo sapiens
gagaagacaacaucugugu

SEQ ID NO: 260223 - RNA, 19 nt, Homo sapiens
acacguugcugacuccauu

SEQ ID NO: 260224 - RNA, 19 nt, Homo sapiens
cauccuagccauccuguuu

SEQ ID NO: 260225 - RNA, 19 nt, Homo sapiens
caggaacgagucagaauuu

SEQ ID NO: 260226 - RNA, 19 nt, Homo sapiens
cagccucccugaagccuuu

SEQ ID NO: 260227 - RNA, 19 nt, Homo sapiens
gaaauccauucacaguucu

SEQ ID NO: 260228 - RNA, 19 nt, Homo sapiens
cuacaagcuuggauucuuc

SEQ ID NO: 260229 - RNA, 19 nt, Homo sapiens
cauuuagccugcaguguga

SEQ ID NO: 260230 - RNA, 19 nt, Homo sapiens
gcccggaggcugaguguuu

SEQ ID NO: 260231 - RNA, 19 nt, Homo sapiens
gagaccagccucagaagga

SEQ ID NO: 260232 - RNA, 19 nt, Homo sapiens
gggacgggcuggaugacuu

SEQ ID NO: 260233 - RNA, 19 nt, Homo sapiens
aaagaacacuaacuaugca

SEQ ID NO: 260234 - RNA, 19 nt, Homo sapiens
acaaagaacacuaacuaug

SEQ ID NO: 260235 - RNA, 19 nt, Homo sapiens
caaacgcucccucccauau

SEQ ID NO: 260236 - RNA, 19 nt, Homo sapiens
gucagaauuucgagacaaa

SEQ ID NO: 260237 - RNA, 19 nt, Homo sapiens
cgagaggauugcagagaga

SEQ ID NO: 260238 - RNA, 19 nt, Homo sapiens
caauggauauccugaucug

SEQ ID NO: 260239 - RNA, 19 nt, Homo sapiens
gacauucgaucccucuaca

SEQ ID NO: 260240 - RNA, 19 nt, Homo sapiens
ggcaugcgcuccacuguac

SEQ ID NO: 260241 - RNA, 19 nt, Homo sapiens
cuggaaagauaacuaggaa

SEQ ID NO: 260242 - RNA, 19 nt, Homo sapiens
ggcaauggauauccugauc

SEQ ID NO: 260243 - RNA, 19 nt, Homo sapiens
ugacacagaagacuuuguu

SEQ ID NO: 260244 - RNA, 19 nt, Homo sapiens
gaaagauaacuaggaaauc

SEQ ID NO: 260245 - RNA, 19 nt, Homo sapiens
gaccugcuguccaccaugu

SEQ ID NO: 260246 - RNA, 19 nt, Homo sapiens
uggauauccugaucugauu

SEQ ID NO: 260247 - RNA, 19 nt, Homo sapiens
gcaggguggugcugucuac

SEQ ID NO: 260248 - RNA, 19 nt, Homo sapiens
gacagaugccacaaggaua

SEQ ID NO: 260249 - RNA, 19 nt, Homo sapiens
cacauacccucuucaugga

SEQ ID NO: 260250 - RNA, 19 nt, Homo sapiens
gcccagagacauacuugaa

SEQ ID NO: 260251 - RNA, 19 nt, Homo sapiens
gcagggaguaguguuugua

SEQ ID NO: 260252 - RNA, 19 nt, Homo sapiens
gaacagauggccuccuacu

SEQ ID NO: 260253 - RNA, 19 nt, Homo sapiens
ucacccgaauucuggagua

SEQ ID NO: 260254 - RNA, 19 nt, Homo sapiens
ggccaacaaagaacacuaa

SEQ ID NO: 260255 - RNA, 19 nt, Homo sapiens
cagcaagaaucucaacaac

SEQ ID NO: 260256 - RNA, 19 nt, Homo sapiens
ugacaagaaugcccugaac

SEQ ID NO: 260257 - RNA, 19 nt, Homo sapiens
cagauaacuucacccgaau

SEQ ID NO: 260258 - RNA, 19 nt, Homo sapiens
ccauugaauuugacagcaa

SEQ ID NO: 260259 - RNA, 19 nt, Homo sapiens
gauaacuucacccgaauuc

SEQ ID NO: 260260 - RNA, 19 nt, Homo sapiens
caacuggaaagauaacuag

SEQ ID NO: 260261 - RNA, 19 nt, Homo sapiens
guacucaggacucgucaga

SEQ ID NO: 260262 - RNA, 19 nt, Homo sapiens
uuuaaacucuguugcaagu

SEQ ID NO: 260263 - RNA, 19 nt, Homo sapiens
aaagauaacuaggaaaucc

SEQ ID NO: 260264 - RNA, 19 nt, Homo sapiens
ggucagcagcuccuauaug

SEQ ID NO: 260265 - RNA, 19 nt, Homo sapiens
uaacuucacccgaauucug

SEQ ID NO: 260266 - RNA, 19 nt, Homo sapiens
ugaugaguuuggccgauuu

SEQ ID NO: 260267 - RNA, 19 nt, Homo sapiens
ccaggccaguuccaucuau

SEQ ID NO: 260268 - RNA, 19 nt, Homo sapiens
gauggcaacagaucuggaa

SEQ ID NO: 260269 - RNA, 19 nt, Homo sapiens
gcacccugccgcucagauu

SEQ ID NO: 260270 - RNA, 19 nt, Homo sapiens
ucaucuacauccucuacaa

SEQ ID NO: 260271 - RNA, 19 nt, Homo sapiens
gcaauggaccaaggcagaa

SEQ ID NO: 260272 - RNA, 19 nt, Homo sapiens
gugugaggcuguguacaaa

SEQ ID NO: 260273 - RNA, 19 nt, Homo sapiens
cgggagcaccagccauuua

SEQ ID NO: 260274 - RNA, 19 nt, Homo sapiens
caacaagagagccaaaguc

SEQ ID NO: 260275 - RNA, 19 nt, Homo sapiens
cuauaugugaccagaguua

SEQ ID NO: 260276 - RNA, 19 nt, Homo sapiens
agacacccaggacuuauuu

SEQ ID NO: 260277 - RNA, 19 nt, Homo sapiens
gaccagcucaggacagaug

SEQ ID NO: 260278 - RNA, 19 nt, Homo sapiens
caagauggcuuuccagaua

SEQ ID NO: 260279 - RNA, 19 nt, Homo sapiens
gcagcaaggucaaguauga

SEQ ID NO: 260280 - RNA, 19 nt, Homo sapiens
gagaaugccucccauguug

SEQ ID NO: 260281 - RNA, 19 nt, Homo sapiens
ccaaggccaugaacaauuu

SEQ ID NO: 260282 - RNA, 19 nt, Homo sapiens
ggaagugccuuaaccuaga

SEQ ID NO: 260283 - RNA, 19 nt, Homo sapiens
cgagaugccuccacaguga

SEQ ID NO: 260284 - RNA, 19 nt, Homo sapiens
ccagggagcugauaugcaa

SEQ ID NO: 260285 - RNA, 19 nt, Homo sapiens
gcaccuuucuggaggagua

SEQ ID NO: 260286 - RNA, 19 nt, Homo sapiens
ccacggaacuggagguaga

SEQ ID NO: 260287 - RNA, 19 nt, Homo sapiens
acagugaaguccuccauaa

SEQ ID NO: 260288 - RNA, 19 nt, Homo sapiens
gugaaguccuccauaaaga

SEQ ID NO: 260289 - RNA, 19 nt, Homo sapiens
uggcugaccucaacaguga

SEQ ID NO: 260290 - RNA, 19 nt, Homo sapiens
ccaggaaccuauaauugga

SEQ ID NO: 260291 - RNA, 19 nt, Homo sapiens
ggauguggauggaacaaca

SEQ ID NO: 260292 - RNA, 19 nt, Homo sapiens
gaugagaguggguaaauca

SEQ ID NO: 260293 - RNA, 19 nt, Homo sapiens
gaagcaaggcuguggugaa

SEQ ID NO: 260294 - RNA, 19 nt, Homo sapiens
gaggaguacucagcuguga

SEQ ID NO: 260295 - RNA, 19 nt, Homo sapiens
caaccaagauggcuuucca

SEQ ID NO: 260296 - RNA, 19 nt, Homo sapiens
ggauauggaugggaaccaa

SEQ ID NO: 260297 - RNA, 19 nt, Homo sapiens
uacuuaggcuucucuauug

SEQ ID NO: 260298 - RNA, 19 nt, Homo sapiens
cuacuuaggcuucucuauu

SEQ ID NO: 260299 - RNA, 19 nt, Homo sapiens
gggaauggaaguucuguga

SEQ ID NO: 260300 - RNA, 19 nt, Homo sapiens
agagagccaugcagucuga

SEQ ID NO: 260301 - RNA, 19 nt, Homo sapiens
gcaaggcuguggugaagac

SEQ ID NO: 260302 - RNA, 19 nt, Homo sapiens
gggaggagguugugucacu

SEQ ID NO: 260303 - RNA, 19 nt, Homo sapiens
gauguggacaguagggaua

SEQ ID NO: 260304 - RNA, 19 nt, Homo sapiens
ggcccucaauagcuacuua

SEQ ID NO: 260305 - RNA, 19 nt, Homo sapiens
ggaaagucuucaucuacca

SEQ ID NO: 260306 - RNA, 19 nt, Homo sapiens
uaugauuggucgcugcuuu

SEQ ID NO: 260307 - RNA, 19 nt, Homo sapiens
gagcccgugucuucauuga

SEQ ID NO: 260308 - RNA, 19 nt, Homo sapiens
gagcugauaugcaaaagga

SEQ ID NO: 260309 - RNA, 19 nt, Homo sapiens
gagaugagaguggguaaau

SEQ ID NO: 260310 - RNA, 19 nt, Homo sapiens
ggcccuggacuauguguua

SEQ ID NO: 260311 - RNA, 19 nt, Homo sapiens
uuagagugcugugagauga

SEQ ID NO: 260312 - RNA, 19 nt, Homo sapiens
ugaagucccuggaagugau

SEQ ID NO: 260313 - RNA, 19 nt, Homo sapiens
gagcugccacuguccauug

SEQ ID NO: 260314 - RNA, 19 nt, Homo sapiens
gaagugccuuaaccuagag

SEQ ID NO: 260315 - RNA, 19 nt, Homo sapiens
ggagguagagcugcuguug

SEQ ID NO: 260316 - RNA, 19 nt, Homo sapiens
ggugucgcaucaagauuug

SEQ ID NO: 260317 - RNA, 19 nt, Homo sapiens
ccacagugaucccagugau

SEQ ID NO: 260318 - RNA, 19 nt, Homo sapiens
caaggccagucgcucagaa

SEQ ID NO: 260319 - RNA, 19 nt, Homo sapiens
gggcagagauccacuuccu

SEQ ID NO: 260320 - RNA, 19 nt, Homo sapiens
ucaggcagcuuggauaugg

SEQ ID NO: 260321 - RNA, 19 nt, Homo sapiens
gcugcuccuucucuaguuu

SEQ ID NO: 260322 - RNA, 19 nt, Homo sapiens
gggaagaccgacagcaguu

SEQ ID NO: 260323 - RNA, 19 nt, Homo sapiens
ugacguuccugagccguaa

SEQ ID NO: 260324 - RNA, 19 nt, Homo sapiens
ccucucaucugaccuuagu

SEQ ID NO: 260325 - RNA, 19 nt, Homo sapiens
gaagaccgacagcaguuca

SEQ ID NO: 260326 - RNA, 19 nt, Homo sapiens
gccacuaccuccucuuugg

SEQ ID NO: 260327 - RNA, 19 nt, Homo sapiens
ggagacugacugcuacaga

SEQ ID NO: 260328 - RNA, 19 nt, Homo sapiens
aguaugaggucacgguuuc

SEQ ID NO: 260329 - RNA, 19 nt, Homo sapiens
ugagaaugccucccauguu

SEQ ID NO: 260330 - RNA, 19 nt, Homo sapiens
ccagacccauccuccaugu

SEQ ID NO: 260331 - RNA, 19 nt, Homo sapiens
ggagacgcgggauaugauu

SEQ ID NO: 260332 - RNA, 19 nt, Homo sapiens
gugguuucgucuauuuauu

SEQ ID NO: 260333 - RNA, 19 nt, Homo sapiens
gaacuccucccacccaacu

SEQ ID NO: 260334 - RNA, 19 nt, Homo sapiens
ggagacuuggcccucaaua

SEQ ID NO: 260335 - RNA, 19 nt, Homo sapiens
cgagauuucccuugcauuc

SEQ ID NO: 260336 - RNA, 19 nt, Homo sapiens
ggagcugcauccagucucu

SEQ ID NO: 260337 - RNA, 19 nt, Homo sapiens
ugaaguccuccauaaagaa

SEQ ID NO: 260338 - RNA, 19 nt, Homo sapiens
gggcagcaaggucaaguau

SEQ ID NO: 260339 - RNA, 19 nt, Homo sapiens
aagcaaggcuguggugaag

SEQ ID NO: 260340 - RNA, 19 nt, Homo sapiens
ucaggcugcuccuucucua

SEQ ID NO: 260341 - RNA, 19 nt, Homo sapiens
gaacuugaugcuccgagau

SEQ ID NO: 260342 - RNA, 19 nt, Homo sapiens
ggaguacucagcugugaag

SEQ ID NO: 260343 - RNA, 19 nt, Homo sapiens
ccucccauguugaguguga

SEQ ID NO: 260344 - RNA, 19 nt, Homo sapiens
aagauggcuuuccagauau

SEQ ID NO: 260345 - RNA, 19 nt, Homo sapiens
uggaggagacugacugcua

SEQ ID NO: 260346 - RNA, 19 nt, Homo sapiens
uuaguuugcugccaucagu

SEQ ID NO: 260347 - RNA, 19 nt, Homo sapiens
gggagaagggauccuaauc

SEQ ID NO: 260348 - RNA, 19 nt, Homo sapiens
gaagucccuggaagugauu

SEQ ID NO: 260349 - RNA, 19 nt, Homo sapiens
ggccaacugugugguguuc

SEQ ID NO: 260350 - RNA, 19 nt, Homo sapiens
gcauugagaccacggaacu

SEQ ID NO: 260351 - RNA, 19 nt, Homo sapiens
caucugaccuuaguuugcu

SEQ ID NO: 260352 - RNA, 19 nt, Homo sapiens
ucucaucugaccuuaguuu

SEQ ID NO: 260353 - RNA, 19 nt, Homo sapiens
gaggagguugugucacuga

SEQ ID NO: 260354 - RNA, 19 nt, Homo sapiens
gcucugccuuccucaacau

SEQ ID NO: 260355 - RNA, 19 nt, Homo sapiens
cacucugccuguccaauga

SEQ ID NO: 260356 - RNA, 19 nt, Homo sapiens
gcagcuauagcccuacugu

SEQ ID NO: 260357 - RNA, 19 nt, Homo sapiens
gaaagucuucaucuaccau

SEQ ID NO: 260358 - RNA, 19 nt, Homo sapiens
ugccaucagucuagugguu

SEQ ID NO: 260359 - RNA, 19 nt, Homo sapiens
gugcugcuccuguggaaga

SEQ ID NO: 260360 - RNA, 19 nt, Homo sapiens
gaaguccuccauaaagaac

SEQ ID NO: 260361 - RNA, 19 nt, Homo sapiens
ccacucugccuguccaaug

SEQ ID NO: 260362 - RNA, 19 nt, Homo sapiens
gagacuuggcccucaauag

SEQ ID NO: 260363 - RNA, 19 nt, Homo sapiens
ccauucacccuguguaaca

SEQ ID NO: 260364 - RNA, 19 nt, Homo sapiens
ucccagugaugguauacuu

SEQ ID NO: 260365 - RNA, 19 nt, Homo sapiens
cagugaaguccuccauaaa

SEQ ID NO: 260366 - RNA, 19 nt, Homo sapiens
ccaguguccucugcugaga

SEQ ID NO: 260367 - RNA, 19 nt, Homo sapiens
ucuagugguuucgugguuu

SEQ ID NO: 260368 - RNA, 19 nt, Homo sapiens
gcuacagaguggacaucga

SEQ ID NO: 260369 - RNA, 19 nt, Homo sapiens
gagacgcgggauaugauug

SEQ ID NO: 260370 - RNA, 19 nt, Homo sapiens
ggucagcgacacggaauuc

SEQ ID NO: 260371 - RNA, 19 nt, Homo sapiens
cccaugaggucucuauugc

SEQ ID NO: 260372 - RNA, 19 nt, Homo sapiens
agauggcuuuccagauauu

SEQ ID NO: 260373 - RNA, 19 nt, Homo sapiens
guguucagcugcccacucu

SEQ ID NO: 260374 - RNA, 19 nt, Homo sapiens
gauggcuccuugggaugaa

SEQ ID NO: 260375 - RNA, 19 nt, Homo sapiens
cgagagagccaugcagucu

SEQ ID NO: 260376 - RNA, 19 nt, Homo sapiens
agacaagcuucgggccauu

SEQ ID NO: 260377 - RNA, 19 nt, Homo sapiens
augggaaagucuucaucua

SEQ ID NO: 260378 - RNA, 19 nt, Homo sapiens
ggaagaacaucuacuauga

SEQ ID NO: 260379 - RNA, 19 nt, Homo sapiens
guucucagcuucauuguua

SEQ ID NO: 260380 - RNA, 19 nt, Homo sapiens
ggaaauggcuauccugaug

SEQ ID NO: 260381 - RNA, 19 nt, Homo sapiens
ggaaguccaugaauacaaa

SEQ ID NO: 260382 - RNA, 19 nt, Homo sapiens
gaaaauaucuuccacacaa

SEQ ID NO: 260383 - RNA, 19 nt, Homo sapiens
gcaaacacguuccagaaga

SEQ ID NO: 260384 - RNA, 19 nt, Homo sapiens
gaagaaagucguacuauag

SEQ ID NO: 260385 - RNA, 19 nt, Homo sapiens
gaaagagaaugaagacagu

SEQ ID NO: 260386 - RNA, 19 nt, Homo sapiens
gaacaucucccuaaacauc

SEQ ID NO: 260387 - RNA, 19 nt, Homo sapiens
gaacacagaaauacugaaa

SEQ ID NO: 260388 - RNA, 19 nt, Homo sapiens
gagaagaaccggaaagaga

SEQ ID NO: 260389 - RNA, 19 nt, Homo sapiens
agaagaaagucguacuaua

SEQ ID NO: 260390 - RNA, 19 nt, Homo sapiens
gcauugauauggauggaaa

SEQ ID NO: 260391 - RNA, 19 nt, Homo sapiens
gcucaucgcuggaagaaca

SEQ ID NO: 260392 - RNA, 19 nt, Homo sapiens
gugcagagauguuucaugu

SEQ ID NO: 260393 - RNA, 19 nt, Homo sapiens
gaucaggcaccuuaauuaa

SEQ ID NO: 260394 - RNA, 19 nt, Homo sapiens
caucaucccucaagaacaa

SEQ ID NO: 260395 - RNA, 19 nt, Homo sapiens
ggggaaaacuguuaaagua

SEQ ID NO: 260396 - RNA, 19 nt, Homo sapiens
ggacacugaucccuugcua

SEQ ID NO: 260397 - RNA, 19 nt, Homo sapiens
ggacgcagccaacuucauu

SEQ ID NO: 260398 - RNA, 19 nt, Homo sapiens
ugaagaacaucucccuaaa

SEQ ID NO: 260399 - RNA, 19 nt, Homo sapiens
caaaggcagauuccaaaua

SEQ ID NO: 260400 - RNA, 19 nt, Homo sapiens
gagauuggccugaauuaug

SEQ ID NO: 260401 - RNA, 19 nt, Homo sapiens
ugacagagccgagcaauau

SEQ ID NO: 260402 - RNA, 19 nt, Homo sapiens
ggacaacaccuauuuaaaa

SEQ ID NO: 260403 - RNA, 19 nt, Homo sapiens
ggucaaagucaaaguauga

SEQ ID NO: 260404 - RNA, 19 nt, Homo sapiens
gaagagauuggccugaauu

SEQ ID NO: 260405 - RNA, 19 nt, Homo sapiens
gaaucggacuuccucaaau

SEQ ID NO: 260406 - RNA, 19 nt, Homo sapiens
gacaaaagauugcccaaaa

SEQ ID NO: 260407 - RNA, 19 nt, Homo sapiens
gaagaaguacggagaggaa

SEQ ID NO: 260408 - RNA, 19 nt, Homo sapiens
ccacuucgcuuuaaagacu

SEQ ID NO: 260409 - RNA, 19 nt, Homo sapiens
gaucaucgccaucaguuug

SEQ ID NO: 260410 - RNA, 19 nt, Homo sapiens
ccaggaauuucuugccuaa

SEQ ID NO: 260411 - RNA, 19 nt, Homo sapiens
gaagaacaucuacuaugaa

SEQ ID NO: 260412 - RNA, 19 nt, Homo sapiens
gcuguucucuucuucauuc

SEQ ID NO: 260413 - RNA, 19 nt, Homo sapiens
caacguguccuucaauguu

SEQ ID NO: 260414 - RNA, 19 nt, Homo sapiens
cagcaucucuuucccuaau

SEQ ID NO: 260415 - RNA, 19 nt, Homo sapiens
gaauucagcgugaucuuug

SEQ ID NO: 260416 - RNA, 19 nt, Homo sapiens
gauagucccucaguacuca

SEQ ID NO: 260417 - RNA, 19 nt, Homo sapiens
gggaagaccgcgaugauga

SEQ ID NO: 260418 - RNA, 19 nt, Homo sapiens
ucacaugaccugaucacua

SEQ ID NO: 260419 - RNA, 19 nt, Homo sapiens
gaaauuaucgaagcugaga

SEQ ID NO: 260420 - RNA, 19 nt, Homo sapiens
aagaacaucucccuaaaca

SEQ ID NO: 260421 - RNA, 19 nt, Homo sapiens
gaaaggaauugccguucag

SEQ ID NO: 260422 - RNA, 19 nt, Homo sapiens
gagcaaggccugucauuac

SEQ ID NO: 260423 - RNA, 19 nt, Homo sapiens
uggacgaucuggacaauga

SEQ ID NO: 260424 - RNA, 19 nt, Homo sapiens
uaagaucuuucaagcauca

SEQ ID NO: 260425 - RNA, 19 nt, Homo sapiens
cagcaccacuucgcuuuaa

SEQ ID NO: 260426 - RNA, 19 nt, Homo sapiens
cacaugaccugaucacuag

SEQ ID NO: 260427 - RNA, 19 nt, Homo sapiens
gugaagaacaucucccuaa

SEQ ID NO: 260428 - RNA, 19 nt, Homo sapiens
aaaggcagauuccaaauac

SEQ ID NO: 260429 - RNA, 19 nt, Homo sapiens
ccgaagaucaggcaccuua

SEQ ID NO: 260430 - RNA, 19 nt, Homo sapiens
aaauacagcccuucaguga

SEQ ID NO: 260431 - RNA, 19 nt, Homo sapiens
ucacuagccugucauccuu

SEQ ID NO: 260432 - RNA, 19 nt, Homo sapiens
cagaagagauuggccugaa

SEQ ID NO: 260433 - RNA, 19 nt, Homo sapiens
ccucggagaugaugccuau

SEQ ID NO: 260434 - RNA, 19 nt, Homo sapiens
ucacagcgccucaguguca

SEQ ID NO: 260435 - RNA, 19 nt, Homo sapiens
ucaaagugcugaaccuuac

SEQ ID NO: 260436 - RNA, 19 nt, Homo sapiens
gcuaugaagaguauaagaa

SEQ ID NO: 260437 - RNA, 19 nt, Homo sapiens
gauguuuggucaguccaua

SEQ ID NO: 260438 - RNA, 19 nt, Homo sapiens
gaagaucaggcaccuuaau

SEQ ID NO: 260439 - RNA, 19 nt, Homo sapiens
gaaagucguacuauagaca

SEQ ID NO: 260440 - RNA, 19 nt, Homo sapiens
gcuggaagaacaucuacua

SEQ ID NO: 260441 - RNA, 19 nt, Homo sapiens
gcagcaccacuucgcuuua

SEQ ID NO: 260442 - RNA, 19 nt, Homo sapiens
ucuccaaccuccuuuguau

SEQ ID NO: 260443 - RNA, 19 nt, Homo sapiens
ucacaaagucuggaagaaa

SEQ ID NO: 260444 - RNA, 19 nt, Homo sapiens
ccugugagcugcuggaauc

SEQ ID NO: 260445 - RNA, 19 nt, Homo sapiens
gucguacuauagacauuua

SEQ ID NO: 260446 - RNA, 19 nt, Homo sapiens
gaacgacgaagugaucaug

SEQ ID NO: 260447 - RNA, 19 nt, Homo sapiens
acgcaguucuggagcauuu

SEQ ID NO: 260448 - RNA, 19 nt, Homo sapiens
caaagaaauuaucgaagcu

SEQ ID NO: 260449 - RNA, 19 nt, Homo sapiens
gauguuucauguccaggaa

SEQ ID NO: 260450 - RNA, 19 nt, Homo sapiens
caaccuccuuuguauaugg

SEQ ID NO: 260451 - RNA, 19 nt, Homo sapiens
ggaaucaugucuccaaccu

SEQ ID NO: 260452 - RNA, 19 nt, Homo sapiens
gagcucuucuucaucaaca

SEQ ID NO: 260453 - RNA, 19 nt, Homo sapiens
cgggagcucuucuucauca

SEQ ID NO: 260454 - RNA, 19 nt, Homo sapiens
agauuggccugaauuaugu

SEQ ID NO: 260455 - RNA, 19 nt, Homo sapiens
uuacggacaacaccuauuu

SEQ ID NO: 260456 - RNA, 19 nt, Homo sapiens
gccaaaggcaggacacuga

SEQ ID NO: 260457 - RNA, 19 nt, Homo sapiens
cagagccgagcaauauuua

SEQ ID NO: 260458 - RNA, 19 nt, Homo sapiens
cgccgaagguacaaagaaa

SEQ ID NO: 260459 - RNA, 19 nt, Homo sapiens
caaacacguuccagaagag

SEQ ID NO: 260460 - RNA, 19 nt, Homo sapiens
cagcgugguucuucucaga

SEQ ID NO: 260461 - RNA, 19 nt, Homo sapiens
guucucuucuucauucuau

SEQ ID NO: 260462 - RNA, 19 nt, Homo sapiens
aaucggacuuccucaaaug

SEQ ID NO: 260463 - RNA, 19 nt, Homo sapiens
gaagaacaucucccuaaac

SEQ ID NO: 260464 - RNA, 19 nt, Homo sapiens
agaucaggcaccuuaauua

SEQ ID NO: 260465 - RNA, 19 nt, Homo sapiens
cgaagguacaaagaaauua

SEQ ID NO: 260466 - RNA, 19 nt, Homo sapiens
guucgucugucauccaguu

SEQ ID NO: 260467 - RNA, 19 nt, Homo sapiens
aaagaagaaagucguacua

SEQ ID NO: 260468 - RNA, 19 nt, Homo sapiens
gaaauggcuauccugaugu

SEQ ID NO: 260469 - RNA, 19 nt, Homo sapiens
gaagaaccggaaagagaau

SEQ ID NO: 260470 - RNA, 19 nt, Homo sapiens
aagaacaucuacuaugaag

SEQ ID NO: 260471 - RNA, 19 nt, Homo sapiens
agaagaaccggaaagagaa

SEQ ID NO: 260472 - RNA, 19 nt, Homo sapiens
uaucgaagcugagaagaac

SEQ ID NO: 260473 - RNA, 19 nt, Homo sapiens
gcuaaagaagaaagucgua

SEQ ID NO: 260474 - RNA, 19 nt, Homo sapiens
gagaaaacccuguaucuag

SEQ ID NO: 260475 - RNA, 19 nt, Homo sapiens
cugaaucccugcaugacaa

SEQ ID NO: 260476 - RNA, 19 nt, Homo sapiens
gcucugaaucccugcauga

SEQ ID NO: 260477 - RNA, 19 nt, Homo sapiens
gcacugauucuggccuaaa

SEQ ID NO: 260478 - RNA, 19 nt, Homo sapiens
gagaaggccugcaagaaua

SEQ ID NO: 260479 - RNA, 19 nt, Homo sapiens
gcagauccuuggugaaaua

SEQ ID NO: 260480 - RNA, 19 nt, Homo sapiens
gaauaccaguugcaaauuu

SEQ ID NO: 260481 - RNA, 19 nt, Homo sapiens
gagcugacccugaacauua

SEQ ID NO: 260482 - RNA, 19 nt, Homo sapiens
caacaaaucucuauaugag

SEQ ID NO: 260483 - RNA, 19 nt, Homo sapiens
caaaggagcugacccugaa

SEQ ID NO: 260484 - RNA, 19 nt, Homo sapiens
gcugguggcuuugauauua

SEQ ID NO: 260485 - RNA, 19 nt, Homo sapiens
gagaaugccuuuccaaaca

SEQ ID NO: 260486 - RNA, 19 nt, Homo sapiens
ccagaaaccugcaguugaa

SEQ ID NO: 260487 - RNA, 19 nt, Homo sapiens
gcauggagcuguugguaga

SEQ ID NO: 260488 - RNA, 19 nt, Homo sapiens
gcagagaaccacagaacua

SEQ ID NO: 260489 - RNA, 19 nt, Homo sapiens
gaaaucagcucuguaacca

SEQ ID NO: 260490 - RNA, 19 nt, Homo sapiens
ggagacggcugcaguguuc

SEQ ID NO: 260491 - RNA, 19 nt, Homo sapiens
gcugguggcugcuccauuu

SEQ ID NO: 260492 - RNA, 19 nt, Homo sapiens
ugucaucgcuucagauaaa

SEQ ID NO: 260493 - RNA, 19 nt, Homo sapiens
gaagauuccuacaugacaa

SEQ ID NO: 260494 - RNA, 19 nt, Homo sapiens
gaggucaucugcucauguu

SEQ ID NO: 260495 - RNA, 19 nt, Homo sapiens
gaggagugauccagacuga

SEQ ID NO: 260496 - RNA, 19 nt, Homo sapiens
ccaaagacuucaucuccaa

SEQ ID NO: 260497 - RNA, 19 nt, Homo sapiens
caaagaaggcgguggagaa

SEQ ID NO: 260498 - RNA, 19 nt, Homo sapiens
gaaccucuuuggagcagaa

SEQ ID NO: 260499 - RNA, 19 nt, Homo sapiens
guccauggcugguggcuuu

SEQ ID NO: 260500 - RNA, 19 nt, Homo sapiens
gcaccgagauugccaucau

SEQ ID NO: 260501 - RNA, 19 nt, Homo sapiens
gaggacugcuucuccaaug

SEQ ID NO: 260502 - RNA, 19 nt, Homo sapiens
gaauuccucuuccauguac

SEQ ID NO: 260503 - RNA, 19 nt, Homo sapiens
cgucgugaauguccguuua

SEQ ID NO: 260504 - RNA, 19 nt, Homo sapiens
aggauaagcucacagaugu

SEQ ID NO: 260505 - RNA, 19 nt, Homo sapiens
gaucaugaacugcaggauu

SEQ ID NO: 260506 - RNA, 19 nt, Homo sapiens
gagaaccacagaacuaaga

SEQ ID NO: 260507 - RNA, 19 nt, Homo sapiens
aaacugcgguacaacauca

SEQ ID NO: 260508 - RNA, 19 nt, Homo sapiens
guugagcgcuuugccauug

SEQ ID NO: 260509 - RNA, 19 nt, Homo sapiens
ccacguucauggagaagaa

SEQ ID NO: 260510 - RNA, 19 nt, Homo sapiens
augaggaacuucuaugaaa

SEQ ID NO: 260511 - RNA, 19 nt, Homo sapiens
ucagagagccaaagacuuc

SEQ ID NO: 260512 - RNA, 19 nt, Homo sapiens
cagaauaccaguugcaaau

SEQ ID NO: 260513 - RNA, 19 nt, Homo sapiens
agaauaagcuguuuugugu

SEQ ID NO: 260514 - RNA, 19 nt, Homo sapiens
cgagggaacugaaccugau

SEQ ID NO: 260515 - RNA, 19 nt, Homo sapiens
gacagcaucuucaccucaa

SEQ ID NO: 260516 - RNA, 19 nt, Homo sapiens
aaccauacauugucccaaa

SEQ ID NO: 260517 - RNA, 19 nt, Homo sapiens
gauccuuggugaaauaucu

SEQ ID NO: 260518 - RNA, 19 nt, Homo sapiens
uaacugaacugcagauccu

SEQ ID NO: 260519 - RNA, 19 nt, Homo sapiens
gcucauguuucagucguuu

SEQ ID NO: 260520 - RNA, 19 nt, Homo sapiens
ggagaaaggcauccaaggu

SEQ ID NO: 260521 - RNA, 19 nt, Homo sapiens
gaugaggaacuucuaugaa

SEQ ID NO: 260522 - RNA, 19 nt, Homo sapiens
ggaaggcccagcugaaauc

SEQ ID NO: 260523 - RNA, 19 nt, Homo sapiens
gugaauguccguuuauguu

SEQ ID NO: 260524 - RNA, 19 nt, Homo sapiens
gcaguucuguccaaaccau

SEQ ID NO: 260525 - RNA, 19 nt, Homo sapiens
cuccaaacauucaguguga

SEQ ID NO: 260526 - RNA, 19 nt, Homo sapiens
ugagaaggccugcaagaau

SEQ ID NO: 260527 - RNA, 19 nt, Homo sapiens
gaauguccguuuauguuuu

SEQ ID NO: 260528 - RNA, 19 nt, Homo sapiens
ggacagccaggaugugaug

SEQ ID NO: 260529 - RNA, 19 nt, Homo sapiens
agaaucugcucgaagaaga

SEQ ID NO: 260530 - RNA, 19 nt, Homo sapiens
ccacagaacuaagaucacu

SEQ ID NO: 260531 - RNA, 19 nt, Homo sapiens
gcagaauaccaguugcaaa

SEQ ID NO: 260532 - RNA, 19 nt, Homo sapiens
cccagcauccuuugcauua

SEQ ID NO: 260533 - RNA, 19 nt, Homo sapiens
guucaccaaugcccgcuuu

SEQ ID NO: 260534 - RNA, 19 nt, Homo sapiens
uguuugagcuccagaagga

SEQ ID NO: 260535 - RNA, 19 nt, Homo sapiens
ggagaaugccuuuccaaac

SEQ ID NO: 260536 - RNA, 19 nt, Homo sapiens
gcugcaguguucagacgua

SEQ ID NO: 260537 - RNA, 19 nt, Homo sapiens
ugaauguccguuuauguuu

SEQ ID NO: 260538 - RNA, 19 nt, Homo sapiens
cagagaaccacagaacuaa

SEQ ID NO: 260539 - RNA, 19 nt, Homo sapiens
ccaaaccauccauaaugua

SEQ ID NO: 260540 - RNA, 19 nt, Homo sapiens
guccaaaccauccauaaug

SEQ ID NO: 260541 - RNA, 19 nt, Homo sapiens
gcuggccgcuuucaaugug

SEQ ID NO: 260542 - RNA, 19 nt, Homo sapiens
gcugugcccuguggacauu

SEQ ID NO: 260543 - RNA, 19 nt, Homo sapiens
cggaugagacccaugcuuu

SEQ ID NO: 260544 - RNA, 19 nt, Homo sapiens
ggagugauccagacugagu

SEQ ID NO: 260545 - RNA, 19 nt, Homo sapiens
acaguucgguucagcaugu

SEQ ID NO: 260546 - RNA, 19 nt, Homo sapiens
gaacauuaaccuaacuaac

SEQ ID NO: 260547 - RNA, 19 nt, Homo sapiens
gcaguguucagacguaaga

SEQ ID NO: 260548 - RNA, 19 nt, Homo sapiens
gagacgcccuucacuacca

SEQ ID NO: 260549 - RNA, 19 nt, Homo sapiens
ggacugcgagggaacugaa

SEQ ID NO: 260550 - RNA, 19 nt, Homo sapiens
caccguggcugcagagauc

SEQ ID NO: 260551 - RNA, 19 nt, Homo sapiens
gggagaagaauuuaagagu

SEQ ID NO: 260552 - RNA, 19 nt, Homo sapiens
gaagcuggcaccgagauug

SEQ ID NO: 260553 - RNA, 19 nt, Homo sapiens
caacuucuucgaccuugaa

SEQ ID NO: 260554 - RNA, 19 nt, Homo sapiens
ucaacggcgucgugaaugu

SEQ ID NO: 260555 - RNA, 19 nt, Homo sapiens
gguacaacaucaucagcau

SEQ ID NO: 260556 - RNA, 19 nt, Homo sapiens
gcaaacugcgguacaacau

SEQ ID NO: 260557 - RNA, 19 nt, Homo sapiens
aauaccaguugcaaauuug

SEQ ID NO: 260558 - RNA, 19 nt, Homo sapiens
uccaaaccauccauaaugu

SEQ ID NO: 260559 - RNA, 19 nt, Homo sapiens
gguggugggucucacaaag

SEQ ID NO: 260560 - RNA, 19 nt, Homo sapiens
gcggaucccagcuuuguga

SEQ ID NO: 260561 - RNA, 19 nt, Homo sapiens
caacaucaucagcauggaa

SEQ ID NO: 260562 - RNA, 19 nt, Homo sapiens
ugagcaaacugcgguacaa

SEQ ID NO: 260563 - RNA, 19 nt, Homo sapiens
caaggugaccaacuacaug

SEQ ID NO: 260564 - RNA, 19 nt, Homo sapiens
gcaggguguugagcgcuuu

SEQ ID NO: 260565 - RNA, 19 nt, Homo sapiens
caggauaagcucacagaug

SEQ ID NO: 260566 - RNA, 19 nt, Homo sapiens
cgagcaggaugguucuuuc

SEQ ID NO: 260567 - RNA, 19 nt, Homo sapiens
gaugagacccaugcuuuca

SEQ ID NO: 260568 - RNA, 19 nt, Homo sapiens
ccugaaagaugagaaguac

SEQ ID NO: 260569 - RNA, 19 nt, Homo sapiens
gacccacacccuucaauuc

SEQ ID NO: 260570 - RNA, 19 nt, Homo sapiens
ccgcuacacugagcccuuu

SEQ ID NO: 260571 - RNA, 19 nt, Homo sapiens
uuugaaaucagcucuguaa

SEQ ID NO: 260572 - RNA, 19 nt, Homo sapiens
gaauuuaagagugcuagga

SEQ ID NO: 260573 - RNA, 19 nt, Homo sapiens
ugucaccaauuccaaugaa

SEQ ID NO: 260574 - RNA, 19 nt, Homo sapiens
aaacaggacagcagacauc

SEQ ID NO: 260575 - RNA, 19 nt, Homo sapiens
ggucaucugcucauguuuc

SEQ ID NO: 260576 - RNA, 19 nt, Homo sapiens
aucaugaacugcaggauug

SEQ ID NO: 260577 - RNA, 19 nt, Homo sapiens
gcaagaauaagcuguuuug

SEQ ID NO: 260578 - RNA, 19 nt, Homo sapiens
gagaaugucugaucuaaau

SEQ ID NO: 260579 - RNA, 19 nt, Homo sapiens
ucacugagcugcagaagaa

SEQ ID NO: 260580 - RNA, 19 nt, Homo sapiens
ggacccagauuggcucuua

SEQ ID NO: 260581 - RNA, 19 nt, Homo sapiens
gcacugacuucucauuuca

SEQ ID NO: 260582 - RNA, 19 nt, Homo sapiens
ugaaggaugugaugaagaa

SEQ ID NO: 260583 - RNA, 19 nt, Homo sapiens
caacguagaccugguauuu

SEQ ID NO: 260584 - RNA, 19 nt, Homo sapiens
guacaagguugguuucuuc

SEQ ID NO: 260585 - RNA, 19 nt, Homo sapiens
gaaagaaggaguuaauauc

SEQ ID NO: 260586 - RNA, 19 nt, Homo sapiens
gaacucagaaggaauauag

SEQ ID NO: 260587 - RNA, 19 nt, Homo sapiens
gcagcuaucucucagugaa

SEQ ID NO: 260588 - RNA, 19 nt, Homo sapiens
gaagaucuaugucauugag

SEQ ID NO: 260589 - RNA, 19 nt, Homo sapiens
gagccaagauugcgccauu

SEQ ID NO: 260590 - RNA, 19 nt, Homo sapiens
caagguugguuucuucaaa

SEQ ID NO: 260591 - RNA, 19 nt, Homo sapiens
gaagaagaucuaugucauu

SEQ ID NO: 260592 - RNA, 19 nt, Homo sapiens
caacaucgaugcggccaaa

SEQ ID NO: 260593 - RNA, 19 nt, Homo sapiens
caagaagacuccacacucu

SEQ ID NO: 260594 - RNA, 19 nt, Homo sapiens
gaagagaaugucugaucua

SEQ ID NO: 260595 - RNA, 19 nt, Homo sapiens
ggaagagaaugucugaucu

SEQ ID NO: 260596 - RNA, 19 nt, Homo sapiens
gacaugaacucagaaggaa

SEQ ID NO: 260597 - RNA, 19 nt, Homo sapiens
guaggugcuugacauaauu

SEQ ID NO: 260598 - RNA, 19 nt, Homo sapiens
caaagcacacgucauguuu

SEQ ID NO: 260599 - RNA, 19 nt, Homo sapiens
gaggcaaacuugagagugu

SEQ ID NO: 260600 - RNA, 19 nt, Homo sapiens
caacggcgaugggcuggua

SEQ ID NO: 260601 - RNA, 19 nt, Homo sapiens
agacagagcugcugcugau

SEQ ID NO: 260602 - RNA, 19 nt, Homo sapiens
gguaaaggcuauacuuguc

SEQ ID NO: 260603 - RNA, 19 nt, Homo sapiens
ccaaagugcuuaucaucau

SEQ ID NO: 260604 - RNA, 19 nt, Homo sapiens
ccugagagguuccaacuau

SEQ ID NO: 260605 - RNA, 19 nt, Homo sapiens
gcagaggugucccgaaugg

SEQ ID NO: 260606 - RNA, 19 nt, Homo sapiens
gcaagcauuuccaccucua

SEQ ID NO: 260607 - RNA, 19 nt, Homo sapiens
gaggacaacucagccacua

SEQ ID NO: 260608 - RNA, 19 nt, Homo sapiens
caagugcucucaggaauuc

SEQ ID NO: 260609 - RNA, 19 nt, Homo sapiens
ggaaugaccuuggcaacag

SEQ ID NO: 260610 - RNA, 19 nt, Homo sapiens
gaucccagcucacgucaca

SEQ ID NO: 260611 - RNA, 19 nt, Homo sapiens
ccaacuauaccuccaagua

SEQ ID NO: 260612 - RNA, 19 nt, Homo sapiens
gagcugagccugaguaacu

SEQ ID NO: 260613 - RNA, 19 nt, Homo sapiens
gaugaaagaaggaguuaau

SEQ ID NO: 260614 - RNA, 19 nt, Homo sapiens
aagaagaucuaugucauug

SEQ ID NO: 260615 - RNA, 19 nt, Homo sapiens
gaccugguauuucuguuug

SEQ ID NO: 260616 - RNA, 19 nt, Homo sapiens
gcacaggaagccucuauca

SEQ ID NO: 260617 - RNA, 19 nt, Homo sapiens
ccucacaucuuucacacuu

SEQ ID NO: 260618 - RNA, 19 nt, Homo sapiens
gaaugaccuuggcaacaga

SEQ ID NO: 260619 - RNA, 19 nt, Homo sapiens
gcacacgucauguuucuuc

SEQ ID NO: 260620 - RNA, 19 nt, Homo sapiens
gcacuacucccucaaagca

SEQ ID NO: 260621 - RNA, 19 nt, Homo sapiens
aagagaaugucugaucuaa

SEQ ID NO: 260622 - RNA, 19 nt, Homo sapiens
aaugugaccuguaacaaug

SEQ ID NO: 260623 - RNA, 19 nt, Homo sapiens
caugaacucagaaggaaua

SEQ ID NO: 260624 - RNA, 19 nt, Homo sapiens
ggagccagguccagacaau

SEQ ID NO: 260625 - RNA, 19 nt, Homo sapiens
ggaccugacuuccuucaac

SEQ ID NO: 260626 - RNA, 19 nt, Homo sapiens
aagcaaaugugaccugugu

SEQ ID NO: 260627 - RNA, 19 nt, Homo sapiens
caagagggcugcaaaagug

SEQ ID NO: 260628 - RNA, 19 nt, Homo sapiens
gauguuuaauacacuggua

SEQ ID NO: 260629 - RNA, 19 nt, Homo sapiens
ucacugaauuaaugacaga

SEQ ID NO: 260630 - RNA, 19 nt, Homo sapiens
cagauuggcucuuauuucg

SEQ ID NO: 260631 - RNA, 19 nt, Homo sapiens
gagcaggcuauuuggguua

SEQ ID NO: 260632 - RNA, 19 nt, Homo sapiens
caacacuucguaccaguuu

SEQ ID NO: 260633 - RNA, 19 nt, Homo sapiens
gaaccacgucugcuaacuu

SEQ ID NO: 260634 - RNA, 19 nt, Homo sapiens
cugcagaugauguuuaaua

SEQ ID NO: 260635 - RNA, 19 nt, Homo sapiens
ugaguaacuuggaagaaga

SEQ ID NO: 260636 - RNA, 19 nt, Homo sapiens
gaguuaauaucacaaucug

SEQ ID NO: 260637 - RNA, 19 nt, Homo sapiens
gaagugagagcaggcuauu

SEQ ID NO: 260638 - RNA, 19 nt, Homo sapiens
caggaugacacauuuauug

SEQ ID NO: 260639 - RNA, 19 nt, Homo sapiens
agaagaagaucuaugucau

SEQ ID NO: 260640 - RNA, 19 nt, Homo sapiens
cacagugccugcauguauu

SEQ ID NO: 260641 - RNA, 19 nt, Homo sapiens
gaaaccccaucucuacuaa

SEQ ID NO: 260642 - RNA, 19 nt, Homo sapiens
guuggguccucacaucuuu

SEQ ID NO: 260643 - RNA, 19 nt, Homo sapiens
gggcgugggacaucuagua

SEQ ID NO: 260644 - RNA, 19 nt, Homo sapiens
ccucaaagcacacgucaug

SEQ ID NO: 260645 - RNA, 19 nt, Homo sapiens
gaaugucugaucuaaaugu

SEQ ID NO: 260646 - RNA, 19 nt, Homo sapiens
gcucugcagaugauguuua

SEQ ID NO: 260647 - RNA, 19 nt, Homo sapiens
gaagcugaaagaucuauuc

SEQ ID NO: 260648 - RNA, 19 nt, Homo sapiens
cgugaugccucccuguuga

SEQ ID NO: 260649 - RNA, 19 nt, Homo sapiens
gcccugggauguccacaga

SEQ ID NO: 260650 - RNA, 19 nt, Homo sapiens
aaagugagggcuugucauu

SEQ ID NO: 260651 - RNA, 19 nt, Homo sapiens
gaauggaaucccugcagaa

SEQ ID NO: 260652 - RNA, 19 nt, Homo sapiens
caucaauguuucccugaau

SEQ ID NO: 260653 - RNA, 19 nt, Homo sapiens
agaaggaguuaauaucaca

SEQ ID NO: 260654 - RNA, 19 nt, Homo sapiens
gaccugacuuccuucaaca

SEQ ID NO: 260655 - RNA, 19 nt, Homo sapiens
uugagaagcugaaagaucu

SEQ ID NO: 260656 - RNA, 19 nt, Homo sapiens
caaagugcuuaucaucauc

SEQ ID NO: 260657 - RNA, 19 nt, Homo sapiens
cgaggccucuuccauguuc

SEQ ID NO: 260658 - RNA, 19 nt, Homo sapiens
ggaugcagcugagccuugu

SEQ ID NO: 260659 - RNA, 19 nt, Homo sapiens
cauccacgaccacaacaua

SEQ ID NO: 260660 - RNA, 19 nt, Homo sapiens
aaugugagcucucccaucu

SEQ ID NO: 260661 - RNA, 19 nt, Homo sapiens
ccaguaacaagaugaaaga

SEQ ID NO: 260662 - RNA, 19 nt, Homo sapiens
uaaaggcuauacuugucuu

SEQ ID NO: 260663 - RNA, 19 nt, Homo sapiens
ucaaagcacacgucauguu

SEQ ID NO: 260664 - RNA, 19 nt, Homo sapiens
uggcagaggugucccgaau

SEQ ID NO: 260665 - RNA, 19 nt, Homo sapiens
gagccugaguaacuuggaa

SEQ ID NO: 260666 - RNA, 19 nt, Homo sapiens
ggagaucccuuuugagaag

SEQ ID NO: 260667 - RNA, 19 nt, Homo sapiens
caagaugaaagaaggaguu

SEQ ID NO: 260668 - RNA, 19 nt, Homo sapiens
ucucaggaauucagugguu

SEQ ID NO: 260669 - RNA, 19 nt, Homo sapiens
gaagacaguugggguuuga

SEQ ID NO: 260670 - RNA, 19 nt, Homo sapiens
guguuuaucuaccagagaa

SEQ ID NO: 260671 - RNA, 19 nt, Homo sapiens
gcaggaugacacauuuauu

SEQ ID NO: 260672 - RNA, 19 nt, Homo sapiens
ccugcaggaugacacauuu

SEQ ID NO: 260673 - RNA, 19 nt, Homo sapiens
gacaucauccgcuacauca

SEQ ID NO: 260674 - RNA, 19 nt, Homo sapiens
gcugcugucuggguucuuu

SEQ ID NO: 260675 - RNA, 19 nt, Homo sapiens
gaaagacugagcucaaggu

SEQ ID NO: 260676 - RNA, 19 nt, Homo sapiens
cagaaagacugagcucaag

SEQ ID NO: 260677 - RNA, 19 nt, Homo sapiens
uuaauacacugguaaacag

SEQ ID NO: 260678 - RNA, 19 nt, Homo sapiens
gaaauaugcugucuacaug

SEQ ID NO: 260679 - RNA, 19 nt, Homo sapiens
gcaaugaccuuccaagaga

SEQ ID NO: 260680 - RNA, 19 nt, Homo sapiens
gaacaacccuaacccaaga

SEQ ID NO: 260681 - RNA, 19 nt, Homo sapiens
caauaaagaugcccacuga

SEQ ID NO: 260682 - RNA, 19 nt, Homo sapiens
cagcugagaucuuguuuaa

SEQ ID NO: 260683 - RNA, 19 nt, Homo sapiens
gcaguacucugaagaauuc

SEQ ID NO: 260684 - RNA, 19 nt, Homo sapiens
agacaucgguucauauuaa

SEQ ID NO: 260685 - RNA, 19 nt, Homo sapiens
gaaacaaacugcuccucaa

SEQ ID NO: 260686 - RNA, 19 nt, Homo sapiens
gagcacagcugagaucuug

SEQ ID NO: 260687 - RNA, 19 nt, Homo sapiens
gguggagucuuucuauaua

SEQ ID NO: 260688 - RNA, 19 nt, Homo sapiens
gaaccagacugucauaugg

SEQ ID NO: 260689 - RNA, 19 nt, Homo sapiens
ggacagauccagaguguug

SEQ ID NO: 260690 - RNA, 19 nt, Homo sapiens
ggaauguauuugaguguaa

SEQ ID NO: 260691 - RNA, 19 nt, Homo sapiens
cagcaucucuccacugaaa

SEQ ID NO: 260692 - RNA, 19 nt, Homo sapiens
gacauugccuucuugauug

SEQ ID NO: 260693 - RNA, 19 nt, Homo sapiens
guaagccgcugcuggguuu

SEQ ID NO: 260694 - RNA, 19 nt, Homo sapiens
caacugugauggagcaauu

SEQ ID NO: 260695 - RNA, 19 nt, Homo sapiens
caacggagcccgaaagaau

SEQ ID NO: 260696 - RNA, 19 nt, Homo sapiens
gaacgccauugucugcuuu

SEQ ID NO: 260697 - RNA, 19 nt, Homo sapiens
gccaagagcuuaauaccau

SEQ ID NO: 260698 - RNA, 19 nt, Homo sapiens
uuacacaaaugguagcaua

SEQ ID NO: 260699 - RNA, 19 nt, Homo sapiens
gcauucaaguguacaguga

SEQ ID NO: 260700 - RNA, 19 nt, Homo sapiens
acaaggacaugaugaguga

SEQ ID NO: 260701 - RNA, 19 nt, Homo sapiens
cacaauggauggacuggua

SEQ ID NO: 260702 - RNA, 19 nt, Homo sapiens
caaaugguagcauacuuua

SEQ ID NO: 260703 - RNA, 19 nt, Homo sapiens
gaagcuuccuuucuggauu

SEQ ID NO: 260704 - RNA, 19 nt, Homo sapiens
gaagagagagggaaacaca

SEQ ID NO: 260705 - RNA, 19 nt, Homo sapiens
uauugcaucugcugaguua

SEQ ID NO: 260706 - RNA, 19 nt, Homo sapiens
gcgcugccaucaccucuaa

SEQ ID NO: 260707 - RNA, 19 nt, Homo sapiens
ucaagaggauagugacauu

SEQ ID NO: 260708 - RNA, 19 nt, Homo sapiens
guuaacagccuugaccuua

SEQ ID NO: 260709 - RNA, 19 nt, Homo sapiens
gcugagaucuuguuuaacg

SEQ ID NO: 260710 - RNA, 19 nt, Homo sapiens
uaacagccuugaccuuaug

SEQ ID NO: 260711 - RNA, 19 nt, Homo sapiens
ugacauugccuucuugauu

SEQ ID NO: 260712 - RNA, 19 nt, Homo sapiens
gcagugagaacacguaugu

SEQ ID NO: 260713 - RNA, 19 nt, Homo sapiens
gguagcauacuuuauauug

SEQ ID NO: 260714 - RNA, 19 nt, Homo sapiens
caggaagaauucaaugcua

SEQ ID NO: 260715 - RNA, 19 nt, Homo sapiens
ggugaaauaugcugucuac

SEQ ID NO: 260716 - RNA, 19 nt, Homo sapiens
caugaaugaugcuuacuug

SEQ ID NO: 260717 - RNA, 19 nt, Homo sapiens
ucucagacaucgguucaua

SEQ ID NO: 260718 - RNA, 19 nt, Homo sapiens
cagaguggauucagacaug

SEQ ID NO: 260719 - RNA, 19 nt, Homo sapiens
gagguuuccuucagacaga

SEQ ID NO: 260720 - RNA, 19 nt, Homo sapiens
gagaacaacaugcccagaa

SEQ ID NO: 260721 - RNA, 19 nt, Homo sapiens
ccagggaaguggcaaggaa

SEQ ID NO: 260722 - RNA, 19 nt, Homo sapiens
caaaggcaaccucucguuu

SEQ ID NO: 260723 - RNA, 19 nt, Homo sapiens
cuaaauaucucaacuucac

SEQ ID NO: 260724 - RNA, 19 nt, Homo sapiens
ucaaggcaaucauggaguu

SEQ ID NO: 260725 - RNA, 19 nt, Homo sapiens
gccaggaccucacaaugga

SEQ ID NO: 260726 - RNA, 19 nt, Homo sapiens
cacaaggcauucaagugua

SEQ ID NO: 260727 - RNA, 19 nt, Homo sapiens
ggaacgccauugucugcuu

SEQ ID NO: 260728 - RNA, 19 nt, Homo sapiens
uaaagguagucaagauugu

SEQ ID NO: 260729 - RNA, 19 nt, Homo sapiens
ucaugaagcuuccuuucug

SEQ ID NO: 260730 - RNA, 19 nt, Homo sapiens
cagcgcugaugcccaauaa

SEQ ID NO: 260731 - RNA, 19 nt, Homo sapiens
gcacagcugagaucuuguu

SEQ ID NO: 260732 - RNA, 19 nt, Homo sapiens
guaaugaucagguggugaa

SEQ ID NO: 260733 - RNA, 19 nt, Homo sapiens
gcacacaccacacacauac

SEQ ID NO: 260734 - RNA, 19 nt, Homo sapiens
ucacaaggcauucaagugu

SEQ ID NO: 260735 - RNA, 19 nt, Homo sapiens
gaaguggcaaggaauguau

SEQ ID NO: 260736 - RNA, 19 nt, Homo sapiens
ggaaguggcaaggaaugua

SEQ ID NO: 260737 - RNA, 19 nt, Homo sapiens
gaucgaggguacucagaca

SEQ ID NO: 260738 - RNA, 19 nt, Homo sapiens
agacagagagggagucauu

SEQ ID NO: 260739 - RNA, 19 nt, Homo sapiens
gagaucuuguuuaacgauu

SEQ ID NO: 260740 - RNA, 19 nt, Homo sapiens
gccagagaauccaguguga

SEQ ID NO: 260741 - RNA, 19 nt, Homo sapiens
uccagaguguugugacuua

SEQ ID NO: 260742 - RNA, 19 nt, Homo sapiens
gcaauacaaggacaugaug

SEQ ID NO: 260743 - RNA, 19 nt, Homo sapiens
cgguucauauuaagacaua

SEQ ID NO: 260744 - RNA, 19 nt, Homo sapiens
ccacacacauacacacaca

SEQ ID NO: 260745 - RNA, 19 nt, Homo sapiens
ugaaauaugcugucuacau

SEQ ID NO: 260746 - RNA, 19 nt, Homo sapiens
ccuuuaauaucacguuuga

SEQ ID NO: 260747 - RNA, 19 nt, Homo sapiens
ugagaacacguaugugaaa

SEQ ID NO: 260748 - RNA, 19 nt, Homo sapiens
acaaaugguagcauacuuu

SEQ ID NO: 260749 - RNA, 19 nt, Homo sapiens
cacuaaauaucucaacuuc

SEQ ID NO: 260750 - RNA, 19 nt, Homo sapiens
gagcaccagcugcagcaua

SEQ ID NO: 260751 - RNA, 19 nt, Homo sapiens
gcuaagagaaggacagauc

SEQ ID NO: 260752 - RNA, 19 nt, Homo sapiens
ugaaggaguuugucucaac

SEQ ID NO: 260753 - RNA, 19 nt, Homo sapiens
gaugaaggaguuugucuca

SEQ ID NO: 260754 - RNA, 19 nt, Homo sapiens
gggcucugcuuccuguuug

SEQ ID NO: 260755 - RNA, 19 nt, Homo sapiens
gaguguaccauaauguauu

SEQ ID NO: 260756 - RNA, 19 nt, Homo sapiens
ucagacaucgguucauauu

SEQ ID NO: 260757 - RNA, 19 nt, Homo sapiens
guuuaacgauuccguguuc

SEQ ID NO: 260758 - RNA, 19 nt, Homo sapiens
caacaaaaccgaauuccaa

SEQ ID NO: 260759 - RNA, 19 nt, Homo sapiens
guauuugaguguaaugauc

SEQ ID NO: 260760 - RNA, 19 nt, Homo sapiens
caacaugaccagaguggau

SEQ ID NO: 260761 - RNA, 19 nt, Homo sapiens
cggauucacuuuaccuuca

SEQ ID NO: 260762 - RNA, 19 nt, Homo sapiens
ccaaaaccuuguucucuuu

SEQ ID NO: 260763 - RNA, 19 nt, Homo sapiens
gcauaguauuccauugugu

SEQ ID NO: 260764 - RNA, 19 nt, Homo sapiens
caccagacuugcagugaga

SEQ ID NO: 260765 - RNA, 19 nt, Homo sapiens
gggcuugggcuuccauuug

SEQ ID NO: 260766 - RNA, 19 nt, Homo sapiens
aaggcaaccucucguuuga

SEQ ID NO: 260767 - RNA, 19 nt, Homo sapiens
agaguguugugacuuauga

SEQ ID NO: 260768 - RNA, 19 nt, Homo sapiens
cucccaggcuccaguauuu

SEQ ID NO: 260769 - RNA, 19 nt, Homo sapiens
gagaaaagcaccuucauca

SEQ ID NO: 260770 - RNA, 19 nt, Homo sapiens
ggauucacuuuaccuucaa

SEQ ID NO: 260771 - RNA, 19 nt, Homo sapiens
gaauaccagucgggucaug

SEQ ID NO: 260772 - RNA, 19 nt, Homo sapiens
cugcugaguuaauaaauca

SEQ ID NO: 260773 - RNA, 19 nt, Homo sapiens
uuaacagccuugaccuuau

SEQ ID NO: 260774 - RNA, 19 nt, Homo sapiens
gcaaggaauguauuugagu

SEQ ID NO: 260775 - RNA, 19 nt, Homo sapiens
gcucaggucccagccagua

SEQ ID NO: 260776 - RNA, 19 nt, Homo sapiens
caaugaccuuccaagagaa

SEQ ID NO: 260777 - RNA, 19 nt, Homo sapiens
guagcauacuuuauauugg

SEQ ID NO: 260778 - RNA, 19 nt, Homo sapiens
gagcuaaucuugagaauau

SEQ ID NO: 260779 - RNA, 19 nt, Homo sapiens
gaaaggagccacagauaua

SEQ ID NO: 260780 - RNA, 19 nt, Homo sapiens
cgacaaagcugaauggauu

SEQ ID NO: 260781 - RNA, 19 nt, Homo sapiens
gaacagcucucaaaguuuc

SEQ ID NO: 260782 - RNA, 19 nt, Homo sapiens
gaaagaugcuguaauuuag

SEQ ID NO: 260783 - RNA, 19 nt, Homo sapiens
gaacugcacuucagauaug

SEQ ID NO: 260784 - RNA, 19 nt, Homo sapiens
guacggaacuuuauuuguu

SEQ ID NO: 260785 - RNA, 19 nt, Homo sapiens
gaauaucgguuggauuaua

SEQ ID NO: 260786 - RNA, 19 nt, Homo sapiens
gcaucuaucuugaaaguaa

SEQ ID NO: 260787 - RNA, 19 nt, Homo sapiens
ugagaaaucuuuacaguug

SEQ ID NO: 260788 - RNA, 19 nt, Homo sapiens
gaaggaaacucagaaacuu

SEQ ID NO: 260789 - RNA, 19 nt, Homo sapiens
ggaugaaucugaauuuaga

SEQ ID NO: 260790 - RNA, 19 nt, Homo sapiens
gauaguugcuuaugcauau

SEQ ID NO: 260791 - RNA, 19 nt, Homo sapiens
ccauguagaucacaagaua

SEQ ID NO: 260792 - RNA, 19 nt, Homo sapiens
uaaggcaacucacugauuu

SEQ ID NO: 260793 - RNA, 19 nt, Homo sapiens
ccucugacauugauuguua

SEQ ID NO: 260794 - RNA, 19 nt, Homo sapiens
gacaaacucacuccaauua

SEQ ID NO: 260795 - RNA, 19 nt, Homo sapiens
gaacauguccuccuuauac

SEQ ID NO: 260796 - RNA, 19 nt, Homo sapiens
gcaacucacugauuuacuu

SEQ ID NO: 260797 - RNA, 19 nt, Homo sapiens
gcucagugcuugaagauug

SEQ ID NO: 260798 - RNA, 19 nt, Homo sapiens
gcagaaaucguaucuaaau

SEQ ID NO: 260799 - RNA, 19 nt, Homo sapiens
ggaagaacauguccuccuu

SEQ ID NO: 260800 - RNA, 19 nt, Homo sapiens
caaggaggauucagcauug

SEQ ID NO: 260801 - RNA, 19 nt, Homo sapiens
uaagcaagguaauguguaa

SEQ ID NO: 260802 - RNA, 19 nt, Homo sapiens
cauauggaguuggaaauua

SEQ ID NO: 260803 - RNA, 19 nt, Homo sapiens
ccaagaacaugacuauuuc

SEQ ID NO: 260804 - RNA, 19 nt, Homo sapiens
ggcuggaacucaacucuua

SEQ ID NO: 260805 - RNA, 19 nt, Homo sapiens
caggaugguuucaaugaua

SEQ ID NO: 260806 - RNA, 19 nt, Homo sapiens
uggcagaaaucguaucuaa

SEQ ID NO: 260807 - RNA, 19 nt, Homo sapiens
gaaagagcuuaaucauaug

SEQ ID NO: 260808 - RNA, 19 nt, Homo sapiens
gcaauagcaugauguuaca

SEQ ID NO: 260809 - RNA, 19 nt, Homo sapiens
caaaguaagcccaguugua

SEQ ID NO: 260810 - RNA, 19 nt, Homo sapiens
uggaacagcucucaaaguu

SEQ ID NO: 260811 - RNA, 19 nt, Homo sapiens
gaugaucaguuauaccuau

SEQ ID NO: 260812 - RNA, 19 nt, Homo sapiens
ucaguggccuuacaaauau

SEQ ID NO: 260813 - RNA, 19 nt, Homo sapiens
ccgaaacaaugaagccuua

SEQ ID NO: 260814 - RNA, 19 nt, Homo sapiens
gaaguguacccuagcauuu

SEQ ID NO: 260815 - RNA, 19 nt, Homo sapiens
gaauggauuugaggucuuu

SEQ ID NO: 260816 - RNA, 19 nt, Homo sapiens
gaauuuaagucccaucagu

SEQ ID NO: 260817 - RNA, 19 nt, Homo sapiens
ggaauauuaccucuguuua

SEQ ID NO: 260818 - RNA, 19 nt, Homo sapiens
gcacaucuaugagcugaga

SEQ ID NO: 260819 - RNA, 19 nt, Homo sapiens
aaggagauauucacacuuu

SEQ ID NO: 260820 - RNA, 19 nt, Homo sapiens
gcaaacaacugaaaagaau

SEQ ID NO: 260821 - RNA, 19 nt, Homo sapiens
gauggauacuucugugaaa

SEQ ID NO: 260822 - RNA, 19 nt, Homo sapiens
ggaaguuucuguagauagu

SEQ ID NO: 260823 - RNA, 19 nt, Homo sapiens
gagacaaacucacuccaau

SEQ ID NO: 260824 - RNA, 19 nt, Homo sapiens
ucacucauaugguagaauu

SEQ ID NO: 260825 - RNA, 19 nt, Homo sapiens
ggauacuucugugaaauuu

SEQ ID NO: 260826 - RNA, 19 nt, Homo sapiens
gaagaacauguccuccuua

SEQ ID NO: 260827 - RNA, 19 nt, Homo sapiens
gaaauggagaguuuaauag

SEQ ID NO: 260828 - RNA, 19 nt, Homo sapiens
uggaauaucgguuggauua

SEQ ID NO: 260829 - RNA, 19 nt, Homo sapiens
uggcauagaugacuuuguu

SEQ ID NO: 260830 - RNA, 19 nt, Homo sapiens
gagauuaugccaaggauga

SEQ ID NO: 260831 - RNA, 19 nt, Homo sapiens
gcacuucggcgauggcuuu

SEQ ID NO: 260832 - RNA, 19 nt, Homo sapiens
gaucucaucuuugcaaaca

SEQ ID NO: 260833 - RNA, 19 nt, Homo sapiens
gagaaacaaugguccaagu

SEQ ID NO: 260834 - RNA, 19 nt, Homo sapiens
ggaacaugcuuucuucaag

SEQ ID NO: 260835 - RNA, 19 nt, Homo sapiens
uuaaagcaguccaaauuug

SEQ ID NO: 260836 - RNA, 19 nt, Homo sapiens
caaugaagccuuagcaaga

SEQ ID NO: 260837 - RNA, 19 nt, Homo sapiens
ugacaacccucugacauug

SEQ ID NO: 260838 - RNA, 19 nt, Homo sapiens
gagcaccucucuucaugga

SEQ ID NO: 260839 - RNA, 19 nt, Homo sapiens
gaguaaugcuuggaauaaa

SEQ ID NO: 260840 - RNA, 19 nt, Homo sapiens
aauaguaccuccuucaguu

SEQ ID NO: 260841 - RNA, 19 nt, Homo sapiens
caaaguugaucuugcuguu

SEQ ID NO: 260842 - RNA, 19 nt, Homo sapiens
caacaggcaauagagauua

SEQ ID NO: 260843 - RNA, 19 nt, Homo sapiens
aauguuagguucugcuuaa

SEQ ID NO: 260844 - RNA, 19 nt, Homo sapiens
ggagaacccugagacugaa

SEQ ID NO: 260845 - RNA, 19 nt, Homo sapiens
ccaagucacuccaagaaca

SEQ ID NO: 260846 - RNA, 19 nt, Homo sapiens
gacgagcacuguuucucua

SEQ ID NO: 260847 - RNA, 19 nt, Homo sapiens
ugccauaucucauaauuuc

SEQ ID NO: 260848 - RNA, 19 nt, Homo sapiens
gagaaaucuuuacaguuga

SEQ ID NO: 260849 - RNA, 19 nt, Homo sapiens
gucauagaguuuccuuaua

SEQ ID NO: 260850 - RNA, 19 nt, Homo sapiens
gaagauugucugccaaguu

SEQ ID NO: 260851 - RNA, 19 nt, Homo sapiens
agacuuuccugugcauuua

SEQ ID NO: 260852 - RNA, 19 nt, Homo sapiens
guucacgccugcuaacauu

SEQ ID NO: 260853 - RNA, 19 nt, Homo sapiens
gcagugccauagcuccuuu

SEQ ID NO: 260854 - RNA, 19 nt, Homo sapiens
caaagacuguugaguaugc

SEQ ID NO: 260855 - RNA, 19 nt, Homo sapiens
aguaaugggucuuggagua

SEQ ID NO: 260856 - RNA, 19 nt, Homo sapiens
uaacugcuguccucauuag

SEQ ID NO: 260857 - RNA, 19 nt, Homo sapiens
uaaguuaugcuacaucuug

SEQ ID NO: 260858 - RNA, 19 nt, Homo sapiens
gcaaggcaaugcuccaucu

SEQ ID NO: 260859 - RNA, 19 nt, Homo sapiens
ugacugagcuaaucuugag

SEQ ID NO: 260860 - RNA, 19 nt, Homo sapiens
caaguugacugagcuaauc

SEQ ID NO: 260861 - RNA, 19 nt, Homo sapiens
gaucagugagaaaucuuua

SEQ ID NO: 260862 - RNA, 19 nt, Homo sapiens
ccuauuacacuucuguuua

SEQ ID NO: 260863 - RNA, 19 nt, Homo sapiens
gaaacaaugguccaaguuc

SEQ ID NO: 260864 - RNA, 19 nt, Homo sapiens
agucagagauggauacuuc

SEQ ID NO: 260865 - RNA, 19 nt, Homo sapiens
ucaaguggcagaaaucgua

SEQ ID NO: 260866 - RNA, 19 nt, Homo sapiens
ggucuuggaguauagauuu

SEQ ID NO: 260867 - RNA, 19 nt, Homo sapiens
gcaugauguuacaggaaua

SEQ ID NO: 260868 - RNA, 19 nt, Homo sapiens
gagaaugggucaagaucag

SEQ ID NO: 260869 - RNA, 19 nt, Homo sapiens
aagauugucugccaaguug

SEQ ID NO: 260870 - RNA, 19 nt, Homo sapiens
aaacaaugguccaaguuca

SEQ ID NO: 260871 - RNA, 19 nt, Homo sapiens
auccaaagcucaaaucuau

SEQ ID NO: 260872 - RNA, 19 nt, Homo sapiens
gcuggaaguuucuguagau

SEQ ID NO: 260873 - RNA, 19 nt, Homo sapiens
gcaaucaugucuuuuguau

SEQ ID NO: 260874 - RNA, 19 nt, Homo sapiens
uaacauagggugacuugug

SEQ ID NO: 260875 - RNA, 19 nt, Homo sapiens
gagcaucugugaggucgaa

SEQ ID NO: 260876 - RNA, 19 nt, Homo sapiens
ucuaugagcugagaaacaa

SEQ ID NO: 260877 - RNA, 19 nt, Homo sapiens
cgggaugaaucugaauuua

SEQ ID NO: 260878 - RNA, 19 nt, Homo sapiens
caacggugcuggagaagua

SEQ ID NO: 260879 - RNA, 19 nt, Homo sapiens
gagaagaucuuugccauug

SEQ ID NO: 260880 - RNA, 19 nt, Homo sapiens
ggacuugacuugcaauuuc

SEQ ID NO: 260881 - RNA, 19 nt, Homo sapiens
gauaacagcugccaaccaa

SEQ ID NO: 260882 - RNA, 19 nt, Homo sapiens
guacaaaguuggcuucuuc

SEQ ID NO: 260883 - RNA, 19 nt, Homo sapiens
caacauugcuggccuggaa

SEQ ID NO: 260884 - RNA, 19 nt, Homo sapiens
ggaggcaaauggacaaauu

SEQ ID NO: 260885 - RNA, 19 nt, Homo sapiens
ggacuuugaugcucugaaa

SEQ ID NO: 260886 - RNA, 19 nt, Homo sapiens
gccaagcacuagauuauuu

SEQ ID NO: 260887 - RNA, 19 nt, Homo sapiens
ggaguaaccuggagcugaa

SEQ ID NO: 260888 - RNA, 19 nt, Homo sapiens
gcgacagccuggauuauaa

SEQ ID NO: 260889 - RNA, 19 nt, Homo sapiens
gcacgaaugaucuuucuuu

SEQ ID NO: 260890 - RNA, 19 nt, Homo sapiens
ggacagcgcuggguuugga

SEQ ID NO: 260891 - RNA, 19 nt, Homo sapiens
gagaaaugaucccucuuug

SEQ ID NO: 260892 - RNA, 19 nt, Homo sapiens
cgacaacggugcuggagaa

SEQ ID NO: 260893 - RNA, 19 nt, Homo sapiens
ccaaauaccucaacuucuc

SEQ ID NO: 260894 - RNA, 19 nt, Homo sapiens
agaaauacauggacaauac

SEQ ID NO: 260895 - RNA, 19 nt, Homo sapiens
ggacaggaggcauuuauga

SEQ ID NO: 260896 - RNA, 19 nt, Homo sapiens
caacaucugccuuuacauu

SEQ ID NO: 260897 - RNA, 19 nt, Homo sapiens
gaaauuacguucgacacau

SEQ ID NO: 260898 - RNA, 19 nt, Homo sapiens
ccuccaggcugcaguauuu

SEQ ID NO: 260899 - RNA, 19 nt, Homo sapiens
ggacucagaucggcuccua

SEQ ID NO: 260900 - RNA, 19 nt, Homo sapiens
gaaguaugcugucuacacu

SEQ ID NO: 260901 - RNA, 19 nt, Homo sapiens
acagauaccaggucaauaa

SEQ ID NO: 260902 - RNA, 19 nt, Homo sapiens
acaaagaaccggagucuga

SEQ ID NO: 260903 - RNA, 19 nt, Homo sapiens
gggagcagguggucucuga

SEQ ID NO: 260904 - RNA, 19 nt, Homo sapiens
guucauaccugccgagauc

SEQ ID NO: 260905 - RNA, 19 nt, Homo sapiens
acacuucacuuucgaggaa

SEQ ID NO: 260906 - RNA, 19 nt, Homo sapiens
gaagggcaaccucagcuuu

SEQ ID NO: 260907 - RNA, 19 nt, Homo sapiens
acgaacaauucaccaaaua

SEQ ID NO: 260908 - RNA, 19 nt, Homo sapiens
gaagaucuuugccauugag

SEQ ID NO: 260909 - RNA, 19 nt, Homo sapiens
gggcagcacuccuccuguu

SEQ ID NO: 260910 - RNA, 19 nt, Homo sapiens
gagacagcgugguccagua

SEQ ID NO: 260911 - RNA, 19 nt, Homo sapiens
gaagugaugguguggaaug

SEQ ID NO: 260912 - RNA, 19 nt, Homo sapiens
cccauuaccuugcgucuga

SEQ ID NO: 260913 - RNA, 19 nt, Homo sapiens
gcaguucuccaacaaauuc

SEQ ID NO: 260914 - RNA, 19 nt, Homo sapiens
gcacagauaccaggucaau

SEQ ID NO: 260915 - RNA, 19 nt, Homo sapiens
cagaagugaugguguggaa

SEQ ID NO: 260916 - RNA, 19 nt, Homo sapiens
ggagugcaauggcgugauc

SEQ ID NO: 260917 - RNA, 19 nt, Homo sapiens
cgaaugaucuuucuuuccu

SEQ ID NO: 260918 - RNA, 19 nt, Homo sapiens
ugagaaaugaucccucuuu

SEQ ID NO: 260919 - RNA, 19 nt, Homo sapiens
ggagaccggcugcuucuga

SEQ ID NO: 260920 - RNA, 19 nt, Homo sapiens
ucagaaaccugcggccuau

SEQ ID NO: 260921 - RNA, 19 nt, Homo sapiens
caacuucucuagguuucaa

SEQ ID NO: 260922 - RNA, 19 nt, Homo sapiens
caaacacacuucacuuucg

SEQ ID NO: 260923 - RNA, 19 nt, Homo sapiens
cgccagauauugcagaaga

SEQ ID NO: 260924 - RNA, 19 nt, Homo sapiens
gcagagggccagaaacaag

SEQ ID NO: 260925 - RNA, 19 nt, Homo sapiens
gagcugaacgcagaaguga

SEQ ID NO: 260926 - RNA, 19 nt, Homo sapiens
ggagaagaucuuugccauu

SEQ ID NO: 260927 - RNA, 19 nt, Homo sapiens
gaugaugaacuucgugaga

SEQ ID NO: 260928 - RNA, 19 nt, Homo sapiens
gacaggagcaggacauugu

SEQ ID NO: 260929 - RNA, 19 nt, Homo sapiens
ugucugaacucuccagcuu

SEQ ID NO: 260930 - RNA, 19 nt, Homo sapiens
gaaccaccaucaccuucuc

SEQ ID NO: 260931 - RNA, 19 nt, Homo sapiens
ccaacaaauuccaaacaca

SEQ ID NO: 260932 - RNA, 19 nt, Homo sapiens
ccaaacggguggccucuac

SEQ ID NO: 260933 - RNA, 19 nt, Homo sapiens
ccaggaacacauauuuaaa

SEQ ID NO: 260934 - RNA, 19 nt, Homo sapiens
caucauccgcuaugcaauu

SEQ ID NO: 260935 - RNA, 19 nt, Homo sapiens
gugaauuagugucauguca

SEQ ID NO: 260936 - RNA, 19 nt, Homo sapiens
gacuugcaauuucuaccua

SEQ ID NO: 260937 - RNA, 19 nt, Homo sapiens
ggugaaguaugcugucuac

SEQ ID NO: 260938 - RNA, 19 nt, Homo sapiens
uugaugcucugaaagauau

SEQ ID NO: 260939 - RNA, 19 nt, Homo sapiens
ggcgacagccuggauuaua

SEQ ID NO: 260940 - RNA, 19 nt, Homo sapiens
aaacacacuucacuuucga

SEQ ID NO: 260941 - RNA, 19 nt, Homo sapiens
gauaagccaguuccagaga

SEQ ID NO: 260942 - RNA, 19 nt, Homo sapiens
ccagugaauuagugucaug

SEQ ID NO: 260943 - RNA, 19 nt, Homo sapiens
gaaugaucuuucuuuccuu

SEQ ID NO: 260944 - RNA, 19 nt, Homo sapiens
ccacgaacaauucaccaaa

SEQ ID NO: 260945 - RNA, 19 nt, Homo sapiens
gcugaacgcagaagugaug

SEQ ID NO: 260946 - RNA, 19 nt, Homo sapiens
ucacugaugggaagaaaga

SEQ ID NO: 260947 - RNA, 19 nt, Homo sapiens
ccucguuuccagugaauua

SEQ ID NO: 260948 - RNA, 19 nt, Homo sapiens
caaaaggacuugacuugca

SEQ ID NO: 260949 - RNA, 19 nt, Homo sapiens
gggccugcuuccugucuuu

SEQ ID NO: 260950 - RNA, 19 nt, Homo sapiens
gagcagacccugguacagu

SEQ ID NO: 260951 - RNA, 19 nt, Homo sapiens
caguagcuccuucgaauug

SEQ ID NO: 260952 - RNA, 19 nt, Homo sapiens
gcaguagcuccuucgaauu

SEQ ID NO: 260953 - RNA, 19 nt, Homo sapiens
ccaaacacacuucacuuuc

SEQ ID NO: 260954 - RNA, 19 nt, Homo sapiens
cccaggaacacauauuuaa

SEQ ID NO: 260955 - RNA, 19 nt, Homo sapiens
gaaggugucggucgugagu

SEQ ID NO: 260956 - RNA, 19 nt, Homo sapiens
gaaucaaccaccucaucuu

SEQ ID NO: 260957 - RNA, 19 nt, Homo sapiens
cuccacaucugaccuucua

SEQ ID NO: 260958 - RNA, 19 nt, Homo sapiens
acaucugccuuuacauuga

SEQ ID NO: 260959 - RNA, 19 nt, Homo sapiens
aauaugagcccuaccuuca

SEQ ID NO: 260960 - RNA, 19 nt, Homo sapiens
ucacagccuuagcaacuuc

SEQ ID NO: 260961 - RNA, 19 nt, Homo sapiens
uggcgcacauucagaagaa

SEQ ID NO: 260962 - RNA, 19 nt, Homo sapiens
caccaaauaccucaacuuc

SEQ ID NO: 260963 - RNA, 19 nt, Homo sapiens
cacgaacaauucaccaaau

SEQ ID NO: 260964 - RNA, 19 nt, Homo sapiens
caucuccucccgcaacuuu

SEQ ID NO: 260965 - RNA, 19 nt, Homo sapiens
gcgcccagaucaccuucuu

SEQ ID NO: 260966 - RNA, 19 nt, Homo sapiens
cagccuggauuauaaggau

SEQ ID NO: 260967 - RNA, 19 nt, Homo sapiens
cugcaaggguuuacauaca

SEQ ID NO: 260968 - RNA, 19 nt, Homo sapiens
caacuggaaacccuuagga

SEQ ID NO: 260969 - RNA, 19 nt, Homo sapiens
gaguguggcugaaauuacg

SEQ ID NO: 260970 - RNA, 19 nt, Homo sapiens
cagccaaugugagcaguga

SEQ ID NO: 260971 - RNA, 19 nt, Homo sapiens
agaaggugguggugugaug

SEQ ID NO: 260972 - RNA, 19 nt, Homo sapiens
ggaggaggcaaauggacaa

SEQ ID NO: 260973 - RNA, 19 nt, Homo sapiens
ucagaucggcuccuacuuc

SEQ ID NO: 260974 - RNA, 19 nt, Homo sapiens
cuugggaaauaaucugaaa

SEQ ID NO: 260975 - RNA, 19 nt, Homo sapiens
caaaguuggcuucuucaag

SEQ ID NO: 260976 - RNA, 19 nt, Homo sapiens
agcaguagcuccuucgaau

SEQ ID NO: 260977 - RNA, 19 nt, Homo sapiens
agaagaucuuugccauuga

SEQ ID NO: 260978 - RNA, 19 nt, Homo sapiens
gaacagaucugaugaauga

SEQ ID NO: 260979 - RNA, 19 nt, Homo sapiens
caagagagcugaagacuau

SEQ ID NO: 260980 - RNA, 19 nt, Homo sapiens
gaagggaguuugcuaaauu

SEQ ID NO: 260981 - RNA, 19 nt, Homo sapiens
ccacagacauuuacauuaa

SEQ ID NO: 260982 - RNA, 19 nt, Homo sapiens
gcgcauaucuggaaauuug

SEQ ID NO: 260983 - RNA, 19 nt, Homo sapiens
agacaugacugaugacaua

SEQ ID NO: 260984 - RNA, 19 nt, Homo sapiens
caaaguaaauguccugcua

SEQ ID NO: 260985 - RNA, 19 nt, Homo sapiens
gaagagggauaauacaaau

SEQ ID NO: 260986 - RNA, 19 nt, Homo sapiens
ugacauaucugaaagacaa

SEQ ID NO: 260987 - RNA, 19 nt, Homo sapiens
gugaagacauggaugcuua

SEQ ID NO: 260988 - RNA, 19 nt, Homo sapiens
ccacaacacugaaugcaaa

SEQ ID NO: 260989 - RNA, 19 nt, Homo sapiens
caaaguagcaauuuccaua

SEQ ID NO: 260990 - RNA, 19 nt, Homo sapiens
guaauucaguugaucauug

SEQ ID NO: 260991 - RNA, 19 nt, Homo sapiens
gaaagacgauuuggagaau

SEQ ID NO: 260992 - RNA, 19 nt, Homo sapiens
gaugagaguuucuguuaau

SEQ ID NO: 260993 - RNA, 19 nt, Homo sapiens
gaaaugaggaggauuacuu

SEQ ID NO: 260994 - RNA, 19 nt, Homo sapiens
caaaucauguggagaaugu

SEQ ID NO: 260995 - RNA, 19 nt, Homo sapiens
guacagauccgaaguuuca

SEQ ID NO: 260996 - RNA, 19 nt, Homo sapiens
gaacugcaccagcccauuu

SEQ ID NO: 260997 - RNA, 19 nt, Homo sapiens
gcaaaucccacaacacuga

SEQ ID NO: 260998 - RNA, 19 nt, Homo sapiens
ggaguuugcuaaauuugaa

SEQ ID NO: 260999 - RNA, 19 nt, Homo sapiens
gugcagagccuucaauaaa

SEQ ID NO: 261000 - RNA, 19 nt, Homo sapiens
cagaugaaguuaacaguga

SEQ ID NO: 261001 - RNA, 19 nt, Homo sapiens
gaacaacgaggucaugguu

SEQ ID NO: 261002 - RNA, 19 nt, Homo sapiens
gaaaugguguuugcaagug

SEQ ID NO: 261003 - RNA, 19 nt, Homo sapiens
gaaacuugguggcauuguu

SEQ ID NO: 261004 - RNA, 19 nt, Homo sapiens
guaaauguccugcuagcua

SEQ ID NO: 261005 - RNA, 19 nt, Homo sapiens
acaaguauguugagaguug

SEQ ID NO: 261006 - RNA, 19 nt, Homo sapiens
ggcaauaguuaaaguaaug

SEQ ID NO: 261007 - RNA, 19 nt, Homo sapiens
gaaguuauacuguggcuau

SEQ ID NO: 261008 - RNA, 19 nt, Homo sapiens
ggaagagggauaauacaaa

SEQ ID NO: 261009 - RNA, 19 nt, Homo sapiens
caaauugucagaaggagua

SEQ ID NO: 261010 - RNA, 19 nt, Homo sapiens
caaauucaagccuuagaua

SEQ ID NO: 261011 - RNA, 19 nt, Homo sapiens
ggagaaguauuuaaugaac

SEQ ID NO: 261012 - RNA, 19 nt, Homo sapiens
cccagaggcuccaaagaua

SEQ ID NO: 261013 - RNA, 19 nt, Homo sapiens
agacaucauuccaauugua

SEQ ID NO: 261014 - RNA, 19 nt, Homo sapiens
gauccugugucccauugua

SEQ ID NO: 261015 - RNA, 19 nt, Homo sapiens
ggaaguagagguuauucuu

SEQ ID NO: 261016 - RNA, 19 nt, Homo sapiens
gcugaagacuaucccauug

SEQ ID NO: 261017 - RNA, 19 nt, Homo sapiens
gaaaaugaaugccaaaugg

SEQ ID NO: 261018 - RNA, 19 nt, Homo sapiens
gcaagugucguguguguga

SEQ ID NO: 261019 - RNA, 19 nt, Homo sapiens
gugauaauuucaacuguga

SEQ ID NO: 261020 - RNA, 19 nt, Homo sapiens
ucagaaggaguaacaauaa

SEQ ID NO: 261021 - RNA, 19 nt, Homo sapiens
gaaaucaagcuuauuggau

SEQ ID NO: 261022 - RNA, 19 nt, Homo sapiens
gaaggaguaacaauaaguu

SEQ ID NO: 261023 - RNA, 19 nt, Homo sapiens
acaauucccuuuccucaga

SEQ ID NO: 261024 - RNA, 19 nt, Homo sapiens
gcaauguaauucaguugau

SEQ ID NO: 261025 - RNA, 19 nt, Homo sapiens
guugagaguugcuggugua

SEQ ID NO: 261026 - RNA, 19 nt, Homo sapiens
gaaggauguugacgacugu

SEQ ID NO: 261027 - RNA, 19 nt, Homo sapiens
gguagaaagucgggacaaa

SEQ ID NO: 261028 - RNA, 19 nt, Homo sapiens
gagaguugcugguguaaaa

SEQ ID NO: 261029 - RNA, 19 nt, Homo sapiens
ccagacaucauuccaauug

SEQ ID NO: 261030 - RNA, 19 nt, Homo sapiens
guaaggagaaggauguuga

SEQ ID NO: 261031 - RNA, 19 nt, Homo sapiens
ugauagauccaauggcuua

SEQ ID NO: 261032 - RNA, 19 nt, Homo sapiens
gaaaucugcaguaacaaug

SEQ ID NO: 261033 - RNA, 19 nt, Homo sapiens
aaacagcgcauaucuggaa

SEQ ID NO: 261034 - RNA, 19 nt, Homo sapiens
cuacaaaggccaugggaaa

SEQ ID NO: 261035 - RNA, 19 nt, Homo sapiens
ugaaagggcaauaguuaaa

SEQ ID NO: 261036 - RNA, 19 nt, Homo sapiens
caacacugaaugcaaagua

SEQ ID NO: 261037 - RNA, 19 nt, Homo sapiens
gcaugugacuguucuuugg

SEQ ID NO: 261038 - RNA, 19 nt, Homo sapiens
ugccuucacuuuacaaauu

SEQ ID NO: 261039 - RNA, 19 nt, Homo sapiens
ggagaugagguucaauuug

SEQ ID NO: 261040 - RNA, 19 nt, Homo sapiens
gcaaacgugugagaugugu

SEQ ID NO: 261041 - RNA, 19 nt, Homo sapiens
gaaagucccaagugucaug

SEQ ID NO: 261042 - RNA, 19 nt, Homo sapiens
gugcucagucuuacuaaua

SEQ ID NO: 261043 - RNA, 19 nt, Homo sapiens
ggacuucagaauuggauuu

SEQ ID NO: 261044 - RNA, 19 nt, Homo sapiens
cagaggauauuacucagau

SEQ ID NO: 261045 - RNA, 19 nt, Homo sapiens
uaaaagaaccgagcaauuu

SEQ ID NO: 261046 - RNA, 19 nt, Homo sapiens
gagaguuucuguuaaucau

SEQ ID NO: 261047 - RNA, 19 nt, Homo sapiens
gggcaaacgugugagaugu

SEQ ID NO: 261048 - RNA, 19 nt, Homo sapiens
gcaaaggaacagcagagaa

SEQ ID NO: 261049 - RNA, 19 nt, Homo sapiens
gagacaggaugguuauucu

SEQ ID NO: 261050 - RNA, 19 nt, Homo sapiens
uagauccaauggcuuaauu

SEQ ID NO: 261051 - RNA, 19 nt, Homo sapiens
gaauuggauuuggcucauu

SEQ ID NO: 261052 - RNA, 19 nt, Homo sapiens
ugcacgaugugaugauuua

SEQ ID NO: 261053 - RNA, 19 nt, Homo sapiens
uaucaccucuucuaaucuu

SEQ ID NO: 261054 - RNA, 19 nt, Homo sapiens
ugaaagacaaguauguuga

SEQ ID NO: 261055 - RNA, 19 nt, Homo sapiens
gaguuucuguuaaucaugu

SEQ ID NO: 261056 - RNA, 19 nt, Homo sapiens
uaacaacuguggucaaucc

SEQ ID NO: 261057 - RNA, 19 nt, Homo sapiens
uagaaagucgggacaaauu

SEQ ID NO: 261058 - RNA, 19 nt, Homo sapiens
gcaaaugccaaaucaugug

SEQ ID NO: 261059 - RNA, 19 nt, Homo sapiens
guagcaauuuccauaguca

SEQ ID NO: 261060 - RNA, 19 nt, Homo sapiens
gaaugcaaaguagcaauuu

SEQ ID NO: 261061 - RNA, 19 nt, Homo sapiens
aauuguagcuggugugguu

SEQ ID NO: 261062 - RNA, 19 nt, Homo sapiens
agaaagucgggacaaauua

SEQ ID NO: 261063 - RNA, 19 nt, Homo sapiens
gagcauaaagaauguguuc

SEQ ID NO: 261064 - RNA, 19 nt, Homo sapiens
uccaauggcuuaauuugug

SEQ ID NO: 261065 - RNA, 19 nt, Homo sapiens
gaaguuaacagugaagaca

SEQ ID NO: 261066 - RNA, 19 nt, Homo sapiens
cagcacagaugaaguuaac

SEQ ID NO: 261067 - RNA, 19 nt, Homo sapiens
gaagaauuucagccuguuu

SEQ ID NO: 261068 - RNA, 19 nt, Homo sapiens
aaugaaaugaggaggauua

SEQ ID NO: 261069 - RNA, 19 nt, Homo sapiens
ucuaucaccucuucuaauc

SEQ ID NO: 261070 - RNA, 19 nt, Homo sapiens
agacaaguauguugagagu

SEQ ID NO: 261071 - RNA, 19 nt, Homo sapiens
cagaggcuccaaagauaua

SEQ ID NO: 261072 - RNA, 19 nt, Homo sapiens
ugaugagaguuucuguuaa

SEQ ID NO: 261073 - RNA, 19 nt, Homo sapiens
gggcaauaguuaaaguaau

SEQ ID NO: 261074 - RNA, 19 nt, Homo sapiens
cugcugauauggaagcuuu

SEQ ID NO: 261075 - RNA, 19 nt, Homo sapiens
caacugugauagauccaau

SEQ ID NO: 261076 - RNA, 19 nt, Homo sapiens
uagagguuauucuucagua

SEQ ID NO: 261077 - RNA, 19 nt, Homo sapiens
cagcgcauaucuggaaauu

SEQ ID NO: 261078 - RNA, 19 nt, Homo sapiens
gaacagaucugaugaauga

SEQ ID NO: 261079 - RNA, 19 nt, Homo sapiens
caaaguggcuuauaaagua

SEQ ID NO: 261080 - RNA, 19 nt, Homo sapiens
caagagagcugaagacuau

SEQ ID NO: 261081 - RNA, 19 nt, Homo sapiens
gaagggaguuugcuaaauu

SEQ ID NO: 261082 - RNA, 19 nt, Homo sapiens
ccacagacauuuacauuaa

SEQ ID NO: 261083 - RNA, 19 nt, Homo sapiens
gcgcauaucuggaaauuug

SEQ ID NO: 261084 - RNA, 19 nt, Homo sapiens
gaagagggauaauacaaau

SEQ ID NO: 261085 - RNA, 19 nt, Homo sapiens
gugaagacauggaugcuua

SEQ ID NO: 261086 - RNA, 19 nt, Homo sapiens
acagaaagcauccuaaaua

SEQ ID NO: 261087 - RNA, 19 nt, Homo sapiens
gaaagguuauguuagcauu

SEQ ID NO: 261088 - RNA, 19 nt, Homo sapiens
ucacagaacuauguacuuu

SEQ ID NO: 261089 - RNA, 19 nt, Homo sapiens
guaauucaguugaucauug

SEQ ID NO: 261090 - RNA, 19 nt, Homo sapiens
gaaagacgauuuggagaau

SEQ ID NO: 261091 - RNA, 19 nt, Homo sapiens
gaaaugaggaggauuacuu

SEQ ID NO: 261092 - RNA, 19 nt, Homo sapiens
caaaucauguggagaaugu

SEQ ID NO: 261093 - RNA, 19 nt, Homo sapiens
cagaaagcauccuaaauau

SEQ ID NO: 261094 - RNA, 19 nt, Homo sapiens
guacagauccgaaguuuca

SEQ ID NO: 261095 - RNA, 19 nt, Homo sapiens
gaacugcaccagcccauuu

SEQ ID NO: 261096 - RNA, 19 nt, Homo sapiens
ggaguuugcuaaauuugaa

SEQ ID NO: 261097 - RNA, 19 nt, Homo sapiens
gugcagagccuucaauaaa

SEQ ID NO: 261098 - RNA, 19 nt, Homo sapiens
cagaugaaguuaacaguga

SEQ ID NO: 261099 - RNA, 19 nt, Homo sapiens
cagaauagcuuugaaugug

SEQ ID NO: 261100 - RNA, 19 nt, Homo sapiens
gaacaacgaggucaugguu

SEQ ID NO: 261101 - RNA, 19 nt, Homo sapiens
ggaaaguguugaccacaga

SEQ ID NO: 261102 - RNA, 19 nt, Homo sapiens
gaaaugguguuugcaagug

SEQ ID NO: 261103 - RNA, 19 nt, Homo sapiens
gaaacuugguggcauuguu

SEQ ID NO: 261104 - RNA, 19 nt, Homo sapiens
ggacaugcagcccagaaua

SEQ ID NO: 261105 - RNA, 19 nt, Homo sapiens
ggaagagggauaauacaaa

SEQ ID NO: 261106 - RNA, 19 nt, Homo sapiens
caaauugucagaaggagua

SEQ ID NO: 261107 - RNA, 19 nt, Homo sapiens
ggagaaguauuuaaugaac

SEQ ID NO: 261108 - RNA, 19 nt, Homo sapiens
cccagaggcuccaaagaua

SEQ ID NO: 261109 - RNA, 19 nt, Homo sapiens
gauguauguuccucuauga

SEQ ID NO: 261110 - RNA, 19 nt, Homo sapiens
gcauguauauucugguuca

SEQ ID NO: 261111 - RNA, 19 nt, Homo sapiens
agacaucauuccaauugua

SEQ ID NO: 261112 - RNA, 19 nt, Homo sapiens
gauccugugucccauugua

SEQ ID NO: 261113 - RNA, 19 nt, Homo sapiens
ggaaguagagguuauucuu

SEQ ID NO: 261114 - RNA, 19 nt, Homo sapiens
gcugaagacuaucccauug

SEQ ID NO: 261115 - RNA, 19 nt, Homo sapiens
gaaaaugaaugccaaaugg

SEQ ID NO: 261116 - RNA, 19 nt, Homo sapiens
gcaagugucguguguguga

SEQ ID NO: 261117 - RNA, 19 nt, Homo sapiens
gugauaauuucaacuguga

SEQ ID NO: 261118 - RNA, 19 nt, Homo sapiens
ucagaaggaguaacaauaa

SEQ ID NO: 261119 - RNA, 19 nt, Homo sapiens
gcaaaguggcuuauaaagu

SEQ ID NO: 261120 - RNA, 19 nt, Homo sapiens
cuaagugaccgaaagguua

SEQ ID NO: 261121 - RNA, 19 nt, Homo sapiens
gaaggaguaacaauaaguu

SEQ ID NO: 261122 - RNA, 19 nt, Homo sapiens
acaauucccuuuccucaga

SEQ ID NO: 261123 - RNA, 19 nt, Homo sapiens
gcaaugccaaucuucagua

SEQ ID NO: 261124 - RNA, 19 nt, Homo sapiens
aaagauguauguuccucua

SEQ ID NO: 261125 - RNA, 19 nt, Homo sapiens
gcaauguaauucaguugau

SEQ ID NO: 261126 - RNA, 19 nt, Homo sapiens
gaaggauguugacgacugu

SEQ ID NO: 261127 - RNA, 19 nt, Homo sapiens
gguagaaagucgggacaaa

SEQ ID NO: 261128 - RNA, 19 nt, Homo sapiens
caaggaauuugcauuuagu

SEQ ID NO: 261129 - RNA, 19 nt, Homo sapiens
ucaaggaauuugcauuuag

SEQ ID NO: 261130 - RNA, 19 nt, Homo sapiens
ccagacaucauuccaauug

SEQ ID NO: 261131 - RNA, 19 nt, Homo sapiens
guaaggagaaggauguuga

SEQ ID NO: 261132 - RNA, 19 nt, Homo sapiens
ugauagauccaauggcuua

SEQ ID NO: 261133 - RNA, 19 nt, Homo sapiens
gaaaucugcaguaacaaug

SEQ ID NO: 261134 - RNA, 19 nt, Homo sapiens
aaacagcgcauaucuggaa

SEQ ID NO: 261135 - RNA, 19 nt, Homo sapiens
gauuguggguggauuuaug

SEQ ID NO: 261136 - RNA, 19 nt, Homo sapiens
caucagcuaucguuagugu

SEQ ID NO: 261137 - RNA, 19 nt, Homo sapiens
ggaauuugcauuuagugaa

SEQ ID NO: 261138 - RNA, 19 nt, Homo sapiens
gcaugugacuguucuuugg

SEQ ID NO: 261139 - RNA, 19 nt, Homo sapiens
augccaaucuucaguauuu

SEQ ID NO: 261140 - RNA, 19 nt, Homo sapiens
ucaguaaacuuuggcuuau

SEQ ID NO: 261141 - RNA, 19 nt, Homo sapiens
ggagaugagguucaauuug

SEQ ID NO: 261142 - RNA, 19 nt, Homo sapiens
ugaccgaaagguuauguua

SEQ ID NO: 261143 - RNA, 19 nt, Homo sapiens
gcaaacgugugagaugugu

SEQ ID NO: 261144 - RNA, 19 nt, Homo sapiens
gaaagucccaagugucaug

SEQ ID NO: 261145 - RNA, 19 nt, Homo sapiens
gugcucagucuuacuaaua

SEQ ID NO: 261146 - RNA, 19 nt, Homo sapiens
ggacuucagaauuggauuu

SEQ ID NO: 261147 - RNA, 19 nt, Homo sapiens
cagaggauauuacucagau

SEQ ID NO: 261148 - RNA, 19 nt, Homo sapiens
aaacagaaagcauccuaaa

SEQ ID NO: 261149 - RNA, 19 nt, Homo sapiens
gggcaaacgugugagaugu

SEQ ID NO: 261150 - RNA, 19 nt, Homo sapiens
gcaaaggaacagcagagaa

SEQ ID NO: 261151 - RNA, 19 nt, Homo sapiens
ugcacgaugugaugauuua

SEQ ID NO: 261152 - RNA, 19 nt, Homo sapiens
uagauccaauggcuuaauu

SEQ ID NO: 261153 - RNA, 19 nt, Homo sapiens
gaauuggauuuggcucauu

SEQ ID NO: 261154 - RNA, 19 nt, Homo sapiens
uagaaagucgggacaaauu

SEQ ID NO: 261155 - RNA, 19 nt, Homo sapiens
caguaaacuuuggcuuaua

SEQ ID NO: 261156 - RNA, 19 nt, Homo sapiens
guggguggauuuauguauu

SEQ ID NO: 261157 - RNA, 19 nt, Homo sapiens
aauuguagcuggugugguu

SEQ ID NO: 261158 - RNA, 19 nt, Homo sapiens
agaaagucgggacaaauua

SEQ ID NO: 261159 - RNA, 19 nt, Homo sapiens
gagcauaaagaauguguuc

SEQ ID NO: 261160 - RNA, 19 nt, Homo sapiens
uccaauggcuuaauuugug

SEQ ID NO: 261161 - RNA, 19 nt, Homo sapiens
gaaguuaacagugaagaca

SEQ ID NO: 261162 - RNA, 19 nt, Homo sapiens
cagcacagaugaaguuaac

SEQ ID NO: 261163 - RNA, 19 nt, Homo sapiens
gaagaauuucagccuguuu

SEQ ID NO: 261164 - RNA, 19 nt, Homo sapiens
gcaaaugccaaaucaugug

SEQ ID NO: 261165 - RNA, 19 nt, Homo sapiens
aaugaaaugaggaggauua

SEQ ID NO: 261166 - RNA, 19 nt, Homo sapiens
cugcugauauggaagcuuu

SEQ ID NO: 261167 - RNA, 19 nt, Homo sapiens
cagaggcuccaaagauaua

SEQ ID NO: 261168 - RNA, 19 nt, Homo sapiens
caacugugauagauccaau

SEQ ID NO: 261169 - RNA, 19 nt, Homo sapiens
uagagguuauucuucagua

SEQ ID NO: 261170 - RNA, 19 nt, Homo sapiens
cagcgcauaucuggaaauu

SEQ ID NO: 261171 - RNA, 19 nt, Homo sapiens
caaaggaacagcagagaag

SEQ ID NO: 261172 - RNA, 19 nt, Homo sapiens
gaaagcaaugccaaucuuc

SEQ ID NO: 261173 - RNA, 19 nt, Homo sapiens
gauccaauggcuuaauuug

SEQ ID NO: 261174 - RNA, 19 nt, Homo sapiens
gaaaacaguucagaaaucu

SEQ ID NO: 261175 - RNA, 19 nt, Homo sapiens
caagugucaugaaggaaau

SEQ ID NO: 261176 - RNA, 19 nt, Homo sapiens
gucagaaggaguaacaaua

SEQ ID NO: 261177 - RNA, 19 nt, Homo sapiens
gaggauuacuucggacuuc

SEQ ID NO: 261178 - RNA, 19 nt, Homo sapiens
gaacagaucugaugaauga

SEQ ID NO: 261179 - RNA, 19 nt, Homo sapiens
caagagagcugaagacuau

SEQ ID NO: 261180 - RNA, 19 nt, Homo sapiens
gaagggaguuugcuaaauu

SEQ ID NO: 261181 - RNA, 19 nt, Homo sapiens
ccacagacauuuacauuaa

SEQ ID NO: 261182 - RNA, 19 nt, Homo sapiens
gcgcauaucuggaaauuug

SEQ ID NO: 261183 - RNA, 19 nt, Homo sapiens
gaagagggauaauacaaau

SEQ ID NO: 261184 - RNA, 19 nt, Homo sapiens
gugaagacauggaugcuua

SEQ ID NO: 261185 - RNA, 19 nt, Homo sapiens
ggagugcaguggugugaua

SEQ ID NO: 261186 - RNA, 19 nt, Homo sapiens
guaauucaguugaucauug

SEQ ID NO: 261187 - RNA, 19 nt, Homo sapiens
gaaagacgauuuggagaau

SEQ ID NO: 261188 - RNA, 19 nt, Homo sapiens
gaaaugaggaggauuacuu

SEQ ID NO: 261189 - RNA, 19 nt, Homo sapiens
caaaucauguggagaaugu

SEQ ID NO: 261190 - RNA, 19 nt, Homo sapiens
guacagauccgaaguuuca

SEQ ID NO: 261191 - RNA, 19 nt, Homo sapiens
gaacugcaccagcccauuu

SEQ ID NO: 261192 - RNA, 19 nt, Homo sapiens
ggaguuugcuaaauuugaa

SEQ ID NO: 261193 - RNA, 19 nt, Homo sapiens
gugcagagccuucaauaaa

SEQ ID NO: 261194 - RNA, 19 nt, Homo sapiens
cagaugaaguuaacaguga

SEQ ID NO: 261195 - RNA, 19 nt, Homo sapiens
gaacaacgaggucaugguu

SEQ ID NO: 261196 - RNA, 19 nt, Homo sapiens
gaaaugguguuugcaagug

SEQ ID NO: 261197 - RNA, 19 nt, Homo sapiens
gaaacuugguggcauuguu

SEQ ID NO: 261198 - RNA, 19 nt, Homo sapiens
ggaagagggauaauacaaa

SEQ ID NO: 261199 - RNA, 19 nt, Homo sapiens
caaauugucagaaggagua

SEQ ID NO: 261200 - RNA, 19 nt, Homo sapiens
ggagaaguauuuaaugaac

SEQ ID NO: 261201 - RNA, 19 nt, Homo sapiens
cccagaggcuccaaagaua

SEQ ID NO: 261202 - RNA, 19 nt, Homo sapiens
agacaucauuccaauugua

SEQ ID NO: 261203 - RNA, 19 nt, Homo sapiens
gauccugugucccauugua

SEQ ID NO: 261204 - RNA, 19 nt, Homo sapiens
ggaaguagagguuauucuu

SEQ ID NO: 261205 - RNA, 19 nt, Homo sapiens
gcugaagacuaucccauug

SEQ ID NO: 261206 - RNA, 19 nt, Homo sapiens
gaaaaugaaugccaaaugg

SEQ ID NO: 261207 - RNA, 19 nt, Homo sapiens
gcaagugucguguguguga

SEQ ID NO: 261208 - RNA, 19 nt, Homo sapiens
gugauaauuucaacuguga

SEQ ID NO: 261209 - RNA, 19 nt, Homo sapiens
ucagaaggaguaacaauaa

SEQ ID NO: 261210 - RNA, 19 nt, Homo sapiens
gaaggaguaacaauaaguu

SEQ ID NO: 261211 - RNA, 19 nt, Homo sapiens
acaauucccuuuccucaga

SEQ ID NO: 261212 - RNA, 19 nt, Homo sapiens
gcaauguaauucaguugau

SEQ ID NO: 261213 - RNA, 19 nt, Homo sapiens
gaaggauguugacgacugu

SEQ ID NO: 261214 - RNA, 19 nt, Homo sapiens
gguagaaagucgggacaaa

SEQ ID NO: 261215 - RNA, 19 nt, Homo sapiens
ccagacaucauuccaauug

SEQ ID NO: 261216 - RNA, 19 nt, Homo sapiens
guaaggagaaggauguuga

SEQ ID NO: 261217 - RNA, 19 nt, Homo sapiens
ugauagauccaauggcuua

SEQ ID NO: 261218 - RNA, 19 nt, Homo sapiens
gaaaucugcaguaacaaug

SEQ ID NO: 261219 - RNA, 19 nt, Homo sapiens
aaacagcgcauaucuggaa

SEQ ID NO: 261220 - RNA, 19 nt, Homo sapiens
gcaugugacuguucuuugg

SEQ ID NO: 261221 - RNA, 19 nt, Homo sapiens
ggagaugagguucaauuug

SEQ ID NO: 261222 - RNA, 19 nt, Homo sapiens
gcaaacgugugagaugugu

SEQ ID NO: 261223 - RNA, 19 nt, Homo sapiens
gaaagucccaagugucaug

SEQ ID NO: 261224 - RNA, 19 nt, Homo sapiens
gugcucagucuuacuaaua

SEQ ID NO: 261225 - RNA, 19 nt, Homo sapiens
ggacuucagaauuggauuu

SEQ ID NO: 261226 - RNA, 19 nt, Homo sapiens
cagaggauauuacucagau

SEQ ID NO: 261227 - RNA, 19 nt, Homo sapiens
gggcaaacgugugagaugu

SEQ ID NO: 261228 - RNA, 19 nt, Homo sapiens
gcaaaggaacagcagagaa

SEQ ID NO: 261229 - RNA, 19 nt, Homo sapiens
uagauccaauggcuuaauu

SEQ ID NO: 261230 - RNA, 19 nt, Homo sapiens
gaauuggauuuggcucauu

SEQ ID NO: 261231 - RNA, 19 nt, Homo sapiens
ugcacgaugugaugauuua

SEQ ID NO: 261232 - RNA, 19 nt, Homo sapiens
uaacaacuguggucaaucc

SEQ ID NO: 261233 - RNA, 19 nt, Homo sapiens
uagaaagucgggacaaauu

SEQ ID NO: 261234 - RNA, 19 nt, Homo sapiens
aauuguagcuggugugguu

SEQ ID NO: 261235 - RNA, 19 nt, Homo sapiens
gcaaaugccaaaucaugug

SEQ ID NO: 261236 - RNA, 19 nt, Homo sapiens
agaaagucgggacaaauua

SEQ ID NO: 261237 - RNA, 19 nt, Homo sapiens
gagcauaaagaauguguuc

SEQ ID NO: 261238 - RNA, 19 nt, Homo sapiens
uccaauggcuuaauuugug

SEQ ID NO: 261239 - RNA, 19 nt, Homo sapiens
gaaguuaacagugaagaca

SEQ ID NO: 261240 - RNA, 19 nt, Homo sapiens
cagcacagaugaaguuaac

SEQ ID NO: 261241 - RNA, 19 nt, Homo sapiens
gaagaauuucagccuguuu

SEQ ID NO: 261242 - RNA, 19 nt, Homo sapiens
aaugaaaugaggaggauua

SEQ ID NO: 261243 - RNA, 19 nt, Homo sapiens
cugcugauauggaagcuuu

SEQ ID NO: 261244 - RNA, 19 nt, Homo sapiens
caacugugauagauccaau

SEQ ID NO: 261245 - RNA, 19 nt, Homo sapiens
uagagguuauucuucagua

SEQ ID NO: 261246 - RNA, 19 nt, Homo sapiens
cagcgcauaucuggaaauu

SEQ ID NO: 261247 - RNA, 19 nt, Homo sapiens
caaaggaacagcagagaag

SEQ ID NO: 261248 - RNA, 19 nt, Homo sapiens
cagaggcuccaaagauaua

SEQ ID NO: 261249 - RNA, 19 nt, Homo sapiens
gauccaauggcuuaauuug

SEQ ID NO: 261250 - RNA, 19 nt, Homo sapiens
gaaaacaguucagaaaucu

SEQ ID NO: 261251 - RNA, 19 nt, Homo sapiens
caagugucaugaaggaaau

SEQ ID NO: 261252 - RNA, 19 nt, Homo sapiens
gucagaaggaguaacaaua

SEQ ID NO: 261253 - RNA, 19 nt, Homo sapiens
gaggauuacuucggacuuc

SEQ ID NO: 261254 - RNA, 19 nt, Homo sapiens
ugaaagacgauuuggagaa

SEQ ID NO: 261255 - RNA, 19 nt, Homo sapiens
gccacagacauuuacauua

SEQ ID NO: 261256 - RNA, 19 nt, Homo sapiens
gcaguugguuuugcgauua

SEQ ID NO: 261257 - RNA, 19 nt, Homo sapiens
gaacagcagagaagcucaa

SEQ ID NO: 261258 - RNA, 19 nt, Homo sapiens
ggaaaugguguuugcaagu

SEQ ID NO: 261259 - RNA, 19 nt, Homo sapiens
gcgaaggcaucccugaaag

SEQ ID NO: 261260 - RNA, 19 nt, Homo sapiens
gcucagucuuacuaauaaa

SEQ ID NO: 261261 - RNA, 19 nt, Homo sapiens
aaaagacugugaugccuua

SEQ ID NO: 261262 - RNA, 19 nt, Homo sapiens
aagggaguuugcuaaauuu

SEQ ID NO: 261263 - RNA, 19 nt, Homo sapiens
acaacgaggucaugguuca

SEQ ID NO: 261264 - RNA, 19 nt, Homo sapiens
cugauuggcuggaggaaug

SEQ ID NO: 261265 - RNA, 19 nt, Homo sapiens
gcaccagcccauuuagcua

SEQ ID NO: 261266 - RNA, 19 nt, Homo sapiens
guccagacaucauuccaau

SEQ ID NO: 261267 - RNA, 19 nt, Homo sapiens
gaaagucgggacaaauuac

SEQ ID NO: 261268 - RNA, 19 nt, Homo sapiens
guguacagauccgaaguuu

SEQ ID NO: 261269 - RNA, 19 nt, Homo sapiens
guaggaagagggauaauac

SEQ ID NO: 261270 - RNA, 19 nt, Homo sapiens
ccaagugucaugaaggaaa

SEQ ID NO: 261271 - RNA, 19 nt, Homo sapiens
aaguagagguuauucuuca

SEQ ID NO: 261272 - RNA, 19 nt, Homo sapiens
cguaacaacuguggucaau

SEQ ID NO: 261273 - RNA, 19 nt, Homo sapiens
gaucugaugaaugaaauga

SEQ ID NO: 261274 - RNA, 19 nt, Homo sapiens
cauuacugcugauauggaa

SEQ ID NO: 261275 - RNA, 19 nt, Homo sapiens
ugacgacuguugguucuau

SEQ ID NO: 261276 - RNA, 19 nt, Homo sapiens
uguggugucuguaagugua

SEQ ID NO: 261277 - RNA, 19 nt, Homo sapiens
gaggaaaugguguuugcaa

SEQ ID NO: 261278 - RNA, 19 nt, Homo sapiens
gaacagaucugaugaauga

SEQ ID NO: 261279 - RNA, 19 nt, Homo sapiens
caagagagcugaagacuau

SEQ ID NO: 261280 - RNA, 19 nt, Homo sapiens
gaagggaguuugcuaaauu

SEQ ID NO: 261281 - RNA, 19 nt, Homo sapiens
ccacagacauuuacauuaa

SEQ ID NO: 261282 - RNA, 19 nt, Homo sapiens
gcgcauaucuggaaauuug

SEQ ID NO: 261283 - RNA, 19 nt, Homo sapiens
gaagagggauaauacaaau

SEQ ID NO: 261284 - RNA, 19 nt, Homo sapiens
gugaagacauggaugcuua

SEQ ID NO: 261285 - RNA, 19 nt, Homo sapiens
guaauucaguugaucauug

SEQ ID NO: 261286 - RNA, 19 nt, Homo sapiens
gaaagacgauuuggagaau

SEQ ID NO: 261287 - RNA, 19 nt, Homo sapiens
gaaaugaggaggauuacuu

SEQ ID NO: 261288 - RNA, 19 nt, Homo sapiens
caaaucauguggagaaugu

SEQ ID NO: 261289 - RNA, 19 nt, Homo sapiens
guacagauccgaaguuuca

SEQ ID NO: 261290 - RNA, 19 nt, Homo sapiens
gaacugcaccagcccauuu

SEQ ID NO: 261291 - RNA, 19 nt, Homo sapiens
ggaguuugcuaaauuugaa

SEQ ID NO: 261292 - RNA, 19 nt, Homo sapiens
gugcagagccuucaauaaa

SEQ ID NO: 261293 - RNA, 19 nt, Homo sapiens
cagaugaaguuaacaguga

SEQ ID NO: 261294 - RNA, 19 nt, Homo sapiens
gaacaacgaggucaugguu

SEQ ID NO: 261295 - RNA, 19 nt, Homo sapiens
gaaaugguguuugcaagug

SEQ ID NO: 261296 - RNA, 19 nt, Homo sapiens
gaaacuugguggcauuguu

SEQ ID NO: 261297 - RNA, 19 nt, Homo sapiens
uaaagcuggucucuaaauu

SEQ ID NO: 261298 - RNA, 19 nt, Homo sapiens
ggaagagggauaauacaaa

SEQ ID NO: 261299 - RNA, 19 nt, Homo sapiens
caaauugucagaaggagua

SEQ ID NO: 261300 - RNA, 19 nt, Homo sapiens
ggagaaguauuuaaugaac

SEQ ID NO: 261301 - RNA, 19 nt, Homo sapiens
acguaaagcuggucucuaa

SEQ ID NO: 261302 - RNA, 19 nt, Homo sapiens
cccagaggcuccaaagaua

SEQ ID NO: 261303 - RNA, 19 nt, Homo sapiens
agacaucauuccaauugua

SEQ ID NO: 261304 - RNA, 19 nt, Homo sapiens
gauccugugucccauugua

SEQ ID NO: 261305 - RNA, 19 nt, Homo sapiens
ggaaguagagguuauucuu

SEQ ID NO: 261306 - RNA, 19 nt, Homo sapiens
gcugaagacuaucccauug

SEQ ID NO: 261307 - RNA, 19 nt, Homo sapiens
gaaaaugaaugccaaaugg

SEQ ID NO: 261308 - RNA, 19 nt, Homo sapiens
gcaagugucguguguguga

SEQ ID NO: 261309 - RNA, 19 nt, Homo sapiens
gugauaauuucaacuguga

SEQ ID NO: 261310 - RNA, 19 nt, Homo sapiens
ucagaaggaguaacaauaa

SEQ ID NO: 261311 - RNA, 19 nt, Homo sapiens
gaaggaguaacaauaaguu

SEQ ID NO: 261312 - RNA, 19 nt, Homo sapiens
acaauucccuuuccucaga

SEQ ID NO: 261313 - RNA, 19 nt, Homo sapiens
gcaauguaauucaguugau

SEQ ID NO: 261314 - RNA, 19 nt, Homo sapiens
gaaggauguugacgacugu

SEQ ID NO: 261315 - RNA, 19 nt, Homo sapiens
gguagaaagucgggacaaa

SEQ ID NO: 261316 - RNA, 19 nt, Homo sapiens
ccagacaucauuccaauug

SEQ ID NO: 261317 - RNA, 19 nt, Homo sapiens
guaaggagaaggauguuga

SEQ ID NO: 261318 - RNA, 19 nt, Homo sapiens
ugauagauccaauggcuua

SEQ ID NO: 261319 - RNA, 19 nt, Homo sapiens
gaaaucugcaguaacaaug

SEQ ID NO: 261320 - RNA, 19 nt, Homo sapiens
aaacagcgcauaucuggaa

SEQ ID NO: 261321 - RNA, 19 nt, Homo sapiens
gcaugugacuguucuuugg

SEQ ID NO: 261322 - RNA, 19 nt, Homo sapiens
ggagaugagguucaauuug

SEQ ID NO: 261323 - RNA, 19 nt, Homo sapiens
gcaaacgugugagaugugu

SEQ ID NO: 261324 - RNA, 19 nt, Homo sapiens
gaaagucccaagugucaug

SEQ ID NO: 261325 - RNA, 19 nt, Homo sapiens
gugcucagucuuacuaaua

SEQ ID NO: 261326 - RNA, 19 nt, Homo sapiens
ggacuucagaauuggauuu

SEQ ID NO: 261327 - RNA, 19 nt, Homo sapiens
cagaggauauuacucagau

SEQ ID NO: 261328 - RNA, 19 nt, Homo sapiens
gggcaaacgugugagaugu

SEQ ID NO: 261329 - RNA, 19 nt, Homo sapiens
gcaaaggaacagcagagaa

SEQ ID NO: 261330 - RNA, 19 nt, Homo sapiens
uagauccaauggcuuaauu

SEQ ID NO: 261331 - RNA, 19 nt, Homo sapiens
gaauuggauuuggcucauu

SEQ ID NO: 261332 - RNA, 19 nt, Homo sapiens
ugcacgaugugaugauuua

SEQ ID NO: 261333 - RNA, 19 nt, Homo sapiens
uaacaacuguggucaaucc

SEQ ID NO: 261334 - RNA, 19 nt, Homo sapiens
guaaagcuggucucuaaau

SEQ ID NO: 261335 - RNA, 19 nt, Homo sapiens
uagaaagucgggacaaauu

SEQ ID NO: 261336 - RNA, 19 nt, Homo sapiens
aauuguagcuggugugguu

SEQ ID NO: 261337 - RNA, 19 nt, Homo sapiens
gcaaaugccaaaucaugug

SEQ ID NO: 261338 - RNA, 19 nt, Homo sapiens
agaaagucgggacaaauua

SEQ ID NO: 261339 - RNA, 19 nt, Homo sapiens
gagcauaaagaauguguuc

SEQ ID NO: 261340 - RNA, 19 nt, Homo sapiens
uccaauggcuuaauuugug

SEQ ID NO: 261341 - RNA, 19 nt, Homo sapiens
gaaguuaacagugaagaca

SEQ ID NO: 261342 - RNA, 19 nt, Homo sapiens
cagcacagaugaaguuaac

SEQ ID NO: 261343 - RNA, 19 nt, Homo sapiens
gaagaauuucagccuguuu

SEQ ID NO: 261344 - RNA, 19 nt, Homo sapiens
aaugaaaugaggaggauua

SEQ ID NO: 261345 - RNA, 19 nt, Homo sapiens
cugcugauauggaagcuuu

SEQ ID NO: 261346 - RNA, 19 nt, Homo sapiens
caacugugauagauccaau

SEQ ID NO: 261347 - RNA, 19 nt, Homo sapiens
uagagguuauucuucagua

SEQ ID NO: 261348 - RNA, 19 nt, Homo sapiens
cagcgcauaucuggaaauu

SEQ ID NO: 261349 - RNA, 19 nt, Homo sapiens
caaaggaacagcagagaag

SEQ ID NO: 261350 - RNA, 19 nt, Homo sapiens
cagaggcuccaaagauaua

SEQ ID NO: 261351 - RNA, 19 nt, Homo sapiens
gauccaauggcuuaauuug

SEQ ID NO: 261352 - RNA, 19 nt, Homo sapiens
gaaaacaguucagaaaucu

SEQ ID NO: 261353 - RNA, 19 nt, Homo sapiens
caagugucaugaaggaaau

SEQ ID NO: 261354 - RNA, 19 nt, Homo sapiens
gucagaaggaguaacaaua

SEQ ID NO: 261355 - RNA, 19 nt, Homo sapiens
gaggauuacuucggacuuc

SEQ ID NO: 261356 - RNA, 19 nt, Homo sapiens
ugaaagacgauuuggagaa

SEQ ID NO: 261357 - RNA, 19 nt, Homo sapiens
gccacagacauuuacauua

SEQ ID NO: 261358 - RNA, 19 nt, Homo sapiens
gcaguugguuuugcgauua

SEQ ID NO: 261359 - RNA, 19 nt, Homo sapiens
gaacagcagagaagcucaa

SEQ ID NO: 261360 - RNA, 19 nt, Homo sapiens
ggaaaugguguuugcaagu

SEQ ID NO: 261361 - RNA, 19 nt, Homo sapiens
gcgaaggcaucccugaaag

SEQ ID NO: 261362 - RNA, 19 nt, Homo sapiens
gcucagucuuacuaauaaa

SEQ ID NO: 261363 - RNA, 19 nt, Homo sapiens
aaaagacugugaugccuua

SEQ ID NO: 261364 - RNA, 19 nt, Homo sapiens
aagggaguuugcuaaauuu

SEQ ID NO: 261365 - RNA, 19 nt, Homo sapiens
acaacgaggucaugguuca

SEQ ID NO: 261366 - RNA, 19 nt, Homo sapiens
cugauuggcuggaggaaug

SEQ ID NO: 261367 - RNA, 19 nt, Homo sapiens
gcaccagcccauuuagcua

SEQ ID NO: 261368 - RNA, 19 nt, Homo sapiens
ccaaaugggacacgcaaga

SEQ ID NO: 261369 - RNA, 19 nt, Homo sapiens
guccagacaucauuccaau

SEQ ID NO: 261370 - RNA, 19 nt, Homo sapiens
gaaagucgggacaaauuac

SEQ ID NO: 261371 - RNA, 19 nt, Homo sapiens
guguacagauccgaaguuu

SEQ ID NO: 261372 - RNA, 19 nt, Homo sapiens
guaggaagagggauaauac

SEQ ID NO: 261373 - RNA, 19 nt, Homo sapiens
ccaagugucaugaaggaaa

SEQ ID NO: 261374 - RNA, 19 nt, Homo sapiens
aaguagagguuauucuuca

SEQ ID NO: 261375 - RNA, 19 nt, Homo sapiens
cguaacaacuguggucaau

SEQ ID NO: 261376 - RNA, 19 nt, Homo sapiens
gaucugaugaaugaaauga

SEQ ID NO: 261377 - RNA, 19 nt, Homo sapiens
cauuacugcugauauggaa

SEQ ID NO: 261378 - RNA, 19 nt, Homo sapiens
gaacagaucugaugaauga

SEQ ID NO: 261379 - RNA, 19 nt, Homo sapiens
caagagagcugaagacuau

SEQ ID NO: 261380 - RNA, 19 nt, Homo sapiens
gaagggaguuugcuaaauu

SEQ ID NO: 261381 - RNA, 19 nt, Homo sapiens
ccacagacauuuacauuaa

SEQ ID NO: 261382 - RNA, 19 nt, Homo sapiens
gcgcauaucuggaaauuug

SEQ ID NO: 261383 - RNA, 19 nt, Homo sapiens
gaagagggauaauacaaau

SEQ ID NO: 261384 - RNA, 19 nt, Homo sapiens
gugaagacauggaugcuua

SEQ ID NO: 261385 - RNA, 19 nt, Homo sapiens
ggagugcaguggugugaua

SEQ ID NO: 261386 - RNA, 19 nt, Homo sapiens
guaauucaguugaucauug

SEQ ID NO: 261387 - RNA, 19 nt, Homo sapiens
gaaagacgauuuggagaau

SEQ ID NO: 261388 - RNA, 19 nt, Homo sapiens
gaaaugaggaggauuacuu

SEQ ID NO: 261389 - RNA, 19 nt, Homo sapiens
caaaucauguggagaaugu

SEQ ID NO: 261390 - RNA, 19 nt, Homo sapiens
guacagauccgaaguuuca

SEQ ID NO: 261391 - RNA, 19 nt, Homo sapiens
gaacugcaccagcccauuu

SEQ ID NO: 261392 - RNA, 19 nt, Homo sapiens
ggaguuugcuaaauuugaa

SEQ ID NO: 261393 - RNA, 19 nt, Homo sapiens
gugcagagccuucaauaaa

SEQ ID NO: 261394 - RNA, 19 nt, Homo sapiens
cagaugaaguuaacaguga

SEQ ID NO: 261395 - RNA, 19 nt, Homo sapiens
gaacaacgaggucaugguu

SEQ ID NO: 261396 - RNA, 19 nt, Homo sapiens
gaaaugguguuugcaagug

SEQ ID NO: 261397 - RNA, 19 nt, Homo sapiens
gaaacuugguggcauuguu

SEQ ID NO: 261398 - RNA, 19 nt, Homo sapiens
ggaagagggauaauacaaa

SEQ ID NO: 261399 - RNA, 19 nt, Homo sapiens
caaauugucagaaggagua

SEQ ID NO: 261400 - RNA, 19 nt, Homo sapiens
ggagaaguauuuaaugaac

SEQ ID NO: 261401 - RNA, 19 nt, Homo sapiens
cccagaggcuccaaagaua

SEQ ID NO: 261402 - RNA, 19 nt, Homo sapiens
agacaucauuccaauugua

SEQ ID NO: 261403 - RNA, 19 nt, Homo sapiens
gauccugugucccauugua

SEQ ID NO: 261404 - RNA, 19 nt, Homo sapiens
ggaaguagagguuauucuu

SEQ ID NO: 261405 - RNA, 19 nt, Homo sapiens
gcugaagacuaucccauug

SEQ ID NO: 261406 - RNA, 19 nt, Homo sapiens
gaaaaugaaugccaaaugg

SEQ ID NO: 261407 - RNA, 19 nt, Homo sapiens
gcaagugucguguguguga

SEQ ID NO: 261408 - RNA, 19 nt, Homo sapiens
gugauaauuucaacuguga

SEQ ID NO: 261409 - RNA, 19 nt, Homo sapiens
ucagaaggaguaacaauaa

SEQ ID NO: 261410 - RNA, 19 nt, Homo sapiens
gaaggaguaacaauaaguu

SEQ ID NO: 261411 - RNA, 19 nt, Homo sapiens
acaauucccuuuccucaga

SEQ ID NO: 261412 - RNA, 19 nt, Homo sapiens
gcaauguaauucaguugau

SEQ ID NO: 261413 - RNA, 19 nt, Homo sapiens
gaaggauguugacgacugu

SEQ ID NO: 261414 - RNA, 19 nt, Homo sapiens
gguagaaagucgggacaaa

SEQ ID NO: 261415 - RNA, 19 nt, Homo sapiens
ccagacaucauuccaauug

SEQ ID NO: 261416 - RNA, 19 nt, Homo sapiens
guaaggagaaggauguuga

SEQ ID NO: 261417 - RNA, 19 nt, Homo sapiens
ugauagauccaauggcuua

SEQ ID NO: 261418 - RNA, 19 nt, Homo sapiens
gaaaucugcaguaacaaug

SEQ ID NO: 261419 - RNA, 19 nt, Homo sapiens
aaacagcgcauaucuggaa

SEQ ID NO: 261420 - RNA, 19 nt, Homo sapiens
gcaugugacuguucuuugg

SEQ ID NO: 261421 - RNA, 19 nt, Homo sapiens
ggagaugagguucaauuug

SEQ ID NO: 261422 - RNA, 19 nt, Homo sapiens
gcaaacgugugagaugugu

SEQ ID NO: 261423 - RNA, 19 nt, Homo sapiens
gaaagucccaagugucaug

SEQ ID NO: 261424 - RNA, 19 nt, Homo sapiens
gugcucagucuuacuaaua

SEQ ID NO: 261425 - RNA, 19 nt, Homo sapiens
ggacuucagaauuggauuu

SEQ ID NO: 261426 - RNA, 19 nt, Homo sapiens
cagaggauauuacucagau

SEQ ID NO: 261427 - RNA, 19 nt, Homo sapiens
gggcaaacgugugagaugu

SEQ ID NO: 261428 - RNA, 19 nt, Homo sapiens
gcaaaggaacagcagagaa

SEQ ID NO: 261429 - RNA, 19 nt, Homo sapiens
uagauccaauggcuuaauu

SEQ ID NO: 261430 - RNA, 19 nt, Homo sapiens
gaauuggauuuggcucauu

SEQ ID NO: 261431 - RNA, 19 nt, Homo sapiens
ugcacgaugugaugauuua

SEQ ID NO: 261432 - RNA, 19 nt, Homo sapiens
uaacaacuguggucaaucc

SEQ ID NO: 261433 - RNA, 19 nt, Homo sapiens
uagaaagucgggacaaauu

SEQ ID NO: 261434 - RNA, 19 nt, Homo sapiens
aauuguagcuggugugguu

SEQ ID NO: 261435 - RNA, 19 nt, Homo sapiens
gcaaaugccaaaucaugug

SEQ ID NO: 261436 - RNA, 19 nt, Homo sapiens
agaaagucgggacaaauua

SEQ ID NO: 261437 - RNA, 19 nt, Homo sapiens
gagcauaaagaauguguuc

SEQ ID NO: 261438 - RNA, 19 nt, Homo sapiens
uccaauggcuuaauuugug

SEQ ID NO: 261439 - RNA, 19 nt, Homo sapiens
gaaguuaacagugaagaca

SEQ ID NO: 261440 - RNA, 19 nt, Homo sapiens
cagcacagaugaaguuaac

SEQ ID NO: 261441 - RNA, 19 nt, Homo sapiens
gaagaauuucagccuguuu

SEQ ID NO: 261442 - RNA, 19 nt, Homo sapiens
aaugaaaugaggaggauua

SEQ ID NO: 261443 - RNA, 19 nt, Homo sapiens
cugcugauauggaagcuuu

SEQ ID NO: 261444 - RNA, 19 nt, Homo sapiens
caacugugauagauccaau

SEQ ID NO: 261445 - RNA, 19 nt, Homo sapiens
uagagguuauucuucagua

SEQ ID NO: 261446 - RNA, 19 nt, Homo sapiens
cagcgcauaucuggaaauu

SEQ ID NO: 261447 - RNA, 19 nt, Homo sapiens
caaaggaacagcagagaag

SEQ ID NO: 261448 - RNA, 19 nt, Homo sapiens
cagaggcuccaaagauaua

SEQ ID NO: 261449 - RNA, 19 nt, Homo sapiens
gauccaauggcuuaauuug

SEQ ID NO: 261450 - RNA, 19 nt, Homo sapiens
gaaaacaguucagaaaucu

SEQ ID NO: 261451 - RNA, 19 nt, Homo sapiens
caagugucaugaaggaaau

SEQ ID NO: 261452 - RNA, 19 nt, Homo sapiens
gucagaaggaguaacaaua

SEQ ID NO: 261453 - RNA, 19 nt, Homo sapiens
gaggauuacuucggacuuc

SEQ ID NO: 261454 - RNA, 19 nt, Homo sapiens
ugaaagacgauuuggagaa

SEQ ID NO: 261455 - RNA, 19 nt, Homo sapiens
gccacagacauuuacauua

SEQ ID NO: 261456 - RNA, 19 nt, Homo sapiens
gcaguugguuuugcgauua

SEQ ID NO: 261457 - RNA, 19 nt, Homo sapiens
gaacagcagagaagcucaa

SEQ ID NO: 261458 - RNA, 19 nt, Homo sapiens
ggaaaugguguuugcaagu

SEQ ID NO: 261459 - RNA, 19 nt, Homo sapiens
gcgaaggcaucccugaaag

SEQ ID NO: 261460 - RNA, 19 nt, Homo sapiens
gcucagucuuacuaauaaa

SEQ ID NO: 261461 - RNA, 19 nt, Homo sapiens
aaaagacugugaugccuua

SEQ ID NO: 261462 - RNA, 19 nt, Homo sapiens
aagggaguuugcuaaauuu

SEQ ID NO: 261463 - RNA, 19 nt, Homo sapiens
acaacgaggucaugguuca

SEQ ID NO: 261464 - RNA, 19 nt, Homo sapiens
cugauuggcuggaggaaug

SEQ ID NO: 261465 - RNA, 19 nt, Homo sapiens
gcaccagcccauuuagcua

SEQ ID NO: 261466 - RNA, 19 nt, Homo sapiens
guccagacaucauuccaau

SEQ ID NO: 261467 - RNA, 19 nt, Homo sapiens
gaaagucgggacaaauuac

SEQ ID NO: 261468 - RNA, 19 nt, Homo sapiens
guguacagauccgaaguuu

SEQ ID NO: 261469 - RNA, 19 nt, Homo sapiens
guaggaagagggauaauac

SEQ ID NO: 261470 - RNA, 19 nt, Homo sapiens
ccaagugucaugaaggaaa

SEQ ID NO: 261471 - RNA, 19 nt, Homo sapiens
aaguagagguuauucuuca

SEQ ID NO: 261472 - RNA, 19 nt, Homo sapiens
cguaacaacuguggucaau

SEQ ID NO: 261473 - RNA, 19 nt, Homo sapiens
gaucugaugaaugaaauga

SEQ ID NO: 261474 - RNA, 19 nt, Homo sapiens
cauuacugcugauauggaa

SEQ ID NO: 261475 - RNA, 19 nt, Homo sapiens
ugacgacuguugguucuau

SEQ ID NO: 261476 - RNA, 19 nt, Homo sapiens
uguggugucuguaagugua

SEQ ID NO: 261477 - RNA, 19 nt, Homo sapiens
gaggaaaugguguuugcaa

SEQ ID NO: 261478 - RNA, 19 nt, Homo sapiens
gaacagaucugaugaauga

SEQ ID NO: 261479 - RNA, 19 nt, Homo sapiens
caagagagcugaagacuau

SEQ ID NO: 261480 - RNA, 19 nt, Homo sapiens
gaagggaguuugcuaaauu

SEQ ID NO: 261481 - RNA, 19 nt, Homo sapiens
ccacagacauuuacauuaa

SEQ ID NO: 261482 - RNA, 19 nt, Homo sapiens
gcgcauaucuggaaauuug

SEQ ID NO: 261483 - RNA, 19 nt, Homo sapiens
gaagagggauaauacaaau

SEQ ID NO: 261484 - RNA, 19 nt, Homo sapiens
gugaagacauggaugcuua

SEQ ID NO: 261485 - RNA, 19 nt, Homo sapiens
guaauucaguugaucauug

SEQ ID NO: 261486 - RNA, 19 nt, Homo sapiens
gaaagacgauuuggagaau

SEQ ID NO: 261487 - RNA, 19 nt, Homo sapiens
gaaaugaggaggauuacuu

SEQ ID NO: 261488 - RNA, 19 nt, Homo sapiens
caaaucauguggagaaugu

SEQ ID NO: 261489 - RNA, 19 nt, Homo sapiens
guacagauccgaaguuuca

SEQ ID NO: 261490 - RNA, 19 nt, Homo sapiens
gaacugcaccagcccauuu

SEQ ID NO: 261491 - RNA, 19 nt, Homo sapiens
ggaguuugcuaaauuugaa

SEQ ID NO: 261492 - RNA, 19 nt, Homo sapiens
gugcagagccuucaauaaa

SEQ ID NO: 261493 - RNA, 19 nt, Homo sapiens
cagaugaaguuaacaguga

SEQ ID NO: 261494 - RNA, 19 nt, Homo sapiens
gaacaacgaggucaugguu

SEQ ID NO: 261495 - RNA, 19 nt, Homo sapiens
gaaaugguguuugcaagug

SEQ ID NO: 261496 - RNA, 19 nt, Homo sapiens
gaaacuugguggcauuguu

SEQ ID NO: 261497 - RNA, 19 nt, Homo sapiens
ggaagagggauaauacaaa

SEQ ID NO: 261498 - RNA, 19 nt, Homo sapiens
caaauugucagaaggagua

SEQ ID NO: 261499 - RNA, 19 nt, Homo sapiens
ggagaaguauuuaaugaac

SEQ ID NO: 261500 - RNA, 19 nt, Homo sapiens
ggcaagcgcagaugaauuu

SEQ ID NO: 261501 - RNA, 19 nt, Homo sapiens
cccagaggcuccaaagaua

SEQ ID NO: 261502 - RNA, 19 nt, Homo sapiens
gcagaugaauuuacaacca

SEQ ID NO: 261503 - RNA, 19 nt, Homo sapiens
agacaucauuccaauugua

SEQ ID NO: 261504 - RNA, 19 nt, Homo sapiens
gauccugugucccauugua

SEQ ID NO: 261505 - RNA, 19 nt, Homo sapiens
ggaaguagagguuauucuu

SEQ ID NO: 261506 - RNA, 19 nt, Homo sapiens
gcugaagacuaucccauug

SEQ ID NO: 261507 - RNA, 19 nt, Homo sapiens
gaaaaugaaugccaaaugg

SEQ ID NO: 261508 - RNA, 19 nt, Homo sapiens
gcaagugucguguguguga

SEQ ID NO: 261509 - RNA, 19 nt, Homo sapiens
gugauaauuucaacuguga

SEQ ID NO: 261510 - RNA, 19 nt, Homo sapiens
ucagaaggaguaacaauaa

SEQ ID NO: 261511 - RNA, 19 nt, Homo sapiens
gaaggaguaacaauaaguu

SEQ ID NO: 261512 - RNA, 19 nt, Homo sapiens
acaauucccuuuccucaga

SEQ ID NO: 261513 - RNA, 19 nt, Homo sapiens
gcaauguaauucaguugau

SEQ ID NO: 261514 - RNA, 19 nt, Homo sapiens
gaaggauguugacgacugu

SEQ ID NO: 261515 - RNA, 19 nt, Homo sapiens
gguagaaagucgggacaaa

SEQ ID NO: 261516 - RNA, 19 nt, Homo sapiens
ccagacaucauuccaauug

SEQ ID NO: 261517 - RNA, 19 nt, Homo sapiens
guaaggagaaggauguuga

SEQ ID NO: 261518 - RNA, 19 nt, Homo sapiens
ugauagauccaauggcuua

SEQ ID NO: 261519 - RNA, 19 nt, Homo sapiens
gaaaucugcaguaacaaug

SEQ ID NO: 261520 - RNA, 19 nt, Homo sapiens
aaacagcgcauaucuggaa

SEQ ID NO: 261521 - RNA, 19 nt, Homo sapiens
gcaugugacuguucuuugg

SEQ ID NO: 261522 - RNA, 19 nt, Homo sapiens
ggagaugagguucaauuug

SEQ ID NO: 261523 - RNA, 19 nt, Homo sapiens
gcaaacgugugagaugugu

SEQ ID NO: 261524 - RNA, 19 nt, Homo sapiens
gaaagucccaagugucaug

SEQ ID NO: 261525 - RNA, 19 nt, Homo sapiens
gugcucagucuuacuaaua

SEQ ID NO: 261526 - RNA, 19 nt, Homo sapiens
ggacuucagaauuggauuu

SEQ ID NO: 261527 - RNA, 19 nt, Homo sapiens
cagaggauauuacucagau

SEQ ID NO: 261528 - RNA, 19 nt, Homo sapiens
gggcaaacgugugagaugu

SEQ ID NO: 261529 - RNA, 19 nt, Homo sapiens
gcaaaggaacagcagagaa

SEQ ID NO: 261530 - RNA, 19 nt, Homo sapiens
cagaugaauuuacaaccaa

SEQ ID NO: 261531 - RNA, 19 nt, Homo sapiens
uagauccaauggcuuaauu

SEQ ID NO: 261532 - RNA, 19 nt, Homo sapiens
gaauuggauuuggcucauu

SEQ ID NO: 261533 - RNA, 19 nt, Homo sapiens
ugcacgaugugaugauuua

SEQ ID NO: 261534 - RNA, 19 nt, Homo sapiens
uaacaacuguggucaaucc

SEQ ID NO: 261535 - RNA, 19 nt, Homo sapiens
uagaaagucgggacaaauu

SEQ ID NO: 261536 - RNA, 19 nt, Homo sapiens
aauuguagcuggugugguu

SEQ ID NO: 261537 - RNA, 19 nt, Homo sapiens
agaaagucgggacaaauua

SEQ ID NO: 261538 - RNA, 19 nt, Homo sapiens
gcaaaugccaaaucaugug

SEQ ID NO: 261539 - RNA, 19 nt, Homo sapiens
gagcauaaagaauguguuc

SEQ ID NO: 261540 - RNA, 19 nt, Homo sapiens
uccaauggcuuaauuugug

SEQ ID NO: 261541 - RNA, 19 nt, Homo sapiens
gaaguuaacagugaagaca

SEQ ID NO: 261542 - RNA, 19 nt, Homo sapiens
cagcacagaugaaguuaac

SEQ ID NO: 261543 - RNA, 19 nt, Homo sapiens
gaagaauuucagccuguuu

SEQ ID NO: 261544 - RNA, 19 nt, Homo sapiens
aaugaaaugaggaggauua

SEQ ID NO: 261545 - RNA, 19 nt, Homo sapiens
cugcugauauggaagcuuu

SEQ ID NO: 261546 - RNA, 19 nt, Homo sapiens
caacugugauagauccaau

SEQ ID NO: 261547 - RNA, 19 nt, Homo sapiens
uagagguuauucuucagua

SEQ ID NO: 261548 - RNA, 19 nt, Homo sapiens
cagcgcauaucuggaaauu

SEQ ID NO: 261549 - RNA, 19 nt, Homo sapiens
caaaggaacagcagagaag

SEQ ID NO: 261550 - RNA, 19 nt, Homo sapiens
cagaggcuccaaagauaua

SEQ ID NO: 261551 - RNA, 19 nt, Homo sapiens
gauccaauggcuuaauuug

SEQ ID NO: 261552 - RNA, 19 nt, Homo sapiens
gaaaacaguucagaaaucu

SEQ ID NO: 261553 - RNA, 19 nt, Homo sapiens
caagugucaugaaggaaau

SEQ ID NO: 261554 - RNA, 19 nt, Homo sapiens
gucagaaggaguaacaaua

SEQ ID NO: 261555 - RNA, 19 nt, Homo sapiens
gaggauuacuucggacuuc

SEQ ID NO: 261556 - RNA, 19 nt, Homo sapiens
ugaaagacgauuuggagaa

SEQ ID NO: 261557 - RNA, 19 nt, Homo sapiens
gccacagacauuuacauua

SEQ ID NO: 261558 - RNA, 19 nt, Homo sapiens
gcaguugguuuugcgauua

SEQ ID NO: 261559 - RNA, 19 nt, Homo sapiens
gaacagcagagaagcucaa

SEQ ID NO: 261560 - RNA, 19 nt, Homo sapiens
ggaaaugguguuugcaagu

SEQ ID NO: 261561 - RNA, 19 nt, Homo sapiens
gcgaaggcaucccugaaag

SEQ ID NO: 261562 - RNA, 19 nt, Homo sapiens
gcucagucuuacuaauaaa

SEQ ID NO: 261563 - RNA, 19 nt, Homo sapiens
aaaagacugugaugccuua

SEQ ID NO: 261564 - RNA, 19 nt, Homo sapiens
aagggaguuugcuaaauuu

SEQ ID NO: 261565 - RNA, 19 nt, Homo sapiens
acaacgaggucaugguuca

SEQ ID NO: 261566 - RNA, 19 nt, Homo sapiens
cugauuggcuggaggaaug

SEQ ID NO: 261567 - RNA, 19 nt, Homo sapiens
gcaccagcccauuuagcua

SEQ ID NO: 261568 - RNA, 19 nt, Homo sapiens
guccagacaucauuccaau

SEQ ID NO: 261569 - RNA, 19 nt, Homo sapiens
gaaagucgggacaaauuac

SEQ ID NO: 261570 - RNA, 19 nt, Homo sapiens
guguacagauccgaaguuu

SEQ ID NO: 261571 - RNA, 19 nt, Homo sapiens
guaggaagagggauaauac

SEQ ID NO: 261572 - RNA, 19 nt, Homo sapiens
ccaagugucaugaaggaaa

SEQ ID NO: 261573 - RNA, 19 nt, Homo sapiens
aaguagagguuauucuuca

SEQ ID NO: 261574 - RNA, 19 nt, Homo sapiens
cguaacaacuguggucaau

SEQ ID NO: 261575 - RNA, 19 nt, Homo sapiens
gaucugaugaaugaaauga

SEQ ID NO: 261576 - RNA, 19 nt, Homo sapiens
cauuacugcugauauggaa

SEQ ID NO: 261577 - RNA, 19 nt, Homo sapiens
ugacgacuguugguucuau

SEQ ID NO: 261578 - RNA, 19 nt, Homo sapiens
ccacagcucuugaggaugu

SEQ ID NO: 261579 - RNA, 19 nt, Homo sapiens
uugaggaugucaccaauua

SEQ ID NO: 261580 - RNA, 19 nt, Homo sapiens
ucaaucacguguauagaaa

SEQ ID NO: 261581 - RNA, 19 nt, Homo sapiens
gauuaaagguggugccaau

SEQ ID NO: 261582 - RNA, 19 nt, Homo sapiens
guuaaucaaucacguguau

SEQ ID NO: 261583 - RNA, 19 nt, Homo sapiens
gacaacaacuccaucaucu

SEQ ID NO: 261584 - RNA, 19 nt, Homo sapiens
gcaaggagagggacucaga

SEQ ID NO: 261585 - RNA, 19 nt, Homo sapiens
aaccagaaauccaguuauu

SEQ ID NO: 261586 - RNA, 19 nt, Homo sapiens
ggccacagcucuugaggau

SEQ ID NO: 261587 - RNA, 19 nt, Homo sapiens
ggacaacaacuccaucauc

SEQ ID NO: 261588 - RNA, 19 nt, Homo sapiens
ccaaguuugcugagaguua

SEQ ID NO: 261589 - RNA, 19 nt, Homo sapiens
ggugaagaccuacgagaaa

SEQ ID NO: 261590 - RNA, 19 nt, Homo sapiens
ccacaagccucgcugaaac

SEQ ID NO: 261591 - RNA, 19 nt, Homo sapiens
gaugacggcuuccauuucg

SEQ ID NO: 261592 - RNA, 19 nt, Homo sapiens
gagguuaggugcguguuuc

SEQ ID NO: 261593 - RNA, 19 nt, Homo sapiens
gguggugccaauuuauuua

SEQ ID NO: 261594 - RNA, 19 nt, Homo sapiens
gcccagaggugacugugau

SEQ ID NO: 261595 - RNA, 19 nt, Homo sapiens
ugaacacgcacccugauaa

SEQ ID NO: 261596 - RNA, 19 nt, Homo sapiens
ggccacagcugcucaugag

SEQ ID NO: 261597 - RNA, 19 nt, Homo sapiens
uuaaagguggugccaauuu

SEQ ID NO: 261598 - RNA, 19 nt, Homo sapiens
gcaaugugguccaucucau

SEQ ID NO: 261599 - RNA, 19 nt, Homo sapiens
gaacacgcacccugauaag

SEQ ID NO: 261600 - RNA, 19 nt, Homo sapiens
caaguuugcugagaguuag

SEQ ID NO: 261601 - RNA, 19 nt, Homo sapiens
ucacgcggcugcugguguu

SEQ ID NO: 261602 - RNA, 19 nt, Homo sapiens
ccaucgaccuguacuaucu

SEQ ID NO: 261603 - RNA, 19 nt, Homo sapiens
ggggacagcuccacucuga

SEQ ID NO: 261604 - RNA, 19 nt, Homo sapiens
ggaccgcuaccucaucuau

SEQ ID NO: 261605 - RNA, 19 nt, Homo sapiens
caggagcagucguuuguca

SEQ ID NO: 261606 - RNA, 19 nt, Homo sapiens
caacauccagcccaucuuc

SEQ ID NO: 261607 - RNA, 19 nt, Homo sapiens
caagaggagcaacgaauuc

SEQ ID NO: 261608 - RNA, 19 nt, Homo sapiens
gugacaccaucaacuguga

SEQ ID NO: 261609 - RNA, 19 nt, Homo sapiens
gaaacucaccgagaucauc

SEQ ID NO: 261610 - RNA, 19 nt, Homo sapiens
gagcaacgaauucgacuac

SEQ ID NO: 261611 - RNA, 19 nt, Homo sapiens
gaguacaggcgcuuugaga

SEQ ID NO: 261612 - RNA, 19 nt, Homo sapiens
gccugcagcugucgaacaa

SEQ ID NO: 261613 - RNA, 19 nt, Homo sapiens
ucugaggacuccagcaaug

SEQ ID NO: 261614 - RNA, 19 nt, Homo sapiens
guuaggagcacuuggugaa

SEQ ID NO: 261615 - RNA, 19 nt, Homo sapiens
gauaauccccuuuucaaga

SEQ ID NO: 261616 - RNA, 19 nt, Homo sapiens
uaggagcacuuggugaaga

SEQ ID NO: 261617 - RNA, 19 nt, Homo sapiens
gagaaacucaccgagauca

SEQ ID NO: 261618 - RNA, 19 nt, Homo sapiens
ccaguaggauggugaagac

SEQ ID NO: 261619 - RNA, 19 nt, Homo sapiens
ggacagcuccacucugacu

SEQ ID NO: 261620 - RNA, 19 nt, Homo sapiens
ugucaccaauuaaccagaa

SEQ ID NO: 261621 - RNA, 19 nt, Homo sapiens
guacaggcgcuuugagaag

SEQ ID NO: 261622 - RNA, 19 nt, Homo sapiens
ggaaggacaacaacuccau

SEQ ID NO: 261623 - RNA, 19 nt, Homo sapiens
acgagaaacucaccgagau

SEQ ID NO: 261624 - RNA, 19 nt, Homo sapiens
ccucaggaaugucaagaag

SEQ ID NO: 261625 - RNA, 19 nt, Homo sapiens
ccuacuccaugcuugauga

SEQ ID NO: 261626 - RNA, 19 nt, Homo sapiens
aaacuugucaggguauaaa

SEQ ID NO: 261627 - RNA, 19 nt, Homo sapiens
gugaacacgcacccugaua

SEQ ID NO: 261628 - RNA, 19 nt, Homo sapiens
ucaggaaugucaagaagcu

SEQ ID NO: 261629 - RNA, 19 nt, Homo sapiens
ugauggaccucuccuacuc

SEQ ID NO: 261630 - RNA, 19 nt, Homo sapiens
uaaucaaucacguguauag

SEQ ID NO: 261631 - RNA, 19 nt, Homo sapiens
acaagaggagcaacgaauu

SEQ ID NO: 261632 - RNA, 19 nt, Homo sapiens
gaagcugccggaaggacaa

SEQ ID NO: 261633 - RNA, 19 nt, Homo sapiens
ccagcaaugugguccaucu

SEQ ID NO: 261634 - RNA, 19 nt, Homo sapiens
ugcugaagcugaccaacaa

SEQ ID NO: 261635 - RNA, 19 nt, Homo sapiens
uugaugaccucaggaaugu

SEQ ID NO: 261636 - RNA, 19 nt, Homo sapiens
gcuugagguuggugagguu

SEQ ID NO: 261637 - RNA, 19 nt, Homo sapiens
ccaauuaaccagaaaucca

SEQ ID NO: 261638 - RNA, 19 nt, Homo sapiens
guacaagaggagcaacgaa

SEQ ID NO: 261639 - RNA, 19 nt, Homo sapiens
gggcuucacggacauagug

SEQ ID NO: 261640 - RNA, 19 nt, Homo sapiens
ccaccacgacggucaugaa

SEQ ID NO: 261641 - RNA, 19 nt, Homo sapiens
gugaagaccuacgagaaac

SEQ ID NO: 261642 - RNA, 19 nt, Homo sapiens
uuaaacuugucaggguaua

SEQ ID NO: 261643 - RNA, 19 nt, Homo sapiens
gaggaugucaccaauuaac

SEQ ID NO: 261644 - RNA, 19 nt, Homo sapiens
gcgcacaagcuggcugaaa

SEQ ID NO: 261645 - RNA, 19 nt, Homo sapiens
ggagcaacgaauucgacua

SEQ ID NO: 261646 - RNA, 19 nt, Homo sapiens
cgaccuguacuaucugaug

SEQ ID NO: 261647 - RNA, 19 nt, Homo sapiens
agaaggagaagcucaaguc

SEQ ID NO: 261648 - RNA, 19 nt, Homo sapiens
ggagcagucguuugucauc

SEQ ID NO: 261649 - RNA, 19 nt, Homo sapiens
ugguccaucucauuaagaa

SEQ ID NO: 261650 - RNA, 19 nt, Homo sapiens
ucucaggagugcacgaagu

SEQ ID NO: 261651 - RNA, 19 nt, Homo sapiens
cccaguggaacaaugauaa

SEQ ID NO: 261652 - RNA, 19 nt, Homo sapiens
ggucaugaaccccaaguuu

SEQ ID NO: 261653 - RNA, 19 nt, Homo sapiens
ggaugagagccgagagugu

SEQ ID NO: 261654 - RNA, 19 nt, Homo sapiens
ucaccuggaggacaacuug

SEQ ID NO: 261655 - RNA, 19 nt, Homo sapiens
ggugccaauuuauuuacau

SEQ ID NO: 261656 - RNA, 19 nt, Homo sapiens
aaagguggugccaauuuau

SEQ ID NO: 261657 - RNA, 19 nt, Homo sapiens
ggaugucaccaauuaacca

SEQ ID NO: 261658 - RNA, 19 nt, Homo sapiens
gggaguacaggcgcuuuga

SEQ ID NO: 261659 - RNA, 19 nt, Homo sapiens
cugaugacggcuuccauuu

SEQ ID NO: 261660 - RNA, 19 nt, Homo sapiens
ucaaugucccgaucaccuu

SEQ ID NO: 261661 - RNA, 19 nt, Homo sapiens
gaagaccuacgagaaacuc

SEQ ID NO: 261662 - RNA, 19 nt, Homo sapiens
cgcacaagcuggcugaaaa

SEQ ID NO: 261663 - RNA, 19 nt, Homo sapiens
gugcugaagcugaccaaca

SEQ ID NO: 261664 - RNA, 19 nt, Homo sapiens
uaaacuugucaggguauaa

SEQ ID NO: 261665 - RNA, 19 nt, Homo sapiens
ggcacagucuuugcaugga

SEQ ID NO: 261666 - RNA, 19 nt, Homo sapiens
gagaaggagaagcucaagu

SEQ ID NO: 261667 - RNA, 19 nt, Homo sapiens
accgcuaccucaucuaugu

SEQ ID NO: 261668 - RNA, 19 nt, Homo sapiens
cauagugaccgugcagguu

SEQ ID NO: 261669 - RNA, 19 nt, Homo sapiens
uacaagaggagcaacgaau

SEQ ID NO: 261670 - RNA, 19 nt, Homo sapiens
ucgggaagcagcugauuuc

SEQ ID NO: 261671 - RNA, 19 nt, Homo sapiens
ucgcugaaacccaggaaga

SEQ ID NO: 261672 - RNA, 19 nt, Homo sapiens
ccaguggaacaaugauaau

SEQ ID NO: 261673 - RNA, 19 nt, Homo sapiens
ugaugacggcuuccauuuc

SEQ ID NO: 261674 - RNA, 19 nt, Homo sapiens
ugacauacauccaacauua

SEQ ID NO: 261675 - RNA, 19 nt, Homo sapiens
gagcagguguucuucauua

SEQ ID NO: 261676 - RNA, 19 nt, Homo sapiens
agggagagcugaacuauua

SEQ ID NO: 261677 - RNA, 19 nt, Homo sapiens
gagaaguccuuuaccauaa

SEQ ID NO: 261678 - RNA, 19 nt, Homo sapiens
gaaaguccauccuguaugu

SEQ ID NO: 261679 - RNA, 19 nt, Homo sapiens
gaaaauccguucuaaagua

SEQ ID NO: 261680 - RNA, 19 nt, Homo sapiens
ccagaugccugcaccuuua

SEQ ID NO: 261681 - RNA, 19 nt, Homo sapiens
gcagugaauuguaccuaua

SEQ ID NO: 261682 - RNA, 19 nt, Homo sapiens
gaaaaccccugcuaugaua

SEQ ID NO: 261683 - RNA, 19 nt, Homo sapiens
ucacaacccuucagauuug

SEQ ID NO: 261684 - RNA, 19 nt, Homo sapiens
ggagaaguccuuuaccaua

SEQ ID NO: 261685 - RNA, 19 nt, Homo sapiens
gaaagaauguguggagugu

SEQ ID NO: 261686 - RNA, 19 nt, Homo sapiens
ggaaguccuugcaagcuaa

SEQ ID NO: 261687 - RNA, 19 nt, Homo sapiens
ccaccugccucaacaauga

SEQ ID NO: 261688 - RNA, 19 nt, Homo sapiens
gcucuacccugaguucaua

SEQ ID NO: 261689 - RNA, 19 nt, Homo sapiens
gcaaggaugcagugaauug

SEQ ID NO: 261690 - RNA, 19 nt, Homo sapiens
ggagguuuguuuagaagaa

SEQ ID NO: 261691 - RNA, 19 nt, Homo sapiens
gagaaucugcugaaggaua

SEQ ID NO: 261692 - RNA, 19 nt, Homo sapiens
gcugugaccugaaggagaa

SEQ ID NO: 261693 - RNA, 19 nt, Homo sapiens
guacagacacucccacuug

SEQ ID NO: 261694 - RNA, 19 nt, Homo sapiens
gggagagagugcuauugua

SEQ ID NO: 261695 - RNA, 19 nt, Homo sapiens
gcucuacucuggagguuug

SEQ ID NO: 261696 - RNA, 19 nt, Homo sapiens
gggaaguccuugcaagcua

SEQ ID NO: 261697 - RNA, 19 nt, Homo sapiens
ccaacaacccacuguauaa

SEQ ID NO: 261698 - RNA, 19 nt, Homo sapiens
aagaauguguggaguguaa

SEQ ID NO: 261699 - RNA, 19 nt, Homo sapiens
agaaucugcugaaggauaa

SEQ ID NO: 261700 - RNA, 19 nt, Homo sapiens
ccucuuggcugccuuguga

SEQ ID NO: 261701 - RNA, 19 nt, Homo sapiens
gaagaacgcgccagagcaa

SEQ ID NO: 261702 - RNA, 19 nt, Homo sapiens
ggaugucucucaugaccaa

SEQ ID NO: 261703 - RNA, 19 nt, Homo sapiens
gaaaagcaguggcuccauu

SEQ ID NO: 261704 - RNA, 19 nt, Homo sapiens
cuucagauuugccuuauug

SEQ ID NO: 261705 - RNA, 19 nt, Homo sapiens
ugaccucccugaagaguug

SEQ ID NO: 261706 - RNA, 19 nt, Homo sapiens
gcugaugacugagaagcua

SEQ ID NO: 261707 - RNA, 19 nt, Homo sapiens
acccugaguucauaaauuu

SEQ ID NO: 261708 - RNA, 19 nt, Homo sapiens
gugggaguguguaauuuaa

SEQ ID NO: 261709 - RNA, 19 nt, Homo sapiens
caacaacccacuguauaaa

SEQ ID NO: 261710 - RNA, 19 nt, Homo sapiens
gccaacaacccacuguaua

SEQ ID NO: 261711 - RNA, 19 nt, Homo sapiens
ggucaucccuggccucaag

SEQ ID NO: 261712 - RNA, 19 nt, Homo sapiens
aagauuggcuggaggaaug

SEQ ID NO: 261713 - RNA, 19 nt, Homo sapiens
gagcugagcagguguucuu

SEQ ID NO: 261714 - RNA, 19 nt, Homo sapiens
ggagagagugcuauuguag

SEQ ID NO: 261715 - RNA, 19 nt, Homo sapiens
ggaaacuccucaucaccau

SEQ ID NO: 261716 - RNA, 19 nt, Homo sapiens
acggugagcuucagcauug

SEQ ID NO: 261717 - RNA, 19 nt, Homo sapiens
gcucauuguugaugcuuau

SEQ ID NO: 261718 - RNA, 19 nt, Homo sapiens
gacaagggcucuggagaca

SEQ ID NO: 261719 - RNA, 19 nt, Homo sapiens
ccucacugcuguagacauu

SEQ ID NO: 261720 - RNA, 19 nt, Homo sapiens
uaaggacacuggcaaggau

SEQ ID NO: 261721 - RNA, 19 nt, Homo sapiens
gcaaguacugcgaguguga

SEQ ID NO: 261722 - RNA, 19 nt, Homo sapiens
gcaaagaaggagagcauag

SEQ ID NO: 261723 - RNA, 19 nt, Homo sapiens
cagcaucucccaguucaua

SEQ ID NO: 261724 - RNA, 19 nt, Homo sapiens
cuaauucuuugaccuguug

SEQ ID NO: 261725 - RNA, 19 nt, Homo sapiens
gcugagcuccuuagccuuu

SEQ ID NO: 261726 - RNA, 19 nt, Homo sapiens
ggcccaagcugaaccuaau

SEQ ID NO: 261727 - RNA, 19 nt, Homo sapiens
gaacuauagugagcucauc

SEQ ID NO: 261728 - RNA, 19 nt, Homo sapiens
gagaagcuaucccagaaaa

SEQ ID NO: 261729 - RNA, 19 nt, Homo sapiens
gaggggcucucucaugaua

SEQ ID NO: 261730 - RNA, 19 nt, Homo sapiens
ucacugcuguagacauuug

SEQ ID NO: 261731 - RNA, 19 nt, Homo sapiens
gagugaggcccgaguacua

SEQ ID NO: 261732 - RNA, 19 nt, Homo sapiens
cugagaagcuaucccagaa

SEQ ID NO: 261733 - RNA, 19 nt, Homo sapiens
gaaugaugcaucccacuug

SEQ ID NO: 261734 - RNA, 19 nt, Homo sapiens
ggccagcaccaucucuuua

SEQ ID NO: 261735 - RNA, 19 nt, Homo sapiens
guaccagcaucucccaguu

SEQ ID NO: 261736 - RNA, 19 nt, Homo sapiens
acaacccacuguauaaaga

SEQ ID NO: 261737 - RNA, 19 nt, Homo sapiens
gaaggagaaucugcugaag

SEQ ID NO: 261738 - RNA, 19 nt, Homo sapiens
aggagaaucugcugaagga

SEQ ID NO: 261739 - RNA, 19 nt, Homo sapiens
guggacaucuacuacuuga

SEQ ID NO: 261740 - RNA, 19 nt, Homo sapiens
ccaggucacucaagucagu

SEQ ID NO: 261741 - RNA, 19 nt, Homo sapiens
gcagugacuuuggcaagau

SEQ ID NO: 261742 - RNA, 19 nt, Homo sapiens
gaauuucuccauccaagug

SEQ ID NO: 261743 - RNA, 19 nt, Homo sapiens
gacauacauccaacauuaa

SEQ ID NO: 261744 - RNA, 19 nt, Homo sapiens
caagacucauauagcauug

SEQ ID NO: 261745 - RNA, 19 nt, Homo sapiens
ccaagacucauauagcauu

SEQ ID NO: 261746 - RNA, 19 nt, Homo sapiens
ggaaugaugcaucccacuu

SEQ ID NO: 261747 - RNA, 19 nt, Homo sapiens
gaaugaugggucaguugua

SEQ ID NO: 261748 - RNA, 19 nt, Homo sapiens
ggaaugaugggucaguugu

SEQ ID NO: 261749 - RNA, 19 nt, Homo sapiens
uggcaaggaugcagugaau

SEQ ID NO: 261750 - RNA, 19 nt, Homo sapiens
uuacugccgugacgagauu

SEQ ID NO: 261751 - RNA, 19 nt, Homo sapiens
gacgggcagugucauguug

SEQ ID NO: 261752 - RNA, 19 nt, Homo sapiens
acaagccugugucaccaua

SEQ ID NO: 261753 - RNA, 19 nt, Homo sapiens
ggaaaguccauccuguaug

SEQ ID NO: 261754 - RNA, 19 nt, Homo sapiens
ccuauaagaaugaggauga

SEQ ID NO: 261755 - RNA, 19 nt, Homo sapiens
guaugggacucaagauugg

SEQ ID NO: 261756 - RNA, 19 nt, Homo sapiens
gcaauguccuccagcucau

SEQ ID NO: 261757 - RNA, 19 nt, Homo sapiens
ccacugaugccaagacuca

SEQ ID NO: 261758 - RNA, 19 nt, Homo sapiens
ucaaugaggaagugaagaa

SEQ ID NO: 261759 - RNA, 19 nt, Homo sapiens
cuccauugguguugacaua

SEQ ID NO: 261760 - RNA, 19 nt, Homo sapiens
gagcauaggaaaccacaca

SEQ ID NO: 261761 - RNA, 19 nt, Homo sapiens
gggagaaugucaguaugug

SEQ ID NO: 261762 - RNA, 19 nt, Homo sapiens
uagucaaucucuaucagaa

SEQ ID NO: 261763 - RNA, 19 nt, Homo sapiens
cguguggccuguucuucua

SEQ ID NO: 261764 - RNA, 19 nt, Homo sapiens
cgucuaccuucaccaauau

SEQ ID NO: 261765 - RNA, 19 nt, Homo sapiens
ccaguacuaugaagauucu

SEQ ID NO: 261766 - RNA, 19 nt, Homo sapiens
gaagaagcagaguguguca

SEQ ID NO: 261767 - RNA, 19 nt, Homo sapiens
ccacuuggcaucauucaca

SEQ ID NO: 261768 - RNA, 19 nt, Homo sapiens
uacccugaguucauaaauu

SEQ ID NO: 261769 - RNA, 19 nt, Homo sapiens
uaugaagauucuaguggaa

SEQ ID NO: 261770 - RNA, 19 nt, Homo sapiens
ucagauuccaguacuauga

SEQ ID NO: 261771 - RNA, 19 nt, Homo sapiens
ggauuacccuguggacauc

SEQ ID NO: 261772 - RNA, 19 nt, Homo sapiens
gagauugagucagugaaag

SEQ ID NO: 261773 - RNA, 19 nt, Homo sapiens
ugcggcagguggaggauua

SEQ ID NO: 261774 - RNA, 19 nt, Homo sapiens
ggaaagagcugcaggugaa

SEQ ID NO: 261775 - RNA, 19 nt, Homo sapiens
gagagcagcuuccaaauca

SEQ ID NO: 261776 - RNA, 19 nt, Homo sapiens
cgacuacacuauuggauuu

SEQ ID NO: 261777 - RNA, 19 nt, Homo sapiens
guucugcacuuaauaaaug

SEQ ID NO: 261778 - RNA, 19 nt, Homo sapiens
cagaagauguggaugaguu

SEQ ID NO: 261779 - RNA, 19 nt, Homo sapiens
gaugacaaccgaccuauug

SEQ ID NO: 261780 - RNA, 19 nt, Homo sapiens
gaccaacaguucuuccaaa

SEQ ID NO: 261781 - RNA, 19 nt, Homo sapiens
ugaagaaagugcugguuga

SEQ ID NO: 261782 - RNA, 19 nt, Homo sapiens
ccaggaagauccauuucaa

SEQ ID NO: 261783 - RNA, 19 nt, Homo sapiens
gcuggaaggucaccaacaa

SEQ ID NO: 261784 - RNA, 19 nt, Homo sapiens
acgagaagcuucacaccua

SEQ ID NO: 261785 - RNA, 19 nt, Homo sapiens
guggaugaguuccggaaua

SEQ ID NO: 261786 - RNA, 19 nt, Homo sapiens
gaccagugcugcugccuau

SEQ ID NO: 261787 - RNA, 19 nt, Homo sapiens
gcgagaacgugcccuacaa

SEQ ID NO: 261788 - RNA, 19 nt, Homo sapiens
gaacuggaccggagcuuca

SEQ ID NO: 261789 - RNA, 19 nt, Homo sapiens
agaaagugcugguugacaa

SEQ ID NO: 261790 - RNA, 19 nt, Homo sapiens
guaaacaucaccaucauca

SEQ ID NO: 261791 - RNA, 19 nt, Homo sapiens
uacgacagcuuccuuaugu

SEQ ID NO: 261792 - RNA, 19 nt, Homo sapiens
ggaugcugcuuauugagaa

SEQ ID NO: 261793 - RNA, 19 nt, Homo sapiens
gcucagcaacccuaaguuu

SEQ ID NO: 261794 - RNA, 19 nt, Homo sapiens
gauggccucugaccacuug

SEQ ID NO: 261795 - RNA, 19 nt, Homo sapiens
gccaggagguggaggagaa

SEQ ID NO: 261796 - RNA, 19 nt, Homo sapiens
ccagagacgugguguccuu

SEQ ID NO: 261797 - RNA, 19 nt, Homo sapiens
gaaggucaccaacaacaug

SEQ ID NO: 261798 - RNA, 19 nt, Homo sapiens
gcuauggccuggucaacga

SEQ ID NO: 261799 - RNA, 19 nt, Homo sapiens
ggaagucccaggucuccua

SEQ ID NO: 261800 - RNA, 19 nt, Homo sapiens
gagacgugguguccuuuga

SEQ ID NO: 261801 - RNA, 19 nt, Homo sapiens
uaaggaagaccacuacaug

SEQ ID NO: 261802 - RNA, 19 nt, Homo sapiens
ccacauggaccaacaguuc

SEQ ID NO: 261803 - RNA, 19 nt, Homo sapiens
ccaacuccauguccgauga

SEQ ID NO: 261804 - RNA, 19 nt, Homo sapiens
uggaugaguuccggaauaa

SEQ ID NO: 261805 - RNA, 19 nt, Homo sapiens
ugacagaagauguggauga

SEQ ID NO: 261806 - RNA, 19 nt, Homo sapiens
cagaggagacccagauuga

SEQ ID NO: 261807 - RNA, 19 nt, Homo sapiens
cgagucagccuuccacuau

SEQ ID NO: 261808 - RNA, 19 nt, Homo sapiens
gcacccaccugcuggucuu

SEQ ID NO: 261809 - RNA, 19 nt, Homo sapiens
gaacggcggugagcugcau

SEQ ID NO: 261810 - RNA, 19 nt, Homo sapiens
ccuccaagauguuccagaa

SEQ ID NO: 261811 - RNA, 19 nt, Homo sapiens
ggagagcagcuuccaaauc

SEQ ID NO: 261812 - RNA, 19 nt, Homo sapiens
gcacccacauggaccaaca

SEQ ID NO: 261813 - RNA, 19 nt, Homo sapiens
gaucuccgguguacacaag

SEQ ID NO: 261814 - RNA, 19 nt, Homo sapiens
gaugacgacugcaccuaca

SEQ ID NO: 261815 - RNA, 19 nt, Homo sapiens
cgagaagcuucacaccuau

SEQ ID NO: 261816 - RNA, 19 nt, Homo sapiens
uauuggauuuggcaaguuu

SEQ ID NO: 261817 - RNA, 19 nt, Homo sapiens
caaccacuccuacguguuc

SEQ ID NO: 261818 - RNA, 19 nt, Homo sapiens
guacccguauugcgacuau

SEQ ID NO: 261819 - RNA, 19 nt, Homo sapiens
ggacguggccacugugagu

SEQ ID NO: 261820 - RNA, 19 nt, Homo sapiens
uaauggacguggccacugu

SEQ ID NO: 261821 - RNA, 19 nt, Homo sapiens
uccaagauguuccagaaga

SEQ ID NO: 261822 - RNA, 19 nt, Homo sapiens
ggacccagccuuuguucug

SEQ ID NO: 261823 - RNA, 19 nt, Homo sapiens
gaggagacccagauugaca

SEQ ID NO: 261824 - RNA, 19 nt, Homo sapiens
gcaugugacccaggaguuu

SEQ ID NO: 261825 - RNA, 19 nt, Homo sapiens
ggacuacgacagcuuccuu

SEQ ID NO: 261826 - RNA, 19 nt, Homo sapiens
uggacaaccucaagaagau

SEQ ID NO: 261827 - RNA, 19 nt, Homo sapiens
gcaccgagaaccugcugaa

SEQ ID NO: 261828 - RNA, 19 nt, Homo sapiens
caacuucaaggucaagaug

SEQ ID NO: 261829 - RNA, 19 nt, Homo sapiens
gggcaacauccaucugaaa

SEQ ID NO: 261830 - RNA, 19 nt, Homo sapiens
ccacgacucucgccugacu

SEQ ID NO: 261831 - RNA, 19 nt, Homo sapiens
ucaaggagcaagccagaga

SEQ ID NO: 261832 - RNA, 19 nt, Homo sapiens
gacagaagauguggaugag

SEQ ID NO: 261833 - RNA, 19 nt, Homo sapiens
ggaccaacaguucuuccaa

SEQ ID NO: 261834 - RNA, 19 nt, Homo sapiens
ggaagauccauuucaacug

SEQ ID NO: 261835 - RNA, 19 nt, Homo sapiens
agucagccuuccacuauga

SEQ ID NO: 261836 - RNA, 19 nt, Homo sapiens
gauaaggacugcgccuacu

SEQ ID NO: 261837 - RNA, 19 nt, Homo sapiens
ggagagggaggaagaggau

SEQ ID NO: 261838 - RNA, 19 nt, Homo sapiens
gguccaggaagauccauuu

SEQ ID NO: 261839 - RNA, 19 nt, Homo sapiens
aaacaucaccaucaucaag

SEQ ID NO: 261840 - RNA, 19 nt, Homo sapiens
cagagaagcagguggaaca

SEQ ID NO: 261841 - RNA, 19 nt, Homo sapiens
ugcugaagcuuacagagaa

SEQ ID NO: 261842 - RNA, 19 nt, Homo sapiens
gcgacuacacuauuggauu

SEQ ID NO: 261843 - RNA, 19 nt, Homo sapiens
aaagcaagaccacaccauu

SEQ ID NO: 261844 - RNA, 19 nt, Homo sapiens
ggucaguucugcgaguaug

SEQ ID NO: 261845 - RNA, 19 nt, Homo sapiens
gucaccaacuacuccuaua

SEQ ID NO: 261846 - RNA, 19 nt, Homo sapiens
ggacaugaggccugagaag

SEQ ID NO: 261847 - RNA, 19 nt, Homo sapiens
cuauugggcccaugaagaa

SEQ ID NO: 261848 - RNA, 19 nt, Homo sapiens
guauugcgacuaugagaug

SEQ ID NO: 261849 - RNA, 19 nt, Homo sapiens
gcagcccaaugccgggaaa

SEQ ID NO: 261850 - RNA, 19 nt, Homo sapiens
caacauccaucugaaaccu

SEQ ID NO: 261851 - RNA, 19 nt, Homo sapiens
ucacagaggagacccagau

SEQ ID NO: 261852 - RNA, 19 nt, Homo sapiens
ccaacuacuccuauagcua

SEQ ID NO: 261853 - RNA, 19 nt, Homo sapiens
gaucuggacaaccucaaga

SEQ ID NO: 261854 - RNA, 19 nt, Homo sapiens
ccaagaggcccauguccau

SEQ ID NO: 261855 - RNA, 19 nt, Homo sapiens
ggucacauggugggcuuua

SEQ ID NO: 261856 - RNA, 19 nt, Homo sapiens
gcacgugugaggaaugcaa

SEQ ID NO: 261857 - RNA, 19 nt, Homo sapiens
ccaccugcaucgacagcaa

SEQ ID NO: 261858 - RNA, 19 nt, Homo sapiens
gagucagccuuccacuaug

SEQ ID NO: 261859 - RNA, 19 nt, Homo sapiens
gcacagacgagauguucag

SEQ ID NO: 261860 - RNA, 19 nt, Homo sapiens
gcagaucuccgguguacac

SEQ ID NO: 261861 - RNA, 19 nt, Homo sapiens
gagcagcuuccaaaucaca

SEQ ID NO: 261862 - RNA, 19 nt, Homo sapiens
gagaagcuucacaccuauu

SEQ ID NO: 261863 - RNA, 19 nt, Homo sapiens
gaugaguuccggaauaaac

SEQ ID NO: 261864 - RNA, 19 nt, Homo sapiens
caccagcgacuacacuauu

SEQ ID NO: 261865 - RNA, 19 nt, Homo sapiens
gcuaccuggugaccuguga

SEQ ID NO: 261866 - RNA, 19 nt, Homo sapiens
gacuacgacagcuuccuua

SEQ ID NO: 261867 - RNA, 19 nt, Homo sapiens
gagcuucacgagucagaug

SEQ ID NO: 261868 - RNA, 19 nt, Homo sapiens
ggcaagguccguccucugu

SEQ ID NO: 261869 - RNA, 19 nt, Homo sapiens
ccaccgagcccuuccuagu

SEQ ID NO: 261870 - RNA, 19 nt, Homo sapiens
ggaguggccagaccugcaa

SEQ ID NO: 261871 - RNA, 19 nt, Homo sapiens
cgugcuggcuggcaucaug

SEQ ID NO: 261872 - RNA, 19 nt, Homo sapiens
gagggcaucaucaccauag

SEQ ID NO: 261873 - RNA, 19 nt, Homo sapiens
gcgagggcaucaucaccau

SEQ ID NO: 261874 - RNA, 19 nt, Homo sapiens
gaucuaucauuacugcaaa

SEQ ID NO: 261875 - RNA, 19 nt, Homo sapiens
ugagucaccuuccaaguug

SEQ ID NO: 261876 - RNA, 19 nt, Homo sapiens
ucgccuggaucuaucauua

SEQ ID NO: 261877 - RNA, 19 nt, Homo sapiens
ggacagggagacagaagaa

SEQ ID NO: 261878 - RNA, 19 nt, Homo sapiens
ccagacacagugcagauua

SEQ ID NO: 261879 - RNA, 19 nt, Homo sapiens
gcgagcuuguuacugguua

SEQ ID NO: 261880 - RNA, 19 nt, Homo sapiens
gcuuguuacugguuacuug

SEQ ID NO: 261881 - RNA, 19 nt, Homo sapiens
ugacuggugugccuucugu

SEQ ID NO: 261882 - RNA, 19 nt, Homo sapiens
caauugaagaccaggauga

SEQ ID NO: 261883 - RNA, 19 nt, Homo sapiens
gaucggaggcucagagaac

SEQ ID NO: 261884 - RNA, 19 nt, Homo sapiens
gcuacugugucuucagcaa

SEQ ID NO: 261885 - RNA, 19 nt, Homo sapiens
ggaucuaucauuacugcaa

SEQ ID NO: 261886 - RNA, 19 nt, Homo sapiens
uggcagaugugcucaaggu

SEQ ID NO: 261887 - RNA, 19 nt, Homo sapiens
cagggagacagaagaaauu

SEQ ID NO: 261888 - RNA, 19 nt, Homo sapiens
gcuuaucgccuggaucuau

SEQ ID NO: 261889 - RNA, 19 nt, Homo sapiens
gguggagagugucuucaag

SEQ ID NO: 261890 - RNA, 19 nt, Homo sapiens
cagacacagugcagauuag

SEQ ID NO: 261891 - RNA, 19 nt, Homo sapiens
gcaaugucaccaccugcaa

SEQ ID NO: 261892 - RNA, 19 nt, Homo sapiens
ugucagugguggagagugu

SEQ ID NO: 261893 - RNA, 19 nt, Homo sapiens
caacagccucccagacaca

SEQ ID NO: 261894 - RNA, 19 nt, Homo sapiens
cgagaacaacugugagauc

SEQ ID NO: 261895 - RNA, 19 nt, Homo sapiens
cugggaugguggugaauga

SEQ ID NO: 261896 - RNA, 19 nt, Homo sapiens
gaccaggagcugcaacaca

SEQ ID NO: 261897 - RNA, 19 nt, Homo sapiens
gagggcgagcucuccgaua

SEQ ID NO: 261898 - RNA, 19 nt, Homo sapiens
cugagucaccuuccaaguu

SEQ ID NO: 261899 - RNA, 19 nt, Homo sapiens
accaggagcugcaacacau

SEQ ID NO: 261900 - RNA, 19 nt, Homo sapiens
cugcugggaugguggugaa

SEQ ID NO: 261901 - RNA, 19 nt, Homo sapiens
ccgaggcagugaggugauu

SEQ ID NO: 261902 - RNA, 19 nt, Homo sapiens
caucccaagacuucaauug

SEQ ID NO: 261903 - RNA, 19 nt, Homo sapiens
gaccaggugcuaguaggaa

SEQ ID NO: 261904 - RNA, 19 nt, Homo sapiens
acagggagacagaagaaau

SEQ ID NO: 261905 - RNA, 19 nt, Homo sapiens
gcucucagccuugggcaau

SEQ ID NO: 261906 - RNA, 19 nt, Homo sapiens
ccaccagcaugcgggauuc

SEQ ID NO: 261907 - RNA, 19 nt, Homo sapiens
ugugagaucggcugcuuug

SEQ ID NO: 261908 - RNA, 19 nt, Homo sapiens
gugcuuaucgccuggaucu

SEQ ID NO: 261909 - RNA, 19 nt, Homo sapiens
acauuccgcccaaucugua

SEQ ID NO: 261910 - RNA, 19 nt, Homo sapiens
gcuggugcaucccaagacu

SEQ ID NO: 261911 - RNA, 19 nt, Homo sapiens
cgcaacagccucccagaca

SEQ ID NO: 261912 - RNA, 19 nt, Homo sapiens
gaucacagcucccuaggua

SEQ ID NO: 261913 - RNA, 19 nt, Homo sapiens
gaacaacgguggagauuuu

SEQ ID NO: 261914 - RNA, 19 nt, Homo sapiens
ggagggaguuugcaaaguu

SEQ ID NO: 261915 - RNA, 19 nt, Homo sapiens
gaagguacaucguuugcaa

SEQ ID NO: 261916 - RNA, 19 nt, Homo sapiens
gcucgcaggucucaacaua

SEQ ID NO: 261917 - RNA, 19 nt, Homo sapiens
caacaucaaccucaucuuu

SEQ ID NO: 261918 - RNA, 19 nt, Homo sapiens
gggaugaggugaucacaug

SEQ ID NO: 261919 - RNA, 19 nt, Homo sapiens
gcaagugccaugcagguua

SEQ ID NO: 261920 - RNA, 19 nt, Homo sapiens
ggagagaaauuggcagaga

SEQ ID NO: 261921 - RNA, 19 nt, Homo sapiens
gagagaaauuggcagagaa

SEQ ID NO: 261922 - RNA, 19 nt, Homo sapiens
gggcagagauggccagauc

SEQ ID NO: 261923 - RNA, 19 nt, Homo sapiens
ccaaugaaauacugagaug

SEQ ID NO: 261924 - RNA, 19 nt, Homo sapiens
ggacugauguuuccuucuc

SEQ ID NO: 261925 - RNA, 19 nt, Homo sapiens
gagggaguuugcaaaguuu

SEQ ID NO: 261926 - RNA, 19 nt, Homo sapiens
ggauuggaaguaaagauua

SEQ ID NO: 261927 - RNA, 19 nt, Homo sapiens
gaaggugccuggccauguc

SEQ ID NO: 261928 - RNA, 19 nt, Homo sapiens
ucaacaaguucaacaaauc

SEQ ID NO: 261929 - RNA, 19 nt, Homo sapiens
gaagugccaccucauguga

SEQ ID NO: 261930 - RNA, 19 nt, Homo sapiens
cgacagacaucagcacaug

SEQ ID NO: 261931 - RNA, 19 nt, Homo sapiens
gugcauugguuacaaguug

SEQ ID NO: 261932 - RNA, 19 nt, Homo sapiens
gaacgaggccaacgaguac

SEQ ID NO: 261933 - RNA, 19 nt, Homo sapiens
ggacuucaccuucaacaag

SEQ ID NO: 261934 - RNA, 19 nt, Homo sapiens
ggaucuuaaucucuucuuu

SEQ ID NO: 261935 - RNA, 19 nt, Homo sapiens
aaggaugacuuggacaaua

SEQ ID NO: 261936 - RNA, 19 nt, Homo sapiens
ccaggaggcugugcuaugu

SEQ ID NO: 261937 - RNA, 19 nt, Homo sapiens
ugagaugccuguugaaggu

SEQ ID NO: 261938 - RNA, 19 nt, Homo sapiens
gccaaggacugcgucauga

SEQ ID NO: 261939 - RNA, 19 nt, Homo sapiens
ggugugaucugagggcaaa

SEQ ID NO: 261940 - RNA, 19 nt, Homo sapiens
ugaagaaugucugcuaauc

SEQ ID NO: 261941 - RNA, 19 nt, Homo sapiens
gguagcauccuccuuguug

SEQ ID NO: 261942 - RNA, 19 nt, Homo sapiens
ggucuaaaguggaguuguc

SEQ ID NO: 261943 - RNA, 19 nt, Homo sapiens
acaauaguauccggucuaa

SEQ ID NO: 261944 - RNA, 19 nt, Homo sapiens
ucgcaggucucaacauaug

SEQ ID NO: 261945 - RNA, 19 nt, Homo sapiens
caauggcacuguggacuga

SEQ ID NO: 261946 - RNA, 19 nt, Homo sapiens
cuuaaucucuucuuuacug

SEQ ID NO: 261947 - RNA, 19 nt, Homo sapiens
cagcauacaguuuggcuuu

SEQ ID NO: 261948 - RNA, 19 nt, Homo sapiens
ccuccgagcuugggauaaa

SEQ ID NO: 261949 - RNA, 19 nt, Homo sapiens
ugaacgaggccaacgagua

SEQ ID NO: 261950 - RNA, 19 nt, Homo sapiens
caagaccaccuuccagcua

SEQ ID NO: 261951 - RNA, 19 nt, Homo sapiens
gggauuggaaguaaagauu

SEQ ID NO: 261952 - RNA, 19 nt, Homo sapiens
cacaggagauugccgugaa

SEQ ID NO: 261953 - RNA, 19 nt, Homo sapiens
gaacaacaucaaccucauc

SEQ ID NO: 261954 - RNA, 19 nt, Homo sapiens
ugugaagaaugucugcuaa

SEQ ID NO: 261955 - RNA, 19 nt, Homo sapiens
caagaucuaugggccuuuc

SEQ ID NO: 261956 - RNA, 19 nt, Homo sapiens
gcagacacacggagcaugu

SEQ ID NO: 261957 - RNA, 19 nt, Homo sapiens
ggaacaacgguggagauuu

SEQ ID NO: 261958 - RNA, 19 nt, Homo sapiens
gaaauuggcagagaacaac

SEQ ID NO: 261959 - RNA, 19 nt, Homo sapiens
ggucucaacauaugcacua

SEQ ID NO: 261960 - RNA, 19 nt, Homo sapiens
ggacagcuucaaugaggaa

SEQ ID NO: 261961 - RNA, 19 nt, Homo sapiens
ggauuugggucuuuuguug

SEQ ID NO: 261962 - RNA, 19 nt, Homo sapiens
caccucaugugaagaaugu

SEQ ID NO: 261963 - RNA, 19 nt, Homo sapiens
gcugggacgucauucagau

SEQ ID NO: 261964 - RNA, 19 nt, Homo sapiens
ggaagugccaccucaugug

SEQ ID NO: 261965 - RNA, 19 nt, Homo sapiens
gcagagggcaagccacugu

SEQ ID NO: 261966 - RNA, 19 nt, Homo sapiens
aggaugacuuggacaauau

SEQ ID NO: 261967 - RNA, 19 nt, Homo sapiens
gagggcaaaccuugucaaa

SEQ ID NO: 261968 - RNA, 19 nt, Homo sapiens
cauaugcacuaguggaagu

SEQ ID NO: 261969 - RNA, 19 nt, Homo sapiens
ucuaugggccuuucuguga

SEQ ID NO: 261970 - RNA, 19 nt, Homo sapiens
gugagggucugaagauugg

SEQ ID NO: 261971 - RNA, 19 nt, Homo sapiens
cugaggaucuuaaucucuu

SEQ ID NO: 261972 - RNA, 19 nt, Homo sapiens
aagauuggcuggcgaaagg

SEQ ID NO: 261973 - RNA, 19 nt, Homo sapiens
gaguggacagcuucaauga

SEQ ID NO: 261974 - RNA, 19 nt, Homo sapiens
ggaagggucggagucugua

SEQ ID NO: 261975 - RNA, 19 nt, Homo sapiens
gcacuguggacugauguuu

SEQ ID NO: 261976 - RNA, 19 nt, Homo sapiens
ugugcuauguuucuacaaa

SEQ ID NO: 261977 - RNA, 19 nt, Homo sapiens
ggaccuguacuaccugaug

SEQ ID NO: 261978 - RNA, 19 nt, Homo sapiens
gucaugauguucaccuaug

SEQ ID NO: 261979 - RNA, 19 nt, Homo sapiens
aggaggcugugcuauguuu

SEQ ID NO: 261980 - RNA, 19 nt, Homo sapiens
aauaguauccggucuaaag

SEQ ID NO: 261981 - RNA, 19 nt, Homo sapiens
cauuauaugcuguacaaga

SEQ ID NO: 261982 - RNA, 19 nt, Homo sapiens
caagugccaugcagguuac

SEQ ID NO: 261983 - RNA, 19 nt, Homo sapiens
aagaaugucugcuaaucca

SEQ ID NO: 261984 - RNA, 19 nt, Homo sapiens
caaguuguuuccaaauugc

SEQ ID NO: 261985 - RNA, 19 nt, Homo sapiens
gaugacaccacaggagauu

SEQ ID NO: 261986 - RNA, 19 nt, Homo sapiens
uguugaagguacaucguuu

SEQ ID NO: 261987 - RNA, 19 nt, Homo sapiens
cugcauuuaugguguaguu

SEQ ID NO: 261988 - RNA, 19 nt, Homo sapiens
aaucucuucuuuacugcua

SEQ ID NO: 261989 - RNA, 19 nt, Homo sapiens
ggaaggugccuggccaugu

SEQ ID NO: 261990 - RNA, 19 nt, Homo sapiens
caaggacugcgucaugaug

SEQ ID NO: 261991 - RNA, 19 nt, Homo sapiens
aaaguggaguugucagucu

SEQ ID NO: 261992 - RNA, 19 nt, Homo sapiens
accauuauaugcuguacaa

SEQ ID NO: 261993 - RNA, 19 nt, Homo sapiens
gaggaaguucggaaacaga

SEQ ID NO: 261994 - RNA, 19 nt, Homo sapiens
gaaggaugacuuggacaau

SEQ ID NO: 261995 - RNA, 19 nt, Homo sapiens
gaagggucggagucuguaa

SEQ ID NO: 261996 - RNA, 19 nt, Homo sapiens
gagcggcgacacacuagga

SEQ ID NO: 261997 - RNA, 19 nt, Homo sapiens
gcugugcuauguuucuaca

SEQ ID NO: 261998 - RNA, 19 nt, Homo sapiens
ccaaccagauggacuaucc

SEQ ID NO: 261999 - RNA, 19 nt, Homo sapiens
gggcuuugaugcaguacuc

SEQ ID NO: 262000 - RNA, 19 nt, Homo sapiens
uguccguguuuguuuagua

SEQ ID NO: 262001 - RNA, 19 nt, Homo sapiens
gagccagaguguggaaaca

SEQ ID NO: 262002 - RNA, 19 nt, Homo sapiens
gagagcgaguucggcaaga

SEQ ID NO: 262003 - RNA, 19 nt, Homo sapiens
gaagaaugucugcuaaucc

SEQ ID NO: 262004 - RNA, 19 nt, Homo sapiens
ggaagcccacgguccauca

SEQ ID NO: 262005 - RNA, 19 nt, Homo sapiens
caagauuguuugggauugg

SEQ ID NO: 262006 - RNA, 19 nt, Homo sapiens
ggacacggcaucuuuugaa

SEQ ID NO: 262007 - RNA, 19 nt, Homo sapiens
aaccucaucuuugcaguga

SEQ ID NO: 262008 - RNA, 19 nt, Homo sapiens
caaugaggaaguucggaaa

SEQ ID NO: 262009 - RNA, 19 nt, Homo sapiens
gagcggggaucugaugaaa

SEQ ID NO: 262010 - RNA, 19 nt, Homo sapiens
gggagaaccagagcgugua

SEQ ID NO: 262011 - RNA, 19 nt, Homo sapiens
gaagauuggcuggcgaaag

SEQ ID NO: 262012 - RNA, 19 nt, Homo sapiens
ggacucaacuugucauuua

SEQ ID NO: 262013 - RNA, 19 nt, Homo sapiens
ccaaagagaugucuaaauu

SEQ ID NO: 262014 - RNA, 19 nt, Homo sapiens
gaaaugcucucacaugaaa

SEQ ID NO: 262015 - RNA, 19 nt, Homo sapiens
guaaagaaguugccaaauu

SEQ ID NO: 262016 - RNA, 19 nt, Homo sapiens
gcuaaaggaugucaauuaa

SEQ ID NO: 262017 - RNA, 19 nt, Homo sapiens
gaacggcucuuuccagugu

SEQ ID NO: 262018 - RNA, 19 nt, Homo sapiens
caucucagcuuaugaagaa

SEQ ID NO: 262019 - RNA, 19 nt, Homo sapiens
agaagaagcaggcacauua

SEQ ID NO: 262020 - RNA, 19 nt, Homo sapiens
aaacggagcugcauugagu

SEQ ID NO: 262021 - RNA, 19 nt, Homo sapiens
gaagacugccugcuuauug

SEQ ID NO: 262022 - RNA, 19 nt, Homo sapiens
caaaugaugcugaaagauu

SEQ ID NO: 262023 - RNA, 19 nt, Homo sapiens
gaccaucagugaagaagaa

SEQ ID NO: 262024 - RNA, 19 nt, Homo sapiens
gaaggacuccggaaacauu

SEQ ID NO: 262025 - RNA, 19 nt, Homo sapiens
gacaaaugaugcugaaaga

SEQ ID NO: 262026 - RNA, 19 nt, Homo sapiens
ggaagcuacuggugucauu

SEQ ID NO: 262027 - RNA, 19 nt, Homo sapiens
uaacaacgguacccucuuc

SEQ ID NO: 262028 - RNA, 19 nt, Homo sapiens
gaagugaacagcuccaaau

SEQ ID NO: 262029 - RNA, 19 nt, Homo sapiens
aagaaaugcucucacauga

SEQ ID NO: 262030 - RNA, 19 nt, Homo sapiens
gaagguggauuugaugcaa

SEQ ID NO: 262031 - RNA, 19 nt, Homo sapiens
ugucaacugucuuggaaua

SEQ ID NO: 262032 - RNA, 19 nt, Homo sapiens
aaauaagccucucagugua

SEQ ID NO: 262033 - RNA, 19 nt, Homo sapiens
agaaagaaguggaagugaa

SEQ ID NO: 262034 - RNA, 19 nt, Homo sapiens
caacugcgacugucagaaa

SEQ ID NO: 262035 - RNA, 19 nt, Homo sapiens
ugugaagacugccugcuua

SEQ ID NO: 262036 - RNA, 19 nt, Homo sapiens
ggauuuguauuaccucaug

SEQ ID NO: 262037 - RNA, 19 nt, Homo sapiens
cagcaaaccuuuuagcuaa

SEQ ID NO: 262038 - RNA, 19 nt, Homo sapiens
gcagaaaccugugaagacu

SEQ ID NO: 262039 - RNA, 19 nt, Homo sapiens
uacagaggauccacaagua

SEQ ID NO: 262040 - RNA, 19 nt, Homo sapiens
ccacuugucucccuaugga

SEQ ID NO: 262041 - RNA, 19 nt, Homo sapiens
gaagaagcaggcacauuau

SEQ ID NO: 262042 - RNA, 19 nt, Homo sapiens
gaaugaauacuccauguca

SEQ ID NO: 262043 - RNA, 19 nt, Homo sapiens
gugaacagcuccaaauguc

SEQ ID NO: 262044 - RNA, 19 nt, Homo sapiens
ggaccaaccugugaacgau

SEQ ID NO: 262045 - RNA, 19 nt, Homo sapiens
gaaacauucuccagcugau

SEQ ID NO: 262046 - RNA, 19 nt, Homo sapiens
uuggacaacucauugauaa

SEQ ID NO: 262047 - RNA, 19 nt, Homo sapiens
ggaugucaauuaaacuuca

SEQ ID NO: 262048 - RNA, 19 nt, Homo sapiens
caugucaacugucuuggaa

SEQ ID NO: 262049 - RNA, 19 nt, Homo sapiens
gaaaacaacaccagaagaa

SEQ ID NO: 262050 - RNA, 19 nt, Homo sapiens
gguggaacuggaaguauua

SEQ ID NO: 262051 - RNA, 19 nt, Homo sapiens
ccacagauugcuagaacua

SEQ ID NO: 262052 - RNA, 19 nt, Homo sapiens
ggaauggacagcaaacuag

SEQ ID NO: 262053 - RNA, 19 nt, Homo sapiens
gaaauugugaagaaucaga

SEQ ID NO: 262054 - RNA, 19 nt, Homo sapiens
guagaccuuuccacagauu

SEQ ID NO: 262055 - RNA, 19 nt, Homo sapiens
caaaagaaaugcucucaca

SEQ ID NO: 262056 - RNA, 19 nt, Homo sapiens
uuauugaucuucgcuguaa

SEQ ID NO: 262057 - RNA, 19 nt, Homo sapiens
aaaugaugcugaaagauuc

SEQ ID NO: 262058 - RNA, 19 nt, Homo sapiens
cuacuggugucauuucaug

SEQ ID NO: 262059 - RNA, 19 nt, Homo sapiens
gaaagaaguggaagugaac

SEQ ID NO: 262060 - RNA, 19 nt, Homo sapiens
aaagaaaugcucucacaug

SEQ ID NO: 262061 - RNA, 19 nt, Homo sapiens
gcaggcaucgucauuccua

SEQ ID NO: 262062 - RNA, 19 nt, Homo sapiens
uaugcaagcugcugugugu

SEQ ID NO: 262063 - RNA, 19 nt, Homo sapiens
aggaaggaaugaucacgua

SEQ ID NO: 262064 - RNA, 19 nt, Homo sapiens
ggugugcucaggagaauuu

SEQ ID NO: 262065 - RNA, 19 nt, Homo sapiens
ggaacuggaaguauuagga

SEQ ID NO: 262066 - RNA, 19 nt, Homo sapiens
cagaaggacuccggaaaca

SEQ ID NO: 262067 - RNA, 19 nt, Homo sapiens
gccaacccuugcaguagua

SEQ ID NO: 262068 - RNA, 19 nt, Homo sapiens
aaacaacaccagaagaaau

SEQ ID NO: 262069 - RNA, 19 nt, Homo sapiens
ccauacuucuguuuaccua

SEQ ID NO: 262070 - RNA, 19 nt, Homo sapiens
aaagcuugauccuuaaguu

SEQ ID NO: 262071 - RNA, 19 nt, Homo sapiens
gaaccaauccacucuacag

SEQ ID NO: 262072 - RNA, 19 nt, Homo sapiens
aagaauguguggacaagug

SEQ ID NO: 262073 - RNA, 19 nt, Homo sapiens
gagaauuacgcaaaacuua

SEQ ID NO: 262074 - RNA, 19 nt, Homo sapiens
caaaggaugguucuguuuc

SEQ ID NO: 262075 - RNA, 19 nt, Homo sapiens
ggaagugaacagcuccaaa

SEQ ID NO: 262076 - RNA, 19 nt, Homo sapiens
ggacaacucauugauaaac

SEQ ID NO: 262077 - RNA, 19 nt, Homo sapiens
gcccuggaauuacuuguca

SEQ ID NO: 262078 - RNA, 19 nt, Homo sapiens
gagaagaagcaggcacauu

SEQ ID NO: 262079 - RNA, 19 nt, Homo sapiens
uaacggcgacugugacugu

SEQ ID NO: 262080 - RNA, 19 nt, Homo sapiens
gggaugcccuggaauuacu

SEQ ID NO: 262081 - RNA, 19 nt, Homo sapiens
ggacagcaagaaugaauac

SEQ ID NO: 262082 - RNA, 19 nt, Homo sapiens
aaaauuggcuggcggaaug

SEQ ID NO: 262083 - RNA, 19 nt, Homo sapiens
ggacuacccgguggauuug

SEQ ID NO: 262084 - RNA, 19 nt, Homo sapiens
gaaggaaugaucacguaca

SEQ ID NO: 262085 - RNA, 19 nt, Homo sapiens
gaaguugccaaauuugaag

SEQ ID NO: 262086 - RNA, 19 nt, Homo sapiens
ucaaaggaugguucuguuu

SEQ ID NO: 262087 - RNA, 19 nt, Homo sapiens
gagaagaauguguggacaa

SEQ ID NO: 262088 - RNA, 19 nt, Homo sapiens
acucauugauaaacuggua

SEQ ID NO: 262089 - RNA, 19 nt, Homo sapiens
guggacaagugcaaacuag

SEQ ID NO: 262090 - RNA, 19 nt, Homo sapiens
gggaaccaauccacucuac

SEQ ID NO: 262091 - RNA, 19 nt, Homo sapiens
ccaaacauucccaugauca

SEQ ID NO: 262092 - RNA, 19 nt, Homo sapiens
uccgaagccuccaaacauu

SEQ ID NO: 262093 - RNA, 19 nt, Homo sapiens
ggagaaaaugaaugucuua

SEQ ID NO: 262094 - RNA, 19 nt, Homo sapiens
gagguaacggcgacuguga

SEQ ID NO: 262095 - RNA, 19 nt, Homo sapiens
aaacauuuaugggccuuau

SEQ ID NO: 262096 - RNA, 19 nt, Homo sapiens
gaagcaggcacauuaucau

SEQ ID NO: 262097 - RNA, 19 nt, Homo sapiens
agacugggcuucggaucuu

SEQ ID NO: 262098 - RNA, 19 nt, Homo sapiens
ugccaaauuugaagcagaa

SEQ ID NO: 262099 - RNA, 19 nt, Homo sapiens
gaagcuacuggugucauuu

SEQ ID NO: 262100 - RNA, 19 nt, Homo sapiens
augaagaacugcggucuga

SEQ ID NO: 262101 - RNA, 19 nt, Homo sapiens
aagaaugaauacuccaugu

SEQ ID NO: 262102 - RNA, 19 nt, Homo sapiens
gaaauugccaacccuugca

SEQ ID NO: 262103 - RNA, 19 nt, Homo sapiens
gacgaccucaacacaauaa

SEQ ID NO: 262104 - RNA, 19 nt, Homo sapiens
gaugacgaccucaacacaa

SEQ ID NO: 262105 - RNA, 19 nt, Homo sapiens
aaggaaugaucacguacaa

SEQ ID NO: 262106 - RNA, 19 nt, Homo sapiens
gcugcuguguguaaggaaa

SEQ ID NO: 262107 - RNA, 19 nt, Homo sapiens
uggauuugaugcaauuaug

SEQ ID NO: 262108 - RNA, 19 nt, Homo sapiens
ucagugaagaagaagauuu

SEQ ID NO: 262109 - RNA, 19 nt, Homo sapiens
agcuaaaggaugucaauua

SEQ ID NO: 262110 - RNA, 19 nt, Homo sapiens
aagcaggcacauuaucaua

SEQ ID NO: 262111 - RNA, 19 nt, Homo sapiens
cagcgugacugugaauauc

SEQ ID NO: 262112 - RNA, 19 nt, Homo sapiens
gcaccuauguggaaacuaa

SEQ ID NO: 262113 - RNA, 19 nt, Homo sapiens
ugaguaaacugauuccuaa

SEQ ID NO: 262114 - RNA, 19 nt, Homo sapiens
gaccugagcuacuccauga

SEQ ID NO: 262115 - RNA, 19 nt, Homo sapiens
cagauuggcuggagaaaug

SEQ ID NO: 262116 - RNA, 19 nt, Homo sapiens
gaugauggcuggugcaaag

SEQ ID NO: 262117 - RNA, 19 nt, Homo sapiens
gagcagaggugagagugaa

SEQ ID NO: 262118 - RNA, 19 nt, Homo sapiens
ggacagcaauggccucuac

SEQ ID NO: 262119 - RNA, 19 nt, Homo sapiens
aauaaagucuuaccucaga

SEQ ID NO: 262120 - RNA, 19 nt, Homo sapiens
ccacccaaguauacaauaa

SEQ ID NO: 262121 - RNA, 19 nt, Homo sapiens
ccaccacccuacuucauuu

SEQ ID NO: 262122 - RNA, 19 nt, Homo sapiens
gcaaauauccagcccaucu

SEQ ID NO: 262123 - RNA, 19 nt, Homo sapiens
ggacaguaauccucucuac

SEQ ID NO: 262124 - RNA, 19 nt, Homo sapiens
gcacgcaccuauguggaaa

SEQ ID NO: 262125 - RNA, 19 nt, Homo sapiens
gaggaagggugggucugua

SEQ ID NO: 262126 - RNA, 19 nt, Homo sapiens
gaauacagucgcuuugaga

SEQ ID NO: 262127 - RNA, 19 nt, Homo sapiens
ggaauacagucgcuuugag

SEQ ID NO: 262128 - RNA, 19 nt, Homo sapiens
guaaacugauuccuaaguc

SEQ ID NO: 262129 - RNA, 19 nt, Homo sapiens
ggagcugaguaaacugauu

SEQ ID NO: 262130 - RNA, 19 nt, Homo sapiens
aaacggugcugcccuuugu

SEQ ID NO: 262131 - RNA, 19 nt, Homo sapiens
caccaucaauccucgcuuu

SEQ ID NO: 262132 - RNA, 19 nt, Homo sapiens
caucaauccucgcuuucaa

SEQ ID NO: 262133 - RNA, 19 nt, Homo sapiens
caguaauccucucuacaaa

SEQ ID NO: 262134 - RNA, 19 nt, Homo sapiens
acaaccagcuguucuucuu

SEQ ID NO: 262135 - RNA, 19 nt, Homo sapiens
gaaagggucacugucaaug

SEQ ID NO: 262136 - RNA, 19 nt, Homo sapiens
gauacccgguggaccugua

SEQ ID NO: 262137 - RNA, 19 nt, Homo sapiens
ccacauuucuuacgaaucc

SEQ ID NO: 262138 - RNA, 19 nt, Homo sapiens
aaacuaaagcccagagaga

SEQ ID NO: 262139 - RNA, 19 nt, Homo sapiens
ggaaagggucacugucaau

SEQ ID NO: 262140 - RNA, 19 nt, Homo sapiens
gaagggugggucuguaaga

SEQ ID NO: 262141 - RNA, 19 nt, Homo sapiens
caagacaccaugcgagaga

SEQ ID NO: 262142 - RNA, 19 nt, Homo sapiens
caacugcaguacagcuugu

SEQ ID NO: 262143 - RNA, 19 nt, Homo sapiens
acaguaauccucucuacaa

SEQ ID NO: 262144 - RNA, 19 nt, Homo sapiens
gcacaguacccuccaaacu

SEQ ID NO: 262145 - RNA, 19 nt, Homo sapiens
ucaaccagacggugacuuu

SEQ ID NO: 262146 - RNA, 19 nt, Homo sapiens
uauaauagccugucuucca

SEQ ID NO: 262147 - RNA, 19 nt, Homo sapiens
gggcauggacgcugcaaau

SEQ ID NO: 262148 - RNA, 19 nt, Homo sapiens
gagcagauuggcuggagaa

SEQ ID NO: 262149 - RNA, 19 nt, Homo sapiens
ggaccuguacuaccuuaug

SEQ ID NO: 262150 - RNA, 19 nt, Homo sapiens
guggaccuguacuaccuua

SEQ ID NO: 262151 - RNA, 19 nt, Homo sapiens
ccaaguauacaauaaaguc

SEQ ID NO: 262152 - RNA, 19 nt, Homo sapiens
ucuggucuguuuccuguuu

SEQ ID NO: 262153 - RNA, 19 nt, Homo sapiens
ccagggacaccuacaaugu

SEQ ID NO: 262154 - RNA, 19 nt, Homo sapiens
gagcacaguacccuccaaa

SEQ ID NO: 262155 - RNA, 19 nt, Homo sapiens
gaggugagagugaauugga

SEQ ID NO: 262156 - RNA, 19 nt, Homo sapiens
agcaacaacucaacuggaa

SEQ ID NO: 262157 - RNA, 19 nt, Homo sapiens
gguccacauuucuuacgaa

SEQ ID NO: 262158 - RNA, 19 nt, Homo sapiens
ccagucaccauucagcuuu

SEQ ID NO: 262159 - RNA, 19 nt, Homo sapiens
gggaauacagucgcuuuga

SEQ ID NO: 262160 - RNA, 19 nt, Homo sapiens
gcaaccacguccgaaucaa

SEQ ID NO: 262161 - RNA, 19 nt, Homo sapiens
ggacuccagcaacguggua

SEQ ID NO: 262162 - RNA, 19 nt, Homo sapiens
gaccuguacuaccuuaugg

SEQ ID NO: 262163 - RNA, 19 nt, Homo sapiens
uaaagucuuaccucagaaa

SEQ ID NO: 262164 - RNA, 19 nt, Homo sapiens
aaggagggagggacacuua

SEQ ID NO: 262165 - RNA, 19 nt, Homo sapiens
gagcugaguaaacugauuc

SEQ ID NO: 262166 - RNA, 19 nt, Homo sapiens
ucagacgacacauuccaua

SEQ ID NO: 262167 - RNA, 19 nt, Homo sapiens
ggacaaccagcuguucuuc

SEQ ID NO: 262168 - RNA, 19 nt, Homo sapiens
uggaaagggucacugucaa

SEQ ID NO: 262169 - RNA, 19 nt, Homo sapiens
ugguacagcucaucaugga

SEQ ID NO: 262170 - RNA, 19 nt, Homo sapiens
uaaacugauuccuaagucu

SEQ ID NO: 262171 - RNA, 19 nt, Homo sapiens
agaagugcauccucucaca

SEQ ID NO: 262172 - RNA, 19 nt, Homo sapiens
gcagaggugagagugaauu

SEQ ID NO: 262173 - RNA, 19 nt, Homo sapiens
gcagacagucccacucucu

SEQ ID NO: 262174 - RNA, 19 nt, Homo sapiens
ggagcugauuguggaguug

SEQ ID NO: 262175 - RNA, 19 nt, Homo sapiens
ucauggaugcuuauaauag

SEQ ID NO: 262176 - RNA, 19 nt, Homo sapiens
ggcccucucugcagcaaau

SEQ ID NO: 262177 - RNA, 19 nt, Homo sapiens
gacgacacauuccauacag

SEQ ID NO: 262178 - RNA, 19 nt, Homo sapiens
gcucugcacgcaccuaugu

SEQ ID NO: 262179 - RNA, 19 nt, Homo sapiens
caugaaggacgaccuggaa

SEQ ID NO: 262180 - RNA, 19 nt, Homo sapiens
guaauccucucuacaaaag

SEQ ID NO: 262181 - RNA, 19 nt, Homo sapiens
gacauggacaguugcauca

SEQ ID NO: 262182 - RNA, 19 nt, Homo sapiens
aaauauccagcccaucuuu

SEQ ID NO: 262183 - RNA, 19 nt, Homo sapiens
cuacuauggugcucuaugc

SEQ ID NO: 262184 - RNA, 19 nt, Homo sapiens
cggcuacuauggugcucua

SEQ ID NO: 262185 - RNA, 19 nt, Homo sapiens
gugcuuggacggcuacuau

SEQ ID NO: 262186 - RNA, 19 nt, Homo sapiens
ucucgggcaugguggcuuu

SEQ ID NO: 262187 - RNA, 19 nt, Homo sapiens
gcagauuggcuggagaaau

SEQ ID NO: 262188 - RNA, 19 nt, Homo sapiens
aaucuggacucgccugaag

SEQ ID NO: 262189 - RNA, 19 nt, Homo sapiens
ggaaacuaaagcccagaga

SEQ ID NO: 262190 - RNA, 19 nt, Homo sapiens
cugccaauguggaguaugu

SEQ ID NO: 262191 - RNA, 19 nt, Homo sapiens
guggaaagggucacuguca

SEQ ID NO: 262192 - RNA, 19 nt, Homo sapiens
ggguaaggcugaggaucga

SEQ ID NO: 262193 - RNA, 19 nt, Homo sapiens
caaauauccagcccaucuu

SEQ ID NO: 262194 - RNA, 19 nt, Homo sapiens
gaguuugacuacccuucug

SEQ ID NO: 262195 - RNA, 19 nt, Homo sapiens
ucacuucagacgacacauu

SEQ ID NO: 262196 - RNA, 19 nt, Homo sapiens
aagggucacugucaaugug

SEQ ID NO: 262197 - RNA, 19 nt, Homo sapiens
gcagcacagaguuugacua

SEQ ID NO: 262198 - RNA, 19 nt, Homo sapiens
gccaccacccuacuucauu

SEQ ID NO: 262199 - RNA, 19 nt, Homo sapiens
cauggacaguugcaucagu

SEQ ID NO: 262200 - RNA, 19 nt, Homo sapiens
gcauggugcaagcaacuga

SEQ ID NO: 262201 - RNA, 19 nt, Homo sapiens
cauggaugcuuauaauagc

SEQ ID NO: 262202 - RNA, 19 nt, Homo sapiens
cugaguaaacugauuccua

SEQ ID NO: 262203 - RNA, 19 nt, Homo sapiens
gcaggaagucacccauucu

SEQ ID NO: 262204 - RNA, 19 nt, Homo sapiens
ugcaggaagucacccauuc

SEQ ID NO: 262205 - RNA, 19 nt, Homo sapiens
ucaauccucgcuuucaaga

SEQ ID NO: 262206 - RNA, 19 nt, Homo sapiens
gaaggagcagcaacaacuc

SEQ ID NO: 262207 - RNA, 19 nt, Homo sapiens
guccacauuucuuacgaau

SEQ ID NO: 262208 - RNA, 19 nt, Homo sapiens
agacagucccacucucuga

SEQ ID NO: 262209 - RNA, 19 nt, Homo sapiens
agaaggagcagcaacaacu

SEQ ID NO: 262210 - RNA, 19 nt, Homo sapiens
caggagcugaguaaacuga

SEQ ID NO: 262211 - RNA, 19 nt, Homo sapiens
ggugcaagcaacugaacuu

SEQ ID NO: 262212 - RNA, 19 nt, Homo sapiens
gaagaucucuggaaacaua

SEQ ID NO: 262213 - RNA, 19 nt, Homo sapiens
ucacauagcugcugacuuu

SEQ ID NO: 262214 - RNA, 19 nt, Homo sapiens
gaacgaagacugacaagua

SEQ ID NO: 262215 - RNA, 19 nt, Homo sapiens
gcaaguauauucuaagguu

SEQ ID NO: 262216 - RNA, 19 nt, Homo sapiens
ugagaagccugaagaaaua

SEQ ID NO: 262217 - RNA, 19 nt, Homo sapiens
cugcaaaccucaauaauuu

SEQ ID NO: 262218 - RNA, 19 nt, Homo sapiens
gagcacugauuacacuuua

SEQ ID NO: 262219 - RNA, 19 nt, Homo sapiens
aaacauagauacaccagaa

SEQ ID NO: 262220 - RNA, 19 nt, Homo sapiens
aagaacagcuagaugaaua

SEQ ID NO: 262221 - RNA, 19 nt, Homo sapiens
ggaaacgauuuaucuagaa

SEQ ID NO: 262222 - RNA, 19 nt, Homo sapiens
acagaugacuggauuaauu

SEQ ID NO: 262223 - RNA, 19 nt, Homo sapiens
gaagagcacugauuacacu

SEQ ID NO: 262224 - RNA, 19 nt, Homo sapiens
gugaacagauacaaccuua

SEQ ID NO: 262225 - RNA, 19 nt, Homo sapiens
gaauguagauccucugaag

SEQ ID NO: 262226 - RNA, 19 nt, Homo sapiens
cgaccaaacuucagaaugu

SEQ ID NO: 262227 - RNA, 19 nt, Homo sapiens
gaacagauacaaccuuaau

SEQ ID NO: 262228 - RNA, 19 nt, Homo sapiens
gcagaaacgugacgagcaa

SEQ ID NO: 262229 - RNA, 19 nt, Homo sapiens
gacggaaacugucaucuga

SEQ ID NO: 262230 - RNA, 19 nt, Homo sapiens
gaaaagaggcuaaaagauu

SEQ ID NO: 262231 - RNA, 19 nt, Homo sapiens
ggaagcaacugcgcugauu

SEQ ID NO: 262232 - RNA, 19 nt, Homo sapiens
gaacaucacugaguuugag

SEQ ID NO: 262233 - RNA, 19 nt, Homo sapiens
gaauguggaugguguguuc

SEQ ID NO: 262234 - RNA, 19 nt, Homo sapiens
gcauaguggugcccaauga

SEQ ID NO: 262235 - RNA, 19 nt, Homo sapiens
caaugucacuuuaucagaa

SEQ ID NO: 262236 - RNA, 19 nt, Homo sapiens
gcauguguguuuaugguuu

SEQ ID NO: 262237 - RNA, 19 nt, Homo sapiens
gaaauguucaugucacaaa

SEQ ID NO: 262238 - RNA, 19 nt, Homo sapiens
gccaaacacuucaacaguu

SEQ ID NO: 262239 - RNA, 19 nt, Homo sapiens
ucaagaggauuucauuuca

SEQ ID NO: 262240 - RNA, 19 nt, Homo sapiens
caacagaggaccuaaagga

SEQ ID NO: 262241 - RNA, 19 nt, Homo sapiens
gagcaaugaugaaguucuu

SEQ ID NO: 262242 - RNA, 19 nt, Homo sapiens
gacaagaacagcuagauga

SEQ ID NO: 262243 - RNA, 19 nt, Homo sapiens
ugauuacacuuuacaggua

SEQ ID NO: 262244 - RNA, 19 nt, Homo sapiens
guacaaggcaucuauuuua

SEQ ID NO: 262245 - RNA, 19 nt, Homo sapiens
gaauagacaagaacagcua

SEQ ID NO: 262246 - RNA, 19 nt, Homo sapiens
cuuaaaguccugaucauua

SEQ ID NO: 262247 - RNA, 19 nt, Homo sapiens
gacgagcaaugaugaaguu

SEQ ID NO: 262248 - RNA, 19 nt, Homo sapiens
gaagugaacguugugauau

SEQ ID NO: 262249 - RNA, 19 nt, Homo sapiens
cagaugacuggauuaauua

SEQ ID NO: 262250 - RNA, 19 nt, Homo sapiens
acagcuagaugaauaaaug

SEQ ID NO: 262251 - RNA, 19 nt, Homo sapiens
caauuugucucaggcuaua

SEQ ID NO: 262252 - RNA, 19 nt, Homo sapiens
cagagaacaucacugaguu

SEQ ID NO: 262253 - RNA, 19 nt, Homo sapiens
ugacagagaacaucacuga

SEQ ID NO: 262254 - RNA, 19 nt, Homo sapiens
gauacuaauuccagcauuc

SEQ ID NO: 262255 - RNA, 19 nt, Homo sapiens
gaaaguguguagaugaaac

SEQ ID NO: 262256 - RNA, 19 nt, Homo sapiens
ugagaaagcaguucauaga

SEQ ID NO: 262257 - RNA, 19 nt, Homo sapiens
gcaaauuaaaugcucauga

SEQ ID NO: 262258 - RNA, 19 nt, Homo sapiens
cggaaacugucaucugaaa

SEQ ID NO: 262259 - RNA, 19 nt, Homo sapiens
caaauuggcaggcauagug

SEQ ID NO: 262260 - RNA, 19 nt, Homo sapiens
ugacuuucgucuuggauuu

SEQ ID NO: 262261 - RNA, 19 nt, Homo sapiens
ccaaguguuuccaguguga

SEQ ID NO: 262262 - RNA, 19 nt, Homo sapiens
gaagcucauuucagaagug

SEQ ID NO: 262263 - RNA, 19 nt, Homo sapiens
gcugcaaaccucaauaauu

SEQ ID NO: 262264 - RNA, 19 nt, Homo sapiens
gggccaaggugaagacaau

SEQ ID NO: 262265 - RNA, 19 nt, Homo sapiens
gcucuucgcuaagcugauu

SEQ ID NO: 262266 - RNA, 19 nt, Homo sapiens
cuacaaggguacaguaauc

SEQ ID NO: 262267 - RNA, 19 nt, Homo sapiens
aaacuggaauuguaugcaa

SEQ ID NO: 262268 - RNA, 19 nt, Homo sapiens
ggaagaggcacgugugugu

SEQ ID NO: 262269 - RNA, 19 nt, Homo sapiens
ucgcuaagcugauuuaugc

SEQ ID NO: 262270 - RNA, 19 nt, Homo sapiens
gcaagucacacaaggauca

SEQ ID NO: 262271 - RNA, 19 nt, Homo sapiens
gcaagauggauacuaauuc

SEQ ID NO: 262272 - RNA, 19 nt, Homo sapiens
gcacuggacaugugaggaa

SEQ ID NO: 262273 - RNA, 19 nt, Homo sapiens
gugagagaguuuagcauug

SEQ ID NO: 262274 - RNA, 19 nt, Homo sapiens
gugagaagccugaagaaau

SEQ ID NO: 262275 - RNA, 19 nt, Homo sapiens
guguuuggcucuucgcuaa

SEQ ID NO: 262276 - RNA, 19 nt, Homo sapiens
ucaggcagcugucugugaa

SEQ ID NO: 262277 - RNA, 19 nt, Homo sapiens
gaacguugugauauuguuu

SEQ ID NO: 262278 - RNA, 19 nt, Homo sapiens
cuaaguuacuacugccaua

SEQ ID NO: 262279 - RNA, 19 nt, Homo sapiens
gaacagcuagaugaauaaa

SEQ ID NO: 262280 - RNA, 19 nt, Homo sapiens
gcacaagagcagucaccua

SEQ ID NO: 262281 - RNA, 19 nt, Homo sapiens
gaccaaacuucagaauguu

SEQ ID NO: 262282 - RNA, 19 nt, Homo sapiens
gcccagcacugugucaauu

SEQ ID NO: 262283 - RNA, 19 nt, Homo sapiens
ggacaacagaggaccuaaa

SEQ ID NO: 262284 - RNA, 19 nt, Homo sapiens
ucaaugcagugacuacaau

SEQ ID NO: 262285 - RNA, 19 nt, Homo sapiens
uggaaacgauuuaucuaga

SEQ ID NO: 262286 - RNA, 19 nt, Homo sapiens
ccagcauucucuccucuuu

SEQ ID NO: 262287 - RNA, 19 nt, Homo sapiens
aaaugugucuuacuacugu

SEQ ID NO: 262288 - RNA, 19 nt, Homo sapiens
uuaaaguccugaucauuag

SEQ ID NO: 262289 - RNA, 19 nt, Homo sapiens
ucagguggaucaagaagug

SEQ ID NO: 262290 - RNA, 19 nt, Homo sapiens
ugacagaucagacgucuca

SEQ ID NO: 262291 - RNA, 19 nt, Homo sapiens
agaaagcaguucauagaca

SEQ ID NO: 262292 - RNA, 19 nt, Homo sapiens
guuauaauacccacugaaa

SEQ ID NO: 262293 - RNA, 19 nt, Homo sapiens
ggucgaggaguuuguguuu

SEQ ID NO: 262294 - RNA, 19 nt, Homo sapiens
gcaaagcugcaacuaaugg

SEQ ID NO: 262295 - RNA, 19 nt, Homo sapiens
uuauguaugucacagauga

SEQ ID NO: 262296 - RNA, 19 nt, Homo sapiens
ugagagaguuuagcauugu

SEQ ID NO: 262297 - RNA, 19 nt, Homo sapiens
agagaacaaugcugugaga

SEQ ID NO: 262298 - RNA, 19 nt, Homo sapiens
cagaggaccuaaaggaaag

SEQ ID NO: 262299 - RNA, 19 nt, Homo sapiens
gaaacgugacgagcaauga

SEQ ID NO: 262300 - RNA, 19 nt, Homo sapiens
cgucucaucucgcucuuga

SEQ ID NO: 262301 - RNA, 19 nt, Homo sapiens
aaaagaggcuaaaagauug

SEQ ID NO: 262302 - RNA, 19 nt, Homo sapiens
guugugauauuguuuccaa

SEQ ID NO: 262303 - RNA, 19 nt, Homo sapiens
agaagugaacguugugaua

SEQ ID NO: 262304 - RNA, 19 nt, Homo sapiens
ccucuuugccuuuauguuu

SEQ ID NO: 262305 - RNA, 19 nt, Homo sapiens
ggccaagugugcaguggaa

SEQ ID NO: 262306 - RNA, 19 nt, Homo sapiens
ggauacuaauuccagcauu

SEQ ID NO: 262307 - RNA, 19 nt, Homo sapiens
ugacaaguauccucaucau

SEQ ID NO: 262308 - RNA, 19 nt, Homo sapiens
aaaggaaaguguguagaug

SEQ ID NO: 262309 - RNA, 19 nt, Homo sapiens
uaaaggaaaguguguagau

SEQ ID NO: 262310 - RNA, 19 nt, Homo sapiens
uaacauuaccgccaucugu

SEQ ID NO: 262311 - RNA, 19 nt, Homo sapiens
aaagauugcugcuggugau

SEQ ID NO: 262312 - RNA, 19 nt, Homo sapiens
ggacaagaauucaguauaa

SEQ ID NO: 262313 - RNA, 19 nt, Homo sapiens
ugacaaacaugaacaagaa

SEQ ID NO: 262314 - RNA, 19 nt, Homo sapiens
ggagaacuauggagcaauu

SEQ ID NO: 262315 - RNA, 19 nt, Homo sapiens
acaagcagcucaagacuuu

SEQ ID NO: 262316 - RNA, 19 nt, Homo sapiens
gcgcauugcugacaacaaa

SEQ ID NO: 262317 - RNA, 19 nt, Homo sapiens
ggucaacacugccaaugaa

SEQ ID NO: 262318 - RNA, 19 nt, Homo sapiens
cagcaaccaugccucaaua

SEQ ID NO: 262319 - RNA, 19 nt, Homo sapiens
gaauugagaucuugaacca

SEQ ID NO: 262320 - RNA, 19 nt, Homo sapiens
gaaauugucaucaaaguca

SEQ ID NO: 262321 - RNA, 19 nt, Homo sapiens
ccaagcagcuggugcauca

SEQ ID NO: 262322 - RNA, 19 nt, Homo sapiens
ccucaugccuuccauuaaa

SEQ ID NO: 262323 - RNA, 19 nt, Homo sapiens
ggaugucgcuggacuaugg

SEQ ID NO: 262324 - RNA, 19 nt, Homo sapiens
ggacacagacccucacuuc

SEQ ID NO: 262325 - RNA, 19 nt, Homo sapiens
ggaagugacuccucagaac

SEQ ID NO: 262326 - RNA, 19 nt, Homo sapiens
ggacuacuuugaccugguu

SEQ ID NO: 262327 - RNA, 19 nt, Homo sapiens
gauggugccuacacugauu

SEQ ID NO: 262328 - RNA, 19 nt, Homo sapiens
gaacuggcagcccaaacua

SEQ ID NO: 262329 - RNA, 19 nt, Homo sapiens
aaagucaacugcaaaguca

SEQ ID NO: 262330 - RNA, 19 nt, Homo sapiens
caauguggacuuuaacuuu

SEQ ID NO: 262331 - RNA, 19 nt, Homo sapiens
ccacuuugcccacuucuuu

SEQ ID NO: 262332 - RNA, 19 nt, Homo sapiens
cacaugcucuacauccuua

SEQ ID NO: 262333 - RNA, 19 nt, Homo sapiens
cguuucagcugacuuauga

SEQ ID NO: 262334 - RNA, 19 nt, Homo sapiens
uaaccugccuaguggauga

SEQ ID NO: 262335 - RNA, 19 nt, Homo sapiens
gaaagucaacugcaaaguc

SEQ ID NO: 262336 - RNA, 19 nt, Homo sapiens
gagaaaccauaugcaguau

SEQ ID NO: 262337 - RNA, 19 nt, Homo sapiens
gcagauggaaacgcauuua

SEQ ID NO: 262338 - RNA, 19 nt, Homo sapiens
agagaaaccauaugcagua

SEQ ID NO: 262339 - RNA, 19 nt, Homo sapiens
agacagcauucaucaguga

SEQ ID NO: 262340 - RNA, 19 nt, Homo sapiens
gaaccaccauaaacaguac

SEQ ID NO: 262341 - RNA, 19 nt, Homo sapiens
gcugguuccuugugucaaa

SEQ ID NO: 262342 - RNA, 19 nt, Homo sapiens
cuacgaaggcucagagauu

SEQ ID NO: 262343 - RNA, 19 nt, Homo sapiens
aggaagugcugaagagaaa

SEQ ID NO: 262344 - RNA, 19 nt, Homo sapiens
gggacaagaauucaguaua

SEQ ID NO: 262345 - RNA, 19 nt, Homo sapiens
ccucaauacucaucauguu

SEQ ID NO: 262346 - RNA, 19 nt, Homo sapiens
caagacagcauucaucagu

SEQ ID NO: 262347 - RNA, 19 nt, Homo sapiens
ccacggacuuucaguugga

SEQ ID NO: 262348 - RNA, 19 nt, Homo sapiens
ggcuguaccuccuugacua

SEQ ID NO: 262349 - RNA, 19 nt, Homo sapiens
ucacguuucagcugacuua

SEQ ID NO: 262350 - RNA, 19 nt, Homo sapiens
ucagcugacuuaugaggaa

SEQ ID NO: 262351 - RNA, 19 nt, Homo sapiens
gaagugacuccucagaaca

SEQ ID NO: 262352 - RNA, 19 nt, Homo sapiens
aaccaugccucaauacuca

SEQ ID NO: 262353 - RNA, 19 nt, Homo sapiens
gggcugcuguugugcaugu

SEQ ID NO: 262354 - RNA, 19 nt, Homo sapiens
gcugguggauguggauuug

SEQ ID NO: 262355 - RNA, 19 nt, Homo sapiens
gaaagccucccagaacuca

SEQ ID NO: 262356 - RNA, 19 nt, Homo sapiens
gaggaagugcugaagagaa

SEQ ID NO: 262357 - RNA, 19 nt, Homo sapiens
aaagagaggccguguccaa

SEQ ID NO: 262358 - RNA, 19 nt, Homo sapiens
uacgaaggcucagagauug

SEQ ID NO: 262359 - RNA, 19 nt, Homo sapiens
guucccaaauccucaagaa

SEQ ID NO: 262360 - RNA, 19 nt, Homo sapiens
agagcaaggucacguuuca

SEQ ID NO: 262361 - RNA, 19 nt, Homo sapiens
ccugguaucucuccucauc

SEQ ID NO: 262362 - RNA, 19 nt, Homo sapiens
caccucaugccuuccauua

SEQ ID NO: 262363 - RNA, 19 nt, Homo sapiens
aacacaggcuucucaguga

SEQ ID NO: 262364 - RNA, 19 nt, Homo sapiens
gaaucuacgaggaccauga

SEQ ID NO: 262365 - RNA, 19 nt, Homo sapiens
ggaaccugguggugucugu

SEQ ID NO: 262366 - RNA, 19 nt, Homo sapiens
gaggacacccugugcuuca

SEQ ID NO: 262367 - RNA, 19 nt, Homo sapiens
gugccuacacugauuauau

SEQ ID NO: 262368 - RNA, 19 nt, Homo sapiens
gagguguccugcugguuca

SEQ ID NO: 262369 - RNA, 19 nt, Homo sapiens
ucuaugugcuggacaguca

SEQ ID NO: 262370 - RNA, 19 nt, Homo sapiens
caguauaaccugccuagug

SEQ ID NO: 262371 - RNA, 19 nt, Homo sapiens
ggauguggauuugcaguac

SEQ ID NO: 262372 - RNA, 19 nt, Homo sapiens
aauguggacuuuaacuuuc

SEQ ID NO: 262373 - RNA, 19 nt, Homo sapiens
uaaccacuuugcccacuuc

SEQ ID NO: 262374 - RNA, 19 nt, Homo sapiens
gugcugaagagaaaccaua

SEQ ID NO: 262375 - RNA, 19 nt, Homo sapiens
gauggaaacgcauuuaucg

SEQ ID NO: 262376 - RNA, 19 nt, Homo sapiens
ggacagcucauuggcaaca

SEQ ID NO: 262377 - RNA, 19 nt, Homo sapiens
cacagacccucacuucauc

SEQ ID NO: 262378 - RNA, 19 nt, Homo sapiens
gacaagaauucaguauaac

SEQ ID NO: 262379 - RNA, 19 nt, Homo sapiens
gcagguucccgcucuacaa

SEQ ID NO: 262380 - RNA, 19 nt, Homo sapiens
gcugguucauucacaacaa

SEQ ID NO: 262381 - RNA, 19 nt, Homo sapiens
acacaggcuucucagugaa

SEQ ID NO: 262382 - RNA, 19 nt, Homo sapiens
ccauaaacaguacuacgaa

SEQ ID NO: 262383 - RNA, 19 nt, Homo sapiens
ccggaaagcagcuaucuca

SEQ ID NO: 262384 - RNA, 19 nt, Homo sapiens
ggacuuccugggcuucuau

SEQ ID NO: 262385 - RNA, 19 nt, Homo sapiens
acacagacccucacuucau

SEQ ID NO: 262386 - RNA, 19 nt, Homo sapiens
ggagggacaagaauucagu

SEQ ID NO: 262387 - RNA, 19 nt, Homo sapiens
aggaggagaugaagaaacu

SEQ ID NO: 262388 - RNA, 19 nt, Homo sapiens
ugacccagaaccaccauaa

SEQ ID NO: 262389 - RNA, 19 nt, Homo sapiens
caggaaagccucccagaac

SEQ ID NO: 262390 - RNA, 19 nt, Homo sapiens
ggaacuggcagcccaaacu

SEQ ID NO: 262391 - RNA, 19 nt, Homo sapiens
gggccuaccucaccaucca

SEQ ID NO: 262392 - RNA, 19 nt, Homo sapiens
agaaccaccauaaacagua

SEQ ID NO: 262393 - RNA, 19 nt, Homo sapiens
ccagagcaaggucacguuu

SEQ ID NO: 262394 - RNA, 19 nt, Homo sapiens
cagaggauucuccgccuuu

SEQ ID NO: 262395 - RNA, 19 nt, Homo sapiens
cccaaacuaucaagaaguc

SEQ ID NO: 262396 - RNA, 19 nt, Homo sapiens
gcuguaccuccuugacuaa

SEQ ID NO: 262397 - RNA, 19 nt, Homo sapiens
ugaccggcguggacacaga

SEQ ID NO: 262398 - RNA, 19 nt, Homo sapiens
ggaaagccucccagaacuc

SEQ ID NO: 262399 - RNA, 19 nt, Homo sapiens
ugccuacacugauuauauc

SEQ ID NO: 262400 - RNA, 19 nt, Homo sapiens
gcuacaggcagguccaaga

SEQ ID NO: 262401 - RNA, 19 nt, Homo sapiens
gagggacaagaauucagua

SEQ ID NO: 262402 - RNA, 19 nt, Homo sapiens
ucaggaaagccucccagaa

SEQ ID NO: 262403 - RNA, 19 nt, Homo sapiens
caucaguggcuccaugaga

SEQ ID NO: 262404 - RNA, 19 nt, Homo sapiens
caaugaagccagggaagug

SEQ ID NO: 262405 - RNA, 19 nt, Homo sapiens
cuaagcugguuccuugugu

SEQ ID NO: 262406 - RNA, 19 nt, Homo sapiens
caaccaugccucaauacuc

SEQ ID NO: 262407 - RNA, 19 nt, Homo sapiens
caugagaggccagaaagug

SEQ ID NO: 262408 - RNA, 19 nt, Homo sapiens
gacaucaguggcuccauga

SEQ ID NO: 262409 - RNA, 19 nt, Homo sapiens
ccacaugcucuacauccuu

SEQ ID NO: 262410 - RNA, 19 nt, Homo sapiens
ucgcuucgcccacuauguu

SEQ ID NO: 262411 - RNA, 19 nt, Homo sapiens
gacccagaaccaccauaaa

SEQ ID NO: 262412 - RNA, 19 nt, Homo sapiens
ggacugagauuucuucaug

SEQ ID NO: 262413 - RNA, 19 nt, Homo sapiens
ggaagagguugaucaagua

SEQ ID NO: 262414 - RNA, 19 nt, Homo sapiens
gcaaaguggugaacaauuc

SEQ ID NO: 262415 - RNA, 19 nt, Homo sapiens
gaacggaucuaguguuugg

SEQ ID NO: 262416 - RNA, 19 nt, Homo sapiens
caaacaaguucucaccuaa

SEQ ID NO: 262417 - RNA, 19 nt, Homo sapiens
gcacaaaggauuuauggaa

SEQ ID NO: 262418 - RNA, 19 nt, Homo sapiens
ugaagagacuguccaauga

SEQ ID NO: 262419 - RNA, 19 nt, Homo sapiens
gcaaagugguuccagauuc

SEQ ID NO: 262420 - RNA, 19 nt, Homo sapiens
gaagaagcaucccgucaau

SEQ ID NO: 262421 - RNA, 19 nt, Homo sapiens
gaaugaagccaauaacuug

SEQ ID NO: 262422 - RNA, 19 nt, Homo sapiens
gauuugauguggacuauga

SEQ ID NO: 262423 - RNA, 19 nt, Homo sapiens
gagcaaaggugcaguucga

SEQ ID NO: 262424 - RNA, 19 nt, Homo sapiens
aaaguccagucuacuauua

SEQ ID NO: 262425 - RNA, 19 nt, Homo sapiens
gaagaccauuucucuguga

SEQ ID NO: 262426 - RNA, 19 nt, Homo sapiens
gaaacaaacuguggaagca

SEQ ID NO: 262427 - RNA, 19 nt, Homo sapiens
caagagguauauugagaaa

SEQ ID NO: 262428 - RNA, 19 nt, Homo sapiens
cagaacggaucuaguguuu

SEQ ID NO: 262429 - RNA, 19 nt, Homo sapiens
aaacacagguugcagauag

SEQ ID NO: 262430 - RNA, 19 nt, Homo sapiens
ggacacgucuucccagcuu

SEQ ID NO: 262431 - RNA, 19 nt, Homo sapiens
gaucaaauagagagcguua

SEQ ID NO: 262432 - RNA, 19 nt, Homo sapiens
gccaagagguauauugaga

SEQ ID NO: 262433 - RNA, 19 nt, Homo sapiens
caagaucgauccugcagau

SEQ ID NO: 262434 - RNA, 19 nt, Homo sapiens
cacaaaggauuuauggaaa

SEQ ID NO: 262435 - RNA, 19 nt, Homo sapiens
gagcauucauuuccaacuu

SEQ ID NO: 262436 - RNA, 19 nt, Homo sapiens
gcagagaaccggagauauc

SEQ ID NO: 262437 - RNA, 19 nt, Homo sapiens
gacguuaccugcugguuug

SEQ ID NO: 262438 - RNA, 19 nt, Homo sapiens
auacacaucuucaaugaga

SEQ ID NO: 262439 - RNA, 19 nt, Homo sapiens
acaaacaaguucucaccua

SEQ ID NO: 262440 - RNA, 19 nt, Homo sapiens
ccaagaagcccaacaaugg

SEQ ID NO: 262441 - RNA, 19 nt, Homo sapiens
ggaauugcacaaaggauuu

SEQ ID NO: 262442 - RNA, 19 nt, Homo sapiens
gaacuggagguguuuaaug

SEQ ID NO: 262443 - RNA, 19 nt, Homo sapiens
gagaacauccaagacaaua

SEQ ID NO: 262444 - RNA, 19 nt, Homo sapiens
cggaagaaaugauggaaga

SEQ ID NO: 262445 - RNA, 19 nt, Homo sapiens
uauaaagccuguaaacaca

SEQ ID NO: 262446 - RNA, 19 nt, Homo sapiens
gcaaaacuguccagcaaaa

SEQ ID NO: 262447 - RNA, 19 nt, Homo sapiens
cauauuggaugaccucaga

SEQ ID NO: 262448 - RNA, 19 nt, Homo sapiens
gugcagaucucagugaaga

SEQ ID NO: 262449 - RNA, 19 nt, Homo sapiens
gcaugcagaucccgauuuc

SEQ ID NO: 262450 - RNA, 19 nt, Homo sapiens
ggaagaagcaucccgucaa

SEQ ID NO: 262451 - RNA, 19 nt, Homo sapiens
gaacauccaagacaauauc

SEQ ID NO: 262452 - RNA, 19 nt, Homo sapiens
ggagcucuauuaaggagaa

SEQ ID NO: 262453 - RNA, 19 nt, Homo sapiens
gcagauauucuucgguuug

SEQ ID NO: 262454 - RNA, 19 nt, Homo sapiens
gaagagacuguccaaugaa

SEQ ID NO: 262455 - RNA, 19 nt, Homo sapiens
gcuauaaaguccagucuac

SEQ ID NO: 262456 - RNA, 19 nt, Homo sapiens
ggacguuaccugcugguuu

SEQ ID NO: 262457 - RNA, 19 nt, Homo sapiens
cuucccagcuuaagaaauu

SEQ ID NO: 262458 - RNA, 19 nt, Homo sapiens
gcagauagccaagagguau

SEQ ID NO: 262459 - RNA, 19 nt, Homo sapiens
gcagcgcucuugauaugga

SEQ ID NO: 262460 - RNA, 19 nt, Homo sapiens
acauuuaggagcucuauua

SEQ ID NO: 262461 - RNA, 19 nt, Homo sapiens
ucaaguaacucuuuauagc

SEQ ID NO: 262462 - RNA, 19 nt, Homo sapiens
uaaagcccacggacuaaua

SEQ ID NO: 262463 - RNA, 19 nt, Homo sapiens
acaaggaucucaggugcua

SEQ ID NO: 262464 - RNA, 19 nt, Homo sapiens
gaccauuucucugugauug

SEQ ID NO: 262465 - RNA, 19 nt, Homo sapiens
ccagauaucagggugguua

SEQ ID NO: 262466 - RNA, 19 nt, Homo sapiens
ugaagaccauauuggauga

SEQ ID NO: 262467 - RNA, 19 nt, Homo sapiens
ggagguguuuaauggauau

SEQ ID NO: 262468 - RNA, 19 nt, Homo sapiens
agagaaggcuggugaacug

SEQ ID NO: 262469 - RNA, 19 nt, Homo sapiens
ggccaaacacuuagaggua

SEQ ID NO: 262470 - RNA, 19 nt, Homo sapiens
cuaugaagaucuuguggaa

SEQ ID NO: 262471 - RNA, 19 nt, Homo sapiens
gaagagguugaucaaguaa

SEQ ID NO: 262472 - RNA, 19 nt, Homo sapiens
auaucagggugguuaauua

SEQ ID NO: 262473 - RNA, 19 nt, Homo sapiens
gaauugcacaaaggauuua

SEQ ID NO: 262474 - RNA, 19 nt, Homo sapiens
gggccgagcucuuuaugca

SEQ ID NO: 262475 - RNA, 19 nt, Homo sapiens
gauaucagggugguuuaua

SEQ ID NO: 262476 - RNA, 19 nt, Homo sapiens
gacccacauuucaucauuu

SEQ ID NO: 262477 - RNA, 19 nt, Homo sapiens
ugacccacauuucaucauu

SEQ ID NO: 262478 - RNA, 19 nt, Homo sapiens
ggacgucacucaaaacaau

SEQ ID NO: 262479 - RNA, 19 nt, Homo sapiens
uggaagagguugaucaagu

SEQ ID NO: 262480 - RNA, 19 nt, Homo sapiens
gcacaacaguggaaaagga

SEQ ID NO: 262481 - RNA, 19 nt, Homo sapiens
gcagaucucagugaagaaa

SEQ ID NO: 262482 - RNA, 19 nt, Homo sapiens
ggucauuucuaaaggacaa

SEQ ID NO: 262483 - RNA, 19 nt, Homo sapiens
ccacagggacugagauuuc

SEQ ID NO: 262484 - RNA, 19 nt, Homo sapiens
gagauguccuuuucuguuu

SEQ ID NO: 262485 - RNA, 19 nt, Homo sapiens
gccaagagaagaauuacaa

SEQ ID NO: 262486 - RNA, 19 nt, Homo sapiens
ugaaugaagccaauaacuu

SEQ ID NO: 262487 - RNA, 19 nt, Homo sapiens
uauaaaguccagucuacua

SEQ ID NO: 262488 - RNA, 19 nt, Homo sapiens
gauaucagggugguuaauu

SEQ ID NO: 262489 - RNA, 19 nt, Homo sapiens
cuacagaacggaucuagug

SEQ ID NO: 262490 - RNA, 19 nt, Homo sapiens
gggccuaucuaaccaucaa

SEQ ID NO: 262491 - RNA, 19 nt, Homo sapiens
gaaaccaggacacgucuuc

SEQ ID NO: 262492 - RNA, 19 nt, Homo sapiens
ggacuaauaggccaguuca

SEQ ID NO: 262493 - RNA, 19 nt, Homo sapiens
uuuccaaagugaagacaua

SEQ ID NO: 262494 - RNA, 19 nt, Homo sapiens
acccacauuucaucauuua

SEQ ID NO: 262495 - RNA, 19 nt, Homo sapiens
caagagaagaauuacaaga

SEQ ID NO: 262496 - RNA, 19 nt, Homo sapiens
aagagacuguccaaugaaa

SEQ ID NO: 262497 - RNA, 19 nt, Homo sapiens
gggaacugguggugcugua

SEQ ID NO: 262498 - RNA, 19 nt, Homo sapiens
uuuaggagcucuauuaagg

SEQ ID NO: 262499 - RNA, 19 nt, Homo sapiens
gcucaagucacgaaucaga

SEQ ID NO: 262500 - RNA, 19 nt, Homo sapiens
agagaagaauuacaagauc

SEQ ID NO: 262501 - RNA, 19 nt, Homo sapiens
gaaacugugggccuaucua

SEQ ID NO: 262502 - RNA, 19 nt, Homo sapiens
gaaagacaagcaugcagau

SEQ ID NO: 262503 - RNA, 19 nt, Homo sapiens
gcacaggaucuaucugcaa

SEQ ID NO: 262504 - RNA, 19 nt, Homo sapiens
cagauauucuucgguuuga

SEQ ID NO: 262505 - RNA, 19 nt, Homo sapiens
gcucuacagcuuucucaaa

SEQ ID NO: 262506 - RNA, 19 nt, Homo sapiens
ccacaugugaugagaguug

SEQ ID NO: 262507 - RNA, 19 nt, Homo sapiens
gaucgauccugcagauguc

SEQ ID NO: 262508 - RNA, 19 nt, Homo sapiens
caaaggagcauucauuucc

SEQ ID NO: 262509 - RNA, 19 nt, Homo sapiens
auaucagggugguuuauaa

SEQ ID NO: 262510 - RNA, 19 nt, Homo sapiens
ccagauaucagggugguuu

SEQ ID NO: 262511 - RNA, 19 nt, Homo sapiens
uaucagggugguuaauuaa

SEQ ID NO: 262512 - RNA, 19 nt, Homo sapiens
gaacguggccuuugugauu

SEQ ID NO: 262513 - RNA, 19 nt, Homo sapiens
ggaggaaguuggagaaguu

SEQ ID NO: 262514 - RNA, 19 nt, Homo sapiens
ucacaggccucacaguuaa

SEQ ID NO: 262515 - RNA, 19 nt, Homo sapiens
gaggaagacuaucugaauu

SEQ ID NO: 262516 - RNA, 19 nt, Homo sapiens
gaaggaaguugccaagaag

SEQ ID NO: 262517 - RNA, 19 nt, Homo sapiens
gaacaugguggucuccuuu

SEQ ID NO: 262518 - RNA, 19 nt, Homo sapiens
gcagaucacuggcgacaag

SEQ ID NO: 262519 - RNA, 19 nt, Homo sapiens
ugaagagcauggaggauaa

SEQ ID NO: 262520 - RNA, 19 nt, Homo sapiens
gggccuaccucaccauuga

SEQ ID NO: 262521 - RNA, 19 nt, Homo sapiens
gauagucaauggcuacuuc

SEQ ID NO: 262522 - RNA, 19 nt, Homo sapiens
gaagaucaccuguggaaca

SEQ ID NO: 262523 - RNA, 19 nt, Homo sapiens
gagaagaucaccuguggaa

SEQ ID NO: 262524 - RNA, 19 nt, Homo sapiens
agaaggaaguugccaagaa

SEQ ID NO: 262525 - RNA, 19 nt, Homo sapiens
cagaggagguggacaugaa

SEQ ID NO: 262526 - RNA, 19 nt, Homo sapiens
ggaagacuaucugaauuuc

SEQ ID NO: 262527 - RNA, 19 nt, Homo sapiens
ggacucugaugccgauuug

SEQ ID NO: 262528 - RNA, 19 nt, Homo sapiens
gcugaggccucuuucauca

SEQ ID NO: 262529 - RNA, 19 nt, Homo sapiens
caaagucaccuucgagcua

SEQ ID NO: 262530 - RNA, 19 nt, Homo sapiens
ggagaagggcugauugaug

SEQ ID NO: 262531 - RNA, 19 nt, Homo sapiens
ggaaugaccaacaucaaug

SEQ ID NO: 262532 - RNA, 19 nt, Homo sapiens
ucagaauccuggaagauau

SEQ ID NO: 262533 - RNA, 19 nt, Homo sapiens
caauggagauuucacuauc

SEQ ID NO: 262534 - RNA, 19 nt, Homo sapiens
cuaagcaacuggucaaaca

SEQ ID NO: 262535 - RNA, 19 nt, Homo sapiens
gaagcgcccucaccaaguc

SEQ ID NO: 262536 - RNA, 19 nt, Homo sapiens
gcaauucuuccaacccuuu

SEQ ID NO: 262537 - RNA, 19 nt, Homo sapiens
gaaugaccaacaucaauga

SEQ ID NO: 262538 - RNA, 19 nt, Homo sapiens
gaaauuagagcagacaaag

SEQ ID NO: 262539 - RNA, 19 nt, Homo sapiens
gagcauggaggauaaagga

SEQ ID NO: 262540 - RNA, 19 nt, Homo sapiens
ggaaauuagagcagacaaa

SEQ ID NO: 262541 - RNA, 19 nt, Homo sapiens
gaacauggcccuggagaac

SEQ ID NO: 262542 - RNA, 19 nt, Homo sapiens
cuaagaacguggccuuugu

SEQ ID NO: 262543 - RNA, 19 nt, Homo sapiens
cagauucccuccucaaugg

SEQ ID NO: 262544 - RNA, 19 nt, Homo sapiens
aaagucaccuucgagcuaa

SEQ ID NO: 262545 - RNA, 19 nt, Homo sapiens
ccaauggcaucgaggucua

SEQ ID NO: 262546 - RNA, 19 nt, Homo sapiens
ggugagagcagacccgaaa

SEQ ID NO: 262547 - RNA, 19 nt, Homo sapiens
aaagccagaugccacauug

SEQ ID NO: 262548 - RNA, 19 nt, Homo sapiens
gugaagagcauggaggaua

SEQ ID NO: 262549 - RNA, 19 nt, Homo sapiens
gaaagaggaagacuaucug

SEQ ID NO: 262550 - RNA, 19 nt, Homo sapiens
gcacuucuuugcaccucaa

SEQ ID NO: 262551 - RNA, 19 nt, Homo sapiens
ccuaugacgugaacagaga

SEQ ID NO: 262552 - RNA, 19 nt, Homo sapiens
gcaucgaggucuacaguac

SEQ ID NO: 262553 - RNA, 19 nt, Homo sapiens
ggcaacaaucugaauuaua

SEQ ID NO: 262554 - RNA, 19 nt, Homo sapiens
gagcacagaaucccagaga

SEQ ID NO: 262555 - RNA, 19 nt, Homo sapiens
gauaaaggaaugaccaaca

SEQ ID NO: 262556 - RNA, 19 nt, Homo sapiens
gcaacuggucaaacacuuu

SEQ ID NO: 262557 - RNA, 19 nt, Homo sapiens
gcaaugcucagauggacuu

SEQ ID NO: 262558 - RNA, 19 nt, Homo sapiens
gacuacaucuucgggaauu

SEQ ID NO: 262559 - RNA, 19 nt, Homo sapiens
gaacagcuuuaaggcagau

SEQ ID NO: 262560 - RNA, 19 nt, Homo sapiens
gcagcaaagucaccuucga

SEQ ID NO: 262561 - RNA, 19 nt, Homo sapiens
gggaggggcugggaaaaua

SEQ ID NO: 262562 - RNA, 19 nt, Homo sapiens
ccaagaccagaaagacuua

SEQ ID NO: 262563 - RNA, 19 nt, Homo sapiens
ugacuccacugaccucaau

SEQ ID NO: 262564 - RNA, 19 nt, Homo sapiens
gcauuuaugaggacucuga

SEQ ID NO: 262565 - RNA, 19 nt, Homo sapiens
caacggagaagggcugauu

SEQ ID NO: 262566 - RNA, 19 nt, Homo sapiens
gucacaggccucacaguua

SEQ ID NO: 262567 - RNA, 19 nt, Homo sapiens
uguccuaccugaccagcua

SEQ ID NO: 262568 - RNA, 19 nt, Homo sapiens
gaggacaugaacagcuuua

SEQ ID NO: 262569 - RNA, 19 nt, Homo sapiens
gcaccuccauugucaucau

SEQ ID NO: 262570 - RNA, 19 nt, Homo sapiens
uaugaaagaggaagacuau

SEQ ID NO: 262571 - RNA, 19 nt, Homo sapiens
ggacaugaacagcuuuaag

SEQ ID NO: 262572 - RNA, 19 nt, Homo sapiens
acacuuaccagcacuucua

SEQ ID NO: 262573 - RNA, 19 nt, Homo sapiens
ggacguuugugaagagcau

SEQ ID NO: 262574 - RNA, 19 nt, Homo sapiens
gccaagaagcaguaugaaa

SEQ ID NO: 262575 - RNA, 19 nt, Homo sapiens
uguccacacugacuacauu

SEQ ID NO: 262576 - RNA, 19 nt, Homo sapiens
ugaccaagccugaggacaa

SEQ ID NO: 262577 - RNA, 19 nt, Homo sapiens
cauggcuggucggaaauua

SEQ ID NO: 262578 - RNA, 19 nt, Homo sapiens
ccaagaagcaguaugaaaa

SEQ ID NO: 262579 - RNA, 19 nt, Homo sapiens
cauggaggauaaaggaaug

SEQ ID NO: 262580 - RNA, 19 nt, Homo sapiens
cuccauggcuggucggaaa

SEQ ID NO: 262581 - RNA, 19 nt, Homo sapiens
gagauuucacuaucaccua

SEQ ID NO: 262582 - RNA, 19 nt, Homo sapiens
ccaacccuuugacuuuaaa

SEQ ID NO: 262583 - RNA, 19 nt, Homo sapiens
acgaggagcugcugaagag

SEQ ID NO: 262584 - RNA, 19 nt, Homo sapiens
uuccaacccuuugacuuua

SEQ ID NO: 262585 - RNA, 19 nt, Homo sapiens
caagagaaugugcggaaug

SEQ ID NO: 262586 - RNA, 19 nt, Homo sapiens
auaaaggaaugaccaacau

SEQ ID NO: 262587 - RNA, 19 nt, Homo sapiens
gaagagcauggaggauaaa

SEQ ID NO: 262588 - RNA, 19 nt, Homo sapiens
ugaaagaggaagacuaucu

SEQ ID NO: 262589 - RNA, 19 nt, Homo sapiens
ugcccaaccuguacagauu

SEQ ID NO: 262590 - RNA, 19 nt, Homo sapiens
ggagcgggacuacaucuuc

SEQ ID NO: 262591 - RNA, 19 nt, Homo sapiens
gacaugaacagcuuuaagg

SEQ ID NO: 262592 - RNA, 19 nt, Homo sapiens
ugacggguguggagaugga

SEQ ID NO: 262593 - RNA, 19 nt, Homo sapiens
gcauggaggauaaaggaau

SEQ ID NO: 262594 - RNA, 19 nt, Homo sapiens
gccaggacguuugugaaga

SEQ ID NO: 262595 - RNA, 19 nt, Homo sapiens
agaggaagacuaucugaau

SEQ ID NO: 262596 - RNA, 19 nt, Homo sapiens
guacagauucccuccucaa

SEQ ID NO: 262597 - RNA, 19 nt, Homo sapiens
ccacuucaucauccaaauu

SEQ ID NO: 262598 - RNA, 19 nt, Homo sapiens
gcaguugcagggcuucuau

SEQ ID NO: 262599 - RNA, 19 nt, Homo sapiens
ggagguuuccuuugaugug

SEQ ID NO: 262600 - RNA, 19 nt, Homo sapiens
uggcaacaaucugaauuau

SEQ ID NO: 262601 - RNA, 19 nt, Homo sapiens
gggaggaaguuggagaagu

SEQ ID NO: 262602 - RNA, 19 nt, Homo sapiens
cuuccaacccuuugacuuu

SEQ ID NO: 262603 - RNA, 19 nt, Homo sapiens
gaucacuggcgacaagaga

SEQ ID NO: 262604 - RNA, 19 nt, Homo sapiens
ccaggacguuugugaagag

SEQ ID NO: 262605 - RNA, 19 nt, Homo sapiens
aggaagacuaucugaauuu

SEQ ID NO: 262606 - RNA, 19 nt, Homo sapiens
cuacuucgugcacuucuuu

SEQ ID NO: 262607 - RNA, 19 nt, Homo sapiens
ggaagcgcccucaccaagu

SEQ ID NO: 262608 - RNA, 19 nt, Homo sapiens
gaugcccucugcuucaaca

SEQ ID NO: 262609 - RNA, 19 nt, Homo sapiens
cauccaaauuccggagaaa

SEQ ID NO: 262610 - RNA, 19 nt, Homo sapiens
gaccaagccugaggacaac

SEQ ID NO: 262611 - RNA, 19 nt, Homo sapiens
ggacuacaucuucgggaau

SEQ ID NO: 262612 - RNA, 19 nt, Homo sapiens
gaaccaagcgcugaauuua

SEQ ID NO: 262613 - RNA, 19 nt, Homo sapiens
gaacaucacuuuccaaacg

SEQ ID NO: 262614 - RNA, 19 nt, Homo sapiens
ggagaaacauggagcaguu

SEQ ID NO: 262615 - RNA, 19 nt, Homo sapiens
caagagcagucucaaguug

SEQ ID NO: 262616 - RNA, 19 nt, Homo sapiens
ccaagaagaggauggaaua

SEQ ID NO: 262617 - RNA, 19 nt, Homo sapiens
ccaggagcauccagaauaa

SEQ ID NO: 262618 - RNA, 19 nt, Homo sapiens
gaacaaggccaggagcuuu

SEQ ID NO: 262619 - RNA, 19 nt, Homo sapiens
gaaaguagaaacaggaaug

SEQ ID NO: 262620 - RNA, 19 nt, Homo sapiens
ccaaguauaucuuccacaa

SEQ ID NO: 262621 - RNA, 19 nt, Homo sapiens
gcgcugaauuuaucacuug

SEQ ID NO: 262622 - RNA, 19 nt, Homo sapiens
ccuuugagcuggucuauga

SEQ ID NO: 262623 - RNA, 19 nt, Homo sapiens
gaagaaacaaccaugacaa

SEQ ID NO: 262624 - RNA, 19 nt, Homo sapiens
aaacaggaauguccacuca

SEQ ID NO: 262625 - RNA, 19 nt, Homo sapiens
ggaaccaagcgcugaauuu

SEQ ID NO: 262626 - RNA, 19 nt, Homo sapiens
gcugauggcugugcaguug

SEQ ID NO: 262627 - RNA, 19 nt, Homo sapiens
gagaacggcuacuuuguac

SEQ ID NO: 262628 - RNA, 19 nt, Homo sapiens
agauggagcugcccaagaa

SEQ ID NO: 262629 - RNA, 19 nt, Homo sapiens
gggaagcccuaaucaagau

SEQ ID NO: 262630 - RNA, 19 nt, Homo sapiens
gggcauaccugacuaucca

SEQ ID NO: 262631 - RNA, 19 nt, Homo sapiens
uaaccacaaugcccaagaa

SEQ ID NO: 262632 - RNA, 19 nt, Homo sapiens
ccacaaugcccaagaaugu

SEQ ID NO: 262633 - RNA, 19 nt, Homo sapiens
cgagaacggcuacuuugua

SEQ ID NO: 262634 - RNA, 19 nt, Homo sapiens
guuccacuuucuucaaaua

SEQ ID NO: 262635 - RNA, 19 nt, Homo sapiens
ccacucagguuccacuuuc

SEQ ID NO: 262636 - RNA, 19 nt, Homo sapiens
gaucgagaacggcuacuuu

SEQ ID NO: 262637 - RNA, 19 nt, Homo sapiens
cgaagaagcucugcguaca

SEQ ID NO: 262638 - RNA, 19 nt, Homo sapiens
ucacgccucucacaucuau

SEQ ID NO: 262639 - RNA, 19 nt, Homo sapiens
cuacacagaacaucacuuu

SEQ ID NO: 262640 - RNA, 19 nt, Homo sapiens
acagagagcaccuucauga

SEQ ID NO: 262641 - RNA, 19 nt, Homo sapiens
gaagaagcucugcguacaa

SEQ ID NO: 262642 - RNA, 19 nt, Homo sapiens
ucaagcaccugcagaugga

SEQ ID NO: 262643 - RNA, 19 nt, Homo sapiens
ucacuugccuacagcuuug

SEQ ID NO: 262644 - RNA, 19 nt, Homo sapiens
gugggaagcugccuacaca

SEQ ID NO: 262645 - RNA, 19 nt, Homo sapiens
agaauggcaucgacaucua

SEQ ID NO: 262646 - RNA, 19 nt, Homo sapiens
ggaagcugccuacacagaa

SEQ ID NO: 262647 - RNA, 19 nt, Homo sapiens
uggaggaggucacucagaa

SEQ ID NO: 262648 - RNA, 19 nt, Homo sapiens
cagugaaccugcucucaga

SEQ ID NO: 262649 - RNA, 19 nt, Homo sapiens
gagcugugcccacccugua

SEQ ID NO: 262650 - RNA, 19 nt, Homo sapiens
cagaacaucacuuuccaaa

SEQ ID NO: 262651 - RNA, 19 nt, Homo sapiens
cccaggagcauccagaaua

SEQ ID NO: 262652 - RNA, 19 nt, Homo sapiens
gagcuguaguucugaugga

SEQ ID NO: 262653 - RNA, 19 nt, Homo sapiens
gcuggucuguggagcugua

SEQ ID NO: 262654 - RNA, 19 nt, Homo sapiens
gcucagugacccagacaaa

SEQ ID NO: 262655 - RNA, 19 nt, Homo sapiens
ggagggaccaacaucaaug

SEQ ID NO: 262656 - RNA, 19 nt, Homo sapiens
ucaccaacuucuccaugaa

SEQ ID NO: 262657 - RNA, 19 nt, Homo sapiens
gagagcgcaggcuggauua

SEQ ID NO: 262658 - RNA, 19 nt, Homo sapiens
gaagcugccuacacagaac

SEQ ID NO: 262659 - RNA, 19 nt, Homo sapiens
gcuaugccuuccuggagaa

SEQ ID NO: 262660 - RNA, 19 nt, Homo sapiens
uguacgagcugcugcugaa

SEQ ID NO: 262661 - RNA, 19 nt, Homo sapiens
ugacagcagugaccuucga

SEQ ID NO: 262662 - RNA, 19 nt, Homo sapiens
ggacggcaaccucauuauc

SEQ ID NO: 262663 - RNA, 19 nt, Homo sapiens
caaacccgaugaccaagag

SEQ ID NO: 262664 - RNA, 19 nt, Homo sapiens
ggaggucacucagaacaac

SEQ ID NO: 262665 - RNA, 19 nt, Homo sapiens
cagcagugaccuucgagua

SEQ ID NO: 262666 - RNA, 19 nt, Homo sapiens
gaagcucugcguacaagug

SEQ ID NO: 262667 - RNA, 19 nt, Homo sapiens
gagggaccaacaucaauga

SEQ ID NO: 262668 - RNA, 19 nt, Homo sapiens
agaaagccuucaucaccaa

SEQ ID NO: 262669 - RNA, 19 nt, Homo sapiens
gaagaggauggaauagaca

SEQ ID NO: 262670 - RNA, 19 nt, Homo sapiens
agaagaggauggaauagac

SEQ ID NO: 262671 - RNA, 19 nt, Homo sapiens
accaagcgcugaauuuauc

SEQ ID NO: 262672 - RNA, 19 nt, Homo sapiens
gaagaugaccauggacaag

SEQ ID NO: 262673 - RNA, 19 nt, Homo sapiens
caccaaacccgaugaccaa

SEQ ID NO: 262674 - RNA, 19 nt, Homo sapiens
guccguaccugcagcaaag

SEQ ID NO: 262675 - RNA, 19 nt, Homo sapiens
gggaagcugccuacacaga

SEQ ID NO: 262676 - RNA, 19 nt, Homo sapiens
ucccacucauuacaaauaa

SEQ ID NO: 262677 - RNA, 19 nt, Homo sapiens
ugucucgugucaugaauau

SEQ ID NO: 262678 - RNA, 19 nt, Homo sapiens
gcucacagccacagucagu

SEQ ID NO: 262679 - RNA, 19 nt, Homo sapiens
ggaggccaccuuccagaug

SEQ ID NO: 262680 - RNA, 19 nt, Homo sapiens
gaacggcuacuuuguacac

SEQ ID NO: 262681 - RNA, 19 nt, Homo sapiens
gccugaagaugaccaugga

SEQ ID NO: 262682 - RNA, 19 nt, Homo sapiens
ccaagagcagucucaaguu

SEQ ID NO: 262683 - RNA, 19 nt, Homo sapiens
caaccucauuauccgcuau

SEQ ID NO: 262684 - RNA, 19 nt, Homo sapiens
gucccacucauuacaaaua

SEQ ID NO: 262685 - RNA, 19 nt, Homo sapiens
cgaagaaacaaccaugaca

SEQ ID NO: 262686 - RNA, 19 nt, Homo sapiens
gaaggcgaaaguagaaaca

SEQ ID NO: 262687 - RNA, 19 nt, Homo sapiens
aaguauaucuuccacaacu

SEQ ID NO: 262688 - RNA, 19 nt, Homo sapiens
gaggaggucacucagaaca

SEQ ID NO: 262689 - RNA, 19 nt, Homo sapiens
augccaagaucaccuuuga

SEQ ID NO: 262690 - RNA, 19 nt, Homo sapiens
cauggaaggcgaaaguaga

SEQ ID NO: 262691 - RNA, 19 nt, Homo sapiens
gaagcuggcacuggacaau

SEQ ID NO: 262692 - RNA, 19 nt, Homo sapiens
cucaccaccuggcagaaua

SEQ ID NO: 262693 - RNA, 19 nt, Homo sapiens
cagggucucaucccgauuu

SEQ ID NO: 262694 - RNA, 19 nt, Homo sapiens
ccagcugugucucguguca

SEQ ID NO: 262695 - RNA, 19 nt, Homo sapiens
caacuuccggcuccucuuc

SEQ ID NO: 262696 - RNA, 19 nt, Homo sapiens
uaacgugcgggaagcugua

SEQ ID NO: 262697 - RNA, 19 nt, Homo sapiens
gcaccuucaugaccaacca

SEQ ID NO: 262698 - RNA, 19 nt, Homo sapiens
acccagggaucaucaagga

SEQ ID NO: 262699 - RNA, 19 nt, Homo sapiens
agagagcgcaggcuggauu

SEQ ID NO: 262700 - RNA, 19 nt, Homo sapiens
gaccaucggccuguuguuc

SEQ ID NO: 262701 - RNA, 19 nt, Homo sapiens
ucagugacccagacaaagu

SEQ ID NO: 262702 - RNA, 19 nt, Homo sapiens
ccgagggccuaaccacaau

SEQ ID NO: 262703 - RNA, 19 nt, Homo sapiens
aagaagcucugcguacaag

SEQ ID NO: 262704 - RNA, 19 nt, Homo sapiens
gcgaaaguagaaacaggaa

SEQ ID NO: 262705 - RNA, 19 nt, Homo sapiens
guauaucuuccacaacuuc

SEQ ID NO: 262706 - RNA, 19 nt, Homo sapiens
caacuucuccaugaacauc

SEQ ID NO: 262707 - RNA, 19 nt, Homo sapiens
gggagggaccaacaucaau

SEQ ID NO: 262708 - RNA, 19 nt, Homo sapiens
cgggaagcccuaaucaaga

SEQ ID NO: 262709 - RNA, 19 nt, Homo sapiens
cagggaucaucaaggagaa

SEQ ID NO: 262710 - RNA, 19 nt, Homo sapiens
cagcaguggccaagggaaa

SEQ ID NO: 262711 - RNA, 19 nt, Homo sapiens
cacagaacaucacuuucca

SEQ ID NO: 262712 - RNA, 19 nt, Homo sapiens
gaucuuaggucucuucuuu

SEQ ID NO: 262713 - RNA, 19 nt, Homo sapiens
caaauaaucuggaaaccua

SEQ ID NO: 262714 - RNA, 19 nt, Homo sapiens
gcaauuggcucuuucuaaa

SEQ ID NO: 262715 - RNA, 19 nt, Homo sapiens
gaagaaacgaggaauaaua

SEQ ID NO: 262716 - RNA, 19 nt, Homo sapiens
gaaacucucucaucccaaa

SEQ ID NO: 262717 - RNA, 19 nt, Homo sapiens
ggaauugacugaucucugu

SEQ ID NO: 262718 - RNA, 19 nt, Homo sapiens
guagagaacucccuuauac

SEQ ID NO: 262719 - RNA, 19 nt, Homo sapiens
guuaaugacuuuggaguua

SEQ ID NO: 262720 - RNA, 19 nt, Homo sapiens
gcaauacacagauucuuua

SEQ ID NO: 262721 - RNA, 19 nt, Homo sapiens
gacauucccugauauaaga

SEQ ID NO: 262722 - RNA, 19 nt, Homo sapiens
gaacaggagugaugucucu

SEQ ID NO: 262723 - RNA, 19 nt, Homo sapiens
ggaaugggcaugaaggaua

SEQ ID NO: 262724 - RNA, 19 nt, Homo sapiens
aagaacagcucaucaagaa

SEQ ID NO: 262725 - RNA, 19 nt, Homo sapiens
guaaagaagucaguauaga

SEQ ID NO: 262726 - RNA, 19 nt, Homo sapiens
uggaucagaugcauauuua

SEQ ID NO: 262727 - RNA, 19 nt, Homo sapiens
uaauguaacugaggcuuua

SEQ ID NO: 262728 - RNA, 19 nt, Homo sapiens
gaacagcucaucaagaaau

SEQ ID NO: 262729 - RNA, 19 nt, Homo sapiens
caagacaucugcccaaagu

SEQ ID NO: 262730 - RNA, 19 nt, Homo sapiens
gggaauaaauacaaagaug

SEQ ID NO: 262731 - RNA, 19 nt, Homo sapiens
gaacaaagagcaugagucu

SEQ ID NO: 262732 - RNA, 19 nt, Homo sapiens
gaacuucucccucgaacuu

SEQ ID NO: 262733 - RNA, 19 nt, Homo sapiens
acacacgucuaccagauua

SEQ ID NO: 262734 - RNA, 19 nt, Homo sapiens
gaacaaucccuguauaaag

SEQ ID NO: 262735 - RNA, 19 nt, Homo sapiens
ugaagaaacuguggucauu

SEQ ID NO: 262736 - RNA, 19 nt, Homo sapiens
guggagagccucaagauaa

SEQ ID NO: 262737 - RNA, 19 nt, Homo sapiens
gagaacaaucccuguauaa

SEQ ID NO: 262738 - RNA, 19 nt, Homo sapiens
gaaugggcaugaaggauau

SEQ ID NO: 262739 - RNA, 19 nt, Homo sapiens
ugacugaucucugugguuu

SEQ ID NO: 262740 - RNA, 19 nt, Homo sapiens
gaugauuucuggaacauuc

SEQ ID NO: 262741 - RNA, 19 nt, Homo sapiens
ggagagaaauaaagagucu

SEQ ID NO: 262742 - RNA, 19 nt, Homo sapiens
ugagaacaaucccuguaua

SEQ ID NO: 262743 - RNA, 19 nt, Homo sapiens
ccaaggcuguuguaaguga

SEQ ID NO: 262744 - RNA, 19 nt, Homo sapiens
gcaguuaucugguggaaaa

SEQ ID NO: 262745 - RNA, 19 nt, Homo sapiens
gaagaacagcucaucaaga

SEQ ID NO: 262746 - RNA, 19 nt, Homo sapiens
acaacuaccuccuauaugu

SEQ ID NO: 262747 - RNA, 19 nt, Homo sapiens
ggaaagagagaccagaaga

SEQ ID NO: 262748 - RNA, 19 nt, Homo sapiens
ggacaggaaugggcaugaa

SEQ ID NO: 262749 - RNA, 19 nt, Homo sapiens
aguaugaguucuuccuuua

SEQ ID NO: 262750 - RNA, 19 nt, Homo sapiens
agaggaggcugaaguaaug

SEQ ID NO: 262751 - RNA, 19 nt, Homo sapiens
gcuacuggcucaacaagga

SEQ ID NO: 262752 - RNA, 19 nt, Homo sapiens
acaguuuggugccuaaaua

SEQ ID NO: 262753 - RNA, 19 nt, Homo sapiens
gugaauauguacugagcua

SEQ ID NO: 262754 - RNA, 19 nt, Homo sapiens
gaccacagcuggcagucaa

SEQ ID NO: 262755 - RNA, 19 nt, Homo sapiens
ggacuuuaguagagacuga

SEQ ID NO: 262756 - RNA, 19 nt, Homo sapiens
caccaaggcuguuguaagu

SEQ ID NO: 262757 - RNA, 19 nt, Homo sapiens
ccaagaaugcuucaaagaa

SEQ ID NO: 262758 - RNA, 19 nt, Homo sapiens
guacugagcuaggagacuu

SEQ ID NO: 262759 - RNA, 19 nt, Homo sapiens
uaugcaaggugaauaugua

SEQ ID NO: 262760 - RNA, 19 nt, Homo sapiens
ggacaagguggcuaucaaa

SEQ ID NO: 262761 - RNA, 19 nt, Homo sapiens
gacaacaggcgaccacuuu

SEQ ID NO: 262762 - RNA, 19 nt, Homo sapiens
caucuaauccucaacugua

SEQ ID NO: 262763 - RNA, 19 nt, Homo sapiens
gcagagggaauaaauacaa

SEQ ID NO: 262764 - RNA, 19 nt, Homo sapiens
ccaaagugauggaacuaga

SEQ ID NO: 262765 - RNA, 19 nt, Homo sapiens
caaccaagaaugcuucaaa

SEQ ID NO: 262766 - RNA, 19 nt, Homo sapiens
agacaucaguaccggauuu

SEQ ID NO: 262767 - RNA, 19 nt, Homo sapiens
ggacacaggcaaagaagga

SEQ ID NO: 262768 - RNA, 19 nt, Homo sapiens
gaaacgaggaauaauaaca

SEQ ID NO: 262769 - RNA, 19 nt, Homo sapiens
gaaagccaguaaagaaguc

SEQ ID NO: 262770 - RNA, 19 nt, Homo sapiens
gacacuggcuucuacugaa

SEQ ID NO: 262771 - RNA, 19 nt, Homo sapiens
gcccuaggguugagcaauu

SEQ ID NO: 262772 - RNA, 19 nt, Homo sapiens
cgacuccgguauccaguuu

SEQ ID NO: 262773 - RNA, 19 nt, Homo sapiens
ucaacuaucaccaacauaa

SEQ ID NO: 262774 - RNA, 19 nt, Homo sapiens
ccauugagcucucccgaau

SEQ ID NO: 262775 - RNA, 19 nt, Homo sapiens
gagauucagaugcauaauu

SEQ ID NO: 262776 - RNA, 19 nt, Homo sapiens
auaccaagcucaucuuuua

SEQ ID NO: 262777 - RNA, 19 nt, Homo sapiens
gagagagacaugaguaaga

SEQ ID NO: 262778 - RNA, 19 nt, Homo sapiens
gaugaucaguacaccaguu

SEQ ID NO: 262779 - RNA, 19 nt, Homo sapiens
gggcauggccuaccuggaa

SEQ ID NO: 262780 - RNA, 19 nt, Homo sapiens
ggaagaggcaugugucauc

SEQ ID NO: 262781 - RNA, 19 nt, Homo sapiens
uucaagaacuggaucauga

SEQ ID NO: 262782 - RNA, 19 nt, Homo sapiens
ugacaacuaccuccuauau

SEQ ID NO: 262783 - RNA, 19 nt, Homo sapiens
cagagggaauaaauacaaa

SEQ ID NO: 262784 - RNA, 19 nt, Homo sapiens
caagguucguucuggauga

SEQ ID NO: 262785 - RNA, 19 nt, Homo sapiens
ccaaacuggugcagcugua

SEQ ID NO: 262786 - RNA, 19 nt, Homo sapiens
ggaaacaaaugacaauccu

SEQ ID NO: 262787 - RNA, 19 nt, Homo sapiens
cgaggaauaauaacaguuu

SEQ ID NO: 262788 - RNA, 19 nt, Homo sapiens
uggagagccucaagauaaa

SEQ ID NO: 262789 - RNA, 19 nt, Homo sapiens
ggacauucccugauauaag

SEQ ID NO: 262790 - RNA, 19 nt, Homo sapiens
gcuguagucuucuugaaca

SEQ ID NO: 262791 - RNA, 19 nt, Homo sapiens
ccacacacgucuaccagau

SEQ ID NO: 262792 - RNA, 19 nt, Homo sapiens
gugcugaugugggaaguuu

SEQ ID NO: 262793 - RNA, 19 nt, Homo sapiens
gcuggacaguucugagauu

SEQ ID NO: 262794 - RNA, 19 nt, Homo sapiens
gcugggugcuggcccuuaa

SEQ ID NO: 262795 - RNA, 19 nt, Homo sapiens
ggcgagcaauugaaacuug

SEQ ID NO: 262796 - RNA, 19 nt, Homo sapiens
gaaagagagaccagaagau

SEQ ID NO: 262797 - RNA, 19 nt, Homo sapiens
acucagaggugguggaaga

SEQ ID NO: 262798 - RNA, 19 nt, Homo sapiens
gaaguaaugaugaaacucu

SEQ ID NO: 262799 - RNA, 19 nt, Homo sapiens
caucaacuaucaccaacau

SEQ ID NO: 262800 - RNA, 19 nt, Homo sapiens
gaagaaacuguggucauug

SEQ ID NO: 262801 - RNA, 19 nt, Homo sapiens
aaagaagaaacgaggaaua

SEQ ID NO: 262802 - RNA, 19 nt, Homo sapiens
agaacuggaucaugaacaa

SEQ ID NO: 262803 - RNA, 19 nt, Homo sapiens
cacagauucuuuauuccua

SEQ ID NO: 262804 - RNA, 19 nt, Homo sapiens
aaucaggacuuuaguagag

SEQ ID NO: 262805 - RNA, 19 nt, Homo sapiens
gaggaauaauaacaguuug

SEQ ID NO: 262806 - RNA, 19 nt, Homo sapiens
gagugagugugcucuguug

SEQ ID NO: 262807 - RNA, 19 nt, Homo sapiens
ucaacuggcugaaauugca

SEQ ID NO: 262808 - RNA, 19 nt, Homo sapiens
ccuaugagugguacaauaa

SEQ ID NO: 262809 - RNA, 19 nt, Homo sapiens
gauauguaccaagcaguua

SEQ ID NO: 262810 - RNA, 19 nt, Homo sapiens
aagaagaaacgaggaauaa

SEQ ID NO: 262811 - RNA, 19 nt, Homo sapiens
caugacaacuaccuccuau

SEQ ID NO: 262812 - RNA, 19 nt, Homo sapiens
gauuauggcuaucagauua

SEQ ID NO: 262813 - RNA, 19 nt, Homo sapiens
gucaauggcugcuguauua

SEQ ID NO: 262814 - RNA, 19 nt, Homo sapiens
gcaaacauaucaaggagaa

SEQ ID NO: 262815 - RNA, 19 nt, Homo sapiens
gcaguaggaucauauuuga

SEQ ID NO: 262816 - RNA, 19 nt, Homo sapiens
gcacugagcacaucacauu

SEQ ID NO: 262817 - RNA, 19 nt, Homo sapiens
ucaaggagaaugacuauua

SEQ ID NO: 262818 - RNA, 19 nt, Homo sapiens
gacaauaacacauggaaua

SEQ ID NO: 262819 - RNA, 19 nt, Homo sapiens
cuaaacagguuaccaaaug

SEQ ID NO: 262820 - RNA, 19 nt, Homo sapiens
ccacauacaugaagaaucu

SEQ ID NO: 262821 - RNA, 19 nt, Homo sapiens
uaaaggaccuggauaaucg

SEQ ID NO: 262822 - RNA, 19 nt, Homo sapiens
gagcacagauacaggcaaa

SEQ ID NO: 262823 - RNA, 19 nt, Homo sapiens
ggauauaucucccgaucug

SEQ ID NO: 262824 - RNA, 19 nt, Homo sapiens
caaggagaaugacuauuau

SEQ ID NO: 262825 - RNA, 19 nt, Homo sapiens
gauuccaccuacccuauua

SEQ ID NO: 262826 - RNA, 19 nt, Homo sapiens
gcuuuacuuuggucaauua

SEQ ID NO: 262827 - RNA, 19 nt, Homo sapiens
ggaagcauauaccacagaa

SEQ ID NO: 262828 - RNA, 19 nt, Homo sapiens
gagaaugacuauuauacuc

SEQ ID NO: 262829 - RNA, 19 nt, Homo sapiens
gcuaucagauuacagcuau

SEQ ID NO: 262830 - RNA, 19 nt, Homo sapiens
ugaagaaucuggacauaag

SEQ ID NO: 262831 - RNA, 19 nt, Homo sapiens
gcaagaagcaacaggauuc

SEQ ID NO: 262832 - RNA, 19 nt, Homo sapiens
uaaacagguuaccaaauga

SEQ ID NO: 262833 - RNA, 19 nt, Homo sapiens
ggucauggcuuucuuucuc

SEQ ID NO: 262834 - RNA, 19 nt, Homo sapiens
gaucaccucugcugcaauc

SEQ ID NO: 262835 - RNA, 19 nt, Homo sapiens
guggcuggcuccuaugaua

SEQ ID NO: 262836 - RNA, 19 nt, Homo sapiens
gagcacaucacauuuagga

SEQ ID NO: 262837 - RNA, 19 nt, Homo sapiens
ccacaacaauuugaaguuc

SEQ ID NO: 262838 - RNA, 19 nt, Homo sapiens
ugaagggauugccaucuuu

SEQ ID NO: 262839 - RNA, 19 nt, Homo sapiens
caugaagaaucuggacaua

SEQ ID NO: 262840 - RNA, 19 nt, Homo sapiens
ggaacaauuuacccagguu

SEQ ID NO: 262841 - RNA, 19 nt, Homo sapiens
gaaaugucauggcuuuacu

SEQ ID NO: 262842 - RNA, 19 nt, Homo sapiens
ucaacugccucauguacaa

SEQ ID NO: 262843 - RNA, 19 nt, Homo sapiens
caucauugcuucugugucu

SEQ ID NO: 262844 - RNA, 19 nt, Homo sapiens
ugucauggcuuuacuuugg

SEQ ID NO: 262845 - RNA, 19 nt, Homo sapiens
uuuaggacguugaagauuu

SEQ ID NO: 262846 - RNA, 19 nt, Homo sapiens
gcauauaccacagaacauu

SEQ ID NO: 262847 - RNA, 19 nt, Homo sapiens
gcaugcuacucaccuacua

SEQ ID NO: 262848 - RNA, 19 nt, Homo sapiens
ccacaucaccaucgacauu

SEQ ID NO: 262849 - RNA, 19 nt, Homo sapiens
caagaugacuaaguuugga

SEQ ID NO: 262850 - RNA, 19 nt, Homo sapiens
gaacaauuuacccagguuu

SEQ ID NO: 262851 - RNA, 19 nt, Homo sapiens
ggacgaaucauuggaggaa

SEQ ID NO: 262852 - RNA, 19 nt, Homo sapiens
gauccguacuuuaauuauc

SEQ ID NO: 262853 - RNA, 19 nt, Homo sapiens
ggauauacaagguaaagga

SEQ ID NO: 262854 - RNA, 19 nt, Homo sapiens
ggacagguuuacacagaag

SEQ ID NO: 262855 - RNA, 19 nt, Homo sapiens
agugugcccuugcuuauuu

SEQ ID NO: 262856 - RNA, 19 nt, Homo sapiens
acagauacaggcaaacaua

SEQ ID NO: 262857 - RNA, 19 nt, Homo sapiens
gagguuauguguuccugau

SEQ ID NO: 262858 - RNA, 19 nt, Homo sapiens
guaaaggaccuggauaauc

SEQ ID NO: 262859 - RNA, 19 nt, Homo sapiens
ucaacaaguuucuuuggau

SEQ ID NO: 262860 - RNA, 19 nt, Homo sapiens
ggguauuccucugaugaua

SEQ ID NO: 262861 - RNA, 19 nt, Homo sapiens
gaggagggguuuuauaaau

SEQ ID NO: 262862 - RNA, 19 nt, Homo sapiens
cccaggugcuguccacaua

SEQ ID NO: 262863 - RNA, 19 nt, Homo sapiens
gucaggauauacaagguaa

SEQ ID NO: 262864 - RNA, 19 nt, Homo sapiens
ucauguacaagauguguua

SEQ ID NO: 262865 - RNA, 19 nt, Homo sapiens
gaugauaucaacaaguuuc

SEQ ID NO: 262866 - RNA, 19 nt, Homo sapiens
gcuaugugcuggucauuuu

SEQ ID NO: 262867 - RNA, 19 nt, Homo sapiens
ggauggcaguaggaucaua

SEQ ID NO: 262868 - RNA, 19 nt, Homo sapiens
ccagauccaugccuuugug

SEQ ID NO: 262869 - RNA, 19 nt, Homo sapiens
cuacucaccuacuacaugu

SEQ ID NO: 262870 - RNA, 19 nt, Homo sapiens
gagaagcaggacacacuuu

SEQ ID NO: 262871 - RNA, 19 nt, Homo sapiens
augcugagauugggaauaa

SEQ ID NO: 262872 - RNA, 19 nt, Homo sapiens
uguacaagauguguuacua

SEQ ID NO: 262873 - RNA, 19 nt, Homo sapiens
caaccugguccucauacua

SEQ ID NO: 262874 - RNA, 19 nt, Homo sapiens
gguuauguguuccugauca

SEQ ID NO: 262875 - RNA, 19 nt, Homo sapiens
gaucaaggcaguaaagacu

SEQ ID NO: 262876 - RNA, 19 nt, Homo sapiens
uuccauaacugguuugaug

SEQ ID NO: 262877 - RNA, 19 nt, Homo sapiens
uugaaaguguuauccauga

SEQ ID NO: 262878 - RNA, 19 nt, Homo sapiens
guacaagauguguuacuau

SEQ ID NO: 262879 - RNA, 19 nt, Homo sapiens
gcacagauacaggcaaaca

SEQ ID NO: 262880 - RNA, 19 nt, Homo sapiens
ggauuauggcuaucagauu

SEQ ID NO: 262881 - RNA, 19 nt, Homo sapiens
ggcaguaggaucauauuug

SEQ ID NO: 262882 - RNA, 19 nt, Homo sapiens
ggaucuauguggccuacug

SEQ ID NO: 262883 - RNA, 19 nt, Homo sapiens
ugaguuugauccguacuuu

SEQ ID NO: 262884 - RNA, 19 nt, Homo sapiens
uacaagauguguuacuauc

SEQ ID NO: 262885 - RNA, 19 nt, Homo sapiens
ccagugaggccuacucuuc

SEQ ID NO: 262886 - RNA, 19 nt, Homo sapiens
gcuguaauggugcgucuaa

SEQ ID NO: 262887 - RNA, 19 nt, Homo sapiens
ccacaaccugguccucaua

SEQ ID NO: 262888 - RNA, 19 nt, Homo sapiens
cuggaucccucuuaugcua

SEQ ID NO: 262889 - RNA, 19 nt, Homo sapiens
gauaaucgaggcuugucaa

SEQ ID NO: 262890 - RNA, 19 nt, Homo sapiens
cuucuccacucgucuguuu

SEQ ID NO: 262891 - RNA, 19 nt, Homo sapiens
guauuccucugaugauauc

SEQ ID NO: 262892 - RNA, 19 nt, Homo sapiens
ucucaucaccuacaccuuu

SEQ ID NO: 262893 - RNA, 19 nt, Homo sapiens
gagcgucaucucucuggua

SEQ ID NO: 262894 - RNA, 19 nt, Homo sapiens
guuaccaaaugaaauguca

SEQ ID NO: 262895 - RNA, 19 nt, Homo sapiens
uguccgaaaugcugagauu

SEQ ID NO: 262896 - RNA, 19 nt, Homo sapiens
guccugagauuugaaagug

SEQ ID NO: 262897 - RNA, 19 nt, Homo sapiens
aaaguguuauccaugaguu

SEQ ID NO: 262898 - RNA, 19 nt, Homo sapiens
agaauugucuggaaguuuu

SEQ ID NO: 262899 - RNA, 19 nt, Homo sapiens
ccugagauuugaaaguguu

SEQ ID NO: 262900 - RNA, 19 nt, Homo sapiens
ggucaggauauacaaggua

SEQ ID NO: 262901 - RNA, 19 nt, Homo sapiens
ggagaaugacuauuauacu

SEQ ID NO: 262902 - RNA, 19 nt, Homo sapiens
gaaaguguuauccaugagu

SEQ ID NO: 262903 - RNA, 19 nt, Homo sapiens
gaacaacauccccaucauu

SEQ ID NO: 262904 - RNA, 19 nt, Homo sapiens
aaagacugguuccaucugu

SEQ ID NO: 262905 - RNA, 19 nt, Homo sapiens
gaguuugauccguacuuua

SEQ ID NO: 262906 - RNA, 19 nt, Homo sapiens
gggcugggccaaaugaaau

SEQ ID NO: 262907 - RNA, 19 nt, Homo sapiens
acugagcacaucacauuua

SEQ ID NO: 262908 - RNA, 19 nt, Homo sapiens
aaacauaucaaggagaaug

SEQ ID NO: 262909 - RNA, 19 nt, Homo sapiens
gcuccucgucuucauguuu

SEQ ID NO: 262910 - RNA, 19 nt, Homo sapiens
gcugcuggaucccucuuau

SEQ ID NO: 262911 - RNA, 19 nt, Homo sapiens
ucacaggccguuucucuca

SEQ ID NO: 262912 - RNA, 19 nt, Homo sapiens
ggaagaagaucguguuugu

SEQ ID NO: 262913 - RNA, 19 nt, Homo sapiens
gaugagacuuguuuccaaa

SEQ ID NO: 262914 - RNA, 19 nt, Homo sapiens
gaugagauuuccauacaga

SEQ ID NO: 262915 - RNA, 19 nt, Homo sapiens
gcacuuugguggcacagaa

SEQ ID NO: 262916 - RNA, 19 nt, Homo sapiens
caaaucgccuuccaugguu

SEQ ID NO: 262917 - RNA, 19 nt, Homo sapiens
ggaggcaguucgccaggua

SEQ ID NO: 262918 - RNA, 19 nt, Homo sapiens
aaauugaccugccggagua

SEQ ID NO: 262919 - RNA, 19 nt, Homo sapiens
ggaugagacuuguuuccaa

SEQ ID NO: 262920 - RNA, 19 nt, Homo sapiens
gcaaaucgccuuccauggu

SEQ ID NO: 262921 - RNA, 19 nt, Homo sapiens
uaaaccagcuauaucuguu

SEQ ID NO: 262922 - RNA, 19 nt, Homo sapiens
aagaagaucguguuuguaa

SEQ ID NO: 262923 - RNA, 19 nt, Homo sapiens
gaagaagaucguguuugua

SEQ ID NO: 262924 - RNA, 19 nt, Homo sapiens
ggaggucguucagauucua

SEQ ID NO: 262925 - RNA, 19 nt, Homo sapiens
cggaugagauuuccauaca

SEQ ID NO: 262926 - RNA, 19 nt, Homo sapiens
gagcagacguacgcagaga

SEQ ID NO: 262927 - RNA, 19 nt, Homo sapiens
ggaggaggucguucagauu

SEQ ID NO: 262928 - RNA, 19 nt, Homo sapiens
gauucuaggagauaaguuu

SEQ ID NO: 262929 - RNA, 19 nt, Homo sapiens
gaggaggucguucagauuc

SEQ ID NO: 262930 - RNA, 19 nt, Homo sapiens
gagacuuguuuccaaaaua

SEQ ID NO: 262931 - RNA, 19 nt, Homo sapiens
ggaggaaccaugcaaaucg

SEQ ID NO: 262932 - RNA, 19 nt, Homo sapiens
gccauucucuugcccuuag

SEQ ID NO: 262933 - RNA, 19 nt, Homo sapiens
guucagauucuaggagaua

SEQ ID NO: 262934 - RNA, 19 nt, Homo sapiens
ucacugcucucuccuacag

SEQ ID NO: 262935 - RNA, 19 nt, Homo sapiens
gaccuugggugguaaagcu

SEQ ID NO: 262936 - RNA, 19 nt, Homo sapiens
ccuaugcgcucugcacguu

SEQ ID NO: 262937 - RNA, 19 nt, Homo sapiens
ugguaaagcuguacuuggu

SEQ ID NO: 262938 - RNA, 19 nt, Homo sapiens
gaggacaagucagccuaug

SEQ ID NO: 262939 - RNA, 19 nt, Homo sapiens
uggaggaggucguucagau

SEQ ID NO: 262940 - RNA, 19 nt, Homo sapiens
gaagaucguguuuguaacg

SEQ ID NO: 262941 - RNA, 19 nt, Homo sapiens
gcagacguacgcagagaug

SEQ ID NO: 262942 - RNA, 19 nt, Homo sapiens
acacuugucugugcuucaa

SEQ ID NO: 262943 - RNA, 19 nt, Homo sapiens
gcaaguggacgccauucuc

SEQ ID NO: 262944 - RNA, 19 nt, Homo sapiens
gcucugcucugagaaacuc

SEQ ID NO: 262945 - RNA, 19 nt, Homo sapiens
gugcuucaaugcccuugga

SEQ ID NO: 262946 - RNA, 19 nt, Homo sapiens
guacuuccuucaggguuuc

SEQ ID NO: 262947 - RNA, 19 nt, Homo sapiens
ggaugagauuuccauacag

SEQ ID NO: 262948 - RNA, 19 nt, Homo sapiens
uaugcgcucugcacguuug

SEQ ID NO: 262949 - RNA, 19 nt, Homo sapiens
gggaagaagaucguguuug

SEQ ID NO: 262950 - RNA, 19 nt, Homo sapiens
gggaggaaccaugcaaauc

SEQ ID NO: 262951 - RNA, 19 nt, Homo sapiens
gaaaugucaggaggcaguu

SEQ ID NO: 262952 - RNA, 19 nt, Homo sapiens
caaguggacgccauucucu

SEQ ID NO: 262953 - RNA, 19 nt, Homo sapiens
aaaucgccuuccaugguuu

SEQ ID NO: 262954 - RNA, 19 nt, Homo sapiens
cugagaaacucuggcaagu

SEQ ID NO: 262955 - RNA, 19 nt, Homo sapiens
aguacuuccuucaggguuu

SEQ ID NO: 262956 - RNA, 19 nt, Homo sapiens
ucucuugcccuuaggauuc

SEQ ID NO: 262957 - RNA, 19 nt, Homo sapiens
gaagcuggaggaggucguu

SEQ ID NO: 262958 - RNA, 19 nt, Homo sapiens
ggugguaaagcuguacuug

SEQ ID NO: 262959 - RNA, 19 nt, Homo sapiens
cagaggcugccaggacuuu

SEQ ID NO: 262960 - RNA, 19 nt, Homo sapiens
gugcagaccuccuaacuga

SEQ ID NO: 262961 - RNA, 19 nt, Homo sapiens
ugacggagcuggacaagau

SEQ ID NO: 262962 - RNA, 19 nt, Homo sapiens
ggaggaagaugcagaccuu

SEQ ID NO: 262963 - RNA, 19 nt, Homo sapiens
gauagcaguuuacuuugaa

SEQ ID NO: 262964 - RNA, 19 nt, Homo sapiens
caacacacgucccauuuag

SEQ ID NO: 262965 - RNA, 19 nt, Homo sapiens
caacaacuaaccacguuua

SEQ ID NO: 262966 - RNA, 19 nt, Homo sapiens
ggaggacgcuagagaaagu

SEQ ID NO: 262967 - RNA, 19 nt, Homo sapiens
cgagauggcuaucguguuc

SEQ ID NO: 262968 - RNA, 19 nt, Homo sapiens
ucaagaagcugaauuucca

SEQ ID NO: 262969 - RNA, 19 nt, Homo sapiens
gagaguggcuucccuucug

SEQ ID NO: 262970 - RNA, 19 nt, Homo sapiens
ucacagaccuccugaacca

SEQ ID NO: 262971 - RNA, 19 nt, Homo sapiens
gcaaaucauuccaggucuu

SEQ ID NO: 262972 - RNA, 19 nt, Homo sapiens
gaggauuugugcugugauu

SEQ ID NO: 262973 - RNA, 19 nt, Homo sapiens
gagcucauccggaagauug

SEQ ID NO: 262974 - RNA, 19 nt, Homo sapiens
gggcugugcucccucacua

SEQ ID NO: 262975 - RNA, 19 nt, Homo sapiens
gagaagaacggcuugacuu

SEQ ID NO: 262976 - RNA, 19 nt, Homo sapiens
cagccugccuuuccauaaa

SEQ ID NO: 262977 - RNA, 19 nt, Homo sapiens
ccaacacacgucccauuua

SEQ ID NO: 262978 - RNA, 19 nt, Homo sapiens
ccagugaucugauucuucu

SEQ ID NO: 262979 - RNA, 19 nt, Homo sapiens
aagcguggcuggccucuug

SEQ ID NO: 262980 - RNA, 19 nt, Homo sapiens
gcugcaggaugcccacuuu

SEQ ID NO: 262981 - RNA, 19 nt, Homo sapiens
ucucugaugucaugaucua

SEQ ID NO: 262982 - RNA, 19 nt, Homo sapiens
gaagccgaccagaaugaua

SEQ ID NO: 262983 - RNA, 19 nt, Homo sapiens
uagagaaagugcugagugu

SEQ ID NO: 262984 - RNA, 19 nt, Homo sapiens
agauagcaguuuacuuuga

SEQ ID NO: 262985 - RNA, 19 nt, Homo sapiens
gucuuaagauagcaguuua

SEQ ID NO: 262986 - RNA, 19 nt, Homo sapiens
gcaucgacaucaucaucaa

SEQ ID NO: 262987 - RNA, 19 nt, Homo sapiens
gaagauugaggccuacaug

SEQ ID NO: 262988 - RNA, 19 nt, Homo sapiens
gaagaacggcuugacuuuc

SEQ ID NO: 262989 - RNA, 19 nt, Homo sapiens
ggaagagaguuggcuacug

SEQ ID NO: 262990 - RNA, 19 nt, Homo sapiens
ccacaacgccguccuguac

SEQ ID NO: 262991 - RNA, 19 nt, Homo sapiens
cggcuugacuuucccauuc

SEQ ID NO: 262992 - RNA, 19 nt, Homo sapiens
gcuguccucugcccaguga

SEQ ID NO: 262993 - RNA, 19 nt, Homo sapiens
gauugaggccuacauggaa

SEQ ID NO: 262994 - RNA, 19 nt, Homo sapiens
gcuacuggcugagcgagaa

SEQ ID NO: 262995 - RNA, 19 nt, Homo sapiens
gcgaugcuacuacuaagaa

SEQ ID NO: 262996 - RNA, 19 nt, Homo sapiens
caacggcgaugcuacuacu

SEQ ID NO: 262997 - RNA, 19 nt, Homo sapiens
ggacauuugagaucagaga

SEQ ID NO: 262998 - RNA, 19 nt, Homo sapiens
ggauuugugcugugauuug

SEQ ID NO: 262999 - RNA, 19 nt, Homo sapiens
gcacugggcgugucacucu

SEQ ID NO: 263000 - RNA, 19 nt, Homo sapiens
ugagcgaguucuucacaga

SEQ ID NO: 263001 - RNA, 19 nt, Homo sapiens
agaagaacggcuugacuuu

SEQ ID NO: 263002 - RNA, 19 nt, Homo sapiens
gcagaggccaucagaacug

SEQ ID NO: 263003 - RNA, 19 nt, Homo sapiens
gauggaggacgcuagagaa

SEQ ID NO: 263004 - RNA, 19 nt, Homo sapiens
caaaucauuccaggucuuu

SEQ ID NO: 263005 - RNA, 19 nt, Homo sapiens
cugauucucugaugucaug

SEQ ID NO: 263006 - RNA, 19 nt, Homo sapiens
uaaccugauucucugaugu

SEQ ID NO: 263007 - RNA, 19 nt, Homo sapiens
guacaagguguucgugguu

SEQ ID NO: 263008 - RNA, 19 nt, Homo sapiens
gcagaccuccuaacugagu

SEQ ID NO: 263009 - RNA, 19 nt, Homo sapiens
caagaucgagggcguguuc

SEQ ID NO: 263010 - RNA, 19 nt, Homo sapiens
ggcccucacucaagaacuu

SEQ ID NO: 263011 - RNA, 19 nt, Homo sapiens
ccaugcggcugcuggagaa

SEQ ID NO: 263012 - RNA, 19 nt, Homo sapiens
caacagccacaacguguca

SEQ ID NO: 263013 - RNA, 19 nt, Homo sapiens
gaguccaucuucuucaaca

SEQ ID NO: 263014 - RNA, 19 nt, Homo sapiens
cuaaagggaaggaaaggaa

SEQ ID NO: 263015 - RNA, 19 nt, Homo sapiens
gugaguccaucuucuucaa

SEQ ID NO: 263016 - RNA, 19 nt, Homo sapiens
ggaagaugcagaccuuucu

SEQ ID NO: 263017 - RNA, 19 nt, Homo sapiens
cccaacaacuaaccacguu

SEQ ID NO: 263018 - RNA, 19 nt, Homo sapiens
caacuaaccacguuuacac

SEQ ID NO: 263019 - RNA, 19 nt, Homo sapiens
gggcagaggccaucagaac

SEQ ID NO: 263020 - RNA, 19 nt, Homo sapiens
gcugugcucccucacuaaa

SEQ ID NO: 263021 - RNA, 19 nt, Homo sapiens
ugaucugauucuucuguuu

SEQ ID NO: 263022 - RNA, 19 nt, Homo sapiens
agaauuucaucaaccacaa

SEQ ID NO: 263023 - RNA, 19 nt, Homo sapiens
cugaggacccaacaacuaa

SEQ ID NO: 263024 - RNA, 19 nt, Homo sapiens
ccucugcaguccuggaaga

SEQ ID NO: 263025 - RNA, 19 nt, Homo sapiens
ugaaccacaucgccacugu

SEQ ID NO: 263026 - RNA, 19 nt, Homo sapiens
ccugcgugguccagaauuu

SEQ ID NO: 263027 - RNA, 19 nt, Homo sapiens
guugugcagcugaaccuua

SEQ ID NO: 263028 - RNA, 19 nt, Homo sapiens
gaaacugaggacccaacaa

SEQ ID NO: 263029 - RNA, 19 nt, Homo sapiens
gcaccacagggcuggcuuu

SEQ ID NO: 263030 - RNA, 19 nt, Homo sapiens
gcgccugugcugaggauuu

SEQ ID NO: 263031 - RNA, 19 nt, Homo sapiens
ugacuuucccauucauuug

SEQ ID NO: 263032 - RNA, 19 nt, Homo sapiens
gaaaaggguuggggagaag

SEQ ID NO: 263033 - RNA, 19 nt, Homo sapiens
gauuugugcugugauuugg

SEQ ID NO: 263034 - RNA, 19 nt, Homo sapiens
ccaaggccuccucccagua

SEQ ID NO: 263035 - RNA, 19 nt, Homo sapiens
acaacgccguccuguacaa

SEQ ID NO: 263036 - RNA, 19 nt, Homo sapiens
ggagaagaacggcuugacu

SEQ ID NO: 263037 - RNA, 19 nt, Homo sapiens
uuacacgacuugaguuuug

SEQ ID NO: 263038 - RNA, 19 nt, Homo sapiens
gcaggaugcccacuuugag

SEQ ID NO: 263039 - RNA, 19 nt, Homo sapiens
ucgccgagcugugcaggaa

SEQ ID NO: 263040 - RNA, 19 nt, Homo sapiens
gaccgugaguccaucuucu

SEQ ID NO: 263041 - RNA, 19 nt, Homo sapiens
gguccagaauuucaucaac

SEQ ID NO: 263042 - RNA, 19 nt, Homo sapiens
ggaaacugaggacccaaca

SEQ ID NO: 263043 - RNA, 19 nt, Homo sapiens
cugcaguccuggaagaugu

SEQ ID NO: 263044 - RNA, 19 nt, Homo sapiens
cacuggcucugccgucuga

SEQ ID NO: 263045 - RNA, 19 nt, Homo sapiens
gaucggugcaugugagagu

SEQ ID NO: 263046 - RNA, 19 nt, Homo sapiens
gaucugauucuucuguuuu

SEQ ID NO: 263047 - RNA, 19 nt, Homo sapiens
gugaucugauucuucuguu

SEQ ID NO: 263048 - RNA, 19 nt, Homo sapiens
caucagaccgugaguccau

SEQ ID NO: 263049 - RNA, 19 nt, Homo sapiens
acugaggacccaacaacua

SEQ ID NO: 263050 - RNA, 19 nt, Homo sapiens
cccaacacacgucccauuu

SEQ ID NO: 263051 - RNA, 19 nt, Homo sapiens
gcaggaagcgagggaugga

SEQ ID NO: 263052 - RNA, 19 nt, Homo sapiens
cuacugugcagaccuccua

SEQ ID NO: 263053 - RNA, 19 nt, Homo sapiens
cugaugucaugaucuaaau

SEQ ID NO: 263054 - RNA, 19 nt, Homo sapiens
caaggccuccucccaguag

SEQ ID NO: 263055 - RNA, 19 nt, Homo sapiens
aaacugaggacccaacaac

SEQ ID NO: 263056 - RNA, 19 nt, Homo sapiens
ucacuaaagggaaggaaag

SEQ ID NO: 263057 - RNA, 19 nt, Homo sapiens
aagaacggcuugacuuucc

SEQ ID NO: 263058 - RNA, 19 nt, Homo sapiens
uccauaaagucaccuaggu

SEQ ID NO: 263059 - RNA, 19 nt, Homo sapiens
ggcuugacuuucccauuca

SEQ ID NO: 263060 - RNA, 19 nt, Homo sapiens
ggaaggacauguacaagaa

SEQ ID NO: 263061 - RNA, 19 nt, Homo sapiens
gcaaggagaugaggaagug

SEQ ID NO: 263062 - RNA, 19 nt, Homo sapiens
gcagcucgcuccucuuugu

SEQ ID NO: 263063 - RNA, 19 nt, Homo sapiens
ggacuccccuuccuaauaa

SEQ ID NO: 263064 - RNA, 19 nt, Homo sapiens
gcaggugcuucgcgucuuu

SEQ ID NO: 263065 - RNA, 19 nt, Homo sapiens
cauaagcccuuucaagaag

SEQ ID NO: 263066 - RNA, 19 nt, Homo sapiens
ccaaaugacacuaacuuau

SEQ ID NO: 263067 - RNA, 19 nt, Homo sapiens
gccaaaugacacuaacuua

SEQ ID NO: 263068 - RNA, 19 nt, Homo sapiens
gcaccgacuucaagacuac

SEQ ID NO: 263069 - RNA, 19 nt, Homo sapiens
ggagguauccgaguucuuc

SEQ ID NO: 263070 - RNA, 19 nt, Homo sapiens
gaaggacauguacaagaaa

SEQ ID NO: 263071 - RNA, 19 nt, Homo sapiens
gucauaagcccuuucaaga

SEQ ID NO: 263072 - RNA, 19 nt, Homo sapiens
gugcugaggcgguaucuga

SEQ ID NO: 263073 - RNA, 19 nt, Homo sapiens
cgucaggacuuaccuagag

SEQ ID NO: 263074 - RNA, 19 nt, Homo sapiens
ucauaagcccuuucaagaa

SEQ ID NO: 263075 - RNA, 19 nt, Homo sapiens
aaaugggcgucaggacuua

SEQ ID NO: 263076 - RNA, 19 nt, Homo sapiens
gcguguggcucaucgacuu

SEQ ID NO: 263077 - RNA, 19 nt, Homo sapiens
ggucauaagcccuuucaag

SEQ ID NO: 263078 - RNA, 19 nt, Homo sapiens
gcgaggacgugggucagaa

SEQ ID NO: 263079 - RNA, 19 nt, Homo sapiens
gcaucgagggcaucaagaa

SEQ ID NO: 263080 - RNA, 19 nt, Homo sapiens
cauguggaccugcagcuuu

SEQ ID NO: 263081 - RNA, 19 nt, Homo sapiens
cggcagcucgcuccucuuu

SEQ ID NO: 263082 - RNA, 19 nt, Homo sapiens
caucgagggcaucaagaaa

SEQ ID NO: 263083 - RNA, 19 nt, Homo sapiens
gggacacccuggagguauc

SEQ ID NO: 263084 - RNA, 19 nt, Homo sapiens
ugaagaguuugugcaagga

SEQ ID NO: 263085 - RNA, 19 nt, Homo sapiens
cggaaggacauguacaaga

SEQ ID NO: 263086 - RNA, 19 nt, Homo sapiens
ggugccagaccgcggauuu

SEQ ID NO: 263087 - RNA, 19 nt, Homo sapiens
cagagccaaaugacacuaa

SEQ ID NO: 263088 - RNA, 19 nt, Homo sapiens
ccgcgaggacggcuauuug

SEQ ID NO: 263089 - RNA, 19 nt, Homo sapiens
ggcagaagauccggaccau

SEQ ID NO: 263090 - RNA, 19 nt, Homo sapiens
caaccgcgaggacggcuau

SEQ ID NO: 263091 - RNA, 19 nt, Homo sapiens
gcagggcacacugggaguu

SEQ ID NO: 263092 - RNA, 19 nt, Homo sapiens
gaagugcugaggcgguauc

SEQ ID NO: 263093 - RNA, 19 nt, Homo sapiens
cgaggacgugggucagaaa

SEQ ID NO: 263094 - RNA, 19 nt, Homo sapiens
gaccaggugccagccacua

SEQ ID NO: 263095 - RNA, 19 nt, Homo sapiens
uagaggaggagcugaccaa

SEQ ID NO: 263096 - RNA, 19 nt, Homo sapiens
gucaaucugccggucauaa

SEQ ID NO: 263097 - RNA, 19 nt, Homo sapiens
ggagaaaacugaacuguua

SEQ ID NO: 263098 - RNA, 19 nt, Homo sapiens
caacauaccugcugucauc

SEQ ID NO: 263099 - RNA, 19 nt, Homo sapiens
gaaauggaaucucccagaa

SEQ ID NO: 263100 - RNA, 19 nt, Homo sapiens
gcagaaugcuggagccuuu

SEQ ID NO: 263101 - RNA, 19 nt, Homo sapiens
gcaaaugaugugcuuauua

SEQ ID NO: 263102 - RNA, 19 nt, Homo sapiens
ggaaggacauguaccagaa

SEQ ID NO: 263103 - RNA, 19 nt, Homo sapiens
gaaagaaguuugcuaaagc

SEQ ID NO: 263104 - RNA, 19 nt, Homo sapiens
gaacuuccuuucccacuug

SEQ ID NO: 263105 - RNA, 19 nt, Homo sapiens
aaauuugccugacuucuua

SEQ ID NO: 263106 - RNA, 19 nt, Homo sapiens
ggucaacccugccugcaua

SEQ ID NO: 263107 - RNA, 19 nt, Homo sapiens
gaagagaaaugcccagucu

SEQ ID NO: 263108 - RNA, 19 nt, Homo sapiens
gcaaagugucuuccgauua

SEQ ID NO: 263109 - RNA, 19 nt, Homo sapiens
caaagugucuuccgauuag

SEQ ID NO: 263110 - RNA, 19 nt, Homo sapiens
caaacaaugugcuaauaug

SEQ ID NO: 263111 - RNA, 19 nt, Homo sapiens
ggaagggaauguaaaauuu

SEQ ID NO: 263112 - RNA, 19 nt, Homo sapiens
ccgaaaggcuggacucuug

SEQ ID NO: 263113 - RNA, 19 nt, Homo sapiens
gaagaggagaugagaguuu

SEQ ID NO: 263114 - RNA, 19 nt, Homo sapiens
augcaaaccuuccugaaua

SEQ ID NO: 263115 - RNA, 19 nt, Homo sapiens
ggaaaucaacuuacacuuc

SEQ ID NO: 263116 - RNA, 19 nt, Homo sapiens
gaaccacucuagaaguuuc

SEQ ID NO: 263117 - RNA, 19 nt, Homo sapiens
ucaaacagaugcaaaccuu

SEQ ID NO: 263118 - RNA, 19 nt, Homo sapiens
aaacugaacuguuacaaac

SEQ ID NO: 263119 - RNA, 19 nt, Homo sapiens
gacaccagcuguuugcaaa

SEQ ID NO: 263120 - RNA, 19 nt, Homo sapiens
caucauuaauucagacgua

SEQ ID NO: 263121 - RNA, 19 nt, Homo sapiens
caagacacuuuguagaaga

SEQ ID NO: 263122 - RNA, 19 nt, Homo sapiens
ugggauagauggauuguga

SEQ ID NO: 263123 - RNA, 19 nt, Homo sapiens
gcaaacaaugugcuaauau

SEQ ID NO: 263124 - RNA, 19 nt, Homo sapiens
ggacacagagggagacuau

SEQ ID NO: 263125 - RNA, 19 nt, Homo sapiens
agagaaaugcccagucuua

SEQ ID NO: 263126 - RNA, 19 nt, Homo sapiens
guauuuagcuuugaguuuc

SEQ ID NO: 263127 - RNA, 19 nt, Homo sapiens
cagagucccuugcagauau

SEQ ID NO: 263128 - RNA, 19 nt, Homo sapiens
gaagaagcacugugaguca

SEQ ID NO: 263129 - RNA, 19 nt, Homo sapiens
ugaaagaaguuugcuaaag

SEQ ID NO: 263130 - RNA, 19 nt, Homo sapiens
ggucugugcuucagccauu

SEQ ID NO: 263131 - RNA, 19 nt, Homo sapiens
ggaaccacauguugacugu

SEQ ID NO: 263132 - RNA, 19 nt, Homo sapiens
uagagagggucaccuacua

SEQ ID NO: 263133 - RNA, 19 nt, Homo sapiens
ugaagucucugcauuugga

SEQ ID NO: 263134 - RNA, 19 nt, Homo sapiens
auagauggauugugaaaug

SEQ ID NO: 263135 - RNA, 19 nt, Homo sapiens
ucaauaaccucgucgacau

SEQ ID NO: 263136 - RNA, 19 nt, Homo sapiens
gaugggaucuauagagucu

SEQ ID NO: 263137 - RNA, 19 nt, Homo sapiens
gaugaucgacuuugggaaa

SEQ ID NO: 263138 - RNA, 19 nt, Homo sapiens
gauauggaagggaauguaa

SEQ ID NO: 263139 - RNA, 19 nt, Homo sapiens
cuuccuggcucuuguuuaa

SEQ ID NO: 263140 - RNA, 19 nt, Homo sapiens
gccaagcacagccuuauuu

SEQ ID NO: 263141 - RNA, 19 nt, Homo sapiens
gccagacccugcagcauga

SEQ ID NO: 263142 - RNA, 19 nt, Homo sapiens
cagcagaaaccuagaguga

SEQ ID NO: 263143 - RNA, 19 nt, Homo sapiens
ccacgggacauguacauuu

SEQ ID NO: 263144 - RNA, 19 nt, Homo sapiens
gaaaugcccagucuuagag

SEQ ID NO: 263145 - RNA, 19 nt, Homo sapiens
ucagagaguucacuaaagg

SEQ ID NO: 263146 - RNA, 19 nt, Homo sapiens
ccuugcagauauagaaaua

SEQ ID NO: 263147 - RNA, 19 nt, Homo sapiens
gaaggaacaggccaaagug

SEQ ID NO: 263148 - RNA, 19 nt, Homo sapiens
ucaguuguauuuagcuuug

SEQ ID NO: 263149 - RNA, 19 nt, Homo sapiens
gugcuaauaugcaaaugau

SEQ ID NO: 263150 - RNA, 19 nt, Homo sapiens
uaaaggaaaccauaacauc

SEQ ID NO: 263151 - RNA, 19 nt, Homo sapiens
gcuaaagcaaaucaugaua

SEQ ID NO: 263152 - RNA, 19 nt, Homo sapiens
gagaugagaguuucuaguc

SEQ ID NO: 263153 - RNA, 19 nt, Homo sapiens
ucgaaccacucuagaaguu

SEQ ID NO: 263154 - RNA, 19 nt, Homo sapiens
gauggauugugaaauggaa

SEQ ID NO: 263155 - RNA, 19 nt, Homo sapiens
gcuaauaugcaaaugaugu

SEQ ID NO: 263156 - RNA, 19 nt, Homo sapiens
ggagcagggcuuucuggua

SEQ ID NO: 263157 - RNA, 19 nt, Homo sapiens
aagcagcccuggcccugua

SEQ ID NO: 263158 - RNA, 19 nt, Homo sapiens
ggauagauggauugugaaa

SEQ ID NO: 263159 - RNA, 19 nt, Homo sapiens
ugcaaacaaugugcuaaua

SEQ ID NO: 263160 - RNA, 19 nt, Homo sapiens
ugcaaaccuuccugaauaa

SEQ ID NO: 263161 - RNA, 19 nt, Homo sapiens
ggacauguaccagaagaug

SEQ ID NO: 263162 - RNA, 19 nt, Homo sapiens
guuauugccucugaaacaa

SEQ ID NO: 263163 - RNA, 19 nt, Homo sapiens
gaauugcaacccaugaguu

SEQ ID NO: 263164 - RNA, 19 nt, Homo sapiens
ucacuaaaggaaaccauaa

SEQ ID NO: 263165 - RNA, 19 nt, Homo sapiens
gaugcaaaccuuccugaau

SEQ ID NO: 263166 - RNA, 19 nt, Homo sapiens
acaaugugcuaauaugcaa

SEQ ID NO: 263167 - RNA, 19 nt, Homo sapiens
cuccuggcaucauuuguua

SEQ ID NO: 263168 - RNA, 19 nt, Homo sapiens
cauaccugcugucaucauu

SEQ ID NO: 263169 - RNA, 19 nt, Homo sapiens
ucagugggauagauggauu

SEQ ID NO: 263170 - RNA, 19 nt, Homo sapiens
gcuguggguuacauuaaau

SEQ ID NO: 263171 - RNA, 19 nt, Homo sapiens
ggcuguggguuacauuaaa

SEQ ID NO: 263172 - RNA, 19 nt, Homo sapiens
cagugagucugauauggaa

SEQ ID NO: 263173 - RNA, 19 nt, Homo sapiens
gcagggcuuucugguaguu

SEQ ID NO: 263174 - RNA, 19 nt, Homo sapiens
gaaccuauuuaagcccaau

SEQ ID NO: 263175 - RNA, 19 nt, Homo sapiens
gaucgagggaaucaagaaa

SEQ ID NO: 263176 - RNA, 19 nt, Homo sapiens
gaaaggcuggacucuuguu

SEQ ID NO: 263177 - RNA, 19 nt, Homo sapiens
ggcagcaugugaucuggaa

SEQ ID NO: 263178 - RNA, 19 nt, Homo sapiens
ccugaagucucugcauuug

SEQ ID NO: 263179 - RNA, 19 nt, Homo sapiens
gagaguuucuagucauuuu

SEQ ID NO: 263180 - RNA, 19 nt, Homo sapiens
ucgagggaaucaagaaaga

SEQ ID NO: 263181 - RNA, 19 nt, Homo sapiens
gaagcugugccacuuggaa

SEQ ID NO: 263182 - RNA, 19 nt, Homo sapiens
gcuuggcuguguucucuga

SEQ ID NO: 263183 - RNA, 19 nt, Homo sapiens
gcagcucccuccucuucau

SEQ ID NO: 263184 - RNA, 19 nt, Homo sapiens
gcaaaccuuccugaauaaa

SEQ ID NO: 263185 - RNA, 19 nt, Homo sapiens
aaauugcacagaacacuaa

SEQ ID NO: 263186 - RNA, 19 nt, Homo sapiens
gcaggacaaacucugugua

SEQ ID NO: 263187 - RNA, 19 nt, Homo sapiens
ugcgaaagaucugaaagaa

SEQ ID NO: 263188 - RNA, 19 nt, Homo sapiens
guauuuaccgugcuaguuc

SEQ ID NO: 263189 - RNA, 19 nt, Homo sapiens
ugugaaagaaguuugcuaa

SEQ ID NO: 263190 - RNA, 19 nt, Homo sapiens
agacguaaagauucuauga

SEQ ID NO: 263191 - RNA, 19 nt, Homo sapiens
gcaggggcaucauuaauuc

SEQ ID NO: 263192 - RNA, 19 nt, Homo sapiens
cauguugacugugagcaaa

SEQ ID NO: 263193 - RNA, 19 nt, Homo sapiens
gaaagccagugagucugau

SEQ ID NO: 263194 - RNA, 19 nt, Homo sapiens
ugaaagccagugagucuga

SEQ ID NO: 263195 - RNA, 19 nt, Homo sapiens
cuccugaacugcacuacaa

SEQ ID NO: 263196 - RNA, 19 nt, Homo sapiens
aaucauggaggaagauaaa

SEQ ID NO: 263197 - RNA, 19 nt, Homo sapiens
gagguuggcucaugaauuu

SEQ ID NO: 263198 - RNA, 19 nt, Homo sapiens
gaaauggagugauaacaaa

SEQ ID NO: 263199 - RNA, 19 nt, Homo sapiens
gaaccaacaugcuacagua

SEQ ID NO: 263200 - RNA, 19 nt, Homo sapiens
caacaagacugucaccuuu

SEQ ID NO: 263201 - RNA, 19 nt, Homo sapiens
gaagagacuuugcuuaaug

SEQ ID NO: 263202 - RNA, 19 nt, Homo sapiens
gcacaacaucuacauauua

SEQ ID NO: 263203 - RNA, 19 nt, Homo sapiens
agaauaagcuuacguuuga

SEQ ID NO: 263204 - RNA, 19 nt, Homo sapiens
ggacgaggcuggaaaugaa

SEQ ID NO: 263205 - RNA, 19 nt, Homo sapiens
gaaaugaauuggcagaaga

SEQ ID NO: 263206 - RNA, 19 nt, Homo sapiens
gaaaugaugaccaaagaua

SEQ ID NO: 263207 - RNA, 19 nt, Homo sapiens
ccaagucuaugaacuguua

SEQ ID NO: 263208 - RNA, 19 nt, Homo sapiens
gauagagauugucagauua

SEQ ID NO: 263209 - RNA, 19 nt, Homo sapiens
gaacagcccucucauguac

SEQ ID NO: 263210 - RNA, 19 nt, Homo sapiens
gcagagaggauacuuuaua

SEQ ID NO: 263211 - RNA, 19 nt, Homo sapiens
ccaaggagcugacuacaga

SEQ ID NO: 263212 - RNA, 19 nt, Homo sapiens
ccacgaagguuacauuuau

SEQ ID NO: 263213 - RNA, 19 nt, Homo sapiens
gagaagagacuuugcuuaa

SEQ ID NO: 263214 - RNA, 19 nt, Homo sapiens
gcacuucguucacugcaua

SEQ ID NO: 263215 - RNA, 19 nt, Homo sapiens
gcagaagggaaauuuauua

SEQ ID NO: 263216 - RNA, 19 nt, Homo sapiens
uaaccaagcugcuagaaga

SEQ ID NO: 263217 - RNA, 19 nt, Homo sapiens
guacauggaucucauuuua

SEQ ID NO: 263218 - RNA, 19 nt, Homo sapiens
gcaccacgcugcagacuug

SEQ ID NO: 263219 - RNA, 19 nt, Homo sapiens
caacacagauaacagaaga

SEQ ID NO: 263220 - RNA, 19 nt, Homo sapiens
guaagaaugucuacacaga

SEQ ID NO: 263221 - RNA, 19 nt, Homo sapiens
ggaagaaccaggaguauau

SEQ ID NO: 263222 - RNA, 19 nt, Homo sapiens
gaggauggaccuuguguua

SEQ ID NO: 263223 - RNA, 19 nt, Homo sapiens
gcaaucacauguggaaauu

SEQ ID NO: 263224 - RNA, 19 nt, Homo sapiens
ggaaauaacaagccacaaa

SEQ ID NO: 263225 - RNA, 19 nt, Homo sapiens
cagcauaugugaauuccua

SEQ ID NO: 263226 - RNA, 19 nt, Homo sapiens
cagagaggauacuuuauaa

SEQ ID NO: 263227 - RNA, 19 nt, Homo sapiens
ggauggaccuuguguuaga

SEQ ID NO: 263228 - RNA, 19 nt, Homo sapiens
ggaauaucauugagagauu

SEQ ID NO: 263229 - RNA, 19 nt, Homo sapiens
uagauaggcugcccaauga

SEQ ID NO: 263230 - RNA, 19 nt, Homo sapiens
cuucugggcuuguauauaa

SEQ ID NO: 263231 - RNA, 19 nt, Homo sapiens
agacaccuauguacuaaua

SEQ ID NO: 263232 - RNA, 19 nt, Homo sapiens
ccacagacauguuauucuu

SEQ ID NO: 263233 - RNA, 19 nt, Homo sapiens
caagaaagccuacaugcaa

SEQ ID NO: 263234 - RNA, 19 nt, Homo sapiens
uaagagaugugguuuguca

SEQ ID NO: 263235 - RNA, 19 nt, Homo sapiens
cgaaguagguugcggaaug

SEQ ID NO: 263236 - RNA, 19 nt, Homo sapiens
ggagaagaaugccaugaga

SEQ ID NO: 263237 - RNA, 19 nt, Homo sapiens
ugagaaaccugcaggagaa

SEQ ID NO: 263238 - RNA, 19 nt, Homo sapiens
gaggauacuuuauaacaug

SEQ ID NO: 263239 - RNA, 19 nt, Homo sapiens
gaaaucgucaugaguauug

SEQ ID NO: 263240 - RNA, 19 nt, Homo sapiens
gccaagauguggacaacua

SEQ ID NO: 263241 - RNA, 19 nt, Homo sapiens
gagauacuccaguuuauuu

SEQ ID NO: 263242 - RNA, 19 nt, Homo sapiens
gaaaggagaagagaauaaa

SEQ ID NO: 263243 - RNA, 19 nt, Homo sapiens
cggcagagauugacacauu

SEQ ID NO: 263244 - RNA, 19 nt, Homo sapiens
ggaagcauuugccauaguu

SEQ ID NO: 263245 - RNA, 19 nt, Homo sapiens
gccaucaacugguagauaa

SEQ ID NO: 263246 - RNA, 19 nt, Homo sapiens
uggaaagucugaccgaaua

SEQ ID NO: 263247 - RNA, 19 nt, Homo sapiens
gauaagaagucagagaaau

SEQ ID NO: 263248 - RNA, 19 nt, Homo sapiens
gagaagcucugcauuaagg

SEQ ID NO: 263249 - RNA, 19 nt, Homo sapiens
acaaacagaucaaacaaga

SEQ ID NO: 263250 - RNA, 19 nt, Homo sapiens
gauaucagcugaaccucuu

SEQ ID NO: 263251 - RNA, 19 nt, Homo sapiens
ucaagcagaucuucaaguu

SEQ ID NO: 263252 - RNA, 19 nt, Homo sapiens
guaaaggacuccaccgaau

SEQ ID NO: 263253 - RNA, 19 nt, Homo sapiens
ggagcagcauuucguuuaa

SEQ ID NO: 263254 - RNA, 19 nt, Homo sapiens
gaacaaugccucgaaguug

SEQ ID NO: 263255 - RNA, 19 nt, Homo sapiens
gaaggcaucuuuggaggaa

SEQ ID NO: 263256 - RNA, 19 nt, Homo sapiens
gagcccagauucuuagauu

SEQ ID NO: 263257 - RNA, 19 nt, Homo sapiens
gaaaggaggucuguaacca

SEQ ID NO: 263258 - RNA, 19 nt, Homo sapiens
aaagaaagacgaugaggua

SEQ ID NO: 263259 - RNA, 19 nt, Homo sapiens
ggacgaagagagagccuua

SEQ ID NO: 263260 - RNA, 19 nt, Homo sapiens
gggaaaugaugaccaaaga

SEQ ID NO: 263261 - RNA, 19 nt, Homo sapiens
uaaggaagcauuugccaua

SEQ ID NO: 263262 - RNA, 19 nt, Homo sapiens
gagacaaguuugacaacaa

SEQ ID NO: 263263 - RNA, 19 nt, Homo sapiens
agauagagauugucagauu

SEQ ID NO: 263264 - RNA, 19 nt, Homo sapiens
cauauuagcccaucaguug

SEQ ID NO: 263265 - RNA, 19 nt, Homo sapiens
acacagagaucaagugcaa

SEQ ID NO: 263266 - RNA, 19 nt, Homo sapiens
cguuugagguuguaaauuu

SEQ ID NO: 263267 - RNA, 19 nt, Homo sapiens
cuuugaagcugguguguua

SEQ ID NO: 263268 - RNA, 19 nt, Homo sapiens
gaaaucaaagcaacaguga

SEQ ID NO: 263269 - RNA, 19 nt, Homo sapiens
caaaacagcugcuagaaga

SEQ ID NO: 263270 - RNA, 19 nt, Homo sapiens
gaaagcaauucccagacuu

SEQ ID NO: 263271 - RNA, 19 nt, Homo sapiens
gcaguaacgugaugagauc

SEQ ID NO: 263272 - RNA, 19 nt, Homo sapiens
cuaggaaucucauauacuu

SEQ ID NO: 263273 - RNA, 19 nt, Homo sapiens
cccaggaacugauauguaa

SEQ ID NO: 263274 - RNA, 19 nt, Homo sapiens
gcuaaugaguucugauuca

SEQ ID NO: 263275 - RNA, 19 nt, Homo sapiens
gaacguagcgcuuaucaac

SEQ ID NO: 263276 - RNA, 19 nt, Homo sapiens
auacagagguggaaaugaa

SEQ ID NO: 263277 - RNA, 19 nt, Homo sapiens
ggcagaaacugaugagaga

SEQ ID NO: 263278 - RNA, 19 nt, Homo sapiens
gaaaugaucaaggaaagaa

SEQ ID NO: 263279 - RNA, 19 nt, Homo sapiens
ccaaggaacugguggaagu

SEQ ID NO: 263280 - RNA, 19 nt, Homo sapiens
gcaaugacaucuccuccau

SEQ ID NO: 263281 - RNA, 19 nt, Homo sapiens
gugaugcuguuucucguua

SEQ ID NO: 263282 - RNA, 19 nt, Homo sapiens
ccaugaaacuugucacgaa

SEQ ID NO: 263283 - RNA, 19 nt, Homo sapiens
gaagagacggaacaggaua

SEQ ID NO: 263284 - RNA, 19 nt, Homo sapiens
gcacggaggguaagaaugu

SEQ ID NO: 263285 - RNA, 19 nt, Homo sapiens
gcaagagugugagggaauu

SEQ ID NO: 263286 - RNA, 19 nt, Homo sapiens
gaacagggagcccagauuc

SEQ ID NO: 263287 - RNA, 19 nt, Homo sapiens
gcccugauccucaaugaua

SEQ ID NO: 263288 - RNA, 19 nt, Homo sapiens
caacuacaauuugguaugu

SEQ ID NO: 263289 - RNA, 19 nt, Homo sapiens
gcggagggaucgacaaaug

SEQ ID NO: 263290 - RNA, 19 nt, Homo sapiens
gagagagccuuaccagcuu

SEQ ID NO: 263291 - RNA, 19 nt, Homo sapiens
gaauaucauugagagauug

SEQ ID NO: 263292 - RNA, 19 nt, Homo sapiens
gaaucaagcuuugcuacau

SEQ ID NO: 263293 - RNA, 19 nt, Homo sapiens
gaaaugaaggguccugguu

SEQ ID NO: 263294 - RNA, 19 nt, Homo sapiens
ggagugagaagcagaagaa

SEQ ID NO: 263295 - RNA, 19 nt, Homo sapiens
acaaagaacuucagagcau

SEQ ID NO: 263296 - RNA, 19 nt, Homo sapiens
auuagaggcucauacuuua

SEQ ID NO: 263297 - RNA, 19 nt, Homo sapiens
gaaauaagaucaacaguga

SEQ ID NO: 263298 - RNA, 19 nt, Homo sapiens
gaaaugauaugaagaggaa

SEQ ID NO: 263299 - RNA, 19 nt, Homo sapiens
ggaagaggguaacacauua

SEQ ID NO: 263300 - RNA, 19 nt, Homo sapiens
gaagaucucuacaaugaaa

SEQ ID NO: 263301 - RNA, 19 nt, Homo sapiens
cgaaauggccgcucuauua

SEQ ID NO: 263302 - RNA, 19 nt, Homo sapiens
cagaagaucucuacaauga

SEQ ID NO: 263303 - RNA, 19 nt, Homo sapiens
gcacagaacuuugaaccua

SEQ ID NO: 263304 - RNA, 19 nt, Homo sapiens
gaaaugaaguggcagaaga

SEQ ID NO: 263305 - RNA, 19 nt, Homo sapiens
agaaauggauccagaaaua

SEQ ID NO: 263306 - RNA, 19 nt, Homo sapiens
gaaccaauccuuccacaua

SEQ ID NO: 263307 - RNA, 19 nt, Homo sapiens
gggaagcgaugcaagaaua

SEQ ID NO: 263308 - RNA, 19 nt, Homo sapiens
ccacaaagaucacaauuca

SEQ ID NO: 263309 - RNA, 19 nt, Homo sapiens
acauagagcuucuugauaa

SEQ ID NO: 263310 - RNA, 19 nt, Homo sapiens
caaagaaacuaauggagaa

SEQ ID NO: 263311 - RNA, 19 nt, Homo sapiens
gaagagccauucaaauaug

SEQ ID NO: 263312 - RNA, 19 nt, Homo sapiens
caccaaagcugacuuagaa

SEQ ID NO: 263313 - RNA, 19 nt, Homo sapiens
gaagagacuuugcugaaug

SEQ ID NO: 263314 - RNA, 19 nt, Homo sapiens
uaaagaaggugcaucagaa

SEQ ID NO: 263315 - RNA, 19 nt, Homo sapiens
gaacaaggaaguaaaguga

SEQ ID NO: 263316 - RNA, 19 nt, Homo sapiens
gaucaacagugacaguuaa

SEQ ID NO: 263317 - RNA, 19 nt, Homo sapiens
gaaauuagcgagagaguug

SEQ ID NO: 263318 - RNA, 19 nt, Homo sapiens
gaaucuagcccauacauuu

SEQ ID NO: 263319 - RNA, 19 nt, Homo sapiens
agagaggccuguuauguua

SEQ ID NO: 263320 - RNA, 19 nt, Homo sapiens
gaauaacccugcacuguuc

SEQ ID NO: 263321 - RNA, 19 nt, Homo sapiens
gaugaagccuuaaaguauu

SEQ ID NO: 263322 - RNA, 19 nt, Homo sapiens
gcagaaagccucaguggaa

SEQ ID NO: 263323 - RNA, 19 nt, Homo sapiens
gcgaagaccuaaccucaaa

SEQ ID NO: 263324 - RNA, 19 nt, Homo sapiens
caaagaaaccucagauuga

SEQ ID NO: 263325 - RNA, 19 nt, Homo sapiens
gaacuugucaucgauguua

SEQ ID NO: 263326 - RNA, 19 nt, Homo sapiens
caaggaaccucauggcaaa

SEQ ID NO: 263327 - RNA, 19 nt, Homo sapiens
gagauuaccugcuuuacug

SEQ ID NO: 263328 - RNA, 19 nt, Homo sapiens
gguaacacauuaagaaaga

SEQ ID NO: 263329 - RNA, 19 nt, Homo sapiens
guuaaucacuguuauguug

SEQ ID NO: 263330 - RNA, 19 nt, Homo sapiens
gaucucauauucuuuguug

SEQ ID NO: 263331 - RNA, 19 nt, Homo sapiens
ggacguuguuagauuauuu

SEQ ID NO: 263332 - RNA, 19 nt, Homo sapiens
gagauacucugcaaguuga

SEQ ID NO: 263333 - RNA, 19 nt, Homo sapiens
gcaacaagagcaauaagua

SEQ ID NO: 263334 - RNA, 19 nt, Homo sapiens
gaaagacccugacauucau

SEQ ID NO: 263335 - RNA, 19 nt, Homo sapiens
gagaugaagccuuaaagua

SEQ ID NO: 263336 - RNA, 19 nt, Homo sapiens
gaacaaugcaucuaaacuu

SEQ ID NO: 263337 - RNA, 19 nt, Homo sapiens
gaagaaguuuggcucuauu

SEQ ID NO: 263338 - RNA, 19 nt, Homo sapiens
gcaauggguuggagacuau

SEQ ID NO: 263339 - RNA, 19 nt, Homo sapiens
gugaagaaaugccaggaua

SEQ ID NO: 263340 - RNA, 19 nt, Homo sapiens
gcacagguauuuggaauuc

SEQ ID NO: 263341 - RNA, 19 nt, Homo sapiens
ggaaugaaagggcaauuaa

SEQ ID NO: 263342 - RNA, 19 nt, Homo sapiens
gauaugcacccuacaagua

SEQ ID NO: 263343 - RNA, 19 nt, Homo sapiens
gaaauacacaaacacagua

SEQ ID NO: 263344 - RNA, 19 nt, Homo sapiens
gaaagauacuucugaaucg

SEQ ID NO: 263345 - RNA, 19 nt, Homo sapiens
aaacuaagguggucucaau

SEQ ID NO: 263346 - RNA, 19 nt, Homo sapiens
uaaaauggcuuucccaaaa

SEQ ID NO: 263347 - RNA, 19 nt, Homo sapiens
caaccacacugcacagauu

SEQ ID NO: 263348 - RNA, 19 nt, Homo sapiens
cauaaacccucuugguaaa

SEQ ID NO: 263349 - RNA, 19 nt, Homo sapiens
gggagaagaucauguauac

SEQ ID NO: 263350 - RNA, 19 nt, Homo sapiens
guaugaagauggaauugaa

SEQ ID NO: 263351 - RNA, 19 nt, Homo sapiens
ugaaagggaugaacaagga

SEQ ID NO: 263352 - RNA, 19 nt, Homo sapiens
gagauuguccggcaugaua

SEQ ID NO: 263353 - RNA, 19 nt, Homo sapiens
ugacagaguugauaaaugg

SEQ ID NO: 263354 - RNA, 19 nt, Homo sapiens
ugacauugaugaugaagaa

SEQ ID NO: 263355 - RNA, 19 nt, Homo sapiens
cagauuggcuaugauauuu

SEQ ID NO: 263356 - RNA, 19 nt, Homo sapiens
gagaagaucauguauacuu

SEQ ID NO: 263357 - RNA, 19 nt, Homo sapiens
caaagcauauuguguauac

SEQ ID NO: 263358 - RNA, 19 nt, Homo sapiens
ggacaagauucagauaaga

SEQ ID NO: 263359 - RNA, 19 nt, Homo sapiens
gaaauggccgcucuauuau

SEQ ID NO: 263360 - RNA, 19 nt, Homo sapiens
ggauauggccuuucucuau

SEQ ID NO: 263361 - RNA, 19 nt, Homo sapiens
gaagaaugccuauaaccaa

SEQ ID NO: 263362 - RNA, 19 nt, Homo sapiens
gugaagacgugcugauauu

SEQ ID NO: 263363 - RNA, 19 nt, Homo sapiens
gaaacaaugugaugagaac

SEQ ID NO: 263364 - RNA, 19 nt, Homo sapiens
gcacaauaacucagaauga

SEQ ID NO: 263365 - RNA, 19 nt, Homo sapiens
gaagagaggccuguuaugu

SEQ ID NO: 263366 - RNA, 19 nt, Homo sapiens
gaucauguauacuuugguu

SEQ ID NO: 263367 - RNA, 19 nt, Homo sapiens
agaauaaccugguguguuc

SEQ ID NO: 263368 - RNA, 19 nt, Homo sapiens
ggaagagacuuugcugaau

SEQ ID NO: 263369 - RNA, 19 nt, Homo sapiens
gcagcuaaucuuuguaaua

SEQ ID NO: 263370 - RNA, 19 nt, Homo sapiens
gacauaaacccucuuggua

SEQ ID NO: 263371 - RNA, 19 nt, Homo sapiens
gugagcggcuucuuuaauu

SEQ ID NO: 263372 - RNA, 19 nt, Homo sapiens
caacaucaacgauuacuga

SEQ ID NO: 263373 - RNA, 19 nt, Homo sapiens
gcaaagguguuggagagaa

SEQ ID NO: 263374 - RNA, 19 nt, Homo sapiens
ggaauaacccugcacuguu

SEQ ID NO: 263375 - RNA, 19 nt, Homo sapiens
uaaacccucuugguaaaua

SEQ ID NO: 263376 - RNA, 19 nt, Homo sapiens
gaaaugccaggauauggua

SEQ ID NO: 263377 - RNA, 19 nt, Homo sapiens
ggacagaaauccccacaaa

SEQ ID NO: 263378 - RNA, 19 nt, Homo sapiens
cucaagaacucaucuguaa

SEQ ID NO: 263379 - RNA, 19 nt, Homo sapiens
aguaagagauucaacacua

SEQ ID NO: 263380 - RNA, 19 nt, Homo sapiens
caucagaacuugucaucga

SEQ ID NO: 263381 - RNA, 19 nt, Homo sapiens
aaauagaggugguucauca

SEQ ID NO: 263382 - RNA, 19 nt, Homo sapiens
gaaaugaagggucuugguu

SEQ ID NO: 263383 - RNA, 19 nt, Homo sapiens
gauaggagauguacucacu

SEQ ID NO: 263384 - RNA, 19 nt, Homo sapiens
gaaauucagcugucauuca

SEQ ID NO: 263385 - RNA, 19 nt, Homo sapiens
gaaaugauaaugcuuccaa

SEQ ID NO: 263386 - RNA, 19 nt, Homo sapiens
uuaaagacccaacagaaua

SEQ ID NO: 263387 - RNA, 19 nt, Homo sapiens
gaaggugcaucagaacuug

SEQ ID NO: 263388 - RNA, 19 nt, Homo sapiens
gaacaaagaaaccucagau

SEQ ID NO: 263389 - RNA, 19 nt, Homo sapiens
gagaagagcagcaacuaug

SEQ ID NO: 263390 - RNA, 19 nt, Homo sapiens
gaacacuucuggcuauuuu

SEQ ID NO: 263391 - RNA, 19 nt, Homo sapiens
gauguagacuuggaacaaa

SEQ ID NO: 263392 - RNA, 19 nt, Homo sapiens
uuacagcucuaggaacuua

SEQ ID NO: 263393 - RNA, 19 nt, Homo sapiens
gauaaugcuuccaaacugu

SEQ ID NO: 263394 - RNA, 19 nt, Homo sapiens
aaugaaggcugcucagaaa

SEQ ID NO: 263395 - RNA, 19 nt, Homo sapiens
gagaaauguuagagaagaa

SEQ ID NO: 263396 - RNA, 19 nt, Homo sapiens
gaacuuuguuaaucacugu

SEQ ID NO: 263397 - RNA, 19 nt, Homo sapiens
gcaaggaggucaauucugu

SEQ ID NO: 263398 - RNA, 19 nt, Homo sapiens
gaacauggaugcccacaag

SEQ ID NO: 263399 - RNA, 19 nt, Homo sapiens
ccugagaacuaauauguua

SEQ ID NO: 263400 - RNA, 19 nt, Homo sapiens
gcaaguacgucaagaagug

SEQ ID NO: 263401 - RNA, 19 nt, Homo sapiens
gaagcaaguuugaggagaa

SEQ ID NO: 263402 - RNA, 19 nt, Homo sapiens
gaaccagacuugcauugug

SEQ ID NO: 263403 - RNA, 19 nt, Homo sapiens
ggacucaguuuaccuuaau

SEQ ID NO: 263404 - RNA, 19 nt, Homo sapiens
acacagagauccagaaauc

SEQ ID NO: 263405 - RNA, 19 nt, Homo sapiens
ugacaucgccucucucuuu

SEQ ID NO: 263406 - RNA, 19 nt, Homo sapiens
acauggagcugcugcauuu

SEQ ID NO: 263407 - RNA, 19 nt, Homo sapiens
gcacuucccugcagacaca

SEQ ID NO: 263408 - RNA, 19 nt, Homo sapiens
ggacaaguuugauaacaag

SEQ ID NO: 263409 - RNA, 19 nt, Homo sapiens
ugacugagcugaccaaugc

SEQ ID NO: 263410 - RNA, 19 nt, Homo sapiens
gcaaugacaucgccucucu

SEQ ID NO: 263411 - RNA, 19 nt, Homo sapiens
gauaaauccuaccuagaga

SEQ ID NO: 263412 - RNA, 19 nt, Homo sapiens
gcacugauccucaaugaca

SEQ ID NO: 263413 - RNA, 19 nt, Homo sapiens
gggagaagaucaaguacug

SEQ ID NO: 263414 - RNA, 19 nt, Homo sapiens
gagcagggcagcaaaguga

SEQ ID NO: 263415 - RNA, 19 nt, Homo sapiens
acaagaacaucauugagaa

SEQ ID NO: 263416 - RNA, 19 nt, Homo sapiens
acaaguaccugacagugaa

SEQ ID NO: 263417 - RNA, 19 nt, Homo sapiens
gagcugacaguccugcuua

SEQ ID NO: 263418 - RNA, 19 nt, Homo sapiens
gggacaaguuugauaacaa

SEQ ID NO: 263419 - RNA, 19 nt, Homo sapiens
acacggagguggagaugaa

SEQ ID NO: 263420 - RNA, 19 nt, Homo sapiens
aaacaggucuuuggcauuc

SEQ ID NO: 263421 - RNA, 19 nt, Homo sapiens
gaacuacuuguacuucauu

SEQ ID NO: 263422 - RNA, 19 nt, Homo sapiens
uggaaaggcugaacaagau

SEQ ID NO: 263423 - RNA, 19 nt, Homo sapiens
ugaaggagauggcccaauc

SEQ ID NO: 263424 - RNA, 19 nt, Homo sapiens
gcacuggaauggcuuguac

SEQ ID NO: 263425 - RNA, 19 nt, Homo sapiens
gcaaccagcugcgcaagau

SEQ ID NO: 263426 - RNA, 19 nt, Homo sapiens
cagcacaucuuccugaaca

SEQ ID NO: 263427 - RNA, 19 nt, Homo sapiens
cccaagagcucaucugcaa

SEQ ID NO: 263428 - RNA, 19 nt, Homo sapiens
gcacauugccaagcaguuu

SEQ ID NO: 263429 - RNA, 19 nt, Homo sapiens
gcuggaagaucaaccuguu

SEQ ID NO: 263430 - RNA, 19 nt, Homo sapiens
guuaugcuguuacuaguga

SEQ ID NO: 263431 - RNA, 19 nt, Homo sapiens
gggacaagauggacugugu

SEQ ID NO: 263432 - RNA, 19 nt, Homo sapiens
gcaagaugcugcugcaaaa

SEQ ID NO: 263433 - RNA, 19 nt, Homo sapiens
gcaguuaugcuguuacuag

SEQ ID NO: 263434 - RNA, 19 nt, Homo sapiens
uagagaccuuuguuccuua

SEQ ID NO: 263435 - RNA, 19 nt, Homo sapiens
gagagggacaaguuugaua

SEQ ID NO: 263436 - RNA, 19 nt, Homo sapiens
gaugaugagugacaagaag

SEQ ID NO: 263437 - RNA, 19 nt, Homo sapiens
caacacagagauccagaaa

SEQ ID NO: 263438 - RNA, 19 nt, Homo sapiens
gaacuucacccuggacaug

SEQ ID NO: 263439 - RNA, 19 nt, Homo sapiens
ccacagccaucaccaucaa

SEQ ID NO: 263440 - RNA, 19 nt, Homo sapiens
ggaaggccaagcagacuaa

SEQ ID NO: 263441 - RNA, 19 nt, Homo sapiens
gggacucaguuuaccuuaa

SEQ ID NO: 263442 - RNA, 19 nt, Homo sapiens
guagugagaagcagaagaa

SEQ ID NO: 263443 - RNA, 19 nt, Homo sapiens
caagauggacugugucuca

SEQ ID NO: 263444 - RNA, 19 nt, Homo sapiens
gggacaaggugauccugaa

SEQ ID NO: 263445 - RNA, 19 nt, Homo sapiens
aagcucaacuccaccauga

SEQ ID NO: 263446 - RNA, 19 nt, Homo sapiens
gaucagcgagccuguguug

SEQ ID NO: 263447 - RNA, 19 nt, Homo sapiens
ggaaauccuucaguucauc

SEQ ID NO: 263448 - RNA, 19 nt, Homo sapiens
gagcaucgaguacucagaa

SEQ ID NO: 263449 - RNA, 19 nt, Homo sapiens
gaacagugacauucucauc

SEQ ID NO: 263450 - RNA, 19 nt, Homo sapiens
caaaggugaugccucagau

SEQ ID NO: 263451 - RNA, 19 nt, Homo sapiens
gaagaucaaccuguuuaug

SEQ ID NO: 263452 - RNA, 19 nt, Homo sapiens
ggaacuacuuguacuucau

SEQ ID NO: 263453 - RNA, 19 nt, Homo sapiens
ggacauggaauuccucuac

SEQ ID NO: 263454 - RNA, 19 nt, Homo sapiens
gcaugccgcugaucuacug

SEQ ID NO: 263455 - RNA, 19 nt, Homo sapiens
gaagugggccauaacaucu

SEQ ID NO: 263456 - RNA, 19 nt, Homo sapiens
gcaaguaccgcauggaucu

SEQ ID NO: 263457 - RNA, 19 nt, Homo sapiens
caagggugaugccaagaug

SEQ ID NO: 263458 - RNA, 19 nt, Homo sapiens
agaaugugcucagcuacua

SEQ ID NO: 263459 - RNA, 19 nt, Homo sapiens
uaacgagcaucaugagaag

SEQ ID NO: 263460 - RNA, 19 nt, Homo sapiens
ggacugacaagaauaacga

SEQ ID NO: 263461 - RNA, 19 nt, Homo sapiens
gaccugguguucuuuguca

SEQ ID NO: 263462 - RNA, 19 nt, Homo sapiens
agaaguuccugacguguga

SEQ ID NO: 263463 - RNA, 19 nt, Homo sapiens
gauccugaauccugucaau

SEQ ID NO: 263464 - RNA, 19 nt, Homo sapiens
gagaugacaagaagaacaa

SEQ ID NO: 263465 - RNA, 19 nt, Homo sapiens
gacaucgccucucucuuug

SEQ ID NO: 263466 - RNA, 19 nt, Homo sapiens
ucaauucugugaacugcaa

SEQ ID NO: 263467 - RNA, 19 nt, Homo sapiens
uugcguggcuguuucauga

SEQ ID NO: 263468 - RNA, 19 nt, Homo sapiens
caauaacugacaacucuuu

SEQ ID NO: 263469 - RNA, 19 nt, Homo sapiens
cuagagaccuuuguuccuu

SEQ ID NO: 263470 - RNA, 19 nt, Homo sapiens
caucaucauugccuucuuc

SEQ ID NO: 263471 - RNA, 19 nt, Homo sapiens
gcaccaagaacgagaagau

SEQ ID NO: 263472 - RNA, 19 nt, Homo sapiens
gaggagaagcugugcauca

SEQ ID NO: 263473 - RNA, 19 nt, Homo sapiens
acaaacaccugcaccucuu

SEQ ID NO: 263474 - RNA, 19 nt, Homo sapiens
gcaaguuugaggagaauga

SEQ ID NO: 263475 - RNA, 19 nt, Homo sapiens
gagaagaacaagcucacuu

SEQ ID NO: 263476 - RNA, 19 nt, Homo sapiens
ucacugcccugcugcacaa

SEQ ID NO: 263477 - RNA, 19 nt, Homo sapiens
ugagugaaauguccagcuu

SEQ ID NO: 263478 - RNA, 19 nt, Homo sapiens
ucuaugaccuccuguucuu

SEQ ID NO: 263479 - RNA, 19 nt, Homo sapiens
uauccuaccugcugucugu

SEQ ID NO: 263480 - RNA, 19 nt, Homo sapiens
gauccgagaccuggacuuu

SEQ ID NO: 263481 - RNA, 19 nt, Homo sapiens
agacuaagcaggacaagga

SEQ ID NO: 263482 - RNA, 19 nt, Homo sapiens
ggacuacaagaacaucauu

SEQ ID NO: 263483 - RNA, 19 nt, Homo sapiens
gggagcaaaugaggaagaa

SEQ ID NO: 263484 - RNA, 19 nt, Homo sapiens
agaacaagcucacuuuuga

SEQ ID NO: 263485 - RNA, 19 nt, Homo sapiens
ggacuaccucaacaaugua

SEQ ID NO: 263486 - RNA, 19 nt, Homo sapiens
ucacguggacugacaagaa

SEQ ID NO: 263487 - RNA, 19 nt, Homo sapiens
gaacggcagaagcugauga

SEQ ID NO: 263488 - RNA, 19 nt, Homo sapiens
ggaggucaauucugugaac

SEQ ID NO: 263489 - RNA, 19 nt, Homo sapiens
gguggcaguuaugcuguua

SEQ ID NO: 263490 - RNA, 19 nt, Homo sapiens
caacauguggaacuacuug

SEQ ID NO: 263491 - RNA, 19 nt, Homo sapiens
gugagaagcagaagaagga

SEQ ID NO: 263492 - RNA, 19 nt, Homo sapiens
caccggcucuucaccacua

SEQ ID NO: 263493 - RNA, 19 nt, Homo sapiens
gcauggagcagaucguguu

SEQ ID NO: 263494 - RNA, 19 nt, Homo sapiens
gaggugagcccacgugaag

SEQ ID NO: 263495 - RNA, 19 nt, Homo sapiens
agacuugcauugugacuca

SEQ ID NO: 263496 - RNA, 19 nt, Homo sapiens
caaugcaggugacgaugug

SEQ ID NO: 263497 - RNA, 19 nt, Homo sapiens
gaagauggcugacauguac

SEQ ID NO: 263498 - RNA, 19 nt, Homo sapiens
gaaaggaaaucacuacauc

SEQ ID NO: 263499 - RNA, 19 nt, Homo sapiens
ggaaugaggcccagaaaga

SEQ ID NO: 263500 - RNA, 19 nt, Homo sapiens
guagagauguggcggcuuu

SEQ ID NO: 263501 - RNA, 19 nt, Homo sapiens
ggacucagcaggaagcaua

SEQ ID NO: 263502 - RNA, 19 nt, Homo sapiens
gugcaggugugauucuuua

SEQ ID NO: 263503 - RNA, 19 nt, Homo sapiens
gcucugauguugucucuau

SEQ ID NO: 263504 - RNA, 19 nt, Homo sapiens
ggagaucgaucgcagcaau

SEQ ID NO: 263505 - RNA, 19 nt, Homo sapiens
ucaagaaccugcgagaauu

SEQ ID NO: 263506 - RNA, 19 nt, Homo sapiens
ggcaauggcuacaucaaug

SEQ ID NO: 263507 - RNA, 19 nt, Homo sapiens
gaggagauaucccgagcuu

SEQ ID NO: 263508 - RNA, 19 nt, Homo sapiens
caacagcucccaagcauca

SEQ ID NO: 263509 - RNA, 19 nt, Homo sapiens
ccugugagcuaaucuuuga

SEQ ID NO: 263510 - RNA, 19 nt, Homo sapiens
ggcaguaugucuacaaugu

SEQ ID NO: 263511 - RNA, 19 nt, Homo sapiens
ggaagauggcugacaugua

SEQ ID NO: 263512 - RNA, 19 nt, Homo sapiens
ccugaaaucugaaacacuu

SEQ ID NO: 263513 - RNA, 19 nt, Homo sapiens
ggaacuugguacagguuaa

SEQ ID NO: 263514 - RNA, 19 nt, Homo sapiens
ggacugugcaggugugauu

SEQ ID NO: 263515 - RNA, 19 nt, Homo sapiens
uaaggcaaauucaacuuuc

SEQ ID NO: 263516 - RNA, 19 nt, Homo sapiens
gcaauggcuacaucaauga

SEQ ID NO: 263517 - RNA, 19 nt, Homo sapiens
ggcaacaaguucuggauca

SEQ ID NO: 263518 - RNA, 19 nt, Homo sapiens
caagaaccugcgagaauuu

SEQ ID NO: 263519 - RNA, 19 nt, Homo sapiens
gaccauggcuaaguuccuu

SEQ ID NO: 263520 - RNA, 19 nt, Homo sapiens
guacccaccucuuucucuu

SEQ ID NO: 263521 - RNA, 19 nt, Homo sapiens
gagguugaguucuccacaa

SEQ ID NO: 263522 - RNA, 19 nt, Homo sapiens
gagaugccaagcuguauga

SEQ ID NO: 263523 - RNA, 19 nt, Homo sapiens
ucuaacaccugugagcuaa

SEQ ID NO: 263524 - RNA, 19 nt, Homo sapiens
gggcaucacagccuucauu

SEQ ID NO: 263525 - RNA, 19 nt, Homo sapiens
gcuaguguugugugauuua

SEQ ID NO: 263526 - RNA, 19 nt, Homo sapiens
gcacgugagggaagccuuu

SEQ ID NO: 263527 - RNA, 19 nt, Homo sapiens
gaucaguggugaguacauc

SEQ ID NO: 263528 - RNA, 19 nt, Homo sapiens
agaaguaucucccgaagcu

SEQ ID NO: 263529 - RNA, 19 nt, Homo sapiens
gcagcaaugaguucaagaa

SEQ ID NO: 263530 - RNA, 19 nt, Homo sapiens
cggcuaguguugugugauu

SEQ ID NO: 263531 - RNA, 19 nt, Homo sapiens
cacaacagcucccaagcau

SEQ ID NO: 263532 - RNA, 19 nt, Homo sapiens
ggcaggcgaucacgguuga

SEQ ID NO: 263533 - RNA, 19 nt, Homo sapiens
gcucaaagcggaaaagaaa

SEQ ID NO: 263534 - RNA, 19 nt, Homo sapiens
gaucggccacuuccaguug

SEQ ID NO: 263535 - RNA, 19 nt, Homo sapiens
uaacaccugugagcuaauc

SEQ ID NO: 263536 - RNA, 19 nt, Homo sapiens
caaauucaacuuucagucu

SEQ ID NO: 263537 - RNA, 19 nt, Homo sapiens
gaaaucacuacauccugaa

SEQ ID NO: 263538 - RNA, 19 nt, Homo sapiens
aacaaguucuggaucacua

SEQ ID NO: 263539 - RNA, 19 nt, Homo sapiens
gcugaucaguggugaguac

SEQ ID NO: 263540 - RNA, 19 nt, Homo sapiens
gauaaggcaaauucaacuu

SEQ ID NO: 263541 - RNA, 19 nt, Homo sapiens
uuugaagacugcaagauuc

SEQ ID NO: 263542 - RNA, 19 nt, Homo sapiens
caaugcagacuuucacuag

SEQ ID NO: 263543 - RNA, 19 nt, Homo sapiens
cggcagagccuucaaugca

SEQ ID NO: 263544 - RNA, 19 nt, Homo sapiens
ggaagccuuuggccagaag

SEQ ID NO: 263545 - RNA, 19 nt, Homo sapiens
gccagaagaucggccacuu

SEQ ID NO: 263546 - RNA, 19 nt, Homo sapiens
cguggacgaugcaaucaau

SEQ ID NO: 263547 - RNA, 19 nt, Homo sapiens
caaugcaggcucugauguu

SEQ ID NO: 263548 - RNA, 19 nt, Homo sapiens
gaaugaggcccagaaagag

SEQ ID NO: 263549 - RNA, 19 nt, Homo sapiens
caaccagcuuguacgcaau

SEQ ID NO: 263550 - RNA, 19 nt, Homo sapiens
uggacggcauucaguguuu

SEQ ID NO: 263551 - RNA, 19 nt, Homo sapiens
cagguuaaguaucccuaau

SEQ ID NO: 263552 - RNA, 19 nt, Homo sapiens
cuaguguugugugauuuaa

SEQ ID NO: 263553 - RNA, 19 nt, Homo sapiens
gcaccuaguggccuuucuu

SEQ ID NO: 263554 - RNA, 19 nt, Homo sapiens
gggaagccuuuggccagaa

SEQ ID NO: 263555 - RNA, 19 nt, Homo sapiens
ccaacauccugggccauga

SEQ ID NO: 263556 - RNA, 19 nt, Homo sapiens
gagggccauugcacugcua

SEQ ID NO: 263557 - RNA, 19 nt, Homo sapiens
ccacaacagcucccaagca

SEQ ID NO: 263558 - RNA, 19 nt, Homo sapiens
ucaaugcagacuuucacua

SEQ ID NO: 263559 - RNA, 19 nt, Homo sapiens
agccuucaaugcagacuuu

SEQ ID NO: 263560 - RNA, 19 nt, Homo sapiens
gaugcugacguccugauug

SEQ ID NO: 263561 - RNA, 19 nt, Homo sapiens
aaagaaaggaaaucacuac

SEQ ID NO: 263562 - RNA, 19 nt, Homo sapiens
ggauaaggcaaauucaacu

SEQ ID NO: 263563 - RNA, 19 nt, Homo sapiens
gaaaagaaaggaaaucacu

SEQ ID NO: 263564 - RNA, 19 nt, Homo sapiens
guuaggggcugcuauuuca

SEQ ID NO: 263565 - RNA, 19 nt, Homo sapiens
gaacuugguacagguuaag

SEQ ID NO: 263566 - RNA, 19 nt, Homo sapiens
uggaugagguugaguucuc

SEQ ID NO: 263567 - RNA, 19 nt, Homo sapiens
cccuaauccugaaaucuga

SEQ ID NO: 263568 - RNA, 19 nt, Homo sapiens
ucugugcccuugcucucua

SEQ ID NO: 263569 - RNA, 19 nt, Homo sapiens
aaugcaggcucugauguug

SEQ ID NO: 263570 - RNA, 19 nt, Homo sapiens
gaaaucugaaacacuugug

SEQ ID NO: 263571 - RNA, 19 nt, Homo sapiens
gguuaaguaucccuaaucc

SEQ ID NO: 263572 - RNA, 19 nt, Homo sapiens
augccaagcuguaugagau

SEQ ID NO: 263573 - RNA, 19 nt, Homo sapiens
gaaggguaugccuggcuuu

SEQ ID NO: 263574 - RNA, 19 nt, Homo sapiens
gcaacaaguucuggaucac

SEQ ID NO: 263575 - RNA, 19 nt, Homo sapiens
cauccugaauggcaacaag

SEQ ID NO: 263576 - RNA, 19 nt, Homo sapiens
gaugccaagcuguaugaga

SEQ ID NO: 263577 - RNA, 19 nt, Homo sapiens
cagccuucauuguggagaa

SEQ ID NO: 263578 - RNA, 19 nt, Homo sapiens
ugggcuaccuggagcaugu

SEQ ID NO: 263579 - RNA, 19 nt, Homo sapiens
aaguaucccuaauccugaa

SEQ ID NO: 263580 - RNA, 19 nt, Homo sapiens
gccaagcuguaugagauag

SEQ ID NO: 263581 - RNA, 19 nt, Homo sapiens
ggacggcauucaguguuuu

SEQ ID NO: 263582 - RNA, 19 nt, Homo sapiens
caggugugauucuuuacuc

SEQ ID NO: 263583 - RNA, 19 nt, Homo sapiens
gggaagauggcugacaugu

SEQ ID NO: 263584 - RNA, 19 nt, Homo sapiens
ggguaugccuggcuuuagc

SEQ ID NO: 263585 - RNA, 19 nt, Homo sapiens
aaggcaaauucaacuuuca

SEQ ID NO: 263586 - RNA, 19 nt, Homo sapiens
ggcuaguguugugugauuu

SEQ ID NO: 263587 - RNA, 19 nt, Homo sapiens
uggccuuucuugggaagua

SEQ ID NO: 263588 - RNA, 19 nt, Homo sapiens
uuucaacgcagggagauaa

SEQ ID NO: 263589 - RNA, 19 nt, Homo sapiens
ccaaugcaggcucugaugu

SEQ ID NO: 263590 - RNA, 19 nt, Homo sapiens
gaugcaaucaaugggcuaa

SEQ ID NO: 263591 - RNA, 19 nt, Homo sapiens
gcucaagcacagcagaauc

SEQ ID NO: 263592 - RNA, 19 nt, Homo sapiens
aaaauggacucagcaggaa

SEQ ID NO: 263593 - RNA, 19 nt, Homo sapiens
gccauugcacugcuaagga

SEQ ID NO: 263594 - RNA, 19 nt, Homo sapiens
caccugugagcuaaucuuu

SEQ ID NO: 263595 - RNA, 19 nt, Homo sapiens
gaucgcagcaaugaguuca

SEQ ID NO: 263596 - RNA, 19 nt, Homo sapiens
ugaauuggaacuugguaca

SEQ ID NO: 263597 - RNA, 19 nt, Homo sapiens
gcacaugacugcuguaaag

SEQ ID NO: 263598 - RNA, 19 nt, Homo sapiens
acaaacagcuggaagaaga

SEQ ID NO: 263599 - RNA, 19 nt, Homo sapiens
gcaacuggaucaagagcua

SEQ ID NO: 263600 - RNA, 19 nt, Homo sapiens
gggaacagcaugaggaaua

SEQ ID NO: 263601 - RNA, 19 nt, Homo sapiens
caagagagaugagcaacug

SEQ ID NO: 263602 - RNA, 19 nt, Homo sapiens
ggaacagcaugaggaauau

SEQ ID NO: 263603 - RNA, 19 nt, Homo sapiens
ugaagcagcuagagaagca

SEQ ID NO: 263604 - RNA, 19 nt, Homo sapiens
caguggaggucccaucaaa

SEQ ID NO: 263605 - RNA, 19 nt, Homo sapiens
acaaagggaucagcagcua

SEQ ID NO: 263606 - RNA, 19 nt, Homo sapiens
gcaagaaugugagcaacag

SEQ ID NO: 263607 - RNA, 19 nt, Homo sapiens
cagcaggacggacaacuaa

SEQ ID NO: 263608 - RNA, 19 nt, Homo sapiens
ugaagcaccuggagaagca

SEQ ID NO: 263609 - RNA, 19 nt, Homo sapiens
ccacaaagggagaaguauu

SEQ ID NO: 263610 - RNA, 19 nt, Homo sapiens
gcagcaggacggacaacua

SEQ ID NO: 263611 - RNA, 19 nt, Homo sapiens
uaaacaaacagcuggaaga

SEQ ID NO: 263612 - RNA, 19 nt, Homo sapiens
gcaugaggaauaucagaaa

SEQ ID NO: 263613 - RNA, 19 nt, Homo sapiens
gggaucagcagcuaaacaa

SEQ ID NO: 263614 - RNA, 19 nt, Homo sapiens
aaccagcccugcccacaaa

SEQ ID NO: 263615 - RNA, 19 nt, Homo sapiens
gagcaacugggaaugaaga

SEQ ID NO: 263616 - RNA, 19 nt, Homo sapiens
gagaugagcaacugggaau

SEQ ID NO: 263617 - RNA, 19 nt, Homo sapiens
gaugagcaacugggaauga

SEQ ID NO: 263618 - RNA, 19 nt, Homo sapiens
cacaaagggagaaguauug

SEQ ID NO: 263619 - RNA, 19 nt, Homo sapiens
aaacaaacagcuggaagaa

SEQ ID NO: 263620 - RNA, 19 nt, Homo sapiens
gggacugccugagcaagaa

SEQ ID NO: 263621 - RNA, 19 nt, Homo sapiens
gaucaagagcuagucaaga

SEQ ID NO: 263622 - RNA, 19 nt, Homo sapiens
aaagggaucagcagcuaaa

SEQ ID NO: 263623 - RNA, 19 nt, Homo sapiens
gcccacaaagggagaagua

SEQ ID NO: 263624 - RNA, 19 nt, Homo sapiens
caacugggaaugaagaaag

SEQ ID NO: 263625 - RNA, 19 nt, Homo sapiens
ggaggucccaucaaagcaa

SEQ ID NO: 263626 - RNA, 19 nt, Homo sapiens
gaucagcagcuaaacaaac

SEQ ID NO: 263627 - RNA, 19 nt, Homo sapiens
ugaggaauaucagaaagca

SEQ ID NO: 263628 - RNA, 19 nt, Homo sapiens
gagcuagucaagagagaug

SEQ ID NO: 263629 - RNA, 19 nt, Homo sapiens
caaaugaaacagccaacuc

SEQ ID NO: 263630 - RNA, 19 nt, Homo sapiens
caaagggaucagcagcuaa

SEQ ID NO: 263631 - RNA, 19 nt, Homo sapiens
aaagggagaaguauugcuu

SEQ ID NO: 263632 - RNA, 19 nt, Homo sapiens
gaauaucagaaagcagaaa

SEQ ID NO: 263633 - RNA, 19 nt, Homo sapiens
caugaggaauaucagaaag

SEQ ID NO: 263634 - RNA, 19 nt, Homo sapiens
aaguauugcuuccuguaga

SEQ ID NO: 263635 - RNA, 19 nt, Homo sapiens
caaccagcccugcccacaa

SEQ ID NO: 263636 - RNA, 19 nt, Homo sapiens
agggacagcugaagcaucu

SEQ ID NO: 263637 - RNA, 19 nt, Homo sapiens
ugaagaaagagcaacuguu

SEQ ID NO: 263638 - RNA, 19 nt, Homo sapiens
ggccacccaaacauaaaua

SEQ ID NO: 263639 - RNA, 19 nt, Homo sapiens
gcaguggccacccaaacau

SEQ ID NO: 263640 - RNA, 19 nt, Homo sapiens
caucaaagcaagaggaaaa

SEQ ID NO: 263641 - RNA, 19 nt, Homo sapiens
gaaugaagaaagagcaacu

SEQ ID NO: 263642 - RNA, 19 nt, Homo sapiens
gcucuuagaccagcaacug

SEQ ID NO: 263643 - RNA, 19 nt, Homo sapiens
acccagagcagcagcuuaa

SEQ ID NO: 263644 - RNA, 19 nt, Homo sapiens
ggaauaucagaaagcagaa

SEQ ID NO: 263645 - RNA, 19 nt, Homo sapiens
gcaagagggccaggugaag

SEQ ID NO: 263646 - RNA, 19 nt, Homo sapiens
gcaacugggaaugaagaaa

SEQ ID NO: 263647 - RNA, 19 nt, Homo sapiens
gcaggacggacaacuaaaa

SEQ ID NO: 263648 - RNA, 19 nt, Homo sapiens
cagagcagcagcuuaagca

SEQ ID NO: 263649 - RNA, 19 nt, Homo sapiens
ggaucagcagcuaaacaaa

SEQ ID NO: 263650 - RNA, 19 nt, Homo sapiens
aucaagagcuagucaagag

SEQ ID NO: 263651 - RNA, 19 nt, Homo sapiens
ggaucaagagcuagucaag

SEQ ID NO: 263652 - RNA, 19 nt, Homo sapiens
gcagguaggacagccaaag

SEQ ID NO: 263653 - RNA, 19 nt, Homo sapiens
caauacccaucaggagcaa

SEQ ID NO: 263654 - RNA, 19 nt, Homo sapiens
gcagcugaaguaccuggaa

SEQ ID NO: 263655 - RNA, 19 nt, Homo sapiens
caguggccacccaaacaua

SEQ ID NO: 263656 - RNA, 19 nt, Homo sapiens
gugagcaacagcagaagga

SEQ ID NO: 263657 - RNA, 19 nt, Homo sapiens
gcuaaacaaacagcuggaa

SEQ ID NO: 263658 - RNA, 19 nt, Homo sapiens
gaacagcaugaggaauauc

SEQ ID NO: 263659 - RNA, 19 nt, Homo sapiens
gccacccaaacauaaauaa

SEQ ID NO: 263660 - RNA, 19 nt, Homo sapiens
gcaaaugaaacagccaacu

SEQ ID NO: 263661 - RNA, 19 nt, Homo sapiens
aaugugagcaacagcagaa

SEQ ID NO: 263662 - RNA, 19 nt, Homo sapiens
gggaaugaagaaagagcaa

SEQ ID NO: 263663 - RNA, 19 nt, Homo sapiens
gagcuccucaagacuguuc

SEQ ID NO: 263664 - RNA, 19 nt, Homo sapiens
ugccugagcaagaauguga

SEQ ID NO: 263665 - RNA, 19 nt, Homo sapiens
cagcaugaggaauaucaga

SEQ ID NO: 263666 - RNA, 19 nt, Homo sapiens
uagagcaccagcagcagaa

SEQ ID NO: 263667 - RNA, 19 nt, Homo sapiens
ccaucaggagcaaaugaaa

SEQ ID NO: 263668 - RNA, 19 nt, Homo sapiens
gaacggcgcucgcugcuau

SEQ ID NO: 263669 - RNA, 19 nt, Homo sapiens
gaagcacucuguauauuug

SEQ ID NO: 263670 - RNA, 19 nt, Homo sapiens
gcaaggaagcuguguguaa

SEQ ID NO: 263671 - RNA, 19 nt, Homo sapiens
caaggaagcuguguguaaa

SEQ ID NO: 263672 - RNA, 19 nt, Homo sapiens
ggaagcacucuguauauuu

SEQ ID NO: 263673 - RNA, 19 nt, Homo sapiens
acaaagaccugaacuacug

SEQ ID NO: 263674 - RNA, 19 nt, Homo sapiens
aaaggaagcacucuguaua

SEQ ID NO: 263675 - RNA, 19 nt, Homo sapiens
ggaguauucucggauaguu

SEQ ID NO: 263676 - RNA, 19 nt, Homo sapiens
aaacaaggguguaauuugc

SEQ ID NO: 263677 - RNA, 19 nt, Homo sapiens
gaggccaugugcauaguuu

SEQ ID NO: 263678 - RNA, 19 nt, Homo sapiens
acaagugccuucacacaga

SEQ ID NO: 263679 - RNA, 19 nt, Homo sapiens
guaaacaaggguguaauuu

SEQ ID NO: 263680 - RNA, 19 nt, Homo sapiens
ccacugugcuuucagaagu

SEQ ID NO: 263681 - RNA, 19 nt, Homo sapiens
gcgugugccuuaaggagua

SEQ ID NO: 263682 - RNA, 19 nt, Homo sapiens
uaaacaaggguguaauuug

SEQ ID NO: 263683 - RNA, 19 nt, Homo sapiens
gaagcuguguguaaacaag

SEQ ID NO: 263684 - RNA, 19 nt, Homo sapiens
ucacacaaauucaccaaag

SEQ ID NO: 263685 - RNA, 19 nt, Homo sapiens
gaaguuccucucacacaaa

SEQ ID NO: 263686 - RNA, 19 nt, Homo sapiens
ccagcgaucucuccacugu

SEQ ID NO: 263687 - RNA, 19 nt, Homo sapiens
gugggacccugguuauuga

SEQ ID NO: 263688 - RNA, 19 nt, Homo sapiens
uaaaggaagcacucuguau

SEQ ID NO: 263689 - RNA, 19 nt, Homo sapiens
cagagguugugcacuguuu

SEQ ID NO: 263690 - RNA, 19 nt, Homo sapiens
ccaugugcauaguuucuuu

SEQ ID NO: 263691 - RNA, 19 nt, Homo sapiens
cuacaaugguggcaucugu

SEQ ID NO: 263692 - RNA, 19 nt, Homo sapiens
cgccugcccugaugacuuu

SEQ ID NO: 263693 - RNA, 19 nt, Homo sapiens
ggacccugguuauugaugu

SEQ ID NO: 263694 - RNA, 19 nt, Homo sapiens
ccggccaccuggacaauaa

SEQ ID NO: 263695 - RNA, 19 nt, Homo sapiens
uauugaagcucgugacaag

SEQ ID NO: 263696 - RNA, 19 nt, Homo sapiens
ggucguacuugcacucaca

SEQ ID NO: 263697 - RNA, 19 nt, Homo sapiens
ugacgcaccugugguuguu

SEQ ID NO: 263698 - RNA, 19 nt, Homo sapiens
aauggaguauucucggaua

SEQ ID NO: 263699 - RNA, 19 nt, Homo sapiens
ugaaaacaauggaguauuc

SEQ ID NO: 263700 - RNA, 19 nt, Homo sapiens
aggaagcacucuguauauu

SEQ ID NO: 263701 - RNA, 19 nt, Homo sapiens
agccaugccuuaacgcuuu

SEQ ID NO: 263702 - RNA, 19 nt, Homo sapiens
ggugggacccugguuauug

SEQ ID NO: 263703 - RNA, 19 nt, Homo sapiens
ggcacucgcuguaugaaag

SEQ ID NO: 263704 - RNA, 19 nt, Homo sapiens
cacacaaauucaccaaaga

SEQ ID NO: 263705 - RNA, 19 nt, Homo sapiens
guacuugcacucacaauac

SEQ ID NO: 263706 - RNA, 19 nt, Homo sapiens
cuacugccaugagaacauu

SEQ ID NO: 263707 - RNA, 19 nt, Homo sapiens
agaaguuccucucacacaa

SEQ ID NO: 263708 - RNA, 19 nt, Homo sapiens
gggcaaggagugcaaggaa

SEQ ID NO: 263709 - RNA, 19 nt, Homo sapiens
gcacucacaauaccaacga

SEQ ID NO: 263710 - RNA, 19 nt, Homo sapiens
gcacucuguauauuugauu

SEQ ID NO: 263711 - RNA, 19 nt, Homo sapiens
gggaggagagcgccaacaa

SEQ ID NO: 263712 - RNA, 19 nt, Homo sapiens
gggaagccaugccuuaacg

SEQ ID NO: 263713 - RNA, 19 nt, Homo sapiens
ugacaaagaccugaacuac

SEQ ID NO: 263714 - RNA, 19 nt, Homo sapiens
acaaggacgugcucuacca

SEQ ID NO: 263715 - RNA, 19 nt, Homo sapiens
gcaacaaggccugcaugga

SEQ ID NO: 263716 - RNA, 19 nt, Homo sapiens
cgccucaccuugcauuuca

SEQ ID NO: 263717 - RNA, 19 nt, Homo sapiens
gcaccuacugccaugagaa

SEQ ID NO: 263718 - RNA, 19 nt, Homo sapiens
uguaaacaaggguguaauu

SEQ ID NO: 263719 - RNA, 19 nt, Homo sapiens
uaaccuggagggugacuau

SEQ ID NO: 263720 - RNA, 19 nt, Homo sapiens
ggaccagguggacggcuuu

SEQ ID NO: 263721 - RNA, 19 nt, Homo sapiens
ucaccaaaucguagcguuu

SEQ ID NO: 263722 - RNA, 19 nt, Homo sapiens
ugacaagugccuucacaca

SEQ ID NO: 263723 - RNA, 19 nt, Homo sapiens
gcguggcacucgcuguaug

SEQ ID NO: 263724 - RNA, 19 nt, Homo sapiens
gcuggugccugugcugugu

SEQ ID NO: 263725 - RNA, 19 nt, Homo sapiens
gcaaaggugccuggagaag

SEQ ID NO: 263726 - RNA, 19 nt, Homo sapiens
gauuggcggcuauuacugu

SEQ ID NO: 263727 - RNA, 19 nt, Homo sapiens
aaggaagcacucuguauau

SEQ ID NO: 263728 - RNA, 19 nt, Homo sapiens
uuaaaggaagcacucugua

SEQ ID NO: 263729 - RNA, 19 nt, Homo sapiens
ugagacccauggcuguguu

SEQ ID NO: 263730 - RNA, 19 nt, Homo sapiens
guuuacagaaucuuccuuu

SEQ ID NO: 263731 - RNA, 19 nt, Homo sapiens
ugacuuugguggcaagaac

SEQ ID NO: 263732 - RNA, 19 nt, Homo sapiens
aaaccugauuggcggcuau

SEQ ID NO: 263733 - RNA, 19 nt, Homo sapiens
acacaaauucaccaaagau

SEQ ID NO: 263734 - RNA, 19 nt, Homo sapiens
cguacuugcacucacaaua

SEQ ID NO: 263735 - RNA, 19 nt, Homo sapiens
augaggagcugcugaucga

SEQ ID NO: 263736 - RNA, 19 nt, Homo sapiens
acgccgagccugaccagua

SEQ ID NO: 263737 - RNA, 19 nt, Homo sapiens
gacaaagaccugaacuacu

SEQ ID NO: 263738 - RNA, 19 nt, Homo sapiens
gagguucugcgaugagugu

SEQ ID NO: 263739 - RNA, 19 nt, Homo sapiens
cgaaugaggagcugcugau

SEQ ID NO: 263740 - RNA, 19 nt, Homo sapiens
caugugcauaguuucuuua

SEQ ID NO: 263741 - RNA, 19 nt, Homo sapiens
gugacaaagaccugaacua

SEQ ID NO: 263742 - RNA, 19 nt, Homo sapiens
uacgugcgcgugugccuua

SEQ ID NO: 263743 - RNA, 19 nt, Homo sapiens
ccucugccuugcuacaaug

SEQ ID NO: 263744 - RNA, 19 nt, Homo sapiens
ggugaacggguaccagugu

SEQ ID NO: 263745 - RNA, 19 nt, Homo sapiens
gggcaggaacugugagaag

SEQ ID NO: 263746 - RNA, 19 nt, Homo sapiens
ggaagcuguguguaaacaa

SEQ ID NO: 263747 - RNA, 19 nt, Homo sapiens
gugcaaggaagcugugugu

SEQ ID NO: 263748 - RNA, 19 nt, Homo sapiens
ccuggagggugacuauuac

SEQ ID NO: 263749 - RNA, 19 nt, Homo sapiens
gcugcgacgagaacuacua

SEQ ID NO: 263750 - RNA, 19 nt, Homo sapiens
gacccugguuauugaugug

SEQ ID NO: 263751 - RNA, 19 nt, Homo sapiens
gcuggaagagccugcacuu

SEQ ID NO: 263752 - RNA, 19 nt, Homo sapiens
guuccucucacacaaauuc

SEQ ID NO: 263753 - RNA, 19 nt, Homo sapiens
ccacaaggacgugcucuac

SEQ ID NO: 263754 - RNA, 19 nt, Homo sapiens
aaugguggcaucuguguug

SEQ ID NO: 263755 - RNA, 19 nt, Homo sapiens
gcuggaagggcaucaacug

SEQ ID NO: 263756 - RNA, 19 nt, Homo sapiens
ggccugcucugugacaaag

SEQ ID NO: 263757 - RNA, 19 nt, Homo sapiens
uaugaaaggagagagcaaa

SEQ ID NO: 263758 - RNA, 19 nt, Homo sapiens
ccaccuggacaauaacugu

SEQ ID NO: 263759 - RNA, 19 nt, Homo sapiens
gcaacugugagaccaacug

SEQ ID NO: 263760 - RNA, 19 nt, Homo sapiens
ucuccacugugcuuucaga

SEQ ID NO: 263761 - RNA, 19 nt, Homo sapiens
gggagguucugcgaugagu

SEQ ID NO: 263762 - RNA, 19 nt, Homo sapiens
ccugugcccuugacaucga

SEQ ID NO: 263763 - RNA, 19 nt, Homo sapiens
gaguauucucggauaguug

SEQ ID NO: 263764 - RNA, 19 nt, Homo sapiens
gcugggagggucguacuug

SEQ ID NO: 263765 - RNA, 19 nt, Homo sapiens
caucaacugccauaucaac

SEQ ID NO: 263766 - RNA, 19 nt, Homo sapiens
aggaagcuguguguaaaca

SEQ ID NO: 263767 - RNA, 19 nt, Homo sapiens
gcggucaggagcaucaaug

SEQ ID NO: 263768 - RNA, 19 nt, Homo sapiens
gaacggcgcucgcugcuau

SEQ ID NO: 263769 - RNA, 19 nt, Homo sapiens
gaagcacucuguauauuug

SEQ ID NO: 263770 - RNA, 19 nt, Homo sapiens
gcaaggaagcuguguguaa

SEQ ID NO: 263771 - RNA, 19 nt, Homo sapiens
caaggaagcuguguguaaa

SEQ ID NO: 263772 - RNA, 19 nt, Homo sapiens
ggaagcacucuguauauuu

SEQ ID NO: 263773 - RNA, 19 nt, Homo sapiens
acaaagaccugaacuacug

SEQ ID NO: 263774 - RNA, 19 nt, Homo sapiens
aaaggaagcacucuguaua

SEQ ID NO: 263775 - RNA, 19 nt, Homo sapiens
ggaguauucucggauaguu

SEQ ID NO: 263776 - RNA, 19 nt, Homo sapiens
aaacaaggguguaauuugc

SEQ ID NO: 263777 - RNA, 19 nt, Homo sapiens
gaggccaugugcauaguuu

SEQ ID NO: 263778 - RNA, 19 nt, Homo sapiens
acaagugccuucacacaga

SEQ ID NO: 263779 - RNA, 19 nt, Homo sapiens
guaaacaaggguguaauuu

SEQ ID NO: 263780 - RNA, 19 nt, Homo sapiens
ccacugugcuuucagaagu

SEQ ID NO: 263781 - RNA, 19 nt, Homo sapiens
gcgugugccuuaaggagua

SEQ ID NO: 263782 - RNA, 19 nt, Homo sapiens
uaaacaaggguguaauuug

SEQ ID NO: 263783 - RNA, 19 nt, Homo sapiens
gaagcuguguguaaacaag

SEQ ID NO: 263784 - RNA, 19 nt, Homo sapiens
ucacacaaauucaccaaag

SEQ ID NO: 263785 - RNA, 19 nt, Homo sapiens
gaaguuccucucacacaaa

SEQ ID NO: 263786 - RNA, 19 nt, Homo sapiens
ccagcgaucucuccacugu

SEQ ID NO: 263787 - RNA, 19 nt, Homo sapiens
gugggacccugguuauuga

SEQ ID NO: 263788 - RNA, 19 nt, Homo sapiens
uaaaggaagcacucuguau

SEQ ID NO: 263789 - RNA, 19 nt, Homo sapiens
cagagguugugcacuguuu

SEQ ID NO: 263790 - RNA, 19 nt, Homo sapiens
ccaugugcauaguuucuuu

SEQ ID NO: 263791 - RNA, 19 nt, Homo sapiens
cuacaaugguggcaucugu

SEQ ID NO: 263792 - RNA, 19 nt, Homo sapiens
cgccugcccugaugacuuu

SEQ ID NO: 263793 - RNA, 19 nt, Homo sapiens
ggacccugguuauugaugu

SEQ ID NO: 263794 - RNA, 19 nt, Homo sapiens
ccggccaccuggacaauaa

SEQ ID NO: 263795 - RNA, 19 nt, Homo sapiens
uauugaagcucgugacaag

SEQ ID NO: 263796 - RNA, 19 nt, Homo sapiens
ggucguacuugcacucaca

SEQ ID NO: 263797 - RNA, 19 nt, Homo sapiens
ugacgcaccugugguuguu

SEQ ID NO: 263798 - RNA, 19 nt, Homo sapiens
aauggaguauucucggaua

SEQ ID NO: 263799 - RNA, 19 nt, Homo sapiens
ugaaaacaauggaguauuc

SEQ ID NO: 263800 - RNA, 19 nt, Homo sapiens
aggaagcacucuguauauu

SEQ ID NO: 263801 - RNA, 19 nt, Homo sapiens
ggugggacccugguuauug

SEQ ID NO: 263802 - RNA, 19 nt, Homo sapiens
ggcacucgcuguaugaaag

SEQ ID NO: 263803 - RNA, 19 nt, Homo sapiens
cacacaaauucaccaaaga

SEQ ID NO: 263804 - RNA, 19 nt, Homo sapiens
guacuugcacucacaauac

SEQ ID NO: 263805 - RNA, 19 nt, Homo sapiens
cuacugccaugagaacauu

SEQ ID NO: 263806 - RNA, 19 nt, Homo sapiens
agaaguuccucucacacaa

SEQ ID NO: 263807 - RNA, 19 nt, Homo sapiens
gggcaaggagugcaaggaa

SEQ ID NO: 263808 - RNA, 19 nt, Homo sapiens
gcacucacaauaccaacga

SEQ ID NO: 263809 - RNA, 19 nt, Homo sapiens
gcacucuguauauuugauu

SEQ ID NO: 263810 - RNA, 19 nt, Homo sapiens
gggaggagagcgccaacaa

SEQ ID NO: 263811 - RNA, 19 nt, Homo sapiens
ugacaaagaccugaacuac

SEQ ID NO: 263812 - RNA, 19 nt, Homo sapiens
acaaggacgugcucuacca

SEQ ID NO: 263813 - RNA, 19 nt, Homo sapiens
gcaacaaggccugcaugga

SEQ ID NO: 263814 - RNA, 19 nt, Homo sapiens
cgccucaccuugcauuuca

SEQ ID NO: 263815 - RNA, 19 nt, Homo sapiens
gcaccuacugccaugagaa

SEQ ID NO: 263816 - RNA, 19 nt, Homo sapiens
uguaaacaaggguguaauu

SEQ ID NO: 263817 - RNA, 19 nt, Homo sapiens
uaaccuggagggugacuau

SEQ ID NO: 263818 - RNA, 19 nt, Homo sapiens
ggaccagguggacggcuuu

SEQ ID NO: 263819 - RNA, 19 nt, Homo sapiens
ucaccaaaucguagcguuu

SEQ ID NO: 263820 - RNA, 19 nt, Homo sapiens
ugacaagugccuucacaca

SEQ ID NO: 263821 - RNA, 19 nt, Homo sapiens
gcguggcacucgcuguaug

SEQ ID NO: 263822 - RNA, 19 nt, Homo sapiens
gcuggugccugugcugugu

SEQ ID NO: 263823 - RNA, 19 nt, Homo sapiens
gcaaaggugccuggagaag

SEQ ID NO: 263824 - RNA, 19 nt, Homo sapiens
aaggaagcacucuguauau

SEQ ID NO: 263825 - RNA, 19 nt, Homo sapiens
uuaaaggaagcacucugua

SEQ ID NO: 263826 - RNA, 19 nt, Homo sapiens
ugagacccauggcuguguu

SEQ ID NO: 263827 - RNA, 19 nt, Homo sapiens
guuuacagaaucuuccuuu

SEQ ID NO: 263828 - RNA, 19 nt, Homo sapiens
ugacuuugguggcaagaac

SEQ ID NO: 263829 - RNA, 19 nt, Homo sapiens
augaggagcugcugaucga

SEQ ID NO: 263830 - RNA, 19 nt, Homo sapiens
acacaaauucaccaaagau

SEQ ID NO: 263831 - RNA, 19 nt, Homo sapiens
cguacuugcacucacaaua

SEQ ID NO: 263832 - RNA, 19 nt, Homo sapiens
acgccgagccugaccagua

SEQ ID NO: 263833 - RNA, 19 nt, Homo sapiens
gacaaagaccugaacuacu

SEQ ID NO: 263834 - RNA, 19 nt, Homo sapiens
gagguucugcgaugagugu

SEQ ID NO: 263835 - RNA, 19 nt, Homo sapiens
cgaaugaggagcugcugau

SEQ ID NO: 263836 - RNA, 19 nt, Homo sapiens
caugugcauaguuucuuua

SEQ ID NO: 263837 - RNA, 19 nt, Homo sapiens
gugacaaagaccugaacua

SEQ ID NO: 263838 - RNA, 19 nt, Homo sapiens
uacgugcgcgugugccuua

SEQ ID NO: 263839 - RNA, 19 nt, Homo sapiens
ccucugccuugcuacaaug

SEQ ID NO: 263840 - RNA, 19 nt, Homo sapiens
ggugaacggguaccagugu

SEQ ID NO: 263841 - RNA, 19 nt, Homo sapiens
gggcaggaacugugagaag

SEQ ID NO: 263842 - RNA, 19 nt, Homo sapiens
ccuggagggugacuauuac

SEQ ID NO: 263843 - RNA, 19 nt, Homo sapiens
ggaagcuguguguaaacaa

SEQ ID NO: 263844 - RNA, 19 nt, Homo sapiens
gugcaaggaagcugugugu

SEQ ID NO: 263845 - RNA, 19 nt, Homo sapiens
gacccugguuauugaugug

SEQ ID NO: 263846 - RNA, 19 nt, Homo sapiens
gcuggaagagccugcacuu

SEQ ID NO: 263847 - RNA, 19 nt, Homo sapiens
guuccucucacacaaauuc

SEQ ID NO: 263848 - RNA, 19 nt, Homo sapiens
ccacaaggacgugcucuac

SEQ ID NO: 263849 - RNA, 19 nt, Homo sapiens
gcugcgacgagaacuacua

SEQ ID NO: 263850 - RNA, 19 nt, Homo sapiens
aaugguggcaucuguguug

SEQ ID NO: 263851 - RNA, 19 nt, Homo sapiens
ggccugcucugugacaaag

SEQ ID NO: 263852 - RNA, 19 nt, Homo sapiens
uaugaaaggagagagcaaa

SEQ ID NO: 263853 - RNA, 19 nt, Homo sapiens
ccaccuggacaauaacugu

SEQ ID NO: 263854 - RNA, 19 nt, Homo sapiens
gcaacugugagaccaacug

SEQ ID NO: 263855 - RNA, 19 nt, Homo sapiens
ucuccacugugcuuucaga

SEQ ID NO: 263856 - RNA, 19 nt, Homo sapiens
gggagguucugcgaugagu

SEQ ID NO: 263857 - RNA, 19 nt, Homo sapiens
ccugugcccuugacaucga

SEQ ID NO: 263858 - RNA, 19 nt, Homo sapiens
gaguauucucggauaguug

SEQ ID NO: 263859 - RNA, 19 nt, Homo sapiens
gcugggagggucguacuug

SEQ ID NO: 263860 - RNA, 19 nt, Homo sapiens
gcggucaggagcaucaaug

SEQ ID NO: 263861 - RNA, 19 nt, Homo sapiens
ucacugcuccuggcuguca

SEQ ID NO: 263862 - RNA, 19 nt, Homo sapiens
gagguggccguguccuuca

SEQ ID NO: 263863 - RNA, 19 nt, Homo sapiens
gaagcuccuggguggaaga

SEQ ID NO: 263864 - RNA, 19 nt, Homo sapiens
aggaagcuguguguaaaca

SEQ ID NO: 263865 - RNA, 19 nt, Homo sapiens
ccacauagcugaucugaaa

SEQ ID NO: 263866 - RNA, 19 nt, Homo sapiens
ugaaaucacucacauugua

SEQ ID NO: 263867 - RNA, 19 nt, Homo sapiens
uaaggaaccucuaucauga

SEQ ID NO: 263868 - RNA, 19 nt, Homo sapiens
gcagguggcuguuaaaucu

SEQ ID NO: 263869 - RNA, 19 nt, Homo sapiens
ugcaugagcugcugacuua

SEQ ID NO: 263870 - RNA, 19 nt, Homo sapiens
uuacggugcugaaauauuu

SEQ ID NO: 263871 - RNA, 19 nt, Homo sapiens
guauuaagcucaucaugga

SEQ ID NO: 263872 - RNA, 19 nt, Homo sapiens
ggaaauguguguacuaaaa

SEQ ID NO: 263873 - RNA, 19 nt, Homo sapiens
cagaauacgccaucaauaa

SEQ ID NO: 263874 - RNA, 19 nt, Homo sapiens
ccagaaacauugaauaagu

SEQ ID NO: 263875 - RNA, 19 nt, Homo sapiens
gaaugacgguggaaacguu

SEQ ID NO: 263876 - RNA, 19 nt, Homo sapiens
caagaaggaugaggagaaa

SEQ ID NO: 263877 - RNA, 19 nt, Homo sapiens
gaaccacgcucugggaaau

SEQ ID NO: 263878 - RNA, 19 nt, Homo sapiens
acaagacgcugauugagaa

SEQ ID NO: 263879 - RNA, 19 nt, Homo sapiens
gcacaggcaugccguaucu

SEQ ID NO: 263880 - RNA, 19 nt, Homo sapiens
gaugagguuuaucagcuua

SEQ ID NO: 263881 - RNA, 19 nt, Homo sapiens
cgggaagccuuaaggaaua

SEQ ID NO: 263882 - RNA, 19 nt, Homo sapiens
gggaagaguggaacaauuu

SEQ ID NO: 263883 - RNA, 19 nt, Homo sapiens
gaaacguucucuacuacga

SEQ ID NO: 263884 - RNA, 19 nt, Homo sapiens
guggaaacguucucuacua

SEQ ID NO: 263885 - RNA, 19 nt, Homo sapiens
ugaaaugccuggcuccuau

SEQ ID NO: 263886 - RNA, 19 nt, Homo sapiens
ccaccuaacuguccagaug

SEQ ID NO: 263887 - RNA, 19 nt, Homo sapiens
gaaaugguauuaagcucau

SEQ ID NO: 263888 - RNA, 19 nt, Homo sapiens
ggagcuggcugaccucaug

SEQ ID NO: 263889 - RNA, 19 nt, Homo sapiens
gaaaucacucacauuguaa

SEQ ID NO: 263890 - RNA, 19 nt, Homo sapiens
gggagcagguggcuguuaa

SEQ ID NO: 263891 - RNA, 19 nt, Homo sapiens
acauuacggugcugaaaua

SEQ ID NO: 263892 - RNA, 19 nt, Homo sapiens
aaaccgauaaggaguauua

SEQ ID NO: 263893 - RNA, 19 nt, Homo sapiens
gaagacggaggaaauggua

SEQ ID NO: 263894 - RNA, 19 nt, Homo sapiens
gcugguggcuacuaagaaa

SEQ ID NO: 263895 - RNA, 19 nt, Homo sapiens
caaauguuguuucuguuga

SEQ ID NO: 263896 - RNA, 19 nt, Homo sapiens
guaaggggauggacuauuu

SEQ ID NO: 263897 - RNA, 19 nt, Homo sapiens
gaagagcagaauccagaua

SEQ ID NO: 263898 - RNA, 19 nt, Homo sapiens
gaaauucaaaguugccaaa

SEQ ID NO: 263899 - RNA, 19 nt, Homo sapiens
ccauggaaauucaaaguug

SEQ ID NO: 263900 - RNA, 19 nt, Homo sapiens
gacaugauauugagaacga

SEQ ID NO: 263901 - RNA, 19 nt, Homo sapiens
gaaagagagauucuaugaa

SEQ ID NO: 263902 - RNA, 19 nt, Homo sapiens
uuacaaggaugacgaagga

SEQ ID NO: 263903 - RNA, 19 nt, Homo sapiens
cggaugagguucuauuuca

SEQ ID NO: 263904 - RNA, 19 nt, Homo sapiens
aacaucagcuucaugcuaa

SEQ ID NO: 263905 - RNA, 19 nt, Homo sapiens
ugaaauacuuggcuaccuu

SEQ ID NO: 263906 - RNA, 19 nt, Homo sapiens
cuggacagcugaauaaaug

SEQ ID NO: 263907 - RNA, 19 nt, Homo sapiens
uaacaucagcuucaugcua

SEQ ID NO: 263908 - RNA, 19 nt, Homo sapiens
gaaccucuaucaugagaac

SEQ ID NO: 263909 - RNA, 19 nt, Homo sapiens
ugggaaaucugcuacaaug

SEQ ID NO: 263910 - RNA, 19 nt, Homo sapiens
ugccguaucucuccucuuu

SEQ ID NO: 263911 - RNA, 19 nt, Homo sapiens
gcaaugccauggcuuucug

SEQ ID NO: 263912 - RNA, 19 nt, Homo sapiens
gagcagaauccagauauug

SEQ ID NO: 263913 - RNA, 19 nt, Homo sapiens
gaauacgccaucaauaaau

SEQ ID NO: 263914 - RNA, 19 nt, Homo sapiens
caagcgauauauuccagaa

SEQ ID NO: 263915 - RNA, 19 nt, Homo sapiens
aaaucgagaucuuaaggaa

SEQ ID NO: 263916 - RNA, 19 nt, Homo sapiens
gcauaaaccaaauguuguu

SEQ ID NO: 263917 - RNA, 19 nt, Homo sapiens
ccaggaugcggauaaauaa

SEQ ID NO: 263918 - RNA, 19 nt, Homo sapiens
ccaaggacaucagcuacaa

SEQ ID NO: 263919 - RNA, 19 nt, Homo sapiens
gguaugcuccagaauguuu

SEQ ID NO: 263920 - RNA, 19 nt, Homo sapiens
ucaaacagcagcuaaaaua

SEQ ID NO: 263921 - RNA, 19 nt, Homo sapiens
gacaagacgcugauugaga

SEQ ID NO: 263922 - RNA, 19 nt, Homo sapiens
cugggacccugauggauua

SEQ ID NO: 263923 - RNA, 19 nt, Homo sapiens
gcaccgacuuugacaacau

SEQ ID NO: 263924 - RNA, 19 nt, Homo sapiens
gcugaaauauuugagacuu

SEQ ID NO: 263925 - RNA, 19 nt, Homo sapiens
ggaugcggauaaauaaugu

SEQ ID NO: 263926 - RNA, 19 nt, Homo sapiens
augagaacauugugaagua

SEQ ID NO: 263927 - RNA, 19 nt, Homo sapiens
gcugacaaguggagcuuug

SEQ ID NO: 263928 - RNA, 19 nt, Homo sapiens
gagcaggauggacaugaua

SEQ ID NO: 263929 - RNA, 19 nt, Homo sapiens
ccaagaagacugaggugaa

SEQ ID NO: 263930 - RNA, 19 nt, Homo sapiens
ugaaggauuugaagcacuu

SEQ ID NO: 263931 - RNA, 19 nt, Homo sapiens
acacuggacagcugaauaa

SEQ ID NO: 263932 - RNA, 19 nt, Homo sapiens
ugagagacauuaauaagcu

SEQ ID NO: 263933 - RNA, 19 nt, Homo sapiens
ccagugacaccaucaugua

SEQ ID NO: 263934 - RNA, 19 nt, Homo sapiens
gcaagaaugcauugaacga

SEQ ID NO: 263935 - RNA, 19 nt, Homo sapiens
ugagcuacuuggaggauaa

SEQ ID NO: 263936 - RNA, 19 nt, Homo sapiens
agaauacgccaucaauaaa

SEQ ID NO: 263937 - RNA, 19 nt, Homo sapiens
ggauggacaugauauugag

SEQ ID NO: 263938 - RNA, 19 nt, Homo sapiens
caacgacaaugagcaguca

SEQ ID NO: 263939 - RNA, 19 nt, Homo sapiens
gagguucuauuucaccaau

SEQ ID NO: 263940 - RNA, 19 nt, Homo sapiens
gcucugguaugcuccaaau

SEQ ID NO: 263941 - RNA, 19 nt, Homo sapiens
gaaaucgagaucuuaagga

SEQ ID NO: 263942 - RNA, 19 nt, Homo sapiens
uaaagaggauccgugacuu

SEQ ID NO: 263943 - RNA, 19 nt, Homo sapiens
gcagaggaacugugcauca

SEQ ID NO: 263944 - RNA, 19 nt, Homo sapiens
cugaauaaaugcaguaucu

SEQ ID NO: 263945 - RNA, 19 nt, Homo sapiens
ggacccugauggauuacaa

SEQ ID NO: 263946 - RNA, 19 nt, Homo sapiens
cgagaacacacaucuauuc

SEQ ID NO: 263947 - RNA, 19 nt, Homo sapiens
caaccucuuugcccuguau

SEQ ID NO: 263948 - RNA, 19 nt, Homo sapiens
gcagaauccagauauuguu

SEQ ID NO: 263949 - RNA, 19 nt, Homo sapiens
gaguguggcugcugacaag

SEQ ID NO: 263950 - RNA, 19 nt, Homo sapiens
gugagggaaucgacaguga

SEQ ID NO: 263951 - RNA, 19 nt, Homo sapiens
aaccaaauguuguuucugu

SEQ ID NO: 263952 - RNA, 19 nt, Homo sapiens
cagaaacauugaauaaguc

SEQ ID NO: 263953 - RNA, 19 nt, Homo sapiens
gcucagggacaguaugauu

SEQ ID NO: 263954 - RNA, 19 nt, Homo sapiens
uuaaggaaccucuaucaug

SEQ ID NO: 263955 - RNA, 19 nt, Homo sapiens
gcacggauaacaucagcuu

SEQ ID NO: 263956 - RNA, 19 nt, Homo sapiens
auacuuggcuaccuuggaa

SEQ ID NO: 263957 - RNA, 19 nt, Homo sapiens
aauaugccguucagauuug

SEQ ID NO: 263958 - RNA, 19 nt, Homo sapiens
gcacagaagacggaggaaa

SEQ ID NO: 263959 - RNA, 19 nt, Homo sapiens
augaggagcuccaagaaga

SEQ ID NO: 263960 - RNA, 19 nt, Homo sapiens
gcacgagaacacacaucua

SEQ ID NO: 263961 - RNA, 19 nt, Homo sapiens
ugccagaacugcccaagga

SEQ ID NO: 263962 - RNA, 19 nt, Homo sapiens
gguucuauuucaccaauug

SEQ ID NO: 263963 - RNA, 19 nt, Homo sapiens
ggacaagcuuucagaaccu

SEQ ID NO: 263964 - RNA, 19 nt, Homo sapiens
ccucugacgucuggucuuu

SEQ ID NO: 263965 - RNA, 19 nt, Homo sapiens
gaaacaagcuuacaaagau

SEQ ID NO: 263966 - RNA, 19 nt, Homo sapiens
gcaaauagauccaguucuu

SEQ ID NO: 263967 - RNA, 19 nt, Homo sapiens
gagcaaagauccaagacua

SEQ ID NO: 263968 - RNA, 19 nt, Homo sapiens
gccagaaacuugaaacuua

SEQ ID NO: 263969 - RNA, 19 nt, Homo sapiens
guacagauuucgcagauuu

SEQ ID NO: 263970 - RNA, 19 nt, Homo sapiens
gaacaggauuuacaguuau

SEQ ID NO: 263971 - RNA, 19 nt, Homo sapiens
gagcauacaucuuaaaucu

SEQ ID NO: 263972 - RNA, 19 nt, Homo sapiens
gggaacaaaugucuaguuu

SEQ ID NO: 263973 - RNA, 19 nt, Homo sapiens
gggcugguguucauuaaua

SEQ ID NO: 263974 - RNA, 19 nt, Homo sapiens
gauccuggcauuaguauua

SEQ ID NO: 263975 - RNA, 19 nt, Homo sapiens
uaacauggcuggaugaaag

SEQ ID NO: 263976 - RNA, 19 nt, Homo sapiens
gaaaauaucugcucaaaac

SEQ ID NO: 263977 - RNA, 19 nt, Homo sapiens
caaaguagauuuacagaac

SEQ ID NO: 263978 - RNA, 19 nt, Homo sapiens
agaacaggauuuacaguua

SEQ ID NO: 263979 - RNA, 19 nt, Homo sapiens
acagaaugcuggaacaaua

SEQ ID NO: 263980 - RNA, 19 nt, Homo sapiens
gcagauuuauucagcaauu

SEQ ID NO: 263981 - RNA, 19 nt, Homo sapiens
gaacauccaccucuucuau

SEQ ID NO: 263982 - RNA, 19 nt, Homo sapiens
ggaacuaucuccaaauuuu

SEQ ID NO: 263983 - RNA, 19 nt, Homo sapiens
gaacgaaugguguuucuga

SEQ ID NO: 263984 - RNA, 19 nt, Homo sapiens
ccagaaacuugaaacuuaa

SEQ ID NO: 263985 - RNA, 19 nt, Homo sapiens
ccuaaagacuguauauuug

SEQ ID NO: 263986 - RNA, 19 nt, Homo sapiens
guaguuccauguacuguaa

SEQ ID NO: 263987 - RNA, 19 nt, Homo sapiens
gaacggauagaucacauaa

SEQ ID NO: 263988 - RNA, 19 nt, Homo sapiens
uacgagaucuuaacaguuu

SEQ ID NO: 263989 - RNA, 19 nt, Homo sapiens
gaagagaaguaggagacua

SEQ ID NO: 263990 - RNA, 19 nt, Homo sapiens
ggaaaugccaauucuauga

SEQ ID NO: 263991 - RNA, 19 nt, Homo sapiens
gauuuaugcucaugaacua

SEQ ID NO: 263992 - RNA, 19 nt, Homo sapiens
cgaauaagguacagauuuc

SEQ ID NO: 263993 - RNA, 19 nt, Homo sapiens
ggaauggccugccuuacga

SEQ ID NO: 263994 - RNA, 19 nt, Homo sapiens
ugaaaucccuacagcauga

SEQ ID NO: 263995 - RNA, 19 nt, Homo sapiens
ugucaugucuuaccucuuu

SEQ ID NO: 263996 - RNA, 19 nt, Homo sapiens
gaauuuaugcguaugauug

SEQ ID NO: 263997 - RNA, 19 nt, Homo sapiens
gaaauauauugguggagaa

SEQ ID NO: 263998 - RNA, 19 nt, Homo sapiens
gcacaucauuaccucugua

SEQ ID NO: 263999 - RNA, 19 nt, Homo sapiens
uuacagaggccuacucaua

SEQ ID NO: 264000 - RNA, 19 nt, Homo sapiens
gaugugaacuguuucucuu

SEQ ID NO: 264001 - RNA, 19 nt, Homo sapiens
ggaacaagaugugaacugu

SEQ ID NO: 264002 - RNA, 19 nt, Homo sapiens
ggaauauugucauccuuug

SEQ ID NO: 264003 - RNA, 19 nt, Homo sapiens
agacuacuaugaacaguuu

SEQ ID NO: 264004 - RNA, 19 nt, Homo sapiens
gcaaggguauggaguaucu

SEQ ID NO: 264005 - RNA, 19 nt, Homo sapiens
ggagauaaaccucuaagug

SEQ ID NO: 264006 - RNA, 19 nt, Homo sapiens
gaaugguguuucugaugua

SEQ ID NO: 264007 - RNA, 19 nt, Homo sapiens
gauccaagacuaucauauu

SEQ ID NO: 264008 - RNA, 19 nt, Homo sapiens
gcacagaauauguauguau

SEQ ID NO: 264009 - RNA, 19 nt, Homo sapiens
gcaaagccacugccagaaa

SEQ ID NO: 264010 - RNA, 19 nt, Homo sapiens
gggaguauguugcagaaga

SEQ ID NO: 264011 - RNA, 19 nt, Homo sapiens
auaagcagguguauacuuu

SEQ ID NO: 264012 - RNA, 19 nt, Homo sapiens
ucacauacauugagaagag

SEQ ID NO: 264013 - RNA, 19 nt, Homo sapiens
gaaacuauucagagucuuu

SEQ ID NO: 264014 - RNA, 19 nt, Homo sapiens
gcgaauaagguacagauuu

SEQ ID NO: 264015 - RNA, 19 nt, Homo sapiens
caaggaagcgaauaaggua

SEQ ID NO: 264016 - RNA, 19 nt, Homo sapiens
gaacgagaacagaguuaaa

SEQ ID NO: 264017 - RNA, 19 nt, Homo sapiens
uaagugcucuggauucuca

SEQ ID NO: 264018 - RNA, 19 nt, Homo sapiens
gaacuucagcagucuuaaa

SEQ ID NO: 264019 - RNA, 19 nt, Homo sapiens
gaaagcagguaaucagacu

SEQ ID NO: 264020 - RNA, 19 nt, Homo sapiens
cagcaaagaugugaaaaua

SEQ ID NO: 264021 - RNA, 19 nt, Homo sapiens
acauugcuguggacuauua

SEQ ID NO: 264022 - RNA, 19 nt, Homo sapiens
ggaauucaguggucaagag

SEQ ID NO: 264023 - RNA, 19 nt, Homo sapiens
ggaguauguugcagaagaa

SEQ ID NO: 264024 - RNA, 19 nt, Homo sapiens
ccaauucuaugaagcaaau

SEQ ID NO: 264025 - RNA, 19 nt, Homo sapiens
auggauagcucauuaagaa

SEQ ID NO: 264026 - RNA, 19 nt, Homo sapiens
gcaaagaugugaaaauauc

SEQ ID NO: 264027 - RNA, 19 nt, Homo sapiens
gaacagaguuaaaauugga

SEQ ID NO: 264028 - RNA, 19 nt, Homo sapiens
ugaaguugcuaaacaguug

SEQ ID NO: 264029 - RNA, 19 nt, Homo sapiens
guaccaaccucaccaacau

SEQ ID NO: 264030 - RNA, 19 nt, Homo sapiens
gaagaaagcagguaaucag

SEQ ID NO: 264031 - RNA, 19 nt, Homo sapiens
gaaaugccaauucuaugaa

SEQ ID NO: 264032 - RNA, 19 nt, Homo sapiens
ccagauggaugcccagaug

SEQ ID NO: 264033 - RNA, 19 nt, Homo sapiens
gaucuggcaacgagaaaua

SEQ ID NO: 264034 - RNA, 19 nt, Homo sapiens
uaagggaagcuuugucuuu

SEQ ID NO: 264035 - RNA, 19 nt, Homo sapiens
ggauggcaguguuagauau

SEQ ID NO: 264036 - RNA, 19 nt, Homo sapiens
caacugucauggcccaauu

SEQ ID NO: 264037 - RNA, 19 nt, Homo sapiens
ggaaacauaaagaaaguga

SEQ ID NO: 264038 - RNA, 19 nt, Homo sapiens
ggaaaugagguaaauaagu

SEQ ID NO: 264039 - RNA, 19 nt, Homo sapiens
gcauugcagucauagaaga

SEQ ID NO: 264040 - RNA, 19 nt, Homo sapiens
gguauggaguaucuuggua

SEQ ID NO: 264041 - RNA, 19 nt, Homo sapiens
aaucaaaccuucuagucuu

SEQ ID NO: 264042 - RNA, 19 nt, Homo sapiens
gaucguguuccauuugaua

SEQ ID NO: 264043 - RNA, 19 nt, Homo sapiens
gcagaauuagcaaaccuua

SEQ ID NO: 264044 - RNA, 19 nt, Homo sapiens
ccaccugaaugcauugaaa

SEQ ID NO: 264045 - RNA, 19 nt, Homo sapiens
cgaaugguguuucugaugu

SEQ ID NO: 264046 - RNA, 19 nt, Homo sapiens
gcaauucagccaaugcaaa

SEQ ID NO: 264047 - RNA, 19 nt, Homo sapiens
ugcagcagguuaagaauuu

SEQ ID NO: 264048 - RNA, 19 nt, Homo sapiens
uauaauaccuuggcaucuu

SEQ ID NO: 264049 - RNA, 19 nt, Homo sapiens
uuacgagacuaucuucaaa

SEQ ID NO: 264050 - RNA, 19 nt, Homo sapiens
gaaaacacccuuauucaug

SEQ ID NO: 264051 - RNA, 19 nt, Homo sapiens
ugaaacaagcuuacaaaga

SEQ ID NO: 264052 - RNA, 19 nt, Homo sapiens
ggaaauugaaauccugaaa

SEQ ID NO: 264053 - RNA, 19 nt, Homo sapiens
gguaccaccugaaugcauu

SEQ ID NO: 264054 - RNA, 19 nt, Homo sapiens
gaagaaaacacccuuauuc

SEQ ID NO: 264055 - RNA, 19 nt, Homo sapiens
gagggcugguguucauuaa

SEQ ID NO: 264056 - RNA, 19 nt, Homo sapiens
gacggcaaauguucugaaa

SEQ ID NO: 264057 - RNA, 19 nt, Homo sapiens
gaagagcaccuaagagacu

SEQ ID NO: 264058 - RNA, 19 nt, Homo sapiens
ccaaccaugucuuccauau

SEQ ID NO: 264059 - RNA, 19 nt, Homo sapiens
uggaguaucuugguacaaa

SEQ ID NO: 264060 - RNA, 19 nt, Homo sapiens
cauacgagaucuuaacagu

SEQ ID NO: 264061 - RNA, 19 nt, Homo sapiens
gaagacaggaagacaggaa

SEQ ID NO: 264062 - RNA, 19 nt, Homo sapiens
cagcaaguaugaugagcaa

SEQ ID NO: 264063 - RNA, 19 nt, Homo sapiens
ggucaagagggaaacauaa

SEQ ID NO: 264064 - RNA, 19 nt, Homo sapiens
aaccaugucuuccauauag

SEQ ID NO: 264065 - RNA, 19 nt, Homo sapiens
gcgccuaucuuucuccuuu

SEQ ID NO: 264066 - RNA, 19 nt, Homo sapiens
gaaccaaauuuaagacucu

SEQ ID NO: 264067 - RNA, 19 nt, Homo sapiens
gaagcaaggaaccaaauuu

SEQ ID NO: 264068 - RNA, 19 nt, Homo sapiens
ccagaaaucguagacauua

SEQ ID NO: 264069 - RNA, 19 nt, Homo sapiens
ccucaucucuucagacuau

SEQ ID NO: 264070 - RNA, 19 nt, Homo sapiens
ucaauagccucaucucuuc

SEQ ID NO: 264071 - RNA, 19 nt, Homo sapiens
cagaugacauuucacaaga

SEQ ID NO: 264072 - RNA, 19 nt, Homo sapiens
agacagaggugcugcugaa

SEQ ID NO: 264073 - RNA, 19 nt, Homo sapiens
uaauagagaugagguuuca

SEQ ID NO: 264074 - RNA, 19 nt, Homo sapiens
gcacccaaguccugcugua

SEQ ID NO: 264075 - RNA, 19 nt, Homo sapiens
gcaaggaaccaaauuuaag

SEQ ID NO: 264076 - RNA, 19 nt, Homo sapiens
caagacagaugggcauaug

SEQ ID NO: 264077 - RNA, 19 nt, Homo sapiens
ucaacuaucuggaggacaa

SEQ ID NO: 264078 - RNA, 19 nt, Homo sapiens
gugauuucauugucaagua

SEQ ID NO: 264079 - RNA, 19 nt, Homo sapiens
caaggaaccaaauuuaaga

SEQ ID NO: 264080 - RNA, 19 nt, Homo sapiens
uguacgagcucuucaccua

SEQ ID NO: 264081 - RNA, 19 nt, Homo sapiens
aagcaaggaaccaaauuua

SEQ ID NO: 264082 - RNA, 19 nt, Homo sapiens
caucuucucucgccaguca

SEQ ID NO: 264083 - RNA, 19 nt, Homo sapiens
gcagacacuuagcuuggaa

SEQ ID NO: 264084 - RNA, 19 nt, Homo sapiens
gagagcugcugaagacugu

SEQ ID NO: 264085 - RNA, 19 nt, Homo sapiens
caccacacccggcuaauuu

SEQ ID NO: 264086 - RNA, 19 nt, Homo sapiens
gaugacauuucacaagauc

SEQ ID NO: 264087 - RNA, 19 nt, Homo sapiens
ggagagacaccucaaguac

SEQ ID NO: 264088 - RNA, 19 nt, Homo sapiens
gguuugggcuggagaagug

SEQ ID NO: 264089 - RNA, 19 nt, Homo sapiens
agaauagccuguggccuuu

SEQ ID NO: 264090 - RNA, 19 nt, Homo sapiens
ccuguggccuuugcaauuu

SEQ ID NO: 264091 - RNA, 19 nt, Homo sapiens
agagacaccucaaguacau

SEQ ID NO: 264092 - RNA, 19 nt, Homo sapiens
ggacagacaaccagauuuu

SEQ ID NO: 264093 - RNA, 19 nt, Homo sapiens
gaugagguuucaccaugau

SEQ ID NO: 264094 - RNA, 19 nt, Homo sapiens
gagcuggcccugcugauuc

SEQ ID NO: 264095 - RNA, 19 nt, Homo sapiens
ggaauggugcccagcucua

SEQ ID NO: 264096 - RNA, 19 nt, Homo sapiens
gcuaagaaacuccaauuuu

SEQ ID NO: 264097 - RNA, 19 nt, Homo sapiens
ccgaguagcugggauuaca

SEQ ID NO: 264098 - RNA, 19 nt, Homo sapiens
agaacugcauggagucauu

SEQ ID NO: 264099 - RNA, 19 nt, Homo sapiens
cguccuggcuccuauguuc

SEQ ID NO: 264100 - RNA, 19 nt, Homo sapiens
cgggagagcugcugaagac

SEQ ID NO: 264101 - RNA, 19 nt, Homo sapiens
gaacuccuaaccucaagug

SEQ ID NO: 264102 - RNA, 19 nt, Homo sapiens
ggccuacgcccucaacuau

SEQ ID NO: 264103 - RNA, 19 nt, Homo sapiens
cauggcaccuccaagugaa

SEQ ID NO: 264104 - RNA, 19 nt, Homo sapiens
ggacuuugccaucaacaag

SEQ ID NO: 264105 - RNA, 19 nt, Homo sapiens
caaagaagcaaggaaccaa

SEQ ID NO: 264106 - RNA, 19 nt, Homo sapiens
gcaagggcauggaguaccu

SEQ ID NO: 264107 - RNA, 19 nt, Homo sapiens
gugaugggcuguggaaugg

SEQ ID NO: 264108 - RNA, 19 nt, Homo sapiens
gagagacaccucaaguaca

SEQ ID NO: 264109 - RNA, 19 nt, Homo sapiens
cagaggugcugcugaaggu

SEQ ID NO: 264110 - RNA, 19 nt, Homo sapiens
gguccuucaccaagauuua

SEQ ID NO: 264111 - RNA, 19 nt, Homo sapiens
ugaagacugucagcuacaa

SEQ ID NO: 264112 - RNA, 19 nt, Homo sapiens
caaguugcacucauuaugg

SEQ ID NO: 264113 - RNA, 19 nt, Homo sapiens
cagaugggcauauguguca

SEQ ID NO: 264114 - RNA, 19 nt, Homo sapiens
aacagugcauggccuauga

SEQ ID NO: 264115 - RNA, 19 nt, Homo sapiens
uggccaggcugaucucgaa

SEQ ID NO: 264116 - RNA, 19 nt, Homo sapiens
agaugagguuucaccauga

SEQ ID NO: 264117 - RNA, 19 nt, Homo sapiens
ucccguggccuguagaaua

SEQ ID NO: 264118 - RNA, 19 nt, Homo sapiens
gaauggugcccagcucuau

SEQ ID NO: 264119 - RNA, 19 nt, Homo sapiens
ccuggauccugcuaagaaa

SEQ ID NO: 264120 - RNA, 19 nt, Homo sapiens
ggucacagcccacccacau

SEQ ID NO: 264121 - RNA, 19 nt, Homo sapiens
gcugaucucgaacuccuaa

SEQ ID NO: 264122 - RNA, 19 nt, Homo sapiens
guagcgaucucggcucaca

SEQ ID NO: 264123 - RNA, 19 nt, Homo sapiens
cauggguccuucaccaaga

SEQ ID NO: 264124 - RNA, 19 nt, Homo sapiens
gagcgaggcacacgucaag

SEQ ID NO: 264125 - RNA, 19 nt, Homo sapiens
gcucguggacggcuacuuc

SEQ ID NO: 264126 - RNA, 19 nt, Homo sapiens
cagaaaucguagacauuag

SEQ ID NO: 264127 - RNA, 19 nt, Homo sapiens
ucacagcccacccacauca

SEQ ID NO: 264128 - RNA, 19 nt, Homo sapiens
gagguucacgagcucauga

SEQ ID NO: 264129 - RNA, 19 nt, Homo sapiens
gcccaucagugcccuggau

SEQ ID NO: 264130 - RNA, 19 nt, Homo sapiens
gcacucauggcaccuccaa

SEQ ID NO: 264131 - RNA, 19 nt, Homo sapiens
caggacagacaaccagauu

SEQ ID NO: 264132 - RNA, 19 nt, Homo sapiens
cuccuaaccucaagugauc

SEQ ID NO: 264133 - RNA, 19 nt, Homo sapiens
ccaccacacccggcuaauu

SEQ ID NO: 264134 - RNA, 19 nt, Homo sapiens
aaagaagcaaggaaccaaa

SEQ ID NO: 264135 - RNA, 19 nt, Homo sapiens
cacaggaccggccaucauu

SEQ ID NO: 264136 - RNA, 19 nt, Homo sapiens
guguaccacucccucuuug

SEQ ID NO: 264137 - RNA, 19 nt, Homo sapiens
ccuacgcccucaacuaucu

SEQ ID NO: 264138 - RNA, 19 nt, Homo sapiens
gaaaucguagacauuagca

SEQ ID NO: 264139 - RNA, 19 nt, Homo sapiens
gccuguggccuuugcaauu

SEQ ID NO: 264140 - RNA, 19 nt, Homo sapiens
ccacaggaccggccaucau

SEQ ID NO: 264141 - RNA, 19 nt, Homo sapiens
gaacugcauggagucauuc

SEQ ID NO: 264142 - RNA, 19 nt, Homo sapiens
cccguggccuguagaauag

SEQ ID NO: 264143 - RNA, 19 nt, Homo sapiens
caacagugcauggccuaug

SEQ ID NO: 264144 - RNA, 19 nt, Homo sapiens
ucauggcaccuccaaguga

SEQ ID NO: 264145 - RNA, 19 nt, Homo sapiens
ucagaugacauuucacaag

SEQ ID NO: 264146 - RNA, 19 nt, Homo sapiens
ccacaucauccuugguuca

SEQ ID NO: 264147 - RNA, 19 nt, Homo sapiens
ggacucccagcacuucuuc

SEQ ID NO: 264148 - RNA, 19 nt, Homo sapiens
gcucauggccaaguacauc

SEQ ID NO: 264149 - RNA, 19 nt, Homo sapiens
agacagaugggcauaugug

SEQ ID NO: 264150 - RNA, 19 nt, Homo sapiens
ggauuuggccagugcuauc

SEQ ID NO: 264151 - RNA, 19 nt, Homo sapiens
gaaucccucucggacaaca

SEQ ID NO: 264152 - RNA, 19 nt, Homo sapiens
ccagccgccuccuucucua

SEQ ID NO: 264153 - RNA, 19 nt, Homo sapiens
cgaggcugcuggaggaagu

SEQ ID NO: 264154 - RNA, 19 nt, Homo sapiens
agcaaggaaccaaauuuaa

SEQ ID NO: 264155 - RNA, 19 nt, Homo sapiens
ggccuuugcaauuuguuaa

SEQ ID NO: 264156 - RNA, 19 nt, Homo sapiens
gcgaggcacacgucaagau

SEQ ID NO: 264157 - RNA, 19 nt, Homo sapiens
guaucguggugucagcuau

SEQ ID NO: 264158 - RNA, 19 nt, Homo sapiens
guggagcugugccgcuaug

SEQ ID NO: 264159 - RNA, 19 nt, Homo sapiens
gggaggcgcagacacuuag

SEQ ID NO: 264160 - RNA, 19 nt, Homo sapiens
aaguugcacucauuaugga

SEQ ID NO: 264161 - RNA, 19 nt, Homo sapiens
gcugggcaagggcaacuuu

SEQ ID NO: 264162 - RNA, 19 nt, Homo sapiens
aggagagacaccucaagua

SEQ ID NO: 264163 - RNA, 19 nt, Homo sapiens
cucaauagccucaucucuu

SEQ ID NO: 264164 - RNA, 19 nt, Homo sapiens
cccaauaccagcugaguca

SEQ ID NO: 264165 - RNA, 19 nt, Homo sapiens
gcagaagacugaacuguuu

SEQ ID NO: 264166 - RNA, 19 nt, Homo sapiens
ggaaauccauucuguuauu

SEQ ID NO: 264167 - RNA, 19 nt, Homo sapiens
gaaaguggcugcaguugga

SEQ ID NO: 264168 - RNA, 19 nt, Homo sapiens
gcaagugacugaccucaaa

SEQ ID NO: 264169 - RNA, 19 nt, Homo sapiens
gcaaauuucugacggcuuu

SEQ ID NO: 264170 - RNA, 19 nt, Homo sapiens
gcauuaaacuguugaacuu

SEQ ID NO: 264171 - RNA, 19 nt, Homo sapiens
gaaaugaagcgucgccaua

SEQ ID NO: 264172 - RNA, 19 nt, Homo sapiens
caacaaugcuucaucuuca

SEQ ID NO: 264173 - RNA, 19 nt, Homo sapiens
gauguuaguucuucagauu

SEQ ID NO: 264174 - RNA, 19 nt, Homo sapiens
ugaaugggcuccuugguaa

SEQ ID NO: 264175 - RNA, 19 nt, Homo sapiens
gaaauacgaugacagugau

SEQ ID NO: 264176 - RNA, 19 nt, Homo sapiens
gcuuacaguuugacauuua

SEQ ID NO: 264177 - RNA, 19 nt, Homo sapiens
ggaggaagaugaugagaca

SEQ ID NO: 264178 - RNA, 19 nt, Homo sapiens
ggacaaguaugggcuuuga

SEQ ID NO: 264179 - RNA, 19 nt, Homo sapiens
gaaagacccaagaggaaua

SEQ ID NO: 264180 - RNA, 19 nt, Homo sapiens
gcguucaucuugucuauuu

SEQ ID NO: 264181 - RNA, 19 nt, Homo sapiens
ggagaccugugccugauuu

SEQ ID NO: 264182 - RNA, 19 nt, Homo sapiens
caagucagcauuaaucuuu

SEQ ID NO: 264183 - RNA, 19 nt, Homo sapiens
gggaaggucuguuucucua

SEQ ID NO: 264184 - RNA, 19 nt, Homo sapiens
ccaacagcaugguguauuu

SEQ ID NO: 264185 - RNA, 19 nt, Homo sapiens
uuacaucacugaacaacaa

SEQ ID NO: 264186 - RNA, 19 nt, Homo sapiens
gaagaaauacgaugacagu

SEQ ID NO: 264187 - RNA, 19 nt, Homo sapiens
gagaggaggugucagaucu

SEQ ID NO: 264188 - RNA, 19 nt, Homo sapiens
gaaguuacucuaccagauu

SEQ ID NO: 264189 - RNA, 19 nt, Homo sapiens
acaaaggcguccucaauga

SEQ ID NO: 264190 - RNA, 19 nt, Homo sapiens
agagagaacuggucaagga

SEQ ID NO: 264191 - RNA, 19 nt, Homo sapiens
gagaagacaagaugaagaa

SEQ ID NO: 264192 - RNA, 19 nt, Homo sapiens
uaggaaauccauucuguua

SEQ ID NO: 264193 - RNA, 19 nt, Homo sapiens
cguggucgauuuauauaua

SEQ ID NO: 264194 - RNA, 19 nt, Homo sapiens
gcuguuggcuacuuuauca

SEQ ID NO: 264195 - RNA, 19 nt, Homo sapiens
agaacaagcuggaagaugu

SEQ ID NO: 264196 - RNA, 19 nt, Homo sapiens
gaacaaacuagcagacaug

SEQ ID NO: 264197 - RNA, 19 nt, Homo sapiens
gaagaaaagccuuacauuu

SEQ ID NO: 264198 - RNA, 19 nt, Homo sapiens
gcgcucagguggagaaguu

SEQ ID NO: 264199 - RNA, 19 nt, Homo sapiens
caacgcccguggucgauuu

SEQ ID NO: 264200 - RNA, 19 nt, Homo sapiens
cagcacaacuccaguaaag

SEQ ID NO: 264201 - RNA, 19 nt, Homo sapiens
gcagcagaguggccaguuu

SEQ ID NO: 264202 - RNA, 19 nt, Homo sapiens
ccacaaacauguucacaac

SEQ ID NO: 264203 - RNA, 19 nt, Homo sapiens
gcacaacuccaguaaagau

SEQ ID NO: 264204 - RNA, 19 nt, Homo sapiens
gcaacgauguuaguucuuc

SEQ ID NO: 264205 - RNA, 19 nt, Homo sapiens
acaguaaacuucugccuau

SEQ ID NO: 264206 - RNA, 19 nt, Homo sapiens
gcuguucuuuguuucauaa

SEQ ID NO: 264207 - RNA, 19 nt, Homo sapiens
ggaacaaacuagcagacau

SEQ ID NO: 264208 - RNA, 19 nt, Homo sapiens
ggaagaugaugagacagaa

SEQ ID NO: 264209 - RNA, 19 nt, Homo sapiens
aaaggaagccuaagacaga

SEQ ID NO: 264210 - RNA, 19 nt, Homo sapiens
ggaaacugccguauaguca

SEQ ID NO: 264211 - RNA, 19 nt, Homo sapiens
gauaucagaccucucuaaa

SEQ ID NO: 264212 - RNA, 19 nt, Homo sapiens
cguaagugcuucuuuguca

SEQ ID NO: 264213 - RNA, 19 nt, Homo sapiens
ugaaauggcuuugcuuugg

SEQ ID NO: 264214 - RNA, 19 nt, Homo sapiens
agaagcaccucaaaucuca

SEQ ID NO: 264215 - RNA, 19 nt, Homo sapiens
uaggaggccugcaguuauu

SEQ ID NO: 264216 - RNA, 19 nt, Homo sapiens
ccauauagcuaagccauuc

SEQ ID NO: 264217 - RNA, 19 nt, Homo sapiens
gaagaacgggugguacgua

SEQ ID NO: 264218 - RNA, 19 nt, Homo sapiens
uacaguauguguggaauaa

SEQ ID NO: 264219 - RNA, 19 nt, Homo sapiens
ucaauagcauccuuaagau

SEQ ID NO: 264220 - RNA, 19 nt, Homo sapiens
gaaagcaacgucaugaucu

SEQ ID NO: 264221 - RNA, 19 nt, Homo sapiens
gaacagcgaggaauaucau

SEQ ID NO: 264222 - RNA, 19 nt, Homo sapiens
gcaaucagcauuuggaucu

SEQ ID NO: 264223 - RNA, 19 nt, Homo sapiens
gccuauggcuuacaguuug

SEQ ID NO: 264224 - RNA, 19 nt, Homo sapiens
caaugugguuguccgguuu

SEQ ID NO: 264225 - RNA, 19 nt, Homo sapiens
ggaaagcaacgucaugauc

SEQ ID NO: 264226 - RNA, 19 nt, Homo sapiens
agaaggaggugcugaugga

SEQ ID NO: 264227 - RNA, 19 nt, Homo sapiens
ucaagaagcaccucaaauc

SEQ ID NO: 264228 - RNA, 19 nt, Homo sapiens
ugaccagucuaagggauua

SEQ ID NO: 264229 - RNA, 19 nt, Homo sapiens
gacuucaugugguuuauug

SEQ ID NO: 264230 - RNA, 19 nt, Homo sapiens
ggagacuucaugugguuua

SEQ ID NO: 264231 - RNA, 19 nt, Homo sapiens
gcacaucacuaugcaucug

SEQ ID NO: 264232 - RNA, 19 nt, Homo sapiens
ucucagcccuccuggauga

SEQ ID NO: 264233 - RNA, 19 nt, Homo sapiens
aaugaagcgucgccauaua

SEQ ID NO: 264234 - RNA, 19 nt, Homo sapiens
gcucaggacuuacggaaac

SEQ ID NO: 264235 - RNA, 19 nt, Homo sapiens
gauucaagcugucuuugca

SEQ ID NO: 264236 - RNA, 19 nt, Homo sapiens
gaugagaugcgguuuguca

SEQ ID NO: 264237 - RNA, 19 nt, Homo sapiens
uaaagauaguggagccauu

SEQ ID NO: 264238 - RNA, 19 nt, Homo sapiens
gaacagucagagaaugaaa

SEQ ID NO: 264239 - RNA, 19 nt, Homo sapiens
caucagaacagucagagaa

SEQ ID NO: 264240 - RNA, 19 nt, Homo sapiens
gcggcaaagugucugguaa

SEQ ID NO: 264241 - RNA, 19 nt, Homo sapiens
gaaggucuguuucucuaac

SEQ ID NO: 264242 - RNA, 19 nt, Homo sapiens
gaucaaccaccaccaacaa

SEQ ID NO: 264243 - RNA, 19 nt, Homo sapiens
acauaugccuguaaauugu

SEQ ID NO: 264244 - RNA, 19 nt, Homo sapiens
ucucaccgcuucuuguuug

SEQ ID NO: 264245 - RNA, 19 nt, Homo sapiens
gacaaaggcguccucaaug

SEQ ID NO: 264246 - RNA, 19 nt, Homo sapiens
ugaagagggugaaguuugg

SEQ ID NO: 264247 - RNA, 19 nt, Homo sapiens
cgaaggcccuggcaagaag

SEQ ID NO: 264248 - RNA, 19 nt, Homo sapiens
gugaaugggcuccuuggua

SEQ ID NO: 264249 - RNA, 19 nt, Homo sapiens
aagaacgggugguacguaa

SEQ ID NO: 264250 - RNA, 19 nt, Homo sapiens
ucaucgacgugcaaucuuu

SEQ ID NO: 264251 - RNA, 19 nt, Homo sapiens
ggaaagacccaagaggaau

SEQ ID NO: 264252 - RNA, 19 nt, Homo sapiens
ggugaaguuuggagaacaa

SEQ ID NO: 264253 - RNA, 19 nt, Homo sapiens
gcacuagcucuaaagaaga

SEQ ID NO: 264254 - RNA, 19 nt, Homo sapiens
ucaguaaacccacaccaaa

SEQ ID NO: 264255 - RNA, 19 nt, Homo sapiens
uauaagggaaggucuguuu

SEQ ID NO: 264256 - RNA, 19 nt, Homo sapiens
guucacaacgggcauguuu

SEQ ID NO: 264257 - RNA, 19 nt, Homo sapiens
gauaguggagccauugcua

SEQ ID NO: 264258 - RNA, 19 nt, Homo sapiens
agaaauacgaugacaguga

SEQ ID NO: 264259 - RNA, 19 nt, Homo sapiens
ucuauggccuugcugugua

SEQ ID NO: 264260 - RNA, 19 nt, Homo sapiens
ucccguagcuacccauauu

SEQ ID NO: 264261 - RNA, 19 nt, Homo sapiens
gcauuugcguucaucuugu

SEQ ID NO: 264262 - RNA, 19 nt, Homo sapiens
gccgagggcugaaguugau

SEQ ID NO: 264263 - RNA, 19 nt, Homo sapiens
ucacaagucagcauuaauc

SEQ ID NO: 264264 - RNA, 19 nt, Homo sapiens
cgacgugcaaucuuucuaa

SEQ ID NO: 264265 - RNA, 19 nt, Homo sapiens
guagauugcuucuguagua

SEQ ID NO: 264266 - RNA, 19 nt, Homo sapiens
gaacagguggcacagcuua

SEQ ID NO: 264267 - RNA, 19 nt, Homo sapiens
ccaagaacgugacagauga

SEQ ID NO: 264268 - RNA, 19 nt, Homo sapiens
ggacuuucguuaacauuga

SEQ ID NO: 264269 - RNA, 19 nt, Homo sapiens
aaaggaagcuggagagaau

SEQ ID NO: 264270 - RNA, 19 nt, Homo sapiens
gaacuaaagccaaggguau

SEQ ID NO: 264271 - RNA, 19 nt, Homo sapiens
gcugauuacugucaauaaa

SEQ ID NO: 264272 - RNA, 19 nt, Homo sapiens
gcgggaggcaucuuaauua

SEQ ID NO: 264273 - RNA, 19 nt, Homo sapiens
gauguauccuuccaauuug

SEQ ID NO: 264274 - RNA, 19 nt, Homo sapiens
caugugcugugaccauuua

SEQ ID NO: 264275 - RNA, 19 nt, Homo sapiens
gagacagacuugagaacuu

SEQ ID NO: 264276 - RNA, 19 nt, Homo sapiens
ccagaaaggauauuuaaga

SEQ ID NO: 264277 - RNA, 19 nt, Homo sapiens
uggcacagcuuaaacagaa

SEQ ID NO: 264278 - RNA, 19 nt, Homo sapiens
gaaauaaauguaccugaug

SEQ ID NO: 264279 - RNA, 19 nt, Homo sapiens
ggaaucuucucuuugacaa

SEQ ID NO: 264280 - RNA, 19 nt, Homo sapiens
gccuacagaugaacucuuu

SEQ ID NO: 264281 - RNA, 19 nt, Homo sapiens
acugagaagucaaacauuu

SEQ ID NO: 264282 - RNA, 19 nt, Homo sapiens
gugacggacuguucuauga

SEQ ID NO: 264283 - RNA, 19 nt, Homo sapiens
ucucagugcuucuuacuau

SEQ ID NO: 264284 - RNA, 19 nt, Homo sapiens
cauucgaucucauucagua

SEQ ID NO: 264285 - RNA, 19 nt, Homo sapiens
agauguauccuuccaauuu

SEQ ID NO: 264286 - RNA, 19 nt, Homo sapiens
gccuuugucuuaugaauau

SEQ ID NO: 264287 - RNA, 19 nt, Homo sapiens
ccaguguuguuuguaaaua

SEQ ID NO: 264288 - RNA, 19 nt, Homo sapiens
cgggaggcaucuuaauuaa

SEQ ID NO: 264289 - RNA, 19 nt, Homo sapiens
cagcguaucuauauggaau

SEQ ID NO: 264290 - RNA, 19 nt, Homo sapiens
ucagugcuucuuacuauua

SEQ ID NO: 264291 - RNA, 19 nt, Homo sapiens
gacuguagauugcuucugu

SEQ ID NO: 264292 - RNA, 19 nt, Homo sapiens
gauggccuuugucuuauga

SEQ ID NO: 264293 - RNA, 19 nt, Homo sapiens
gaguuaagaaugcucgaua

SEQ ID NO: 264294 - RNA, 19 nt, Homo sapiens
uaaacagcuucaugccuuu

SEQ ID NO: 264295 - RNA, 19 nt, Homo sapiens
gcauggaccuaacauucga

SEQ ID NO: 264296 - RNA, 19 nt, Homo sapiens
gaacugcacagccagaaca

SEQ ID NO: 264297 - RNA, 19 nt, Homo sapiens
gaccuuauggcuacaguaa

SEQ ID NO: 264298 - RNA, 19 nt, Homo sapiens
ggaggcaucuuaauuaacc

SEQ ID NO: 264299 - RNA, 19 nt, Homo sapiens
aaagauguauccuuccaau

SEQ ID NO: 264300 - RNA, 19 nt, Homo sapiens
gagcuggagcgccugauaa

SEQ ID NO: 264301 - RNA, 19 nt, Homo sapiens
uuuggaaucuucucuuuga

SEQ ID NO: 264302 - RNA, 19 nt, Homo sapiens
guuacaaacugcaauagag

SEQ ID NO: 264303 - RNA, 19 nt, Homo sapiens
gaccuaacauucgaucuca

SEQ ID NO: 264304 - RNA, 19 nt, Homo sapiens
ugauguaccugaugcuaug

SEQ ID NO: 264305 - RNA, 19 nt, Homo sapiens
gaaaauuccagaaaggaua

SEQ ID NO: 264306 - RNA, 19 nt, Homo sapiens
ucgaucucauucaguauua

SEQ ID NO: 264307 - RNA, 19 nt, Homo sapiens
agacagacuugagaacuug

SEQ ID NO: 264308 - RNA, 19 nt, Homo sapiens
caaguggcaugugcuguga

SEQ ID NO: 264309 - RNA, 19 nt, Homo sapiens
gaagugacggacuguucua

SEQ ID NO: 264310 - RNA, 19 nt, Homo sapiens
aggaauugguggcagauuu

SEQ ID NO: 264311 - RNA, 19 nt, Homo sapiens
gugcugugaccauuuauaa

SEQ ID NO: 264312 - RNA, 19 nt, Homo sapiens
gcaggagggagguuuguga

SEQ ID NO: 264313 - RNA, 19 nt, Homo sapiens
uggaaacgaccuucuauga

SEQ ID NO: 264314 - RNA, 19 nt, Homo sapiens
cuucaugccuuuguaaguu

SEQ ID NO: 264315 - RNA, 19 nt, Homo sapiens
aaacugcaauagagacugu

SEQ ID NO: 264316 - RNA, 19 nt, Homo sapiens
gagagggacagcccacuga

SEQ ID NO: 264317 - RNA, 19 nt, Homo sapiens
guugaaagaguuaagaaug

SEQ ID NO: 264318 - RNA, 19 nt, Homo sapiens
gauggaaacgaccuucuau

SEQ ID NO: 264319 - RNA, 19 nt, Homo sapiens
gcccaguguuguuuguaaa

SEQ ID NO: 264320 - RNA, 19 nt, Homo sapiens
guaguacuccuuaagaaca

SEQ ID NO: 264321 - RNA, 19 nt, Homo sapiens
uaacauugaccaagaacug

SEQ ID NO: 264322 - RNA, 19 nt, Homo sapiens
gaagucaaacauuucaaag

SEQ ID NO: 264323 - RNA, 19 nt, Homo sapiens
gcaauagagacuguagauu

SEQ ID NO: 264324 - RNA, 19 nt, Homo sapiens
gaacugcauggaccuaaca

SEQ ID NO: 264325 - RNA, 19 nt, Homo sapiens
uggaauugcuuaccaaagg

SEQ ID NO: 264326 - RNA, 19 nt, Homo sapiens
acacagagagacagacuug

SEQ ID NO: 264327 - RNA, 19 nt, Homo sapiens
ccacugagaagucaaacau

SEQ ID NO: 264328 - RNA, 19 nt, Homo sapiens
cagugcuucuuacuauuaa

SEQ ID NO: 264329 - RNA, 19 nt, Homo sapiens
guuaagaaugcucgauaaa

SEQ ID NO: 264330 - RNA, 19 nt, Homo sapiens
cuaucuagguggaguugaa

SEQ ID NO: 264331 - RNA, 19 nt, Homo sapiens
cccaagauccugaaacaga

SEQ ID NO: 264332 - RNA, 19 nt, Homo sapiens
gcguaucuauauggaauug

SEQ ID NO: 264333 - RNA, 19 nt, Homo sapiens
aguuaagaaugcucgauaa

SEQ ID NO: 264334 - RNA, 19 nt, Homo sapiens
gagauuuggagcacucuga

SEQ ID NO: 264335 - RNA, 19 nt, Homo sapiens
agaaguguccgagaacuaa

SEQ ID NO: 264336 - RNA, 19 nt, Homo sapiens
ggaucaaggcggagaggaa

SEQ ID NO: 264337 - RNA, 19 nt, Homo sapiens
guucgggaguguccagaga

SEQ ID NO: 264338 - RNA, 19 nt, Homo sapiens
ggaaacgaccuucuaugac

SEQ ID NO: 264339 - RNA, 19 nt, Homo sapiens
caaaggcuagugcgauguu

SEQ ID NO: 264340 - RNA, 19 nt, Homo sapiens
gaaguguccgagaacuaaa

SEQ ID NO: 264341 - RNA, 19 nt, Homo sapiens
gaaagucaugaaccacguu

SEQ ID NO: 264342 - RNA, 19 nt, Homo sapiens
agaggaagcgcaugaggaa

SEQ ID NO: 264343 - RNA, 19 nt, Homo sapiens
ggccuuugucuuaugaaua

SEQ ID NO: 264344 - RNA, 19 nt, Homo sapiens
cuuugacaauuccuagaua

SEQ ID NO: 264345 - RNA, 19 nt, Homo sapiens
ggcaugugcugugaccauu

SEQ ID NO: 264346 - RNA, 19 nt, Homo sapiens
ccgcugcucugggaaguga

SEQ ID NO: 264347 - RNA, 19 nt, Homo sapiens
ggaguugaaagaguuaaga

SEQ ID NO: 264348 - RNA, 19 nt, Homo sapiens
guacuccccuaaccucuuu

SEQ ID NO: 264349 - RNA, 19 nt, Homo sapiens
uucaugccuuuguaaguua

SEQ ID NO: 264350 - RNA, 19 nt, Homo sapiens
cgcagcaguugcaaacauu

SEQ ID NO: 264351 - RNA, 19 nt, Homo sapiens
uauauggaauugcuuacca

SEQ ID NO: 264352 - RNA, 19 nt, Homo sapiens
guccgaacugcaaaucuua

SEQ ID NO: 264353 - RNA, 19 nt, Homo sapiens
aauagagacuguagauugc

SEQ ID NO: 264354 - RNA, 19 nt, Homo sapiens
ggaccuaacauucgaucuc

SEQ ID NO: 264355 - RNA, 19 nt, Homo sapiens
gcagcaguugcaaacauuu

SEQ ID NO: 264356 - RNA, 19 nt, Homo sapiens
gcggagaggaagcgcauga

SEQ ID NO: 264357 - RNA, 19 nt, Homo sapiens
cagcauucugucacaauaa

SEQ ID NO: 264358 - RNA, 19 nt, Homo sapiens
ggacagcccacugagaagu

SEQ ID NO: 264359 - RNA, 19 nt, Homo sapiens
gagugcgggaggcaucuua

SEQ ID NO: 264360 - RNA, 19 nt, Homo sapiens
gaguugaaagaguuaagaa

SEQ ID NO: 264361 - RNA, 19 nt, Homo sapiens
uaacauucgaucucauuca

SEQ ID NO: 264362 - RNA, 19 nt, Homo sapiens
cguuaacauugaccaagaa

SEQ ID NO: 264363 - RNA, 19 nt, Homo sapiens
uaacgcagcaguugcaaac

SEQ ID NO: 264364 - RNA, 19 nt, Homo sapiens
cagcuuaaacagaaaguca

SEQ ID NO: 264365 - RNA, 19 nt, Homo sapiens
gaaacagacucgauucaua

SEQ ID NO: 264366 - RNA, 19 nt, Homo sapiens
cagacucgauucauauuga

SEQ ID NO: 264367 - RNA, 19 nt, Homo sapiens
ggacacgccuucugaacgu

SEQ ID NO: 264368 - RNA, 19 nt, Homo sapiens
gaaaagaaacacgcacuua

SEQ ID NO: 264369 - RNA, 19 nt, Homo sapiens
aaacagacucgauucauau

SEQ ID NO: 264370 - RNA, 19 nt, Homo sapiens
ucaaagcccuggacgaucu

SEQ ID NO: 264371 - RNA, 19 nt, Homo sapiens
gcagguggcccagcucaaa

SEQ ID NO: 264372 - RNA, 19 nt, Homo sapiens
gggaaacgacgccaggaaa

SEQ ID NO: 264373 - RNA, 19 nt, Homo sapiens
caacauggaagaccaagag

SEQ ID NO: 264374 - RNA, 19 nt, Homo sapiens
gagcuggaacgccugauug

SEQ ID NO: 264375 - RNA, 19 nt, Homo sapiens
acaccaaccucagcagcua

SEQ ID NO: 264376 - RNA, 19 nt, Homo sapiens
uuuaagacguguuuguguu

SEQ ID NO: 264377 - RNA, 19 nt, Homo sapiens
ggaaacagacucgauucau

SEQ ID NO: 264378 - RNA, 19 nt, Homo sapiens
caacagcaacggcgugauc

SEQ ID NO: 264379 - RNA, 19 nt, Homo sapiens
uaagacguguuuguguuug

SEQ ID NO: 264380 - RNA, 19 nt, Homo sapiens
gaacguccccugccccuuu

SEQ ID NO: 264381 - RNA, 19 nt, Homo sapiens
uggcccagcucaaacagaa

SEQ ID NO: 264382 - RNA, 19 nt, Homo sapiens
gcuggaaacagacucgauu

SEQ ID NO: 264383 - RNA, 19 nt, Homo sapiens
cgacuacaaacuccugaaa

SEQ ID NO: 264384 - RNA, 19 nt, Homo sapiens
aaagaaacacgcacuuagu

SEQ ID NO: 264385 - RNA, 19 nt, Homo sapiens
ggaaacgacgccaggaaag

SEQ ID NO: 264386 - RNA, 19 nt, Homo sapiens
caagaugaaccacgugaca

SEQ ID NO: 264387 - RNA, 19 nt, Homo sapiens
ccuuccaccucgacguuua

SEQ ID NO: 264388 - RNA, 19 nt, Homo sapiens
cgacgaccaccaucagcua

SEQ ID NO: 264389 - RNA, 19 nt, Homo sapiens
ccacgacgacucauacaca

SEQ ID NO: 264390 - RNA, 19 nt, Homo sapiens
ggagcuggaacgccugauu

SEQ ID NO: 264391 - RNA, 19 nt, Homo sapiens
uuaagacguguuuguguuu

SEQ ID NO: 264392 - RNA, 19 nt, Homo sapiens
gcccggaugugcacuaaaa

SEQ ID NO: 264393 - RNA, 19 nt, Homo sapiens
aaauggaacagcccuucua

SEQ ID NO: 264394 - RNA, 19 nt, Homo sapiens
agaccaagagcgcaucaaa

SEQ ID NO: 264395 - RNA, 19 nt, Homo sapiens
gaugugcacuaaaauggaa

SEQ ID NO: 264396 - RNA, 19 nt, Homo sapiens
cauacacagcuacgggaua

SEQ ID NO: 264397 - RNA, 19 nt, Homo sapiens
gaagaccaagagcgcauca

SEQ ID NO: 264398 - RNA, 19 nt, Homo sapiens
gaccaagagcgcaucaaag

SEQ ID NO: 264399 - RNA, 19 nt, Homo sapiens
auacacagcuacgggauac

SEQ ID NO: 264400 - RNA, 19 nt, Homo sapiens
aaagcuaucgcgccagaga

SEQ ID NO: 264401 - RNA, 19 nt, Homo sapiens
ccaagagcgcaucaaagug

SEQ ID NO: 264402 - RNA, 19 nt, Homo sapiens
gaaacgacgccaggaaagc

SEQ ID NO: 264403 - RNA, 19 nt, Homo sapiens
ccaccucgacguuuacaag

SEQ ID NO: 264404 - RNA, 19 nt, Homo sapiens
gacgacucauacacagcua

SEQ ID NO: 264405 - RNA, 19 nt, Homo sapiens
ugucaaagcccuggacgau

SEQ ID NO: 264406 - RNA, 19 nt, Homo sapiens
accaagagcgcaucaaagu

SEQ ID NO: 264407 - RNA, 19 nt, Homo sapiens
uggaacagcccuucuacca

SEQ ID NO: 264408 - RNA, 19 nt, Homo sapiens
aaacacgcacuuagucucu

SEQ ID NO: 264409 - RNA, 19 nt, Homo sapiens
aagaaacacgcacuuaguc

SEQ ID NO: 264410 - RNA, 19 nt, Homo sapiens
gcucaaacagaaggucaug

SEQ ID NO: 264411 - RNA, 19 nt, Homo sapiens
ucaaggcccuggaggauuu

SEQ ID NO: 264412 - RNA, 19 nt, Homo sapiens
guucgauucugcccuauuu

SEQ ID NO: 264413 - RNA, 19 nt, Homo sapiens
gaagagagaagaacagagu

SEQ ID NO: 264414 - RNA, 19 nt, Homo sapiens
ugaagacccucaagaguca

SEQ ID NO: 264415 - RNA, 19 nt, Homo sapiens
ccacauuccuguuuguaau

SEQ ID NO: 264416 - RNA, 19 nt, Homo sapiens
gcagcaugaugaagaagga

SEQ ID NO: 264417 - RNA, 19 nt, Homo sapiens
aaagaaaugggaagaagaa

SEQ ID NO: 264418 - RNA, 19 nt, Homo sapiens
aaacguugguugugugugu

SEQ ID NO: 264419 - RNA, 19 nt, Homo sapiens
uggcgcagcucaagcagaa

SEQ ID NO: 264420 - RNA, 19 nt, Homo sapiens
uaaagaaaugggaagaaga

SEQ ID NO: 264421 - RNA, 19 nt, Homo sapiens
uuaaagaaaugggaagaag

SEQ ID NO: 264422 - RNA, 19 nt, Homo sapiens
aaacccugccuuuccuuua

SEQ ID NO: 264423 - RNA, 19 nt, Homo sapiens
ggauggaaacacccuucua

SEQ ID NO: 264424 - RNA, 19 nt, Homo sapiens
gauggaaacacccuucuac

SEQ ID NO: 264425 - RNA, 19 nt, Homo sapiens
gcuauaagagggcgcacaa

SEQ ID NO: 264426 - RNA, 19 nt, Homo sapiens
cgaguccacauuccuguuu

SEQ ID NO: 264427 - RNA, 19 nt, Homo sapiens
gauucugcccuauuuaugu

SEQ ID NO: 264428 - RNA, 19 nt, Homo sapiens
gaguccacauuccuguuug

SEQ ID NO: 264429 - RNA, 19 nt, Homo sapiens
caaacccugccuuuccuuu

SEQ ID NO: 264430 - RNA, 19 nt, Homo sapiens
gaaagugaagacccucaag

SEQ ID NO: 264431 - RNA, 19 nt, Homo sapiens
acgcgaaccugagcagcua

SEQ ID NO: 264432 - RNA, 19 nt, Homo sapiens
uauaagagggcgcacaagu

SEQ ID NO: 264433 - RNA, 19 nt, Homo sapiens
aaagugaagacccucaaga

SEQ ID NO: 264434 - RNA, 19 nt, Homo sapiens
ccuggaggauuuacacaag

SEQ ID NO: 264435 - RNA, 19 nt, Homo sapiens
gguuuucuguuuucaguaa

SEQ ID NO: 264436 - RNA, 19 nt, Homo sapiens
gcaucucgcgccuggaaga

SEQ ID NO: 264437 - RNA, 19 nt, Homo sapiens
gggaggcggaggauggaaa

SEQ ID NO: 264438 - RNA, 19 nt, Homo sapiens
ccggcagcaugaugaagaa

SEQ ID NO: 264439 - RNA, 19 nt, Homo sapiens
auucugcccuauuuauguu

SEQ ID NO: 264440 - RNA, 19 nt, Homo sapiens
gccggcagcaugaugaaga

SEQ ID NO: 264441 - RNA, 19 nt, Homo sapiens
ugccuuuccuuuacuuuua

SEQ ID NO: 264442 - RNA, 19 nt, Homo sapiens
gagcucgagcgccucauca

SEQ ID NO: 264443 - RNA, 19 nt, Homo sapiens
gagcucacaguuccucuac

SEQ ID NO: 264444 - RNA, 19 nt, Homo sapiens
ucgauucugcccuauuuau

SEQ ID NO: 264445 - RNA, 19 nt, Homo sapiens
ccagcgaggagcaggaguu

SEQ ID NO: 264446 - RNA, 19 nt, Homo sapiens
ggacauggauggagacuac

SEQ ID NO: 264447 - RNA, 19 nt, Homo sapiens
gcaagcaccugaccagcaa

SEQ ID NO: 264448 - RNA, 19 nt, Homo sapiens
ugaaccagcugucgaagaa

SEQ ID NO: 264449 - RNA, 19 nt, Homo sapiens
gaggagauauggagugagu

SEQ ID NO: 264450 - RNA, 19 nt, Homo sapiens
ucaaguacccauucuguuu

SEQ ID NO: 264451 - RNA, 19 nt, Homo sapiens
cacuaaagcuucagacuca

SEQ ID NO: 264452 - RNA, 19 nt, Homo sapiens
caagcagaguguuuuauua

SEQ ID NO: 264453 - RNA, 19 nt, Homo sapiens
ucaccaaacugcucaacga

SEQ ID NO: 264454 - RNA, 19 nt, Homo sapiens
gggaggagauauggaguga

SEQ ID NO: 264455 - RNA, 19 nt, Homo sapiens
acaagacgcuggugacaca

SEQ ID NO: 264456 - RNA, 19 nt, Homo sapiens
gaucaugcguaacuacagu

SEQ ID NO: 264457 - RNA, 19 nt, Homo sapiens
gugcguaccaugcagaaua

SEQ ID NO: 264458 - RNA, 19 nt, Homo sapiens
ugagucaccugcuccagaa

SEQ ID NO: 264459 - RNA, 19 nt, Homo sapiens
gaacuccaccgaccaacug

SEQ ID NO: 264460 - RNA, 19 nt, Homo sapiens
gcugaaaccugcgcuccuu

SEQ ID NO: 264461 - RNA, 19 nt, Homo sapiens
ggacaagaacccagacuac

SEQ ID NO: 264462 - RNA, 19 nt, Homo sapiens
gcaacaacagcaagaacaa

SEQ ID NO: 264463 - RNA, 19 nt, Homo sapiens
ccaacucccucuucaagca

SEQ ID NO: 264464 - RNA, 19 nt, Homo sapiens
gaacaagacgcuggugaca

SEQ ID NO: 264465 - RNA, 19 nt, Homo sapiens
ggagauauggagugaguca

SEQ ID NO: 264466 - RNA, 19 nt, Homo sapiens
gagagugugcugaagauuc

SEQ ID NO: 264467 - RNA, 19 nt, Homo sapiens
caugugcccugguguguca

SEQ ID NO: 264468 - RNA, 19 nt, Homo sapiens
gcaaccaucggcuugauca

SEQ ID NO: 264469 - RNA, 19 nt, Homo sapiens
ucucagauguggccaccaa

SEQ ID NO: 264470 - RNA, 19 nt, Homo sapiens
uggagucgguccuguucua

SEQ ID NO: 264471 - RNA, 19 nt, Homo sapiens
ucaagaaaaccaccacuua

SEQ ID NO: 264472 - RNA, 19 nt, Homo sapiens
gaccaaagcaaagaaaaua

SEQ ID NO: 264473 - RNA, 19 nt, Homo sapiens
gcucugcgccaccucacua

SEQ ID NO: 264474 - RNA, 19 nt, Homo sapiens
ccaguacacgcucaagaaa

SEQ ID NO: 264475 - RNA, 19 nt, Homo sapiens
gcacacagcagcccuacac

SEQ ID NO: 264476 - RNA, 19 nt, Homo sapiens
gccaguacacgcucaagaa

SEQ ID NO: 264477 - RNA, 19 nt, Homo sapiens
caaaacuucucuugaaaag

SEQ ID NO: 264478 - RNA, 19 nt, Homo sapiens
uagggucuuucuugggaua

SEQ ID NO: 264479 - RNA, 19 nt, Homo sapiens
ucuccaaccugacaugcaa

SEQ ID NO: 264480 - RNA, 19 nt, Homo sapiens
ggucugauuuucucacuga

SEQ ID NO: 264481 - RNA, 19 nt, Homo sapiens
gggcuuugguuccuucucu

SEQ ID NO: 264482 - RNA, 19 nt, Homo sapiens
ucuccagggugcuuaguug

SEQ ID NO: 264483 - RNA, 19 nt, Homo sapiens
caggagagcaagcugauca

SEQ ID NO: 264484 - RNA, 19 nt, Homo sapiens
ccaccagcauccugcacaa

SEQ ID NO: 264485 - RNA, 19 nt, Homo sapiens
gcagcaagggcaucaugga

SEQ ID NO: 264486 - RNA, 19 nt, Homo sapiens
cggaguggcuugagcuucu

SEQ ID NO: 264487 - RNA, 19 nt, Homo sapiens
cugaguggcagcagacaua

SEQ ID NO: 264488 - RNA, 19 nt, Homo sapiens
agagugugcugaagauucu

SEQ ID NO: 264489 - RNA, 19 nt, Homo sapiens
ugcacaaccugcuccugua

SEQ ID NO: 264490 - RNA, 19 nt, Homo sapiens
guauagaccaaagcaaaga

SEQ ID NO: 264491 - RNA, 19 nt, Homo sapiens
gaguguggaugacgucaac

SEQ ID NO: 264492 - RNA, 19 nt, Homo sapiens
gcucaagucggccauugug

SEQ ID NO: 264493 - RNA, 19 nt, Homo sapiens
cgucccagcugcucaaguc

SEQ ID NO: 264494 - RNA, 19 nt, Homo sapiens
gccuucuucuugugucuuu

SEQ ID NO: 264495 - RNA, 19 nt, Homo sapiens
gugcagaucaugcguaacu

SEQ ID NO: 264496 - RNA, 19 nt, Homo sapiens
ucgugcagaucaugcguaa

SEQ ID NO: 264497 - RNA, 19 nt, Homo sapiens
uaccagauguccacaacag

SEQ ID NO: 264498 - RNA, 19 nt, Homo sapiens
caggugcgguuccucaucu

SEQ ID NO: 264499 - RNA, 19 nt, Homo sapiens
uugugcaucucaucaacua

SEQ ID NO: 264500 - RNA, 19 nt, Homo sapiens
caaugagcccuauggagau

SEQ ID NO: 264501 - RNA, 19 nt, Homo sapiens
agacgcuggugacacagaa

SEQ ID NO: 264502 - RNA, 19 nt, Homo sapiens
aaccugacaugcaacaaca

SEQ ID NO: 264503 - RNA, 19 nt, Homo sapiens
ccguggagcucaccaacuc

SEQ ID NO: 264504 - RNA, 19 nt, Homo sapiens
uggagagugugcugaagau

SEQ ID NO: 264505 - RNA, 19 nt, Homo sapiens
gcacaaccugcuccuguac

SEQ ID NO: 264506 - RNA, 19 nt, Homo sapiens
ucaccacgcugcacaaccu

SEQ ID NO: 264507 - RNA, 19 nt, Homo sapiens
ggagguccaagcagagugu

SEQ ID NO: 264508 - RNA, 19 nt, Homo sapiens
gguccuccguagggucuuu

SEQ ID NO: 264509 - RNA, 19 nt, Homo sapiens
gcucaccaacucccucuuc

SEQ ID NO: 264510 - RNA, 19 nt, Homo sapiens
ugacaugcaacaacagcaa

SEQ ID NO: 264511 - RNA, 19 nt, Homo sapiens
ucgugaagcugcucaacca

SEQ ID NO: 264512 - RNA, 19 nt, Homo sapiens
cgagauggcccagaacucu

SEQ ID NO: 264513 - RNA, 19 nt, Homo sapiens
gcagaucaugcguaacuac

SEQ ID NO: 264514 - RNA, 19 nt, Homo sapiens
gaggcugcccagagcauga

SEQ ID NO: 264515 - RNA, 19 nt, Homo sapiens
ggcagcagacauacaccua

SEQ ID NO: 264516 - RNA, 19 nt, Homo sapiens
ggagagugugcugaagauu

SEQ ID NO: 264517 - RNA, 19 nt, Homo sapiens
aggagggccuggagagugu

SEQ ID NO: 264518 - RNA, 19 nt, Homo sapiens
agacucaaguacccauucu

SEQ ID NO: 264519 - RNA, 19 nt, Homo sapiens
caccaacucccucuucaag

SEQ ID NO: 264520 - RNA, 19 nt, Homo sapiens
ccacgauggaggugaugaa

SEQ ID NO: 264521 - RNA, 19 nt, Homo sapiens
ccaaaacuucucuugaaaa

SEQ ID NO: 264522 - RNA, 19 nt, Homo sapiens
caacaacagcaagaacaag

SEQ ID NO: 264523 - RNA, 19 nt, Homo sapiens
ccagucgugugcucaaggu

SEQ ID NO: 264524 - RNA, 19 nt, Homo sapiens
agagcaagcugaucauccu

SEQ ID NO: 264525 - RNA, 19 nt, Homo sapiens
ugcccgagcucaccaaacu

SEQ ID NO: 264526 - RNA, 19 nt, Homo sapiens
cagcagcaagggcaucaug

SEQ ID NO: 264527 - RNA, 19 nt, Homo sapiens
caaguacccauucuguuuu

SEQ ID NO: 264528 - RNA, 19 nt, Homo sapiens
ggccugccuucuucuugug

SEQ ID NO: 264529 - RNA, 19 nt, Homo sapiens
ugaaccgcauggagaucuu

SEQ ID NO: 264530 - RNA, 19 nt, Homo sapiens
uuguauagaccaaagcaaa

SEQ ID NO: 264531 - RNA, 19 nt, Homo sapiens
ggaguggcuugagcuucug

SEQ ID NO: 264532 - RNA, 19 nt, Homo sapiens
aaugagcccuauggagaug

SEQ ID NO: 264533 - RNA, 19 nt, Homo sapiens
acucgucgguggagaacau

SEQ ID NO: 264534 - RNA, 19 nt, Homo sapiens
gagaucuuccggcucaaca

SEQ ID NO: 264535 - RNA, 19 nt, Homo sapiens
gugugaggauggaggagau

SEQ ID NO: 264536 - RNA, 19 nt, Homo sapiens
aacaacagcaagaacaaga

SEQ ID NO: 264537 - RNA, 19 nt, Homo sapiens
caaccugacaugcaacaac

SEQ ID NO: 264538 - RNA, 19 nt, Homo sapiens
gcgcaaccucucagaugug

SEQ ID NO: 264539 - RNA, 19 nt, Homo sapiens
ggagagcaagcugaucauc

SEQ ID NO: 264540 - RNA, 19 nt, Homo sapiens
ggagucgguccuguucuau

SEQ ID NO: 264541 - RNA, 19 nt, Homo sapiens
gggcugcucgccaucuuca

SEQ ID NO: 264542 - RNA, 19 nt, Homo sapiens
ggacauggauggagacuac

SEQ ID NO: 264543 - RNA, 19 nt, Homo sapiens
gcaagcaccugaccagcaa

SEQ ID NO: 264544 - RNA, 19 nt, Homo sapiens
ugaaccagcugucgaagaa

SEQ ID NO: 264545 - RNA, 19 nt, Homo sapiens
gaggagauauggagugagu

SEQ ID NO: 264546 - RNA, 19 nt, Homo sapiens
ucaaguacccauucuguuu

SEQ ID NO: 264547 - RNA, 19 nt, Homo sapiens
cacuaaagcuucagacuca

SEQ ID NO: 264548 - RNA, 19 nt, Homo sapiens
caagcagaguguuuuauua

SEQ ID NO: 264549 - RNA, 19 nt, Homo sapiens
ucaccaaacugcucaacga

SEQ ID NO: 264550 - RNA, 19 nt, Homo sapiens
gggaggagauauggaguga

SEQ ID NO: 264551 - RNA, 19 nt, Homo sapiens
acaagacgcuggugacaca

SEQ ID NO: 264552 - RNA, 19 nt, Homo sapiens
gaucaugcguaacuacagu

SEQ ID NO: 264553 - RNA, 19 nt, Homo sapiens
gugcguaccaugcagaaua

SEQ ID NO: 264554 - RNA, 19 nt, Homo sapiens
ugagucaccugcuccagaa

SEQ ID NO: 264555 - RNA, 19 nt, Homo sapiens
gaacuccaccgaccaacug

SEQ ID NO: 264556 - RNA, 19 nt, Homo sapiens
ggacaagaacccagacuac

SEQ ID NO: 264557 - RNA, 19 nt, Homo sapiens
gcaacaacagcaagaacaa

SEQ ID NO: 264558 - RNA, 19 nt, Homo sapiens
ccaacucccucuucaagca

SEQ ID NO: 264559 - RNA, 19 nt, Homo sapiens
gaacaagacgcuggugaca

SEQ ID NO: 264560 - RNA, 19 nt, Homo sapiens
ggagauauggagugaguca

SEQ ID NO: 264561 - RNA, 19 nt, Homo sapiens
gagagugugcugaagauuc

SEQ ID NO: 264562 - RNA, 19 nt, Homo sapiens
caugugcccugguguguca

SEQ ID NO: 264563 - RNA, 19 nt, Homo sapiens
gcaaccaucggcuugauca

SEQ ID NO: 264564 - RNA, 19 nt, Homo sapiens
ucucagauguggccaccaa

SEQ ID NO: 264565 - RNA, 19 nt, Homo sapiens
uggagucgguccuguucua

SEQ ID NO: 264566 - RNA, 19 nt, Homo sapiens
ucaagaaaaccaccacuua

SEQ ID NO: 264567 - RNA, 19 nt, Homo sapiens
gaccaaagcaaagaaaaua

SEQ ID NO: 264568 - RNA, 19 nt, Homo sapiens
ccagugcgguuccucaucu

SEQ ID NO: 264569 - RNA, 19 nt, Homo sapiens
gcucugcgccaccucacua

SEQ ID NO: 264570 - RNA, 19 nt, Homo sapiens
ccaguacacgcucaagaaa

SEQ ID NO: 264571 - RNA, 19 nt, Homo sapiens
gcacacagcagcccuacac

SEQ ID NO: 264572 - RNA, 19 nt, Homo sapiens
gccaguacacgcucaagaa

SEQ ID NO: 264573 - RNA, 19 nt, Homo sapiens
caaaacuucucuugaaaag

SEQ ID NO: 264574 - RNA, 19 nt, Homo sapiens
uagggucuuucuugggaua

SEQ ID NO: 264575 - RNA, 19 nt, Homo sapiens
ucuccaaccugacaugcaa

SEQ ID NO: 264576 - RNA, 19 nt, Homo sapiens
ggucugauuuucucacuga

SEQ ID NO: 264577 - RNA, 19 nt, Homo sapiens
gggcuuugguuccuucucu

SEQ ID NO: 264578 - RNA, 19 nt, Homo sapiens
ucuccagggugcuuaguug

SEQ ID NO: 264579 - RNA, 19 nt, Homo sapiens
caggagagcaagcugauca

SEQ ID NO: 264580 - RNA, 19 nt, Homo sapiens
ccaccagcauccugcacaa

SEQ ID NO: 264581 - RNA, 19 nt, Homo sapiens
gcagcaagggcaucaugga

SEQ ID NO: 264582 - RNA, 19 nt, Homo sapiens
cugaguggcagcagacaua

SEQ ID NO: 264583 - RNA, 19 nt, Homo sapiens
agagugugcugaagauucu

SEQ ID NO: 264584 - RNA, 19 nt, Homo sapiens
ugcacaaccugcuccugua

SEQ ID NO: 264585 - RNA, 19 nt, Homo sapiens
guauagaccaaagcaaaga

SEQ ID NO: 264586 - RNA, 19 nt, Homo sapiens
gaguguggaugacgucaac

SEQ ID NO: 264587 - RNA, 19 nt, Homo sapiens
gcucaagucggccauugug

SEQ ID NO: 264588 - RNA, 19 nt, Homo sapiens
cgucccagcugcucaaguc

SEQ ID NO: 264589 - RNA, 19 nt, Homo sapiens
gugcagaucaugcguaacu

SEQ ID NO: 264590 - RNA, 19 nt, Homo sapiens
ucgugcagaucaugcguaa

SEQ ID NO: 264591 - RNA, 19 nt, Homo sapiens
uaccagauguccacaacag

SEQ ID NO: 264592 - RNA, 19 nt, Homo sapiens
uugugcaucucaucaacua

SEQ ID NO: 264593 - RNA, 19 nt, Homo sapiens
caaugagcccuauggagau

SEQ ID NO: 264594 - RNA, 19 nt, Homo sapiens
agacgcuggugacacagaa

SEQ ID NO: 264595 - RNA, 19 nt, Homo sapiens
aaccugacaugcaacaaca

SEQ ID NO: 264596 - RNA, 19 nt, Homo sapiens
ccguggagcucaccaacuc

SEQ ID NO: 264597 - RNA, 19 nt, Homo sapiens
uggagagugugcugaagau

SEQ ID NO: 264598 - RNA, 19 nt, Homo sapiens
gcacaaccugcuccuguac

SEQ ID NO: 264599 - RNA, 19 nt, Homo sapiens
ucaccacgcugcacaaccu

SEQ ID NO: 264600 - RNA, 19 nt, Homo sapiens
ggagguccaagcagagugu

SEQ ID NO: 264601 - RNA, 19 nt, Homo sapiens
gguccuccguagggucuuu

SEQ ID NO: 264602 - RNA, 19 nt, Homo sapiens
gcucaccaacucccucuuc

SEQ ID NO: 264603 - RNA, 19 nt, Homo sapiens
ugacaugcaacaacagcaa

SEQ ID NO: 264604 - RNA, 19 nt, Homo sapiens
ucgugaagcugcucaacca

SEQ ID NO: 264605 - RNA, 19 nt, Homo sapiens
cgagauggcccagaacucu

SEQ ID NO: 264606 - RNA, 19 nt, Homo sapiens
gcagaucaugcguaacuac

SEQ ID NO: 264607 - RNA, 19 nt, Homo sapiens
gaggcugcccagagcauga

SEQ ID NO: 264608 - RNA, 19 nt, Homo sapiens
ggcagcagacauacaccua

SEQ ID NO: 264609 - RNA, 19 nt, Homo sapiens
ggagagugugcugaagauu

SEQ ID NO: 264610 - RNA, 19 nt, Homo sapiens
aggagggccuggagagugu

SEQ ID NO: 264611 - RNA, 19 nt, Homo sapiens
agacucaaguacccauucu

SEQ ID NO: 264612 - RNA, 19 nt, Homo sapiens
caccaacucccucuucaag

SEQ ID NO: 264613 - RNA, 19 nt, Homo sapiens
ccacgauggaggugaugaa

SEQ ID NO: 264614 - RNA, 19 nt, Homo sapiens
ccaaaacuucucuugaaaa

SEQ ID NO: 264615 - RNA, 19 nt, Homo sapiens
caacaacagcaagaacaag

SEQ ID NO: 264616 - RNA, 19 nt, Homo sapiens
ccagucgugugcucaaggu

SEQ ID NO: 264617 - RNA, 19 nt, Homo sapiens
agagcaagcugaucauccu

SEQ ID NO: 264618 - RNA, 19 nt, Homo sapiens
ugcccgagcucaccaaacu

SEQ ID NO: 264619 - RNA, 19 nt, Homo sapiens
cagcagcaagggcaucaug

SEQ ID NO: 264620 - RNA, 19 nt, Homo sapiens
caaguacccauucuguuuu

SEQ ID NO: 264621 - RNA, 19 nt, Homo sapiens
ugaaccgcauggagaucuu

SEQ ID NO: 264622 - RNA, 19 nt, Homo sapiens
uuguauagaccaaagcaaa

SEQ ID NO: 264623 - RNA, 19 nt, Homo sapiens
aaugagcccuauggagaug

SEQ ID NO: 264624 - RNA, 19 nt, Homo sapiens
acucgucgguggagaacau

SEQ ID NO: 264625 - RNA, 19 nt, Homo sapiens
gagaucuuccggcucaaca

SEQ ID NO: 264626 - RNA, 19 nt, Homo sapiens
gugugaggauggaggagau

SEQ ID NO: 264627 - RNA, 19 nt, Homo sapiens
aacaacagcaagaacaaga

SEQ ID NO: 264628 - RNA, 19 nt, Homo sapiens
caaccugacaugcaacaac

SEQ ID NO: 264629 - RNA, 19 nt, Homo sapiens
gcgcaaccucucagaugug

SEQ ID NO: 264630 - RNA, 19 nt, Homo sapiens
ggagagcaagcugaucauc

SEQ ID NO: 264631 - RNA, 19 nt, Homo sapiens
ggagucgguccuguucuau

SEQ ID NO: 264632 - RNA, 19 nt, Homo sapiens
gggcugcucgccaucuuca

SEQ ID NO: 264633 - RNA, 19 nt, Homo sapiens
gaauauaccuugagcauga

SEQ ID NO: 264634 - RNA, 19 nt, Homo sapiens
gcaguuacaugcauuauuu

SEQ ID NO: 264635 - RNA, 19 nt, Homo sapiens
gauauucugugacucauua

SEQ ID NO: 264636 - RNA, 19 nt, Homo sapiens
gaacaucaccggucacuuu

SEQ ID NO: 264637 - RNA, 19 nt, Homo sapiens
gaaauaagcugcuaaucag

SEQ ID NO: 264638 - RNA, 19 nt, Homo sapiens
caaagaagauggaauuaug

SEQ ID NO: 264639 - RNA, 19 nt, Homo sapiens
gaaauuaccugguucuaag

SEQ ID NO: 264640 - RNA, 19 nt, Homo sapiens
gaagaaauguuguucgaau

SEQ ID NO: 264641 - RNA, 19 nt, Homo sapiens
ggacaguuauuugcauuua

SEQ ID NO: 264642 - RNA, 19 nt, Homo sapiens
ucacauacaugguuugaaa

SEQ ID NO: 264643 - RNA, 19 nt, Homo sapiens
gggagucucugcauagaua

SEQ ID NO: 264644 - RNA, 19 nt, Homo sapiens
aaacauggauaccugauaa

SEQ ID NO: 264645 - RNA, 19 nt, Homo sapiens
cuaaauaucuguugcaugu

SEQ ID NO: 264646 - RNA, 19 nt, Homo sapiens
uaagaaacccagugaauuu

SEQ ID NO: 264647 - RNA, 19 nt, Homo sapiens
gaaagauacuaaacuguuc

SEQ ID NO: 264648 - RNA, 19 nt, Homo sapiens
caaguggucuguagaauuc

SEQ ID NO: 264649 - RNA, 19 nt, Homo sapiens
aaagaaagguguccauaug

SEQ ID NO: 264650 - RNA, 19 nt, Homo sapiens
guacaaagaagauggaauu

SEQ ID NO: 264651 - RNA, 19 nt, Homo sapiens
gaauaggccuguuuaaugc

SEQ ID NO: 264652 - RNA, 19 nt, Homo sapiens
ccacuaaacaacuugauua

SEQ ID NO: 264653 - RNA, 19 nt, Homo sapiens
guacauacugguucaauaa

SEQ ID NO: 264654 - RNA, 19 nt, Homo sapiens
gaaccuuucugcuucauuc

SEQ ID NO: 264655 - RNA, 19 nt, Homo sapiens
aaucaaaguucccucuaua

SEQ ID NO: 264656 - RNA, 19 nt, Homo sapiens
gaacacaauggcuaaauau

SEQ ID NO: 264657 - RNA, 19 nt, Homo sapiens
gaauuugcccuuuauaaga

SEQ ID NO: 264658 - RNA, 19 nt, Homo sapiens
cagaggaacucaaugaaau

SEQ ID NO: 264659 - RNA, 19 nt, Homo sapiens
acacuaagcguaaaucuaa

SEQ ID NO: 264660 - RNA, 19 nt, Homo sapiens
guagagaagauaagguuua

SEQ ID NO: 264661 - RNA, 19 nt, Homo sapiens
gcauuuaauucacccauau

SEQ ID NO: 264662 - RNA, 19 nt, Homo sapiens
ggacgcaucuggagacaag

SEQ ID NO: 264663 - RNA, 19 nt, Homo sapiens
ugagaaagccaguggauuu

SEQ ID NO: 264664 - RNA, 19 nt, Homo sapiens
agaacacaauggcuaaaua

SEQ ID NO: 264665 - RNA, 19 nt, Homo sapiens
uuacugaauuugcccuuua

SEQ ID NO: 264666 - RNA, 19 nt, Homo sapiens
ggacagacacggcugaaga

SEQ ID NO: 264667 - RNA, 19 nt, Homo sapiens
guugaaagcugcgaaguug

SEQ ID NO: 264668 - RNA, 19 nt, Homo sapiens
uuacaacauuugcuccuua

SEQ ID NO: 264669 - RNA, 19 nt, Homo sapiens
ccagaaagauacuaaacug

SEQ ID NO: 264670 - RNA, 19 nt, Homo sapiens
gcuaagaaguuauuauggu

SEQ ID NO: 264671 - RNA, 19 nt, Homo sapiens
ucaacugacugacauaaga

SEQ ID NO: 264672 - RNA, 19 nt, Homo sapiens
ggacagcuaagaaguuauu

SEQ ID NO: 264673 - RNA, 19 nt, Homo sapiens
ucccuaagcuugaauaaau

SEQ ID NO: 264674 - RNA, 19 nt, Homo sapiens
ugaaauaagcugcuaauca

SEQ ID NO: 264675 - RNA, 19 nt, Homo sapiens
ccagcgaauuuaaaucuaa

SEQ ID NO: 264676 - RNA, 19 nt, Homo sapiens
guuaugaaauuaccugguu

SEQ ID NO: 264677 - RNA, 19 nt, Homo sapiens
caaugcagauaauagcuuu

SEQ ID NO: 264678 - RNA, 19 nt, Homo sapiens
guagauuggugaagacaga

SEQ ID NO: 264679 - RNA, 19 nt, Homo sapiens
ccaccaugcucugcucuua

SEQ ID NO: 264680 - RNA, 19 nt, Homo sapiens
guccauaugucuuuaccua

SEQ ID NO: 264681 - RNA, 19 nt, Homo sapiens
gaaggacaguuauuugcau

SEQ ID NO: 264682 - RNA, 19 nt, Homo sapiens
ugauagagaaggacaguua

SEQ ID NO: 264683 - RNA, 19 nt, Homo sapiens
caaagaacagcuugugaaa

SEQ ID NO: 264684 - RNA, 19 nt, Homo sapiens
gcuccuuaaugaugaauuu

SEQ ID NO: 264685 - RNA, 19 nt, Homo sapiens
gaaggaauacucacauaca

SEQ ID NO: 264686 - RNA, 19 nt, Homo sapiens
gagcauguuuaaaucuuug

SEQ ID NO: 264687 - RNA, 19 nt, Homo sapiens
gaagaauaggccuguuuaa

SEQ ID NO: 264688 - RNA, 19 nt, Homo sapiens
gaagauggaauuauggaau

SEQ ID NO: 264689 - RNA, 19 nt, Homo sapiens
gcugcgaaguugacaauga

SEQ ID NO: 264690 - RNA, 19 nt, Homo sapiens
ucaaaggccuaaacugugu

SEQ ID NO: 264691 - RNA, 19 nt, Homo sapiens
caggucauguucuuucuaa

SEQ ID NO: 264692 - RNA, 19 nt, Homo sapiens
guuaaagucuacuggaaga

SEQ ID NO: 264693 - RNA, 19 nt, Homo sapiens
agagaaugaucuuuacuga

SEQ ID NO: 264694 - RNA, 19 nt, Homo sapiens
guguuucucuuauggauuu

SEQ ID NO: 264695 - RNA, 19 nt, Homo sapiens
ggauggauuuaucacauug

SEQ ID NO: 264696 - RNA, 19 nt, Homo sapiens
gugcugcucuuuaugcaaa

SEQ ID NO: 264697 - RNA, 19 nt, Homo sapiens
cgaagcaggucauguucuu

SEQ ID NO: 264698 - RNA, 19 nt, Homo sapiens
ccaagacucuguacaaagg

SEQ ID NO: 264699 - RNA, 19 nt, Homo sapiens
aaaccaacaugugcucuuu

SEQ ID NO: 264700 - RNA, 19 nt, Homo sapiens
ugacauacauugcaguuac

SEQ ID NO: 264701 - RNA, 19 nt, Homo sapiens
aagcuuacaucucccuuaa

SEQ ID NO: 264702 - RNA, 19 nt, Homo sapiens
gggauggauuuaucacauu

SEQ ID NO: 264703 - RNA, 19 nt, Homo sapiens
guacuugcuucuuguuguu

SEQ ID NO: 264704 - RNA, 19 nt, Homo sapiens
ccuauuaugugagagauuu

SEQ ID NO: 264705 - RNA, 19 nt, Homo sapiens
gcaaagguaaaucaaaguu

SEQ ID NO: 264706 - RNA, 19 nt, Homo sapiens
agaauaggccuguuuaaug

SEQ ID NO: 264707 - RNA, 19 nt, Homo sapiens
gcaaacacuuccguucuuc

SEQ ID NO: 264708 - RNA, 19 nt, Homo sapiens
ucaaauacauccuguuggu

SEQ ID NO: 264709 - RNA, 19 nt, Homo sapiens
guagaauucaugucccuua

SEQ ID NO: 264710 - RNA, 19 nt, Homo sapiens
ggauuuaucacauugaguu

SEQ ID NO: 264711 - RNA, 19 nt, Homo sapiens
caaugguacuugcuucuug

SEQ ID NO: 264712 - RNA, 19 nt, Homo sapiens
caaaguucccucuauaaau

SEQ ID NO: 264713 - RNA, 19 nt, Homo sapiens
ugaagaauaggccuguuua

SEQ ID NO: 264714 - RNA, 19 nt, Homo sapiens
gaacuucggccacgagaca

SEQ ID NO: 264715 - RNA, 19 nt, Homo sapiens
agucggagcucccuucuau

SEQ ID NO: 264716 - RNA, 19 nt, Homo sapiens
ggacaucccugugcaucau

SEQ ID NO: 264717 - RNA, 19 nt, Homo sapiens
ugucuuaccucuacugaau

SEQ ID NO: 264718 - RNA, 19 nt, Homo sapiens
gagaaccauugcuagagaa

SEQ ID NO: 264719 - RNA, 19 nt, Homo sapiens
ggaacuccauagaaugaug

SEQ ID NO: 264720 - RNA, 19 nt, Homo sapiens
gaaaguucauguugguucu

SEQ ID NO: 264721 - RNA, 19 nt, Homo sapiens
ggccggaguugaaggauug

SEQ ID NO: 264722 - RNA, 19 nt, Homo sapiens
caacagaacaaccggauca

SEQ ID NO: 264723 - RNA, 19 nt, Homo sapiens
gugacuauguuguggaauu

SEQ ID NO: 264724 - RNA, 19 nt, Homo sapiens
ugagaaccauugcuagaga

SEQ ID NO: 264725 - RNA, 19 nt, Homo sapiens
auacaucuguguccugaaa

SEQ ID NO: 264726 - RNA, 19 nt, Homo sapiens
aauaugacaugguagagaa

SEQ ID NO: 264727 - RNA, 19 nt, Homo sapiens
aaauacaggugguuaaucu

SEQ ID NO: 264728 - RNA, 19 nt, Homo sapiens
gaagcuuacaucucccuua

SEQ ID NO: 264729 - RNA, 19 nt, Homo sapiens
uuucuaaggugcuagcuaa

SEQ ID NO: 264730 - RNA, 19 nt, Homo sapiens
gcaaguauaaggugacugu

SEQ ID NO: 264731 - RNA, 19 nt, Homo sapiens
gugaagaaauguuguucga

SEQ ID NO: 264732 - RNA, 19 nt, Homo sapiens
auacagagguucaucucaa

SEQ ID NO: 264733 - RNA, 19 nt, Homo sapiens
guaucaaagucaccaaaua

SEQ ID NO: 264734 - RNA, 19 nt, Homo sapiens
caucaggguucucuuauca

SEQ ID NO: 264735 - RNA, 19 nt, Homo sapiens
gaagaggacaacagccuuu

SEQ ID NO: 264736 - RNA, 19 nt, Homo sapiens
caggugggcuggacuucua

SEQ ID NO: 264737 - RNA, 19 nt, Homo sapiens
agacaacgcugagcucaug

SEQ ID NO: 264738 - RNA, 19 nt, Homo sapiens
gacaagagcaguuucaucu

SEQ ID NO: 264739 - RNA, 19 nt, Homo sapiens
gagcugagaucgugcuacu

SEQ ID NO: 264740 - RNA, 19 nt, Homo sapiens
ucaaggguguguauauugu

SEQ ID NO: 264741 - RNA, 19 nt, Homo sapiens
ccucaaggguguguauauu

SEQ ID NO: 264742 - RNA, 19 nt, Homo sapiens
caucgugacugagcucauu

SEQ ID NO: 264743 - RNA, 19 nt, Homo sapiens
gcacguccauuccgaagac

SEQ ID NO: 264744 - RNA, 19 nt, Homo sapiens
gcccaucaggguucucuua

SEQ ID NO: 264745 - RNA, 19 nt, Homo sapiens
guacugaggcagcugcuau

SEQ ID NO: 264746 - RNA, 19 nt, Homo sapiens
gcaggagaauggugugaac

SEQ ID NO: 264747 - RNA, 19 nt, Homo sapiens
gaaaccccgucucuacuaa

SEQ ID NO: 264748 - RNA, 19 nt, Homo sapiens
gcagaagugggcccuguga

SEQ ID NO: 264749 - RNA, 19 nt, Homo sapiens
caccaaauacuuucucuuc

SEQ ID NO: 264750 - RNA, 19 nt, Homo sapiens
acgcugagcucaugaaucg

SEQ ID NO: 264751 - RNA, 19 nt, Homo sapiens
ccaaauacuuucucuuccu

SEQ ID NO: 264752 - RNA, 19 nt, Homo sapiens
aggcguggcugcaggagaa

SEQ ID NO: 264753 - RNA, 19 nt, Homo sapiens
ccugaggacuggccugugu

SEQ ID NO: 264754 - RNA, 19 nt, Homo sapiens
caacuugaucuucuuuauc

SEQ ID NO: 264755 - RNA, 19 nt, Homo sapiens
ucgagaccauccuggcuaa

SEQ ID NO: 264756 - RNA, 19 nt, Homo sapiens
uuucaucucuguccugcaa

SEQ ID NO: 264757 - RNA, 19 nt, Homo sapiens
uaucaaagucaccaaauac

SEQ ID NO: 264758 - RNA, 19 nt, Homo sapiens
gcggugcucacgccuguaa

SEQ ID NO: 264759 - RNA, 19 nt, Homo sapiens
caaggguguguauauugua

SEQ ID NO: 264760 - RNA, 19 nt, Homo sapiens
gcaccuguagucccagcua

SEQ ID NO: 264761 - RNA, 19 nt, Homo sapiens
gucaggagaucgagaccau

SEQ ID NO: 264762 - RNA, 19 nt, Homo sapiens
ccuguaaucccagcacuuu

SEQ ID NO: 264763 - RNA, 19 nt, Homo sapiens
ccaucaggguucucuuauc

SEQ ID NO: 264764 - RNA, 19 nt, Homo sapiens
acagcaagguccccaagua

SEQ ID NO: 264765 - RNA, 19 nt, Homo sapiens
cgacaagagcaguuucauc

SEQ ID NO: 264766 - RNA, 19 nt, Homo sapiens
aaggguguguauauuguau

SEQ ID NO: 264767 - RNA, 19 nt, Homo sapiens
guucucuuaucaacucaga

SEQ ID NO: 264768 - RNA, 19 nt, Homo sapiens
gaggacaacagccuuucug

SEQ ID NO: 264769 - RNA, 19 nt, Homo sapiens
ggcagucacuaugcucaug

SEQ ID NO: 264770 - RNA, 19 nt, Homo sapiens
ucaggguucucuuaucaac

SEQ ID NO: 264771 - RNA, 19 nt, Homo sapiens
gaucucuccuggccuaucc

SEQ ID NO: 264772 - RNA, 19 nt, Homo sapiens
caacaugggcaagcugaag

SEQ ID NO: 264773 - RNA, 19 nt, Homo sapiens
gagaccauccuggcuaaca

SEQ ID NO: 264774 - RNA, 19 nt, Homo sapiens
ugggucagcuucuacaacu

SEQ ID NO: 264775 - RNA, 19 nt, Homo sapiens
ggagaaccugggcaucauc

SEQ ID NO: 264776 - RNA, 19 nt, Homo sapiens
ccucuucuacuucaacaug

SEQ ID NO: 264777 - RNA, 19 nt, Homo sapiens
agaccauccuggcuaacau

SEQ ID NO: 264778 - RNA, 19 nt, Homo sapiens
gcucagccuguaucaaagu

SEQ ID NO: 264779 - RNA, 19 nt, Homo sapiens
gaccauccuggcuaacaug

SEQ ID NO: 264780 - RNA, 19 nt, Homo sapiens
cugcacugguuucguggaa

SEQ ID NO: 264781 - RNA, 19 nt, Homo sapiens
uacuuucucuuccucuuca

SEQ ID NO: 264782 - RNA, 19 nt, Homo sapiens
caacgcugagcucaugaau

SEQ ID NO: 264783 - RNA, 19 nt, Homo sapiens
gcucuaagaucaucacaua

SEQ ID NO: 264784 - RNA, 19 nt, Homo sapiens
gaagagagacaaggaauua

SEQ ID NO: 264785 - RNA, 19 nt, Homo sapiens
gaaacgaaccucuuugaaa

SEQ ID NO: 264786 - RNA, 19 nt, Homo sapiens
ugacugacaucaccuuaaa

SEQ ID NO: 264787 - RNA, 19 nt, Homo sapiens
ccagaacucuaucauaaga

SEQ ID NO: 264788 - RNA, 19 nt, Homo sapiens
gaaggaggccaaacagaaa

SEQ ID NO: 264789 - RNA, 19 nt, Homo sapiens
gaaucaacaugguagaaga

SEQ ID NO: 264790 - RNA, 19 nt, Homo sapiens
ggacaugaacuuauauaug

SEQ ID NO: 264791 - RNA, 19 nt, Homo sapiens
gagcugggauuccuagaga

SEQ ID NO: 264792 - RNA, 19 nt, Homo sapiens
gauugaaacucccaugaug

SEQ ID NO: 264793 - RNA, 19 nt, Homo sapiens
cuccagaacucuaucauaa

SEQ ID NO: 264794 - RNA, 19 nt, Homo sapiens
guacugcccuggaauaugg

SEQ ID NO: 264795 - RNA, 19 nt, Homo sapiens
ccaagccuuucaucacuua

SEQ ID NO: 264796 - RNA, 19 nt, Homo sapiens
ccugaaagcugagaagaaa

SEQ ID NO: 264797 - RNA, 19 nt, Homo sapiens
ggaugaagcugccagaaac

SEQ ID NO: 264798 - RNA, 19 nt, Homo sapiens
gagaauugcuccagaacuc

SEQ ID NO: 264799 - RNA, 19 nt, Homo sapiens
acaacgagcuggacaugaa

SEQ ID NO: 264800 - RNA, 19 nt, Homo sapiens
ugaagaaacucgcaaaauu

SEQ ID NO: 264801 - RNA, 19 nt, Homo sapiens
aaacgaaccucuuugaaac

SEQ ID NO: 264802 - RNA, 19 nt, Homo sapiens
cgaccggguuuaugaaauu

SEQ ID NO: 264803 - RNA, 19 nt, Homo sapiens
ccacacaaguuccauguag

SEQ ID NO: 264804 - RNA, 19 nt, Homo sapiens
gaagaaagagauaugcaau

SEQ ID NO: 264805 - RNA, 19 nt, Homo sapiens
gaaccucuuugaaacugaa

SEQ ID NO: 264806 - RNA, 19 nt, Homo sapiens
ggaaagcucaucuucuaug

SEQ ID NO: 264807 - RNA, 19 nt, Homo sapiens
ggggaaagcucaucuucua

SEQ ID NO: 264808 - RNA, 19 nt, Homo sapiens
gguagaagagcuugagaaa

SEQ ID NO: 264809 - RNA, 19 nt, Homo sapiens
ggacccaaaucaauacuac

SEQ ID NO: 264810 - RNA, 19 nt, Homo sapiens
gaagaaaguagcagagaag

SEQ ID NO: 264811 - RNA, 19 nt, Homo sapiens
cuaaagagggucugacuga

SEQ ID NO: 264812 - RNA, 19 nt, Homo sapiens
ggacgccaguuccggaaug

SEQ ID NO: 264813 - RNA, 19 nt, Homo sapiens
gaugaaaacuucuguacug

SEQ ID NO: 264814 - RNA, 19 nt, Homo sapiens
ggauugauuugacgcacaa

SEQ ID NO: 264815 - RNA, 19 nt, Homo sapiens
caacaucaaggaaguacuu

SEQ ID NO: 264816 - RNA, 19 nt, Homo sapiens
agaagaaaguagcagagaa

SEQ ID NO: 264817 - RNA, 19 nt, Homo sapiens
ccaacaacaucaaggaagu

SEQ ID NO: 264818 - RNA, 19 nt, Homo sapiens
ggaaaucacggagaagaug

SEQ ID NO: 264819 - RNA, 19 nt, Homo sapiens
ggaaugaggggauugauuu

SEQ ID NO: 264820 - RNA, 19 nt, Homo sapiens
gggaugaagcugccagaaa

SEQ ID NO: 264821 - RNA, 19 nt, Homo sapiens
gggauggugaagcauauua

SEQ ID NO: 264822 - RNA, 19 nt, Homo sapiens
gcaucgaccggguuuauga

SEQ ID NO: 264823 - RNA, 19 nt, Homo sapiens
gaagacccauacccacaca

SEQ ID NO: 264824 - RNA, 19 nt, Homo sapiens
gaucacccacagauaauga

SEQ ID NO: 264825 - RNA, 19 nt, Homo sapiens
uaugagaauugcuccagaa

SEQ ID NO: 264826 - RNA, 19 nt, Homo sapiens
gaaacucccaugaugaaca

SEQ ID NO: 264827 - RNA, 19 nt, Homo sapiens
gauccugaaugacuuugug

SEQ ID NO: 264828 - RNA, 19 nt, Homo sapiens
ggccaaggcugcaggugau

SEQ ID NO: 264829 - RNA, 19 nt, Homo sapiens
cuaaauggcaccgcucuaa

SEQ ID NO: 264830 - RNA, 19 nt, Homo sapiens
cagaaacgaaccucuuuga

SEQ ID NO: 264831 - RNA, 19 nt, Homo sapiens
ucauggaaaucacggagaa

SEQ ID NO: 264832 - RNA, 19 nt, Homo sapiens
gagcaagaaugagcugaag

SEQ ID NO: 264833 - RNA, 19 nt, Homo sapiens
agaaggaggccaaacagaa

SEQ ID NO: 264834 - RNA, 19 nt, Homo sapiens
gcuuugagcuguuugucau

SEQ ID NO: 264835 - RNA, 19 nt, Homo sapiens
gcuccagaacucuaucaua

SEQ ID NO: 264836 - RNA, 19 nt, Homo sapiens
gagauugaaacucccauga

SEQ ID NO: 264837 - RNA, 19 nt, Homo sapiens
gggaucaccugacugacau

SEQ ID NO: 264838 - RNA, 19 nt, Homo sapiens
gcguggacccaaaucaaua

SEQ ID NO: 264839 - RNA, 19 nt, Homo sapiens
caacaacaucaaggaagua

SEQ ID NO: 264840 - RNA, 19 nt, Homo sapiens
gaggccauguucauagaug

SEQ ID NO: 264841 - RNA, 19 nt, Homo sapiens
gaagaaacucgcaaaauuc

SEQ ID NO: 264842 - RNA, 19 nt, Homo sapiens
gcaagaaugagcugaagag

SEQ ID NO: 264843 - RNA, 19 nt, Homo sapiens
gaauugcuccagaacucua

SEQ ID NO: 264844 - RNA, 19 nt, Homo sapiens
gagcuggacaugaacuuau

SEQ ID NO: 264845 - RNA, 19 nt, Homo sapiens
agaaagagauaugcaaugc

SEQ ID NO: 264846 - RNA, 19 nt, Homo sapiens
caucaauccuacauucauc

SEQ ID NO: 264847 - RNA, 19 nt, Homo sapiens
gagaagaaaguagcagaga

SEQ ID NO: 264848 - RNA, 19 nt, Homo sapiens
agaacucuaucauaagaug

SEQ ID NO: 264849 - RNA, 19 nt, Homo sapiens
ccaccaaccacaccacuga

SEQ ID NO: 264850 - RNA, 19 nt, Homo sapiens
cgaaacugagcaagaauga

SEQ ID NO: 264851 - RNA, 19 nt, Homo sapiens
gagcguggacccaaaucaa

SEQ ID NO: 264852 - RNA, 19 nt, Homo sapiens
uaaauggcaccgcucuaaa

SEQ ID NO: 264853 - RNA, 19 nt, Homo sapiens
ggcaaaagcuguugaaugc

SEQ ID NO: 264854 - RNA, 19 nt, Homo sapiens
ccaaccacaccacugauaa

SEQ ID NO: 264855 - RNA, 19 nt, Homo sapiens
agagagacaaggaauuaaa

SEQ ID NO: 264856 - RNA, 19 nt, Homo sapiens
gccagaaacgaaccucuuu

SEQ ID NO: 264857 - RNA, 19 nt, Homo sapiens
caacaugguagaagagcuu

SEQ ID NO: 264858 - RNA, 19 nt, Homo sapiens
ggccaagccuuucaucacu

SEQ ID NO: 264859 - RNA, 19 nt, Homo sapiens
gagccgaaacugagcaaga

SEQ ID NO: 264860 - RNA, 19 nt, Homo sapiens
gagaaggaggccaaacaga

SEQ ID NO: 264861 - RNA, 19 nt, Homo sapiens
ccagagauacuuggacuug

SEQ ID NO: 264862 - RNA, 19 nt, Homo sapiens
gaauguagcaaccacugau

SEQ ID NO: 264863 - RNA, 19 nt, Homo sapiens
agagauacuuggacuugau

SEQ ID NO: 264864 - RNA, 19 nt, Homo sapiens
caucuucuaugaucuucga

SEQ ID NO: 264865 - RNA, 19 nt, Homo sapiens
caugaaacccgaagacaag

SEQ ID NO: 264866 - RNA, 19 nt, Homo sapiens
gaaagcugagaagaaagua

SEQ ID NO: 264867 - RNA, 19 nt, Homo sapiens
cagggauggugaagcauau

SEQ ID NO: 264868 - RNA, 19 nt, Homo sapiens
gcucaaagacaaggaaaca

SEQ ID NO: 264869 - RNA, 19 nt, Homo sapiens
guucagccaucagaagaga

SEQ ID NO: 264870 - RNA, 19 nt, Homo sapiens
uugcauauguuaccucauc

SEQ ID NO: 264871 - RNA, 19 nt, Homo sapiens
ugacaccgcaguucuguuc

SEQ ID NO: 264872 - RNA, 19 nt, Homo sapiens
gcagucaagcaauucauca

SEQ ID NO: 264873 - RNA, 19 nt, Homo sapiens
aaacucccaugaugaacau

SEQ ID NO: 264874 - RNA, 19 nt, Homo sapiens
gaucgagucgccauguuuc

SEQ ID NO: 264875 - RNA, 19 nt, Homo sapiens
ucagggauggugaagcaua

SEQ ID NO: 264876 - RNA, 19 nt, Homo sapiens
gccaagccuuucaucacuu

SEQ ID NO: 264877 - RNA, 19 nt, Homo sapiens
uggacuugauccugaauga

SEQ ID NO: 264878 - RNA, 19 nt, Homo sapiens
cagagauacuuggacuuga

SEQ ID NO: 264879 - RNA, 19 nt, Homo sapiens
ucaaagacaaggaaacaag

SEQ ID NO: 264880 - RNA, 19 nt, Homo sapiens
ccaugaaacccgaagacaa

SEQ ID NO: 264881 - RNA, 19 nt, Homo sapiens
ugaagaaagagauaugcaa

SEQ ID NO: 264882 - RNA, 19 nt, Homo sapiens
uugcaucaauccuacauuc

SEQ ID NO: 264883 - RNA, 19 nt, Homo sapiens
cgagauagcugagcaggaa

SEQ ID NO: 264884 - RNA, 19 nt, Homo sapiens
uagcauagcccauuauaga

SEQ ID NO: 264885 - RNA, 19 nt, Homo sapiens
uaacuuagccucugacagu

SEQ ID NO: 264886 - RNA, 19 nt, Homo sapiens
ucgaagaggauaugaauaa

SEQ ID NO: 264887 - RNA, 19 nt, Homo sapiens
gagcaaguaugaguacaug

SEQ ID NO: 264888 - RNA, 19 nt, Homo sapiens
gaaacgcugugcaucaucu

SEQ ID NO: 264889 - RNA, 19 nt, Homo sapiens
gaucgaagaggauaugaau

SEQ ID NO: 264890 - RNA, 19 nt, Homo sapiens
caucauuccuuauuucauc

SEQ ID NO: 264891 - RNA, 19 nt, Homo sapiens
gcaagcuacugaccgaugu

SEQ ID NO: 264892 - RNA, 19 nt, Homo sapiens
uaucagaacugccaauugc

SEQ ID NO: 264893 - RNA, 19 nt, Homo sapiens
ucaagacccuggcgcaguu

SEQ ID NO: 264894 - RNA, 19 nt, Homo sapiens
ccgaggagaucaaguuuua

SEQ ID NO: 264895 - RNA, 19 nt, Homo sapiens
gagucgcacuucuccagua

SEQ ID NO: 264896 - RNA, 19 nt, Homo sapiens
gcuacugaccgauguuuaa

SEQ ID NO: 264897 - RNA, 19 nt, Homo sapiens
gcccguaccugucauugug

SEQ ID NO: 264898 - RNA, 19 nt, Homo sapiens
ggccagacccucaaagcua

SEQ ID NO: 264899 - RNA, 19 nt, Homo sapiens
gcaaguaugaguacaugga

SEQ ID NO: 264900 - RNA, 19 nt, Homo sapiens
ccacggucaucuacaauuc

SEQ ID NO: 264901 - RNA, 19 nt, Homo sapiens
ggugacauguacccuguga

SEQ ID NO: 264902 - RNA, 19 nt, Homo sapiens
aauaagagcaagcuacuga

SEQ ID NO: 264903 - RNA, 19 nt, Homo sapiens
ugccaucgcuggugugcua

SEQ ID NO: 264904 - RNA, 19 nt, Homo sapiens
ccaauugcaccacagcuaa

SEQ ID NO: 264905 - RNA, 19 nt, Homo sapiens
cgaagaggauaugaauaau

SEQ ID NO: 264906 - RNA, 19 nt, Homo sapiens
caucuacaauuccaacauc

SEQ ID NO: 264907 - RNA, 19 nt, Homo sapiens
ggacgagggcuucaucaag

SEQ ID NO: 264908 - RNA, 19 nt, Homo sapiens
gcgaggaggccauggagaa

SEQ ID NO: 264909 - RNA, 19 nt, Homo sapiens
cauguacccugugacaauu

SEQ ID NO: 264910 - RNA, 19 nt, Homo sapiens
ggccaucauuccuuauuuc

SEQ ID NO: 264911 - RNA, 19 nt, Homo sapiens
gaucaaguuuuacgaguug

SEQ ID NO: 264912 - RNA, 19 nt, Homo sapiens
gaggaacgaguacuucuuc

SEQ ID NO: 264913 - RNA, 19 nt, Homo sapiens
gaucgugggcuccuugugu

SEQ ID NO: 264914 - RNA, 19 nt, Homo sapiens
uagcugagcaggaaggaaa

SEQ ID NO: 264915 - RNA, 19 nt, Homo sapiens
acaccacggucaucuacaa

SEQ ID NO: 264916 - RNA, 19 nt, Homo sapiens
cgcaguuccucuacuauga

SEQ ID NO: 264917 - RNA, 19 nt, Homo sapiens
gaacuucauagacauugug

SEQ ID NO: 264918 - RNA, 19 nt, Homo sapiens
aaccaaaacugcguuaaua

SEQ ID NO: 264919 - RNA, 19 nt, Homo sapiens
gcauagcccauuauagaca

SEQ ID NO: 264920 - RNA, 19 nt, Homo sapiens
gcuggugugcuaacaauug

SEQ ID NO: 264921 - RNA, 19 nt, Homo sapiens
cauuauagacaggucaaua

SEQ ID NO: 264922 - RNA, 19 nt, Homo sapiens
aauaauagcauagcccauu

SEQ ID NO: 264923 - RNA, 19 nt, Homo sapiens
ggagaucgaagaggauaug

SEQ ID NO: 264924 - RNA, 19 nt, Homo sapiens
caugaccacuguaggauac

SEQ ID NO: 264925 - RNA, 19 nt, Homo sapiens
ucaaagcuaguaugagaga

SEQ ID NO: 264926 - RNA, 19 nt, Homo sapiens
uaggauacggugacaugua

SEQ ID NO: 264927 - RNA, 19 nt, Homo sapiens
gaggauaugaauaauagca

SEQ ID NO: 264928 - RNA, 19 nt, Homo sapiens
uggccaucauuccuuauuu

SEQ ID NO: 264929 - RNA, 19 nt, Homo sapiens
caacaccacggucaucuac

SEQ ID NO: 264930 - RNA, 19 nt, Homo sapiens
gccaauugcaccacagcua

SEQ ID NO: 264931 - RNA, 19 nt, Homo sapiens
cgccgcaguuccucuacua

SEQ ID NO: 264932 - RNA, 19 nt, Homo sapiens
gcaagaucgugggcuccuu

SEQ ID NO: 264933 - RNA, 19 nt, Homo sapiens
agacaggucaauaucagaa

SEQ ID NO: 264934 - RNA, 19 nt, Homo sapiens
aauagcauagcccauuaua

SEQ ID NO: 264935 - RNA, 19 nt, Homo sapiens
gcaggaaggaaaccagaag

SEQ ID NO: 264936 - RNA, 19 nt, Homo sapiens
ggaacgaguacuucuucga

SEQ ID NO: 264937 - RNA, 19 nt, Homo sapiens
guacauggagaucgaagag

SEQ ID NO: 264938 - RNA, 19 nt, Homo sapiens
ugacauguacccugugaca

SEQ ID NO: 264939 - RNA, 19 nt, Homo sapiens
ccaugaccacuguaggaua

SEQ ID NO: 264940 - RNA, 19 nt, Homo sapiens
gcugggcaacccuaagaaa

SEQ ID NO: 264941 - RNA, 19 nt, Homo sapiens
gaaacgcaugcgcuacuuc

SEQ ID NO: 264942 - RNA, 19 nt, Homo sapiens
caaaacugcguuaauaaga

SEQ ID NO: 264943 - RNA, 19 nt, Homo sapiens
guggaaacgcugugcauca

SEQ ID NO: 264944 - RNA, 19 nt, Homo sapiens
cuacaauuccaacaucuuc

SEQ ID NO: 264945 - RNA, 19 nt, Homo sapiens
uguggcugcucuucgagua

SEQ ID NO: 264946 - RNA, 19 nt, Homo sapiens
ggaggacgagggcuucauc

SEQ ID NO: 264947 - RNA, 19 nt, Homo sapiens
ucgacgccauccucuacua

SEQ ID NO: 264948 - RNA, 19 nt, Homo sapiens
aggaggccauggagaaguu

SEQ ID NO: 264949 - RNA, 19 nt, Homo sapiens
gcgagcgcguggugaucaa

SEQ ID NO: 264950 - RNA, 19 nt, Homo sapiens
ucgcuggugugcuaacaau

SEQ ID NO: 264951 - RNA, 19 nt, Homo sapiens
gcuagggcugcucaucuuu

SEQ ID NO: 264952 - RNA, 19 nt, Homo sapiens
uggaaacgcugugcaucau

SEQ ID NO: 264953 - RNA, 19 nt, Homo sapiens
ugaaggaugacaaggacuu

SEQ ID NO: 264954 - RNA, 19 nt, Homo sapiens
uauagacaggucaauauca

SEQ ID NO: 264955 - RNA, 19 nt, Homo sapiens
acauguacccugugacaau

SEQ ID NO: 264956 - RNA, 19 nt, Homo sapiens
agaaacgcaugcgcuacuu

SEQ ID NO: 264957 - RNA, 19 nt, Homo sapiens
uguguccaauuucaacuau

SEQ ID NO: 264958 - RNA, 19 nt, Homo sapiens
acgccauccucuacuacua

SEQ ID NO: 264959 - RNA, 19 nt, Homo sapiens
aggauacggugacauguac

SEQ ID NO: 264960 - RNA, 19 nt, Homo sapiens
gacauuguggccaucauuc

SEQ ID NO: 264961 - RNA, 19 nt, Homo sapiens
caucuccaucgucaucuuu

SEQ ID NO: 264962 - RNA, 19 nt, Homo sapiens
auagacaggucaauaucag

SEQ ID NO: 264963 - RNA, 19 nt, Homo sapiens
gaccucagucgccgcaguu

SEQ ID NO: 264964 - RNA, 19 nt, Homo sapiens
uuguggccaucauuccuua

SEQ ID NO: 264965 - RNA, 19 nt, Homo sapiens
ggaaacgcugugcaucauc

SEQ ID NO: 264966 - RNA, 19 nt, Homo sapiens
uguaggauacggugacaug

SEQ ID NO: 264967 - RNA, 19 nt, Homo sapiens
gacaauuggaggcaagauc

SEQ ID NO: 264968 - RNA, 19 nt, Homo sapiens
agacauuguggccaucauu

SEQ ID NO: 264969 - RNA, 19 nt, Homo sapiens
auuccaacaucuucacaga

SEQ ID NO: 264970 - RNA, 19 nt, Homo sapiens
guccaugaccacuguagga

SEQ ID NO: 264971 - RNA, 19 nt, Homo sapiens
cuagugcaguguacuuugc

SEQ ID NO: 264972 - RNA, 19 nt, Homo sapiens
ggacagaguuggcugagaa

SEQ ID NO: 264973 - RNA, 19 nt, Homo sapiens
cauaauagccugcauugua

SEQ ID NO: 264974 - RNA, 19 nt, Homo sapiens
agaagugccucuaccauua

SEQ ID NO: 264975 - RNA, 19 nt, Homo sapiens
gcagguguguuaacuauug

SEQ ID NO: 264976 - RNA, 19 nt, Homo sapiens
gaacaucauugacauugug

SEQ ID NO: 264977 - RNA, 19 nt, Homo sapiens
gaaugugcccuuagauaua

SEQ ID NO: 264978 - RNA, 19 nt, Homo sapiens
gagaggaacaggcccaaua

SEQ ID NO: 264979 - RNA, 19 nt, Homo sapiens
gauuauagcuauugugucu

SEQ ID NO: 264980 - RNA, 19 nt, Homo sapiens
ggaacaggcccaauacuug

SEQ ID NO: 264981 - RNA, 19 nt, Homo sapiens
gaauugggccuccugauau

SEQ ID NO: 264982 - RNA, 19 nt, Homo sapiens
caaagaaacgaaugaggua

SEQ ID NO: 264983 - RNA, 19 nt, Homo sapiens
aauguuaacugaugucuga

SEQ ID NO: 264984 - RNA, 19 nt, Homo sapiens
uaacugaugucugauugaa

SEQ ID NO: 264985 - RNA, 19 nt, Homo sapiens
ccaaaggucuccagauucu

SEQ ID NO: 264986 - RNA, 19 nt, Homo sapiens
uaacaguaaugaggacuuu

SEQ ID NO: 264987 - RNA, 19 nt, Homo sapiens
uguguuaacuauugccuua

SEQ ID NO: 264988 - RNA, 19 nt, Homo sapiens
guaaugaggacuuuagaga

SEQ ID NO: 264989 - RNA, 19 nt, Homo sapiens
caugacaacuguaggcuau

SEQ ID NO: 264990 - RNA, 19 nt, Homo sapiens
cacagacccuuucuucauu

SEQ ID NO: 264991 - RNA, 19 nt, Homo sapiens
ggaugagaaugaagacaug

SEQ ID NO: 264992 - RNA, 19 nt, Homo sapiens
gaaccgcccuagcuuugau

SEQ ID NO: 264993 - RNA, 19 nt, Homo sapiens
gcagucgucuccaugacaa

SEQ ID NO: 264994 - RNA, 19 nt, Homo sapiens
caauggaacuaaugcagau

SEQ ID NO: 264995 - RNA, 19 nt, Homo sapiens
gcaguccacuuccuucaca

SEQ ID NO: 264996 - RNA, 19 nt, Homo sapiens
aagaagcgauggagauguu

SEQ ID NO: 264997 - RNA, 19 nt, Homo sapiens
gugaaugugcccuuagaua

SEQ ID NO: 264998 - RNA, 19 nt, Homo sapiens
ggaguugggcugccuguug

SEQ ID NO: 264999 - RNA, 19 nt, Homo sapiens
gaugucugauugaaaccua

SEQ ID NO: 265000 - RNA, 19 nt, Homo sapiens
guuaacugaugucugauug

SEQ ID NO: 265001 - RNA, 19 nt, Homo sapiens
agaauugggccuccugaua

SEQ ID NO: 265002 - RNA, 19 nt, Homo sapiens
cuccaaaggucuccagauu

SEQ ID NO: 265003 - RNA, 19 nt, Homo sapiens
gagacacucugcaucaucu

SEQ ID NO: 265004 - RNA, 19 nt, Homo sapiens
gagaagaagcgauggagau

SEQ ID NO: 265005 - RNA, 19 nt, Homo sapiens
ggagacagagggagaggaa

SEQ ID NO: 265006 - RNA, 19 nt, Homo sapiens
ugaaugugcccuuagauau

SEQ ID NO: 265007 - RNA, 19 nt, Homo sapiens
gcaauaguugugcaaguga

SEQ ID NO: 265008 - RNA, 19 nt, Homo sapiens
gcauggaaagcaauaguug

SEQ ID NO: 265009 - RNA, 19 nt, Homo sapiens
auaauagccugcauuguag

SEQ ID NO: 265010 - RNA, 19 nt, Homo sapiens
gcccuuagauauauucucu

SEQ ID NO: 265011 - RNA, 19 nt, Homo sapiens
ucucagggcugcgguuuga

SEQ ID NO: 265012 - RNA, 19 nt, Homo sapiens
ggccaaugcuccugugcuu

SEQ ID NO: 265013 - RNA, 19 nt, Homo sapiens
ggagacaugguuccgacua

SEQ ID NO: 265014 - RNA, 19 nt, Homo sapiens
gcuucugucuggaaacauu

SEQ ID NO: 265015 - RNA, 19 nt, Homo sapiens
aaguguggcuucucuuuga

SEQ ID NO: 265016 - RNA, 19 nt, Homo sapiens
ccuuagauauauucucuga

SEQ ID NO: 265017 - RNA, 19 nt, Homo sapiens
ugacucaccauuauuucua

SEQ ID NO: 265018 - RNA, 19 nt, Homo sapiens
ucaccaacaucaugaacau

SEQ ID NO: 265019 - RNA, 19 nt, Homo sapiens
ucacagacccuuucuucau

SEQ ID NO: 265020 - RNA, 19 nt, Homo sapiens
ggagauguuucgggaagau

SEQ ID NO: 265021 - RNA, 19 nt, Homo sapiens
gaccacgagugcugugaga

SEQ ID NO: 265022 - RNA, 19 nt, Homo sapiens
ccauuaguaagucugauua

SEQ ID NO: 265023 - RNA, 19 nt, Homo sapiens
ggaaacauugcccaucuuc

SEQ ID NO: 265024 - RNA, 19 nt, Homo sapiens
auucugaucucaauuguca

SEQ ID NO: 265025 - RNA, 19 nt, Homo sapiens
caauaguugugcaagugaa

SEQ ID NO: 265026 - RNA, 19 nt, Homo sapiens
gaaagcaauaguugugcaa

SEQ ID NO: 265027 - RNA, 19 nt, Homo sapiens
gaggaaaacuugaaaacag

SEQ ID NO: 265028 - RNA, 19 nt, Homo sapiens
gaagacgugaugaggaguu

SEQ ID NO: 265029 - RNA, 19 nt, Homo sapiens
uaaagaccuuagcccaguu

SEQ ID NO: 265030 - RNA, 19 nt, Homo sapiens
gugagaggguggugaucaa

SEQ ID NO: 265031 - RNA, 19 nt, Homo sapiens
gacccuuucuucauuguag

SEQ ID NO: 265032 - RNA, 19 nt, Homo sapiens
uuuaugagcugggagaaga

SEQ ID NO: 265033 - RNA, 19 nt, Homo sapiens
aaugugcccuuagauauau

SEQ ID NO: 265034 - RNA, 19 nt, Homo sapiens
cgauugaggcgaccuguga

SEQ ID NO: 265035 - RNA, 19 nt, Homo sapiens
ccuccgaaaugaguacuuu

SEQ ID NO: 265036 - RNA, 19 nt, Homo sapiens
gcucggcugucuucaaguc

SEQ ID NO: 265037 - RNA, 19 nt, Homo sapiens
ccaggaggguguaaauaac

SEQ ID NO: 265038 - RNA, 19 nt, Homo sapiens
gaagugccucuaccauuag

SEQ ID NO: 265039 - RNA, 19 nt, Homo sapiens
agacaaguguggcuucucu

SEQ ID NO: 265040 - RNA, 19 nt, Homo sapiens
gaagaaauucgguuuuaug

SEQ ID NO: 265041 - RNA, 19 nt, Homo sapiens
aaacgaaugagguacuuug

SEQ ID NO: 265042 - RNA, 19 nt, Homo sapiens
guaccuuggcuaacacaaa

SEQ ID NO: 265043 - RNA, 19 nt, Homo sapiens
gaaacgaaugagguacuuu

SEQ ID NO: 265044 - RNA, 19 nt, Homo sapiens
uugcagguguguuaacuau

SEQ ID NO: 265045 - RNA, 19 nt, Homo sapiens
ucucuagugcuguguauuu

SEQ ID NO: 265046 - RNA, 19 nt, Homo sapiens
caucaucugguucuccuuu

SEQ ID NO: 265047 - RNA, 19 nt, Homo sapiens
gaggcgaccugugaaugug

SEQ ID NO: 265048 - RNA, 19 nt, Homo sapiens
uccaggaggguguaaauaa

SEQ ID NO: 265049 - RNA, 19 nt, Homo sapiens
guucuccuuugaauucuug

SEQ ID NO: 265050 - RNA, 19 nt, Homo sapiens
gaagacaugcaugguagug

SEQ ID NO: 265051 - RNA, 19 nt, Homo sapiens
cgagugagaagacgugaug

SEQ ID NO: 265052 - RNA, 19 nt, Homo sapiens
agacccagcuaaagaccuu

SEQ ID NO: 265053 - RNA, 19 nt, Homo sapiens
gauccaggaggguguaaau

SEQ ID NO: 265054 - RNA, 19 nt, Homo sapiens
gagacaugguuccgacuac

SEQ ID NO: 265055 - RNA, 19 nt, Homo sapiens
uguggcuucucuuugaaua

SEQ ID NO: 265056 - RNA, 19 nt, Homo sapiens
gaucggaaccgcccuagcu

SEQ ID NO: 265057 - RNA, 19 nt, Homo sapiens
gguuugagacccagcuaaa

SEQ ID NO: 265058 - RNA, 19 nt, Homo sapiens
aauugggccuccugauauu

SEQ ID NO: 265059 - RNA, 19 nt, Homo sapiens
acagacccuuucuucauug

SEQ ID NO: 265060 - RNA, 19 nt, Homo sapiens
uuauagcuauugugucugu

SEQ ID NO: 265061 - RNA, 19 nt, Homo sapiens
caaguguggcuucucuuug

SEQ ID NO: 265062 - RNA, 19 nt, Homo sapiens
gagcguccucugccugaaa

SEQ ID NO: 265063 - RNA, 19 nt, Homo sapiens
gaagaagcgauggagaugu

SEQ ID NO: 265064 - RNA, 19 nt, Homo sapiens
ggguguaaauaacaguaau

SEQ ID NO: 265065 - RNA, 19 nt, Homo sapiens
aaugaagacaugcauggua

SEQ ID NO: 265066 - RNA, 19 nt, Homo sapiens
gugauucugaucucaauug

SEQ ID NO: 265067 - RNA, 19 nt, Homo sapiens
cugaagaaauucgguuuua

SEQ ID NO: 265068 - RNA, 19 nt, Homo sapiens
caucugaucagcucugcaa

SEQ ID NO: 265069 - RNA, 19 nt, Homo sapiens
gaggguguaaauaacagua

SEQ ID NO: 265070 - RNA, 19 nt, Homo sapiens
ugaacaucauugacauugu

SEQ ID NO: 265071 - RNA, 19 nt, Homo sapiens
acaaguguggcuucucuuu

SEQ ID NO: 265072 - RNA, 19 nt, Homo sapiens
gaaaggaccugaagaagug

SEQ ID NO: 265073 - RNA, 19 nt, Homo sapiens
guccugaucugacuaauua

SEQ ID NO: 265074 - RNA, 19 nt, Homo sapiens
gagauaagcuucggcagua

SEQ ID NO: 265075 - RNA, 19 nt, Homo sapiens
uaaagaugcuucccaagaa

SEQ ID NO: 265076 - RNA, 19 nt, Homo sapiens
caacaacuaucaaagucua

SEQ ID NO: 265077 - RNA, 19 nt, Homo sapiens
guagauauguggaugaaga

SEQ ID NO: 265078 - RNA, 19 nt, Homo sapiens
gauauucaccgauguuuaa

SEQ ID NO: 265079 - RNA, 19 nt, Homo sapiens
ggcaugaucuggauuaaau

SEQ ID NO: 265080 - RNA, 19 nt, Homo sapiens
gggaggaaaugaaacuaaa

SEQ ID NO: 265081 - RNA, 19 nt, Homo sapiens
gaacaauaaucccaacucu

SEQ ID NO: 265082 - RNA, 19 nt, Homo sapiens
gcaguuguuucuuuccuaa

SEQ ID NO: 265083 - RNA, 19 nt, Homo sapiens
cuaaggaggugaaaugaau

SEQ ID NO: 265084 - RNA, 19 nt, Homo sapiens
ccagaugguuccuacuuaa

SEQ ID NO: 265085 - RNA, 19 nt, Homo sapiens
guaaacccaccaugaguua

SEQ ID NO: 265086 - RNA, 19 nt, Homo sapiens
cagcggaaguuacuaauuc

SEQ ID NO: 265087 - RNA, 19 nt, Homo sapiens
gauggaccuuucaacguua

SEQ ID NO: 265088 - RNA, 19 nt, Homo sapiens
gaagagcaaucccaguaca

SEQ ID NO: 265089 - RNA, 19 nt, Homo sapiens
caacuucaauuacuucuac

SEQ ID NO: 265090 - RNA, 19 nt, Homo sapiens
uggcaucucuugcacagua

SEQ ID NO: 265091 - RNA, 19 nt, Homo sapiens
caagugggcugcauucucu

SEQ ID NO: 265092 - RNA, 19 nt, Homo sapiens
ggaaaggaccugaagaagu

SEQ ID NO: 265093 - RNA, 19 nt, Homo sapiens
ucaccgauguuuaauaugu

SEQ ID NO: 265094 - RNA, 19 nt, Homo sapiens
gaaguucugugcauauguc

SEQ ID NO: 265095 - RNA, 19 nt, Homo sapiens
acaguaaccuuuccagaug

SEQ ID NO: 265096 - RNA, 19 nt, Homo sapiens
acaacagacuuacguuaaa

SEQ ID NO: 265097 - RNA, 19 nt, Homo sapiens
aaacaacagacuuacguua

SEQ ID NO: 265098 - RNA, 19 nt, Homo sapiens
acaauaaucccaacucuug

SEQ ID NO: 265099 - RNA, 19 nt, Homo sapiens
cagugugccugaaaccuua

SEQ ID NO: 265100 - RNA, 19 nt, Homo sapiens
gaagacccuuugccaguuc

SEQ ID NO: 265101 - RNA, 19 nt, Homo sapiens
guaagggucuuccgcaucu

SEQ ID NO: 265102 - RNA, 19 nt, Homo sapiens
uaugguguuuggaauguua

SEQ ID NO: 265103 - RNA, 19 nt, Homo sapiens
ugauggaccuuucaacguu

SEQ ID NO: 265104 - RNA, 19 nt, Homo sapiens
gaugguuccuacuuaaaug

SEQ ID NO: 265105 - RNA, 19 nt, Homo sapiens
uaaaugaugcuucgguuug

SEQ ID NO: 265106 - RNA, 19 nt, Homo sapiens
agacuuacguuaaacuuca

SEQ ID NO: 265107 - RNA, 19 nt, Homo sapiens
gacaugcugugcucaguau

SEQ ID NO: 265108 - RNA, 19 nt, Homo sapiens
ugaaaugaaucccaaaugc

SEQ ID NO: 265109 - RNA, 19 nt, Homo sapiens
guggaaagcacacuucauu

SEQ ID NO: 265110 - RNA, 19 nt, Homo sapiens
ccugaaaccuuacuacaag

SEQ ID NO: 265111 - RNA, 19 nt, Homo sapiens
gaacuuucaagccaacaaa

SEQ ID NO: 265112 - RNA, 19 nt, Homo sapiens
gaaaugaaucccaaaugca

SEQ ID NO: 265113 - RNA, 19 nt, Homo sapiens
gacagagcaucgcggcuuu

SEQ ID NO: 265114 - RNA, 19 nt, Homo sapiens
ggaaagcacacuucauucu

SEQ ID NO: 265115 - RNA, 19 nt, Homo sapiens
caaaugagagauucgauca

SEQ ID NO: 265116 - RNA, 19 nt, Homo sapiens
uaaggcaugaucuggauua

SEQ ID NO: 265117 - RNA, 19 nt, Homo sapiens
ccuucaggcuuucucuuua

SEQ ID NO: 265118 - RNA, 19 nt, Homo sapiens
gaaaauaugguguuuggaa

SEQ ID NO: 265119 - RNA, 19 nt, Homo sapiens
gcuaagcauuucuaaagca

SEQ ID NO: 265120 - RNA, 19 nt, Homo sapiens
gaggaaaugaaacuaaaga

SEQ ID NO: 265121 - RNA, 19 nt, Homo sapiens
gcucaucuucuuccucuuu

SEQ ID NO: 265122 - RNA, 19 nt, Homo sapiens
caacgugcccaucgacauu

SEQ ID NO: 265123 - RNA, 19 nt, Homo sapiens
cgacgucgcaggacucauu

SEQ ID NO: 265124 - RNA, 19 nt, Homo sapiens
cuaguacacgcccuauuua

SEQ ID NO: 265125 - RNA, 19 nt, Homo sapiens
ugaguaagucggaguauau

SEQ ID NO: 265126 - RNA, 19 nt, Homo sapiens
ugaagacccuuugccaguu

SEQ ID NO: 265127 - RNA, 19 nt, Homo sapiens
cuucaggcuuucucuuuaa

SEQ ID NO: 265128 - RNA, 19 nt, Homo sapiens
uccagaugguuccuacuua

SEQ ID NO: 265129 - RNA, 19 nt, Homo sapiens
ggaugaagagucuaacuag

SEQ ID NO: 265130 - RNA, 19 nt, Homo sapiens
guaaaugaugcuucgguuu

SEQ ID NO: 265131 - RNA, 19 nt, Homo sapiens
gccagcaccucuccucuuc

SEQ ID NO: 265132 - RNA, 19 nt, Homo sapiens
gcgaggaggccauggagaa

SEQ ID NO: 265133 - RNA, 19 nt, Homo sapiens
ccaguucccgugauuguuu

SEQ ID NO: 265134 - RNA, 19 nt, Homo sapiens
uuaaagaugcuucccaaga

SEQ ID NO: 265135 - RNA, 19 nt, Homo sapiens
ucuaguacacgcccuauuu

SEQ ID NO: 265136 - RNA, 19 nt, Homo sapiens
caacagacuuacguuaaac

SEQ ID NO: 265137 - RNA, 19 nt, Homo sapiens
gaccuuucaacguuauuua

SEQ ID NO: 265138 - RNA, 19 nt, Homo sapiens
uagaguaacuguuuaaccu

SEQ ID NO: 265139 - RNA, 19 nt, Homo sapiens
ggaaaugaaacuaaagaac

SEQ ID NO: 265140 - RNA, 19 nt, Homo sapiens
caguaucacaagaagauua

SEQ ID NO: 265141 - RNA, 19 nt, Homo sapiens
gaaagcacacuucauucuc

SEQ ID NO: 265142 - RNA, 19 nt, Homo sapiens
uggagacgcugccggaguu

SEQ ID NO: 265143 - RNA, 19 nt, Homo sapiens
cauaagcaaaugagagauu

SEQ ID NO: 265144 - RNA, 19 nt, Homo sapiens
ccuaugcccuuguuuuaua

SEQ ID NO: 265145 - RNA, 19 nt, Homo sapiens
aaaguguucuguacauaag

SEQ ID NO: 265146 - RNA, 19 nt, Homo sapiens
caagccaacaaaugaaauu

SEQ ID NO: 265147 - RNA, 19 nt, Homo sapiens
ccgaggagauccgcuucua

SEQ ID NO: 265148 - RNA, 19 nt, Homo sapiens
aaaugaugcuucgguuuga

SEQ ID NO: 265149 - RNA, 19 nt, Homo sapiens
gaccauucaucaaggaaag

SEQ ID NO: 265150 - RNA, 19 nt, Homo sapiens
cuguuuaaccucagaauuu

SEQ ID NO: 265151 - RNA, 19 nt, Homo sapiens
guacacgcccuauuuaaaa

SEQ ID NO: 265152 - RNA, 19 nt, Homo sapiens
ggaggaaaauaugguguuu

SEQ ID NO: 265153 - RNA, 19 nt, Homo sapiens
ggcaguuguuucuuuccua

SEQ ID NO: 265154 - RNA, 19 nt, Homo sapiens
guaacuguuuaaccucaga

SEQ ID NO: 265155 - RNA, 19 nt, Homo sapiens
ccagaccauucaucaagga

SEQ ID NO: 265156 - RNA, 19 nt, Homo sapiens
caacucuugugucaacauc

SEQ ID NO: 265157 - RNA, 19 nt, Homo sapiens
ucaugaaccugaucgacau

SEQ ID NO: 265158 - RNA, 19 nt, Homo sapiens
aauaaggcaugaucuggau

SEQ ID NO: 265159 - RNA, 19 nt, Homo sapiens
uaaccacaauaaggcauga

SEQ ID NO: 265160 - RNA, 19 nt, Homo sapiens
gugaaguucugugcauaug

SEQ ID NO: 265161 - RNA, 19 nt, Homo sapiens
aacaacagacuuacguuaa

SEQ ID NO: 265162 - RNA, 19 nt, Homo sapiens
guaaaaguguucuguacau

SEQ ID NO: 265163 - RNA, 19 nt, Homo sapiens
aaucccaacucuuguguca

SEQ ID NO: 265164 - RNA, 19 nt, Homo sapiens
cugaguaagucggaguaua

SEQ ID NO: 265165 - RNA, 19 nt, Homo sapiens
gagacgcugugcaucaucu

SEQ ID NO: 265166 - RNA, 19 nt, Homo sapiens
ggcaguaucacaagaagau

SEQ ID NO: 265167 - RNA, 19 nt, Homo sapiens
aaacccaccaugaguuauu

SEQ ID NO: 265168 - RNA, 19 nt, Homo sapiens
cguuaaacuucauuucuag

SEQ ID NO: 265169 - RNA, 19 nt, Homo sapiens
cggaguauauggugaucga

SEQ ID NO: 265170 - RNA, 19 nt, Homo sapiens
gcaggacucauucgaagca

SEQ ID NO: 265171 - RNA, 19 nt, Homo sapiens
aaugagagauucgaucagu

SEQ ID NO: 265172 - RNA, 19 nt, Homo sapiens
gugauugucucuaacuuua

SEQ ID NO: 265173 - RNA, 19 nt, Homo sapiens
gaacucagggcacacaaua

SEQ ID NO: 265174 - RNA, 19 nt, Homo sapiens
aaaagaagcugcccuauuu

SEQ ID NO: 265175 - RNA, 19 nt, Homo sapiens
ucacaugccuuaugguuau

SEQ ID NO: 265176 - RNA, 19 nt, Homo sapiens
caaaggcuguggagacuga

SEQ ID NO: 265177 - RNA, 19 nt, Homo sapiens
cagagcagcuucccucauu

SEQ ID NO: 265178 - RNA, 19 nt, Homo sapiens
ccacaucccagacauauuu

SEQ ID NO: 265179 - RNA, 19 nt, Homo sapiens
caacaucacuaaccacauc

SEQ ID NO: 265180 - RNA, 19 nt, Homo sapiens
gcaaaugauccaaugcaua

SEQ ID NO: 265181 - RNA, 19 nt, Homo sapiens
gaaaauauccuuagucuuc

SEQ ID NO: 265182 - RNA, 19 nt, Homo sapiens
cgacagggaucucgucaug

SEQ ID NO: 265183 - RNA, 19 nt, Homo sapiens
gagagugccaggcuauuua

SEQ ID NO: 265184 - RNA, 19 nt, Homo sapiens
ggaagaaggaguuaaggaa

SEQ ID NO: 265185 - RNA, 19 nt, Homo sapiens
gaacugggccuucugaucu

SEQ ID NO: 265186 - RNA, 19 nt, Homo sapiens
agacacagcuaacgcagaa

SEQ ID NO: 265187 - RNA, 19 nt, Homo sapiens
gcaacagucacaugccuua

SEQ ID NO: 265188 - RNA, 19 nt, Homo sapiens
gaacguguggugauaaaug

SEQ ID NO: 265189 - RNA, 19 nt, Homo sapiens
gaaggcaagugcuaacagu

SEQ ID NO: 265190 - RNA, 19 nt, Homo sapiens
gugcugaacuccagaggaa

SEQ ID NO: 265191 - RNA, 19 nt, Homo sapiens
gcgggugucuuaaccauug

SEQ ID NO: 265192 - RNA, 19 nt, Homo sapiens
caaaccacaucuuaacaug

SEQ ID NO: 265193 - RNA, 19 nt, Homo sapiens
caguaaagauggagagaga

SEQ ID NO: 265194 - RNA, 19 nt, Homo sapiens
uaucguaugucuuuggauu

SEQ ID NO: 265195 - RNA, 19 nt, Homo sapiens
gagggaagguuuuacuaua

SEQ ID NO: 265196 - RNA, 19 nt, Homo sapiens
guaaaggcuuauuugcauu

SEQ ID NO: 265197 - RNA, 19 nt, Homo sapiens
gaagaaggaguuaaggaau

SEQ ID NO: 265198 - RNA, 19 nt, Homo sapiens
ggaagaggagggaagguuu

SEQ ID NO: 265199 - RNA, 19 nt, Homo sapiens
guuccaaacuuaccuuaau

SEQ ID NO: 265200 - RNA, 19 nt, Homo sapiens
ggacgagggcuuugugaga

SEQ ID NO: 265201 - RNA, 19 nt, Homo sapiens
gaggugaaguucuaucagu

SEQ ID NO: 265202 - RNA, 19 nt, Homo sapiens
ugauagacuuugaguagaa

SEQ ID NO: 265203 - RNA, 19 nt, Homo sapiens
gcauuuccuugauuucuau

SEQ ID NO: 265204 - RNA, 19 nt, Homo sapiens
gauguuaacaguaaagaug

SEQ ID NO: 265205 - RNA, 19 nt, Homo sapiens
gccaagcacucuucuucaa

SEQ ID NO: 265206 - RNA, 19 nt, Homo sapiens
agauuuggcuccucuuuga

SEQ ID NO: 265207 - RNA, 19 nt, Homo sapiens
caaaggaggagaaguguca

SEQ ID NO: 265208 - RNA, 19 nt, Homo sapiens
ggacaagucagaguaucua

SEQ ID NO: 265209 - RNA, 19 nt, Homo sapiens
cgacagcggucugagaaga

SEQ ID NO: 265210 - RNA, 19 nt, Homo sapiens
gcuuaaggguuccaaacuu

SEQ ID NO: 265211 - RNA, 19 nt, Homo sapiens
agaaauggcuggacauacu

SEQ ID NO: 265212 - RNA, 19 nt, Homo sapiens
gauagacuuugaguagaaa

SEQ ID NO: 265213 - RNA, 19 nt, Homo sapiens
ggaagccuuugaugaacuu

SEQ ID NO: 265214 - RNA, 19 nt, Homo sapiens
caagccagccgguggauuu

SEQ ID NO: 265215 - RNA, 19 nt, Homo sapiens
aaugauacaucuuggagaa

SEQ ID NO: 265216 - RNA, 19 nt, Homo sapiens
gguggguuguugaaugaua

SEQ ID NO: 265217 - RNA, 19 nt, Homo sapiens
gcugacaccucaucuagca

SEQ ID NO: 265218 - RNA, 19 nt, Homo sapiens
gcucugcauuuccuugauu

SEQ ID NO: 265219 - RNA, 19 nt, Homo sapiens
caaaugauccaaugcauac

SEQ ID NO: 265220 - RNA, 19 nt, Homo sapiens
gcauagagagugcaguuau

SEQ ID NO: 265221 - RNA, 19 nt, Homo sapiens
ccucuaauuugcucaagaa

SEQ ID NO: 265222 - RNA, 19 nt, Homo sapiens
ggagagcaauguugaaucc

SEQ ID NO: 265223 - RNA, 19 nt, Homo sapiens
ggcaagugcuaacaguaaa

SEQ ID NO: 265224 - RNA, 19 nt, Homo sapiens
gaaucugagcagucauuua

SEQ ID NO: 265225 - RNA, 19 nt, Homo sapiens
uaaugaaucugagcaguca

SEQ ID NO: 265226 - RNA, 19 nt, Homo sapiens
aggagcaaaucuaucuuua

SEQ ID NO: 265227 - RNA, 19 nt, Homo sapiens
cugagagacuccagcauuu

SEQ ID NO: 265228 - RNA, 19 nt, Homo sapiens
cagcaucuccaaauauauu

SEQ ID NO: 265229 - RNA, 19 nt, Homo sapiens
cucagcaucuccaaauaua

SEQ ID NO: 265230 - RNA, 19 nt, Homo sapiens
gaaaagaagcugcccuauu

SEQ ID NO: 265231 - RNA, 19 nt, Homo sapiens
caacuguucuaaugcaaag

SEQ ID NO: 265232 - RNA, 19 nt, Homo sapiens
cugaggaggugaaguucua

SEQ ID NO: 265233 - RNA, 19 nt, Homo sapiens
gugaacguguggugauaaa

SEQ ID NO: 265234 - RNA, 19 nt, Homo sapiens
gacacuugcugccuuugaa

SEQ ID NO: 265235 - RNA, 19 nt, Homo sapiens
guagaaauggcuggacaua

SEQ ID NO: 265236 - RNA, 19 nt, Homo sapiens
acaggaagccuuugaugaa

SEQ ID NO: 265237 - RNA, 19 nt, Homo sapiens
gcagcaacaucacuaacca

SEQ ID NO: 265238 - RNA, 19 nt, Homo sapiens
caugguggguuguugaaug

SEQ ID NO: 265239 - RNA, 19 nt, Homo sapiens
gaagaugaccauggugaug

SEQ ID NO: 265240 - RNA, 19 nt, Homo sapiens
ucagacacuugcugccuuu

SEQ ID NO: 265241 - RNA, 19 nt, Homo sapiens
aaucugagcagucauuuau

SEQ ID NO: 265242 - RNA, 19 nt, Homo sapiens
ggagcaaaucuaucuuuau

SEQ ID NO: 265243 - RNA, 19 nt, Homo sapiens
gaucgcugcugucuaggau

SEQ ID NO: 265244 - RNA, 19 nt, Homo sapiens
guaaagauggagagagaga

SEQ ID NO: 265245 - RNA, 19 nt, Homo sapiens
uuucggagcucuacuucuu

SEQ ID NO: 265246 - RNA, 19 nt, Homo sapiens
gaucuucuuccucuucauu

SEQ ID NO: 265247 - RNA, 19 nt, Homo sapiens
gcagauuuggcuccucuuu

SEQ ID NO: 265248 - RNA, 19 nt, Homo sapiens
gaagaggccagucaauguc

SEQ ID NO: 265249 - RNA, 19 nt, Homo sapiens
augcaaaguuggacugaaa

SEQ ID NO: 265250 - RNA, 19 nt, Homo sapiens
aguaaaggcuuauuugcau

SEQ ID NO: 265251 - RNA, 19 nt, Homo sapiens
gaaauggcuggacauacuu

SEQ ID NO: 265252 - RNA, 19 nt, Homo sapiens
gaugacagugagacagaua

SEQ ID NO: 265253 - RNA, 19 nt, Homo sapiens
ggagaagugucagggaaag

SEQ ID NO: 265254 - RNA, 19 nt, Homo sapiens
gugguucgcugcuuugcuu

SEQ ID NO: 265255 - RNA, 19 nt, Homo sapiens
gggaggaggcccuguugaa

SEQ ID NO: 265256 - RNA, 19 nt, Homo sapiens
ccuuugauaucuucacuga

SEQ ID NO: 265257 - RNA, 19 nt, Homo sapiens
ucgcugcugucuaggauuu

SEQ ID NO: 265258 - RNA, 19 nt, Homo sapiens
guuaguaauugugcaguga

SEQ ID NO: 265259 - RNA, 19 nt, Homo sapiens
ugccagugauugucucuaa

SEQ ID NO: 265260 - RNA, 19 nt, Homo sapiens
ggcacacaauauucaauga

SEQ ID NO: 265261 - RNA, 19 nt, Homo sapiens
ugaagaggccagucaaugu

SEQ ID NO: 265262 - RNA, 19 nt, Homo sapiens
ucugagcagucauuuauca

SEQ ID NO: 265263 - RNA, 19 nt, Homo sapiens
uccaaugcauacaguagua

SEQ ID NO: 265264 - RNA, 19 nt, Homo sapiens
uguggagacugauguguga

SEQ ID NO: 265265 - RNA, 19 nt, Homo sapiens
guccauaccuccccucuaa

SEQ ID NO: 265266 - RNA, 19 nt, Homo sapiens
ucauugcucugaccugaug

SEQ ID NO: 265267 - RNA, 19 nt, Homo sapiens
aaacccgagugauuccuuu

SEQ ID NO: 265268 - RNA, 19 nt, Homo sapiens
gcagaaugcagucaguugu

SEQ ID NO: 265269 - RNA, 19 nt, Homo sapiens
gaggaacagacacagcuaa

SEQ ID NO: 265270 - RNA, 19 nt, Homo sapiens
gaagaagaaagcccacuac

SEQ ID NO: 265271 - RNA, 19 nt, Homo sapiens
guacaggaagccuuugaug

SEQ ID NO: 265272 - RNA, 19 nt, Homo sapiens
gaacauggauaucuacauu

SEQ ID NO: 265273 - RNA, 19 nt, Homo sapiens
gguaugggcuguucuguuu

SEQ ID NO: 265274 - RNA, 19 nt, Homo sapiens
ugagauggauguauuugua

SEQ ID NO: 265275 - RNA, 19 nt, Homo sapiens
ggaggaauacuucugauaa

SEQ ID NO: 265276 - RNA, 19 nt, Homo sapiens
ggaaacagauuugugaaag

SEQ ID NO: 265277 - RNA, 19 nt, Homo sapiens
gcugugagauggauguauu

SEQ ID NO: 265278 - RNA, 19 nt, Homo sapiens
guaacgggcugccagaaga

SEQ ID NO: 265279 - RNA, 19 nt, Homo sapiens
gaggaauacuucugauaau

SEQ ID NO: 265280 - RNA, 19 nt, Homo sapiens
gcccagaucccaagagauu

SEQ ID NO: 265281 - RNA, 19 nt, Homo sapiens
aaacagauuugugaaagga

SEQ ID NO: 265282 - RNA, 19 nt, Homo sapiens
gaaacagauuugugaaagg

SEQ ID NO: 265283 - RNA, 19 nt, Homo sapiens
guacuguaguucagauaga

SEQ ID NO: 265284 - RNA, 19 nt, Homo sapiens
gcagagggauaacccaaac

SEQ ID NO: 265285 - RNA, 19 nt, Homo sapiens
ccacgugcgucaucugguu

SEQ ID NO: 265286 - RNA, 19 nt, Homo sapiens
gaugugguauuggugcuuu

SEQ ID NO: 265287 - RNA, 19 nt, Homo sapiens
agucagagaucuugguaug

SEQ ID NO: 265288 - RNA, 19 nt, Homo sapiens
cccaagagauuauguaacu

SEQ ID NO: 265289 - RNA, 19 nt, Homo sapiens
gaagagcagggcacucaga

SEQ ID NO: 265290 - RNA, 19 nt, Homo sapiens
ugaagaaaggcaaaucuga

SEQ ID NO: 265291 - RNA, 19 nt, Homo sapiens
ggcagaguauguucuugaa

SEQ ID NO: 265292 - RNA, 19 nt, Homo sapiens
gggaaacagauuugugaaa

SEQ ID NO: 265293 - RNA, 19 nt, Homo sapiens
gaacccauuucucuagcau

SEQ ID NO: 265294 - RNA, 19 nt, Homo sapiens
gaagagagagaggcagaga

SEQ ID NO: 265295 - RNA, 19 nt, Homo sapiens
ucuccaagccucugucuuu

SEQ ID NO: 265296 - RNA, 19 nt, Homo sapiens
cagaguauuugaagucaca

SEQ ID NO: 265297 - RNA, 19 nt, Homo sapiens
gggcagaguauguucuuga

SEQ ID NO: 265298 - RNA, 19 nt, Homo sapiens
cgcaggagcuguggaaaug

SEQ ID NO: 265299 - RNA, 19 nt, Homo sapiens
uauuugaagucacacugua

SEQ ID NO: 265300 - RNA, 19 nt, Homo sapiens
gaggaacgaguacuucuuc

SEQ ID NO: 265301 - RNA, 19 nt, Homo sapiens
gcuguucuguuuccugugu

SEQ ID NO: 265302 - RNA, 19 nt, Homo sapiens
gaaauggugagcgcuguga

SEQ ID NO: 265303 - RNA, 19 nt, Homo sapiens
gaggcuugcugaacaugga

SEQ ID NO: 265304 - RNA, 19 nt, Homo sapiens
caacuucaacuacuucuac

SEQ ID NO: 265305 - RNA, 19 nt, Homo sapiens
auccauguguuccaaauuu

SEQ ID NO: 265306 - RNA, 19 nt, Homo sapiens
gaucccaagagauuaugua

SEQ ID NO: 265307 - RNA, 19 nt, Homo sapiens
gagaacggcggugccauga

SEQ ID NO: 265308 - RNA, 19 nt, Homo sapiens
uacauuauaccgcagagua

SEQ ID NO: 265309 - RNA, 19 nt, Homo sapiens
uagcccagaucccaagaga

SEQ ID NO: 265310 - RNA, 19 nt, Homo sapiens
uggagacccugccugaguu

SEQ ID NO: 265311 - RNA, 19 nt, Homo sapiens
ggucuugguuauccucauc

SEQ ID NO: 265312 - RNA, 19 nt, Homo sapiens
uugcggaggucccuuuaug

SEQ ID NO: 265313 - RNA, 19 nt, Homo sapiens
ccagggaacccauuucucu

SEQ ID NO: 265314 - RNA, 19 nt, Homo sapiens
ccagaucccaagagauuau

SEQ ID NO: 265315 - RNA, 19 nt, Homo sapiens
ggaacccauuucucuagca

SEQ ID NO: 265316 - RNA, 19 nt, Homo sapiens
cguguucgcggacgagaua

SEQ ID NO: 265317 - RNA, 19 nt, Homo sapiens
uauauuagagucagagauc

SEQ ID NO: 265318 - RNA, 19 nt, Homo sapiens
guuccaaauuugcuuuaca

SEQ ID NO: 265319 - RNA, 19 nt, Homo sapiens
gcucaucuucuuccucuuc

SEQ ID NO: 265320 - RNA, 19 nt, Homo sapiens
gagggauaacccaaacaaa

SEQ ID NO: 265321 - RNA, 19 nt, Homo sapiens
uuucugggaugugguauug

SEQ ID NO: 265322 - RNA, 19 nt, Homo sapiens
ucgacgguauccucuacua

SEQ ID NO: 265323 - RNA, 19 nt, Homo sapiens
ccgggaaacagauuuguga

SEQ ID NO: 265324 - RNA, 19 nt, Homo sapiens
cggaacaucaugaacauca

SEQ ID NO: 265325 - RNA, 19 nt, Homo sapiens
ggaacgaguacuucuucga

SEQ ID NO: 265326 - RNA, 19 nt, Homo sapiens
gcaguggaguagggaaugg

SEQ ID NO: 265327 - RNA, 19 nt, Homo sapiens
acgguauccucuacuacua

SEQ ID NO: 265328 - RNA, 19 nt, Homo sapiens
ggagaccacgugcgucauc

SEQ ID NO: 265329 - RNA, 19 nt, Homo sapiens
gagauggauguauuuguag

SEQ ID NO: 265330 - RNA, 19 nt, Homo sapiens
aaaguaccacauuccauga

SEQ ID NO: 265331 - RNA, 19 nt, Homo sapiens
uggaggaauacuucugaua

SEQ ID NO: 265332 - RNA, 19 nt, Homo sapiens
caccagcgcguccacauca

SEQ ID NO: 265333 - RNA, 19 nt, Homo sapiens
ccauccauguguuccaaau

SEQ ID NO: 265334 - RNA, 19 nt, Homo sapiens
ucuccaacuucaacuacuu

SEQ ID NO: 265335 - RNA, 19 nt, Homo sapiens
ggacaugaggcccaucacu

SEQ ID NO: 265336 - RNA, 19 nt, Homo sapiens
uggcuuaucuucgaguauc

SEQ ID NO: 265337 - RNA, 19 nt, Homo sapiens
cagggaacccauuucucua

SEQ ID NO: 265338 - RNA, 19 nt, Homo sapiens
caucgucucggucuugguu

SEQ ID NO: 265339 - RNA, 19 nt, Homo sapiens
caggagcuguggaaauggu

SEQ ID NO: 265340 - RNA, 19 nt, Homo sapiens
ccucuccuuucacuccuuu

SEQ ID NO: 265341 - RNA, 19 nt, Homo sapiens
agagaaguguaacgucaag

SEQ ID NO: 265342 - RNA, 19 nt, Homo sapiens
ugacgcaggagcuguggaa

SEQ ID NO: 265343 - RNA, 19 nt, Homo sapiens
gaaugggaggcuugcugaa

SEQ ID NO: 265344 - RNA, 19 nt, Homo sapiens
ggacaccagccgggaaaca

SEQ ID NO: 265345 - RNA, 19 nt, Homo sapiens
gucaucgucuccaacuuca

SEQ ID NO: 265346 - RNA, 19 nt, Homo sapiens
gaucgugggcucgcugugu

SEQ ID NO: 265347 - RNA, 19 nt, Homo sapiens
cgucaucgucuccaacuuc

SEQ ID NO: 265348 - RNA, 19 nt, Homo sapiens
ucugugcgccuuaaacaau

SEQ ID NO: 265349 - RNA, 19 nt, Homo sapiens
cggacgagauacgcuucua

SEQ ID NO: 265350 - RNA, 19 nt, Homo sapiens
cccaggaaauaaaagguua

SEQ ID NO: 265351 - RNA, 19 nt, Homo sapiens
gguaacgggcugccagaag

SEQ ID NO: 265352 - RNA, 19 nt, Homo sapiens
guaguucagauagagauau

SEQ ID NO: 265353 - RNA, 19 nt, Homo sapiens
gauuguauuuguguauagg

SEQ ID NO: 265354 - RNA, 19 nt, Homo sapiens
uaacuccuccauccaugug

SEQ ID NO: 265355 - RNA, 19 nt, Homo sapiens
ugcugaacauggauaucua

SEQ ID NO: 265356 - RNA, 19 nt, Homo sapiens
agagucagagaucuuggua

SEQ ID NO: 265357 - RNA, 19 nt, Homo sapiens
uccauguguuccaaauuug

SEQ ID NO: 265358 - RNA, 19 nt, Homo sapiens
ccgcagaguauuugaaguc

SEQ ID NO: 265359 - RNA, 19 nt, Homo sapiens
ggacgagauacgcuucuac

SEQ ID NO: 265360 - RNA, 19 nt, Homo sapiens
caaccagggaacccauuuc

SEQ ID NO: 265361 - RNA, 19 nt, Homo sapiens
agagggauaacccaaacaa

SEQ ID NO: 265362 - RNA, 19 nt, Homo sapiens
acaugaggcccaucacugu

SEQ ID NO: 265363 - RNA, 19 nt, Homo sapiens
gaacaagcauuauuccuuu

SEQ ID NO: 265364 - RNA, 19 nt, Homo sapiens
ccaaauaccuggacuauca

SEQ ID NO: 265365 - RNA, 19 nt, Homo sapiens
gaauaaggaacaagcauua

SEQ ID NO: 265366 - RNA, 19 nt, Homo sapiens
gguguucggucuacauuua

SEQ ID NO: 265367 - RNA, 19 nt, Homo sapiens
gcaaaugugugaaucuuag

SEQ ID NO: 265368 - RNA, 19 nt, Homo sapiens
ugaaaggacuguuaacaug

SEQ ID NO: 265369 - RNA, 19 nt, Homo sapiens
ggaguuugauuuaggauug

SEQ ID NO: 265370 - RNA, 19 nt, Homo sapiens
guacucaacuugcuguuau

SEQ ID NO: 265371 - RNA, 19 nt, Homo sapiens
gaaacugaaaggacuguua

SEQ ID NO: 265372 - RNA, 19 nt, Homo sapiens
caaagaggccaauggauuu

SEQ ID NO: 265373 - RNA, 19 nt, Homo sapiens
aaacuuggauggaauuaga

SEQ ID NO: 265374 - RNA, 19 nt, Homo sapiens
gauaaacugugauguacug

SEQ ID NO: 265375 - RNA, 19 nt, Homo sapiens
gaccugcucucacugguaa

SEQ ID NO: 265376 - RNA, 19 nt, Homo sapiens
uaacuuggguccacaguca

SEQ ID NO: 265377 - RNA, 19 nt, Homo sapiens
cagaagaacuggagaaagg

SEQ ID NO: 265378 - RNA, 19 nt, Homo sapiens
guacuguucugagaucuuu

SEQ ID NO: 265379 - RNA, 19 nt, Homo sapiens
ccaaagaggccaauggauu

SEQ ID NO: 265380 - RNA, 19 nt, Homo sapiens
ucaguaacauugccauuug

SEQ ID NO: 265381 - RNA, 19 nt, Homo sapiens
gccaacagccucacucuaa

SEQ ID NO: 265382 - RNA, 19 nt, Homo sapiens
uuaaagcccuagacaggua

SEQ ID NO: 265383 - RNA, 19 nt, Homo sapiens
agucuucgcucccuccuua

SEQ ID NO: 265384 - RNA, 19 nt, Homo sapiens
gauuuaggauugcuguuga

SEQ ID NO: 265385 - RNA, 19 nt, Homo sapiens
caaucaaacuuuaccacuu

SEQ ID NO: 265386 - RNA, 19 nt, Homo sapiens
aaucaaacuuuaccacuug

SEQ ID NO: 265387 - RNA, 19 nt, Homo sapiens
gaaaggacuguuaacaugu

SEQ ID NO: 265388 - RNA, 19 nt, Homo sapiens
caggcaaacuccagcuuaa

SEQ ID NO: 265389 - RNA, 19 nt, Homo sapiens
ggaauuagagaauacaauc

SEQ ID NO: 265390 - RNA, 19 nt, Homo sapiens
gguagagucuuuauuugca

SEQ ID NO: 265391 - RNA, 19 nt, Homo sapiens
ggaaaccagcccuaucuga

SEQ ID NO: 265392 - RNA, 19 nt, Homo sapiens
aaacugugauguacuguuc

SEQ ID NO: 265393 - RNA, 19 nt, Homo sapiens
gcagaugacccuugguaga

SEQ ID NO: 265394 - RNA, 19 nt, Homo sapiens
ugagaccacugccaucuau

SEQ ID NO: 265395 - RNA, 19 nt, Homo sapiens
gcagaggaaucguguugca

SEQ ID NO: 265396 - RNA, 19 nt, Homo sapiens
gacagaagcugggcaugau

SEQ ID NO: 265397 - RNA, 19 nt, Homo sapiens
ugaagacgauuccuacaca

SEQ ID NO: 265398 - RNA, 19 nt, Homo sapiens
ccacuugauuuagccauuu

SEQ ID NO: 265399 - RNA, 19 nt, Homo sapiens
gcaugaaauaugugguuua

SEQ ID NO: 265400 - RNA, 19 nt, Homo sapiens
aaaggacuguuaacauguu

SEQ ID NO: 265401 - RNA, 19 nt, Homo sapiens
ggagaaagggaaccacaga

SEQ ID NO: 265402 - RNA, 19 nt, Homo sapiens
gcaagugugcgucuauuuc

SEQ ID NO: 265403 - RNA, 19 nt, Homo sapiens
cgagaggacagccuuauga

SEQ ID NO: 265404 - RNA, 19 nt, Homo sapiens
aaacugaaaggacuguuaa

SEQ ID NO: 265405 - RNA, 19 nt, Homo sapiens
aaaucucgaucuugccaua

SEQ ID NO: 265406 - RNA, 19 nt, Homo sapiens
gauguacuguucugagauc

SEQ ID NO: 265407 - RNA, 19 nt, Homo sapiens
aaacaaugguggugugagu

SEQ ID NO: 265408 - RNA, 19 nt, Homo sapiens
ucaguuuacccacccauua

SEQ ID NO: 265409 - RNA, 19 nt, Homo sapiens
cagcuucugucauaugaau

SEQ ID NO: 265410 - RNA, 19 nt, Homo sapiens
gagcggcuggugaucaaua

SEQ ID NO: 265411 - RNA, 19 nt, Homo sapiens
caugaaauaugugguuuag

SEQ ID NO: 265412 - RNA, 19 nt, Homo sapiens
ggacagaagcaguacucaa

SEQ ID NO: 265413 - RNA, 19 nt, Homo sapiens
gcgagcggcuggugaucaa

SEQ ID NO: 265414 - RNA, 19 nt, Homo sapiens
gggaagcgcagaaccaaau

SEQ ID NO: 265415 - RNA, 19 nt, Homo sapiens
uaaggaacaagcauuauuc

SEQ ID NO: 265416 - RNA, 19 nt, Homo sapiens
ggauggaauuagagaauac

SEQ ID NO: 265417 - RNA, 19 nt, Homo sapiens
cagaagcaguacucaacuu

SEQ ID NO: 265418 - RNA, 19 nt, Homo sapiens
cuuaaucccugcagcauuc

SEQ ID NO: 265419 - RNA, 19 nt, Homo sapiens
gaagacgauuccuacacau

SEQ ID NO: 265420 - RNA, 19 nt, Homo sapiens
gugauguacuguucugaga

SEQ ID NO: 265421 - RNA, 19 nt, Homo sapiens
caaugaccacgguagguua

SEQ ID NO: 265422 - RNA, 19 nt, Homo sapiens
ggcaugagaucggagaaau

SEQ ID NO: 265423 - RNA, 19 nt, Homo sapiens
ucaaggaacagcaauguca

SEQ ID NO: 265424 - RNA, 19 nt, Homo sapiens
uggcaccgcuggaauuuca

SEQ ID NO: 265425 - RNA, 19 nt, Homo sapiens
agacccagcuaccuuccua

SEQ ID NO: 265426 - RNA, 19 nt, Homo sapiens
uaugaggguuugcuugaga

SEQ ID NO: 265427 - RNA, 19 nt, Homo sapiens
gggcagaggaaucguguug

SEQ ID NO: 265428 - RNA, 19 nt, Homo sapiens
uggauggaauuagagaaua

SEQ ID NO: 265429 - RNA, 19 nt, Homo sapiens
gaggaacgaguacuucuuc

SEQ ID NO: 265430 - RNA, 19 nt, Homo sapiens
ggcaugaaauaugugguuu

SEQ ID NO: 265431 - RNA, 19 nt, Homo sapiens
gagcagaagaacuggagaa

SEQ ID NO: 265432 - RNA, 19 nt, Homo sapiens
gaccaaagaggccaaugga

SEQ ID NO: 265433 - RNA, 19 nt, Homo sapiens
gaccaaauaccuggacuau

SEQ ID NO: 265434 - RNA, 19 nt, Homo sapiens
gacgauuccuacacauuuc

SEQ ID NO: 265435 - RNA, 19 nt, Homo sapiens
agacgauuccuacacauuu

SEQ ID NO: 265436 - RNA, 19 nt, Homo sapiens
ucagacucuuugaugauaa

SEQ ID NO: 265437 - RNA, 19 nt, Homo sapiens
ggcguucccacuugauuua

SEQ ID NO: 265438 - RNA, 19 nt, Homo sapiens
caacagccucacucuaaga

SEQ ID NO: 265439 - RNA, 19 nt, Homo sapiens
gcacugguguucggucuac

SEQ ID NO: 265440 - RNA, 19 nt, Homo sapiens
gacccuugguagagucuuu

SEQ ID NO: 265441 - RNA, 19 nt, Homo sapiens
augcccagcuucugucaua

SEQ ID NO: 265442 - RNA, 19 nt, Homo sapiens
gaggagcaaggccaguaua

SEQ ID NO: 265443 - RNA, 19 nt, Homo sapiens
caacuucaacuacuucuac

SEQ ID NO: 265444 - RNA, 19 nt, Homo sapiens
ucgcagaggcugacgauga

SEQ ID NO: 265445 - RNA, 19 nt, Homo sapiens
gguccacagucacucuuug

SEQ ID NO: 265446 - RNA, 19 nt, Homo sapiens
ucaggcaaacuccagcuua

SEQ ID NO: 265447 - RNA, 19 nt, Homo sapiens
gaucuugccauaacuuuac

SEQ ID NO: 265448 - RNA, 19 nt, Homo sapiens
gaggaaucguguugcagau

SEQ ID NO: 265449 - RNA, 19 nt, Homo sapiens
cuugguagagucuuuauuu

SEQ ID NO: 265450 - RNA, 19 nt, Homo sapiens
ugacagaagcugggcauga

SEQ ID NO: 265451 - RNA, 19 nt, Homo sapiens
ccugcagcauucaagguua

SEQ ID NO: 265452 - RNA, 19 nt, Homo sapiens
ggaccaaauaccuggacua

SEQ ID NO: 265453 - RNA, 19 nt, Homo sapiens
ggugggcagugguuacaau

SEQ ID NO: 265454 - RNA, 19 nt, Homo sapiens
ggaggaagaggaggaugaa

SEQ ID NO: 265455 - RNA, 19 nt, Homo sapiens
ccaacagccucacucuaag

SEQ ID NO: 265456 - RNA, 19 nt, Homo sapiens
uuucuaaacuuggauggaa

SEQ ID NO: 265457 - RNA, 19 nt, Homo sapiens
uagcuucaguugacuucuu

SEQ ID NO: 265458 - RNA, 19 nt, Homo sapiens
ggaaacaauggugguguga

SEQ ID NO: 265459 - RNA, 19 nt, Homo sapiens
caguuuacccacccauuaa

SEQ ID NO: 265460 - RNA, 19 nt, Homo sapiens
gggcaugaaauaugugguu

SEQ ID NO: 265461 - RNA, 19 nt, Homo sapiens
gacagaagcaguacucaac

SEQ ID NO: 265462 - RNA, 19 nt, Homo sapiens
cugcagcauucaagguuaa

SEQ ID NO: 265463 - RNA, 19 nt, Homo sapiens
gaagaaggcugaaaucacu

SEQ ID NO: 265464 - RNA, 19 nt, Homo sapiens
ggaaagagaaccacaauag

SEQ ID NO: 265465 - RNA, 19 nt, Homo sapiens
gaaguuggguugaguugga

SEQ ID NO: 265466 - RNA, 19 nt, Homo sapiens
caaagggcauuuagaggaa

SEQ ID NO: 265467 - RNA, 19 nt, Homo sapiens
gaaccaggccugucaccua

SEQ ID NO: 265468 - RNA, 19 nt, Homo sapiens
ugagauagguuuggucgua

SEQ ID NO: 265469 - RNA, 19 nt, Homo sapiens
gaauugaguuccauugagu

SEQ ID NO: 265470 - RNA, 19 nt, Homo sapiens
caaagggccugcaaaucuu

SEQ ID NO: 265471 - RNA, 19 nt, Homo sapiens
gcaaggcuaucuucuucaa

SEQ ID NO: 265472 - RNA, 19 nt, Homo sapiens
gaaagagaaccacaauaga

SEQ ID NO: 265473 - RNA, 19 nt, Homo sapiens
gcagaaggacggagagaaa

SEQ ID NO: 265474 - RNA, 19 nt, Homo sapiens
caacagagucucagggaaa

SEQ ID NO: 265475 - RNA, 19 nt, Homo sapiens
gggauuggguuuaggaaga

SEQ ID NO: 265476 - RNA, 19 nt, Homo sapiens
gaagagaggaacagaaauc

SEQ ID NO: 265477 - RNA, 19 nt, Homo sapiens
ggagaaaacuguacucugu

SEQ ID NO: 265478 - RNA, 19 nt, Homo sapiens
ggacagagccaaaaggaua

SEQ ID NO: 265479 - RNA, 19 nt, Homo sapiens
ugaguuguguugaauugua

SEQ ID NO: 265480 - RNA, 19 nt, Homo sapiens
aaagagaaccacaauagaa

SEQ ID NO: 265481 - RNA, 19 nt, Homo sapiens
gaucccagcuacucaggaa

SEQ ID NO: 265482 - RNA, 19 nt, Homo sapiens
ggucuuggguugugugguu

SEQ ID NO: 265483 - RNA, 19 nt, Homo sapiens
gcccaugccuguaaucuca

SEQ ID NO: 265484 - RNA, 19 nt, Homo sapiens
agagcuagguuaagucgua

SEQ ID NO: 265485 - RNA, 19 nt, Homo sapiens
cagaagagaggaacagaaa

SEQ ID NO: 265486 - RNA, 19 nt, Homo sapiens
cgaagaggcugggauguuc

SEQ ID NO: 265487 - RNA, 19 nt, Homo sapiens
cccguagccucauuucuua

SEQ ID NO: 265488 - RNA, 19 nt, Homo sapiens
gcaauggguuguguugugu

SEQ ID NO: 265489 - RNA, 19 nt, Homo sapiens
aagcaaggcuaucuucuuc

SEQ ID NO: 265490 - RNA, 19 nt, Homo sapiens
gagcaacacucugucucaa

SEQ ID NO: 265491 - RNA, 19 nt, Homo sapiens
gaaugugugugguguuaag

SEQ ID NO: 265492 - RNA, 19 nt, Homo sapiens
aaugaagacucaauugguu

SEQ ID NO: 265493 - RNA, 19 nt, Homo sapiens
gagacgcuguguauuuguu

SEQ ID NO: 265494 - RNA, 19 nt, Homo sapiens
caagagugauguacagucu

SEQ ID NO: 265495 - RNA, 19 nt, Homo sapiens
gcaacacucugucucaaaa

SEQ ID NO: 265496 - RNA, 19 nt, Homo sapiens
ucgaaugugugugguguua

SEQ ID NO: 265497 - RNA, 19 nt, Homo sapiens
ucaaagggccugcaaaucu

SEQ ID NO: 265498 - RNA, 19 nt, Homo sapiens
guggagacgcuguguauuu

SEQ ID NO: 265499 - RNA, 19 nt, Homo sapiens
gaacucaaagggcauuuag

SEQ ID NO: 265500 - RNA, 19 nt, Homo sapiens
ggagagaaacagagacuca

SEQ ID NO: 265501 - RNA, 19 nt, Homo sapiens
cgaguugaguuguguugaa

SEQ ID NO: 265502 - RNA, 19 nt, Homo sapiens
guugagacaugguggaaau

SEQ ID NO: 265503 - RNA, 19 nt, Homo sapiens
cauguugggucaaguuaga

SEQ ID NO: 265504 - RNA, 19 nt, Homo sapiens
ggcaauggguuguguugug

SEQ ID NO: 265505 - RNA, 19 nt, Homo sapiens
guacuuuacuuggguuaau

SEQ ID NO: 265506 - RNA, 19 nt, Homo sapiens
guugaguuguguugaauug

SEQ ID NO: 265507 - RNA, 19 nt, Homo sapiens
gaacuugcgagucauguag

SEQ ID NO: 265508 - RNA, 19 nt, Homo sapiens
gggaaacacugagucuugu

SEQ ID NO: 265509 - RNA, 19 nt, Homo sapiens
gagcuagguuaagucguaa

SEQ ID NO: 265510 - RNA, 19 nt, Homo sapiens
gaagugugaggaacaguug

SEQ ID NO: 265511 - RNA, 19 nt, Homo sapiens
gaggcgacuggguaaauua

SEQ ID NO: 265512 - RNA, 19 nt, Homo sapiens
cacauuggguuaaguuugu

SEQ ID NO: 265513 - RNA, 19 nt, Homo sapiens
gagacaugguggaaauugu

SEQ ID NO: 265514 - RNA, 19 nt, Homo sapiens
gagauagguuuggucguau

SEQ ID NO: 265515 - RNA, 19 nt, Homo sapiens
ccaaaaggauagagaaaga

SEQ ID NO: 265516 - RNA, 19 nt, Homo sapiens
gcaccaggacccaaaggaa

SEQ ID NO: 265517 - RNA, 19 nt, Homo sapiens
agacucaauugguucauau

SEQ ID NO: 265518 - RNA, 19 nt, Homo sapiens
gaauuguacaaccauauga

SEQ ID NO: 265519 - RNA, 19 nt, Homo sapiens
gauagugggcucucugugu

SEQ ID NO: 265520 - RNA, 19 nt, Homo sapiens
uauagggcuuccuuuggua

SEQ ID NO: 265521 - RNA, 19 nt, Homo sapiens
agagugauguacagucuau

SEQ ID NO: 265522 - RNA, 19 nt, Homo sapiens
gcagaagagaggaacagaa

SEQ ID NO: 265523 - RNA, 19 nt, Homo sapiens
ccaggggcauguuauuuua

SEQ ID NO: 265524 - RNA, 19 nt, Homo sapiens
cuaggucaguguuggguuu

SEQ ID NO: 265525 - RNA, 19 nt, Homo sapiens
gaauggcaauggguugugu

SEQ ID NO: 265526 - RNA, 19 nt, Homo sapiens
ucacaaggccgaacauuuu

SEQ ID NO: 265527 - RNA, 19 nt, Homo sapiens
gcaggagaauggcaugaac

SEQ ID NO: 265528 - RNA, 19 nt, Homo sapiens
gaaaccccgucucuacuaa

SEQ ID NO: 265529 - RNA, 19 nt, Homo sapiens
gggaaagagaaccacaaua

SEQ ID NO: 265530 - RNA, 19 nt, Homo sapiens
uggagacgcuguguauuug

SEQ ID NO: 265531 - RNA, 19 nt, Homo sapiens
gcgacuggguaaauuagga

SEQ ID NO: 265532 - RNA, 19 nt, Homo sapiens
gaagaguccagugguagaa

SEQ ID NO: 265533 - RNA, 19 nt, Homo sapiens
ucugugaacuugcgaguca

SEQ ID NO: 265534 - RNA, 19 nt, Homo sapiens
uaaguuucguugagacaug

SEQ ID NO: 265535 - RNA, 19 nt, Homo sapiens
aauggguuguguuguguua

SEQ ID NO: 265536 - RNA, 19 nt, Homo sapiens
gauguacagucuauuccau

SEQ ID NO: 265537 - RNA, 19 nt, Homo sapiens
aagagaaccacaauagaaa

SEQ ID NO: 265538 - RNA, 19 nt, Homo sapiens
ggagacagaacaacagagu

SEQ ID NO: 265539 - RNA, 19 nt, Homo sapiens
ugugaagaguccaguggua

SEQ ID NO: 265540 - RNA, 19 nt, Homo sapiens
ccauugaguugugucacua

SEQ ID NO: 265541 - RNA, 19 nt, Homo sapiens
gaguugaguuguguugaau

SEQ ID NO: 265542 - RNA, 19 nt, Homo sapiens
caagcaaggcuaucuucuu

SEQ ID NO: 265543 - RNA, 19 nt, Homo sapiens
gguguuaaguuucguugag

SEQ ID NO: 265544 - RNA, 19 nt, Homo sapiens
guggguaccuccugaagca

SEQ ID NO: 265545 - RNA, 19 nt, Homo sapiens
cacuguggguggcaagaua

SEQ ID NO: 265546 - RNA, 19 nt, Homo sapiens
gagcugggccuccucaucu

SEQ ID NO: 265547 - RNA, 19 nt, Homo sapiens
ggaagaaggcugaaaucac

SEQ ID NO: 265548 - RNA, 19 nt, Homo sapiens
ggccgaggugggcaaauua

SEQ ID NO: 265549 - RNA, 19 nt, Homo sapiens
uggaugcuccuccuguuua

SEQ ID NO: 265550 - RNA, 19 nt, Homo sapiens
gguggaugcuccuccuguu

SEQ ID NO: 265551 - RNA, 19 nt, Homo sapiens
uagguuuggucguaucauu

SEQ ID NO: 265552 - RNA, 19 nt, Homo sapiens
gcgaagaggcugggauguu

SEQ ID NO: 265553 - RNA, 19 nt, Homo sapiens
ugugugugguguuaaguuu

SEQ ID NO: 265554 - RNA, 19 nt, Homo sapiens
cgucagacacccagaguug

SEQ ID NO: 265555 - RNA, 19 nt, Homo sapiens
ugaauugaguuccauugag

SEQ ID NO: 265556 - RNA, 19 nt, Homo sapiens
gggccaugcugaauugagu

SEQ ID NO: 265557 - RNA, 19 nt, Homo sapiens
gaauuugagcuuucuaggu

SEQ ID NO: 265558 - RNA, 19 nt, Homo sapiens
aggaagagcuagguuaagu

SEQ ID NO: 265559 - RNA, 19 nt, Homo sapiens
ucgagacgcugccugacuu

SEQ ID NO: 265560 - RNA, 19 nt, Homo sapiens
gagagacgcaggacaggau

SEQ ID NO: 265561 - RNA, 19 nt, Homo sapiens
ggcuauccuucccuacuuu

SEQ ID NO: 265562 - RNA, 19 nt, Homo sapiens
gaaguggcccaugccugua

SEQ ID NO: 265563 - RNA, 19 nt, Homo sapiens
gcacagacucucuuaauaa

SEQ ID NO: 265564 - RNA, 19 nt, Homo sapiens
gaacaucccaggagaaauu

SEQ ID NO: 265565 - RNA, 19 nt, Homo sapiens
gaugaaaucuccuucuaug

SEQ ID NO: 265566 - RNA, 19 nt, Homo sapiens
gaacaucauugacaucauc

SEQ ID NO: 265567 - RNA, 19 nt, Homo sapiens
gaacuucuucuucuccaua

SEQ ID NO: 265568 - RNA, 19 nt, Homo sapiens
gaagcaugcugccaaaaua

SEQ ID NO: 265569 - RNA, 19 nt, Homo sapiens
caacauugcugggcugaga

SEQ ID NO: 265570 - RNA, 19 nt, Homo sapiens
caacuucaauuacuucuac

SEQ ID NO: 265571 - RNA, 19 nt, Homo sapiens
cagaugaaauccaagaaga

SEQ ID NO: 265572 - RNA, 19 nt, Homo sapiens
caggagaaauugaaagaau

SEQ ID NO: 265573 - RNA, 19 nt, Homo sapiens
caugacaacuguaggcuau

SEQ ID NO: 265574 - RNA, 19 nt, Homo sapiens
uaccuuaccucaauaaaca

SEQ ID NO: 265575 - RNA, 19 nt, Homo sapiens
ccacagagaagucuaggaa

SEQ ID NO: 265576 - RNA, 19 nt, Homo sapiens
acagagaagucuaggaaau

SEQ ID NO: 265577 - RNA, 19 nt, Homo sapiens
caucaaagacccugaaaca

SEQ ID NO: 265578 - RNA, 19 nt, Homo sapiens
ucuaugagcuggguaguga

SEQ ID NO: 265579 - RNA, 19 nt, Homo sapiens
uaucuuugcugaugaaauc

SEQ ID NO: 265580 - RNA, 19 nt, Homo sapiens
aaagaauccucaacagugu

SEQ ID NO: 265581 - RNA, 19 nt, Homo sapiens
gaaagcaccaaccaugaga

SEQ ID NO: 265582 - RNA, 19 nt, Homo sapiens
gaauguuaacuuccucuuu

SEQ ID NO: 265583 - RNA, 19 nt, Homo sapiens
caucuucuuucucuucauu

SEQ ID NO: 265584 - RNA, 19 nt, Homo sapiens
guguguggcuggaaagaaa

SEQ ID NO: 265585 - RNA, 19 nt, Homo sapiens
ggauguguguggcuggaaa

SEQ ID NO: 265586 - RNA, 19 nt, Homo sapiens
agagaagucuaggaaauga

SEQ ID NO: 265587 - RNA, 19 nt, Homo sapiens
ucagaacccuuagucaguu

SEQ ID NO: 265588 - RNA, 19 nt, Homo sapiens
gcgaaagcaccaaccauga

SEQ ID NO: 265589 - RNA, 19 nt, Homo sapiens
gacaucaucuccauuaucc

SEQ ID NO: 265590 - RNA, 19 nt, Homo sapiens
ucaggaacaucaugaacau

SEQ ID NO: 265591 - RNA, 19 nt, Homo sapiens
cugaugaaaucuccuucua

SEQ ID NO: 265592 - RNA, 19 nt, Homo sapiens
agguugcgcuggucaauuu

SEQ ID NO: 265593 - RNA, 19 nt, Homo sapiens
gguguaccuuaccucaaua

SEQ ID NO: 265594 - RNA, 19 nt, Homo sapiens
agcacagacucucuuaaua

SEQ ID NO: 265595 - RNA, 19 nt, Homo sapiens
ccacagacuucgacucaac

SEQ ID NO: 265596 - RNA, 19 nt, Homo sapiens
caccgacccuuucuucaug

SEQ ID NO: 265597 - RNA, 19 nt, Homo sapiens
uugcaacucucaucacaga

SEQ ID NO: 265598 - RNA, 19 nt, Homo sapiens
ucaaagacccugaaacacu

SEQ ID NO: 265599 - RNA, 19 nt, Homo sapiens
ugcccuggaucuuguauaa

SEQ ID NO: 265600 - RNA, 19 nt, Homo sapiens
cagcacagacucucuuaau

SEQ ID NO: 265601 - RNA, 19 nt, Homo sapiens
gcagaacaucccaggagaa

SEQ ID NO: 265602 - RNA, 19 nt, Homo sapiens
aaacacugcuacccaccaa

SEQ ID NO: 265603 - RNA, 19 nt, Homo sapiens
gaaaccagcgggugaucau

SEQ ID NO: 265604 - RNA, 19 nt, Homo sapiens
cccuggaucuuguauaaug

SEQ ID NO: 265605 - RNA, 19 nt, Homo sapiens
cagaacaucccaggagaaa

SEQ ID NO: 265606 - RNA, 19 nt, Homo sapiens
uggagacacugccagaguu

SEQ ID NO: 265607 - RNA, 19 nt, Homo sapiens
ugauaucuuugcugaugaa

SEQ ID NO: 265608 - RNA, 19 nt, Homo sapiens
gucauugucuccaacuuca

SEQ ID NO: 265609 - RNA, 19 nt, Homo sapiens
ugaaaucuccuucuaugag

SEQ ID NO: 265610 - RNA, 19 nt, Homo sapiens
gcucaucuucuuucucuuc

SEQ ID NO: 265611 - RNA, 19 nt, Homo sapiens
gugaggccauggaccaguu

SEQ ID NO: 265612 - RNA, 19 nt, Homo sapiens
ugaaagaauccucaacagu

SEQ ID NO: 265613 - RNA, 19 nt, Homo sapiens
gagccagagucccauuucu

SEQ ID NO: 265614 - RNA, 19 nt, Homo sapiens
gugagggucuuccgcaucu

SEQ ID NO: 265615 - RNA, 19 nt, Homo sapiens
gacguuccuucccaagcua

SEQ ID NO: 265616 - RNA, 19 nt, Homo sapiens
aguguaggcucaagaaugg

SEQ ID NO: 265617 - RNA, 19 nt, Homo sapiens
agccagugguccuaaauga

SEQ ID NO: 265618 - RNA, 19 nt, Homo sapiens
caacaguguaggcucaaga

SEQ ID NO: 265619 - RNA, 19 nt, Homo sapiens
uugcugggcugagauuuga

SEQ ID NO: 265620 - RNA, 19 nt, Homo sapiens
ugguguaccuuaccucaau

SEQ ID NO: 265621 - RNA, 19 nt, Homo sapiens
cagagaagucuaggaaaug

SEQ ID NO: 265622 - RNA, 19 nt, Homo sapiens
gcagcacagacucucuuaa

SEQ ID NO: 265623 - RNA, 19 nt, Homo sapiens
cuaccugcaucgugugguu

SEQ ID NO: 265624 - RNA, 19 nt, Homo sapiens
ggagacugagaaugaagaa

SEQ ID NO: 265625 - RNA, 19 nt, Homo sapiens
ucccauuucucuagcauuc

SEQ ID NO: 265626 - RNA, 19 nt, Homo sapiens
ucuccaacuucaauuacuu

SEQ ID NO: 265627 - RNA, 19 nt, Homo sapiens
ggaagauugugggcacucu

SEQ ID NO: 265628 - RNA, 19 nt, Homo sapiens
ugacaacuguaggcuaugg

SEQ ID NO: 265629 - RNA, 19 nt, Homo sapiens
auugacaucaucuccauua

SEQ ID NO: 265630 - RNA, 19 nt, Homo sapiens
ucauugacaucaucuccau

SEQ ID NO: 265631 - RNA, 19 nt, Homo sapiens
auugauaucuuugcugaug

SEQ ID NO: 265632 - RNA, 19 nt, Homo sapiens
ccagugguccuaaaugaag

SEQ ID NO: 265633 - RNA, 19 nt, Homo sapiens
cuacuuugcugagguggau

SEQ ID NO: 265634 - RNA, 19 nt, Homo sapiens
ggagacacugccagaguuc

SEQ ID NO: 265635 - RNA, 19 nt, Homo sapiens
ggaaaccagcgggugauca

SEQ ID NO: 265636 - RNA, 19 nt, Homo sapiens
ccuggaucuuguauaauga

SEQ ID NO: 265637 - RNA, 19 nt, Homo sapiens
caguguaggcucaagaaug

SEQ ID NO: 265638 - RNA, 19 nt, Homo sapiens
aggagaaauugaaagaauc

SEQ ID NO: 265639 - RNA, 19 nt, Homo sapiens
ccagugcagucuacuuugc

SEQ ID NO: 265640 - RNA, 19 nt, Homo sapiens
gcccauugguguaccuuac

SEQ ID NO: 265641 - RNA, 19 nt, Homo sapiens
cuuagucaguucccagaga

SEQ ID NO: 265642 - RNA, 19 nt, Homo sapiens
uaaugaacuucuucuucuc

SEQ ID NO: 265643 - RNA, 19 nt, Homo sapiens
ggcagcacagacucucuua

SEQ ID NO: 265644 - RNA, 19 nt, Homo sapiens
ugacaucaucuccauuauc

SEQ ID NO: 265645 - RNA, 19 nt, Homo sapiens
guucaccgacccuuucuuc

SEQ ID NO: 265646 - RNA, 19 nt, Homo sapiens
ccagaguuccgggaggaua

SEQ ID NO: 265647 - RNA, 19 nt, Homo sapiens
ucaguucuggcuccucuuu

SEQ ID NO: 265648 - RNA, 19 nt, Homo sapiens
ggaauccuauauuauuacc

SEQ ID NO: 265649 - RNA, 19 nt, Homo sapiens
gagccagugguccuaaaug

SEQ ID NO: 265650 - RNA, 19 nt, Homo sapiens
gggagacugagaaugaaga

SEQ ID NO: 265651 - RNA, 19 nt, Homo sapiens
ugacguuccuucccaagcu

SEQ ID NO: 265652 - RNA, 19 nt, Homo sapiens
gagccgagugcccaacaga

SEQ ID NO: 265653 - RNA, 19 nt, Homo sapiens
cgaaagcaccaaccaugag

SEQ ID NO: 265654 - RNA, 19 nt, Homo sapiens
uugcucaucuucuuucucu

SEQ ID NO: 265655 - RNA, 19 nt, Homo sapiens
caauaaacaagggccaguu

SEQ ID NO: 265656 - RNA, 19 nt, Homo sapiens
uugaguacccugaaaguuc

SEQ ID NO: 265657 - RNA, 19 nt, Homo sapiens
ugaugaaaucuccuucuau

SEQ ID NO: 265658 - RNA, 19 nt, Homo sapiens
guaccuuaccucaauaaac

SEQ ID NO: 265659 - RNA, 19 nt, Homo sapiens
gggcagcacagacucucuu

SEQ ID NO: 265660 - RNA, 19 nt, Homo sapiens
ccgggagacugagaaugaa

SEQ ID NO: 265661 - RNA, 19 nt, Homo sapiens
aguucuggcuccucuuuga

SEQ ID NO: 265662 - RNA, 19 nt, Homo sapiens
aauaaacaagggccaguug

SEQ ID NO: 265663 - RNA, 19 nt, Homo sapiens
gaaaccagcucaaguaagu

SEQ ID NO: 265664 - RNA, 19 nt, Homo sapiens
ucaaagagacuguguguua

SEQ ID NO: 265665 - RNA, 19 nt, Homo sapiens
gaagacauguacaauaaga

SEQ ID NO: 265666 - RNA, 19 nt, Homo sapiens
gcacagcaccuccuuguaa

SEQ ID NO: 265667 - RNA, 19 nt, Homo sapiens
gaagagagacuccagagaa

SEQ ID NO: 265668 - RNA, 19 nt, Homo sapiens
ggaagucucugcgccauaa

SEQ ID NO: 265669 - RNA, 19 nt, Homo sapiens
uggaagacauguacaauaa

SEQ ID NO: 265670 - RNA, 19 nt, Homo sapiens
gauaaccacuugucuccua

SEQ ID NO: 265671 - RNA, 19 nt, Homo sapiens
cgaaguaugucaagcauug

SEQ ID NO: 265672 - RNA, 19 nt, Homo sapiens
ggaacacgcuuucuuuaca

SEQ ID NO: 265673 - RNA, 19 nt, Homo sapiens
gcaauagcguucaacuuug

SEQ ID NO: 265674 - RNA, 19 nt, Homo sapiens
gccaagagcucgacuacug

SEQ ID NO: 265675 - RNA, 19 nt, Homo sapiens
ggaggaacacgcuuucuuu

SEQ ID NO: 265676 - RNA, 19 nt, Homo sapiens
gauaugcaagugucaaaua

SEQ ID NO: 265677 - RNA, 19 nt, Homo sapiens
guaaagcccucagagagaa

SEQ ID NO: 265678 - RNA, 19 nt, Homo sapiens
cgaauucuccgcauccuua

SEQ ID NO: 265679 - RNA, 19 nt, Homo sapiens
gaggaacacgcuuucuuua

SEQ ID NO: 265680 - RNA, 19 nt, Homo sapiens
gaacacgcuuucuuuacau

SEQ ID NO: 265681 - RNA, 19 nt, Homo sapiens
gcaaaacccuuacucaaau

SEQ ID NO: 265682 - RNA, 19 nt, Homo sapiens
cgacaacgaguacuucuuu

SEQ ID NO: 265683 - RNA, 19 nt, Homo sapiens
aaauggaaauggacaaaga

SEQ ID NO: 265684 - RNA, 19 nt, Homo sapiens
gggagaauauggguaagaa

SEQ ID NO: 265685 - RNA, 19 nt, Homo sapiens
gcacagagcaaaccaaagg

SEQ ID NO: 265686 - RNA, 19 nt, Homo sapiens
gcauugagaugauggacau

SEQ ID NO: 265687 - RNA, 19 nt, Homo sapiens
agaguggguugaccaauuu

SEQ ID NO: 265688 - RNA, 19 nt, Homo sapiens
ccacagcccuuugacauca

SEQ ID NO: 265689 - RNA, 19 nt, Homo sapiens
gucaauaacuucucugagu

SEQ ID NO: 265690 - RNA, 19 nt, Homo sapiens
guccagaucuuccgcauca

SEQ ID NO: 265691 - RNA, 19 nt, Homo sapiens
gaaagacaaaguacaagau

SEQ ID NO: 265692 - RNA, 19 nt, Homo sapiens
ggagaugacaugaguggaa

SEQ ID NO: 265693 - RNA, 19 nt, Homo sapiens
gaacuugaaauggagagua

SEQ ID NO: 265694 - RNA, 19 nt, Homo sapiens
aggaagaacuugaaaugga

SEQ ID NO: 265695 - RNA, 19 nt, Homo sapiens
gaacucacagccaccacua

SEQ ID NO: 265696 - RNA, 19 nt, Homo sapiens
ugagaaacacacagcaaua

SEQ ID NO: 265697 - RNA, 19 nt, Homo sapiens
ucacuaguguagacucaaa

SEQ ID NO: 265698 - RNA, 19 nt, Homo sapiens
ugacuucgguauuucauag

SEQ ID NO: 265699 - RNA, 19 nt, Homo sapiens
aagaguggguugaccaauu

SEQ ID NO: 265700 - RNA, 19 nt, Homo sapiens
guaaguccuuugaaaccaa

SEQ ID NO: 265701 - RNA, 19 nt, Homo sapiens
acaagcggcugguguugaa

SEQ ID NO: 265702 - RNA, 19 nt, Homo sapiens
cagagaaggcucccuaaga

SEQ ID NO: 265703 - RNA, 19 nt, Homo sapiens
ggacauugugguugagaaa

SEQ ID NO: 265704 - RNA, 19 nt, Homo sapiens
agaaagagcagaugaacga

SEQ ID NO: 265705 - RNA, 19 nt, Homo sapiens
cagaagcauugacuggaaa

SEQ ID NO: 265706 - RNA, 19 nt, Homo sapiens
aaaggaagaacuugaaaug

SEQ ID NO: 265707 - RNA, 19 nt, Homo sapiens
acaagagcgugcugcaauu

SEQ ID NO: 265708 - RNA, 19 nt, Homo sapiens
gagacuguguguuacugaa

SEQ ID NO: 265709 - RNA, 19 nt, Homo sapiens
uaaggcagaacuguauuua

SEQ ID NO: 265710 - RNA, 19 nt, Homo sapiens
gagcaaaccaaaggaagaa

SEQ ID NO: 265711 - RNA, 19 nt, Homo sapiens
acaauaagauggccaagac

SEQ ID NO: 265712 - RNA, 19 nt, Homo sapiens
aaagccagaucgucuucua

SEQ ID NO: 265713 - RNA, 19 nt, Homo sapiens
gagaauauggguaagaaag

SEQ ID NO: 265714 - RNA, 19 nt, Homo sapiens
ucucugaguucuauaagga

SEQ ID NO: 265715 - RNA, 19 nt, Homo sapiens
caaagagacuguguguuac

SEQ ID NO: 265716 - RNA, 19 nt, Homo sapiens
ccaacagcaugaacucaga

SEQ ID NO: 265717 - RNA, 19 nt, Homo sapiens
acagaagcauugacuggaa

SEQ ID NO: 265718 - RNA, 19 nt, Homo sapiens
gccauaauuuccaucaugu

SEQ ID NO: 265719 - RNA, 19 nt, Homo sapiens
ccacuuguacucaauucua

SEQ ID NO: 265720 - RNA, 19 nt, Homo sapiens
gaaagaguggguugaccaa

SEQ ID NO: 265721 - RNA, 19 nt, Homo sapiens
ccuaacaaauggaaaugga

SEQ ID NO: 265722 - RNA, 19 nt, Homo sapiens
ggacgacaccaaguucaaa

SEQ ID NO: 265723 - RNA, 19 nt, Homo sapiens
agcaauagcguucaacuuu

SEQ ID NO: 265724 - RNA, 19 nt, Homo sapiens
gcacucuaguuucuucauc

SEQ ID NO: 265725 - RNA, 19 nt, Homo sapiens
ugauggacauugugguuga

SEQ ID NO: 265726 - RNA, 19 nt, Homo sapiens
ggagagagccaagaggaau

SEQ ID NO: 265727 - RNA, 19 nt, Homo sapiens
cggaggagcuacaaugagu

SEQ ID NO: 265728 - RNA, 19 nt, Homo sapiens
gcaagugucaaauaugcaa

SEQ ID NO: 265729 - RNA, 19 nt, Homo sapiens
agagaaggaugcuggaaca

SEQ ID NO: 265730 - RNA, 19 nt, Homo sapiens
gagaaacacacagcaauag

SEQ ID NO: 265731 - RNA, 19 nt, Homo sapiens
ucugaaaccagcucaagua

SEQ ID NO: 265732 - RNA, 19 nt, Homo sapiens
gaugauggacauugugguu

SEQ ID NO: 265733 - RNA, 19 nt, Homo sapiens
gaaaugcccaguucagacu

SEQ ID NO: 265734 - RNA, 19 nt, Homo sapiens
gaacucagagcauuguuuu

SEQ ID NO: 265735 - RNA, 19 nt, Homo sapiens
cccauucucucguggcuuu

SEQ ID NO: 265736 - RNA, 19 nt, Homo sapiens
agagaaggcucccuaagac

SEQ ID NO: 265737 - RNA, 19 nt, Homo sapiens
gacagcugcucuacagugu

SEQ ID NO: 265738 - RNA, 19 nt, Homo sapiens
gaauauggguaagaaagac

SEQ ID NO: 265739 - RNA, 19 nt, Homo sapiens
gaagaaagagcagaugaac

SEQ ID NO: 265740 - RNA, 19 nt, Homo sapiens
gacaacgaguacuucuuug

SEQ ID NO: 265741 - RNA, 19 nt, Homo sapiens
aaacuaacaacccuuugaa

SEQ ID NO: 265742 - RNA, 19 nt, Homo sapiens
gaacaugaaggaugcuuuu

SEQ ID NO: 265743 - RNA, 19 nt, Homo sapiens
uuagacagcuacagggaau

SEQ ID NO: 265744 - RNA, 19 nt, Homo sapiens
gcauugauaguuucauuag

SEQ ID NO: 265745 - RNA, 19 nt, Homo sapiens
caaaggaagaacuugaaau

SEQ ID NO: 265746 - RNA, 19 nt, Homo sapiens
cacuuguacucaauucuaa

SEQ ID NO: 265747 - RNA, 19 nt, Homo sapiens
aggcagaacuguauuuacu

SEQ ID NO: 265748 - RNA, 19 nt, Homo sapiens
ccagccagcacucuaguuu

SEQ ID NO: 265749 - RNA, 19 nt, Homo sapiens
ccaaaggaagaacuugaaa

SEQ ID NO: 265750 - RNA, 19 nt, Homo sapiens
gaagagacaggagaaagca

SEQ ID NO: 265751 - RNA, 19 nt, Homo sapiens
ggagacaucuaccccaaga

SEQ ID NO: 265752 - RNA, 19 nt, Homo sapiens
uacagagccucgaugaguu

SEQ ID NO: 265753 - RNA, 19 nt, Homo sapiens
gagcaccaguccgaaguuc

SEQ ID NO: 265754 - RNA, 19 nt, Homo sapiens
gcccagaguccuccaucua

SEQ ID NO: 265755 - RNA, 19 nt, Homo sapiens
ccagcacucuaguuucuuc

SEQ ID NO: 265756 - RNA, 19 nt, Homo sapiens
gaggagcuacaaugaguug

SEQ ID NO: 265757 - RNA, 19 nt, Homo sapiens
ggaccgaggccacauacuc

SEQ ID NO: 265758 - RNA, 19 nt, Homo sapiens
ccaaagaggagagcuguuc

SEQ ID NO: 265759 - RNA, 19 nt, Homo sapiens
guacauugacgcagacaca

SEQ ID NO: 265760 - RNA, 19 nt, Homo sapiens
cagaagaaagagcagauga

SEQ ID NO: 265761 - RNA, 19 nt, Homo sapiens
ucaccuccauccucaacuu

SEQ ID NO: 265762 - RNA, 19 nt, Homo sapiens
ggguaagaaagacaaagua

SEQ ID NO: 265763 - RNA, 19 nt, Homo sapiens
gaaauuaacagagcaggua

SEQ ID NO: 265764 - RNA, 19 nt, Homo sapiens
uaacagagcagguaggaaa

SEQ ID NO: 265765 - RNA, 19 nt, Homo sapiens
caacaucauugacuuugug

SEQ ID NO: 265766 - RNA, 19 nt, Homo sapiens
guaaaucugucguaaacuc

SEQ ID NO: 265767 - RNA, 19 nt, Homo sapiens
cgggauguauuacuccuua

SEQ ID NO: 265768 - RNA, 19 nt, Homo sapiens
gcagaaacuaccaaagaaa

SEQ ID NO: 265769 - RNA, 19 nt, Homo sapiens
ggccuucgcuucccucuuc

SEQ ID NO: 265770 - RNA, 19 nt, Homo sapiens
gagcccugcugcuggauga

SEQ ID NO: 265771 - RNA, 19 nt, Homo sapiens
gagcacacgcacuuuaaga

SEQ ID NO: 265772 - RNA, 19 nt, Homo sapiens
aagcagaaacuaccaaaga

SEQ ID NO: 265773 - RNA, 19 nt, Homo sapiens
ccacagccacuucgacuau

SEQ ID NO: 265774 - RNA, 19 nt, Homo sapiens
acaauuucgggauguauua

SEQ ID NO: 265775 - RNA, 19 nt, Homo sapiens
ccucaugcgugucaucuuc

SEQ ID NO: 265776 - RNA, 19 nt, Homo sapiens
gaacaauuucgggauguau

SEQ ID NO: 265777 - RNA, 19 nt, Homo sapiens
ugaacaauuucgggaugua

SEQ ID NO: 265778 - RNA, 19 nt, Homo sapiens
agacggagaucgagaacgu

SEQ ID NO: 265779 - RNA, 19 nt, Homo sapiens
uaagcugacccgccacuuu

SEQ ID NO: 265780 - RNA, 19 nt, Homo sapiens
caagaacucgcucaacauc

SEQ ID NO: 265781 - RNA, 19 nt, Homo sapiens
caagguagaguucaucaag

SEQ ID NO: 265782 - RNA, 19 nt, Homo sapiens
cuacuacgccgagaggaua

SEQ ID NO: 265783 - RNA, 19 nt, Homo sapiens
gcaucuugcgcaucuuuaa

SEQ ID NO: 265784 - RNA, 19 nt, Homo sapiens
gaacucgcucaacaucauu

SEQ ID NO: 265785 - RNA, 19 nt, Homo sapiens
ccaacaagguagaguucau

SEQ ID NO: 265786 - RNA, 19 nt, Homo sapiens
agcagaaacuaccaaagaa

SEQ ID NO: 265787 - RNA, 19 nt, Homo sapiens
agaacucgcucaacaucau

SEQ ID NO: 265788 - RNA, 19 nt, Homo sapiens
ucgcgcacauccugaacua

SEQ ID NO: 265789 - RNA, 19 nt, Homo sapiens
agguagaguucaucaagaa

SEQ ID NO: 265790 - RNA, 19 nt, Homo sapiens
gugagcacacgcacuuuaa

SEQ ID NO: 265791 - RNA, 19 nt, Homo sapiens
gagacggaggccuuccuua

SEQ ID NO: 265792 - RNA, 19 nt, Homo sapiens
ccacaccacaguacucaga

SEQ ID NO: 265793 - RNA, 19 nt, Homo sapiens
ugacgacccugggcuaugg

SEQ ID NO: 265794 - RNA, 19 nt, Homo sapiens
gcacacgcacuuuaagaac

SEQ ID NO: 265795 - RNA, 19 nt, Homo sapiens
cacacgcacuuuaagaaca

SEQ ID NO: 265796 - RNA, 19 nt, Homo sapiens
aggaggagcuggccuucug

SEQ ID NO: 265797 - RNA, 19 nt, Homo sapiens
aagguagaguucaucaaga

SEQ ID NO: 265798 - RNA, 19 nt, Homo sapiens
gaucgagaacguucgcaau

SEQ ID NO: 265799 - RNA, 19 nt, Homo sapiens
ucgccaccaugaucuacua

SEQ ID NO: 265800 - RNA, 19 nt, Homo sapiens
gcgagcgcaucgugaucaa

SEQ ID NO: 265801 - RNA, 19 nt, Homo sapiens
acagccacuucgacuauga

SEQ ID NO: 265802 - RNA, 19 nt, Homo sapiens
uuguaaaucugucguaaac

SEQ ID NO: 265803 - RNA, 19 nt, Homo sapiens
acacgcacuuuaagaacau

SEQ ID NO: 265804 - RNA, 19 nt, Homo sapiens
aagcugacccgccacuuug

SEQ ID NO: 265805 - RNA, 19 nt, Homo sapiens
gcgcuccucuggacaacag

SEQ ID NO: 265806 - RNA, 19 nt, Homo sapiens
aucaagaacucgcucaaca

SEQ ID NO: 265807 - RNA, 19 nt, Homo sapiens
gugaacaauuucgggaugu

SEQ ID NO: 265808 - RNA, 19 nt, Homo sapiens
cgcacauccugaacuacua

SEQ ID NO: 265809 - RNA, 19 nt, Homo sapiens
ugagcggccuguccuccaa

SEQ ID NO: 265810 - RNA, 19 nt, Homo sapiens
cggaggccuuccuuaccua

SEQ ID NO: 265811 - RNA, 19 nt, Homo sapiens
gagccagcaccaacgaguu

SEQ ID NO: 265812 - RNA, 19 nt, Homo sapiens
caacaagguagaguucauc

SEQ ID NO: 265813 - RNA, 19 nt, Homo sapiens
ugaacaagacggagaucga

SEQ ID NO: 265814 - RNA, 19 nt, Homo sapiens
acaagacggagaucgagaa

SEQ ID NO: 265815 - RNA, 19 nt, Homo sapiens
uuagaggcaugucgaucug

SEQ ID NO: 265816 - RNA, 19 nt, Homo sapiens
ccugggcuauggagacaug

SEQ ID NO: 265817 - RNA, 19 nt, Homo sapiens
gcgcacauccugaacuacu

SEQ ID NO: 265818 - RNA, 19 nt, Homo sapiens
ucgcuucccucuucuucau

SEQ ID NO: 265819 - RNA, 19 nt, Homo sapiens
aggaggcucuggacagcuu

SEQ ID NO: 265820 - RNA, 19 nt, Homo sapiens
cuaagcagaaacuaccaaa

SEQ ID NO: 265821 - RNA, 19 nt, Homo sapiens
ucaagaacucgcucaacau

SEQ ID NO: 265822 - RNA, 19 nt, Homo sapiens
gcacauccugaacuacuac

SEQ ID NO: 265823 - RNA, 19 nt, Homo sapiens
cagaaacuaccaaagaaaa

SEQ ID NO: 265824 - RNA, 19 nt, Homo sapiens
ucgagaacguucgcaaugg

SEQ ID NO: 265825 - RNA, 19 nt, Homo sapiens
gaggacgagcuggagauga

SEQ ID NO: 265826 - RNA, 19 nt, Homo sapiens
gcuaagcagaaacuaccaa

SEQ ID NO: 265827 - RNA, 19 nt, Homo sapiens
ccgucaucgugaacaauuu

SEQ ID NO: 265828 - RNA, 19 nt, Homo sapiens
agacggaggccuuccuuac

SEQ ID NO: 265829 - RNA, 19 nt, Homo sapiens
gcaaagagguugucauuac

SEQ ID NO: 265830 - RNA, 19 nt, Homo sapiens
cauccuaccuuucuacuua

SEQ ID NO: 265831 - RNA, 19 nt, Homo sapiens
gaacauaacagaucagugu

SEQ ID NO: 265832 - RNA, 19 nt, Homo sapiens
ggccagaucucuuacuuaa

SEQ ID NO: 265833 - RNA, 19 nt, Homo sapiens
ccagaucucuuacuuaaug

SEQ ID NO: 265834 - RNA, 19 nt, Homo sapiens
gggaaauuguuauagcuua

SEQ ID NO: 265835 - RNA, 19 nt, Homo sapiens
gagaaaguguuguacagaa

SEQ ID NO: 265836 - RNA, 19 nt, Homo sapiens
gauaaccaguggaaaugua

SEQ ID NO: 265837 - RNA, 19 nt, Homo sapiens
ggacuauacuggaaacaga

SEQ ID NO: 265838 - RNA, 19 nt, Homo sapiens
ggagggaucaggaaagaua

SEQ ID NO: 265839 - RNA, 19 nt, Homo sapiens
guacagaauuuaucaugga

SEQ ID NO: 265840 - RNA, 19 nt, Homo sapiens
ggagcaaugucaguauaua

SEQ ID NO: 265841 - RNA, 19 nt, Homo sapiens
guaacuaacugaaaugaag

SEQ ID NO: 265842 - RNA, 19 nt, Homo sapiens
gaaagggacaguggaauuu

SEQ ID NO: 265843 - RNA, 19 nt, Homo sapiens
aauauggccugcaauagua

SEQ ID NO: 265844 - RNA, 19 nt, Homo sapiens
gaagccaaauucaugauca

SEQ ID NO: 265845 - RNA, 19 nt, Homo sapiens
gugaggauccugagaauuu

SEQ ID NO: 265846 - RNA, 19 nt, Homo sapiens
ggacauacucuucgagcua

SEQ ID NO: 265847 - RNA, 19 nt, Homo sapiens
gaacucaccaacauuauuc

SEQ ID NO: 265848 - RNA, 19 nt, Homo sapiens
ucgccuaugugcucaauua

SEQ ID NO: 265849 - RNA, 19 nt, Homo sapiens
caggaaagauaacugcaaa

SEQ ID NO: 265850 - RNA, 19 nt, Homo sapiens
gaucuacuaugccgagaga

SEQ ID NO: 265851 - RNA, 19 nt, Homo sapiens
gaauaucauugacuuugug

SEQ ID NO: 265852 - RNA, 19 nt, Homo sapiens
ccuaugugcucaauuacua

SEQ ID NO: 265853 - RNA, 19 nt, Homo sapiens
caaguguuguucuacagua

SEQ ID NO: 265854 - RNA, 19 nt, Homo sapiens
ggaaagauaacugcaaaga

SEQ ID NO: 265855 - RNA, 19 nt, Homo sapiens
gaacacgccuggcccuucu

SEQ ID NO: 265856 - RNA, 19 nt, Homo sapiens
gcaaugucaguauauagua

SEQ ID NO: 265857 - RNA, 19 nt, Homo sapiens
gaaaguguuguacagaauu

SEQ ID NO: 265858 - RNA, 19 nt, Homo sapiens
gauauuugcuaccaugauc

SEQ ID NO: 265859 - RNA, 19 nt, Homo sapiens
ucacagagaugggcaagau

SEQ ID NO: 265860 - RNA, 19 nt, Homo sapiens
gcuuguacgugucuuuaaa

SEQ ID NO: 265861 - RNA, 19 nt, Homo sapiens
gagagaaaguguuguacag

SEQ ID NO: 265862 - RNA, 19 nt, Homo sapiens
gagcuaguacuaaugaauu

SEQ ID NO: 265863 - RNA, 19 nt, Homo sapiens
guaaggcccacacuucuuu

SEQ ID NO: 265864 - RNA, 19 nt, Homo sapiens
gaugauaaccaguggaaau

SEQ ID NO: 265865 - RNA, 19 nt, Homo sapiens
gcacaaccuugaugauaac

SEQ ID NO: 265866 - RNA, 19 nt, Homo sapiens
aaacauaauucuggcaaug

SEQ ID NO: 265867 - RNA, 19 nt, Homo sapiens
ucaccaacauuauucauag

SEQ ID NO: 265868 - RNA, 19 nt, Homo sapiens
gcacaaaacaugagagaaa

SEQ ID NO: 265869 - RNA, 19 nt, Homo sapiens
acacaugucugggcaaaga

SEQ ID NO: 265870 - RNA, 19 nt, Homo sapiens
uuaaauauggccugcaaua

SEQ ID NO: 265871 - RNA, 19 nt, Homo sapiens
ggaaauguaacuaacugaa

SEQ ID NO: 265872 - RNA, 19 nt, Homo sapiens
ggaacucaccaacauuauu

SEQ ID NO: 265873 - RNA, 19 nt, Homo sapiens
caggcaagcucaccuacuu

SEQ ID NO: 265874 - RNA, 19 nt, Homo sapiens
gaucaacaucucugaaguu

SEQ ID NO: 265875 - RNA, 19 nt, Homo sapiens
caaagacaaucgacuucug

SEQ ID NO: 265876 - RNA, 19 nt, Homo sapiens
gcaauaguacacagaguga

SEQ ID NO: 265877 - RNA, 19 nt, Homo sapiens
ugcacaaccuugaugauaa

SEQ ID NO: 265878 - RNA, 19 nt, Homo sapiens
ucaacagucuuggccauuu

SEQ ID NO: 265879 - RNA, 19 nt, Homo sapiens
acaguggaauuuagccaua

SEQ ID NO: 265880 - RNA, 19 nt, Homo sapiens
ucagugggcugucauccaa

SEQ ID NO: 265881 - RNA, 19 nt, Homo sapiens
gauccugccuugacguaug

SEQ ID NO: 265882 - RNA, 19 nt, Homo sapiens
gcccacacuucuuugaauu

SEQ ID NO: 265883 - RNA, 19 nt, Homo sapiens
gaggccagaucucuuacuu

SEQ ID NO: 265884 - RNA, 19 nt, Homo sapiens
uaacgacccuucagcuagu

SEQ ID NO: 265885 - RNA, 19 nt, Homo sapiens
ccaaauucaugaucaacau

SEQ ID NO: 265886 - RNA, 19 nt, Homo sapiens
caacagucuuggccauuuc

SEQ ID NO: 265887 - RNA, 19 nt, Homo sapiens
caaagagguugucauuacu

SEQ ID NO: 265888 - RNA, 19 nt, Homo sapiens
guacacagagugacacaug

SEQ ID NO: 265889 - RNA, 19 nt, Homo sapiens
aaggagcaaugucaguaua

SEQ ID NO: 265890 - RNA, 19 nt, Homo sapiens
aaauggaacucaccaacau

SEQ ID NO: 265891 - RNA, 19 nt, Homo sapiens
augaggcacuuaaagcuua

SEQ ID NO: 265892 - RNA, 19 nt, Homo sapiens
gauccucgcgucuucauga

SEQ ID NO: 265893 - RNA, 19 nt, Homo sapiens
guccagagccgccagguuu

SEQ ID NO: 265894 - RNA, 19 nt, Homo sapiens
uagguugugcugugaauua

SEQ ID NO: 265895 - RNA, 19 nt, Homo sapiens
gaacugcggcuggaacuca

SEQ ID NO: 265896 - RNA, 19 nt, Homo sapiens
caaagcugcuaaagaugug

SEQ ID NO: 265897 - RNA, 19 nt, Homo sapiens
gagcccugcugcuggauga

SEQ ID NO: 265898 - RNA, 19 nt, Homo sapiens
caaauccgcagaucacaga

SEQ ID NO: 265899 - RNA, 19 nt, Homo sapiens
uguuguagaugaaacugua

SEQ ID NO: 265900 - RNA, 19 nt, Homo sapiens
gguugaaucuaugaacuug

SEQ ID NO: 265901 - RNA, 19 nt, Homo sapiens
ccaaagcugcuaaagaugu

SEQ ID NO: 265902 - RNA, 19 nt, Homo sapiens
gugcaugggucaacagucu

SEQ ID NO: 265903 - RNA, 19 nt, Homo sapiens
ugaaacaacuguaaauacc

SEQ ID NO: 265904 - RNA, 19 nt, Homo sapiens
agaaaguguuguacagaau

SEQ ID NO: 265905 - RNA, 19 nt, Homo sapiens
gccgaggccagaucucuua

SEQ ID NO: 265906 - RNA, 19 nt, Homo sapiens
gaaagauaacugcaaagag

SEQ ID NO: 265907 - RNA, 19 nt, Homo sapiens
gggcaaagacaaucgacuu

SEQ ID NO: 265908 - RNA, 19 nt, Homo sapiens
auccaaagcugcuaaagau

SEQ ID NO: 265909 - RNA, 19 nt, Homo sapiens
caugagagaaaguguugua

SEQ ID NO: 265910 - RNA, 19 nt, Homo sapiens
gacagaaccagucaucaau

SEQ ID NO: 265911 - RNA, 19 nt, Homo sapiens
caaugucaguauauaguag

SEQ ID NO: 265912 - RNA, 19 nt, Homo sapiens
guggaaauguaacuaacug

SEQ ID NO: 265913 - RNA, 19 nt, Homo sapiens
ucaaggagcaaugucagua

SEQ ID NO: 265914 - RNA, 19 nt, Homo sapiens
aaagaagccaaauucauga

SEQ ID NO: 265915 - RNA, 19 nt, Homo sapiens
aaagggacaguggaauuua

SEQ ID NO: 265916 - RNA, 19 nt, Homo sapiens
auuauugacugcugagaaa

SEQ ID NO: 265917 - RNA, 19 nt, Homo sapiens
guuaucaggugacgacagu

SEQ ID NO: 265918 - RNA, 19 nt, Homo sapiens
cagaaccagucaucaaugg

SEQ ID NO: 265919 - RNA, 19 nt, Homo sapiens
ccaguggaaauguaacuaa

SEQ ID NO: 265920 - RNA, 19 nt, Homo sapiens
guacgugucuuuaaaacug

SEQ ID NO: 265921 - RNA, 19 nt, Homo sapiens
ggcccacacuucuuugaau

SEQ ID NO: 265922 - RNA, 19 nt, Homo sapiens
agaaagggacaguggaauu

SEQ ID NO: 265923 - RNA, 19 nt, Homo sapiens
gaguguguguggugugguu

SEQ ID NO: 265924 - RNA, 19 nt, Homo sapiens
guucuacaguaugaaauug

SEQ ID NO: 265925 - RNA, 19 nt, Homo sapiens
ccaagaggcugggcaucga

SEQ ID NO: 265926 - RNA, 19 nt, Homo sapiens
gauguaaucagcuugucaa

SEQ ID NO: 265927 - RNA, 19 nt, Homo sapiens
guugugcugugaauuacuu

SEQ ID NO: 265928 - RNA, 19 nt, Homo sapiens
gagguugucauuacugguu

SEQ ID NO: 265929 - RNA, 19 nt, Homo sapiens
cauccuaccuuucuacuua

SEQ ID NO: 265930 - RNA, 19 nt, Homo sapiens
gaacauaacagaucagugu

SEQ ID NO: 265931 - RNA, 19 nt, Homo sapiens
aauauggccugcaauagua

SEQ ID NO: 265932 - RNA, 19 nt, Homo sapiens
gugaggauccugagaauuu

SEQ ID NO: 265933 - RNA, 19 nt, Homo sapiens
ggacauacucuucgagcua

SEQ ID NO: 265934 - RNA, 19 nt, Homo sapiens
ucgccuaugugcucaauua

SEQ ID NO: 265935 - RNA, 19 nt, Homo sapiens
gaucuacuaugccgagaga

SEQ ID NO: 265936 - RNA, 19 nt, Homo sapiens
gaauaucauugacuuugug

SEQ ID NO: 265937 - RNA, 19 nt, Homo sapiens
ccuaugugcucaauuacua

SEQ ID NO: 265938 - RNA, 19 nt, Homo sapiens
caaguguuguucuacagua

SEQ ID NO: 265939 - RNA, 19 nt, Homo sapiens
gaacacgccuggcccuucu

SEQ ID NO: 265940 - RNA, 19 nt, Homo sapiens
gauauuugcuaccaugauc

SEQ ID NO: 265941 - RNA, 19 nt, Homo sapiens
ucacagagaugggcaagau

SEQ ID NO: 265942 - RNA, 19 nt, Homo sapiens
caucccaucuaucuuguaa

SEQ ID NO: 265943 - RNA, 19 nt, Homo sapiens
gagcuaguacuaaugaauu

SEQ ID NO: 265944 - RNA, 19 nt, Homo sapiens
acacaugucugggcaaaga

SEQ ID NO: 265945 - RNA, 19 nt, Homo sapiens
uuaaauauggccugcaaua

SEQ ID NO: 265946 - RNA, 19 nt, Homo sapiens
gaucucccaucccaucuau

SEQ ID NO: 265947 - RNA, 19 nt, Homo sapiens
caggcaagcucaccuacuu

SEQ ID NO: 265948 - RNA, 19 nt, Homo sapiens
caaagacaaucgacuucug

SEQ ID NO: 265949 - RNA, 19 nt, Homo sapiens
gcaauaguacacagaguga

SEQ ID NO: 265950 - RNA, 19 nt, Homo sapiens
ucagugggcugucauccaa

SEQ ID NO: 265951 - RNA, 19 nt, Homo sapiens
gauccugccuugacguaug

SEQ ID NO: 265952 - RNA, 19 nt, Homo sapiens
uaacgacccuucagcuagu

SEQ ID NO: 265953 - RNA, 19 nt, Homo sapiens
guacacagagugacacaug

SEQ ID NO: 265954 - RNA, 19 nt, Homo sapiens
gaggcucucuccaguaaca

SEQ ID NO: 265955 - RNA, 19 nt, Homo sapiens
cugaggcucucuccaguaa

SEQ ID NO: 265956 - RNA, 19 nt, Homo sapiens
guccagagccgccagguuu

SEQ ID NO: 265957 - RNA, 19 nt, Homo sapiens
caaagcugcuaaagaugug

SEQ ID NO: 265958 - RNA, 19 nt, Homo sapiens
gagcccugcugcuggauga

SEQ ID NO: 265959 - RNA, 19 nt, Homo sapiens
gaucaggaaaggauaugaa

SEQ ID NO: 265960 - RNA, 19 nt, Homo sapiens
caaauccgcagaucacaga

SEQ ID NO: 265961 - RNA, 19 nt, Homo sapiens
uaacaucacccuacaacuc

SEQ ID NO: 265962 - RNA, 19 nt, Homo sapiens
ucccgaagcuuaaacaaca

SEQ ID NO: 265963 - RNA, 19 nt, Homo sapiens
ccaaagcugcuaaagaugu

SEQ ID NO: 265964 - RNA, 19 nt, Homo sapiens
gggcaaagacaaucgacuu

SEQ ID NO: 265965 - RNA, 19 nt, Homo sapiens
auccaaagcugcuaaagau

SEQ ID NO: 265966 - RNA, 19 nt, Homo sapiens
ccaguaacaucacccuaca

SEQ ID NO: 265967 - RNA, 19 nt, Homo sapiens
ggagggaucaggaaaggau

SEQ ID NO: 265968 - RNA, 19 nt, Homo sapiens
gacagaaccagucaucaau

SEQ ID NO: 265969 - RNA, 19 nt, Homo sapiens
guuaucaggugacgacagu

SEQ ID NO: 265970 - RNA, 19 nt, Homo sapiens
cagaaccagucaucaaugg

SEQ ID NO: 265971 - RNA, 19 nt, Homo sapiens
ccaucuaucuuguaaacca

SEQ ID NO: 265972 - RNA, 19 nt, Homo sapiens
gaguguguguggugugguu

SEQ ID NO: 265973 - RNA, 19 nt, Homo sapiens
guucuacaguaugaaauug

SEQ ID NO: 265974 - RNA, 19 nt, Homo sapiens
ccaagaggcugggcaucga

SEQ ID NO: 265975 - RNA, 19 nt, Homo sapiens
acaaucgacuucuggaaca

SEQ ID NO: 265976 - RNA, 19 nt, Homo sapiens
cuagugagcacacacaguu

SEQ ID NO: 265977 - RNA, 19 nt, Homo sapiens
agacagaaccagucaucaa

SEQ ID NO: 265978 - RNA, 19 nt, Homo sapiens
gcaaagcagaaacuuccaa

SEQ ID NO: 265979 - RNA, 19 nt, Homo sapiens
guacuacuccuuggcaaug

SEQ ID NO: 265980 - RNA, 19 nt, Homo sapiens
caagacagaaccagucauc

SEQ ID NO: 265981 - RNA, 19 nt, Homo sapiens
gcacccggcacgaaaccua

SEQ ID NO: 265982 - RNA, 19 nt, Homo sapiens
aaauauggccugcaauagu

SEQ ID NO: 265983 - RNA, 19 nt, Homo sapiens
ggaaaacgccaacaaguag

SEQ ID NO: 265984 - RNA, 19 nt, Homo sapiens
cauccaaagcugcuaaaga

SEQ ID NO: 265985 - RNA, 19 nt, Homo sapiens
aauuaaauauggccugcaa

SEQ ID NO: 265986 - RNA, 19 nt, Homo sapiens
aagcagaaacuuccaagga

SEQ ID NO: 265987 - RNA, 19 nt, Homo sapiens
uugcuaccaugaucuacua

SEQ ID NO: 265988 - RNA, 19 nt, Homo sapiens
uggaaacacaugaagcuuu

SEQ ID NO: 265989 - RNA, 19 nt, Homo sapiens
ccgccagguuuauugcuuu

SEQ ID NO: 265990 - RNA, 19 nt, Homo sapiens
gaacaacgagagggugauc

SEQ ID NO: 265991 - RNA, 19 nt, Homo sapiens
gccagugccugucauuguc

SEQ ID NO: 265992 - RNA, 19 nt, Homo sapiens
caugugggcccucuucgaa

SEQ ID NO: 265993 - RNA, 19 nt, Homo sapiens
guauguagaaggagugugu

SEQ ID NO: 265994 - RNA, 19 nt, Homo sapiens
guguuguucuacaguauga

SEQ ID NO: 265995 - RNA, 19 nt, Homo sapiens
cauccugguuucaauuaca

SEQ ID NO: 265996 - RNA, 19 nt, Homo sapiens
cccaucagacgcucuagua

SEQ ID NO: 265997 - RNA, 19 nt, Homo sapiens
aggaggagcuggccuucug

SEQ ID NO: 265998 - RNA, 19 nt, Homo sapiens
ugggcaagaucgagaacaa

SEQ ID NO: 265999 - RNA, 19 nt, Homo sapiens
gagguuggcgacuggcaaa

SEQ ID NO: 266000 - RNA, 19 nt, Homo sapiens
gcaaagacaaucgacuucu

SEQ ID NO: 266001 - RNA, 19 nt, Homo sapiens
gccccgagcuccaugguuu

SEQ ID NO: 266002 - RNA, 19 nt, Homo sapiens
gauggcgaguggugcugaa

SEQ ID NO: 266003 - RNA, 19 nt, Homo sapiens
aggaggcgcuggacaucuu

SEQ ID NO: 266004 - RNA, 19 nt, Homo sapiens
uaaauauggccugcaauag

SEQ ID NO: 266005 - RNA, 19 nt, Homo sapiens
cucguuaagucaugucuga

SEQ ID NO: 266006 - RNA, 19 nt, Homo sapiens
ugacgacaguacaggaagu

SEQ ID NO: 266007 - RNA, 19 nt, Homo sapiens
ccuaacgacccuucagcua

SEQ ID NO: 266008 - RNA, 19 nt, Homo sapiens
gagugggagcucaaccuaa

SEQ ID NO: 266009 - RNA, 19 nt, Homo sapiens
aaccaaagcagaaccacuu

SEQ ID NO: 266010 - RNA, 19 nt, Homo sapiens
caucuaucuuguaaaccaa

SEQ ID NO: 266011 - RNA, 19 nt, Homo sapiens
cacgugugcuucugaugga

SEQ ID NO: 266012 - RNA, 19 nt, Homo sapiens
ggaaaccaaagcagaacca

SEQ ID NO: 266013 - RNA, 19 nt, Homo sapiens
ggcaauggcaaagcagaaa

SEQ ID NO: 266014 - RNA, 19 nt, Homo sapiens
gcuggagugcugacaauag

SEQ ID NO: 266015 - RNA, 19 nt, Homo sapiens
aaacggauccugccuugac

SEQ ID NO: 266016 - RNA, 19 nt, Homo sapiens
agucaucaauggcacaagu

SEQ ID NO: 266017 - RNA, 19 nt, Homo sapiens
ccgcagaucacagaaugaa

SEQ ID NO: 266018 - RNA, 19 nt, Homo sapiens
gagggaucaggaaaggaua

SEQ ID NO: 266019 - RNA, 19 nt, Homo sapiens
cagggcgacuucaccuuca

SEQ ID NO: 266020 - RNA, 19 nt, Homo sapiens
cuaccaugaucuacuaugc

SEQ ID NO: 266021 - RNA, 19 nt, Homo sapiens
uguguggugugguuuacuu

SEQ ID NO: 266022 - RNA, 19 nt, Homo sapiens
gaaacggauccugccuuga

SEQ ID NO: 266023 - RNA, 19 nt, Homo sapiens
gcaagaucgagaacaacga

SEQ ID NO: 266024 - RNA, 19 nt, Homo sapiens
ucccaucuaucuuguaaac

SEQ ID NO: 266025 - RNA, 19 nt, Homo sapiens
ggugacgacaguacaggaa

SEQ ID NO: 266026 - RNA, 19 nt, Homo sapiens
ggcaaagacaaucgacuuc

SEQ ID NO: 266027 - RNA, 19 nt, Homo sapiens
uggcuggagugcugacaau

SEQ ID NO: 266028 - RNA, 19 nt, Homo sapiens
cggaaaacgccaacaagua

SEQ ID NO: 266029 - RNA, 19 nt, Homo sapiens
gaacauaacagaucagaua

SEQ ID NO: 266030 - RNA, 19 nt, Homo sapiens
gcaaagagguugucauuac

SEQ ID NO: 266031 - RNA, 19 nt, Homo sapiens
cauccuaccuuucuacuua

SEQ ID NO: 266032 - RNA, 19 nt, Homo sapiens
ggccagaucucuuacuuaa

SEQ ID NO: 266033 - RNA, 19 nt, Homo sapiens
ccagaucucuuacuuaaug

SEQ ID NO: 266034 - RNA, 19 nt, Homo sapiens
gggaaauuguuauagcuua

SEQ ID NO: 266035 - RNA, 19 nt, Homo sapiens
gagaaaguguuguacagaa

SEQ ID NO: 266036 - RNA, 19 nt, Homo sapiens
gauaaccaguggaaaugua

SEQ ID NO: 266037 - RNA, 19 nt, Homo sapiens
ggacuauacuggaaacaga

SEQ ID NO: 266038 - RNA, 19 nt, Homo sapiens
guacagaauuuaucaugga

SEQ ID NO: 266039 - RNA, 19 nt, Homo sapiens
ggagcaaugucaguauaua

SEQ ID NO: 266040 - RNA, 19 nt, Homo sapiens
guaacuaacugaaaugaag

SEQ ID NO: 266041 - RNA, 19 nt, Homo sapiens
gaaagggacaguggaauuu

SEQ ID NO: 266042 - RNA, 19 nt, Homo sapiens
aauauggccugcaauagua

SEQ ID NO: 266043 - RNA, 19 nt, Homo sapiens
gaagccaaauucaugauca

SEQ ID NO: 266044 - RNA, 19 nt, Homo sapiens
gugaggauccugagaauuu

SEQ ID NO: 266045 - RNA, 19 nt, Homo sapiens
ggacauacucuucgagcua

SEQ ID NO: 266046 - RNA, 19 nt, Homo sapiens
gaacucaccaacauuauuc

SEQ ID NO: 266047 - RNA, 19 nt, Homo sapiens
ucgccuaugugcucaauua

SEQ ID NO: 266048 - RNA, 19 nt, Homo sapiens
gaucuacuaugccgagaga

SEQ ID NO: 266049 - RNA, 19 nt, Homo sapiens
gaauaucauugacuuugug

SEQ ID NO: 266050 - RNA, 19 nt, Homo sapiens
ccuaugugcucaauuacua

SEQ ID NO: 266051 - RNA, 19 nt, Homo sapiens
caaguguuguucuacagua

SEQ ID NO: 266052 - RNA, 19 nt, Homo sapiens
gaacacgccuggcccuucu

SEQ ID NO: 266053 - RNA, 19 nt, Homo sapiens
gcaaugucaguauauagua

SEQ ID NO: 266054 - RNA, 19 nt, Homo sapiens
gaaaguguuguacagaauu

SEQ ID NO: 266055 - RNA, 19 nt, Homo sapiens
gauauuugcuaccaugauc

SEQ ID NO: 266056 - RNA, 19 nt, Homo sapiens
ucacagagaugggcaagau

SEQ ID NO: 266057 - RNA, 19 nt, Homo sapiens
gcuuguacgugucuuuaaa

SEQ ID NO: 266058 - RNA, 19 nt, Homo sapiens
gagagaaaguguuguacag

SEQ ID NO: 266059 - RNA, 19 nt, Homo sapiens
gagcuaguacuaaugaauu

SEQ ID NO: 266060 - RNA, 19 nt, Homo sapiens
guaaggcccacacuucuuu

SEQ ID NO: 266061 - RNA, 19 nt, Homo sapiens
gaugauaaccaguggaaau

SEQ ID NO: 266062 - RNA, 19 nt, Homo sapiens
gcacaaccuugaugauaac

SEQ ID NO: 266063 - RNA, 19 nt, Homo sapiens
aaacauaauucuggcaaug

SEQ ID NO: 266064 - RNA, 19 nt, Homo sapiens
ucaccaacauuauucauag

SEQ ID NO: 266065 - RNA, 19 nt, Homo sapiens
gcacaaaacaugagagaaa

SEQ ID NO: 266066 - RNA, 19 nt, Homo sapiens
acacaugucugggcaaaga

SEQ ID NO: 266067 - RNA, 19 nt, Homo sapiens
uuaaauauggccugcaaua

SEQ ID NO: 266068 - RNA, 19 nt, Homo sapiens
ggaaauguaacuaacugaa

SEQ ID NO: 266069 - RNA, 19 nt, Homo sapiens
ggaacucaccaacauuauu

SEQ ID NO: 266070 - RNA, 19 nt, Homo sapiens
caggcaagcucaccuacuu

SEQ ID NO: 266071 - RNA, 19 nt, Homo sapiens
gaucaacaucucugaaguu

SEQ ID NO: 266072 - RNA, 19 nt, Homo sapiens
caaagacaaucgacuucug

SEQ ID NO: 266073 - RNA, 19 nt, Homo sapiens
gcaauaguacacagaguga

SEQ ID NO: 266074 - RNA, 19 nt, Homo sapiens
ugcacaaccuugaugauaa

SEQ ID NO: 266075 - RNA, 19 nt, Homo sapiens
ucaacagucuuggccauuu

SEQ ID NO: 266076 - RNA, 19 nt, Homo sapiens
acaguggaauuuagccaua

SEQ ID NO: 266077 - RNA, 19 nt, Homo sapiens
cagaucagauaacugcaaa

SEQ ID NO: 266078 - RNA, 19 nt, Homo sapiens
ucagugggcugucauccaa

SEQ ID NO: 266079 - RNA, 19 nt, Homo sapiens
gauccugccuugacguaug

SEQ ID NO: 266080 - RNA, 19 nt, Homo sapiens
gcccacacuucuuugaauu

SEQ ID NO: 266081 - RNA, 19 nt, Homo sapiens
gaggccagaucucuuacuu

SEQ ID NO: 266082 - RNA, 19 nt, Homo sapiens
uaacgacccuucagcuagu

SEQ ID NO: 266083 - RNA, 19 nt, Homo sapiens
ccaaauucaugaucaacau

SEQ ID NO: 266084 - RNA, 19 nt, Homo sapiens
caacagucuuggccauuuc

SEQ ID NO: 266085 - RNA, 19 nt, Homo sapiens
caaagagguugucauuacu

SEQ ID NO: 266086 - RNA, 19 nt, Homo sapiens
gaucagauaacugcaaaga

SEQ ID NO: 266087 - RNA, 19 nt, Homo sapiens
guacacagagugacacaug

SEQ ID NO: 266088 - RNA, 19 nt, Homo sapiens
aaggagcaaugucaguaua

SEQ ID NO: 266089 - RNA, 19 nt, Homo sapiens
aaauggaacucaccaacau

SEQ ID NO: 266090 - RNA, 19 nt, Homo sapiens
augaggcacuuaaagcuua

SEQ ID NO: 266091 - RNA, 19 nt, Homo sapiens
gauccucgcgucuucauga

SEQ ID NO: 266092 - RNA, 19 nt, Homo sapiens
guccagagccgccagguuu

SEQ ID NO: 266093 - RNA, 19 nt, Homo sapiens
uagguugugcugugaauua

SEQ ID NO: 266094 - RNA, 19 nt, Homo sapiens
gaacugcggcuggaacuca

SEQ ID NO: 266095 - RNA, 19 nt, Homo sapiens
caaagcugcuaaagaugug

SEQ ID NO: 266096 - RNA, 19 nt, Homo sapiens
gagcccugcugcuggauga

SEQ ID NO: 266097 - RNA, 19 nt, Homo sapiens
caaauccgcagaucacaga

SEQ ID NO: 266098 - RNA, 19 nt, Homo sapiens
uguuguagaugaaacugua

SEQ ID NO: 266099 - RNA, 19 nt, Homo sapiens
gguugaaucuaugaacuug

SEQ ID NO: 266100 - RNA, 19 nt, Homo sapiens
cauaacagaucagauaacu

SEQ ID NO: 266101 - RNA, 19 nt, Homo sapiens
ccaaagcugcuaaagaugu

SEQ ID NO: 266102 - RNA, 19 nt, Homo sapiens
gugcaugggucaacagucu

SEQ ID NO: 266103 - RNA, 19 nt, Homo sapiens
ugaaacaacuguaaauacc

SEQ ID NO: 266104 - RNA, 19 nt, Homo sapiens
agaaaguguuguacagaau

SEQ ID NO: 266105 - RNA, 19 nt, Homo sapiens
gccgaggccagaucucuua

SEQ ID NO: 266106 - RNA, 19 nt, Homo sapiens
gggcaaagacaaucgacuu

SEQ ID NO: 266107 - RNA, 19 nt, Homo sapiens
auccaaagcugcuaaagau

SEQ ID NO: 266108 - RNA, 19 nt, Homo sapiens
caugagagaaaguguugua

SEQ ID NO: 266109 - RNA, 19 nt, Homo sapiens
gacagaaccagucaucaau

SEQ ID NO: 266110 - RNA, 19 nt, Homo sapiens
caaugucaguauauaguag

SEQ ID NO: 266111 - RNA, 19 nt, Homo sapiens
guggaaauguaacuaacug

SEQ ID NO: 266112 - RNA, 19 nt, Homo sapiens
ucaaggagcaaugucagua

SEQ ID NO: 266113 - RNA, 19 nt, Homo sapiens
aaagaagccaaauucauga

SEQ ID NO: 266114 - RNA, 19 nt, Homo sapiens
aaagggacaguggaauuua

SEQ ID NO: 266115 - RNA, 19 nt, Homo sapiens
auuauugacugcugagaaa

SEQ ID NO: 266116 - RNA, 19 nt, Homo sapiens
cagaaccagucaucaaugg

SEQ ID NO: 266117 - RNA, 19 nt, Homo sapiens
ccaguggaaauguaacuaa

SEQ ID NO: 266118 - RNA, 19 nt, Homo sapiens
guacgugucuuuaaaacug

SEQ ID NO: 266119 - RNA, 19 nt, Homo sapiens
ggcccacacuucuuugaau

SEQ ID NO: 266120 - RNA, 19 nt, Homo sapiens
agaaagggacaguggaauu

SEQ ID NO: 266121 - RNA, 19 nt, Homo sapiens
gaguguguguggugugguu

SEQ ID NO: 266122 - RNA, 19 nt, Homo sapiens
guucuacaguaugaaauug

SEQ ID NO: 266123 - RNA, 19 nt, Homo sapiens
ccaagaggcugggcaucga

SEQ ID NO: 266124 - RNA, 19 nt, Homo sapiens
gauguaaucagcuugucaa

SEQ ID NO: 266125 - RNA, 19 nt, Homo sapiens
guugugcugugaauuacuu

SEQ ID NO: 266126 - RNA, 19 nt, Homo sapiens
gagguugucauuacugguu

SEQ ID NO: 266127 - RNA, 19 nt, Homo sapiens
acaaucgacuucuggaaca

SEQ ID NO: 266128 - RNA, 19 nt, Homo sapiens
cuagugagcacacacaguu

SEQ ID NO: 266129 - RNA, 19 nt, Homo sapiens
ccuccucccugcucucuua

SEQ ID NO: 266130 - RNA, 19 nt, Homo sapiens
caacaacuuuggcauguac

SEQ ID NO: 266131 - RNA, 19 nt, Homo sapiens
ccaagaagaagaacaaaca

SEQ ID NO: 266132 - RNA, 19 nt, Homo sapiens
caagguggaguuucuuaaa

SEQ ID NO: 266133 - RNA, 19 nt, Homo sapiens
gaagaagaacaaacacauc

SEQ ID NO: 266134 - RNA, 19 nt, Homo sapiens
gacaagguggaguuucuua

SEQ ID NO: 266135 - RNA, 19 nt, Homo sapiens
ucgcguacgugcucaacua

SEQ ID NO: 266136 - RNA, 19 nt, Homo sapiens
gaaaccacacacacuguug

SEQ ID NO: 266137 - RNA, 19 nt, Homo sapiens
gagggcuucauccauauua

SEQ ID NO: 266138 - RNA, 19 nt, Homo sapiens
cguacgugcucaacuacua

SEQ ID NO: 266139 - RNA, 19 nt, Homo sapiens
ccgacgaguucuucuuuga

SEQ ID NO: 266140 - RNA, 19 nt, Homo sapiens
ccaagacacugggcuucaa

SEQ ID NO: 266141 - RNA, 19 nt, Homo sapiens
caucuucgccaccaugauu

SEQ ID NO: 266142 - RNA, 19 nt, Homo sapiens
acacugggcuucaaaucuc

SEQ ID NO: 266143 - RNA, 19 nt, Homo sapiens
ucaacaacuuuggcaugua

SEQ ID NO: 266144 - RNA, 19 nt, Homo sapiens
cagacaagguggaguuucu

SEQ ID NO: 266145 - RNA, 19 nt, Homo sapiens
gaggccugcugcuggauga

SEQ ID NO: 266146 - RNA, 19 nt, Homo sapiens
ccagcugggucgcguuaga

SEQ ID NO: 266147 - RNA, 19 nt, Homo sapiens
gaucuugagucccauuagc

SEQ ID NO: 266148 - RNA, 19 nt, Homo sapiens
gucaacaacuuuggcaugu

SEQ ID NO: 266149 - RNA, 19 nt, Homo sapiens
aaccacaccuacuucaaga

SEQ ID NO: 266150 - RNA, 19 nt, Homo sapiens
caaccacaccuacuucaag

SEQ ID NO: 266151 - RNA, 19 nt, Homo sapiens
caagacacugggcuucaaa

SEQ ID NO: 266152 - RNA, 19 nt, Homo sapiens
ggaagccguggccgcuaua

SEQ ID NO: 266153 - RNA, 19 nt, Homo sapiens
gagccuucuuggacccuuu

SEQ ID NO: 266154 - RNA, 19 nt, Homo sapiens
aggaggaggugauugagau

SEQ ID NO: 266155 - RNA, 19 nt, Homo sapiens
ugacgacccugggcuaugg

SEQ ID NO: 266156 - RNA, 19 nt, Homo sapiens
ucgccaccaugauuuacua

SEQ ID NO: 266157 - RNA, 19 nt, Homo sapiens
cuuggacccuuuaaagaug

SEQ ID NO: 266158 - RNA, 19 nt, Homo sapiens
ugagaccucgcgagacuuu

SEQ ID NO: 266159 - RNA, 19 nt, Homo sapiens
cagaagcugcccaagaaga

SEQ ID NO: 266160 - RNA, 19 nt, Homo sapiens
gcuccaaccacaccuacuu

SEQ ID NO: 266161 - RNA, 19 nt, Homo sapiens
ccugagaccucgcgagacu

SEQ ID NO: 266162 - RNA, 19 nt, Homo sapiens
ccucccugcucucuuagaa

SEQ ID NO: 266163 - RNA, 19 nt, Homo sapiens
gccgacgaguucuucuuug

SEQ ID NO: 266164 - RNA, 19 nt, Homo sapiens
agaagcugcccaagaagaa

SEQ ID NO: 266165 - RNA, 19 nt, Homo sapiens
ggagacauguaccccaaga

SEQ ID NO: 266166 - RNA, 19 nt, Homo sapiens
acaccuacuucaagaacau

SEQ ID NO: 266167 - RNA, 19 nt, Homo sapiens
aaagcagccucaacaucau

SEQ ID NO: 266168 - RNA, 19 nt, Homo sapiens
cggagaacaucaccaacgu

SEQ ID NO: 266169 - RNA, 19 nt, Homo sapiens
cacuguugcuggaucuuga

SEQ ID NO: 266170 - RNA, 19 nt, Homo sapiens
uggaagccguggccgcuau

SEQ ID NO: 266171 - RNA, 19 nt, Homo sapiens
caacuuuggcauguacuau

SEQ ID NO: 266172 - RNA, 19 nt, Homo sapiens
ucaacaucaucgacugugu

SEQ ID NO: 266173 - RNA, 19 nt, Homo sapiens
gcccagacaagguggaguu

SEQ ID NO: 266174 - RNA, 19 nt, Homo sapiens
gccaaucgcuccgucucau

SEQ ID NO: 266175 - RNA, 19 nt, Homo sapiens
cuggaguucucaucggauu

SEQ ID NO: 266176 - RNA, 19 nt, Homo sapiens
ccuuagcguugccuggaaa

SEQ ID NO: 266177 - RNA, 19 nt, Homo sapiens
gguuagcaauugggaaugg

SEQ ID NO: 266178 - RNA, 19 nt, Homo sapiens
agaagaagaacaaacacau

SEQ ID NO: 266179 - RNA, 19 nt, Homo sapiens
gggugugcguggucugguu

SEQ ID NO: 266180 - RNA, 19 nt, Homo sapiens
ugagucccauuagcuguga

SEQ ID NO: 266181 - RNA, 19 nt, Homo sapiens
gacacugggcuucaaaucu

SEQ ID NO: 266182 - RNA, 19 nt, Homo sapiens
acaagguggaguuucuuaa

SEQ ID NO: 266183 - RNA, 19 nt, Homo sapiens
gaggacugcccagccauug

SEQ ID NO: 266184 - RNA, 19 nt, Homo sapiens
ccugggcuauggagacaug

SEQ ID NO: 266185 - RNA, 19 nt, Homo sapiens
aaaagcagccucaacauca

SEQ ID NO: 266186 - RNA, 19 nt, Homo sapiens
cagguuagcaauugggaau

SEQ ID NO: 266187 - RNA, 19 nt, Homo sapiens
gggcaccuccggagaacau

SEQ ID NO: 266188 - RNA, 19 nt, Homo sapiens
ucccugcucucuuagaaag

SEQ ID NO: 266189 - RNA, 19 nt, Homo sapiens
cagaaaccacacacacugu

SEQ ID NO: 266190 - RNA, 19 nt, Homo sapiens
guccagcugggucgcguua

SEQ ID NO: 266191 - RNA, 19 nt, Homo sapiens
ggacugcccagccauugac

SEQ ID NO: 266192 - RNA, 19 nt, Homo sapiens
ccaaucgcuccgucucauu

SEQ ID NO: 266193 - RNA, 19 nt, Homo sapiens
agaaaccacacacacuguu

SEQ ID NO: 266194 - RNA, 19 nt, Homo sapiens
cgccgacgaguucuucuuu

SEQ ID NO: 266195 - RNA, 19 nt, Homo sapiens
cgaggacugcccagccauu

SEQ ID NO: 266196 - RNA, 19 nt, Homo sapiens
ccaaccacaccuacuucaa

SEQ ID NO: 266197 - RNA, 19 nt, Homo sapiens
gaacaagccuccguccaaa

SEQ ID NO: 266198 - RNA, 19 nt, Homo sapiens
gacagcaccugcagugaua

SEQ ID NO: 266199 - RNA, 19 nt, Homo sapiens
gcagagcuauggucccuuu

SEQ ID NO: 266200 - RNA, 19 nt, Homo sapiens
gaacagagaccugccaaga

SEQ ID NO: 266201 - RNA, 19 nt, Homo sapiens
gauguucuguuccauugua

SEQ ID NO: 266202 - RNA, 19 nt, Homo sapiens
gaacccugcugcuggauga

SEQ ID NO: 266203 - RNA, 19 nt, Homo sapiens
gcacaggacugguggaaaa

SEQ ID NO: 266204 - RNA, 19 nt, Homo sapiens
gguggaaugucccaagaaa

SEQ ID NO: 266205 - RNA, 19 nt, Homo sapiens
ucaagaaccugcucaacau

SEQ ID NO: 266206 - RNA, 19 nt, Homo sapiens
gaaagacucagauauccuu

SEQ ID NO: 266207 - RNA, 19 nt, Homo sapiens
ccacugcacuggagcuuug

SEQ ID NO: 266208 - RNA, 19 nt, Homo sapiens
ggaaacgggcagacucuaa

SEQ ID NO: 266209 - RNA, 19 nt, Homo sapiens
ggaacaagccuccguccaa

SEQ ID NO: 266210 - RNA, 19 nt, Homo sapiens
ucacugauuucuguuguuu

SEQ ID NO: 266211 - RNA, 19 nt, Homo sapiens
ugguuugucuucuuuguua

SEQ ID NO: 266212 - RNA, 19 nt, Homo sapiens
ggcacgacauggcaucaua

SEQ ID NO: 266213 - RNA, 19 nt, Homo sapiens
gugguuaccugaacagaga

SEQ ID NO: 266214 - RNA, 19 nt, Homo sapiens
cgacauggcaucauacuca

SEQ ID NO: 266215 - RNA, 19 nt, Homo sapiens
guacaucgaagagauauau

SEQ ID NO: 266216 - RNA, 19 nt, Homo sapiens
cggagaagaucaucaucaa

SEQ ID NO: 266217 - RNA, 19 nt, Homo sapiens
ccgcagcgcuucuuaugau

SEQ ID NO: 266218 - RNA, 19 nt, Homo sapiens
acucagauauccuuguuug

SEQ ID NO: 266219 - RNA, 19 nt, Homo sapiens
ccaacgcagugcugucuga

SEQ ID NO: 266220 - RNA, 19 nt, Homo sapiens
ggacagcaccugcagugau

SEQ ID NO: 266221 - RNA, 19 nt, Homo sapiens
caugaggccuuuaauaucg

SEQ ID NO: 266222 - RNA, 19 nt, Homo sapiens
ggagacccaugaggccuuu

SEQ ID NO: 266223 - RNA, 19 nt, Homo sapiens
agacucagauauccuuguu

SEQ ID NO: 266224 - RNA, 19 nt, Homo sapiens
acgcagugcugucugauga

SEQ ID NO: 266225 - RNA, 19 nt, Homo sapiens
guaaugaccacaccgacuu

SEQ ID NO: 266226 - RNA, 19 nt, Homo sapiens
aagaggagcucaccuucug

SEQ ID NO: 266227 - RNA, 19 nt, Homo sapiens
ccuacgugcucaacuacua

SEQ ID NO: 266228 - RNA, 19 nt, Homo sapiens
ucgaagagauauauaugca

SEQ ID NO: 266229 - RNA, 19 nt, Homo sapiens
ccacaggccacaucaggaa

SEQ ID NO: 266230 - RNA, 19 nt, Homo sapiens
ccaagaaacggaagaagca

SEQ ID NO: 266231 - RNA, 19 nt, Homo sapiens
gcacgcgacaugagaccua

SEQ ID NO: 266232 - RNA, 19 nt, Homo sapiens
ggucugauguucuguucca

SEQ ID NO: 266233 - RNA, 19 nt, Homo sapiens
gggcagacucuaagcagaa

SEQ ID NO: 266234 - RNA, 19 nt, Homo sapiens
gaaacgggcagacucuaag

SEQ ID NO: 266235 - RNA, 19 nt, Homo sapiens
gagcuuugaagaccuaaga

SEQ ID NO: 266236 - RNA, 19 nt, Homo sapiens
caacaucaucgacuuugug

SEQ ID NO: 266237 - RNA, 19 nt, Homo sapiens
gcguaugugugcugugguu

SEQ ID NO: 266238 - RNA, 19 nt, Homo sapiens
cccaugaggccuuuaauau

SEQ ID NO: 266239 - RNA, 19 nt, Homo sapiens
cgacgagaccgacguggaa

SEQ ID NO: 266240 - RNA, 19 nt, Homo sapiens
gggaaagacucagauaucc

SEQ ID NO: 266241 - RNA, 19 nt, Homo sapiens
ucaacaacuucggcaugua

SEQ ID NO: 266242 - RNA, 19 nt, Homo sapiens
gcucaacaucaucgacuuu

SEQ ID NO: 266243 - RNA, 19 nt, Homo sapiens
ucgccuacgugcucaacua

SEQ ID NO: 266244 - RNA, 19 nt, Homo sapiens
gggaagaggguaugaucga

SEQ ID NO: 266245 - RNA, 19 nt, Homo sapiens
cagcuggagucacccaugu

SEQ ID NO: 266246 - RNA, 19 nt, Homo sapiens
caucgaagagauauauaug

SEQ ID NO: 266247 - RNA, 19 nt, Homo sapiens
cugauguucuguuccauug

SEQ ID NO: 266248 - RNA, 19 nt, Homo sapiens
ggcgggagguagagacaga

SEQ ID NO: 266249 - RNA, 19 nt, Homo sapiens
gcugggaaagacucagaua

SEQ ID NO: 266250 - RNA, 19 nt, Homo sapiens
gcuagugguuaccugaaca

SEQ ID NO: 266251 - RNA, 19 nt, Homo sapiens
cauuguacaucgaagagau

SEQ ID NO: 266252 - RNA, 19 nt, Homo sapiens
gagcuauggucccuuucuc

SEQ ID NO: 266253 - RNA, 19 nt, Homo sapiens
caacaacuucggcauguac

SEQ ID NO: 266254 - RNA, 19 nt, Homo sapiens
gucaacaacuucggcaugu

SEQ ID NO: 266255 - RNA, 19 nt, Homo sapiens
aaugaguuccugcugcuua

SEQ ID NO: 266256 - RNA, 19 nt, Homo sapiens
gucaagaaccugcucaaca

SEQ ID NO: 266257 - RNA, 19 nt, Homo sapiens
cagagcccauccugaccua

SEQ ID NO: 266258 - RNA, 19 nt, Homo sapiens
ccaugaggccuuuaauauc

SEQ ID NO: 266259 - RNA, 19 nt, Homo sapiens
ggugguuugucuucuuugu

SEQ ID NO: 266260 - RNA, 19 nt, Homo sapiens
gcacuggagcuuugaagac

SEQ ID NO: 266261 - RNA, 19 nt, Homo sapiens
auuauacucuuguguguag

SEQ ID NO: 266262 - RNA, 19 nt, Homo sapiens
cagcagauggagcuacuug

SEQ ID NO: 266263 - RNA, 19 nt, Homo sapiens
gacagcagauggagcuacu

SEQ ID NO: 266264 - RNA, 19 nt, Homo sapiens
gaccacaccgacuucaaga

SEQ ID NO: 266265 - RNA, 19 nt, Homo sapiens
aggaggcgcucgacaucuu

SEQ ID NO: 266266 - RNA, 19 nt, Homo sapiens
gaaaagugcaucugggaau

SEQ ID NO: 266267 - RNA, 19 nt, Homo sapiens
guccucacccucucuuaaa

SEQ ID NO: 266268 - RNA, 19 nt, Homo sapiens
caacuaugcccaggcugaa

SEQ ID NO: 266269 - RNA, 19 nt, Homo sapiens
ggggagagcucaaguuggu

SEQ ID NO: 266270 - RNA, 19 nt, Homo sapiens
ugagcggccugucauccaa

SEQ ID NO: 266271 - RNA, 19 nt, Homo sapiens
gaccgcaacgugacagaga

SEQ ID NO: 266272 - RNA, 19 nt, Homo sapiens
gcugcgaguucuucuucga

SEQ ID NO: 266273 - RNA, 19 nt, Homo sapiens
gcaaggcugcagagcuaug

SEQ ID NO: 266274 - RNA, 19 nt, Homo sapiens
gggcugcgaguucuucuuc

SEQ ID NO: 266275 - RNA, 19 nt, Homo sapiens
ggagacauguaccccaaga

SEQ ID NO: 266276 - RNA, 19 nt, Homo sapiens
ucaacaucaucgacuuugu

SEQ ID NO: 266277 - RNA, 19 nt, Homo sapiens
ucagauauccuuguuugca

SEQ ID NO: 266278 - RNA, 19 nt, Homo sapiens
gagcuagugguuaccugaa

SEQ ID NO: 266279 - RNA, 19 nt, Homo sapiens
gaaguccucacccucucuu

SEQ ID NO: 266280 - RNA, 19 nt, Homo sapiens
caacugcugggacucuguu

SEQ ID NO: 266281 - RNA, 19 nt, Homo sapiens
ggccagcaccaaugaguuc

SEQ ID NO: 266282 - RNA, 19 nt, Homo sapiens
ggccuuugccucucucuuc

SEQ ID NO: 266283 - RNA, 19 nt, Homo sapiens
ugggaaagacucagauauc

SEQ ID NO: 266284 - RNA, 19 nt, Homo sapiens
gccagaggcuuagggaaac

SEQ ID NO: 266285 - RNA, 19 nt, Homo sapiens
ggcagacucuaagcagaau

SEQ ID NO: 266286 - RNA, 19 nt, Homo sapiens
gaggaaacgggcagacucu

SEQ ID NO: 266287 - RNA, 19 nt, Homo sapiens
acaccgacuucaagaacau

SEQ ID NO: 266288 - RNA, 19 nt, Homo sapiens
gcucagcacuggggacuau

SEQ ID NO: 266289 - RNA, 19 nt, Homo sapiens
acacugggcuacggagaca

SEQ ID NO: 266290 - RNA, 19 nt, Homo sapiens
agagagacaggcagacaga

SEQ ID NO: 266291 - RNA, 19 nt, Homo sapiens
gcagcgcuucuuaugauca

SEQ ID NO: 266292 - RNA, 19 nt, Homo sapiens
ggccacaucaggaacuuuc

SEQ ID NO: 266293 - RNA, 19 nt, Homo sapiens
cgaugguaguguccggaaa

SEQ ID NO: 266294 - RNA, 19 nt, Homo sapiens
ccaccacucgagacagaaa

SEQ ID NO: 266295 - RNA, 19 nt, Homo sapiens
ccacaccgacuucaagaac

SEQ ID NO: 266296 - RNA, 19 nt, Homo sapiens
gaaccugcucaacaucauc

SEQ ID NO: 266297 - RNA, 19 nt, Homo sapiens
gaacaagccuccguccaaa

SEQ ID NO: 266298 - RNA, 19 nt, Homo sapiens
gacagcaccugcagugaua

SEQ ID NO: 266299 - RNA, 19 nt, Homo sapiens
gaacccugcugcuggauga

SEQ ID NO: 266300 - RNA, 19 nt, Homo sapiens
gaaacgggcaggugagauu

SEQ ID NO: 266301 - RNA, 19 nt, Homo sapiens
ucaagaaccugcucaacau

SEQ ID NO: 266302 - RNA, 19 nt, Homo sapiens
ggaacaagccuccguccaa

SEQ ID NO: 266303 - RNA, 19 nt, Homo sapiens
ccucagaccuugggauuug

SEQ ID NO: 266304 - RNA, 19 nt, Homo sapiens
cggagaagaucaucaucaa

SEQ ID NO: 266305 - RNA, 19 nt, Homo sapiens
ccgcagcgcuucuuaugau

SEQ ID NO: 266306 - RNA, 19 nt, Homo sapiens
caaauggaccucagaccuu

SEQ ID NO: 266307 - RNA, 19 nt, Homo sapiens
ggacagcaccugcagugau

SEQ ID NO: 266308 - RNA, 19 nt, Homo sapiens
caugaggccuuuaauaucg

SEQ ID NO: 266309 - RNA, 19 nt, Homo sapiens
ggagacccaugaggccuuu

SEQ ID NO: 266310 - RNA, 19 nt, Homo sapiens
guaaugaccacaccgacuu

SEQ ID NO: 266311 - RNA, 19 nt, Homo sapiens
aagaggagcucaccuucug

SEQ ID NO: 266312 - RNA, 19 nt, Homo sapiens
ccuacgugcucaacuacua

SEQ ID NO: 266313 - RNA, 19 nt, Homo sapiens
cuagggaguuuccaaaugg

SEQ ID NO: 266314 - RNA, 19 nt, Homo sapiens
ccuagggaguuuccaaaug

SEQ ID NO: 266315 - RNA, 19 nt, Homo sapiens
ccaguggccuagggaguuu

SEQ ID NO: 266316 - RNA, 19 nt, Homo sapiens
ccaagaaacggaagaagca

SEQ ID NO: 266317 - RNA, 19 nt, Homo sapiens
gcacgcgacaugagaccua

SEQ ID NO: 266318 - RNA, 19 nt, Homo sapiens
caacaucaucgacuuugug

SEQ ID NO: 266319 - RNA, 19 nt, Homo sapiens
gcguaugugugcugugguu

SEQ ID NO: 266320 - RNA, 19 nt, Homo sapiens
cccaugaggccuuuaauau

SEQ ID NO: 266321 - RNA, 19 nt, Homo sapiens
cgacgagaccgacguggaa

SEQ ID NO: 266322 - RNA, 19 nt, Homo sapiens
ucaacaacuucggcaugua

SEQ ID NO: 266323 - RNA, 19 nt, Homo sapiens
gcucaacaucaucgacuuu

SEQ ID NO: 266324 - RNA, 19 nt, Homo sapiens
gaccucagaccuugggauu

SEQ ID NO: 266325 - RNA, 19 nt, Homo sapiens
ucgccuacgugcucaacua

SEQ ID NO: 266326 - RNA, 19 nt, Homo sapiens
gggaagaggguaugaucga

SEQ ID NO: 266327 - RNA, 19 nt, Homo sapiens
cagcuggagucacccaugu

SEQ ID NO: 266328 - RNA, 19 nt, Homo sapiens
ggcgggagguagagacaga

SEQ ID NO: 266329 - RNA, 19 nt, Homo sapiens
aaacgggcaggugagauua

SEQ ID NO: 266330 - RNA, 19 nt, Homo sapiens
caacaacuucggcauguac

SEQ ID NO: 266331 - RNA, 19 nt, Homo sapiens
gucaacaacuucggcaugu

SEQ ID NO: 266332 - RNA, 19 nt, Homo sapiens
aaugaguuccugcugcuua

SEQ ID NO: 266333 - RNA, 19 nt, Homo sapiens
gucaagaaccugcucaaca

SEQ ID NO: 266334 - RNA, 19 nt, Homo sapiens
cagagcccauccugaccua

SEQ ID NO: 266335 - RNA, 19 nt, Homo sapiens
ccaugaggccuuuaauauc

SEQ ID NO: 266336 - RNA, 19 nt, Homo sapiens
gaccacaccgacuucaaga

SEQ ID NO: 266337 - RNA, 19 nt, Homo sapiens
aggaggcgcucgacaucuu

SEQ ID NO: 266338 - RNA, 19 nt, Homo sapiens
ugagcggccugucauccaa

SEQ ID NO: 266339 - RNA, 19 nt, Homo sapiens
gaccgcaacgugacagaga

SEQ ID NO: 266340 - RNA, 19 nt, Homo sapiens
ggagacauguaccccaaga

SEQ ID NO: 266341 - RNA, 19 nt, Homo sapiens
ucaacaucaucgacuuugu

SEQ ID NO: 266342 - RNA, 19 nt, Homo sapiens
gcugcgaguucuucuucga

SEQ ID NO: 266343 - RNA, 19 nt, Homo sapiens
gggcugcgaguucuucuuc

SEQ ID NO: 266344 - RNA, 19 nt, Homo sapiens
ggccagcaccaaugaguuc

SEQ ID NO: 266345 - RNA, 19 nt, Homo sapiens
ucccuaagcauaaagaugu

SEQ ID NO: 266346 - RNA, 19 nt, Homo sapiens
acaccgacuucaagaacau

SEQ ID NO: 266347 - RNA, 19 nt, Homo sapiens
ggccuuugccucucucuuc

SEQ ID NO: 266348 - RNA, 19 nt, Homo sapiens
acacugggcuacggagaca

SEQ ID NO: 266349 - RNA, 19 nt, Homo sapiens
ggauuuggcauguguuuug

SEQ ID NO: 266350 - RNA, 19 nt, Homo sapiens
gcagcgcuucuuaugauca

SEQ ID NO: 266351 - RNA, 19 nt, Homo sapiens
ccacaccgacuucaagaac

SEQ ID NO: 266352 - RNA, 19 nt, Homo sapiens
gaaccugcucaacaucauc

SEQ ID NO: 266353 - RNA, 19 nt, Homo sapiens
uugccaccaugaucuacua

SEQ ID NO: 266354 - RNA, 19 nt, Homo sapiens
caagcucacacgccacuuc

SEQ ID NO: 266355 - RNA, 19 nt, Homo sapiens
ggccuagggaguuuccaaa

SEQ ID NO: 266356 - RNA, 19 nt, Homo sapiens
ugagggccagcaccaauga

SEQ ID NO: 266357 - RNA, 19 nt, Homo sapiens
gagcccauccugaccuaca

SEQ ID NO: 266358 - RNA, 19 nt, Homo sapiens
acccaugaggccuuuaaua

SEQ ID NO: 266359 - RNA, 19 nt, Homo sapiens
gcgaggcgucggagaagau

SEQ ID NO: 266360 - RNA, 19 nt, Homo sapiens
caagaaccugcucaacauc

SEQ ID NO: 266361 - RNA, 19 nt, Homo sapiens
gcaugugggcgcucuucga

SEQ ID NO: 266362 - RNA, 19 nt, Homo sapiens
gguaugaucgagaggaaac

SEQ ID NO: 266363 - RNA, 19 nt, Homo sapiens
ccauguacugcaagucuga

SEQ ID NO: 266364 - RNA, 19 nt, Homo sapiens
caacuucggcauguacuac

SEQ ID NO: 266365 - RNA, 19 nt, Homo sapiens
agaagaucaucaucaacgu

SEQ ID NO: 266366 - RNA, 19 nt, Homo sapiens
ucgaagaggagcucaccuu

SEQ ID NO: 266367 - RNA, 19 nt, Homo sapiens
acgcuggacuucgucaaga

SEQ ID NO: 266368 - RNA, 19 nt, Homo sapiens
caucugagcucuagccuaa

SEQ ID NO: 266369 - RNA, 19 nt, Homo sapiens
ccagcaaacucuagcaaua

SEQ ID NO: 266370 - RNA, 19 nt, Homo sapiens
caaagccucugaccaguuu

SEQ ID NO: 266371 - RNA, 19 nt, Homo sapiens
ucacagggcuugaggauuc

SEQ ID NO: 266372 - RNA, 19 nt, Homo sapiens
gaaggagaguugagauuuc

SEQ ID NO: 266373 - RNA, 19 nt, Homo sapiens
gagcugggcuguauuugga

SEQ ID NO: 266374 - RNA, 19 nt, Homo sapiens
ggaaguagccaggaaauga

SEQ ID NO: 266375 - RNA, 19 nt, Homo sapiens
acgaagagcuggcuuucua

SEQ ID NO: 266376 - RNA, 19 nt, Homo sapiens
ggacggcgcuuugagacuu

SEQ ID NO: 266377 - RNA, 19 nt, Homo sapiens
ucagauagcacaaauucua

SEQ ID NO: 266378 - RNA, 19 nt, Homo sapiens
gcucucagaugaaggcaaa

SEQ ID NO: 266379 - RNA, 19 nt, Homo sapiens
gcacaaacaagaccaacuu

SEQ ID NO: 266380 - RNA, 19 nt, Homo sapiens
gagaagggcacaaacaaga

SEQ ID NO: 266381 - RNA, 19 nt, Homo sapiens
gccaugaguucacagauga

SEQ ID NO: 266382 - RNA, 19 nt, Homo sapiens
gcauuuacaucugcccuaa

SEQ ID NO: 266383 - RNA, 19 nt, Homo sapiens
gcugguggcugacaaagau

SEQ ID NO: 266384 - RNA, 19 nt, Homo sapiens
gcccaacaauucccagauu

SEQ ID NO: 266385 - RNA, 19 nt, Homo sapiens
ugacaaagauguaguuucc

SEQ ID NO: 266386 - RNA, 19 nt, Homo sapiens
caagagcugggcuguauuu

SEQ ID NO: 266387 - RNA, 19 nt, Homo sapiens
caagaucucaucccuguga

SEQ ID NO: 266388 - RNA, 19 nt, Homo sapiens
ccaaugccuuccugcagua

SEQ ID NO: 266389 - RNA, 19 nt, Homo sapiens
gucauuguguccaacuuua

SEQ ID NO: 266390 - RNA, 19 nt, Homo sapiens
gccaugugcugaacuucua

SEQ ID NO: 266391 - RNA, 19 nt, Homo sapiens
ggcacaggcugacuccuuu

SEQ ID NO: 266392 - RNA, 19 nt, Homo sapiens
gcugggauauggagcuuug

SEQ ID NO: 266393 - RNA, 19 nt, Homo sapiens
ccuccuagguucuguaaau

SEQ ID NO: 266394 - RNA, 19 nt, Homo sapiens
cgaugucucuggcgccuuu

SEQ ID NO: 266395 - RNA, 19 nt, Homo sapiens
gcugacuccuuuagaauca

SEQ ID NO: 266396 - RNA, 19 nt, Homo sapiens
cagaugagcucaccuucag

SEQ ID NO: 266397 - RNA, 19 nt, Homo sapiens
caaacaagaccaacuuuac

SEQ ID NO: 266398 - RNA, 19 nt, Homo sapiens
acaaacaagaccaacuuua

SEQ ID NO: 266399 - RNA, 19 nt, Homo sapiens
gauaagagccuggcaacca

SEQ ID NO: 266400 - RNA, 19 nt, Homo sapiens
gcaaagccucugaccaguu

SEQ ID NO: 266401 - RNA, 19 nt, Homo sapiens
ccaacuuccuaacauuuga

SEQ ID NO: 266402 - RNA, 19 nt, Homo sapiens
gggcaacaguccagaagca

SEQ ID NO: 266403 - RNA, 19 nt, Homo sapiens
uuugagacuuggaagaaua

SEQ ID NO: 266404 - RNA, 19 nt, Homo sapiens
gcacaggcugacuccuuua

SEQ ID NO: 266405 - RNA, 19 nt, Homo sapiens
ggguaggccugcugauuca

SEQ ID NO: 266406 - RNA, 19 nt, Homo sapiens
gcugggcuuucuccucuuu

SEQ ID NO: 266407 - RNA, 19 nt, Homo sapiens
caggcugacuccuuuagaa

SEQ ID NO: 266408 - RNA, 19 nt, Homo sapiens
ggauguuucugaacuuugg

SEQ ID NO: 266409 - RNA, 19 nt, Homo sapiens
gcuuugauccgacaucuga

SEQ ID NO: 266410 - RNA, 19 nt, Homo sapiens
gcucuggccucuccuuucu

SEQ ID NO: 266411 - RNA, 19 nt, Homo sapiens
gcuccggccugggauguuu

SEQ ID NO: 266412 - RNA, 19 nt, Homo sapiens
acacucagauagcacaaau

SEQ ID NO: 266413 - RNA, 19 nt, Homo sapiens
acaaagauguaguuuccau

SEQ ID NO: 266414 - RNA, 19 nt, Homo sapiens
ggccugggauguuucugaa

SEQ ID NO: 266415 - RNA, 19 nt, Homo sapiens
ccucugaucuggccucuac

SEQ ID NO: 266416 - RNA, 19 nt, Homo sapiens
gaagacaacgugccaugag

SEQ ID NO: 266417 - RNA, 19 nt, Homo sapiens
caacaguccagaagcauca

SEQ ID NO: 266418 - RNA, 19 nt, Homo sapiens
acagcaacaucaccacuug

SEQ ID NO: 266419 - RNA, 19 nt, Homo sapiens
caagaacgacgaugucucu

SEQ ID NO: 266420 - RNA, 19 nt, Homo sapiens
uaaacgccacccucacuaa

SEQ ID NO: 266421 - RNA, 19 nt, Homo sapiens
gccaggaaaugagaaacuu

SEQ ID NO: 266422 - RNA, 19 nt, Homo sapiens
ugaaaugguccacauagug

SEQ ID NO: 266423 - RNA, 19 nt, Homo sapiens
aaacaagaccaacuuuaca

SEQ ID NO: 266424 - RNA, 19 nt, Homo sapiens
agaaggagaguugagauuu

SEQ ID NO: 266425 - RNA, 19 nt, Homo sapiens
ccacugagaacuaugcaau

SEQ ID NO: 266426 - RNA, 19 nt, Homo sapiens
gaaaucuggcaucaucuca

SEQ ID NO: 266427 - RNA, 19 nt, Homo sapiens
agcaagagcugggcuguau

SEQ ID NO: 266428 - RNA, 19 nt, Homo sapiens
gcccaacuuccuaacauuu

SEQ ID NO: 266429 - RNA, 19 nt, Homo sapiens
ucugagcucuagccuaaga

SEQ ID NO: 266430 - RNA, 19 nt, Homo sapiens
cagaugaaggcaaagcuuu

SEQ ID NO: 266431 - RNA, 19 nt, Homo sapiens
gguauaccauugucaccau

SEQ ID NO: 266432 - RNA, 19 nt, Homo sapiens
aagcaccucuggucccauu

SEQ ID NO: 266433 - RNA, 19 nt, Homo sapiens
ucccaucucuuuaguucuu

SEQ ID NO: 266434 - RNA, 19 nt, Homo sapiens
gaaguagccaggaaaugag

SEQ ID NO: 266435 - RNA, 19 nt, Homo sapiens
acacccaacucccuuucaa

SEQ ID NO: 266436 - RNA, 19 nt, Homo sapiens
gcagcucggagaaggaauu

SEQ ID NO: 266437 - RNA, 19 nt, Homo sapiens
ucgcgacccugacauguuc

SEQ ID NO: 266438 - RNA, 19 nt, Homo sapiens
ccagcucccuuuccagauc

SEQ ID NO: 266439 - RNA, 19 nt, Homo sapiens
ccugcggccuucugguaua

SEQ ID NO: 266440 - RNA, 19 nt, Homo sapiens
ccugccagcuuccugcaaa

SEQ ID NO: 266441 - RNA, 19 nt, Homo sapiens
ccucugagcugggcuuucu

SEQ ID NO: 266442 - RNA, 19 nt, Homo sapiens
ggugacugcugccuugaag

SEQ ID NO: 266443 - RNA, 19 nt, Homo sapiens
cuucuacgaugcugacuca

SEQ ID NO: 266444 - RNA, 19 nt, Homo sapiens
uggacuggcugagauaaga

SEQ ID NO: 266445 - RNA, 19 nt, Homo sapiens
cauccugcccuacuacauu

SEQ ID NO: 266446 - RNA, 19 nt, Homo sapiens
cagccuguguacucauauu

SEQ ID NO: 266447 - RNA, 19 nt, Homo sapiens
uaguuuccaucagucaaua

SEQ ID NO: 266448 - RNA, 19 nt, Homo sapiens
auauggagcuuuggagguu

SEQ ID NO: 266449 - RNA, 19 nt, Homo sapiens
ccaucuggcccaacaauuc

SEQ ID NO: 266450 - RNA, 19 nt, Homo sapiens
cccuugggcucucagauga

SEQ ID NO: 266451 - RNA, 19 nt, Homo sapiens
ucacagaugagcucaccuu

SEQ ID NO: 266452 - RNA, 19 nt, Homo sapiens
uugcugcacugucuagaga

SEQ ID NO: 266453 - RNA, 19 nt, Homo sapiens
aagaccaacuuuacaagca

SEQ ID NO: 266454 - RNA, 19 nt, Homo sapiens
gugcccaacuuccuaacau

SEQ ID NO: 266455 - RNA, 19 nt, Homo sapiens
gacagccacauucuccuaa

SEQ ID NO: 266456 - RNA, 19 nt, Homo sapiens
gagaauuccccacguguuu

SEQ ID NO: 266457 - RNA, 19 nt, Homo sapiens
gcaagagcugggcuguauu

SEQ ID NO: 266458 - RNA, 19 nt, Homo sapiens
gcugagaagggcacaaaca

SEQ ID NO: 266459 - RNA, 19 nt, Homo sapiens
gcuuugagacuuggaagaa

SEQ ID NO: 266460 - RNA, 19 nt, Homo sapiens
cuucccaucucuuuaguuc

SEQ ID NO: 266461 - RNA, 19 nt, Homo sapiens
uuucugcucuucuccaugu

SEQ ID NO: 266462 - RNA, 19 nt, Homo sapiens
ggagacaggaggaacuucu

SEQ ID NO: 266463 - RNA, 19 nt, Homo sapiens
ccauggccaucaucaucuu

SEQ ID NO: 266464 - RNA, 19 nt, Homo sapiens
ucacauauuccuuucuucu

SEQ ID NO: 266465 - RNA, 19 nt, Homo sapiens
caacacacacucagauagc

SEQ ID NO: 266466 - RNA, 19 nt, Homo sapiens
caugaaaugguccacauag

SEQ ID NO: 266467 - RNA, 19 nt, Homo sapiens
acuaugcaauggaguuuca

SEQ ID NO: 266468 - RNA, 19 nt, Homo sapiens
ggaauaaggucuaagagaa

SEQ ID NO: 266469 - RNA, 19 nt, Homo sapiens
gaaagaagguugguaguga

SEQ ID NO: 266470 - RNA, 19 nt, Homo sapiens
gaauugggcuucuugcuuu

SEQ ID NO: 266471 - RNA, 19 nt, Homo sapiens
ggauugaaauguagagaua

SEQ ID NO: 266472 - RNA, 19 nt, Homo sapiens
guaaguagcuugucaucaa

SEQ ID NO: 266473 - RNA, 19 nt, Homo sapiens
gaauaggcaugauaaacua

SEQ ID NO: 266474 - RNA, 19 nt, Homo sapiens
gcaguuagguuauuucaau

SEQ ID NO: 266475 - RNA, 19 nt, Homo sapiens
ggaagaguguguuaaacua

SEQ ID NO: 266476 - RNA, 19 nt, Homo sapiens
guugaucucuguacauuua

SEQ ID NO: 266477 - RNA, 19 nt, Homo sapiens
gaaagucucuaugcaacua

SEQ ID NO: 266478 - RNA, 19 nt, Homo sapiens
aaacuuaucugauggcauu

SEQ ID NO: 266479 - RNA, 19 nt, Homo sapiens
gcacaaauuuaucucagaa

SEQ ID NO: 266480 - RNA, 19 nt, Homo sapiens
gagaauaacuaauguggau

SEQ ID NO: 266481 - RNA, 19 nt, Homo sapiens
acacaaagcuuccaaucuu

SEQ ID NO: 266482 - RNA, 19 nt, Homo sapiens
gaacaggaguuugaugaug

SEQ ID NO: 266483 - RNA, 19 nt, Homo sapiens
gguaauuucugugcacuua

SEQ ID NO: 266484 - RNA, 19 nt, Homo sapiens
gaaagguuccuguguauug

SEQ ID NO: 266485 - RNA, 19 nt, Homo sapiens
ucagaaagguuccugugua

SEQ ID NO: 266486 - RNA, 19 nt, Homo sapiens
gaaggaaaccaucauaaug

SEQ ID NO: 266487 - RNA, 19 nt, Homo sapiens
ggaaauauugucagaguuu

SEQ ID NO: 266488 - RNA, 19 nt, Homo sapiens
gaaaggaagguuugaaaga

SEQ ID NO: 266489 - RNA, 19 nt, Homo sapiens
gguaagagccacauucgua

SEQ ID NO: 266490 - RNA, 19 nt, Homo sapiens
caacauagaagaaagaaga

SEQ ID NO: 266491 - RNA, 19 nt, Homo sapiens
gaacucagcacgauucaga

SEQ ID NO: 266492 - RNA, 19 nt, Homo sapiens
gaaggcagcacaaauuuau

SEQ ID NO: 266493 - RNA, 19 nt, Homo sapiens
gaacauuggcuaugaugaa

SEQ ID NO: 266494 - RNA, 19 nt, Homo sapiens
gaucucaguuuccuuaugu

SEQ ID NO: 266495 - RNA, 19 nt, Homo sapiens
gcaccucucuauuggguuu

SEQ ID NO: 266496 - RNA, 19 nt, Homo sapiens
cauaaugcaugcuagaauu

SEQ ID NO: 266497 - RNA, 19 nt, Homo sapiens
gaaaguugcccuucugaga

SEQ ID NO: 266498 - RNA, 19 nt, Homo sapiens
gggaagggcuacuuggaaa

SEQ ID NO: 266499 - RNA, 19 nt, Homo sapiens
ggaaggcagcacaaauuua

SEQ ID NO: 266500 - RNA, 19 nt, Homo sapiens
gaagaguugugccucagaa

SEQ ID NO: 266501 - RNA, 19 nt, Homo sapiens
gaggaaauauugucagagu

SEQ ID NO: 266502 - RNA, 19 nt, Homo sapiens
gaucagauguguggagaga

SEQ ID NO: 266503 - RNA, 19 nt, Homo sapiens
caccugagcugaacuugaa

SEQ ID NO: 266504 - RNA, 19 nt, Homo sapiens
gacccaagaugcucucauu

SEQ ID NO: 266505 - RNA, 19 nt, Homo sapiens
cacaaagcuuccaaucuua

SEQ ID NO: 266506 - RNA, 19 nt, Homo sapiens
gaauugacugggacuaaua

SEQ ID NO: 266507 - RNA, 19 nt, Homo sapiens
gcaccuagauacuguuaca

SEQ ID NO: 266508 - RNA, 19 nt, Homo sapiens
gaacaaccuuaugugacua

SEQ ID NO: 266509 - RNA, 19 nt, Homo sapiens
ggaguugacccauauaaau

SEQ ID NO: 266510 - RNA, 19 nt, Homo sapiens
gaagaguguguuaaacuaa

SEQ ID NO: 266511 - RNA, 19 nt, Homo sapiens
gucaugaucuucacaguug

SEQ ID NO: 266512 - RNA, 19 nt, Homo sapiens
ggucauugcucuaccuguu

SEQ ID NO: 266513 - RNA, 19 nt, Homo sapiens
cagaaacucagcaguauuu

SEQ ID NO: 266514 - RNA, 19 nt, Homo sapiens
gagaacaggaguuugauga

SEQ ID NO: 266515 - RNA, 19 nt, Homo sapiens
ugcauuaucuguucuugua

SEQ ID NO: 266516 - RNA, 19 nt, Homo sapiens
gguacacacugaagaguug

SEQ ID NO: 266517 - RNA, 19 nt, Homo sapiens
ucugagaacugugacuuua

SEQ ID NO: 266518 - RNA, 19 nt, Homo sapiens
agaacuggcuucauuccua

SEQ ID NO: 266519 - RNA, 19 nt, Homo sapiens
cagaaagguuccuguguau

SEQ ID NO: 266520 - RNA, 19 nt, Homo sapiens
ggagcccuaucuuggaaua

SEQ ID NO: 266521 - RNA, 19 nt, Homo sapiens
gaccgcaucuccugagcua

SEQ ID NO: 266522 - RNA, 19 nt, Homo sapiens
gaaucuuacuugaugcauu

SEQ ID NO: 266523 - RNA, 19 nt, Homo sapiens
gaagguugguagugaaaca

SEQ ID NO: 266524 - RNA, 19 nt, Homo sapiens
cauccugccuuauuacauu

SEQ ID NO: 266525 - RNA, 19 nt, Homo sapiens
caucuucgcuacaguuaug

SEQ ID NO: 266526 - RNA, 19 nt, Homo sapiens
gcaucuguauuguaaguga

SEQ ID NO: 266527 - RNA, 19 nt, Homo sapiens
gaauaacuaauguggauug

SEQ ID NO: 266528 - RNA, 19 nt, Homo sapiens
gaaaugccgccuacugaug

SEQ ID NO: 266529 - RNA, 19 nt, Homo sapiens
uaacagccgauccaguuua

SEQ ID NO: 266530 - RNA, 19 nt, Homo sapiens
ccaagaugcucucauugug

SEQ ID NO: 266531 - RNA, 19 nt, Homo sapiens
gaucaaucaucucagaauc

SEQ ID NO: 266532 - RNA, 19 nt, Homo sapiens
cuggauauaucacuaugua

SEQ ID NO: 266533 - RNA, 19 nt, Homo sapiens
gaguugacccauauaaauu

SEQ ID NO: 266534 - RNA, 19 nt, Homo sapiens
caagacuacuguuuacugu

SEQ ID NO: 266535 - RNA, 19 nt, Homo sapiens
cuacugaugcuucuuauga

SEQ ID NO: 266536 - RNA, 19 nt, Homo sapiens
ugaaugagcacaaugaaau

SEQ ID NO: 266537 - RNA, 19 nt, Homo sapiens
ggacgaacaagucuuugaa

SEQ ID NO: 266538 - RNA, 19 nt, Homo sapiens
gcacaucaccuccaucucu

SEQ ID NO: 266539 - RNA, 19 nt, Homo sapiens
guaacuaaggucauuguuu

SEQ ID NO: 266540 - RNA, 19 nt, Homo sapiens
gguggugaaugacuauuga

SEQ ID NO: 266541 - RNA, 19 nt, Homo sapiens
gaauaaggucuaagagaau

SEQ ID NO: 266542 - RNA, 19 nt, Homo sapiens
gcacuuggccagguaugua

SEQ ID NO: 266543 - RNA, 19 nt, Homo sapiens
ggaccacguuucucacuag

SEQ ID NO: 266544 - RNA, 19 nt, Homo sapiens
uauguugucuucagaauag

SEQ ID NO: 266545 - RNA, 19 nt, Homo sapiens
caacuucagucgcaucuac

SEQ ID NO: 266546 - RNA, 19 nt, Homo sapiens
aaauagaccuuuggagaau

SEQ ID NO: 266547 - RNA, 19 nt, Homo sapiens
aaauacagcccgaggagua

SEQ ID NO: 266548 - RNA, 19 nt, Homo sapiens
ucaggaagccaucaaggua

SEQ ID NO: 266549 - RNA, 19 nt, Homo sapiens
gaucuucacaguugaguau

SEQ ID NO: 266550 - RNA, 19 nt, Homo sapiens
caaugucuagugaaacuua

SEQ ID NO: 266551 - RNA, 19 nt, Homo sapiens
caaaguugaucucuguaca

SEQ ID NO: 266552 - RNA, 19 nt, Homo sapiens
ucagauaguucaguauuca

SEQ ID NO: 266553 - RNA, 19 nt, Homo sapiens
gcagauuaaugcagcaaag

SEQ ID NO: 266554 - RNA, 19 nt, Homo sapiens
guacucaggaggaaauauu

SEQ ID NO: 266555 - RNA, 19 nt, Homo sapiens
guguuaaacuaaacuguga

SEQ ID NO: 266556 - RNA, 19 nt, Homo sapiens
uaaggaaaccauaaucaga

SEQ ID NO: 266557 - RNA, 19 nt, Homo sapiens
uagugaaacuuaucugaug

SEQ ID NO: 266558 - RNA, 19 nt, Homo sapiens
ccaaaacuauugugccaua

SEQ ID NO: 266559 - RNA, 19 nt, Homo sapiens
ggugggcugugcaaauaaa

SEQ ID NO: 266560 - RNA, 19 nt, Homo sapiens
ccaugaacauuggcuauga

SEQ ID NO: 266561 - RNA, 19 nt, Homo sapiens
aaagaagguugguagugaa

SEQ ID NO: 266562 - RNA, 19 nt, Homo sapiens
gugcaucucugcuuacgau

SEQ ID NO: 266563 - RNA, 19 nt, Homo sapiens
gaccuuuggagaauacuua

SEQ ID NO: 266564 - RNA, 19 nt, Homo sapiens
caggaaggcagcacaaauu

SEQ ID NO: 266565 - RNA, 19 nt, Homo sapiens
caggaucaaucaucucaga

SEQ ID NO: 266566 - RNA, 19 nt, Homo sapiens
aaacuaaacugugaacaac

SEQ ID NO: 266567 - RNA, 19 nt, Homo sapiens
ggacgucagcggagccuuu

SEQ ID NO: 266568 - RNA, 19 nt, Homo sapiens
gaacugggcuuucuucucu

SEQ ID NO: 266569 - RNA, 19 nt, Homo sapiens
guacgaaccuccaccauca

SEQ ID NO: 266570 - RNA, 19 nt, Homo sapiens
ccacacaccugcccaauuc

SEQ ID NO: 266571 - RNA, 19 nt, Homo sapiens
gcaacgggcuccucaacga

SEQ ID NO: 266572 - RNA, 19 nt, Homo sapiens
gagcagcccucccucacaa

SEQ ID NO: 266573 - RNA, 19 nt, Homo sapiens
ggacauagcccugugauac

SEQ ID NO: 266574 - RNA, 19 nt, Homo sapiens
gaacuacccauccacaaga

SEQ ID NO: 266575 - RNA, 19 nt, Homo sapiens
gauccgagauguucugcuu

SEQ ID NO: 266576 - RNA, 19 nt, Homo sapiens
gaaaucgcacugcaagaaa

SEQ ID NO: 266577 - RNA, 19 nt, Homo sapiens
gugauuguuuccaacuuua

SEQ ID NO: 266578 - RNA, 19 nt, Homo sapiens
ggaagggacugggcaaagu

SEQ ID NO: 266579 - RNA, 19 nt, Homo sapiens
ggagagggaucgaaagacu

SEQ ID NO: 266580 - RNA, 19 nt, Homo sapiens
gcuccagccuuaauuugaa

SEQ ID NO: 266581 - RNA, 19 nt, Homo sapiens
gaaccuccaccaucaagaa

SEQ ID NO: 266582 - RNA, 19 nt, Homo sapiens
aagcaucccugccucguuu

SEQ ID NO: 266583 - RNA, 19 nt, Homo sapiens
gauaaacgcagggcacaaa

SEQ ID NO: 266584 - RNA, 19 nt, Homo sapiens
gaaggggacuggcauguug

SEQ ID NO: 266585 - RNA, 19 nt, Homo sapiens
uguccuaucuuguggauga

SEQ ID NO: 266586 - RNA, 19 nt, Homo sapiens
cuacgugacuggcuucuuc

SEQ ID NO: 266587 - RNA, 19 nt, Homo sapiens
caucaagaaccacgaguuu

SEQ ID NO: 266588 - RNA, 19 nt, Homo sapiens
ucaagaaccacgaguuuau

SEQ ID NO: 266589 - RNA, 19 nt, Homo sapiens
aaaguuaccuggacucaac

SEQ ID NO: 266590 - RNA, 19 nt, Homo sapiens
ggagacauggugccuaaga

SEQ ID NO: 266591 - RNA, 19 nt, Homo sapiens
uaccuggacucaacuaaau

SEQ ID NO: 266592 - RNA, 19 nt, Homo sapiens
gaagggacugggcaaaguu

SEQ ID NO: 266593 - RNA, 19 nt, Homo sapiens
accagucgcuccagccuua

SEQ ID NO: 266594 - RNA, 19 nt, Homo sapiens
ccacuggguuguccuaucu

SEQ ID NO: 266595 - RNA, 19 nt, Homo sapiens
gaaccacgaguuuauugau

SEQ ID NO: 266596 - RNA, 19 nt, Homo sapiens
guugguggguggucacuga

SEQ ID NO: 266597 - RNA, 19 nt, Homo sapiens
cuacaucggucuggucaug

SEQ ID NO: 266598 - RNA, 19 nt, Homo sapiens
ugaaaucgcacugcaagaa

SEQ ID NO: 266599 - RNA, 19 nt, Homo sapiens
ccacagccaucaucagcau

SEQ ID NO: 266600 - RNA, 19 nt, Homo sapiens
ugaauaggauccgagaugu

SEQ ID NO: 266601 - RNA, 19 nt, Homo sapiens
gcuuaguguugacauuuga

SEQ ID NO: 266602 - RNA, 19 nt, Homo sapiens
gcugcgugcucaacuucua

SEQ ID NO: 266603 - RNA, 19 nt, Homo sapiens
gaauaggauccgagauguu

SEQ ID NO: 266604 - RNA, 19 nt, Homo sapiens
caagaaccacgaguuuauu

SEQ ID NO: 266605 - RNA, 19 nt, Homo sapiens
acgacgagcuggccuucua

SEQ ID NO: 266606 - RNA, 19 nt, Homo sapiens
cacgaacauuccuuccaua

SEQ ID NO: 266607 - RNA, 19 nt, Homo sapiens
ugugauuguuuccaacuuu

SEQ ID NO: 266608 - RNA, 19 nt, Homo sapiens
agaacaagcggcaggauga

SEQ ID NO: 266609 - RNA, 19 nt, Homo sapiens
acggagacauggugccuaa

SEQ ID NO: 266610 - RNA, 19 nt, Homo sapiens
acacgaacauuccuuccau

SEQ ID NO: 266611 - RNA, 19 nt, Homo sapiens
caucaugcccuacuacauc

SEQ ID NO: 266612 - RNA, 19 nt, Homo sapiens
gcaacaggcugagguucca

SEQ ID NO: 266613 - RNA, 19 nt, Homo sapiens
ccagcaauguugucaaggu

SEQ ID NO: 266614 - RNA, 19 nt, Homo sapiens
guaguaagaagaccacaca

SEQ ID NO: 266615 - RNA, 19 nt, Homo sapiens
gcuacucgguggccuucuu

SEQ ID NO: 266616 - RNA, 19 nt, Homo sapiens
gaaauggcugaaaguggaa

SEQ ID NO: 266617 - RNA, 19 nt, Homo sapiens
ggcaagaccaccucacuca

SEQ ID NO: 266618 - RNA, 19 nt, Homo sapiens
caagaccaccucacucauc

SEQ ID NO: 266619 - RNA, 19 nt, Homo sapiens
gccagucccugugauuguu

SEQ ID NO: 266620 - RNA, 19 nt, Homo sapiens
uugaugagcagauguuuga

SEQ ID NO: 266621 - RNA, 19 nt, Homo sapiens
gacaacgacucggagaaca

SEQ ID NO: 266622 - RNA, 19 nt, Homo sapiens
gagcugugccuccgaacug

SEQ ID NO: 266623 - RNA, 19 nt, Homo sapiens
cugcugcacugccuggaaa

SEQ ID NO: 266624 - RNA, 19 nt, Homo sapiens
gcaaaguuaccuggacuca

SEQ ID NO: 266625 - RNA, 19 nt, Homo sapiens
gaucaccacagccaucauc

SEQ ID NO: 266626 - RNA, 19 nt, Homo sapiens
ugcaagagcucagcacgau

SEQ ID NO: 266627 - RNA, 19 nt, Homo sapiens
gccagcaaguucacaagca

SEQ ID NO: 266628 - RNA, 19 nt, Homo sapiens
gcuacgaggaguacaagga

SEQ ID NO: 266629 - RNA, 19 nt, Homo sapiens
guugacauuugaauaggau

SEQ ID NO: 266630 - RNA, 19 nt, Homo sapiens
acaagaagucccucacugu

SEQ ID NO: 266631 - RNA, 19 nt, Homo sapiens
gcagauguuugagcagaac

SEQ ID NO: 266632 - RNA, 19 nt, Homo sapiens
ccagcaaguucacaagcau

SEQ ID NO: 266633 - RNA, 19 nt, Homo sapiens
ccauggccaucaucaucuu

SEQ ID NO: 266634 - RNA, 19 nt, Homo sapiens
gcggcaggaugagcugauu

SEQ ID NO: 266635 - RNA, 19 nt, Homo sapiens
accacgaguuuauugauga

SEQ ID NO: 266636 - RNA, 19 nt, Homo sapiens
gagacauggugccuaagac

SEQ ID NO: 266637 - RNA, 19 nt, Homo sapiens
ucaacgaggacaccaagga

SEQ ID NO: 266638 - RNA, 19 nt, Homo sapiens
gcagcacggagaaggaguu

SEQ ID NO: 266639 - RNA, 19 nt, Homo sapiens
gagauguucugcuuuuauc

SEQ ID NO: 266640 - RNA, 19 nt, Homo sapiens
aaccacgaguuuauugaug

SEQ ID NO: 266641 - RNA, 19 nt, Homo sapiens
uuccugcgcuugcuuagug

SEQ ID NO: 266642 - RNA, 19 nt, Homo sapiens
caggauccguguggccaaa

SEQ ID NO: 266643 - RNA, 19 nt, Homo sapiens
gguacaccauugucaccau

SEQ ID NO: 266644 - RNA, 19 nt, Homo sapiens
cuucaggaucuucaaguuu

SEQ ID NO: 266645 - RNA, 19 nt, Homo sapiens
gaucuucaccguggaguac

SEQ ID NO: 266646 - RNA, 19 nt, Homo sapiens
caccaaggaguacuucuuc

SEQ ID NO: 266647 - RNA, 19 nt, Homo sapiens
aaauuccugcgcuugcuua

SEQ ID NO: 266648 - RNA, 19 nt, Homo sapiens
acacaccugcccaauucua

SEQ ID NO: 266649 - RNA, 19 nt, Homo sapiens
gcaagaccaccucacucau

SEQ ID NO: 266650 - RNA, 19 nt, Homo sapiens
gaggagcacaugggcaaga

SEQ ID NO: 266651 - RNA, 19 nt, Homo sapiens
cauggugccuaagacgauu

SEQ ID NO: 266652 - RNA, 19 nt, Homo sapiens
caccauggccaucaucauc

SEQ ID NO: 266653 - RNA, 19 nt, Homo sapiens
ccaaggaguacuucuucga

SEQ ID NO: 266654 - RNA, 19 nt, Homo sapiens
ggacaccaaggaguacuuc

SEQ ID NO: 266655 - RNA, 19 nt, Homo sapiens
aagaaccacgaguuuauug

SEQ ID NO: 266656 - RNA, 19 nt, Homo sapiens
ucuucaggaucuucaaguu

SEQ ID NO: 266657 - RNA, 19 nt, Homo sapiens
cggcgugcgucaugaucuu

SEQ ID NO: 266658 - RNA, 19 nt, Homo sapiens
uuaccuggacucaacuaaa

SEQ ID NO: 266659 - RNA, 19 nt, Homo sapiens
acgaggacaccaaggagua

SEQ ID NO: 266660 - RNA, 19 nt, Homo sapiens
aauaggauccgagauguuc

SEQ ID NO: 266661 - RNA, 19 nt, Homo sapiens
acauagcccugugauacug

SEQ ID NO: 266662 - RNA, 19 nt, Homo sapiens
gacauagcccugugauacu

SEQ ID NO: 266663 - RNA, 19 nt, Homo sapiens
ccacgaguuuauugaugag

SEQ ID NO: 266664 - RNA, 19 nt, Homo sapiens
gaacaagcggcaggaugag

SEQ ID NO: 266665 - RNA, 19 nt, Homo sapiens
gcucagcacgauccacauc

SEQ ID NO: 266666 - RNA, 19 nt, Homo sapiens
aaacaggcaguucgaaugc

SEQ ID NO: 266667 - RNA, 19 nt, Homo sapiens
aagggacugggcaaaguua

SEQ ID NO: 266668 - RNA, 19 nt, Homo sapiens
gaacugggcuuucuucucu

SEQ ID NO: 266669 - RNA, 19 nt, Homo sapiens
ccacacaccugcccaauuc

SEQ ID NO: 266670 - RNA, 19 nt, Homo sapiens
gcaacgggcuccucaacga

SEQ ID NO: 266671 - RNA, 19 nt, Homo sapiens
gagcagcccucccucacaa

SEQ ID NO: 266672 - RNA, 19 nt, Homo sapiens
ggacauagcccugugauac

SEQ ID NO: 266673 - RNA, 19 nt, Homo sapiens
gaacuacccauccacaaga

SEQ ID NO: 266674 - RNA, 19 nt, Homo sapiens
gauccgagauguucugcuu

SEQ ID NO: 266675 - RNA, 19 nt, Homo sapiens
gaaaucgcacugcaagaaa

SEQ ID NO: 266676 - RNA, 19 nt, Homo sapiens
gugauuguuuccaacuuua

SEQ ID NO: 266677 - RNA, 19 nt, Homo sapiens
ggaagggacugggcaaagu

SEQ ID NO: 266678 - RNA, 19 nt, Homo sapiens
ggagagggaucgaaagacu

SEQ ID NO: 266679 - RNA, 19 nt, Homo sapiens
gcuccagccuuaauuugaa

SEQ ID NO: 266680 - RNA, 19 nt, Homo sapiens
aagcaucccugccucguuu

SEQ ID NO: 266681 - RNA, 19 nt, Homo sapiens
ccacuaaccacgaguuuau

SEQ ID NO: 266682 - RNA, 19 nt, Homo sapiens
gauaaacgcagggcacaaa

SEQ ID NO: 266683 - RNA, 19 nt, Homo sapiens
gaaggggacuggcauguug

SEQ ID NO: 266684 - RNA, 19 nt, Homo sapiens
cuacgugacuggcuucuuc

SEQ ID NO: 266685 - RNA, 19 nt, Homo sapiens
aaaguuaccuggacucaac

SEQ ID NO: 266686 - RNA, 19 nt, Homo sapiens
ggagacauggugccuaaga

SEQ ID NO: 266687 - RNA, 19 nt, Homo sapiens
uaccuggacucaacuaaau

SEQ ID NO: 266688 - RNA, 19 nt, Homo sapiens
gaagggacugggcaaaguu

SEQ ID NO: 266689 - RNA, 19 nt, Homo sapiens
accagucgcuccagccuua

SEQ ID NO: 266690 - RNA, 19 nt, Homo sapiens
guugguggguggucacuga

SEQ ID NO: 266691 - RNA, 19 nt, Homo sapiens
cuacaucggucuggucaug

SEQ ID NO: 266692 - RNA, 19 nt, Homo sapiens
ugaaaucgcacugcaagaa

SEQ ID NO: 266693 - RNA, 19 nt, Homo sapiens
ccacagccaucaucagcau

SEQ ID NO: 266694 - RNA, 19 nt, Homo sapiens
ugaauaggauccgagaugu

SEQ ID NO: 266695 - RNA, 19 nt, Homo sapiens
gcuuaguguugacauuuga

SEQ ID NO: 266696 - RNA, 19 nt, Homo sapiens
gcugcgugcucaacuucua

SEQ ID NO: 266697 - RNA, 19 nt, Homo sapiens
gaauaggauccgagauguu

SEQ ID NO: 266698 - RNA, 19 nt, Homo sapiens
acgacgagcuggccuucua

SEQ ID NO: 266699 - RNA, 19 nt, Homo sapiens
cacgaacauuccuuccaua

SEQ ID NO: 266700 - RNA, 19 nt, Homo sapiens
ugugauuguuuccaacuuu

SEQ ID NO: 266701 - RNA, 19 nt, Homo sapiens
agaacaagcggcaggauga

SEQ ID NO: 266702 - RNA, 19 nt, Homo sapiens
acggagacauggugccuaa

SEQ ID NO: 266703 - RNA, 19 nt, Homo sapiens
acacgaacauuccuuccau

SEQ ID NO: 266704 - RNA, 19 nt, Homo sapiens
caucaugcccuacuacauc

SEQ ID NO: 266705 - RNA, 19 nt, Homo sapiens
gcaacaggcugagguucca

SEQ ID NO: 266706 - RNA, 19 nt, Homo sapiens
ccagcaauguugucaaggu

SEQ ID NO: 266707 - RNA, 19 nt, Homo sapiens
guaguaagaagaccacaca

SEQ ID NO: 266708 - RNA, 19 nt, Homo sapiens
gcuacucgguggccuucuu

SEQ ID NO: 266709 - RNA, 19 nt, Homo sapiens
gaaauggcugaaaguggaa

SEQ ID NO: 266710 - RNA, 19 nt, Homo sapiens
ggcaagaccaccucacuca

SEQ ID NO: 266711 - RNA, 19 nt, Homo sapiens
caagaccaccucacucauc

SEQ ID NO: 266712 - RNA, 19 nt, Homo sapiens
gccagucccugugauuguu

SEQ ID NO: 266713 - RNA, 19 nt, Homo sapiens
uugaugagcagauguuuga

SEQ ID NO: 266714 - RNA, 19 nt, Homo sapiens
gacaacgacucggagaaca

SEQ ID NO: 266715 - RNA, 19 nt, Homo sapiens
gagcugugccuccgaacug

SEQ ID NO: 266716 - RNA, 19 nt, Homo sapiens
cugcugcacugccuggaaa

SEQ ID NO: 266717 - RNA, 19 nt, Homo sapiens
gcaaaguuaccuggacuca

SEQ ID NO: 266718 - RNA, 19 nt, Homo sapiens
gaucaccacagccaucauc

SEQ ID NO: 266719 - RNA, 19 nt, Homo sapiens
ugcaagagcucagcacgau

SEQ ID NO: 266720 - RNA, 19 nt, Homo sapiens
gccagcaaguucacaagca

SEQ ID NO: 266721 - RNA, 19 nt, Homo sapiens
gcuacgaggaguacaagga

SEQ ID NO: 266722 - RNA, 19 nt, Homo sapiens
guugacauuugaauaggau

SEQ ID NO: 266723 - RNA, 19 nt, Homo sapiens
acaagaagucccucacugu

SEQ ID NO: 266724 - RNA, 19 nt, Homo sapiens
gcagauguuugagcagaac

SEQ ID NO: 266725 - RNA, 19 nt, Homo sapiens
ccagcaaguucacaagcau

SEQ ID NO: 266726 - RNA, 19 nt, Homo sapiens
ccauggccaucaucaucuu

SEQ ID NO: 266727 - RNA, 19 nt, Homo sapiens
gcggcaggaugagcugauu

SEQ ID NO: 266728 - RNA, 19 nt, Homo sapiens
accacgaguuuauugauga

SEQ ID NO: 266729 - RNA, 19 nt, Homo sapiens
gagacauggugccuaagac

SEQ ID NO: 266730 - RNA, 19 nt, Homo sapiens
ucaacgaggacaccaagga

SEQ ID NO: 266731 - RNA, 19 nt, Homo sapiens
gcagcacggagaaggaguu

SEQ ID NO: 266732 - RNA, 19 nt, Homo sapiens
gagauguucugcuuuuauc

SEQ ID NO: 266733 - RNA, 19 nt, Homo sapiens
aaccacgaguuuauugaug

SEQ ID NO: 266734 - RNA, 19 nt, Homo sapiens
uaaccacgaguuuauugau

SEQ ID NO: 266735 - RNA, 19 nt, Homo sapiens
uuccugcgcuugcuuagug

SEQ ID NO: 266736 - RNA, 19 nt, Homo sapiens
caggauccguguggccaaa

SEQ ID NO: 266737 - RNA, 19 nt, Homo sapiens
gguacaccauugucaccau

SEQ ID NO: 266738 - RNA, 19 nt, Homo sapiens
cuucaggaucuucaaguuu

SEQ ID NO: 266739 - RNA, 19 nt, Homo sapiens
gaucuucaccguggaguac

SEQ ID NO: 266740 - RNA, 19 nt, Homo sapiens
caccaaggaguacuucuuc

SEQ ID NO: 266741 - RNA, 19 nt, Homo sapiens
acacaccugcccaauucua

SEQ ID NO: 266742 - RNA, 19 nt, Homo sapiens
aaauuccugcgcuugcuua

SEQ ID NO: 266743 - RNA, 19 nt, Homo sapiens
gcaagaccaccucacucau

SEQ ID NO: 266744 - RNA, 19 nt, Homo sapiens
gaggagcacaugggcaaga

SEQ ID NO: 266745 - RNA, 19 nt, Homo sapiens
cauggugccuaagacgauu

SEQ ID NO: 266746 - RNA, 19 nt, Homo sapiens
caccauggccaucaucauc

SEQ ID NO: 266747 - RNA, 19 nt, Homo sapiens
ccaaggaguacuucuucga

SEQ ID NO: 266748 - RNA, 19 nt, Homo sapiens
ggacaccaaggaguacuuc

SEQ ID NO: 266749 - RNA, 19 nt, Homo sapiens
aauaggauccgagauguuc

SEQ ID NO: 266750 - RNA, 19 nt, Homo sapiens
ucuucaggaucuucaaguu

SEQ ID NO: 266751 - RNA, 19 nt, Homo sapiens
cggcgugcgucaugaucuu

SEQ ID NO: 266752 - RNA, 19 nt, Homo sapiens
uuaccuggacucaacuaaa

SEQ ID NO: 266753 - RNA, 19 nt, Homo sapiens
acgaggacaccaaggagua

SEQ ID NO: 266754 - RNA, 19 nt, Homo sapiens
acauagcccugugauacug

SEQ ID NO: 266755 - RNA, 19 nt, Homo sapiens
gacauagcccugugauacu

SEQ ID NO: 266756 - RNA, 19 nt, Homo sapiens
ccacgaguuuauugaugag

SEQ ID NO: 266757 - RNA, 19 nt, Homo sapiens
gaacaagcggcaggaugag

SEQ ID NO: 266758 - RNA, 19 nt, Homo sapiens
gcucagcacgauccacauc

SEQ ID NO: 266759 - RNA, 19 nt, Homo sapiens
uugaauaggauccgagaug

SEQ ID NO: 266760 - RNA, 19 nt, Homo sapiens
aaacaggcaguucgaaugc

SEQ ID NO: 266761 - RNA, 19 nt, Homo sapiens
aagggacugggcaaaguua

SEQ ID NO: 266762 - RNA, 19 nt, Homo sapiens
uuccauagccagcaauguu

SEQ ID NO: 266763 - RNA, 19 nt, Homo sapiens
guuuauugaugagcagaug

SEQ ID NO: 266764 - RNA, 19 nt, Homo sapiens
ggcuccaucugcuccuuga

SEQ ID NO: 266765 - RNA, 19 nt, Homo sapiens
ccugugauacugcaucuca

SEQ ID NO: 266766 - RNA, 19 nt, Homo sapiens
cuaaccacgaguuuauuga

SEQ ID NO: 266767 - RNA, 19 nt, Homo sapiens
caaaguuaccuggacucaa

SEQ ID NO: 266768 - RNA, 19 nt, Homo sapiens
gcacucgaacgacccauuc

SEQ ID NO: 266769 - RNA, 19 nt, Homo sapiens
gcggugacgcccuuucuga

SEQ ID NO: 266770 - RNA, 19 nt, Homo sapiens
uagaacaacccaacacaca

SEQ ID NO: 266771 - RNA, 19 nt, Homo sapiens
ucagcaggguggcaacaug

SEQ ID NO: 266772 - RNA, 19 nt, Homo sapiens
agaaggacaaggccuaugu

SEQ ID NO: 266773 - RNA, 19 nt, Homo sapiens
ugaaaaccaucuggccaua

SEQ ID NO: 266774 - RNA, 19 nt, Homo sapiens
ccucuacguccucauggua

SEQ ID NO: 266775 - RNA, 19 nt, Homo sapiens
aaaaccaucuggccauaga

SEQ ID NO: 266776 - RNA, 19 nt, Homo sapiens
gucgugcuaugucguugaa

SEQ ID NO: 266777 - RNA, 19 nt, Homo sapiens
cauagaacaacccaacaca

SEQ ID NO: 266778 - RNA, 19 nt, Homo sapiens
gggauucuucggcuucuuc

SEQ ID NO: 266779 - RNA, 19 nt, Homo sapiens
ugacgcccuuucugaccaa

SEQ ID NO: 266780 - RNA, 19 nt, Homo sapiens
cuacauccgcuccaagaag

SEQ ID NO: 266781 - RNA, 19 nt, Homo sapiens
cuacaggucgugcuauguc

SEQ ID NO: 266782 - RNA, 19 nt, Homo sapiens
cagaagggcuguccugugu

SEQ ID NO: 266783 - RNA, 19 nt, Homo sapiens
ccagagacccuguuuaaga

SEQ ID NO: 266784 - RNA, 19 nt, Homo sapiens
gagcagagccauccagaga

SEQ ID NO: 266785 - RNA, 19 nt, Homo sapiens
ucaucgagguguacuauuu

SEQ ID NO: 266786 - RNA, 19 nt, Homo sapiens
gcgaggagcuggaggagau

SEQ ID NO: 266787 - RNA, 19 nt, Homo sapiens
guaagacuccucuauguug

SEQ ID NO: 266788 - RNA, 19 nt, Homo sapiens
ggguaagacuccucuaugu

SEQ ID NO: 266789 - RNA, 19 nt, Homo sapiens
ggacagauggguagaugug

SEQ ID NO: 266790 - RNA, 19 nt, Homo sapiens
gcagugaccuggacaaccu

SEQ ID NO: 266791 - RNA, 19 nt, Homo sapiens
gcuccagaguugcaaguga

SEQ ID NO: 266792 - RNA, 19 nt, Homo sapiens
uggcggagcucaucaacug

SEQ ID NO: 266793 - RNA, 19 nt, Homo sapiens
gcaaagccagcccaaguuc

SEQ ID NO: 266794 - RNA, 19 nt, Homo sapiens
gguaagacuccucuauguu

SEQ ID NO: 266795 - RNA, 19 nt, Homo sapiens
cagcgacgacauagagaua

SEQ ID NO: 266796 - RNA, 19 nt, Homo sapiens
ugauggagcugaccaacgu

SEQ ID NO: 266797 - RNA, 19 nt, Homo sapiens
gcgcuguccuucaugaaca

SEQ ID NO: 266798 - RNA, 19 nt, Homo sapiens
caagcgcgaguucuacuuu

SEQ ID NO: 266799 - RNA, 19 nt, Homo sapiens
uucuguaucucccucaaua

SEQ ID NO: 266800 - RNA, 19 nt, Homo sapiens
acauagagauagucgucaa

SEQ ID NO: 266801 - RNA, 19 nt, Homo sapiens
gaagugcgucuggaaguuc

SEQ ID NO: 266802 - RNA, 19 nt, Homo sapiens
agaagugcgucuggaaguu

SEQ ID NO: 266803 - RNA, 19 nt, Homo sapiens
guggacagauggguagaug

SEQ ID NO: 266804 - RNA, 19 nt, Homo sapiens
ggcaaagccagcccaaguu

SEQ ID NO: 266805 - RNA, 19 nt, Homo sapiens
gcgacgacauagagauagu

SEQ ID NO: 266806 - RNA, 19 nt, Homo sapiens
ccacagcgacaccuucauc

SEQ ID NO: 266807 - RNA, 19 nt, Homo sapiens
guaucucccucaauaaagc

SEQ ID NO: 266808 - RNA, 19 nt, Homo sapiens
gcaagcgcgaguucuacuu

SEQ ID NO: 266809 - RNA, 19 nt, Homo sapiens
auccagagacccuguuuaa

SEQ ID NO: 266810 - RNA, 19 nt, Homo sapiens
gggagguccacaugaagaa

SEQ ID NO: 266811 - RNA, 19 nt, Homo sapiens
ucaagaacgagauggacuu

SEQ ID NO: 266812 - RNA, 19 nt, Homo sapiens
gggcuacgacaccaucuuc

SEQ ID NO: 266813 - RNA, 19 nt, Homo sapiens
ggccaucagcuucuugugu

SEQ ID NO: 266814 - RNA, 19 nt, Homo sapiens
cuggacgacuguugcaaga

SEQ ID NO: 266815 - RNA, 19 nt, Homo sapiens
cauccagagacccuguuua

SEQ ID NO: 266816 - RNA, 19 nt, Homo sapiens
cugcagacccucaccuaug

SEQ ID NO: 266817 - RNA, 19 nt, Homo sapiens
guggagacggcgugcauug

SEQ ID NO: 266818 - RNA, 19 nt, Homo sapiens
gggaccuccucagucagua

SEQ ID NO: 266819 - RNA, 19 nt, Homo sapiens
aagcgcgaguucuacuuug

SEQ ID NO: 266820 - RNA, 19 nt, Homo sapiens
guggguaucuucgucuucu

SEQ ID NO: 266821 - RNA, 19 nt, Homo sapiens
caagaacgagauggacuuc

SEQ ID NO: 266822 - RNA, 19 nt, Homo sapiens
cuguaucucccucaauaaa

SEQ ID NO: 266823 - RNA, 19 nt, Homo sapiens
caucgagguguacuauuuc

SEQ ID NO: 266824 - RNA, 19 nt, Homo sapiens
ccucaccuaugcccucaag

SEQ ID NO: 266825 - RNA, 19 nt, Homo sapiens
gaagaacacuagaacauca

SEQ ID NO: 266826 - RNA, 19 nt, Homo sapiens
ggaccacgcuggacgaguu

SEQ ID NO: 266827 - RNA, 19 nt, Homo sapiens
caaauaacaugcccagcaa

SEQ ID NO: 266828 - RNA, 19 nt, Homo sapiens
ggagaugccuuguucuuuu

SEQ ID NO: 266829 - RNA, 19 nt, Homo sapiens
aaaggaagcugggucauca

SEQ ID NO: 266830 - RNA, 19 nt, Homo sapiens
gcaacgaguucuucuucga

SEQ ID NO: 266831 - RNA, 19 nt, Homo sapiens
ccaggacagugacaucuug

SEQ ID NO: 266832 - RNA, 19 nt, Homo sapiens
gcagaagauugaggaguuc

SEQ ID NO: 266833 - RNA, 19 nt, Homo sapiens
caacguaggcggcaucaag

SEQ ID NO: 266834 - RNA, 19 nt, Homo sapiens
ggacagugacaucuuguuc

SEQ ID NO: 266835 - RNA, 19 nt, Homo sapiens
gaaaggaagcugggucauc

SEQ ID NO: 266836 - RNA, 19 nt, Homo sapiens
gggaagaacacuagaacau

SEQ ID NO: 266837 - RNA, 19 nt, Homo sapiens
caccagagacaauaacuga

SEQ ID NO: 266838 - RNA, 19 nt, Homo sapiens
ggaagaacacuagaacauc

SEQ ID NO: 266839 - RNA, 19 nt, Homo sapiens
gggagacaauucugacuac

SEQ ID NO: 266840 - RNA, 19 nt, Homo sapiens
ugcagaagauugaggaguu

SEQ ID NO: 266841 - RNA, 19 nt, Homo sapiens
aggaggagcugcuguacug

SEQ ID NO: 266842 - RNA, 19 nt, Homo sapiens
gcaccaacuucgacgacau

SEQ ID NO: 266843 - RNA, 19 nt, Homo sapiens
gggcgcaguuccucaucaa

SEQ ID NO: 266844 - RNA, 19 nt, Homo sapiens
guguuucccucaauaagga

SEQ ID NO: 266845 - RNA, 19 nt, Homo sapiens
gccgcuaccugcagaagau

SEQ ID NO: 266846 - RNA, 19 nt, Homo sapiens
gggccacuguucccagaug

SEQ ID NO: 266847 - RNA, 19 nt, Homo sapiens
gcacuauccugaccuuccu

SEQ ID NO: 266848 - RNA, 19 nt, Homo sapiens
caacgugugcgaugacuac

SEQ ID NO: 266849 - RNA, 19 nt, Homo sapiens
gagacaauucugacuacga

SEQ ID NO: 266850 - RNA, 19 nt, Homo sapiens
aaacagcagaaacagcaaa

SEQ ID NO: 266851 - RNA, 19 nt, Homo sapiens
gcaagagagggugauguuc

SEQ ID NO: 266852 - RNA, 19 nt, Homo sapiens
caacagcuaccuggacaag

SEQ ID NO: 266853 - RNA, 19 nt, Homo sapiens
ccucuuaccgggagacaau

SEQ ID NO: 266854 - RNA, 19 nt, Homo sapiens
acaauucugacuacgacua

SEQ ID NO: 266855 - RNA, 19 nt, Homo sapiens
gagaugccuuguucuuuuc

SEQ ID NO: 266856 - RNA, 19 nt, Homo sapiens
cgggagacaauucugacua

SEQ ID NO: 266857 - RNA, 19 nt, Homo sapiens
gccgucggaucaucaucaa

SEQ ID NO: 266858 - RNA, 19 nt, Homo sapiens
uggccauccugcccuacua

SEQ ID NO: 266859 - RNA, 19 nt, Homo sapiens
aauacaaacagcagaaaca

SEQ ID NO: 266860 - RNA, 19 nt, Homo sapiens
ggacaccagagacaauaac

SEQ ID NO: 266861 - RNA, 19 nt, Homo sapiens
uauguguguuucccucaau

SEQ ID NO: 266862 - RNA, 19 nt, Homo sapiens
gagcaagagagggugaugu

SEQ ID NO: 266863 - RNA, 19 nt, Homo sapiens
cucauggccuucccaguca

SEQ ID NO: 266864 - RNA, 19 nt, Homo sapiens
ggccacuguucccagaugu

SEQ ID NO: 266865 - RNA, 19 nt, Homo sapiens
gcuaccugcagaagauuga

SEQ ID NO: 266866 - RNA, 19 nt, Homo sapiens
gagaaugaauggaaaguuu

SEQ ID NO: 266867 - RNA, 19 nt, Homo sapiens
gagcgaagcacauuacaua

SEQ ID NO: 266868 - RNA, 19 nt, Homo sapiens
guacaugugugucuacaaa

SEQ ID NO: 266869 - RNA, 19 nt, Homo sapiens
cgaagcacauuacauauau

SEQ ID NO: 266870 - RNA, 19 nt, Homo sapiens
ggaccacgcuggacgaguu

SEQ ID NO: 266871 - RNA, 19 nt, Homo sapiens
gcgaagcacauuacauaua

SEQ ID NO: 266872 - RNA, 19 nt, Homo sapiens
ggaagggacucugagcauu

SEQ ID NO: 266873 - RNA, 19 nt, Homo sapiens
auaaauggguggugugauu

SEQ ID NO: 266874 - RNA, 19 nt, Homo sapiens
ccuaauccuuugcaucaua

SEQ ID NO: 266875 - RNA, 19 nt, Homo sapiens
gcaacgaguucuucuucga

SEQ ID NO: 266876 - RNA, 19 nt, Homo sapiens
ggugugugcuacagucuaa

SEQ ID NO: 266877 - RNA, 19 nt, Homo sapiens
gaagggacucugagcauug

SEQ ID NO: 266878 - RNA, 19 nt, Homo sapiens
caacguuccuaauccuuug

SEQ ID NO: 266879 - RNA, 19 nt, Homo sapiens
gcacacagacaauucuaga

SEQ ID NO: 266880 - RNA, 19 nt, Homo sapiens
cauaagagaaugaauggaa

SEQ ID NO: 266881 - RNA, 19 nt, Homo sapiens
gcguggagcgcgcuuguua

SEQ ID NO: 266882 - RNA, 19 nt, Homo sapiens
gcacauuacauauaucauc

SEQ ID NO: 266883 - RNA, 19 nt, Homo sapiens
gcacucaaccacuauuugu

SEQ ID NO: 266884 - RNA, 19 nt, Homo sapiens
gaauaaaugggugguguga

SEQ ID NO: 266885 - RNA, 19 nt, Homo sapiens
ugaaugaacaaaugaguga

SEQ ID NO: 266886 - RNA, 19 nt, Homo sapiens
gaacaguguccagcacaaa

SEQ ID NO: 266887 - RNA, 19 nt, Homo sapiens
gcagaagauugaggaguuc

SEQ ID NO: 266888 - RNA, 19 nt, Homo sapiens
caacguaggcggcaucaag

SEQ ID NO: 266889 - RNA, 19 nt, Homo sapiens
gaagcacauuacauauauc

SEQ ID NO: 266890 - RNA, 19 nt, Homo sapiens
caaaugagugaauaaaugg

SEQ ID NO: 266891 - RNA, 19 nt, Homo sapiens
ugcagaagauugaggaguu

SEQ ID NO: 266892 - RNA, 19 nt, Homo sapiens
gggagacaauucugacuac

SEQ ID NO: 266893 - RNA, 19 nt, Homo sapiens
gcacaaacaggcacucaac

SEQ ID NO: 266894 - RNA, 19 nt, Homo sapiens
aggaggagcugcuguacug

SEQ ID NO: 266895 - RNA, 19 nt, Homo sapiens
gcaccaacuucgacgacau

SEQ ID NO: 266896 - RNA, 19 nt, Homo sapiens
gaaagccuccucugauugc

SEQ ID NO: 266897 - RNA, 19 nt, Homo sapiens
aguccagucugucuuugua

SEQ ID NO: 266898 - RNA, 19 nt, Homo sapiens
ccacacaagguuucccaaa

SEQ ID NO: 266899 - RNA, 19 nt, Homo sapiens
aacaggcacucaaccacua

SEQ ID NO: 266900 - RNA, 19 nt, Homo sapiens
acaugugugucuacaaaug

SEQ ID NO: 266901 - RNA, 19 nt, Homo sapiens
gaacuugaggugggaacuu

SEQ ID NO: 266902 - RNA, 19 nt, Homo sapiens
guuaauaugugagcaucau

SEQ ID NO: 266903 - RNA, 19 nt, Homo sapiens
ucacacccacuagguauuu

SEQ ID NO: 266904 - RNA, 19 nt, Homo sapiens
gcacacuggcugaauagca

SEQ ID NO: 266905 - RNA, 19 nt, Homo sapiens
gccgcuaccugcagaagau

SEQ ID NO: 266906 - RNA, 19 nt, Homo sapiens
cuaaguccagucugucuuu

SEQ ID NO: 266907 - RNA, 19 nt, Homo sapiens
gcacuauccugaccuuccu

SEQ ID NO: 266908 - RNA, 19 nt, Homo sapiens
ggaggaggaggagcaggua

SEQ ID NO: 266909 - RNA, 19 nt, Homo sapiens
acagacaauucuagaacug

SEQ ID NO: 266910 - RNA, 19 nt, Homo sapiens
ucuaagggcucccacucau

SEQ ID NO: 266911 - RNA, 19 nt, Homo sapiens
ucaacguuccuaauccuuu

SEQ ID NO: 266912 - RNA, 19 nt, Homo sapiens
ggaggaggagcagguaaga

SEQ ID NO: 266913 - RNA, 19 nt, Homo sapiens
caacgugugcgaugacuac

SEQ ID NO: 266914 - RNA, 19 nt, Homo sapiens
agaaagccuccucugauug

SEQ ID NO: 266915 - RNA, 19 nt, Homo sapiens
gagacaauucugacuacga

SEQ ID NO: 266916 - RNA, 19 nt, Homo sapiens
cuaauccuuugcaucauag

SEQ ID NO: 266917 - RNA, 19 nt, Homo sapiens
accacuauuuguugaauga

SEQ ID NO: 266918 - RNA, 19 nt, Homo sapiens
cacacuggcugaauagcau

SEQ ID NO: 266919 - RNA, 19 nt, Homo sapiens
uaaguccagucugucuuug

SEQ ID NO: 266920 - RNA, 19 nt, Homo sapiens
uaguagcccagacacauuu

SEQ ID NO: 266921 - RNA, 19 nt, Homo sapiens
caucauaguagcccagaca

SEQ ID NO: 266922 - RNA, 19 nt, Homo sapiens
gggaagggacucugagcau

SEQ ID NO: 266923 - RNA, 19 nt, Homo sapiens
agaacaguguccagcacaa

SEQ ID NO: 266924 - RNA, 19 nt, Homo sapiens
cugccucccuguuaauaug

SEQ ID NO: 266925 - RNA, 19 nt, Homo sapiens
auugcacacuggcugaaua

SEQ ID NO: 266926 - RNA, 19 nt, Homo sapiens
uaagggcucccacucaucu

SEQ ID NO: 266927 - RNA, 19 nt, Homo sapiens
aacuugaggugggaacuuu

SEQ ID NO: 266928 - RNA, 19 nt, Homo sapiens
cauaguagcccagacacau

SEQ ID NO: 266929 - RNA, 19 nt, Homo sapiens
gaggaggaggagcagguaa

SEQ ID NO: 266930 - RNA, 19 nt, Homo sapiens
cacacaagguuucccaaaa

SEQ ID NO: 266931 - RNA, 19 nt, Homo sapiens
ccuggucccuccugacauc

SEQ ID NO: 266932 - RNA, 19 nt, Homo sapiens
ccucuuaccgggagacaau

SEQ ID NO: 266933 - RNA, 19 nt, Homo sapiens
acaauucugacuacgacua

SEQ ID NO: 266934 - RNA, 19 nt, Homo sapiens
gccgucggaucaucaucaa

SEQ ID NO: 266935 - RNA, 19 nt, Homo sapiens
cgggagacaauucugacua

SEQ ID NO: 266936 - RNA, 19 nt, Homo sapiens
gauuggcccacacaagguu

SEQ ID NO: 266937 - RNA, 19 nt, Homo sapiens
auagguacaugugugucua

SEQ ID NO: 266938 - RNA, 19 nt, Homo sapiens
gauagguacaugugugucu

SEQ ID NO: 266939 - RNA, 19 nt, Homo sapiens
accauucgguccuuucuca

SEQ ID NO: 266940 - RNA, 19 nt, Homo sapiens
cacagacaauucuagaacu

SEQ ID NO: 266941 - RNA, 19 nt, Homo sapiens
gcccugagcgaagcacauu

SEQ ID NO: 266942 - RNA, 19 nt, Homo sapiens
gaaugaacaaaugagugaa

SEQ ID NO: 266943 - RNA, 19 nt, Homo sapiens
acacagacaauucuagaac

SEQ ID NO: 266944 - RNA, 19 nt, Homo sapiens
gggcugcaugugccaacua

SEQ ID NO: 266945 - RNA, 19 nt, Homo sapiens
gaauguuugugugcauggu

SEQ ID NO: 266946 - RNA, 19 nt, Homo sapiens
uaagagaaugaauggaaag

SEQ ID NO: 266947 - RNA, 19 nt, Homo sapiens
ucuggguccugaagauaau

SEQ ID NO: 266948 - RNA, 19 nt, Homo sapiens
ggcacucaaccacuauuug

SEQ ID NO: 266949 - RNA, 19 nt, Homo sapiens
caggaauguuugugugcau

SEQ ID NO: 266950 - RNA, 19 nt, Homo sapiens
gcuaccugcagaagauuga

SEQ ID NO: 266951 - RNA, 19 nt, Homo sapiens
guacagcaaugauggauuu

SEQ ID NO: 266952 - RNA, 19 nt, Homo sapiens
gcugagaggucuauuuaaa

SEQ ID NO: 266953 - RNA, 19 nt, Homo sapiens
gagaugaauuccuuugaaa

SEQ ID NO: 266954 - RNA, 19 nt, Homo sapiens
gaagaacgcaugaaacgaa

SEQ ID NO: 266955 - RNA, 19 nt, Homo sapiens
ccacagacauugagaagau

SEQ ID NO: 266956 - RNA, 19 nt, Homo sapiens
gauaaagacacgauugaaa

SEQ ID NO: 266957 - RNA, 19 nt, Homo sapiens
gagauacucaggauauuaa

SEQ ID NO: 266958 - RNA, 19 nt, Homo sapiens
caacagauaccaugagaug

SEQ ID NO: 266959 - RNA, 19 nt, Homo sapiens
ugacauaacagcuuucaaa

SEQ ID NO: 266960 - RNA, 19 nt, Homo sapiens
guucggcgguccaaugaua

SEQ ID NO: 266961 - RNA, 19 nt, Homo sapiens
cagcugagaggucuauuua

SEQ ID NO: 266962 - RNA, 19 nt, Homo sapiens
gaaacgaacaggauaaagu

SEQ ID NO: 266963 - RNA, 19 nt, Homo sapiens
ggaccuggaugaccuagau

SEQ ID NO: 266964 - RNA, 19 nt, Homo sapiens
cauaacagcuuucaaacag

SEQ ID NO: 266965 - RNA, 19 nt, Homo sapiens
caagaauucugucuacauc

SEQ ID NO: 266966 - RNA, 19 nt, Homo sapiens
gaaauucugauguacaaga

SEQ ID NO: 266967 - RNA, 19 nt, Homo sapiens
ggaaccugauucugacgua

SEQ ID NO: 266968 - RNA, 19 nt, Homo sapiens
ggacuggccuauuguguac

SEQ ID NO: 266969 - RNA, 19 nt, Homo sapiens
ugagaugaauuccuuugaa

SEQ ID NO: 266970 - RNA, 19 nt, Homo sapiens
gcaugaaacgaaagaauga

SEQ ID NO: 266971 - RNA, 19 nt, Homo sapiens
ccucaggaguuguuugaaa

SEQ ID NO: 266972 - RNA, 19 nt, Homo sapiens
ugaccaauauugagaaaca

SEQ ID NO: 266973 - RNA, 19 nt, Homo sapiens
uggcagaggucaagcauuc

SEQ ID NO: 266974 - RNA, 19 nt, Homo sapiens
gggaaugugacgacuauuu

SEQ ID NO: 266975 - RNA, 19 nt, Homo sapiens
ccaguuuccugcugucgua

SEQ ID NO: 266976 - RNA, 19 nt, Homo sapiens
gggaugcccugcagaaagu

SEQ ID NO: 266977 - RNA, 19 nt, Homo sapiens
ccagaggcauugacacaga

SEQ ID NO: 266978 - RNA, 19 nt, Homo sapiens
gaaguuugcucggcugaca

SEQ ID NO: 266979 - RNA, 19 nt, Homo sapiens
ucagugacauaacagcuuu

SEQ ID NO: 266980 - RNA, 19 nt, Homo sapiens
gguccaaugauacuaauuu

SEQ ID NO: 266981 - RNA, 19 nt, Homo sapiens
caacagauguaugccaaca

SEQ ID NO: 266982 - RNA, 19 nt, Homo sapiens
agacgugguuugugauuga

SEQ ID NO: 266983 - RNA, 19 nt, Homo sapiens
cugaagacgugguuuguga

SEQ ID NO: 266984 - RNA, 19 nt, Homo sapiens
cagagaagguccugcagau

SEQ ID NO: 266985 - RNA, 19 nt, Homo sapiens
gcgagaauguccacaagca

SEQ ID NO: 266986 - RNA, 19 nt, Homo sapiens
gaacgcaugaaacgaaaga

SEQ ID NO: 266987 - RNA, 19 nt, Homo sapiens
gaagacgugguuugugauu

SEQ ID NO: 266988 - RNA, 19 nt, Homo sapiens
gaagaggaagaacgcauga

SEQ ID NO: 266989 - RNA, 19 nt, Homo sapiens
gaucuugaccuucuauaca

SEQ ID NO: 266990 - RNA, 19 nt, Homo sapiens
ccuuugaaauucugaugua

SEQ ID NO: 266991 - RNA, 19 nt, Homo sapiens
ggaguuguuugaaauaucg

SEQ ID NO: 266992 - RNA, 19 nt, Homo sapiens
gcaagaauucugucuacau

SEQ ID NO: 266993 - RNA, 19 nt, Homo sapiens
cccguaagcuggaccacua

SEQ ID NO: 266994 - RNA, 19 nt, Homo sapiens
ccaucuuggucccuuauaa

SEQ ID NO: 266995 - RNA, 19 nt, Homo sapiens
cgaacaggauaaagugguu

SEQ ID NO: 266996 - RNA, 19 nt, Homo sapiens
gggcagaagugaugcaaaa

SEQ ID NO: 266997 - RNA, 19 nt, Homo sapiens
cagcaagaauucugucuac

SEQ ID NO: 266998 - RNA, 19 nt, Homo sapiens
gaagguggucccagcaaga

SEQ ID NO: 266999 - RNA, 19 nt, Homo sapiens
ccacuacauugaauaugga

SEQ ID NO: 267000 - RNA, 19 nt, Homo sapiens
ggaccacuacauugaauau

SEQ ID NO: 267001 - RNA, 19 nt, Homo sapiens
ggagcugacugauaaagac

SEQ ID NO: 267002 - RNA, 19 nt, Homo sapiens
gcagaaagugcuggaauuc

SEQ ID NO: 267003 - RNA, 19 nt, Homo sapiens
gagaagguccugcagaucu

SEQ ID NO: 267004 - RNA, 19 nt, Homo sapiens
acuaugagaugaauuccuu

SEQ ID NO: 267005 - RNA, 19 nt, Homo sapiens
cagaagauccucucagucu

SEQ ID NO: 267006 - RNA, 19 nt, Homo sapiens
ggagacguguuuggagaug

SEQ ID NO: 267007 - RNA, 19 nt, Homo sapiens
guucagcucucuaaaaguu

SEQ ID NO: 267008 - RNA, 19 nt, Homo sapiens
ccaagacaauccgcaacaa

SEQ ID NO: 267009 - RNA, 19 nt, Homo sapiens
aaaccaggcagaauaaugu

SEQ ID NO: 267010 - RNA, 19 nt, Homo sapiens
ggacaucaaggccuuaaac

SEQ ID NO: 267011 - RNA, 19 nt, Homo sapiens
gacaguggcaucaccaaga

SEQ ID NO: 267012 - RNA, 19 nt, Homo sapiens
ggaagagugaggacuggaa

SEQ ID NO: 267013 - RNA, 19 nt, Homo sapiens
ugaccagccucaccagugu

SEQ ID NO: 267014 - RNA, 19 nt, Homo sapiens
ccucacaucaucuuacauu

SEQ ID NO: 267015 - RNA, 19 nt, Homo sapiens
gcaagaggcaccaaagacu

SEQ ID NO: 267016 - RNA, 19 nt, Homo sapiens
ugcagaaagugcuggaauu

SEQ ID NO: 267017 - RNA, 19 nt, Homo sapiens
guugacagccucugcuuug

SEQ ID NO: 267018 - RNA, 19 nt, Homo sapiens
ggauugagugagcgaguaa

SEQ ID NO: 267019 - RNA, 19 nt, Homo sapiens
cgcaugaacuaccugaaga

SEQ ID NO: 267020 - RNA, 19 nt, Homo sapiens
aaacuuauccgcaugaacu

SEQ ID NO: 267021 - RNA, 19 nt, Homo sapiens
aaacgaacaggauaaagug

SEQ ID NO: 267022 - RNA, 19 nt, Homo sapiens
ugagaacuaugagaugaau

SEQ ID NO: 267023 - RNA, 19 nt, Homo sapiens
cuuauaaugucuccuucaa

SEQ ID NO: 267024 - RNA, 19 nt, Homo sapiens
gaacaggauaaagugguuu

SEQ ID NO: 267025 - RNA, 19 nt, Homo sapiens
caggaguuguuugaaauau

SEQ ID NO: 267026 - RNA, 19 nt, Homo sapiens
aagaacgcaugaaacgaaa

SEQ ID NO: 267027 - RNA, 19 nt, Homo sapiens
ggacaugagagccgacauc

SEQ ID NO: 267028 - RNA, 19 nt, Homo sapiens
uaagcuggaccacuacauu

SEQ ID NO: 267029 - RNA, 19 nt, Homo sapiens
ucaggaguuguuugaaaua

SEQ ID NO: 267030 - RNA, 19 nt, Homo sapiens
ggucaagcauucguucuac

SEQ ID NO: 267031 - RNA, 19 nt, Homo sapiens
ggaaugugacgacuauuuu

SEQ ID NO: 267032 - RNA, 19 nt, Homo sapiens
agaggaagaacgcaugaaa

SEQ ID NO: 267033 - RNA, 19 nt, Homo sapiens
gaaagugcuggaauucuac

SEQ ID NO: 267034 - RNA, 19 nt, Homo sapiens
gagauguguucuggaagga

SEQ ID NO: 267035 - RNA, 19 nt, Homo sapiens
ucgggaaugugacgacuau

SEQ ID NO: 267036 - RNA, 19 nt, Homo sapiens
uggccuggcugguuguuga

SEQ ID NO: 267037 - RNA, 19 nt, Homo sapiens
ugacguacaacuugaggaa

SEQ ID NO: 267038 - RNA, 19 nt, Homo sapiens
gggacuaugagaucuuuga

SEQ ID NO: 267039 - RNA, 19 nt, Homo sapiens
ccugugugguucuuuguga

SEQ ID NO: 267040 - RNA, 19 nt, Homo sapiens
ugaccuagauguggagaag

SEQ ID NO: 267041 - RNA, 19 nt, Homo sapiens
gaaacgugaagaggaagaa

SEQ ID NO: 267042 - RNA, 19 nt, Homo sapiens
gaccuacugugaucugcau

SEQ ID NO: 267043 - RNA, 19 nt, Homo sapiens
ccaguccugugccaauguu

SEQ ID NO: 267044 - RNA, 19 nt, Homo sapiens
uuggagauguguucuggaa

SEQ ID NO: 267045 - RNA, 19 nt, Homo sapiens
uuugagaacuaugagauga

SEQ ID NO: 267046 - RNA, 19 nt, Homo sapiens
uuucauaccaccuuuguug

SEQ ID NO: 267047 - RNA, 19 nt, Homo sapiens
caugaugauuggcucacuu

SEQ ID NO: 267048 - RNA, 19 nt, Homo sapiens
ggaagaacgcaugaaacga

SEQ ID NO: 267049 - RNA, 19 nt, Homo sapiens
gauuggcucacuucucuau

SEQ ID NO: 267050 - RNA, 19 nt, Homo sapiens
caggggaggugauuucuga

SEQ ID NO: 267051 - RNA, 19 nt, Homo sapiens
guacagcaaugauggauuu

SEQ ID NO: 267052 - RNA, 19 nt, Homo sapiens
gcugagaggucuauuuaaa

SEQ ID NO: 267053 - RNA, 19 nt, Homo sapiens
gagaugaauuccuuugaaa

SEQ ID NO: 267054 - RNA, 19 nt, Homo sapiens
gaagaacgcaugaaacgaa

SEQ ID NO: 267055 - RNA, 19 nt, Homo sapiens
ccacagacauugagaagau

SEQ ID NO: 267056 - RNA, 19 nt, Homo sapiens
gauaaagacacgauugaaa

SEQ ID NO: 267057 - RNA, 19 nt, Homo sapiens
gagauacucaggauauuaa

SEQ ID NO: 267058 - RNA, 19 nt, Homo sapiens
caacagauaccaugagaug

SEQ ID NO: 267059 - RNA, 19 nt, Homo sapiens
ugacauaacagcuuucaaa

SEQ ID NO: 267060 - RNA, 19 nt, Homo sapiens
guucggcgguccaaugaua

SEQ ID NO: 267061 - RNA, 19 nt, Homo sapiens
cagcugagaggucuauuua

SEQ ID NO: 267062 - RNA, 19 nt, Homo sapiens
gaaacgaacaggauaaagu

SEQ ID NO: 267063 - RNA, 19 nt, Homo sapiens
ggaccuggaugaccuagau

SEQ ID NO: 267064 - RNA, 19 nt, Homo sapiens
gaacguggaugagguuagu

SEQ ID NO: 267065 - RNA, 19 nt, Homo sapiens
cauaacagcuuucaaacag

SEQ ID NO: 267066 - RNA, 19 nt, Homo sapiens
caagaauucugucuacauc

SEQ ID NO: 267067 - RNA, 19 nt, Homo sapiens
gaaauucugauguacaaga

SEQ ID NO: 267068 - RNA, 19 nt, Homo sapiens
ggaaccugauucugacgua

SEQ ID NO: 267069 - RNA, 19 nt, Homo sapiens
ggacuggccuauuguguac

SEQ ID NO: 267070 - RNA, 19 nt, Homo sapiens
ugagaugaauuccuuugaa

SEQ ID NO: 267071 - RNA, 19 nt, Homo sapiens
gcaugaaacgaaagaauga

SEQ ID NO: 267072 - RNA, 19 nt, Homo sapiens
ccucaggaguuguuugaaa

SEQ ID NO: 267073 - RNA, 19 nt, Homo sapiens
ugaccaauauugagaaaca

SEQ ID NO: 267074 - RNA, 19 nt, Homo sapiens
uggcagaggucaagcauuc

SEQ ID NO: 267075 - RNA, 19 nt, Homo sapiens
gggaaugugacgacuauuu

SEQ ID NO: 267076 - RNA, 19 nt, Homo sapiens
ccaguuuccugcugucgua

SEQ ID NO: 267077 - RNA, 19 nt, Homo sapiens
gggaugcccugcagaaagu

SEQ ID NO: 267078 - RNA, 19 nt, Homo sapiens
ccagaggcauugacacaga

SEQ ID NO: 267079 - RNA, 19 nt, Homo sapiens
gaaguuugcucggcugaca

SEQ ID NO: 267080 - RNA, 19 nt, Homo sapiens
ucagugacauaacagcuuu

SEQ ID NO: 267081 - RNA, 19 nt, Homo sapiens
gguccaaugauacuaauuu

SEQ ID NO: 267082 - RNA, 19 nt, Homo sapiens
caacagauguaugccaaca

SEQ ID NO: 267083 - RNA, 19 nt, Homo sapiens
agacgugguuugugauuga

SEQ ID NO: 267084 - RNA, 19 nt, Homo sapiens
cugaagacgugguuuguga

SEQ ID NO: 267085 - RNA, 19 nt, Homo sapiens
cagagaagguccugcagau

SEQ ID NO: 267086 - RNA, 19 nt, Homo sapiens
gcgagaauguccacaagca

SEQ ID NO: 267087 - RNA, 19 nt, Homo sapiens
gaacgcaugaaacgaaaga

SEQ ID NO: 267088 - RNA, 19 nt, Homo sapiens
gaagacgugguuugugauu

SEQ ID NO: 267089 - RNA, 19 nt, Homo sapiens
gaagaggaagaacgcauga

SEQ ID NO: 267090 - RNA, 19 nt, Homo sapiens
ggaugagguuagugccuuu

SEQ ID NO: 267091 - RNA, 19 nt, Homo sapiens
gaucuugaccuucuauaca

SEQ ID NO: 267092 - RNA, 19 nt, Homo sapiens
ccuuugaaauucugaugua

SEQ ID NO: 267093 - RNA, 19 nt, Homo sapiens
ggaguuguuugaaauaucg

SEQ ID NO: 267094 - RNA, 19 nt, Homo sapiens
gcaagaauucugucuacau

SEQ ID NO: 267095 - RNA, 19 nt, Homo sapiens
cccguaagcuggaccacua

SEQ ID NO: 267096 - RNA, 19 nt, Homo sapiens
ccaucuuggucccuuauaa

SEQ ID NO: 267097 - RNA, 19 nt, Homo sapiens
cgaacaggauaaagugguu

SEQ ID NO: 267098 - RNA, 19 nt, Homo sapiens
gggcagaagugaugcaaaa

SEQ ID NO: 267099 - RNA, 19 nt, Homo sapiens
cagcaagaauucugucuac

SEQ ID NO: 267100 - RNA, 19 nt, Homo sapiens
gaagguggucccagcaaga

SEQ ID NO: 267101 - RNA, 19 nt, Homo sapiens
ccacuacauugaauaugga

SEQ ID NO: 267102 - RNA, 19 nt, Homo sapiens
ggaccacuacauugaauau

SEQ ID NO: 267103 - RNA, 19 nt, Homo sapiens
ggagcugacugauaaagac

SEQ ID NO: 267104 - RNA, 19 nt, Homo sapiens
gcagaaagugcuggaauuc

SEQ ID NO: 267105 - RNA, 19 nt, Homo sapiens
gagaagguccugcagaucu

SEQ ID NO: 267106 - RNA, 19 nt, Homo sapiens
acuaugagaugaauuccuu

SEQ ID NO: 267107 - RNA, 19 nt, Homo sapiens
cagaagauccucucagucu

SEQ ID NO: 267108 - RNA, 19 nt, Homo sapiens
ggagacguguuuggagaug

SEQ ID NO: 267109 - RNA, 19 nt, Homo sapiens
guucagcucucuaaaaguu

SEQ ID NO: 267110 - RNA, 19 nt, Homo sapiens
ccaagacaauccgcaacaa

SEQ ID NO: 267111 - RNA, 19 nt, Homo sapiens
aaaccaggcagaauaaugu

SEQ ID NO: 267112 - RNA, 19 nt, Homo sapiens
ggacaucaaggccuuaaac

SEQ ID NO: 267113 - RNA, 19 nt, Homo sapiens
gacaguggcaucaccaaga

SEQ ID NO: 267114 - RNA, 19 nt, Homo sapiens
ggaagagugaggacuggaa

SEQ ID NO: 267115 - RNA, 19 nt, Homo sapiens
ugaccagccucaccagugu

SEQ ID NO: 267116 - RNA, 19 nt, Homo sapiens
ccucacaucaucuuacauu

SEQ ID NO: 267117 - RNA, 19 nt, Homo sapiens
gcaagaggcaccaaagacu

SEQ ID NO: 267118 - RNA, 19 nt, Homo sapiens
ugcagaaagugcuggaauu

SEQ ID NO: 267119 - RNA, 19 nt, Homo sapiens
guugacagccucugcuuug

SEQ ID NO: 267120 - RNA, 19 nt, Homo sapiens
ggauugagugagcgaguaa

SEQ ID NO: 267121 - RNA, 19 nt, Homo sapiens
cgcaugaacuaccugaaga

SEQ ID NO: 267122 - RNA, 19 nt, Homo sapiens
aaacuuauccgcaugaacu

SEQ ID NO: 267123 - RNA, 19 nt, Homo sapiens
aaacgaacaggauaaagug

SEQ ID NO: 267124 - RNA, 19 nt, Homo sapiens
ugagaacuaugagaugaau

SEQ ID NO: 267125 - RNA, 19 nt, Homo sapiens
cuuauaaugucuccuucaa

SEQ ID NO: 267126 - RNA, 19 nt, Homo sapiens
gaacaggauaaagugguuu

SEQ ID NO: 267127 - RNA, 19 nt, Homo sapiens
caggaguuguuugaaauau

SEQ ID NO: 267128 - RNA, 19 nt, Homo sapiens
aagaacgcaugaaacgaaa

SEQ ID NO: 267129 - RNA, 19 nt, Homo sapiens
ggacaugagagccgacauc

SEQ ID NO: 267130 - RNA, 19 nt, Homo sapiens
uaagcuggaccacuacauu

SEQ ID NO: 267131 - RNA, 19 nt, Homo sapiens
ucaggaguuguuugaaaua

SEQ ID NO: 267132 - RNA, 19 nt, Homo sapiens
ggucaagcauucguucuac

SEQ ID NO: 267133 - RNA, 19 nt, Homo sapiens
ggaaugugacgacuauuuu

SEQ ID NO: 267134 - RNA, 19 nt, Homo sapiens
agaggaagaacgcaugaaa

SEQ ID NO: 267135 - RNA, 19 nt, Homo sapiens
gaaagugcuggaauucuac

SEQ ID NO: 267136 - RNA, 19 nt, Homo sapiens
gagauguguucuggaagga

SEQ ID NO: 267137 - RNA, 19 nt, Homo sapiens
ucgggaaugugacgacuau

SEQ ID NO: 267138 - RNA, 19 nt, Homo sapiens
uggccuggcugguuguuga

SEQ ID NO: 267139 - RNA, 19 nt, Homo sapiens
ugacguacaacuugaggaa

SEQ ID NO: 267140 - RNA, 19 nt, Homo sapiens
gggacuaugagaucuuuga

SEQ ID NO: 267141 - RNA, 19 nt, Homo sapiens
gaagauugguuuugcugau

SEQ ID NO: 267142 - RNA, 19 nt, Homo sapiens
ccugugugguucuuuguga

SEQ ID NO: 267143 - RNA, 19 nt, Homo sapiens
ugaccuagauguggagaag

SEQ ID NO: 267144 - RNA, 19 nt, Homo sapiens
gaaacgugaagaggaagaa

SEQ ID NO: 267145 - RNA, 19 nt, Homo sapiens
uuugagaacuaugagauga

SEQ ID NO: 267146 - RNA, 19 nt, Homo sapiens
gaccuacugugaucugcau

SEQ ID NO: 267147 - RNA, 19 nt, Homo sapiens
ccaguccugugccaauguu

SEQ ID NO: 267148 - RNA, 19 nt, Homo sapiens
uuggagauguguucuggaa

SEQ ID NO: 267149 - RNA, 19 nt, Homo sapiens
uuucauaccaccuuuguug

SEQ ID NO: 267150 - RNA, 19 nt, Homo sapiens
caugaugauuggcucacuu

SEQ ID NO: 267151 - RNA, 19 nt, Homo sapiens
gaucauagcaccuaagaua

SEQ ID NO: 267152 - RNA, 19 nt, Homo sapiens
gaugggagcugcuuccuau

SEQ ID NO: 267153 - RNA, 19 nt, Homo sapiens
ccaaaucacccucaacuuu

SEQ ID NO: 267154 - RNA, 19 nt, Homo sapiens
ugaagaugcugaugacuau

SEQ ID NO: 267155 - RNA, 19 nt, Homo sapiens
gcuauuuacugcucuuauu

SEQ ID NO: 267156 - RNA, 19 nt, Homo sapiens
gaagcuggaucgcuacuca

SEQ ID NO: 267157 - RNA, 19 nt, Homo sapiens
gcuggaccauccugcauua

SEQ ID NO: 267158 - RNA, 19 nt, Homo sapiens
gaacugcgccgucaucuac

SEQ ID NO: 267159 - RNA, 19 nt, Homo sapiens
ucaggaguguccaacauuu

SEQ ID NO: 267160 - RNA, 19 nt, Homo sapiens
ggacauguacccugaguuc

SEQ ID NO: 267161 - RNA, 19 nt, Homo sapiens
gggagccucugaaccugua

SEQ ID NO: 267162 - RNA, 19 nt, Homo sapiens
cuacacggcugucuucaca

SEQ ID NO: 267163 - RNA, 19 nt, Homo sapiens
gugcagacauggccacugu

SEQ ID NO: 267164 - RNA, 19 nt, Homo sapiens
ggacucgcuuucucagguu

SEQ ID NO: 267165 - RNA, 19 nt, Homo sapiens
ggccagagccguaaguuca

SEQ ID NO: 267166 - RNA, 19 nt, Homo sapiens
gagaagagcagcgacacuu

SEQ ID NO: 267167 - RNA, 19 nt, Homo sapiens
ucauguucauccucaauuu

SEQ ID NO: 267168 - RNA, 19 nt, Homo sapiens
uggaggugcuggacaugua

SEQ ID NO: 267169 - RNA, 19 nt, Homo sapiens
ucauagcaccuaagauaaa

SEQ ID NO: 267170 - RNA, 19 nt, Homo sapiens
gcugaugacuaugaauaau

SEQ ID NO: 267171 - RNA, 19 nt, Homo sapiens
gagaucauagcaccuaaga

SEQ ID NO: 267172 - RNA, 19 nt, Homo sapiens
ccaacggcaucgacaugaa

SEQ ID NO: 267173 - RNA, 19 nt, Homo sapiens
ggacauccucaucaacuuc

SEQ ID NO: 267174 - RNA, 19 nt, Homo sapiens
uaaugaagaugcugaugac

SEQ ID NO: 267175 - RNA, 19 nt, Homo sapiens
ggaccauccugcauuacag

SEQ ID NO: 267176 - RNA, 19 nt, Homo sapiens
ugacagccauggacaacca

SEQ ID NO: 267177 - RNA, 19 nt, Homo sapiens
guuagaggguggcuucagu

SEQ ID NO: 267178 - RNA, 19 nt, Homo sapiens
ggcaacgucucucccaaca

SEQ ID NO: 267179 - RNA, 19 nt, Homo sapiens
gugcuguucuugcucaugu

SEQ ID NO: 267180 - RNA, 19 nt, Homo sapiens
ccgacgugcugccugagua

SEQ ID NO: 267181 - RNA, 19 nt, Homo sapiens
ggaaagaugggagcugcuu

SEQ ID NO: 267182 - RNA, 19 nt, Homo sapiens
uuaaugaagaugcugauga

SEQ ID NO: 267183 - RNA, 19 nt, Homo sapiens
ggagaacugcgccgucauc

SEQ ID NO: 267184 - RNA, 19 nt, Homo sapiens
gcaucgccguccacuacuu

SEQ ID NO: 267185 - RNA, 19 nt, Homo sapiens
aaaucacccucaacuuugu

SEQ ID NO: 267186 - RNA, 19 nt, Homo sapiens
caacgugucggccaucauc

SEQ ID NO: 267187 - RNA, 19 nt, Homo sapiens
cauagcaccuaagauaaag

SEQ ID NO: 267188 - RNA, 19 nt, Homo sapiens
gccuggagaucaccuucaa

SEQ ID NO: 267189 - RNA, 19 nt, Homo sapiens
ccucugaaccuguaugcaa

SEQ ID NO: 267190 - RNA, 19 nt, Homo sapiens
gcucauuggcucccucaug

SEQ ID NO: 267191 - RNA, 19 nt, Homo sapiens
caacaccaacucagagaag

SEQ ID NO: 267192 - RNA, 19 nt, Homo sapiens
ucagcagccucaccagugu

SEQ ID NO: 267193 - RNA, 19 nt, Homo sapiens
uuucucagguuucccaguu

SEQ ID NO: 267194 - RNA, 19 nt, Homo sapiens
ugacggcgcucuacuucac

SEQ ID NO: 267195 - RNA, 19 nt, Homo sapiens
cagcacgccugguccuaca

SEQ ID NO: 267196 - RNA, 19 nt, Homo sapiens
cucauuggcucccucaugu

SEQ ID NO: 267197 - RNA, 19 nt, Homo sapiens
gcgcucuacuucaccuuca

SEQ ID NO: 267198 - RNA, 19 nt, Homo sapiens
gugagaucauagcaccuaa

SEQ ID NO: 267199 - RNA, 19 nt, Homo sapiens
aaguggaaaucgccuucua

SEQ ID NO: 267200 - RNA, 19 nt, Homo sapiens
cagugaccgugagaucaua

SEQ ID NO: 267201 - RNA, 19 nt, Homo sapiens
uggcuucgcccaccaguga

SEQ ID NO: 267202 - RNA, 19 nt, Homo sapiens
gggagcugcuuccuauguc

SEQ ID NO: 267203 - RNA, 19 nt, Homo sapiens
ugaguucuccgaccacuuc

SEQ ID NO: 267204 - RNA, 19 nt, Homo sapiens
ucaccgcccuguacuucau

SEQ ID NO: 267205 - RNA, 19 nt, Homo sapiens
gcucaccgcccuguacuuc

SEQ ID NO: 267206 - RNA, 19 nt, Homo sapiens
caccaucauccgcaaguuu

SEQ ID NO: 267207 - RNA, 19 nt, Homo sapiens
cccacaaugucacugagaa

SEQ ID NO: 267208 - RNA, 19 nt, Homo sapiens
ggagcugcuuccuaugucu

SEQ ID NO: 267209 - RNA, 19 nt, Homo sapiens
ccccagagcuuccccaaga

SEQ ID NO: 267210 - RNA, 19 nt, Homo sapiens
ucucaggaguguccaacau

SEQ ID NO: 267211 - RNA, 19 nt, Homo sapiens
ggagaggaacucgaaagca

SEQ ID NO: 267212 - RNA, 19 nt, Homo sapiens
gaggagcgcaaaguggaaa

SEQ ID NO: 267213 - RNA, 19 nt, Homo sapiens
gauggaggacugcgagaag

SEQ ID NO: 267214 - RNA, 19 nt, Homo sapiens
caucuacacggcugucuuc

SEQ ID NO: 267215 - RNA, 19 nt, Homo sapiens
ccugcgagauaccaacaug

SEQ ID NO: 267216 - RNA, 19 nt, Homo sapiens
ucgagguggugauggagaa

SEQ ID NO: 267217 - RNA, 19 nt, Homo sapiens
aagaugcugaugacuauga

SEQ ID NO: 267218 - RNA, 19 nt, Homo sapiens
ccaucaaggacaaguaugu

SEQ ID NO: 267219 - RNA, 19 nt, Homo sapiens
gcugguuccucaucgacau

SEQ ID NO: 267220 - RNA, 19 nt, Homo sapiens
augaagaugcugaugacua

SEQ ID NO: 267221 - RNA, 19 nt, Homo sapiens
cuauuuacugcucuuauug

SEQ ID NO: 267222 - RNA, 19 nt, Homo sapiens
gcaagcgcaaguuguccuu

SEQ ID NO: 267223 - RNA, 19 nt, Homo sapiens
ccgcaccauuagcaagauu

SEQ ID NO: 267224 - RNA, 19 nt, Homo sapiens
gggcugucaucauguucau

SEQ ID NO: 267225 - RNA, 19 nt, Homo sapiens
augcugaugacuaugaaua

SEQ ID NO: 267226 - RNA, 19 nt, Homo sapiens
ucucagguuucccaguuca

SEQ ID NO: 267227 - RNA, 19 nt, Homo sapiens
ccaacgcucggguggagaa

SEQ ID NO: 267228 - RNA, 19 nt, Homo sapiens
uggacauccucaucaacuu

SEQ ID NO: 267229 - RNA, 19 nt, Homo sapiens
ccagagccguaaguucauc

SEQ ID NO: 267230 - RNA, 19 nt, Homo sapiens
gacucgcuuucucagguuu

SEQ ID NO: 267231 - RNA, 19 nt, Homo sapiens
cgugagaucauagcaccua

SEQ ID NO: 267232 - RNA, 19 nt, Homo sapiens
ccagugaccgugagaucau

SEQ ID NO: 267233 - RNA, 19 nt, Homo sapiens
gcagcggcuugcucaacuc

SEQ ID NO: 267234 - RNA, 19 nt, Homo sapiens
ccaagaccuuccgccugaa

SEQ ID NO: 267235 - RNA, 19 nt, Homo sapiens
agaagagcagcgacacuug

SEQ ID NO: 267236 - RNA, 19 nt, Homo sapiens
gaaguucaagaccacacau

SEQ ID NO: 267237 - RNA, 19 nt, Homo sapiens
uugcucaugugcaccuuug

SEQ ID NO: 267238 - RNA, 19 nt, Homo sapiens
ccuucgaccugcucaucuu

SEQ ID NO: 267239 - RNA, 19 nt, Homo sapiens
gaucauagcaccuaagaua

SEQ ID NO: 267240 - RNA, 19 nt, Homo sapiens
ucacugggcuccuuuaauu

SEQ ID NO: 267241 - RNA, 19 nt, Homo sapiens
gaugggagcugcuuccuau

SEQ ID NO: 267242 - RNA, 19 nt, Homo sapiens
ccaaaucacccucaacuuu

SEQ ID NO: 267243 - RNA, 19 nt, Homo sapiens
gaagcuggaucgcuacuca

SEQ ID NO: 267244 - RNA, 19 nt, Homo sapiens
gcuggaccauccugcauua

SEQ ID NO: 267245 - RNA, 19 nt, Homo sapiens
gaacugcgccgucaucuac

SEQ ID NO: 267246 - RNA, 19 nt, Homo sapiens
gugcgagccuucugaauau

SEQ ID NO: 267247 - RNA, 19 nt, Homo sapiens
gcuaagcuauacuacugua

SEQ ID NO: 267248 - RNA, 19 nt, Homo sapiens
ggugcgagccuucugaaua

SEQ ID NO: 267249 - RNA, 19 nt, Homo sapiens
gugcuaagcuauacuacug

SEQ ID NO: 267250 - RNA, 19 nt, Homo sapiens
aaaguaggaucaaaucuag

SEQ ID NO: 267251 - RNA, 19 nt, Homo sapiens
cuacacggcugucuucaca

SEQ ID NO: 267252 - RNA, 19 nt, Homo sapiens
ucucagcucuguacaaaca

SEQ ID NO: 267253 - RNA, 19 nt, Homo sapiens
guacaaacacaaauacaca

SEQ ID NO: 267254 - RNA, 19 nt, Homo sapiens
gaagcucggcauuugguuu

SEQ ID NO: 267255 - RNA, 19 nt, Homo sapiens
ggccagagccguaaguuca

SEQ ID NO: 267256 - RNA, 19 nt, Homo sapiens
ucauguucauccucaauuu

SEQ ID NO: 267257 - RNA, 19 nt, Homo sapiens
gcauuugguuucacuaagg

SEQ ID NO: 267258 - RNA, 19 nt, Homo sapiens
ccuggaagcucggcauuug

SEQ ID NO: 267259 - RNA, 19 nt, Homo sapiens
ucauagcaccuaagauaaa

SEQ ID NO: 267260 - RNA, 19 nt, Homo sapiens
gugguucauucuagcauuu

SEQ ID NO: 267261 - RNA, 19 nt, Homo sapiens
gagaucauagcaccuaaga

SEQ ID NO: 267262 - RNA, 19 nt, Homo sapiens
gcagauauagcaagcucuu

SEQ ID NO: 267263 - RNA, 19 nt, Homo sapiens
aagaaaugcuagccuggaa

SEQ ID NO: 267264 - RNA, 19 nt, Homo sapiens
ccaacggcaucgacaugaa

SEQ ID NO: 267265 - RNA, 19 nt, Homo sapiens
ggcaguagaggaagaaaug

SEQ ID NO: 267266 - RNA, 19 nt, Homo sapiens
ggacauccucaucaacuuc

SEQ ID NO: 267267 - RNA, 19 nt, Homo sapiens
ggaccauccugcauuacag

SEQ ID NO: 267268 - RNA, 19 nt, Homo sapiens
uuucucagcucuguacaaa

SEQ ID NO: 267269 - RNA, 19 nt, Homo sapiens
ugacagccauggacaacca

SEQ ID NO: 267270 - RNA, 19 nt, Homo sapiens
ggcaacgucucucccaaca

SEQ ID NO: 267271 - RNA, 19 nt, Homo sapiens
gugcuguucuugcucaugu

SEQ ID NO: 267272 - RNA, 19 nt, Homo sapiens
ccgacgugcugccugagua

SEQ ID NO: 267273 - RNA, 19 nt, Homo sapiens
ggaaagaugggagcugcuu

SEQ ID NO: 267274 - RNA, 19 nt, Homo sapiens
gcaagcucuuucgaccaua

SEQ ID NO: 267275 - RNA, 19 nt, Homo sapiens
gcaucgccguccacuacuu

SEQ ID NO: 267276 - RNA, 19 nt, Homo sapiens
ggagaacugcgccgucauc

SEQ ID NO: 267277 - RNA, 19 nt, Homo sapiens
aaaucacccucaacuuugu

SEQ ID NO: 267278 - RNA, 19 nt, Homo sapiens
guaggacauuuuagacuuu

SEQ ID NO: 267279 - RNA, 19 nt, Homo sapiens
caacgugucggccaucauc

SEQ ID NO: 267280 - RNA, 19 nt, Homo sapiens
cauagcaccuaagauaaag

SEQ ID NO: 267281 - RNA, 19 nt, Homo sapiens
caagcucuuucgaccauag

SEQ ID NO: 267282 - RNA, 19 nt, Homo sapiens
gcucauuggcucccucaug

SEQ ID NO: 267283 - RNA, 19 nt, Homo sapiens
caacaccaacucagagaag

SEQ ID NO: 267284 - RNA, 19 nt, Homo sapiens
ucagcagccucaccagugu

SEQ ID NO: 267285 - RNA, 19 nt, Homo sapiens
gguaggacauuuuagacuu

SEQ ID NO: 267286 - RNA, 19 nt, Homo sapiens
ugacacauccaaagcaaag

SEQ ID NO: 267287 - RNA, 19 nt, Homo sapiens
gggugaggcugcugaacuc

SEQ ID NO: 267288 - RNA, 19 nt, Homo sapiens
ugacggcgcucuacuucac

SEQ ID NO: 267289 - RNA, 19 nt, Homo sapiens
aaguggaaaucgccuucua

SEQ ID NO: 267290 - RNA, 19 nt, Homo sapiens
ggucacugggcuccuuuaa

SEQ ID NO: 267291 - RNA, 19 nt, Homo sapiens
cagcacgccugguccuaca

SEQ ID NO: 267292 - RNA, 19 nt, Homo sapiens
cucauuggcucccucaugu

SEQ ID NO: 267293 - RNA, 19 nt, Homo sapiens
gcgcucuacuucaccuuca

SEQ ID NO: 267294 - RNA, 19 nt, Homo sapiens
gugagaucauagcaccuaa

SEQ ID NO: 267295 - RNA, 19 nt, Homo sapiens
cagugaccgugagaucaua

SEQ ID NO: 267296 - RNA, 19 nt, Homo sapiens
uggcuucgcccaccaguga

SEQ ID NO: 267297 - RNA, 19 nt, Homo sapiens
gggagcugcuuccuauguc

SEQ ID NO: 267298 - RNA, 19 nt, Homo sapiens
gcugugcuaagcuauacua

SEQ ID NO: 267299 - RNA, 19 nt, Homo sapiens
caccaucauccgcaaguuu

SEQ ID NO: 267300 - RNA, 19 nt, Homo sapiens
ucaccgcccuguacuucau

SEQ ID NO: 267301 - RNA, 19 nt, Homo sapiens
ggagcugcuuccuaugucu

SEQ ID NO: 267302 - RNA, 19 nt, Homo sapiens
gcucaccgcccuguacuuc

SEQ ID NO: 267303 - RNA, 19 nt, Homo sapiens
cccacaaugucacugagaa

SEQ ID NO: 267304 - RNA, 19 nt, Homo sapiens
ucugugcugugcuaagcua

SEQ ID NO: 267305 - RNA, 19 nt, Homo sapiens
ucuguucugugcugugcua

SEQ ID NO: 267306 - RNA, 19 nt, Homo sapiens
uacauaacacugggccuua

SEQ ID NO: 267307 - RNA, 19 nt, Homo sapiens
gaggagcgcaaaguggaaa

SEQ ID NO: 267308 - RNA, 19 nt, Homo sapiens
ccucagggcagauauagca

SEQ ID NO: 267309 - RNA, 19 nt, Homo sapiens
caucuacacggcugucuuc

SEQ ID NO: 267310 - RNA, 19 nt, Homo sapiens
cauucuagcauuucuguuc

SEQ ID NO: 267311 - RNA, 19 nt, Homo sapiens
caaaguuucacuacauaac

SEQ ID NO: 267312 - RNA, 19 nt, Homo sapiens
ggcauuugguuucacuaag

SEQ ID NO: 267313 - RNA, 19 nt, Homo sapiens
ucgagguggugauggagaa

SEQ ID NO: 267314 - RNA, 19 nt, Homo sapiens
ccaucaaggacaaguaugu

SEQ ID NO: 267315 - RNA, 19 nt, Homo sapiens
acacugggccuuacugcau

SEQ ID NO: 267316 - RNA, 19 nt, Homo sapiens
agauauagcaagcucuuuc

SEQ ID NO: 267317 - RNA, 19 nt, Homo sapiens
cuugacacauccaaagcaa

SEQ ID NO: 267318 - RNA, 19 nt, Homo sapiens
cggcauuugguuucacuaa

SEQ ID NO: 267319 - RNA, 19 nt, Homo sapiens
gcugguuccucaucgacau

SEQ ID NO: 267320 - RNA, 19 nt, Homo sapiens
gggcugucaucauguucau

SEQ ID NO: 267321 - RNA, 19 nt, Homo sapiens
ccucuagccugggcaguag

SEQ ID NO: 267322 - RNA, 19 nt, Homo sapiens
gaggugcgagccuucugaa

SEQ ID NO: 267323 - RNA, 19 nt, Homo sapiens
ccgcaccauuagcaagauu

SEQ ID NO: 267324 - RNA, 19 nt, Homo sapiens
acuacuguauguucuuuca

SEQ ID NO: 267325 - RNA, 19 nt, Homo sapiens
gugcugugcuaagcuauac

SEQ ID NO: 267326 - RNA, 19 nt, Homo sapiens
ccagagccguaaguucauc

SEQ ID NO: 267327 - RNA, 19 nt, Homo sapiens
uggacauccucaucaacuu

SEQ ID NO: 267328 - RNA, 19 nt, Homo sapiens
ccaacgcucggguggagaa

SEQ ID NO: 267329 - RNA, 19 nt, Homo sapiens
cgugagaucauagcaccua

SEQ ID NO: 267330 - RNA, 19 nt, Homo sapiens
ccagugaccgugagaucau

SEQ ID NO: 267331 - RNA, 19 nt, Homo sapiens
gcagcggcuugcucaacuc

SEQ ID NO: 267332 - RNA, 19 nt, Homo sapiens
ccaagaccuuccgccugaa

SEQ ID NO: 267333 - RNA, 19 nt, Homo sapiens
gaugguaggacauuuuaga

SEQ ID NO: 267334 - RNA, 19 nt, Homo sapiens
gcucuuucgaccauaguug

SEQ ID NO: 267335 - RNA, 19 nt, Homo sapiens
cgccacaaacagacacuuu

SEQ ID NO: 267336 - RNA, 19 nt, Homo sapiens
cacauucuccuucccuuca

SEQ ID NO: 267337 - RNA, 19 nt, Homo sapiens
gaaguucaagaccacacau

SEQ ID NO: 267338 - RNA, 19 nt, Homo sapiens
uugcucaugugcaccuuug

SEQ ID NO: 267339 - RNA, 19 nt, Homo sapiens
ugaagaugcugaugacuau

SEQ ID NO: 267340 - RNA, 19 nt, Homo sapiens
gcuauuuacugcucuuauu

SEQ ID NO: 267341 - RNA, 19 nt, Homo sapiens
gaagcuggaucgcuacuca

SEQ ID NO: 267342 - RNA, 19 nt, Homo sapiens
gcuggaccauccugcauua

SEQ ID NO: 267343 - RNA, 19 nt, Homo sapiens
caaccacccuggcuucaug

SEQ ID NO: 267344 - RNA, 19 nt, Homo sapiens
ucaggaguguccaacauuu

SEQ ID NO: 267345 - RNA, 19 nt, Homo sapiens
ggacauguacccugaguuc

SEQ ID NO: 267346 - RNA, 19 nt, Homo sapiens
gggagccucugaaccugua

SEQ ID NO: 267347 - RNA, 19 nt, Homo sapiens
cuacacggcugucuucaca

SEQ ID NO: 267348 - RNA, 19 nt, Homo sapiens
gugcagacauggccacugu

SEQ ID NO: 267349 - RNA, 19 nt, Homo sapiens
ggacucgcuuucucagguu

SEQ ID NO: 267350 - RNA, 19 nt, Homo sapiens
gagaagagcagcgacacuu

SEQ ID NO: 267351 - RNA, 19 nt, Homo sapiens
uggaggugcuggacaugua

SEQ ID NO: 267352 - RNA, 19 nt, Homo sapiens
gcugaugacuaugaauaau

SEQ ID NO: 267353 - RNA, 19 nt, Homo sapiens
ccaacggcaucgacaugaa

SEQ ID NO: 267354 - RNA, 19 nt, Homo sapiens
ggacauccucaucaacuuc

SEQ ID NO: 267355 - RNA, 19 nt, Homo sapiens
uaaugaagaugcugaugac

SEQ ID NO: 267356 - RNA, 19 nt, Homo sapiens
ggaccauccugcauuacag

SEQ ID NO: 267357 - RNA, 19 nt, Homo sapiens
guuagaggguggcuucagu

SEQ ID NO: 267358 - RNA, 19 nt, Homo sapiens
ccgacgugcugccugagua

SEQ ID NO: 267359 - RNA, 19 nt, Homo sapiens
ggcaacgucucucccaaca

SEQ ID NO: 267360 - RNA, 19 nt, Homo sapiens
gugcuguucuugcucaugu

SEQ ID NO: 267361 - RNA, 19 nt, Homo sapiens
uuaaugaagaugcugauga

SEQ ID NO: 267362 - RNA, 19 nt, Homo sapiens
gcaucgccguccacuacuu

SEQ ID NO: 267363 - RNA, 19 nt, Homo sapiens
caacgugucggccaucauc

SEQ ID NO: 267364 - RNA, 19 nt, Homo sapiens
gccuggagaucaccuucaa

SEQ ID NO: 267365 - RNA, 19 nt, Homo sapiens
ccucugaaccuguaugcaa

SEQ ID NO: 267366 - RNA, 19 nt, Homo sapiens
gcucauuggcucccucaug

SEQ ID NO: 267367 - RNA, 19 nt, Homo sapiens
caacaccaacucagagaag

SEQ ID NO: 267368 - RNA, 19 nt, Homo sapiens
ucagcagccucaccagugu

SEQ ID NO: 267369 - RNA, 19 nt, Homo sapiens
uuucucagguuucccaguu

SEQ ID NO: 267370 - RNA, 19 nt, Homo sapiens
ugacggcgcucuacuucac

SEQ ID NO: 267371 - RNA, 19 nt, Homo sapiens
cagcacgccugguccuaca

SEQ ID NO: 267372 - RNA, 19 nt, Homo sapiens
cucauuggcucccucaugu

SEQ ID NO: 267373 - RNA, 19 nt, Homo sapiens
gcgcucuacuucaccuuca

SEQ ID NO: 267374 - RNA, 19 nt, Homo sapiens
ugaguucuccgaccacuuc

SEQ ID NO: 267375 - RNA, 19 nt, Homo sapiens
ucaccgcccuguacuucau

SEQ ID NO: 267376 - RNA, 19 nt, Homo sapiens
gcucaccgcccuguacuuc

SEQ ID NO: 267377 - RNA, 19 nt, Homo sapiens
ccccagagcuuccccaaga

SEQ ID NO: 267378 - RNA, 19 nt, Homo sapiens
ucucaggaguguccaacau

SEQ ID NO: 267379 - RNA, 19 nt, Homo sapiens
ggagaggaacucgaaagca

SEQ ID NO: 267380 - RNA, 19 nt, Homo sapiens
gauggaggacugcgagaag

SEQ ID NO: 267381 - RNA, 19 nt, Homo sapiens
caucuacacggcugucuuc

SEQ ID NO: 267382 - RNA, 19 nt, Homo sapiens
ccugcgagauaccaacaug

SEQ ID NO: 267383 - RNA, 19 nt, Homo sapiens
aagaugcugaugacuauga

SEQ ID NO: 267384 - RNA, 19 nt, Homo sapiens
ccaucaaggacaaguaugu

SEQ ID NO: 267385 - RNA, 19 nt, Homo sapiens
gcugguuccucaucgacau

SEQ ID NO: 267386 - RNA, 19 nt, Homo sapiens
augaagaugcugaugacua

SEQ ID NO: 267387 - RNA, 19 nt, Homo sapiens
cuauuuacugcucuuauug

SEQ ID NO: 267388 - RNA, 19 nt, Homo sapiens
gcaagcgcaaguuguccuu

SEQ ID NO: 267389 - RNA, 19 nt, Homo sapiens
augcugaugacuaugaaua

SEQ ID NO: 267390 - RNA, 19 nt, Homo sapiens
ucucagguuucccaguuca

SEQ ID NO: 267391 - RNA, 19 nt, Homo sapiens
uggacauccucaucaacuu

SEQ ID NO: 267392 - RNA, 19 nt, Homo sapiens
gacucgcuuucucagguuu

SEQ ID NO: 267393 - RNA, 19 nt, Homo sapiens
agaagagcagcgacacuug

SEQ ID NO: 267394 - RNA, 19 nt, Homo sapiens
gaaguucaagaccacacau

SEQ ID NO: 267395 - RNA, 19 nt, Homo sapiens
uugcucaugugcaccuuug

SEQ ID NO: 267396 - RNA, 19 nt, Homo sapiens
ccuucgaccugcucaucuu

SEQ ID NO: 267397 - RNA, 19 nt, Homo sapiens
ccacaaggcuacuguauua

SEQ ID NO: 267398 - RNA, 19 nt, Homo sapiens
ggaaugcuauuucuaaaga

SEQ ID NO: 267399 - RNA, 19 nt, Homo sapiens
agacauaggugcucucuug

SEQ ID NO: 267400 - RNA, 19 nt, Homo sapiens
gcucuaagcuucucaugug

SEQ ID NO: 267401 - RNA, 19 nt, Homo sapiens
ugaaacagaugacaccaaa

SEQ ID NO: 267402 - RNA, 19 nt, Homo sapiens
gcagucacauuuauggaaa

SEQ ID NO: 267403 - RNA, 19 nt, Homo sapiens
gagcaaggcuagucuccaa

SEQ ID NO: 267404 - RNA, 19 nt, Homo sapiens
ccaugugccuuuauaauga

SEQ ID NO: 267405 - RNA, 19 nt, Homo sapiens
gauggaaggugcaacauag

SEQ ID NO: 267406 - RNA, 19 nt, Homo sapiens
ccagaucaauaucaacuuu

SEQ ID NO: 267407 - RNA, 19 nt, Homo sapiens
gaaggagagaccauuauuu

SEQ ID NO: 267408 - RNA, 19 nt, Homo sapiens
guucaaacaucuucggaaa

SEQ ID NO: 267409 - RNA, 19 nt, Homo sapiens
ucaaacaucuucggaaaug

SEQ ID NO: 267410 - RNA, 19 nt, Homo sapiens
gaugagagccuucaaaguc

SEQ ID NO: 267411 - RNA, 19 nt, Homo sapiens
cauaggugcucucuugaaa

SEQ ID NO: 267412 - RNA, 19 nt, Homo sapiens
gaagagaggcuaugacaac

SEQ ID NO: 267413 - RNA, 19 nt, Homo sapiens
uagcguacauucacaaaga

SEQ ID NO: 267414 - RNA, 19 nt, Homo sapiens
caacauagaauuuggcaau

SEQ ID NO: 267415 - RNA, 19 nt, Homo sapiens
gagaugaaccaaccaauca

SEQ ID NO: 267416 - RNA, 19 nt, Homo sapiens
guaccuagaagcauuauga

SEQ ID NO: 267417 - RNA, 19 nt, Homo sapiens
ccagcaggacuuugaauua

SEQ ID NO: 267418 - RNA, 19 nt, Homo sapiens
gaggcacagucaagguuua

SEQ ID NO: 267419 - RNA, 19 nt, Homo sapiens
gaacaggccaaacaaaaua

SEQ ID NO: 267420 - RNA, 19 nt, Homo sapiens
gacagaaugcuuuaguuaa

SEQ ID NO: 267421 - RNA, 19 nt, Homo sapiens
agacagaaugcuuuaguua

SEQ ID NO: 267422 - RNA, 19 nt, Homo sapiens
caaggcuacuguauuagaa

SEQ ID NO: 267423 - RNA, 19 nt, Homo sapiens
gcaggacuuugaauuagug

SEQ ID NO: 267424 - RNA, 19 nt, Homo sapiens
gggaagcuuugccuccuaa

SEQ ID NO: 267425 - RNA, 19 nt, Homo sapiens
gaccucagcuuuucuguuu

SEQ ID NO: 267426 - RNA, 19 nt, Homo sapiens
gaaggugcaacauagaauu

SEQ ID NO: 267427 - RNA, 19 nt, Homo sapiens
aagaaugacuccacuuuua

SEQ ID NO: 267428 - RNA, 19 nt, Homo sapiens
gcacagucaagguuuauau

SEQ ID NO: 267429 - RNA, 19 nt, Homo sapiens
guacuggaaugcuauuucu

SEQ ID NO: 267430 - RNA, 19 nt, Homo sapiens
gcucauauaagguggauug

SEQ ID NO: 267431 - RNA, 19 nt, Homo sapiens
gauguuagagccaggauga

SEQ ID NO: 267432 - RNA, 19 nt, Homo sapiens
gacagaaaguauguucaaa

SEQ ID NO: 267433 - RNA, 19 nt, Homo sapiens
guuggaaggugcaaaguca

SEQ ID NO: 267434 - RNA, 19 nt, Homo sapiens
ggcuaaaucugcacacuag

SEQ ID NO: 267435 - RNA, 19 nt, Homo sapiens
aaacgugccaagaccauua

SEQ ID NO: 267436 - RNA, 19 nt, Homo sapiens
cugcuuaucuuucagucua

SEQ ID NO: 267437 - RNA, 19 nt, Homo sapiens
uauuugagcucauauaagg

SEQ ID NO: 267438 - RNA, 19 nt, Homo sapiens
guacgaaaguaggaugaga

SEQ ID NO: 267439 - RNA, 19 nt, Homo sapiens
cagcaggacuuugaauuag

SEQ ID NO: 267440 - RNA, 19 nt, Homo sapiens
uaaugcaccugagaagaaa

SEQ ID NO: 267441 - RNA, 19 nt, Homo sapiens
guaaagcaaagucucuaaa

SEQ ID NO: 267442 - RNA, 19 nt, Homo sapiens
uuccauaacuuuagcaaga

SEQ ID NO: 267443 - RNA, 19 nt, Homo sapiens
ugacagcccaucuuccuaa

SEQ ID NO: 267444 - RNA, 19 nt, Homo sapiens
cuaagcuucucauguggua

SEQ ID NO: 267445 - RNA, 19 nt, Homo sapiens
agacaaaggaagggaaaua

SEQ ID NO: 267446 - RNA, 19 nt, Homo sapiens
gcaaagagcaaggcuaguc

SEQ ID NO: 267447 - RNA, 19 nt, Homo sapiens
ucacauuuauggaaagcuu

SEQ ID NO: 267448 - RNA, 19 nt, Homo sapiens
gaucaggggacaauaauaa

SEQ ID NO: 267449 - RNA, 19 nt, Homo sapiens
gaaacugguguauggaaga

SEQ ID NO: 267450 - RNA, 19 nt, Homo sapiens
cauagaauuuggcaaugug

SEQ ID NO: 267451 - RNA, 19 nt, Homo sapiens
acuagaaucuugaugauac

SEQ ID NO: 267452 - RNA, 19 nt, Homo sapiens
ggagaugaaccaaccaauc

SEQ ID NO: 267453 - RNA, 19 nt, Homo sapiens
gcaguagcguacauucaca

SEQ ID NO: 267454 - RNA, 19 nt, Homo sapiens
ggggaaaguuuuacuguga

SEQ ID NO: 267455 - RNA, 19 nt, Homo sapiens
guuacuaugucuuucuuuc

SEQ ID NO: 267456 - RNA, 19 nt, Homo sapiens
agacagcaaugaggaguug

SEQ ID NO: 267457 - RNA, 19 nt, Homo sapiens
uaggugcucucuugaaauc

SEQ ID NO: 267458 - RNA, 19 nt, Homo sapiens
uuaaugcaccugagaagaa

SEQ ID NO: 267459 - RNA, 19 nt, Homo sapiens
cuagaagcauuaugaagca

SEQ ID NO: 267460 - RNA, 19 nt, Homo sapiens
gaacgcagugaucagcaaa

SEQ ID NO: 267461 - RNA, 19 nt, Homo sapiens
uguauuggauggcuuaaag

SEQ ID NO: 267462 - RNA, 19 nt, Homo sapiens
ugacagaaaguauguucaa

SEQ ID NO: 267463 - RNA, 19 nt, Homo sapiens
agaagucaaugaaacagau

SEQ ID NO: 267464 - RNA, 19 nt, Homo sapiens
ugaaggagagaccauuauu

SEQ ID NO: 267465 - RNA, 19 nt, Homo sapiens
caacaaccagcaccacuuc

SEQ ID NO: 267466 - RNA, 19 nt, Homo sapiens
gaccucaaguggagauaca

SEQ ID NO: 267467 - RNA, 19 nt, Homo sapiens
gacagcccaucuuccuaaa

SEQ ID NO: 267468 - RNA, 19 nt, Homo sapiens
caaggcuagucuccaaaga

SEQ ID NO: 267469 - RNA, 19 nt, Homo sapiens
acacuagaaucuugaugau

SEQ ID NO: 267470 - RNA, 19 nt, Homo sapiens
gaaaacgcuuacacaaaga

SEQ ID NO: 267471 - RNA, 19 nt, Homo sapiens
ugaaccaaccaaucaauga

SEQ ID NO: 267472 - RNA, 19 nt, Homo sapiens
gugcucucuugaaaucuua

SEQ ID NO: 267473 - RNA, 19 nt, Homo sapiens
ggugcucucuugaaaucuu

SEQ ID NO: 267474 - RNA, 19 nt, Homo sapiens
agacaugcaucuccacaag

SEQ ID NO: 267475 - RNA, 19 nt, Homo sapiens
caaagucuaccagcacaaa

SEQ ID NO: 267476 - RNA, 19 nt, Homo sapiens
gccaugugccuuuauaaug

SEQ ID NO: 267477 - RNA, 19 nt, Homo sapiens
caagacaaaggaagggaaa

SEQ ID NO: 267478 - RNA, 19 nt, Homo sapiens
caagacagaaugcuuuagu

SEQ ID NO: 267479 - RNA, 19 nt, Homo sapiens
ggaggcacagucaagguuu

SEQ ID NO: 267480 - RNA, 19 nt, Homo sapiens
ugagagccuucaaagucua

SEQ ID NO: 267481 - RNA, 19 nt, Homo sapiens
ggaaggugcaacauagaau

SEQ ID NO: 267482 - RNA, 19 nt, Homo sapiens
ucaagugaccauuggauau

SEQ ID NO: 267483 - RNA, 19 nt, Homo sapiens
accaaucaaugacaagaaa

SEQ ID NO: 267484 - RNA, 19 nt, Homo sapiens
gaucacaacagcccuuucu

SEQ ID NO: 267485 - RNA, 19 nt, Homo sapiens
gcuuaucuuucagucuaua

SEQ ID NO: 267486 - RNA, 19 nt, Homo sapiens
gaauguuacuaugucuuuc

SEQ ID NO: 267487 - RNA, 19 nt, Homo sapiens
ggaaggugcaaagucagua

SEQ ID NO: 267488 - RNA, 19 nt, Homo sapiens
guggugaugauauuucuuu

SEQ ID NO: 267489 - RNA, 19 nt, Homo sapiens
aagacagaaugcuuuaguu

SEQ ID NO: 267490 - RNA, 19 nt, Homo sapiens
auaugaaacugguguaugg

SEQ ID NO: 267491 - RNA, 19 nt, Homo sapiens
cuaaagcuccuaguaccua

SEQ ID NO: 267492 - RNA, 19 nt, Homo sapiens
ugucagaagucaaugaaac

SEQ ID NO: 267493 - RNA, 19 nt, Homo sapiens
ccaacuucaucuugucaga

SEQ ID NO: 267494 - RNA, 19 nt, Homo sapiens
ucacaacagcccuuucuuc

SEQ ID NO: 267495 - RNA, 19 nt, Homo sapiens
cuuauuggcagucacauuu

SEQ ID NO: 267496 - RNA, 19 nt, Homo sapiens
gauauggauucaggugugu

SEQ ID NO: 267497 - RNA, 19 nt, Homo sapiens
ccacaaggcuacuguauua

SEQ ID NO: 267498 - RNA, 19 nt, Homo sapiens
ggaaugcuauuucuaaaga

SEQ ID NO: 267499 - RNA, 19 nt, Homo sapiens
agacauaggugcucucuug

SEQ ID NO: 267500 - RNA, 19 nt, Homo sapiens
gcucuaagcuucucaugug

SEQ ID NO: 267501 - RNA, 19 nt, Homo sapiens
ugaaacagaugacaccaaa

SEQ ID NO: 267502 - RNA, 19 nt, Homo sapiens
gcagucacauuuauggaaa

SEQ ID NO: 267503 - RNA, 19 nt, Homo sapiens
gagcaaggcuagucuccaa

SEQ ID NO: 267504 - RNA, 19 nt, Homo sapiens
ccaugugccuuuauaauga

SEQ ID NO: 267505 - RNA, 19 nt, Homo sapiens
gauggaaggugcaacauag

SEQ ID NO: 267506 - RNA, 19 nt, Homo sapiens
ccagaucaauaucaacuuu

SEQ ID NO: 267507 - RNA, 19 nt, Homo sapiens
gaaggagagaccauuauuu

SEQ ID NO: 267508 - RNA, 19 nt, Homo sapiens
guucaaacaucuucggaaa

SEQ ID NO: 267509 - RNA, 19 nt, Homo sapiens
ucaaacaucuucggaaaug

SEQ ID NO: 267510 - RNA, 19 nt, Homo sapiens
gaugagagccuucaaaguc

SEQ ID NO: 267511 - RNA, 19 nt, Homo sapiens
cauaggugcucucuugaaa

SEQ ID NO: 267512 - RNA, 19 nt, Homo sapiens
gaagagaggcuaugacaac

SEQ ID NO: 267513 - RNA, 19 nt, Homo sapiens
uagcguacauucacaaaga

SEQ ID NO: 267514 - RNA, 19 nt, Homo sapiens
caacauagaauuuggcaau

SEQ ID NO: 267515 - RNA, 19 nt, Homo sapiens
ucgagaaucugguugcuuu

SEQ ID NO: 267516 - RNA, 19 nt, Homo sapiens
gagaugaaccaaccaauca

SEQ ID NO: 267517 - RNA, 19 nt, Homo sapiens
guaccuagaagcauuauga

SEQ ID NO: 267518 - RNA, 19 nt, Homo sapiens
ccagcaggacuuugaauua

SEQ ID NO: 267519 - RNA, 19 nt, Homo sapiens
gaaucugguugcuuucuug

SEQ ID NO: 267520 - RNA, 19 nt, Homo sapiens
gaggcacagucaagguuua

SEQ ID NO: 267521 - RNA, 19 nt, Homo sapiens
gaacaggccaaacaaaaua

SEQ ID NO: 267522 - RNA, 19 nt, Homo sapiens
gacagaaugcuuuaguuaa

SEQ ID NO: 267523 - RNA, 19 nt, Homo sapiens
agacagaaugcuuuaguua

SEQ ID NO: 267524 - RNA, 19 nt, Homo sapiens
caaggcuacuguauuagaa

SEQ ID NO: 267525 - RNA, 19 nt, Homo sapiens
gcaggacuuugaauuagug

SEQ ID NO: 267526 - RNA, 19 nt, Homo sapiens
gggaagcuuugccuccuaa

SEQ ID NO: 267527 - RNA, 19 nt, Homo sapiens
gaccucagcuuuucuguuu

SEQ ID NO: 267528 - RNA, 19 nt, Homo sapiens
gaaggugcaacauagaauu

SEQ ID NO: 267529 - RNA, 19 nt, Homo sapiens
uauccaaacucuugcauca

SEQ ID NO: 267530 - RNA, 19 nt, Homo sapiens
aagaaugacuccacuuuua

SEQ ID NO: 267531 - RNA, 19 nt, Homo sapiens
gcacagucaagguuuauau

SEQ ID NO: 267532 - RNA, 19 nt, Homo sapiens
guacuggaaugcuauuucu

SEQ ID NO: 267533 - RNA, 19 nt, Homo sapiens
uccaaacucuugcaucaaa

SEQ ID NO: 267534 - RNA, 19 nt, Homo sapiens
gcucauauaagguggauug

SEQ ID NO: 267535 - RNA, 19 nt, Homo sapiens
gauguuagagccaggauga

SEQ ID NO: 267536 - RNA, 19 nt, Homo sapiens
gacagaaaguauguucaaa

SEQ ID NO: 267537 - RNA, 19 nt, Homo sapiens
guuggaaggugcaaaguca

SEQ ID NO: 267538 - RNA, 19 nt, Homo sapiens
uagcauauccaaacucuug

SEQ ID NO: 267539 - RNA, 19 nt, Homo sapiens
ggcuaaaucugcacacuag

SEQ ID NO: 267540 - RNA, 19 nt, Homo sapiens
aaacgugccaagaccauua

SEQ ID NO: 267541 - RNA, 19 nt, Homo sapiens
cugcuuaucuuucagucua

SEQ ID NO: 267542 - RNA, 19 nt, Homo sapiens
gcagggacuugcucacauc

SEQ ID NO: 267543 - RNA, 19 nt, Homo sapiens
uauuugagcucauauaagg

SEQ ID NO: 267544 - RNA, 19 nt, Homo sapiens
guacgaaaguaggaugaga

SEQ ID NO: 267545 - RNA, 19 nt, Homo sapiens
cagcaggacuuugaauuag

SEQ ID NO: 267546 - RNA, 19 nt, Homo sapiens
uaaugcaccugagaagaaa

SEQ ID NO: 267547 - RNA, 19 nt, Homo sapiens
guaaagcaaagucucuaaa

SEQ ID NO: 267548 - RNA, 19 nt, Homo sapiens
uuccauaacuuuagcaaga

SEQ ID NO: 267549 - RNA, 19 nt, Homo sapiens
ugacagcccaucuuccuaa

SEQ ID NO: 267550 - RNA, 19 nt, Homo sapiens
cuaagcuucucauguggua

SEQ ID NO: 267551 - RNA, 19 nt, Homo sapiens
agacaaaggaagggaaaua

SEQ ID NO: 267552 - RNA, 19 nt, Homo sapiens
ucacauuuauggaaagcuu

SEQ ID NO: 267553 - RNA, 19 nt, Homo sapiens
gcaaagagcaaggcuaguc

SEQ ID NO: 267554 - RNA, 19 nt, Homo sapiens
gaucaggggacaauaauaa

SEQ ID NO: 267555 - RNA, 19 nt, Homo sapiens
gaaacugguguauggaaga

SEQ ID NO: 267556 - RNA, 19 nt, Homo sapiens
cauagaauuuggcaaugug

SEQ ID NO: 267557 - RNA, 19 nt, Homo sapiens
acuagaaucuugaugauac

SEQ ID NO: 267558 - RNA, 19 nt, Homo sapiens
ggagaugaaccaaccaauc

SEQ ID NO: 267559 - RNA, 19 nt, Homo sapiens
gcaguagcguacauucaca

SEQ ID NO: 267560 - RNA, 19 nt, Homo sapiens
ggggaaaguuuuacuguga

SEQ ID NO: 267561 - RNA, 19 nt, Homo sapiens
guuacuaugucuuucuuuc

SEQ ID NO: 267562 - RNA, 19 nt, Homo sapiens
agacagcaaugaggaguug

SEQ ID NO: 267563 - RNA, 19 nt, Homo sapiens
uaggugcucucuugaaauc

SEQ ID NO: 267564 - RNA, 19 nt, Homo sapiens
uuaaugcaccugagaagaa

SEQ ID NO: 267565 - RNA, 19 nt, Homo sapiens
cuagaagcauuaugaagca

SEQ ID NO: 267566 - RNA, 19 nt, Homo sapiens
gaacgcagugaucagcaaa

SEQ ID NO: 267567 - RNA, 19 nt, Homo sapiens
uguauuggauggcuuaaag

SEQ ID NO: 267568 - RNA, 19 nt, Homo sapiens
agaagucaaugaaacagau

SEQ ID NO: 267569 - RNA, 19 nt, Homo sapiens
ugaaggagagaccauuauu

SEQ ID NO: 267570 - RNA, 19 nt, Homo sapiens
gaccucaaguggagauaca

SEQ ID NO: 267571 - RNA, 19 nt, Homo sapiens
ugacagaaaguauguucaa

SEQ ID NO: 267572 - RNA, 19 nt, Homo sapiens
gacagcccaucuuccuaaa

SEQ ID NO: 267573 - RNA, 19 nt, Homo sapiens
acacuagaaucuugaugau

SEQ ID NO: 267574 - RNA, 19 nt, Homo sapiens
gaaaacgcuuacacaaaga

SEQ ID NO: 267575 - RNA, 19 nt, Homo sapiens
ugaaccaaccaaucaauga

SEQ ID NO: 267576 - RNA, 19 nt, Homo sapiens
gugcucucuugaaaucuua

SEQ ID NO: 267577 - RNA, 19 nt, Homo sapiens
ggugcucucuugaaaucuu

SEQ ID NO: 267578 - RNA, 19 nt, Homo sapiens
agacaugcaucuccacaag

SEQ ID NO: 267579 - RNA, 19 nt, Homo sapiens
caaagucuaccagcacaaa

SEQ ID NO: 267580 - RNA, 19 nt, Homo sapiens
gccaugugccuuuauaaug

SEQ ID NO: 267581 - RNA, 19 nt, Homo sapiens
caagacaaaggaagggaaa

SEQ ID NO: 267582 - RNA, 19 nt, Homo sapiens
caaggcuagucuccaaaga

SEQ ID NO: 267583 - RNA, 19 nt, Homo sapiens
caagacagaaugcuuuagu

SEQ ID NO: 267584 - RNA, 19 nt, Homo sapiens
ugagagccuucaaagucua

SEQ ID NO: 267585 - RNA, 19 nt, Homo sapiens
ucaagugaccauuggauau

SEQ ID NO: 267586 - RNA, 19 nt, Homo sapiens
ggaggcacagucaagguuu

SEQ ID NO: 267587 - RNA, 19 nt, Homo sapiens
ggaaggugcaacauagaau

SEQ ID NO: 267588 - RNA, 19 nt, Homo sapiens
accaaucaaugacaagaaa

SEQ ID NO: 267589 - RNA, 19 nt, Homo sapiens
gaucacaacagcccuuucu

SEQ ID NO: 267590 - RNA, 19 nt, Homo sapiens
gcuuaucuuucagucuaua

SEQ ID NO: 267591 - RNA, 19 nt, Homo sapiens
gaauguuacuaugucuuuc

SEQ ID NO: 267592 - RNA, 19 nt, Homo sapiens
ggaaggugcaaagucagua

SEQ ID NO: 267593 - RNA, 19 nt, Homo sapiens
guggugaugauauuucuuu

SEQ ID NO: 267594 - RNA, 19 nt, Homo sapiens
aagacagaaugcuuuaguu

SEQ ID NO: 267595 - RNA, 19 nt, Homo sapiens
auaugaaacugguguaugg

SEQ ID NO: 267596 - RNA, 19 nt, Homo sapiens
cuaaagcuccuaguaccua

SEQ ID NO: 267597 - RNA, 19 nt, Homo sapiens
ccacaaggcuacuguauua

SEQ ID NO: 267598 - RNA, 19 nt, Homo sapiens
ggaaugcuauuucuaaaga

SEQ ID NO: 267599 - RNA, 19 nt, Homo sapiens
agacauaggugcucucuug

SEQ ID NO: 267600 - RNA, 19 nt, Homo sapiens
gcucuaagcuucucaugug

SEQ ID NO: 267601 - RNA, 19 nt, Homo sapiens
ugaaacagaugacaccaaa

SEQ ID NO: 267602 - RNA, 19 nt, Homo sapiens
gcagucacauuuauggaaa

SEQ ID NO: 267603 - RNA, 19 nt, Homo sapiens
gagcaaggcuagucuccaa

SEQ ID NO: 267604 - RNA, 19 nt, Homo sapiens
ccaugugccuuuauaauga

SEQ ID NO: 267605 - RNA, 19 nt, Homo sapiens
gauggaaggugcaacauag

SEQ ID NO: 267606 - RNA, 19 nt, Homo sapiens
ccagaucaauaucaacuuu

SEQ ID NO: 267607 - RNA, 19 nt, Homo sapiens
gaaggagagaccauuauuu

SEQ ID NO: 267608 - RNA, 19 nt, Homo sapiens
guucaaacaucuucggaaa

SEQ ID NO: 267609 - RNA, 19 nt, Homo sapiens
ucaaacaucuucggaaaug

SEQ ID NO: 267610 - RNA, 19 nt, Homo sapiens
gaugagagccuucaaaguc

SEQ ID NO: 267611 - RNA, 19 nt, Homo sapiens
cauaggugcucucuugaaa

SEQ ID NO: 267612 - RNA, 19 nt, Homo sapiens
caugaggacuuuauaggaa

SEQ ID NO: 267613 - RNA, 19 nt, Homo sapiens
gaagagaggcuaugacaac

SEQ ID NO: 267614 - RNA, 19 nt, Homo sapiens
uagcguacauucacaaaga

SEQ ID NO: 267615 - RNA, 19 nt, Homo sapiens
caacauagaauuuggcaau

SEQ ID NO: 267616 - RNA, 19 nt, Homo sapiens
ucgagaaucugguugcuuu

SEQ ID NO: 267617 - RNA, 19 nt, Homo sapiens
gagaugaaccaaccaauca

SEQ ID NO: 267618 - RNA, 19 nt, Homo sapiens
guaccuagaagcauuauga

SEQ ID NO: 267619 - RNA, 19 nt, Homo sapiens
ccagcaggacuuugaauua

SEQ ID NO: 267620 - RNA, 19 nt, Homo sapiens
gaaucugguugcuuucuug

SEQ ID NO: 267621 - RNA, 19 nt, Homo sapiens
gaggcacagucaagguuua

SEQ ID NO: 267622 - RNA, 19 nt, Homo sapiens
gaacaggccaaacaaaaua

SEQ ID NO: 267623 - RNA, 19 nt, Homo sapiens
gacagaaugcuuuaguuaa

SEQ ID NO: 267624 - RNA, 19 nt, Homo sapiens
agacagaaugcuuuaguua

SEQ ID NO: 267625 - RNA, 19 nt, Homo sapiens
caaggcuacuguauuagaa

SEQ ID NO: 267626 - RNA, 19 nt, Homo sapiens
gcaggacuuugaauuagug

SEQ ID NO: 267627 - RNA, 19 nt, Homo sapiens
gggaagcuuugccuccuaa

SEQ ID NO: 267628 - RNA, 19 nt, Homo sapiens
gaccucagcuuuucuguuu

SEQ ID NO: 267629 - RNA, 19 nt, Homo sapiens
gaaggugcaacauagaauu

SEQ ID NO: 267630 - RNA, 19 nt, Homo sapiens
uauccaaacucuugcauca

SEQ ID NO: 267631 - RNA, 19 nt, Homo sapiens
aagaaugacuccacuuuua

SEQ ID NO: 267632 - RNA, 19 nt, Homo sapiens
gcacagucaagguuuauau

SEQ ID NO: 267633 - RNA, 19 nt, Homo sapiens
guacuggaaugcuauuucu

SEQ ID NO: 267634 - RNA, 19 nt, Homo sapiens
gcucauauaagguggauug

SEQ ID NO: 267635 - RNA, 19 nt, Homo sapiens
gauguuagagccaggauga

SEQ ID NO: 267636 - RNA, 19 nt, Homo sapiens
uccaaacucuugcaucaaa

SEQ ID NO: 267637 - RNA, 19 nt, Homo sapiens
gacagaaaguauguucaaa

SEQ ID NO: 267638 - RNA, 19 nt, Homo sapiens
guuggaaggugcaaaguca

SEQ ID NO: 267639 - RNA, 19 nt, Homo sapiens
uagcauauccaaacucuug

SEQ ID NO: 267640 - RNA, 19 nt, Homo sapiens
ccuaaugacuguugugaca

SEQ ID NO: 267641 - RNA, 19 nt, Homo sapiens
ggcuaaaucugcacacuag

SEQ ID NO: 267642 - RNA, 19 nt, Homo sapiens
gcagggacuugcucacauc

SEQ ID NO: 267643 - RNA, 19 nt, Homo sapiens
aaacgugccaagaccauua

SEQ ID NO: 267644 - RNA, 19 nt, Homo sapiens
cugcuuaucuuucagucua

SEQ ID NO: 267645 - RNA, 19 nt, Homo sapiens
uauuugagcucauauaagg

SEQ ID NO: 267646 - RNA, 19 nt, Homo sapiens
guacgaaaguaggaugaga

SEQ ID NO: 267647 - RNA, 19 nt, Homo sapiens
cagcaggacuuugaauuag

SEQ ID NO: 267648 - RNA, 19 nt, Homo sapiens
uaaugcaccugagaagaaa

SEQ ID NO: 267649 - RNA, 19 nt, Homo sapiens
guaaagcaaagucucuaaa

SEQ ID NO: 267650 - RNA, 19 nt, Homo sapiens
uuccauaacuuuagcaaga

SEQ ID NO: 267651 - RNA, 19 nt, Homo sapiens
ugacagcccaucuuccuaa

SEQ ID NO: 267652 - RNA, 19 nt, Homo sapiens
cuaagcuucucauguggua

SEQ ID NO: 267653 - RNA, 19 nt, Homo sapiens
agacaaaggaagggaaaua

SEQ ID NO: 267654 - RNA, 19 nt, Homo sapiens
ucacauuuauggaaagcuu

SEQ ID NO: 267655 - RNA, 19 nt, Homo sapiens
gcaaagagcaaggcuaguc

SEQ ID NO: 267656 - RNA, 19 nt, Homo sapiens
gaucaggggacaauaauaa

SEQ ID NO: 267657 - RNA, 19 nt, Homo sapiens
gaaacugguguauggaaga

SEQ ID NO: 267658 - RNA, 19 nt, Homo sapiens
cauagaauuuggcaaugug

SEQ ID NO: 267659 - RNA, 19 nt, Homo sapiens
acuagaaucuugaugauac

SEQ ID NO: 267660 - RNA, 19 nt, Homo sapiens
ggagaugaaccaaccaauc

SEQ ID NO: 267661 - RNA, 19 nt, Homo sapiens
gcaguagcguacauucaca

SEQ ID NO: 267662 - RNA, 19 nt, Homo sapiens
ggggaaaguuuuacuguga

SEQ ID NO: 267663 - RNA, 19 nt, Homo sapiens
guuacuaugucuuucuuuc

SEQ ID NO: 267664 - RNA, 19 nt, Homo sapiens
agacagcaaugaggaguug

SEQ ID NO: 267665 - RNA, 19 nt, Homo sapiens
uaggugcucucuugaaauc

SEQ ID NO: 267666 - RNA, 19 nt, Homo sapiens
uuaaugcaccugagaagaa

SEQ ID NO: 267667 - RNA, 19 nt, Homo sapiens
cuagaagcauuaugaagca

SEQ ID NO: 267668 - RNA, 19 nt, Homo sapiens
gaacgcagugaucagcaaa

SEQ ID NO: 267669 - RNA, 19 nt, Homo sapiens
uguauuggauggcuuaaag

SEQ ID NO: 267670 - RNA, 19 nt, Homo sapiens
agaagucaaugaaacagau

SEQ ID NO: 267671 - RNA, 19 nt, Homo sapiens
ugaaggagagaccauuauu

SEQ ID NO: 267672 - RNA, 19 nt, Homo sapiens
gaccucaaguggagauaca

SEQ ID NO: 267673 - RNA, 19 nt, Homo sapiens
ugacagaaaguauguucaa

SEQ ID NO: 267674 - RNA, 19 nt, Homo sapiens
uuguucagcuuccuaauga

SEQ ID NO: 267675 - RNA, 19 nt, Homo sapiens
gacagcccaucuuccuaaa

SEQ ID NO: 267676 - RNA, 19 nt, Homo sapiens
acacuagaaucuugaugau

SEQ ID NO: 267677 - RNA, 19 nt, Homo sapiens
gaaaacgcuuacacaaaga

SEQ ID NO: 267678 - RNA, 19 nt, Homo sapiens
ugaaccaaccaaucaauga

SEQ ID NO: 267679 - RNA, 19 nt, Homo sapiens
gugcucucuugaaaucuua

SEQ ID NO: 267680 - RNA, 19 nt, Homo sapiens
ggugcucucuugaaaucuu

SEQ ID NO: 267681 - RNA, 19 nt, Homo sapiens
agacaugcaucuccacaag

SEQ ID NO: 267682 - RNA, 19 nt, Homo sapiens
caaagucuaccagcacaaa

SEQ ID NO: 267683 - RNA, 19 nt, Homo sapiens
gccaugugccuuuauaaug

SEQ ID NO: 267684 - RNA, 19 nt, Homo sapiens
caagacaaaggaagggaaa

SEQ ID NO: 267685 - RNA, 19 nt, Homo sapiens
caaggcuagucuccaaaga

SEQ ID NO: 267686 - RNA, 19 nt, Homo sapiens
caagacagaaugcuuuagu

SEQ ID NO: 267687 - RNA, 19 nt, Homo sapiens
ugagagccuucaaagucua

SEQ ID NO: 267688 - RNA, 19 nt, Homo sapiens
ucaagugaccauuggauau

SEQ ID NO: 267689 - RNA, 19 nt, Homo sapiens
ggaggcacagucaagguuu

SEQ ID NO: 267690 - RNA, 19 nt, Homo sapiens
ggaaggugcaacauagaau

SEQ ID NO: 267691 - RNA, 19 nt, Homo sapiens
accaaucaaugacaagaaa

SEQ ID NO: 267692 - RNA, 19 nt, Homo sapiens
gaucacaacagcccuuucu

SEQ ID NO: 267693 - RNA, 19 nt, Homo sapiens
gcuuaucuuucagucuaua

SEQ ID NO: 267694 - RNA, 19 nt, Homo sapiens
gaauguuacuaugucuuuc

SEQ ID NO: 267695 - RNA, 19 nt, Homo sapiens
ggaaggugcaaagucagua

SEQ ID NO: 267696 - RNA, 19 nt, Homo sapiens
guggugaugauauuucuuu

SEQ ID NO: 267697 - RNA, 19 nt, Homo sapiens
ccacaaggcuacuguauua

SEQ ID NO: 267698 - RNA, 19 nt, Homo sapiens
ggaaugcuauuucuaaaga

SEQ ID NO: 267699 - RNA, 19 nt, Homo sapiens
agacauaggugcucucuug

SEQ ID NO: 267700 - RNA, 19 nt, Homo sapiens
gcucuaagcuucucaugug

SEQ ID NO: 267701 - RNA, 19 nt, Homo sapiens
ugaaacagaugacaccaaa

SEQ ID NO: 267702 - RNA, 19 nt, Homo sapiens
gcagucacauuuauggaaa

SEQ ID NO: 267703 - RNA, 19 nt, Homo sapiens
gagcaaggcuagucuccaa

SEQ ID NO: 267704 - RNA, 19 nt, Homo sapiens
ccaugugccuuuauaauga

SEQ ID NO: 267705 - RNA, 19 nt, Homo sapiens
gauggaaggugcaacauag

SEQ ID NO: 267706 - RNA, 19 nt, Homo sapiens
ccagaucaauaucaacuuu

SEQ ID NO: 267707 - RNA, 19 nt, Homo sapiens
gaaggagagaccauuauuu

SEQ ID NO: 267708 - RNA, 19 nt, Homo sapiens
guucaaacaucuucggaaa

SEQ ID NO: 267709 - RNA, 19 nt, Homo sapiens
ucaaacaucuucggaaaug

SEQ ID NO: 267710 - RNA, 19 nt, Homo sapiens
gaugagagccuucaaaguc

SEQ ID NO: 267711 - RNA, 19 nt, Homo sapiens
cauaggugcucucuugaaa

SEQ ID NO: 267712 - RNA, 19 nt, Homo sapiens
gaagagaggcuaugacaac

SEQ ID NO: 267713 - RNA, 19 nt, Homo sapiens
uagcguacauucacaaaga

SEQ ID NO: 267714 - RNA, 19 nt, Homo sapiens
caacauagaauuuggcaau

SEQ ID NO: 267715 - RNA, 19 nt, Homo sapiens
ucgagaaucugguugcuuu

SEQ ID NO: 267716 - RNA, 19 nt, Homo sapiens
gagaugaaccaaccaauca

SEQ ID NO: 267717 - RNA, 19 nt, Homo sapiens
guaccuagaagcauuauga

SEQ ID NO: 267718 - RNA, 19 nt, Homo sapiens
ccagcaggacuuugaauua

SEQ ID NO: 267719 - RNA, 19 nt, Homo sapiens
gaaucugguugcuuucuug

SEQ ID NO: 267720 - RNA, 19 nt, Homo sapiens
gaggcacagucaagguuua

SEQ ID NO: 267721 - RNA, 19 nt, Homo sapiens
gaacaggccaaacaaaaua

SEQ ID NO: 267722 - RNA, 19 nt, Homo sapiens
gacagaaugcuuuaguuaa

SEQ ID NO: 267723 - RNA, 19 nt, Homo sapiens
agacagaaugcuuuaguua

SEQ ID NO: 267724 - RNA, 19 nt, Homo sapiens
caaggcuacuguauuagaa

SEQ ID NO: 267725 - RNA, 19 nt, Homo sapiens
gcaggacuuugaauuagug

SEQ ID NO: 267726 - RNA, 19 nt, Homo sapiens
gggaagcuuugccuccuaa

SEQ ID NO: 267727 - RNA, 19 nt, Homo sapiens
gaccucagcuuuucuguuu

SEQ ID NO: 267728 - RNA, 19 nt, Homo sapiens
gaaggugcaacauagaauu

SEQ ID NO: 267729 - RNA, 19 nt, Homo sapiens
ugacagagaucaggguguu

SEQ ID NO: 267730 - RNA, 19 nt, Homo sapiens
uauccaaacucuugcauca

SEQ ID NO: 267731 - RNA, 19 nt, Homo sapiens
aagaaugacuccacuuuua

SEQ ID NO: 267732 - RNA, 19 nt, Homo sapiens
gcacagucaagguuuauau

SEQ ID NO: 267733 - RNA, 19 nt, Homo sapiens
caagaucuacuuauacaug

SEQ ID NO: 267734 - RNA, 19 nt, Homo sapiens
guacuggaaugcuauuucu

SEQ ID NO: 267735 - RNA, 19 nt, Homo sapiens
gcucauauaagguggauug

SEQ ID NO: 267736 - RNA, 19 nt, Homo sapiens
gauguuagagccaggauga

SEQ ID NO: 267737 - RNA, 19 nt, Homo sapiens
uccaaacucuugcaucaaa

SEQ ID NO: 267738 - RNA, 19 nt, Homo sapiens
gacagaaaguauguucaaa

SEQ ID NO: 267739 - RNA, 19 nt, Homo sapiens
guuggaaggugcaaaguca

SEQ ID NO: 267740 - RNA, 19 nt, Homo sapiens
uagcauauccaaacucuug

SEQ ID NO: 267741 - RNA, 19 nt, Homo sapiens
ggcuaaaucugcacacuag

SEQ ID NO: 267742 - RNA, 19 nt, Homo sapiens
gcagggacuugcucacauc

SEQ ID NO: 267743 - RNA, 19 nt, Homo sapiens
aaacgugccaagaccauua

SEQ ID NO: 267744 - RNA, 19 nt, Homo sapiens
cugcuuaucuuucagucua

SEQ ID NO: 267745 - RNA, 19 nt, Homo sapiens
uauuugagcucauauaagg

SEQ ID NO: 267746 - RNA, 19 nt, Homo sapiens
guacgaaaguaggaugaga

SEQ ID NO: 267747 - RNA, 19 nt, Homo sapiens
cagcaggacuuugaauuag

SEQ ID NO: 267748 - RNA, 19 nt, Homo sapiens
uaaugcaccugagaagaaa

SEQ ID NO: 267749 - RNA, 19 nt, Homo sapiens
guaaagcaaagucucuaaa

SEQ ID NO: 267750 - RNA, 19 nt, Homo sapiens
uuccauaacuuuagcaaga

SEQ ID NO: 267751 - RNA, 19 nt, Homo sapiens
ugacagcccaucuuccuaa

SEQ ID NO: 267752 - RNA, 19 nt, Homo sapiens
cuaagcuucucauguggua

SEQ ID NO: 267753 - RNA, 19 nt, Homo sapiens
agacaaaggaagggaaaua

SEQ ID NO: 267754 - RNA, 19 nt, Homo sapiens
ucacauuuauggaaagcuu

SEQ ID NO: 267755 - RNA, 19 nt, Homo sapiens
gcaaagagcaaggcuaguc

SEQ ID NO: 267756 - RNA, 19 nt, Homo sapiens
gaucaggggacaauaauaa

SEQ ID NO: 267757 - RNA, 19 nt, Homo sapiens
gaaacugguguauggaaga

SEQ ID NO: 267758 - RNA, 19 nt, Homo sapiens
cauagaauuuggcaaugug

SEQ ID NO: 267759 - RNA, 19 nt, Homo sapiens
acuagaaucuugaugauac

SEQ ID NO: 267760 - RNA, 19 nt, Homo sapiens
ggagaugaaccaaccaauc

SEQ ID NO: 267761 - RNA, 19 nt, Homo sapiens
gcaguagcguacauucaca

SEQ ID NO: 267762 - RNA, 19 nt, Homo sapiens
ggggaaaguuuuacuguga

SEQ ID NO: 267763 - RNA, 19 nt, Homo sapiens
guuacuaugucuuucuuuc

SEQ ID NO: 267764 - RNA, 19 nt, Homo sapiens
agacagcaaugaggaguug

SEQ ID NO: 267765 - RNA, 19 nt, Homo sapiens
uaggugcucucuugaaauc

SEQ ID NO: 267766 - RNA, 19 nt, Homo sapiens
cccaagaucuacuuauaca

SEQ ID NO: 267767 - RNA, 19 nt, Homo sapiens
uuaaugcaccugagaagaa

SEQ ID NO: 267768 - RNA, 19 nt, Homo sapiens
cuagaagcauuaugaagca

SEQ ID NO: 267769 - RNA, 19 nt, Homo sapiens
gaacgcagugaucagcaaa

SEQ ID NO: 267770 - RNA, 19 nt, Homo sapiens
caaagacagugugacaagu

SEQ ID NO: 267771 - RNA, 19 nt, Homo sapiens
uguauuggauggcuuaaag

SEQ ID NO: 267772 - RNA, 19 nt, Homo sapiens
agaagucaaugaaacagau

SEQ ID NO: 267773 - RNA, 19 nt, Homo sapiens
ugaaggagagaccauuauu

SEQ ID NO: 267774 - RNA, 19 nt, Homo sapiens
gaccucaaguggagauaca

SEQ ID NO: 267775 - RNA, 19 nt, Homo sapiens
ugacagaaaguauguucaa

SEQ ID NO: 267776 - RNA, 19 nt, Homo sapiens
ugacaaagacagugugaca

SEQ ID NO: 267777 - RNA, 19 nt, Homo sapiens
gacagcccaucuuccuaaa

SEQ ID NO: 267778 - RNA, 19 nt, Homo sapiens
acacuagaaucuugaugau

SEQ ID NO: 267779 - RNA, 19 nt, Homo sapiens
gaaaacgcuuacacaaaga

SEQ ID NO: 267780 - RNA, 19 nt, Homo sapiens
ugaaccaaccaaucaauga

SEQ ID NO: 267781 - RNA, 19 nt, Homo sapiens
gugcucucuugaaaucuua

SEQ ID NO: 267782 - RNA, 19 nt, Homo sapiens
ggugcucucuugaaaucuu

SEQ ID NO: 267783 - RNA, 19 nt, Homo sapiens
agacaugcaucuccacaag

SEQ ID NO: 267784 - RNA, 19 nt, Homo sapiens
caaagucuaccagcacaaa

SEQ ID NO: 267785 - RNA, 19 nt, Homo sapiens
gccaugugccuuuauaaug

SEQ ID NO: 267786 - RNA, 19 nt, Homo sapiens
caagacaaaggaagggaaa

SEQ ID NO: 267787 - RNA, 19 nt, Homo sapiens
caaggcuagucuccaaaga

SEQ ID NO: 267788 - RNA, 19 nt, Homo sapiens
caagacagaaugcuuuagu

SEQ ID NO: 267789 - RNA, 19 nt, Homo sapiens
ugagagccuucaaagucua

SEQ ID NO: 267790 - RNA, 19 nt, Homo sapiens
ucaagugaccauuggauau

SEQ ID NO: 267791 - RNA, 19 nt, Homo sapiens
ggaggcacagucaagguuu

SEQ ID NO: 267792 - RNA, 19 nt, Homo sapiens
ggaaggugcaacauagaau

SEQ ID NO: 267793 - RNA, 19 nt, Homo sapiens
accaaucaaugacaagaaa

SEQ ID NO: 267794 - RNA, 19 nt, Homo sapiens
gaucacaacagcccuuucu

SEQ ID NO: 267795 - RNA, 19 nt, Homo sapiens
gcuuaucuuucagucuaua

SEQ ID NO: 267796 - RNA, 19 nt, Homo sapiens
gaauguuacuaugucuuuc

SEQ ID NO: 267797 - RNA, 19 nt, Homo sapiens
ccacaaggcuacuguauua

SEQ ID NO: 267798 - RNA, 19 nt, Homo sapiens
ggaaugcuauuucuaaaga

SEQ ID NO: 267799 - RNA, 19 nt, Homo sapiens
agacauaggugcucucuug

SEQ ID NO: 267800 - RNA, 19 nt, Homo sapiens
gcucuaagcuucucaugug

SEQ ID NO: 267801 - RNA, 19 nt, Homo sapiens
ugaaacagaugacaccaaa

SEQ ID NO: 267802 - RNA, 19 nt, Homo sapiens
gaacagguuucuucucuac

SEQ ID NO: 267803 - RNA, 19 nt, Homo sapiens
gcagucacauuuauggaaa

SEQ ID NO: 267804 - RNA, 19 nt, Homo sapiens
gagcaaggcuagucuccaa

SEQ ID NO: 267805 - RNA, 19 nt, Homo sapiens
ccaugugccuuuauaauga

SEQ ID NO: 267806 - RNA, 19 nt, Homo sapiens
gauggaaggugcaacauag

SEQ ID NO: 267807 - RNA, 19 nt, Homo sapiens
ccagaucaauaucaacuuu

SEQ ID NO: 267808 - RNA, 19 nt, Homo sapiens
gaaggagagaccauuauuu

SEQ ID NO: 267809 - RNA, 19 nt, Homo sapiens
guucaaacaucuucggaaa

SEQ ID NO: 267810 - RNA, 19 nt, Homo sapiens
ucaaacaucuucggaaaug

SEQ ID NO: 267811 - RNA, 19 nt, Homo sapiens
gaugagagccuucaaaguc

SEQ ID NO: 267812 - RNA, 19 nt, Homo sapiens
cauaggugcucucuugaaa

SEQ ID NO: 267813 - RNA, 19 nt, Homo sapiens
caugaggacuuuauaggaa

SEQ ID NO: 267814 - RNA, 19 nt, Homo sapiens
gaagagaggcuaugacaac

SEQ ID NO: 267815 - RNA, 19 nt, Homo sapiens
uagcguacauucacaaaga

SEQ ID NO: 267816 - RNA, 19 nt, Homo sapiens
caacauagaauuuggcaau

SEQ ID NO: 267817 - RNA, 19 nt, Homo sapiens
ucgagaaucugguugcuuu

SEQ ID NO: 267818 - RNA, 19 nt, Homo sapiens
gagaugaaccaaccaauca

SEQ ID NO: 267819 - RNA, 19 nt, Homo sapiens
guaccuagaagcauuauga

SEQ ID NO: 267820 - RNA, 19 nt, Homo sapiens
ccagcaggacuuugaauua

SEQ ID NO: 267821 - RNA, 19 nt, Homo sapiens
gaaucugguugcuuucuug

SEQ ID NO: 267822 - RNA, 19 nt, Homo sapiens
gaggcacagucaagguuua

SEQ ID NO: 267823 - RNA, 19 nt, Homo sapiens
gaacaggccaaacaaaaua

SEQ ID NO: 267824 - RNA, 19 nt, Homo sapiens
gacagaaugcuuuaguuaa

SEQ ID NO: 267825 - RNA, 19 nt, Homo sapiens
agacagaaugcuuuaguua

SEQ ID NO: 267826 - RNA, 19 nt, Homo sapiens
caaggcuacuguauuagaa

SEQ ID NO: 267827 - RNA, 19 nt, Homo sapiens
gcaggacuuugaauuagug

SEQ ID NO: 267828 - RNA, 19 nt, Homo sapiens
gggaagcuuugccuccuaa

SEQ ID NO: 267829 - RNA, 19 nt, Homo sapiens
gaccucagcuuuucuguuu

SEQ ID NO: 267830 - RNA, 19 nt, Homo sapiens
gaaggugcaacauagaauu

SEQ ID NO: 267831 - RNA, 19 nt, Homo sapiens
uauccaaacucuugcauca

SEQ ID NO: 267832 - RNA, 19 nt, Homo sapiens
ugacagagaucaggguguu

SEQ ID NO: 267833 - RNA, 19 nt, Homo sapiens
aagaaugacuccacuuuua

SEQ ID NO: 267834 - RNA, 19 nt, Homo sapiens
gcacagucaagguuuauau

SEQ ID NO: 267835 - RNA, 19 nt, Homo sapiens
caagaucuacuuauacaug

SEQ ID NO: 267836 - RNA, 19 nt, Homo sapiens
guacuggaaugcuauuucu

SEQ ID NO: 267837 - RNA, 19 nt, Homo sapiens
gcucauauaagguggauug

SEQ ID NO: 267838 - RNA, 19 nt, Homo sapiens
gauguuagagccaggauga

SEQ ID NO: 267839 - RNA, 19 nt, Homo sapiens
gacagaaaguauguucaaa

SEQ ID NO: 267840 - RNA, 19 nt, Homo sapiens
uccaaacucuugcaucaaa

SEQ ID NO: 267841 - RNA, 19 nt, Homo sapiens
guuggaaggugcaaaguca

SEQ ID NO: 267842 - RNA, 19 nt, Homo sapiens
uagcauauccaaacucuug

SEQ ID NO: 267843 - RNA, 19 nt, Homo sapiens
ccuaaugacuguugugaca

SEQ ID NO: 267844 - RNA, 19 nt, Homo sapiens
gcagggacuugcucacauc

SEQ ID NO: 267845 - RNA, 19 nt, Homo sapiens
ggcuaaaucugcacacuag

SEQ ID NO: 267846 - RNA, 19 nt, Homo sapiens
aaacgugccaagaccauua

SEQ ID NO: 267847 - RNA, 19 nt, Homo sapiens
cugcuuaucuuucagucua

SEQ ID NO: 267848 - RNA, 19 nt, Homo sapiens
uauuugagcucauauaagg

SEQ ID NO: 267849 - RNA, 19 nt, Homo sapiens
guacgaaaguaggaugaga

SEQ ID NO: 267850 - RNA, 19 nt, Homo sapiens
cagcaggacuuugaauuag

SEQ ID NO: 267851 - RNA, 19 nt, Homo sapiens
uaaugcaccugagaagaaa

SEQ ID NO: 267852 - RNA, 19 nt, Homo sapiens
guaaagcaaagucucuaaa

SEQ ID NO: 267853 - RNA, 19 nt, Homo sapiens
uuccauaacuuuagcaaga

SEQ ID NO: 267854 - RNA, 19 nt, Homo sapiens
ugacagcccaucuuccuaa

SEQ ID NO: 267855 - RNA, 19 nt, Homo sapiens
cuaagcuucucauguggua

SEQ ID NO: 267856 - RNA, 19 nt, Homo sapiens
agacaaaggaagggaaaua

SEQ ID NO: 267857 - RNA, 19 nt, Homo sapiens
ucacauuuauggaaagcuu

SEQ ID NO: 267858 - RNA, 19 nt, Homo sapiens
gcaaagagcaaggcuaguc

SEQ ID NO: 267859 - RNA, 19 nt, Homo sapiens
gaucaggggacaauaauaa

SEQ ID NO: 267860 - RNA, 19 nt, Homo sapiens
gaaacugguguauggaaga

SEQ ID NO: 267861 - RNA, 19 nt, Homo sapiens
cauagaauuuggcaaugug

SEQ ID NO: 267862 - RNA, 19 nt, Homo sapiens
gcucugaacagguuucuuc

SEQ ID NO: 267863 - RNA, 19 nt, Homo sapiens
acuagaaucuugaugauac

SEQ ID NO: 267864 - RNA, 19 nt, Homo sapiens
ggagaugaaccaaccaauc

SEQ ID NO: 267865 - RNA, 19 nt, Homo sapiens
gcaguagcguacauucaca

SEQ ID NO: 267866 - RNA, 19 nt, Homo sapiens
ggggaaaguuuuacuguga

SEQ ID NO: 267867 - RNA, 19 nt, Homo sapiens
guuacuaugucuuucuuuc

SEQ ID NO: 267868 - RNA, 19 nt, Homo sapiens
agacagcaaugaggaguug

SEQ ID NO: 267869 - RNA, 19 nt, Homo sapiens
uaggugcucucuugaaauc

SEQ ID NO: 267870 - RNA, 19 nt, Homo sapiens
cccaagaucuacuuauaca

SEQ ID NO: 267871 - RNA, 19 nt, Homo sapiens
uuaaugcaccugagaagaa

SEQ ID NO: 267872 - RNA, 19 nt, Homo sapiens
cuagaagcauuaugaagca

SEQ ID NO: 267873 - RNA, 19 nt, Homo sapiens
gaacgcagugaucagcaaa

SEQ ID NO: 267874 - RNA, 19 nt, Homo sapiens
caaagacagugugacaagu

SEQ ID NO: 267875 - RNA, 19 nt, Homo sapiens
uguauuggauggcuuaaag

SEQ ID NO: 267876 - RNA, 19 nt, Homo sapiens
agaagucaaugaaacagau

SEQ ID NO: 267877 - RNA, 19 nt, Homo sapiens
ugaaggagagaccauuauu

SEQ ID NO: 267878 - RNA, 19 nt, Homo sapiens
gaccucaaguggagauaca

SEQ ID NO: 267879 - RNA, 19 nt, Homo sapiens
ugacagaaaguauguucaa

SEQ ID NO: 267880 - RNA, 19 nt, Homo sapiens
ugacaaagacagugugaca

SEQ ID NO: 267881 - RNA, 19 nt, Homo sapiens
ugaacagguuucuucucua

SEQ ID NO: 267882 - RNA, 19 nt, Homo sapiens
uuguucagcuuccuaauga

SEQ ID NO: 267883 - RNA, 19 nt, Homo sapiens
gacagcccaucuuccuaaa

SEQ ID NO: 267884 - RNA, 19 nt, Homo sapiens
acacuagaaucuugaugau

SEQ ID NO: 267885 - RNA, 19 nt, Homo sapiens
gaaaacgcuuacacaaaga

SEQ ID NO: 267886 - RNA, 19 nt, Homo sapiens
ugaaccaaccaaucaauga

SEQ ID NO: 267887 - RNA, 19 nt, Homo sapiens
gugcucucuugaaaucuua

SEQ ID NO: 267888 - RNA, 19 nt, Homo sapiens
ggugcucucuugaaaucuu

SEQ ID NO: 267889 - RNA, 19 nt, Homo sapiens
agacaugcaucuccacaag

SEQ ID NO: 267890 - RNA, 19 nt, Homo sapiens
caaagucuaccagcacaaa

SEQ ID NO: 267891 - RNA, 19 nt, Homo sapiens
gccaugugccuuuauaaug

SEQ ID NO: 267892 - RNA, 19 nt, Homo sapiens
caagacaaaggaagggaaa

SEQ ID NO: 267893 - RNA, 19 nt, Homo sapiens
caaggcuagucuccaaaga

SEQ ID NO: 267894 - RNA, 19 nt, Homo sapiens
caagacagaaugcuuuagu

SEQ ID NO: 267895 - RNA, 19 nt, Homo sapiens
ugagagccuucaaagucua

SEQ ID NO: 267896 - RNA, 19 nt, Homo sapiens
ucaagugaccauuggauau

SEQ ID NO: 267897 - RNA, 19 nt, Homo sapiens
gcaagacucugccuuaauu

SEQ ID NO: 267898 - RNA, 19 nt, Homo sapiens
gaagaaagauggccacugu

SEQ ID NO: 267899 - RNA, 19 nt, Homo sapiens
gcaaguauuuggcuauuaa

SEQ ID NO: 267900 - RNA, 19 nt, Homo sapiens
caaagaguauucagugaua

SEQ ID NO: 267901 - RNA, 19 nt, Homo sapiens
gcacaaugguuucaaagaa

SEQ ID NO: 267902 - RNA, 19 nt, Homo sapiens
gaugucagcugagucauua

SEQ ID NO: 267903 - RNA, 19 nt, Homo sapiens
gcaagcagauucccuguug

SEQ ID NO: 267904 - RNA, 19 nt, Homo sapiens
gcucuuaucuagcaaauga

SEQ ID NO: 267905 - RNA, 19 nt, Homo sapiens
gaacagccauaucugaaug

SEQ ID NO: 267906 - RNA, 19 nt, Homo sapiens
ggauugaguuguaaagaaa

SEQ ID NO: 267907 - RNA, 19 nt, Homo sapiens
gacugggucuccuuaauua

SEQ ID NO: 267908 - RNA, 19 nt, Homo sapiens
acuguaagcuccaugauua

SEQ ID NO: 267909 - RNA, 19 nt, Homo sapiens
gaaguagagugaguucuuu

SEQ ID NO: 267910 - RNA, 19 nt, Homo sapiens
uggaaucgaucguauauuu

SEQ ID NO: 267911 - RNA, 19 nt, Homo sapiens
guuaauggguuaucucaaa

SEQ ID NO: 267912 - RNA, 19 nt, Homo sapiens
ugaaauagaugaagacagu

SEQ ID NO: 267913 - RNA, 19 nt, Homo sapiens
cagauucccuguuggauuu

SEQ ID NO: 267914 - RNA, 19 nt, Homo sapiens
guacacaugucauuagaau

SEQ ID NO: 267915 - RNA, 19 nt, Homo sapiens
agaaagagauguuaagcaa

SEQ ID NO: 267916 - RNA, 19 nt, Homo sapiens
aaucaacucucuuauggua

SEQ ID NO: 267917 - RNA, 19 nt, Homo sapiens
uaaaggagauaauggucua

SEQ ID NO: 267918 - RNA, 19 nt, Homo sapiens
uuaaagaguuggaggaauu

SEQ ID NO: 267919 - RNA, 19 nt, Homo sapiens
guaaauagaggucuguaaa

SEQ ID NO: 267920 - RNA, 19 nt, Homo sapiens
gcaacaauuugguucuuga

SEQ ID NO: 267921 - RNA, 19 nt, Homo sapiens
gaugaguucugucccguaa

SEQ ID NO: 267922 - RNA, 19 nt, Homo sapiens
ugaagacaguccuuuauau

SEQ ID NO: 267923 - RNA, 19 nt, Homo sapiens
gcuauguucuucuguuauu

SEQ ID NO: 267924 - RNA, 19 nt, Homo sapiens
gggauugaguuguaaagaa

SEQ ID NO: 267925 - RNA, 19 nt, Homo sapiens
ucucaacucuguuuauuug

SEQ ID NO: 267926 - RNA, 19 nt, Homo sapiens
gaagguguuuaaagaguug

SEQ ID NO: 267927 - RNA, 19 nt, Homo sapiens
ggaagguguuuaaagaguu

SEQ ID NO: 267928 - RNA, 19 nt, Homo sapiens
gauggucucugguucuuga

SEQ ID NO: 267929 - RNA, 19 nt, Homo sapiens
gguauuauaucucuguaug

SEQ ID NO: 267930 - RNA, 19 nt, Homo sapiens
gaagacaguccuuuauaug

SEQ ID NO: 267931 - RNA, 19 nt, Homo sapiens
cgacauugauugcugcauu

SEQ ID NO: 267932 - RNA, 19 nt, Homo sapiens
agccauagauuccugguua

SEQ ID NO: 267933 - RNA, 19 nt, Homo sapiens
gagaagcacuacuacaaag

SEQ ID NO: 267934 - RNA, 19 nt, Homo sapiens
aaauagaggucuguaaaga

SEQ ID NO: 267935 - RNA, 19 nt, Homo sapiens
caagagacaauaacuuuga

SEQ ID NO: 267936 - RNA, 19 nt, Homo sapiens
gacauugauugcugcauuu

SEQ ID NO: 267937 - RNA, 19 nt, Homo sapiens
cuaacuacaugaacacaaa

SEQ ID NO: 267938 - RNA, 19 nt, Homo sapiens
cagcauggacuguucauuu

SEQ ID NO: 267939 - RNA, 19 nt, Homo sapiens
aaagagauguuaagcaagu

SEQ ID NO: 267940 - RNA, 19 nt, Homo sapiens
guuaaugcauucuuucuuc

SEQ ID NO: 267941 - RNA, 19 nt, Homo sapiens
auagaggucuguaaagaaa

SEQ ID NO: 267942 - RNA, 19 nt, Homo sapiens
caagcacaaugguuucaaa

SEQ ID NO: 267943 - RNA, 19 nt, Homo sapiens
gguggaagcucauguucga

SEQ ID NO: 267944 - RNA, 19 nt, Homo sapiens
ccaguacacuccuaucuca

SEQ ID NO: 267945 - RNA, 19 nt, Homo sapiens
ucaacucucuuaugguauu

SEQ ID NO: 267946 - RNA, 19 nt, Homo sapiens
caagaaagagggagggaaa

SEQ ID NO: 267947 - RNA, 19 nt, Homo sapiens
gacaguccuuuauaugauu

SEQ ID NO: 267948 - RNA, 19 nt, Homo sapiens
ucagaugugucacggauga

SEQ ID NO: 267949 - RNA, 19 nt, Homo sapiens
gcacuguugucauuuccaa

SEQ ID NO: 267950 - RNA, 19 nt, Homo sapiens
cauccagcaugaaagauaa

SEQ ID NO: 267951 - RNA, 19 nt, Homo sapiens
caacgcagacuuugaaauc

SEQ ID NO: 267952 - RNA, 19 nt, Homo sapiens
uaaaguaacucugcauguc

SEQ ID NO: 267953 - RNA, 19 nt, Homo sapiens
gaagaagacgguaugaagu

SEQ ID NO: 267954 - RNA, 19 nt, Homo sapiens
ucuaaagucuuccuauugu

SEQ ID NO: 267955 - RNA, 19 nt, Homo sapiens
gggaagguguuuaaagagu

SEQ ID NO: 267956 - RNA, 19 nt, Homo sapiens
uaaaguucccuauuuguga

SEQ ID NO: 267957 - RNA, 19 nt, Homo sapiens
gauggccacuguaauguuc

SEQ ID NO: 267958 - RNA, 19 nt, Homo sapiens
cagaagaggcaacaauuug

SEQ ID NO: 267959 - RNA, 19 nt, Homo sapiens
cuccucaaauccagaauua

SEQ ID NO: 267960 - RNA, 19 nt, Homo sapiens
aaccauggauuguacauau

SEQ ID NO: 267961 - RNA, 19 nt, Homo sapiens
ucacugaagcucaauaaug

SEQ ID NO: 267962 - RNA, 19 nt, Homo sapiens
uagagcagguuacuaagga

SEQ ID NO: 267963 - RNA, 19 nt, Homo sapiens
agauggugauguacucuua

SEQ ID NO: 267964 - RNA, 19 nt, Homo sapiens
ggcaaguauuuggcuauua

SEQ ID NO: 267965 - RNA, 19 nt, Homo sapiens
gaggcaagcacaaugguuu

SEQ ID NO: 267966 - RNA, 19 nt, Homo sapiens
gaaguugcccucacaagca

SEQ ID NO: 267967 - RNA, 19 nt, Homo sapiens
ugacaacgcagacuuugaa

SEQ ID NO: 267968 - RNA, 19 nt, Homo sapiens
gaugaagacaguccuuuau

SEQ ID NO: 267969 - RNA, 19 nt, Homo sapiens
cuaaagucuuccuauugua

SEQ ID NO: 267970 - RNA, 19 nt, Homo sapiens
caacucuguuuauuugaug

SEQ ID NO: 267971 - RNA, 19 nt, Homo sapiens
ggauuuacuucggauuuau

SEQ ID NO: 267972 - RNA, 19 nt, Homo sapiens
gcagauucccuguuggauu

SEQ ID NO: 267973 - RNA, 19 nt, Homo sapiens
ggacucaccaugaauaucu

SEQ ID NO: 267974 - RNA, 19 nt, Homo sapiens
ucugagagcuaguaccuau

SEQ ID NO: 267975 - RNA, 19 nt, Homo sapiens
gaagauacaguggagaaug

SEQ ID NO: 267976 - RNA, 19 nt, Homo sapiens
aaauagagcaucauacuca

SEQ ID NO: 267977 - RNA, 19 nt, Homo sapiens
gccaguaauucguuugcua

SEQ ID NO: 267978 - RNA, 19 nt, Homo sapiens
gagauaugacugacugauu

SEQ ID NO: 267979 - RNA, 19 nt, Homo sapiens
gaucaaauagacaucaaug

SEQ ID NO: 267980 - RNA, 19 nt, Homo sapiens
aaagauggccacuguaaug

SEQ ID NO: 267981 - RNA, 19 nt, Homo sapiens
agaaagauggccacuguaa

SEQ ID NO: 267982 - RNA, 19 nt, Homo sapiens
ugacaaucgugauaguuau

SEQ ID NO: 267983 - RNA, 19 nt, Homo sapiens
ggaaacugagguguuauuu

SEQ ID NO: 267984 - RNA, 19 nt, Homo sapiens
ggagaggaaacuugccuuu

SEQ ID NO: 267985 - RNA, 19 nt, Homo sapiens
cagaucaagugcuuaggaa

SEQ ID NO: 267986 - RNA, 19 nt, Homo sapiens
cagcugagucauuaaagua

SEQ ID NO: 267987 - RNA, 19 nt, Homo sapiens
agauaugacugacugauuc

SEQ ID NO: 267988 - RNA, 19 nt, Homo sapiens
acacccaucucuccucauu

SEQ ID NO: 267989 - RNA, 19 nt, Homo sapiens
gacaaagugaacucuauuu

SEQ ID NO: 267990 - RNA, 19 nt, Homo sapiens
cccaugggcugccuugaaa

SEQ ID NO: 267991 - RNA, 19 nt, Homo sapiens
guaaacaggacauugacaa

SEQ ID NO: 267992 - RNA, 19 nt, Homo sapiens
cacuauaguccaugaaaua

SEQ ID NO: 267993 - RNA, 19 nt, Homo sapiens
gaaagauggccacuguaau

SEQ ID NO: 267994 - RNA, 19 nt, Homo sapiens
uggauuuacuucggauuua

SEQ ID NO: 267995 - RNA, 19 nt, Homo sapiens
guguguugcuucucuauug

SEQ ID NO: 267996 - RNA, 19 nt, Homo sapiens
aaacugagguguuauuuuc

SEQ ID NO: 267997 - RNA, 19 nt, Homo sapiens
gaacaaacacugaaucaug

SEQ ID NO: 267998 - RNA, 19 nt, Homo sapiens
gcaaugaaacagaugauaa

SEQ ID NO: 267999 - RNA, 19 nt, Homo sapiens
gaugagcucugaacaaaca

SEQ ID NO: 268000 - RNA, 19 nt, Homo sapiens
gagagaaucacacaaguuu

SEQ ID NO: 268001 - RNA, 19 nt, Homo sapiens
gaaccuuccagccaaauua

SEQ ID NO: 268002 - RNA, 19 nt, Homo sapiens
uaacgggcauguauuauca

SEQ ID NO: 268003 - RNA, 19 nt, Homo sapiens
gcaaagaaagacauaauuc

SEQ ID NO: 268004 - RNA, 19 nt, Homo sapiens
caucaagcaugcaauaaug

SEQ ID NO: 268005 - RNA, 19 nt, Homo sapiens
gaaaauuacuggaagagaa

SEQ ID NO: 268006 - RNA, 19 nt, Homo sapiens
gagggauucuuuaaaguug

SEQ ID NO: 268007 - RNA, 19 nt, Homo sapiens
gggaggacaucauaaggaa

SEQ ID NO: 268008 - RNA, 19 nt, Homo sapiens
ccaguuccaugcaacauuu

SEQ ID NO: 268009 - RNA, 19 nt, Homo sapiens
aagaugagcucugaacaaa

SEQ ID NO: 268010 - RNA, 19 nt, Homo sapiens
guucaaaguuguaguucuu

SEQ ID NO: 268011 - RNA, 19 nt, Homo sapiens
aaacaugagugaauagcuu

SEQ ID NO: 268012 - RNA, 19 nt, Homo sapiens
gcugcaagcugcucaaauc

SEQ ID NO: 268013 - RNA, 19 nt, Homo sapiens
gugcagaaagcaacaguua

SEQ ID NO: 268014 - RNA, 19 nt, Homo sapiens
uaacaaagcacucccuuag

SEQ ID NO: 268015 - RNA, 19 nt, Homo sapiens
gaacaucauauacugaaga

SEQ ID NO: 268016 - RNA, 19 nt, Homo sapiens
auacaaagaugagcucuga

SEQ ID NO: 268017 - RNA, 19 nt, Homo sapiens
gcucgaacaucauauacug

SEQ ID NO: 268018 - RNA, 19 nt, Homo sapiens
gaaggcuacuggcauuaau

SEQ ID NO: 268019 - RNA, 19 nt, Homo sapiens
gaacucugaucgcuucaca

SEQ ID NO: 268020 - RNA, 19 nt, Homo sapiens
ugaaagagcaggaggaaau

SEQ ID NO: 268021 - RNA, 19 nt, Homo sapiens
gcuggaaccucuucaucuu

SEQ ID NO: 268022 - RNA, 19 nt, Homo sapiens
cuacaaaacuaccaucuaa

SEQ ID NO: 268023 - RNA, 19 nt, Homo sapiens
ggaaacaacugggaugacu

SEQ ID NO: 268024 - RNA, 19 nt, Homo sapiens
gcucaaaucucggcagaca

SEQ ID NO: 268025 - RNA, 19 nt, Homo sapiens
ccuaaggaaucugaaagua

SEQ ID NO: 268026 - RNA, 19 nt, Homo sapiens
caaacugaguaaauuggaa

SEQ ID NO: 268027 - RNA, 19 nt, Homo sapiens
gcauugaacauuucuuaug

SEQ ID NO: 268028 - RNA, 19 nt, Homo sapiens
caucuaagcugcagaaaau

SEQ ID NO: 268029 - RNA, 19 nt, Homo sapiens
gacaguagccaaguuauau

SEQ ID NO: 268030 - RNA, 19 nt, Homo sapiens
ucacaucaagcaugcaaua

SEQ ID NO: 268031 - RNA, 19 nt, Homo sapiens
cuacaagcauauuugagaa

SEQ ID NO: 268032 - RNA, 19 nt, Homo sapiens
gagcauaccaguacucagu

SEQ ID NO: 268033 - RNA, 19 nt, Homo sapiens
caacgaauaaguucaguuc

SEQ ID NO: 268034 - RNA, 19 nt, Homo sapiens
uagauggacuagaugauau

SEQ ID NO: 268035 - RNA, 19 nt, Homo sapiens
gaggaaaugcuucucaugu

SEQ ID NO: 268036 - RNA, 19 nt, Homo sapiens
guagccaaguuauauugaa

SEQ ID NO: 268037 - RNA, 19 nt, Homo sapiens
ggaaggcuacuggcauuaa

SEQ ID NO: 268038 - RNA, 19 nt, Homo sapiens
acacauacauacacauaca

SEQ ID NO: 268039 - RNA, 19 nt, Homo sapiens
gggaggcuuucaauuguau

SEQ ID NO: 268040 - RNA, 19 nt, Homo sapiens
uauuaacgggcauguauua

SEQ ID NO: 268041 - RNA, 19 nt, Homo sapiens
guauagcauugaacauuuc

SEQ ID NO: 268042 - RNA, 19 nt, Homo sapiens
gcuacuggcauuaauuauu

SEQ ID NO: 268043 - RNA, 19 nt, Homo sapiens
uaggaaggcuacuggcauu

SEQ ID NO: 268044 - RNA, 19 nt, Homo sapiens
caagcucgaacaucauaua

SEQ ID NO: 268045 - RNA, 19 nt, Homo sapiens
gaaucugugugaaguuaca

SEQ ID NO: 268046 - RNA, 19 nt, Homo sapiens
aacaaacacugaaucaugu

SEQ ID NO: 268047 - RNA, 19 nt, Homo sapiens
ggacaucauaaggaaguua

SEQ ID NO: 268048 - RNA, 19 nt, Homo sapiens
gcacuccgaaggaaauuug

SEQ ID NO: 268049 - RNA, 19 nt, Homo sapiens
gaagacaugacaaugcaau

SEQ ID NO: 268050 - RNA, 19 nt, Homo sapiens
uuuaauagcaccagccaua

SEQ ID NO: 268051 - RNA, 19 nt, Homo sapiens
caccaaagcuucaaaagau

SEQ ID NO: 268052 - RNA, 19 nt, Homo sapiens
ggacgauuaucagguagug

SEQ ID NO: 268053 - RNA, 19 nt, Homo sapiens
gauacucucccugacauuu

SEQ ID NO: 268054 - RNA, 19 nt, Homo sapiens
ggacuagaugauauuacua

SEQ ID NO: 268055 - RNA, 19 nt, Homo sapiens
gaaagagcaggaggaaaug

SEQ ID NO: 268056 - RNA, 19 nt, Homo sapiens
gaaccucuucaucuucauu

SEQ ID NO: 268057 - RNA, 19 nt, Homo sapiens
acaaugcaaugaaacagau

SEQ ID NO: 268058 - RNA, 19 nt, Homo sapiens
aagaagacaugacaaugca

SEQ ID NO: 268059 - RNA, 19 nt, Homo sapiens
agacaguagccaaguuaua

SEQ ID NO: 268060 - RNA, 19 nt, Homo sapiens
agccaaacaugagugaaua

SEQ ID NO: 268061 - RNA, 19 nt, Homo sapiens
gcaccagccauaacuaaca

SEQ ID NO: 268062 - RNA, 19 nt, Homo sapiens
aaacaacugggaugacuug

SEQ ID NO: 268063 - RNA, 19 nt, Homo sapiens
acaugacaaugcaaugaaa

SEQ ID NO: 268064 - RNA, 19 nt, Homo sapiens
ccugacauuucuaacauau

SEQ ID NO: 268065 - RNA, 19 nt, Homo sapiens
gauggacuagaugauauua

SEQ ID NO: 268066 - RNA, 19 nt, Homo sapiens
ggaaugcuuagauggacua

SEQ ID NO: 268067 - RNA, 19 nt, Homo sapiens
agccauaacuaacagcaaa

SEQ ID NO: 268068 - RNA, 19 nt, Homo sapiens
guguguguguguauguaua

SEQ ID NO: 268069 - RNA, 19 nt, Homo sapiens
ggagggaggacaucauaag

SEQ ID NO: 268070 - RNA, 19 nt, Homo sapiens
aagagaagacuuucccaaa

SEQ ID NO: 268071 - RNA, 19 nt, Homo sapiens
uuagauggacuagaugaua

SEQ ID NO: 268072 - RNA, 19 nt, Homo sapiens
gacaugacaaugcaaugaa

SEQ ID NO: 268073 - RNA, 19 nt, Homo sapiens
caguauagcauugaacauu

SEQ ID NO: 268074 - RNA, 19 nt, Homo sapiens
uguauuaagccaaacauga

SEQ ID NO: 268075 - RNA, 19 nt, Homo sapiens
cuaaggaaucugaaaguau

SEQ ID NO: 268076 - RNA, 19 nt, Homo sapiens
acucugaucgcuucacaua

SEQ ID NO: 268077 - RNA, 19 nt, Homo sapiens
gcagaaaauuacuggaaga

SEQ ID NO: 268078 - RNA, 19 nt, Homo sapiens
cagcaaagaaagacauaau

SEQ ID NO: 268079 - RNA, 19 nt, Homo sapiens
uaacuaacagcaaagaaag

SEQ ID NO: 268080 - RNA, 19 nt, Homo sapiens
gaaacaacugggaugacuu

SEQ ID NO: 268081 - RNA, 19 nt, Homo sapiens
acaaagcccacgucgguaa

SEQ ID NO: 268082 - RNA, 19 nt, Homo sapiens
gacaaugcaaugaaacaga

SEQ ID NO: 268083 - RNA, 19 nt, Homo sapiens
aaagaugagcucugaacaa

SEQ ID NO: 268084 - RNA, 19 nt, Homo sapiens
cagcgaagcaugcaaacug

SEQ ID NO: 268085 - RNA, 19 nt, Homo sapiens
ggaaaacucacgcuuaugu

SEQ ID NO: 268086 - RNA, 19 nt, Homo sapiens
ggaaauuuggggacgauua

SEQ ID NO: 268087 - RNA, 19 nt, Homo sapiens
gaggacaucauaaggaagu

SEQ ID NO: 268088 - RNA, 19 nt, Homo sapiens
gcagaaagcaacaguuacg

SEQ ID NO: 268089 - RNA, 19 nt, Homo sapiens
agagaagacuuucccaaaa

SEQ ID NO: 268090 - RNA, 19 nt, Homo sapiens
ggaggaaaugcuucucaug

SEQ ID NO: 268091 - RNA, 19 nt, Homo sapiens
uaagaagacaugacaaugc

SEQ ID NO: 268092 - RNA, 19 nt, Homo sapiens
uggcaugauuuauauaugg

SEQ ID NO: 268093 - RNA, 19 nt, Homo sapiens
ucugaucgcuucacauaac

SEQ ID NO: 268094 - RNA, 19 nt, Homo sapiens
uggccaaugucuauaacuu

SEQ ID NO: 268095 - RNA, 19 nt, Homo sapiens
uaauugucccuguuucaaa

SEQ ID NO: 268096 - RNA, 19 nt, Homo sapiens
aauagacaguagccaaguu

SEQ ID NO: 268097 - RNA, 19 nt, Homo sapiens
gcgcagacguugcuguuca

SEQ ID NO: 268098 - RNA, 19 nt, Homo sapiens
agaacgagcuggcccuuau

SEQ ID NO: 268099 - RNA, 19 nt, Homo sapiens
gaaagaacagccagugcaa

SEQ ID NO: 268100 - RNA, 19 nt, Homo sapiens
gaggacagcccgcuuuaug

SEQ ID NO: 268101 - RNA, 19 nt, Homo sapiens
gcaugacuguggccuguug

SEQ ID NO: 268102 - RNA, 19 nt, Homo sapiens
cagggagucugccaucuga

SEQ ID NO: 268103 - RNA, 19 nt, Homo sapiens
caucgacuccuucaugauu

SEQ ID NO: 268104 - RNA, 19 nt, Homo sapiens
gccuguugcucaugacuuu

SEQ ID NO: 268105 - RNA, 19 nt, Homo sapiens
gcaaccgcuucgucaagaa

SEQ ID NO: 268106 - RNA, 19 nt, Homo sapiens
gcucaugacuuucuuuugu

SEQ ID NO: 268107 - RNA, 19 nt, Homo sapiens
caacgugggcuaugacauc

SEQ ID NO: 268108 - RNA, 19 nt, Homo sapiens
cuacauggcggacaucuuc

SEQ ID NO: 268109 - RNA, 19 nt, Homo sapiens
ggccuccucuucuggugua

SEQ ID NO: 268110 - RNA, 19 nt, Homo sapiens
ggagaagagccacuacaag

SEQ ID NO: 268111 - RNA, 19 nt, Homo sapiens
gagaacgagcuggcccuua

SEQ ID NO: 268112 - RNA, 19 nt, Homo sapiens
gugcaaaggcccagagaca

SEQ ID NO: 268113 - RNA, 19 nt, Homo sapiens
gaacgagcuggcccuuaug

SEQ ID NO: 268114 - RNA, 19 nt, Homo sapiens
gcagacgaccaucggcuau

SEQ ID NO: 268115 - RNA, 19 nt, Homo sapiens
gcccagagacaggaauaaa

SEQ ID NO: 268116 - RNA, 19 nt, Homo sapiens
cgucaucgacuccuucaug

SEQ ID NO: 268117 - RNA, 19 nt, Homo sapiens
gacgaggacagcccgcuuu

SEQ ID NO: 268118 - RNA, 19 nt, Homo sapiens
caagaagaacggccaaugc

SEQ ID NO: 268119 - RNA, 19 nt, Homo sapiens
gggagcugcaggagaguaa

SEQ ID NO: 268120 - RNA, 19 nt, Homo sapiens
gcucaucaagcccuacaug

SEQ ID NO: 268121 - RNA, 19 nt, Homo sapiens
gcuuugagccuguggucuu

SEQ ID NO: 268122 - RNA, 19 nt, Homo sapiens
ccagagacaggaauaaacu

SEQ ID NO: 268123 - RNA, 19 nt, Homo sapiens
ccucaccacugcccacaag

SEQ ID NO: 268124 - RNA, 19 nt, Homo sapiens
gagcugcaggagaguaaga

SEQ ID NO: 268125 - RNA, 19 nt, Homo sapiens
cccacugacucuucaagga

SEQ ID NO: 268126 - RNA, 19 nt, Homo sapiens
agagacaggaauaaacuug

SEQ ID NO: 268127 - RNA, 19 nt, Homo sapiens
gggcgcagacguugcuguu

SEQ ID NO: 268128 - RNA, 19 nt, Homo sapiens
cgcaaccgcuucgucaaga

SEQ ID NO: 268129 - RNA, 19 nt, Homo sapiens
ucaagaagaacggccaaug

SEQ ID NO: 268130 - RNA, 19 nt, Homo sapiens
gaggagaagagccacuaca

SEQ ID NO: 268131 - RNA, 19 nt, Homo sapiens
ucgccaaccugagcaacaa

SEQ ID NO: 268132 - RNA, 19 nt, Homo sapiens
ccaaugcaacguguacuuc

SEQ ID NO: 268133 - RNA, 19 nt, Homo sapiens
gugcguuucuuuugcauga

SEQ ID NO: 268134 - RNA, 19 nt, Homo sapiens
aaagaacagccagugcaaa

SEQ ID NO: 268135 - RNA, 19 nt, Homo sapiens
gccaaugcaacguguacuu

SEQ ID NO: 268136 - RNA, 19 nt, Homo sapiens
aagaacagccagugcaaag

SEQ ID NO: 268137 - RNA, 19 nt, Homo sapiens
gacagauggagacaccaaa

SEQ ID NO: 268138 - RNA, 19 nt, Homo sapiens
aaacuuggcccugcgucuu

SEQ ID NO: 268139 - RNA, 19 nt, Homo sapiens
aagaagaacggccaaugca

SEQ ID NO: 268140 - RNA, 19 nt, Homo sapiens
agaagaacggccaaugcaa

SEQ ID NO: 268141 - RNA, 19 nt, Homo sapiens
acuacaagguggacuacuc

SEQ ID NO: 268142 - RNA, 19 nt, Homo sapiens
ggugucgcccaucaucauu

SEQ ID NO: 268143 - RNA, 19 nt, Homo sapiens
caucgugggcugcgucauc

SEQ ID NO: 268144 - RNA, 19 nt, Homo sapiens
gcgcagacguugcuguuca

SEQ ID NO: 268145 - RNA, 19 nt, Homo sapiens
agaacgagcuggcccuuau

SEQ ID NO: 268146 - RNA, 19 nt, Homo sapiens
gaggacagcccgcuuuaug

SEQ ID NO: 268147 - RNA, 19 nt, Homo sapiens
gcaugacuguggccuguug

SEQ ID NO: 268148 - RNA, 19 nt, Homo sapiens
gaucgcgccuugggaugua

SEQ ID NO: 268149 - RNA, 19 nt, Homo sapiens
cagggagucugccaucuga

SEQ ID NO: 268150 - RNA, 19 nt, Homo sapiens
caucgacuccuucaugauu

SEQ ID NO: 268151 - RNA, 19 nt, Homo sapiens
gccuguugcucaugacuuu

SEQ ID NO: 268152 - RNA, 19 nt, Homo sapiens
gcaaccgcuucgucaagaa

SEQ ID NO: 268153 - RNA, 19 nt, Homo sapiens
gcucaugacuuucuuuugu

SEQ ID NO: 268154 - RNA, 19 nt, Homo sapiens
caacgugggcuaugacauc

SEQ ID NO: 268155 - RNA, 19 nt, Homo sapiens
cuacauggcggacaucuuc

SEQ ID NO: 268156 - RNA, 19 nt, Homo sapiens
ggccuccucuucuggugua

SEQ ID NO: 268157 - RNA, 19 nt, Homo sapiens
ggagaagagccacuacaag

SEQ ID NO: 268158 - RNA, 19 nt, Homo sapiens
gagaacgagcuggcccuua

SEQ ID NO: 268159 - RNA, 19 nt, Homo sapiens
gaacgagcuggcccuuaug

SEQ ID NO: 268160 - RNA, 19 nt, Homo sapiens
gcagacgaccaucggcuau

SEQ ID NO: 268161 - RNA, 19 nt, Homo sapiens
cgucaucgacuccuucaug

SEQ ID NO: 268162 - RNA, 19 nt, Homo sapiens
gacgaggacagcccgcuuu

SEQ ID NO: 268163 - RNA, 19 nt, Homo sapiens
caagaagaacggccaaugc

SEQ ID NO: 268164 - RNA, 19 nt, Homo sapiens
gggagcugcaggagaguaa

SEQ ID NO: 268165 - RNA, 19 nt, Homo sapiens
gcucaucaagcccuacaug

SEQ ID NO: 268166 - RNA, 19 nt, Homo sapiens
gcuuugagccuguggucuu

SEQ ID NO: 268167 - RNA, 19 nt, Homo sapiens
ccucaccacugcccacaag

SEQ ID NO: 268168 - RNA, 19 nt, Homo sapiens
gagcugcaggagaguaaga

SEQ ID NO: 268169 - RNA, 19 nt, Homo sapiens
cgcaaccgcuucgucaaga

SEQ ID NO: 268170 - RNA, 19 nt, Homo sapiens
cccacugacucuucaagga

SEQ ID NO: 268171 - RNA, 19 nt, Homo sapiens
gggcgcagacguugcuguu

SEQ ID NO: 268172 - RNA, 19 nt, Homo sapiens
ucaagaagaacggccaaug

SEQ ID NO: 268173 - RNA, 19 nt, Homo sapiens
ucgccaaccugagcaacaa

SEQ ID NO: 268174 - RNA, 19 nt, Homo sapiens
gaggagaagagccacuaca

SEQ ID NO: 268175 - RNA, 19 nt, Homo sapiens
ccaaugcaacguguacuuc

SEQ ID NO: 268176 - RNA, 19 nt, Homo sapiens
gugcguuucuuuugcauga

SEQ ID NO: 268177 - RNA, 19 nt, Homo sapiens
gccaaugcaacguguacuu

SEQ ID NO: 268178 - RNA, 19 nt, Homo sapiens
gacagauggagacaccaaa

SEQ ID NO: 268179 - RNA, 19 nt, Homo sapiens
acuacaagguggacuacuc

SEQ ID NO: 268180 - RNA, 19 nt, Homo sapiens
agaagaacggccaaugcaa

SEQ ID NO: 268181 - RNA, 19 nt, Homo sapiens
ggugucgcccaucaucauu

SEQ ID NO: 268182 - RNA, 19 nt, Homo sapiens
caucgugggcugcgucauc

SEQ ID NO: 268183 - RNA, 19 nt, Homo sapiens
aagaagaacggccaaugca

SEQ ID NO: 268184 - RNA, 19 nt, Homo sapiens
gaguuaagauccauccaua

SEQ ID NO: 268185 - RNA, 19 nt, Homo sapiens
ccaaggagcuggcagaaau

SEQ ID NO: 268186 - RNA, 19 nt, Homo sapiens
acagagcccucaugaguua

SEQ ID NO: 268187 - RNA, 19 nt, Homo sapiens
gcuguuaucugccaaaugu

SEQ ID NO: 268188 - RNA, 19 nt, Homo sapiens
uacaacaccuuccaugaua

SEQ ID NO: 268189 - RNA, 19 nt, Homo sapiens
gaagggacaggauggcuua

SEQ ID NO: 268190 - RNA, 19 nt, Homo sapiens
gagaagcugugccucaugu

SEQ ID NO: 268191 - RNA, 19 nt, Homo sapiens
gggagaaaguugaguguca

SEQ ID NO: 268192 - RNA, 19 nt, Homo sapiens
ucacauaggcaauuccuuu

SEQ ID NO: 268193 - RNA, 19 nt, Homo sapiens
gaggagacuuaccugauga

SEQ ID NO: 268194 - RNA, 19 nt, Homo sapiens
gggccaagcucaucaaguc

SEQ ID NO: 268195 - RNA, 19 nt, Homo sapiens
ggaagaguuugaaguugug

SEQ ID NO: 268196 - RNA, 19 nt, Homo sapiens
ggguauggcuuccgaguca

SEQ ID NO: 268197 - RNA, 19 nt, Homo sapiens
gaaucggucucauuagagu

SEQ ID NO: 268198 - RNA, 19 nt, Homo sapiens
ucacagagcccucaugagu

SEQ ID NO: 268199 - RNA, 19 nt, Homo sapiens
gcagaagaauggcaugaac

SEQ ID NO: 268200 - RNA, 19 nt, Homo sapiens
gcuccuacauggauacaga

SEQ ID NO: 268201 - RNA, 19 nt, Homo sapiens
gagcggagacccucauguu

SEQ ID NO: 268202 - RNA, 19 nt, Homo sapiens
ucuaugagguggacuacaa

SEQ ID NO: 268203 - RNA, 19 nt, Homo sapiens
uuugguggcucauugcuua

SEQ ID NO: 268204 - RNA, 19 nt, Homo sapiens
gcuccgaucucaacaacau

SEQ ID NO: 268205 - RNA, 19 nt, Homo sapiens
gaccaagaguggauuccuu

SEQ ID NO: 268206 - RNA, 19 nt, Homo sapiens
ggacaggauggcuuaggua

SEQ ID NO: 268207 - RNA, 19 nt, Homo sapiens
ggagagccaggagcauuua

SEQ ID NO: 268208 - RNA, 19 nt, Homo sapiens
ccaagaagauuccaaaaca

SEQ ID NO: 268209 - RNA, 19 nt, Homo sapiens
ucaacaacaucccagcuau

SEQ ID NO: 268210 - RNA, 19 nt, Homo sapiens
gguguucucugcuguuauc

SEQ ID NO: 268211 - RNA, 19 nt, Homo sapiens
caacgacccauuacugaga

SEQ ID NO: 268212 - RNA, 19 nt, Homo sapiens
cccaugagaucaaccagaa

SEQ ID NO: 268213 - RNA, 19 nt, Homo sapiens
gcagugagccaagaucaug

SEQ ID NO: 268214 - RNA, 19 nt, Homo sapiens
guaccugagugaccucuuc

SEQ ID NO: 268215 - RNA, 19 nt, Homo sapiens
cgaggcggguggaucauga

SEQ ID NO: 268216 - RNA, 19 nt, Homo sapiens
gaagguggccugggacuag

SEQ ID NO: 268217 - RNA, 19 nt, Homo sapiens
agaggagacuuaccugaug

SEQ ID NO: 268218 - RNA, 19 nt, Homo sapiens
caucgucaaugccuucaug

SEQ ID NO: 268219 - RNA, 19 nt, Homo sapiens
cgaaacaaccauuggguau

SEQ ID NO: 268220 - RNA, 19 nt, Homo sapiens
ucagagugcuucuaaucau

SEQ ID NO: 268221 - RNA, 19 nt, Homo sapiens
gauccauccauaucacaua

SEQ ID NO: 268222 - RNA, 19 nt, Homo sapiens
ccuaagaccuccugucacu

SEQ ID NO: 268223 - RNA, 19 nt, Homo sapiens
ucaggaagaguuugaaguu

SEQ ID NO: 268224 - RNA, 19 nt, Homo sapiens
gagaggagacuuaccugau

SEQ ID NO: 268225 - RNA, 19 nt, Homo sapiens
gagagaaccaucaccuugu

SEQ ID NO: 268226 - RNA, 19 nt, Homo sapiens
gaaguuguggucauucuag

SEQ ID NO: 268227 - RNA, 19 nt, Homo sapiens
gaaacaaccauuggguaug

SEQ ID NO: 268228 - RNA, 19 nt, Homo sapiens
guggauuccuuguguugaa

SEQ ID NO: 268229 - RNA, 19 nt, Homo sapiens
guacagcccuugguguucu

SEQ ID NO: 268230 - RNA, 19 nt, Homo sapiens
gaccgccucuuccuugugu

SEQ ID NO: 268231 - RNA, 19 nt, Homo sapiens
caggaagaguuugaaguug

SEQ ID NO: 268232 - RNA, 19 nt, Homo sapiens
aagaguggauuccuugugu

SEQ ID NO: 268233 - RNA, 19 nt, Homo sapiens
gaaccaggacauggagauu

SEQ ID NO: 268234 - RNA, 19 nt, Homo sapiens
guuaagauccauccauauc

SEQ ID NO: 268235 - RNA, 19 nt, Homo sapiens
ucuuguaggugcuggcuaa

SEQ ID NO: 268236 - RNA, 19 nt, Homo sapiens
gggcugacaccuagagaga

SEQ ID NO: 268237 - RNA, 19 nt, Homo sapiens
aggaagaguuugaaguugu

SEQ ID NO: 268238 - RNA, 19 nt, Homo sapiens
gaagcugugccucauguuc

SEQ ID NO: 268239 - RNA, 19 nt, Homo sapiens
cauaggcaauuccuuuuaa

SEQ ID NO: 268240 - RNA, 19 nt, Homo sapiens
ggauuauacuccucuuggu

SEQ ID NO: 268241 - RNA, 19 nt, Homo sapiens
ggacaugaugagccaguug

SEQ ID NO: 268242 - RNA, 19 nt, Homo sapiens
cuacaacaccuuccaugau

SEQ ID NO: 268243 - RNA, 19 nt, Homo sapiens
ucacaccaguccucaccuu

SEQ ID NO: 268244 - RNA, 19 nt, Homo sapiens
gugcauguuugucaagauc

SEQ ID NO: 268245 - RNA, 19 nt, Homo sapiens
gaccucaaguggcgcuuca

SEQ ID NO: 268246 - RNA, 19 nt, Homo sapiens
caacaacaucccagcuaug

SEQ ID NO: 268247 - RNA, 19 nt, Homo sapiens
ucgagaccauccuggcuaa

SEQ ID NO: 268248 - RNA, 19 nt, Homo sapiens
cuaaucaucacaguaguuu

SEQ ID NO: 268249 - RNA, 19 nt, Homo sapiens
gggacaggauggcuuaggu

SEQ ID NO: 268250 - RNA, 19 nt, Homo sapiens
caccuuccaugauaccuau

SEQ ID NO: 268251 - RNA, 19 nt, Homo sapiens
ucaccaugguuuacacugu

SEQ ID NO: 268252 - RNA, 19 nt, Homo sapiens
ggaagcugaggcagaagaa

SEQ ID NO: 268253 - RNA, 19 nt, Homo sapiens
aaucucagagugcuucuaa

SEQ ID NO: 268254 - RNA, 19 nt, Homo sapiens
gaaccagacagacaucaac

SEQ ID NO: 268255 - RNA, 19 nt, Homo sapiens
gguggcucauugcuuauau

SEQ ID NO: 268256 - RNA, 19 nt, Homo sapiens
cgacagagcgagacuccau

SEQ ID NO: 268257 - RNA, 19 nt, Homo sapiens
ucgggaagcugaggcagaa

SEQ ID NO: 268258 - RNA, 19 nt, Homo sapiens
gaaaccccgucucuacuga

SEQ ID NO: 268259 - RNA, 19 nt, Homo sapiens
ccucugagcacaugcauag

SEQ ID NO: 268260 - RNA, 19 nt, Homo sapiens
ggcaauuccuuuuaaauca

SEQ ID NO: 268261 - RNA, 19 nt, Homo sapiens
cauaucacauaggcaauuc

SEQ ID NO: 268262 - RNA, 19 nt, Homo sapiens
acacagagagagagagaga

SEQ ID NO: 268263 - RNA, 19 nt, Homo sapiens
gcugacaccuagagagaac

SEQ ID NO: 268264 - RNA, 19 nt, Homo sapiens
gggugcagccucccuaaga

SEQ ID NO: 268265 - RNA, 19 nt, Homo sapiens
cguguccgcuuuccuguuc

SEQ ID NO: 268266 - RNA, 19 nt, Homo sapiens
agagagagagagagagauu

SEQ ID NO: 268267 - RNA, 19 nt, Homo sapiens
cagagugcuucuaaucauc

SEQ ID NO: 268268 - RNA, 19 nt, Homo sapiens
ugagcagaaugaagaagau

SEQ ID NO: 268269 - RNA, 19 nt, Homo sapiens
gaagcuccgaucucaacaa

SEQ ID NO: 268270 - RNA, 19 nt, Homo sapiens
caugagaucaaccagaaga

SEQ ID NO: 268271 - RNA, 19 nt, Homo sapiens
gaucaugaggucaggagau

SEQ ID NO: 268272 - RNA, 19 nt, Homo sapiens
ccucugcuguguucugugu

SEQ ID NO: 268273 - RNA, 19 nt, Homo sapiens
uaagauccauccauaucac

SEQ ID NO: 268274 - RNA, 19 nt, Homo sapiens
ggagcuggcagaaaugaag

SEQ ID NO: 268275 - RNA, 19 nt, Homo sapiens
gggagagguuccagcuaca

SEQ ID NO: 268276 - RNA, 19 nt, Homo sapiens
guuugaaguuguggucauu

SEQ ID NO: 268277 - RNA, 19 nt, Homo sapiens
gcuuuccuguucuccauug

SEQ ID NO: 268278 - RNA, 19 nt, Homo sapiens
gaguggauuccuuguguug

SEQ ID NO: 268279 - RNA, 19 nt, Homo sapiens
gucaggagaucgagaccau

SEQ ID NO: 268280 - RNA, 19 nt, Homo sapiens
gcguacagcccuugguguu

SEQ ID NO: 268281 - RNA, 19 nt, Homo sapiens
agauaccaacgacccauua

SEQ ID NO: 268282 - RNA, 19 nt, Homo sapiens
caccaguccucaccuugga

SEQ ID NO: 268283 - RNA, 19 nt, Homo sapiens
gagcucaaaccucuagucu

SEQ ID NO: 268284 - RNA, 19 nt, Homo sapiens
ggaaugaucuggugguuga

SEQ ID NO: 268285 - RNA, 19 nt, Homo sapiens
gagaaugaauccaaaguuu

SEQ ID NO: 268286 - RNA, 19 nt, Homo sapiens
gagaggagaucaugauuga

SEQ ID NO: 268287 - RNA, 19 nt, Homo sapiens
ccaaagagcuggccgaguu

SEQ ID NO: 268288 - RNA, 19 nt, Homo sapiens
gcucgaagcuccuacauca

SEQ ID NO: 268289 - RNA, 19 nt, Homo sapiens
acaaaccacuguacauaua

SEQ ID NO: 268290 - RNA, 19 nt, Homo sapiens
caggugagcugaagacaaa

SEQ ID NO: 268291 - RNA, 19 nt, Homo sapiens
uggcaaaccuggagaauga

SEQ ID NO: 268292 - RNA, 19 nt, Homo sapiens
gaaauuugaccaucugauu

SEQ ID NO: 268293 - RNA, 19 nt, Homo sapiens
agaagaaacugcaacaaug

SEQ ID NO: 268294 - RNA, 19 nt, Homo sapiens
gcuaaauacuguacauaga

SEQ ID NO: 268295 - RNA, 19 nt, Homo sapiens
aaaggugugucaaagauuu

SEQ ID NO: 268296 - RNA, 19 nt, Homo sapiens
gugcugaugugaaauuuga

SEQ ID NO: 268297 - RNA, 19 nt, Homo sapiens
gagccaaguugaucaaauc

SEQ ID NO: 268298 - RNA, 19 nt, Homo sapiens
agacauggauuugaugaaa

SEQ ID NO: 268299 - RNA, 19 nt, Homo sapiens
uacaacagcuuccaugaga

SEQ ID NO: 268300 - RNA, 19 nt, Homo sapiens
agaaagaaauggugaugug

SEQ ID NO: 268301 - RNA, 19 nt, Homo sapiens
gggaugaccugccaagaca

SEQ ID NO: 268302 - RNA, 19 nt, Homo sapiens
ugacagaauccaugacuaa

SEQ ID NO: 268303 - RNA, 19 nt, Homo sapiens
cugcauguguuguacaaua

SEQ ID NO: 268304 - RNA, 19 nt, Homo sapiens
uuacuuaccugcauguguu

SEQ ID NO: 268305 - RNA, 19 nt, Homo sapiens
gaaugaauccaaaguuuag

SEQ ID NO: 268306 - RNA, 19 nt, Homo sapiens
caaccaacaugcagaacug

SEQ ID NO: 268307 - RNA, 19 nt, Homo sapiens
gauaugacaagcaagguuu

SEQ ID NO: 268308 - RNA, 19 nt, Homo sapiens
gaaaacaaaucuucaaggu

SEQ ID NO: 268309 - RNA, 19 nt, Homo sapiens
aagaggaacuggaaauugu

SEQ ID NO: 268310 - RNA, 19 nt, Homo sapiens
ccagacggauaucaacgua

SEQ ID NO: 268311 - RNA, 19 nt, Homo sapiens
gaaagugcaauguucauca

SEQ ID NO: 268312 - RNA, 19 nt, Homo sapiens
gaaauggugauguggcaaa

SEQ ID NO: 268313 - RNA, 19 nt, Homo sapiens
gggaaacugugccugaugu

SEQ ID NO: 268314 - RNA, 19 nt, Homo sapiens
gagcaaacagaaagaaaug

SEQ ID NO: 268315 - RNA, 19 nt, Homo sapiens
agacaaaccacuguacaua

SEQ ID NO: 268316 - RNA, 19 nt, Homo sapiens
ccaaguugaucaaauccaa

SEQ ID NO: 268317 - RNA, 19 nt, Homo sapiens
gacggaaagugcaauguuc

SEQ ID NO: 268318 - RNA, 19 nt, Homo sapiens
gaagaaacugcaacaaugg

SEQ ID NO: 268319 - RNA, 19 nt, Homo sapiens
caagguuucuggugccuau

SEQ ID NO: 268320 - RNA, 19 nt, Homo sapiens
ggagaaugaauccaaaguu

SEQ ID NO: 268321 - RNA, 19 nt, Homo sapiens
augcagaacuggagacuga

SEQ ID NO: 268322 - RNA, 19 nt, Homo sapiens
ccagcaaacucaaccaaca

SEQ ID NO: 268323 - RNA, 19 nt, Homo sapiens
gccaugaaauuaaccaaca

SEQ ID NO: 268324 - RNA, 19 nt, Homo sapiens
gaagagcaaacagaaagaa

SEQ ID NO: 268325 - RNA, 19 nt, Homo sapiens
gaaguggagauucaaccua

SEQ ID NO: 268326 - RNA, 19 nt, Homo sapiens
gacaaaccacuguacauau

SEQ ID NO: 268327 - RNA, 19 nt, Homo sapiens
caaagagcuggccgaguua

SEQ ID NO: 268328 - RNA, 19 nt, Homo sapiens
caaagaggaacuggaaauu

SEQ ID NO: 268329 - RNA, 19 nt, Homo sapiens
gaagacaaaccacuguaca

SEQ ID NO: 268330 - RNA, 19 nt, Homo sapiens
gguuucuggugccuauuua

SEQ ID NO: 268331 - RNA, 19 nt, Homo sapiens
ucucuugcuuuguucuuua

SEQ ID NO: 268332 - RNA, 19 nt, Homo sapiens
ggaaauuguggucauccua

SEQ ID NO: 268333 - RNA, 19 nt, Homo sapiens
gaggagaucaugauugagu

SEQ ID NO: 268334 - RNA, 19 nt, Homo sapiens
caagagaggagaucaugau

SEQ ID NO: 268335 - RNA, 19 nt, Homo sapiens
gaccaucugauuccaguuu

SEQ ID NO: 268336 - RNA, 19 nt, Homo sapiens
gugcaaagugcccucauuu

SEQ ID NO: 268337 - RNA, 19 nt, Homo sapiens
ggacggguucuacgaaguu

SEQ ID NO: 268338 - RNA, 19 nt, Homo sapiens
ggaaagacggaaagugcaa

SEQ ID NO: 268339 - RNA, 19 nt, Homo sapiens
ucucggugcugaugugaaa

SEQ ID NO: 268340 - RNA, 19 nt, Homo sapiens
ugucaccgcugaucauuag

SEQ ID NO: 268341 - RNA, 19 nt, Homo sapiens
ccaaagaggaacuggaaau

SEQ ID NO: 268342 - RNA, 19 nt, Homo sapiens
aagcccagcugcccaaaga

SEQ ID NO: 268343 - RNA, 19 nt, Homo sapiens
ucucaguuauucagauuga

SEQ ID NO: 268344 - RNA, 19 nt, Homo sapiens
caaagaagaaacugcaaca

SEQ ID NO: 268345 - RNA, 19 nt, Homo sapiens
ggauaucaacguaggguau

SEQ ID NO: 268346 - RNA, 19 nt, Homo sapiens
gaucccaauucauuucauc

SEQ ID NO: 268347 - RNA, 19 nt, Homo sapiens
caagguagacauggauuug

SEQ ID NO: 268348 - RNA, 19 nt, Homo sapiens
gggcaaacccuucucuucu

SEQ ID NO: 268349 - RNA, 19 nt, Homo sapiens
gcccaaagaggaacuggaa

SEQ ID NO: 268350 - RNA, 19 nt, Homo sapiens
uggccaagcugacagaauc

SEQ ID NO: 268351 - RNA, 19 nt, Homo sapiens
gauuuuaccugggauauga

SEQ ID NO: 268352 - RNA, 19 nt, Homo sapiens
ggaggacggguucuacgaa

SEQ ID NO: 268353 - RNA, 19 nt, Homo sapiens
aaaggaaaauccagaggua

SEQ ID NO: 268354 - RNA, 19 nt, Homo sapiens
cagaauccaugacuaacgu

SEQ ID NO: 268355 - RNA, 19 nt, Homo sapiens
gcaaacagaaagaaauggu

SEQ ID NO: 268356 - RNA, 19 nt, Homo sapiens
gacauggauuugaugaaag

SEQ ID NO: 268357 - RNA, 19 nt, Homo sapiens
ggcaaacccuucucuucuc

SEQ ID NO: 268358 - RNA, 19 nt, Homo sapiens
cuuaggaauucccacauug

SEQ ID NO: 268359 - RNA, 19 nt, Homo sapiens
cgauaucuucaccacauua

SEQ ID NO: 268360 - RNA, 19 nt, Homo sapiens
agagguacgugaggaaaga

SEQ ID NO: 268361 - RNA, 19 nt, Homo sapiens
uuauggaucccaauucauu

SEQ ID NO: 268362 - RNA, 19 nt, Homo sapiens
ggauaugacaagcaagguu

SEQ ID NO: 268363 - RNA, 19 nt, Homo sapiens
guagacauggauuugauga

SEQ ID NO: 268364 - RNA, 19 nt, Homo sapiens
uaccugcccucucucaguu

SEQ ID NO: 268365 - RNA, 19 nt, Homo sapiens
aaucuuuccuugucucuca

SEQ ID NO: 268366 - RNA, 19 nt, Homo sapiens
ucuacgaaguugacuacaa

SEQ ID NO: 268367 - RNA, 19 nt, Homo sapiens
aaagaggaacuggaaauug

SEQ ID NO: 268368 - RNA, 19 nt, Homo sapiens
ccuuaggaauucccacauu

SEQ ID NO: 268369 - RNA, 19 nt, Homo sapiens
ugggaugcauguuuguaaa

SEQ ID NO: 268370 - RNA, 19 nt, Homo sapiens
ggucaucacagauaaaugc

SEQ ID NO: 268371 - RNA, 19 nt, Homo sapiens
gcuaccgggucaucacaga

SEQ ID NO: 268372 - RNA, 19 nt, Homo sapiens
aaguggagauucaaccuau

SEQ ID NO: 268373 - RNA, 19 nt, Homo sapiens
aagaagaaacugcaacaau

SEQ ID NO: 268374 - RNA, 19 nt, Homo sapiens
caaaccacuguacauauau

SEQ ID NO: 268375 - RNA, 19 nt, Homo sapiens
ucucucaguuauucagauu

SEQ ID NO: 268376 - RNA, 19 nt, Homo sapiens
ggagaucaugauugaguga

SEQ ID NO: 268377 - RNA, 19 nt, Homo sapiens
guucagucuugcuccguuu

SEQ ID NO: 268378 - RNA, 19 nt, Homo sapiens
gauaucaacguaggguauu

SEQ ID NO: 268379 - RNA, 19 nt, Homo sapiens
gaaccagacggauaucaac

SEQ ID NO: 268380 - RNA, 19 nt, Homo sapiens
gaaacugugccugauguuc

SEQ ID NO: 268381 - RNA, 19 nt, Homo sapiens
uacaauaccagaucacuca

SEQ ID NO: 268382 - RNA, 19 nt, Homo sapiens
ccugggauaugacaagcaa

SEQ ID NO: 268383 - RNA, 19 nt, Homo sapiens
gaaccucgaagagcaaaca

SEQ ID NO: 268384 - RNA, 19 nt, Homo sapiens
gcacgaaccuccuacauug

SEQ ID NO: 268385 - RNA, 19 nt, Homo sapiens
gaacaauucuucccucaug

SEQ ID NO: 268386 - RNA, 19 nt, Homo sapiens
gaaaugagucuguuugaaa

SEQ ID NO: 268387 - RNA, 19 nt, Homo sapiens
ggacaucuaugcuuacaug

SEQ ID NO: 268388 - RNA, 19 nt, Homo sapiens
gagaaaccuuccauccuua

SEQ ID NO: 268389 - RNA, 19 nt, Homo sapiens
gcagugauauacuuaaguu

SEQ ID NO: 268390 - RNA, 19 nt, Homo sapiens
gaaggaaagcuaagucuug

SEQ ID NO: 268391 - RNA, 19 nt, Homo sapiens
gggcagagcuggacaaggu

SEQ ID NO: 268392 - RNA, 19 nt, Homo sapiens
ccagaucgcuguguuacua

SEQ ID NO: 268393 - RNA, 19 nt, Homo sapiens
gaucaucaaugcagucaug

SEQ ID NO: 268394 - RNA, 19 nt, Homo sapiens
gaacauccgugagcaagga

SEQ ID NO: 268395 - RNA, 19 nt, Homo sapiens
uaacaggccuugagcacaa

SEQ ID NO: 268396 - RNA, 19 nt, Homo sapiens
ggucauaguuauucuggaa

SEQ ID NO: 268397 - RNA, 19 nt, Homo sapiens
uaccaaaggugcaauuuau

SEQ ID NO: 268398 - RNA, 19 nt, Homo sapiens
ugagaaaccuuccauccuu

SEQ ID NO: 268399 - RNA, 19 nt, Homo sapiens
acaauaauguguccuucua

SEQ ID NO: 268400 - RNA, 19 nt, Homo sapiens
caacugaccuggccaacca

SEQ ID NO: 268401 - RNA, 19 nt, Homo sapiens
caucaaugcagucauguua

SEQ ID NO: 268402 - RNA, 19 nt, Homo sapiens
ggacauuccuguugauaac

SEQ ID NO: 268403 - RNA, 19 nt, Homo sapiens
ggacgauguuggccagaaa

SEQ ID NO: 268404 - RNA, 19 nt, Homo sapiens
guaccaaaggugcaauuua

SEQ ID NO: 268405 - RNA, 19 nt, Homo sapiens
gcucguuucucucaauuug

SEQ ID NO: 268406 - RNA, 19 nt, Homo sapiens
gagggaggaugaugacaga

SEQ ID NO: 268407 - RNA, 19 nt, Homo sapiens
gcuaagucuugucucauuu

SEQ ID NO: 268408 - RNA, 19 nt, Homo sapiens
agagugaacugucucauca

SEQ ID NO: 268409 - RNA, 19 nt, Homo sapiens
gaaaacaacuacaccugaa

SEQ ID NO: 268410 - RNA, 19 nt, Homo sapiens
caaggugucuuugaaggaa

SEQ ID NO: 268411 - RNA, 19 nt, Homo sapiens
guaaguggauucaguucau

SEQ ID NO: 268412 - RNA, 19 nt, Homo sapiens
aaacacaucggaaucauga

SEQ ID NO: 268413 - RNA, 19 nt, Homo sapiens
gcaacuccaugagaagaaa

SEQ ID NO: 268414 - RNA, 19 nt, Homo sapiens
gaaguucaaguuaccauug

SEQ ID NO: 268415 - RNA, 19 nt, Homo sapiens
caugauaacugcauuuggu

SEQ ID NO: 268416 - RNA, 19 nt, Homo sapiens
gcauccagguggucaagaa

SEQ ID NO: 268417 - RNA, 19 nt, Homo sapiens
ccaaaggugcaauuuauga

SEQ ID NO: 268418 - RNA, 19 nt, Homo sapiens
gaguguauucuguggauua

SEQ ID NO: 268419 - RNA, 19 nt, Homo sapiens
ggaaaugcaaauagaauag

SEQ ID NO: 268420 - RNA, 19 nt, Homo sapiens
cccgagagcuggaugagaa

SEQ ID NO: 268421 - RNA, 19 nt, Homo sapiens
uuaaguggaucuguuugua

SEQ ID NO: 268422 - RNA, 19 nt, Homo sapiens
caagaaaugagucuguuug

SEQ ID NO: 268423 - RNA, 19 nt, Homo sapiens
uagauucaguugcaccuuu

SEQ ID NO: 268424 - RNA, 19 nt, Homo sapiens
guggaggauucauggcuua

SEQ ID NO: 268425 - RNA, 19 nt, Homo sapiens
ggaaaagcaugaucauuag

SEQ ID NO: 268426 - RNA, 19 nt, Homo sapiens
gaagaaacaauuccaugag

SEQ ID NO: 268427 - RNA, 19 nt, Homo sapiens
ucuccugucuccaugauaa

SEQ ID NO: 268428 - RNA, 19 nt, Homo sapiens
ccugcaaccuggcgcauaa

SEQ ID NO: 268429 - RNA, 19 nt, Homo sapiens
aaagcuaagucuugucuca

SEQ ID NO: 268430 - RNA, 19 nt, Homo sapiens
aaucaugacagcaagauaa

SEQ ID NO: 268431 - RNA, 19 nt, Homo sapiens
caucucacuucuucuucua

SEQ ID NO: 268432 - RNA, 19 nt, Homo sapiens
agaaaugagucuguuugaa

SEQ ID NO: 268433 - RNA, 19 nt, Homo sapiens
cagaagggcagaaacuuug

SEQ ID NO: 268434 - RNA, 19 nt, Homo sapiens
gagcaaggacgcuuucuac

SEQ ID NO: 268435 - RNA, 19 nt, Homo sapiens
cuaaugaucacucuggaaa

SEQ ID NO: 268436 - RNA, 19 nt, Homo sapiens
aagcgcaacuccaugagaa

SEQ ID NO: 268437 - RNA, 19 nt, Homo sapiens
gggaggugguuccuauuca

SEQ ID NO: 268438 - RNA, 19 nt, Homo sapiens
uaaguggaucuguuuguaa

SEQ ID NO: 268439 - RNA, 19 nt, Homo sapiens
uccagaauauuguggguuu

SEQ ID NO: 268440 - RNA, 19 nt, Homo sapiens
agucuugucucauuuagga

SEQ ID NO: 268441 - RNA, 19 nt, Homo sapiens
aaacccagaucgcuguguu

SEQ ID NO: 268442 - RNA, 19 nt, Homo sapiens
agaagaaacaauuccauga

SEQ ID NO: 268443 - RNA, 19 nt, Homo sapiens
gaaggagugguugaaacua

SEQ ID NO: 268444 - RNA, 19 nt, Homo sapiens
ggaaagcuaagucuugucu

SEQ ID NO: 268445 - RNA, 19 nt, Homo sapiens
aaugaucacucuggaaaug

SEQ ID NO: 268446 - RNA, 19 nt, Homo sapiens
gaaaugcuuaguuggugaa

SEQ ID NO: 268447 - RNA, 19 nt, Homo sapiens
gaaucaugacagcaagaua

SEQ ID NO: 268448 - RNA, 19 nt, Homo sapiens
gcguuuagauucaguugca

SEQ ID NO: 268449 - RNA, 19 nt, Homo sapiens
gcaaggacgcuuucuacag

SEQ ID NO: 268450 - RNA, 19 nt, Homo sapiens
cuaagucuugucucauuua

SEQ ID NO: 268451 - RNA, 19 nt, Homo sapiens
uaaguggauucaguucauu

SEQ ID NO: 268452 - RNA, 19 nt, Homo sapiens
uggcuaagcuggcuauggu

SEQ ID NO: 268453 - RNA, 19 nt, Homo sapiens
uaacugcauuugguaggaa

SEQ ID NO: 268454 - RNA, 19 nt, Homo sapiens
gagcuggaacacaauaaug

SEQ ID NO: 268455 - RNA, 19 nt, Homo sapiens
ggaaggagugguugaaacu

SEQ ID NO: 268456 - RNA, 19 nt, Homo sapiens
gaagcgcaacuccaugaga

SEQ ID NO: 268457 - RNA, 19 nt, Homo sapiens
gaaaccuuccauccuuauu

SEQ ID NO: 268458 - RNA, 19 nt, Homo sapiens
cuacauugcugaggagauc

SEQ ID NO: 268459 - RNA, 19 nt, Homo sapiens
gggcagaaacuuugauuuu

SEQ ID NO: 268460 - RNA, 19 nt, Homo sapiens
uguuugaaaugcuuaguug

SEQ ID NO: 268461 - RNA, 19 nt, Homo sapiens
gaggauucauggcuuaugc

SEQ ID NO: 268462 - RNA, 19 nt, Homo sapiens
acagaagggcagaaacuuu

SEQ ID NO: 268463 - RNA, 19 nt, Homo sapiens
gccacacgcuggucaucuu

SEQ ID NO: 268464 - RNA, 19 nt, Homo sapiens
gcaucucacuucuucuucu

SEQ ID NO: 268465 - RNA, 19 nt, Homo sapiens
auucauggcuuaugcuugu

SEQ ID NO: 268466 - RNA, 19 nt, Homo sapiens
gcacuuucuguaguaauaa

SEQ ID NO: 268467 - RNA, 19 nt, Homo sapiens
agugaacugucucaucaaa

SEQ ID NO: 268468 - RNA, 19 nt, Homo sapiens
ugaggaagaaggaguguau

SEQ ID NO: 268469 - RNA, 19 nt, Homo sapiens
aggaaaagcaugaucauua

SEQ ID NO: 268470 - RNA, 19 nt, Homo sapiens
caaguuaccauuggguuug

SEQ ID NO: 268471 - RNA, 19 nt, Homo sapiens
gguaugcucguuucucuca

SEQ ID NO: 268472 - RNA, 19 nt, Homo sapiens
uguagaauucgcagugaua

SEQ ID NO: 268473 - RNA, 19 nt, Homo sapiens
agcacuuucuguaguaaua

SEQ ID NO: 268474 - RNA, 19 nt, Homo sapiens
acaauucuauccgaaggaa

SEQ ID NO: 268475 - RNA, 19 nt, Homo sapiens
aaggaaagcuaagucuugu

SEQ ID NO: 268476 - RNA, 19 nt, Homo sapiens
ucaagaaaugagucuguuu

SEQ ID NO: 268477 - RNA, 19 nt, Homo sapiens
gucaagaaaugagucuguu

SEQ ID NO: 268478 - RNA, 19 nt, Homo sapiens
cauguagaauucgcaguga

SEQ ID NO: 268479 - RNA, 19 nt, Homo sapiens
aauaauguguccuucuaca

SEQ ID NO: 268480 - RNA, 19 nt, Homo sapiens
cauugugacugaggaagaa

SEQ ID NO: 268481 - RNA, 19 nt, Homo sapiens
ucaaugcagucauguuagg

SEQ ID NO: 268482 - RNA, 19 nt, Homo sapiens
gauguuggccagaaagagu

SEQ ID NO: 268483 - RNA, 19 nt, Homo sapiens
cuacuggcaucaccacaca

SEQ ID NO: 268484 - RNA, 19 nt, Homo sapiens
ggagagagaucuagaaagu

SEQ ID NO: 268485 - RNA, 19 nt, Homo sapiens
gaaaggagccggaccaaga

SEQ ID NO: 268486 - RNA, 19 nt, Homo sapiens
gaagagaagcugagaagaa

SEQ ID NO: 268487 - RNA, 19 nt, Homo sapiens
gaaaugugcuaaaguugga

SEQ ID NO: 268488 - RNA, 19 nt, Homo sapiens
auacauagauggaccagua

SEQ ID NO: 268489 - RNA, 19 nt, Homo sapiens
ggaagaugguagcagauaa

SEQ ID NO: 268490 - RNA, 19 nt, Homo sapiens
gaacgagggauaauucaaa

SEQ ID NO: 268491 - RNA, 19 nt, Homo sapiens
ggacugaggaccacacuuu

SEQ ID NO: 268492 - RNA, 19 nt, Homo sapiens
uggcacaacugucuaauga

SEQ ID NO: 268493 - RNA, 19 nt, Homo sapiens
gcauagaaacugaggagua

SEQ ID NO: 268494 - RNA, 19 nt, Homo sapiens
aaagacagcugacagauac

SEQ ID NO: 268495 - RNA, 19 nt, Homo sapiens
gaagaugguagcagauaaa

SEQ ID NO: 268496 - RNA, 19 nt, Homo sapiens
gaagagagagagagagguu

SEQ ID NO: 268497 - RNA, 19 nt, Homo sapiens
uaaagacagcugacagaua

SEQ ID NO: 268498 - RNA, 19 nt, Homo sapiens
ggaccaagaugggcacaug

SEQ ID NO: 268499 - RNA, 19 nt, Homo sapiens
gaaccugugcucuaaguga

SEQ ID NO: 268500 - RNA, 19 nt, Homo sapiens
gaacaccccugugcaaauu

SEQ ID NO: 268501 - RNA, 19 nt, Homo sapiens
gauaaagacagcugacaga

SEQ ID NO: 268502 - RNA, 19 nt, Homo sapiens
gagaaccugugcucuaagu

SEQ ID NO: 268503 - RNA, 19 nt, Homo sapiens
gagggauaauucaaacuga

SEQ ID NO: 268504 - RNA, 19 nt, Homo sapiens
gcugacagauacauagaug

SEQ ID NO: 268505 - RNA, 19 nt, Homo sapiens
ggaagucguuucaggacau

SEQ ID NO: 268506 - RNA, 19 nt, Homo sapiens
cauagaaacugaggaguag

SEQ ID NO: 268507 - RNA, 19 nt, Homo sapiens
ccacuaaccuguagaacac

SEQ ID NO: 268508 - RNA, 19 nt, Homo sapiens
gcaacgugcgcgagacaua

SEQ ID NO: 268509 - RNA, 19 nt, Homo sapiens
agugagaucuuacagguau

SEQ ID NO: 268510 - RNA, 19 nt, Homo sapiens
cuggaaaugugcuaaaguu

SEQ ID NO: 268511 - RNA, 19 nt, Homo sapiens
cccagaaacucaaccauca

SEQ ID NO: 268512 - RNA, 19 nt, Homo sapiens
acaguggagugagaucuua

SEQ ID NO: 268513 - RNA, 19 nt, Homo sapiens
agggauagcuauuuucuua

SEQ ID NO: 268514 - RNA, 19 nt, Homo sapiens
ggaggacggcuucuacgaa

SEQ ID NO: 268515 - RNA, 19 nt, Homo sapiens
agaggaagaugaagagaag

SEQ ID NO: 268516 - RNA, 19 nt, Homo sapiens
gagaggaagaugaagagaa

SEQ ID NO: 268517 - RNA, 19 nt, Homo sapiens
gcacaggcaggaagagaga

SEQ ID NO: 268518 - RNA, 19 nt, Homo sapiens
aagcugaagugaaggagaa

SEQ ID NO: 268519 - RNA, 19 nt, Homo sapiens
gggaagaugguagcagaua

SEQ ID NO: 268520 - RNA, 19 nt, Homo sapiens
guggauggauggacagaau

SEQ ID NO: 268521 - RNA, 19 nt, Homo sapiens
ggaagggccaggagagaga

SEQ ID NO: 268522 - RNA, 19 nt, Homo sapiens
uguuugaccuucacauuug

SEQ ID NO: 268523 - RNA, 19 nt, Homo sapiens
gaaaggaaaaccagggaua

SEQ ID NO: 268524 - RNA, 19 nt, Homo sapiens
ggacagaaugauggacuuu

SEQ ID NO: 268525 - RNA, 19 nt, Homo sapiens
uugagaaccugugcucuaa

SEQ ID NO: 268526 - RNA, 19 nt, Homo sapiens
aaccaugcauuccuaagaa

SEQ ID NO: 268527 - RNA, 19 nt, Homo sapiens
ccacauauggcacaacugu

SEQ ID NO: 268528 - RNA, 19 nt, Homo sapiens
auauguaagucaggaguua

SEQ ID NO: 268529 - RNA, 19 nt, Homo sapiens
gcaggaagagagagagaga

SEQ ID NO: 268530 - RNA, 19 nt, Homo sapiens
cccagaaccucaagucuag

SEQ ID NO: 268531 - RNA, 19 nt, Homo sapiens
aagagaagcugagaagaag

SEQ ID NO: 268532 - RNA, 19 nt, Homo sapiens
ccaaaaccaugcauuccua

SEQ ID NO: 268533 - RNA, 19 nt, Homo sapiens
gaugguagcagauaaagac

SEQ ID NO: 268534 - RNA, 19 nt, Homo sapiens
gcagacagagaaaugugaa

SEQ ID NO: 268535 - RNA, 19 nt, Homo sapiens
ggauggauggacagaauga

SEQ ID NO: 268536 - RNA, 19 nt, Homo sapiens
ggaggaggaggaaggcaaa

SEQ ID NO: 268537 - RNA, 19 nt, Homo sapiens
gagugugggugaucagaag

SEQ ID NO: 268538 - RNA, 19 nt, Homo sapiens
gaaucuaccuguggugacu

SEQ ID NO: 268539 - RNA, 19 nt, Homo sapiens
gaccuuaguccgcaaguuc

SEQ ID NO: 268540 - RNA, 19 nt, Homo sapiens
cagaguauaggauggauug

SEQ ID NO: 268541 - RNA, 19 nt, Homo sapiens
gacuugcgcuccucacaca

SEQ ID NO: 268542 - RNA, 19 nt, Homo sapiens
ggaaacagggcagugacaa

SEQ ID NO: 268543 - RNA, 19 nt, Homo sapiens
gaagucguuucaggacaug

SEQ ID NO: 268544 - RNA, 19 nt, Homo sapiens
caggagagagaucuagaaa

SEQ ID NO: 268545 - RNA, 19 nt, Homo sapiens
ugacagauacauagaugga

SEQ ID NO: 268546 - RNA, 19 nt, Homo sapiens
ccugugcucuaagugaaua

SEQ ID NO: 268547 - RNA, 19 nt, Homo sapiens
gaaacagggcagugacaag

SEQ ID NO: 268548 - RNA, 19 nt, Homo sapiens
cacaggagcagacagagaa

SEQ ID NO: 268549 - RNA, 19 nt, Homo sapiens
guaagucaggaguuagaaa

SEQ ID NO: 268550 - RNA, 19 nt, Homo sapiens
gcacagucauucacaucac

SEQ ID NO: 268551 - RNA, 19 nt, Homo sapiens
gcgcucaccuggcucuucu

SEQ ID NO: 268552 - RNA, 19 nt, Homo sapiens
gaaaaugccagucuguguu

SEQ ID NO: 268553 - RNA, 19 nt, Homo sapiens
gagcagacagagaaaugug

SEQ ID NO: 268554 - RNA, 19 nt, Homo sapiens
gcugagaggaagaugaaga

SEQ ID NO: 268555 - RNA, 19 nt, Homo sapiens
gaggaccacacuuugagaa

SEQ ID NO: 268556 - RNA, 19 nt, Homo sapiens
uaagucaggaguuagaaau

SEQ ID NO: 268557 - RNA, 19 nt, Homo sapiens
gcuccacccucaccaggau

SEQ ID NO: 268558 - RNA, 19 nt, Homo sapiens
guguuugaccuucacauuu

SEQ ID NO: 268559 - RNA, 19 nt, Homo sapiens
uagcugagaggaagaugaa

SEQ ID NO: 268560 - RNA, 19 nt, Homo sapiens
aaaccaugcauuccuaaga

SEQ ID NO: 268561 - RNA, 19 nt, Homo sapiens
gugcuaaaguuggaaaguc

SEQ ID NO: 268562 - RNA, 19 nt, Homo sapiens
ccugguuccuguccucaaa

SEQ ID NO: 268563 - RNA, 19 nt, Homo sapiens
aaaccagggauagcuauuu

SEQ ID NO: 268564 - RNA, 19 nt, Homo sapiens
gaagggagggguccugauu

SEQ ID NO: 268565 - RNA, 19 nt, Homo sapiens
aggccaagcugaagugaag

SEQ ID NO: 268566 - RNA, 19 nt, Homo sapiens
gggcugccacuaaccugua

SEQ ID NO: 268567 - RNA, 19 nt, Homo sapiens
ggagugugggugaucagaa

SEQ ID NO: 268568 - RNA, 19 nt, Homo sapiens
ggauagcuauuuucuuaca

SEQ ID NO: 268569 - RNA, 19 nt, Homo sapiens
gagcagaguauaggaugga

SEQ ID NO: 268570 - RNA, 19 nt, Homo sapiens
ggaagccacgggaaugaca

SEQ ID NO: 268571 - RNA, 19 nt, Homo sapiens
uguaaggcauagggaauau

SEQ ID NO: 268572 - RNA, 19 nt, Homo sapiens
guguaaggcauagggaaua

SEQ ID NO: 268573 - RNA, 19 nt, Homo sapiens
gagggacgacuucgagauc

SEQ ID NO: 268574 - RNA, 19 nt, Homo sapiens
ucuagaaaccaguauggaa

SEQ ID NO: 268575 - RNA, 19 nt, Homo sapiens
gggcugacaaggagcagaa

SEQ ID NO: 268576 - RNA, 19 nt, Homo sapiens
cagaaacucaaccaucaau

SEQ ID NO: 268577 - RNA, 19 nt, Homo sapiens
gaggaagggccaggagaga

SEQ ID NO: 268578 - RNA, 19 nt, Homo sapiens
gagugagaucuuacaggua

SEQ ID NO: 268579 - RNA, 19 nt, Homo sapiens
gacagcugacagauacaua

SEQ ID NO: 268580 - RNA, 19 nt, Homo sapiens
ucaagucuagaaaccagua

SEQ ID NO: 268581 - RNA, 19 nt, Homo sapiens
ggccagacacagauacaug

SEQ ID NO: 268582 - RNA, 19 nt, Homo sapiens
gaggaguagcugagaggaa

SEQ ID NO: 268583 - RNA, 19 nt, Homo sapiens
aaccugugcucuaagugaa

SEQ ID NO: 268584 - RNA, 19 nt, Homo sapiens
ggaaucuccuccauuauua

SEQ ID NO: 268585 - RNA, 19 nt, Homo sapiens
gaagugagauagcugauga

SEQ ID NO: 268586 - RNA, 19 nt, Homo sapiens
gaaaggaaauauucagaga

SEQ ID NO: 268587 - RNA, 19 nt, Homo sapiens
gaagaaagaaacagagaua

SEQ ID NO: 268588 - RNA, 19 nt, Homo sapiens
uaacacggaugcucaagua

SEQ ID NO: 268589 - RNA, 19 nt, Homo sapiens
ugagauagcugaugaagga

SEQ ID NO: 268590 - RNA, 19 nt, Homo sapiens
caccagagcuuuauccaaa

SEQ ID NO: 268591 - RNA, 19 nt, Homo sapiens
uaagucaaguugcaguuua

SEQ ID NO: 268592 - RNA, 19 nt, Homo sapiens
ggaaucugauaucaacaua

SEQ ID NO: 268593 - RNA, 19 nt, Homo sapiens
ggaaauauucagagacuuu

SEQ ID NO: 268594 - RNA, 19 nt, Homo sapiens
aaaucacacuguccuauua

SEQ ID NO: 268595 - RNA, 19 nt, Homo sapiens
gaaauuauaccuucugauc

SEQ ID NO: 268596 - RNA, 19 nt, Homo sapiens
guuacaagcuacagaauau

SEQ ID NO: 268597 - RNA, 19 nt, Homo sapiens
guaaauacauagcugacuu

SEQ ID NO: 268598 - RNA, 19 nt, Homo sapiens
gagaauuggugaugcuuug

SEQ ID NO: 268599 - RNA, 19 nt, Homo sapiens
gaucccagcuccggguuua

SEQ ID NO: 268600 - RNA, 19 nt, Homo sapiens
gaaauacaggaaucugaua

SEQ ID NO: 268601 - RNA, 19 nt, Homo sapiens
gauagcugaugaaggauuu

SEQ ID NO: 268602 - RNA, 19 nt, Homo sapiens
gccaauauguuccuuugaa

SEQ ID NO: 268603 - RNA, 19 nt, Homo sapiens
guacagaaaggaaauauuc

SEQ ID NO: 268604 - RNA, 19 nt, Homo sapiens
gcacaugguuccucuuugg

SEQ ID NO: 268605 - RNA, 19 nt, Homo sapiens
ggcaauaggccgagcuuua

SEQ ID NO: 268606 - RNA, 19 nt, Homo sapiens
ccaaugcccugguaaggaa

SEQ ID NO: 268607 - RNA, 19 nt, Homo sapiens
ggaaaggucugaaaauaau

SEQ ID NO: 268608 - RNA, 19 nt, Homo sapiens
gacaagcccuuaucugauc

SEQ ID NO: 268609 - RNA, 19 nt, Homo sapiens
gcccaaauauauugaaugu

SEQ ID NO: 268610 - RNA, 19 nt, Homo sapiens
gaauaucagcagaguagua

SEQ ID NO: 268611 - RNA, 19 nt, Homo sapiens
guacagagccuugcagaga

SEQ ID NO: 268612 - RNA, 19 nt, Homo sapiens
cagccacuauucucaguua

SEQ ID NO: 268613 - RNA, 19 nt, Homo sapiens
ggaaggacccaagccaaua

SEQ ID NO: 268614 - RNA, 19 nt, Homo sapiens
guaccuggcuucucuucuu

SEQ ID NO: 268615 - RNA, 19 nt, Homo sapiens
aaacauauaaccacccaua

SEQ ID NO: 268616 - RNA, 19 nt, Homo sapiens
gaagcgggcugagaccauu

SEQ ID NO: 268617 - RNA, 19 nt, Homo sapiens
gugagaagaugagaaagaa

SEQ ID NO: 268618 - RNA, 19 nt, Homo sapiens
gaccugaaauccucuuuua

SEQ ID NO: 268619 - RNA, 19 nt, Homo sapiens
gcacagcucugcuccuaac

SEQ ID NO: 268620 - RNA, 19 nt, Homo sapiens
ccaauauguuccuuugaaa

SEQ ID NO: 268621 - RNA, 19 nt, Homo sapiens
gaaaguggccucuccuagu

SEQ ID NO: 268622 - RNA, 19 nt, Homo sapiens
gauccgaguugccaauaug

SEQ ID NO: 268623 - RNA, 19 nt, Homo sapiens
caacauuagacuuaccuua

SEQ ID NO: 268624 - RNA, 19 nt, Homo sapiens
gcuacaagcuucugcucuu

SEQ ID NO: 268625 - RNA, 19 nt, Homo sapiens
ccaaaucccuagagugcuu

SEQ ID NO: 268626 - RNA, 19 nt, Homo sapiens
ccuagauccuucuuccuua

SEQ ID NO: 268627 - RNA, 19 nt, Homo sapiens
gauacccaguucccucaua

SEQ ID NO: 268628 - RNA, 19 nt, Homo sapiens
gaugaaacagugagaagaa

SEQ ID NO: 268629 - RNA, 19 nt, Homo sapiens
ccucuagacucuuggauga

SEQ ID NO: 268630 - RNA, 19 nt, Homo sapiens
gaaccauggucgccacugu

SEQ ID NO: 268631 - RNA, 19 nt, Homo sapiens
guucacaccugccaucuca

SEQ ID NO: 268632 - RNA, 19 nt, Homo sapiens
gggcugagaccauucguuu

SEQ ID NO: 268633 - RNA, 19 nt, Homo sapiens
gaaaucuucaucacaggua

SEQ ID NO: 268634 - RNA, 19 nt, Homo sapiens
gagaagaugagaaagaaau

SEQ ID NO: 268635 - RNA, 19 nt, Homo sapiens
caaggaagccucacauagu

SEQ ID NO: 268636 - RNA, 19 nt, Homo sapiens
caugagggauggguaaauu

SEQ ID NO: 268637 - RNA, 19 nt, Homo sapiens
caacauauccuaggguuuc

SEQ ID NO: 268638 - RNA, 19 nt, Homo sapiens
ggacaaccuucauugacau

SEQ ID NO: 268639 - RNA, 19 nt, Homo sapiens
gaaaucagugucaucucua

SEQ ID NO: 268640 - RNA, 19 nt, Homo sapiens
ccagaaaguuaacacaauc

SEQ ID NO: 268641 - RNA, 19 nt, Homo sapiens
cuaccaaucucuguugaaa

SEQ ID NO: 268642 - RNA, 19 nt, Homo sapiens
acacauaccucccuuaagc

SEQ ID NO: 268643 - RNA, 19 nt, Homo sapiens
ggaauacuacccggguuua

SEQ ID NO: 268644 - RNA, 19 nt, Homo sapiens
gaagauaccuggggugaga

SEQ ID NO: 268645 - RNA, 19 nt, Homo sapiens
ggacaagcccuuaucugau

SEQ ID NO: 268646 - RNA, 19 nt, Homo sapiens
ccucagccaugcuuggaua

SEQ ID NO: 268647 - RNA, 19 nt, Homo sapiens
gcucuucucugcgaccuuu

SEQ ID NO: 268648 - RNA, 19 nt, Homo sapiens
caacuguggacuuggaaua

SEQ ID NO: 268649 - RNA, 19 nt, Homo sapiens
gaaggacccaagccaauau

SEQ ID NO: 268650 - RNA, 19 nt, Homo sapiens
ucuguuaccuuuccaucua

SEQ ID NO: 268651 - RNA, 19 nt, Homo sapiens
gaaauaaagaggcauucau

SEQ ID NO: 268652 - RNA, 19 nt, Homo sapiens
gaagaaaucagugucaucu

SEQ ID NO: 268653 - RNA, 19 nt, Homo sapiens
uggcuucucuucuuccuuu

SEQ ID NO: 268654 - RNA, 19 nt, Homo sapiens
ccauuccucuggucucuuu

SEQ ID NO: 268655 - RNA, 19 nt, Homo sapiens
auacauagcugacuuuagc

SEQ ID NO: 268656 - RNA, 19 nt, Homo sapiens
gaugagaccagucccuuga

SEQ ID NO: 268657 - RNA, 19 nt, Homo sapiens
ugagggaccuagugaaauc

SEQ ID NO: 268658 - RNA, 19 nt, Homo sapiens
gcaauaggccgagcuuuag

SEQ ID NO: 268659 - RNA, 19 nt, Homo sapiens
caaguuggaggagucauua

SEQ ID NO: 268660 - RNA, 19 nt, Homo sapiens
aaaguggccucuccuagug

SEQ ID NO: 268661 - RNA, 19 nt, Homo sapiens
gaagaugagaaagaaauga

SEQ ID NO: 268662 - RNA, 19 nt, Homo sapiens
uauagucugucuccucuga

SEQ ID NO: 268663 - RNA, 19 nt, Homo sapiens
gcagagaaacacaaaauuu

SEQ ID NO: 268664 - RNA, 19 nt, Homo sapiens
gaucaaacucagccuauuc

SEQ ID NO: 268665 - RNA, 19 nt, Homo sapiens
gaaaucaaugaaacucuug

SEQ ID NO: 268666 - RNA, 19 nt, Homo sapiens
cuagauccuucuuccuuaa

SEQ ID NO: 268667 - RNA, 19 nt, Homo sapiens
ccaugugguuggaaggaua

SEQ ID NO: 268668 - RNA, 19 nt, Homo sapiens
uaacacaaucccaccauga

SEQ ID NO: 268669 - RNA, 19 nt, Homo sapiens
gcugagggaccuagugaaa

SEQ ID NO: 268670 - RNA, 19 nt, Homo sapiens
ggagaguccugacaaaaga

SEQ ID NO: 268671 - RNA, 19 nt, Homo sapiens
guaguaggcacaguuguaa

SEQ ID NO: 268672 - RNA, 19 nt, Homo sapiens
gcuaugcuuucuucccauu

SEQ ID NO: 268673 - RNA, 19 nt, Homo sapiens
agugccagcuauuucauua

SEQ ID NO: 268674 - RNA, 19 nt, Homo sapiens
gacccaagaugacgucagu

SEQ ID NO: 268675 - RNA, 19 nt, Homo sapiens
accaaucucuguugaaaga

SEQ ID NO: 268676 - RNA, 19 nt, Homo sapiens
gagcuggugcugauccuaa

SEQ ID NO: 268677 - RNA, 19 nt, Homo sapiens
gcaaaagccuccucauugg

SEQ ID NO: 268678 - RNA, 19 nt, Homo sapiens
uaaaucacacuguccuauu

SEQ ID NO: 268679 - RNA, 19 nt, Homo sapiens
gaaagaagccaggguuugc

SEQ ID NO: 268680 - RNA, 19 nt, Homo sapiens
ugagaccagucccuugaaa

SEQ ID NO: 268681 - RNA, 19 nt, Homo sapiens
uaaagaggcauucaugaag

SEQ ID NO: 268682 - RNA, 19 nt, Homo sapiens
ggugagaagaugagaaaga

SEQ ID NO: 268683 - RNA, 19 nt, Homo sapiens
guucucaacuuuauucaac

SEQ ID NO: 268684 - RNA, 19 nt, Homo sapiens
ggaguuaucucagaaguga

SEQ ID NO: 268685 - RNA, 19 nt, Homo sapiens
gaucaucuaccaugucauu

SEQ ID NO: 268686 - RNA, 19 nt, Homo sapiens
gcacuugucacuaugcuau

SEQ ID NO: 268687 - RNA, 19 nt, Homo sapiens
gaucaacgccaucaugcuu

SEQ ID NO: 268688 - RNA, 19 nt, Homo sapiens
ccacacacauugcucaucu

SEQ ID NO: 268689 - RNA, 19 nt, Homo sapiens
ccuccuaccuggccgauga

SEQ ID NO: 268690 - RNA, 19 nt, Homo sapiens
ggagugcaguggcgugauc

SEQ ID NO: 268691 - RNA, 19 nt, Homo sapiens
ucaaguggccacacacauu

SEQ ID NO: 268692 - RNA, 19 nt, Homo sapiens
ggacccagguggagguaag

SEQ ID NO: 268693 - RNA, 19 nt, Homo sapiens
caaguggccacacacauug

SEQ ID NO: 268694 - RNA, 19 nt, Homo sapiens
caucuaccaugucauugau

SEQ ID NO: 268695 - RNA, 19 nt, Homo sapiens
ggaccacagccuacuggaa

SEQ ID NO: 268696 - RNA, 19 nt, Homo sapiens
gaccucaaguggccacaca

SEQ ID NO: 268697 - RNA, 19 nt, Homo sapiens
ccggcuaacuuuuguauuu

SEQ ID NO: 268698 - RNA, 19 nt, Homo sapiens
cugaguagcugggauuaca

SEQ ID NO: 268699 - RNA, 19 nt, Homo sapiens
ccaagaaaggcaacugcaa

SEQ ID NO: 268700 - RNA, 19 nt, Homo sapiens
gcacugcugagcccugugu

SEQ ID NO: 268701 - RNA, 19 nt, Homo sapiens
uugcucaucuucaccaugu

SEQ ID NO: 268702 - RNA, 19 nt, Homo sapiens
acacauugcucaucuucac

SEQ ID NO: 268703 - RNA, 19 nt, Homo sapiens
gguauuaagaagugaagug

SEQ ID NO: 268704 - RNA, 19 nt, Homo sapiens
cugaucaucuaccauguca

SEQ ID NO: 268705 - RNA, 19 nt, Homo sapiens
gacguuacucuguggacua

SEQ ID NO: 268706 - RNA, 19 nt, Homo sapiens
gagguccaagugacuauug

SEQ ID NO: 268707 - RNA, 19 nt, Homo sapiens
ucaccagcauccacuccuu

SEQ ID NO: 268708 - RNA, 19 nt, Homo sapiens
ccaaggccaagcccaaguu

SEQ ID NO: 268709 - RNA, 19 nt, Homo sapiens
uggcaacaccgucaaagug

SEQ ID NO: 268710 - RNA, 19 nt, Homo sapiens
aggcugguauuaagaagug

SEQ ID NO: 268711 - RNA, 19 nt, Homo sapiens
ucaucuaccaugucauuga

SEQ ID NO: 268712 - RNA, 19 nt, Homo sapiens
cagcaagcaugcggugauc

SEQ ID NO: 268713 - RNA, 19 nt, Homo sapiens
ggaggacggacguuacucu

SEQ ID NO: 268714 - RNA, 19 nt, Homo sapiens
gucucgaacuccugaccua

SEQ ID NO: 268715 - RNA, 19 nt, Homo sapiens
gaccuccgcaagagcauga

SEQ ID NO: 268716 - RNA, 19 nt, Homo sapiens
ucgaacuccugaccuagug

SEQ ID NO: 268717 - RNA, 19 nt, Homo sapiens
gaacuccugaccuagugau

SEQ ID NO: 268718 - RNA, 19 nt, Homo sapiens
cuaccuggccgaugagauc

SEQ ID NO: 268719 - RNA, 19 nt, Homo sapiens
acuugucacuaugcuauuu

SEQ ID NO: 268720 - RNA, 19 nt, Homo sapiens
gcucauccaggguguuaca

SEQ ID NO: 268721 - RNA, 19 nt, Homo sapiens
ccaacguacugggauuaca

SEQ ID NO: 268722 - RNA, 19 nt, Homo sapiens
gcgcuuugugcccauugua

SEQ ID NO: 268723 - RNA, 19 nt, Homo sapiens
caacguacugggauuacag

SEQ ID NO: 268724 - RNA, 19 nt, Homo sapiens
ccaccaggaccucgagauc

SEQ ID NO: 268725 - RNA, 19 nt, Homo sapiens
cgaaggaucugguagagaa

SEQ ID NO: 268726 - RNA, 19 nt, Homo sapiens
gcuccuaccuggccaauga

SEQ ID NO: 268727 - RNA, 19 nt, Homo sapiens
gaccuuagcuugggugaga

SEQ ID NO: 268728 - RNA, 19 nt, Homo sapiens
gagaagaaccaguacaaga

SEQ ID NO: 268729 - RNA, 19 nt, Homo sapiens
gaagaaccaguacaagauu

SEQ ID NO: 268730 - RNA, 19 nt, Homo sapiens
cuaccuggcugacauguuc

SEQ ID NO: 268731 - RNA, 19 nt, Homo sapiens
caucgacuccuucaugauu

SEQ ID NO: 268732 - RNA, 19 nt, Homo sapiens
caacauggacgagaaguca

SEQ ID NO: 268733 - RNA, 19 nt, Homo sapiens
gcaaccgcuucgucaagaa

SEQ ID NO: 268734 - RNA, 19 nt, Homo sapiens
caucaucgacuccuucaug

SEQ ID NO: 268735 - RNA, 19 nt, Homo sapiens
agaagaaccaguacaagau

SEQ ID NO: 268736 - RNA, 19 nt, Homo sapiens
gggccuggaccgcaucuuu

SEQ ID NO: 268737 - RNA, 19 nt, Homo sapiens
ccaucaccaucuugcauga

SEQ ID NO: 268738 - RNA, 19 nt, Homo sapiens
gcaggugcacggcuucaug

SEQ ID NO: 268739 - RNA, 19 nt, Homo sapiens
aagaaccaguacaagauug

SEQ ID NO: 268740 - RNA, 19 nt, Homo sapiens
gcccuggguugcagacuca

SEQ ID NO: 268741 - RNA, 19 nt, Homo sapiens
ucgaggagaagaaccagua

SEQ ID NO: 268742 - RNA, 19 nt, Homo sapiens
gaucguggucauccuggaa

SEQ ID NO: 268743 - RNA, 19 nt, Homo sapiens
ucgccaacauggacgagaa

SEQ ID NO: 268744 - RNA, 19 nt, Homo sapiens
ggagaagaaccaguacaag

SEQ ID NO: 268745 - RNA, 19 nt, Homo sapiens
ggagacggacgacuuugag

SEQ ID NO: 268746 - RNA, 19 nt, Homo sapiens
uagcuugggugagacuguu

SEQ ID NO: 268747 - RNA, 19 nt, Homo sapiens
acauugaguucgccaacau

SEQ ID NO: 268748 - RNA, 19 nt, Homo sapiens
cgcaaccgcuucgucaaga

SEQ ID NO: 268749 - RNA, 19 nt, Homo sapiens
ggcaugacuuugacagacu

SEQ ID NO: 268750 - RNA, 19 nt, Homo sapiens
gcacuuccacaagaccuau

SEQ ID NO: 268751 - RNA, 19 nt, Homo sapiens
gcuugggugagacuguuua

SEQ ID NO: 268752 - RNA, 19 nt, Homo sapiens
agaacgagcuggccuuccu

SEQ ID NO: 268753 - RNA, 19 nt, Homo sapiens
gugcgaaggaucugguaga

SEQ ID NO: 268754 - RNA, 19 nt, Homo sapiens
aagaauggccagugcaaca

SEQ ID NO: 268755 - RNA, 19 nt, Homo sapiens
ucagcuuucuugaccuuag

SEQ ID NO: 268756 - RNA, 19 nt, Homo sapiens
acaccggguuucagcuuuc

SEQ ID NO: 268757 - RNA, 19 nt, Homo sapiens
gcgccaacuccuucugcua

SEQ ID NO: 268758 - RNA, 19 nt, Homo sapiens
gacggacgacuuugagauc

SEQ ID NO: 268759 - RNA, 19 nt, Homo sapiens
gagacggacgacuuugaga

SEQ ID NO: 268760 - RNA, 19 nt, Homo sapiens
caucgugggcugcaucauc

SEQ ID NO: 268761 - RNA, 19 nt, Homo sapiens
cagacucaguagcguuuua

SEQ ID NO: 268762 - RNA, 19 nt, Homo sapiens
gcuguucggcaucaucuuc

SEQ ID NO: 268763 - RNA, 19 nt, Homo sapiens
ggccaggcaugacuuugac

SEQ ID NO: 268764 - RNA, 19 nt, Homo sapiens
ccuggagacggacgacuuu

SEQ ID NO: 268765 - RNA, 19 nt, Homo sapiens
agaagaauggccagugcaa

SEQ ID NO: 268766 - RNA, 19 nt, Homo sapiens
ggaaucaucucuugaaaua

SEQ ID NO: 268767 - RNA, 19 nt, Homo sapiens
uaacacaacugaacucuaa

SEQ ID NO: 268768 - RNA, 19 nt, Homo sapiens
gaagagaaccuacaaacua

SEQ ID NO: 268769 - RNA, 19 nt, Homo sapiens
ggagggcacuggagaaaua

SEQ ID NO: 268770 - RNA, 19 nt, Homo sapiens
aaacaggacugacagaaua

SEQ ID NO: 268771 - RNA, 19 nt, Homo sapiens
ggagaaauaugccaaagga

SEQ ID NO: 268772 - RNA, 19 nt, Homo sapiens
caacuccucugguuucuaa

SEQ ID NO: 268773 - RNA, 19 nt, Homo sapiens
ucaaguauaucaccaguuu

SEQ ID NO: 268774 - RNA, 19 nt, Homo sapiens
aaacuguccuccauaauaa

SEQ ID NO: 268775 - RNA, 19 nt, Homo sapiens
ggcagaaggugaucagaua

SEQ ID NO: 268776 - RNA, 19 nt, Homo sapiens
ggucucagcuguacucuau

SEQ ID NO: 268777 - RNA, 19 nt, Homo sapiens
ggacagcaguaauugcaaa

SEQ ID NO: 268778 - RNA, 19 nt, Homo sapiens
caacugaacucuaagaaaa

SEQ ID NO: 268779 - RNA, 19 nt, Homo sapiens
gcagugcucugguauguuc

SEQ ID NO: 268780 - RNA, 19 nt, Homo sapiens
aagagaaacuguccuuaaa

SEQ ID NO: 268781 - RNA, 19 nt, Homo sapiens
caaccuaaguaaagacauu

SEQ ID NO: 268782 - RNA, 19 nt, Homo sapiens
gacagacacuuauacagaa

SEQ ID NO: 268783 - RNA, 19 nt, Homo sapiens
gauauaacuugagugagua

SEQ ID NO: 268784 - RNA, 19 nt, Homo sapiens
gaaugacgacuucacuaua

SEQ ID NO: 268785 - RNA, 19 nt, Homo sapiens
ucaauucgcuuuacugaca

SEQ ID NO: 268786 - RNA, 19 nt, Homo sapiens
gauggcaaaccuaaucuua

SEQ ID NO: 268787 - RNA, 19 nt, Homo sapiens
caagaacacagaaacuuaa

SEQ ID NO: 268788 - RNA, 19 nt, Homo sapiens
ucaagaacacagaaacuua

SEQ ID NO: 268789 - RNA, 19 nt, Homo sapiens
gcaaggagacgcaaaauuu

SEQ ID NO: 268790 - RNA, 19 nt, Homo sapiens
gaugaauggugaucuggaa

SEQ ID NO: 268791 - RNA, 19 nt, Homo sapiens
gcaaaagaacugagaaaua

SEQ ID NO: 268792 - RNA, 19 nt, Homo sapiens
gcuggugaauuuauaagaa

SEQ ID NO: 268793 - RNA, 19 nt, Homo sapiens
gacccgagguuccaaaugu

SEQ ID NO: 268794 - RNA, 19 nt, Homo sapiens
gcaggaaucaucucuugaa

SEQ ID NO: 268795 - RNA, 19 nt, Homo sapiens
ggaaugacgacuucacuau

SEQ ID NO: 268796 - RNA, 19 nt, Homo sapiens
caaauugaagcaacaguuu

SEQ ID NO: 268797 - RNA, 19 nt, Homo sapiens
gagauggacagcaguaauu

SEQ ID NO: 268798 - RNA, 19 nt, Homo sapiens
aaagagaaacuguccuuaa

SEQ ID NO: 268799 - RNA, 19 nt, Homo sapiens
gcaacaguuuaguuucaaa

SEQ ID NO: 268800 - RNA, 19 nt, Homo sapiens
gaaacaggacugacagaau

SEQ ID NO: 268801 - RNA, 19 nt, Homo sapiens
aaacggugauucaucuaaa

SEQ ID NO: 268802 - RNA, 19 nt, Homo sapiens
ccagaacacauacauauau

SEQ ID NO: 268803 - RNA, 19 nt, Homo sapiens
gaauggugaucuggaacua

SEQ ID NO: 268804 - RNA, 19 nt, Homo sapiens
gacaugcgcuggcguugga

SEQ ID NO: 268805 - RNA, 19 nt, Homo sapiens
ugauggcucuaauucauaa

SEQ ID NO: 268806 - RNA, 19 nt, Homo sapiens
caaacuagacuuguagauu

SEQ ID NO: 268807 - RNA, 19 nt, Homo sapiens
ugacagacacuuauacaga

SEQ ID NO: 268808 - RNA, 19 nt, Homo sapiens
aauuauagcucucuacauc

SEQ ID NO: 268809 - RNA, 19 nt, Homo sapiens
cauccuaccuacagucuga

SEQ ID NO: 268810 - RNA, 19 nt, Homo sapiens
agacacaacucacaauugg

SEQ ID NO: 268811 - RNA, 19 nt, Homo sapiens
ccaagacuauuguaacaca

SEQ ID NO: 268812 - RNA, 19 nt, Homo sapiens
ugaagcaacaguuuaguuu

SEQ ID NO: 268813 - RNA, 19 nt, Homo sapiens
gcaaauugaagcaacaguu

SEQ ID NO: 268814 - RNA, 19 nt, Homo sapiens
caaaagaacugagaaauac

SEQ ID NO: 268815 - RNA, 19 nt, Homo sapiens
gaaaauccuucucacuuug

SEQ ID NO: 268816 - RNA, 19 nt, Homo sapiens
cagcaguaauugcaaaguu

SEQ ID NO: 268817 - RNA, 19 nt, Homo sapiens
agauauaacuugagugagu

SEQ ID NO: 268818 - RNA, 19 nt, Homo sapiens
ucaaauggauggcgcucaa

SEQ ID NO: 268819 - RNA, 19 nt, Homo sapiens
ccacagcacacuucaaaug

SEQ ID NO: 268820 - RNA, 19 nt, Homo sapiens
cauaaagacagcaagaauu

SEQ ID NO: 268821 - RNA, 19 nt, Homo sapiens
acaagacugucccugaauu

SEQ ID NO: 268822 - RNA, 19 nt, Homo sapiens
ggagacacaacucacaauu

SEQ ID NO: 268823 - RNA, 19 nt, Homo sapiens
gcagaaggugaucagauaa

SEQ ID NO: 268824 - RNA, 19 nt, Homo sapiens
gcagaagaauaucaagaac

SEQ ID NO: 268825 - RNA, 19 nt, Homo sapiens
ucccuuauguccaguuuaa

SEQ ID NO: 268826 - RNA, 19 nt, Homo sapiens
aaauacacccagccaguua

SEQ ID NO: 268827 - RNA, 19 nt, Homo sapiens
gcuguacucuaucaggaaa

SEQ ID NO: 268828 - RNA, 19 nt, Homo sapiens
caugacaccagaacacaua

SEQ ID NO: 268829 - RNA, 19 nt, Homo sapiens
caacuugacagacacuuau

SEQ ID NO: 268830 - RNA, 19 nt, Homo sapiens
gagcuaacaauacacauuc

SEQ ID NO: 268831 - RNA, 19 nt, Homo sapiens
agaccuaccuuggcauaaa

SEQ ID NO: 268832 - RNA, 19 nt, Homo sapiens
agcaguaauugcaaaguua

SEQ ID NO: 268833 - RNA, 19 nt, Homo sapiens
gacauucauucuuaaguag

SEQ ID NO: 268834 - RNA, 19 nt, Homo sapiens
guaggagguuggacuagau

SEQ ID NO: 268835 - RNA, 19 nt, Homo sapiens
aagcaacaguuuaguuuca

SEQ ID NO: 268836 - RNA, 19 nt, Homo sapiens
acagugaaguuuaacacaa

SEQ ID NO: 268837 - RNA, 19 nt, Homo sapiens
aagaauggcugagcuaaca

SEQ ID NO: 268838 - RNA, 19 nt, Homo sapiens
ugaaaauccuucucacuuu

SEQ ID NO: 268839 - RNA, 19 nt, Homo sapiens
uggcaaaccuaaucuuauc

SEQ ID NO: 268840 - RNA, 19 nt, Homo sapiens
aguaguagcucacauggau

SEQ ID NO: 268841 - RNA, 19 nt, Homo sapiens
gagacacaacucacaauug

SEQ ID NO: 268842 - RNA, 19 nt, Homo sapiens
caggaaucaucucuugaaa

SEQ ID NO: 268843 - RNA, 19 nt, Homo sapiens
ucugaaauuucccuuauuc

SEQ ID NO: 268844 - RNA, 19 nt, Homo sapiens
gauaagcuccagcccaaau

SEQ ID NO: 268845 - RNA, 19 nt, Homo sapiens
aagagaaccuacaaacuag

SEQ ID NO: 268846 - RNA, 19 nt, Homo sapiens
aauggacagugaaguuuaa

SEQ ID NO: 268847 - RNA, 19 nt, Homo sapiens
ccacaucaauggacaaagc

SEQ ID NO: 268848 - RNA, 19 nt, Homo sapiens
ggccacagcacacuucaaa

SEQ ID NO: 268849 - RNA, 19 nt, Homo sapiens
caagauucaccuaaccuuu

SEQ ID NO: 268850 - RNA, 19 nt, Homo sapiens
caacccaagacuauuguaa

SEQ ID NO: 268851 - RNA, 19 nt, Homo sapiens
aaaugagcccuuucccuua

SEQ ID NO: 268852 - RNA, 19 nt, Homo sapiens
caaacggugauucaucuaa

SEQ ID NO: 268853 - RNA, 19 nt, Homo sapiens
caccagaacacauacauau

SEQ ID NO: 268854 - RNA, 19 nt, Homo sapiens
gaacaugacaccagaacac

SEQ ID NO: 268855 - RNA, 19 nt, Homo sapiens
gaaauguugcuggugaauu

SEQ ID NO: 268856 - RNA, 19 nt, Homo sapiens
caccuaaccuuugaaaaua

SEQ ID NO: 268857 - RNA, 19 nt, Homo sapiens
uggcugagcuaacaauaca

SEQ ID NO: 268858 - RNA, 19 nt, Homo sapiens
ccaguuaugcagcuacuuu

SEQ ID NO: 268859 - RNA, 19 nt, Homo sapiens
caagacugucccugaauuu

SEQ ID NO: 268860 - RNA, 19 nt, Homo sapiens
gaucauucauuugguucuu

SEQ ID NO: 268861 - RNA, 19 nt, Homo sapiens
uacacauucuggaaacaua

SEQ ID NO: 268862 - RNA, 19 nt, Homo sapiens
aaugagcccuuucccuuau

SEQ ID NO: 268863 - RNA, 19 nt, Homo sapiens
ucacuuauuuguggcagaa

SEQ ID NO: 268864 - RNA, 19 nt, Homo sapiens
gaagcaacaguuuaguuuc

SEQ ID NO: 268865 - RNA, 19 nt, Homo sapiens
caauacacauucuggaaac

SEQ ID NO: 268866 - RNA, 19 nt, Homo sapiens
ccagaaagcucauuaguug

SEQ ID NO: 268867 - RNA, 19 nt, Homo sapiens
caucagauaucaagaguuu

SEQ ID NO: 268868 - RNA, 19 nt, Homo sapiens
agacugaagugacagauua

SEQ ID NO: 268869 - RNA, 19 nt, Homo sapiens
gauacagaguuguccauua

SEQ ID NO: 268870 - RNA, 19 nt, Homo sapiens
gaacuacuccagaaacuaa

SEQ ID NO: 268871 - RNA, 19 nt, Homo sapiens
cgacaggccugcuggguaa

SEQ ID NO: 268872 - RNA, 19 nt, Homo sapiens
gagggaagguuauggaaug

SEQ ID NO: 268873 - RNA, 19 nt, Homo sapiens
guaaaugacuaggugguaa

SEQ ID NO: 268874 - RNA, 19 nt, Homo sapiens
gauucuagaugacuucuug

SEQ ID NO: 268875 - RNA, 19 nt, Homo sapiens
ggaaggaaagaaaggcuua

SEQ ID NO: 268876 - RNA, 19 nt, Homo sapiens
aaugaaggcuccagggaua

SEQ ID NO: 268877 - RNA, 19 nt, Homo sapiens
uagaaagacugaagugaca

SEQ ID NO: 268878 - RNA, 19 nt, Homo sapiens
gugagaagccaaugguaua

SEQ ID NO: 268879 - RNA, 19 nt, Homo sapiens
gcaguggcaauucuagaua

SEQ ID NO: 268880 - RNA, 19 nt, Homo sapiens
uccagaaacuaaagaguaa

SEQ ID NO: 268881 - RNA, 19 nt, Homo sapiens
gaagguucccguuggcuuu

SEQ ID NO: 268882 - RNA, 19 nt, Homo sapiens
ggaggaagaugaggacgau

SEQ ID NO: 268883 - RNA, 19 nt, Homo sapiens
ggaagcaaguuggcaguuc

SEQ ID NO: 268884 - RNA, 19 nt, Homo sapiens
ucucaaugauucuagauga

SEQ ID NO: 268885 - RNA, 19 nt, Homo sapiens
ccaauggaguugagaaucu

SEQ ID NO: 268886 - RNA, 19 nt, Homo sapiens
gcacccagccaagagaaua

SEQ ID NO: 268887 - RNA, 19 nt, Homo sapiens
gaagcaaguuggcaguucu

SEQ ID NO: 268888 - RNA, 19 nt, Homo sapiens
ccacuuccaucgcacuuau

SEQ ID NO: 268889 - RNA, 19 nt, Homo sapiens
ggauguggaugugggcuuu

SEQ ID NO: 268890 - RNA, 19 nt, Homo sapiens
ggacauacuggaccuuaau

SEQ ID NO: 268891 - RNA, 19 nt, Homo sapiens
caaggaagcaguggcaauu

SEQ ID NO: 268892 - RNA, 19 nt, Homo sapiens
cagcguggcucccaguaug

SEQ ID NO: 268893 - RNA, 19 nt, Homo sapiens
ccacagccaugaccacaca

SEQ ID NO: 268894 - RNA, 19 nt, Homo sapiens
uuagauaacuccaacuucu

SEQ ID NO: 268895 - RNA, 19 nt, Homo sapiens
gaguaauguuucuagaaug

SEQ ID NO: 268896 - RNA, 19 nt, Homo sapiens
gaacagcaucagauaucaa

SEQ ID NO: 268897 - RNA, 19 nt, Homo sapiens
gaccuuaauuccucugcuu

SEQ ID NO: 268898 - RNA, 19 nt, Homo sapiens
ggaaugggguggaaacaga

SEQ ID NO: 268899 - RNA, 19 nt, Homo sapiens
ggaagcaguggcaauucua

SEQ ID NO: 268900 - RNA, 19 nt, Homo sapiens
gagaaugaacuugcucuga

SEQ ID NO: 268901 - RNA, 19 nt, Homo sapiens
ggucgacuaucgccacuuc

SEQ ID NO: 268902 - RNA, 19 nt, Homo sapiens
uagaugacuucuugugguu

SEQ ID NO: 268903 - RNA, 19 nt, Homo sapiens
auacagaguuguccauuac

SEQ ID NO: 268904 - RNA, 19 nt, Homo sapiens
gaaagacugaagugacaga

SEQ ID NO: 268905 - RNA, 19 nt, Homo sapiens
ggggagaccuggauuguug

SEQ ID NO: 268906 - RNA, 19 nt, Homo sapiens
ggccagggcugacuuugag

SEQ ID NO: 268907 - RNA, 19 nt, Homo sapiens
gaugugugucuauuucuuu

SEQ ID NO: 268908 - RNA, 19 nt, Homo sapiens
gagguggacucaggacuuc

SEQ ID NO: 268909 - RNA, 19 nt, Homo sapiens
ggcaagcacuggugagucu

SEQ ID NO: 268910 - RNA, 19 nt, Homo sapiens
ccaacugaguagcaaauca

SEQ ID NO: 268911 - RNA, 19 nt, Homo sapiens
acaccggucugcagugcua

SEQ ID NO: 268912 - RNA, 19 nt, Homo sapiens
uuaaagugccauucuagaa

SEQ ID NO: 268913 - RNA, 19 nt, Homo sapiens
ggugagaagccaaugguau

SEQ ID NO: 268914 - RNA, 19 nt, Homo sapiens
ccuggaaggugaaggugaa

SEQ ID NO: 268915 - RNA, 19 nt, Homo sapiens
ggagguggacucaggacuu

SEQ ID NO: 268916 - RNA, 19 nt, Homo sapiens
agugacagauuaagaguuc

SEQ ID NO: 268917 - RNA, 19 nt, Homo sapiens
gaagugacagauuaagagu

SEQ ID NO: 268918 - RNA, 19 nt, Homo sapiens
gguaaaugacuagguggua

SEQ ID NO: 268919 - RNA, 19 nt, Homo sapiens
cuagugaugugugucuauu

SEQ ID NO: 268920 - RNA, 19 nt, Homo sapiens
gugcuaaggagcuggauga

SEQ ID NO: 268921 - RNA, 19 nt, Homo sapiens
cgucgugggugcugucaug

SEQ ID NO: 268922 - RNA, 19 nt, Homo sapiens
caaugauucuagaugacuu

SEQ ID NO: 268923 - RNA, 19 nt, Homo sapiens
caguggcaauucuagauau

SEQ ID NO: 268924 - RNA, 19 nt, Homo sapiens
ucagauaucaagaguuugu

SEQ ID NO: 268925 - RNA, 19 nt, Homo sapiens
ggaugugccugcucuucuc

SEQ ID NO: 268926 - RNA, 19 nt, Homo sapiens
uaguugagauucugugagu

SEQ ID NO: 268927 - RNA, 19 nt, Homo sapiens
ggagggaagguuauggaau

SEQ ID NO: 268928 - RNA, 19 nt, Homo sapiens
ugaacagcaucagauauca

SEQ ID NO: 268929 - RNA, 19 nt, Homo sapiens
gauggaggcaccgaucgua

SEQ ID NO: 268930 - RNA, 19 nt, Homo sapiens
gaccugugguuccagaaag

SEQ ID NO: 268931 - RNA, 19 nt, Homo sapiens
uagggcacagggcuaauua

SEQ ID NO: 268932 - RNA, 19 nt, Homo sapiens
uaccaaagccuggaaguuc

SEQ ID NO: 268933 - RNA, 19 nt, Homo sapiens
gaugacuucuugugguucu

SEQ ID NO: 268934 - RNA, 19 nt, Homo sapiens
caacugaguagcaaaucau

SEQ ID NO: 268935 - RNA, 19 nt, Homo sapiens
ggaugugggcuuugaugga

SEQ ID NO: 268936 - RNA, 19 nt, Homo sapiens
guagagcacccagccaaga

SEQ ID NO: 268937 - RNA, 19 nt, Homo sapiens
gucuguggguuuagaaaga

SEQ ID NO: 268938 - RNA, 19 nt, Homo sapiens
cuccagaaacuaaagagua

SEQ ID NO: 268939 - RNA, 19 nt, Homo sapiens
gauuuuacguggagaguug

SEQ ID NO: 268940 - RNA, 19 nt, Homo sapiens
ccuccaugaugcaaacuga

SEQ ID NO: 268941 - RNA, 19 nt, Homo sapiens
cuaccucccuggugaacug

SEQ ID NO: 268942 - RNA, 19 nt, Homo sapiens
ccaucaccaucguccauga

SEQ ID NO: 268943 - RNA, 19 nt, Homo sapiens
ugaugugugucuauuucuu

SEQ ID NO: 268944 - RNA, 19 nt, Homo sapiens
gcuggugagucuagaaugc

SEQ ID NO: 268945 - RNA, 19 nt, Homo sapiens
ggauacagaguuguccauu

SEQ ID NO: 268946 - RNA, 19 nt, Homo sapiens
gacauacuggaccuuaauu

SEQ ID NO: 268947 - RNA, 19 nt, Homo sapiens
aguaugaggucgacuaucg

SEQ ID NO: 268948 - RNA, 19 nt, Homo sapiens
gaagcaguggcaauucuag

SEQ ID NO: 268949 - RNA, 19 nt, Homo sapiens
guuagucuguggguuuaga

SEQ ID NO: 268950 - RNA, 19 nt, Homo sapiens
cagaaacuaaagaguaaug

SEQ ID NO: 268951 - RNA, 19 nt, Homo sapiens
gugagucuaggacagauuu

SEQ ID NO: 268952 - RNA, 19 nt, Homo sapiens
agugaugugugucuauuuc

SEQ ID NO: 268953 - RNA, 19 nt, Homo sapiens
guagggcacagggcuaauu

SEQ ID NO: 268954 - RNA, 19 nt, Homo sapiens
ucaggauucuguggcugua

SEQ ID NO: 268955 - RNA, 19 nt, Homo sapiens
ucaagggaguguugcuucu

SEQ ID NO: 268956 - RNA, 19 nt, Homo sapiens
guuuguaggucuggauuca

SEQ ID NO: 268957 - RNA, 19 nt, Homo sapiens
gagaagccaaugguauaga

SEQ ID NO: 268958 - RNA, 19 nt, Homo sapiens
uggacauacuggaccuuaa

SEQ ID NO: 268959 - RNA, 19 nt, Homo sapiens
agucuagaaugcucuggaa

SEQ ID NO: 268960 - RNA, 19 nt, Homo sapiens
gggcacagggcuaauuagu

SEQ ID NO: 268961 - RNA, 19 nt, Homo sapiens
uuucuggccugaccuggaa

SEQ ID NO: 268962 - RNA, 19 nt, Homo sapiens
ggacgaugagacugaggaa

SEQ ID NO: 268963 - RNA, 19 nt, Homo sapiens
gaagaugaggacgaugaga

SEQ ID NO: 268964 - RNA, 19 nt, Homo sapiens
aggcaccgaucguaucuuc

SEQ ID NO: 268965 - RNA, 19 nt, Homo sapiens
cuccagggauacagaguug

SEQ ID NO: 268966 - RNA, 19 nt, Homo sapiens
ccagaaagcucauuaguug

SEQ ID NO: 268967 - RNA, 19 nt, Homo sapiens
caucagauaucaagaguuu

SEQ ID NO: 268968 - RNA, 19 nt, Homo sapiens
agacugaagugacagauua

SEQ ID NO: 268969 - RNA, 19 nt, Homo sapiens
gauacagaguuguccauua

SEQ ID NO: 268970 - RNA, 19 nt, Homo sapiens
gaacuacuccagaaacuaa

SEQ ID NO: 268971 - RNA, 19 nt, Homo sapiens
cgacaggccugcuggguaa

SEQ ID NO: 268972 - RNA, 19 nt, Homo sapiens
gagggaagguuauggaaug

SEQ ID NO: 268973 - RNA, 19 nt, Homo sapiens
guaaaugacuaggugguaa

SEQ ID NO: 268974 - RNA, 19 nt, Homo sapiens
gauucuagaugacuucuug

SEQ ID NO: 268975 - RNA, 19 nt, Homo sapiens
aaugaaggcuccagggaua

SEQ ID NO: 268976 - RNA, 19 nt, Homo sapiens
ccaccuauuugacagauga

SEQ ID NO: 268977 - RNA, 19 nt, Homo sapiens
uagaaagacugaagugaca

SEQ ID NO: 268978 - RNA, 19 nt, Homo sapiens
gugagaagccaaugguaua

SEQ ID NO: 268979 - RNA, 19 nt, Homo sapiens
gcaguggcaauucuagaua

SEQ ID NO: 268980 - RNA, 19 nt, Homo sapiens
uccagaaacuaaagaguaa

SEQ ID NO: 268981 - RNA, 19 nt, Homo sapiens
ggaggaagaugaggacgau

SEQ ID NO: 268982 - RNA, 19 nt, Homo sapiens
ggaagcaaguuggcaguuc

SEQ ID NO: 268983 - RNA, 19 nt, Homo sapiens
ucucaaugauucuagauga

SEQ ID NO: 268984 - RNA, 19 nt, Homo sapiens
ccaauggaguugagaaucu

SEQ ID NO: 268985 - RNA, 19 nt, Homo sapiens
ugacagaugaggccacuaa

SEQ ID NO: 268986 - RNA, 19 nt, Homo sapiens
gcacccagccaagagaaua

SEQ ID NO: 268987 - RNA, 19 nt, Homo sapiens
gaagcaaguuggcaguucu

SEQ ID NO: 268988 - RNA, 19 nt, Homo sapiens
ccacuuccaucgcacuuau

SEQ ID NO: 268989 - RNA, 19 nt, Homo sapiens
ggauguggaugugggcuuu

SEQ ID NO: 268990 - RNA, 19 nt, Homo sapiens
ggacauacuggaccuuaau

SEQ ID NO: 268991 - RNA, 19 nt, Homo sapiens
caaggaagcaguggcaauu

SEQ ID NO: 268992 - RNA, 19 nt, Homo sapiens
cagcguggcucccaguaug

SEQ ID NO: 268993 - RNA, 19 nt, Homo sapiens
ggagaaucgcuuaaacuug

SEQ ID NO: 268994 - RNA, 19 nt, Homo sapiens
ccacagccaugaccacaca

SEQ ID NO: 268995 - RNA, 19 nt, Homo sapiens
uuagauaacuccaacuucu

SEQ ID NO: 268996 - RNA, 19 nt, Homo sapiens
gaguaauguuucuagaaug

SEQ ID NO: 268997 - RNA, 19 nt, Homo sapiens
gcggugagcugagauugug

SEQ ID NO: 268998 - RNA, 19 nt, Homo sapiens
gaacagcaucagauaucaa

SEQ ID NO: 268999 - RNA, 19 nt, Homo sapiens
gaccuuaauuccucugcuu

SEQ ID NO: 269000 - RNA, 19 nt, Homo sapiens
ggaaugggguggaaacaga

SEQ ID NO: 269001 - RNA, 19 nt, Homo sapiens
ggaagcaguggcaauucua

SEQ ID NO: 269002 - RNA, 19 nt, Homo sapiens
gagaaugaacuugcucuga

SEQ ID NO: 269003 - RNA, 19 nt, Homo sapiens
ggucgacuaucgccacuuc

SEQ ID NO: 269004 - RNA, 19 nt, Homo sapiens
gcaguaagccaggaucaug

SEQ ID NO: 269005 - RNA, 19 nt, Homo sapiens
uagaugacuucuugugguu

SEQ ID NO: 269006 - RNA, 19 nt, Homo sapiens
auacagaguuguccauuac

SEQ ID NO: 269007 - RNA, 19 nt, Homo sapiens
gaaagacugaagugacaga

SEQ ID NO: 269008 - RNA, 19 nt, Homo sapiens
ggggagaccuggauuguug

SEQ ID NO: 269009 - RNA, 19 nt, Homo sapiens
ggccagggcugacuuugag

SEQ ID NO: 269010 - RNA, 19 nt, Homo sapiens
gaugugugucuauuucuuu

SEQ ID NO: 269011 - RNA, 19 nt, Homo sapiens
gagguggacucaggacuuc

SEQ ID NO: 269012 - RNA, 19 nt, Homo sapiens
ggcaagcacuggugagucu

SEQ ID NO: 269013 - RNA, 19 nt, Homo sapiens
ccaacugaguagcaaauca

SEQ ID NO: 269014 - RNA, 19 nt, Homo sapiens
gcguaucguuccaccuauu

SEQ ID NO: 269015 - RNA, 19 nt, Homo sapiens
acaccggucugcagugcua

SEQ ID NO: 269016 - RNA, 19 nt, Homo sapiens
uuaaagugccauucuagaa

SEQ ID NO: 269017 - RNA, 19 nt, Homo sapiens
gagacaggagaaucgcuua

SEQ ID NO: 269018 - RNA, 19 nt, Homo sapiens
ggugagaagccaaugguau

SEQ ID NO: 269019 - RNA, 19 nt, Homo sapiens
ccuggaaggugaaggugaa

SEQ ID NO: 269020 - RNA, 19 nt, Homo sapiens
ggagguggacucaggacuu

SEQ ID NO: 269021 - RNA, 19 nt, Homo sapiens
agugacagauuaagaguuc

SEQ ID NO: 269022 - RNA, 19 nt, Homo sapiens
gaagugacagauuaagagu

SEQ ID NO: 269023 - RNA, 19 nt, Homo sapiens
gguaaaugacuagguggua

SEQ ID NO: 269024 - RNA, 19 nt, Homo sapiens
cuagugaugugugucuauu

SEQ ID NO: 269025 - RNA, 19 nt, Homo sapiens
ggacgcggagauugcagua

SEQ ID NO: 269026 - RNA, 19 nt, Homo sapiens
gugcuaaggagcuggauga

SEQ ID NO: 269027 - RNA, 19 nt, Homo sapiens
cgucgugggugcugucaug

SEQ ID NO: 269028 - RNA, 19 nt, Homo sapiens
ugacguuucugccgguuuc

SEQ ID NO: 269029 - RNA, 19 nt, Homo sapiens
gcacgacuccgucucaaaa

SEQ ID NO: 269030 - RNA, 19 nt, Homo sapiens
caaugauucuagaugacuu

SEQ ID NO: 269031 - RNA, 19 nt, Homo sapiens
caguggcaauucuagauau

SEQ ID NO: 269032 - RNA, 19 nt, Homo sapiens
ucagauaucaagaguuugu

SEQ ID NO: 269033 - RNA, 19 nt, Homo sapiens
gacaggagaaucgcuuaaa

SEQ ID NO: 269034 - RNA, 19 nt, Homo sapiens
ggaugugccugcucuucuc

SEQ ID NO: 269035 - RNA, 19 nt, Homo sapiens
uaguugagauucugugagu

SEQ ID NO: 269036 - RNA, 19 nt, Homo sapiens
ggagggaagguuauggaau

SEQ ID NO: 269037 - RNA, 19 nt, Homo sapiens
ugaacagcaucagauauca

SEQ ID NO: 269038 - RNA, 19 nt, Homo sapiens
gauggaggcaccgaucgua

SEQ ID NO: 269039 - RNA, 19 nt, Homo sapiens
gagcucauccauuccuguu

SEQ ID NO: 269040 - RNA, 19 nt, Homo sapiens
gaccugugguuccagaaag

SEQ ID NO: 269041 - RNA, 19 nt, Homo sapiens
uagggcacagggcuaauua

SEQ ID NO: 269042 - RNA, 19 nt, Homo sapiens
uaccaaagccuggaaguuc

SEQ ID NO: 269043 - RNA, 19 nt, Homo sapiens
gaugacuucuugugguucu

SEQ ID NO: 269044 - RNA, 19 nt, Homo sapiens
gugugcaccuguaguaauc

SEQ ID NO: 269045 - RNA, 19 nt, Homo sapiens
caacugaguagcaaaucau

SEQ ID NO: 269046 - RNA, 19 nt, Homo sapiens
ggaugugggcuuugaugga

SEQ ID NO: 269047 - RNA, 19 nt, Homo sapiens
guagagcacccagccaaga

SEQ ID NO: 269048 - RNA, 19 nt, Homo sapiens
gucuguggguuuagaaaga

SEQ ID NO: 269049 - RNA, 19 nt, Homo sapiens
cuccagaaacuaaagagua

SEQ ID NO: 269050 - RNA, 19 nt, Homo sapiens
gauuuuacguggagaguug

SEQ ID NO: 269051 - RNA, 19 nt, Homo sapiens
ccuccaugaugcaaacuga

SEQ ID NO: 269052 - RNA, 19 nt, Homo sapiens
cuaccucccuggugaacug

SEQ ID NO: 269053 - RNA, 19 nt, Homo sapiens
ccaucaccaucguccauga

SEQ ID NO: 269054 - RNA, 19 nt, Homo sapiens
ugaugugugucuauuucuu

SEQ ID NO: 269055 - RNA, 19 nt, Homo sapiens
gcuggugagucuagaaugc

SEQ ID NO: 269056 - RNA, 19 nt, Homo sapiens
ggauacagaguuguccauu

SEQ ID NO: 269057 - RNA, 19 nt, Homo sapiens
gacauacuggaccuuaauu

SEQ ID NO: 269058 - RNA, 19 nt, Homo sapiens
ccacuaagccccaccagaa

SEQ ID NO: 269059 - RNA, 19 nt, Homo sapiens
aguaugaggucgacuaucg

SEQ ID NO: 269060 - RNA, 19 nt, Homo sapiens
gaagcaguggcaauucuag

SEQ ID NO: 269061 - RNA, 19 nt, Homo sapiens
guuagucuguggguuuaga

SEQ ID NO: 269062 - RNA, 19 nt, Homo sapiens
cagaaacuaaagaguaaug

SEQ ID NO: 269063 - RNA, 19 nt, Homo sapiens
gugagucuaggacagauuu

SEQ ID NO: 269064 - RNA, 19 nt, Homo sapiens
agugaugugugucuauuuc

SEQ ID NO: 269065 - RNA, 19 nt, Homo sapiens
guagggcacagggcuaauu

SEQ ID NO: 269066 - RNA, 19 nt, Homo sapiens
ggaauaauguccuguuaga

SEQ ID NO: 269067 - RNA, 19 nt, Homo sapiens
caucagaacucccuucaaa

SEQ ID NO: 269068 - RNA, 19 nt, Homo sapiens
ggacugagcauuucucuga

SEQ ID NO: 269069 - RNA, 19 nt, Homo sapiens
ggaaggaaauugaucagau

SEQ ID NO: 269070 - RNA, 19 nt, Homo sapiens
uaaaggaacugcauaggau

SEQ ID NO: 269071 - RNA, 19 nt, Homo sapiens
uuugagagauuuccuguua

SEQ ID NO: 269072 - RNA, 19 nt, Homo sapiens
caaaguggauggcauauac

SEQ ID NO: 269073 - RNA, 19 nt, Homo sapiens
uccgagagcuuauuaguaa

SEQ ID NO: 269074 - RNA, 19 nt, Homo sapiens
gugaugaccugguuccuuu

SEQ ID NO: 269075 - RNA, 19 nt, Homo sapiens
gaagaggagcugaagguaa

SEQ ID NO: 269076 - RNA, 19 nt, Homo sapiens
gauacaaacucacccuguu

SEQ ID NO: 269077 - RNA, 19 nt, Homo sapiens
gaagguaagaaacucauaa

SEQ ID NO: 269078 - RNA, 19 nt, Homo sapiens
gaggaacccuaaacaccua

SEQ ID NO: 269079 - RNA, 19 nt, Homo sapiens
gaccuggccucucuucauu

SEQ ID NO: 269080 - RNA, 19 nt, Homo sapiens
ucauugaucucacugcuuu

SEQ ID NO: 269081 - RNA, 19 nt, Homo sapiens
gagacucuauguucacaaa

SEQ ID NO: 269082 - RNA, 19 nt, Homo sapiens
gaaagugaacucucauaau

SEQ ID NO: 269083 - RNA, 19 nt, Homo sapiens
ccaagccacugucaaauuc

SEQ ID NO: 269084 - RNA, 19 nt, Homo sapiens
guggaaaccuacacaaaug

SEQ ID NO: 269085 - RNA, 19 nt, Homo sapiens
caaccaagccacugucaaa

SEQ ID NO: 269086 - RNA, 19 nt, Homo sapiens
uaaaggagaaggaguuuga

SEQ ID NO: 269087 - RNA, 19 nt, Homo sapiens
gguaagaaacucauaaaca

SEQ ID NO: 269088 - RNA, 19 nt, Homo sapiens
caggaaauguucucagaug

SEQ ID NO: 269089 - RNA, 19 nt, Homo sapiens
ggacaguguucucaaagca

SEQ ID NO: 269090 - RNA, 19 nt, Homo sapiens
gccauuguuuccucuauuu

SEQ ID NO: 269091 - RNA, 19 nt, Homo sapiens
ugaauuguauggaaggaaa

SEQ ID NO: 269092 - RNA, 19 nt, Homo sapiens
ugacauaacuucccaucca

SEQ ID NO: 269093 - RNA, 19 nt, Homo sapiens
gcauuucucugacuugaca

SEQ ID NO: 269094 - RNA, 19 nt, Homo sapiens
gagcauuucucugacuuga

SEQ ID NO: 269095 - RNA, 19 nt, Homo sapiens
gaacucccuucaaacacaa

SEQ ID NO: 269096 - RNA, 19 nt, Homo sapiens
cagccagacuuacagaauu

SEQ ID NO: 269097 - RNA, 19 nt, Homo sapiens
gggcugagaccaucaaguu

SEQ ID NO: 269098 - RNA, 19 nt, Homo sapiens
ucagccauuucauuucuua

SEQ ID NO: 269099 - RNA, 19 nt, Homo sapiens
gacaugaaguggagauaca

SEQ ID NO: 269100 - RNA, 19 nt, Homo sapiens
ccacaguuaucgacaugaa

SEQ ID NO: 269101 - RNA, 19 nt, Homo sapiens
ugacaaaguggauggcaua

SEQ ID NO: 269102 - RNA, 19 nt, Homo sapiens
ggcuaugacugguuaaaug

SEQ ID NO: 269103 - RNA, 19 nt, Homo sapiens
cagucaugcuugcugauua

SEQ ID NO: 269104 - RNA, 19 nt, Homo sapiens
guagcagaaucccauggua

SEQ ID NO: 269105 - RNA, 19 nt, Homo sapiens
ucucaagccuguaaagaau

SEQ ID NO: 269106 - RNA, 19 nt, Homo sapiens
ucacagacccgccacauca

SEQ ID NO: 269107 - RNA, 19 nt, Homo sapiens
ccuuugaucuuguggcuaa

SEQ ID NO: 269108 - RNA, 19 nt, Homo sapiens
gcacagcaacgugagaauu

SEQ ID NO: 269109 - RNA, 19 nt, Homo sapiens
gcaugaacaagauuugaaa

SEQ ID NO: 269110 - RNA, 19 nt, Homo sapiens
gaaaaucucaagccuguaa

SEQ ID NO: 269111 - RNA, 19 nt, Homo sapiens
ugaaagugaacucucauaa

SEQ ID NO: 269112 - RNA, 19 nt, Homo sapiens
gcacggacauacaaaauca

SEQ ID NO: 269113 - RNA, 19 nt, Homo sapiens
gaccacaguuaucgacaug

SEQ ID NO: 269114 - RNA, 19 nt, Homo sapiens
gcauauaccuacucuaccu

SEQ ID NO: 269115 - RNA, 19 nt, Homo sapiens
gacaauacaggaaauguuc

SEQ ID NO: 269116 - RNA, 19 nt, Homo sapiens
gaucuguaauucacaacug

SEQ ID NO: 269117 - RNA, 19 nt, Homo sapiens
gcaagcuguuuccacauca

SEQ ID NO: 269118 - RNA, 19 nt, Homo sapiens
gaacugaggacacuuuuau

SEQ ID NO: 269119 - RNA, 19 nt, Homo sapiens
aagcccagauugcacauuu

SEQ ID NO: 269120 - RNA, 19 nt, Homo sapiens
ugugguaucucucuccaaa

SEQ ID NO: 269121 - RNA, 19 nt, Homo sapiens
cuaccugccuugaagaaga

SEQ ID NO: 269122 - RNA, 19 nt, Homo sapiens
aaugggcuaugacugguua

SEQ ID NO: 269123 - RNA, 19 nt, Homo sapiens
aagaggagcugaagguaag

SEQ ID NO: 269124 - RNA, 19 nt, Homo sapiens
uacaggaaauguucucaga

SEQ ID NO: 269125 - RNA, 19 nt, Homo sapiens
agaaggaguuugagcuugu

SEQ ID NO: 269126 - RNA, 19 nt, Homo sapiens
ggagaaggaguuugagcuu

SEQ ID NO: 269127 - RNA, 19 nt, Homo sapiens
ugauucagguagccaauau

SEQ ID NO: 269128 - RNA, 19 nt, Homo sapiens
gagagaguuuucuucauuu

SEQ ID NO: 269129 - RNA, 19 nt, Homo sapiens
ugagagaguuuucuucauu

SEQ ID NO: 269130 - RNA, 19 nt, Homo sapiens
ggaccacaguuaucgacau

SEQ ID NO: 269131 - RNA, 19 nt, Homo sapiens
ucagaucuguaauucacaa

SEQ ID NO: 269132 - RNA, 19 nt, Homo sapiens
aaagcuacauuucuaagag

SEQ ID NO: 269133 - RNA, 19 nt, Homo sapiens
uaaaccagcauuucugugu

SEQ ID NO: 269134 - RNA, 19 nt, Homo sapiens
ucagaacucccuucaaaca

SEQ ID NO: 269135 - RNA, 19 nt, Homo sapiens
aaagagaacugaggacacu

SEQ ID NO: 269136 - RNA, 19 nt, Homo sapiens
cgugagaauugacaaagug

SEQ ID NO: 269137 - RNA, 19 nt, Homo sapiens
caccugaccugcggaguga

SEQ ID NO: 269138 - RNA, 19 nt, Homo sapiens
cacuaucucuuuccauuca

SEQ ID NO: 269139 - RNA, 19 nt, Homo sapiens
uuggaauaauguccuguua

SEQ ID NO: 269140 - RNA, 19 nt, Homo sapiens
aaccagcauuucuguguuu

SEQ ID NO: 269141 - RNA, 19 nt, Homo sapiens
gaaggaguuugagcuugug

SEQ ID NO: 269142 - RNA, 19 nt, Homo sapiens
ucugcacucuucagucuuu

SEQ ID NO: 269143 - RNA, 19 nt, Homo sapiens
aaaccagcauuucuguguu

SEQ ID NO: 269144 - RNA, 19 nt, Homo sapiens
cuacugggguuuugaguuu

SEQ ID NO: 269145 - RNA, 19 nt, Homo sapiens
gaaccuuccuggccaaaau

SEQ ID NO: 269146 - RNA, 19 nt, Homo sapiens
ugaauccacuaucucuuuc

SEQ ID NO: 269147 - RNA, 19 nt, Homo sapiens
guagggcaauuggaauaau

SEQ ID NO: 269148 - RNA, 19 nt, Homo sapiens
agaacucccuucaaacaca

SEQ ID NO: 269149 - RNA, 19 nt, Homo sapiens
gagccgaacaucuuauauc

SEQ ID NO: 269150 - RNA, 19 nt, Homo sapiens
caacgugagaauugacaaa

SEQ ID NO: 269151 - RNA, 19 nt, Homo sapiens
cagaugcugauguuuguaa

SEQ ID NO: 269152 - RNA, 19 nt, Homo sapiens
cuagaauccugugcuguga

SEQ ID NO: 269153 - RNA, 19 nt, Homo sapiens
uccacuaucucuuuccauu

SEQ ID NO: 269154 - RNA, 19 nt, Homo sapiens
aaacugcacggacauacaa

SEQ ID NO: 269155 - RNA, 19 nt, Homo sapiens
gccagagccgaacaucuua

SEQ ID NO: 269156 - RNA, 19 nt, Homo sapiens
gcugagaccaucaaguuca

SEQ ID NO: 269157 - RNA, 19 nt, Homo sapiens
cgaccuugauugagaucuu

SEQ ID NO: 269158 - RNA, 19 nt, Homo sapiens
gugguucaguauucauuga

SEQ ID NO: 269159 - RNA, 19 nt, Homo sapiens
ucagucaguuugaacagau

SEQ ID NO: 269160 - RNA, 19 nt, Homo sapiens
gcuaugacugguuaaaugu

SEQ ID NO: 269161 - RNA, 19 nt, Homo sapiens
ggaagaagaggagcugaag

SEQ ID NO: 269162 - RNA, 19 nt, Homo sapiens
ugacaauacaggaaauguu

SEQ ID NO: 269163 - RNA, 19 nt, Homo sapiens
caaaugaaaguucgaaagc

SEQ ID NO: 269164 - RNA, 19 nt, Homo sapiens
guacaaaugaaaguucgaa

SEQ ID NO: 269165 - RNA, 19 nt, Homo sapiens
ugagagauuuccuguuagg

SEQ ID NO: 269166 - RNA, 19 nt, Homo sapiens
ggaauaauguccuguuaga

SEQ ID NO: 269167 - RNA, 19 nt, Homo sapiens
caucagaacucccuucaaa

SEQ ID NO: 269168 - RNA, 19 nt, Homo sapiens
ggacugagcauuucucuga

SEQ ID NO: 269169 - RNA, 19 nt, Homo sapiens
ggaaggaaauugaucagau

SEQ ID NO: 269170 - RNA, 19 nt, Homo sapiens
uaaaggaacugcauaggau

SEQ ID NO: 269171 - RNA, 19 nt, Homo sapiens
uuugagagauuuccuguua

SEQ ID NO: 269172 - RNA, 19 nt, Homo sapiens
caaaguggauggcauauac

SEQ ID NO: 269173 - RNA, 19 nt, Homo sapiens
uccgagagcuuauuaguaa

SEQ ID NO: 269174 - RNA, 19 nt, Homo sapiens
gugaugaccugguuccuuu

SEQ ID NO: 269175 - RNA, 19 nt, Homo sapiens
gaagaggagcugaagguaa

SEQ ID NO: 269176 - RNA, 19 nt, Homo sapiens
gauacaaacucacccuguu

SEQ ID NO: 269177 - RNA, 19 nt, Homo sapiens
gaagguaagaaacucauaa

SEQ ID NO: 269178 - RNA, 19 nt, Homo sapiens
gaggaacccuaaacaccua

SEQ ID NO: 269179 - RNA, 19 nt, Homo sapiens
gaccuggccucucuucauu

SEQ ID NO: 269180 - RNA, 19 nt, Homo sapiens
ucauugaucucacugcuuu

SEQ ID NO: 269181 - RNA, 19 nt, Homo sapiens
gagacucuauguucacaaa

SEQ ID NO: 269182 - RNA, 19 nt, Homo sapiens
gaaagugaacucucauaau

SEQ ID NO: 269183 - RNA, 19 nt, Homo sapiens
ccaagccacugucaaauuc

SEQ ID NO: 269184 - RNA, 19 nt, Homo sapiens
guggaaaccuacacaaaug

SEQ ID NO: 269185 - RNA, 19 nt, Homo sapiens
caaccaagccacugucaaa

SEQ ID NO: 269186 - RNA, 19 nt, Homo sapiens
uaaaggagaaggaguuuga

SEQ ID NO: 269187 - RNA, 19 nt, Homo sapiens
gguaagaaacucauaaaca

SEQ ID NO: 269188 - RNA, 19 nt, Homo sapiens
caggaaauguucucagaug

SEQ ID NO: 269189 - RNA, 19 nt, Homo sapiens
ggacaguguucucaaagca

SEQ ID NO: 269190 - RNA, 19 nt, Homo sapiens
gccauuguuuccucuauuu

SEQ ID NO: 269191 - RNA, 19 nt, Homo sapiens
ugaauuguauggaaggaaa

SEQ ID NO: 269192 - RNA, 19 nt, Homo sapiens
ugacauaacuucccaucca

SEQ ID NO: 269193 - RNA, 19 nt, Homo sapiens
gcauuucucugacuugaca

SEQ ID NO: 269194 - RNA, 19 nt, Homo sapiens
gagcauuucucugacuuga

SEQ ID NO: 269195 - RNA, 19 nt, Homo sapiens
gaacucccuucaaacacaa

SEQ ID NO: 269196 - RNA, 19 nt, Homo sapiens
cagccagacuuacagaauu

SEQ ID NO: 269197 - RNA, 19 nt, Homo sapiens
gggcugagaccaucaaguu

SEQ ID NO: 269198 - RNA, 19 nt, Homo sapiens
ucagccauuucauuucuua

SEQ ID NO: 269199 - RNA, 19 nt, Homo sapiens
gacaugaaguggagauaca

SEQ ID NO: 269200 - RNA, 19 nt, Homo sapiens
ccacaguuaucgacaugaa

SEQ ID NO: 269201 - RNA, 19 nt, Homo sapiens
ugacaaaguggauggcaua

SEQ ID NO: 269202 - RNA, 19 nt, Homo sapiens
ggcuaugacugguuaaaug

SEQ ID NO: 269203 - RNA, 19 nt, Homo sapiens
cagucaugcuugcugauua

SEQ ID NO: 269204 - RNA, 19 nt, Homo sapiens
guagcagaaucccauggua

SEQ ID NO: 269205 - RNA, 19 nt, Homo sapiens
ucucaagccuguaaagaau

SEQ ID NO: 269206 - RNA, 19 nt, Homo sapiens
ucacagacccgccacauca

SEQ ID NO: 269207 - RNA, 19 nt, Homo sapiens
ccuuugaucuuguggcuaa

SEQ ID NO: 269208 - RNA, 19 nt, Homo sapiens
gcacagcaacgugagaauu

SEQ ID NO: 269209 - RNA, 19 nt, Homo sapiens
gcaugaacaagauuugaaa

SEQ ID NO: 269210 - RNA, 19 nt, Homo sapiens
gaaaaucucaagccuguaa

SEQ ID NO: 269211 - RNA, 19 nt, Homo sapiens
ugaaagugaacucucauaa

SEQ ID NO: 269212 - RNA, 19 nt, Homo sapiens
gcacggacauacaaaauca

SEQ ID NO: 269213 - RNA, 19 nt, Homo sapiens
gaccacaguuaucgacaug

SEQ ID NO: 269214 - RNA, 19 nt, Homo sapiens
gcauauaccuacucuaccu

SEQ ID NO: 269215 - RNA, 19 nt, Homo sapiens
gacaauacaggaaauguuc

SEQ ID NO: 269216 - RNA, 19 nt, Homo sapiens
gaucuguaauucacaacug

SEQ ID NO: 269217 - RNA, 19 nt, Homo sapiens
gcaagcuguuuccacauca

SEQ ID NO: 269218 - RNA, 19 nt, Homo sapiens
gaacugaggacacuuuuau

SEQ ID NO: 269219 - RNA, 19 nt, Homo sapiens
aagcccagauugcacauuu

SEQ ID NO: 269220 - RNA, 19 nt, Homo sapiens
ugugguaucucucuccaaa

SEQ ID NO: 269221 - RNA, 19 nt, Homo sapiens
cuaccugccuugaagaaga

SEQ ID NO: 269222 - RNA, 19 nt, Homo sapiens
aaugggcuaugacugguua

SEQ ID NO: 269223 - RNA, 19 nt, Homo sapiens
aagaggagcugaagguaag

SEQ ID NO: 269224 - RNA, 19 nt, Homo sapiens
uacaggaaauguucucaga

SEQ ID NO: 269225 - RNA, 19 nt, Homo sapiens
agaaggaguuugagcuugu

SEQ ID NO: 269226 - RNA, 19 nt, Homo sapiens
ggagaaggaguuugagcuu

SEQ ID NO: 269227 - RNA, 19 nt, Homo sapiens
ugauucagguagccaauau

SEQ ID NO: 269228 - RNA, 19 nt, Homo sapiens
gagagaguuuucuucauuu

SEQ ID NO: 269229 - RNA, 19 nt, Homo sapiens
ggaccacaguuaucgacau

SEQ ID NO: 269230 - RNA, 19 nt, Homo sapiens
ugagagaguuuucuucauu

SEQ ID NO: 269231 - RNA, 19 nt, Homo sapiens
ucagaucuguaauucacaa

SEQ ID NO: 269232 - RNA, 19 nt, Homo sapiens
aaagcuacauuucuaagag

SEQ ID NO: 269233 - RNA, 19 nt, Homo sapiens
uaaaccagcauuucugugu

SEQ ID NO: 269234 - RNA, 19 nt, Homo sapiens
ucagaacucccuucaaaca

SEQ ID NO: 269235 - RNA, 19 nt, Homo sapiens
aaagagaacugaggacacu

SEQ ID NO: 269236 - RNA, 19 nt, Homo sapiens
cgugagaauugacaaagug

SEQ ID NO: 269237 - RNA, 19 nt, Homo sapiens
caccugaccugcggaguga

SEQ ID NO: 269238 - RNA, 19 nt, Homo sapiens
cacuaucucuuuccauuca

SEQ ID NO: 269239 - RNA, 19 nt, Homo sapiens
uuggaauaauguccuguua

SEQ ID NO: 269240 - RNA, 19 nt, Homo sapiens
aaccagcauuucuguguuu

SEQ ID NO: 269241 - RNA, 19 nt, Homo sapiens
gaaggaguuugagcuugug

SEQ ID NO: 269242 - RNA, 19 nt, Homo sapiens
aaacuuguaccaacuuguu

SEQ ID NO: 269243 - RNA, 19 nt, Homo sapiens
aaaccagcauuucuguguu

SEQ ID NO: 269244 - RNA, 19 nt, Homo sapiens
cuacugggguuuugaguuu

SEQ ID NO: 269245 - RNA, 19 nt, Homo sapiens
gaaccuuccuggccaaaau

SEQ ID NO: 269246 - RNA, 19 nt, Homo sapiens
ucugcacucuucagucuuu

SEQ ID NO: 269247 - RNA, 19 nt, Homo sapiens
ugaauccacuaucucuuuc

SEQ ID NO: 269248 - RNA, 19 nt, Homo sapiens
guagggcaauuggaauaau

SEQ ID NO: 269249 - RNA, 19 nt, Homo sapiens
agaacucccuucaaacaca

SEQ ID NO: 269250 - RNA, 19 nt, Homo sapiens
gagccgaacaucuuauauc

SEQ ID NO: 269251 - RNA, 19 nt, Homo sapiens
caacgugagaauugacaaa

SEQ ID NO: 269252 - RNA, 19 nt, Homo sapiens
cucccaaucucuuuccuuu

SEQ ID NO: 269253 - RNA, 19 nt, Homo sapiens
cagaugcugauguuuguaa

SEQ ID NO: 269254 - RNA, 19 nt, Homo sapiens
uccacuaucucuuuccauu

SEQ ID NO: 269255 - RNA, 19 nt, Homo sapiens
aaacugcacggacauacaa

SEQ ID NO: 269256 - RNA, 19 nt, Homo sapiens
gccagagccgaacaucuua

SEQ ID NO: 269257 - RNA, 19 nt, Homo sapiens
gcugagaccaucaaguuca

SEQ ID NO: 269258 - RNA, 19 nt, Homo sapiens
cgaccuugauugagaucuu

SEQ ID NO: 269259 - RNA, 19 nt, Homo sapiens
ucaaacuuguaccaacuug

SEQ ID NO: 269260 - RNA, 19 nt, Homo sapiens
cccaaucucuuuccuuucu

SEQ ID NO: 269261 - RNA, 19 nt, Homo sapiens
gugguucaguauucauuga

SEQ ID NO: 269262 - RNA, 19 nt, Homo sapiens
ucagucaguuugaacagau

SEQ ID NO: 269263 - RNA, 19 nt, Homo sapiens
gcuaugacugguuaaaugu

SEQ ID NO: 269264 - RNA, 19 nt, Homo sapiens
ggaagaagaggagcugaag

SEQ ID NO: 269265 - RNA, 19 nt, Homo sapiens
ugacaauacaggaaauguu

SEQ ID NO: 269266 - RNA, 19 nt, Homo sapiens
ggaauaauguccuguuaga

SEQ ID NO: 269267 - RNA, 19 nt, Homo sapiens
caucagaacucccuucaaa

SEQ ID NO: 269268 - RNA, 19 nt, Homo sapiens
ggaaggaaauugaucagau

SEQ ID NO: 269269 - RNA, 19 nt, Homo sapiens
uaaaggaacugcauaggau

SEQ ID NO: 269270 - RNA, 19 nt, Homo sapiens
uuugagagauuuccuguua

SEQ ID NO: 269271 - RNA, 19 nt, Homo sapiens
caaaguggauggcauauac

SEQ ID NO: 269272 - RNA, 19 nt, Homo sapiens
uccgagagcuuauuaguaa

SEQ ID NO: 269273 - RNA, 19 nt, Homo sapiens
gugaugaccugguuccuuu

SEQ ID NO: 269274 - RNA, 19 nt, Homo sapiens
gaagaggagcugaagguaa

SEQ ID NO: 269275 - RNA, 19 nt, Homo sapiens
gauacaaacucacccuguu

SEQ ID NO: 269276 - RNA, 19 nt, Homo sapiens
gaagguaagaaacucauaa

SEQ ID NO: 269277 - RNA, 19 nt, Homo sapiens
gaccuggccucucuucauu

SEQ ID NO: 269278 - RNA, 19 nt, Homo sapiens
ucauugaucucacugcuuu

SEQ ID NO: 269279 - RNA, 19 nt, Homo sapiens
gagacucuauguucacaaa

SEQ ID NO: 269280 - RNA, 19 nt, Homo sapiens
gaaagugaacucucauaau

SEQ ID NO: 269281 - RNA, 19 nt, Homo sapiens
ccaagccacugucaaauuc

SEQ ID NO: 269282 - RNA, 19 nt, Homo sapiens
guggaaaccuacacaaaug

SEQ ID NO: 269283 - RNA, 19 nt, Homo sapiens
caaccaagccacugucaaa

SEQ ID NO: 269284 - RNA, 19 nt, Homo sapiens
uaaaggagaaggaguuuga

SEQ ID NO: 269285 - RNA, 19 nt, Homo sapiens
gguaagaaacucauaaaca

SEQ ID NO: 269286 - RNA, 19 nt, Homo sapiens
caggaaauguucucagaug

SEQ ID NO: 269287 - RNA, 19 nt, Homo sapiens
ggacaguguucucaaagca

SEQ ID NO: 269288 - RNA, 19 nt, Homo sapiens
gccauuguuuccucuauuu

SEQ ID NO: 269289 - RNA, 19 nt, Homo sapiens
ugaauuguauggaaggaaa

SEQ ID NO: 269290 - RNA, 19 nt, Homo sapiens
gaacucccuucaaacacaa

SEQ ID NO: 269291 - RNA, 19 nt, Homo sapiens
cagccagacuuacagaauu

SEQ ID NO: 269292 - RNA, 19 nt, Homo sapiens
gggcugagaccaucaaguu

SEQ ID NO: 269293 - RNA, 19 nt, Homo sapiens
ucagccauuucauuucuua

SEQ ID NO: 269294 - RNA, 19 nt, Homo sapiens
gacaugaaguggagauaca

SEQ ID NO: 269295 - RNA, 19 nt, Homo sapiens
ccacaguuaucgacaugaa

SEQ ID NO: 269296 - RNA, 19 nt, Homo sapiens
ugacaaaguggauggcaua

SEQ ID NO: 269297 - RNA, 19 nt, Homo sapiens
ggcuaugacugguuaaaug

SEQ ID NO: 269298 - RNA, 19 nt, Homo sapiens
cagucaugcuugcugauua

SEQ ID NO: 269299 - RNA, 19 nt, Homo sapiens
guagcagaaucccauggua

SEQ ID NO: 269300 - RNA, 19 nt, Homo sapiens
ucucaagccuguaaagaau

SEQ ID NO: 269301 - RNA, 19 nt, Homo sapiens
ucacagacccgccacauca

SEQ ID NO: 269302 - RNA, 19 nt, Homo sapiens
ccuuugaucuuguggcuaa

SEQ ID NO: 269303 - RNA, 19 nt, Homo sapiens
gcacagcaacgugagaauu

SEQ ID NO: 269304 - RNA, 19 nt, Homo sapiens
gcaugaacaagauuugaaa

SEQ ID NO: 269305 - RNA, 19 nt, Homo sapiens
gaaaaucucaagccuguaa

SEQ ID NO: 269306 - RNA, 19 nt, Homo sapiens
ugaaagugaacucucauaa

SEQ ID NO: 269307 - RNA, 19 nt, Homo sapiens
gcacggacauacaaaauca

SEQ ID NO: 269308 - RNA, 19 nt, Homo sapiens
gaccacaguuaucgacaug

SEQ ID NO: 269309 - RNA, 19 nt, Homo sapiens
gcauauaccuacucuaccu

SEQ ID NO: 269310 - RNA, 19 nt, Homo sapiens
gacaauacaggaaauguuc

SEQ ID NO: 269311 - RNA, 19 nt, Homo sapiens
gaucuguaauucacaacug

SEQ ID NO: 269312 - RNA, 19 nt, Homo sapiens
gcaagcuguuuccacauca

SEQ ID NO: 269313 - RNA, 19 nt, Homo sapiens
gaacugaggacacuuuuau

SEQ ID NO: 269314 - RNA, 19 nt, Homo sapiens
aagcccagauugcacauuu

SEQ ID NO: 269315 - RNA, 19 nt, Homo sapiens
ugugguaucucucuccaaa

SEQ ID NO: 269316 - RNA, 19 nt, Homo sapiens
cuaccugccuugaagaaga

SEQ ID NO: 269317 - RNA, 19 nt, Homo sapiens
aaugggcuaugacugguua

SEQ ID NO: 269318 - RNA, 19 nt, Homo sapiens
aagaggagcugaagguaag

SEQ ID NO: 269319 - RNA, 19 nt, Homo sapiens
uacaggaaauguucucaga

SEQ ID NO: 269320 - RNA, 19 nt, Homo sapiens
agaaggaguuugagcuugu

SEQ ID NO: 269321 - RNA, 19 nt, Homo sapiens
ggagaaggaguuugagcuu

SEQ ID NO: 269322 - RNA, 19 nt, Homo sapiens
ugauucagguagccaauau

SEQ ID NO: 269323 - RNA, 19 nt, Homo sapiens
ggaccacaguuaucgacau

SEQ ID NO: 269324 - RNA, 19 nt, Homo sapiens
cgugagaauugacaaagug

SEQ ID NO: 269325 - RNA, 19 nt, Homo sapiens
caccugaccugcggaguga

SEQ ID NO: 269326 - RNA, 19 nt, Homo sapiens
ucagaucuguaauucacaa

SEQ ID NO: 269327 - RNA, 19 nt, Homo sapiens
aaagcuacauuucuaagag

SEQ ID NO: 269328 - RNA, 19 nt, Homo sapiens
uaaaccagcauuucugugu

SEQ ID NO: 269329 - RNA, 19 nt, Homo sapiens
ucagaacucccuucaaaca

SEQ ID NO: 269330 - RNA, 19 nt, Homo sapiens
aaagagaacugaggacacu

SEQ ID NO: 269331 - RNA, 19 nt, Homo sapiens
cacuaucucuuuccauuca

SEQ ID NO: 269332 - RNA, 19 nt, Homo sapiens
uuggaauaauguccuguua

SEQ ID NO: 269333 - RNA, 19 nt, Homo sapiens
aaccagcauuucuguguuu

SEQ ID NO: 269334 - RNA, 19 nt, Homo sapiens
gaaggaguuugagcuugug

SEQ ID NO: 269335 - RNA, 19 nt, Homo sapiens
aaaccagcauuucuguguu

SEQ ID NO: 269336 - RNA, 19 nt, Homo sapiens
cuacugggguuuugaguuu

SEQ ID NO: 269337 - RNA, 19 nt, Homo sapiens
gaaccuuccuggccaaaau

SEQ ID NO: 269338 - RNA, 19 nt, Homo sapiens
ugaauccacuaucucuuuc

SEQ ID NO: 269339 - RNA, 19 nt, Homo sapiens
guagggcaauuggaauaau

SEQ ID NO: 269340 - RNA, 19 nt, Homo sapiens
agaacucccuucaaacaca

SEQ ID NO: 269341 - RNA, 19 nt, Homo sapiens
caacgugagaauugacaaa

SEQ ID NO: 269342 - RNA, 19 nt, Homo sapiens
gagccgaacaucuuauauc

SEQ ID NO: 269343 - RNA, 19 nt, Homo sapiens
cagaugcugauguuuguaa

SEQ ID NO: 269344 - RNA, 19 nt, Homo sapiens
uccacuaucucuuuccauu

SEQ ID NO: 269345 - RNA, 19 nt, Homo sapiens
aaacugcacggacauacaa

SEQ ID NO: 269346 - RNA, 19 nt, Homo sapiens
gccagagccgaacaucuua

SEQ ID NO: 269347 - RNA, 19 nt, Homo sapiens
gcugagaccaucaaguuca

SEQ ID NO: 269348 - RNA, 19 nt, Homo sapiens
cgaccuugauugagaucuu

SEQ ID NO: 269349 - RNA, 19 nt, Homo sapiens
gugguucaguauucauuga

SEQ ID NO: 269350 - RNA, 19 nt, Homo sapiens
ucagucaguuugaacagau

SEQ ID NO: 269351 - RNA, 19 nt, Homo sapiens
gcuaugacugguuaaaugu

SEQ ID NO: 269352 - RNA, 19 nt, Homo sapiens
ggaagaagaggagcugaag

SEQ ID NO: 269353 - RNA, 19 nt, Homo sapiens
ugacaauacaggaaauguu

SEQ ID NO: 269354 - RNA, 19 nt, Homo sapiens
caaaugaaaguucgaaagc

SEQ ID NO: 269355 - RNA, 19 nt, Homo sapiens
guacaaaugaaaguucgaa

SEQ ID NO: 269356 - RNA, 19 nt, Homo sapiens
ugagagauuuccuguuagg

SEQ ID NO: 269357 - RNA, 19 nt, Homo sapiens
cagagccgaacaucuuaua

SEQ ID NO: 269358 - RNA, 19 nt, Homo sapiens
gaguaauuguugucucagu

SEQ ID NO: 269359 - RNA, 19 nt, Homo sapiens
caaaauaaagcucuugaga

SEQ ID NO: 269360 - RNA, 19 nt, Homo sapiens
ccuuauggcugagaguuga

SEQ ID NO: 269361 - RNA, 19 nt, Homo sapiens
aacagcaacucgaggagaa

SEQ ID NO: 269362 - RNA, 19 nt, Homo sapiens
ccagacaaccauuggcuau

SEQ ID NO: 269363 - RNA, 19 nt, Homo sapiens
gagcugaagguaagaaacu

SEQ ID NO: 269364 - RNA, 19 nt, Homo sapiens
aaggaacugcauaggauua

SEQ ID NO: 269365 - RNA, 19 nt, Homo sapiens
gccauuucauuucuuaucu

SEQ ID NO: 269366 - RNA, 19 nt, Homo sapiens
ggaaacaccuuaucagaaa

SEQ ID NO: 269367 - RNA, 19 nt, Homo sapiens
gaaaucagcucaccaguuc

SEQ ID NO: 269368 - RNA, 19 nt, Homo sapiens
gaaggaggcuggaauaaau

SEQ ID NO: 269369 - RNA, 19 nt, Homo sapiens
gaaauccuuuggccuauua

SEQ ID NO: 269370 - RNA, 19 nt, Homo sapiens
gcaccuagcucauagauuc

SEQ ID NO: 269371 - RNA, 19 nt, Homo sapiens
ggcagcagcuaucauauua

SEQ ID NO: 269372 - RNA, 19 nt, Homo sapiens
ggagggagauauuuauuug

SEQ ID NO: 269373 - RNA, 19 nt, Homo sapiens
caucuuaaguugcaucaua

SEQ ID NO: 269374 - RNA, 19 nt, Homo sapiens
ggaugacgauggcauuuaa

SEQ ID NO: 269375 - RNA, 19 nt, Homo sapiens
ccagugaguuacuuaauaa

SEQ ID NO: 269376 - RNA, 19 nt, Homo sapiens
gaaagcaccuagcucauag

SEQ ID NO: 269377 - RNA, 19 nt, Homo sapiens
gcaaagcaguagccaaaga

SEQ ID NO: 269378 - RNA, 19 nt, Homo sapiens
caaauguaguccuaaauug

SEQ ID NO: 269379 - RNA, 19 nt, Homo sapiens
caacaagucuagaauucuu

SEQ ID NO: 269380 - RNA, 19 nt, Homo sapiens
ggccauagguuuaaugaug

SEQ ID NO: 269381 - RNA, 19 nt, Homo sapiens
guaauuacauaguccaaga

SEQ ID NO: 269382 - RNA, 19 nt, Homo sapiens
gcauuucucucuuaacguu

SEQ ID NO: 269383 - RNA, 19 nt, Homo sapiens
ccauaguucucaguuauua

SEQ ID NO: 269384 - RNA, 19 nt, Homo sapiens
gaacaucucaccaaucuag

SEQ ID NO: 269385 - RNA, 19 nt, Homo sapiens
gcgaguggcuguaagaaau

SEQ ID NO: 269386 - RNA, 19 nt, Homo sapiens
gaggaaguauuacaaagug

SEQ ID NO: 269387 - RNA, 19 nt, Homo sapiens
aaacuguucugaagcuuaa

SEQ ID NO: 269388 - RNA, 19 nt, Homo sapiens
gagauaaaguuguauacuc

SEQ ID NO: 269389 - RNA, 19 nt, Homo sapiens
agacgaaggucauuuagug

SEQ ID NO: 269390 - RNA, 19 nt, Homo sapiens
ugaaggaaguguggaagua

SEQ ID NO: 269391 - RNA, 19 nt, Homo sapiens
aaagagagcccaaaccauu

SEQ ID NO: 269392 - RNA, 19 nt, Homo sapiens
gaagagaagagcaagaaga

SEQ ID NO: 269393 - RNA, 19 nt, Homo sapiens
gauaaucugaguacaauga

SEQ ID NO: 269394 - RNA, 19 nt, Homo sapiens
gcuguaacguugagaaaug

SEQ ID NO: 269395 - RNA, 19 nt, Homo sapiens
ucuagaagcuccuauguuc

SEQ ID NO: 269396 - RNA, 19 nt, Homo sapiens
gcuaugagccucuguaauc

SEQ ID NO: 269397 - RNA, 19 nt, Homo sapiens
ggaaggaggcuggaauaaa

SEQ ID NO: 269398 - RNA, 19 nt, Homo sapiens
aaugaugucuuggaaguua

SEQ ID NO: 269399 - RNA, 19 nt, Homo sapiens
gacgauuacuucacaaaga

SEQ ID NO: 269400 - RNA, 19 nt, Homo sapiens
guacugcaaucuuguaagu

SEQ ID NO: 269401 - RNA, 19 nt, Homo sapiens
gagaaaccguugcuagcuu

SEQ ID NO: 269402 - RNA, 19 nt, Homo sapiens
aagcagcauuucucucuua

SEQ ID NO: 269403 - RNA, 19 nt, Homo sapiens
ccaaucaagucguuguaaa

SEQ ID NO: 269404 - RNA, 19 nt, Homo sapiens
gaaguuaagaggaaguauu

SEQ ID NO: 269405 - RNA, 19 nt, Homo sapiens
gauggcagcuguaaugucu

SEQ ID NO: 269406 - RNA, 19 nt, Homo sapiens
agaaugcuauuaagccuaa

SEQ ID NO: 269407 - RNA, 19 nt, Homo sapiens
cagcuacuuugcacuuaua

SEQ ID NO: 269408 - RNA, 19 nt, Homo sapiens
caacguccauucuuucaca

SEQ ID NO: 269409 - RNA, 19 nt, Homo sapiens
cauuauagcugagaagaga

SEQ ID NO: 269410 - RNA, 19 nt, Homo sapiens
gaacaugagauaaaguugu

SEQ ID NO: 269411 - RNA, 19 nt, Homo sapiens
cgauuugaaugcacaguaa

SEQ ID NO: 269412 - RNA, 19 nt, Homo sapiens
ccaaauguaguccuaaauu

SEQ ID NO: 269413 - RNA, 19 nt, Homo sapiens
gauauuuggcucugucuuu

SEQ ID NO: 269414 - RNA, 19 nt, Homo sapiens
ggaaauccuuuggccuauu

SEQ ID NO: 269415 - RNA, 19 nt, Homo sapiens
cccagugaguuacuuaaua

SEQ ID NO: 269416 - RNA, 19 nt, Homo sapiens
caaguaagacagcauaaau

SEQ ID NO: 269417 - RNA, 19 nt, Homo sapiens
gggaaacaccuuaucagaa

SEQ ID NO: 269418 - RNA, 19 nt, Homo sapiens
gcgagacgaaggucauuua

SEQ ID NO: 269419 - RNA, 19 nt, Homo sapiens
gaaauucucuggggccaua

SEQ ID NO: 269420 - RNA, 19 nt, Homo sapiens
gcucauagccuuucaucau

SEQ ID NO: 269421 - RNA, 19 nt, Homo sapiens
uauauucucucgugguuga

SEQ ID NO: 269422 - RNA, 19 nt, Homo sapiens
ucacuagguuugccacuug

SEQ ID NO: 269423 - RNA, 19 nt, Homo sapiens
gaaauguaacugugaaauc

SEQ ID NO: 269424 - RNA, 19 nt, Homo sapiens
caucauggcgaucuauuaa

SEQ ID NO: 269425 - RNA, 19 nt, Homo sapiens
gagaagagaagagcaagaa

SEQ ID NO: 269426 - RNA, 19 nt, Homo sapiens
ucaaaugcuuguacucaga

SEQ ID NO: 269427 - RNA, 19 nt, Homo sapiens
guaaguggauaaucugagu

SEQ ID NO: 269428 - RNA, 19 nt, Homo sapiens
ugaaagcaccuagcucaua

SEQ ID NO: 269429 - RNA, 19 nt, Homo sapiens
aaacuuggaacaaccauuu

SEQ ID NO: 269430 - RNA, 19 nt, Homo sapiens
gagagugaauaaagaaugg

SEQ ID NO: 269431 - RNA, 19 nt, Homo sapiens
gcuguaaugucuacuucaa

SEQ ID NO: 269432 - RNA, 19 nt, Homo sapiens
gaaauagcaacaagucuag

SEQ ID NO: 269433 - RNA, 19 nt, Homo sapiens
aaacccaaaccaagaaaua

SEQ ID NO: 269434 - RNA, 19 nt, Homo sapiens
uguguugccucucacuuua

SEQ ID NO: 269435 - RNA, 19 nt, Homo sapiens
gcuuguaucuucaguugga

SEQ ID NO: 269436 - RNA, 19 nt, Homo sapiens
gauauuaggaacauucaga

SEQ ID NO: 269437 - RNA, 19 nt, Homo sapiens
ugagaaauguaacugugaa

SEQ ID NO: 269438 - RNA, 19 nt, Homo sapiens
aaagauggcagcuguaaug

SEQ ID NO: 269439 - RNA, 19 nt, Homo sapiens
gcuaucauauuaucaaugc

SEQ ID NO: 269440 - RNA, 19 nt, Homo sapiens
cagcagcuaucauauuauc

SEQ ID NO: 269441 - RNA, 19 nt, Homo sapiens
gauguuugccuugucaaua

SEQ ID NO: 269442 - RNA, 19 nt, Homo sapiens
gcacguaugcaaucuuuua

SEQ ID NO: 269443 - RNA, 19 nt, Homo sapiens
acacaugaauauagggaaa

SEQ ID NO: 269444 - RNA, 19 nt, Homo sapiens
ucauggcgaucuauuaaau

SEQ ID NO: 269445 - RNA, 19 nt, Homo sapiens
gagccucuguaaucaaaug

SEQ ID NO: 269446 - RNA, 19 nt, Homo sapiens
uuagaguacugcaaucuug

SEQ ID NO: 269447 - RNA, 19 nt, Homo sapiens
gggagggagauauuuauuu

SEQ ID NO: 269448 - RNA, 19 nt, Homo sapiens
ggcuaccacugaaucauuu

SEQ ID NO: 269449 - RNA, 19 nt, Homo sapiens
gaauauagggaaacaccuu

SEQ ID NO: 269450 - RNA, 19 nt, Homo sapiens
caaguggcgccauauguuu

SEQ ID NO: 269451 - RNA, 19 nt, Homo sapiens
cagcaaagaaugagcuauu

SEQ ID NO: 269452 - RNA, 19 nt, Homo sapiens
gcacuggcaauaaguaugu

SEQ ID NO: 269453 - RNA, 19 nt, Homo sapiens
caacaaauggagaccagaa

SEQ ID NO: 269454 - RNA, 19 nt, Homo sapiens
aaggaaguguggaaguaua

SEQ ID NO: 269455 - RNA, 19 nt, Homo sapiens
agaaauagcaacaagucua

SEQ ID NO: 269456 - RNA, 19 nt, Homo sapiens
auucuuaacugcuguguug

SEQ ID NO: 269457 - RNA, 19 nt, Homo sapiens
gauccuccaguccaucuua

SEQ ID NO: 269458 - RNA, 19 nt, Homo sapiens
gcagcuaucauauuaucaa

SEQ ID NO: 269459 - RNA, 19 nt, Homo sapiens
agcaaagaaugagcuauua

SEQ ID NO: 269460 - RNA, 19 nt, Homo sapiens
gcaucagugucccgugaaa

SEQ ID NO: 269461 - RNA, 19 nt, Homo sapiens
acacacaagugaaugaagu

SEQ ID NO: 269462 - RNA, 19 nt, Homo sapiens
gcaguuauguaugcuucuu

SEQ ID NO: 269463 - RNA, 19 nt, Homo sapiens
cagaagcaguuauguaugc

SEQ ID NO: 269464 - RNA, 19 nt, Homo sapiens
ggaaguauuacaaagugaa

SEQ ID NO: 269465 - RNA, 19 nt, Homo sapiens
uuaaugaugucuuggaagu

SEQ ID NO: 269466 - RNA, 19 nt, Homo sapiens
ggaaacaccuuaucagaaa

SEQ ID NO: 269467 - RNA, 19 nt, Homo sapiens
gaaaucagcucaccaguuc

SEQ ID NO: 269468 - RNA, 19 nt, Homo sapiens
gaaggaggcuggaauaaau

SEQ ID NO: 269469 - RNA, 19 nt, Homo sapiens
gaaauccuuuggccuauua

SEQ ID NO: 269470 - RNA, 19 nt, Homo sapiens
gcaccuagcucauagauuc

SEQ ID NO: 269471 - RNA, 19 nt, Homo sapiens
ggcagcagcuaucauauua

SEQ ID NO: 269472 - RNA, 19 nt, Homo sapiens
ggagggagauauuuauuug

SEQ ID NO: 269473 - RNA, 19 nt, Homo sapiens
caucuuaaguugcaucaua

SEQ ID NO: 269474 - RNA, 19 nt, Homo sapiens
ggaugacgauggcauuuaa

SEQ ID NO: 269475 - RNA, 19 nt, Homo sapiens
ccagugaguuacuuaauaa

SEQ ID NO: 269476 - RNA, 19 nt, Homo sapiens
gaaagcaccuagcucauag

SEQ ID NO: 269477 - RNA, 19 nt, Homo sapiens
gcaaagcaguagccaaaga

SEQ ID NO: 269478 - RNA, 19 nt, Homo sapiens
caaauguaguccuaaauug

SEQ ID NO: 269479 - RNA, 19 nt, Homo sapiens
caacaagucuagaauucuu

SEQ ID NO: 269480 - RNA, 19 nt, Homo sapiens
ggccauagguuuaaugaug

SEQ ID NO: 269481 - RNA, 19 nt, Homo sapiens
guaauuacauaguccaaga

SEQ ID NO: 269482 - RNA, 19 nt, Homo sapiens
gcauuucucucuuaacguu

SEQ ID NO: 269483 - RNA, 19 nt, Homo sapiens
ccauaguucucaguuauua

SEQ ID NO: 269484 - RNA, 19 nt, Homo sapiens
gaacaucucaccaaucuag

SEQ ID NO: 269485 - RNA, 19 nt, Homo sapiens
gcgaguggcuguaagaaau

SEQ ID NO: 269486 - RNA, 19 nt, Homo sapiens
gaggaaguauuacaaagug

SEQ ID NO: 269487 - RNA, 19 nt, Homo sapiens
aaacuguucugaagcuuaa

SEQ ID NO: 269488 - RNA, 19 nt, Homo sapiens
gagauaaaguuguauacuc

SEQ ID NO: 269489 - RNA, 19 nt, Homo sapiens
agacgaaggucauuuagug

SEQ ID NO: 269490 - RNA, 19 nt, Homo sapiens
ugaaggaaguguggaagua

SEQ ID NO: 269491 - RNA, 19 nt, Homo sapiens
aaagagagcccaaaccauu

SEQ ID NO: 269492 - RNA, 19 nt, Homo sapiens
gaagagaagagcaagaaga

SEQ ID NO: 269493 - RNA, 19 nt, Homo sapiens
gauaaucugaguacaauga

SEQ ID NO: 269494 - RNA, 19 nt, Homo sapiens
gcuguaacguugagaaaug

SEQ ID NO: 269495 - RNA, 19 nt, Homo sapiens
ucuagaagcuccuauguuc

SEQ ID NO: 269496 - RNA, 19 nt, Homo sapiens
gcuaugagccucuguaauc

SEQ ID NO: 269497 - RNA, 19 nt, Homo sapiens
ggaaggaggcuggaauaaa

SEQ ID NO: 269498 - RNA, 19 nt, Homo sapiens
aaugaugucuuggaaguua

SEQ ID NO: 269499 - RNA, 19 nt, Homo sapiens
gacgauuacuucacaaaga

SEQ ID NO: 269500 - RNA, 19 nt, Homo sapiens
guacugcaaucuuguaagu

SEQ ID NO: 269501 - RNA, 19 nt, Homo sapiens
gagaaaccguugcuagcuu

SEQ ID NO: 269502 - RNA, 19 nt, Homo sapiens
aagcagcauuucucucuua

SEQ ID NO: 269503 - RNA, 19 nt, Homo sapiens
ccaaucaagucguuguaaa

SEQ ID NO: 269504 - RNA, 19 nt, Homo sapiens
gaaguuaagaggaaguauu

SEQ ID NO: 269505 - RNA, 19 nt, Homo sapiens
gauggcagcuguaaugucu

SEQ ID NO: 269506 - RNA, 19 nt, Homo sapiens
agaaugcuauuaagccuaa

SEQ ID NO: 269507 - RNA, 19 nt, Homo sapiens
cagcuacuuugcacuuaua

SEQ ID NO: 269508 - RNA, 19 nt, Homo sapiens
caacguccauucuuucaca

SEQ ID NO: 269509 - RNA, 19 nt, Homo sapiens
cauuauagcugagaagaga

SEQ ID NO: 269510 - RNA, 19 nt, Homo sapiens
gaacaugagauaaaguugu

SEQ ID NO: 269511 - RNA, 19 nt, Homo sapiens
cgauuugaaugcacaguaa

SEQ ID NO: 269512 - RNA, 19 nt, Homo sapiens
ccaaauguaguccuaaauu

SEQ ID NO: 269513 - RNA, 19 nt, Homo sapiens
gauauuuggcucugucuuu

SEQ ID NO: 269514 - RNA, 19 nt, Homo sapiens
ggaaauccuuuggccuauu

SEQ ID NO: 269515 - RNA, 19 nt, Homo sapiens
cccagugaguuacuuaaua

SEQ ID NO: 269516 - RNA, 19 nt, Homo sapiens
caaguaagacagcauaaau

SEQ ID NO: 269517 - RNA, 19 nt, Homo sapiens
gggaaacaccuuaucagaa

SEQ ID NO: 269518 - RNA, 19 nt, Homo sapiens
gcgagacgaaggucauuua

SEQ ID NO: 269519 - RNA, 19 nt, Homo sapiens
gaaauucucuggggccaua

SEQ ID NO: 269520 - RNA, 19 nt, Homo sapiens
gcucauagccuuucaucau

SEQ ID NO: 269521 - RNA, 19 nt, Homo sapiens
uauauucucucgugguuga

SEQ ID NO: 269522 - RNA, 19 nt, Homo sapiens
ucacuagguuugccacuug

SEQ ID NO: 269523 - RNA, 19 nt, Homo sapiens
gaaauguaacugugaaauc

SEQ ID NO: 269524 - RNA, 19 nt, Homo sapiens
caucauggcgaucuauuaa

SEQ ID NO: 269525 - RNA, 19 nt, Homo sapiens
gagaagagaagagcaagaa

SEQ ID NO: 269526 - RNA, 19 nt, Homo sapiens
ucaaaugcuuguacucaga

SEQ ID NO: 269527 - RNA, 19 nt, Homo sapiens
guaaguggauaaucugagu

SEQ ID NO: 269528 - RNA, 19 nt, Homo sapiens
ugaaagcaccuagcucaua

SEQ ID NO: 269529 - RNA, 19 nt, Homo sapiens
aaacuuggaacaaccauuu

SEQ ID NO: 269530 - RNA, 19 nt, Homo sapiens
gagagugaauaaagaaugg

SEQ ID NO: 269531 - RNA, 19 nt, Homo sapiens
gcuguaaugucuacuucaa

SEQ ID NO: 269532 - RNA, 19 nt, Homo sapiens
gaaauagcaacaagucuag

SEQ ID NO: 269533 - RNA, 19 nt, Homo sapiens
aaacccaaaccaagaaaua

SEQ ID NO: 269534 - RNA, 19 nt, Homo sapiens
uguguugccucucacuuua

SEQ ID NO: 269535 - RNA, 19 nt, Homo sapiens
gcuuguaucuucaguugga

SEQ ID NO: 269536 - RNA, 19 nt, Homo sapiens
gauauuaggaacauucaga

SEQ ID NO: 269537 - RNA, 19 nt, Homo sapiens
ugagaaauguaacugugaa

SEQ ID NO: 269538 - RNA, 19 nt, Homo sapiens
aaagauggcagcuguaaug

SEQ ID NO: 269539 - RNA, 19 nt, Homo sapiens
gcuaucauauuaucaaugc

SEQ ID NO: 269540 - RNA, 19 nt, Homo sapiens
cagcagcuaucauauuauc

SEQ ID NO: 269541 - RNA, 19 nt, Homo sapiens
gauguuugccuugucaaua

SEQ ID NO: 269542 - RNA, 19 nt, Homo sapiens
gcacguaugcaaucuuuua

SEQ ID NO: 269543 - RNA, 19 nt, Homo sapiens
acacaugaauauagggaaa

SEQ ID NO: 269544 - RNA, 19 nt, Homo sapiens
ucauggcgaucuauuaaau

SEQ ID NO: 269545 - RNA, 19 nt, Homo sapiens
gagccucuguaaucaaaug

SEQ ID NO: 269546 - RNA, 19 nt, Homo sapiens
uuagaguacugcaaucuug

SEQ ID NO: 269547 - RNA, 19 nt, Homo sapiens
gggagggagauauuuauuu

SEQ ID NO: 269548 - RNA, 19 nt, Homo sapiens
ggcuaccacugaaucauuu

SEQ ID NO: 269549 - RNA, 19 nt, Homo sapiens
gaauauagggaaacaccuu

SEQ ID NO: 269550 - RNA, 19 nt, Homo sapiens
caaguggcgccauauguuu

SEQ ID NO: 269551 - RNA, 19 nt, Homo sapiens
cagcaaagaaugagcuauu

SEQ ID NO: 269552 - RNA, 19 nt, Homo sapiens
gcacuggcaauaaguaugu

SEQ ID NO: 269553 - RNA, 19 nt, Homo sapiens
caacaaauggagaccagaa

SEQ ID NO: 269554 - RNA, 19 nt, Homo sapiens
aaggaaguguggaaguaua

SEQ ID NO: 269555 - RNA, 19 nt, Homo sapiens
agaaauagcaacaagucua

SEQ ID NO: 269556 - RNA, 19 nt, Homo sapiens
auucuuaacugcuguguug

SEQ ID NO: 269557 - RNA, 19 nt, Homo sapiens
gauccuccaguccaucuua

SEQ ID NO: 269558 - RNA, 19 nt, Homo sapiens
gcagcuaucauauuaucaa

SEQ ID NO: 269559 - RNA, 19 nt, Homo sapiens
agcaaagaaugagcuauua

SEQ ID NO: 269560 - RNA, 19 nt, Homo sapiens
gcaucagugucccgugaaa

SEQ ID NO: 269561 - RNA, 19 nt, Homo sapiens
acacacaagugaaugaagu

SEQ ID NO: 269562 - RNA, 19 nt, Homo sapiens
gcaguuauguaugcuucuu

SEQ ID NO: 269563 - RNA, 19 nt, Homo sapiens
cagaagcaguuauguaugc

SEQ ID NO: 269564 - RNA, 19 nt, Homo sapiens
ggaaguauuacaaagugaa

SEQ ID NO: 269565 - RNA, 19 nt, Homo sapiens
uuaaugaugucuuggaagu

SEQ ID NO: 269566 - RNA, 19 nt, Homo sapiens
ggaaacaccuuaucagaaa

SEQ ID NO: 269567 - RNA, 19 nt, Homo sapiens
gaaaucagcucaccaguuc

SEQ ID NO: 269568 - RNA, 19 nt, Homo sapiens
gaaggaggcuggaauaaau

SEQ ID NO: 269569 - RNA, 19 nt, Homo sapiens
gaaauccuuuggccuauua

SEQ ID NO: 269570 - RNA, 19 nt, Homo sapiens
ggcagcagcuaucauauua

SEQ ID NO: 269571 - RNA, 19 nt, Homo sapiens
ggagggagauauuuauuug

SEQ ID NO: 269572 - RNA, 19 nt, Homo sapiens
caucuuaaguugcaucaua

SEQ ID NO: 269573 - RNA, 19 nt, Homo sapiens
ggaugacgauggcauuuaa

SEQ ID NO: 269574 - RNA, 19 nt, Homo sapiens
ccagugaguuacuuaauaa

SEQ ID NO: 269575 - RNA, 19 nt, Homo sapiens
gcaaagcaguagccaaaga

SEQ ID NO: 269576 - RNA, 19 nt, Homo sapiens
caaauguaguccuaaauug

SEQ ID NO: 269577 - RNA, 19 nt, Homo sapiens
caacaagucuagaauucuu

SEQ ID NO: 269578 - RNA, 19 nt, Homo sapiens
ggccauagguuuaaugaug

SEQ ID NO: 269579 - RNA, 19 nt, Homo sapiens
guaauuacauaguccaaga

SEQ ID NO: 269580 - RNA, 19 nt, Homo sapiens
gcauuucucucuuaacguu

SEQ ID NO: 269581 - RNA, 19 nt, Homo sapiens
ccauaguucucaguuauua

SEQ ID NO: 269582 - RNA, 19 nt, Homo sapiens
gaacaucucaccaaucuag

SEQ ID NO: 269583 - RNA, 19 nt, Homo sapiens
gcgaguggcuguaagaaau

SEQ ID NO: 269584 - RNA, 19 nt, Homo sapiens
gaggaaguauuacaaagug

SEQ ID NO: 269585 - RNA, 19 nt, Homo sapiens
aaacuguucugaagcuuaa

SEQ ID NO: 269586 - RNA, 19 nt, Homo sapiens
gagauaaaguuguauacuc

SEQ ID NO: 269587 - RNA, 19 nt, Homo sapiens
agacgaaggucauuuagug

SEQ ID NO: 269588 - RNA, 19 nt, Homo sapiens
ugaaggaaguguggaagua

SEQ ID NO: 269589 - RNA, 19 nt, Homo sapiens
aaagagagcccaaaccauu

SEQ ID NO: 269590 - RNA, 19 nt, Homo sapiens
gaagagaagagcaagaaga

SEQ ID NO: 269591 - RNA, 19 nt, Homo sapiens
gauaaucugaguacaauga

SEQ ID NO: 269592 - RNA, 19 nt, Homo sapiens
gcuguaacguugagaaaug

SEQ ID NO: 269593 - RNA, 19 nt, Homo sapiens
ucuagaagcuccuauguuc

SEQ ID NO: 269594 - RNA, 19 nt, Homo sapiens
gcuaugagccucuguaauc

SEQ ID NO: 269595 - RNA, 19 nt, Homo sapiens
ggaaggaggcuggaauaaa

SEQ ID NO: 269596 - RNA, 19 nt, Homo sapiens
aaugaugucuuggaaguua

SEQ ID NO: 269597 - RNA, 19 nt, Homo sapiens
gacgauuacuucacaaaga

SEQ ID NO: 269598 - RNA, 19 nt, Homo sapiens
gaucugcacuucaucaucu

SEQ ID NO: 269599 - RNA, 19 nt, Homo sapiens
guacugcaaucuuguaagu

SEQ ID NO: 269600 - RNA, 19 nt, Homo sapiens
gagaaaccguugcuagcuu

SEQ ID NO: 269601 - RNA, 19 nt, Homo sapiens
aagcagcauuucucucuua

SEQ ID NO: 269602 - RNA, 19 nt, Homo sapiens
ccaaucaagucguuguaaa

SEQ ID NO: 269603 - RNA, 19 nt, Homo sapiens
gaaguuaagaggaaguauu

SEQ ID NO: 269604 - RNA, 19 nt, Homo sapiens
gauggcagcuguaaugucu

SEQ ID NO: 269605 - RNA, 19 nt, Homo sapiens
agaaugcuauuaagccuaa

SEQ ID NO: 269606 - RNA, 19 nt, Homo sapiens
cagcuacuuugcacuuaua

SEQ ID NO: 269607 - RNA, 19 nt, Homo sapiens
caacguccauucuuucaca

SEQ ID NO: 269608 - RNA, 19 nt, Homo sapiens
cauuauagcugagaagaga

SEQ ID NO: 269609 - RNA, 19 nt, Homo sapiens
gaacaugagauaaaguugu

SEQ ID NO: 269610 - RNA, 19 nt, Homo sapiens
cgauuugaaugcacaguaa

SEQ ID NO: 269611 - RNA, 19 nt, Homo sapiens
ccaaauguaguccuaaauu

SEQ ID NO: 269612 - RNA, 19 nt, Homo sapiens
gauauuuggcucugucuuu

SEQ ID NO: 269613 - RNA, 19 nt, Homo sapiens
ggaaauccuuuggccuauu

SEQ ID NO: 269614 - RNA, 19 nt, Homo sapiens
cccagugaguuacuuaaua

SEQ ID NO: 269615 - RNA, 19 nt, Homo sapiens
caaguaagacagcauaaau

SEQ ID NO: 269616 - RNA, 19 nt, Homo sapiens
gggaaacaccuuaucagaa

SEQ ID NO: 269617 - RNA, 19 nt, Homo sapiens
gcgagacgaaggucauuua

SEQ ID NO: 269618 - RNA, 19 nt, Homo sapiens
gaaauucucuggggccaua

SEQ ID NO: 269619 - RNA, 19 nt, Homo sapiens
gcucauagccuuucaucau

SEQ ID NO: 269620 - RNA, 19 nt, Homo sapiens
uauauucucucgugguuga

SEQ ID NO: 269621 - RNA, 19 nt, Homo sapiens
ucacuagguuugccacuug

SEQ ID NO: 269622 - RNA, 19 nt, Homo sapiens
gaaauguaacugugaaauc

SEQ ID NO: 269623 - RNA, 19 nt, Homo sapiens
caucauggcgaucuauuaa

SEQ ID NO: 269624 - RNA, 19 nt, Homo sapiens
gagaagagaagagcaagaa

SEQ ID NO: 269625 - RNA, 19 nt, Homo sapiens
guucagaucugcacuucau

SEQ ID NO: 269626 - RNA, 19 nt, Homo sapiens
ucaaaugcuuguacucaga

SEQ ID NO: 269627 - RNA, 19 nt, Homo sapiens
guaaguggauaaucugagu

SEQ ID NO: 269628 - RNA, 19 nt, Homo sapiens
gaaaggcaaagaagagaga

SEQ ID NO: 269629 - RNA, 19 nt, Homo sapiens
aaacuuggaacaaccauuu

SEQ ID NO: 269630 - RNA, 19 nt, Homo sapiens
gcuguaaugucuacuucaa

SEQ ID NO: 269631 - RNA, 19 nt, Homo sapiens
gaaauagcaacaagucuag

SEQ ID NO: 269632 - RNA, 19 nt, Homo sapiens
aaacccaaaccaagaaaua

SEQ ID NO: 269633 - RNA, 19 nt, Homo sapiens
gcuuguaucuucaguugga

SEQ ID NO: 269634 - RNA, 19 nt, Homo sapiens
gauauuaggaacauucaga

SEQ ID NO: 269635 - RNA, 19 nt, Homo sapiens
ugagaaauguaacugugaa

SEQ ID NO: 269636 - RNA, 19 nt, Homo sapiens
aaagauggcagcuguaaug

SEQ ID NO: 269637 - RNA, 19 nt, Homo sapiens
gcuaucauauuaucaaugc

SEQ ID NO: 269638 - RNA, 19 nt, Homo sapiens
cagcagcuaucauauuauc

SEQ ID NO: 269639 - RNA, 19 nt, Homo sapiens
gauguuugccuugucaaua

SEQ ID NO: 269640 - RNA, 19 nt, Homo sapiens
gcacguaugcaaucuuuua

SEQ ID NO: 269641 - RNA, 19 nt, Homo sapiens
acacaugaauauagggaaa

SEQ ID NO: 269642 - RNA, 19 nt, Homo sapiens
ucauggcgaucuauuaaau

SEQ ID NO: 269643 - RNA, 19 nt, Homo sapiens
ucacuaagacauccacauu

SEQ ID NO: 269644 - RNA, 19 nt, Homo sapiens
gagccucuguaaucaaaug

SEQ ID NO: 269645 - RNA, 19 nt, Homo sapiens
uuagaguacugcaaucuug

SEQ ID NO: 269646 - RNA, 19 nt, Homo sapiens
gggagggagauauuuauuu

SEQ ID NO: 269647 - RNA, 19 nt, Homo sapiens
gcaaagaagagagagauuc

SEQ ID NO: 269648 - RNA, 19 nt, Homo sapiens
ggcuaccacugaaucauuu

SEQ ID NO: 269649 - RNA, 19 nt, Homo sapiens
gaauauagggaaacaccuu

SEQ ID NO: 269650 - RNA, 19 nt, Homo sapiens
caaguggcgccauauguuu

SEQ ID NO: 269651 - RNA, 19 nt, Homo sapiens
cagcaaagaaugagcuauu

SEQ ID NO: 269652 - RNA, 19 nt, Homo sapiens
gcacuggcaauaaguaugu

SEQ ID NO: 269653 - RNA, 19 nt, Homo sapiens
caacaaauggagaccagaa

SEQ ID NO: 269654 - RNA, 19 nt, Homo sapiens
aaggaaguguggaaguaua

SEQ ID NO: 269655 - RNA, 19 nt, Homo sapiens
agaaauagcaacaagucua

SEQ ID NO: 269656 - RNA, 19 nt, Homo sapiens
gauccuccaguccaucuua

SEQ ID NO: 269657 - RNA, 19 nt, Homo sapiens
gcagcuaucauauuaucaa

SEQ ID NO: 269658 - RNA, 19 nt, Homo sapiens
agcaaagaaugagcuauua

SEQ ID NO: 269659 - RNA, 19 nt, Homo sapiens
gcaucagugucccgugaaa

SEQ ID NO: 269660 - RNA, 19 nt, Homo sapiens
acacacaagugaaugaagu

SEQ ID NO: 269661 - RNA, 19 nt, Homo sapiens
gcaguuauguaugcuucuu

SEQ ID NO: 269662 - RNA, 19 nt, Homo sapiens
cagaagcaguuauguaugc

SEQ ID NO: 269663 - RNA, 19 nt, Homo sapiens
ggaaguauuacaaagugaa

SEQ ID NO: 269664 - RNA, 19 nt, Homo sapiens
uuaaugaugucuuggaagu

SEQ ID NO: 269665 - RNA, 19 nt, Homo sapiens
uggaacaucucaccaaucu

SEQ ID NO: 269666 - RNA, 19 nt, Homo sapiens
gaaaugagauguccaccua

SEQ ID NO: 269667 - RNA, 19 nt, Homo sapiens
ggaagaggcuuaaguaugu

SEQ ID NO: 269668 - RNA, 19 nt, Homo sapiens
cguaggauuuguugcauua

SEQ ID NO: 269669 - RNA, 19 nt, Homo sapiens
caaggaagaggcuuaagua

SEQ ID NO: 269670 - RNA, 19 nt, Homo sapiens
gguaaggccuucugcauca

SEQ ID NO: 269671 - RNA, 19 nt, Homo sapiens
gaucacguguuaccugcua

SEQ ID NO: 269672 - RNA, 19 nt, Homo sapiens
gcauuuagaucauuuagcu

SEQ ID NO: 269673 - RNA, 19 nt, Homo sapiens
caggaugucuaauauguga

SEQ ID NO: 269674 - RNA, 19 nt, Homo sapiens
agauugggaucacguguua

SEQ ID NO: 269675 - RNA, 19 nt, Homo sapiens
agaaauagcuacuguuugc

SEQ ID NO: 269676 - RNA, 19 nt, Homo sapiens
ccagcaggaugucuaauau

SEQ ID NO: 269677 - RNA, 19 nt, Homo sapiens
cgguggagcugcccuauga

SEQ ID NO: 269678 - RNA, 19 nt, Homo sapiens
augcauagguaaccauuaa

SEQ ID NO: 269679 - RNA, 19 nt, Homo sapiens
gcaggccgguccucuacuu

SEQ ID NO: 269680 - RNA, 19 nt, Homo sapiens
gguaaccauuaacuaugua

SEQ ID NO: 269681 - RNA, 19 nt, Homo sapiens
gaagaggcuuaaguauguu

SEQ ID NO: 269682 - RNA, 19 nt, Homo sapiens
ucuaauaugugaggaaaug

SEQ ID NO: 269683 - RNA, 19 nt, Homo sapiens
aaugagauguccaccuaaa

SEQ ID NO: 269684 - RNA, 19 nt, Homo sapiens
gcaaggaagaggcuuaagu

SEQ ID NO: 269685 - RNA, 19 nt, Homo sapiens
gaaagaggaccagaagcaa

SEQ ID NO: 269686 - RNA, 19 nt, Homo sapiens
gcauagagauguguuuuau

SEQ ID NO: 269687 - RNA, 19 nt, Homo sapiens
cauaggaggagaauacuug

SEQ ID NO: 269688 - RNA, 19 nt, Homo sapiens
acuaaagaauccagaguug

SEQ ID NO: 269689 - RNA, 19 nt, Homo sapiens
auccagaguugcuacaaua

SEQ ID NO: 269690 - RNA, 19 nt, Homo sapiens
guucugaaacuaagacuau

SEQ ID NO: 269691 - RNA, 19 nt, Homo sapiens
caucaucuacuccgucauu

SEQ ID NO: 269692 - RNA, 19 nt, Homo sapiens
ggccuuggcuuuggcuuug

SEQ ID NO: 269693 - RNA, 19 nt, Homo sapiens
ugaaagaggaccagaagca

SEQ ID NO: 269694 - RNA, 19 nt, Homo sapiens
ggggaaggcuacaaucaaa

SEQ ID NO: 269695 - RNA, 19 nt, Homo sapiens
uuacauaggaggagaauac

SEQ ID NO: 269696 - RNA, 19 nt, Homo sapiens
cauagagcaugaccaacug

SEQ ID NO: 269697 - RNA, 19 nt, Homo sapiens
ccagaguugcuacaauaaa

SEQ ID NO: 269698 - RNA, 19 nt, Homo sapiens
ugucuaauaugugaggaaa

SEQ ID NO: 269699 - RNA, 19 nt, Homo sapiens
gcguaggauuuguugcauu

SEQ ID NO: 269700 - RNA, 19 nt, Homo sapiens
gagcguaggauuuguugca

SEQ ID NO: 269701 - RNA, 19 nt, Homo sapiens
aaagaggaccagaagcaaa

SEQ ID NO: 269702 - RNA, 19 nt, Homo sapiens
gaucaggugcacaucauag

SEQ ID NO: 269703 - RNA, 19 nt, Homo sapiens
cagaguugcuacaauaaaa

SEQ ID NO: 269704 - RNA, 19 nt, Homo sapiens
gcaugaaagaggaccagaa

SEQ ID NO: 269705 - RNA, 19 nt, Homo sapiens
gucaccagauccuagugua

SEQ ID NO: 269706 - RNA, 19 nt, Homo sapiens
uaggauuuguugcauuaug

SEQ ID NO: 269707 - RNA, 19 nt, Homo sapiens
ugaacuccaugagcugaaa

SEQ ID NO: 269708 - RNA, 19 nt, Homo sapiens
gggaauaauaaacuugaga

SEQ ID NO: 269709 - RNA, 19 nt, Homo sapiens
cauagguaaccauuaacua

SEQ ID NO: 269710 - RNA, 19 nt, Homo sapiens
aaaauuaucucgaccuuac

SEQ ID NO: 269711 - RNA, 19 nt, Homo sapiens
agcaggaugucuaauaugu

SEQ ID NO: 269712 - RNA, 19 nt, Homo sapiens
uagcuacuguuugcaaugu

SEQ ID NO: 269713 - RNA, 19 nt, Homo sapiens
gagaaucuaagucaaacuc

SEQ ID NO: 269714 - RNA, 19 nt, Homo sapiens
ccauugagcguaggauuug

SEQ ID NO: 269715 - RNA, 19 nt, Homo sapiens
ggaucaggugcacaucaua

SEQ ID NO: 269716 - RNA, 19 nt, Homo sapiens
gagguaaggccuucugcau

SEQ ID NO: 269717 - RNA, 19 nt, Homo sapiens
cccagcaggaugucuaaua

SEQ ID NO: 269718 - RNA, 19 nt, Homo sapiens
gauccuaguguaguucuga

SEQ ID NO: 269719 - RNA, 19 nt, Homo sapiens
ggugcaaggaagaggcuua

SEQ ID NO: 269720 - RNA, 19 nt, Homo sapiens
gaaggacaaggacgaggau

SEQ ID NO: 269721 - RNA, 19 nt, Homo sapiens
cuggaaaccuucugugaac

SEQ ID NO: 269722 - RNA, 19 nt, Homo sapiens
gaggaucaggugcacauca

SEQ ID NO: 269723 - RNA, 19 nt, Homo sapiens
uaaagaauccagaguugcu

SEQ ID NO: 269724 - RNA, 19 nt, Homo sapiens
gaggagaauacuugaagca

SEQ ID NO: 269725 - RNA, 19 nt, Homo sapiens
ggcuuaaguauguucauuu

SEQ ID NO: 269726 - RNA, 19 nt, Homo sapiens
aggaagaggcuuaaguaug

SEQ ID NO: 269727 - RNA, 19 nt, Homo sapiens
ggucagggugcaaggaaga

SEQ ID NO: 269728 - RNA, 19 nt, Homo sapiens
caacuggaacugggacuuc

SEQ ID NO: 269729 - RNA, 19 nt, Homo sapiens
guuuauguguacugguuug

SEQ ID NO: 269730 - RNA, 19 nt, Homo sapiens
gcaggaugucuaauaugug

SEQ ID NO: 269731 - RNA, 19 nt, Homo sapiens
caugaaagaggaccagaag

SEQ ID NO: 269732 - RNA, 19 nt, Homo sapiens
agguaaccauuaacuaugu

SEQ ID NO: 269733 - RNA, 19 nt, Homo sapiens
gguuugcauuuagaucauu

SEQ ID NO: 269734 - RNA, 19 nt, Homo sapiens
ggaaaccuucugugaacuc

SEQ ID NO: 269735 - RNA, 19 nt, Homo sapiens
uagguaaccauuaacuaug

SEQ ID NO: 269736 - RNA, 19 nt, Homo sapiens
gcauagguaaccauuaacu

SEQ ID NO: 269737 - RNA, 19 nt, Homo sapiens
guaugcugcugugguuaga

SEQ ID NO: 269738 - RNA, 19 nt, Homo sapiens
gcgaaaauuaugucacuuu

SEQ ID NO: 269739 - RNA, 19 nt, Homo sapiens
aggcuuaaguauguucauu

SEQ ID NO: 269740 - RNA, 19 nt, Homo sapiens
ccugcuacuuggccuuauu

SEQ ID NO: 269741 - RNA, 19 nt, Homo sapiens
aauccagaguugcuacaau

SEQ ID NO: 269742 - RNA, 19 nt, Homo sapiens
cuaagucaaacucacuauu

SEQ ID NO: 269743 - RNA, 19 nt, Homo sapiens
gcuacuguuugcaaugucu

SEQ ID NO: 269744 - RNA, 19 nt, Homo sapiens
aaauagcuacuguuugcaa

SEQ ID NO: 269745 - RNA, 19 nt, Homo sapiens
ggacaaggacgaggaucag

SEQ ID NO: 269746 - RNA, 19 nt, Homo sapiens
gugcaaggaagaggcuuaa

SEQ ID NO: 269747 - RNA, 19 nt, Homo sapiens
ggaggaugacuggaacuuc

SEQ ID NO: 269748 - RNA, 19 nt, Homo sapiens
agguuuauguguacugguu

SEQ ID NO: 269749 - RNA, 19 nt, Homo sapiens
ggguuugcauuuagaucau

SEQ ID NO: 269750 - RNA, 19 nt, Homo sapiens
gcaaaagcgaaaauuaugu

SEQ ID NO: 269751 - RNA, 19 nt, Homo sapiens
ccuggaauccuuuuauuuu

SEQ ID NO: 269752 - RNA, 19 nt, Homo sapiens
gaauccagaguugcuacaa

SEQ ID NO: 269753 - RNA, 19 nt, Homo sapiens
ucuggaaaccuucugugaa

SEQ ID NO: 269754 - RNA, 19 nt, Homo sapiens
aauagcuacuguuugcaau

SEQ ID NO: 269755 - RNA, 19 nt, Homo sapiens
gagauguccaccuaaaauu

SEQ ID NO: 269756 - RNA, 19 nt, Homo sapiens
cagcaggaugucuaauaug

SEQ ID NO: 269757 - RNA, 19 nt, Homo sapiens
ggaaacaccuccaaucaaa

SEQ ID NO: 269758 - RNA, 19 nt, Homo sapiens
ucaaauagcccucucuuua

SEQ ID NO: 269759 - RNA, 19 nt, Homo sapiens
gcaaauaguggcagcaaua

SEQ ID NO: 269760 - RNA, 19 nt, Homo sapiens
gagaguaucuaucugaaug

SEQ ID NO: 269761 - RNA, 19 nt, Homo sapiens
gaaccucucuagcuaaugu

SEQ ID NO: 269762 - RNA, 19 nt, Homo sapiens
caaauagcccucucuuuaa

SEQ ID NO: 269763 - RNA, 19 nt, Homo sapiens
ggacuucucuaugcucuuu

SEQ ID NO: 269764 - RNA, 19 nt, Homo sapiens
gcucaccucugcagucuuu

SEQ ID NO: 269765 - RNA, 19 nt, Homo sapiens
uaaauaaccuuaggcauag

SEQ ID NO: 269766 - RNA, 19 nt, Homo sapiens
guaucuaucugaaugguuu

SEQ ID NO: 269767 - RNA, 19 nt, Homo sapiens
caacauuccugugucaauu

SEQ ID NO: 269768 - RNA, 19 nt, Homo sapiens
gcagguggauccgauauug

SEQ ID NO: 269769 - RNA, 19 nt, Homo sapiens
gagagugacacgaccauua

SEQ ID NO: 269770 - RNA, 19 nt, Homo sapiens
aaauagcccucucuuuaaa

SEQ ID NO: 269771 - RNA, 19 nt, Homo sapiens
ggagcagccucaugagauu

SEQ ID NO: 269772 - RNA, 19 nt, Homo sapiens
ggagauuuaugacaaguuc

SEQ ID NO: 269773 - RNA, 19 nt, Homo sapiens
gacacgaccauuaauguua

SEQ ID NO: 269774 - RNA, 19 nt, Homo sapiens
gaaacaguguguaaaauga

SEQ ID NO: 269775 - RNA, 19 nt, Homo sapiens
uaccauaccuugcuggaaa

SEQ ID NO: 269776 - RNA, 19 nt, Homo sapiens
ggaggacccugucagugaa

SEQ ID NO: 269777 - RNA, 19 nt, Homo sapiens
cggcagaacuggcuggaaa

SEQ ID NO: 269778 - RNA, 19 nt, Homo sapiens
gcccgaagaugaaauagau

SEQ ID NO: 269779 - RNA, 19 nt, Homo sapiens
ccauaaggccucagaauga

SEQ ID NO: 269780 - RNA, 19 nt, Homo sapiens
uugaauaucuggacuucua

SEQ ID NO: 269781 - RNA, 19 nt, Homo sapiens
gcaauaaaugcagggauua

SEQ ID NO: 269782 - RNA, 19 nt, Homo sapiens
cgacggagcuggaugaacu

SEQ ID NO: 269783 - RNA, 19 nt, Homo sapiens
gacugaguguggagauuua

SEQ ID NO: 269784 - RNA, 19 nt, Homo sapiens
gaaaaggaauugccaaagu

SEQ ID NO: 269785 - RNA, 19 nt, Homo sapiens
caaaguggaagauacguuu

SEQ ID NO: 269786 - RNA, 19 nt, Homo sapiens
uaaaaugacugaagugaug

SEQ ID NO: 269787 - RNA, 19 nt, Homo sapiens
gugaagagauugcugugau

SEQ ID NO: 269788 - RNA, 19 nt, Homo sapiens
uaacugagccuagauaugg

SEQ ID NO: 269789 - RNA, 19 nt, Homo sapiens
cauaaggccucagaaugaa

SEQ ID NO: 269790 - RNA, 19 nt, Homo sapiens
ggucaucuaucaucaagag

SEQ ID NO: 269791 - RNA, 19 nt, Homo sapiens
cgucacagccgaauucaaa

SEQ ID NO: 269792 - RNA, 19 nt, Homo sapiens
gaugaugcccgaagaugaa

SEQ ID NO: 269793 - RNA, 19 nt, Homo sapiens
caucaucucaacaaucaua

SEQ ID NO: 269794 - RNA, 19 nt, Homo sapiens
ugaagagauugcugugauu

SEQ ID NO: 269795 - RNA, 19 nt, Homo sapiens
gaaaccaggaggcgacuga

SEQ ID NO: 269796 - RNA, 19 nt, Homo sapiens
ucacagaggaccaccauug

SEQ ID NO: 269797 - RNA, 19 nt, Homo sapiens
aacagaaccucucuagcua

SEQ ID NO: 269798 - RNA, 19 nt, Homo sapiens
ggugaggacuucucuaugc

SEQ ID NO: 269799 - RNA, 19 nt, Homo sapiens
gaauaucuggacuucuaua

SEQ ID NO: 269800 - RNA, 19 nt, Homo sapiens
gcgaucauauucaaacaca

SEQ ID NO: 269801 - RNA, 19 nt, Homo sapiens
gaacgguccacuuucuuug

SEQ ID NO: 269802 - RNA, 19 nt, Homo sapiens
caacgucacagccgaauuc

SEQ ID NO: 269803 - RNA, 19 nt, Homo sapiens
gagcaugauuggagauugg

SEQ ID NO: 269804 - RNA, 19 nt, Homo sapiens
uaacaacuauuggauuugg

SEQ ID NO: 269805 - RNA, 19 nt, Homo sapiens
gaacucauucagcaaauag

SEQ ID NO: 269806 - RNA, 19 nt, Homo sapiens
gaagagauugcugugauug

SEQ ID NO: 269807 - RNA, 19 nt, Homo sapiens
caaauaguggcagcaauaa

SEQ ID NO: 269808 - RNA, 19 nt, Homo sapiens
gaaauagaugccaaauuag

SEQ ID NO: 269809 - RNA, 19 nt, Homo sapiens
acacgaccauuaauguuau

SEQ ID NO: 269810 - RNA, 19 nt, Homo sapiens
gcacuguuauuacaaccau

SEQ ID NO: 269811 - RNA, 19 nt, Homo sapiens
gggauuauaccguuaggaa

SEQ ID NO: 269812 - RNA, 19 nt, Homo sapiens
cagaaccucucuagcuaau

SEQ ID NO: 269813 - RNA, 19 nt, Homo sapiens
auagcccucucuuuaaaua

SEQ ID NO: 269814 - RNA, 19 nt, Homo sapiens
gagauuggcuccgagugau

SEQ ID NO: 269815 - RNA, 19 nt, Homo sapiens
cgcaucaucucaacaauca

SEQ ID NO: 269816 - RNA, 19 nt, Homo sapiens
aagaagaggugggagaguu

SEQ ID NO: 269817 - RNA, 19 nt, Homo sapiens
uaucaucuaugccuuacug

SEQ ID NO: 269818 - RNA, 19 nt, Homo sapiens
cauaggauuuggaaacauc

SEQ ID NO: 269819 - RNA, 19 nt, Homo sapiens
aaacagaaccucucuagcu

SEQ ID NO: 269820 - RNA, 19 nt, Homo sapiens
gucagugccuuaucuuaug

SEQ ID NO: 269821 - RNA, 19 nt, Homo sapiens
uuugagggaucaguucuua

SEQ ID NO: 269822 - RNA, 19 nt, Homo sapiens
cagaaugaaugagaauugu

SEQ ID NO: 269823 - RNA, 19 nt, Homo sapiens
gguccacuuucuuugauga

SEQ ID NO: 269824 - RNA, 19 nt, Homo sapiens
gcacuuucuuucugaugau

SEQ ID NO: 269825 - RNA, 19 nt, Homo sapiens
gaucagcuaggcaccauau

SEQ ID NO: 269826 - RNA, 19 nt, Homo sapiens
ggcaaaauauucuguauca

SEQ ID NO: 269827 - RNA, 19 nt, Homo sapiens
agcaaugucugaugccuuu

SEQ ID NO: 269828 - RNA, 19 nt, Homo sapiens
guggaagauacguuuauua

SEQ ID NO: 269829 - RNA, 19 nt, Homo sapiens
cagcuaggcaccauauuug

SEQ ID NO: 269830 - RNA, 19 nt, Homo sapiens
cagaggaccaccauuguga

SEQ ID NO: 269831 - RNA, 19 nt, Homo sapiens
gaagaaacagaaccucucu

SEQ ID NO: 269832 - RNA, 19 nt, Homo sapiens
guguggagauuuaugacaa

SEQ ID NO: 269833 - RNA, 19 nt, Homo sapiens
uauacuauuuggcugugua

SEQ ID NO: 269834 - RNA, 19 nt, Homo sapiens
gaccaagauucgcaucauc

SEQ ID NO: 269835 - RNA, 19 nt, Homo sapiens
ucagcuaggcaccauauuu

SEQ ID NO: 269836 - RNA, 19 nt, Homo sapiens
gaaacaccuccaaucaaau

SEQ ID NO: 269837 - RNA, 19 nt, Homo sapiens
ucagugccuuaucuuauga

SEQ ID NO: 269838 - RNA, 19 nt, Homo sapiens
gccagcacuuucuuucuga

SEQ ID NO: 269839 - RNA, 19 nt, Homo sapiens
agagugacacgaccauuaa

SEQ ID NO: 269840 - RNA, 19 nt, Homo sapiens
ucucuuggcuggaguugga

SEQ ID NO: 269841 - RNA, 19 nt, Homo sapiens
gaauuccccucuuugguuu

SEQ ID NO: 269842 - RNA, 19 nt, Homo sapiens
ggaagauacguuuauuaag

SEQ ID NO: 269843 - RNA, 19 nt, Homo sapiens
gaagcaaacauucauaucc

SEQ ID NO: 269844 - RNA, 19 nt, Homo sapiens
ccagaagcaaacauucaua

SEQ ID NO: 269845 - RNA, 19 nt, Homo sapiens
gaugcccgaagaugaaaua

SEQ ID NO: 269846 - RNA, 19 nt, Homo sapiens
ucagaaugaaugagaauug

SEQ ID NO: 269847 - RNA, 19 nt, Homo sapiens
gccauaaggccucagaaug

SEQ ID NO: 269848 - RNA, 19 nt, Homo sapiens
ggauuauaccguuaggaaa

SEQ ID NO: 269849 - RNA, 19 nt, Homo sapiens
acauucauaucccaacauu

SEQ ID NO: 269850 - RNA, 19 nt, Homo sapiens
ccaguucucccauuugaau

SEQ ID NO: 269851 - RNA, 19 nt, Homo sapiens
guaacaauguagcuuugag

SEQ ID NO: 269852 - RNA, 19 nt, Homo sapiens
caucuaucaucaagagaau

SEQ ID NO: 269853 - RNA, 19 nt, Homo sapiens
uaucuggacuucuauaagc

SEQ ID NO: 269854 - RNA, 19 nt, Homo sapiens
agcaauaaaugcagggauu

SEQ ID NO: 269855 - RNA, 19 nt, Homo sapiens
caucggagccaccguguuc

SEQ ID NO: 269856 - RNA, 19 nt, Homo sapiens
ugaguggaaugacaagcaa

SEQ ID NO: 269857 - RNA, 19 nt, Homo sapiens
caacaucccucaccacucu

SEQ ID NO: 269858 - RNA, 19 nt, Homo sapiens
gauaauuacccacucuuaa

SEQ ID NO: 269859 - RNA, 19 nt, Homo sapiens
ccagaaagcaggacagaaa

SEQ ID NO: 269860 - RNA, 19 nt, Homo sapiens
gagccucccuucccuuuga

SEQ ID NO: 269861 - RNA, 19 nt, Homo sapiens
gcgagaagcugcaguacuc

SEQ ID NO: 269862 - RNA, 19 nt, Homo sapiens
gaaagcaggacagaaagaa

SEQ ID NO: 269863 - RNA, 19 nt, Homo sapiens
cagccuaggugacauagug

SEQ ID NO: 269864 - RNA, 19 nt, Homo sapiens
caucggagcccugcaaauu

SEQ ID NO: 269865 - RNA, 19 nt, Homo sapiens
gaagugaccagagagcaaa

SEQ ID NO: 269866 - RNA, 19 nt, Homo sapiens
gcuggccacugauuccuuu

SEQ ID NO: 269867 - RNA, 19 nt, Homo sapiens
ucaccauaauugcugauaa

SEQ ID NO: 269868 - RNA, 19 nt, Homo sapiens
caaauuccgagaaauguga

SEQ ID NO: 269869 - RNA, 19 nt, Homo sapiens
caccauaauugcugauaau

SEQ ID NO: 269870 - RNA, 19 nt, Homo sapiens
caggugaagugaccagaga

SEQ ID NO: 269871 - RNA, 19 nt, Homo sapiens
uuacagaugagaauacuga

SEQ ID NO: 269872 - RNA, 19 nt, Homo sapiens
cacuggagguucaagcuaa

SEQ ID NO: 269873 - RNA, 19 nt, Homo sapiens
gcacuggagguucaagcua

SEQ ID NO: 269874 - RNA, 19 nt, Homo sapiens
ggcaagguguucugcaugu

SEQ ID NO: 269875 - RNA, 19 nt, Homo sapiens
gcucgugccugugguacaa

SEQ ID NO: 269876 - RNA, 19 nt, Homo sapiens
gcaagguguucugcauguu

SEQ ID NO: 269877 - RNA, 19 nt, Homo sapiens
gcauggcuuugcaguuaug

SEQ ID NO: 269878 - RNA, 19 nt, Homo sapiens
ugauaauuacccacucuua

SEQ ID NO: 269879 - RNA, 19 nt, Homo sapiens
gacuucagacucaccauaa

SEQ ID NO: 269880 - RNA, 19 nt, Homo sapiens
ucuuaaauuugucgaguga

SEQ ID NO: 269881 - RNA, 19 nt, Homo sapiens
gcuuugcaguuauggagaa

SEQ ID NO: 269882 - RNA, 19 nt, Homo sapiens
acguuugcaucucuauuua

SEQ ID NO: 269883 - RNA, 19 nt, Homo sapiens
ggacuucauguuccgugua

SEQ ID NO: 269884 - RNA, 19 nt, Homo sapiens
gaagcucccaguccucaga

SEQ ID NO: 269885 - RNA, 19 nt, Homo sapiens
acucuaugcuggccacuga

SEQ ID NO: 269886 - RNA, 19 nt, Homo sapiens
cauguuccguguacguuug

SEQ ID NO: 269887 - RNA, 19 nt, Homo sapiens
gcaaauuccgagaaaugug

SEQ ID NO: 269888 - RNA, 19 nt, Homo sapiens
ggaggucgaggcuguagug

SEQ ID NO: 269889 - RNA, 19 nt, Homo sapiens
gaccagccuaggugacaua

SEQ ID NO: 269890 - RNA, 19 nt, Homo sapiens
uuauaccucuguccugcua

SEQ ID NO: 269891 - RNA, 19 nt, Homo sapiens
ugaggugggaggauuguuu

SEQ ID NO: 269892 - RNA, 19 nt, Homo sapiens
uacccacucuuaaauuugu

SEQ ID NO: 269893 - RNA, 19 nt, Homo sapiens
gcugauaauuacccacucu

SEQ ID NO: 269894 - RNA, 19 nt, Homo sapiens
gaaacccagcagucccuaa

SEQ ID NO: 269895 - RNA, 19 nt, Homo sapiens
aaacccagcagucccuaaa

SEQ ID NO: 269896 - RNA, 19 nt, Homo sapiens
guacaagagccgcgagaag

SEQ ID NO: 269897 - RNA, 19 nt, Homo sapiens
gaggugggaggauuguuug

SEQ ID NO: 269898 - RNA, 19 nt, Homo sapiens
gaacgccgaggacgagaag

SEQ ID NO: 269899 - RNA, 19 nt, Homo sapiens
guagugagcccugauugca

SEQ ID NO: 269900 - RNA, 19 nt, Homo sapiens
gcggcaagguguucugcau

SEQ ID NO: 269901 - RNA, 19 nt, Homo sapiens
gcgagcgcaucaacaccuu

SEQ ID NO: 269902 - RNA, 19 nt, Homo sapiens
agacuucagacucaccaua

SEQ ID NO: 269903 - RNA, 19 nt, Homo sapiens
uccagacacugcccuuaga

SEQ ID NO: 269904 - RNA, 19 nt, Homo sapiens
uacguuugcaucucuauuu

SEQ ID NO: 269905 - RNA, 19 nt, Homo sapiens
ggucaucagggcaggaguu

SEQ ID NO: 269906 - RNA, 19 nt, Homo sapiens
caagguguucugcauguuc

SEQ ID NO: 269907 - RNA, 19 nt, Homo sapiens
aggcugagguuggaggauu

SEQ ID NO: 269908 - RNA, 19 nt, Homo sapiens
gacacugcccuuagaaucu

SEQ ID NO: 269909 - RNA, 19 nt, Homo sapiens
ggcugagguuggaggauug

SEQ ID NO: 269910 - RNA, 19 nt, Homo sapiens
ccuguauucccaacacuuu

SEQ ID NO: 269911 - RNA, 19 nt, Homo sapiens
gcccuuagaaucuggaaca

SEQ ID NO: 269912 - RNA, 19 nt, Homo sapiens
acacugcccuuagaaucug

SEQ ID NO: 269913 - RNA, 19 nt, Homo sapiens
cugcaaauuccgagaaaug

SEQ ID NO: 269914 - RNA, 19 nt, Homo sapiens
ugaagugaccagagagcaa

SEQ ID NO: 269915 - RNA, 19 nt, Homo sapiens
cuucagacucaccauaauu

SEQ ID NO: 269916 - RNA, 19 nt, Homo sapiens
gggugucuauguccaaguc

SEQ ID NO: 269917 - RNA, 19 nt, Homo sapiens
aggcugaggugggaggauu

SEQ ID NO: 269918 - RNA, 19 nt, Homo sapiens
gagaccagccuaggugaca

SEQ ID NO: 269919 - RNA, 19 nt, Homo sapiens
ccagacacugcccuuagaa

SEQ ID NO: 269920 - RNA, 19 nt, Homo sapiens
agaaagcaggacagaaaga

SEQ ID NO: 269921 - RNA, 19 nt, Homo sapiens
guacguuugcaucucuauu

SEQ ID NO: 269922 - RNA, 19 nt, Homo sapiens
gcaguggcucacaccugua

SEQ ID NO: 269923 - RNA, 19 nt, Homo sapiens
agacacugcccuuagaauc

SEQ ID NO: 269924 - RNA, 19 nt, Homo sapiens
gacuucagccuuccagaca

SEQ ID NO: 269925 - RNA, 19 nt, Homo sapiens
cauagcagguaggacuuca

SEQ ID NO: 269926 - RNA, 19 nt, Homo sapiens
gacuucauguuccguguac

SEQ ID NO: 269927 - RNA, 19 nt, Homo sapiens
cuacuacuacugcuucauc

SEQ ID NO: 269928 - RNA, 19 nt, Homo sapiens
ccgagaaaugugaaacuug

SEQ ID NO: 269929 - RNA, 19 nt, Homo sapiens
uccgagaaaugugaaacuu

SEQ ID NO: 269930 - RNA, 19 nt, Homo sapiens
ggacgaugaagcggcagaa

SEQ ID NO: 269931 - RNA, 19 nt, Homo sapiens
gcuguagugagcccugauu

SEQ ID NO: 269932 - RNA, 19 nt, Homo sapiens
cuacggacaccgccucauc

SEQ ID NO: 269933 - RNA, 19 nt, Homo sapiens
cagcuucgucuacauccuu

SEQ ID NO: 269934 - RNA, 19 nt, Homo sapiens
caaaggagguuauaaaguu

SEQ ID NO: 269935 - RNA, 19 nt, Homo sapiens
gcaaacggcuugaagauga

SEQ ID NO: 269936 - RNA, 19 nt, Homo sapiens
gaaggagucucaaaugaaa

SEQ ID NO: 269937 - RNA, 19 nt, Homo sapiens
gaacauuucucaccuuaau

SEQ ID NO: 269938 - RNA, 19 nt, Homo sapiens
gagguuugauugcauauua

SEQ ID NO: 269939 - RNA, 19 nt, Homo sapiens
ggacuaggcugguauauac

SEQ ID NO: 269940 - RNA, 19 nt, Homo sapiens
caacaaggaugaauagaau

SEQ ID NO: 269941 - RNA, 19 nt, Homo sapiens
gaacuaccauccgaagaua

SEQ ID NO: 269942 - RNA, 19 nt, Homo sapiens
gagccgacaugcuaaauaa

SEQ ID NO: 269943 - RNA, 19 nt, Homo sapiens
caaaugaaauguacacaga

SEQ ID NO: 269944 - RNA, 19 nt, Homo sapiens
gcaaagcucugaaaacaua

SEQ ID NO: 269945 - RNA, 19 nt, Homo sapiens
cgagagagccguauauuaa

SEQ ID NO: 269946 - RNA, 19 nt, Homo sapiens
caggaaauaugacaguuua

SEQ ID NO: 269947 - RNA, 19 nt, Homo sapiens
gaccugaucuucugcuuaa

SEQ ID NO: 269948 - RNA, 19 nt, Homo sapiens
ucacauagcuuacuucucu

SEQ ID NO: 269949 - RNA, 19 nt, Homo sapiens
gauagauccucuccagaua

SEQ ID NO: 269950 - RNA, 19 nt, Homo sapiens
gaagacacauggcagaaau

SEQ ID NO: 269951 - RNA, 19 nt, Homo sapiens
cuacgucccugaaaucaua

SEQ ID NO: 269952 - RNA, 19 nt, Homo sapiens
aaucugcucuccauauuua

SEQ ID NO: 269953 - RNA, 19 nt, Homo sapiens
caacaaggcccaucugcua

SEQ ID NO: 269954 - RNA, 19 nt, Homo sapiens
caucaaaucuaugcaguuu

SEQ ID NO: 269955 - RNA, 19 nt, Homo sapiens
gcagugcgguauuucuuaa

SEQ ID NO: 269956 - RNA, 19 nt, Homo sapiens
gggagacgcuucauaacuu

SEQ ID NO: 269957 - RNA, 19 nt, Homo sapiens
agaguaaucuccauaaaga

SEQ ID NO: 269958 - RNA, 19 nt, Homo sapiens
gggaauaauuguauacaug

SEQ ID NO: 269959 - RNA, 19 nt, Homo sapiens
gccaagguaugacaauuaa

SEQ ID NO: 269960 - RNA, 19 nt, Homo sapiens
gaaugugucuauuuacuca

SEQ ID NO: 269961 - RNA, 19 nt, Homo sapiens
cagcaucggugcacuugua

SEQ ID NO: 269962 - RNA, 19 nt, Homo sapiens
gagcagccgucaacacuau

SEQ ID NO: 269963 - RNA, 19 nt, Homo sapiens
ccaagaagguacuuuagga

SEQ ID NO: 269964 - RNA, 19 nt, Homo sapiens
gcagaaauacuacuuggaa

SEQ ID NO: 269965 - RNA, 19 nt, Homo sapiens
gaagagcggcuuugauaug

SEQ ID NO: 269966 - RNA, 19 nt, Homo sapiens
ucauaaagauugaggaaga

SEQ ID NO: 269967 - RNA, 19 nt, Homo sapiens
gcagagcaaguuuauuuaa

SEQ ID NO: 269968 - RNA, 19 nt, Homo sapiens
gcaacaaggaugaauagaa

SEQ ID NO: 269969 - RNA, 19 nt, Homo sapiens
gauccaagaagguacuuua

SEQ ID NO: 269970 - RNA, 19 nt, Homo sapiens
ggaaggagucucaaaugaa

SEQ ID NO: 269971 - RNA, 19 nt, Homo sapiens
ccaaggagauagagaaagu

SEQ ID NO: 269972 - RNA, 19 nt, Homo sapiens
agaagguacuuuaggauuu

SEQ ID NO: 269973 - RNA, 19 nt, Homo sapiens
caggaaagagcaaguauuu

SEQ ID NO: 269974 - RNA, 19 nt, Homo sapiens
gaagggagcacuugugauc

SEQ ID NO: 269975 - RNA, 19 nt, Homo sapiens
ucacucaaaugcugcagua

SEQ ID NO: 269976 - RNA, 19 nt, Homo sapiens
aaagagguuugauugcaua

SEQ ID NO: 269977 - RNA, 19 nt, Homo sapiens
gagagccguauauuaauua

SEQ ID NO: 269978 - RNA, 19 nt, Homo sapiens
uaggaaaccgcaagaaaua

SEQ ID NO: 269979 - RNA, 19 nt, Homo sapiens
uuaaagugcucaacaggaa

SEQ ID NO: 269980 - RNA, 19 nt, Homo sapiens
cgauuuguguagaugauua

SEQ ID NO: 269981 - RNA, 19 nt, Homo sapiens
guacuucaaugacaauauc

SEQ ID NO: 269982 - RNA, 19 nt, Homo sapiens
gaaggaggcccagaagauu

SEQ ID NO: 269983 - RNA, 19 nt, Homo sapiens
ggaccgggaugacgucaau

SEQ ID NO: 269984 - RNA, 19 nt, Homo sapiens
gaaguuggcuugguuugag

SEQ ID NO: 269985 - RNA, 19 nt, Homo sapiens
gaaguauugcgaagcauuu

SEQ ID NO: 269986 - RNA, 19 nt, Homo sapiens
ggaggcagcagucuuagaa

SEQ ID NO: 269987 - RNA, 19 nt, Homo sapiens
acacauggcagaaauacua

SEQ ID NO: 269988 - RNA, 19 nt, Homo sapiens
ggagaguguuuccaacuuc

SEQ ID NO: 269989 - RNA, 19 nt, Homo sapiens
auaagaaugugccaguuaa

SEQ ID NO: 269990 - RNA, 19 nt, Homo sapiens
guucacaccuccaggaaug

SEQ ID NO: 269991 - RNA, 19 nt, Homo sapiens
cugggaaugugucuauuua

SEQ ID NO: 269992 - RNA, 19 nt, Homo sapiens
ugaaucugcucuccauauu

SEQ ID NO: 269993 - RNA, 19 nt, Homo sapiens
gugaauuacuuaccuuaug

SEQ ID NO: 269994 - RNA, 19 nt, Homo sapiens
guuagcacauguuuauuug

SEQ ID NO: 269995 - RNA, 19 nt, Homo sapiens
cgacggaccugaucuucug

SEQ ID NO: 269996 - RNA, 19 nt, Homo sapiens
gccaaccucuucuccauga

SEQ ID NO: 269997 - RNA, 19 nt, Homo sapiens
gagcuggaauuggaaagaa

SEQ ID NO: 269998 - RNA, 19 nt, Homo sapiens
ggccaagguaugacaauua

SEQ ID NO: 269999 - RNA, 19 nt, Homo sapiens
gaauuuaccggcugagaga

SEQ ID NO: 270000 - RNA, 19 nt, Homo sapiens
uggaaggagucucaaauga

SEQ ID NO: 270001 - RNA, 19 nt, Homo sapiens
ucggugcacuuguaauaua

SEQ ID NO: 270002 - RNA, 19 nt, Homo sapiens
ggucauucauaaagauuga

SEQ ID NO: 270003 - RNA, 19 nt, Homo sapiens
ucgaauaucaugagaguaa

SEQ ID NO: 270004 - RNA, 19 nt, Homo sapiens
uauaagaaugugccaguua

SEQ ID NO: 270005 - RNA, 19 nt, Homo sapiens
gcaaaggagguuauaaagu

SEQ ID NO: 270006 - RNA, 19 nt, Homo sapiens
agaaguacgugcaggaaga

SEQ ID NO: 270007 - RNA, 19 nt, Homo sapiens
cgacguacuucaaugacaa

SEQ ID NO: 270008 - RNA, 19 nt, Homo sapiens
agagagccguauauuaauu

SEQ ID NO: 270009 - RNA, 19 nt, Homo sapiens
caagguaugacaauuaaug

SEQ ID NO: 270010 - RNA, 19 nt, Homo sapiens
gaaaagagguuugauugca

SEQ ID NO: 270011 - RNA, 19 nt, Homo sapiens
aggaagagcggcuuugaua

SEQ ID NO: 270012 - RNA, 19 nt, Homo sapiens
gcucaagcuccuaaugaua

SEQ ID NO: 270013 - RNA, 19 nt, Homo sapiens
gaaauacuacuuggaagga

SEQ ID NO: 270014 - RNA, 19 nt, Homo sapiens
gcagaguccugguugucuu

SEQ ID NO: 270015 - RNA, 19 nt, Homo sapiens
ggagacgcuucauaacuuc

SEQ ID NO: 270016 - RNA, 19 nt, Homo sapiens
ccaucaagcuggugaaucu

SEQ ID NO: 270017 - RNA, 19 nt, Homo sapiens
ggaagugaacucuguagug

SEQ ID NO: 270018 - RNA, 19 nt, Homo sapiens
caucggugcacuuguaaua

SEQ ID NO: 270019 - RNA, 19 nt, Homo sapiens
gaugauauccgcccagaca

SEQ ID NO: 270020 - RNA, 19 nt, Homo sapiens
uaaccaauuucccuuaugg

SEQ ID NO: 270021 - RNA, 19 nt, Homo sapiens
aaauaaugcucaggaaaga

SEQ ID NO: 270022 - RNA, 19 nt, Homo sapiens
uuacuuaccuuauguacag

SEQ ID NO: 270023 - RNA, 19 nt, Homo sapiens
ggaccugaucuucugcuua

SEQ ID NO: 270024 - RNA, 19 nt, Homo sapiens
acaaagagguaugucauca

SEQ ID NO: 270025 - RNA, 19 nt, Homo sapiens
ccaguuagcucugcucgau

SEQ ID NO: 270026 - RNA, 19 nt, Homo sapiens
cgucaacacuaucaccaaa

SEQ ID NO: 270027 - RNA, 19 nt, Homo sapiens
guuugugucuguguacuua

SEQ ID NO: 270028 - RNA, 19 nt, Homo sapiens
gcccucagaacauuuauaa

SEQ ID NO: 270029 - RNA, 19 nt, Homo sapiens
gaaagcuggugggaaggaa

SEQ ID NO: 270030 - RNA, 19 nt, Homo sapiens
aggcagagcaaguuuauuu

SEQ ID NO: 270031 - RNA, 19 nt, Homo sapiens
gcacaaagagguaugucau

SEQ ID NO: 270032 - RNA, 19 nt, Homo sapiens
ggaccaagacgaugaugau

SEQ ID NO: 270033 - RNA, 19 nt, Homo sapiens
gaaugggagacgcuucaua

SEQ ID NO: 270034 - RNA, 19 nt, Homo sapiens
ggacuaaccuuugagaaau

SEQ ID NO: 270035 - RNA, 19 nt, Homo sapiens
gagccucccuucuuuguuu

SEQ ID NO: 270036 - RNA, 19 nt, Homo sapiens
gaacgaaaccagcguccua

SEQ ID NO: 270037 - RNA, 19 nt, Homo sapiens
gaagcucuguggccucuuu

SEQ ID NO: 270038 - RNA, 19 nt, Homo sapiens
gaaacugucugcugcucaa

SEQ ID NO: 270039 - RNA, 19 nt, Homo sapiens
gcaagaaggugccccagua

SEQ ID NO: 270040 - RNA, 19 nt, Homo sapiens
cagcgagccucccuucuuu

SEQ ID NO: 270041 - RNA, 19 nt, Homo sapiens
gcucagacuugaccauguu

SEQ ID NO: 270042 - RNA, 19 nt, Homo sapiens
ccacucaacugacucauac

SEQ ID NO: 270043 - RNA, 19 nt, Homo sapiens
ggucagagccaaauuccaa

SEQ ID NO: 270044 - RNA, 19 nt, Homo sapiens
caggcagcguggacaauua

SEQ ID NO: 270045 - RNA, 19 nt, Homo sapiens
aggcugaucuuucguaguu

SEQ ID NO: 270046 - RNA, 19 nt, Homo sapiens
cagugaauauggugaagaa

SEQ ID NO: 270047 - RNA, 19 nt, Homo sapiens
gucauugccugcucaagaa

SEQ ID NO: 270048 - RNA, 19 nt, Homo sapiens
caacagcagcucccauuuc

SEQ ID NO: 270049 - RNA, 19 nt, Homo sapiens
gaaggucagagccaaauuc

SEQ ID NO: 270050 - RNA, 19 nt, Homo sapiens
ggagagacacgagcccuuu

SEQ ID NO: 270051 - RNA, 19 nt, Homo sapiens
cuagaacacauuuacagua

SEQ ID NO: 270052 - RNA, 19 nt, Homo sapiens
gcaggugggcugugcugua

SEQ ID NO: 270053 - RNA, 19 nt, Homo sapiens
gugcagggcuuggguaaca

SEQ ID NO: 270054 - RNA, 19 nt, Homo sapiens
ccacgagacucugggaaga

SEQ ID NO: 270055 - RNA, 19 nt, Homo sapiens
gcaacagcagcucccauuu

SEQ ID NO: 270056 - RNA, 19 nt, Homo sapiens
gaucuuucguaguuucuca

SEQ ID NO: 270057 - RNA, 19 nt, Homo sapiens
gcagcucccauuucuagaa

SEQ ID NO: 270058 - RNA, 19 nt, Homo sapiens
ccaagugccaccugauuga

SEQ ID NO: 270059 - RNA, 19 nt, Homo sapiens
ggccaaacuuccugcugaa

SEQ ID NO: 270060 - RNA, 19 nt, Homo sapiens
cgggaagacuaaaugauca

SEQ ID NO: 270061 - RNA, 19 nt, Homo sapiens
cagcagcucccauuucuag

SEQ ID NO: 270062 - RNA, 19 nt, Homo sapiens
aauccacgcugucuucugu

SEQ ID NO: 270063 - RNA, 19 nt, Homo sapiens
ggagaaggucagagccaaa

SEQ ID NO: 270064 - RNA, 19 nt, Homo sapiens
gcugaucuuucguaguuuc

SEQ ID NO: 270065 - RNA, 19 nt, Homo sapiens
uugcaggacuaaccuuuga

SEQ ID NO: 270066 - RNA, 19 nt, Homo sapiens
cgaaaccagcguccuauuc

SEQ ID NO: 270067 - RNA, 19 nt, Homo sapiens
gacuaaccuuugagaaauc

SEQ ID NO: 270068 - RNA, 19 nt, Homo sapiens
ccgguggccuccucauuau

SEQ ID NO: 270069 - RNA, 19 nt, Homo sapiens
gcugugugcucagacuuga

SEQ ID NO: 270070 - RNA, 19 nt, Homo sapiens
ucaccucugugccugaguu

SEQ ID NO: 270071 - RNA, 19 nt, Homo sapiens
gcaggacuaaccuuugaga

SEQ ID NO: 270072 - RNA, 19 nt, Homo sapiens
ugucuguuguuguuugaaa

SEQ ID NO: 270073 - RNA, 19 nt, Homo sapiens
gagaaauccuuuugugaag

SEQ ID NO: 270074 - RNA, 19 nt, Homo sapiens
gagaaggucagagccaaau

SEQ ID NO: 270075 - RNA, 19 nt, Homo sapiens
gaaaccagcguccuauucc

SEQ ID NO: 270076 - RNA, 19 nt, Homo sapiens
gcugucuguuguuguuuga

SEQ ID NO: 270077 - RNA, 19 nt, Homo sapiens
ugaauauggugaagaagcu

SEQ ID NO: 270078 - RNA, 19 nt, Homo sapiens
ccagcgagccucccuucuu

SEQ ID NO: 270079 - RNA, 19 nt, Homo sapiens
uaggauauaaagugccaua

SEQ ID NO: 270080 - RNA, 19 nt, Homo sapiens
ccauaaggccagccaguuc

SEQ ID NO: 270081 - RNA, 19 nt, Homo sapiens
guuguuguuugaaaucugu

SEQ ID NO: 270082 - RNA, 19 nt, Homo sapiens
cgucaucaccuacuacauc

SEQ ID NO: 270083 - RNA, 19 nt, Homo sapiens
aacagcagcucccauuucu

SEQ ID NO: 270084 - RNA, 19 nt, Homo sapiens
aggacuaaccuuugagaaa

SEQ ID NO: 270085 - RNA, 19 nt, Homo sapiens
gaaauccuuuugugaaguc

SEQ ID NO: 270086 - RNA, 19 nt, Homo sapiens
gguggugugugccgucauc

SEQ ID NO: 270087 - RNA, 19 nt, Homo sapiens
gagagacacgagcccuuug

SEQ ID NO: 270088 - RNA, 19 nt, Homo sapiens
aaauauaccaggcugaucu

SEQ ID NO: 270089 - RNA, 19 nt, Homo sapiens
ucccuucuuuguuugaauu

SEQ ID NO: 270090 - RNA, 19 nt, Homo sapiens
ccaaauauaccaggcugau

SEQ ID NO: 270091 - RNA, 19 nt, Homo sapiens
ccaggcagcguggacaauu

SEQ ID NO: 270092 - RNA, 19 nt, Homo sapiens
gugccgucaucaccuacua

SEQ ID NO: 270093 - RNA, 19 nt, Homo sapiens
accgguggccuccucauua

SEQ ID NO: 270094 - RNA, 19 nt, Homo sapiens
gaccgguggccuccucauu

SEQ ID NO: 270095 - RNA, 19 nt, Homo sapiens
ggacccaggaauccaagug

SEQ ID NO: 270096 - RNA, 19 nt, Homo sapiens
gcccuuugccuggguguaa

SEQ ID NO: 270097 - RNA, 19 nt, Homo sapiens
aaauguaugccaaacaaca

SEQ ID NO: 270098 - RNA, 19 nt, Homo sapiens
gcgagccucccuucuuugu

SEQ ID NO: 270099 - RNA, 19 nt, Homo sapiens
caggugggcugugcuguac

SEQ ID NO: 270100 - RNA, 19 nt, Homo sapiens
uuucguaguuucucagucu

SEQ ID NO: 270101 - RNA, 19 nt, Homo sapiens
ccugaguucucccuguugu

SEQ ID NO: 270102 - RNA, 19 nt, Homo sapiens
ugagaaauccuuuugugaa

SEQ ID NO: 270103 - RNA, 19 nt, Homo sapiens
caccugcccucccacucuu

SEQ ID NO: 270104 - RNA, 19 nt, Homo sapiens
ugugugccgucaucaccua

SEQ ID NO: 270105 - RNA, 19 nt, Homo sapiens
ccauuucuagaacacauuu

SEQ ID NO: 270106 - RNA, 19 nt, Homo sapiens
auaccaggcugaucuuucg

SEQ ID NO: 270107 - RNA, 19 nt, Homo sapiens
caguucuagcucucuauua

SEQ ID NO: 270108 - RNA, 19 nt, Homo sapiens
ccaguucuagcucucuauu

SEQ ID NO: 270109 - RNA, 19 nt, Homo sapiens
gccauaaggccagccaguu

SEQ ID NO: 270110 - RNA, 19 nt, Homo sapiens
agucauugccugcucaaga

SEQ ID NO: 270111 - RNA, 19 nt, Homo sapiens
ccgggaagacuaaaugauc

SEQ ID NO: 270112 - RNA, 19 nt, Homo sapiens
aguucuagcucucuauuac

SEQ ID NO: 270113 - RNA, 19 nt, Homo sapiens
gaagucauugccugcucaa

SEQ ID NO: 270114 - RNA, 19 nt, Homo sapiens
cuugcugucuguuguuguu

SEQ ID NO: 270115 - RNA, 19 nt, Homo sapiens
cgacugugcugccccucua

SEQ ID NO: 270116 - RNA, 19 nt, Homo sapiens
ugccugaguucucccuguu

SEQ ID NO: 270117 - RNA, 19 nt, Homo sapiens
ggugggcugugcuguacca

SEQ ID NO: 270118 - RNA, 19 nt, Homo sapiens
ucaaagcgguacccauccu

SEQ ID NO: 270119 - RNA, 19 nt, Homo sapiens
gcacucaaaugccucauca

SEQ ID NO: 270120 - RNA, 19 nt, Homo sapiens
agacguggcucaucuacaa

SEQ ID NO: 270121 - RNA, 19 nt, Homo sapiens
ggaaggcacuggugauguc

SEQ ID NO: 270122 - RNA, 19 nt, Homo sapiens
ugacgaggaugaugaggaa

SEQ ID NO: 270123 - RNA, 19 nt, Homo sapiens
ucaacaagaucaccuucaa

SEQ ID NO: 270124 - RNA, 19 nt, Homo sapiens
gcacccagguagucaugaa

SEQ ID NO: 270125 - RNA, 19 nt, Homo sapiens
uggcucaucuacaaacaua

SEQ ID NO: 270126 - RNA, 19 nt, Homo sapiens
ggaaacaccagcguaaguu

SEQ ID NO: 270127 - RNA, 19 nt, Homo sapiens
gaacagccacagcuacaau

SEQ ID NO: 270128 - RNA, 19 nt, Homo sapiens
ggaagcgccucagcgacua

SEQ ID NO: 270129 - RNA, 19 nt, Homo sapiens
ccucaucgcccaagccaua

SEQ ID NO: 270130 - RNA, 19 nt, Homo sapiens
cagcgacuaugcccucauu

SEQ ID NO: 270131 - RNA, 19 nt, Homo sapiens
cagaagcuccggaguguga

SEQ ID NO: 270132 - RNA, 19 nt, Homo sapiens
ugaagacacucaugaccau

SEQ ID NO: 270133 - RNA, 19 nt, Homo sapiens
gagaacagcaagacauauc

SEQ ID NO: 270134 - RNA, 19 nt, Homo sapiens
agaaugugaugaugucaau

SEQ ID NO: 270135 - RNA, 19 nt, Homo sapiens
cagagaaugugaugauguc

SEQ ID NO: 270136 - RNA, 19 nt, Homo sapiens
gaaacaccagcguaaguuc

SEQ ID NO: 270137 - RNA, 19 nt, Homo sapiens
agaagcacgugcacaacuu

SEQ ID NO: 270138 - RNA, 19 nt, Homo sapiens
guacucauucgcacucaaa

SEQ ID NO: 270139 - RNA, 19 nt, Homo sapiens
ccauguggcugauuuccau

SEQ ID NO: 270140 - RNA, 19 nt, Homo sapiens
ccaggacgaugacgaggau

SEQ ID NO: 270141 - RNA, 19 nt, Homo sapiens
uaacacgcuuaccgaccua

SEQ ID NO: 270142 - RNA, 19 nt, Homo sapiens
cuacagagaaugugaugau

SEQ ID NO: 270143 - RNA, 19 nt, Homo sapiens
gguccgugcugguucugaa

SEQ ID NO: 270144 - RNA, 19 nt, Homo sapiens
gcacgugcacaacuucaug

SEQ ID NO: 270145 - RNA, 19 nt, Homo sapiens
cgucauguacgaccuugua

SEQ ID NO: 270146 - RNA, 19 nt, Homo sapiens
caacacgcgcuucgucaug

SEQ ID NO: 270147 - RNA, 19 nt, Homo sapiens
ggugaugucccaggaggua

SEQ ID NO: 270148 - RNA, 19 nt, Homo sapiens
gaucucaaagggacaggaa

SEQ ID NO: 270149 - RNA, 19 nt, Homo sapiens
ggagccacgcuuucuguug

SEQ ID NO: 270150 - RNA, 19 nt, Homo sapiens
gagaaugugaugaugucaa

SEQ ID NO: 270151 - RNA, 19 nt, Homo sapiens
ggagaacagcaagacauau

SEQ ID NO: 270152 - RNA, 19 nt, Homo sapiens
gaaggagaacagcaagaca

SEQ ID NO: 270153 - RNA, 19 nt, Homo sapiens
gagcgcguguuccucaucu

SEQ ID NO: 270154 - RNA, 19 nt, Homo sapiens
gagaagcacgugcacaacu

SEQ ID NO: 270155 - RNA, 19 nt, Homo sapiens
agacccagaccgucaugua

SEQ ID NO: 270156 - RNA, 19 nt, Homo sapiens
gcagagagccucggggaaa

SEQ ID NO: 270157 - RNA, 19 nt, Homo sapiens
aggagaacagcaagacaua

SEQ ID NO: 270158 - RNA, 19 nt, Homo sapiens
ucaccaaggcugagaagca

SEQ ID NO: 270159 - RNA, 19 nt, Homo sapiens
acaccaaggagucucugua

SEQ ID NO: 270160 - RNA, 19 nt, Homo sapiens
ccgugcugguucugaauaa

SEQ ID NO: 270161 - RNA, 19 nt, Homo sapiens
gaccaggcuaacacgcuua

SEQ ID NO: 270162 - RNA, 19 nt, Homo sapiens
ggagauccagcuguucaug

SEQ ID NO: 270163 - RNA, 19 nt, Homo sapiens
cgaggaugaugaggaagau

SEQ ID NO: 270164 - RNA, 19 nt, Homo sapiens
aggaaggucauuuggguuu

SEQ ID NO: 270165 - RNA, 19 nt, Homo sapiens
gagcuggagccacgcuuuc

SEQ ID NO: 270166 - RNA, 19 nt, Homo sapiens
ccugcucacuggcaucaug

SEQ ID NO: 270167 - RNA, 19 nt, Homo sapiens
ucaccuuccucuccauugg

SEQ ID NO: 270168 - RNA, 19 nt, Homo sapiens
ggaaggucauuuggguuuu

SEQ ID NO: 270169 - RNA, 19 nt, Homo sapiens
aagcaggacccgccuagug

SEQ ID NO: 270170 - RNA, 19 nt, Homo sapiens
cucagaagcuccggagugu

SEQ ID NO: 270171 - RNA, 19 nt, Homo sapiens
aacacgcgcuucgucauga

SEQ ID NO: 270172 - RNA, 19 nt, Homo sapiens
gggagacguggcucaucua

SEQ ID NO: 270173 - RNA, 19 nt, Homo sapiens
cccgggagauccagcuguu

SEQ ID NO: 270174 - RNA, 19 nt, Homo sapiens
aacaagaucaccuucaaca

SEQ ID NO: 270175 - RNA, 19 nt, Homo sapiens
uacagagaaugugaugaug

SEQ ID NO: 270176 - RNA, 19 nt, Homo sapiens
ggacgaugacgaggaugau

SEQ ID NO: 270177 - RNA, 19 nt, Homo sapiens
aagcaucgcuccccuucaa

SEQ ID NO: 270178 - RNA, 19 nt, Homo sapiens
cggaaacaccagcguaagu

SEQ ID NO: 270179 - RNA, 19 nt, Homo sapiens
cagcucaccaagcggguaa

SEQ ID NO: 270180 - RNA, 19 nt, Homo sapiens
cgagagguaccacgacaag

SEQ ID NO: 270181 - RNA, 19 nt, Homo sapiens
acacgcgcuucgucaugaa

SEQ ID NO: 270182 - RNA, 19 nt, Homo sapiens
acagagaaugugaugaugu

SEQ ID NO: 270183 - RNA, 19 nt, Homo sapiens
cugagaagcacgugcacaa

SEQ ID NO: 270184 - RNA, 19 nt, Homo sapiens
cccaggaccaggacgauga

SEQ ID NO: 270185 - RNA, 19 nt, Homo sapiens
caacaagaucaccuucaac

SEQ ID NO: 270186 - RNA, 19 nt, Homo sapiens
gaagcgccucagcgacuau

SEQ ID NO: 270187 - RNA, 19 nt, Homo sapiens
gaauagccaugacuuauga

SEQ ID NO: 270188 - RNA, 19 nt, Homo sapiens
gagaguagcuagaagagaa

SEQ ID NO: 270189 - RNA, 19 nt, Homo sapiens
gcagaugacuggagaauag

SEQ ID NO: 270190 - RNA, 19 nt, Homo sapiens
aaaggagucugcuuacuua

SEQ ID NO: 270191 - RNA, 19 nt, Homo sapiens
gagaauaaguuaaccacaa

SEQ ID NO: 270192 - RNA, 19 nt, Homo sapiens
gcaagcuauucaucaauua

SEQ ID NO: 270193 - RNA, 19 nt, Homo sapiens
gcagagagauuucauugag

SEQ ID NO: 270194 - RNA, 19 nt, Homo sapiens
gcaaggaagcuagaacuua

SEQ ID NO: 270195 - RNA, 19 nt, Homo sapiens
gcucugaaaugccuuauca

SEQ ID NO: 270196 - RNA, 19 nt, Homo sapiens
gcaaagacccagaacauca

SEQ ID NO: 270197 - RNA, 19 nt, Homo sapiens
gcacuucaaacaaacuuua

SEQ ID NO: 270198 - RNA, 19 nt, Homo sapiens
gcuagaagagaauaaguua

SEQ ID NO: 270199 - RNA, 19 nt, Homo sapiens
ggagaauagccaugacuua

SEQ ID NO: 270200 - RNA, 19 nt, Homo sapiens
aaaugcagcugccaaugua

SEQ ID NO: 270201 - RNA, 19 nt, Homo sapiens
ggagcgaugugguugauau

SEQ ID NO: 270202 - RNA, 19 nt, Homo sapiens
gaaacugaaugaccaagca

SEQ ID NO: 270203 - RNA, 19 nt, Homo sapiens
cuagagacuuugauuggua

SEQ ID NO: 270204 - RNA, 19 nt, Homo sapiens
caaggaagcuagaacuuac

SEQ ID NO: 270205 - RNA, 19 nt, Homo sapiens
ugaaaugccuuaucagucu

SEQ ID NO: 270206 - RNA, 19 nt, Homo sapiens
gcaagcggcucagcgacua

SEQ ID NO: 270207 - RNA, 19 nt, Homo sapiens
gaacuuaccaaagcagaaa

SEQ ID NO: 270208 - RNA, 19 nt, Homo sapiens
gauuguuccuccuguaauu

SEQ ID NO: 270209 - RNA, 19 nt, Homo sapiens
agggaaacauggcuaauuu

SEQ ID NO: 270210 - RNA, 19 nt, Homo sapiens
gaacuguacucuugguuuu

SEQ ID NO: 270211 - RNA, 19 nt, Homo sapiens
gaaccugaacacuaaguuu

SEQ ID NO: 270212 - RNA, 19 nt, Homo sapiens
gaaaauuccugcaagcuau

SEQ ID NO: 270213 - RNA, 19 nt, Homo sapiens
gaagcuagaacuuaccaaa

SEQ ID NO: 270214 - RNA, 19 nt, Homo sapiens
gaaauacuggugugugcua

SEQ ID NO: 270215 - RNA, 19 nt, Homo sapiens
gggaaugcaccuauuauug

SEQ ID NO: 270216 - RNA, 19 nt, Homo sapiens
gagaauagccaugacuuau

SEQ ID NO: 270217 - RNA, 19 nt, Homo sapiens
ccaacaaccuggcgcucua

SEQ ID NO: 270218 - RNA, 19 nt, Homo sapiens
gcacgucacuuacaaugcu

SEQ ID NO: 270219 - RNA, 19 nt, Homo sapiens
uuaagacucuaucugauug

SEQ ID NO: 270220 - RNA, 19 nt, Homo sapiens
gacaaggcgucgcuguauu

SEQ ID NO: 270221 - RNA, 19 nt, Homo sapiens
gcacagggaaugcaccuau

SEQ ID NO: 270222 - RNA, 19 nt, Homo sapiens
cugggaaccugaacacuaa

SEQ ID NO: 270223 - RNA, 19 nt, Homo sapiens
gggaaacauggcuaauuua

SEQ ID NO: 270224 - RNA, 19 nt, Homo sapiens
ggagucugcuuacuuacug

SEQ ID NO: 270225 - RNA, 19 nt, Homo sapiens
ggaaauacaguuguucaug

SEQ ID NO: 270226 - RNA, 19 nt, Homo sapiens
cccaggaacuguacucuug

SEQ ID NO: 270227 - RNA, 19 nt, Homo sapiens
ccgcugauguggauauuau

SEQ ID NO: 270228 - RNA, 19 nt, Homo sapiens
ggaacuguacucuugguuu

SEQ ID NO: 270229 - RNA, 19 nt, Homo sapiens
gagcagaggaaacugaaug

SEQ ID NO: 270230 - RNA, 19 nt, Homo sapiens
gcauuggagcacuuaauaa

SEQ ID NO: 270231 - RNA, 19 nt, Homo sapiens
ccagggaaauacaguuguu

SEQ ID NO: 270232 - RNA, 19 nt, Homo sapiens
ggaaugcaccuauuauugc

SEQ ID NO: 270233 - RNA, 19 nt, Homo sapiens
ccaauguucuuaagacucu

SEQ ID NO: 270234 - RNA, 19 nt, Homo sapiens
ccaccaacuucaucagaga

SEQ ID NO: 270235 - RNA, 19 nt, Homo sapiens
gaaacauggcuaauuuaca

SEQ ID NO: 270236 - RNA, 19 nt, Homo sapiens
ggaaacauggcuaauuuac

SEQ ID NO: 270237 - RNA, 19 nt, Homo sapiens
guaccacgccagggaaaua

SEQ ID NO: 270238 - RNA, 19 nt, Homo sapiens
acaagcacgucacuuacaa

SEQ ID NO: 270239 - RNA, 19 nt, Homo sapiens
cagcagagagauuucauug

SEQ ID NO: 270240 - RNA, 19 nt, Homo sapiens
gauagaucaugcaaaagua

SEQ ID NO: 270241 - RNA, 19 nt, Homo sapiens
ggauguuacuagcaacuuc

SEQ ID NO: 270242 - RNA, 19 nt, Homo sapiens
ugcaagcuauucaucaauu

SEQ ID NO: 270243 - RNA, 19 nt, Homo sapiens
gcugauguggauauuauuu

SEQ ID NO: 270244 - RNA, 19 nt, Homo sapiens
acugaugccuccucuagaa

SEQ ID NO: 270245 - RNA, 19 nt, Homo sapiens
gcacaacaacuccaacaac

SEQ ID NO: 270246 - RNA, 19 nt, Homo sapiens
cgacuacgcgcucaucuuc

SEQ ID NO: 270247 - RNA, 19 nt, Homo sapiens
gaaugcaccuauuauugcu

SEQ ID NO: 270248 - RNA, 19 nt, Homo sapiens
acagggaaugcaccuauua

SEQ ID NO: 270249 - RNA, 19 nt, Homo sapiens
caucagagaguagcuagaa

SEQ ID NO: 270250 - RNA, 19 nt, Homo sapiens
caugguaccuaacacauac

SEQ ID NO: 270251 - RNA, 19 nt, Homo sapiens
gcgcucaucuucggcaugu

SEQ ID NO: 270252 - RNA, 19 nt, Homo sapiens
acgacaagcacgucacuua

SEQ ID NO: 270253 - RNA, 19 nt, Homo sapiens
ccacagcaccaccaacuuc

SEQ ID NO: 270254 - RNA, 19 nt, Homo sapiens
gaggauuguuacccuggaa

SEQ ID NO: 270255 - RNA, 19 nt, Homo sapiens
ggaauuaugggugcugguu

SEQ ID NO: 270256 - RNA, 19 nt, Homo sapiens
guaccaugaucaacaggau

SEQ ID NO: 270257 - RNA, 19 nt, Homo sapiens
ccuguaauuucacuaacuu

SEQ ID NO: 270258 - RNA, 19 nt, Homo sapiens
aaacuagagacuuugauug

SEQ ID NO: 270259 - RNA, 19 nt, Homo sapiens
gcuagaacuuaccaaagca

SEQ ID NO: 270260 - RNA, 19 nt, Homo sapiens
gcaccuauuauugcuauau

SEQ ID NO: 270261 - RNA, 19 nt, Homo sapiens
uguccgagcuugugaaagg

SEQ ID NO: 270262 - RNA, 19 nt, Homo sapiens
uucaugcacuucaaacaaa

SEQ ID NO: 270263 - RNA, 19 nt, Homo sapiens
ccgagaucguggugucuaa

SEQ ID NO: 270264 - RNA, 19 nt, Homo sapiens
ugaaagguaccaugaucaa

SEQ ID NO: 270265 - RNA, 19 nt, Homo sapiens
gccggaaccugcacgagau

SEQ ID NO: 270266 - RNA, 19 nt, Homo sapiens
gaagagaauaaguuaacca

SEQ ID NO: 270267 - RNA, 19 nt, Homo sapiens
ccugcaagcuauucaucaa

SEQ ID NO: 270268 - RNA, 19 nt, Homo sapiens
ugugaaagguaccaugauc

SEQ ID NO: 270269 - RNA, 19 nt, Homo sapiens
ccacaaccaccgcugaugu

SEQ ID NO: 270270 - RNA, 19 nt, Homo sapiens
cggcuugccuucuccuaug

SEQ ID NO: 270271 - RNA, 19 nt, Homo sapiens
cacagggaaugcaccuauu

SEQ ID NO: 270272 - RNA, 19 nt, Homo sapiens
ucagagaguagcuagaaga

SEQ ID NO: 270273 - RNA, 19 nt, Homo sapiens
cacaauuucaugauggaua

SEQ ID NO: 270274 - RNA, 19 nt, Homo sapiens
aggcgucgcuguauuccuu

SEQ ID NO: 270275 - RNA, 19 nt, Homo sapiens
caaccuggcgcucuaugga

SEQ ID NO: 270276 - RNA, 19 nt, Homo sapiens
ccaacuucaucagagagua

SEQ ID NO: 270277 - RNA, 19 nt, Homo sapiens
gacaagcacgucacuuaca

SEQ ID NO: 270278 - RNA, 19 nt, Homo sapiens
gcagcagagagauuucauu

SEQ ID NO: 270279 - RNA, 19 nt, Homo sapiens
gagcacaacaacuccaaca

SEQ ID NO: 270280 - RNA, 19 nt, Homo sapiens
aaagguaccaugaucaaca

SEQ ID NO: 270281 - RNA, 19 nt, Homo sapiens
uagaagcauuggagcacuu

SEQ ID NO: 270282 - RNA, 19 nt, Homo sapiens
ucacugaugccuccucuag

SEQ ID NO: 270283 - RNA, 19 nt, Homo sapiens
ugucuaagcccgagcacaa

SEQ ID NO: 270284 - RNA, 19 nt, Homo sapiens
ccugggaaccugaacacua

SEQ ID NO: 270285 - RNA, 19 nt, Homo sapiens
gccaauguacucagggaaa

SEQ ID NO: 270286 - RNA, 19 nt, Homo sapiens
gagcagaugacuggagaau

SEQ ID NO: 270287 - RNA, 19 nt, Homo sapiens
gagaguagcuagaagagaa

SEQ ID NO: 270288 - RNA, 19 nt, Homo sapiens
aaaggagucugcuuacuua

SEQ ID NO: 270289 - RNA, 19 nt, Homo sapiens
gagaauaaguuaaccacaa

SEQ ID NO: 270290 - RNA, 19 nt, Homo sapiens
gcaagcuauucaucaauua

SEQ ID NO: 270291 - RNA, 19 nt, Homo sapiens
gcagagagauuucauugag

SEQ ID NO: 270292 - RNA, 19 nt, Homo sapiens
gcaaggaagcuagaacuua

SEQ ID NO: 270293 - RNA, 19 nt, Homo sapiens
gcaaagacccagaacauca

SEQ ID NO: 270294 - RNA, 19 nt, Homo sapiens
ggaagaaacuccgaacaca

SEQ ID NO: 270295 - RNA, 19 nt, Homo sapiens
gcacuucaaacaaacuuua

SEQ ID NO: 270296 - RNA, 19 nt, Homo sapiens
gcuagaagagaauaaguua

SEQ ID NO: 270297 - RNA, 19 nt, Homo sapiens
aaaugcagcugccaaugua

SEQ ID NO: 270298 - RNA, 19 nt, Homo sapiens
ggagcgaugugguugauau

SEQ ID NO: 270299 - RNA, 19 nt, Homo sapiens
gaaacugaaugaccaagca

SEQ ID NO: 270300 - RNA, 19 nt, Homo sapiens
cgaaaggucugcagcuuca

SEQ ID NO: 270301 - RNA, 19 nt, Homo sapiens
cuagagacuuugauuggua

SEQ ID NO: 270302 - RNA, 19 nt, Homo sapiens
caaggaagcuagaacuuac

SEQ ID NO: 270303 - RNA, 19 nt, Homo sapiens
gaacuuaccaaagcagaaa

SEQ ID NO: 270304 - RNA, 19 nt, Homo sapiens
gauuguuccuccuguaauu

SEQ ID NO: 270305 - RNA, 19 nt, Homo sapiens
agggaaacauggcuaauuu

SEQ ID NO: 270306 - RNA, 19 nt, Homo sapiens
gaaccugaacacuaaguuu

SEQ ID NO: 270307 - RNA, 19 nt, Homo sapiens
gaaaauuccugcaagcuau

SEQ ID NO: 270308 - RNA, 19 nt, Homo sapiens
gaagcuagaacuuaccaaa

SEQ ID NO: 270309 - RNA, 19 nt, Homo sapiens
gggaaugcaccuauuauug

SEQ ID NO: 270310 - RNA, 19 nt, Homo sapiens
uguggaagcuuuguucuuu

SEQ ID NO: 270311 - RNA, 19 nt, Homo sapiens
gcacgucacuuacaaugcu

SEQ ID NO: 270312 - RNA, 19 nt, Homo sapiens
gaacacauccgaacaucag

SEQ ID NO: 270313 - RNA, 19 nt, Homo sapiens
gcacagggaaugcaccuau

SEQ ID NO: 270314 - RNA, 19 nt, Homo sapiens
cugggaaccugaacacuaa

SEQ ID NO: 270315 - RNA, 19 nt, Homo sapiens
gggaaacauggcuaauuua

SEQ ID NO: 270316 - RNA, 19 nt, Homo sapiens
ggagucugcuuacuuacug

SEQ ID NO: 270317 - RNA, 19 nt, Homo sapiens
gagcagaggaaacugaaug

SEQ ID NO: 270318 - RNA, 19 nt, Homo sapiens
gaacccaccagaaggaaga

SEQ ID NO: 270319 - RNA, 19 nt, Homo sapiens
gguccacacugccuuuaug

SEQ ID NO: 270320 - RNA, 19 nt, Homo sapiens
ggaaugcaccuauuauugc

SEQ ID NO: 270321 - RNA, 19 nt, Homo sapiens
ucaacacuguggaagcuuu

SEQ ID NO: 270322 - RNA, 19 nt, Homo sapiens
ccaccaacuucaucagaga

SEQ ID NO: 270323 - RNA, 19 nt, Homo sapiens
gaacaucagaaggaacaaa

SEQ ID NO: 270324 - RNA, 19 nt, Homo sapiens
gaaacauggcuaauuuaca

SEQ ID NO: 270325 - RNA, 19 nt, Homo sapiens
ggaaacauggcuaauuuac

SEQ ID NO: 270326 - RNA, 19 nt, Homo sapiens
guccagggcuucguucuug

SEQ ID NO: 270327 - RNA, 19 nt, Homo sapiens
gaagaaacuccgaacacau

SEQ ID NO: 270328 - RNA, 19 nt, Homo sapiens
ggaaugaacaacuccagau

SEQ ID NO: 270329 - RNA, 19 nt, Homo sapiens
acaagcacgucacuuacaa

SEQ ID NO: 270330 - RNA, 19 nt, Homo sapiens
cagcagagagauuucauug

SEQ ID NO: 270331 - RNA, 19 nt, Homo sapiens
gcaguaccaugaucaacag

SEQ ID NO: 270332 - RNA, 19 nt, Homo sapiens
gaccaagaacccaccaauu

SEQ ID NO: 270333 - RNA, 19 nt, Homo sapiens
gaaugaacaacuccagaug

SEQ ID NO: 270334 - RNA, 19 nt, Homo sapiens
gauagaucaugcaaaagua

SEQ ID NO: 270335 - RNA, 19 nt, Homo sapiens
ggauguuacuagcaacuuc

SEQ ID NO: 270336 - RNA, 19 nt, Homo sapiens
ugcaagcuauucaucaauu

SEQ ID NO: 270337 - RNA, 19 nt, Homo sapiens
gaaugcaccuauuauugcu

SEQ ID NO: 270338 - RNA, 19 nt, Homo sapiens
acagggaaugcaccuauua

SEQ ID NO: 270339 - RNA, 19 nt, Homo sapiens
caucagagaguagcuagaa

SEQ ID NO: 270340 - RNA, 19 nt, Homo sapiens
caugguaccuaacacauac

SEQ ID NO: 270341 - RNA, 19 nt, Homo sapiens
cagaugcaccgccuuaaga

SEQ ID NO: 270342 - RNA, 19 nt, Homo sapiens
acgacaagcacgucacuua

SEQ ID NO: 270343 - RNA, 19 nt, Homo sapiens
ccacagcaccaccaacuuc

SEQ ID NO: 270344 - RNA, 19 nt, Homo sapiens
gaggauuguuacccuggaa

SEQ ID NO: 270345 - RNA, 19 nt, Homo sapiens
ggaauuaugggugcugguu

SEQ ID NO: 270346 - RNA, 19 nt, Homo sapiens
guaccaugaucaacaggau

SEQ ID NO: 270347 - RNA, 19 nt, Homo sapiens
ccuguaauuucacuaacuu

SEQ ID NO: 270348 - RNA, 19 nt, Homo sapiens
aaacuagagacuuugauug

SEQ ID NO: 270349 - RNA, 19 nt, Homo sapiens
gcuagaacuuaccaaagca

SEQ ID NO: 270350 - RNA, 19 nt, Homo sapiens
ggacgcaguaccaugauca

SEQ ID NO: 270351 - RNA, 19 nt, Homo sapiens
gcaccuauuauugcuauau

SEQ ID NO: 270352 - RNA, 19 nt, Homo sapiens
uucaugcacuucaaacaaa

SEQ ID NO: 270353 - RNA, 19 nt, Homo sapiens
gaagagaauaaguuaacca

SEQ ID NO: 270354 - RNA, 19 nt, Homo sapiens
ccugcaagcuauucaucaa

SEQ ID NO: 270355 - RNA, 19 nt, Homo sapiens
cacagggaaugcaccuauu

SEQ ID NO: 270356 - RNA, 19 nt, Homo sapiens
ucagagaguagcuagaaga

SEQ ID NO: 270357 - RNA, 19 nt, Homo sapiens
ccacagggaggaaugaaca

SEQ ID NO: 270358 - RNA, 19 nt, Homo sapiens
cacaauuucaugauggaua

SEQ ID NO: 270359 - RNA, 19 nt, Homo sapiens
gaagucagugagaccaaga

SEQ ID NO: 270360 - RNA, 19 nt, Homo sapiens
gaccaggaacccaccagaa

SEQ ID NO: 270361 - RNA, 19 nt, Homo sapiens
ccaacuucaucagagagua

SEQ ID NO: 270362 - RNA, 19 nt, Homo sapiens
gacaagcacgucacuuaca

SEQ ID NO: 270363 - RNA, 19 nt, Homo sapiens
gcagcagagagauuucauu

SEQ ID NO: 270364 - RNA, 19 nt, Homo sapiens
ccugggaaccugaacacua

SEQ ID NO: 270365 - RNA, 19 nt, Homo sapiens
gccaauguacucagggaaa

SEQ ID NO: 270366 - RNA, 19 nt, Homo sapiens
caaagacccagaacaucau

SEQ ID NO: 270367 - RNA, 19 nt, Homo sapiens
cagggaaacauggcuaauu

SEQ ID NO: 270368 - RNA, 19 nt, Homo sapiens
uagauuguuccuccuguaa

SEQ ID NO: 270369 - RNA, 19 nt, Homo sapiens
ggcagcagcagagagauuu

SEQ ID NO: 270370 - RNA, 19 nt, Homo sapiens
uggauacucagcugacuaa

SEQ ID NO: 270371 - RNA, 19 nt, Homo sapiens
accaagaacccaccaauuc

SEQ ID NO: 270372 - RNA, 19 nt, Homo sapiens
auagauuguuccuccugua

SEQ ID NO: 270373 - RNA, 19 nt, Homo sapiens
acaauuucaugauggauac

SEQ ID NO: 270374 - RNA, 19 nt, Homo sapiens
cugcuuacuuacuggaauu

SEQ ID NO: 270375 - RNA, 19 nt, Homo sapiens
cauccgaacaucagaagga

SEQ ID NO: 270376 - RNA, 19 nt, Homo sapiens
guggaagcuuuguucuuuc

SEQ ID NO: 270377 - RNA, 19 nt, Homo sapiens
ggaaccugaacacuaaguu

SEQ ID NO: 270378 - RNA, 19 nt, Homo sapiens
aagaaacuccgaacacauc

SEQ ID NO: 270379 - RNA, 19 nt, Homo sapiens
ucaggcagcagcagagaga

SEQ ID NO: 270380 - RNA, 19 nt, Homo sapiens
uggcaaagacccagaacau

SEQ ID NO: 270381 - RNA, 19 nt, Homo sapiens
uagcuguaguggcaaggaa

SEQ ID NO: 270382 - RNA, 19 nt, Homo sapiens
acaugguaccuaacacaua

SEQ ID NO: 270383 - RNA, 19 nt, Homo sapiens
cggcgaaggucugcagcuu

SEQ ID NO: 270384 - RNA, 19 nt, Homo sapiens
auggugacaugguaccuaa

SEQ ID NO: 270385 - RNA, 19 nt, Homo sapiens
caacuucaucagagaguag

SEQ ID NO: 270386 - RNA, 19 nt, Homo sapiens
gaaaaggagucugcuuacu

SEQ ID NO: 270387 - RNA, 19 nt, Homo sapiens
gaacacaccucucuccuuu

SEQ ID NO: 270388 - RNA, 19 nt, Homo sapiens
ggacguaacuaguaacuuu

SEQ ID NO: 270389 - RNA, 19 nt, Homo sapiens
acacaaagcugcuaaagaa

SEQ ID NO: 270390 - RNA, 19 nt, Homo sapiens
gaaagcgacugagugacua

SEQ ID NO: 270391 - RNA, 19 nt, Homo sapiens
agaccgagcuaauuaacua

SEQ ID NO: 270392 - RNA, 19 nt, Homo sapiens
ccaauacaaugcauucuug

SEQ ID NO: 270393 - RNA, 19 nt, Homo sapiens
gaagagagaccgagcuaau

SEQ ID NO: 270394 - RNA, 19 nt, Homo sapiens
gcgaagaccuggagaagca

SEQ ID NO: 270395 - RNA, 19 nt, Homo sapiens
ggaaacaugguuaaucuau

SEQ ID NO: 270396 - RNA, 19 nt, Homo sapiens
caagaaugcugcagccaau

SEQ ID NO: 270397 - RNA, 19 nt, Homo sapiens
ugaaaugccuuaucagucu

SEQ ID NO: 270398 - RNA, 19 nt, Homo sapiens
aaacagauauacucgaauc

SEQ ID NO: 270399 - RNA, 19 nt, Homo sapiens
aaagagagcugcccacaac

SEQ ID NO: 270400 - RNA, 19 nt, Homo sapiens
gaagauugaccaugccaaa

SEQ ID NO: 270401 - RNA, 19 nt, Homo sapiens
agagagaccgagcuaauua

SEQ ID NO: 270402 - RNA, 19 nt, Homo sapiens
ucaacaagaucaacuucaa

SEQ ID NO: 270403 - RNA, 19 nt, Homo sapiens
gaucaucgccuaccacaca

SEQ ID NO: 270404 - RNA, 19 nt, Homo sapiens
gcccugaaaugccuuauca

SEQ ID NO: 270405 - RNA, 19 nt, Homo sapiens
gguccgacaugccuugaaa

SEQ ID NO: 270406 - RNA, 19 nt, Homo sapiens
gccaugagcuccugcaagu

SEQ ID NO: 270407 - RNA, 19 nt, Homo sapiens
gcagccagcucaaucucaa

SEQ ID NO: 270408 - RNA, 19 nt, Homo sapiens
cagcaggacguaacuagua

SEQ ID NO: 270409 - RNA, 19 nt, Homo sapiens
ggaaacaccagaggaaguu

SEQ ID NO: 270410 - RNA, 19 nt, Homo sapiens
caaagcugcuaaagaagau

SEQ ID NO: 270411 - RNA, 19 nt, Homo sapiens
cggagaagcacguucauaa

SEQ ID NO: 270412 - RNA, 19 nt, Homo sapiens
ccagaagcauuacccauag

SEQ ID NO: 270413 - RNA, 19 nt, Homo sapiens
cagauauacucgaaucaga

SEQ ID NO: 270414 - RNA, 19 nt, Homo sapiens
gaagaggagaugacaggaa

SEQ ID NO: 270415 - RNA, 19 nt, Homo sapiens
gaugcagaaugucauguau

SEQ ID NO: 270416 - RNA, 19 nt, Homo sapiens
gcacguucauaacuucaug

SEQ ID NO: 270417 - RNA, 19 nt, Homo sapiens
ugaagacgcucaugaccau

SEQ ID NO: 270418 - RNA, 19 nt, Homo sapiens
ggauagccaugaccuacga

SEQ ID NO: 270419 - RNA, 19 nt, Homo sapiens
gcggaugacuggcggauag

SEQ ID NO: 270420 - RNA, 19 nt, Homo sapiens
gagugacuaugcucugauu

SEQ ID NO: 270421 - RNA, 19 nt, Homo sapiens
caaaacagauauacucgaa

SEQ ID NO: 270422 - RNA, 19 nt, Homo sapiens
gcacugaaguagccaacag

SEQ ID NO: 270423 - RNA, 19 nt, Homo sapiens
ucaaaggacuccauguuuu

SEQ ID NO: 270424 - RNA, 19 nt, Homo sapiens
gagagaccgagcuaauuaa

SEQ ID NO: 270425 - RNA, 19 nt, Homo sapiens
gcauuacccauaggucuua

SEQ ID NO: 270426 - RNA, 19 nt, Homo sapiens
ucaccaagcggaucaagaa

SEQ ID NO: 270427 - RNA, 19 nt, Homo sapiens
ucacauuccuuuccauugg

SEQ ID NO: 270428 - RNA, 19 nt, Homo sapiens
gaaaagagaaagcgacuga

SEQ ID NO: 270429 - RNA, 19 nt, Homo sapiens
agaagcacguucauaacuu

SEQ ID NO: 270430 - RNA, 19 nt, Homo sapiens
ggagggcccuguuugaaaa

SEQ ID NO: 270431 - RNA, 19 nt, Homo sapiens
ggacacuucugggcacuuc

SEQ ID NO: 270432 - RNA, 19 nt, Homo sapiens
ggaagccucugggugacaa

SEQ ID NO: 270433 - RNA, 19 nt, Homo sapiens
ggucuuaagaugcaaauca

SEQ ID NO: 270434 - RNA, 19 nt, Homo sapiens
caaucucaaugaccacuug

SEQ ID NO: 270435 - RNA, 19 nt, Homo sapiens
ccauaggucuuaagaugca

SEQ ID NO: 270436 - RNA, 19 nt, Homo sapiens
acccauaggucuuaagaug

SEQ ID NO: 270437 - RNA, 19 nt, Homo sapiens
cgggaaacaugguuaaucu

SEQ ID NO: 270438 - RNA, 19 nt, Homo sapiens
ucacggagaucgccaugag

SEQ ID NO: 270439 - RNA, 19 nt, Homo sapiens
agagaaagcgacugaguga

SEQ ID NO: 270440 - RNA, 19 nt, Homo sapiens
cugcagaguugguggagaa

SEQ ID NO: 270441 - RNA, 19 nt, Homo sapiens
gaaaccagaaaucuaaucu

SEQ ID NO: 270442 - RNA, 19 nt, Homo sapiens
cuugaaaccagaaaucuaa

SEQ ID NO: 270443 - RNA, 19 nt, Homo sapiens
gauugaccaugccaaagug

SEQ ID NO: 270444 - RNA, 19 nt, Homo sapiens
gagaagcacguucauaacu

SEQ ID NO: 270445 - RNA, 19 nt, Homo sapiens
gcucaucuccaucacauuc

SEQ ID NO: 270446 - RNA, 19 nt, Homo sapiens
cagcgaagccaguccagaa

SEQ ID NO: 270447 - RNA, 19 nt, Homo sapiens
ccaagcggaucaagaaugc

SEQ ID NO: 270448 - RNA, 19 nt, Homo sapiens
caacuucaacacccgcuuu

SEQ ID NO: 270449 - RNA, 19 nt, Homo sapiens
gagagcugcccacaacuug

SEQ ID NO: 270450 - RNA, 19 nt, Homo sapiens
gcuccugucugccaucauc

SEQ ID NO: 270451 - RNA, 19 nt, Homo sapiens
gccaauguccuucgggaaa

SEQ ID NO: 270452 - RNA, 19 nt, Homo sapiens
gaauuguuguuauggugau

SEQ ID NO: 270453 - RNA, 19 nt, Homo sapiens
caugagcuccugcaaguau

SEQ ID NO: 270454 - RNA, 19 nt, Homo sapiens
ccagggaacggaaagaaga

SEQ ID NO: 270455 - RNA, 19 nt, Homo sapiens
agucgaagcuggagcaucu

SEQ ID NO: 270456 - RNA, 19 nt, Homo sapiens
caacacccgcuuugucaug

SEQ ID NO: 270457 - RNA, 19 nt, Homo sapiens
ggcccuugcugcagaguug

SEQ ID NO: 270458 - RNA, 19 nt, Homo sapiens
gcuaauuaacuaacucaug

SEQ ID NO: 270459 - RNA, 19 nt, Homo sapiens
caagcuauccaccaguuga

SEQ ID NO: 270460 - RNA, 19 nt, Homo sapiens
acaaagcugcuaaagaaga

SEQ ID NO: 270461 - RNA, 19 nt, Homo sapiens
aaccagaaaucuaaucucu

SEQ ID NO: 270462 - RNA, 19 nt, Homo sapiens
uuuccaagaugcagaaugu

SEQ ID NO: 270463 - RNA, 19 nt, Homo sapiens
ccauguggcucaucuccau

SEQ ID NO: 270464 - RNA, 19 nt, Homo sapiens
acaccucucuccuuuccuu

SEQ ID NO: 270465 - RNA, 19 nt, Homo sapiens
uccagaagcauuacccaua

SEQ ID NO: 270466 - RNA, 19 nt, Homo sapiens
gcuuugccaucaagaaaca

SEQ ID NO: 270467 - RNA, 19 nt, Homo sapiens
gucuuaagaugcaaaucaa

SEQ ID NO: 270468 - RNA, 19 nt, Homo sapiens
uacacaaguucaagcaguu

SEQ ID NO: 270469 - RNA, 19 nt, Homo sapiens
ugaggaaacaccagaggaa

SEQ ID NO: 270470 - RNA, 19 nt, Homo sapiens
aaacacacaaagcugcuaa

SEQ ID NO: 270471 - RNA, 19 nt, Homo sapiens
ucuccaaguuccacagcua

SEQ ID NO: 270472 - RNA, 19 nt, Homo sapiens
ggaacggaaagaagagaga

SEQ ID NO: 270473 - RNA, 19 nt, Homo sapiens
gggaaacaugguuaaucua

SEQ ID NO: 270474 - RNA, 19 nt, Homo sapiens
gaggacuggagccaagaua

SEQ ID NO: 270475 - RNA, 19 nt, Homo sapiens
ggagaagcacguucauaac

SEQ ID NO: 270476 - RNA, 19 nt, Homo sapiens
gcggagaagcacguucaua

SEQ ID NO: 270477 - RNA, 19 nt, Homo sapiens
caaggcagccagcucaauc

SEQ ID NO: 270478 - RNA, 19 nt, Homo sapiens
guuuggaauuguuguuaug

SEQ ID NO: 270479 - RNA, 19 nt, Homo sapiens
gaaauccacgcucaaucuc

SEQ ID NO: 270480 - RNA, 19 nt, Homo sapiens
gagcuaauuaacuaacuca

SEQ ID NO: 270481 - RNA, 19 nt, Homo sapiens
uguaugacuuaaucacaga

SEQ ID NO: 270482 - RNA, 19 nt, Homo sapiens
ugaggagcgucaagaugga

SEQ ID NO: 270483 - RNA, 19 nt, Homo sapiens
caucacauuccuuuccauu

SEQ ID NO: 270484 - RNA, 19 nt, Homo sapiens
agcaggacguaacuaguaa

SEQ ID NO: 270485 - RNA, 19 nt, Homo sapiens
gagcgaagaccuggagaag

SEQ ID NO: 270486 - RNA, 19 nt, Homo sapiens
cucaaaggacuccauguuu

SEQ ID NO: 270487 - RNA, 19 nt, Homo sapiens
gaacacaccucucuccuuu

SEQ ID NO: 270488 - RNA, 19 nt, Homo sapiens
ggacguaacuaguaacuuu

SEQ ID NO: 270489 - RNA, 19 nt, Homo sapiens
acacaaagcugcuaaagaa

SEQ ID NO: 270490 - RNA, 19 nt, Homo sapiens
agaccgagcuaauuaacua

SEQ ID NO: 270491 - RNA, 19 nt, Homo sapiens
ggacaguuguuugguguuu

SEQ ID NO: 270492 - RNA, 19 nt, Homo sapiens
gaagagagaccgagcuaau

SEQ ID NO: 270493 - RNA, 19 nt, Homo sapiens
gcgaagaccuggagaagca

SEQ ID NO: 270494 - RNA, 19 nt, Homo sapiens
caaauuaacaggaaaguca

SEQ ID NO: 270495 - RNA, 19 nt, Homo sapiens
ggaaacaugguuaaucuau

SEQ ID NO: 270496 - RNA, 19 nt, Homo sapiens
caagaaugcugcagccaau

SEQ ID NO: 270497 - RNA, 19 nt, Homo sapiens
ugaaaugccuuaucagucu

SEQ ID NO: 270498 - RNA, 19 nt, Homo sapiens
aaacagauauacucgaauc

SEQ ID NO: 270499 - RNA, 19 nt, Homo sapiens
aaagagagcugcccacaac

SEQ ID NO: 270500 - RNA, 19 nt, Homo sapiens
gaagauugaccaugccaaa

SEQ ID NO: 270501 - RNA, 19 nt, Homo sapiens
uaacaggaaagucagcuua

SEQ ID NO: 270502 - RNA, 19 nt, Homo sapiens
agagagaccgagcuaauua

SEQ ID NO: 270503 - RNA, 19 nt, Homo sapiens
ucaacaagaucaacuucaa

SEQ ID NO: 270504 - RNA, 19 nt, Homo sapiens
gaucaucgccuaccacaca

SEQ ID NO: 270505 - RNA, 19 nt, Homo sapiens
uauaaaggacuccauguuu

SEQ ID NO: 270506 - RNA, 19 nt, Homo sapiens
gcccugaaaugccuuauca

SEQ ID NO: 270507 - RNA, 19 nt, Homo sapiens
gguccgacaugccuugaaa

SEQ ID NO: 270508 - RNA, 19 nt, Homo sapiens
cagcaggacguaacuagua

SEQ ID NO: 270509 - RNA, 19 nt, Homo sapiens
ggaaacaccagaggaaguu

SEQ ID NO: 270510 - RNA, 19 nt, Homo sapiens
caaagcugcuaaagaagau

SEQ ID NO: 270511 - RNA, 19 nt, Homo sapiens
cggagaagcacguucauaa

SEQ ID NO: 270512 - RNA, 19 nt, Homo sapiens
ccagaagcauuacccauag

SEQ ID NO: 270513 - RNA, 19 nt, Homo sapiens
cagauauacucgaaucaga

SEQ ID NO: 270514 - RNA, 19 nt, Homo sapiens
gaagaggagaugacaggaa

SEQ ID NO: 270515 - RNA, 19 nt, Homo sapiens
gaugcagaaugucauguau

SEQ ID NO: 270516 - RNA, 19 nt, Homo sapiens
gcacguucauaacuucaug

SEQ ID NO: 270517 - RNA, 19 nt, Homo sapiens
ugaagacgcucaugaccau

SEQ ID NO: 270518 - RNA, 19 nt, Homo sapiens
ggauagccaugaccuacga

SEQ ID NO: 270519 - RNA, 19 nt, Homo sapiens
gcggaugacuggcggauag

SEQ ID NO: 270520 - RNA, 19 nt, Homo sapiens
caaaacagauauacucgaa

SEQ ID NO: 270521 - RNA, 19 nt, Homo sapiens
gcacugaaguagccaacag

SEQ ID NO: 270522 - RNA, 19 nt, Homo sapiens
gagagaccgagcuaauuaa

SEQ ID NO: 270523 - RNA, 19 nt, Homo sapiens
gcauuacccauaggucuua

SEQ ID NO: 270524 - RNA, 19 nt, Homo sapiens
ucaccaagcggaucaagaa

SEQ ID NO: 270525 - RNA, 19 nt, Homo sapiens
ucacauuccuuuccauugg

SEQ ID NO: 270526 - RNA, 19 nt, Homo sapiens
ccuuagagcuugcugauac

SEQ ID NO: 270527 - RNA, 19 nt, Homo sapiens
agaagcacguucauaacuu

SEQ ID NO: 270528 - RNA, 19 nt, Homo sapiens
ggaagccucugggugacaa

SEQ ID NO: 270529 - RNA, 19 nt, Homo sapiens
ggucuuaagaugcaaauca

SEQ ID NO: 270530 - RNA, 19 nt, Homo sapiens
ccauaggucuuaagaugca

SEQ ID NO: 270531 - RNA, 19 nt, Homo sapiens
acccauaggucuuaagaug

SEQ ID NO: 270532 - RNA, 19 nt, Homo sapiens
cgggaaacaugguuaaucu

SEQ ID NO: 270533 - RNA, 19 nt, Homo sapiens
ggaaagucagcuuaaagga

SEQ ID NO: 270534 - RNA, 19 nt, Homo sapiens
acaggaaagucagcuuaaa

SEQ ID NO: 270535 - RNA, 19 nt, Homo sapiens
cugcagaguugguggagaa

SEQ ID NO: 270536 - RNA, 19 nt, Homo sapiens
gaaaccagaaaucuaaucu

SEQ ID NO: 270537 - RNA, 19 nt, Homo sapiens
cuugaaaccagaaaucuaa

SEQ ID NO: 270538 - RNA, 19 nt, Homo sapiens
gauugaccaugccaaagug

SEQ ID NO: 270539 - RNA, 19 nt, Homo sapiens
gagaagcacguucauaacu

SEQ ID NO: 270540 - RNA, 19 nt, Homo sapiens
gcucaucuccaucacauuc

SEQ ID NO: 270541 - RNA, 19 nt, Homo sapiens
cagcgaagccaguccagaa

SEQ ID NO: 270542 - RNA, 19 nt, Homo sapiens
ccaagcggaucaagaaugc

SEQ ID NO: 270543 - RNA, 19 nt, Homo sapiens
caacuucaacacccgcuuu

SEQ ID NO: 270544 - RNA, 19 nt, Homo sapiens
gagagcugcccacaacuug

SEQ ID NO: 270545 - RNA, 19 nt, Homo sapiens
gcuccugucugccaucauc

SEQ ID NO: 270546 - RNA, 19 nt, Homo sapiens
gccaauguccuucgggaaa

SEQ ID NO: 270547 - RNA, 19 nt, Homo sapiens
ccagggaacggaaagaaga

SEQ ID NO: 270548 - RNA, 19 nt, Homo sapiens
agucgaagcuggagcaucu

SEQ ID NO: 270549 - RNA, 19 nt, Homo sapiens
caacacccgcuuugucaug

SEQ ID NO: 270550 - RNA, 19 nt, Homo sapiens
ggcccuugcugcagaguug

SEQ ID NO: 270551 - RNA, 19 nt, Homo sapiens
gcuaauuaacuaacucaug

SEQ ID NO: 270552 - RNA, 19 nt, Homo sapiens
caagcuauccaccaguuga

SEQ ID NO: 270553 - RNA, 19 nt, Homo sapiens
acaaagcugcuaaagaaga

SEQ ID NO: 270554 - RNA, 19 nt, Homo sapiens
aaccagaaaucuaaucucu

SEQ ID NO: 270555 - RNA, 19 nt, Homo sapiens
uuuccaagaugcagaaugu

SEQ ID NO: 270556 - RNA, 19 nt, Homo sapiens
ccauguggcucaucuccau

SEQ ID NO: 270557 - RNA, 19 nt, Homo sapiens
acaccucucuccuuuccuu

SEQ ID NO: 270558 - RNA, 19 nt, Homo sapiens
uagauggagagaccuauaa

SEQ ID NO: 270559 - RNA, 19 nt, Homo sapiens
uccagaagcauuacccaua

SEQ ID NO: 270560 - RNA, 19 nt, Homo sapiens
gcuuugccaucaagaaaca

SEQ ID NO: 270561 - RNA, 19 nt, Homo sapiens
auaaaggacuccauguuuu

SEQ ID NO: 270562 - RNA, 19 nt, Homo sapiens
gucuuaagaugcaaaucaa

SEQ ID NO: 270563 - RNA, 19 nt, Homo sapiens
uacacaaguucaagcaguu

SEQ ID NO: 270564 - RNA, 19 nt, Homo sapiens
ugaggaaacaccagaggaa

SEQ ID NO: 270565 - RNA, 19 nt, Homo sapiens
aaacacacaaagcugcuaa

SEQ ID NO: 270566 - RNA, 19 nt, Homo sapiens
ggaacggaaagaagagaga

SEQ ID NO: 270567 - RNA, 19 nt, Homo sapiens
gggaaacaugguuaaucua

SEQ ID NO: 270568 - RNA, 19 nt, Homo sapiens
ggagaagcacguucauaac

SEQ ID NO: 270569 - RNA, 19 nt, Homo sapiens
gcggagaagcacguucaua

SEQ ID NO: 270570 - RNA, 19 nt, Homo sapiens
gaaauccacgcucaaucuc

SEQ ID NO: 270571 - RNA, 19 nt, Homo sapiens
gagcuaauuaacuaacuca

SEQ ID NO: 270572 - RNA, 19 nt, Homo sapiens
uguaugacuuaaucacaga

SEQ ID NO: 270573 - RNA, 19 nt, Homo sapiens
ugaggagcgucaagaugga

SEQ ID NO: 270574 - RNA, 19 nt, Homo sapiens
caucacauuccuuuccauu

SEQ ID NO: 270575 - RNA, 19 nt, Homo sapiens
agcaggacguaacuaguaa

SEQ ID NO: 270576 - RNA, 19 nt, Homo sapiens
cuauaaaggacuccauguu

SEQ ID NO: 270577 - RNA, 19 nt, Homo sapiens
gagcgaagaccuggagaag

SEQ ID NO: 270578 - RNA, 19 nt, Homo sapiens
caacuugccaaaacagaua

SEQ ID NO: 270579 - RNA, 19 nt, Homo sapiens
gaccagggaacggaaagaa

SEQ ID NO: 270580 - RNA, 19 nt, Homo sapiens
ggagcgaagaccuggagaa

SEQ ID NO: 270581 - RNA, 19 nt, Homo sapiens
caagaugcagaaugucaug

SEQ ID NO: 270582 - RNA, 19 nt, Homo sapiens
gcuggcaccuacuccuuag

SEQ ID NO: 270583 - RNA, 19 nt, Homo sapiens
ccugaucgcccgagucaug

SEQ ID NO: 270584 - RNA, 19 nt, Homo sapiens
agaaauccacgcucaaucu

SEQ ID NO: 270585 - RNA, 19 nt, Homo sapiens
gagcuggcaccuacuccuu

SEQ ID NO: 270586 - RNA, 19 nt, Homo sapiens
ccuggucgcuuugccauca

SEQ ID NO: 270587 - RNA, 19 nt, Homo sapiens
gaacaaagcaccucaagug

SEQ ID NO: 270588 - RNA, 19 nt, Homo sapiens
ccaaagagguccagcuguu

SEQ ID NO: 270589 - RNA, 19 nt, Homo sapiens
caacaaagaggacaccauu

SEQ ID NO: 270590 - RNA, 19 nt, Homo sapiens
ggaggaaccaggcuacuuu

SEQ ID NO: 270591 - RNA, 19 nt, Homo sapiens
cccggaagcuggaguuuaa

SEQ ID NO: 270592 - RNA, 19 nt, Homo sapiens
guacugaggugguggacau

SEQ ID NO: 270593 - RNA, 19 nt, Homo sapiens
ucaccagccucugcucuua

SEQ ID NO: 270594 - RNA, 19 nt, Homo sapiens
caucggcgcucucaaucaa

SEQ ID NO: 270595 - RNA, 19 nt, Homo sapiens
ggauggacgucucuuucuu

SEQ ID NO: 270596 - RNA, 19 nt, Homo sapiens
uggccaagcuuuacaugaa

SEQ ID NO: 270597 - RNA, 19 nt, Homo sapiens
ggcaggaacuggcauugga

SEQ ID NO: 270598 - RNA, 19 nt, Homo sapiens
cagcauuuccaccuucuua

SEQ ID NO: 270599 - RNA, 19 nt, Homo sapiens
ccucugcucuuaucuuugu

SEQ ID NO: 270600 - RNA, 19 nt, Homo sapiens
gaagcuggaugcccugacu

SEQ ID NO: 270601 - RNA, 19 nt, Homo sapiens
gggaacaagugaacuccau

SEQ ID NO: 270602 - RNA, 19 nt, Homo sapiens
gaccuccagcucucaguua

SEQ ID NO: 270603 - RNA, 19 nt, Homo sapiens
ccacugggcaccuuucaga

SEQ ID NO: 270604 - RNA, 19 nt, Homo sapiens
agaagcacgugcacaacuu

SEQ ID NO: 270605 - RNA, 19 nt, Homo sapiens
ccagccagcaguccaagua

SEQ ID NO: 270606 - RNA, 19 nt, Homo sapiens
ggauauccaguauaccaaa

SEQ ID NO: 270607 - RNA, 19 nt, Homo sapiens
augcagagaugcugugguu

SEQ ID NO: 270608 - RNA, 19 nt, Homo sapiens
gaacuggcauuggacucau

SEQ ID NO: 270609 - RNA, 19 nt, Homo sapiens
gauggacgucucuuucuug

SEQ ID NO: 270610 - RNA, 19 nt, Homo sapiens
uacagaccauuguguguga

SEQ ID NO: 270611 - RNA, 19 nt, Homo sapiens
acaagaagccuggauguuc

SEQ ID NO: 270612 - RNA, 19 nt, Homo sapiens
caaagcccaucgugugucu

SEQ ID NO: 270613 - RNA, 19 nt, Homo sapiens
gcacgugcacaacuucaug

SEQ ID NO: 270614 - RNA, 19 nt, Homo sapiens
cagagaagcacgugcacaa

SEQ ID NO: 270615 - RNA, 19 nt, Homo sapiens
uggccgagcugaagaacug

SEQ ID NO: 270616 - RNA, 19 nt, Homo sapiens
gauauccaguauaccaaag

SEQ ID NO: 270617 - RNA, 19 nt, Homo sapiens
gaggaagaaguguaacuca

SEQ ID NO: 270618 - RNA, 19 nt, Homo sapiens
gaagcuggaguuuaacaag

SEQ ID NO: 270619 - RNA, 19 nt, Homo sapiens
aagccuggauguucuacaa

SEQ ID NO: 270620 - RNA, 19 nt, Homo sapiens
gacaaagcccaucgugugu

SEQ ID NO: 270621 - RNA, 19 nt, Homo sapiens
ccugugcacuggagucaug

SEQ ID NO: 270622 - RNA, 19 nt, Homo sapiens
ggaacuggcauuggacuca

SEQ ID NO: 270623 - RNA, 19 nt, Homo sapiens
gcugaagaacuggguauga

SEQ ID NO: 270624 - RNA, 19 nt, Homo sapiens
gccgagaggcaggcuguua

SEQ ID NO: 270625 - RNA, 19 nt, Homo sapiens
cagcaucggcgcucucaau

SEQ ID NO: 270626 - RNA, 19 nt, Homo sapiens
cgugggcgcucuaccuguu

SEQ ID NO: 270627 - RNA, 19 nt, Homo sapiens
acaacuucaugauggauau

SEQ ID NO: 270628 - RNA, 19 nt, Homo sapiens
ggaagcuggaguuuaacaa

SEQ ID NO: 270629 - RNA, 19 nt, Homo sapiens
caaaguacagaccauugug

SEQ ID NO: 270630 - RNA, 19 nt, Homo sapiens
agaugcacaugauccugua

SEQ ID NO: 270631 - RNA, 19 nt, Homo sapiens
ucuccaagaugcacaugau

SEQ ID NO: 270632 - RNA, 19 nt, Homo sapiens
cgccgugcgugcaggauuu

SEQ ID NO: 270633 - RNA, 19 nt, Homo sapiens
gagaagcacgugcacaacu

SEQ ID NO: 270634 - RNA, 19 nt, Homo sapiens
gcccggaagcuggaguuua

SEQ ID NO: 270635 - RNA, 19 nt, Homo sapiens
ccgagaggcaggcuguuaa

SEQ ID NO: 270636 - RNA, 19 nt, Homo sapiens
ucacaaaguacagaccauu

SEQ ID NO: 270637 - RNA, 19 nt, Homo sapiens
cugguuaaaugcacgauca

SEQ ID NO: 270638 - RNA, 19 nt, Homo sapiens
acaaagaggacaccauuuu

SEQ ID NO: 270639 - RNA, 19 nt, Homo sapiens
gagcugaagaacuggguau

SEQ ID NO: 270640 - RNA, 19 nt, Homo sapiens
ugacccagcccugaacaaa

SEQ ID NO: 270641 - RNA, 19 nt, Homo sapiens
agccucugcucuuaucuuu

SEQ ID NO: 270642 - RNA, 19 nt, Homo sapiens
gagguccagcuguucauga

SEQ ID NO: 270643 - RNA, 19 nt, Homo sapiens
gaagcuccgggaacaagug

SEQ ID NO: 270644 - RNA, 19 nt, Homo sapiens
caaagagguccagcuguuc

SEQ ID NO: 270645 - RNA, 19 nt, Homo sapiens
gccaagcuuuacaugaaca

SEQ ID NO: 270646 - RNA, 19 nt, Homo sapiens
ggaggaagaaguguaacuc

SEQ ID NO: 270647 - RNA, 19 nt, Homo sapiens
cugaagaacuggguaugag

SEQ ID NO: 270648 - RNA, 19 nt, Homo sapiens
ugcacaugauccuguauga

SEQ ID NO: 270649 - RNA, 19 nt, Homo sapiens
gcaccuuucagacacacuu

SEQ ID NO: 270650 - RNA, 19 nt, Homo sapiens
ggccaagcuuuacaugaac

SEQ ID NO: 270651 - RNA, 19 nt, Homo sapiens
aaagagguccagcuguuca

SEQ ID NO: 270652 - RNA, 19 nt, Homo sapiens
cacaaaguacagaccauug

SEQ ID NO: 270653 - RNA, 19 nt, Homo sapiens
gaggaaccaggcuacuuuc

SEQ ID NO: 270654 - RNA, 19 nt, Homo sapiens
cuacaagaagccuggaugu

SEQ ID NO: 270655 - RNA, 19 nt, Homo sapiens
gagaggcaggcuguuaaug

SEQ ID NO: 270656 - RNA, 19 nt, Homo sapiens
gcaucggcgcucucaauca

SEQ ID NO: 270657 - RNA, 19 nt, Homo sapiens
cuccagcucucaguuacaa

SEQ ID NO: 270658 - RNA, 19 nt, Homo sapiens
acaaacauacucgcaggaa

SEQ ID NO: 270659 - RNA, 19 nt, Homo sapiens
guggauggacgucucuuuc

SEQ ID NO: 270660 - RNA, 19 nt, Homo sapiens
cacaacuucaugauggaua

SEQ ID NO: 270661 - RNA, 19 nt, Homo sapiens
ccaguauaccaaagagaug

SEQ ID NO: 270662 - RNA, 19 nt, Homo sapiens
agacacacuuuggcugauc

SEQ ID NO: 270663 - RNA, 19 nt, Homo sapiens
cgagaggcaggcuguuaau

SEQ ID NO: 270664 - RNA, 19 nt, Homo sapiens
cgaucagcauuuccaccuu

SEQ ID NO: 270665 - RNA, 19 nt, Homo sapiens
gcacaacuucaugauggau

SEQ ID NO: 270666 - RNA, 19 nt, Homo sapiens
gugucugugugugucuuua

SEQ ID NO: 270667 - RNA, 19 nt, Homo sapiens
caagaagucugugguggua

SEQ ID NO: 270668 - RNA, 19 nt, Homo sapiens
uaauaaacguggagaauca

SEQ ID NO: 270669 - RNA, 19 nt, Homo sapiens
gagagaagaugcucacagu

SEQ ID NO: 270670 - RNA, 19 nt, Homo sapiens
gcaacacccugcccaccua

SEQ ID NO: 270671 - RNA, 19 nt, Homo sapiens
gggaagcccucacuguuca

SEQ ID NO: 270672 - RNA, 19 nt, Homo sapiens
ggaaaugcuucguuuacca

SEQ ID NO: 270673 - RNA, 19 nt, Homo sapiens
gcggaagccuuacgaugug

SEQ ID NO: 270674 - RNA, 19 nt, Homo sapiens
gggacagucucaccauuuc

SEQ ID NO: 270675 - RNA, 19 nt, Homo sapiens
gagggacagucucaccauu

SEQ ID NO: 270676 - RNA, 19 nt, Homo sapiens
gggaugggccugagugaga

SEQ ID NO: 270677 - RNA, 19 nt, Homo sapiens
gcccaacacugcuggaagu

SEQ ID NO: 270678 - RNA, 19 nt, Homo sapiens
agaagucuguggugguaaa

SEQ ID NO: 270679 - RNA, 19 nt, Homo sapiens
caccaucgggccaccauua

SEQ ID NO: 270680 - RNA, 19 nt, Homo sapiens
guucaucuccgucucagaa

SEQ ID NO: 270681 - RNA, 19 nt, Homo sapiens
ggcuggaaaugcuucguuu

SEQ ID NO: 270682 - RNA, 19 nt, Homo sapiens
gaaccgaguagaagacaag

SEQ ID NO: 270683 - RNA, 19 nt, Homo sapiens
gagccacacucugcuguca

SEQ ID NO: 270684 - RNA, 19 nt, Homo sapiens
gugcaagcuuuuccuaaua

SEQ ID NO: 270685 - RNA, 19 nt, Homo sapiens
gaagugagcaugccccauu

SEQ ID NO: 270686 - RNA, 19 nt, Homo sapiens
caucuucuccucguacuuu

SEQ ID NO: 270687 - RNA, 19 nt, Homo sapiens
gggacgucauugagcagua

SEQ ID NO: 270688 - RNA, 19 nt, Homo sapiens
gcuggaaaugcuucguuua

SEQ ID NO: 270689 - RNA, 19 nt, Homo sapiens
aguucaagcuggacaaaga

SEQ ID NO: 270690 - RNA, 19 nt, Homo sapiens
gcaaggaucgcggcagcaa

SEQ ID NO: 270691 - RNA, 19 nt, Homo sapiens
caagaagaaauuccagcaa

SEQ ID NO: 270692 - RNA, 19 nt, Homo sapiens
gcaggagacuguggagacu

SEQ ID NO: 270693 - RNA, 19 nt, Homo sapiens
ggacgucauugagcaguac

SEQ ID NO: 270694 - RNA, 19 nt, Homo sapiens
gaagcccauuuccaucauc

SEQ ID NO: 270695 - RNA, 19 nt, Homo sapiens
cgacggcuaugacaguucu

SEQ ID NO: 270696 - RNA, 19 nt, Homo sapiens
ccaccuggcccucucugaa

SEQ ID NO: 270697 - RNA, 19 nt, Homo sapiens
agucuguggugguaaagaa

SEQ ID NO: 270698 - RNA, 19 nt, Homo sapiens
gcugauaaccacccuguac

SEQ ID NO: 270699 - RNA, 19 nt, Homo sapiens
ucucacagcugcgggaaca

SEQ ID NO: 270700 - RNA, 19 nt, Homo sapiens
gugauuuggaucuguguuu

SEQ ID NO: 270701 - RNA, 19 nt, Homo sapiens
gcagccagccaaacacaca

SEQ ID NO: 270702 - RNA, 19 nt, Homo sapiens
ccacuucccuggguuagac

SEQ ID NO: 270703 - RNA, 19 nt, Homo sapiens
gauaaccacccuguacauc

SEQ ID NO: 270704 - RNA, 19 nt, Homo sapiens
gugugugucuggaguguag

SEQ ID NO: 270705 - RNA, 19 nt, Homo sapiens
agcaagcgcggaagccuua

SEQ ID NO: 270706 - RNA, 19 nt, Homo sapiens
gaagugacgguuccuacac

SEQ ID NO: 270707 - RNA, 19 nt, Homo sapiens
ugacacccaucacccacau

SEQ ID NO: 270708 - RNA, 19 nt, Homo sapiens
ccgggaaggcacugucuuu

SEQ ID NO: 270709 - RNA, 19 nt, Homo sapiens
gugcuaugcugccgagaac

SEQ ID NO: 270710 - RNA, 19 nt, Homo sapiens
cgucgacccugagcucuuc

SEQ ID NO: 270711 - RNA, 19 nt, Homo sapiens
gcguggaguucggcagcua

SEQ ID NO: 270712 - RNA, 19 nt, Homo sapiens
ccuaauaaacguggagaau

SEQ ID NO: 270713 - RNA, 19 nt, Homo sapiens
gcaagcuuuuccuaauaaa

SEQ ID NO: 270714 - RNA, 19 nt, Homo sapiens
guccuggucugccucaucu

SEQ ID NO: 270715 - RNA, 19 nt, Homo sapiens
ucagcaaggccaccucuuc

SEQ ID NO: 270716 - RNA, 19 nt, Homo sapiens
caagcuggacaaagacaau

SEQ ID NO: 270717 - RNA, 19 nt, Homo sapiens
gcacuucaaccggcagauc

SEQ ID NO: 270718 - RNA, 19 nt, Homo sapiens
cuaauaaacguggagaauc

SEQ ID NO: 270719 - RNA, 19 nt, Homo sapiens
cgacgcaugcaguacuuug

SEQ ID NO: 270720 - RNA, 19 nt, Homo sapiens
cccugaaggugcagcagaa

SEQ ID NO: 270721 - RNA, 19 nt, Homo sapiens
uuguguaccuggcugagaa

SEQ ID NO: 270722 - RNA, 19 nt, Homo sapiens
ggagggacagucucaccau

SEQ ID NO: 270723 - RNA, 19 nt, Homo sapiens
ccaaacccaagaagucugu

SEQ ID NO: 270724 - RNA, 19 nt, Homo sapiens
cgcggaagccuuacgaugu

SEQ ID NO: 270725 - RNA, 19 nt, Homo sapiens
uaaggaagagcccaacacu

SEQ ID NO: 270726 - RNA, 19 nt, Homo sapiens
agaaggacgcggugaacga

SEQ ID NO: 270727 - RNA, 19 nt, Homo sapiens
ggugcuaugcugccgagaa

SEQ ID NO: 270728 - RNA, 19 nt, Homo sapiens
cagauuagcugagauauua

SEQ ID NO: 270729 - RNA, 19 nt, Homo sapiens
ggagagagauggcucauga

SEQ ID NO: 270730 - RNA, 19 nt, Homo sapiens
gaacuuugccgucuuguaa

SEQ ID NO: 270731 - RNA, 19 nt, Homo sapiens
gagaggacauuguggauga

SEQ ID NO: 270732 - RNA, 19 nt, Homo sapiens
caaagucguugccuuaaug

SEQ ID NO: 270733 - RNA, 19 nt, Homo sapiens
acacacacgugcucacaua

SEQ ID NO: 270734 - RNA, 19 nt, Homo sapiens
acacuucaaucucaacuuu

SEQ ID NO: 270735 - RNA, 19 nt, Homo sapiens
uaacagauuagcugagaua

SEQ ID NO: 270736 - RNA, 19 nt, Homo sapiens
gcacugaccacaccuguau

SEQ ID NO: 270737 - RNA, 19 nt, Homo sapiens
gaacggcucacgagacuug

SEQ ID NO: 270738 - RNA, 19 nt, Homo sapiens
cagcagacgugguaugaga

SEQ ID NO: 270739 - RNA, 19 nt, Homo sapiens
uuacaaagucguugccuua

SEQ ID NO: 270740 - RNA, 19 nt, Homo sapiens
cagcagacguggugugaga

SEQ ID NO: 270741 - RNA, 19 nt, Homo sapiens
cagcagacguggugugaga

SEQ ID NO: 270742 - RNA, 19 nt, Homo sapiens
cagcagacguggugugaga

SEQ ID NO: 270743 - RNA, 19 nt, Homo sapiens
gaaggucaguuugaaagau

SEQ ID NO: 270744 - RNA, 19 nt, Homo sapiens
gcacacagaccacauagca

SEQ ID NO: 270745 - RNA, 19 nt, Homo sapiens
gaaccuggaugcucucaac

SEQ ID NO: 270746 - RNA, 19 nt, Homo sapiens
ugugagagcuuugcagaaa

SEQ ID NO: 270747 - RNA, 19 nt, Homo sapiens
guauagaccaugcacagua

SEQ ID NO: 270748 - RNA, 19 nt, Homo sapiens
acacauacgugcauacaca

SEQ ID NO: 270749 - RNA, 19 nt, Homo sapiens
gaaugagcguggccaagga

SEQ ID NO: 270750 - RNA, 19 nt, Homo sapiens
cagaagcacuuugagaaga

SEQ ID NO: 270751 - RNA, 19 nt, Homo sapiens
guacaucggcuuccuuugu

SEQ ID NO: 270752 - RNA, 19 nt, Homo sapiens
gcugagauauuaacuuacu

SEQ ID NO: 270753 - RNA, 19 nt, Homo sapiens
ucucagcuauuucuaguug

SEQ ID NO: 270754 - RNA, 19 nt, Homo sapiens
cggaaaccguucuguguga

SEQ ID NO: 270755 - RNA, 19 nt, Homo sapiens
gcucaaguuugcccggaaa

SEQ ID NO: 270756 - RNA, 19 nt, Homo sapiens
gagagggacgguucacaaa

SEQ ID NO: 270757 - RNA, 19 nt, Homo sapiens
gcucucagcuauuucuagu

SEQ ID NO: 270758 - RNA, 19 nt, Homo sapiens
uaacacaugcacacacaaa

SEQ ID NO: 270759 - RNA, 19 nt, Homo sapiens
gcugaacuuugccgucuug

SEQ ID NO: 270760 - RNA, 19 nt, Homo sapiens
ggcgugugguuuaauguuu

SEQ ID NO: 270761 - RNA, 19 nt, Homo sapiens
gcauacaggcguacacaug

SEQ ID NO: 270762 - RNA, 19 nt, Homo sapiens
gccagaaggucaguuugaa

SEQ ID NO: 270763 - RNA, 19 nt, Homo sapiens
gagggaggcugugcugugu

SEQ ID NO: 270764 - RNA, 19 nt, Homo sapiens
gcucugggcuuggacacuu

SEQ ID NO: 270765 - RNA, 19 nt, Homo sapiens
ccgguuggguccuguguuu

SEQ ID NO: 270766 - RNA, 19 nt, Homo sapiens
accgcaagcugcagaauuu

SEQ ID NO: 270767 - RNA, 19 nt, Homo sapiens
caaggaacguguggugugu

SEQ ID NO: 270768 - RNA, 19 nt, Homo sapiens
gcagaacucagaagaagca

SEQ ID NO: 270769 - RNA, 19 nt, Homo sapiens
gugcccauguacagacuua

SEQ ID NO: 270770 - RNA, 19 nt, Homo sapiens
ggcagaagcacuuugagaa

SEQ ID NO: 270771 - RNA, 19 nt, Homo sapiens
guacacuucugaccauuuu

SEQ ID NO: 270772 - RNA, 19 nt, Homo sapiens
ucucuggucuuucucuuug

SEQ ID NO: 270773 - RNA, 19 nt, Homo sapiens
gcccagcgaucacggacaa

SEQ ID NO: 270774 - RNA, 19 nt, Homo sapiens
ggaccugugcacucaguaa

SEQ ID NO: 270775 - RNA, 19 nt, Homo sapiens
uaaugcauguggacaggaa

SEQ ID NO: 270776 - RNA, 19 nt, Homo sapiens
ccacacagcacacacaagu

SEQ ID NO: 270777 - RNA, 19 nt, Homo sapiens
ugucugcucuguucccaaa

SEQ ID NO: 270778 - RNA, 19 nt, Homo sapiens
caaagucaggcccuacauu

SEQ ID NO: 270779 - RNA, 19 nt, Homo sapiens
ggaagcugcugggcucugu

SEQ ID NO: 270780 - RNA, 19 nt, Homo sapiens
caacgucuuugccacaucu

SEQ ID NO: 270781 - RNA, 19 nt, Homo sapiens
gauagacgcccagggaaug

SEQ ID NO: 270782 - RNA, 19 nt, Homo sapiens
cuccaaagaacauuucaua

SEQ ID NO: 270783 - RNA, 19 nt, Homo sapiens
gugcacagaucacacacau

SEQ ID NO: 270784 - RNA, 19 nt, Homo sapiens
gcagaagcacuuugagaag

SEQ ID NO: 270785 - RNA, 19 nt, Homo sapiens
gcauacaggcauacacaug

SEQ ID NO: 270786 - RNA, 19 nt, Homo sapiens
gggaggcugugcugugugu

SEQ ID NO: 270787 - RNA, 19 nt, Homo sapiens
guaaaucuggacucgcuuu

SEQ ID NO: 270788 - RNA, 19 nt, Homo sapiens
ggucuggguuugcccugaa

SEQ ID NO: 270789 - RNA, 19 nt, Homo sapiens
acaaagucguugccuuaau

SEQ ID NO: 270790 - RNA, 19 nt, Homo sapiens
gcugcugccuguugugguu

SEQ ID NO: 270791 - RNA, 19 nt, Homo sapiens
aaagucaggcccuacauug

SEQ ID NO: 270792 - RNA, 19 nt, Homo sapiens
cggcagaacucagaagaag

SEQ ID NO: 270793 - RNA, 19 nt, Homo sapiens
caagccagaaggucaguuu

SEQ ID NO: 270794 - RNA, 19 nt, Homo sapiens
gaaaccguucugugugauu

SEQ ID NO: 270795 - RNA, 19 nt, Homo sapiens
gagggacgguucacaaagc

SEQ ID NO: 270796 - RNA, 19 nt, Homo sapiens
gcacacaugcacacacaca

SEQ ID NO: 270797 - RNA, 19 nt, Homo sapiens
cacacacaguauacacaua

SEQ ID NO: 270798 - RNA, 19 nt, Homo sapiens
gggagaacgaccacuuuga

SEQ ID NO: 270799 - RNA, 19 nt, Homo sapiens
gcugggcucuguggucuau

SEQ ID NO: 270800 - RNA, 19 nt, Homo sapiens
gcgugugguuuaauguuug

SEQ ID NO: 270801 - RNA, 19 nt, Homo sapiens
guagcucacacacaguaua

SEQ ID NO: 270802 - RNA, 19 nt, Homo sapiens
ccagcaaggugcccaagag

SEQ ID NO: 270803 - RNA, 19 nt, Homo sapiens
gcacaggcagaagcacuuu

SEQ ID NO: 270804 - RNA, 19 nt, Homo sapiens
ggaaaccguucugugugau

SEQ ID NO: 270805 - RNA, 19 nt, Homo sapiens
ugccagagccguaagaaug

SEQ ID NO: 270806 - RNA, 19 nt, Homo sapiens
gacguacacuucugaccau

SEQ ID NO: 270807 - RNA, 19 nt, Homo sapiens
ccagaaggucaguuugaaa

SEQ ID NO: 270808 - RNA, 19 nt, Homo sapiens
ggauagacgcccagggaau

SEQ ID NO: 270809 - RNA, 19 nt, Homo sapiens
gcuggaggucucaguguuu

SEQ ID NO: 270810 - RNA, 19 nt, Homo sapiens
gccagggcgugugguuuaa

SEQ ID NO: 270811 - RNA, 19 nt, Homo sapiens
ggguagagggucugucuug

SEQ ID NO: 270812 - RNA, 19 nt, Homo sapiens
aggcacggcugcauuguca

SEQ ID NO: 270813 - RNA, 19 nt, Homo sapiens
cgacaggcacggcugcauu

SEQ ID NO: 270814 - RNA, 19 nt, Homo sapiens
ccacguggcaguacuacga

SEQ ID NO: 270815 - RNA, 19 nt, Homo sapiens
aaaccguucugugugauug

SEQ ID NO: 270816 - RNA, 19 nt, Homo sapiens
gcagaacucccaggucaca

SEQ ID NO: 270817 - RNA, 19 nt, Homo sapiens
gacacaaacccucaaagca

SEQ ID NO: 270818 - RNA, 19 nt, Homo sapiens
ggaggucucaguguuucua

SEQ ID NO: 270819 - RNA, 19 nt, Homo sapiens
aggaguaauuguggcuuua

SEQ ID NO: 270820 - RNA, 19 nt, Homo sapiens
ggaccagugccaccuuaug

SEQ ID NO: 270821 - RNA, 19 nt, Homo sapiens
agaagcaggucuuguccau

SEQ ID NO: 270822 - RNA, 19 nt, Homo sapiens
ccacacccaugcagaacuc

SEQ ID NO: 270823 - RNA, 19 nt, Homo sapiens
aaggaguaauuguggcuuu

SEQ ID NO: 270824 - RNA, 19 nt, Homo sapiens
ggagaacgaccacuuugac

SEQ ID NO: 270825 - RNA, 19 nt, Homo sapiens
ucucaguguuucuagauuc

SEQ ID NO: 270826 - RNA, 19 nt, Homo sapiens
agagcacacugcacacaug

SEQ ID NO: 270827 - RNA, 19 nt, Homo sapiens
aaagagcucccgcaguguu

SEQ ID NO: 270828 - RNA, 19 nt, Homo sapiens
gagaggacauuguggauga

SEQ ID NO: 270829 - RNA, 19 nt, Homo sapiens
gaaggucaguuugaaagau

SEQ ID NO: 270830 - RNA, 19 nt, Homo sapiens
gaaccuggaugcucucaac

SEQ ID NO: 270831 - RNA, 19 nt, Homo sapiens
cagaagcacuuugagaaga

SEQ ID NO: 270832 - RNA, 19 nt, Homo sapiens
guacaucggcuuccuuugu

SEQ ID NO: 270833 - RNA, 19 nt, Homo sapiens
cggaaaccguucuguguga

SEQ ID NO: 270834 - RNA, 19 nt, Homo sapiens
gcucaaguuugcccggaaa

SEQ ID NO: 270835 - RNA, 19 nt, Homo sapiens
gccagaaggucaguuugaa

SEQ ID NO: 270836 - RNA, 19 nt, Homo sapiens
gcagaacucagaagaagca

SEQ ID NO: 270837 - RNA, 19 nt, Homo sapiens
ggcagaagcacuuugagaa

SEQ ID NO: 270838 - RNA, 19 nt, Homo sapiens
accgcaagcugcagaauuu

SEQ ID NO: 270839 - RNA, 19 nt, Homo sapiens
gcccagcgaucacggacaa

SEQ ID NO: 270840 - RNA, 19 nt, Homo sapiens
caaagucaggcccuacauu

SEQ ID NO: 270841 - RNA, 19 nt, Homo sapiens
ggaagcugcugggcucugu

SEQ ID NO: 270842 - RNA, 19 nt, Homo sapiens
caacgucuuugccacaucu

SEQ ID NO: 270843 - RNA, 19 nt, Homo sapiens
gcagaagcacuuugagaag

SEQ ID NO: 270844 - RNA, 19 nt, Homo sapiens
guaaaucuggacucgcuuu

SEQ ID NO: 270845 - RNA, 19 nt, Homo sapiens
ggucuggguuugcccugaa

SEQ ID NO: 270846 - RNA, 19 nt, Homo sapiens
aaagucaggcccuacauug

SEQ ID NO: 270847 - RNA, 19 nt, Homo sapiens
cggcagaacucagaagaag

SEQ ID NO: 270848 - RNA, 19 nt, Homo sapiens
caagccagaaggucaguuu

SEQ ID NO: 270849 - RNA, 19 nt, Homo sapiens
gaaaccguucugugugauu

SEQ ID NO: 270850 - RNA, 19 nt, Homo sapiens
gggagaacgaccacuuuga

SEQ ID NO: 270851 - RNA, 19 nt, Homo sapiens
gcugggcucuguggucuau

SEQ ID NO: 270852 - RNA, 19 nt, Homo sapiens
ccagcaaggugcccaagag

SEQ ID NO: 270853 - RNA, 19 nt, Homo sapiens
gcacaggcagaagcacuuu

SEQ ID NO: 270854 - RNA, 19 nt, Homo sapiens
ggaaaccguucugugugau

SEQ ID NO: 270855 - RNA, 19 nt, Homo sapiens
acaaagggcaggccuguuc

SEQ ID NO: 270856 - RNA, 19 nt, Homo sapiens
ccagaaggucaguuugaaa

SEQ ID NO: 270857 - RNA, 19 nt, Homo sapiens
aggcacggcugcauuguca

SEQ ID NO: 270858 - RNA, 19 nt, Homo sapiens
cgacaggcacggcugcauu

SEQ ID NO: 270859 - RNA, 19 nt, Homo sapiens
ccacguggcaguacuacga

SEQ ID NO: 270860 - RNA, 19 nt, Homo sapiens
aaaccguucugugugauug

SEQ ID NO: 270861 - RNA, 19 nt, Homo sapiens
agaagcaggucuuguccau

SEQ ID NO: 270862 - RNA, 19 nt, Homo sapiens
ggagaacgaccacuuugac

SEQ ID NO: 270863 - RNA, 19 nt, Homo sapiens
gacaggcacggcugcauug

SEQ ID NO: 270864 - RNA, 19 nt, Homo sapiens
gagaacgaccacuuugaca

SEQ ID NO: 270865 - RNA, 19 nt, Homo sapiens
ccucguuccugguguacuu

SEQ ID NO: 270866 - RNA, 19 nt, Homo sapiens
ccacgggccagaagaacuu

SEQ ID NO: 270867 - RNA, 19 nt, Homo sapiens
uggacuuccuggugaauau

SEQ ID NO: 270868 - RNA, 19 nt, Homo sapiens
gaaccucaagaguaaaucu

SEQ ID NO: 270869 - RNA, 19 nt, Homo sapiens
gggagaagaagcugaaggu

SEQ ID NO: 270870 - RNA, 19 nt, Homo sapiens
agaauuuccucuacaacgu

SEQ ID NO: 270871 - RNA, 19 nt, Homo sapiens
cgacaucagcccgguguga

SEQ ID NO: 270872 - RNA, 19 nt, Homo sapiens
cagaaggucaguuugaaag

SEQ ID NO: 270873 - RNA, 19 nt, Homo sapiens
guucgcaaacucaaaccua

SEQ ID NO: 270874 - RNA, 19 nt, Homo sapiens
caucaaggaguaugagaag

SEQ ID NO: 270875 - RNA, 19 nt, Homo sapiens
gagcuggagcguuccuuca

SEQ ID NO: 270876 - RNA, 19 nt, Homo sapiens
ucgggaagguggagaagca

SEQ ID NO: 270877 - RNA, 19 nt, Homo sapiens
ccucaaagucagcaucaga

SEQ ID NO: 270878 - RNA, 19 nt, Homo sapiens
ugcagaauuuccucuacaa

SEQ ID NO: 270879 - RNA, 19 nt, Homo sapiens
gagcugccccugcgaguuu

SEQ ID NO: 270880 - RNA, 19 nt, Homo sapiens
agaagcacuuugagaagag

SEQ ID NO: 270881 - RNA, 19 nt, Homo sapiens
gugcucaucgccuccauug

SEQ ID NO: 270882 - RNA, 19 nt, Homo sapiens
ugacuaucgugguguuugg

SEQ ID NO: 270883 - RNA, 19 nt, Homo sapiens
gcacggcugcauugucaag

SEQ ID NO: 270884 - RNA, 19 nt, Homo sapiens
agagaccgaggccuacuuu

SEQ ID NO: 270885 - RNA, 19 nt, Homo sapiens
ccaagcggaaguucaagga

SEQ ID NO: 270886 - RNA, 19 nt, Homo sapiens
uacaucggcuuccuuuguc

SEQ ID NO: 270887 - RNA, 19 nt, Homo sapiens
gcugcagaauuuccucuac

SEQ ID NO: 270888 - RNA, 19 nt, Homo sapiens
aaggucaguuugaaagauc

SEQ ID NO: 270889 - RNA, 19 nt, Homo sapiens
gcugggcguucaucuacca

SEQ ID NO: 270890 - RNA, 19 nt, Homo sapiens
cugcagaauuuccucuaca

SEQ ID NO: 270891 - RNA, 19 nt, Homo sapiens
uuuccaccaucaaggagua

SEQ ID NO: 270892 - RNA, 19 nt, Homo sapiens
ucaaggaguaugagaagag

SEQ ID NO: 270893 - RNA, 19 nt, Homo sapiens
gcuccacgggccagaagaa

SEQ ID NO: 270894 - RNA, 19 nt, Homo sapiens
ccaucaaggaguaugagaa

SEQ ID NO: 270895 - RNA, 19 nt, Homo sapiens
ccuggugaauaucuacaug

SEQ ID NO: 270896 - RNA, 19 nt, Homo sapiens
cgucacggcagaacucaga

SEQ ID NO: 270897 - RNA, 19 nt, Homo sapiens
acaggcagaagcacuuuga

SEQ ID NO: 270898 - RNA, 19 nt, Homo sapiens
gcuccuggcagugaccuuu

SEQ ID NO: 270899 - RNA, 19 nt, Homo sapiens
gcaucucccaguccaagga

SEQ ID NO: 270900 - RNA, 19 nt, Homo sapiens
ugaucacgcugaccaccau

SEQ ID NO: 270901 - RNA, 19 nt, Homo sapiens
aaucuggacucgcuuucag

SEQ ID NO: 270902 - RNA, 19 nt, Homo sapiens
gcggcagcauccucagcaa

SEQ ID NO: 270903 - RNA, 19 nt, Homo sapiens
ccaccaucaaggaguauga

SEQ ID NO: 270904 - RNA, 19 nt, Homo sapiens
gagaggacauuguggauga

SEQ ID NO: 270905 - RNA, 19 nt, Homo sapiens
gaaggucaguuugaaagau

SEQ ID NO: 270906 - RNA, 19 nt, Homo sapiens
gaaccuggaugcucucaac

SEQ ID NO: 270907 - RNA, 19 nt, Homo sapiens
cagaagcacuuugagaaga

SEQ ID NO: 270908 - RNA, 19 nt, Homo sapiens
guacaucggcuuccuuugu

SEQ ID NO: 270909 - RNA, 19 nt, Homo sapiens
cggaaaccguucuguguga

SEQ ID NO: 270910 - RNA, 19 nt, Homo sapiens
gcucaaguuugcccggaaa

SEQ ID NO: 270911 - RNA, 19 nt, Homo sapiens
gccagaaggucaguuugaa

SEQ ID NO: 270912 - RNA, 19 nt, Homo sapiens
gcagaacucagaagaagca

SEQ ID NO: 270913 - RNA, 19 nt, Homo sapiens
ggcagaagcacuuugagaa

SEQ ID NO: 270914 - RNA, 19 nt, Homo sapiens
accgcaagcugcagaauuu

SEQ ID NO: 270915 - RNA, 19 nt, Homo sapiens
gcccagcgaucacggacaa

SEQ ID NO: 270916 - RNA, 19 nt, Homo sapiens
caaagucaggcccuacauu

SEQ ID NO: 270917 - RNA, 19 nt, Homo sapiens
ggaagcugcugggcucugu

SEQ ID NO: 270918 - RNA, 19 nt, Homo sapiens
caacgucuuugccacaucu

SEQ ID NO: 270919 - RNA, 19 nt, Homo sapiens
gcagaagcacuuugagaag

SEQ ID NO: 270920 - RNA, 19 nt, Homo sapiens
guaaaucuggacucgcuuu

SEQ ID NO: 270921 - RNA, 19 nt, Homo sapiens
ggucuggguuugcccugaa

SEQ ID NO: 270922 - RNA, 19 nt, Homo sapiens
aaagucaggcccuacauug

SEQ ID NO: 270923 - RNA, 19 nt, Homo sapiens
cggcagaacucagaagaag

SEQ ID NO: 270924 - RNA, 19 nt, Homo sapiens
gaaaccguucugugugauu

SEQ ID NO: 270925 - RNA, 19 nt, Homo sapiens
gggagaacgaccacuuuga

SEQ ID NO: 270926 - RNA, 19 nt, Homo sapiens
gcugggcucuguggucuau

SEQ ID NO: 270927 - RNA, 19 nt, Homo sapiens
ccagcaaggugcccaagag

SEQ ID NO: 270928 - RNA, 19 nt, Homo sapiens
gcacaggcagaagcacuuu

SEQ ID NO: 270929 - RNA, 19 nt, Homo sapiens
ggaaaccguucugugugau

SEQ ID NO: 270930 - RNA, 19 nt, Homo sapiens
acaaagggcaggccuguuc

SEQ ID NO: 270931 - RNA, 19 nt, Homo sapiens
ccagaaggucaguuugaaa

SEQ ID NO: 270932 - RNA, 19 nt, Homo sapiens
aggcacggcugcauuguca

SEQ ID NO: 270933 - RNA, 19 nt, Homo sapiens
cgacaggcacggcugcauu

SEQ ID NO: 270934 - RNA, 19 nt, Homo sapiens
ccacguggcaguacuacga

SEQ ID NO: 270935 - RNA, 19 nt, Homo sapiens
aaaccguucugugugauug

SEQ ID NO: 270936 - RNA, 19 nt, Homo sapiens
agaagcaggucuuguccau

SEQ ID NO: 270937 - RNA, 19 nt, Homo sapiens
ggagaacgaccacuuugac

SEQ ID NO: 270938 - RNA, 19 nt, Homo sapiens
gacaggcacggcugcauug

SEQ ID NO: 270939 - RNA, 19 nt, Homo sapiens
gagaacgaccacuuugaca

SEQ ID NO: 270940 - RNA, 19 nt, Homo sapiens
ccucguuccugguguacuu

SEQ ID NO: 270941 - RNA, 19 nt, Homo sapiens
ccacgggccagaagaacuu

SEQ ID NO: 270942 - RNA, 19 nt, Homo sapiens
uggacuuccuggugaauau

SEQ ID NO: 270943 - RNA, 19 nt, Homo sapiens
gaaccucaagaguaaaucu

SEQ ID NO: 270944 - RNA, 19 nt, Homo sapiens
gggagaagaagcugaaggu

SEQ ID NO: 270945 - RNA, 19 nt, Homo sapiens
agaauuuccucuacaacgu

SEQ ID NO: 270946 - RNA, 19 nt, Homo sapiens
cgacaucagcccgguguga

SEQ ID NO: 270947 - RNA, 19 nt, Homo sapiens
cagaaggucaguuugaaag

SEQ ID NO: 270948 - RNA, 19 nt, Homo sapiens
guucgcaaacucaaaccua

SEQ ID NO: 270949 - RNA, 19 nt, Homo sapiens
caucaaggaguaugagaag

SEQ ID NO: 270950 - RNA, 19 nt, Homo sapiens
gagcuggagcguuccuuca

SEQ ID NO: 270951 - RNA, 19 nt, Homo sapiens
ucgggaagguggagaagca

SEQ ID NO: 270952 - RNA, 19 nt, Homo sapiens
ccucaaagucagcaucaga

SEQ ID NO: 270953 - RNA, 19 nt, Homo sapiens
ugcagaauuuccucuacaa

SEQ ID NO: 270954 - RNA, 19 nt, Homo sapiens
gagcugccccugcgaguuu

SEQ ID NO: 270955 - RNA, 19 nt, Homo sapiens
agaagcacuuugagaagag

SEQ ID NO: 270956 - RNA, 19 nt, Homo sapiens
gugcucaucgccuccauug

SEQ ID NO: 270957 - RNA, 19 nt, Homo sapiens
ugacuaucgugguguuugg

SEQ ID NO: 270958 - RNA, 19 nt, Homo sapiens
gcacggcugcauugucaag

SEQ ID NO: 270959 - RNA, 19 nt, Homo sapiens
agagaccgaggccuacuuu

SEQ ID NO: 270960 - RNA, 19 nt, Homo sapiens
ccaagcggaaguucaagga

SEQ ID NO: 270961 - RNA, 19 nt, Homo sapiens
gcugcagaauuuccucuac

SEQ ID NO: 270962 - RNA, 19 nt, Homo sapiens
uacaucggcuuccuuuguc

SEQ ID NO: 270963 - RNA, 19 nt, Homo sapiens
gcugggcguucaucuacca

SEQ ID NO: 270964 - RNA, 19 nt, Homo sapiens
ucaaggaguaugagaagag

SEQ ID NO: 270965 - RNA, 19 nt, Homo sapiens
uuuccaccaucaaggagua

SEQ ID NO: 270966 - RNA, 19 nt, Homo sapiens
aaggucaguuugaaagauc

SEQ ID NO: 270967 - RNA, 19 nt, Homo sapiens
cugcagaauuuccucuaca

SEQ ID NO: 270968 - RNA, 19 nt, Homo sapiens
gcuccacgggccagaagaa

SEQ ID NO: 270969 - RNA, 19 nt, Homo sapiens
ccuggugaauaucuacaug

SEQ ID NO: 270970 - RNA, 19 nt, Homo sapiens
ccaucaaggaguaugagaa

SEQ ID NO: 270971 - RNA, 19 nt, Homo sapiens
cgucacggcagaacucaga

SEQ ID NO: 270972 - RNA, 19 nt, Homo sapiens
acaggcagaagcacuuuga

SEQ ID NO: 270973 - RNA, 19 nt, Homo sapiens
gcuccuggcagugaccuuu

SEQ ID NO: 270974 - RNA, 19 nt, Homo sapiens
gcaucucccaguccaagga

SEQ ID NO: 270975 - RNA, 19 nt, Homo sapiens
cuagccagaaggucaguuu

SEQ ID NO: 270976 - RNA, 19 nt, Homo sapiens
ugaucacgcugaccaccau

SEQ ID NO: 270977 - RNA, 19 nt, Homo sapiens
aaucuggacucgcuuucag

SEQ ID NO: 270978 - RNA, 19 nt, Homo sapiens
gcggcagcauccucagcaa

SEQ ID NO: 270979 - RNA, 19 nt, Homo sapiens
ccaccaucaaggaguauga

SEQ ID NO: 270980 - RNA, 19 nt, Homo sapiens
gagaggacauuguggauga

SEQ ID NO: 270981 - RNA, 19 nt, Homo sapiens
gaaccuggaugcucucaac

SEQ ID NO: 270982 - RNA, 19 nt, Homo sapiens
cagaagcacuuugagaaga

SEQ ID NO: 270983 - RNA, 19 nt, Homo sapiens
guacaucggcuuccuuugu

SEQ ID NO: 270984 - RNA, 19 nt, Homo sapiens
cggaaaccguucuguguga

SEQ ID NO: 270985 - RNA, 19 nt, Homo sapiens
gcucaaguuugcccggaaa

SEQ ID NO: 270986 - RNA, 19 nt, Homo sapiens
ggcagaagcacuuugagaa

SEQ ID NO: 270987 - RNA, 19 nt, Homo sapiens
accgcaagcugcagaauuu

SEQ ID NO: 270988 - RNA, 19 nt, Homo sapiens
gcccagcgaucacggacaa

SEQ ID NO: 270989 - RNA, 19 nt, Homo sapiens
cggcagaacucagaagcaa

SEQ ID NO: 270990 - RNA, 19 nt, Homo sapiens
caaagucaggcccuacauu

SEQ ID NO: 270991 - RNA, 19 nt, Homo sapiens
ggaagcugcugggcucugu

SEQ ID NO: 270992 - RNA, 19 nt, Homo sapiens
caacgucuuugccacaucu

SEQ ID NO: 270993 - RNA, 19 nt, Homo sapiens
gcagaagcacuuugagaag

SEQ ID NO: 270994 - RNA, 19 nt, Homo sapiens
guaaaucuggacucgcuuu

SEQ ID NO: 270995 - RNA, 19 nt, Homo sapiens
ggucuggguuugcccugaa

SEQ ID NO: 270996 - RNA, 19 nt, Homo sapiens
aaagucaggcccuacauug

SEQ ID NO: 270997 - RNA, 19 nt, Homo sapiens
gaaaccguucugugugauu

SEQ ID NO: 270998 - RNA, 19 nt, Homo sapiens
gggagaacgaccacuuuga

SEQ ID NO: 270999 - RNA, 19 nt, Homo sapiens
gcugggcucuguggucuau

SEQ ID NO: 271000 - RNA, 19 nt, Homo sapiens
ccagcaaggugcccaagag

SEQ ID NO: 271001 - RNA, 19 nt, Homo sapiens
gcacaggcagaagcacuuu

SEQ ID NO: 271002 - RNA, 19 nt, Homo sapiens
ggaaaccguucugugugau

SEQ ID NO: 271003 - RNA, 19 nt, Homo sapiens
aggcacggcugcauuguca

SEQ ID NO: 271004 - RNA, 19 nt, Homo sapiens
cgacaggcacggcugcauu

SEQ ID NO: 271005 - RNA, 19 nt, Homo sapiens
ccacguggcaguacuacga

SEQ ID NO: 271006 - RNA, 19 nt, Homo sapiens
aaaccguucugugugauug

SEQ ID NO: 271007 - RNA, 19 nt, Homo sapiens
agaagcaggucuuguccau

SEQ ID NO: 271008 - RNA, 19 nt, Homo sapiens
ggagaacgaccacuuugac

SEQ ID NO: 271009 - RNA, 19 nt, Homo sapiens
gacaggcacggcugcauug

SEQ ID NO: 271010 - RNA, 19 nt, Homo sapiens
gagaacgaccacuuugaca

SEQ ID NO: 271011 - RNA, 19 nt, Homo sapiens
ccucguuccugguguacuu

SEQ ID NO: 271012 - RNA, 19 nt, Homo sapiens
ccacgggccagaagaacuu

SEQ ID NO: 271013 - RNA, 19 nt, Homo sapiens
uggacuuccuggugaauau

SEQ ID NO: 271014 - RNA, 19 nt, Homo sapiens
gaaccucaagaguaaaucu

SEQ ID NO: 271015 - RNA, 19 nt, Homo sapiens
agaauuuccucuacaacgu

SEQ ID NO: 271016 - RNA, 19 nt, Homo sapiens
gggagaagaagcugaaggu

SEQ ID NO: 271017 - RNA, 19 nt, Homo sapiens
guucgcaaacucaaaccua

SEQ ID NO: 271018 - RNA, 19 nt, Homo sapiens
caucaaggaguaugagaag

SEQ ID NO: 271019 - RNA, 19 nt, Homo sapiens
gagcuggagcguuccuuca

SEQ ID NO: 271020 - RNA, 19 nt, Homo sapiens
ugcagaauuuccucuacaa

SEQ ID NO: 271021 - RNA, 19 nt, Homo sapiens
ucgggaagguggagaagca

SEQ ID NO: 271022 - RNA, 19 nt, Homo sapiens
ccucaaagucagcaucaga

SEQ ID NO: 271023 - RNA, 19 nt, Homo sapiens
gagcugccccugcgaguuu

SEQ ID NO: 271024 - RNA, 19 nt, Homo sapiens
agaagcacuuugagaagag

SEQ ID NO: 271025 - RNA, 19 nt, Homo sapiens
gugcucaucgccuccauug

SEQ ID NO: 271026 - RNA, 19 nt, Homo sapiens
ugacuaucgugguguuugg

SEQ ID NO: 271027 - RNA, 19 nt, Homo sapiens
gcacggcugcauugucaag

SEQ ID NO: 271028 - RNA, 19 nt, Homo sapiens
agagaccgaggccuacuuu

SEQ ID NO: 271029 - RNA, 19 nt, Homo sapiens
ccaagcggaaguucaagga

SEQ ID NO: 271030 - RNA, 19 nt, Homo sapiens
gcugcagaauuuccucuac

SEQ ID NO: 271031 - RNA, 19 nt, Homo sapiens
uacaucggcuuccuuuguc

SEQ ID NO: 271032 - RNA, 19 nt, Homo sapiens
uuuccaccaucaaggagua

SEQ ID NO: 271033 - RNA, 19 nt, Homo sapiens
gcugggcguucaucuacca

SEQ ID NO: 271034 - RNA, 19 nt, Homo sapiens
cugcagaauuuccucuaca

SEQ ID NO: 271035 - RNA, 19 nt, Homo sapiens
ucaaggaguaugagaagag

SEQ ID NO: 271036 - RNA, 19 nt, Homo sapiens
gcuccacgggccagaagaa

SEQ ID NO: 271037 - RNA, 19 nt, Homo sapiens
ccaucaaggaguaugagaa

SEQ ID NO: 271038 - RNA, 19 nt, Homo sapiens
ccuggugaauaucuacaug

SEQ ID NO: 271039 - RNA, 19 nt, Homo sapiens
cgucacggcagaacucaga

SEQ ID NO: 271040 - RNA, 19 nt, Homo sapiens
acaggcagaagcacuuuga

SEQ ID NO: 271041 - RNA, 19 nt, Homo sapiens
gcuccuggcagugaccuuu

SEQ ID NO: 271042 - RNA, 19 nt, Homo sapiens
gcuccuggcagugaccuuu

SEQ ID NO: 271043 - RNA, 19 nt, Homo sapiens
gcaucucccaguccaagga

SEQ ID NO: 271044 - RNA, 19 nt, Homo sapiens
ugaucacgcugaccaccau

SEQ ID NO: 271045 - RNA, 19 nt, Homo sapiens
aaucuggacucgcuuucag

SEQ ID NO: 271046 - RNA, 19 nt, Homo sapiens
ccaccaucaaggaguauga

SEQ ID NO: 271047 - RNA, 19 nt, Homo sapiens
gcggcagcauccucagcaa

SEQ ID NO: 271048 - RNA, 19 nt, Homo sapiens
ccaagcaacuguuucauuu

SEQ ID NO: 271049 - RNA, 19 nt, Homo sapiens
cagaagcacuuugagaaga

SEQ ID NO: 271050 - RNA, 19 nt, Homo sapiens
guacaucggcuuccuuugu

SEQ ID NO: 271051 - RNA, 19 nt, Homo sapiens
cggaaaccguucuguguga

SEQ ID NO: 271052 - RNA, 19 nt, Homo sapiens
gcucaaguuugcccggaaa

SEQ ID NO: 271053 - RNA, 19 nt, Homo sapiens
ggcagaagcacuuugagaa

SEQ ID NO: 271054 - RNA, 19 nt, Homo sapiens
accgcaagcugcagaauuu

SEQ ID NO: 271055 - RNA, 19 nt, Homo sapiens
ggaagcugcugggcucugu

SEQ ID NO: 271056 - RNA, 19 nt, Homo sapiens
caacgucuuugccacaucu

SEQ ID NO: 271057 - RNA, 19 nt, Homo sapiens
gcagaagcacuuugagaag

SEQ ID NO: 271058 - RNA, 19 nt, Homo sapiens
ggucuggguuugcccugaa

SEQ ID NO: 271059 - RNA, 19 nt, Homo sapiens
gaaaccguucugugugauu

SEQ ID NO: 271060 - RNA, 19 nt, Homo sapiens
gggagaacgaccacuuuga

SEQ ID NO: 271061 - RNA, 19 nt, Homo sapiens
gcugggcucuguggucuau

SEQ ID NO: 271062 - RNA, 19 nt, Homo sapiens
gcacaggcagaagcacuuu

SEQ ID NO: 271063 - RNA, 19 nt, Homo sapiens
ggaaaccguucugugugau

SEQ ID NO: 271064 - RNA, 19 nt, Homo sapiens
ccaccaagcaacuguuuca

SEQ ID NO: 271065 - RNA, 19 nt, Homo sapiens
ccacguggcaguacuacga

SEQ ID NO: 271066 - RNA, 19 nt, Homo sapiens
aaaccguucugugugauug

SEQ ID NO: 271067 - RNA, 19 nt, Homo sapiens
ggagaacgaccacuuugac

SEQ ID NO: 271068 - RNA, 19 nt, Homo sapiens
gagaacgaccacuuugaca

SEQ ID NO: 271069 - RNA, 19 nt, Homo sapiens
ccucguuccugguguacuu

SEQ ID NO: 271070 - RNA, 19 nt, Homo sapiens
gggagaagaagcugaaggu

SEQ ID NO: 271071 - RNA, 19 nt, Homo sapiens
agaauuuccucuacaacgu

SEQ ID NO: 271072 - RNA, 19 nt, Homo sapiens
caucaaggaguaugagaag

SEQ ID NO: 271073 - RNA, 19 nt, Homo sapiens
ugcagaauuuccucuacaa

SEQ ID NO: 271074 - RNA, 19 nt, Homo sapiens
agaagcacuuugagaagag

SEQ ID NO: 271075 - RNA, 19 nt, Homo sapiens
gugcucaucgccuccauug

SEQ ID NO: 271076 - RNA, 19 nt, Homo sapiens
ugacuaucgugguguuugg

SEQ ID NO: 271077 - RNA, 19 nt, Homo sapiens
gcugcagaauuuccucuac

SEQ ID NO: 271078 - RNA, 19 nt, Homo sapiens
uacaucggcuuccuuuguc

SEQ ID NO: 271079 - RNA, 19 nt, Homo sapiens
cugcagaauuuccucuaca

SEQ ID NO: 271080 - RNA, 19 nt, Homo sapiens
gcugggcguucaucuacca

SEQ ID NO: 271081 - RNA, 19 nt, Homo sapiens
ucaaggaguaugagaagag

SEQ ID NO: 271082 - RNA, 19 nt, Homo sapiens
uuuccaccaucaaggagua

SEQ ID NO: 271083 - RNA, 19 nt, Homo sapiens
acaggcagaagcacuuuga

SEQ ID NO: 271084 - RNA, 19 nt, Homo sapiens
ccaucaaggaguaugagaa

SEQ ID NO: 271085 - RNA, 19 nt, Homo sapiens
ugaucacgcugaccaccau

SEQ ID NO: 271086 - RNA, 19 nt, Homo sapiens
gcggcagcauccucagcaa

SEQ ID NO: 271087 - RNA, 19 nt, Homo sapiens
ccaccaucaaggaguauga

SEQ ID NO: 271088 - RNA, 19 nt, Homo sapiens
ggacagagaugauuaugug

SEQ ID NO: 271089 - RNA, 19 nt, Homo sapiens
gaauguagaugccauagaa

SEQ ID NO: 271090 - RNA, 19 nt, Homo sapiens
gcuaaucucuucuaggaua

SEQ ID NO: 271091 - RNA, 19 nt, Homo sapiens
caacagguauuccgauuug

SEQ ID NO: 271092 - RNA, 19 nt, Homo sapiens
gaucugggcugcuggaugu

SEQ ID NO: 271093 - RNA, 19 nt, Homo sapiens
guacaucgguuuccugaca

SEQ ID NO: 271094 - RNA, 19 nt, Homo sapiens
agacagacuuuguauaguu

SEQ ID NO: 271095 - RNA, 19 nt, Homo sapiens
cgacaugcuuuccaggaua

SEQ ID NO: 271096 - RNA, 19 nt, Homo sapiens
ggacaucuuugugcugauu

SEQ ID NO: 271097 - RNA, 19 nt, Homo sapiens
gggaugggauuucugauuc

SEQ ID NO: 271098 - RNA, 19 nt, Homo sapiens
ccaaguggcuucagcaucu

SEQ ID NO: 271099 - RNA, 19 nt, Homo sapiens
gacaacagguauuccgauu

SEQ ID NO: 271100 - RNA, 19 nt, Homo sapiens
ccgcuaaucucuucuagga

SEQ ID NO: 271101 - RNA, 19 nt, Homo sapiens
guagacagacuuuguauag

SEQ ID NO: 271102 - RNA, 19 nt, Homo sapiens
ccaauaagcccauuuaaaa

SEQ ID NO: 271103 - RNA, 19 nt, Homo sapiens
gacaugcuuuccaggauaa

SEQ ID NO: 271104 - RNA, 19 nt, Homo sapiens
acaauuccgucucuauaaa

SEQ ID NO: 271105 - RNA, 19 nt, Homo sapiens
gcaugacuuuacacuauau

SEQ ID NO: 271106 - RNA, 19 nt, Homo sapiens
uugcaugacuuuacacuau

SEQ ID NO: 271107 - RNA, 19 nt, Homo sapiens
gagacuggcuucuguuacu

SEQ ID NO: 271108 - RNA, 19 nt, Homo sapiens
cauccgagccgucagaauu

SEQ ID NO: 271109 - RNA, 19 nt, Homo sapiens
aagaggaguuugagaccua

SEQ ID NO: 271110 - RNA, 19 nt, Homo sapiens
cagagaugauuauguguuc

SEQ ID NO: 271111 - RNA, 19 nt, Homo sapiens
cuacaauuccgucucuaua

SEQ ID NO: 271112 - RNA, 19 nt, Homo sapiens
ggauguugcugccgauaca

SEQ ID NO: 271113 - RNA, 19 nt, Homo sapiens
gacagacuuuguauaguuc

SEQ ID NO: 271114 - RNA, 19 nt, Homo sapiens
gaaggaggacaacagguau

SEQ ID NO: 271115 - RNA, 19 nt, Homo sapiens
cuggagacauuugcuauuu

SEQ ID NO: 271116 - RNA, 19 nt, Homo sapiens
gaucauggcauuggaguuc

SEQ ID NO: 271117 - RNA, 19 nt, Homo sapiens
cagaaagggucagcauuca

SEQ ID NO: 271118 - RNA, 19 nt, Homo sapiens
cacaagaagucucagaaag

SEQ ID NO: 271119 - RNA, 19 nt, Homo sapiens
gggagacuggcuucuguua

SEQ ID NO: 271120 - RNA, 19 nt, Homo sapiens
aaagacagguucaggacau

SEQ ID NO: 271121 - RNA, 19 nt, Homo sapiens
ccagcaaucucccaggaau

SEQ ID NO: 271122 - RNA, 19 nt, Homo sapiens
acucauccuuucuucauuu

SEQ ID NO: 271123 - RNA, 19 nt, Homo sapiens
ggaugggauuucugauuca

SEQ ID NO: 271124 - RNA, 19 nt, Homo sapiens
agaaggaggacaacaggua

SEQ ID NO: 271125 - RNA, 19 nt, Homo sapiens
agagaaacaacgccaagua

SEQ ID NO: 271126 - RNA, 19 nt, Homo sapiens
ggagaugaaagaggaguuu

SEQ ID NO: 271127 - RNA, 19 nt, Homo sapiens
gacugaaguuugccaggaa

SEQ ID NO: 271128 - RNA, 19 nt, Homo sapiens
ugaccacauucaaggagua

SEQ ID NO: 271129 - RNA, 19 nt, Homo sapiens
guagcaauacuaaaggaaa

SEQ ID NO: 271130 - RNA, 19 nt, Homo sapiens
ucagaagcacuuugagaaa

SEQ ID NO: 271131 - RNA, 19 nt, Homo sapiens
uauaaaugguuccgcuaau

SEQ ID NO: 271132 - RNA, 19 nt, Homo sapiens
accaauggcugcaucaaau

SEQ ID NO: 271133 - RNA, 19 nt, Homo sapiens
guagaugccauagaagaaa

SEQ ID NO: 271134 - RNA, 19 nt, Homo sapiens
gcacaaggagaggagauga

SEQ ID NO: 271135 - RNA, 19 nt, Homo sapiens
agagguggaugcacaagga

SEQ ID NO: 271136 - RNA, 19 nt, Homo sapiens
ggaaaccaaggcaauguuc

SEQ ID NO: 271137 - RNA, 19 nt, Homo sapiens
ugcaugacuuuacacuaua

SEQ ID NO: 271138 - RNA, 19 nt, Homo sapiens
ccacgguccugccuaucuu

SEQ ID NO: 271139 - RNA, 19 nt, Homo sapiens
ucagaaagggucagcauuc

SEQ ID NO: 271140 - RNA, 19 nt, Homo sapiens
augaaucagucgucucuuu

SEQ ID NO: 271141 - RNA, 19 nt, Homo sapiens
ccacauucaaggaguauga

SEQ ID NO: 271142 - RNA, 19 nt, Homo sapiens
gcugggcgcugcuuuacca

SEQ ID NO: 271143 - RNA, 19 nt, Homo sapiens
gagccgaguuugcuuugag

SEQ ID NO: 271144 - RNA, 19 nt, Homo sapiens
gagaaacaacgccaaguac

SEQ ID NO: 271145 - RNA, 19 nt, Homo sapiens
cuucagacgagaauagaua

SEQ ID NO: 271146 - RNA, 19 nt, Homo sapiens
cggcagagacguagcauca

SEQ ID NO: 271147 - RNA, 19 nt, Homo sapiens
gacgagaauagauaugauu

SEQ ID NO: 271148 - RNA, 19 nt, Homo sapiens
gcacggccuuccgcaugaa

SEQ ID NO: 271149 - RNA, 19 nt, Homo sapiens
gcguugguguuccugauug

SEQ ID NO: 271150 - RNA, 19 nt, Homo sapiens
cugccuaucuugacucuuc

SEQ ID NO: 271151 - RNA, 19 nt, Homo sapiens
uacaauuccgucucuauaa

SEQ ID NO: 271152 - RNA, 19 nt, Homo sapiens
gaggcagcauccagccaaa

SEQ ID NO: 271153 - RNA, 19 nt, Homo sapiens
gccuggagguauuaugcua

SEQ ID NO: 271154 - RNA, 19 nt, Homo sapiens
gucagaagcacuuugagaa

SEQ ID NO: 271155 - RNA, 19 nt, Homo sapiens
ugacacucauccuuucuuc

SEQ ID NO: 271156 - RNA, 19 nt, Homo sapiens
ccaggugaccauugacaaa

SEQ ID NO: 271157 - RNA, 19 nt, Homo sapiens
acacaagaagucucagaaa

SEQ ID NO: 271158 - RNA, 19 nt, Homo sapiens
ggagacauuugcuauuuuc

SEQ ID NO: 271159 - RNA, 19 nt, Homo sapiens
ggaugugauugagcaguau

SEQ ID NO: 271160 - RNA, 19 nt, Homo sapiens
aggaugugauugagcagua

SEQ ID NO: 271161 - RNA, 19 nt, Homo sapiens
cauccuuucuucauuucuu

SEQ ID NO: 271162 - RNA, 19 nt, Homo sapiens
uccaauaagcccauuuaaa

SEQ ID NO: 271163 - RNA, 19 nt, Homo sapiens
ucccaggaaugaaccauau

SEQ ID NO: 271164 - RNA, 19 nt, Homo sapiens
uagcaauacuaaaggaaag

SEQ ID NO: 271165 - RNA, 19 nt, Homo sapiens
uaauguagacagacuuugu

SEQ ID NO: 271166 - RNA, 19 nt, Homo sapiens
cagcugaagcagagaagaa

SEQ ID NO: 271167 - RNA, 19 nt, Homo sapiens
cagaagcacuuugagaaaa

SEQ ID NO: 271168 - RNA, 19 nt, Homo sapiens
gugggaaggccgucugauu

SEQ ID NO: 271169 - RNA, 19 nt, Homo sapiens
aaggagaggagaugaaaga

SEQ ID NO: 271170 - RNA, 19 nt, Homo sapiens
cagacgagaauagauauga

SEQ ID NO: 271171 - RNA, 19 nt, Homo sapiens
gaucggguucgccuuucua

SEQ ID NO: 271172 - RNA, 19 nt, Homo sapiens
ggagccgaguuugcuuuga

SEQ ID NO: 271173 - RNA, 19 nt, Homo sapiens
ugggaaggccgucugauug

SEQ ID NO: 271174 - RNA, 19 nt, Homo sapiens
uggcuguccugaccacauu

SEQ ID NO: 271175 - RNA, 19 nt, Homo sapiens
acacaccucugucccugau

SEQ ID NO: 271176 - RNA, 19 nt, Homo sapiens
aggauaaaguaccuucaga

SEQ ID NO: 271177 - RNA, 19 nt, Homo sapiens
aaagcugggucucuuggau

SEQ ID NO: 271178 - RNA, 19 nt, Homo sapiens
gggaaaccaaggcaauguu

SEQ ID NO: 271179 - RNA, 19 nt, Homo sapiens
auaaaugguuccgcuaauc

SEQ ID NO: 271180 - RNA, 19 nt, Homo sapiens
ucaaggaguaugagacugu

SEQ ID NO: 271181 - RNA, 19 nt, Homo sapiens
accaucaucugcaacuauu

SEQ ID NO: 271182 - RNA, 19 nt, Homo sapiens
aaaccaucaucugcaacua

SEQ ID NO: 271183 - RNA, 19 nt, Homo sapiens
cagguauuccgauuugaaa

SEQ ID NO: 271184 - RNA, 19 nt, Homo sapiens
cagagaagaaggaggacaa

SEQ ID NO: 271185 - RNA, 19 nt, Homo sapiens
caggaaugaaccauaugua

SEQ ID NO: 271186 - RNA, 19 nt, Homo sapiens
agacgagaauagauaugau

SEQ ID NO: 271187 - RNA, 19 nt, Homo sapiens
acaaggagaggagaugaaa

SEQ ID NO: 271188 - RNA, 19 nt, Homo sapiens
gcaauaaucuuccgaccuu

SEQ ID NO: 271189 - RNA, 19 nt, Homo sapiens
ggaggaaguugaaaggaua

SEQ ID NO: 271190 - RNA, 19 nt, Homo sapiens
gccaagaccugcuguguaa

SEQ ID NO: 271191 - RNA, 19 nt, Homo sapiens
gcagucauguuucggcuua

SEQ ID NO: 271192 - RNA, 19 nt, Homo sapiens
uauacuggcuucugacuua

SEQ ID NO: 271193 - RNA, 19 nt, Homo sapiens
gaaaggauacuaaugauuc

SEQ ID NO: 271194 - RNA, 19 nt, Homo sapiens
gaggagcacugaaaccuuu

SEQ ID NO: 271195 - RNA, 19 nt, Homo sapiens
gacaggagauuuggauaua

SEQ ID NO: 271196 - RNA, 19 nt, Homo sapiens
gaaguaccauagcauugua

SEQ ID NO: 271197 - RNA, 19 nt, Homo sapiens
gggcugacauauaugaaua

SEQ ID NO: 271198 - RNA, 19 nt, Homo sapiens
gaacagaggauggagcuaa

SEQ ID NO: 271199 - RNA, 19 nt, Homo sapiens
ggaccaugcugccgauaaa

SEQ ID NO: 271200 - RNA, 19 nt, Homo sapiens
ggacagugcuacccuagau

SEQ ID NO: 271201 - RNA, 19 nt, Homo sapiens
ggagcuacaucacacguuu

SEQ ID NO: 271202 - RNA, 19 nt, Homo sapiens
cagaguagguauuugguaa

SEQ ID NO: 271203 - RNA, 19 nt, Homo sapiens
ucaugaagcuuaccgacua

SEQ ID NO: 271204 - RNA, 19 nt, Homo sapiens
gcauuguacuugccucuuu

SEQ ID NO: 271205 - RNA, 19 nt, Homo sapiens
gaaguugaaaggauacuaa

SEQ ID NO: 271206 - RNA, 19 nt, Homo sapiens
auaaacaccuugcaucauu

SEQ ID NO: 271207 - RNA, 19 nt, Homo sapiens
caaccuagcugcgccaaga

SEQ ID NO: 271208 - RNA, 19 nt, Homo sapiens
caguagcccuuuccacaua

SEQ ID NO: 271209 - RNA, 19 nt, Homo sapiens
caacaggagucagcaauca

SEQ ID NO: 271210 - RNA, 19 nt, Homo sapiens
ucagaaagcuuuauaaacc

SEQ ID NO: 271211 - RNA, 19 nt, Homo sapiens
uaugaauacuggcuucuaa

SEQ ID NO: 271212 - RNA, 19 nt, Homo sapiens
caacucagaaagcuuuaua

SEQ ID NO: 271213 - RNA, 19 nt, Homo sapiens
uaaacaccuugcaucauuu

SEQ ID NO: 271214 - RNA, 19 nt, Homo sapiens
acaaacaggucccuaauac

SEQ ID NO: 271215 - RNA, 19 nt, Homo sapiens
uagcugguaugcaagauuu

SEQ ID NO: 271216 - RNA, 19 nt, Homo sapiens
gaaaugagauucaaaagcu

SEQ ID NO: 271217 - RNA, 19 nt, Homo sapiens
acaaauacccguuggaaga

SEQ ID NO: 271218 - RNA, 19 nt, Homo sapiens
caccuugcaucauuuaauu

SEQ ID NO: 271219 - RNA, 19 nt, Homo sapiens
aaagauagccagagagaga

SEQ ID NO: 271220 - RNA, 19 nt, Homo sapiens
gagcaccuccuguacauga

SEQ ID NO: 271221 - RNA, 19 nt, Homo sapiens
guugaaaggauacuaauga

SEQ ID NO: 271222 - RNA, 19 nt, Homo sapiens
cuacaucacacguuuauug

SEQ ID NO: 271223 - RNA, 19 nt, Homo sapiens
acacagggccuaguacaua

SEQ ID NO: 271224 - RNA, 19 nt, Homo sapiens
gaguugauccacaagauaa

SEQ ID NO: 271225 - RNA, 19 nt, Homo sapiens
gcaagguggugcagguguu

SEQ ID NO: 271226 - RNA, 19 nt, Homo sapiens
ggagggaggagcacugaaa

SEQ ID NO: 271227 - RNA, 19 nt, Homo sapiens
cccgacggcuuccauauuu

SEQ ID NO: 271228 - RNA, 19 nt, Homo sapiens
ugaauucaccacacacaua

SEQ ID NO: 271229 - RNA, 19 nt, Homo sapiens
gggacagucugcagaucua

SEQ ID NO: 271230 - RNA, 19 nt, Homo sapiens
gggaggaaguugaaaggau

SEQ ID NO: 271231 - RNA, 19 nt, Homo sapiens
gagagaauggcauguguga

SEQ ID NO: 271232 - RNA, 19 nt, Homo sapiens
cauuguacuugccucuuua

SEQ ID NO: 271233 - RNA, 19 nt, Homo sapiens
caagauaagaaaucccuuu

SEQ ID NO: 271234 - RNA, 19 nt, Homo sapiens
ccagaugucacaauuagaa

SEQ ID NO: 271235 - RNA, 19 nt, Homo sapiens
gagaauggcaugugugaag

SEQ ID NO: 271236 - RNA, 19 nt, Homo sapiens
aaucuaaccugccauccaa

SEQ ID NO: 271237 - RNA, 19 nt, Homo sapiens
gguaaauguugaauagauc

SEQ ID NO: 271238 - RNA, 19 nt, Homo sapiens
ggauggagcuaagcagcaa

SEQ ID NO: 271239 - RNA, 19 nt, Homo sapiens
ccauccaaaugauaaauug

SEQ ID NO: 271240 - RNA, 19 nt, Homo sapiens
gaccauggcccgagaaagu

SEQ ID NO: 271241 - RNA, 19 nt, Homo sapiens
gcuaaaguucuucauggua

SEQ ID NO: 271242 - RNA, 19 nt, Homo sapiens
ggaaguaccauagcauugu

SEQ ID NO: 271243 - RNA, 19 nt, Homo sapiens
gcaagcaacucagaaagcu

SEQ ID NO: 271244 - RNA, 19 nt, Homo sapiens
gugcugcccuucuaucuca

SEQ ID NO: 271245 - RNA, 19 nt, Homo sapiens
cagcaaccaccaagaguuu

SEQ ID NO: 271246 - RNA, 19 nt, Homo sapiens
aaacaggucccuaauacug

SEQ ID NO: 271247 - RNA, 19 nt, Homo sapiens
uaaccugccauccaaauga

SEQ ID NO: 271248 - RNA, 19 nt, Homo sapiens
cucacucacucaacaaaua

SEQ ID NO: 271249 - RNA, 19 nt, Homo sapiens
agucagcaaucaaagauga

SEQ ID NO: 271250 - RNA, 19 nt, Homo sapiens
guagugagccucccaggau

SEQ ID NO: 271251 - RNA, 19 nt, Homo sapiens
gcagaguagguauuuggua

SEQ ID NO: 271252 - RNA, 19 nt, Homo sapiens
cagcugugguuccuuucua

SEQ ID NO: 271253 - RNA, 19 nt, Homo sapiens
ucucagcugugguuccuuu

SEQ ID NO: 271254 - RNA, 19 nt, Homo sapiens
aaacaccuugcaucauuua

SEQ ID NO: 271255 - RNA, 19 nt, Homo sapiens
ccuauacucaugaagcuua

SEQ ID NO: 271256 - RNA, 19 nt, Homo sapiens
gcccagccacucugauaua

SEQ ID NO: 271257 - RNA, 19 nt, Homo sapiens
agagagaccuggcccucaa

SEQ ID NO: 271258 - RNA, 19 nt, Homo sapiens
gcagaggcgagaccgagua

SEQ ID NO: 271259 - RNA, 19 nt, Homo sapiens
gaggaaguaccauagcauu

SEQ ID NO: 271260 - RNA, 19 nt, Homo sapiens
cuuaugggcugcuuacuag

SEQ ID NO: 271261 - RNA, 19 nt, Homo sapiens
ucccagggcugaugugaga

SEQ ID NO: 271262 - RNA, 19 nt, Homo sapiens
ggagucagcaaucaaagau

SEQ ID NO: 271263 - RNA, 19 nt, Homo sapiens
aaaccaaggcuaagagaug

SEQ ID NO: 271264 - RNA, 19 nt, Homo sapiens
acacguuuauugugcauug

SEQ ID NO: 271265 - RNA, 19 nt, Homo sapiens
gagaaccuccggucuaaag

SEQ ID NO: 271266 - RNA, 19 nt, Homo sapiens
cagagagaauggcaugugu

SEQ ID NO: 271267 - RNA, 19 nt, Homo sapiens
auagcgagcucuacuaagu

SEQ ID NO: 271268 - RNA, 19 nt, Homo sapiens
gagccucuccuggaaagua

SEQ ID NO: 271269 - RNA, 19 nt, Homo sapiens
gagcuacaucacacguuua

SEQ ID NO: 271270 - RNA, 19 nt, Homo sapiens
ggaaaccaaggcuaagaga

SEQ ID NO: 271271 - RNA, 19 nt, Homo sapiens
ggccugagaucuagacaac

SEQ ID NO: 271272 - RNA, 19 nt, Homo sapiens
gggaggaaguaccauagca

SEQ ID NO: 271273 - RNA, 19 nt, Homo sapiens
ggauauaggagcucuggau

SEQ ID NO: 271274 - RNA, 19 nt, Homo sapiens
cagaguugauccacaagau

SEQ ID NO: 271275 - RNA, 19 nt, Homo sapiens
ggucauguuuggccuugug

SEQ ID NO: 271276 - RNA, 19 nt, Homo sapiens
uacccuagauucugugaga

SEQ ID NO: 271277 - RNA, 19 nt, Homo sapiens
gaggaggacgugggcuuua

SEQ ID NO: 271278 - RNA, 19 nt, Homo sapiens
gagauacagugguggaaaa

SEQ ID NO: 271279 - RNA, 19 nt, Homo sapiens
ucaugaaguuugcgugugu

SEQ ID NO: 271280 - RNA, 19 nt, Homo sapiens
cuggagacaucccgagaaa

SEQ ID NO: 271281 - RNA, 19 nt, Homo sapiens
gcaaccaccaagaguuuga

SEQ ID NO: 271282 - RNA, 19 nt, Homo sapiens
cagccacucugauauacug

SEQ ID NO: 271283 - RNA, 19 nt, Homo sapiens
ggcuaucucugucccauca

SEQ ID NO: 271284 - RNA, 19 nt, Homo sapiens
ccacuucacagaugaggaa

SEQ ID NO: 271285 - RNA, 19 nt, Homo sapiens
gugcuacccuagauucugu

SEQ ID NO: 271286 - RNA, 19 nt, Homo sapiens
caacagcaaccaccaagag

SEQ ID NO: 271287 - RNA, 19 nt, Homo sapiens
gaggcgagaccgaguauag

SEQ ID NO: 271288 - RNA, 19 nt, Homo sapiens
agaaagagcuggagaaguu

SEQ ID NO: 271289 - RNA, 19 nt, Homo sapiens
ggagaaagaugaccacaca

SEQ ID NO: 271290 - RNA, 19 nt, Homo sapiens
gcugaauucugaaaugaua

SEQ ID NO: 271291 - RNA, 19 nt, Homo sapiens
gaacaucauugacuuuguc

SEQ ID NO: 271292 - RNA, 19 nt, Homo sapiens
gaaugaggauggagaagug

SEQ ID NO: 271293 - RNA, 19 nt, Homo sapiens
ucaauuaaaugccuuguuc

SEQ ID NO: 271294 - RNA, 19 nt, Homo sapiens
uaacacagcuuuauaaacc

SEQ ID NO: 271295 - RNA, 19 nt, Homo sapiens
ggaagagagugaggauauu

SEQ ID NO: 271296 - RNA, 19 nt, Homo sapiens
ccgcuaagcuuaucgcuau

SEQ ID NO: 271297 - RNA, 19 nt, Homo sapiens
uaaaugccuuguucugaaa

SEQ ID NO: 271298 - RNA, 19 nt, Homo sapiens
caucaucuguggcaucuug

SEQ ID NO: 271299 - RNA, 19 nt, Homo sapiens
uuaaaugccuuguucugaa

SEQ ID NO: 271300 - RNA, 19 nt, Homo sapiens
gauccugacuccacagaug

SEQ ID NO: 271301 - RNA, 19 nt, Homo sapiens
gacuuugucucuauuauuc

SEQ ID NO: 271302 - RNA, 19 nt, Homo sapiens
guccagauccuacggcuua

SEQ ID NO: 271303 - RNA, 19 nt, Homo sapiens
gguuaacacagcuuuauaa

SEQ ID NO: 271304 - RNA, 19 nt, Homo sapiens
ugucggaguuccagaauga

SEQ ID NO: 271305 - RNA, 19 nt, Homo sapiens
gaacuugucaaccugaaug

SEQ ID NO: 271306 - RNA, 19 nt, Homo sapiens
gucaugagcuaccuuacuu

SEQ ID NO: 271307 - RNA, 19 nt, Homo sapiens
gaagagagugaggauauug

SEQ ID NO: 271308 - RNA, 19 nt, Homo sapiens
ucacauugagcuaacuuua

SEQ ID NO: 271309 - RNA, 19 nt, Homo sapiens
ucugugaggucaauuaaau

SEQ ID NO: 271310 - RNA, 19 nt, Homo sapiens
agacacagcuaccaugaag

SEQ ID NO: 271311 - RNA, 19 nt, Homo sapiens
caugagcuaccuuacuuua

SEQ ID NO: 271312 - RNA, 19 nt, Homo sapiens
agagaagugucaugagcua

SEQ ID NO: 271313 - RNA, 19 nt, Homo sapiens
gaaaagccaugaugugagu

SEQ ID NO: 271314 - RNA, 19 nt, Homo sapiens
caaaggugcagcugacuga

SEQ ID NO: 271315 - RNA, 19 nt, Homo sapiens
gccaggagaucgaguacug

SEQ ID NO: 271316 - RNA, 19 nt, Homo sapiens
gguguaccuuucagccaua

SEQ ID NO: 271317 - RNA, 19 nt, Homo sapiens
gugaggauauugagaacau

SEQ ID NO: 271318 - RNA, 19 nt, Homo sapiens
uaagcagucuguugaccaa

SEQ ID NO: 271319 - RNA, 19 nt, Homo sapiens
gagcuaccuuacuuuaaca

SEQ ID NO: 271320 - RNA, 19 nt, Homo sapiens
aacgagcucuucauugauu

SEQ ID NO: 271321 - RNA, 19 nt, Homo sapiens
cggaaucccuccuuguuca

SEQ ID NO: 271322 - RNA, 19 nt, Homo sapiens
ucaacaaguuuuccaagua

SEQ ID NO: 271323 - RNA, 19 nt, Homo sapiens
gaaagagcuggagaaguuu

SEQ ID NO: 271324 - RNA, 19 nt, Homo sapiens
caucaacgagcucuucauu

SEQ ID NO: 271325 - RNA, 19 nt, Homo sapiens
caugguguuuggugaguuu

SEQ ID NO: 271326 - RNA, 19 nt, Homo sapiens
ucauugacuuugucucuau

SEQ ID NO: 271327 - RNA, 19 nt, Homo sapiens
gacaaugcauguaaaucca

SEQ ID NO: 271328 - RNA, 19 nt, Homo sapiens
uggaggagcugugcguauu

SEQ ID NO: 271329 - RNA, 19 nt, Homo sapiens
ccaaggaggaagagaguga

SEQ ID NO: 271330 - RNA, 19 nt, Homo sapiens
ggagcugugugaugauuac

SEQ ID NO: 271331 - RNA, 19 nt, Homo sapiens
acacagcuaccaugaaguu

SEQ ID NO: 271332 - RNA, 19 nt, Homo sapiens
cguacugccuguccgcuaa

SEQ ID NO: 271333 - RNA, 19 nt, Homo sapiens
caggauucuucccuucuuu

SEQ ID NO: 271334 - RNA, 19 nt, Homo sapiens
guucuaaacauggaaacua

SEQ ID NO: 271335 - RNA, 19 nt, Homo sapiens
ugagcuaccuuacuuuaac

SEQ ID NO: 271336 - RNA, 19 nt, Homo sapiens
caugacaacugugggcuau

SEQ ID NO: 271337 - RNA, 19 nt, Homo sapiens
ccagcacucugccuucugu

SEQ ID NO: 271338 - RNA, 19 nt, Homo sapiens
cacauugagcuaacuuuaa

SEQ ID NO: 271339 - RNA, 19 nt, Homo sapiens
uuaccagucucucuucugu

SEQ ID NO: 271340 - RNA, 19 nt, Homo sapiens
ggcagagcuucuuggauga

SEQ ID NO: 271341 - RNA, 19 nt, Homo sapiens
gaguggagaucgcgugcau

SEQ ID NO: 271342 - RNA, 19 nt, Homo sapiens
aaugagacaaugcauguaa

SEQ ID NO: 271343 - RNA, 19 nt, Homo sapiens
cauguaagauccacaaaau

SEQ ID NO: 271344 - RNA, 19 nt, Homo sapiens
caucaucuucaacaaguuu

SEQ ID NO: 271345 - RNA, 19 nt, Homo sapiens
ugacaacugugggcuaugg

SEQ ID NO: 271346 - RNA, 19 nt, Homo sapiens
guggagaucgcgugcauug

SEQ ID NO: 271347 - RNA, 19 nt, Homo sapiens
guaccgacuccucguuuga

SEQ ID NO: 271348 - RNA, 19 nt, Homo sapiens
gccuuguucugaaauuuau

SEQ ID NO: 271349 - RNA, 19 nt, Homo sapiens
agccauaguuggacauuca

SEQ ID NO: 271350 - RNA, 19 nt, Homo sapiens
gguaggacuucggucucua

SEQ ID NO: 271351 - RNA, 19 nt, Homo sapiens
gagagugauuuuccaguga

SEQ ID NO: 271352 - RNA, 19 nt, Homo sapiens
ucaccaucaucuucaacaa

SEQ ID NO: 271353 - RNA, 19 nt, Homo sapiens
agagugaggauauugagaa

SEQ ID NO: 271354 - RNA, 19 nt, Homo sapiens
cuucuuggaugaugaugga

SEQ ID NO: 271355 - RNA, 19 nt, Homo sapiens
gcacucugccuucuguauc

SEQ ID NO: 271356 - RNA, 19 nt, Homo sapiens
ugacugagacgacaugcau

SEQ ID NO: 271357 - RNA, 19 nt, Homo sapiens
gagacacagcuaccaugaa

SEQ ID NO: 271358 - RNA, 19 nt, Homo sapiens
ggaggaagagagugaggau

SEQ ID NO: 271359 - RNA, 19 nt, Homo sapiens
ugaacaucauugacuuugu

SEQ ID NO: 271360 - RNA, 19 nt, Homo sapiens
gcaugucggaguuccagaa

SEQ ID NO: 271361 - RNA, 19 nt, Homo sapiens
acugacaaguagaaucaaa

SEQ ID NO: 271362 - RNA, 19 nt, Homo sapiens
uaugcaucauucuguguuu

SEQ ID NO: 271363 - RNA, 19 nt, Homo sapiens
ucugugggcauuuccauuu

SEQ ID NO: 271364 - RNA, 19 nt, Homo sapiens
cagauccuacggcuuauga

SEQ ID NO: 271365 - RNA, 19 nt, Homo sapiens
aggaagagagugaggauau

SEQ ID NO: 271366 - RNA, 19 nt, Homo sapiens
ucucuauuauucccuucua

SEQ ID NO: 271367 - RNA, 19 nt, Homo sapiens
gaggagcugugcguauucu

SEQ ID NO: 271368 - RNA, 19 nt, Homo sapiens
uugcugaauucugaaauga

SEQ ID NO: 271369 - RNA, 19 nt, Homo sapiens
guaccuuucagccauaguu

SEQ ID NO: 271370 - RNA, 19 nt, Homo sapiens
ugagacacagcuaccauga

SEQ ID NO: 271371 - RNA, 19 nt, Homo sapiens
gaggaagagagugaggaua

SEQ ID NO: 271372 - RNA, 19 nt, Homo sapiens
ggagcugugcguauucuca

SEQ ID NO: 271373 - RNA, 19 nt, Homo sapiens
gaucggaaucccuccuugu

SEQ ID NO: 271374 - RNA, 19 nt, Homo sapiens
cauuagggauauauaugca

SEQ ID NO: 271375 - RNA, 19 nt, Homo sapiens
caccagagaagugucauga

SEQ ID NO: 271376 - RNA, 19 nt, Homo sapiens
caacaaguuuuccaaguac

SEQ ID NO: 271377 - RNA, 19 nt, Homo sapiens
gcaaggugguccagauccu

SEQ ID NO: 271378 - RNA, 19 nt, Homo sapiens
acaggauucuucccuucuu

SEQ ID NO: 271379 - RNA, 19 nt, Homo sapiens
gcuuuggccuguacaacca

SEQ ID NO: 271380 - RNA, 19 nt, Homo sapiens
cauaguuggacauucauug

SEQ ID NO: 271381 - RNA, 19 nt, Homo sapiens
gccagcacaugcaucaucu

SEQ ID NO: 271382 - RNA, 19 nt, Homo sapiens
ucucugugcuuaucuacuc

SEQ ID NO: 271383 - RNA, 19 nt, Homo sapiens
gagugaggauauugagaac

SEQ ID NO: 271384 - RNA, 19 nt, Homo sapiens
gagagugaggauauugaga

SEQ ID NO: 271385 - RNA, 19 nt, Homo sapiens
caacgagcucuucauugau

SEQ ID NO: 271386 - RNA, 19 nt, Homo sapiens
uuacuugccauucugaaga

SEQ ID NO: 271387 - RNA, 19 nt, Homo sapiens
cauugacuuugucucuauu

SEQ ID NO: 271388 - RNA, 19 nt, Homo sapiens
ggagugagaugaagaaauu

SEQ ID NO: 271389 - RNA, 19 nt, Homo sapiens
ggaaaucucuugcaagcua

SEQ ID NO: 271390 - RNA, 19 nt, Homo sapiens
gauuacagaucuccauuua

SEQ ID NO: 271391 - RNA, 19 nt, Homo sapiens
gaaaguuaccagucuauua

SEQ ID NO: 271392 - RNA, 19 nt, Homo sapiens
gaaaggaagacuaacguua

SEQ ID NO: 271393 - RNA, 19 nt, Homo sapiens
gagaaaagcuugucuuaaa

SEQ ID NO: 271394 - RNA, 19 nt, Homo sapiens
gcagaugccuuuggaauug

SEQ ID NO: 271395 - RNA, 19 nt, Homo sapiens
gcagacagaucuacguuug

SEQ ID NO: 271396 - RNA, 19 nt, Homo sapiens
gaaaggacauucagcucaa

SEQ ID NO: 271397 - RNA, 19 nt, Homo sapiens
gaauucggauugauagaaa

SEQ ID NO: 271398 - RNA, 19 nt, Homo sapiens
gcgauggccucuucuguaa

SEQ ID NO: 271399 - RNA, 19 nt, Homo sapiens
gaagauaucccguuagaag

SEQ ID NO: 271400 - RNA, 19 nt, Homo sapiens
cagaagagcugaaaacuuu

SEQ ID NO: 271401 - RNA, 19 nt, Homo sapiens
aagaagggcuuuacuauuc

SEQ ID NO: 271402 - RNA, 19 nt, Homo sapiens
ggucuguucugaaauguaa

SEQ ID NO: 271403 - RNA, 19 nt, Homo sapiens
ggaaguagccgcauuugau

SEQ ID NO: 271404 - RNA, 19 nt, Homo sapiens
gaagacagaaccaaauuau

SEQ ID NO: 271405 - RNA, 19 nt, Homo sapiens
gaacuuggauacucuuugg

SEQ ID NO: 271406 - RNA, 19 nt, Homo sapiens
gaaaugcugggaacaauga

SEQ ID NO: 271407 - RNA, 19 nt, Homo sapiens
ggaagacagaaccaaauua

SEQ ID NO: 271408 - RNA, 19 nt, Homo sapiens
ggguaaagauugaugaaga

SEQ ID NO: 271409 - RNA, 19 nt, Homo sapiens
uggagcaucucaucuguua

SEQ ID NO: 271410 - RNA, 19 nt, Homo sapiens
gcaagaagggcuuuacuau

SEQ ID NO: 271411 - RNA, 19 nt, Homo sapiens
guacauuacugagaacaaa

SEQ ID NO: 271412 - RNA, 19 nt, Homo sapiens
gguaaagauugaugaagaa

SEQ ID NO: 271413 - RNA, 19 nt, Homo sapiens
gguauaggauuuaugaugu

SEQ ID NO: 271414 - RNA, 19 nt, Homo sapiens
uaacaaaggucauaaugcu

SEQ ID NO: 271415 - RNA, 19 nt, Homo sapiens
ccucauaucuguccugaug

SEQ ID NO: 271416 - RNA, 19 nt, Homo sapiens
ugaacuaucuguuggagaa

SEQ ID NO: 271417 - RNA, 19 nt, Homo sapiens
gaacaaugacuauaagaca

SEQ ID NO: 271418 - RNA, 19 nt, Homo sapiens
gaaagaaggaacuagaaug

SEQ ID NO: 271419 - RNA, 19 nt, Homo sapiens
gaaagagacacaggaaauu

SEQ ID NO: 271420 - RNA, 19 nt, Homo sapiens
gggcauguacugacgauua

SEQ ID NO: 271421 - RNA, 19 nt, Homo sapiens
gugaacgacugccuuauga

SEQ ID NO: 271422 - RNA, 19 nt, Homo sapiens
ggaauugaacuaucuguug

SEQ ID NO: 271423 - RNA, 19 nt, Homo sapiens
gaaguagccgcauuugauu

SEQ ID NO: 271424 - RNA, 19 nt, Homo sapiens
guagaagacucaggcauug

SEQ ID NO: 271425 - RNA, 19 nt, Homo sapiens
gggaauacccuucuucgaa

SEQ ID NO: 271426 - RNA, 19 nt, Homo sapiens
gaugaaaguuaccagucua

SEQ ID NO: 271427 - RNA, 19 nt, Homo sapiens
ugaauacccucauaucugu

SEQ ID NO: 271428 - RNA, 19 nt, Homo sapiens
gagcucuccuccuguuuaa

SEQ ID NO: 271429 - RNA, 19 nt, Homo sapiens
cugaagaucuguauaagga

SEQ ID NO: 271430 - RNA, 19 nt, Homo sapiens
cggcaaaugugucagcuuu

SEQ ID NO: 271431 - RNA, 19 nt, Homo sapiens
gaaaucucuugcaagcuaa

SEQ ID NO: 271432 - RNA, 19 nt, Homo sapiens
gcagggagccagucuucua

SEQ ID NO: 271433 - RNA, 19 nt, Homo sapiens
cagaugaacucccauugga

SEQ ID NO: 271434 - RNA, 19 nt, Homo sapiens
gagaaucagacgacaagua

SEQ ID NO: 271435 - RNA, 19 nt, Homo sapiens
ggcacgaaauauccucuua

SEQ ID NO: 271436 - RNA, 19 nt, Homo sapiens
ucaagauccucauucauau

SEQ ID NO: 271437 - RNA, 19 nt, Homo sapiens
gaacgacugccuuaugaug

SEQ ID NO: 271438 - RNA, 19 nt, Homo sapiens
ggaugaacauugugaacga

SEQ ID NO: 271439 - RNA, 19 nt, Homo sapiens
caagaggcuuuguuuagga

SEQ ID NO: 271440 - RNA, 19 nt, Homo sapiens
cagaguugguggaacauuu

SEQ ID NO: 271441 - RNA, 19 nt, Homo sapiens
gccaccauguucucuaaua

SEQ ID NO: 271442 - RNA, 19 nt, Homo sapiens
gaaguggcauggaaucucu

SEQ ID NO: 271443 - RNA, 19 nt, Homo sapiens
caagaagggcuuuacuauu

SEQ ID NO: 271444 - RNA, 19 nt, Homo sapiens
gcuaauacaacucuucaaa

SEQ ID NO: 271445 - RNA, 19 nt, Homo sapiens
cuacauuguucuuccgaua

SEQ ID NO: 271446 - RNA, 19 nt, Homo sapiens
gcaucgagcucucaugucu

SEQ ID NO: 271447 - RNA, 19 nt, Homo sapiens
gauacucuuuggaaauuga

SEQ ID NO: 271448 - RNA, 19 nt, Homo sapiens
aaagagacacaggaaauua

SEQ ID NO: 271449 - RNA, 19 nt, Homo sapiens
ggucauuuaugucuauguu

SEQ ID NO: 271450 - RNA, 19 nt, Homo sapiens
caccauggguuuagaacaa

SEQ ID NO: 271451 - RNA, 19 nt, Homo sapiens
guuagaagaaccagaagua

SEQ ID NO: 271452 - RNA, 19 nt, Homo sapiens
caaauuccauuaugacaac

SEQ ID NO: 271453 - RNA, 19 nt, Homo sapiens
ccagugggcugaugaccaa

SEQ ID NO: 271454 - RNA, 19 nt, Homo sapiens
gagcugacacuucuguaaa

SEQ ID NO: 271455 - RNA, 19 nt, Homo sapiens
gcaggaaguagccgcauuu

SEQ ID NO: 271456 - RNA, 19 nt, Homo sapiens
gggagucuguggcaucuga

SEQ ID NO: 271457 - RNA, 19 nt, Homo sapiens
ggcaaagacuacauuguuc

SEQ ID NO: 271458 - RNA, 19 nt, Homo sapiens
aaagaaggaacuagaauga

SEQ ID NO: 271459 - RNA, 19 nt, Homo sapiens
gauugaagcagaugccuuu

SEQ ID NO: 271460 - RNA, 19 nt, Homo sapiens
gugaagcggucaacaaagu

SEQ ID NO: 271461 - RNA, 19 nt, Homo sapiens
agcaagaacugaacuaaau

SEQ ID NO: 271462 - RNA, 19 nt, Homo sapiens
caacacagcaggaaucagu

SEQ ID NO: 271463 - RNA, 19 nt, Homo sapiens
ccacuuaccugaggagcaa

SEQ ID NO: 271464 - RNA, 19 nt, Homo sapiens
gaacucaagauccucauuc

SEQ ID NO: 271465 - RNA, 19 nt, Homo sapiens
ucauggagcuuaagaaugc

SEQ ID NO: 271466 - RNA, 19 nt, Homo sapiens
caagaagaacagcacauuu

SEQ ID NO: 271467 - RNA, 19 nt, Homo sapiens
gauaaaccaggcaacguaa

SEQ ID NO: 271468 - RNA, 19 nt, Homo sapiens
ccucagugauguagaagaa

SEQ ID NO: 271469 - RNA, 19 nt, Homo sapiens
aauagaaggugcccaggaa

SEQ ID NO: 271470 - RNA, 19 nt, Homo sapiens
gaucauggagcuuaagaau

SEQ ID NO: 271471 - RNA, 19 nt, Homo sapiens
ggaaguaugugaccccaaa

SEQ ID NO: 271472 - RNA, 19 nt, Homo sapiens
ugaagcagaugccuuugga

SEQ ID NO: 271473 - RNA, 19 nt, Homo sapiens
guuguaggguauaggauuu

SEQ ID NO: 271474 - RNA, 19 nt, Homo sapiens
ggaauucggauugauagaa

SEQ ID NO: 271475 - RNA, 19 nt, Homo sapiens
ccucaaagaaguagcagua

SEQ ID NO: 271476 - RNA, 19 nt, Homo sapiens
cagcaggaaucagucagua

SEQ ID NO: 271477 - RNA, 19 nt, Homo sapiens
aaacaaaacuguggugauu

SEQ ID NO: 271478 - RNA, 19 nt, Homo sapiens
gugcagcgauggccucuuc

SEQ ID NO: 271479 - RNA, 19 nt, Homo sapiens
ggagcugacacuucuguaa

SEQ ID NO: 271480 - RNA, 19 nt, Homo sapiens
ggauaucacuccgaugaca

SEQ ID NO: 271481 - RNA, 19 nt, Homo sapiens
cucaagauccucauucaua

SEQ ID NO: 271482 - RNA, 19 nt, Homo sapiens
ggaaagcaucgaagucuca

SEQ ID NO: 271483 - RNA, 19 nt, Homo sapiens
ccaaucccauuucaaagga

SEQ ID NO: 271484 - RNA, 19 nt, Homo sapiens
uagccagacuucaaaauua

SEQ ID NO: 271485 - RNA, 19 nt, Homo sapiens
gauagagauuggagugcaa

SEQ ID NO: 271486 - RNA, 19 nt, Homo sapiens
uggauacucuuuggaaauu

SEQ ID NO: 271487 - RNA, 19 nt, Homo sapiens
ugaaagagacacaggaaau

SEQ ID NO: 271488 - RNA, 19 nt, Homo sapiens
gcagaaagcucagccagaa

SEQ ID NO: 271489 - RNA, 19 nt, Homo sapiens
cagcagaucuucuuucgaa

SEQ ID NO: 271490 - RNA, 19 nt, Homo sapiens
ggagaaagccuuccaguuc

SEQ ID NO: 271491 - RNA, 19 nt, Homo sapiens
ggacgucaaugcuuacuau

SEQ ID NO: 271492 - RNA, 19 nt, Homo sapiens
gcacagaaauaucgaccaa

SEQ ID NO: 271493 - RNA, 19 nt, Homo sapiens
ccaaagagaccaauaauuc

SEQ ID NO: 271494 - RNA, 19 nt, Homo sapiens
gcacuuggcuuccgcuugu

SEQ ID NO: 271495 - RNA, 19 nt, Homo sapiens
guaaauggacuuccuuaaa

SEQ ID NO: 271496 - RNA, 19 nt, Homo sapiens
cgacaagaauacaacgaua

SEQ ID NO: 271497 - RNA, 19 nt, Homo sapiens
gaagugcugccaugaaauu

SEQ ID NO: 271498 - RNA, 19 nt, Homo sapiens
uaaauggacuuccuuaaac

SEQ ID NO: 271499 - RNA, 19 nt, Homo sapiens
gcgcaucucugguaaaugg

SEQ ID NO: 271500 - RNA, 19 nt, Homo sapiens
cgaaagagcagcagaagug

SEQ ID NO: 271501 - RNA, 19 nt, Homo sapiens
ucacauccauggaaucaga

SEQ ID NO: 271502 - RNA, 19 nt, Homo sapiens
ucagaaaccuucccuggau

SEQ ID NO: 271503 - RNA, 19 nt, Homo sapiens
gcccagaucuuucgggaau

SEQ ID NO: 271504 - RNA, 19 nt, Homo sapiens
gaacauggcccaggacaag

SEQ ID NO: 271505 - RNA, 19 nt, Homo sapiens
ccgaagugcugccaugaaa

SEQ ID NO: 271506 - RNA, 19 nt, Homo sapiens
gcagaaccuccuucaauga

SEQ ID NO: 271507 - RNA, 19 nt, Homo sapiens
caagcaaggugcaagaaca

SEQ ID NO: 271508 - RNA, 19 nt, Homo sapiens
ggcuuccgcuugucucuua

SEQ ID NO: 271509 - RNA, 19 nt, Homo sapiens
gggaauaccugacuuaccu

SEQ ID NO: 271510 - RNA, 19 nt, Homo sapiens
ggauacacuugccauugaa

SEQ ID NO: 271511 - RNA, 19 nt, Homo sapiens
gugcugccaugaaauuauu

SEQ ID NO: 271512 - RNA, 19 nt, Homo sapiens
ccauuucccuuucuucaga

SEQ ID NO: 271513 - RNA, 19 nt, Homo sapiens
caagagagcacuccagaag

SEQ ID NO: 271514 - RNA, 19 nt, Homo sapiens
ccucaucacucgccucaga

SEQ ID NO: 271515 - RNA, 19 nt, Homo sapiens
gcagagccacaugaucuua

SEQ ID NO: 271516 - RNA, 19 nt, Homo sapiens
uggauacacuugccauuga

SEQ ID NO: 271517 - RNA, 19 nt, Homo sapiens
gcaccgacuucuucagcuu

SEQ ID NO: 271518 - RNA, 19 nt, Homo sapiens
acagaaauaucgaccaaca

SEQ ID NO: 271519 - RNA, 19 nt, Homo sapiens
agagaaugcugcagacguu

SEQ ID NO: 271520 - RNA, 19 nt, Homo sapiens
caagcaagaucaagaacag

SEQ ID NO: 271521 - RNA, 19 nt, Homo sapiens
ccaucgcgcugcaggcaua

SEQ ID NO: 271522 - RNA, 19 nt, Homo sapiens
uggaggagaugcugcuaaa

SEQ ID NO: 271523 - RNA, 19 nt, Homo sapiens
gagcaagauuuccuuucug

SEQ ID NO: 271524 - RNA, 19 nt, Homo sapiens
ugagacaucuguguguuug

SEQ ID NO: 271525 - RNA, 19 nt, Homo sapiens
uagcagaaccuccuucaau

SEQ ID NO: 271526 - RNA, 19 nt, Homo sapiens
ugaaucagcugggaaccuu

SEQ ID NO: 271527 - RNA, 19 nt, Homo sapiens
cacagaagauagacagaug

SEQ ID NO: 271528 - RNA, 19 nt, Homo sapiens
cuugggacgucaaugcuua

SEQ ID NO: 271529 - RNA, 19 nt, Homo sapiens
gauagaccagccagaguuu

SEQ ID NO: 271530 - RNA, 19 nt, Homo sapiens
uucaggagcuugccacaaa

SEQ ID NO: 271531 - RNA, 19 nt, Homo sapiens
ugacguggaauauuugaaa

SEQ ID NO: 271532 - RNA, 19 nt, Homo sapiens
gaacacucuuccuugucaa

SEQ ID NO: 271533 - RNA, 19 nt, Homo sapiens
agaacacucuuccuuguca

SEQ ID NO: 271534 - RNA, 19 nt, Homo sapiens
gggccaaagagaccaauaa

SEQ ID NO: 271535 - RNA, 19 nt, Homo sapiens
ugacagcuauccugauuuu

SEQ ID NO: 271536 - RNA, 19 nt, Homo sapiens
gacaagaauacaacgauau

SEQ ID NO: 271537 - RNA, 19 nt, Homo sapiens
ggaccaaagugaggaagag

SEQ ID NO: 271538 - RNA, 19 nt, Homo sapiens
caagauuuccuuucugcuu

SEQ ID NO: 271539 - RNA, 19 nt, Homo sapiens
gagcuggcccgacaagaau

SEQ ID NO: 271540 - RNA, 19 nt, Homo sapiens
gguaaauggacuuccuuaa

SEQ ID NO: 271541 - RNA, 19 nt, Homo sapiens
cuucacggcuguuccaguu

SEQ ID NO: 271542 - RNA, 19 nt, Homo sapiens
caaagagaccaauaauucu

SEQ ID NO: 271543 - RNA, 19 nt, Homo sapiens
auacaacgauauacagcuu

SEQ ID NO: 271544 - RNA, 19 nt, Homo sapiens
ugaaugaggagacccagaa

SEQ ID NO: 271545 - RNA, 19 nt, Homo sapiens
gccaaagagaccaauaauu

SEQ ID NO: 271546 - RNA, 19 nt, Homo sapiens
agagagcacuccagaagag

SEQ ID NO: 271547 - RNA, 19 nt, Homo sapiens
caucuucuaccagcucuua

SEQ ID NO: 271548 - RNA, 19 nt, Homo sapiens
ccagagccgugaacuuugg

SEQ ID NO: 271549 - RNA, 19 nt, Homo sapiens
uacaacuccugcauggaua

SEQ ID NO: 271550 - RNA, 19 nt, Homo sapiens
ucacggcuguuccaguuuc

SEQ ID NO: 271551 - RNA, 19 nt, Homo sapiens
caaccaugcccuccaggaa

SEQ ID NO: 271552 - RNA, 19 nt, Homo sapiens
cgucaaugcuuacuauucg

SEQ ID NO: 271553 - RNA, 19 nt, Homo sapiens
agagcaagauuuccuuucu

SEQ ID NO: 271554 - RNA, 19 nt, Homo sapiens
gcuggcggcuuuguuuguu

SEQ ID NO: 271555 - RNA, 19 nt, Homo sapiens
ucgaccagcucaaggaaau

SEQ ID NO: 271556 - RNA, 19 nt, Homo sapiens
gcuggcgcaucucugguaa

SEQ ID NO: 271557 - RNA, 19 nt, Homo sapiens
agcagaaccuccuucaaug

SEQ ID NO: 271558 - RNA, 19 nt, Homo sapiens
ucccagagccgugaacuuu

SEQ ID NO: 271559 - RNA, 19 nt, Homo sapiens
gagcuugccacaaagaaca

SEQ ID NO: 271560 - RNA, 19 nt, Homo sapiens
ccacagcacagaaauaucg

SEQ ID NO: 271561 - RNA, 19 nt, Homo sapiens
gcgccauuaugcugccuuu

SEQ ID NO: 271562 - RNA, 19 nt, Homo sapiens
auaccugacuuaccugaau

SEQ ID NO: 271563 - RNA, 19 nt, Homo sapiens
guauggccauuucccuuuc

SEQ ID NO: 271564 - RNA, 19 nt, Homo sapiens
cuacaacuccugcauggau

SEQ ID NO: 271565 - RNA, 19 nt, Homo sapiens
ggucacauccauggaauca

SEQ ID NO: 271566 - RNA, 19 nt, Homo sapiens
aaccuucccuggaugaaug

SEQ ID NO: 271567 - RNA, 19 nt, Homo sapiens
caagaucaagaacagaaga

SEQ ID NO: 271568 - RNA, 19 nt, Homo sapiens
agacaucuguguguuugga

SEQ ID NO: 271569 - RNA, 19 nt, Homo sapiens
cauccugccucuccacaca

SEQ ID NO: 271570 - RNA, 19 nt, Homo sapiens
acgcugagacuucugauga

SEQ ID NO: 271571 - RNA, 19 nt, Homo sapiens
gaagcuaugcccaggugau

SEQ ID NO: 271572 - RNA, 19 nt, Homo sapiens
gaggagaugcugcuaaagc

SEQ ID NO: 271573 - RNA, 19 nt, Homo sapiens
caccagucauccagauaga

SEQ ID NO: 271574 - RNA, 19 nt, Homo sapiens
gagucaguauggccauuuc

SEQ ID NO: 271575 - RNA, 19 nt, Homo sapiens
acaccucccuggucacauc

SEQ ID NO: 271576 - RNA, 19 nt, Homo sapiens
ccuccgagcuagaauuguc

SEQ ID NO: 271577 - RNA, 19 nt, Homo sapiens
ggagacaggcacguucuuc

SEQ ID NO: 271578 - RNA, 19 nt, Homo sapiens
gaaacugcgggaacugaca

SEQ ID NO: 271579 - RNA, 19 nt, Homo sapiens
acacaccagucauccagau

SEQ ID NO: 271580 - RNA, 19 nt, Homo sapiens
ggccaaagagaccaauaau

SEQ ID NO: 271581 - RNA, 19 nt, Homo sapiens
gcugagacuucugaugagu

SEQ ID NO: 271582 - RNA, 19 nt, Homo sapiens
aaauggacuuccuuaaacu

SEQ ID NO: 271583 - RNA, 19 nt, Homo sapiens
uggcgcaucucugguaaau

SEQ ID NO: 271584 - RNA, 19 nt, Homo sapiens
gugagacaucuguguguuu

SEQ ID NO: 271585 - RNA, 19 nt, Homo sapiens
uuaugcugccuuuccauua

SEQ ID NO: 271586 - RNA, 19 nt, Homo sapiens
cuagaauuguccagagcuu

SEQ ID NO: 271587 - RNA, 19 nt, Homo sapiens
ccagaucuuucgggaauac

SEQ ID NO: 271588 - RNA, 19 nt, Homo sapiens
gcaaagauguggccaagca

SEQ ID NO: 271589 - RNA, 19 nt, Homo sapiens
guacagcacuuaacgcaau

SEQ ID NO: 271590 - RNA, 19 nt, Homo sapiens
cugcuuggcuacagaauua

SEQ ID NO: 271591 - RNA, 19 nt, Homo sapiens
gaacacauauuggaauugg

SEQ ID NO: 271592 - RNA, 19 nt, Homo sapiens
gcaccauccuauacuauga

SEQ ID NO: 271593 - RNA, 19 nt, Homo sapiens
gagcccaccuuggaauuaa

SEQ ID NO: 271594 - RNA, 19 nt, Homo sapiens
cagugaaccugccaaagaa

SEQ ID NO: 271595 - RNA, 19 nt, Homo sapiens
caaauaaaucuuccucaga

SEQ ID NO: 271596 - RNA, 19 nt, Homo sapiens
ggucuucauuguccagaaa

SEQ ID NO: 271597 - RNA, 19 nt, Homo sapiens
ccgcugagcugaacugaca

SEQ ID NO: 271598 - RNA, 19 nt, Homo sapiens
ccagugaaccugccaaaga

SEQ ID NO: 271599 - RNA, 19 nt, Homo sapiens
ccauuuaauuagcugcaua

SEQ ID NO: 271600 - RNA, 19 nt, Homo sapiens
ggagcccaccuuggaauua

SEQ ID NO: 271601 - RNA, 19 nt, Homo sapiens
gcaggaagcacugagauuc

SEQ ID NO: 271602 - RNA, 19 nt, Homo sapiens
ccaccagccugugauuuga

SEQ ID NO: 271603 - RNA, 19 nt, Homo sapiens
cuacagacuuugagaaggu

SEQ ID NO: 271604 - RNA, 19 nt, Homo sapiens
uuaauuagcugcauaucac

SEQ ID NO: 271605 - RNA, 19 nt, Homo sapiens
gaccuacgcuacacagucu

SEQ ID NO: 271606 - RNA, 19 nt, Homo sapiens
caaucugccucaauuucuu

SEQ ID NO: 271607 - RNA, 19 nt, Homo sapiens
uggaacacauauuggaauu

SEQ ID NO: 271608 - RNA, 19 nt, Homo sapiens
gguccgaucuggaacacau

SEQ ID NO: 271609 - RNA, 19 nt, Homo sapiens
aaggaggacucggagauaa

SEQ ID NO: 271610 - RNA, 19 nt, Homo sapiens
gaucugacccaguucaagu

SEQ ID NO: 271611 - RNA, 19 nt, Homo sapiens
cuucaucugucaaauggaa

SEQ ID NO: 271612 - RNA, 19 nt, Homo sapiens
uaaggaggacucggagaua

SEQ ID NO: 271613 - RNA, 19 nt, Homo sapiens
cagcuucuccucucaaugu

SEQ ID NO: 271614 - RNA, 19 nt, Homo sapiens
cuacggagacgugguguuu

SEQ ID NO: 271615 - RNA, 19 nt, Homo sapiens
caucggagcaggugaagau

SEQ ID NO: 271616 - RNA, 19 nt, Homo sapiens
gcaaucugccucaauuucu

SEQ ID NO: 271617 - RNA, 19 nt, Homo sapiens
cagaauuauugugaggaua

SEQ ID NO: 271618 - RNA, 19 nt, Homo sapiens
ccucagagcaaauaaaucu

SEQ ID NO: 271619 - RNA, 19 nt, Homo sapiens
acaaaugugacccaggaua

SEQ ID NO: 271620 - RNA, 19 nt, Homo sapiens
gggcccugauggcaaauug

SEQ ID NO: 271621 - RNA, 19 nt, Homo sapiens
gaagaugcugcagcggaua

SEQ ID NO: 271622 - RNA, 19 nt, Homo sapiens
ucaauuucuucaucuguca

SEQ ID NO: 271623 - RNA, 19 nt, Homo sapiens
acucggagauaagguguuu

SEQ ID NO: 271624 - RNA, 19 nt, Homo sapiens
aacgcaaucugccucaauu

SEQ ID NO: 271625 - RNA, 19 nt, Homo sapiens
gagccagcuucuccucuca

SEQ ID NO: 271626 - RNA, 19 nt, Homo sapiens
gaaaggggcugugcuuguc

SEQ ID NO: 271627 - RNA, 19 nt, Homo sapiens
ccacggucaucaucaacga

SEQ ID NO: 271628 - RNA, 19 nt, Homo sapiens
uuagcugcauaucaccuua

SEQ ID NO: 271629 - RNA, 19 nt, Homo sapiens
gacccaggauacagagugu

SEQ ID NO: 271630 - RNA, 19 nt, Homo sapiens
ccacaccgcugagcugaac

SEQ ID NO: 271631 - RNA, 19 nt, Homo sapiens
ccugggcccugauggcaaa

SEQ ID NO: 271632 - RNA, 19 nt, Homo sapiens
caaaugugacccaggauac

SEQ ID NO: 271633 - RNA, 19 nt, Homo sapiens
ucagccugguggacaagua

SEQ ID NO: 271634 - RNA, 19 nt, Homo sapiens
gagccucagagcaaauaaa

SEQ ID NO: 271635 - RNA, 19 nt, Homo sapiens
gccgcaccauccuauacua

SEQ ID NO: 271636 - RNA, 19 nt, Homo sapiens
cauaucaccuuaggguaca

SEQ ID NO: 271637 - RNA, 19 nt, Homo sapiens
acagaauuauugugaggau

SEQ ID NO: 271638 - RNA, 19 nt, Homo sapiens
ucaaauggaaccaauucug

SEQ ID NO: 271639 - RNA, 19 nt, Homo sapiens
ucagagcaaauaaaucuuc

SEQ ID NO: 271640 - RNA, 19 nt, Homo sapiens
ucacacaccauggagacua

SEQ ID NO: 271641 - RNA, 19 nt, Homo sapiens
ggagacgugguguuuguca

SEQ ID NO: 271642 - RNA, 19 nt, Homo sapiens
gcggauagacgcacacaac

SEQ ID NO: 271643 - RNA, 19 nt, Homo sapiens
ggaacacauauuggaauug

SEQ ID NO: 271644 - RNA, 19 nt, Homo sapiens
ugacccaguucaaguggau

SEQ ID NO: 271645 - RNA, 19 nt, Homo sapiens
ggcuacagaauuauuguga

SEQ ID NO: 271646 - RNA, 19 nt, Homo sapiens
uaacgcaaucugccucaau

SEQ ID NO: 271647 - RNA, 19 nt, Homo sapiens
cagagccucagagcaaaua

SEQ ID NO: 271648 - RNA, 19 nt, Homo sapiens
acggagacgugguguuugu

SEQ ID NO: 271649 - RNA, 19 nt, Homo sapiens
agguugaucugacccaguu

SEQ ID NO: 271650 - RNA, 19 nt, Homo sapiens
gcagagccucagagcaaau

SEQ ID NO: 271651 - RNA, 19 nt, Homo sapiens
gguagccgcaccauccuau

SEQ ID NO: 271652 - RNA, 19 nt, Homo sapiens
gaucuggaacacauauugg

SEQ ID NO: 271653 - RNA, 19 nt, Homo sapiens
cgaucuggaacacauauug

SEQ ID NO: 271654 - RNA, 19 nt, Homo sapiens
gccagcuucuccucucaau

SEQ ID NO: 271655 - RNA, 19 nt, Homo sapiens
caaugccuccgucaucuuc

SEQ ID NO: 271656 - RNA, 19 nt, Homo sapiens
gcuggagacaccuucaaug

SEQ ID NO: 271657 - RNA, 19 nt, Homo sapiens
ugucaaauggaaccaauuc

SEQ ID NO: 271658 - RNA, 19 nt, Homo sapiens
augcagagccucagagcaa

SEQ ID NO: 271659 - RNA, 19 nt, Homo sapiens
ccgcuauucuguggaccua

SEQ ID NO: 271660 - RNA, 19 nt, Homo sapiens
cuaaggaggacucggagau

SEQ ID NO: 271661 - RNA, 19 nt, Homo sapiens
uccaauauaggguggguaa

SEQ ID NO: 271662 - RNA, 19 nt, Homo sapiens
ucuucauuguccagaaaua

SEQ ID NO: 271663 - RNA, 19 nt, Homo sapiens
ucaucagccugguggacaa

SEQ ID NO: 271664 - RNA, 19 nt, Homo sapiens
cuucgauccucccucuuug

SEQ ID NO: 271665 - RNA, 19 nt, Homo sapiens
gggaggacucugccugugu

SEQ ID NO: 271666 - RNA, 19 nt, Homo sapiens
gagcuggagacaccuucaa

SEQ ID NO: 271667 - RNA, 19 nt, Homo sapiens
ggaaaggggcugugcuugu

SEQ ID NO: 271668 - RNA, 19 nt, Homo sapiens
caauauaggguggguaagg

SEQ ID NO: 271669 - RNA, 19 nt, Homo sapiens
cuggccauguugcugauuu

SEQ ID NO: 271670 - RNA, 19 nt, Homo sapiens
ggccuuauaauguaaagag

SEQ ID NO: 271671 - RNA, 19 nt, Homo sapiens
ggagguccgaucuggaaca

SEQ ID NO: 271672 - RNA, 19 nt, Homo sapiens
guagccgcaccauccuaua

SEQ ID NO: 271673 - RNA, 19 nt, Homo sapiens
gcuagagcagcgagaagug

SEQ ID NO: 271674 - RNA, 19 nt, Homo sapiens
ucgccacggucaucaucaa

SEQ ID NO: 271675 - RNA, 19 nt, Homo sapiens
gcaaagauguggccaagca

SEQ ID NO: 271676 - RNA, 19 nt, Homo sapiens
guacagcacuuaacgcaau

SEQ ID NO: 271677 - RNA, 19 nt, Homo sapiens
cugcuuggcuacagaauua

SEQ ID NO: 271678 - RNA, 19 nt, Homo sapiens
gaacacauauuggaauugg

SEQ ID NO: 271679 - RNA, 19 nt, Homo sapiens
gagcccaccuuggaauuaa

SEQ ID NO: 271680 - RNA, 19 nt, Homo sapiens
cagugaaccugccaaagaa

SEQ ID NO: 271681 - RNA, 19 nt, Homo sapiens
caaauaaaucuuccucaga

SEQ ID NO: 271682 - RNA, 19 nt, Homo sapiens
ggucuucauuguccagaaa

SEQ ID NO: 271683 - RNA, 19 nt, Homo sapiens
ccgcugagcugaacugaca

SEQ ID NO: 271684 - RNA, 19 nt, Homo sapiens
ccagugaaccugccaaaga

SEQ ID NO: 271685 - RNA, 19 nt, Homo sapiens
ccauuuaauuagcugcaua

SEQ ID NO: 271686 - RNA, 19 nt, Homo sapiens
ggagcccaccuuggaauua

SEQ ID NO: 271687 - RNA, 19 nt, Homo sapiens
gcaggaagcacugagauuc

SEQ ID NO: 271688 - RNA, 19 nt, Homo sapiens
ccaccagccugugauuuga

SEQ ID NO: 271689 - RNA, 19 nt, Homo sapiens
cuacagacuuugagaaggu

SEQ ID NO: 271690 - RNA, 19 nt, Homo sapiens
uuaauuagcugcauaucac

SEQ ID NO: 271691 - RNA, 19 nt, Homo sapiens
caaucugccucaauuucuu

SEQ ID NO: 271692 - RNA, 19 nt, Homo sapiens
uggaacacauauuggaauu

SEQ ID NO: 271693 - RNA, 19 nt, Homo sapiens
gguccgaucuggaacacau

SEQ ID NO: 271694 - RNA, 19 nt, Homo sapiens
aaggaggacucggagauaa

SEQ ID NO: 271695 - RNA, 19 nt, Homo sapiens
gaucugacccaguucaagu

SEQ ID NO: 271696 - RNA, 19 nt, Homo sapiens
cuucaucugucaaauggaa

SEQ ID NO: 271697 - RNA, 19 nt, Homo sapiens
uaaggaggacucggagaua

SEQ ID NO: 271698 - RNA, 19 nt, Homo sapiens
cagcuucuccucucaaugu

SEQ ID NO: 271699 - RNA, 19 nt, Homo sapiens
cuacggagacgugguguuu

SEQ ID NO: 271700 - RNA, 19 nt, Homo sapiens
caucggagcaggugaagau

SEQ ID NO: 271701 - RNA, 19 nt, Homo sapiens
gcaaucugccucaauuucu

SEQ ID NO: 271702 - RNA, 19 nt, Homo sapiens
cagaauuauugugaggaua

SEQ ID NO: 271703 - RNA, 19 nt, Homo sapiens
ccucagagcaaauaaaucu

SEQ ID NO: 271704 - RNA, 19 nt, Homo sapiens
acaaaugugacccaggaua

SEQ ID NO: 271705 - RNA, 19 nt, Homo sapiens
gggcccugauggcaaauug

SEQ ID NO: 271706 - RNA, 19 nt, Homo sapiens
gaagaugcugcagcggaua

SEQ ID NO: 271707 - RNA, 19 nt, Homo sapiens
ucaauuucuucaucuguca

SEQ ID NO: 271708 - RNA, 19 nt, Homo sapiens
acucggagauaagguguuu

SEQ ID NO: 271709 - RNA, 19 nt, Homo sapiens
aacgcaaucugccucaauu

SEQ ID NO: 271710 - RNA, 19 nt, Homo sapiens
gagccagcuucuccucuca

SEQ ID NO: 271711 - RNA, 19 nt, Homo sapiens
gaaaggggcugugcuuguc

SEQ ID NO: 271712 - RNA, 19 nt, Homo sapiens
uuagcugcauaucaccuua

SEQ ID NO: 271713 - RNA, 19 nt, Homo sapiens
gacccaggauacagagugu

SEQ ID NO: 271714 - RNA, 19 nt, Homo sapiens
ccacaccgcugagcugaac

SEQ ID NO: 271715 - RNA, 19 nt, Homo sapiens
ccugggcccugauggcaaa

SEQ ID NO: 271716 - RNA, 19 nt, Homo sapiens
caaaugugacccaggauac

SEQ ID NO: 271717 - RNA, 19 nt, Homo sapiens
gagccucagagcaaauaaa

SEQ ID NO: 271718 - RNA, 19 nt, Homo sapiens
ucagccugguggacaagua

SEQ ID NO: 271719 - RNA, 19 nt, Homo sapiens
cauaucaccuuaggguaca

SEQ ID NO: 271720 - RNA, 19 nt, Homo sapiens
acagaauuauugugaggau

SEQ ID NO: 271721 - RNA, 19 nt, Homo sapiens
ucaaauggaaccaauucug

SEQ ID NO: 271722 - RNA, 19 nt, Homo sapiens
ucagagcaaauaaaucuuc

SEQ ID NO: 271723 - RNA, 19 nt, Homo sapiens
ucacacaccauggagacua

SEQ ID NO: 271724 - RNA, 19 nt, Homo sapiens
ggagacgugguguuuguca

SEQ ID NO: 271725 - RNA, 19 nt, Homo sapiens
gcggauagacgcacacaac

SEQ ID NO: 271726 - RNA, 19 nt, Homo sapiens
ggaacacauauuggaauug

SEQ ID NO: 271727 - RNA, 19 nt, Homo sapiens
ugacccaguucaaguggau

SEQ ID NO: 271728 - RNA, 19 nt, Homo sapiens
ggcuacagaauuauuguga

SEQ ID NO: 271729 - RNA, 19 nt, Homo sapiens
uaacgcaaucugccucaau

SEQ ID NO: 271730 - RNA, 19 nt, Homo sapiens
cagagccucagagcaaaua

SEQ ID NO: 271731 - RNA, 19 nt, Homo sapiens
acggagacgugguguuugu

SEQ ID NO: 271732 - RNA, 19 nt, Homo sapiens
agguugaucugacccaguu

SEQ ID NO: 271733 - RNA, 19 nt, Homo sapiens
gcagagccucagagcaaau

SEQ ID NO: 271734 - RNA, 19 nt, Homo sapiens
gaucuggaacacauauugg

SEQ ID NO: 271735 - RNA, 19 nt, Homo sapiens
cgaucuggaacacauauug

SEQ ID NO: 271736 - RNA, 19 nt, Homo sapiens
gccagcuucuccucucaau

SEQ ID NO: 271737 - RNA, 19 nt, Homo sapiens
caaugccuccgucaucuuc

SEQ ID NO: 271738 - RNA, 19 nt, Homo sapiens
gcuggagacaccuucaaug

SEQ ID NO: 271739 - RNA, 19 nt, Homo sapiens
ugucaaauggaaccaauuc

SEQ ID NO: 271740 - RNA, 19 nt, Homo sapiens
augcagagccucagagcaa

SEQ ID NO: 271741 - RNA, 19 nt, Homo sapiens
uccaauauaggguggguaa

SEQ ID NO: 271742 - RNA, 19 nt, Homo sapiens
cuaaggaggacucggagau

SEQ ID NO: 271743 - RNA, 19 nt, Homo sapiens
ucuucauuguccagaaaua

SEQ ID NO: 271744 - RNA, 19 nt, Homo sapiens
ucaucagccugguggacaa

SEQ ID NO: 271745 - RNA, 19 nt, Homo sapiens
cuucgauccucccucuuug

SEQ ID NO: 271746 - RNA, 19 nt, Homo sapiens
gggaggacucugccugugu

SEQ ID NO: 271747 - RNA, 19 nt, Homo sapiens
gagcuggagacaccuucaa

SEQ ID NO: 271748 - RNA, 19 nt, Homo sapiens
ggaaaggggcugugcuugu

SEQ ID NO: 271749 - RNA, 19 nt, Homo sapiens
caauauaggguggguaagg

SEQ ID NO: 271750 - RNA, 19 nt, Homo sapiens
ggccuuauaauguaaagag

SEQ ID NO: 271751 - RNA, 19 nt, Homo sapiens
ggagguccgaucuggaaca

SEQ ID NO: 271752 - RNA, 19 nt, Homo sapiens
gcuagagcagcgagaagug

SEQ ID NO: 271753 - RNA, 19 nt, Homo sapiens
gaacggaacuaaagucugu

SEQ ID NO: 271754 - RNA, 19 nt, Homo sapiens
caaauagggucaaagaauu

SEQ ID NO: 271755 - RNA, 19 nt, Homo sapiens
gaaaugguuuacagguuua

SEQ ID NO: 271756 - RNA, 19 nt, Homo sapiens
uaacugaacugcgggauaa

SEQ ID NO: 271757 - RNA, 19 nt, Homo sapiens
ccacgaagcuguuucacaa

SEQ ID NO: 271758 - RNA, 19 nt, Homo sapiens
gaagaagucucuccacagu

SEQ ID NO: 271759 - RNA, 19 nt, Homo sapiens
ggaauggcauccugugaaa

SEQ ID NO: 271760 - RNA, 19 nt, Homo sapiens
gggaauggcuacaugcuuu

SEQ ID NO: 271761 - RNA, 19 nt, Homo sapiens
agagaugacugaagaagua

SEQ ID NO: 271762 - RNA, 19 nt, Homo sapiens
uaaacucacucagguguua

SEQ ID NO: 271763 - RNA, 19 nt, Homo sapiens
gcaaauagggucaaagaau

SEQ ID NO: 271764 - RNA, 19 nt, Homo sapiens
ugaaaugguuuacagguuu

SEQ ID NO: 271765 - RNA, 19 nt, Homo sapiens
gaaugacccuccuucaaga

SEQ ID NO: 271766 - RNA, 19 nt, Homo sapiens
ugacucagcuccuaaugaa

SEQ ID NO: 271767 - RNA, 19 nt, Homo sapiens
gagagcaucuuuucacuua

SEQ ID NO: 271768 - RNA, 19 nt, Homo sapiens
gaacaagccagcaagcaaa

SEQ ID NO: 271769 - RNA, 19 nt, Homo sapiens
caaauguguugaagaugua

SEQ ID NO: 271770 - RNA, 19 nt, Homo sapiens
gcuugaaggugcugaaauu

SEQ ID NO: 271771 - RNA, 19 nt, Homo sapiens
cuacaaacccaaauuauga

SEQ ID NO: 271772 - RNA, 19 nt, Homo sapiens
cuacacaacuugaagcuau

SEQ ID NO: 271773 - RNA, 19 nt, Homo sapiens
guaaagauguugugauggu

SEQ ID NO: 271774 - RNA, 19 nt, Homo sapiens
cagcagauccuauugauga

SEQ ID NO: 271775 - RNA, 19 nt, Homo sapiens
ggucaaacaucugcaaaug

SEQ ID NO: 271776 - RNA, 19 nt, Homo sapiens
gaaagaucuugauguaauc

SEQ ID NO: 271777 - RNA, 19 nt, Homo sapiens
aaaccagauugaugacuua

SEQ ID NO: 271778 - RNA, 19 nt, Homo sapiens
gaagauguacugaaacuca

SEQ ID NO: 271779 - RNA, 19 nt, Homo sapiens
gcaaugguaacaucuuuaa

SEQ ID NO: 271780 - RNA, 19 nt, Homo sapiens
agacagcugugcucacuuu

SEQ ID NO: 271781 - RNA, 19 nt, Homo sapiens
gcaaccuucuuugaaauuu

SEQ ID NO: 271782 - RNA, 19 nt, Homo sapiens
cuaaagaagccaaacuaua

SEQ ID NO: 271783 - RNA, 19 nt, Homo sapiens
caaaccagauugaugacuu

SEQ ID NO: 271784 - RNA, 19 nt, Homo sapiens
ucacucagguguuaagaga

SEQ ID NO: 271785 - RNA, 19 nt, Homo sapiens
caagauuguucuaaaggaa

SEQ ID NO: 271786 - RNA, 19 nt, Homo sapiens
ggaaagaaccaagauuguu

SEQ ID NO: 271787 - RNA, 19 nt, Homo sapiens
ccagaacccucacuacugu

SEQ ID NO: 271788 - RNA, 19 nt, Homo sapiens
agaagucucuccacaguug

SEQ ID NO: 271789 - RNA, 19 nt, Homo sapiens
ugaaggugcugaaauuaau

SEQ ID NO: 271790 - RNA, 19 nt, Homo sapiens
gaggaaguuuggauuauag

SEQ ID NO: 271791 - RNA, 19 nt, Homo sapiens
ccgaauacaucaagcaaug

SEQ ID NO: 271792 - RNA, 19 nt, Homo sapiens
guaagacuguggacucaau

SEQ ID NO: 271793 - RNA, 19 nt, Homo sapiens
gaacugcgggauaaaguga

SEQ ID NO: 271794 - RNA, 19 nt, Homo sapiens
ucucguaccugcaugauug

SEQ ID NO: 271795 - RNA, 19 nt, Homo sapiens
caucagagccuuagguaga

SEQ ID NO: 271796 - RNA, 19 nt, Homo sapiens
gauguaaucacaauuccua

SEQ ID NO: 271797 - RNA, 19 nt, Homo sapiens
ggacuguagcuucuauuaa

SEQ ID NO: 271798 - RNA, 19 nt, Homo sapiens
caaccaagaacugggauua

SEQ ID NO: 271799 - RNA, 19 nt, Homo sapiens
cugaagaaguagauuauga

SEQ ID NO: 271800 - RNA, 19 nt, Homo sapiens
caugcaguguuucagauua

SEQ ID NO: 271801 - RNA, 19 nt, Homo sapiens
uaugcaaccuucuuugaaa

SEQ ID NO: 271802 - RNA, 19 nt, Homo sapiens
guaaucacaauuccuagua

SEQ ID NO: 271803 - RNA, 19 nt, Homo sapiens
gacuguagcuucuauuaag

SEQ ID NO: 271804 - RNA, 19 nt, Homo sapiens
caagaacugggauuaauga

SEQ ID NO: 271805 - RNA, 19 nt, Homo sapiens
agaaguagauuaugauguc

SEQ ID NO: 271806 - RNA, 19 nt, Homo sapiens
gaaggugcugaaauuaaua

SEQ ID NO: 271807 - RNA, 19 nt, Homo sapiens
guggaaagguguuugacuu

SEQ ID NO: 271808 - RNA, 19 nt, Homo sapiens
uaguaaagauguugugaug

SEQ ID NO: 271809 - RNA, 19 nt, Homo sapiens
agaggaaguuuggauuaua

SEQ ID NO: 271810 - RNA, 19 nt, Homo sapiens
gaaauggaagaacaaguug

SEQ ID NO: 271811 - RNA, 19 nt, Homo sapiens
cacaaucucuccaggaaug

SEQ ID NO: 271812 - RNA, 19 nt, Homo sapiens
gaaaacgaccacucaauaa

SEQ ID NO: 271813 - RNA, 19 nt, Homo sapiens
augcauaccucaucaguga

SEQ ID NO: 271814 - RNA, 19 nt, Homo sapiens
ugacugaagaaguagauua

SEQ ID NO: 271815 - RNA, 19 nt, Homo sapiens
caacagcagauccuauuga

SEQ ID NO: 271816 - RNA, 19 nt, Homo sapiens
gugugugacuaguuaauuu

SEQ ID NO: 271817 - RNA, 19 nt, Homo sapiens
ggaacaagccagcaagcaa

SEQ ID NO: 271818 - RNA, 19 nt, Homo sapiens
gaacauccggucaaacauc

SEQ ID NO: 271819 - RNA, 19 nt, Homo sapiens
uuaacaagguaccuagaaa

SEQ ID NO: 271820 - RNA, 19 nt, Homo sapiens
gauaauagagugguugguu

SEQ ID NO: 271821 - RNA, 19 nt, Homo sapiens
ggcauuugcugcuaaagga

SEQ ID NO: 271822 - RNA, 19 nt, Homo sapiens
gaagcuguuucacaaaugg

SEQ ID NO: 271823 - RNA, 19 nt, Homo sapiens
gccacaaucucuccaggaa

SEQ ID NO: 271824 - RNA, 19 nt, Homo sapiens
gaagaaguagauuaugaug

SEQ ID NO: 271825 - RNA, 19 nt, Homo sapiens
ccaagauuguucuaaagga

SEQ ID NO: 271826 - RNA, 19 nt, Homo sapiens
guuuacagguuuacugcua

SEQ ID NO: 271827 - RNA, 19 nt, Homo sapiens
uaaagauguugugauggua

SEQ ID NO: 271828 - RNA, 19 nt, Homo sapiens
ggacguugaugcuacaaac

SEQ ID NO: 271829 - RNA, 19 nt, Homo sapiens
uuacauuccuugucauugu

SEQ ID NO: 271830 - RNA, 19 nt, Homo sapiens
caacuugaagcuauucuug

SEQ ID NO: 271831 - RNA, 19 nt, Homo sapiens
aagcaaugguaacaucuuu

SEQ ID NO: 271832 - RNA, 19 nt, Homo sapiens
gcuacaaacccaaauuaug

SEQ ID NO: 271833 - RNA, 19 nt, Homo sapiens
gaugugccauaucauugaa

SEQ ID NO: 271834 - RNA, 19 nt, Homo sapiens
gaaagaggagcugauacuu

SEQ ID NO: 271835 - RNA, 19 nt, Homo sapiens
guacugaaacucauugaca

SEQ ID NO: 271836 - RNA, 19 nt, Homo sapiens
gacccuccuucaagagaua

SEQ ID NO: 271837 - RNA, 19 nt, Homo sapiens
caccaaaccagauugauga

SEQ ID NO: 271838 - RNA, 19 nt, Homo sapiens
ggugauguucguccaauaa

SEQ ID NO: 271839 - RNA, 19 nt, Homo sapiens
uguugaagauguacugaaa

SEQ ID NO: 271840 - RNA, 19 nt, Homo sapiens
cagcaagaacuuagagaaa

SEQ ID NO: 271841 - RNA, 19 nt, Homo sapiens
gguaguguuucagauauau

SEQ ID NO: 271842 - RNA, 19 nt, Homo sapiens
uaagggccauuugaaaguu

SEQ ID NO: 271843 - RNA, 19 nt, Homo sapiens
gcaaaucaacccgaagaga

SEQ ID NO: 271844 - RNA, 19 nt, Homo sapiens
agaaauggaagaacaaguu

SEQ ID NO: 271845 - RNA, 19 nt, Homo sapiens
caggaaagaaccaagauug

SEQ ID NO: 271846 - RNA, 19 nt, Homo sapiens
cuaaugaaaugguuuacag

SEQ ID NO: 271847 - RNA, 19 nt, Homo sapiens
gcacggcccagucaauuuc

SEQ ID NO: 271848 - RNA, 19 nt, Homo sapiens
ggaccauuccaucuuauau

SEQ ID NO: 271849 - RNA, 19 nt, Homo sapiens
ggaugugccauaucauuga

SEQ ID NO: 271850 - RNA, 19 nt, Homo sapiens
uggagauccuugucaguuu

SEQ ID NO: 271851 - RNA, 19 nt, Homo sapiens
gaaacacucuuuugucuac

SEQ ID NO: 271852 - RNA, 19 nt, Homo sapiens
ccagauugaugacuuagag

SEQ ID NO: 271853 - RNA, 19 nt, Homo sapiens
agaagaacauggagaauua

SEQ ID NO: 271854 - RNA, 19 nt, Homo sapiens
gcagcaagauggccaguaa

SEQ ID NO: 271855 - RNA, 19 nt, Homo sapiens
ggaguuguguguagaaauu

SEQ ID NO: 271856 - RNA, 19 nt, Homo sapiens
gaauuaggauuucaaagug

SEQ ID NO: 271857 - RNA, 19 nt, Homo sapiens
gaaaugaacccuucuuaca

SEQ ID NO: 271858 - RNA, 19 nt, Homo sapiens
guacagggcugaaaacaua

SEQ ID NO: 271859 - RNA, 19 nt, Homo sapiens
ugacagaucugccugaaau

SEQ ID NO: 271860 - RNA, 19 nt, Homo sapiens
ggaauucucucacgaccaa

SEQ ID NO: 271861 - RNA, 19 nt, Homo sapiens
ggacaacaauuaacaaugc

SEQ ID NO: 271862 - RNA, 19 nt, Homo sapiens
ggacaggaguuguguguag

SEQ ID NO: 271863 - RNA, 19 nt, Homo sapiens
gugaagaggucauaacgaa

SEQ ID NO: 271864 - RNA, 19 nt, Homo sapiens
gaacagcaauugagacaac

SEQ ID NO: 271865 - RNA, 19 nt, Homo sapiens
gcaggaacaucauggauca

SEQ ID NO: 271866 - RNA, 19 nt, Homo sapiens
ccaagaacaucaagaacaa

SEQ ID NO: 271867 - RNA, 19 nt, Homo sapiens
gcaagaggcuagagcugaa

SEQ ID NO: 271868 - RNA, 19 nt, Homo sapiens
caucagagcccaagagauu

SEQ ID NO: 271869 - RNA, 19 nt, Homo sapiens
ugucauuucugcuucauua

SEQ ID NO: 271870 - RNA, 19 nt, Homo sapiens
gaacccuucuuacaucauu

SEQ ID NO: 271871 - RNA, 19 nt, Homo sapiens
gagaagaacaagaucauga

SEQ ID NO: 271872 - RNA, 19 nt, Homo sapiens
ggacaaagcagcacguauc

SEQ ID NO: 271873 - RNA, 19 nt, Homo sapiens
ggaucaagcuugggucuga

SEQ ID NO: 271874 - RNA, 19 nt, Homo sapiens
caagagacauccugacagu

SEQ ID NO: 271875 - RNA, 19 nt, Homo sapiens
ggaccagcaugaugaguau

SEQ ID NO: 271876 - RNA, 19 nt, Homo sapiens
ggcuagagcugaaagagaa

SEQ ID NO: 271877 - RNA, 19 nt, Homo sapiens
ccacuggauuccuuuguuu

SEQ ID NO: 271878 - RNA, 19 nt, Homo sapiens
gaaauggaacagcaauuga

SEQ ID NO: 271879 - RNA, 19 nt, Homo sapiens
gacaauaaaggaaugagua

SEQ ID NO: 271880 - RNA, 19 nt, Homo sapiens
gcacguaucaccucauuca

SEQ ID NO: 271881 - RNA, 19 nt, Homo sapiens
cccaagagauuauuugaga

SEQ ID NO: 271882 - RNA, 19 nt, Homo sapiens
ggaaauggaacagcaauug

SEQ ID NO: 271883 - RNA, 19 nt, Homo sapiens
gaauuucuguugagcugaa

SEQ ID NO: 271884 - RNA, 19 nt, Homo sapiens
ccaagaaacucaagaagcu

SEQ ID NO: 271885 - RNA, 19 nt, Homo sapiens
cagaagauguuggaacuga

SEQ ID NO: 271886 - RNA, 19 nt, Homo sapiens
gagaagaacauggagaauu

SEQ ID NO: 271887 - RNA, 19 nt, Homo sapiens
ggaccaaauucucgugugu

SEQ ID NO: 271888 - RNA, 19 nt, Homo sapiens
acacaucgccuuugcauug

SEQ ID NO: 271889 - RNA, 19 nt, Homo sapiens
agaauuaccugcaggaaca

SEQ ID NO: 271890 - RNA, 19 nt, Homo sapiens
ccaagaaugucaaggagau

SEQ ID NO: 271891 - RNA, 19 nt, Homo sapiens
gcucaugcccuucagcuuu

SEQ ID NO: 271892 - RNA, 19 nt, Homo sapiens
uuaauaaccucaccaacau

SEQ ID NO: 271893 - RNA, 19 nt, Homo sapiens
caaagugcccuaauagugu

SEQ ID NO: 271894 - RNA, 19 nt, Homo sapiens
caaaaucaaccucucauua

SEQ ID NO: 271895 - RNA, 19 nt, Homo sapiens
gaagaggucauaacgaaag

SEQ ID NO: 271896 - RNA, 19 nt, Homo sapiens
ggugaaaccaugagacuga

SEQ ID NO: 271897 - RNA, 19 nt, Homo sapiens
gauccuuuauucacuaguu

SEQ ID NO: 271898 - RNA, 19 nt, Homo sapiens
gagacaacuugaacaguca

SEQ ID NO: 271899 - RNA, 19 nt, Homo sapiens
cccaagaccuucaccuuug

SEQ ID NO: 271900 - RNA, 19 nt, Homo sapiens
ccaagaccuucaccuuuga

SEQ ID NO: 271901 - RNA, 19 nt, Homo sapiens
gcuauggucuuuauuuagg

SEQ ID NO: 271902 - RNA, 19 nt, Homo sapiens
gaauugcaucuuuaaggua

SEQ ID NO: 271903 - RNA, 19 nt, Homo sapiens
caacaguggcggaccauga

SEQ ID NO: 271904 - RNA, 19 nt, Homo sapiens
gagccaagaacaucaagaa

SEQ ID NO: 271905 - RNA, 19 nt, Homo sapiens
cguaucaccucauucauca

SEQ ID NO: 271906 - RNA, 19 nt, Homo sapiens
gaugggaacuguggaccaa

SEQ ID NO: 271907 - RNA, 19 nt, Homo sapiens
cagcacguaucaccucauu

SEQ ID NO: 271908 - RNA, 19 nt, Homo sapiens
gaacucacggcuucccaaa

SEQ ID NO: 271909 - RNA, 19 nt, Homo sapiens
ggagauugccgagcagaaa

SEQ ID NO: 271910 - RNA, 19 nt, Homo sapiens
gcacgguguuugccuaugg

SEQ ID NO: 271911 - RNA, 19 nt, Homo sapiens
ucaaagugcccuaauagug

SEQ ID NO: 271912 - RNA, 19 nt, Homo sapiens
caaggcaacuccccauuuu

SEQ ID NO: 271913 - RNA, 19 nt, Homo sapiens
gcaauugagacaacuugaa

SEQ ID NO: 271914 - RNA, 19 nt, Homo sapiens
ugaauugcaucuuuaaggu

SEQ ID NO: 271915 - RNA, 19 nt, Homo sapiens
uggagaggcucaugcgauu

SEQ ID NO: 271916 - RNA, 19 nt, Homo sapiens
auacgggacauauguaaua

SEQ ID NO: 271917 - RNA, 19 nt, Homo sapiens
ucuugucacucuacacaua

SEQ ID NO: 271918 - RNA, 19 nt, Homo sapiens
gcccaagaccuucaccuuu

SEQ ID NO: 271919 - RNA, 19 nt, Homo sapiens
aagcuugggucugauuuaa

SEQ ID NO: 271920 - RNA, 19 nt, Homo sapiens
gagcagacccgcgaacuca

SEQ ID NO: 271921 - RNA, 19 nt, Homo sapiens
gcagcacccacaugaauga

SEQ ID NO: 271922 - RNA, 19 nt, Homo sapiens
ggaaaugaacccuucuuac

SEQ ID NO: 271923 - RNA, 19 nt, Homo sapiens
caacaggagcacccacauu

SEQ ID NO: 271924 - RNA, 19 nt, Homo sapiens
caaaaugucucuagguauc

SEQ ID NO: 271925 - RNA, 19 nt, Homo sapiens
gggaacagcaggccacaga

SEQ ID NO: 271926 - RNA, 19 nt, Homo sapiens
aaaucaaccucucauuauc

SEQ ID NO: 271927 - RNA, 19 nt, Homo sapiens
gauggaggaauuucuguug

SEQ ID NO: 271928 - RNA, 19 nt, Homo sapiens
cgaccuagcgagcaggaua

SEQ ID NO: 271929 - RNA, 19 nt, Homo sapiens
cauaauguuucuggaguug

SEQ ID NO: 271930 - RNA, 19 nt, Homo sapiens
gcaguugacaauaaaggaa

SEQ ID NO: 271931 - RNA, 19 nt, Homo sapiens
ggacacaucgccuuugcau

SEQ ID NO: 271932 - RNA, 19 nt, Homo sapiens
aaugaacccuucuuacauc

SEQ ID NO: 271933 - RNA, 19 nt, Homo sapiens
gaaccugcaggaaauggaa

SEQ ID NO: 271934 - RNA, 19 nt, Homo sapiens
gagacauccugacaguguu

SEQ ID NO: 271935 - RNA, 19 nt, Homo sapiens
gggcagcacccacaugaau

SEQ ID NO: 271936 - RNA, 19 nt, Homo sapiens
caagcuugggucugauuua

SEQ ID NO: 271937 - RNA, 19 nt, Homo sapiens
uaugaagagugcugucguu

SEQ ID NO: 271938 - RNA, 19 nt, Homo sapiens
ucaaggacauuaauaaccu

SEQ ID NO: 271939 - RNA, 19 nt, Homo sapiens
gaccaugagugacaaccau

SEQ ID NO: 271940 - RNA, 19 nt, Homo sapiens
ugaagaagcggccaacauc

SEQ ID NO: 271941 - RNA, 19 nt, Homo sapiens
gcacaauauacccaaauca

SEQ ID NO: 271942 - RNA, 19 nt, Homo sapiens
gacaggaguuguguguaga

SEQ ID NO: 271943 - RNA, 19 nt, Homo sapiens
gccauuugcuccuguccuu

SEQ ID NO: 271944 - RNA, 19 nt, Homo sapiens
gacaagagacauccugaca

SEQ ID NO: 271945 - RNA, 19 nt, Homo sapiens
caugccaucuucaucauca

SEQ ID NO: 271946 - RNA, 19 nt, Homo sapiens
ggagauugagcaugugaug

SEQ ID NO: 271947 - RNA, 19 nt, Homo sapiens
gaaggucagagcagcaaga

SEQ ID NO: 271948 - RNA, 19 nt, Homo sapiens
ucaccucauucaucacuug

SEQ ID NO: 271949 - RNA, 19 nt, Homo sapiens
gagcagccucucccacuga

SEQ ID NO: 271950 - RNA, 19 nt, Homo sapiens
ucgcuaaacgaagauauua

SEQ ID NO: 271951 - RNA, 19 nt, Homo sapiens
caauuaccaucgccuugga

SEQ ID NO: 271952 - RNA, 19 nt, Homo sapiens
ggucaucccgaaugccuuu

SEQ ID NO: 271953 - RNA, 19 nt, Homo sapiens
guugugagcuuccuaaauu

SEQ ID NO: 271954 - RNA, 19 nt, Homo sapiens
ucaaagaccuaaaucagaa

SEQ ID NO: 271955 - RNA, 19 nt, Homo sapiens
gaaaucaaaucgucaugug

SEQ ID NO: 271956 - RNA, 19 nt, Homo sapiens
caaagaauaucaacaaguc

SEQ ID NO: 271957 - RNA, 19 nt, Homo sapiens
caucaagguuucuuacuuu

SEQ ID NO: 271958 - RNA, 19 nt, Homo sapiens
cgacaaggaugaugaaauc

SEQ ID NO: 271959 - RNA, 19 nt, Homo sapiens
gcaaaccuguggucucuga

SEQ ID NO: 271960 - RNA, 19 nt, Homo sapiens
ccacagauaucaaugacaa

SEQ ID NO: 271961 - RNA, 19 nt, Homo sapiens
caacaaagccaacucauag

SEQ ID NO: 271962 - RNA, 19 nt, Homo sapiens
uuacaaagguucacaaaca

SEQ ID NO: 271963 - RNA, 19 nt, Homo sapiens
gggcaaagaccauuaagaa

SEQ ID NO: 271964 - RNA, 19 nt, Homo sapiens
gcaaagaccauuaagaaca

SEQ ID NO: 271965 - RNA, 19 nt, Homo sapiens
gcacacacacaaagccuua

SEQ ID NO: 271966 - RNA, 19 nt, Homo sapiens
gaauguuucuucuuucuca

SEQ ID NO: 271967 - RNA, 19 nt, Homo sapiens
uggaagggcugcuaauuga

SEQ ID NO: 271968 - RNA, 19 nt, Homo sapiens
gccaagauccgcucgcuua

SEQ ID NO: 271969 - RNA, 19 nt, Homo sapiens
gggugaauguuucuucuuu

SEQ ID NO: 271970 - RNA, 19 nt, Homo sapiens
caagguuucuuacuuugaa

SEQ ID NO: 271971 - RNA, 19 nt, Homo sapiens
ggaggagggugaauguuuc

SEQ ID NO: 271972 - RNA, 19 nt, Homo sapiens
ggaagaagaaauaugagaa

SEQ ID NO: 271973 - RNA, 19 nt, Homo sapiens
gcaaguuuaucaugcaugu

SEQ ID NO: 271974 - RNA, 19 nt, Homo sapiens
gaguagaggucacagagau

SEQ ID NO: 271975 - RNA, 19 nt, Homo sapiens
uagucuaccuuccuuauuu

SEQ ID NO: 271976 - RNA, 19 nt, Homo sapiens
gggacgagaucaacgagaa

SEQ ID NO: 271977 - RNA, 19 nt, Homo sapiens
gaugaaaucaaccaacaaa

SEQ ID NO: 271978 - RNA, 19 nt, Homo sapiens
cacaaagccuuaagcagaa

SEQ ID NO: 271979 - RNA, 19 nt, Homo sapiens
ggagcuggcugugaacuau

SEQ ID NO: 271980 - RNA, 19 nt, Homo sapiens
gcacgacccucagcugaug

SEQ ID NO: 271981 - RNA, 19 nt, Homo sapiens
ccgaggagcggcagaaaua

SEQ ID NO: 271982 - RNA, 19 nt, Homo sapiens
gaaccaggcugagauucug

SEQ ID NO: 271983 - RNA, 19 nt, Homo sapiens
ugaacgggcugaugaagga

SEQ ID NO: 271984 - RNA, 19 nt, Homo sapiens
ccaacaaagccaacucaua

SEQ ID NO: 271985 - RNA, 19 nt, Homo sapiens
ggacgacuauguucaucug

SEQ ID NO: 271986 - RNA, 19 nt, Homo sapiens
ccaugcagauugucaaaga

SEQ ID NO: 271987 - RNA, 19 nt, Homo sapiens
caacgaauguagcaucaag

SEQ ID NO: 271988 - RNA, 19 nt, Homo sapiens
aaacacgacucaagagcaa

SEQ ID NO: 271989 - RNA, 19 nt, Homo sapiens
uguuugaugucuucucuua

SEQ ID NO: 271990 - RNA, 19 nt, Homo sapiens
ggaaaugccacagauauca

SEQ ID NO: 271991 - RNA, 19 nt, Homo sapiens
caagaaaagugcagaaaug

SEQ ID NO: 271992 - RNA, 19 nt, Homo sapiens
ugaaggaucugagcgaguu

SEQ ID NO: 271993 - RNA, 19 nt, Homo sapiens
ggaaacugccggacgacua

SEQ ID NO: 271994 - RNA, 19 nt, Homo sapiens
caucaugagacgagaaaua

SEQ ID NO: 271995 - RNA, 19 nt, Homo sapiens
gggaggagggugaauguuu

SEQ ID NO: 271996 - RNA, 19 nt, Homo sapiens
ccaacagccucuuccagaa

SEQ ID NO: 271997 - RNA, 19 nt, Homo sapiens
ccaggaaacugugcaugaa

SEQ ID NO: 271998 - RNA, 19 nt, Homo sapiens
gaacgaugccgcuaaggau

SEQ ID NO: 271999 - RNA, 19 nt, Homo sapiens
gacgagaaauagacucuuc

SEQ ID NO: 272000 - RNA, 19 nt, Homo sapiens
caacauggacaauggaaau

SEQ ID NO: 272001 - RNA, 19 nt, Homo sapiens
cgacuauguucaucuguug

SEQ ID NO: 272002 - RNA, 19 nt, Homo sapiens
gaagggcugcuaauugaga

SEQ ID NO: 272003 - RNA, 19 nt, Homo sapiens
gaaacugccggacgacuau

SEQ ID NO: 272004 - RNA, 19 nt, Homo sapiens
ucagauauguacuuugcaa

SEQ ID NO: 272005 - RNA, 19 nt, Homo sapiens
uggaacagcuuacaaaggu

SEQ ID NO: 272006 - RNA, 19 nt, Homo sapiens
ggaugcagaugaagugaag

SEQ ID NO: 272007 - RNA, 19 nt, Homo sapiens
aaagccaacucauagagaa

SEQ ID NO: 272008 - RNA, 19 nt, Homo sapiens
gcugagcaguggaagaaga

SEQ ID NO: 272009 - RNA, 19 nt, Homo sapiens
gcaaagaauaucaacaagu

SEQ ID NO: 272010 - RNA, 19 nt, Homo sapiens
cggaggagauucuggaugu

SEQ ID NO: 272011 - RNA, 19 nt, Homo sapiens
gcaagcuguucguucaaga

SEQ ID NO: 272012 - RNA, 19 nt, Homo sapiens
acaaggagccugacacuca

SEQ ID NO: 272013 - RNA, 19 nt, Homo sapiens
gaagaagaaauaugagaag

SEQ ID NO: 272014 - RNA, 19 nt, Homo sapiens
gaaaugccacagauaucaa

SEQ ID NO: 272015 - RNA, 19 nt, Homo sapiens
caauggaaaugccacagau

SEQ ID NO: 272016 - RNA, 19 nt, Homo sapiens
uggaggagcuggcugugaa

SEQ ID NO: 272017 - RNA, 19 nt, Homo sapiens
agacaaaggcccagaagga

SEQ ID NO: 272018 - RNA, 19 nt, Homo sapiens
cuacugauguauuuagcaa

SEQ ID NO: 272019 - RNA, 19 nt, Homo sapiens
cgacucaagagcaaguuua

SEQ ID NO: 272020 - RNA, 19 nt, Homo sapiens
ucaccaacaugaaugaaca

SEQ ID NO: 272021 - RNA, 19 nt, Homo sapiens
gagcugagccaccugcaau

SEQ ID NO: 272022 - RNA, 19 nt, Homo sapiens
caaagaccauuaagaacac

SEQ ID NO: 272023 - RNA, 19 nt, Homo sapiens
cacagcaucuuccucauca

SEQ ID NO: 272024 - RNA, 19 nt, Homo sapiens
ggacaaaauucgugaccuu

SEQ ID NO: 272025 - RNA, 19 nt, Homo sapiens
gcacacacgcacacaaaca

SEQ ID NO: 272026 - RNA, 19 nt, Homo sapiens
gcacuuucaguuucuaaga

SEQ ID NO: 272027 - RNA, 19 nt, Homo sapiens
ggaacagcuuacaaagguu

SEQ ID NO: 272028 - RNA, 19 nt, Homo sapiens
ggagugagaaggucagcaa

SEQ ID NO: 272029 - RNA, 19 nt, Homo sapiens
ugucaaggguuguacugaa

SEQ ID NO: 272030 - RNA, 19 nt, Homo sapiens
gaacaaccuggaacagcuu

SEQ ID NO: 272031 - RNA, 19 nt, Homo sapiens
uaaaucagaagcuccaguu

SEQ ID NO: 272032 - RNA, 19 nt, Homo sapiens
guacuauguuugaugucuu

SEQ ID NO: 272033 - RNA, 19 nt, Homo sapiens
guuggacuguacuauguuu

SEQ ID NO: 272034 - RNA, 19 nt, Homo sapiens
gagaagcucaagcagcaaa

SEQ ID NO: 272035 - RNA, 19 nt, Homo sapiens
ggagagaaugugccugaga

SEQ ID NO: 272036 - RNA, 19 nt, Homo sapiens
agaaauaugagaaggagaa

SEQ ID NO: 272037 - RNA, 19 nt, Homo sapiens
caagagcaaguuuaucaug

SEQ ID NO: 272038 - RNA, 19 nt, Homo sapiens
gauauguacuuugcaaacu

SEQ ID NO: 272039 - RNA, 19 nt, Homo sapiens
ccucagauauguacuuugc

SEQ ID NO: 272040 - RNA, 19 nt, Homo sapiens
gacaugagcaguccaagca

SEQ ID NO: 272041 - RNA, 19 nt, Homo sapiens
acaucaagguuucuuacuu

SEQ ID NO: 272042 - RNA, 19 nt, Homo sapiens
ggacuguacuauguuugau

SEQ ID NO: 272043 - RNA, 19 nt, Homo sapiens
gcgaagaacacgagaagag

SEQ ID NO: 272044 - RNA, 19 nt, Homo sapiens
cgaguucagugucauugug

SEQ ID NO: 272045 - RNA, 19 nt, Homo sapiens
ggguuguacugaacgcuuu

SEQ ID NO: 272046 - RNA, 19 nt, Homo sapiens
ggugaauguuucuucuuuc

SEQ ID NO: 272047 - RNA, 19 nt, Homo sapiens
ucaaggugcucugccgauu

SEQ ID NO: 272048 - RNA, 19 nt, Homo sapiens
agagacagcagccagcuaa

SEQ ID NO: 272049 - RNA, 19 nt, Homo sapiens
caccucagauauguacuuu

SEQ ID NO: 272050 - RNA, 19 nt, Homo sapiens
gcucaaagaccuaaaucag

SEQ ID NO: 272051 - RNA, 19 nt, Homo sapiens
ugagccaccugcaaucaga

SEQ ID NO: 272052 - RNA, 19 nt, Homo sapiens
gaaauacgaggaggagauc

SEQ ID NO: 272053 - RNA, 19 nt, Homo sapiens
gaagugagcauuaggguua

SEQ ID NO: 272054 - RNA, 19 nt, Homo sapiens
gcagucaggucaaagaaua

SEQ ID NO: 272055 - RNA, 19 nt, Homo sapiens
gaacuggcaugauagauga

SEQ ID NO: 272056 - RNA, 19 nt, Homo sapiens
ugacaaggaugaagaaauu

SEQ ID NO: 272057 - RNA, 19 nt, Homo sapiens
gcaaacaaguguaaucguu

SEQ ID NO: 272058 - RNA, 19 nt, Homo sapiens
caacagacauguagcaguu

SEQ ID NO: 272059 - RNA, 19 nt, Homo sapiens
gcaggaacgucuaagagua

SEQ ID NO: 272060 - RNA, 19 nt, Homo sapiens
gaaccacuauuguaauuug

SEQ ID NO: 272061 - RNA, 19 nt, Homo sapiens
ugagggaacuggcaugaua

SEQ ID NO: 272062 - RNA, 19 nt, Homo sapiens
gaauaugaauugcuuagug

SEQ ID NO: 272063 - RNA, 19 nt, Homo sapiens
gaauugcugugggaaauaa

SEQ ID NO: 272064 - RNA, 19 nt, Homo sapiens
gugcugagauugauucuga

SEQ ID NO: 272065 - RNA, 19 nt, Homo sapiens
caugauagaugaagaguuc

SEQ ID NO: 272066 - RNA, 19 nt, Homo sapiens
acaaacagcuugaugacaa

SEQ ID NO: 272067 - RNA, 19 nt, Homo sapiens
caacacaacuagagugcaa

SEQ ID NO: 272068 - RNA, 19 nt, Homo sapiens
gaaauuaaccagcaaaguc

SEQ ID NO: 272069 - RNA, 19 nt, Homo sapiens
uaagggaccuguuagaugu

SEQ ID NO: 272070 - RNA, 19 nt, Homo sapiens
uaagauaagggaccuguua

SEQ ID NO: 272071 - RNA, 19 nt, Homo sapiens
gaagggaucaagacaauau

SEQ ID NO: 272072 - RNA, 19 nt, Homo sapiens
gaagaaagugugaagaaga

SEQ ID NO: 272073 - RNA, 19 nt, Homo sapiens
ggaccuggcuacaagaguu

SEQ ID NO: 272074 - RNA, 19 nt, Homo sapiens
gagaugaaguagaagcaaa

SEQ ID NO: 272075 - RNA, 19 nt, Homo sapiens
caaagaauauggccagaag

SEQ ID NO: 272076 - RNA, 19 nt, Homo sapiens
gcaagaaguagaucgcaua

SEQ ID NO: 272077 - RNA, 19 nt, Homo sapiens
gcaagacucuacauuagca

SEQ ID NO: 272078 - RNA, 19 nt, Homo sapiens
ggaguuaacugcagaacag

SEQ ID NO: 272079 - RNA, 19 nt, Homo sapiens
guccaagccuuaugcauuu

SEQ ID NO: 272080 - RNA, 19 nt, Homo sapiens
gaguauagaugcugagcuu

SEQ ID NO: 272081 - RNA, 19 nt, Homo sapiens
ucagaaaucggcaacuuua

SEQ ID NO: 272082 - RNA, 19 nt, Homo sapiens
agaaguagaucgcauaaag

SEQ ID NO: 272083 - RNA, 19 nt, Homo sapiens
ucaggaaguugaagacaaa

SEQ ID NO: 272084 - RNA, 19 nt, Homo sapiens
ugacaagaauccuucaaga

SEQ ID NO: 272085 - RNA, 19 nt, Homo sapiens
aaaccgaguucccuaugua

SEQ ID NO: 272086 - RNA, 19 nt, Homo sapiens
caagaauagugcaagauau

SEQ ID NO: 272087 - RNA, 19 nt, Homo sapiens
ccagaaggcaugggaauua

SEQ ID NO: 272088 - RNA, 19 nt, Homo sapiens
gcaaguguauaaugacugu

SEQ ID NO: 272089 - RNA, 19 nt, Homo sapiens
guacgaagaggacauggua

SEQ ID NO: 272090 - RNA, 19 nt, Homo sapiens
gggagacggugccuauuga

SEQ ID NO: 272091 - RNA, 19 nt, Homo sapiens
cagaagggaucaagacaau

SEQ ID NO: 272092 - RNA, 19 nt, Homo sapiens
ccaagaauagugcaagaua

SEQ ID NO: 272093 - RNA, 19 nt, Homo sapiens
acaaguacaucgccaaguu

SEQ ID NO: 272094 - RNA, 19 nt, Homo sapiens
uaaaagaccuugcagaaau

SEQ ID NO: 272095 - RNA, 19 nt, Homo sapiens
uagaagaacuugcugucaa

SEQ ID NO: 272096 - RNA, 19 nt, Homo sapiens
aaagucaacugguagagaa

SEQ ID NO: 272097 - RNA, 19 nt, Homo sapiens
ugauuuagcugguagugaa

SEQ ID NO: 272098 - RNA, 19 nt, Homo sapiens
gcacagauugcuaaaccua

SEQ ID NO: 272099 - RNA, 19 nt, Homo sapiens
gaaaaggagcacuuaaaua

SEQ ID NO: 272100 - RNA, 19 nt, Homo sapiens
caagagaaaguccaugaaa

SEQ ID NO: 272101 - RNA, 19 nt, Homo sapiens
gcaauuggaguuauaggaa

SEQ ID NO: 272102 - RNA, 19 nt, Homo sapiens
uauaaugacugugcaaaga

SEQ ID NO: 272103 - RNA, 19 nt, Homo sapiens
cuacaugaacuuacgguua

SEQ ID NO: 272104 - RNA, 19 nt, Homo sapiens
caacgagucugaagugaac

SEQ ID NO: 272105 - RNA, 19 nt, Homo sapiens
aagaaagugugaagaagaa

SEQ ID NO: 272106 - RNA, 19 nt, Homo sapiens
aaaaugagcucaacagaug

SEQ ID NO: 272107 - RNA, 19 nt, Homo sapiens
gugcaaagaagauuguuaa

SEQ ID NO: 272108 - RNA, 19 nt, Homo sapiens
gaguagaacaugagaaguu

SEQ ID NO: 272109 - RNA, 19 nt, Homo sapiens
gaaagaagaaagugugaag

SEQ ID NO: 272110 - RNA, 19 nt, Homo sapiens
caauuggaguuauaggaaa

SEQ ID NO: 272111 - RNA, 19 nt, Homo sapiens
aagagcaaguguauaauga

SEQ ID NO: 272112 - RNA, 19 nt, Homo sapiens
uacaugaacuuacgguuau

SEQ ID NO: 272113 - RNA, 19 nt, Homo sapiens
gaaaagagcagaaaacuac

SEQ ID NO: 272114 - RNA, 19 nt, Homo sapiens
uuugagagaugaaguagaa

SEQ ID NO: 272115 - RNA, 19 nt, Homo sapiens
ucagaagucucaggaaguu

SEQ ID NO: 272116 - RNA, 19 nt, Homo sapiens
guuugucuaucgugucuua

SEQ ID NO: 272117 - RNA, 19 nt, Homo sapiens
gaucuccgcugugaacuuc

SEQ ID NO: 272118 - RNA, 19 nt, Homo sapiens
cagcagauccagagccaua

SEQ ID NO: 272119 - RNA, 19 nt, Homo sapiens
gcacacaaacugagagcaa

SEQ ID NO: 272120 - RNA, 19 nt, Homo sapiens
gaaagcacacaaacugaga

SEQ ID NO: 272121 - RNA, 19 nt, Homo sapiens
guugcaagacucuacauua

SEQ ID NO: 272122 - RNA, 19 nt, Homo sapiens
gggaaauaaugauguaaag

SEQ ID NO: 272123 - RNA, 19 nt, Homo sapiens
guaauuugcugcucuccau

SEQ ID NO: 272124 - RNA, 19 nt, Homo sapiens
gaaaaugcaucucgugauc

SEQ ID NO: 272125 - RNA, 19 nt, Homo sapiens
gaaagccacagaucaggaa

SEQ ID NO: 272126 - RNA, 19 nt, Homo sapiens
ggaacuggcaugauagaug

SEQ ID NO: 272127 - RNA, 19 nt, Homo sapiens
gaucggaagugagcauuag

SEQ ID NO: 272128 - RNA, 19 nt, Homo sapiens
agugaaagcuuuggaauca

SEQ ID NO: 272129 - RNA, 19 nt, Homo sapiens
agaacuugcugucaauuau

SEQ ID NO: 272130 - RNA, 19 nt, Homo sapiens
gaagaaauuaaccagcaaa

SEQ ID NO: 272131 - RNA, 19 nt, Homo sapiens
gauauuacucuuaccaaug

SEQ ID NO: 272132 - RNA, 19 nt, Homo sapiens
gaacaaaagcugaguggaa

SEQ ID NO: 272133 - RNA, 19 nt, Homo sapiens
cagaugaaguuauggauac

SEQ ID NO: 272134 - RNA, 19 nt, Homo sapiens
aagauguacuugaaggaua

SEQ ID NO: 272135 - RNA, 19 nt, Homo sapiens
gcaaagaagauuguuaaag

SEQ ID NO: 272136 - RNA, 19 nt, Homo sapiens
gaagcagucaggucaaaga

SEQ ID NO: 272137 - RNA, 19 nt, Homo sapiens
gaaaagcgacuucgagcua

SEQ ID NO: 272138 - RNA, 19 nt, Homo sapiens
cuucguaucucucaacaug

SEQ ID NO: 272139 - RNA, 19 nt, Homo sapiens
ggaggugcauuuguucaga

SEQ ID NO: 272140 - RNA, 19 nt, Homo sapiens
caaacgcuaucagcaagaa

SEQ ID NO: 272141 - RNA, 19 nt, Homo sapiens
uugaacagcucacuaaagu

SEQ ID NO: 272142 - RNA, 19 nt, Homo sapiens
agaguucacuguugcaaga

SEQ ID NO: 272143 - RNA, 19 nt, Homo sapiens
aagaagaagugaaagaagu

SEQ ID NO: 272144 - RNA, 19 nt, Homo sapiens
acaaugagucugaaacaaa

SEQ ID NO: 272145 - RNA, 19 nt, Homo sapiens
ugaaggauauaauggaaca

SEQ ID NO: 272146 - RNA, 19 nt, Homo sapiens
uaccuacucuucuuguaaa

SEQ ID NO: 272147 - RNA, 19 nt, Homo sapiens
caaguguaaucguuuauac

SEQ ID NO: 272148 - RNA, 19 nt, Homo sapiens
caugauggaucggaaguga

SEQ ID NO: 272149 - RNA, 19 nt, Homo sapiens
uggaggaggugcauuuguu

SEQ ID NO: 272150 - RNA, 19 nt, Homo sapiens
acagauugcuaaaccuauu

SEQ ID NO: 272151 - RNA, 19 nt, Homo sapiens
aagcacaucucaagagcaa

SEQ ID NO: 272152 - RNA, 19 nt, Homo sapiens
gaacuucagacuuuacaca

SEQ ID NO: 272153 - RNA, 19 nt, Homo sapiens
caacuaagcucaugaauau

SEQ ID NO: 272154 - RNA, 19 nt, Homo sapiens
caacugagauccugaauuu

SEQ ID NO: 272155 - RNA, 19 nt, Homo sapiens
gaagaucaauuuccaagua

SEQ ID NO: 272156 - RNA, 19 nt, Homo sapiens
ggagauagguggaauuauu

SEQ ID NO: 272157 - RNA, 19 nt, Homo sapiens
gaacacagcucuagaaguc

SEQ ID NO: 272158 - RNA, 19 nt, Homo sapiens
gaagguagcucaagugugu

SEQ ID NO: 272159 - RNA, 19 nt, Homo sapiens
ggaggcagcucuucaaauu

SEQ ID NO: 272160 - RNA, 19 nt, Homo sapiens
uacaguagcuuucacauua

SEQ ID NO: 272161 - RNA, 19 nt, Homo sapiens
gaacaaaggucaguaaugg

SEQ ID NO: 272162 - RNA, 19 nt, Homo sapiens
ccaaauagguuucaucuuc

SEQ ID NO: 272163 - RNA, 19 nt, Homo sapiens
gaaaugugaucucugcuuu

SEQ ID NO: 272164 - RNA, 19 nt, Homo sapiens
ucaccuagcuucaaucuuu

SEQ ID NO: 272165 - RNA, 19 nt, Homo sapiens
ugacaaggaugaugaaauu

SEQ ID NO: 272166 - RNA, 19 nt, Homo sapiens
caacuuggcuguucaugaa

SEQ ID NO: 272167 - RNA, 19 nt, Homo sapiens
gaagaaauccaacaucauu

SEQ ID NO: 272168 - RNA, 19 nt, Homo sapiens
gcaaacauaucaucucuuc

SEQ ID NO: 272169 - RNA, 19 nt, Homo sapiens
ggagaauggugguuuauau

SEQ ID NO: 272170 - RNA, 19 nt, Homo sapiens
gcuauaggguucaaaguuu

SEQ ID NO: 272171 - RNA, 19 nt, Homo sapiens
caauaacgaugcuguacua

SEQ ID NO: 272172 - RNA, 19 nt, Homo sapiens
gcuaagaacugugcauuga

SEQ ID NO: 272173 - RNA, 19 nt, Homo sapiens
gcaggaugcugaagaaaug

SEQ ID NO: 272174 - RNA, 19 nt, Homo sapiens
gcuaagaccaucaagaaua

SEQ ID NO: 272175 - RNA, 19 nt, Homo sapiens
ccacauaaccuuguugaua

SEQ ID NO: 272176 - RNA, 19 nt, Homo sapiens
uugcaaagcuuaucaggua

SEQ ID NO: 272177 - RNA, 19 nt, Homo sapiens
gcauugacauccaaacauu

SEQ ID NO: 272178 - RNA, 19 nt, Homo sapiens
gaucugaccacccgaguua

SEQ ID NO: 272179 - RNA, 19 nt, Homo sapiens
ggagcuggcugucaauuau

SEQ ID NO: 272180 - RNA, 19 nt, Homo sapiens
gcagaagaauggaagaaga

SEQ ID NO: 272181 - RNA, 19 nt, Homo sapiens
gaaccaccaucgucauuug

SEQ ID NO: 272182 - RNA, 19 nt, Homo sapiens
uaacgaugcuguacuauag

SEQ ID NO: 272183 - RNA, 19 nt, Homo sapiens
ccacauagauggauauuuu

SEQ ID NO: 272184 - RNA, 19 nt, Homo sapiens
ugaauuugcuguugaaaga

SEQ ID NO: 272185 - RNA, 19 nt, Homo sapiens
caugauaucuuugaccaua

SEQ ID NO: 272186 - RNA, 19 nt, Homo sapiens
cauaucaucucuucaaaug

SEQ ID NO: 272187 - RNA, 19 nt, Homo sapiens
gcacuuuguuuauguaugu

SEQ ID NO: 272188 - RNA, 19 nt, Homo sapiens
gagcuaagaccaucaagaa

SEQ ID NO: 272189 - RNA, 19 nt, Homo sapiens
gaaccuggaguuucacaua

SEQ ID NO: 272190 - RNA, 19 nt, Homo sapiens
gguggaaacuccuauccua

SEQ ID NO: 272191 - RNA, 19 nt, Homo sapiens
gaaacugacugugcugcua

SEQ ID NO: 272192 - RNA, 19 nt, Homo sapiens
agaauucugugcaaacaua

SEQ ID NO: 272193 - RNA, 19 nt, Homo sapiens
uagcauguauugugucuuu

SEQ ID NO: 272194 - RNA, 19 nt, Homo sapiens
ccacuacucuccauuacuu

SEQ ID NO: 272195 - RNA, 19 nt, Homo sapiens
cacauaaccuuguugauau

SEQ ID NO: 272196 - RNA, 19 nt, Homo sapiens
cgaagcaaauugucaaaga

SEQ ID NO: 272197 - RNA, 19 nt, Homo sapiens
gcaggaugguggauuggua

SEQ ID NO: 272198 - RNA, 19 nt, Homo sapiens
ugacaaacaugaaugaaca

SEQ ID NO: 272199 - RNA, 19 nt, Homo sapiens
uguaauagaugaaggcaaa

SEQ ID NO: 272200 - RNA, 19 nt, Homo sapiens
gagaacagccagaugguuu

SEQ ID NO: 272201 - RNA, 19 nt, Homo sapiens
ggagagagaggacgacaaa

SEQ ID NO: 272202 - RNA, 19 nt, Homo sapiens
ggagaugguugcagaagau

SEQ ID NO: 272203 - RNA, 19 nt, Homo sapiens
caauauugcuccuguuguu

SEQ ID NO: 272204 - RNA, 19 nt, Homo sapiens
gaagcaaauugucaaagau

SEQ ID NO: 272205 - RNA, 19 nt, Homo sapiens
gguaguagacagaacaaua

SEQ ID NO: 272206 - RNA, 19 nt, Homo sapiens
gaugguggauugguaaauu

SEQ ID NO: 272207 - RNA, 19 nt, Homo sapiens
ccacacuucugaacaacua

SEQ ID NO: 272208 - RNA, 19 nt, Homo sapiens
ggaaacuccuauccuauca

SEQ ID NO: 272209 - RNA, 19 nt, Homo sapiens
caacaucauuccagcaguu

SEQ ID NO: 272210 - RNA, 19 nt, Homo sapiens
gggaauggcugcuuucucu

SEQ ID NO: 272211 - RNA, 19 nt, Homo sapiens
cuggauaacugccgaagua

SEQ ID NO: 272212 - RNA, 19 nt, Homo sapiens
gaacaacuaagcucaugaa

SEQ ID NO: 272213 - RNA, 19 nt, Homo sapiens
gagacgaaauugaggagaa

SEQ ID NO: 272214 - RNA, 19 nt, Homo sapiens
ugacacgucuccagauuga

SEQ ID NO: 272215 - RNA, 19 nt, Homo sapiens
guaguagacagaacaauaa

SEQ ID NO: 272216 - RNA, 19 nt, Homo sapiens
ccaaacauuucuuguacaa

SEQ ID NO: 272217 - RNA, 19 nt, Homo sapiens
ggagaaagugcuugucaaa

SEQ ID NO: 272218 - RNA, 19 nt, Homo sapiens
ggaagucauggauguaaua

SEQ ID NO: 272219 - RNA, 19 nt, Homo sapiens
acaagggacugacaacauu

SEQ ID NO: 272220 - RNA, 19 nt, Homo sapiens
caauauaccugcucuacca

SEQ ID NO: 272221 - RNA, 19 nt, Homo sapiens
cagacugcauguuguauaa

SEQ ID NO: 272222 - RNA, 19 nt, Homo sapiens
gcuuggcacuuucauguuu

SEQ ID NO: 272223 - RNA, 19 nt, Homo sapiens
cuaaacagguggaggaaug

SEQ ID NO: 272224 - RNA, 19 nt, Homo sapiens
ccagaugguuuauaugaau

SEQ ID NO: 272225 - RNA, 19 nt, Homo sapiens
ucaccacuguaaugaaaua

SEQ ID NO: 272226 - RNA, 19 nt, Homo sapiens
gaaagugcuugucaaaauu

SEQ ID NO: 272227 - RNA, 19 nt, Homo sapiens
caguagcaguguagaauuu

SEQ ID NO: 272228 - RNA, 19 nt, Homo sapiens
gaauggugguuuauaucaa

SEQ ID NO: 272229 - RNA, 19 nt, Homo sapiens
aauaauggcuggauaacug

SEQ ID NO: 272230 - RNA, 19 nt, Homo sapiens
caaagcuuaucagguaaua

SEQ ID NO: 272231 - RNA, 19 nt, Homo sapiens
gacgacaaauucuauugaa

SEQ ID NO: 272232 - RNA, 19 nt, Homo sapiens
gggcagacuucaucaggaa

SEQ ID NO: 272233 - RNA, 19 nt, Homo sapiens
gaagcuuaguucugauuau

SEQ ID NO: 272234 - RNA, 19 nt, Homo sapiens
cacaggaaguggaggauaa

SEQ ID NO: 272235 - RNA, 19 nt, Homo sapiens
ggagacauuuggacucuag

SEQ ID NO: 272236 - RNA, 19 nt, Homo sapiens
gagaauguuguuugagaua

SEQ ID NO: 272237 - RNA, 19 nt, Homo sapiens
gaauggcugcuuucucuaa

SEQ ID NO: 272238 - RNA, 19 nt, Homo sapiens
ccuccgagcugcuugcuuu

SEQ ID NO: 272239 - RNA, 19 nt, Homo sapiens
ggagguggaucguaucaag

SEQ ID NO: 272240 - RNA, 19 nt, Homo sapiens
gaaguacgaugaggagauc

SEQ ID NO: 272241 - RNA, 19 nt, Homo sapiens
aaaccacacuucugaacaa

SEQ ID NO: 272242 - RNA, 19 nt, Homo sapiens
ucacaucuuuggaucugua

SEQ ID NO: 272243 - RNA, 19 nt, Homo sapiens
gaacaggagaagcuuaguu

SEQ ID NO: 272244 - RNA, 19 nt, Homo sapiens
ccaaugaugugaaaacuuu

SEQ ID NO: 272245 - RNA, 19 nt, Homo sapiens
gcgaugaccugcugagaag

SEQ ID NO: 272246 - RNA, 19 nt, Homo sapiens
uauaccugcucuaccauua

SEQ ID NO: 272247 - RNA, 19 nt, Homo sapiens
gagagaggacgacaaauuc

SEQ ID NO: 272248 - RNA, 19 nt, Homo sapiens
aaagcugaaucaacccuua

SEQ ID NO: 272249 - RNA, 19 nt, Homo sapiens
gaagauguauggguacucu

SEQ ID NO: 272250 - RNA, 19 nt, Homo sapiens
gcuaaagaaaccaucauaa

SEQ ID NO: 272251 - RNA, 19 nt, Homo sapiens
ggacgacaaauucuauuga

SEQ ID NO: 272252 - RNA, 19 nt, Homo sapiens
ugacugugcugcuauuugu

SEQ ID NO: 272253 - RNA, 19 nt, Homo sapiens
gcaaaggcaugcugucaga

SEQ ID NO: 272254 - RNA, 19 nt, Homo sapiens
ggaaagagccucaggaaaa

SEQ ID NO: 272255 - RNA, 19 nt, Homo sapiens
gggcgcagauugccaugua

SEQ ID NO: 272256 - RNA, 19 nt, Homo sapiens
ggagauggcggaaagcaaa

SEQ ID NO: 272257 - RNA, 19 nt, Homo sapiens
uagaacaccugaaggagaa

SEQ ID NO: 272258 - RNA, 19 nt, Homo sapiens
ucgcuggucucucgaauuu

SEQ ID NO: 272259 - RNA, 19 nt, Homo sapiens
cugcggagaucuacaauga

SEQ ID NO: 272260 - RNA, 19 nt, Homo sapiens
guaagaagugccacaauga

SEQ ID NO: 272261 - RNA, 19 nt, Homo sapiens
agaaacauguucagaagga

SEQ ID NO: 272262 - RNA, 19 nt, Homo sapiens
cguaagaagugccacaaug

SEQ ID NO: 272263 - RNA, 19 nt, Homo sapiens
ugagaaacauguucagaag

SEQ ID NO: 272264 - RNA, 19 nt, Homo sapiens
uaccagggcugacugaguu

SEQ ID NO: 272265 - RNA, 19 nt, Homo sapiens
gagcccagguggagaugaa

SEQ ID NO: 272266 - RNA, 19 nt, Homo sapiens
gcagugggcagcuguaugu

SEQ ID NO: 272267 - RNA, 19 nt, Homo sapiens
ggaccaacuugcugaccuu

SEQ ID NO: 272268 - RNA, 19 nt, Homo sapiens
caaauugcaugggcggaaa

SEQ ID NO: 272269 - RNA, 19 nt, Homo sapiens
gagcuuggguccuggucaa

SEQ ID NO: 272270 - RNA, 19 nt, Homo sapiens
ggucaccucuugcauugau

SEQ ID NO: 272271 - RNA, 19 nt, Homo sapiens
gaaacauguucagaaggaa

SEQ ID NO: 272272 - RNA, 19 nt, Homo sapiens
ccaccaaugcugugacuuu

SEQ ID NO: 272273 - RNA, 19 nt, Homo sapiens
gcucuauucccucaaguuu

SEQ ID NO: 272274 - RNA, 19 nt, Homo sapiens
ugcaagagcugcgcacaaa

SEQ ID NO: 272275 - RNA, 19 nt, Homo sapiens
ucaaguaugucaucaagac

SEQ ID NO: 272276 - RNA, 19 nt, Homo sapiens
gcaccgacuuggagaagca

SEQ ID NO: 272277 - RNA, 19 nt, Homo sapiens
uuuggaagcuuagccauuu

SEQ ID NO: 272278 - RNA, 19 nt, Homo sapiens
ugaaggcugugcacgagaa

SEQ ID NO: 272279 - RNA, 19 nt, Homo sapiens
ucaaagaugagaaacaugu

SEQ ID NO: 272280 - RNA, 19 nt, Homo sapiens
aaagggaacauccgaguga

SEQ ID NO: 272281 - RNA, 19 nt, Homo sapiens
gcugagaacccagguauca

SEQ ID NO: 272282 - RNA, 19 nt, Homo sapiens
ccaaugcugugacuuucga

SEQ ID NO: 272283 - RNA, 19 nt, Homo sapiens
gggaacauccgagugauug

SEQ ID NO: 272284 - RNA, 19 nt, Homo sapiens
ggacuccagugcccgaagu

SEQ ID NO: 272285 - RNA, 19 nt, Homo sapiens
gcaagccuguguccuucga

SEQ ID NO: 272286 - RNA, 19 nt, Homo sapiens
ucgaggaggucaacagcaa

SEQ ID NO: 272287 - RNA, 19 nt, Homo sapiens
gggaaagagccucaggaaa

SEQ ID NO: 272288 - RNA, 19 nt, Homo sapiens
ugaaggagaagcucauuag

SEQ ID NO: 272289 - RNA, 19 nt, Homo sapiens
ggagaugcagucccuggaa

SEQ ID NO: 272290 - RNA, 19 nt, Homo sapiens
agaggcaggugcugaagga

SEQ ID NO: 272291 - RNA, 19 nt, Homo sapiens
cgaauuuucuucccucuga

SEQ ID NO: 272292 - RNA, 19 nt, Homo sapiens
ccaacuugcugaccuugca

SEQ ID NO: 272293 - RNA, 19 nt, Homo sapiens
gaugagaaacauguucaga

SEQ ID NO: 272294 - RNA, 19 nt, Homo sapiens
uucaaugucugcaucuuug

SEQ ID NO: 272295 - RNA, 19 nt, Homo sapiens
ggcagaugcuggaggagau

SEQ ID NO: 272296 - RNA, 19 nt, Homo sapiens
ggcaggugcugaaggagau

SEQ ID NO: 272297 - RNA, 19 nt, Homo sapiens
ugucaaguaugucaucaag

SEQ ID NO: 272298 - RNA, 19 nt, Homo sapiens
gcaacuccaagcucaccua

SEQ ID NO: 272299 - RNA, 19 nt, Homo sapiens
gcaagacguacacgaugga

SEQ ID NO: 272300 - RNA, 19 nt, Homo sapiens
cuggucaccucuugcauug

SEQ ID NO: 272301 - RNA, 19 nt, Homo sapiens
gaguuuggccacacuaauc

SEQ ID NO: 272302 - RNA, 19 nt, Homo sapiens
caaagaugagaaacauguu

SEQ ID NO: 272303 - RNA, 19 nt, Homo sapiens
gaccugaggccaccaaugc

SEQ ID NO: 272304 - RNA, 19 nt, Homo sapiens
gaacugggcguggaaaaga

SEQ ID NO: 272305 - RNA, 19 nt, Homo sapiens
aaacauguucagaaggaaa

SEQ ID NO: 272306 - RNA, 19 nt, Homo sapiens
gcgcagcacaucaacaagu

SEQ ID NO: 272307 - RNA, 19 nt, Homo sapiens
gcacgaccgaguucaccaa

SEQ ID NO: 272308 - RNA, 19 nt, Homo sapiens
caccaaugcugugacuuuc

SEQ ID NO: 272309 - RNA, 19 nt, Homo sapiens
gggccgugcuguguuuaug

SEQ ID NO: 272310 - RNA, 19 nt, Homo sapiens
gagugucaaggccgagaua

SEQ ID NO: 272311 - RNA, 19 nt, Homo sapiens
gggaggcgcagcacaucaa

SEQ ID NO: 272312 - RNA, 19 nt, Homo sapiens
cgacuacaaugggcucaag

SEQ ID NO: 272313 - RNA, 19 nt, Homo sapiens
ucuauucccucaaguuugc

SEQ ID NO: 272314 - RNA, 19 nt, Homo sapiens
gagcguggacgacaucaac

SEQ ID NO: 272315 - RNA, 19 nt, Homo sapiens
gcagagcguggacgacauc

SEQ ID NO: 272316 - RNA, 19 nt, Homo sapiens
gcgcugcggagaucuacaa

SEQ ID NO: 272317 - RNA, 19 nt, Homo sapiens
caaagaggauggggaagga

SEQ ID NO: 272318 - RNA, 19 nt, Homo sapiens
ggucaagccaggagcaucu

SEQ ID NO: 272319 - RNA, 19 nt, Homo sapiens
gcuggucucucgaauuuuc

SEQ ID NO: 272320 - RNA, 19 nt, Homo sapiens
ggaccugaggccaccaaug

SEQ ID NO: 272321 - RNA, 19 nt, Homo sapiens
gagguggagcugcgacuca

SEQ ID NO: 272322 - RNA, 19 nt, Homo sapiens
gcucgcuggucucucgaau

SEQ ID NO: 272323 - RNA, 19 nt, Homo sapiens
cgaccgaguucaccaaccu

SEQ ID NO: 272324 - RNA, 19 nt, Homo sapiens
acaagguguuugaguuugg

SEQ ID NO: 272325 - RNA, 19 nt, Homo sapiens
guaccagggcugacugagu

SEQ ID NO: 272326 - RNA, 19 nt, Homo sapiens
uaagaagugccacaaugag

SEQ ID NO: 272327 - RNA, 19 nt, Homo sapiens
cugaaggagaagcucauua

SEQ ID NO: 272328 - RNA, 19 nt, Homo sapiens
cugcaggauucgcuuagug

SEQ ID NO: 272329 - RNA, 19 nt, Homo sapiens
cuucaaugucugcaucuuu

SEQ ID NO: 272330 - RNA, 19 nt, Homo sapiens
ucauccaccugcugcacaa

SEQ ID NO: 272331 - RNA, 19 nt, Homo sapiens
gaggaggucaacagcaaca

SEQ ID NO: 272332 - RNA, 19 nt, Homo sapiens
agaaggaaacggugucucu

SEQ ID NO: 272333 - RNA, 19 nt, Homo sapiens
aaagaugagaaacauguuc

SEQ ID NO: 272334 - RNA, 19 nt, Homo sapiens
caagagcugcgcacaaagc

SEQ ID NO: 272335 - RNA, 19 nt, Homo sapiens
gaguggaggcucuucuucu

SEQ ID NO: 272336 - RNA, 19 nt, Homo sapiens
aggacugccuggcugagaa

SEQ ID NO: 272337 - RNA, 19 nt, Homo sapiens
uggacgacaucaacaaggu

SEQ ID NO: 272338 - RNA, 19 nt, Homo sapiens
ugacagccacgagaccauu

SEQ ID NO: 272339 - RNA, 19 nt, Homo sapiens
aguggaggcucuucuucug

SEQ ID NO: 272340 - RNA, 19 nt, Homo sapiens
gacgcucuauucccucaag

SEQ ID NO: 272341 - RNA, 19 nt, Homo sapiens
ugagccgacugcgaucuga

SEQ ID NO: 272342 - RNA, 19 nt, Homo sapiens
ccgcugagaacccagguau

SEQ ID NO: 272343 - RNA, 19 nt, Homo sapiens
gaaggagaagcucauuagc

SEQ ID NO: 272344 - RNA, 19 nt, Homo sapiens
aggagcugcugcgcaagua

SEQ ID NO: 272345 - RNA, 19 nt, Homo sapiens
ccagagcccagguggagau

SEQ ID NO: 272346 - RNA, 19 nt, Homo sapiens
caaccuaacuggcuuacuu

SEQ ID NO: 272347 - RNA, 19 nt, Homo sapiens
ggaaacccuucaaauaguu

SEQ ID NO: 272348 - RNA, 19 nt, Homo sapiens
ggaaacagaacagcgaaua

SEQ ID NO: 272349 - RNA, 19 nt, Homo sapiens
acaggaaacccuucaaaua

SEQ ID NO: 272350 - RNA, 19 nt, Homo sapiens
cuaacuggcuuacuuccua

SEQ ID NO: 272351 - RNA, 19 nt, Homo sapiens
cgaggacucugaugaacaa

SEQ ID NO: 272352 - RNA, 19 nt, Homo sapiens
gagagaaugugaccuuguc

SEQ ID NO: 272353 - RNA, 19 nt, Homo sapiens
gaacucacaauuccaaaca

SEQ ID NO: 272354 - RNA, 19 nt, Homo sapiens
gcccaccucuccaaccuaa

SEQ ID NO: 272355 - RNA, 19 nt, Homo sapiens
caggaaacccuucaaauag

SEQ ID NO: 272356 - RNA, 19 nt, Homo sapiens
gaacauuccaggcugacuu

SEQ ID NO: 272357 - RNA, 19 nt, Homo sapiens
acucacaauuccaaacaua

SEQ ID NO: 272358 - RNA, 19 nt, Homo sapiens
gaguccagauccaaaguug

SEQ ID NO: 272359 - RNA, 19 nt, Homo sapiens
ccaagagucugcaggaaac

SEQ ID NO: 272360 - RNA, 19 nt, Homo sapiens
gaaacagaacagcgaauag

SEQ ID NO: 272361 - RNA, 19 nt, Homo sapiens
gaccaagagucugcaggaa

SEQ ID NO: 272362 - RNA, 19 nt, Homo sapiens
ccucuuaacgcagcacuua

SEQ ID NO: 272363 - RNA, 19 nt, Homo sapiens
ggagggaccuacagaugcu

SEQ ID NO: 272364 - RNA, 19 nt, Homo sapiens
gcagggaccuacagaugcu

SEQ ID NO: 272365 - RNA, 19 nt, Homo sapiens
ggacucugaugaacaagac

SEQ ID NO: 272366 - RNA, 19 nt, Homo sapiens
uaugacauguaccaucuau

SEQ ID NO: 272367 - RNA, 19 nt, Homo sapiens
gagcuccuaugacauguac

SEQ ID NO: 272368 - RNA, 19 nt, Homo sapiens
ggugaaaucagaagagaca

SEQ ID NO: 272369 - RNA, 19 nt, Homo sapiens
gguaauggaccaagagucu

SEQ ID NO: 272370 - RNA, 19 nt, Homo sapiens
ucaaauaguuggccuucac

SEQ ID NO: 272371 - RNA, 19 nt, Homo sapiens
aggaaacccuucaaauagu

SEQ ID NO: 272372 - RNA, 19 nt, Homo sapiens
ucacaggaaacccuucaaa

SEQ ID NO: 272373 - RNA, 19 nt, Homo sapiens
ccuaugacauguaccaucu

SEQ ID NO: 272374 - RNA, 19 nt, Homo sapiens
agacagucauccugcaaug

SEQ ID NO: 272375 - RNA, 19 nt, Homo sapiens
caccuucccucaugcuguu

SEQ ID NO: 272376 - RNA, 19 nt, Homo sapiens
gcacuuagacacguguugu

SEQ ID NO: 272377 - RNA, 19 nt, Homo sapiens
ccucacaccacaaaucuga

SEQ ID NO: 272378 - RNA, 19 nt, Homo sapiens
caaggucaacggaacauuc

SEQ ID NO: 272379 - RNA, 19 nt, Homo sapiens
ucccggagcuccuaugaca

SEQ ID NO: 272380 - RNA, 19 nt, Homo sapiens
gcacagagaggggauguuu

SEQ ID NO: 272381 - RNA, 19 nt, Homo sapiens
ggagagaaugugaccuugu

SEQ ID NO: 272382 - RNA, 19 nt, Homo sapiens
gaauagcgaggacucugau

SEQ ID NO: 272383 - RNA, 19 nt, Homo sapiens
gaaacccuucaaauaguug

SEQ ID NO: 272384 - RNA, 19 nt, Homo sapiens
gagaggggauguuuaacga

SEQ ID NO: 272385 - RNA, 19 nt, Homo sapiens
gcaaucacacugaggaacu

SEQ ID NO: 272386 - RNA, 19 nt, Homo sapiens
gcagcaccaugucgcucuu

SEQ ID NO: 272387 - RNA, 19 nt, Homo sapiens
cgaauagcgaggacucuga

SEQ ID NO: 272388 - RNA, 19 nt, Homo sapiens
acagaugcuucggcucuuu

SEQ ID NO: 272389 - RNA, 19 nt, Homo sapiens
uggcuuacuuccuagucua

SEQ ID NO: 272390 - RNA, 19 nt, Homo sapiens
ccacaguucuccauuucac

SEQ ID NO: 272391 - RNA, 19 nt, Homo sapiens
ccauacgaguggucaaagu

SEQ ID NO: 272392 - RNA, 19 nt, Homo sapiens
ggauguuuaacgacacuuu

SEQ ID NO: 272393 - RNA, 19 nt, Homo sapiens
ccaugucgcucuuguucgu

SEQ ID NO: 272394 - RNA, 19 nt, Homo sapiens
cgacaccugcacauucuga

SEQ ID NO: 272395 - RNA, 19 nt, Homo sapiens
ccacggagggaccuacaga

SEQ ID NO: 272396 - RNA, 19 nt, Homo sapiens
caggagagaaugugaccuu

SEQ ID NO: 272397 - RNA, 19 nt, Homo sapiens
caaaugcugaguccagauc

SEQ ID NO: 272398 - RNA, 19 nt, Homo sapiens
uagcgaggacucugaugaa

SEQ ID NO: 272399 - RNA, 19 nt, Homo sapiens
acagucauccugcaauguu

SEQ ID NO: 272400 - RNA, 19 nt, Homo sapiens
ucagucgcaugacgcaaga

SEQ ID NO: 272401 - RNA, 19 nt, Homo sapiens
agucuucugucagcaguaa

SEQ ID NO: 272402 - RNA, 19 nt, Homo sapiens
gauguuuaacgacacuuug

SEQ ID NO: 272403 - RNA, 19 nt, Homo sapiens
ucacaauuccaaacauaca

SEQ ID NO: 272404 - RNA, 19 nt, Homo sapiens
ggucaucauccucuucauc

SEQ ID NO: 272405 - RNA, 19 nt, Homo sapiens
caccugcacauucugauug

SEQ ID NO: 272406 - RNA, 19 nt, Homo sapiens
gcaccaugucgcucuuguu

SEQ ID NO: 272407 - RNA, 19 nt, Homo sapiens
cacaggaaacccuucaaau

SEQ ID NO: 272408 - RNA, 19 nt, Homo sapiens
ggagcuccuaugacaugua

SEQ ID NO: 272409 - RNA, 19 nt, Homo sapiens
caccaugucgcucuuguuc

SEQ ID NO: 272410 - RNA, 19 nt, Homo sapiens
cuacagaugcuacgguucu

SEQ ID NO: 272411 - RNA, 19 nt, Homo sapiens
aaggccaacuucuccauca

SEQ ID NO: 272412 - RNA, 19 nt, Homo sapiens
gagacagucauccugcaau

SEQ ID NO: 272413 - RNA, 19 nt, Homo sapiens
cagucauccugcaauguug

SEQ ID NO: 272414 - RNA, 19 nt, Homo sapiens
gcgaggacucugaugaaca

SEQ ID NO: 272415 - RNA, 19 nt, Homo sapiens
ccggagcuccuaugacaug

SEQ ID NO: 272416 - RNA, 19 nt, Homo sapiens
cccaugagcaccacaguca

SEQ ID NO: 272417 - RNA, 19 nt, Homo sapiens
cuucauccuccucuucuuu

SEQ ID NO: 272418 - RNA, 19 nt, Homo sapiens
gugacccacugcuuguuuc

SEQ ID NO: 272419 - RNA, 19 nt, Homo sapiens
uggcagggaccuacagaug

SEQ ID NO: 272420 - RNA, 19 nt, Homo sapiens
ugacauguaccaucuaucc

SEQ ID NO: 272421 - RNA, 19 nt, Homo sapiens
acagagaggggauguuuaa

SEQ ID NO: 272422 - RNA, 19 nt, Homo sapiens
cccacugccugcuggagaa

SEQ ID NO: 272423 - RNA, 19 nt, Homo sapiens
gaggcugcaaucacacuga

SEQ ID NO: 272424 - RNA, 19 nt, Homo sapiens
caaccuaacuggcuuacuu

SEQ ID NO: 272425 - RNA, 19 nt, Homo sapiens
ggaaacccuucaaauaguu

SEQ ID NO: 272426 - RNA, 19 nt, Homo sapiens
gcacagagaagggaaguuu

SEQ ID NO: 272427 - RNA, 19 nt, Homo sapiens
ucacaggucuauaugagaa

SEQ ID NO: 272428 - RNA, 19 nt, Homo sapiens
cuaacuggcuuacuuccua

SEQ ID NO: 272429 - RNA, 19 nt, Homo sapiens
cgaggacucugaugaacaa

SEQ ID NO: 272430 - RNA, 19 nt, Homo sapiens
auaggaaacccuucaaaua

SEQ ID NO: 272431 - RNA, 19 nt, Homo sapiens
ggagagagcgugaccuugu

SEQ ID NO: 272432 - RNA, 19 nt, Homo sapiens
gaacucacaauuccaaaca

SEQ ID NO: 272433 - RNA, 19 nt, Homo sapiens
gcccaccucuccaaccuaa

SEQ ID NO: 272434 - RNA, 19 nt, Homo sapiens
gagaagggaaguuuaagga

SEQ ID NO: 272435 - RNA, 19 nt, Homo sapiens
acucacaauuccaaacaua

SEQ ID NO: 272436 - RNA, 19 nt, Homo sapiens
uaggaaacccuucaaauag

SEQ ID NO: 272437 - RNA, 19 nt, Homo sapiens
gaguccagauccaaaguug

SEQ ID NO: 272438 - RNA, 19 nt, Homo sapiens
caucacaggucuauaugag

SEQ ID NO: 272439 - RNA, 19 nt, Homo sapiens
ccacugaaccaagcucuaa

SEQ ID NO: 272440 - RNA, 19 nt, Homo sapiens
gaacauuccaggccgacuu

SEQ ID NO: 272441 - RNA, 19 nt, Homo sapiens
gggaacagaacagcgaaua

SEQ ID NO: 272442 - RNA, 19 nt, Homo sapiens
ggaggaaccuacagaugcu

SEQ ID NO: 272443 - RNA, 19 nt, Homo sapiens
acagagaagggaaguuuaa

SEQ ID NO: 272444 - RNA, 19 nt, Homo sapiens
ccucuuaacgcagcacuua

SEQ ID NO: 272445 - RNA, 19 nt, Homo sapiens
gaacagaacagcgaauagc

SEQ ID NO: 272446 - RNA, 19 nt, Homo sapiens
gcagggaccuacagaugcu

SEQ ID NO: 272447 - RNA, 19 nt, Homo sapiens
ggacucugaugaacaagac

SEQ ID NO: 272448 - RNA, 19 nt, Homo sapiens
ggugaaaucagaagagaca

SEQ ID NO: 272449 - RNA, 19 nt, Homo sapiens
uaugacauguaccaucuau

SEQ ID NO: 272450 - RNA, 19 nt, Homo sapiens
gagcuccuaugacauguac

SEQ ID NO: 272451 - RNA, 19 nt, Homo sapiens
gagagagcgugaccuuguc

SEQ ID NO: 272452 - RNA, 19 nt, Homo sapiens
gguaauggaccaagagucu

SEQ ID NO: 272453 - RNA, 19 nt, Homo sapiens
ucaaauaguuggccuucac

SEQ ID NO: 272454 - RNA, 19 nt, Homo sapiens
aggaaacccuucaaauagu

SEQ ID NO: 272455 - RNA, 19 nt, Homo sapiens
cauaggaaacccuucaaau

SEQ ID NO: 272456 - RNA, 19 nt, Homo sapiens
ccuaugacauguaccaucu

SEQ ID NO: 272457 - RNA, 19 nt, Homo sapiens
agacagucauccugcaaug

SEQ ID NO: 272458 - RNA, 19 nt, Homo sapiens
caccuucccucaugcuguu

SEQ ID NO: 272459 - RNA, 19 nt, Homo sapiens
gcacuuagacacguguugu

SEQ ID NO: 272460 - RNA, 19 nt, Homo sapiens
ccucacaccacaaaucuga

SEQ ID NO: 272461 - RNA, 19 nt, Homo sapiens
caaggucaacggaacauuc

SEQ ID NO: 272462 - RNA, 19 nt, Homo sapiens
ucccggagcuccuaugaca

SEQ ID NO: 272463 - RNA, 19 nt, Homo sapiens
ggaacagaacagcgaauag

SEQ ID NO: 272464 - RNA, 19 nt, Homo sapiens
gaauagcgaggacucugau

SEQ ID NO: 272465 - RNA, 19 nt, Homo sapiens
gaaacccuucaaauaguug

SEQ ID NO: 272466 - RNA, 19 nt, Homo sapiens
gcaaucacacugaggaacu

SEQ ID NO: 272467 - RNA, 19 nt, Homo sapiens
cgaauagcgaggacucuga

SEQ ID NO: 272468 - RNA, 19 nt, Homo sapiens
acagaugcuucggcucuuu

SEQ ID NO: 272469 - RNA, 19 nt, Homo sapiens
uggcuuacuuccuagucua

SEQ ID NO: 272470 - RNA, 19 nt, Homo sapiens
ccacaguucuccauuucac

SEQ ID NO: 272471 - RNA, 19 nt, Homo sapiens
ccacggaggaaccuacaga

SEQ ID NO: 272472 - RNA, 19 nt, Homo sapiens
gcccaugaauguagguucu

SEQ ID NO: 272473 - RNA, 19 nt, Homo sapiens
caauguuggucagauguca

SEQ ID NO: 272474 - RNA, 19 nt, Homo sapiens
uuggucagaugucagguuu

SEQ ID NO: 272475 - RNA, 19 nt, Homo sapiens
cgacaccugcacauucuga

SEQ ID NO: 272476 - RNA, 19 nt, Homo sapiens
cacagagaagggaaguuua

SEQ ID NO: 272477 - RNA, 19 nt, Homo sapiens
caaaugcugaguccagauc

SEQ ID NO: 272478 - RNA, 19 nt, Homo sapiens
uagcgaggacucugaugaa

SEQ ID NO: 272479 - RNA, 19 nt, Homo sapiens
acagucauccugcaauguu

SEQ ID NO: 272480 - RNA, 19 nt, Homo sapiens
agucuucugucagcaguaa

SEQ ID NO: 272481 - RNA, 19 nt, Homo sapiens
ucacaauuccaaacauaca

SEQ ID NO: 272482 - RNA, 19 nt, Homo sapiens
gggaggcccaugaauguag

SEQ ID NO: 272483 - RNA, 19 nt, Homo sapiens
ggacacuuugcaccucauu

SEQ ID NO: 272484 - RNA, 19 nt, Homo sapiens
ggucaucauccucuucauc

SEQ ID NO: 272485 - RNA, 19 nt, Homo sapiens
caccugcacauucugauug

SEQ ID NO: 272486 - RNA, 19 nt, Homo sapiens
ggagcuccuaugacaugua

SEQ ID NO: 272487 - RNA, 19 nt, Homo sapiens
caggagagagcgugaccuu

SEQ ID NO: 272488 - RNA, 19 nt, Homo sapiens
cuacagaugcuacgguucu

SEQ ID NO: 272489 - RNA, 19 nt, Homo sapiens
gcgaggacucugaugaaca

SEQ ID NO: 272490 - RNA, 19 nt, Homo sapiens
cagucauccugcaauguug

SEQ ID NO: 272491 - RNA, 19 nt, Homo sapiens
ucauaggaaacccuucaaa

SEQ ID NO: 272492 - RNA, 19 nt, Homo sapiens
gagacagucauccugcaau

SEQ ID NO: 272493 - RNA, 19 nt, Homo sapiens
ccggagcuccuaugacaug

SEQ ID NO: 272494 - RNA, 19 nt, Homo sapiens
cccaugagcaccacaguca

SEQ ID NO: 272495 - RNA, 19 nt, Homo sapiens
cuucauccuccucuucuuu

SEQ ID NO: 272496 - RNA, 19 nt, Homo sapiens
gugacccacugcuuguuuc

SEQ ID NO: 272497 - RNA, 19 nt, Homo sapiens
cugcaauguuggucagaug

SEQ ID NO: 272498 - RNA, 19 nt, Homo sapiens
ugacauguaccaucuaucc

SEQ ID NO: 272499 - RNA, 19 nt, Homo sapiens
cccacugccugcuggagaa

SEQ ID NO: 272500 - RNA, 19 nt, Homo sapiens
gaggcugcaaucacacuga

SEQ ID NO: 272501 - RNA, 19 nt, Homo sapiens
cccgacaccugcacauucu

SEQ ID NO: 272502 - RNA, 19 nt, Homo sapiens
caaccuaacuggcuuacuu

SEQ ID NO: 272503 - RNA, 19 nt, Homo sapiens
ggaggacucugaugaacaa

SEQ ID NO: 272504 - RNA, 19 nt, Homo sapiens
ggaaacccuucaaauaguu

SEQ ID NO: 272505 - RNA, 19 nt, Homo sapiens
acaggaaacccuucaaaua

SEQ ID NO: 272506 - RNA, 19 nt, Homo sapiens
ucacaggucuauaugagaa

SEQ ID NO: 272507 - RNA, 19 nt, Homo sapiens
cuaacuggcuuacuuccua

SEQ ID NO: 272508 - RNA, 19 nt, Homo sapiens
gcagggaacagaacaguga

SEQ ID NO: 272509 - RNA, 19 nt, Homo sapiens
ggugacauaugcacaguug

SEQ ID NO: 272510 - RNA, 19 nt, Homo sapiens
ggagagagcgugaccuugu

SEQ ID NO: 272511 - RNA, 19 nt, Homo sapiens
gaacucacaauuccaaaca

SEQ ID NO: 272512 - RNA, 19 nt, Homo sapiens
aaacacacuccuuugcuua

SEQ ID NO: 272513 - RNA, 19 nt, Homo sapiens
gcccaccucuccaaccuaa

SEQ ID NO: 272514 - RNA, 19 nt, Homo sapiens
caggaaacccuucaaauag

SEQ ID NO: 272515 - RNA, 19 nt, Homo sapiens
acucacaauuccaaacaua

SEQ ID NO: 272516 - RNA, 19 nt, Homo sapiens
gaacagggaggacucugau

SEQ ID NO: 272517 - RNA, 19 nt, Homo sapiens
caucacaggucuauaugag

SEQ ID NO: 272518 - RNA, 19 nt, Homo sapiens
gcugagcccugauccaaag

SEQ ID NO: 272519 - RNA, 19 nt, Homo sapiens
gaacauuccaggccgacuu

SEQ ID NO: 272520 - RNA, 19 nt, Homo sapiens
ccagacaccugcauguucu

SEQ ID NO: 272521 - RNA, 19 nt, Homo sapiens
ggaggaaccuacagaugcu

SEQ ID NO: 272522 - RNA, 19 nt, Homo sapiens
ugacauaugcacaguugaa

SEQ ID NO: 272523 - RNA, 19 nt, Homo sapiens
gagcccugauccaaaguug

SEQ ID NO: 272524 - RNA, 19 nt, Homo sapiens
acaccugcauguucugauu

SEQ ID NO: 272525 - RNA, 19 nt, Homo sapiens
gcagggaccuacagaugcu

SEQ ID NO: 272526 - RNA, 19 nt, Homo sapiens
ccucuuaacacggcacuua

SEQ ID NO: 272527 - RNA, 19 nt, Homo sapiens
ggugaaaucagaagagaca

SEQ ID NO: 272528 - RNA, 19 nt, Homo sapiens
ggacucugaugaacaagac

SEQ ID NO: 272529 - RNA, 19 nt, Homo sapiens
uaugacauguaccaucuau

SEQ ID NO: 272530 - RNA, 19 nt, Homo sapiens
gagcuccuaugacauguac

SEQ ID NO: 272531 - RNA, 19 nt, Homo sapiens
gagagagcgugaccuuguc

SEQ ID NO: 272532 - RNA, 19 nt, Homo sapiens
ucaaauaguuggccuucac

SEQ ID NO: 272533 - RNA, 19 nt, Homo sapiens
aggaaacccuucaaauagu

SEQ ID NO: 272534 - RNA, 19 nt, Homo sapiens
ucacaggaaacccuucaaa

SEQ ID NO: 272535 - RNA, 19 nt, Homo sapiens
agacagucauccugcaaug

SEQ ID NO: 272536 - RNA, 19 nt, Homo sapiens
ccuaugacauguaccaucu

SEQ ID NO: 272537 - RNA, 19 nt, Homo sapiens
caccuucccucaugcuguu

SEQ ID NO: 272538 - RNA, 19 nt, Homo sapiens
ccucacaccacaaaucuga

SEQ ID NO: 272539 - RNA, 19 nt, Homo sapiens
caaggucaacggaacauuc

SEQ ID NO: 272540 - RNA, 19 nt, Homo sapiens
ucccggagcuccuaugaca

SEQ ID NO: 272541 - RNA, 19 nt, Homo sapiens
ccacaauucuccauuucac

SEQ ID NO: 272542 - RNA, 19 nt, Homo sapiens
gaaacccuucaaauaguug

SEQ ID NO: 272543 - RNA, 19 nt, Homo sapiens
gcaaucacacugaggaacu

SEQ ID NO: 272544 - RNA, 19 nt, Homo sapiens
acagaugcuucggcucuuu

SEQ ID NO: 272545 - RNA, 19 nt, Homo sapiens
uggcuuacuuccuagucua

SEQ ID NO: 272546 - RNA, 19 nt, Homo sapiens
ccacggaggaaccuacaga

SEQ ID NO: 272547 - RNA, 19 nt, Homo sapiens
acagggaggacucugauga

SEQ ID NO: 272548 - RNA, 19 nt, Homo sapiens
caauguuggucagauguca

SEQ ID NO: 272549 - RNA, 19 nt, Homo sapiens
uuggucagaugucagguuu

SEQ ID NO: 272550 - RNA, 19 nt, Homo sapiens
gaggugacauaugcacagu

SEQ ID NO: 272551 - RNA, 19 nt, Homo sapiens
acagucauccugcaauguu

SEQ ID NO: 272552 - RNA, 19 nt, Homo sapiens
ucacaauuccaaacauaca

SEQ ID NO: 272553 - RNA, 19 nt, Homo sapiens
acaauucuccauuucacuu

SEQ ID NO: 272554 - RNA, 19 nt, Homo sapiens
ggacacuuugcaccucauu

SEQ ID NO: 272555 - RNA, 19 nt, Homo sapiens
caaaugcugagcccugauc

SEQ ID NO: 272556 - RNA, 19 nt, Homo sapiens
ggucaucauccucuucauc

SEQ ID NO: 272557 - RNA, 19 nt, Homo sapiens
cacaggaaacccuucaaau

SEQ ID NO: 272558 - RNA, 19 nt, Homo sapiens
ggagcuccuaugacaugua

SEQ ID NO: 272559 - RNA, 19 nt, Homo sapiens
caugagggaguccacagaa

SEQ ID NO: 272560 - RNA, 19 nt, Homo sapiens
cagggaggacucugaugaa

SEQ ID NO: 272561 - RNA, 19 nt, Homo sapiens
ugaacagggaggacucuga

SEQ ID NO: 272562 - RNA, 19 nt, Homo sapiens
caggagagagcgugaccuu

SEQ ID NO: 272563 - RNA, 19 nt, Homo sapiens
cuacagaugcuacgguucu

SEQ ID NO: 272564 - RNA, 19 nt, Homo sapiens
cagucauccugcaauguug

SEQ ID NO: 272565 - RNA, 19 nt, Homo sapiens
gggaggacucugaugaaca

SEQ ID NO: 272566 - RNA, 19 nt, Homo sapiens
aaaaugcuguuguaaugga

SEQ ID NO: 272567 - RNA, 19 nt, Homo sapiens
gagacagucauccugcaau

SEQ ID NO: 272568 - RNA, 19 nt, Homo sapiens
ccggagcuccuaugacaug

SEQ ID NO: 272569 - RNA, 19 nt, Homo sapiens
cugcaauguuggucagaug

SEQ ID NO: 272570 - RNA, 19 nt, Homo sapiens
gagaaaacacacuccuuug

SEQ ID NO: 272571 - RNA, 19 nt, Homo sapiens
cccaugagcaccacaguca

SEQ ID NO: 272572 - RNA, 19 nt, Homo sapiens
cucaggaggugacauaugc

SEQ ID NO: 272573 - RNA, 19 nt, Homo sapiens
gugacccacugcuuguuuc

SEQ ID NO: 272574 - RNA, 19 nt, Homo sapiens
ugacauguaccaucuaucc

SEQ ID NO: 272575 - RNA, 19 nt, Homo sapiens
aaaacacacuccuuugcuu

SEQ ID NO: 272576 - RNA, 19 nt, Homo sapiens
augagggaguccacagaaa

SEQ ID NO: 272577 - RNA, 19 nt, Homo sapiens
cauccuccuccucuucuuu

SEQ ID NO: 272578 - RNA, 19 nt, Homo sapiens
gaggcugcaaucacacuga

SEQ ID NO: 272579 - RNA, 19 nt, Homo sapiens
caauucuccauuucacuug

SEQ ID NO: 272580 - RNA, 19 nt, Homo sapiens
gggaacagaacagugaaca

SEQ ID NO: 272581 - RNA, 19 nt, Homo sapiens
aaacaugucugccuucauu

SEQ ID NO: 272582 - RNA, 19 nt, Homo sapiens
caaccuaacuggcuuacuu

SEQ ID NO: 272583 - RNA, 19 nt, Homo sapiens
ggaggacucugaugaacaa

SEQ ID NO: 272584 - RNA, 19 nt, Homo sapiens
ggaaacccuucuaguaguu

SEQ ID NO: 272585 - RNA, 19 nt, Homo sapiens
guauagaacuuccaaaugc

SEQ ID NO: 272586 - RNA, 19 nt, Homo sapiens
gaaccaagcuucaaaacug

SEQ ID NO: 272587 - RNA, 19 nt, Homo sapiens
ucacaggucuauaugagaa

SEQ ID NO: 272588 - RNA, 19 nt, Homo sapiens
aagagacccucaacagaua

SEQ ID NO: 272589 - RNA, 19 nt, Homo sapiens
cuaacuggcuuacuuccua

SEQ ID NO: 272590 - RNA, 19 nt, Homo sapiens
gcaagagacccucaacaga

SEQ ID NO: 272591 - RNA, 19 nt, Homo sapiens
guucucuccucuucaaaua

SEQ ID NO: 272592 - RNA, 19 nt, Homo sapiens
guaguucucuccucuucaa

SEQ ID NO: 272593 - RNA, 19 nt, Homo sapiens
acaggaaacccuucuagua

SEQ ID NO: 272594 - RNA, 19 nt, Homo sapiens
caagagacccucaacagau

SEQ ID NO: 272595 - RNA, 19 nt, Homo sapiens
gaacucacaauuccaaaca

SEQ ID NO: 272596 - RNA, 19 nt, Homo sapiens
aaacacacuccuuugcuua

SEQ ID NO: 272597 - RNA, 19 nt, Homo sapiens
gcccaccucuccaaccuaa

SEQ ID NO: 272598 - RNA, 19 nt, Homo sapiens
gagagaacgugaccuuguc

SEQ ID NO: 272599 - RNA, 19 nt, Homo sapiens
uaugagaaaccuucgcuua

SEQ ID NO: 272600 - RNA, 19 nt, Homo sapiens
gcagggaccuacagauguc

SEQ ID NO: 272601 - RNA, 19 nt, Homo sapiens
ggagagaccuacagaugcu

SEQ ID NO: 272602 - RNA, 19 nt, Homo sapiens
ggucacaggucuauaugag

SEQ ID NO: 272603 - RNA, 19 nt, Homo sapiens
ggagagaacgugaccuugu

SEQ ID NO: 272604 - RNA, 19 nt, Homo sapiens
acucacaauuccaaacaua

SEQ ID NO: 272605 - RNA, 19 nt, Homo sapiens
ugagaaaccuucgcuuaca

SEQ ID NO: 272606 - RNA, 19 nt, Homo sapiens
gaacagggaggacucugau

SEQ ID NO: 272607 - RNA, 19 nt, Homo sapiens
gaacauuccaggccgacuu

SEQ ID NO: 272608 - RNA, 19 nt, Homo sapiens
ucccagagcuccuuugaca

SEQ ID NO: 272609 - RNA, 19 nt, Homo sapiens
ucucuccucuucaaauaaa

SEQ ID NO: 272610 - RNA, 19 nt, Homo sapiens
ggcgugagucuccaucuua

SEQ ID NO: 272611 - RNA, 19 nt, Homo sapiens
caggaaacccuucuaguag

SEQ ID NO: 272612 - RNA, 19 nt, Homo sapiens
ggcaucagcaaaccuuaua

SEQ ID NO: 272613 - RNA, 19 nt, Homo sapiens
ucacuaucgucguggguuu

SEQ ID NO: 272614 - RNA, 19 nt, Homo sapiens
gagaaaccuucgcuuacag

SEQ ID NO: 272615 - RNA, 19 nt, Homo sapiens
gaauauucuggaacaguuu

SEQ ID NO: 272616 - RNA, 19 nt, Homo sapiens
cuacagaugucgagguuuu

SEQ ID NO: 272617 - RNA, 19 nt, Homo sapiens
caucagcaaaccuuauaaa

SEQ ID NO: 272618 - RNA, 19 nt, Homo sapiens
ggaggacacgugacucuuc

SEQ ID NO: 272619 - RNA, 19 nt, Homo sapiens
ggacucugaugaacaagac

SEQ ID NO: 272620 - RNA, 19 nt, Homo sapiens
ggaagcccaugaacuuagg

SEQ ID NO: 272621 - RNA, 19 nt, Homo sapiens
gcagugcccagcaucaaug

SEQ ID NO: 272622 - RNA, 19 nt, Homo sapiens
ccugagcucuacaacagaa

SEQ ID NO: 272623 - RNA, 19 nt, Homo sapiens
acaccugcaugcugugauu

SEQ ID NO: 272624 - RNA, 19 nt, Homo sapiens
ccacaauucucuauuucac

SEQ ID NO: 272625 - RNA, 19 nt, Homo sapiens
cagcguguguauagaacuu

SEQ ID NO: 272626 - RNA, 19 nt, Homo sapiens
ggugacauacgcacaguug

SEQ ID NO: 272627 - RNA, 19 nt, Homo sapiens
ggacacagaacagugaaca

SEQ ID NO: 272628 - RNA, 19 nt, Homo sapiens
ccagagcuccuuugacauc

SEQ ID NO: 272629 - RNA, 19 nt, Homo sapiens
ucucuuaacacggcacuua

SEQ ID NO: 272630 - RNA, 19 nt, Homo sapiens
gaucauggucacaggucua

SEQ ID NO: 272631 - RNA, 19 nt, Homo sapiens
gcucuacaacagaauauuc

SEQ ID NO: 272632 - RNA, 19 nt, Homo sapiens
ugucugccuucauucuuaa

SEQ ID NO: 272633 - RNA, 19 nt, Homo sapiens
cgucguggguuuaacaucu

SEQ ID NO: 272634 - RNA, 19 nt, Homo sapiens
ugcaugcugugauuaggua

SEQ ID NO: 272635 - RNA, 19 nt, Homo sapiens
caccuucccucgugcuguu

SEQ ID NO: 272636 - RNA, 19 nt, Homo sapiens
gcaaucacacugaggaacu

SEQ ID NO: 272637 - RNA, 19 nt, Homo sapiens
gcgugagucuccaucuuag

SEQ ID NO: 272638 - RNA, 19 nt, Homo sapiens
acagaugcuucggcucuuu

SEQ ID NO: 272639 - RNA, 19 nt, Homo sapiens
ccacggagagaccuacaga

SEQ ID NO: 272640 - RNA, 19 nt, Homo sapiens
uuugacaucuaccaucuau

SEQ ID NO: 272641 - RNA, 19 nt, Homo sapiens
cauggucacaggucuauau

SEQ ID NO: 272642 - RNA, 19 nt, Homo sapiens
uggcuuacuuccuagucua

SEQ ID NO: 272643 - RNA, 19 nt, Homo sapiens
ugacauacgcacaguugga

SEQ ID NO: 272644 - RNA, 19 nt, Homo sapiens
gagcuccuuugacaucuac

SEQ ID NO: 272645 - RNA, 19 nt, Homo sapiens
guguaguucucuccucuuc

SEQ ID NO: 272646 - RNA, 19 nt, Homo sapiens
ucccugagcucuacaacag

SEQ ID NO: 272647 - RNA, 19 nt, Homo sapiens
gcaucagcaaaccuuauaa

SEQ ID NO: 272648 - RNA, 19 nt, Homo sapiens
acagggaggacucugauga

SEQ ID NO: 272649 - RNA, 19 nt, Homo sapiens
gggaagcccaugaacuuag

SEQ ID NO: 272650 - RNA, 19 nt, Homo sapiens
gagcaagagacccucaaca

SEQ ID NO: 272651 - RNA, 19 nt, Homo sapiens
gcgggacacagaacaguga

SEQ ID NO: 272652 - RNA, 19 nt, Homo sapiens
aggaaacccuucuaguagu

SEQ ID NO: 272653 - RNA, 19 nt, Homo sapiens
ccaccuuuccucagacuau

SEQ ID NO: 272654 - RNA, 19 nt, Homo sapiens
cuucggcucuuuccaugga

SEQ ID NO: 272655 - RNA, 19 nt, Homo sapiens
guguauagaacuuccaaau

SEQ ID NO: 272656 - RNA, 19 nt, Homo sapiens
uggcaugucuuggguucuu

SEQ ID NO: 272657 - RNA, 19 nt, Homo sapiens
augucugccuucauucuua

SEQ ID NO: 272658 - RNA, 19 nt, Homo sapiens
ucacaauuccaaacauaca

SEQ ID NO: 272659 - RNA, 19 nt, Homo sapiens
uguauagaacuuccaaaug

SEQ ID NO: 272660 - RNA, 19 nt, Homo sapiens
gagcucuacaacagaauau

SEQ ID NO: 272661 - RNA, 19 nt, Homo sapiens
gaaacccuucuaguaguug

SEQ ID NO: 272662 - RNA, 19 nt, Homo sapiens
caggagagaacgugaccuu

SEQ ID NO: 272663 - RNA, 19 nt, Homo sapiens
gaacaguuuccucauuagc

SEQ ID NO: 272664 - RNA, 19 nt, Homo sapiens
acagauaccagcgugugua

SEQ ID NO: 272665 - RNA, 19 nt, Homo sapiens
gaggugacauacgcacagu

SEQ ID NO: 272666 - RNA, 19 nt, Homo sapiens
ucacaggaaacccuucuag

SEQ ID NO: 272667 - RNA, 19 nt, Homo sapiens
ucccacaauucucuauuuc

SEQ ID NO: 272668 - RNA, 19 nt, Homo sapiens
cagggaggacucugaugaa

SEQ ID NO: 272669 - RNA, 19 nt, Homo sapiens
ugaacagggaggacucuga

SEQ ID NO: 272670 - RNA, 19 nt, Homo sapiens
ugagcucuacaacagaaua

SEQ ID NO: 272671 - RNA, 19 nt, Homo sapiens
auaaacaugucugccuuca

SEQ ID NO: 272672 - RNA, 19 nt, Homo sapiens
gggaggacucugaugaaca

SEQ ID NO: 272673 - RNA, 19 nt, Homo sapiens
guggccaucauccucuuua

SEQ ID NO: 272674 - RNA, 19 nt, Homo sapiens
caccuuuccucagacuauu

SEQ ID NO: 272675 - RNA, 19 nt, Homo sapiens
gagaaaacacacuccuuug

SEQ ID NO: 272676 - RNA, 19 nt, Homo sapiens
gugccugucucuugcuuac

SEQ ID NO: 272677 - RNA, 19 nt, Homo sapiens
uauagaacuuccaaaugcu

SEQ ID NO: 272678 - RNA, 19 nt, Homo sapiens
guacucaguggccaucauc

SEQ ID NO: 272679 - RNA, 19 nt, Homo sapiens
aucccacaauucucuauuu

SEQ ID NO: 272680 - RNA, 19 nt, Homo sapiens
gguacucaguggccaucau

SEQ ID NO: 272681 - RNA, 19 nt, Homo sapiens
ggaaacccuucaaauaguu

SEQ ID NO: 272682 - RNA, 19 nt, Homo sapiens
acaggaaacccuucaaaua

SEQ ID NO: 272683 - RNA, 19 nt, Homo sapiens
gagcccagauccaaaguug

SEQ ID NO: 272684 - RNA, 19 nt, Homo sapiens
guacauagaacuuccaaau

SEQ ID NO: 272685 - RNA, 19 nt, Homo sapiens
caacagauaccagcaugua

SEQ ID NO: 272686 - RNA, 19 nt, Homo sapiens
gcagggaacagaacaguga

SEQ ID NO: 272687 - RNA, 19 nt, Homo sapiens
ggaggugucauacgcauaa

SEQ ID NO: 272688 - RNA, 19 nt, Homo sapiens
gaacauuccaggccaacuu

SEQ ID NO: 272689 - RNA, 19 nt, Homo sapiens
gagagaaugugaccuuguc

SEQ ID NO: 272690 - RNA, 19 nt, Homo sapiens
caggaaacccuucaaauag

SEQ ID NO: 272691 - RNA, 19 nt, Homo sapiens
gauccaaaguugucuucug

SEQ ID NO: 272692 - RNA, 19 nt, Homo sapiens
acauagaacuuccaaaugc

SEQ ID NO: 272693 - RNA, 19 nt, Homo sapiens
gauaccagcauguacauag

SEQ ID NO: 272694 - RNA, 19 nt, Homo sapiens
auaauuggaucacuguguu

SEQ ID NO: 272695 - RNA, 19 nt, Homo sapiens
ggugucauacgcauaauug

SEQ ID NO: 272696 - RNA, 19 nt, Homo sapiens
ggagggaccuacagaugcu

SEQ ID NO: 272697 - RNA, 19 nt, Homo sapiens
gcagggaccuacagaugcu

SEQ ID NO: 272698 - RNA, 19 nt, Homo sapiens
ggugaaaucagaagagaca

SEQ ID NO: 272699 - RNA, 19 nt, Homo sapiens
uaugacauguaccaucuau

SEQ ID NO: 272700 - RNA, 19 nt, Homo sapiens
gagcuccuaugacauguac

SEQ ID NO: 272701 - RNA, 19 nt, Homo sapiens
ucaaauaguuggccuucac

SEQ ID NO: 272702 - RNA, 19 nt, Homo sapiens
aggaaacccuucaaauagu

SEQ ID NO: 272703 - RNA, 19 nt, Homo sapiens
agacagucauccugcaaug

SEQ ID NO: 272704 - RNA, 19 nt, Homo sapiens
ucacaggaaacccuucaaa

SEQ ID NO: 272705 - RNA, 19 nt, Homo sapiens
ccuaugacauguaccaucu

SEQ ID NO: 272706 - RNA, 19 nt, Homo sapiens
caaggucaacggaacauuc

SEQ ID NO: 272707 - RNA, 19 nt, Homo sapiens
ucccggagcuccuaugaca

SEQ ID NO: 272708 - RNA, 19 nt, Homo sapiens
gcacagagaggggauguuu

SEQ ID NO: 272709 - RNA, 19 nt, Homo sapiens
ggagagaaugugaccuugu

SEQ ID NO: 272710 - RNA, 19 nt, Homo sapiens
gaaacccuucaaauaguug

SEQ ID NO: 272711 - RNA, 19 nt, Homo sapiens
gagaggggauguuuaacga

SEQ ID NO: 272712 - RNA, 19 nt, Homo sapiens
acagaugcuucggcucuuu

SEQ ID NO: 272713 - RNA, 19 nt, Homo sapiens
ggauguuuaacgacacuuu

SEQ ID NO: 272714 - RNA, 19 nt, Homo sapiens
cagcauguacauagaacuu

SEQ ID NO: 272715 - RNA, 19 nt, Homo sapiens
caggagagaaugugaccuu

SEQ ID NO: 272716 - RNA, 19 nt, Homo sapiens
acagucauccugcaauguu

SEQ ID NO: 272717 - RNA, 19 nt, Homo sapiens
auaccagcauguacauaga

SEQ ID NO: 272718 - RNA, 19 nt, Homo sapiens
gauguuuaacgacacuuug

SEQ ID NO: 272719 - RNA, 19 nt, Homo sapiens
cauagaacuuccaaaugcu

SEQ ID NO: 272720 - RNA, 19 nt, Homo sapiens
gcccagauccaaaguuguc

SEQ ID NO: 272721 - RNA, 19 nt, Homo sapiens
caaaugcugagcccagauc

SEQ ID NO: 272722 - RNA, 19 nt, Homo sapiens
cauaauuggaucacugugu

SEQ ID NO: 272723 - RNA, 19 nt, Homo sapiens
ggauucugaugaacaagac

SEQ ID NO: 272724 - RNA, 19 nt, Homo sapiens
cacaggaaacccuucaaau

SEQ ID NO: 272725 - RNA, 19 nt, Homo sapiens
ggagcuccuaugacaugua

SEQ ID NO: 272726 - RNA, 19 nt, Homo sapiens
auccaaaguugucuucugu

SEQ ID NO: 272727 - RNA, 19 nt, Homo sapiens
uacauagaacuuccaaaug

SEQ ID NO: 272728 - RNA, 19 nt, Homo sapiens
cuacagaugcuacgguucu

SEQ ID NO: 272729 - RNA, 19 nt, Homo sapiens
aaggccaacuucuccauca

SEQ ID NO: 272730 - RNA, 19 nt, Homo sapiens
acagauaccagcauguaca

SEQ ID NO: 272731 - RNA, 19 nt, Homo sapiens
gagacagucauccugcaau

SEQ ID NO: 272732 - RNA, 19 nt, Homo sapiens
cagucauccugcaauguug

SEQ ID NO: 272733 - RNA, 19 nt, Homo sapiens
ccggagcuccuaugacaug

SEQ ID NO: 272734 - RNA, 19 nt, Homo sapiens
uaauuggaucacuguguuu

SEQ ID NO: 272735 - RNA, 19 nt, Homo sapiens
gugacccacugcuuguuuc

SEQ ID NO: 272736 - RNA, 19 nt, Homo sapiens
uggcagggaccuacagaug

SEQ ID NO: 272737 - RNA, 19 nt, Homo sapiens
ugacauguaccaucuaucc

SEQ ID NO: 272738 - RNA, 19 nt, Homo sapiens
acagagaggggauguuuaa

SEQ ID NO: 272739 - RNA, 19 nt, Homo sapiens
gcugagcccagauccaaag

SEQ ID NO: 272740 - RNA, 19 nt, Homo sapiens
gucauacgcauaauuggau

SEQ ID NO: 272741 - RNA, 19 nt, Homo sapiens
ugucauacgcauaauugga

SEQ ID NO: 272742 - RNA, 19 nt, Homo sapiens
gggaacagaacagugaaca

SEQ ID NO: 272743 - RNA, 19 nt, Homo sapiens
cuaacuagcuuacuuccua

SEQ ID NO: 272744 - RNA, 19 nt, Homo sapiens
ggaaacccuucaaauaguu

SEQ ID NO: 272745 - RNA, 19 nt, Homo sapiens
caaccuaacuagcuuacuu

SEQ ID NO: 272746 - RNA, 19 nt, Homo sapiens
acaggaaacccuucaaaua

SEQ ID NO: 272747 - RNA, 19 nt, Homo sapiens
ucacaggucuauaugagaa

SEQ ID NO: 272748 - RNA, 19 nt, Homo sapiens
gagcccagauccaaaguug

SEQ ID NO: 272749 - RNA, 19 nt, Homo sapiens
guacauagaacuuccaaau

SEQ ID NO: 272750 - RNA, 19 nt, Homo sapiens
caacagauaccagcaugua

SEQ ID NO: 272751 - RNA, 19 nt, Homo sapiens
gcagggaacagaacaguga

SEQ ID NO: 272752 - RNA, 19 nt, Homo sapiens
ggaggugucauacgcauaa

SEQ ID NO: 272753 - RNA, 19 nt, Homo sapiens
ggagagagcgugaccuugu

SEQ ID NO: 272754 - RNA, 19 nt, Homo sapiens
ccaccucccuucagacuau

SEQ ID NO: 272755 - RNA, 19 nt, Homo sapiens
gaacucacaauuccaaaca

SEQ ID NO: 272756 - RNA, 19 nt, Homo sapiens
aaacacacuccuuugcuua

SEQ ID NO: 272757 - RNA, 19 nt, Homo sapiens
gcccaccucuccaaccuaa

SEQ ID NO: 272758 - RNA, 19 nt, Homo sapiens
caggaaacccuucaaauag

SEQ ID NO: 272759 - RNA, 19 nt, Homo sapiens
ggcaucagucuucaucuua

SEQ ID NO: 272760 - RNA, 19 nt, Homo sapiens
acucacaauuccaaacaua

SEQ ID NO: 272761 - RNA, 19 nt, Homo sapiens
gauccaaaguugucuucug

SEQ ID NO: 272762 - RNA, 19 nt, Homo sapiens
acauagaacuuccaaaugc

SEQ ID NO: 272763 - RNA, 19 nt, Homo sapiens
caucacaggucuauaugag

SEQ ID NO: 272764 - RNA, 19 nt, Homo sapiens
gaacauuccaggccgacuu

SEQ ID NO: 272765 - RNA, 19 nt, Homo sapiens
gcaucagucuucaucuuag

SEQ ID NO: 272766 - RNA, 19 nt, Homo sapiens
ggaggaaccuacagaugcu

SEQ ID NO: 272767 - RNA, 19 nt, Homo sapiens
ccucuuaacacagcacuua

SEQ ID NO: 272768 - RNA, 19 nt, Homo sapiens
uagcuuacuuccuagucua

SEQ ID NO: 272769 - RNA, 19 nt, Homo sapiens
gauaccagcauguacauag

SEQ ID NO: 272770 - RNA, 19 nt, Homo sapiens
auaauuggaucacuguguu

SEQ ID NO: 272771 - RNA, 19 nt, Homo sapiens
ggugucauacgcauaauug

SEQ ID NO: 272772 - RNA, 19 nt, Homo sapiens
gcagggaccuacagaugcu

SEQ ID NO: 272773 - RNA, 19 nt, Homo sapiens
gcccacaauucuccauuuc

SEQ ID NO: 272774 - RNA, 19 nt, Homo sapiens
ggugaaaucagaagagaca

SEQ ID NO: 272775 - RNA, 19 nt, Homo sapiens
uaugacauguaccaucuau

SEQ ID NO: 272776 - RNA, 19 nt, Homo sapiens
gagcuccuaugacauguac

SEQ ID NO: 272777 - RNA, 19 nt, Homo sapiens
gagagagcgugaccuuguc

SEQ ID NO: 272778 - RNA, 19 nt, Homo sapiens
agacagucauccugcaaug

SEQ ID NO: 272779 - RNA, 19 nt, Homo sapiens
ucaaauaguuggccuucac

SEQ ID NO: 272780 - RNA, 19 nt, Homo sapiens
aggaaacccuucaaauagu

SEQ ID NO: 272781 - RNA, 19 nt, Homo sapiens
ucacaggaaacccuucaaa

SEQ ID NO: 272782 - RNA, 19 nt, Homo sapiens
ccuaugacauguaccaucu

SEQ ID NO: 272783 - RNA, 19 nt, Homo sapiens
caaggucaacggaacauuc

SEQ ID NO: 272784 - RNA, 19 nt, Homo sapiens
ucccggagcuccuaugaca

SEQ ID NO: 272785 - RNA, 19 nt, Homo sapiens
ccacaauucuccauuucac

SEQ ID NO: 272786 - RNA, 19 nt, Homo sapiens
ugaacaugccucucucuug

SEQ ID NO: 272787 - RNA, 19 nt, Homo sapiens
gaaaucacucgcccuucug

SEQ ID NO: 272788 - RNA, 19 nt, Homo sapiens
gaaacccuucaaauaguug

SEQ ID NO: 272789 - RNA, 19 nt, Homo sapiens
gcaaucacacugaggaacu

SEQ ID NO: 272790 - RNA, 19 nt, Homo sapiens
acagaugcuucggcucuuu

SEQ ID NO: 272791 - RNA, 19 nt, Homo sapiens
ccacggaggaaccuacaga

SEQ ID NO: 272792 - RNA, 19 nt, Homo sapiens
caauguuggucagauguca

SEQ ID NO: 272793 - RNA, 19 nt, Homo sapiens
uuggucagaugucagguuu

SEQ ID NO: 272794 - RNA, 19 nt, Homo sapiens
cagcauguacauagaacuu

SEQ ID NO: 272795 - RNA, 19 nt, Homo sapiens
acagucauccugcaauguu

SEQ ID NO: 272796 - RNA, 19 nt, Homo sapiens
ucuccaaccuaacuagcuu

SEQ ID NO: 272797 - RNA, 19 nt, Homo sapiens
aggcaucagucuucaucuu

SEQ ID NO: 272798 - RNA, 19 nt, Homo sapiens
auaccagcauguacauaga

SEQ ID NO: 272799 - RNA, 19 nt, Homo sapiens
ucacaauuccaaacauaca

SEQ ID NO: 272800 - RNA, 19 nt, Homo sapiens
acaauucuccauuucacuu

SEQ ID NO: 272801 - RNA, 19 nt, Homo sapiens
cauagaacuuccaaaugcu

SEQ ID NO: 272802 - RNA, 19 nt, Homo sapiens
ggacacuuugcaccucauu

SEQ ID NO: 272803 - RNA, 19 nt, Homo sapiens
gccucucucuugcuuacaa

SEQ ID NO: 272804 - RNA, 19 nt, Homo sapiens
gcccagauccaaaguuguc

SEQ ID NO: 272805 - RNA, 19 nt, Homo sapiens
caaaugcugagcccagauc

SEQ ID NO: 272806 - RNA, 19 nt, Homo sapiens
cauaauuggaucacugugu

SEQ ID NO: 272807 - RNA, 19 nt, Homo sapiens
ggauucugaugaacaagac

SEQ ID NO: 272808 - RNA, 19 nt, Homo sapiens
cacaggaaacccuucaaau

SEQ ID NO: 272809 - RNA, 19 nt, Homo sapiens
ggagcuccuaugacaugua

SEQ ID NO: 272810 - RNA, 19 nt, Homo sapiens
auccaaaguugucuucugu

SEQ ID NO: 272811 - RNA, 19 nt, Homo sapiens
cuacagaugcuacgguucu

SEQ ID NO: 272812 - RNA, 19 nt, Homo sapiens
uacauagaacuuccaaaug

SEQ ID NO: 272813 - RNA, 19 nt, Homo sapiens
caggagagagcgugaccuu

SEQ ID NO: 272814 - RNA, 19 nt, Homo sapiens
cagucauccugcaauguug

SEQ ID NO: 272815 - RNA, 19 nt, Homo sapiens
gagacagucauccugcaau

SEQ ID NO: 272816 - RNA, 19 nt, Homo sapiens
acagauaccagcauguaca

SEQ ID NO: 272817 - RNA, 19 nt, Homo sapiens
ccggagcuccuaugacaug

SEQ ID NO: 272818 - RNA, 19 nt, Homo sapiens
uuucccgccuucaaauaaa

SEQ ID NO: 272819 - RNA, 19 nt, Homo sapiens
gagaaaacacacuccuuug

SEQ ID NO: 272820 - RNA, 19 nt, Homo sapiens
uaauuggaucacuguguuu

SEQ ID NO: 272821 - RNA, 19 nt, Homo sapiens
gugacccacugcuuguuuc

SEQ ID NO: 272822 - RNA, 19 nt, Homo sapiens
cugcaauguuggucagaug

SEQ ID NO: 272823 - RNA, 19 nt, Homo sapiens
ugacauguaccaucuaucc

SEQ ID NO: 272824 - RNA, 19 nt, Homo sapiens
agcccacaauucuccauuu

SEQ ID NO: 272825 - RNA, 19 nt, Homo sapiens
uugcuuagcccacaauucu

SEQ ID NO: 272826 - RNA, 19 nt, Homo sapiens
aaaacacacuccuuugcuu

SEQ ID NO: 272827 - RNA, 19 nt, Homo sapiens
gaggcugcaaucacacuga

SEQ ID NO: 272828 - RNA, 19 nt, Homo sapiens
caauucuccauuucacuug

SEQ ID NO: 272829 - RNA, 19 nt, Homo sapiens
gcugagcccagauccaaag

SEQ ID NO: 272830 - RNA, 19 nt, Homo sapiens
gucauacgcauaauuggau

SEQ ID NO: 272831 - RNA, 19 nt, Homo sapiens
ugucauacgcauaauugga

SEQ ID NO: 272832 - RNA, 19 nt, Homo sapiens
gggaacagaacagugaaca

SEQ ID NO: 272833 - RNA, 19 nt, Homo sapiens
ggaaacccuucaaauaguu

SEQ ID NO: 272834 - RNA, 19 nt, Homo sapiens
acaggaaacccuucaaaua

SEQ ID NO: 272835 - RNA, 19 nt, Homo sapiens
ucacaggucuauaugagaa

SEQ ID NO: 272836 - RNA, 19 nt, Homo sapiens
guacauagaacuuccaaau

SEQ ID NO: 272837 - RNA, 19 nt, Homo sapiens
gaucacaggucuauaugag

SEQ ID NO: 272838 - RNA, 19 nt, Homo sapiens
ggaggugucauacgcauaa

SEQ ID NO: 272839 - RNA, 19 nt, Homo sapiens
ggagagagcgugaccuugu

SEQ ID NO: 272840 - RNA, 19 nt, Homo sapiens
caacagauagcagcaugua

SEQ ID NO: 272841 - RNA, 19 nt, Homo sapiens
caggaaacccuucaaauag

SEQ ID NO: 272842 - RNA, 19 nt, Homo sapiens
gauagcagcauguacauag

SEQ ID NO: 272843 - RNA, 19 nt, Homo sapiens
caugagggauuccgcagaa

SEQ ID NO: 272844 - RNA, 19 nt, Homo sapiens
acauagaacuuccaaaugc

SEQ ID NO: 272845 - RNA, 19 nt, Homo sapiens
gaacauuccaggccgacuu

SEQ ID NO: 272846 - RNA, 19 nt, Homo sapiens
cagggaggauucugacgaa

SEQ ID NO: 272847 - RNA, 19 nt, Homo sapiens
ggaggaaccuacagaugcu

SEQ ID NO: 272848 - RNA, 19 nt, Homo sapiens
auaauuggaucacuguguu

SEQ ID NO: 272849 - RNA, 19 nt, Homo sapiens
auccaaagcugucuucugu

SEQ ID NO: 272850 - RNA, 19 nt, Homo sapiens
ggugucauacgcauaauug

SEQ ID NO: 272851 - RNA, 19 nt, Homo sapiens
ggaggauucugacgaacag

SEQ ID NO: 272852 - RNA, 19 nt, Homo sapiens
gcagggaccuacagaugcu

SEQ ID NO: 272853 - RNA, 19 nt, Homo sapiens
uaugacauguaccaucuau

SEQ ID NO: 272854 - RNA, 19 nt, Homo sapiens
gagcuccuaugacauguac

SEQ ID NO: 272855 - RNA, 19 nt, Homo sapiens
gagagagcgugaccuuguc

SEQ ID NO: 272856 - RNA, 19 nt, Homo sapiens
ggugaaaucagaagagaca

SEQ ID NO: 272857 - RNA, 19 nt, Homo sapiens
ucaaauaguuggccuucac

SEQ ID NO: 272858 - RNA, 19 nt, Homo sapiens
aggaaacccuucaaauagu

SEQ ID NO: 272859 - RNA, 19 nt, Homo sapiens
ucacaggaaacccuucaaa

SEQ ID NO: 272860 - RNA, 19 nt, Homo sapiens
ccuaugacauguaccaucu

SEQ ID NO: 272861 - RNA, 19 nt, Homo sapiens
agacagucauccugcaaug

SEQ ID NO: 272862 - RNA, 19 nt, Homo sapiens
caaggucaacggaacauuc

SEQ ID NO: 272863 - RNA, 19 nt, Homo sapiens
ccaaggaggaaccuacaga

SEQ ID NO: 272864 - RNA, 19 nt, Homo sapiens
gaaacccuucaaauaguug

SEQ ID NO: 272865 - RNA, 19 nt, Homo sapiens
acagauagcagcauguaca

SEQ ID NO: 272866 - RNA, 19 nt, Homo sapiens
acagaugcuucggcucuuu

SEQ ID NO: 272867 - RNA, 19 nt, Homo sapiens
cagcauguacauagaacuu

SEQ ID NO: 272868 - RNA, 19 nt, Homo sapiens
caaaugcugaguccagauc

SEQ ID NO: 272869 - RNA, 19 nt, Homo sapiens
acagucauccugcaauguu

SEQ ID NO: 272870 - RNA, 19 nt, Homo sapiens
gauccaaagcugucuucug

SEQ ID NO: 272871 - RNA, 19 nt, Homo sapiens
ugaacagggaggauucuga

SEQ ID NO: 272872 - RNA, 19 nt, Homo sapiens
gcacagagaggggacguuu

SEQ ID NO: 272873 - RNA, 19 nt, Homo sapiens
cauagaacuuccaaaugcu

SEQ ID NO: 272874 - RNA, 19 nt, Homo sapiens
caaggaggaaccuacagau

SEQ ID NO: 272875 - RNA, 19 nt, Homo sapiens
cauaauuggaucacugugu

SEQ ID NO: 272876 - RNA, 19 nt, Homo sapiens
cacaggaaacccuucaaau

SEQ ID NO: 272877 - RNA, 19 nt, Homo sapiens
ggagcuccuaugacaugua

SEQ ID NO: 272878 - RNA, 19 nt, Homo sapiens
uacauagaacuuccaaaug

SEQ ID NO: 272879 - RNA, 19 nt, Homo sapiens
caggagagagcgugaccuu

SEQ ID NO: 272880 - RNA, 19 nt, Homo sapiens
cuacagaugcuacgguucu

SEQ ID NO: 272881 - RNA, 19 nt, Homo sapiens
gagacagucauccugcaau

SEQ ID NO: 272882 - RNA, 19 nt, Homo sapiens
uagcagcauguacauagaa

SEQ ID NO: 272883 - RNA, 19 nt, Homo sapiens
gggaggauucugacgaaca

SEQ ID NO: 272884 - RNA, 19 nt, Homo sapiens
cagucauccugcaauguug

SEQ ID NO: 272885 - RNA, 19 nt, Homo sapiens
uaauuggaucacuguguuu

SEQ ID NO: 272886 - RNA, 19 nt, Homo sapiens
gcagcaccaugucgcucau

SEQ ID NO: 272887 - RNA, 19 nt, Homo sapiens
gugacccacugcuuguuuc

SEQ ID NO: 272888 - RNA, 19 nt, Homo sapiens
uggcagggaccuacagaug

SEQ ID NO: 272889 - RNA, 19 nt, Homo sapiens
ugacauguaccaucuaucc

SEQ ID NO: 272890 - RNA, 19 nt, Homo sapiens
uccuggagcuccuaugaca

SEQ ID NO: 272891 - RNA, 19 nt, Homo sapiens
gaacuuccaaaugcugagu

SEQ ID NO: 272892 - RNA, 19 nt, Homo sapiens
auagcagcauguacauaga

SEQ ID NO: 272893 - RNA, 19 nt, Homo sapiens
gucauacgcauaauuggau

SEQ ID NO: 272894 - RNA, 19 nt, Homo sapiens
ugucauacgcauaauugga

SEQ ID NO: 272895 - RNA, 19 nt, Homo sapiens
gggaacagaacagugaaca

SEQ ID NO: 272896 - RNA, 19 nt, Homo sapiens
ggaaacccuucaaauaguu

SEQ ID NO: 272897 - RNA, 19 nt, Homo sapiens
acaggaaacccuucaaaua

SEQ ID NO: 272898 - RNA, 19 nt, Homo sapiens
gagcccagauccaaaguug

SEQ ID NO: 272899 - RNA, 19 nt, Homo sapiens
guacauagaacuuccaaau

SEQ ID NO: 272900 - RNA, 19 nt, Homo sapiens
caacagauaccagcaugua

SEQ ID NO: 272901 - RNA, 19 nt, Homo sapiens
gcagggaacagaacaguga

SEQ ID NO: 272902 - RNA, 19 nt, Homo sapiens
ggaggugucauacgcauaa

SEQ ID NO: 272903 - RNA, 19 nt, Homo sapiens
gagagaaugugaccuuguc

SEQ ID NO: 272904 - RNA, 19 nt, Homo sapiens
caggaaacccuucaaauag

SEQ ID NO: 272905 - RNA, 19 nt, Homo sapiens
ggcaucagucuucaucuua

SEQ ID NO: 272906 - RNA, 19 nt, Homo sapiens
gauccaaaguugucuucug

SEQ ID NO: 272907 - RNA, 19 nt, Homo sapiens
acauagaacuuccaaaugc

SEQ ID NO: 272908 - RNA, 19 nt, Homo sapiens
gcaucagucuucaucuuag

SEQ ID NO: 272909 - RNA, 19 nt, Homo sapiens
gcaggaaccuacagaugcu

SEQ ID NO: 272910 - RNA, 19 nt, Homo sapiens
gauaccagcauguacauag

SEQ ID NO: 272911 - RNA, 19 nt, Homo sapiens
auaauuggaucacuguguu

SEQ ID NO: 272912 - RNA, 19 nt, Homo sapiens
ggugucauacgcauaauug

SEQ ID NO: 272913 - RNA, 19 nt, Homo sapiens
ggagggaccuacagaugcu

SEQ ID NO: 272914 - RNA, 19 nt, Homo sapiens
uaugacauguaccaucuau

SEQ ID NO: 272915 - RNA, 19 nt, Homo sapiens
ggugaaaucagaagagaca

SEQ ID NO: 272916 - RNA, 19 nt, Homo sapiens
gagcuccuaugacauguac

SEQ ID NO: 272917 - RNA, 19 nt, Homo sapiens
ucaaauaguuggccuucac

SEQ ID NO: 272918 - RNA, 19 nt, Homo sapiens
aggaaacccuucaaauagu

SEQ ID NO: 272919 - RNA, 19 nt, Homo sapiens
ucacaggaaacccuucaaa

SEQ ID NO: 272920 - RNA, 19 nt, Homo sapiens
ccuaugacauguaccaucu

SEQ ID NO: 272921 - RNA, 19 nt, Homo sapiens
agacagucauccugcaaug

SEQ ID NO: 272922 - RNA, 19 nt, Homo sapiens
ucccggagcuccuaugaca

SEQ ID NO: 272923 - RNA, 19 nt, Homo sapiens
gugauccacugcuuguuuc

SEQ ID NO: 272924 - RNA, 19 nt, Homo sapiens
ugaacaugccucucucuug

SEQ ID NO: 272925 - RNA, 19 nt, Homo sapiens
cagcaucaacggaacauuc

SEQ ID NO: 272926 - RNA, 19 nt, Homo sapiens
ggagagaaugugaccuugu

SEQ ID NO: 272927 - RNA, 19 nt, Homo sapiens
ccucacaccacgaaucuga

SEQ ID NO: 272928 - RNA, 19 nt, Homo sapiens
gaaacccuucaaauaguug

SEQ ID NO: 272929 - RNA, 19 nt, Homo sapiens
acagaugcuucggcucuuu

SEQ ID NO: 272930 - RNA, 19 nt, Homo sapiens
cagcauguacauagaacuu

SEQ ID NO: 272931 - RNA, 19 nt, Homo sapiens
caggagagaaugugaccuu

SEQ ID NO: 272932 - RNA, 19 nt, Homo sapiens
acagucauccugcaauguu

SEQ ID NO: 272933 - RNA, 19 nt, Homo sapiens
aggcaucagucuucaucuu

SEQ ID NO: 272934 - RNA, 19 nt, Homo sapiens
guugccagcucccauguac

SEQ ID NO: 272935 - RNA, 19 nt, Homo sapiens
auaccagcauguacauaga

SEQ ID NO: 272936 - RNA, 19 nt, Homo sapiens
cauagaacuuccaaaugcu

SEQ ID NO: 272937 - RNA, 19 nt, Homo sapiens
caaggccaacuucuccauu

SEQ ID NO: 272938 - RNA, 19 nt, Homo sapiens
gccucucucuugcuuacaa

SEQ ID NO: 272939 - RNA, 19 nt, Homo sapiens
gcccagauccaaaguuguc

SEQ ID NO: 272940 - RNA, 19 nt, Homo sapiens
caaaugcugagcccagauc

SEQ ID NO: 272941 - RNA, 19 nt, Homo sapiens
cauaauuggaucacugugu

SEQ ID NO: 272942 - RNA, 19 nt, Homo sapiens
ggauucugaugaacaagac

SEQ ID NO: 272943 - RNA, 19 nt, Homo sapiens
cacaggaaacccuucaaau

SEQ ID NO: 272944 - RNA, 19 nt, Homo sapiens
ggagcuccuaugacaugua

SEQ ID NO: 272945 - RNA, 19 nt, Homo sapiens
cuacagaugcuacgguucu

SEQ ID NO: 272946 - RNA, 19 nt, Homo sapiens
auccaaaguugucuucugu

SEQ ID NO: 272947 - RNA, 19 nt, Homo sapiens
uacauagaacuuccaaaug

SEQ ID NO: 272948 - RNA, 19 nt, Homo sapiens
acagauaccagcauguaca

SEQ ID NO: 272949 - RNA, 19 nt, Homo sapiens
gagacagucauccugcaau

SEQ ID NO: 272950 - RNA, 19 nt, Homo sapiens
ccggagcuccuaugacaug

SEQ ID NO: 272951 - RNA, 19 nt, Homo sapiens
cagucauccugcaauguug

SEQ ID NO: 272952 - RNA, 19 nt, Homo sapiens
gagaaaacacacuccuuug

SEQ ID NO: 272953 - RNA, 19 nt, Homo sapiens
uaauuggaucacuguguuu

SEQ ID NO: 272954 - RNA, 19 nt, Homo sapiens
gcagcaccaugucgcucau

SEQ ID NO: 272955 - RNA, 19 nt, Homo sapiens
ugacauguaccaucuaucc

SEQ ID NO: 272956 - RNA, 19 nt, Homo sapiens
caccacgaaucugaacaug

SEQ ID NO: 272957 - RNA, 19 nt, Homo sapiens
gcugagcccagauccaaag

SEQ ID NO: 272958 - RNA, 19 nt, Homo sapiens
gucauacgcauaauuggau

SEQ ID NO: 272959 - RNA, 19 nt, Homo sapiens
ugucauacgcauaauugga

SEQ ID NO: 272960 - RNA, 19 nt, Homo sapiens
gggaacagaacagugaaca

SEQ ID NO: 272961 - RNA, 19 nt, Homo sapiens
acaggaaacucuucaaaua

SEQ ID NO: 272962 - RNA, 19 nt, Homo sapiens
caaccuaacuggcuuacuu

SEQ ID NO: 272963 - RNA, 19 nt, Homo sapiens
ucacaggucuauaugagaa

SEQ ID NO: 272964 - RNA, 19 nt, Homo sapiens
guacauagaacuuccaaau

SEQ ID NO: 272965 - RNA, 19 nt, Homo sapiens
gaucacaggucuauaugag

SEQ ID NO: 272966 - RNA, 19 nt, Homo sapiens
caacagauaccagcaugua

SEQ ID NO: 272967 - RNA, 19 nt, Homo sapiens
ggaggugucauacgcauaa

SEQ ID NO: 272968 - RNA, 19 nt, Homo sapiens
ggagagagcgugaccuugu

SEQ ID NO: 272969 - RNA, 19 nt, Homo sapiens
gaacucacaauuccaaaca

SEQ ID NO: 272970 - RNA, 19 nt, Homo sapiens
aaacacacuccuuugcuua

SEQ ID NO: 272971 - RNA, 19 nt, Homo sapiens
gcccaccucuccaaccuaa

SEQ ID NO: 272972 - RNA, 19 nt, Homo sapiens
caugagggauuccgcagaa

SEQ ID NO: 272973 - RNA, 19 nt, Homo sapiens
ggcaucagucuucaucuua

SEQ ID NO: 272974 - RNA, 19 nt, Homo sapiens
acucacaauuccaaacaua

SEQ ID NO: 272975 - RNA, 19 nt, Homo sapiens
acauagaacuuccaaaugc

SEQ ID NO: 272976 - RNA, 19 nt, Homo sapiens
gcaucagucuucaucuuag

SEQ ID NO: 272977 - RNA, 19 nt, Homo sapiens
ggacguuuaaccacacuuu

SEQ ID NO: 272978 - RNA, 19 nt, Homo sapiens
ccucuuaacacagcacuua

SEQ ID NO: 272979 - RNA, 19 nt, Homo sapiens
gauaccagcauguacauag

SEQ ID NO: 272980 - RNA, 19 nt, Homo sapiens
auaauuggaucacuguguu

SEQ ID NO: 272981 - RNA, 19 nt, Homo sapiens
auccaaagcugucuucugu

SEQ ID NO: 272982 - RNA, 19 nt, Homo sapiens
ggugucauacgcauaauug

SEQ ID NO: 272983 - RNA, 19 nt, Homo sapiens
aggaaacucuucaaauagu

SEQ ID NO: 272984 - RNA, 19 nt, Homo sapiens
ucacaggaaacucuucaaa

SEQ ID NO: 272985 - RNA, 19 nt, Homo sapiens
gcagggaccuacagaugcu

SEQ ID NO: 272986 - RNA, 19 nt, Homo sapiens
gcccacaauucuccauuuc

SEQ ID NO: 272987 - RNA, 19 nt, Homo sapiens
uaugacauguaccaucuau

SEQ ID NO: 272988 - RNA, 19 nt, Homo sapiens
gagcuccuaugacauguac

SEQ ID NO: 272989 - RNA, 19 nt, Homo sapiens
gagagagcgugaccuuguc

SEQ ID NO: 272990 - RNA, 19 nt, Homo sapiens
ggugaaaucagaagagaca

SEQ ID NO: 272991 - RNA, 19 nt, Homo sapiens
ucaaauaguuggccuucac

SEQ ID NO: 272992 - RNA, 19 nt, Homo sapiens
ccuaugacauguaccaucu

SEQ ID NO: 272993 - RNA, 19 nt, Homo sapiens
agacagucauccugcaaug

SEQ ID NO: 272994 - RNA, 19 nt, Homo sapiens
caggaaacucuucaaauag

SEQ ID NO: 272995 - RNA, 19 nt, Homo sapiens
ucccggagcuccuaugaca

SEQ ID NO: 272996 - RNA, 19 nt, Homo sapiens
ccacaauucuccauuucac

SEQ ID NO: 272997 - RNA, 19 nt, Homo sapiens
ccucucuccugcuuacaaa

SEQ ID NO: 272998 - RNA, 19 nt, Homo sapiens
gcaaucacacugaggaacu

SEQ ID NO: 272999 - RNA, 19 nt, Homo sapiens
acagaugcuucggcucuuu

SEQ ID NO: 273000 - RNA, 19 nt, Homo sapiens
cgugaucacaggucuauau

SEQ ID NO: 273001 - RNA, 19 nt, Homo sapiens
ccauacgaguggucaaagu

SEQ ID NO: 273002 - RNA, 19 nt, Homo sapiens
cagcauguacauagaacuu

SEQ ID NO: 273003 - RNA, 19 nt, Homo sapiens
caaggucaacagaacauuc

SEQ ID NO: 273004 - RNA, 19 nt, Homo sapiens
uggcuuacuuccuggucua

SEQ ID NO: 273005 - RNA, 19 nt, Homo sapiens
caaaugcugaguccagauc

SEQ ID NO: 273006 - RNA, 19 nt, Homo sapiens
cacaggaaacucuucaaau

SEQ ID NO: 273007 - RNA, 19 nt, Homo sapiens
acagucauccugcaauguu

SEQ ID NO: 273008 - RNA, 19 nt, Homo sapiens
ggcccaaggucaacagaac

SEQ ID NO: 273009 - RNA, 19 nt, Homo sapiens
aggcaucagucuucaucuu

SEQ ID NO: 273010 - RNA, 19 nt, Homo sapiens
guugccagcucccauguac

SEQ ID NO: 273011 - RNA, 19 nt, Homo sapiens
gauccaaagcugucuucug

SEQ ID NO: 273012 - RNA, 19 nt, Homo sapiens
gcacagagaggggacguuu

SEQ ID NO: 273013 - RNA, 19 nt, Homo sapiens
auaccagcauguacauaga

SEQ ID NO: 273014 - RNA, 19 nt, Homo sapiens
ucacaauuccaaacauaca

SEQ ID NO: 273015 - RNA, 19 nt, Homo sapiens
acaauucuccauuucacuu

SEQ ID NO: 273016 - RNA, 19 nt, Homo sapiens
cauagaacuuccaaaugcu

SEQ ID NO: 273017 - RNA, 19 nt, Homo sapiens
cauaauuggaucacugugu

SEQ ID NO: 273018 - RNA, 19 nt, Homo sapiens
ggagcuccuaugacaugua

SEQ ID NO: 273019 - RNA, 19 nt, Homo sapiens
uacauagaacuuccaaaug

SEQ ID NO: 273020 - RNA, 19 nt, Homo sapiens
caggagagagcgugaccuu

SEQ ID NO: 273021 - RNA, 19 nt, Homo sapiens
cuacagaugcuacgguucu

SEQ ID NO: 273022 - RNA, 19 nt, Homo sapiens
gagacagucauccugcaau

SEQ ID NO: 273023 - RNA, 19 nt, Homo sapiens
cagucauccugcaauguug

SEQ ID NO: 273024 - RNA, 19 nt, Homo sapiens
acagauaccagcauguaca

SEQ ID NO: 273025 - RNA, 19 nt, Homo sapiens
ccggagcuccuaugacaug

SEQ ID NO: 273026 - RNA, 19 nt, Homo sapiens
gagaaaacacacuccuuug

SEQ ID NO: 273027 - RNA, 19 nt, Homo sapiens
uaauuggaucacuguguuu

SEQ ID NO: 273028 - RNA, 19 nt, Homo sapiens
gugacccacugcuuguuuc

SEQ ID NO: 273029 - RNA, 19 nt, Homo sapiens
uggcagggaccuacagaug

SEQ ID NO: 273030 - RNA, 19 nt, Homo sapiens
ugacauguaccaucuaucc

SEQ ID NO: 273031 - RNA, 19 nt, Homo sapiens
agcccacaauucuccauuu

SEQ ID NO: 273032 - RNA, 19 nt, Homo sapiens
uugcuuagcccacaauucu

SEQ ID NO: 273033 - RNA, 19 nt, Homo sapiens
aaaacacacuccuuugcuu

SEQ ID NO: 273034 - RNA, 19 nt, Homo sapiens
gaggcugcaaucacacuga

SEQ ID NO: 273035 - RNA, 19 nt, Homo sapiens
caauucuccauuucacuug

SEQ ID NO: 273036 - RNA, 19 nt, Homo sapiens
gaacuuccaaaugcugagu

SEQ ID NO: 273037 - RNA, 19 nt, Homo sapiens
cuccaucggucgcaugaca

SEQ ID NO: 273038 - RNA, 19 nt, Homo sapiens
gucauacgcauaauuggau

SEQ ID NO: 273039 - RNA, 19 nt, Homo sapiens
ugucauacgcauaauugga

SEQ ID NO: 273040 - RNA, 19 nt, Homo sapiens
uggcguguguugcguucuu

SEQ ID NO: 273041 - RNA, 19 nt, Homo sapiens
gggaacagaacagugaaca

SEQ ID NO: 273042 - RNA, 19 nt, Homo sapiens
gaaccaagcuccaaaucug

SEQ ID NO: 273043 - RNA, 19 nt, Homo sapiens
ggucagauaucauguuuga

SEQ ID NO: 273044 - RNA, 19 nt, Homo sapiens
caggagagcuucaacauga

SEQ ID NO: 273045 - RNA, 19 nt, Homo sapiens
cgucauagguuuaacaauu

SEQ ID NO: 273046 - RNA, 19 nt, Homo sapiens
caaccuaacuggcuuacuu

SEQ ID NO: 273047 - RNA, 19 nt, Homo sapiens
gaacauuccaggcagauuu

SEQ ID NO: 273048 - RNA, 19 nt, Homo sapiens
ggaaacccuucaaguaguu

SEQ ID NO: 273049 - RNA, 19 nt, Homo sapiens
aaacaugucugcccuccaa

SEQ ID NO: 273050 - RNA, 19 nt, Homo sapiens
cuaacuggcuuacuuccua

SEQ ID NO: 273051 - RNA, 19 nt, Homo sapiens
gcugucuccucuucaaaua

SEQ ID NO: 273052 - RNA, 19 nt, Homo sapiens
ggagagagcgugaccuugu

SEQ ID NO: 273053 - RNA, 19 nt, Homo sapiens
gcacuucuuucugcacaaa

SEQ ID NO: 273054 - RNA, 19 nt, Homo sapiens
acaggaaacccuucaagua

SEQ ID NO: 273055 - RNA, 19 nt, Homo sapiens
gcagggaacuacacauguc

SEQ ID NO: 273056 - RNA, 19 nt, Homo sapiens
aaacacacuccuuugcuua

SEQ ID NO: 273057 - RNA, 19 nt, Homo sapiens
gcccaccucuccaaccuaa

SEQ ID NO: 273058 - RNA, 19 nt, Homo sapiens
acucacaauuccaaacaua

SEQ ID NO: 273059 - RNA, 19 nt, Homo sapiens
ggcgugagucuucaucuua

SEQ ID NO: 273060 - RNA, 19 nt, Homo sapiens
ugucuccucuucaaauaaa

SEQ ID NO: 273061 - RNA, 19 nt, Homo sapiens
gcccacaguucuccauuuc

SEQ ID NO: 273062 - RNA, 19 nt, Homo sapiens
guagcugucuccucuucaa

SEQ ID NO: 273063 - RNA, 19 nt, Homo sapiens
caggaaacccuucaaguag

SEQ ID NO: 273064 - RNA, 19 nt, Homo sapiens
cugcaauguuggucagaua

SEQ ID NO: 273065 - RNA, 19 nt, Homo sapiens
gaauccacguucccaucuu

SEQ ID NO: 273066 - RNA, 19 nt, Homo sapiens
ggagggaccuacagaugcu

SEQ ID NO: 273067 - RNA, 19 nt, Homo sapiens
gcagggaccuacagaugcu

SEQ ID NO: 273068 - RNA, 19 nt, Homo sapiens
ugucagcagugaaacuuau

SEQ ID NO: 273069 - RNA, 19 nt, Homo sapiens
ggaggacacgugacucuuc

SEQ ID NO: 273070 - RNA, 19 nt, Homo sapiens
uaugacauguaccaucuau

SEQ ID NO: 273071 - RNA, 19 nt, Homo sapiens
gagcuccuaugacauguac

SEQ ID NO: 273072 - RNA, 19 nt, Homo sapiens
gagagagcgugaccuuguc

SEQ ID NO: 273073 - RNA, 19 nt, Homo sapiens
caauguuggucagauauca

SEQ ID NO: 273074 - RNA, 19 nt, Homo sapiens
aagcccagauccaaaguug

SEQ ID NO: 273075 - RNA, 19 nt, Homo sapiens
ccuaugacauguaccaucu

SEQ ID NO: 273076 - RNA, 19 nt, Homo sapiens
ucacaggaaaccacagaaa

SEQ ID NO: 273077 - RNA, 19 nt, Homo sapiens
cggugucacuaucgucaua

SEQ ID NO: 273078 - RNA, 19 nt, Homo sapiens
caccuucccucaugcuguu

SEQ ID NO: 273079 - RNA, 19 nt, Homo sapiens
ucccggagcuccuaugaca

SEQ ID NO: 273080 - RNA, 19 nt, Homo sapiens
gcgugagucuucaucuuag

SEQ ID NO: 273081 - RNA, 19 nt, Homo sapiens
guugucagcucccagugau

SEQ ID NO: 273082 - RNA, 19 nt, Homo sapiens
gcacaugcagggaacuaca

SEQ ID NO: 273083 - RNA, 19 nt, Homo sapiens
auacaaagaagacagaauc

SEQ ID NO: 273084 - RNA, 19 nt, Homo sapiens
ccacagaaccaagcuccaa

SEQ ID NO: 273085 - RNA, 19 nt, Homo sapiens
acagaugcuucggcucuuu

SEQ ID NO: 273086 - RNA, 19 nt, Homo sapiens
uuggucagauaucauguuu

SEQ ID NO: 273087 - RNA, 19 nt, Homo sapiens
uggcuuacuuccuagucua

SEQ ID NO: 273088 - RNA, 19 nt, Homo sapiens
ccacaguucuccauuucac

SEQ ID NO: 273089 - RNA, 19 nt, Homo sapiens
gcuauacaaagaagacaga

SEQ ID NO: 273090 - RNA, 19 nt, Homo sapiens
gcuaagcccagauccaaag

SEQ ID NO: 273091 - RNA, 19 nt, Homo sapiens
ucaccuuucuucggacuau

SEQ ID NO: 273092 - RNA, 19 nt, Homo sapiens
aggaaacccuucaaguagu

SEQ ID NO: 273093 - RNA, 19 nt, Homo sapiens
ccacggagggaccuacaga

SEQ ID NO: 273094 - RNA, 19 nt, Homo sapiens
caaggucaacagaacauuc

SEQ ID NO: 273095 - RNA, 19 nt, Homo sapiens
uaucauguuugagcacuuc

SEQ ID NO: 273096 - RNA, 19 nt, Homo sapiens
ggucacaggaaaccacaga

SEQ ID NO: 273097 - RNA, 19 nt, Homo sapiens
ccucuugacguggcacuua

SEQ ID NO: 273098 - RNA, 19 nt, Homo sapiens
gaaagaaaacacacuccuu

SEQ ID NO: 273099 - RNA, 19 nt, Homo sapiens
caaaugcuaagcccagauc

SEQ ID NO: 273100 - RNA, 19 nt, Homo sapiens
cagcagugaaacuuauaaa

SEQ ID NO: 273101 - RNA, 19 nt, Homo sapiens
guugccagcucccauguac

SEQ ID NO: 273102 - RNA, 19 nt, Homo sapiens
ucaaguaguuggccuucac

SEQ ID NO: 273103 - RNA, 19 nt, Homo sapiens
cucaugcuguuucaccuuu

SEQ ID NO: 273104 - RNA, 19 nt, Homo sapiens
ucacaauuccaaacauaca

SEQ ID NO: 273105 - RNA, 19 nt, Homo sapiens
cauguuugagcacuucuuu

SEQ ID NO: 273106 - RNA, 19 nt, Homo sapiens
gcaauguuggucagauauc

SEQ ID NO: 273107 - RNA, 19 nt, Homo sapiens
gccucucucuugcuuacaa

SEQ ID NO: 273108 - RNA, 19 nt, Homo sapiens
gcccagauccaaaguuguc

SEQ ID NO: 273109 - RNA, 19 nt, Homo sapiens
caccugcacauucugauug

SEQ ID NO: 273110 - RNA, 19 nt, Homo sapiens
gaggaggacacgugacucu

SEQ ID NO: 273111 - RNA, 19 nt, Homo sapiens
gcaaggucaacagaacauu

SEQ ID NO: 273112 - RNA, 19 nt, Homo sapiens
ggagcuccuaugacaugua

SEQ ID NO: 273113 - RNA, 19 nt, Homo sapiens
ccaggagagcuucaacaug

SEQ ID NO: 273114 - RNA, 19 nt, Homo sapiens
caggagagagcgugaccuu

SEQ ID NO: 273115 - RNA, 19 nt, Homo sapiens
cuacagaugcuacgguucu

SEQ ID NO: 273116 - RNA, 19 nt, Homo sapiens
gcaccggcagcaccauguu

SEQ ID NO: 273117 - RNA, 19 nt, Homo sapiens
ccggagcuccuaugacaug

SEQ ID NO: 273118 - RNA, 19 nt, Homo sapiens
gugccucucucuugcuuac

SEQ ID NO: 273119 - RNA, 19 nt, Homo sapiens
cccaugagcaccacaguca

SEQ ID NO: 273120 - RNA, 19 nt, Homo sapiens
aauccacguucccaucuuc

SEQ ID NO: 273121 - RNA, 19 nt, Homo sapiens
gaucauggucacaggaaac

SEQ ID NO: 273122 - RNA, 19 nt, Homo sapiens
gugacccacugcuuguuuc

SEQ ID NO: 273123 - RNA, 19 nt, Homo sapiens
ucagcagugaaacuuauaa

SEQ ID NO: 273124 - RNA, 19 nt, Homo sapiens
ugaucauggucacaggaaa

SEQ ID NO: 273125 - RNA, 19 nt, Homo sapiens
ugacauguaccaucuaucc

SEQ ID NO: 273126 - RNA, 19 nt, Homo sapiens
aaaacacacuccuuugcuu

SEQ ID NO: 273127 - RNA, 19 nt, Homo sapiens
cauccuccuccucuucuuu

SEQ ID NO: 273128 - RNA, 19 nt, Homo sapiens
gcgcaaggucaacagaaca

SEQ ID NO: 273129 - RNA, 19 nt, Homo sapiens
agacaccugcacauucuga

SEQ ID NO: 273130 - RNA, 19 nt, Homo sapiens
cacagaaccaagcuccaaa

SEQ ID NO: 273131 - RNA, 19 nt, Homo sapiens
acucuucggugucacuauc

SEQ ID NO: 273132 - RNA, 19 nt, Homo sapiens
gaaccaagcuccaaaucug

SEQ ID NO: 273133 - RNA, 19 nt, Homo sapiens
ggucagaugucauguuuga

SEQ ID NO: 273134 - RNA, 19 nt, Homo sapiens
caaccuaacuggcuuacuu

SEQ ID NO: 273135 - RNA, 19 nt, Homo sapiens
gcaggacucugaugaacaa

SEQ ID NO: 273136 - RNA, 19 nt, Homo sapiens
gcaggaaccuacagauguu

SEQ ID NO: 273137 - RNA, 19 nt, Homo sapiens
aaagaaugcugcuguaaug

SEQ ID NO: 273138 - RNA, 19 nt, Homo sapiens
caagguaucuauuucacuu

SEQ ID NO: 273139 - RNA, 19 nt, Homo sapiens
ggaaacccuucaaguaguu

SEQ ID NO: 273140 - RNA, 19 nt, Homo sapiens
gcucucuccucuucaaaua

SEQ ID NO: 273141 - RNA, 19 nt, Homo sapiens
cuaacuggcuuacuuccua

SEQ ID NO: 273142 - RNA, 19 nt, Homo sapiens
acaggaaacccuucaagua

SEQ ID NO: 273143 - RNA, 19 nt, Homo sapiens
cgucguggguuuaacaauu

SEQ ID NO: 273144 - RNA, 19 nt, Homo sapiens
gaacucacaauuccaaaca

SEQ ID NO: 273145 - RNA, 19 nt, Homo sapiens
aaacacacuccuuugcuua

SEQ ID NO: 273146 - RNA, 19 nt, Homo sapiens
gcccaccucuccaaccuaa

SEQ ID NO: 273147 - RNA, 19 nt, Homo sapiens
gagagaacgugaccuuguc

SEQ ID NO: 273148 - RNA, 19 nt, Homo sapiens
gcagggaccuacagauguc

SEQ ID NO: 273149 - RNA, 19 nt, Homo sapiens
ggagagaacgugaccuugu

SEQ ID NO: 273150 - RNA, 19 nt, Homo sapiens
gaacauuccaggcagacuu

SEQ ID NO: 273151 - RNA, 19 nt, Homo sapiens
acucacaauuccaaacaua

SEQ ID NO: 273152 - RNA, 19 nt, Homo sapiens
cuacagauguuaugguucu

SEQ ID NO: 273153 - RNA, 19 nt, Homo sapiens
gaagccacguucccaucuu

SEQ ID NO: 273154 - RNA, 19 nt, Homo sapiens
uaacagauaccagcgugua

SEQ ID NO: 273155 - RNA, 19 nt, Homo sapiens
ugaauaggcaggacucuga

SEQ ID NO: 273156 - RNA, 19 nt, Homo sapiens
gucguggguuuaacaauuu

SEQ ID NO: 273157 - RNA, 19 nt, Homo sapiens
ucucuccucuucaaauaaa

SEQ ID NO: 273158 - RNA, 19 nt, Homo sapiens
acacggcacuuacacacuu

SEQ ID NO: 273159 - RNA, 19 nt, Homo sapiens
gaggacacguggcucuuca

SEQ ID NO: 273160 - RNA, 19 nt, Homo sapiens
guagcucucuccucuucaa

SEQ ID NO: 273161 - RNA, 19 nt, Homo sapiens
gcccacaagguaucuauuu

SEQ ID NO: 273162 - RNA, 19 nt, Homo sapiens
caggaaacccuucaaguag

SEQ ID NO: 273163 - RNA, 19 nt, Homo sapiens
ucacuaucgucguggguuu

SEQ ID NO: 273164 - RNA, 19 nt, Homo sapiens
caucuuccacggcagaaua

SEQ ID NO: 273165 - RNA, 19 nt, Homo sapiens
uaugacaucuaccaucugu

SEQ ID NO: 273166 - RNA, 19 nt, Homo sapiens
uugcuuagcccacaaggua

SEQ ID NO: 273167 - RNA, 19 nt, Homo sapiens
acaccugcauguucugauu

SEQ ID NO: 273168 - RNA, 19 nt, Homo sapiens
ggagggaccuacagaugcu

SEQ ID NO: 273169 - RNA, 19 nt, Homo sapiens
ccucuuaacacggcacuua

SEQ ID NO: 273170 - RNA, 19 nt, Homo sapiens
ggacucugaugaacaagac

SEQ ID NO: 273171 - RNA, 19 nt, Homo sapiens
ggacagaacagugaauagg

SEQ ID NO: 273172 - RNA, 19 nt, Homo sapiens
gagcuccuaugacaucuac

SEQ ID NO: 273173 - RNA, 19 nt, Homo sapiens
guguagcucucuccucuuc

SEQ ID NO: 273174 - RNA, 19 nt, Homo sapiens
ccacaagguaucuauuuca

SEQ ID NO: 273175 - RNA, 19 nt, Homo sapiens
acaauuucaugcuguacaa

SEQ ID NO: 273176 - RNA, 19 nt, Homo sapiens
aacgugaccuuguccugua

SEQ ID NO: 273177 - RNA, 19 nt, Homo sapiens
uuggucagaugucauguuu

SEQ ID NO: 273178 - RNA, 19 nt, Homo sapiens
ccuaugacaucuaccaucu

SEQ ID NO: 273179 - RNA, 19 nt, Homo sapiens
ucacaggaaaccacagaaa

SEQ ID NO: 273180 - RNA, 19 nt, Homo sapiens
caccuucccucaugcuguu

SEQ ID NO: 273181 - RNA, 19 nt, Homo sapiens
ccucuucuuucuccuuuau

SEQ ID NO: 273182 - RNA, 19 nt, Homo sapiens
guggucaucuuccucuuca

SEQ ID NO: 273183 - RNA, 19 nt, Homo sapiens
gaauauuccaggagagcuu

SEQ ID NO: 273184 - RNA, 19 nt, Homo sapiens
ugaacaugccucucucuug

SEQ ID NO: 273185 - RNA, 19 nt, Homo sapiens
ccucacaccacgaaucuga

SEQ ID NO: 273186 - RNA, 19 nt, Homo sapiens
gcaaucacacugaggaacu

SEQ ID NO: 273187 - RNA, 19 nt, Homo sapiens
ccacagaaccaagcuccaa

SEQ ID NO: 273188 - RNA, 19 nt, Homo sapiens
acagaugcuucggcucuuu

SEQ ID NO: 273189 - RNA, 19 nt, Homo sapiens
ugucugcccucaugguuuc

SEQ ID NO: 273190 - RNA, 19 nt, Homo sapiens
agccuucugucaucaguaa

SEQ ID NO: 273191 - RNA, 19 nt, Homo sapiens
caauguuggucagauguca

SEQ ID NO: 273192 - RNA, 19 nt, Homo sapiens
gcacaugcagggaccuaca

SEQ ID NO: 273193 - RNA, 19 nt, Homo sapiens
aggaaacccuucaaguagu

SEQ ID NO: 273194 - RNA, 19 nt, Homo sapiens
ccacggagggaccuacaga

SEQ ID NO: 273195 - RNA, 19 nt, Homo sapiens
caaggucaacagaacauuc

SEQ ID NO: 273196 - RNA, 19 nt, Homo sapiens
ggucacaggaaaccacaga

SEQ ID NO: 273197 - RNA, 19 nt, Homo sapiens
cccacaagguaucuauuuc

SEQ ID NO: 273198 - RNA, 19 nt, Homo sapiens
ucaaguaguuggccuucac

SEQ ID NO: 273199 - RNA, 19 nt, Homo sapiens
gaaccuacagauguuaugg

SEQ ID NO: 273200 - RNA, 19 nt, Homo sapiens
ucacaauuccaaacauaca

SEQ ID NO: 273201 - RNA, 19 nt, Homo sapiens
caggagagaacgugaccuu

SEQ ID NO: 273202 - RNA, 19 nt, Homo sapiens
cauguuugagcacuucuuu

SEQ ID NO: 273203 - RNA, 19 nt, Homo sapiens
gccucucucuugcuuacaa

SEQ ID NO: 273204 - RNA, 19 nt, Homo sapiens
caaaugcugagcccagauc

SEQ ID NO: 273205 - RNA, 19 nt, Homo sapiens
ggacacguggcucuucagu

SEQ ID NO: 273206 - RNA, 19 nt, Homo sapiens
ggucaucuuccucuucauc

SEQ ID NO: 273207 - RNA, 19 nt, Homo sapiens
ccaggagagcuucaucaug

SEQ ID NO: 273208 - RNA, 19 nt, Homo sapiens
cauggguggucaggacaaa

SEQ ID NO: 273209 - RNA, 19 nt, Homo sapiens
agguaucuauuucacuuga

SEQ ID NO: 273210 - RNA, 19 nt, Homo sapiens
gaauaggcaggacucugau

SEQ ID NO: 273211 - RNA, 19 nt, Homo sapiens
ggaggacacguggcucuuc

SEQ ID NO: 273212 - RNA, 19 nt, Homo sapiens
ggaaccuacagauguuaug

SEQ ID NO: 273213 - RNA, 19 nt, Homo sapiens
gaucauggucacaggaaac

SEQ ID NO: 273214 - RNA, 19 nt, Homo sapiens
gagaaaacacacuccuuug

SEQ ID NO: 273215 - RNA, 19 nt, Homo sapiens
gugacccacugcuuguuuc

SEQ ID NO: 273216 - RNA, 19 nt, Homo sapiens
cugcaauguuggucagaug

SEQ ID NO: 273217 - RNA, 19 nt, Homo sapiens
ugaucauggucacaggaaa

SEQ ID NO: 273218 - RNA, 19 nt, Homo sapiens
uccuggagcuccuaugaca

SEQ ID NO: 273219 - RNA, 19 nt, Homo sapiens
caggaaccuacagauguua

SEQ ID NO: 273220 - RNA, 19 nt, Homo sapiens
aaaacacacuccuuugcuu

SEQ ID NO: 273221 - RNA, 19 nt, Homo sapiens
agaaugcugcuguaaugga

SEQ ID NO: 273222 - RNA, 19 nt, Homo sapiens
cauccuccuccucuucuuu

SEQ ID NO: 273223 - RNA, 19 nt, Homo sapiens
gaggcugcaaucacacuga

SEQ ID NO: 273224 - RNA, 19 nt, Homo sapiens
aagccacguucccaucuuc

SEQ ID NO: 273225 - RNA, 19 nt, Homo sapiens
caccacgaaucugaacaug

SEQ ID NO: 273226 - RNA, 19 nt, Homo sapiens
cacagaaccaagcuccaaa

SEQ ID NO: 273227 - RNA, 19 nt, Homo sapiens
gugcagugcccaaggucaa

SEQ ID NO: 273228 - RNA, 19 nt, Homo sapiens
accuacagauguuaugguu

SEQ ID NO: 273229 - RNA, 19 nt, Homo sapiens
ugcaggaaccuacagaugu

SEQ ID NO: 273230 - RNA, 19 nt, Homo sapiens
cuugaugccuguccuugca

SEQ ID NO: 273231 - RNA, 19 nt, Homo sapiens
gaaccaagcuccaaaucug

SEQ ID NO: 273232 - RNA, 19 nt, Homo sapiens
ggucagauaucauguuuga

SEQ ID NO: 273233 - RNA, 19 nt, Homo sapiens
cgucauagguuuaacaauu

SEQ ID NO: 273234 - RNA, 19 nt, Homo sapiens
caaccuaacuggcuuacuu

SEQ ID NO: 273235 - RNA, 19 nt, Homo sapiens
gaacauuccaggcagauuu

SEQ ID NO: 273236 - RNA, 19 nt, Homo sapiens
caggagggcuucaacauga

SEQ ID NO: 273237 - RNA, 19 nt, Homo sapiens
ggaaacccuucaaguaguu

SEQ ID NO: 273238 - RNA, 19 nt, Homo sapiens
gagcccagauccaaaguug

SEQ ID NO: 273239 - RNA, 19 nt, Homo sapiens
guacauagaacuuccaaau

SEQ ID NO: 273240 - RNA, 19 nt, Homo sapiens
cuaacuggcuuacuuccua

SEQ ID NO: 273241 - RNA, 19 nt, Homo sapiens
ggaggugacauacgcauaa

SEQ ID NO: 273242 - RNA, 19 nt, Homo sapiens
ggagagagcgugaccuugu

SEQ ID NO: 273243 - RNA, 19 nt, Homo sapiens
gcacuucuuucugcacaaa

SEQ ID NO: 273244 - RNA, 19 nt, Homo sapiens
acaggaaacccuucaagua

SEQ ID NO: 273245 - RNA, 19 nt, Homo sapiens
gcagggaacuacacauguc

SEQ ID NO: 273246 - RNA, 19 nt, Homo sapiens
aaacacacuccuuugcuua

SEQ ID NO: 273247 - RNA, 19 nt, Homo sapiens
gcccaccucuccaaccuaa

SEQ ID NO: 273248 - RNA, 19 nt, Homo sapiens
ggcaucagucuucaucuua

SEQ ID NO: 273249 - RNA, 19 nt, Homo sapiens
gauccaaaguugucuucug

SEQ ID NO: 273250 - RNA, 19 nt, Homo sapiens
acauagaacuuccaaaugc

SEQ ID NO: 273251 - RNA, 19 nt, Homo sapiens
gacauacgcauaauuggaa

SEQ ID NO: 273252 - RNA, 19 nt, Homo sapiens
ggugacauacgcauaauug

SEQ ID NO: 273253 - RNA, 19 nt, Homo sapiens
acucacaauuccacacaua

SEQ ID NO: 273254 - RNA, 19 nt, Homo sapiens
gcaucagucuucaucuuag

SEQ ID NO: 273255 - RNA, 19 nt, Homo sapiens
gaacucacaauuccacaca

SEQ ID NO: 273256 - RNA, 19 nt, Homo sapiens
caggaaacccuucaaguag

SEQ ID NO: 273257 - RNA, 19 nt, Homo sapiens
gauaccagcauguacauag

SEQ ID NO: 273258 - RNA, 19 nt, Homo sapiens
cugcaauguuggucagaua

SEQ ID NO: 273259 - RNA, 19 nt, Homo sapiens
gaauccacguucccaucuu

SEQ ID NO: 273260 - RNA, 19 nt, Homo sapiens
cgucuuaacgcagcacuua

SEQ ID NO: 273261 - RNA, 19 nt, Homo sapiens
ggagggaccuacagaugcu

SEQ ID NO: 273262 - RNA, 19 nt, Homo sapiens
gcagggaccuacagaugcu

SEQ ID NO: 273263 - RNA, 19 nt, Homo sapiens
ggaggacacgugacucuuc

SEQ ID NO: 273264 - RNA, 19 nt, Homo sapiens
uaugacauguaccaucuau

SEQ ID NO: 273265 - RNA, 19 nt, Homo sapiens
gagcuccuaugacauguac

SEQ ID NO: 273266 - RNA, 19 nt, Homo sapiens
gagagagcgugaccuuguc

SEQ ID NO: 273267 - RNA, 19 nt, Homo sapiens
caauguuggucagauauca

SEQ ID NO: 273268 - RNA, 19 nt, Homo sapiens
ccuaugacauguaccaucu

SEQ ID NO: 273269 - RNA, 19 nt, Homo sapiens
ucacaggaaaccacagaaa

SEQ ID NO: 273270 - RNA, 19 nt, Homo sapiens
ugacauacgcauaauugga

SEQ ID NO: 273271 - RNA, 19 nt, Homo sapiens
cggugucacuaucgucaua

SEQ ID NO: 273272 - RNA, 19 nt, Homo sapiens
gaggugacauacgcauaau

SEQ ID NO: 273273 - RNA, 19 nt, Homo sapiens
ucccggagcuccuaugaca

SEQ ID NO: 273274 - RNA, 19 nt, Homo sapiens
gcagggaacagaagugaac

SEQ ID NO: 273275 - RNA, 19 nt, Homo sapiens
guugucagcucccagugau

SEQ ID NO: 273276 - RNA, 19 nt, Homo sapiens
gcacaugcagggaacuaca

SEQ ID NO: 273277 - RNA, 19 nt, Homo sapiens
gcaaucacacugaggaacu

SEQ ID NO: 273278 - RNA, 19 nt, Homo sapiens
auacaaagaagacagaauc

SEQ ID NO: 273279 - RNA, 19 nt, Homo sapiens
ccacagaaccaagcuccaa

SEQ ID NO: 273280 - RNA, 19 nt, Homo sapiens
acagaugcuucggcucuuu

SEQ ID NO: 273281 - RNA, 19 nt, Homo sapiens
uuggucagauaucauguuu

SEQ ID NO: 273282 - RNA, 19 nt, Homo sapiens
gcuauacaaagaagacaga

SEQ ID NO: 273283 - RNA, 19 nt, Homo sapiens
uggcuuacuuccuagucua

SEQ ID NO: 273284 - RNA, 19 nt, Homo sapiens
ccacaguucuccauuucac

SEQ ID NO: 273285 - RNA, 19 nt, Homo sapiens
gguugccaguucccaugua

SEQ ID NO: 273286 - RNA, 19 nt, Homo sapiens
ccaggagggcuucaacaug

SEQ ID NO: 273287 - RNA, 19 nt, Homo sapiens
cagcauguacauagaacuu

SEQ ID NO: 273288 - RNA, 19 nt, Homo sapiens
aggaaacccuucaaguagu

SEQ ID NO: 273289 - RNA, 19 nt, Homo sapiens
ccacggagggaccuacaga

SEQ ID NO: 273290 - RNA, 19 nt, Homo sapiens
caaggucaacagaacauuc

SEQ ID NO: 273291 - RNA, 19 nt, Homo sapiens
ggucacaggaaaccacaga

SEQ ID NO: 273292 - RNA, 19 nt, Homo sapiens
uaucauguuugagcacuuc

SEQ ID NO: 273293 - RNA, 19 nt, Homo sapiens
aggcaucagucuucaucuu

SEQ ID NO: 273294 - RNA, 19 nt, Homo sapiens
auaccagcauguacauaga

SEQ ID NO: 273295 - RNA, 19 nt, Homo sapiens
ucaaguaguuggccuucac

SEQ ID NO: 273296 - RNA, 19 nt, Homo sapiens
cauagaacuuccaaaugcu

SEQ ID NO: 273297 - RNA, 19 nt, Homo sapiens
cauguuugagcacuucuuu

SEQ ID NO: 273298 - RNA, 19 nt, Homo sapiens
gcaauguuggucagauauc

SEQ ID NO: 273299 - RNA, 19 nt, Homo sapiens
caauuccacacauacaaga

SEQ ID NO: 273300 - RNA, 19 nt, Homo sapiens
gcccagauccaaaguuguc

SEQ ID NO: 273301 - RNA, 19 nt, Homo sapiens
caaaugcugagcccagauc

SEQ ID NO: 273302 - RNA, 19 nt, Homo sapiens
ggauucugaugaacaagac

SEQ ID NO: 273303 - RNA, 19 nt, Homo sapiens
gcaaggucaacagaacauu

SEQ ID NO: 273304 - RNA, 19 nt, Homo sapiens
ggagcuccuaugacaugua

SEQ ID NO: 273305 - RNA, 19 nt, Homo sapiens
auccaaaguugucuucugu

SEQ ID NO: 273306 - RNA, 19 nt, Homo sapiens
uacauagaacuuccaaaug

SEQ ID NO: 273307 - RNA, 19 nt, Homo sapiens
caggagagagcgugaccuu

SEQ ID NO: 273308 - RNA, 19 nt, Homo sapiens
cuacagaugcuacgguucu

SEQ ID NO: 273309 - RNA, 19 nt, Homo sapiens
caugaugcgugcccuugca

SEQ ID NO: 273310 - RNA, 19 nt, Homo sapiens
ucacaauuccacacauaca

SEQ ID NO: 273311 - RNA, 19 nt, Homo sapiens
acagauaccagcauguaca

SEQ ID NO: 273312 - RNA, 19 nt, Homo sapiens
ccggagcuccuaugacaug

SEQ ID NO: 273313 - RNA, 19 nt, Homo sapiens
aauccacguucccaucuuc

SEQ ID NO: 273314 - RNA, 19 nt, Homo sapiens
gcagcaccaugucgcucau

SEQ ID NO: 273315 - RNA, 19 nt, Homo sapiens
gaucauggucacaggaaac

SEQ ID NO: 273316 - RNA, 19 nt, Homo sapiens
gugacccacugcuuguuuc

SEQ ID NO: 273317 - RNA, 19 nt, Homo sapiens
ugaucauggucacaggaaa

SEQ ID NO: 273318 - RNA, 19 nt, Homo sapiens
ugacauguaccaucuaucc

SEQ ID NO: 273319 - RNA, 19 nt, Homo sapiens
cacaauuccacacauacaa

SEQ ID NO: 273320 - RNA, 19 nt, Homo sapiens
aaaacacacuccuuugcuu

SEQ ID NO: 273321 - RNA, 19 nt, Homo sapiens
cccacugccugcuggagaa

SEQ ID NO: 273322 - RNA, 19 nt, Homo sapiens
gcgcaaggucaacagaaca

SEQ ID NO: 273323 - RNA, 19 nt, Homo sapiens
gaggcugcaaucacacuga

SEQ ID NO: 273324 - RNA, 19 nt, Homo sapiens
gcugagcccagauccaaag

SEQ ID NO: 273325 - RNA, 19 nt, Homo sapiens
acucuucggugucacuauc

SEQ ID NO: 273326 - RNA, 19 nt, Homo sapiens
cacagaaccaagcuccaaa

SEQ ID NO: 273327 - RNA, 19 nt, Homo sapiens
agaaggaccugccgaacua

SEQ ID NO: 273328 - RNA, 19 nt, Homo sapiens
aagaugaacucacugguuu

SEQ ID NO: 273329 - RNA, 19 nt, Homo sapiens
ugaacucacugguuucuug

SEQ ID NO: 273330 - RNA, 19 nt, Homo sapiens
aaagaaauguugcguaacu

SEQ ID NO: 273331 - RNA, 19 nt, Homo sapiens
caagaugaacucacugguu

SEQ ID NO: 273332 - RNA, 19 nt, Homo sapiens
ucaccaagaugaacucacu

SEQ ID NO: 273333 - RNA, 19 nt, Homo sapiens
gaaauguugcguaacucaa

SEQ ID NO: 273334 - RNA, 19 nt, Homo sapiens
gagaaggaccugccgaacu

SEQ ID NO: 273335 - RNA, 19 nt, Homo sapiens
ccucaaggcacuucuagga

SEQ ID NO: 273336 - RNA, 19 nt, Homo sapiens
gagaggaagccagcugcua

SEQ ID NO: 273337 - RNA, 19 nt, Homo sapiens
uagaaaagguggccucugu

SEQ ID NO: 273338 - RNA, 19 nt, Homo sapiens
ccacaggccagcagcuaga

SEQ ID NO: 273339 - RNA, 19 nt, Homo sapiens
aaauguugcguaacucaaa

SEQ ID NO: 273340 - RNA, 19 nt, Homo sapiens
ucuaggaccugccucuucu

SEQ ID NO: 273341 - RNA, 19 nt, Homo sapiens
ccucugugccacccacuuu

SEQ ID NO: 273342 - RNA, 19 nt, Homo sapiens
agaaauguugcguaacuca

SEQ ID NO: 273343 - RNA, 19 nt, Homo sapiens
gaugaacucacugguuucu

SEQ ID NO: 273344 - RNA, 19 nt, Homo sapiens
caacacaacuuccuuauga

SEQ ID NO: 273345 - RNA, 19 nt, Homo sapiens
gagaauaggcucauacaua

SEQ ID NO: 273346 - RNA, 19 nt, Homo sapiens
guacugcucuuguuucuuu

SEQ ID NO: 273347 - RNA, 19 nt, Homo sapiens
gaaaagugguuguuaguua

SEQ ID NO: 273348 - RNA, 19 nt, Homo sapiens
gaaaagugguuguuaguua

SEQ ID NO: 273349 - RNA, 19 nt, Homo sapiens
ggaaaacacugccaucuua

SEQ ID NO: 273350 - RNA, 19 nt, Homo sapiens
ggagauaaauggaaacaau

SEQ ID NO: 273351 - RNA, 19 nt, Homo sapiens
aaagcaagcuaucuucuua

SEQ ID NO: 273352 - RNA, 19 nt, Homo sapiens
ccagagacaucaagaauga

SEQ ID NO: 273353 - RNA, 19 nt, Homo sapiens
gaaauauccuccuuacuca

SEQ ID NO: 273354 - RNA, 19 nt, Homo sapiens
gcaggaagaucaugcagaa

SEQ ID NO: 273355 - RNA, 19 nt, Homo sapiens
ccaagaggguccuuuagua

SEQ ID NO: 273356 - RNA, 19 nt, Homo sapiens
aaacacggcuuaagcaauu

SEQ ID NO: 273357 - RNA, 19 nt, Homo sapiens
ucacauagcugucuagagu

SEQ ID NO: 273358 - RNA, 19 nt, Homo sapiens
ggaaacaguuaauaccauu

SEQ ID NO: 273359 - RNA, 19 nt, Homo sapiens
gagaugcucugcuucugua

SEQ ID NO: 273360 - RNA, 19 nt, Homo sapiens
guucagaguucuauagauu

SEQ ID NO: 273361 - RNA, 19 nt, Homo sapiens
gaacagaaccuucacugau

SEQ ID NO: 273362 - RNA, 19 nt, Homo sapiens
ggaaugaucucuucuuuug

SEQ ID NO: 273363 - RNA, 19 nt, Homo sapiens
gggaagcccucaugucuga

SEQ ID NO: 273364 - RNA, 19 nt, Homo sapiens
gcaauuccauuuauguguu

SEQ ID NO: 273365 - RNA, 19 nt, Homo sapiens
ucagagagcaccaaucaua

SEQ ID NO: 273366 - RNA, 19 nt, Homo sapiens
aaccagaaauccugacuua

SEQ ID NO: 273367 - RNA, 19 nt, Homo sapiens
gaacuuauucuguagauuc

SEQ ID NO: 273368 - RNA, 19 nt, Homo sapiens
cgaguuggcccuagacuua

SEQ ID NO: 273369 - RNA, 19 nt, Homo sapiens
ccacugcaauccugucuuu

SEQ ID NO: 273370 - RNA, 19 nt, Homo sapiens
ggcaugaugugcauuauug

SEQ ID NO: 273371 - RNA, 19 nt, Homo sapiens
gcucauacauagaaagaga

SEQ ID NO: 273372 - RNA, 19 nt, Homo sapiens
acagugacgugcacaauaa

SEQ ID NO: 273373 - RNA, 19 nt, Homo sapiens
gaacaucauuagaacaaag

SEQ ID NO: 273374 - RNA, 19 nt, Homo sapiens
ccucaugucugaacucaaa

SEQ ID NO: 273375 - RNA, 19 nt, Homo sapiens
ggcaacugcuuauggcuua

SEQ ID NO: 273376 - RNA, 19 nt, Homo sapiens
aacagaaccuucacugaua

SEQ ID NO: 273377 - RNA, 19 nt, Homo sapiens
agaauaggcucauacauag

SEQ ID NO: 273378 - RNA, 19 nt, Homo sapiens
gguaaucacaugaauauug

SEQ ID NO: 273379 - RNA, 19 nt, Homo sapiens
acccagaagugaccaauua

SEQ ID NO: 273380 - RNA, 19 nt, Homo sapiens
gaagguuguugaggagaua

SEQ ID NO: 273381 - RNA, 19 nt, Homo sapiens
gcaagacuucugccuauuu

SEQ ID NO: 273382 - RNA, 19 nt, Homo sapiens
cauaagcggcguaaguuua

SEQ ID NO: 273383 - RNA, 19 nt, Homo sapiens
guauguguguagacaaaua

SEQ ID NO: 273384 - RNA, 19 nt, Homo sapiens
ugacaaaguuacugauuca

SEQ ID NO: 273385 - RNA, 19 nt, Homo sapiens
gagcuguucucuuuaggaa

SEQ ID NO: 273386 - RNA, 19 nt, Homo sapiens
gauggcaccugaaagcauu

SEQ ID NO: 273387 - RNA, 19 nt, Homo sapiens
gaaagauucagguauguug

SEQ ID NO: 273388 - RNA, 19 nt, Homo sapiens
gacuguagccuggauauua

SEQ ID NO: 273389 - RNA, 19 nt, Homo sapiens
uuaaggcacucuguuauuu

SEQ ID NO: 273390 - RNA, 19 nt, Homo sapiens
aaaccuaaguccuuuaugu

SEQ ID NO: 273391 - RNA, 19 nt, Homo sapiens
aaggagaucugugagaaua

SEQ ID NO: 273392 - RNA, 19 nt, Homo sapiens
aaucguagcuggcaugaug

SEQ ID NO: 273393 - RNA, 19 nt, Homo sapiens
uagaguagcuuaccagaag

SEQ ID NO: 273394 - RNA, 19 nt, Homo sapiens
caggaaugaucucuucuuu

SEQ ID NO: 273395 - RNA, 19 nt, Homo sapiens
ggucggaucacaaagauuu

SEQ ID NO: 273396 - RNA, 19 nt, Homo sapiens
cugaugaacuuauucugua

SEQ ID NO: 273397 - RNA, 19 nt, Homo sapiens
uaaauuguccguguucaua

SEQ ID NO: 273398 - RNA, 19 nt, Homo sapiens
agacuaaacuacaggagaa

SEQ ID NO: 273399 - RNA, 19 nt, Homo sapiens
gcuauuagagcauugaauu

SEQ ID NO: 273400 - RNA, 19 nt, Homo sapiens
gaacaaaggacagaguaug

SEQ ID NO: 273401 - RNA, 19 nt, Homo sapiens
aagcugcacuuuauaagaa

SEQ ID NO: 273402 - RNA, 19 nt, Homo sapiens
ggccaugacugucgcugua

SEQ ID NO: 273403 - RNA, 19 nt, Homo sapiens
ugacgucaaugcugccaua

SEQ ID NO: 273404 - RNA, 19 nt, Homo sapiens
ggaaguaguagauaaagga

SEQ ID NO: 273405 - RNA, 19 nt, Homo sapiens
ucagguauguugccuuuau

SEQ ID NO: 273406 - RNA, 19 nt, Homo sapiens
caucagucccuauguauuu

SEQ ID NO: 273407 - RNA, 19 nt, Homo sapiens
ccaaucauauuuacuccaa

SEQ ID NO: 273408 - RNA, 19 nt, Homo sapiens
gagagcaccaaucauauuu

SEQ ID NO: 273409 - RNA, 19 nt, Homo sapiens
cccaagagauuguuguuug

SEQ ID NO: 273410 - RNA, 19 nt, Homo sapiens
uauguugccuuuaugguuu

SEQ ID NO: 273411 - RNA, 19 nt, Homo sapiens
ccuuagaccuuccauaaug

SEQ ID NO: 273412 - RNA, 19 nt, Homo sapiens
uuugggagcuguucucuuu

SEQ ID NO: 273413 - RNA, 19 nt, Homo sapiens
gaagaaaacgugauucauu

SEQ ID NO: 273414 - RNA, 19 nt, Homo sapiens
gaacaccugggcuuaagaa

SEQ ID NO: 273415 - RNA, 19 nt, Homo sapiens
guugauaguuuaccugaau

SEQ ID NO: 273416 - RNA, 19 nt, Homo sapiens
gcaaagguuccaacuguau

SEQ ID NO: 273417 - RNA, 19 nt, Homo sapiens
caagcaaauuguucagcua

SEQ ID NO: 273418 - RNA, 19 nt, Homo sapiens
acacgcaccugcugaaaug

SEQ ID NO: 273419 - RNA, 19 nt, Homo sapiens
uggcagaguuuguguguug

SEQ ID NO: 273420 - RNA, 19 nt, Homo sapiens
uaagagccauauaaguuug

SEQ ID NO: 273421 - RNA, 19 nt, Homo sapiens
gagaauaagcagaaugaau

SEQ ID NO: 273422 - RNA, 19 nt, Homo sapiens
ccuaucagcuucagaaugg

SEQ ID NO: 273423 - RNA, 19 nt, Homo sapiens
guauacaacccuggcauua

SEQ ID NO: 273424 - RNA, 19 nt, Homo sapiens
caccugggcuuaagaaauc

SEQ ID NO: 273425 - RNA, 19 nt, Homo sapiens
uaaaggaaacgcucgacua

SEQ ID NO: 273426 - RNA, 19 nt, Homo sapiens
gaagcugcacuuuauaaga

SEQ ID NO: 273427 - RNA, 19 nt, Homo sapiens
agaauaagcagaaugaaug

SEQ ID NO: 273428 - RNA, 19 nt, Homo sapiens
cgaaugagaauaagcagaa

SEQ ID NO: 273429 - RNA, 19 nt, Homo sapiens
gagcaccaaucauauuuac

SEQ ID NO: 273430 - RNA, 19 nt, Homo sapiens
cuaauuaugugguuaaagg

SEQ ID NO: 273431 - RNA, 19 nt, Homo sapiens
guucaaagcaggaagauca

SEQ ID NO: 273432 - RNA, 19 nt, Homo sapiens
acagaaccuucacugauaa

SEQ ID NO: 273433 - RNA, 19 nt, Homo sapiens
caccagcaguggaucuaua

SEQ ID NO: 273434 - RNA, 19 nt, Homo sapiens
uaaaagaugugucuaguuc

SEQ ID NO: 273435 - RNA, 19 nt, Homo sapiens
caucggcucugucugcauu

SEQ ID NO: 273436 - RNA, 19 nt, Homo sapiens
gaguuuguguguugucuug

SEQ ID NO: 273437 - RNA, 19 nt, Homo sapiens
uaaggcacucuguuauuua

SEQ ID NO: 273438 - RNA, 19 nt, Homo sapiens
gccaguaucuauauaugug

SEQ ID NO: 273439 - RNA, 19 nt, Homo sapiens
auacaacccuggcauuaug

SEQ ID NO: 273440 - RNA, 19 nt, Homo sapiens
gauucuaaguucuacaaga

SEQ ID NO: 273441 - RNA, 19 nt, Homo sapiens
gcagcgauaguacuaauga

SEQ ID NO: 273442 - RNA, 19 nt, Homo sapiens
gacugucgcuguaaagaug

SEQ ID NO: 273443 - RNA, 19 nt, Homo sapiens
caacaaagagcaaauccau

SEQ ID NO: 273444 - RNA, 19 nt, Homo sapiens
ucagagugcugucuuaugu

SEQ ID NO: 273445 - RNA, 19 nt, Homo sapiens
caacuuguuugacgacgaa

SEQ ID NO: 273446 - RNA, 19 nt, Homo sapiens
gcuccaaggugucacauca

SEQ ID NO: 273447 - RNA, 19 nt, Homo sapiens
gcucacagcugcucauugc

SEQ ID NO: 273448 - RNA, 19 nt, Homo sapiens
gcaucgaaccagagaauuu

SEQ ID NO: 273449 - RNA, 19 nt, Homo sapiens
ugacagagccugcugauac

SEQ ID NO: 273450 - RNA, 19 nt, Homo sapiens
cacccuggcuucaacauga

SEQ ID NO: 273451 - RNA, 19 nt, Homo sapiens
agagugcugucuuauguga

SEQ ID NO: 273452 - RNA, 19 nt, Homo sapiens
ucaaaauccugccuaauga

SEQ ID NO: 273453 - RNA, 19 nt, Homo sapiens
aggcggcucuguaccauuu

SEQ ID NO: 273454 - RNA, 19 nt, Homo sapiens
gaaccacacccgccaagca

SEQ ID NO: 273455 - RNA, 19 nt, Homo sapiens
gaauuucucauuuccagau

SEQ ID NO: 273456 - RNA, 19 nt, Homo sapiens
ccgauucagucccggauug

SEQ ID NO: 273457 - RNA, 19 nt, Homo sapiens
ugucuuaugugaaguggau

SEQ ID NO: 273458 - RNA, 19 nt, Homo sapiens
ggaguugcccaccgaggaa

SEQ ID NO: 273459 - RNA, 19 nt, Homo sapiens
gcaggcggcucuguaccau

SEQ ID NO: 273460 - RNA, 19 nt, Homo sapiens
cagcccaguuuguucaugu

SEQ ID NO: 273461 - RNA, 19 nt, Homo sapiens
guggaucgaggacaccaua

SEQ ID NO: 273462 - RNA, 19 nt, Homo sapiens
ccgucagagugcugucuua

SEQ ID NO: 273463 - RNA, 19 nt, Homo sapiens
cagcaucgaaccagagaau

SEQ ID NO: 273464 - RNA, 19 nt, Homo sapiens
uccaaggugucacaucaug

SEQ ID NO: 273465 - RNA, 19 nt, Homo sapiens
ccaguuuguucaugucagu

SEQ ID NO: 273466 - RNA, 19 nt, Homo sapiens
cuacagccacgaccucaug

SEQ ID NO: 273467 - RNA, 19 nt, Homo sapiens
caucgaaccagagaauuuc

SEQ ID NO: 273468 - RNA, 19 nt, Homo sapiens
ccuggaagguggcaaagac

SEQ ID NO: 273469 - RNA, 19 nt, Homo sapiens
acacagcccaguuuguuca

SEQ ID NO: 273470 - RNA, 19 nt, Homo sapiens
cugugaaggucguggaguu

SEQ ID NO: 273471 - RNA, 19 nt, Homo sapiens
acaccucugucaccaugug

SEQ ID NO: 273472 - RNA, 19 nt, Homo sapiens
gacagagccugcugauacc

SEQ ID NO: 273473 - RNA, 19 nt, Homo sapiens
cagacuucaugcugugugu

SEQ ID NO: 273474 - RNA, 19 nt, Homo sapiens
gccaagcagacgaggacua

SEQ ID NO: 273475 - RNA, 19 nt, Homo sapiens
ucacagcugcucauugcau

SEQ ID NO: 273476 - RNA, 19 nt, Homo sapiens
gcggcucuguaccauuuca

SEQ ID NO: 273477 - RNA, 19 nt, Homo sapiens
gccuaaugaugagugcaaa

SEQ ID NO: 273478 - RNA, 19 nt, Homo sapiens
ugacagaguucauguugug

SEQ ID NO: 273479 - RNA, 19 nt, Homo sapiens
gcucacagcugcccauugc

SEQ ID NO: 273480 - RNA, 19 nt, Homo sapiens
ccaggagucuucagugugu

SEQ ID NO: 273481 - RNA, 19 nt, Homo sapiens
ccacacccgcucuacaaua

SEQ ID NO: 273482 - RNA, 19 nt, Homo sapiens
cugagaaggugacagaguu

SEQ ID NO: 273483 - RNA, 19 nt, Homo sapiens
cacacccgcucuacaauau

SEQ ID NO: 273484 - RNA, 19 nt, Homo sapiens
ugucagagccugccaagau

SEQ ID NO: 273485 - RNA, 19 nt, Homo sapiens
ggugacagaguucauguug

SEQ ID NO: 273486 - RNA, 19 nt, Homo sapiens
cacccgcucuacaauauga

SEQ ID NO: 273487 - RNA, 19 nt, Homo sapiens
gcccauugccuaaagaaga

SEQ ID NO: 273488 - RNA, 19 nt, Homo sapiens
gaaggugacagaguucaug

SEQ ID NO: 273489 - RNA, 19 nt, Homo sapiens
aaauuuaaguccaccucaa

SEQ ID NO: 273490 - RNA, 19 nt, Homo sapiens
cccauugccuaaagaagaa

SEQ ID NO: 273491 - RNA, 19 nt, Homo sapiens
gccaagaucacagauguug

SEQ ID NO: 273492 - RNA, 19 nt, Homo sapiens
gcuucaagguaucacauca

SEQ ID NO: 273493 - RNA, 19 nt, Homo sapiens
cccuaccucuaguaaauuu

SEQ ID NO: 273494 - RNA, 19 nt, Homo sapiens
gcucuggacaggugguaaa

SEQ ID NO: 273495 - RNA, 19 nt, Homo sapiens
gagcuuacucugagaaggu

SEQ ID NO: 273496 - RNA, 19 nt, Homo sapiens
cugccaagaucacagaugu

SEQ ID NO: 273497 - RNA, 19 nt, Homo sapiens
uacaauaugagccuucuga

SEQ ID NO: 273498 - RNA, 19 nt, Homo sapiens
gcaucgaaccagaggaguu

SEQ ID NO: 273499 - RNA, 19 nt, Homo sapiens
ccaugugcccugccugaaa

SEQ ID NO: 273500 - RNA, 19 nt, Homo sapiens
ucaaagccuuagaccagau

SEQ ID NO: 273501 - RNA, 19 nt, Homo sapiens
gucagagccugccaagauc

SEQ ID NO: 273502 - RNA, 19 nt, Homo sapiens
ugaaaagccugcuguguac

SEQ ID NO: 273503 - RNA, 19 nt, Homo sapiens
gggguccacuugucuguaa

SEQ ID NO: 273504 - RNA, 19 nt, Homo sapiens
guuugagccugaagacaca

SEQ ID NO: 273505 - RNA, 19 nt, Homo sapiens
gugacagaguucauguugu

SEQ ID NO: 273506 - RNA, 19 nt, Homo sapiens
caaccuguuugagccugaa

SEQ ID NO: 273507 - RNA, 19 nt, Homo sapiens
uucaagguaucacaucaug

SEQ ID NO: 273508 - RNA, 19 nt, Homo sapiens
uccaucuccuguccaauga

SEQ ID NO: 273509 - RNA, 19 nt, Homo sapiens
caugugcccugccugaaaa

SEQ ID NO: 273510 - RNA, 19 nt, Homo sapiens
aauuuaaguccaccucaaa

SEQ ID NO: 273511 - RNA, 19 nt, Homo sapiens
gggagugugagaagcauuc

SEQ ID NO: 273512 - RNA, 19 nt, Homo sapiens
cagcaugugggaccugguu

SEQ ID NO: 273513 - RNA, 19 nt, Homo sapiens
cugaaaagccugcugugua

SEQ ID NO: 273514 - RNA, 19 nt, Homo sapiens
gcugcccauugccuaaaga

SEQ ID NO: 273515 - RNA, 19 nt, Homo sapiens
ggucggcacaaccuguuug

SEQ ID NO: 273516 - RNA, 19 nt, Homo sapiens
gcaauguggucaucaaaua

SEQ ID NO: 273517 - RNA, 19 nt, Homo sapiens
gcaagcaacuuauuucauu

SEQ ID NO: 273518 - RNA, 19 nt, Homo sapiens
gaaauugguugccacauga

SEQ ID NO: 273519 - RNA, 19 nt, Homo sapiens
gaagagaaguguaaguguu

SEQ ID NO: 273520 - RNA, 19 nt, Homo sapiens
ggagaaaggugaaauccaa

SEQ ID NO: 273521 - RNA, 19 nt, Homo sapiens
ggagaagaauugaauguga

SEQ ID NO: 273522 - RNA, 19 nt, Homo sapiens
gaaaguggcacaccaaguu

SEQ ID NO: 273523 - RNA, 19 nt, Homo sapiens
uaaaggaguugauaugaga

SEQ ID NO: 273524 - RNA, 19 nt, Homo sapiens
cuauaaaggugcugaguaa

SEQ ID NO: 273525 - RNA, 19 nt, Homo sapiens
ggauguagcuuccauguac

SEQ ID NO: 273526 - RNA, 19 nt, Homo sapiens
ccggaacaauugccuauua

SEQ ID NO: 273527 - RNA, 19 nt, Homo sapiens
ggacauuccuugaagcaau

SEQ ID NO: 273528 - RNA, 19 nt, Homo sapiens
caaagucgcugaguacaug

SEQ ID NO: 273529 - RNA, 19 nt, Homo sapiens
caacuaggauugcguaugg

SEQ ID NO: 273530 - RNA, 19 nt, Homo sapiens
gacacaagcacaauuuaua

SEQ ID NO: 273531 - RNA, 19 nt, Homo sapiens
ggucugugcuggcuauaaa

SEQ ID NO: 273532 - RNA, 19 nt, Homo sapiens
ccaagaagcaauuguguuu

SEQ ID NO: 273533 - RNA, 19 nt, Homo sapiens
gaacaccuaccgcuauaaa

SEQ ID NO: 273534 - RNA, 19 nt, Homo sapiens
gaagcaauguggucaucaa

SEQ ID NO: 273535 - RNA, 19 nt, Homo sapiens
gacuguguguugugaaaua

SEQ ID NO: 273536 - RNA, 19 nt, Homo sapiens
guaaggaagagaaguguaa

SEQ ID NO: 273537 - RNA, 19 nt, Homo sapiens
gguguuugcuauucaguuu

SEQ ID NO: 273538 - RNA, 19 nt, Homo sapiens
acaccuuucucacaaauaa

SEQ ID NO: 273539 - RNA, 19 nt, Homo sapiens
gaacaauugccuauuaaag

SEQ ID NO: 273540 - RNA, 19 nt, Homo sapiens
gguaaauauuccuuuggua

SEQ ID NO: 273541 - RNA, 19 nt, Homo sapiens
caacugagaucuccaugac

SEQ ID NO: 273542 - RNA, 19 nt, Homo sapiens
ggagcaaccuggugucuac

SEQ ID NO: 273543 - RNA, 19 nt, Homo sapiens
gguaacaaaugaagaaugc

SEQ ID NO: 273544 - RNA, 19 nt, Homo sapiens
gcagaguaccggaacaauu

SEQ ID NO: 273545 - RNA, 19 nt, Homo sapiens
cggaacaauugccuauuaa

SEQ ID NO: 273546 - RNA, 19 nt, Homo sapiens
gauacaccuuucucacaaa

SEQ ID NO: 273547 - RNA, 19 nt, Homo sapiens
uuaaaggagugaauguuug

SEQ ID NO: 273548 - RNA, 19 nt, Homo sapiens
gcccaauacugccagauga

SEQ ID NO: 273549 - RNA, 19 nt, Homo sapiens
gagaagcaguccagagucu

SEQ ID NO: 273550 - RNA, 19 nt, Homo sapiens
acaccaaagucgcugagua

SEQ ID NO: 273551 - RNA, 19 nt, Homo sapiens
guuaaaggagugaauguuu

SEQ ID NO: 273552 - RNA, 19 nt, Homo sapiens
gagaguggcaucuucuuug

SEQ ID NO: 273553 - RNA, 19 nt, Homo sapiens
cagaguaccggaacaauug

SEQ ID NO: 273554 - RNA, 19 nt, Homo sapiens
gguuagcaguguugaagaa

SEQ ID NO: 273555 - RNA, 19 nt, Homo sapiens
ggagaguggcaucuucuuu

SEQ ID NO: 273556 - RNA, 19 nt, Homo sapiens
agauucagguggucccuua

SEQ ID NO: 273557 - RNA, 19 nt, Homo sapiens
caauaugccuaccuuccaa

SEQ ID NO: 273558 - RNA, 19 nt, Homo sapiens
gaaaaucgagucacaaaga

SEQ ID NO: 273559 - RNA, 19 nt, Homo sapiens
caucuucuuugcauccuaa

SEQ ID NO: 273560 - RNA, 19 nt, Homo sapiens
gcgcaucuauaguggcauu

SEQ ID NO: 273561 - RNA, 19 nt, Homo sapiens
agaaauugguugccacaug

SEQ ID NO: 273562 - RNA, 19 nt, Homo sapiens
gauaugagaggagucaauu

SEQ ID NO: 273563 - RNA, 19 nt, Homo sapiens
ccagcaaguucaaucaaug

SEQ ID NO: 273564 - RNA, 19 nt, Homo sapiens
aaaccaauaugccuaccuu

SEQ ID NO: 273565 - RNA, 19 nt, Homo sapiens
gcuauaaaggugcugagua

SEQ ID NO: 273566 - RNA, 19 nt, Homo sapiens
ggaacaauugccuauuaaa

SEQ ID NO: 273567 - RNA, 19 nt, Homo sapiens
uaacauucgcugccaguuu

SEQ ID NO: 273568 - RNA, 19 nt, Homo sapiens
caagcacaauuuauaccaa

SEQ ID NO: 273569 - RNA, 19 nt, Homo sapiens
caagggagcucugguuacu

SEQ ID NO: 273570 - RNA, 19 nt, Homo sapiens
caaagaugauucgcuguca

SEQ ID NO: 273571 - RNA, 19 nt, Homo sapiens
ccugaacccugccauucua

SEQ ID NO: 273572 - RNA, 19 nt, Homo sapiens
ucaagcaagcaacuuauuu

SEQ ID NO: 273573 - RNA, 19 nt, Homo sapiens
gagcucugguuacucuuug

SEQ ID NO: 273574 - RNA, 19 nt, Homo sapiens
acaagagacucaccuccaa

SEQ ID NO: 273575 - RNA, 19 nt, Homo sapiens
caaguucaaucaaugacau

SEQ ID NO: 273576 - RNA, 19 nt, Homo sapiens
gaaagacacagugcacuca

SEQ ID NO: 273577 - RNA, 19 nt, Homo sapiens
gauggucugugcuggcuau

SEQ ID NO: 273578 - RNA, 19 nt, Homo sapiens
ggugacacaagcacaauuu

SEQ ID NO: 273579 - RNA, 19 nt, Homo sapiens
gaggaacaccuaccgcuau

SEQ ID NO: 273580 - RNA, 19 nt, Homo sapiens
aaccugaguucaagucaaa

SEQ ID NO: 273581 - RNA, 19 nt, Homo sapiens
uccaggcuccuuugaauua

SEQ ID NO: 273582 - RNA, 19 nt, Homo sapiens
gcaauuguguuuucagaau

SEQ ID NO: 273583 - RNA, 19 nt, Homo sapiens
gaugauucgcugucaguuu

SEQ ID NO: 273584 - RNA, 19 nt, Homo sapiens
ccaacugccucuucuuuac

SEQ ID NO: 273585 - RNA, 19 nt, Homo sapiens
ugacucaacucuaugaaaa

SEQ ID NO: 273586 - RNA, 19 nt, Homo sapiens
caauguggucaucaaauaa

SEQ ID NO: 273587 - RNA, 19 nt, Homo sapiens
ggacuggauuuuagagaaa

SEQ ID NO: 273588 - RNA, 19 nt, Homo sapiens
gaaggagaaaggugaaauc

SEQ ID NO: 273589 - RNA, 19 nt, Homo sapiens
gugaauguuugccaagaga

SEQ ID NO: 273590 - RNA, 19 nt, Homo sapiens
ccaagguguuugcuauuca

SEQ ID NO: 273591 - RNA, 19 nt, Homo sapiens
caaccugaguucaagucaa

SEQ ID NO: 273592 - RNA, 19 nt, Homo sapiens
gcagucaccagcaugagaa

SEQ ID NO: 273593 - RNA, 19 nt, Homo sapiens
cagaagggaaucaugauau

SEQ ID NO: 273594 - RNA, 19 nt, Homo sapiens
agauacaccuuucucacaa

SEQ ID NO: 273595 - RNA, 19 nt, Homo sapiens
ggaagagaaguguaagugu

SEQ ID NO: 273596 - RNA, 19 nt, Homo sapiens
aggaacaccuaccgcuaua

SEQ ID NO: 273597 - RNA, 19 nt, Homo sapiens
aaagauaguguuacaggaa

SEQ ID NO: 273598 - RNA, 19 nt, Homo sapiens
guacauggacuggauuuua

SEQ ID NO: 273599 - RNA, 19 nt, Homo sapiens
ucagaagggaaucaugaua

SEQ ID NO: 273600 - RNA, 19 nt, Homo sapiens
gaggaacaaacucuucuug

SEQ ID NO: 273601 - RNA, 19 nt, Homo sapiens
gagugaauguuugccaaga

SEQ ID NO: 273602 - RNA, 19 nt, Homo sapiens
caagcaagcaacuuauuuc

SEQ ID NO: 273603 - RNA, 19 nt, Homo sapiens
gaagcccugugcccuuuca

SEQ ID NO: 273604 - RNA, 19 nt, Homo sapiens
gagacuugcacaaagauga

SEQ ID NO: 273605 - RNA, 19 nt, Homo sapiens
gaggagaagaauugaaugu

SEQ ID NO: 273606 - RNA, 19 nt, Homo sapiens
gcaacugagaucuccauga

SEQ ID NO: 273607 - RNA, 19 nt, Homo sapiens
agaagggaaucaugauauc

SEQ ID NO: 273608 - RNA, 19 nt, Homo sapiens
cacaagggagcucugguua

SEQ ID NO: 273609 - RNA, 19 nt, Homo sapiens
ugagaggagucaauuuuaa

SEQ ID NO: 273610 - RNA, 19 nt, Homo sapiens
acacagagcagugauggaa

SEQ ID NO: 273611 - RNA, 19 nt, Homo sapiens
aaaugaagaaugccagaaa

SEQ ID NO: 273612 - RNA, 19 nt, Homo sapiens
gaacaucuuccagcaucuu

SEQ ID NO: 273613 - RNA, 19 nt, Homo sapiens
gagaaaggugaaauccaaa

SEQ ID NO: 273614 - RNA, 19 nt, Homo sapiens
ugacacaagcacaauuuau

SEQ ID NO: 273615 - RNA, 19 nt, Homo sapiens
ucuuugagauuguguaaca

SEQ ID NO: 273616 - RNA, 19 nt, Homo sapiens
ugacaaagcaauucuguuu

SEQ ID NO: 273617 - RNA, 19 nt, Homo sapiens
uaacaccugugagaaauaa

SEQ ID NO: 273618 - RNA, 19 nt, Homo sapiens
cgagagaaaugcuuguuau

SEQ ID NO: 273619 - RNA, 19 nt, Homo sapiens
caauuugcccugaaacuua

SEQ ID NO: 273620 - RNA, 19 nt, Homo sapiens
gaaauuagaggugaugcua

SEQ ID NO: 273621 - RNA, 19 nt, Homo sapiens
agacaucuguguauucuga

SEQ ID NO: 273622 - RNA, 19 nt, Homo sapiens
caacagagcaggaauaaaa

SEQ ID NO: 273623 - RNA, 19 nt, Homo sapiens
gaacuaacaccugugagaa

SEQ ID NO: 273624 - RNA, 19 nt, Homo sapiens
guacagaaaucagauggau

SEQ ID NO: 273625 - RNA, 19 nt, Homo sapiens
gaauaacagucuagcugau

SEQ ID NO: 273626 - RNA, 19 nt, Homo sapiens
ggaccaacaagcaauauau

SEQ ID NO: 273627 - RNA, 19 nt, Homo sapiens
guuacuggguugaguguuu

SEQ ID NO: 273628 - RNA, 19 nt, Homo sapiens
gaauugagaguuuguucuu

SEQ ID NO: 273629 - RNA, 19 nt, Homo sapiens
gcaucaauuugcccugaaa

SEQ ID NO: 273630 - RNA, 19 nt, Homo sapiens
ucagugacauccuuaauac

SEQ ID NO: 273631 - RNA, 19 nt, Homo sapiens
uaaaguguauccugacucu

SEQ ID NO: 273632 - RNA, 19 nt, Homo sapiens
gagauaaggaugaauugau

SEQ ID NO: 273633 - RNA, 19 nt, Homo sapiens
uagaggugaugcuaaagaa

SEQ ID NO: 273634 - RNA, 19 nt, Homo sapiens
gaauugauacacacacaga

SEQ ID NO: 273635 - RNA, 19 nt, Homo sapiens
gagagaaaugcuuguuauu

SEQ ID NO: 273636 - RNA, 19 nt, Homo sapiens
guucuuacacacaaguuua

SEQ ID NO: 273637 - RNA, 19 nt, Homo sapiens
ugacauccuuaauacagaa

SEQ ID NO: 273638 - RNA, 19 nt, Homo sapiens
gagaguuuguucuuacaca

SEQ ID NO: 273639 - RNA, 19 nt, Homo sapiens
gaaaguucuucaccuucau

SEQ ID NO: 273640 - RNA, 19 nt, Homo sapiens
ucucuuaaacugcccaaua

SEQ ID NO: 273641 - RNA, 19 nt, Homo sapiens
aaacuuacccacagacuca

SEQ ID NO: 273642 - RNA, 19 nt, Homo sapiens
ggauuauucuccuugucuu

SEQ ID NO: 273643 - RNA, 19 nt, Homo sapiens
gaaccugauacgugacaaa

SEQ ID NO: 273644 - RNA, 19 nt, Homo sapiens
cuccuugucuugguuguua

SEQ ID NO: 273645 - RNA, 19 nt, Homo sapiens
uagcugugcugggauuauu

SEQ ID NO: 273646 - RNA, 19 nt, Homo sapiens
ccugauacgugacaaagca

SEQ ID NO: 273647 - RNA, 19 nt, Homo sapiens
gcagcaacuccgagagaaa

SEQ ID NO: 273648 - RNA, 19 nt, Homo sapiens
gugacauccuuaauacaga

SEQ ID NO: 273649 - RNA, 19 nt, Homo sapiens
aaagaacuaacaccuguga

SEQ ID NO: 273650 - RNA, 19 nt, Homo sapiens
ccgagagaaaugcuuguua

SEQ ID NO: 273651 - RNA, 19 nt, Homo sapiens
gaccaacaagcaauauaug

SEQ ID NO: 273652 - RNA, 19 nt, Homo sapiens
auaacagucuagcugauug

SEQ ID NO: 273653 - RNA, 19 nt, Homo sapiens
ggcagcaacuccgagagaa

SEQ ID NO: 273654 - RNA, 19 nt, Homo sapiens
cucuuaaacugcccaauau

SEQ ID NO: 273655 - RNA, 19 nt, Homo sapiens
acacacacagaaccugaua

SEQ ID NO: 273656 - RNA, 19 nt, Homo sapiens
aaggaugaauugauacaca

SEQ ID NO: 273657 - RNA, 19 nt, Homo sapiens
cuuaaacugcccaauauau

SEQ ID NO: 273658 - RNA, 19 nt, Homo sapiens
acuaacaccugugagaaau

SEQ ID NO: 273659 - RNA, 19 nt, Homo sapiens
gaauaaaacaacagagaga

SEQ ID NO: 273660 - RNA, 19 nt, Homo sapiens
gauacgugacaaagcaauu

SEQ ID NO: 273661 - RNA, 19 nt, Homo sapiens
gcugauuguuccaccaaag

SEQ ID NO: 273662 - RNA, 19 nt, Homo sapiens
agaacuaacaccugugaga

SEQ ID NO: 273663 - RNA, 19 nt, Homo sapiens
cauggaccaacaagcaaua

SEQ ID NO: 273664 - RNA, 19 nt, Homo sapiens
acugucaacccuuggaaua

SEQ ID NO: 273665 - RNA, 19 nt, Homo sapiens
ucaauuugcccugaaacuu

SEQ ID NO: 273666 - RNA, 19 nt, Homo sapiens
cuaacaccugugagaaaua

SEQ ID NO: 273667 - RNA, 19 nt, Homo sapiens
cgagauaaggaugaauuga

SEQ ID NO: 273668 - RNA, 19 nt, Homo sapiens
cagcaacuccgagagaaau

SEQ ID NO: 273669 - RNA, 19 nt, Homo sapiens
ggaugucugucaggguuca

SEQ ID NO: 273670 - RNA, 19 nt, Homo sapiens
aaguguauccugacucuug

SEQ ID NO: 273671 - RNA, 19 nt, Homo sapiens
cagcuguauuuccaucuca

SEQ ID NO: 273672 - RNA, 19 nt, Homo sapiens
gaggugaugcuaaagaaaa

SEQ ID NO: 273673 - RNA, 19 nt, Homo sapiens
gagcaggaauaaaacaaca

SEQ ID NO: 273674 - RNA, 19 nt, Homo sapiens
agacucaggcccagaaagu

SEQ ID NO: 273675 - RNA, 19 nt, Homo sapiens
ggguugaguguuucaguga

SEQ ID NO: 273676 - RNA, 19 nt, Homo sapiens
gggauuauucuccuugucu

SEQ ID NO: 273677 - RNA, 19 nt, Homo sapiens
guucuucaccuucaucucu

SEQ ID NO: 273678 - RNA, 19 nt, Homo sapiens
gcaauauaugcugaguuaa

SEQ ID NO: 273679 - RNA, 19 nt, Homo sapiens
uucagugacauccuuaaua

SEQ ID NO: 273680 - RNA, 19 nt, Homo sapiens
guugaguguuucagugaca

SEQ ID NO: 273681 - RNA, 19 nt, Homo sapiens
gcaguguggacauucaaca

SEQ ID NO: 273682 - RNA, 19 nt, Homo sapiens
gauuauucuccuugucuug

SEQ ID NO: 273683 - RNA, 19 nt, Homo sapiens
caucuguguauucugagua

SEQ ID NO: 273684 - RNA, 19 nt, Homo sapiens
aauaacagucuagcugauu

SEQ ID NO: 273685 - RNA, 19 nt, Homo sapiens
gcagaauugagaguuuguu

SEQ ID NO: 273686 - RNA, 19 nt, Homo sapiens
aauuugcccugaaacuuag

SEQ ID NO: 273687 - RNA, 19 nt, Homo sapiens
ggguucaccuuggcaucaa

SEQ ID NO: 273688 - RNA, 19 nt, Homo sapiens
gauaaggaugaauugauac

SEQ ID NO: 273689 - RNA, 19 nt, Homo sapiens
gucaacccuuggaauaaca

SEQ ID NO: 273690 - RNA, 19 nt, Homo sapiens
cauccuuaauacagaaauc

SEQ ID NO: 273691 - RNA, 19 nt, Homo sapiens
aauaaaguguauccugacu

SEQ ID NO: 273692 - RNA, 19 nt, Homo sapiens
ugucaacccuuggaauaac

SEQ ID NO: 273693 - RNA, 19 nt, Homo sapiens
aguguauccugacucuuga

SEQ ID NO: 273694 - RNA, 19 nt, Homo sapiens
guaguacagaaaucagaug

SEQ ID NO: 273695 - RNA, 19 nt, Homo sapiens
ugucugccauggaccaaca

SEQ ID NO: 273696 - RNA, 19 nt, Homo sapiens
cagaauugagaguuuguuc

SEQ ID NO: 273697 - RNA, 19 nt, Homo sapiens
ucuuaaacugcccaauaua

SEQ ID NO: 273698 - RNA, 19 nt, Homo sapiens
guguuucagugacauccuu

SEQ ID NO: 273699 - RNA, 19 nt, Homo sapiens
uuacuggguugaguguuuc

SEQ ID NO: 273700 - RNA, 19 nt, Homo sapiens
ggaauuaucugucuuaucu

SEQ ID NO: 273701 - RNA, 19 nt, Homo sapiens
caauaaagcuauccagaaa

SEQ ID NO: 273702 - RNA, 19 nt, Homo sapiens
guacagacauccuagcauu

SEQ ID NO: 273703 - RNA, 19 nt, Homo sapiens
guguggaucuucaauaaua

SEQ ID NO: 273704 - RNA, 19 nt, Homo sapiens
guuauucccucuacauuaa

SEQ ID NO: 273705 - RNA, 19 nt, Homo sapiens
gaauagugguugccaaugu

SEQ ID NO: 273706 - RNA, 19 nt, Homo sapiens
gaaauaaccuaugcggaau

SEQ ID NO: 273707 - RNA, 19 nt, Homo sapiens
gaaacaggauacacacaau

SEQ ID NO: 273708 - RNA, 19 nt, Homo sapiens
guacacgacacuucaauaa

SEQ ID NO: 273709 - RNA, 19 nt, Homo sapiens
ggagacagaaaguagaaua

SEQ ID NO: 273710 - RNA, 19 nt, Homo sapiens
ggauugguguguuucguaa

SEQ ID NO: 273711 - RNA, 19 nt, Homo sapiens
guaacacguugaugagaaa

SEQ ID NO: 273712 - RNA, 19 nt, Homo sapiens
caguguggaucuucaauaa

SEQ ID NO: 273713 - RNA, 19 nt, Homo sapiens
gguuguaacucugcgaaua

SEQ ID NO: 273714 - RNA, 19 nt, Homo sapiens
agcauaagcuuuagaggua

SEQ ID NO: 273715 - RNA, 19 nt, Homo sapiens
gaagauugcaggcauuguu

SEQ ID NO: 273716 - RNA, 19 nt, Homo sapiens
gcgaauauacuaaacauca

SEQ ID NO: 273717 - RNA, 19 nt, Homo sapiens
aaaguugcauguuauguga

SEQ ID NO: 273718 - RNA, 19 nt, Homo sapiens
cugcaaagauuuaccauca

SEQ ID NO: 273719 - RNA, 19 nt, Homo sapiens
gaacaggaaauaaccuaug

SEQ ID NO: 273720 - RNA, 19 nt, Homo sapiens
gacagaaaguagaauagug

SEQ ID NO: 273721 - RNA, 19 nt, Homo sapiens
caaagaggcagcaacgaaa

SEQ ID NO: 273722 - RNA, 19 nt, Homo sapiens
acacgacacuucaauaaag

SEQ ID NO: 273723 - RNA, 19 nt, Homo sapiens
ugaaauguaugcuuuguac

SEQ ID NO: 273724 - RNA, 19 nt, Homo sapiens
gguaaagcguuugcauuug

SEQ ID NO: 273725 - RNA, 19 nt, Homo sapiens
aauaaccuaugcggaauua

SEQ ID NO: 273726 - RNA, 19 nt, Homo sapiens
ggauacacacaauuacuaa

SEQ ID NO: 273727 - RNA, 19 nt, Homo sapiens
guaaagcguuugcauuugc

SEQ ID NO: 273728 - RNA, 19 nt, Homo sapiens
gaagaacuccagucugcuu

SEQ ID NO: 273729 - RNA, 19 nt, Homo sapiens
ccagagaagcucauuguug

SEQ ID NO: 273730 - RNA, 19 nt, Homo sapiens
cagauaaugcugaacuuaa

SEQ ID NO: 273731 - RNA, 19 nt, Homo sapiens
uaaccuaugcggaauuaaa

SEQ ID NO: 273732 - RNA, 19 nt, Homo sapiens
gcauaagcuuuagagguaa

SEQ ID NO: 273733 - RNA, 19 nt, Homo sapiens
guugggauccugggaauua

SEQ ID NO: 273734 - RNA, 19 nt, Homo sapiens
ccaaagaggcagcaacgaa

SEQ ID NO: 273735 - RNA, 19 nt, Homo sapiens
gugcagugcuacaaguaaa

SEQ ID NO: 273736 - RNA, 19 nt, Homo sapiens
gccuuuaaauuucaccuuu

SEQ ID NO: 273737 - RNA, 19 nt, Homo sapiens
ucaauaaagcuauccagaa

SEQ ID NO: 273738 - RNA, 19 nt, Homo sapiens
caacaugguauuugugguu

SEQ ID NO: 273739 - RNA, 19 nt, Homo sapiens
gauuacauauuccaacagu

SEQ ID NO: 273740 - RNA, 19 nt, Homo sapiens
ucagaaagcacgucauugu

SEQ ID NO: 273741 - RNA, 19 nt, Homo sapiens
guucuugucuuggauuuau

SEQ ID NO: 273742 - RNA, 19 nt, Homo sapiens
ccagucugcuuucuauaga

SEQ ID NO: 273743 - RNA, 19 nt, Homo sapiens
uaaccuggccucuccacua

SEQ ID NO: 273744 - RNA, 19 nt, Homo sapiens
ucaaacccauggagacaga

SEQ ID NO: 273745 - RNA, 19 nt, Homo sapiens
gagguaaagcguuugcauu

SEQ ID NO: 273746 - RNA, 19 nt, Homo sapiens
gaauacaagaacucagaaa

SEQ ID NO: 273747 - RNA, 19 nt, Homo sapiens
cuuaauggccucuguggua

SEQ ID NO: 273748 - RNA, 19 nt, Homo sapiens
uaacagcagucaucaucca

SEQ ID NO: 273749 - RNA, 19 nt, Homo sapiens
aggaguggauuacauauuc

SEQ ID NO: 273750 - RNA, 19 nt, Homo sapiens
uuaauggccucugugguaa

SEQ ID NO: 273751 - RNA, 19 nt, Homo sapiens
agagauggauaaccaagga

SEQ ID NO: 273752 - RNA, 19 nt, Homo sapiens
gaaguaccaagaacaguca

SEQ ID NO: 273753 - RNA, 19 nt, Homo sapiens
gggugacaaugaaugguuu

SEQ ID NO: 273754 - RNA, 19 nt, Homo sapiens
gcacgucauuguggccauu

SEQ ID NO: 273755 - RNA, 19 nt, Homo sapiens
caacugaacaggaaauaac

SEQ ID NO: 273756 - RNA, 19 nt, Homo sapiens
aaccuggccucuccacuaa

SEQ ID NO: 273757 - RNA, 19 nt, Homo sapiens
gcaacugaacaggaaauaa

SEQ ID NO: 273758 - RNA, 19 nt, Homo sapiens
aacaggauacacacaauua

SEQ ID NO: 273759 - RNA, 19 nt, Homo sapiens
gcagugcaucagauaaauu

SEQ ID NO: 273760 - RNA, 19 nt, Homo sapiens
guaaaucgacuuaaaucag

SEQ ID NO: 273761 - RNA, 19 nt, Homo sapiens
caaugaaugguuuggcuuu

SEQ ID NO: 273762 - RNA, 19 nt, Homo sapiens
agucugcuuucuauagaua

SEQ ID NO: 273763 - RNA, 19 nt, Homo sapiens
gaacuccagucugcuuucu

SEQ ID NO: 273764 - RNA, 19 nt, Homo sapiens
uacaagaacucagaaagca

SEQ ID NO: 273765 - RNA, 19 nt, Homo sapiens
auacagaggcacaacaauu

SEQ ID NO: 273766 - RNA, 19 nt, Homo sapiens
gugcaucagauaaauugua

SEQ ID NO: 273767 - RNA, 19 nt, Homo sapiens
aagaagaacuugggaagag

SEQ ID NO: 273768 - RNA, 19 nt, Homo sapiens
gaggaguggauuacauauu

SEQ ID NO: 273769 - RNA, 19 nt, Homo sapiens
aguaacacguugaugagaa

SEQ ID NO: 273770 - RNA, 19 nt, Homo sapiens
cuacauugguaaggaaaga

SEQ ID NO: 273771 - RNA, 19 nt, Homo sapiens
caaaaccuaucacugcaaa

SEQ ID NO: 273772 - RNA, 19 nt, Homo sapiens
cugcagagauggauaacca

SEQ ID NO: 273773 - RNA, 19 nt, Homo sapiens
ugaaacaggauacacacaa

SEQ ID NO: 273774 - RNA, 19 nt, Homo sapiens
gguaaggaaagaagaacuu

SEQ ID NO: 273775 - RNA, 19 nt, Homo sapiens
uuuagcaacugaacaggaa

SEQ ID NO: 273776 - RNA, 19 nt, Homo sapiens
caugaaauguaugcuuugu

SEQ ID NO: 273777 - RNA, 19 nt, Homo sapiens
uaacucugcgaauauacua

SEQ ID NO: 273778 - RNA, 19 nt, Homo sapiens
aaacaggauacacacaauu

SEQ ID NO: 273779 - RNA, 19 nt, Homo sapiens
agguaaagcguuugcauuu

SEQ ID NO: 273780 - RNA, 19 nt, Homo sapiens
ccaguguggaucuucaaua

SEQ ID NO: 273781 - RNA, 19 nt, Homo sapiens
gauggauaaccaaggagua

SEQ ID NO: 273782 - RNA, 19 nt, Homo sapiens
uaauacagaggcacaacaa

SEQ ID NO: 273783 - RNA, 19 nt, Homo sapiens
ggauaaccaaggaguaauc

SEQ ID NO: 273784 - RNA, 19 nt, Homo sapiens
cuaaaguacagacauccua

SEQ ID NO: 273785 - RNA, 19 nt, Homo sapiens
caucauccaugggugacaa

SEQ ID NO: 273786 - RNA, 19 nt, Homo sapiens
ccucauggauugguguguu

SEQ ID NO: 273787 - RNA, 19 nt, Homo sapiens
agaagaacuugggaagaga

SEQ ID NO: 273788 - RNA, 19 nt, Homo sapiens
uguuauucccucuacauua

SEQ ID NO: 273789 - RNA, 19 nt, Homo sapiens
uaaccaaggaguaaucuac

SEQ ID NO: 273790 - RNA, 19 nt, Homo sapiens
aaaccuaucacugcaaaga

SEQ ID NO: 273791 - RNA, 19 nt, Homo sapiens
uuguaacucugcgaauaua

SEQ ID NO: 273792 - RNA, 19 nt, Homo sapiens
gagacagaaaguagaauag

SEQ ID NO: 273793 - RNA, 19 nt, Homo sapiens
uacagucccugacaucaca

SEQ ID NO: 273794 - RNA, 19 nt, Homo sapiens
agauaaugcugaacuuaac

SEQ ID NO: 273795 - RNA, 19 nt, Homo sapiens
acuccagucugcuuucuau

SEQ ID NO: 273796 - RNA, 19 nt, Homo sapiens
acacugcagagauggauaa

SEQ ID NO: 273797 - RNA, 19 nt, Homo sapiens
guaaggaaagaagaacuug

SEQ ID NO: 273798 - RNA, 19 nt, Homo sapiens
uugcaggcauuguuuguuc

SEQ ID NO: 273799 - RNA, 19 nt, Homo sapiens
guuguaacucugcgaauau

SEQ ID NO: 273800 - RNA, 19 nt, Homo sapiens
ggaauuaucugucuuaucu

SEQ ID NO: 273801 - RNA, 19 nt, Homo sapiens
caauaaagcuauccagaaa

SEQ ID NO: 273802 - RNA, 19 nt, Homo sapiens
guacagacauccuagcauu

SEQ ID NO: 273803 - RNA, 19 nt, Homo sapiens
guguggaucuucaauaaua

SEQ ID NO: 273804 - RNA, 19 nt, Homo sapiens
gaauagugguugccaaugu

SEQ ID NO: 273805 - RNA, 19 nt, Homo sapiens
gaaauaaccuaugcggaau

SEQ ID NO: 273806 - RNA, 19 nt, Homo sapiens
gaaacaggauacacacaau

SEQ ID NO: 273807 - RNA, 19 nt, Homo sapiens
guacacgacacuucaauaa

SEQ ID NO: 273808 - RNA, 19 nt, Homo sapiens
ggagacagaaaguagaaua

SEQ ID NO: 273809 - RNA, 19 nt, Homo sapiens
ggauugguguguuucguaa

SEQ ID NO: 273810 - RNA, 19 nt, Homo sapiens
caguguggaucuucaauaa

SEQ ID NO: 273811 - RNA, 19 nt, Homo sapiens
gguuguaacucugcgaaua

SEQ ID NO: 273812 - RNA, 19 nt, Homo sapiens
agcauaagcuuuagaggua

SEQ ID NO: 273813 - RNA, 19 nt, Homo sapiens
guuauucccucacgucauu

SEQ ID NO: 273814 - RNA, 19 nt, Homo sapiens
gcgaauauacuaaacauca

SEQ ID NO: 273815 - RNA, 19 nt, Homo sapiens
aaaguugcauguuauguga

SEQ ID NO: 273816 - RNA, 19 nt, Homo sapiens
cugcaaagauuuaccauca

SEQ ID NO: 273817 - RNA, 19 nt, Homo sapiens
gaacaggaaauaaccuaug

SEQ ID NO: 273818 - RNA, 19 nt, Homo sapiens
gacagaaaguagaauagug

SEQ ID NO: 273819 - RNA, 19 nt, Homo sapiens
caaagaggcagcaacgaaa

SEQ ID NO: 273820 - RNA, 19 nt, Homo sapiens
acacgacacuucaauaaag

SEQ ID NO: 273821 - RNA, 19 nt, Homo sapiens
ugaaauguaugcuuuguac

SEQ ID NO: 273822 - RNA, 19 nt, Homo sapiens
gguaaagcguuugcauuug

SEQ ID NO: 273823 - RNA, 19 nt, Homo sapiens
aauaaccuaugcggaauua

SEQ ID NO: 273824 - RNA, 19 nt, Homo sapiens
ggauacacacaauuacuaa

SEQ ID NO: 273825 - RNA, 19 nt, Homo sapiens
guaaagcguuugcauuugc

SEQ ID NO: 273826 - RNA, 19 nt, Homo sapiens
gaagaacuccagucugcuu

SEQ ID NO: 273827 - RNA, 19 nt, Homo sapiens
ccagagaagcucauuguug

SEQ ID NO: 273828 - RNA, 19 nt, Homo sapiens
cagauaaugcugaacuuaa

SEQ ID NO: 273829 - RNA, 19 nt, Homo sapiens
uaaccuaugcggaauuaaa

SEQ ID NO: 273830 - RNA, 19 nt, Homo sapiens
gcauaagcuuuagagguaa

SEQ ID NO: 273831 - RNA, 19 nt, Homo sapiens
guugggauccugggaauua

SEQ ID NO: 273832 - RNA, 19 nt, Homo sapiens
ccaaagaggcagcaacgaa

SEQ ID NO: 273833 - RNA, 19 nt, Homo sapiens
gugcagugcuacaaguaaa

SEQ ID NO: 273834 - RNA, 19 nt, Homo sapiens
gccuuuaaauuucaccuuu

SEQ ID NO: 273835 - RNA, 19 nt, Homo sapiens
ucaauaaagcuauccagaa

SEQ ID NO: 273836 - RNA, 19 nt, Homo sapiens
caacaugguauuugugguu

SEQ ID NO: 273837 - RNA, 19 nt, Homo sapiens
guucuugucuuggauuuau

SEQ ID NO: 273838 - RNA, 19 nt, Homo sapiens
gauuacauauuccaacagu

SEQ ID NO: 273839 - RNA, 19 nt, Homo sapiens
uaaccuggccucuccacua

SEQ ID NO: 273840 - RNA, 19 nt, Homo sapiens
ccagucugcuuucuauaga

SEQ ID NO: 273841 - RNA, 19 nt, Homo sapiens
ucaaacccauggagacaga

SEQ ID NO: 273842 - RNA, 19 nt, Homo sapiens
gagguaaagcguuugcauu

SEQ ID NO: 273843 - RNA, 19 nt, Homo sapiens
cuuaauggccucuguggua

SEQ ID NO: 273844 - RNA, 19 nt, Homo sapiens
uaacagcagucaucaucca

SEQ ID NO: 273845 - RNA, 19 nt, Homo sapiens
aggaguggauuacauauuc

SEQ ID NO: 273846 - RNA, 19 nt, Homo sapiens
uuaauggccucugugguaa

SEQ ID NO: 273847 - RNA, 19 nt, Homo sapiens
agagauggauaaccaagga

SEQ ID NO: 273848 - RNA, 19 nt, Homo sapiens
gaaguaccaagaacaguca

SEQ ID NO: 273849 - RNA, 19 nt, Homo sapiens
aaccuggccucuccacuaa

SEQ ID NO: 273850 - RNA, 19 nt, Homo sapiens
gggugacaaugaaugguuu

SEQ ID NO: 273851 - RNA, 19 nt, Homo sapiens
caacugaacaggaaauaac

SEQ ID NO: 273852 - RNA, 19 nt, Homo sapiens
gcaacugaacaggaaauaa

SEQ ID NO: 273853 - RNA, 19 nt, Homo sapiens
aacaggauacacacaauua

SEQ ID NO: 273854 - RNA, 19 nt, Homo sapiens
gcagugcaucagauaaauu

SEQ ID NO: 273855 - RNA, 19 nt, Homo sapiens
guaaaucgacuuaaaucag

SEQ ID NO: 273856 - RNA, 19 nt, Homo sapiens
caaugaaugguuuggcuuu

SEQ ID NO: 273857 - RNA, 19 nt, Homo sapiens
agucugcuuucuauagaua

SEQ ID NO: 273858 - RNA, 19 nt, Homo sapiens
gaacuccagucugcuuucu

SEQ ID NO: 273859 - RNA, 19 nt, Homo sapiens
gugcaucagauaaauugua

SEQ ID NO: 273860 - RNA, 19 nt, Homo sapiens
aagaagaacuugggaagag

SEQ ID NO: 273861 - RNA, 19 nt, Homo sapiens
gaggaguggauuacauauu

SEQ ID NO: 273862 - RNA, 19 nt, Homo sapiens
cugcagagauggauaacca

SEQ ID NO: 273863 - RNA, 19 nt, Homo sapiens
cuacauugguaaggaaaga

SEQ ID NO: 273864 - RNA, 19 nt, Homo sapiens
caaaaccuaucacugcaaa

SEQ ID NO: 273865 - RNA, 19 nt, Homo sapiens
ugaaacaggauacacacaa

SEQ ID NO: 273866 - RNA, 19 nt, Homo sapiens
gguaaggaaagaagaacuu

SEQ ID NO: 273867 - RNA, 19 nt, Homo sapiens
uuuagcaacugaacaggaa

SEQ ID NO: 273868 - RNA, 19 nt, Homo sapiens
caugaaauguaugcuuugu

SEQ ID NO: 273869 - RNA, 19 nt, Homo sapiens
uaacucugcgaauauacua

SEQ ID NO: 273870 - RNA, 19 nt, Homo sapiens
aaacaggauacacacaauu

SEQ ID NO: 273871 - RNA, 19 nt, Homo sapiens
agguaaagcguuugcauuu

SEQ ID NO: 273872 - RNA, 19 nt, Homo sapiens
ccaguguggaucuucaaua

SEQ ID NO: 273873 - RNA, 19 nt, Homo sapiens
gauggauaaccaaggagua

SEQ ID NO: 273874 - RNA, 19 nt, Homo sapiens
ggauaaccaaggaguaauc

SEQ ID NO: 273875 - RNA, 19 nt, Homo sapiens
cuaaaguacagacauccua

SEQ ID NO: 273876 - RNA, 19 nt, Homo sapiens
caucauccaugggugacaa

SEQ ID NO: 273877 - RNA, 19 nt, Homo sapiens
ccucauggauugguguguu

SEQ ID NO: 273878 - RNA, 19 nt, Homo sapiens
agaagaacuugggaagaga

SEQ ID NO: 273879 - RNA, 19 nt, Homo sapiens
uaaccaaggaguaaucuac

SEQ ID NO: 273880 - RNA, 19 nt, Homo sapiens
aaaccuaucacugcaaaga

SEQ ID NO: 273881 - RNA, 19 nt, Homo sapiens
uuguaacucugcgaauaua

SEQ ID NO: 273882 - RNA, 19 nt, Homo sapiens
gagacagaaaguagaauag

SEQ ID NO: 273883 - RNA, 19 nt, Homo sapiens
acacugcagagauggauaa

SEQ ID NO: 273884 - RNA, 19 nt, Homo sapiens
agauaaugcugaacuuaac

SEQ ID NO: 273885 - RNA, 19 nt, Homo sapiens
acuccagucugcuuucuau

SEQ ID NO: 273886 - RNA, 19 nt, Homo sapiens
guaaggaaagaagaacuug

SEQ ID NO: 273887 - RNA, 19 nt, Homo sapiens
uacagucccugacaucaca

SEQ ID NO: 273888 - RNA, 19 nt, Homo sapiens
guuguaacucugcgaauau

SEQ ID NO: 273889 - RNA, 19 nt, Homo sapiens
gaacagucaaacccaugga

SEQ ID NO: 273890 - RNA, 19 nt, Homo sapiens
uuaugugagucagcuuaua

SEQ ID NO: 273891 - RNA, 19 nt, Homo sapiens
cguaacagcagucaucauc

SEQ ID NO: 273892 - RNA, 19 nt, Homo sapiens
acagacauccuagcauuug

SEQ ID NO: 273893 - RNA, 19 nt, Homo sapiens
cagugcaucagauaaauug

SEQ ID NO: 273894 - RNA, 19 nt, Homo sapiens
gagauaaaagacucagaua

SEQ ID NO: 273895 - RNA, 19 nt, Homo sapiens
agaguuugcuggccuguac

SEQ ID NO: 273896 - RNA, 19 nt, Homo sapiens
cugaggaguggauuacaua

SEQ ID NO: 273897 - RNA, 19 nt, Homo sapiens
acacuucaauaaagcuauc

SEQ ID NO: 273898 - RNA, 19 nt, Homo sapiens
uauaggaaguaccaagaac

SEQ ID NO: 273899 - RNA, 19 nt, Homo sapiens
accuaucacugcaaagauu

SEQ ID NO: 273900 - RNA, 19 nt, Homo sapiens
caauaaagcuauccagaaa

SEQ ID NO: 273901 - RNA, 19 nt, Homo sapiens
gaaauaggaugcacacaau

SEQ ID NO: 273902 - RNA, 19 nt, Homo sapiens
guacagacauccuagcauu

SEQ ID NO: 273903 - RNA, 19 nt, Homo sapiens
guacaugacacuucaauaa

SEQ ID NO: 273904 - RNA, 19 nt, Homo sapiens
ucacacagcugcagagaug

SEQ ID NO: 273905 - RNA, 19 nt, Homo sapiens
gaaccgaacaggaaauauu

SEQ ID NO: 273906 - RNA, 19 nt, Homo sapiens
gaauagugguugccaaugu

SEQ ID NO: 273907 - RNA, 19 nt, Homo sapiens
agcauaagcuuuagaagua

SEQ ID NO: 273908 - RNA, 19 nt, Homo sapiens
gcagaaagcacgucauugu

SEQ ID NO: 273909 - RNA, 19 nt, Homo sapiens
guguggaucuucaaugaua

SEQ ID NO: 273910 - RNA, 19 nt, Homo sapiens
gcagagaugaguaaacaaa

SEQ ID NO: 273911 - RNA, 19 nt, Homo sapiens
gguuguaacuuugcgaaua

SEQ ID NO: 273912 - RNA, 19 nt, Homo sapiens
ggagacagaaaguagaaua

SEQ ID NO: 273913 - RNA, 19 nt, Homo sapiens
ggauugguguguuucguaa

SEQ ID NO: 273914 - RNA, 19 nt, Homo sapiens
gcauaagcuuuagaaguaa

SEQ ID NO: 273915 - RNA, 19 nt, Homo sapiens
gcgaauauacuaaacauca

SEQ ID NO: 273916 - RNA, 19 nt, Homo sapiens
aaaguugcauguuauguga

SEQ ID NO: 273917 - RNA, 19 nt, Homo sapiens
gacagaaaguagaauagug

SEQ ID NO: 273918 - RNA, 19 nt, Homo sapiens
ugaaauguaugcuuuguac

SEQ ID NO: 273919 - RNA, 19 nt, Homo sapiens
ggugaugguuguaacuuug

SEQ ID NO: 273920 - RNA, 19 nt, Homo sapiens
caguguggaucuucaauga

SEQ ID NO: 273921 - RNA, 19 nt, Homo sapiens
gaagaacuccagucugcuu

SEQ ID NO: 273922 - RNA, 19 nt, Homo sapiens
guuguaacuuugcgaauau

SEQ ID NO: 273923 - RNA, 19 nt, Homo sapiens
aauaggaugcacacaauua

SEQ ID NO: 273924 - RNA, 19 nt, Homo sapiens
cagauaaugcugaacuuaa

SEQ ID NO: 273925 - RNA, 19 nt, Homo sapiens
caauaaaugguuuggcuuu

SEQ ID NO: 273926 - RNA, 19 nt, Homo sapiens
gugcagugcuacaaguaaa

SEQ ID NO: 273927 - RNA, 19 nt, Homo sapiens
ucaauaaagcuauccagaa

SEQ ID NO: 273928 - RNA, 19 nt, Homo sapiens
caacaugguauuugugguu

SEQ ID NO: 273929 - RNA, 19 nt, Homo sapiens
uaaaugguuuggcuuucaa

SEQ ID NO: 273930 - RNA, 19 nt, Homo sapiens
gauuacauauuccaacagu

SEQ ID NO: 273931 - RNA, 19 nt, Homo sapiens
ccugauggccacuguguua

SEQ ID NO: 273932 - RNA, 19 nt, Homo sapiens
agagaugaguaaacaaaga

SEQ ID NO: 273933 - RNA, 19 nt, Homo sapiens
ccagucugcuuucuauaga

SEQ ID NO: 273934 - RNA, 19 nt, Homo sapiens
ucaaacccauggagacaga

SEQ ID NO: 273935 - RNA, 19 nt, Homo sapiens
ugaaauaggaugcacacaa

SEQ ID NO: 273936 - RNA, 19 nt, Homo sapiens
uaacagcagucaucaucca

SEQ ID NO: 273937 - RNA, 19 nt, Homo sapiens
aggaguggauuacauauuc

SEQ ID NO: 273938 - RNA, 19 nt, Homo sapiens
gaaguaccaagaacaguca

SEQ ID NO: 273939 - RNA, 19 nt, Homo sapiens
gcacgucauuguggccauu

SEQ ID NO: 273940 - RNA, 19 nt, Homo sapiens
ggaugcacacaauuacuaa

SEQ ID NO: 273941 - RNA, 19 nt, Homo sapiens
caaagcggcagcaaaggaa

SEQ ID NO: 273942 - RNA, 19 nt, Homo sapiens
guaaaucgacuuaaaucag

SEQ ID NO: 273943 - RNA, 19 nt, Homo sapiens
cuaggaaucauuugcauug

SEQ ID NO: 273944 - RNA, 19 nt, Homo sapiens
ggaaaccuaaaggcaauaa

SEQ ID NO: 273945 - RNA, 19 nt, Homo sapiens
agucugcuuucuauagaua

SEQ ID NO: 273946 - RNA, 19 nt, Homo sapiens
gaacuccagucugcuuucu

SEQ ID NO: 273947 - RNA, 19 nt, Homo sapiens
acaugacacuucaauaaag

SEQ ID NO: 273948 - RNA, 19 nt, Homo sapiens
cugcagagaugaguaaaca

SEQ ID NO: 273949 - RNA, 19 nt, Homo sapiens
aaguaaagcauuugcguuu

SEQ ID NO: 273950 - RNA, 19 nt, Homo sapiens
aagaagaacuugggaagag

SEQ ID NO: 273951 - RNA, 19 nt, Homo sapiens
gaggaguggauuacauauu

SEQ ID NO: 273952 - RNA, 19 nt, Homo sapiens
aaggaaaccuaaaggcaau

SEQ ID NO: 273953 - RNA, 19 nt, Homo sapiens
ccaaagcggcagcaaagga

SEQ ID NO: 273954 - RNA, 19 nt, Homo sapiens
auauaugacugccaagguu

SEQ ID NO: 273955 - RNA, 19 nt, Homo sapiens
aaacaaagaggaaccuucu

SEQ ID NO: 273956 - RNA, 19 nt, Homo sapiens
guaauggugaugguuguaa

SEQ ID NO: 273957 - RNA, 19 nt, Homo sapiens
gggugacaauaaaugguuu

SEQ ID NO: 273958 - RNA, 19 nt, Homo sapiens
gguaaggaaagaagaacuu

SEQ ID NO: 273959 - RNA, 19 nt, Homo sapiens
gagcacagucccucacauc

SEQ ID NO: 273960 - RNA, 19 nt, Homo sapiens
caugaaauguaugcuuugu

SEQ ID NO: 273961 - RNA, 19 nt, Homo sapiens
uuaccuuccucauggauug

SEQ ID NO: 273962 - RNA, 19 nt, Homo sapiens
cacagucccucacaucaca

SEQ ID NO: 273963 - RNA, 19 nt, Homo sapiens
aaagaggaaccuucucaga

SEQ ID NO: 273964 - RNA, 19 nt, Homo sapiens
cagcaaaggaaaccuaaag

SEQ ID NO: 273965 - RNA, 19 nt, Homo sapiens
cuaaaguacagacauccua

SEQ ID NO: 273966 - RNA, 19 nt, Homo sapiens
gaaaccuaaaggcaauaaa

SEQ ID NO: 273967 - RNA, 19 nt, Homo sapiens
acaaagaggaaccuucuca

SEQ ID NO: 273968 - RNA, 19 nt, Homo sapiens
caucauccaugggugacaa

SEQ ID NO: 273969 - RNA, 19 nt, Homo sapiens
ccucauggauugguguguu

SEQ ID NO: 273970 - RNA, 19 nt, Homo sapiens
agaagaacuugggaagaga

SEQ ID NO: 273971 - RNA, 19 nt, Homo sapiens
auaaaugguuuggcuuuca

SEQ ID NO: 273972 - RNA, 19 nt, Homo sapiens
auccaugggugacaauaaa

SEQ ID NO: 273973 - RNA, 19 nt, Homo sapiens
cagcugcagagaugaguaa

SEQ ID NO: 273974 - RNA, 19 nt, Homo sapiens
gagacagaaaguagaauag

SEQ ID NO: 273975 - RNA, 19 nt, Homo sapiens
agauaaugcugaacuuaac

SEQ ID NO: 273976 - RNA, 19 nt, Homo sapiens
acuccagucugcuuucuau

SEQ ID NO: 273977 - RNA, 19 nt, Homo sapiens
guaaggaaagaagaacuug

SEQ ID NO: 273978 - RNA, 19 nt, Homo sapiens
gagguccuaggaaucauuu

SEQ ID NO: 273979 - RNA, 19 nt, Homo sapiens
gaacagucaaacccaugga

SEQ ID NO: 273980 - RNA, 19 nt, Homo sapiens
uuaugugagucagcuuaua

SEQ ID NO: 273981 - RNA, 19 nt, Homo sapiens
cguaacagcagucaucauc

SEQ ID NO: 273982 - RNA, 19 nt, Homo sapiens
acagacauccuagcauuug

SEQ ID NO: 273983 - RNA, 19 nt, Homo sapiens
cagugcaucagauacauuu

SEQ ID NO: 273984 - RNA, 19 nt, Homo sapiens
agaguuugcuggccuguac

SEQ ID NO: 273985 - RNA, 19 nt, Homo sapiens
cugaggaguggauuacaua

SEQ ID NO: 273986 - RNA, 19 nt, Homo sapiens
gaauacaagaacgcagaaa

SEQ ID NO: 273987 - RNA, 19 nt, Homo sapiens
uggugaugguuguaacuuu

SEQ ID NO: 273988 - RNA, 19 nt, Homo sapiens
gcaauaaaagcuccauuuc

SEQ ID NO: 273989 - RNA, 19 nt, Homo sapiens
gagaugaguaaacaaagag

SEQ ID NO: 273990 - RNA, 19 nt, Homo sapiens
guggaucuucaaugauaua

SEQ ID NO: 273991 - RNA, 19 nt, Homo sapiens
cauccaugggugacaauaa

SEQ ID NO: 273992 - RNA, 19 nt, Homo sapiens
caaaauccuucccugaauc

SEQ ID NO: 273993 - RNA, 19 nt, Homo sapiens
gcagcaaaggaaaccuaaa

SEQ ID NO: 273994 - RNA, 19 nt, Homo sapiens
acacuucaauaaagcuauc

SEQ ID NO: 273995 - RNA, 19 nt, Homo sapiens
uauaggaaguaccaagaac

SEQ ID NO: 273996 - RNA, 19 nt, Homo sapiens
ucaaaauccuucccugaau

SEQ ID NO: 273997 - RNA, 19 nt, Homo sapiens
cagaaagcacgucauugug

SEQ ID NO: 273998 - RNA, 19 nt, Homo sapiens
gacccaaagcggcagcaaa

SEQ ID NO: 273999 - RNA, 19 nt, Homo sapiens
gugagucagcuuauaggaa

SEQ ID NO: 274000 - RNA, 19 nt, Homo sapiens
gaacguaacugugcaaugc

SEQ ID NO: 274001 - RNA, 19 nt, Homo sapiens
ucacacagcugcagagaug

SEQ ID NO: 274002 - RNA, 19 nt, Homo sapiens
gaaccgaacaggaaauauu

SEQ ID NO: 274003 - RNA, 19 nt, Homo sapiens
ccauuuagcuuguguuuua

SEQ ID NO: 274004 - RNA, 19 nt, Homo sapiens
ggauugguguguuucguaa

SEQ ID NO: 274005 - RNA, 19 nt, Homo sapiens
gcagaaagcacguccuugu

SEQ ID NO: 274006 - RNA, 19 nt, Homo sapiens
gcagagaugaauaaacaaa

SEQ ID NO: 274007 - RNA, 19 nt, Homo sapiens
cugcagagaugaauaaaca

SEQ ID NO: 274008 - RNA, 19 nt, Homo sapiens
acauguacguggacuuaua

SEQ ID NO: 274009 - RNA, 19 nt, Homo sapiens
gaacucuucuagucugcuu

SEQ ID NO: 274010 - RNA, 19 nt, Homo sapiens
caauaaaugguuuggcuuu

SEQ ID NO: 274011 - RNA, 19 nt, Homo sapiens
uaaaugguuuggcuuucaa

SEQ ID NO: 274012 - RNA, 19 nt, Homo sapiens
gauuacauauuccaacagu

SEQ ID NO: 274013 - RNA, 19 nt, Homo sapiens
ccugauggccacuguguua

SEQ ID NO: 274014 - RNA, 19 nt, Homo sapiens
ccaaguagaauuaaaccuu

SEQ ID NO: 274015 - RNA, 19 nt, Homo sapiens
gaacuccugagcucaagaa

SEQ ID NO: 274016 - RNA, 19 nt, Homo sapiens
cuacauguacguggacuua

SEQ ID NO: 274017 - RNA, 19 nt, Homo sapiens
cuucuagucugcuuucuau

SEQ ID NO: 274018 - RNA, 19 nt, Homo sapiens
cuccugagcucaagaaauc

SEQ ID NO: 274019 - RNA, 19 nt, Homo sapiens
uaacagcagucaucaucca

SEQ ID NO: 274020 - RNA, 19 nt, Homo sapiens
aggaguggauuacauauuc

SEQ ID NO: 274021 - RNA, 19 nt, Homo sapiens
caaagccgcagcaaaggaa

SEQ ID NO: 274022 - RNA, 19 nt, Homo sapiens
cuaggaaucauuugcauug

SEQ ID NO: 274023 - RNA, 19 nt, Homo sapiens
ggaaaccuaaaggcaauaa

SEQ ID NO: 274024 - RNA, 19 nt, Homo sapiens
agucugcuuucuauagaua

SEQ ID NO: 274025 - RNA, 19 nt, Homo sapiens
gcacguccuuguggccauu

SEQ ID NO: 274026 - RNA, 19 nt, Homo sapiens
cagcugcagagaugaauaa

SEQ ID NO: 274027 - RNA, 19 nt, Homo sapiens
cuagucugcuuucuauaga

SEQ ID NO: 274028 - RNA, 19 nt, Homo sapiens
gaggaguggauuacauauu

SEQ ID NO: 274029 - RNA, 19 nt, Homo sapiens
ucaaaaugcuucucugaau

SEQ ID NO: 274030 - RNA, 19 nt, Homo sapiens
aaggaaaccuaaaggcaau

SEQ ID NO: 274031 - RNA, 19 nt, Homo sapiens
uacguggacuuauaucaga

SEQ ID NO: 274032 - RNA, 19 nt, Homo sapiens
auauaugacugccaagguu

SEQ ID NO: 274033 - RNA, 19 nt, Homo sapiens
cagaucaugcugaacguaa

SEQ ID NO: 274034 - RNA, 19 nt, Homo sapiens
gggugacaauaaaugguuu

SEQ ID NO: 274035 - RNA, 19 nt, Homo sapiens
aaacaaagaggaaccuucu

SEQ ID NO: 274036 - RNA, 19 nt, Homo sapiens
gcauuagucauuuacaaca

SEQ ID NO: 274037 - RNA, 19 nt, Homo sapiens
gagcacagucccucacauc

SEQ ID NO: 274038 - RNA, 19 nt, Homo sapiens
gagugcucauguaccauuu

SEQ ID NO: 274039 - RNA, 19 nt, Homo sapiens
uuaccuuccucauggauug

SEQ ID NO: 274040 - RNA, 19 nt, Homo sapiens
gcaggccugugcuucaaag

SEQ ID NO: 274041 - RNA, 19 nt, Homo sapiens
cacagucccucacaucaca

SEQ ID NO: 274042 - RNA, 19 nt, Homo sapiens
aaagaggaaccuucucaga

SEQ ID NO: 274043 - RNA, 19 nt, Homo sapiens
cauguaccauuuagcuugu

SEQ ID NO: 274044 - RNA, 19 nt, Homo sapiens
cucaagaaaucaacacauc

SEQ ID NO: 274045 - RNA, 19 nt, Homo sapiens
caucauccaugggugacaa

SEQ ID NO: 274046 - RNA, 19 nt, Homo sapiens
ccucauggauugguguguu

SEQ ID NO: 274047 - RNA, 19 nt, Homo sapiens
acaaagaggaaccuucuca

SEQ ID NO: 274048 - RNA, 19 nt, Homo sapiens
gaaaccuaaaggcaauaaa

SEQ ID NO: 274049 - RNA, 19 nt, Homo sapiens
cagcaaaggaaaccuaaag

SEQ ID NO: 274050 - RNA, 19 nt, Homo sapiens
auaaaugguuuggcuuuca

SEQ ID NO: 274051 - RNA, 19 nt, Homo sapiens
auccaugggugacaauaaa

SEQ ID NO: 274052 - RNA, 19 nt, Homo sapiens
gagguccuaggaaucauuu

SEQ ID NO: 274053 - RNA, 19 nt, Homo sapiens
caaaaugcuucucugaauc

SEQ ID NO: 274054 - RNA, 19 nt, Homo sapiens
gcagaccguuaugauugga

SEQ ID NO: 274055 - RNA, 19 nt, Homo sapiens
gugcucauguaccauuuag

SEQ ID NO: 274056 - RNA, 19 nt, Homo sapiens
cguaacagcagucaucauc

SEQ ID NO: 274057 - RNA, 19 nt, Homo sapiens
ggccugugcuucaaagaac

SEQ ID NO: 274058 - RNA, 19 nt, Homo sapiens
ccaaguugcugggauuacu

SEQ ID NO: 274059 - RNA, 19 nt, Homo sapiens
ccaaagccgcagcaaagga

SEQ ID NO: 274060 - RNA, 19 nt, Homo sapiens
gauaaaagacucagaucau

SEQ ID NO: 274061 - RNA, 19 nt, Homo sapiens
cugaggaguggauuacaua

SEQ ID NO: 274062 - RNA, 19 nt, Homo sapiens
gaauacaagaacgcagaaa

SEQ ID NO: 274063 - RNA, 19 nt, Homo sapiens
augcuucucugaaucauca

SEQ ID NO: 274064 - RNA, 19 nt, Homo sapiens
gcaauaaaagcuccauuuc

SEQ ID NO: 274065 - RNA, 19 nt, Homo sapiens
guacguggacuuauaucag

SEQ ID NO: 274066 - RNA, 19 nt, Homo sapiens
cauccaugggugacaauaa

SEQ ID NO: 274067 - RNA, 19 nt, Homo sapiens
gcagcaaaggaaaccuaaa

SEQ ID NO: 274068 - RNA, 19 nt, Homo sapiens
agaccguuaugauuggaaa

SEQ ID NO: 274069 - RNA, 19 nt, Homo sapiens
gacccaaagccgcagcaaa

SEQ ID NO: 274070 - RNA, 19 nt, Homo sapiens
ccugaggaguggauuacau

SEQ ID NO: 274071 - RNA, 19 nt, Homo sapiens
augcagaccguuaugauug

SEQ ID NO: 274072 - RNA, 19 nt, Homo sapiens
gcucauguaccauuuagcu

SEQ ID NO: 274073 - RNA, 19 nt, Homo sapiens
cauguacguggacuuauau

SEQ ID NO: 274074 - RNA, 19 nt, Homo sapiens
aauaaaugguuuggcuuuc

SEQ ID NO: 274075 - RNA, 19 nt, Homo sapiens
aauaaaagcuccauuucag

SEQ ID NO: 274076 - RNA, 19 nt, Homo sapiens
ucaggaaccgaacaggaaa

SEQ ID NO: 274077 - RNA, 19 nt, Homo sapiens
gauggccacuguguuaaaa

SEQ ID NO: 274078 - RNA, 19 nt, Homo sapiens
uauaugacugccaagguuu

SEQ ID NO: 274079 - RNA, 19 nt, Homo sapiens
agaccaguguggaucuuca

SEQ ID NO: 274080 - RNA, 19 nt, Homo sapiens
cagaaagcacguccuugug

SEQ ID NO: 274081 - RNA, 19 nt, Homo sapiens
cucauggauugguguguuu

SEQ ID NO: 274082 - RNA, 19 nt, Homo sapiens
uucccucucuauauaguuu

SEQ ID NO: 274083 - RNA, 19 nt, Homo sapiens
cgaauacaagaacgcagaa

SEQ ID NO: 274084 - RNA, 19 nt, Homo sapiens
gagaugaauaaacaaagag

SEQ ID NO: 274085 - RNA, 19 nt, Homo sapiens
caauaaaagcuccauuuca

SEQ ID NO: 274086 - RNA, 19 nt, Homo sapiens
gcucaagaaaucaacacau

SEQ ID NO: 274087 - RNA, 19 nt, Homo sapiens
acguaacugugcaaugcua

SEQ ID NO: 274088 - RNA, 19 nt, Homo sapiens
ggcaauaaaagcuccauuu

SEQ ID NO: 274089 - RNA, 19 nt, Homo sapiens
acacagcugcagagaugaa

SEQ ID NO: 274090 - RNA, 19 nt, Homo sapiens
gcacagucccucacaucac

SEQ ID NO: 274091 - RNA, 19 nt, Homo sapiens
cauuugcauuguccugaug

SEQ ID NO: 274092 - RNA, 19 nt, Homo sapiens
ucuagucugcuuucuauag

SEQ ID NO: 274093 - RNA, 19 nt, Homo sapiens
ggaguggauuacauauucc

SEQ ID NO: 274094 - RNA, 19 nt, Homo sapiens
ugauggccacuguguuaaa

SEQ ID NO: 274095 - RNA, 19 nt, Homo sapiens
gcucacugccgagguccua

SEQ ID NO: 274096 - RNA, 19 nt, Homo sapiens
ggaaccgaacaggaaauau

SEQ ID NO: 274097 - RNA, 19 nt, Homo sapiens
uaccauuuagcuuguguuu

SEQ ID NO: 274098 - RNA, 19 nt, Homo sapiens
ggcuuucaaacaugagaua

SEQ ID NO: 274099 - RNA, 19 nt, Homo sapiens
ucauuugcauuguccugau

SEQ ID NO: 274100 - RNA, 19 nt, Homo sapiens
gaacguaacugugcaaugc

SEQ ID NO: 274101 - RNA, 19 nt, Homo sapiens
gagcauaagcuuuagaauu

SEQ ID NO: 274102 - RNA, 19 nt, Homo sapiens
gaaccgaacaggaaauauu

SEQ ID NO: 274103 - RNA, 19 nt, Homo sapiens
ggauugguguguuucguaa

SEQ ID NO: 274104 - RNA, 19 nt, Homo sapiens
gcagaaagcacguccuugu

SEQ ID NO: 274105 - RNA, 19 nt, Homo sapiens
acauguacguggacuuaua

SEQ ID NO: 274106 - RNA, 19 nt, Homo sapiens
gaacucuucuagucugcuu

SEQ ID NO: 274107 - RNA, 19 nt, Homo sapiens
caauaaaugguuuggcuuu

SEQ ID NO: 274108 - RNA, 19 nt, Homo sapiens
uaaaugguuuggcuuucaa

SEQ ID NO: 274109 - RNA, 19 nt, Homo sapiens
gauuacauauuccaacagu

SEQ ID NO: 274110 - RNA, 19 nt, Homo sapiens
ccugauggccacuguguua

SEQ ID NO: 274111 - RNA, 19 nt, Homo sapiens
ccaaguagaauuaaaccuu

SEQ ID NO: 274112 - RNA, 19 nt, Homo sapiens
cuacauguacguggacuua

SEQ ID NO: 274113 - RNA, 19 nt, Homo sapiens
cuucuagucugcuuucuau

SEQ ID NO: 274114 - RNA, 19 nt, Homo sapiens
uaacagcagucaucaucca

SEQ ID NO: 274115 - RNA, 19 nt, Homo sapiens
aggaguggauuacauauuc

SEQ ID NO: 274116 - RNA, 19 nt, Homo sapiens
caaagccgcagcaaaggaa

SEQ ID NO: 274117 - RNA, 19 nt, Homo sapiens
cuaggaaucauuugcauug

SEQ ID NO: 274118 - RNA, 19 nt, Homo sapiens
ggaaaccuaaaggcaauaa

SEQ ID NO: 274119 - RNA, 19 nt, Homo sapiens
agucugcuuucuauagaua

SEQ ID NO: 274120 - RNA, 19 nt, Homo sapiens
gcacguccuuguggccauu

SEQ ID NO: 274121 - RNA, 19 nt, Homo sapiens
caagaaucauugugagcau

SEQ ID NO: 274122 - RNA, 19 nt, Homo sapiens
cuagucugcuuucuauaga

SEQ ID NO: 274123 - RNA, 19 nt, Homo sapiens
gaggaguggauuacauauu

SEQ ID NO: 274124 - RNA, 19 nt, Homo sapiens
aaggaaaccuaaaggcaau

SEQ ID NO: 274125 - RNA, 19 nt, Homo sapiens
ucaaaaugcuucucugaau

SEQ ID NO: 274126 - RNA, 19 nt, Homo sapiens
uacguggacuuauaucaga

SEQ ID NO: 274127 - RNA, 19 nt, Homo sapiens
auauaugacugccaagguu

SEQ ID NO: 274128 - RNA, 19 nt, Homo sapiens
aagaaucauugugagcaua

SEQ ID NO: 274129 - RNA, 19 nt, Homo sapiens
cagaucaugcugaacguaa

SEQ ID NO: 274130 - RNA, 19 nt, Homo sapiens
gggugacaauaaaugguuu

SEQ ID NO: 274131 - RNA, 19 nt, Homo sapiens
aaacaaagaggaaccuucu

SEQ ID NO: 274132 - RNA, 19 nt, Homo sapiens
uuaccuuccucauggauug

SEQ ID NO: 274133 - RNA, 19 nt, Homo sapiens
gcaggccugugcuucaaag

SEQ ID NO: 274134 - RNA, 19 nt, Homo sapiens
aaagaggaaccuucucaga

SEQ ID NO: 274135 - RNA, 19 nt, Homo sapiens
auugugagcauaagcuuua

SEQ ID NO: 274136 - RNA, 19 nt, Homo sapiens
gaaaccuaaaggcaauaaa

SEQ ID NO: 274137 - RNA, 19 nt, Homo sapiens
caucauccaugggugacaa

SEQ ID NO: 274138 - RNA, 19 nt, Homo sapiens
ccucauggauugguguguu

SEQ ID NO: 274139 - RNA, 19 nt, Homo sapiens
cagcaaaggaaaccuaaag

SEQ ID NO: 274140 - RNA, 19 nt, Homo sapiens
acaaagaggaaccuucuca

SEQ ID NO: 274141 - RNA, 19 nt, Homo sapiens
auaaaugguuuggcuuuca

SEQ ID NO: 274142 - RNA, 19 nt, Homo sapiens
auccaugggugacaauaaa

SEQ ID NO: 274143 - RNA, 19 nt, Homo sapiens
gagguccuaggaaucauuu

SEQ ID NO: 274144 - RNA, 19 nt, Homo sapiens
caaaaugcuucucugaauc

SEQ ID NO: 274145 - RNA, 19 nt, Homo sapiens
cguaacagcagucaucauc

SEQ ID NO: 274146 - RNA, 19 nt, Homo sapiens
ggccugugcuucaaagaac

SEQ ID NO: 274147 - RNA, 19 nt, Homo sapiens
agaaucauugugagcauaa

SEQ ID NO: 274148 - RNA, 19 nt, Homo sapiens
gauaaaagacucagaucau

SEQ ID NO: 274149 - RNA, 19 nt, Homo sapiens
cugaggaguggauuacaua

SEQ ID NO: 274150 - RNA, 19 nt, Homo sapiens
gaauacaagaacgcagaaa

SEQ ID NO: 274151 - RNA, 19 nt, Homo sapiens
ccaaagccgcagcaaagga

SEQ ID NO: 274152 - RNA, 19 nt, Homo sapiens
augcuucucugaaucauca

SEQ ID NO: 274153 - RNA, 19 nt, Homo sapiens
guacguggacuuauaucag

SEQ ID NO: 274154 - RNA, 19 nt, Homo sapiens
gcaauaaaagcuccauuuc

SEQ ID NO: 274155 - RNA, 19 nt, Homo sapiens
cauccaugggugacaauaa

SEQ ID NO: 274156 - RNA, 19 nt, Homo sapiens
gcagcaaaggaaaccuaaa

SEQ ID NO: 274157 - RNA, 19 nt, Homo sapiens
gugagcauaagcuuuagaa

SEQ ID NO: 274158 - RNA, 19 nt, Homo sapiens
gacccaaagccgcagcaaa

SEQ ID NO: 274159 - RNA, 19 nt, Homo sapiens
ccugaggaguggauuacau

SEQ ID NO: 274160 - RNA, 19 nt, Homo sapiens
cauguacguggacuuauau

SEQ ID NO: 274161 - RNA, 19 nt, Homo sapiens
aauaaaugguuuggcuuuc

SEQ ID NO: 274162 - RNA, 19 nt, Homo sapiens
ucaggaaccgaacaggaaa

SEQ ID NO: 274163 - RNA, 19 nt, Homo sapiens
aauaaaagcuccauuucag

SEQ ID NO: 274164 - RNA, 19 nt, Homo sapiens
uauaugacugccaagguuu

SEQ ID NO: 274165 - RNA, 19 nt, Homo sapiens
gauggccacuguguuaaaa

SEQ ID NO: 274166 - RNA, 19 nt, Homo sapiens
agaccaguguggaucuuca

SEQ ID NO: 274167 - RNA, 19 nt, Homo sapiens
cagaaagcacguccuugug

SEQ ID NO: 274168 - RNA, 19 nt, Homo sapiens
cucauggauugguguguuu

SEQ ID NO: 274169 - RNA, 19 nt, Homo sapiens
cgaauacaagaacgcagaa

SEQ ID NO: 274170 - RNA, 19 nt, Homo sapiens
acguaacugugcaaugcua

SEQ ID NO: 274171 - RNA, 19 nt, Homo sapiens
ggcaauaaaagcuccauuu

SEQ ID NO: 274172 - RNA, 19 nt, Homo sapiens
caauaaaagcuccauuuca

SEQ ID NO: 274173 - RNA, 19 nt, Homo sapiens
cauuugcauuguccugaug

SEQ ID NO: 274174 - RNA, 19 nt, Homo sapiens
ucuagucugcuuucuauag

SEQ ID NO: 274175 - RNA, 19 nt, Homo sapiens
ggaguggauuacauauucc

SEQ ID NO: 274176 - RNA, 19 nt, Homo sapiens
ugauggccacuguguuaaa

SEQ ID NO: 274177 - RNA, 19 nt, Homo sapiens
gcucacugccgagguccua

SEQ ID NO: 274178 - RNA, 19 nt, Homo sapiens
gaaucauugugagcauaag

SEQ ID NO: 274179 - RNA, 19 nt, Homo sapiens
gccgagguccuaggaauca

SEQ ID NO: 274180 - RNA, 19 nt, Homo sapiens
ggcuuucaaacaugagaua

SEQ ID NO: 274181 - RNA, 19 nt, Homo sapiens
ggaaccgaacaggaaauau

SEQ ID NO: 274182 - RNA, 19 nt, Homo sapiens
cugccgagguccuaggaau

SEQ ID NO: 274183 - RNA, 19 nt, Homo sapiens
ucauuugcauuguccugau

SEQ ID NO: 274184 - RNA, 19 nt, Homo sapiens
gaguaaagacccaacauua

SEQ ID NO: 274185 - RNA, 19 nt, Homo sapiens
cagagaagguggagaguaa

SEQ ID NO: 274186 - RNA, 19 nt, Homo sapiens
caacauagaacuccagaaa

SEQ ID NO: 274187 - RNA, 19 nt, Homo sapiens
gaaauucguucaccuacau

SEQ ID NO: 274188 - RNA, 19 nt, Homo sapiens
gagcuccagucaacaauuu

SEQ ID NO: 274189 - RNA, 19 nt, Homo sapiens
guaagcaacagcucauuua

SEQ ID NO: 274190 - RNA, 19 nt, Homo sapiens
gaugaauccugugaagaua

SEQ ID NO: 274191 - RNA, 19 nt, Homo sapiens
gcucugcacucucccagua

SEQ ID NO: 274192 - RNA, 19 nt, Homo sapiens
acauagaacuccagaaaga

SEQ ID NO: 274193 - RNA, 19 nt, Homo sapiens
caccuacauuugagaauua

SEQ ID NO: 274194 - RNA, 19 nt, Homo sapiens
ugacucagccucccaagua

SEQ ID NO: 274195 - RNA, 19 nt, Homo sapiens
aaacacagaugaacuggau

SEQ ID NO: 274196 - RNA, 19 nt, Homo sapiens
gaaaugcuuuagaugaauc

SEQ ID NO: 274197 - RNA, 19 nt, Homo sapiens
gugcaacuguuacuucauu

SEQ ID NO: 274198 - RNA, 19 nt, Homo sapiens
ggaaaugcuuuagaugaau

SEQ ID NO: 274199 - RNA, 19 nt, Homo sapiens
gagaauggcucugcacucu

SEQ ID NO: 274200 - RNA, 19 nt, Homo sapiens
auacaugucucaccaauag

SEQ ID NO: 274201 - RNA, 19 nt, Homo sapiens
gcaagaucauagcucauug

SEQ ID NO: 274202 - RNA, 19 nt, Homo sapiens
guuaauuucugggaccuua

SEQ ID NO: 274203 - RNA, 19 nt, Homo sapiens
gacccaacauuacuaacaa

SEQ ID NO: 274204 - RNA, 19 nt, Homo sapiens
cuacuucgcucuuggaaca

SEQ ID NO: 274205 - RNA, 19 nt, Homo sapiens
uggaaaugcuuuagaugaa

SEQ ID NO: 274206 - RNA, 19 nt, Homo sapiens
uaauaugccuuucguugau

SEQ ID NO: 274207 - RNA, 19 nt, Homo sapiens
caucgugccuucucuacuu

SEQ ID NO: 274208 - RNA, 19 nt, Homo sapiens
agcaacagcucauuuaaau

SEQ ID NO: 274209 - RNA, 19 nt, Homo sapiens
ugaauccugugaagauaaa

SEQ ID NO: 274210 - RNA, 19 nt, Homo sapiens
ucacuaugcccgacuaauu

SEQ ID NO: 274211 - RNA, 19 nt, Homo sapiens
gugauucuacugcuucuua

SEQ ID NO: 274212 - RNA, 19 nt, Homo sapiens
auacucaacuuucagauuc

SEQ ID NO: 274213 - RNA, 19 nt, Homo sapiens
accaauagaugauucaaga

SEQ ID NO: 274214 - RNA, 19 nt, Homo sapiens
gagcauaguggcaagauca

SEQ ID NO: 274215 - RNA, 19 nt, Homo sapiens
gaacgaaagucggcaucuc

SEQ ID NO: 274216 - RNA, 19 nt, Homo sapiens
ucaccuacauuugagaauu

SEQ ID NO: 274217 - RNA, 19 nt, Homo sapiens
ucauguaugugaaacaaug

SEQ ID NO: 274218 - RNA, 19 nt, Homo sapiens
ucaacgcuguucuuucuga

SEQ ID NO: 274219 - RNA, 19 nt, Homo sapiens
uaaagacccaacauuacua

SEQ ID NO: 274220 - RNA, 19 nt, Homo sapiens
agaacugcauagcguauaa

SEQ ID NO: 274221 - RNA, 19 nt, Homo sapiens
gcagagaagguggagagua

SEQ ID NO: 274222 - RNA, 19 nt, Homo sapiens
cagaugaacuggauuuuau

SEQ ID NO: 274223 - RNA, 19 nt, Homo sapiens
augauacaguugcauguua

SEQ ID NO: 274224 - RNA, 19 nt, Homo sapiens
ggauuggacucucuuacag

SEQ ID NO: 274225 - RNA, 19 nt, Homo sapiens
gcaggcaccaugucacuau

SEQ ID NO: 274226 - RNA, 19 nt, Homo sapiens
uaacaaugauacaguugca

SEQ ID NO: 274227 - RNA, 19 nt, Homo sapiens
uaauacaugucucaccaau

SEQ ID NO: 274228 - RNA, 19 nt, Homo sapiens
caaauggaaaugcuuuaga

SEQ ID NO: 274229 - RNA, 19 nt, Homo sapiens
ugauacaguugcauguuau

SEQ ID NO: 274230 - RNA, 19 nt, Homo sapiens
uaagcaacagcucauuuaa

SEQ ID NO: 274231 - RNA, 19 nt, Homo sapiens
ucugggaccuuagggauaa

SEQ ID NO: 274232 - RNA, 19 nt, Homo sapiens
acaauugucauguauguga

SEQ ID NO: 274233 - RNA, 19 nt, Homo sapiens
acacagaugaacuggauuu

SEQ ID NO: 274234 - RNA, 19 nt, Homo sapiens
gggauaauaugccuuucgu

SEQ ID NO: 274235 - RNA, 19 nt, Homo sapiens
cacuaugcccgacuaauuu

SEQ ID NO: 274236 - RNA, 19 nt, Homo sapiens
gauacaguugcauguuaua

SEQ ID NO: 274237 - RNA, 19 nt, Homo sapiens
gcauagcguauaauccaaa

SEQ ID NO: 274238 - RNA, 19 nt, Homo sapiens
ggcaagaucauagcucauu

SEQ ID NO: 274239 - RNA, 19 nt, Homo sapiens
gcucuuggaacauaauuuc

SEQ ID NO: 274240 - RNA, 19 nt, Homo sapiens
caacgcuguucuuucugaa

SEQ ID NO: 274241 - RNA, 19 nt, Homo sapiens
caauugucauguaugugaa

SEQ ID NO: 274242 - RNA, 19 nt, Homo sapiens
aagcaacagcucauuuaaa

SEQ ID NO: 274243 - RNA, 19 nt, Homo sapiens
gaguauugagccagcauuu

SEQ ID NO: 274244 - RNA, 19 nt, Homo sapiens
aaagacccaacauuacuaa

SEQ ID NO: 274245 - RNA, 19 nt, Homo sapiens
uuuaugagcuccagucaac

SEQ ID NO: 274246 - RNA, 19 nt, Homo sapiens
gcauaguggcaagaucaua

SEQ ID NO: 274247 - RNA, 19 nt, Homo sapiens
acagugucauauacaauug

SEQ ID NO: 274248 - RNA, 19 nt, Homo sapiens
auucaacgcuguucuuucu

SEQ ID NO: 274249 - RNA, 19 nt, Homo sapiens
caauucaacgcuguucuuu

SEQ ID NO: 274250 - RNA, 19 nt, Homo sapiens
guauugagccagcauuuac

SEQ ID NO: 274251 - RNA, 19 nt, Homo sapiens
ugucauguaugugaaacaa

SEQ ID NO: 274252 - RNA, 19 nt, Homo sapiens
cuacuucuggagucuauaa

SEQ ID NO: 274253 - RNA, 19 nt, Homo sapiens
uuagaugaauccugugaag

SEQ ID NO: 274254 - RNA, 19 nt, Homo sapiens
gcacucucccaguaucuau

SEQ ID NO: 274255 - RNA, 19 nt, Homo sapiens
gagcacaccgccugguugu

SEQ ID NO: 274256 - RNA, 19 nt, Homo sapiens
ucagaaauccagccugcuu

SEQ ID NO: 274257 - RNA, 19 nt, Homo sapiens
guuacuucauuuccaguga

SEQ ID NO: 274258 - RNA, 19 nt, Homo sapiens
uuuagaggcuugugauucu

SEQ ID NO: 274259 - RNA, 19 nt, Homo sapiens
cauacucaacuuucagauu

SEQ ID NO: 274260 - RNA, 19 nt, Homo sapiens
cagaaaacuuggaacgaaa

SEQ ID NO: 274261 - RNA, 19 nt, Homo sapiens
ggagcauaguggcaagauc

SEQ ID NO: 274262 - RNA, 19 nt, Homo sapiens
cauagcguauaauccaaau

SEQ ID NO: 274263 - RNA, 19 nt, Homo sapiens
auaauaugccuuucguuga

SEQ ID NO: 274264 - RNA, 19 nt, Homo sapiens
agaguaaagacccaacauu

SEQ ID NO: 274265 - RNA, 19 nt, Homo sapiens
uguaagcaacagcucauuu

SEQ ID NO: 274266 - RNA, 19 nt, Homo sapiens
agaugaauccugugaagau

SEQ ID NO: 274267 - RNA, 19 nt, Homo sapiens
gaacugcauagcguauaau

SEQ ID NO: 274268 - RNA, 19 nt, Homo sapiens
gcaacuguuacuucauuuc

SEQ ID NO: 274269 - RNA, 19 nt, Homo sapiens
ggguaccggugcaacuguu

SEQ ID NO: 274270 - RNA, 19 nt, Homo sapiens
cauaguggcaagaucauag

SEQ ID NO: 274271 - RNA, 19 nt, Homo sapiens
caauagaugauucaagaac

SEQ ID NO: 274272 - RNA, 19 nt, Homo sapiens
gagaagguggagaguaaag

SEQ ID NO: 274273 - RNA, 19 nt, Homo sapiens
guacacaucgugccuucuc

SEQ ID NO: 274274 - RNA, 19 nt, Homo sapiens
uuagggauaauaugccuuu

SEQ ID NO: 274275 - RNA, 19 nt, Homo sapiens
cuuggaacauaauuucuca

SEQ ID NO: 274276 - RNA, 19 nt, Homo sapiens
caguaucuauuuccaucau

SEQ ID NO: 274277 - RNA, 19 nt, Homo sapiens
acagaaaacuuggaacgaa

SEQ ID NO: 274278 - RNA, 19 nt, Homo sapiens
gguaccggugcaacuguua

SEQ ID NO: 274279 - RNA, 19 nt, Homo sapiens
ccaauagaugauucaagaa

SEQ ID NO: 274280 - RNA, 19 nt, Homo sapiens
gagaguaaagacccaacau

SEQ ID NO: 274281 - RNA, 19 nt, Homo sapiens
gaagguggagaguaaagac

SEQ ID NO: 274282 - RNA, 19 nt, Homo sapiens
gacucugacugcuguucuu

SEQ ID NO: 274283 - RNA, 19 nt, Homo sapiens
gaccuuagggauaauaugc

SEQ ID NO: 274284 - RNA, 19 nt, Homo sapiens
gaguaaagacccaacauua

SEQ ID NO: 274285 - RNA, 19 nt, Homo sapiens
cagagaagguggagaguaa

SEQ ID NO: 274286 - RNA, 19 nt, Homo sapiens
caacauagaacuccagaaa

SEQ ID NO: 274287 - RNA, 19 nt, Homo sapiens
gaaauucguucaccuacau

SEQ ID NO: 274288 - RNA, 19 nt, Homo sapiens
gagcuccagucaacaauuu

SEQ ID NO: 274289 - RNA, 19 nt, Homo sapiens
guaagcaacagcucauuua

SEQ ID NO: 274290 - RNA, 19 nt, Homo sapiens
gaugaauccugugaagaua

SEQ ID NO: 274291 - RNA, 19 nt, Homo sapiens
gcucugcacucucccagua

SEQ ID NO: 274292 - RNA, 19 nt, Homo sapiens
acauagaacuccagaaaga

SEQ ID NO: 274293 - RNA, 19 nt, Homo sapiens
caccuacauuugagaauua

SEQ ID NO: 274294 - RNA, 19 nt, Homo sapiens
ugacucagccucccaagua

SEQ ID NO: 274295 - RNA, 19 nt, Homo sapiens
aaacacagaugaacuggau

SEQ ID NO: 274296 - RNA, 19 nt, Homo sapiens
gaaaugcuuuagaugaauc

SEQ ID NO: 274297 - RNA, 19 nt, Homo sapiens
gugcaacuguuacuucauu

SEQ ID NO: 274298 - RNA, 19 nt, Homo sapiens
ggaaaugcuuuagaugaau

SEQ ID NO: 274299 - RNA, 19 nt, Homo sapiens
gagaauggcucugcacucu

SEQ ID NO: 274300 - RNA, 19 nt, Homo sapiens
auacaugucucaccaauag

SEQ ID NO: 274301 - RNA, 19 nt, Homo sapiens
gcaagaucauagcucauug

SEQ ID NO: 274302 - RNA, 19 nt, Homo sapiens
gacccaacauuacuaacaa

SEQ ID NO: 274303 - RNA, 19 nt, Homo sapiens
cuacuucgcucuuggaaca

SEQ ID NO: 274304 - RNA, 19 nt, Homo sapiens
uggaaaugcuuuagaugaa

SEQ ID NO: 274305 - RNA, 19 nt, Homo sapiens
caucgugccuucucuacuu

SEQ ID NO: 274306 - RNA, 19 nt, Homo sapiens
agcaacagcucauuuaaau

SEQ ID NO: 274307 - RNA, 19 nt, Homo sapiens
ugaauccugugaagauaaa

SEQ ID NO: 274308 - RNA, 19 nt, Homo sapiens
ucacuaugcccgacuaauu

SEQ ID NO: 274309 - RNA, 19 nt, Homo sapiens
gugauucuacugcuucuua

SEQ ID NO: 274310 - RNA, 19 nt, Homo sapiens
auacucaacuuucagauuc

SEQ ID NO: 274311 - RNA, 19 nt, Homo sapiens
accaauagaugauucaaga

SEQ ID NO: 274312 - RNA, 19 nt, Homo sapiens
gagcauaguggcaagauca

SEQ ID NO: 274313 - RNA, 19 nt, Homo sapiens
gaacgaaagucggcaucuc

SEQ ID NO: 274314 - RNA, 19 nt, Homo sapiens
ucaccuacauuugagaauu

SEQ ID NO: 274315 - RNA, 19 nt, Homo sapiens
ucauguaugugaaacaaug

SEQ ID NO: 274316 - RNA, 19 nt, Homo sapiens
ucaacgcuguucuuucuga

SEQ ID NO: 274317 - RNA, 19 nt, Homo sapiens
uaaagacccaacauuacua

SEQ ID NO: 274318 - RNA, 19 nt, Homo sapiens
agaacugcauagcguauaa

SEQ ID NO: 274319 - RNA, 19 nt, Homo sapiens
gcagagaagguggagagua

SEQ ID NO: 274320 - RNA, 19 nt, Homo sapiens
cagaugaacuggauuuuau

SEQ ID NO: 274321 - RNA, 19 nt, Homo sapiens
augauacaguugcauguua

SEQ ID NO: 274322 - RNA, 19 nt, Homo sapiens
ggauuggacucucuuacag

SEQ ID NO: 274323 - RNA, 19 nt, Homo sapiens
gcaggcaccaugucacuau

SEQ ID NO: 274324 - RNA, 19 nt, Homo sapiens
uaacaaugauacaguugca

SEQ ID NO: 274325 - RNA, 19 nt, Homo sapiens
uaauacaugucucaccaau

SEQ ID NO: 274326 - RNA, 19 nt, Homo sapiens
caaauggaaaugcuuuaga

SEQ ID NO: 274327 - RNA, 19 nt, Homo sapiens
ugauacaguugcauguuau

SEQ ID NO: 274328 - RNA, 19 nt, Homo sapiens
uaagcaacagcucauuuaa

SEQ ID NO: 274329 - RNA, 19 nt, Homo sapiens
acaauugucauguauguga

SEQ ID NO: 274330 - RNA, 19 nt, Homo sapiens
acacagaugaacuggauuu

SEQ ID NO: 274331 - RNA, 19 nt, Homo sapiens
cacuaugcccgacuaauuu

SEQ ID NO: 274332 - RNA, 19 nt, Homo sapiens
gauacaguugcauguuaua

SEQ ID NO: 274333 - RNA, 19 nt, Homo sapiens
gcauagcguauaauccaaa

SEQ ID NO: 274334 - RNA, 19 nt, Homo sapiens
ggcaagaucauagcucauu

SEQ ID NO: 274335 - RNA, 19 nt, Homo sapiens
gcucuuggaacauaauuuc

SEQ ID NO: 274336 - RNA, 19 nt, Homo sapiens
caacgcuguucuuucugaa

SEQ ID NO: 274337 - RNA, 19 nt, Homo sapiens
caauugucauguaugugaa

SEQ ID NO: 274338 - RNA, 19 nt, Homo sapiens
aagcaacagcucauuuaaa

SEQ ID NO: 274339 - RNA, 19 nt, Homo sapiens
gaguauugagccagcauuu

SEQ ID NO: 274340 - RNA, 19 nt, Homo sapiens
aaagacccaacauuacuaa

SEQ ID NO: 274341 - RNA, 19 nt, Homo sapiens
uuuaugagcuccagucaac

SEQ ID NO: 274342 - RNA, 19 nt, Homo sapiens
gcauaguggcaagaucaua

SEQ ID NO: 274343 - RNA, 19 nt, Homo sapiens
caauucaacgcuguucuuu

SEQ ID NO: 274344 - RNA, 19 nt, Homo sapiens
acagugucauauacaauug

SEQ ID NO: 274345 - RNA, 19 nt, Homo sapiens
auucaacgcuguucuuucu

SEQ ID NO: 274346 - RNA, 19 nt, Homo sapiens
guauugagccagcauuuac

SEQ ID NO: 274347 - RNA, 19 nt, Homo sapiens
ugucauguaugugaaacaa

SEQ ID NO: 274348 - RNA, 19 nt, Homo sapiens
cuacuucuggagucuauaa

SEQ ID NO: 274349 - RNA, 19 nt, Homo sapiens
uuagaugaauccugugaag

SEQ ID NO: 274350 - RNA, 19 nt, Homo sapiens
gcacucucccaguaucuau

SEQ ID NO: 274351 - RNA, 19 nt, Homo sapiens
gagcacaccgccugguugu

SEQ ID NO: 274352 - RNA, 19 nt, Homo sapiens
ucagaaauccagccugcuu

SEQ ID NO: 274353 - RNA, 19 nt, Homo sapiens
guuacuucauuuccaguga

SEQ ID NO: 274354 - RNA, 19 nt, Homo sapiens
uuuagaggcuugugauucu

SEQ ID NO: 274355 - RNA, 19 nt, Homo sapiens
cauacucaacuuucagauu

SEQ ID NO: 274356 - RNA, 19 nt, Homo sapiens
cagaaaacuuggaacgaaa

SEQ ID NO: 274357 - RNA, 19 nt, Homo sapiens
ggagcauaguggcaagauc

SEQ ID NO: 274358 - RNA, 19 nt, Homo sapiens
cauagcguauaauccaaau

SEQ ID NO: 274359 - RNA, 19 nt, Homo sapiens
agaguaaagacccaacauu

SEQ ID NO: 274360 - RNA, 19 nt, Homo sapiens
uguaagcaacagcucauuu

SEQ ID NO: 274361 - RNA, 19 nt, Homo sapiens
agaugaauccugugaagau

SEQ ID NO: 274362 - RNA, 19 nt, Homo sapiens
gaacugcauagcguauaau

SEQ ID NO: 274363 - RNA, 19 nt, Homo sapiens
gcaacuguuacuucauuuc

SEQ ID NO: 274364 - RNA, 19 nt, Homo sapiens
ggguaccggugcaacuguu

SEQ ID NO: 274365 - RNA, 19 nt, Homo sapiens
cauaguggcaagaucauag

SEQ ID NO: 274366 - RNA, 19 nt, Homo sapiens
gagaagguggagaguaaag

SEQ ID NO: 274367 - RNA, 19 nt, Homo sapiens
guacacaucgugccuucuc

SEQ ID NO: 274368 - RNA, 19 nt, Homo sapiens
caauagaugauucaagaac

SEQ ID NO: 274369 - RNA, 19 nt, Homo sapiens
caguaucuauuuccaucau

SEQ ID NO: 274370 - RNA, 19 nt, Homo sapiens
acagaaaacuuggaacgaa

SEQ ID NO: 274371 - RNA, 19 nt, Homo sapiens
cuuggaacauaauuucuca

SEQ ID NO: 274372 - RNA, 19 nt, Homo sapiens
gguaccggugcaacuguua

SEQ ID NO: 274373 - RNA, 19 nt, Homo sapiens
ccaauagaugauucaagaa

SEQ ID NO: 274374 - RNA, 19 nt, Homo sapiens
gagaguaaagacccaacau

SEQ ID NO: 274375 - RNA, 19 nt, Homo sapiens
gaagguggagaguaaagac

SEQ ID NO: 274376 - RNA, 19 nt, Homo sapiens
gacucugacugcuguucuu

SEQ ID NO: 274377 - RNA, 19 nt, Homo sapiens
gacucagccucccaaguag

SEQ ID NO: 274378 - RNA, 19 nt, Homo sapiens
aaagaacugcauagcguau

SEQ ID NO: 274379 - RNA, 19 nt, Homo sapiens
ucucaccaauagaugauuc

SEQ ID NO: 274380 - RNA, 19 nt, Homo sapiens
ugauucuacugcuucuuau

SEQ ID NO: 274381 - RNA, 19 nt, Homo sapiens
gcucagcuucaacaauuca

SEQ ID NO: 274382 - RNA, 19 nt, Homo sapiens
uagcguauaauccaaaugg

SEQ ID NO: 274383 - RNA, 19 nt, Homo sapiens
uaugagcuccagucaacaa

SEQ ID NO: 274384 - RNA, 19 nt, Homo sapiens
ggauugaacuuucgaauua

SEQ ID NO: 274385 - RNA, 19 nt, Homo sapiens
ggaaugaucucacugauga

SEQ ID NO: 274386 - RNA, 19 nt, Homo sapiens
gaagaaagaugggauagaa

SEQ ID NO: 274387 - RNA, 19 nt, Homo sapiens
ggaaaguaaugaagaguug

SEQ ID NO: 274388 - RNA, 19 nt, Homo sapiens
gauaaugcauacaucgaua

SEQ ID NO: 274389 - RNA, 19 nt, Homo sapiens
uaacgcaacuuucuauuuc

SEQ ID NO: 274390 - RNA, 19 nt, Homo sapiens
gcaaacgaauuguuccaaa

SEQ ID NO: 274391 - RNA, 19 nt, Homo sapiens
gaaagaugggauagaauuu

SEQ ID NO: 274392 - RNA, 19 nt, Homo sapiens
gcaaugacaaggauuuauu

SEQ ID NO: 274393 - RNA, 19 nt, Homo sapiens
ggugguggcuggcaagaaa

SEQ ID NO: 274394 - RNA, 19 nt, Homo sapiens
acccagaccugccagauua

SEQ ID NO: 274395 - RNA, 19 nt, Homo sapiens
ggaaggacaagaagaaaga

SEQ ID NO: 274396 - RNA, 19 nt, Homo sapiens
ggagauuguuagaucauga

SEQ ID NO: 274397 - RNA, 19 nt, Homo sapiens
gaauaacgcaacuuucuau

SEQ ID NO: 274398 - RNA, 19 nt, Homo sapiens
caacauuccucccucuuca

SEQ ID NO: 274399 - RNA, 19 nt, Homo sapiens
gcaagucccuuuggaaugg

SEQ ID NO: 274400 - RNA, 19 nt, Homo sapiens
gaaacuaauuaccauccuu

SEQ ID NO: 274401 - RNA, 19 nt, Homo sapiens
gcaacuuucuauuucaaga

SEQ ID NO: 274402 - RNA, 19 nt, Homo sapiens
caacaacacucaacauucc

SEQ ID NO: 274403 - RNA, 19 nt, Homo sapiens
ccagcaaccuugagaggaa

SEQ ID NO: 274404 - RNA, 19 nt, Homo sapiens
guacaaggaugcugcaaaa

SEQ ID NO: 274405 - RNA, 19 nt, Homo sapiens
uugcaacgcugaaguuuau

SEQ ID NO: 274406 - RNA, 19 nt, Homo sapiens
augcugcucugaagaaaua

SEQ ID NO: 274407 - RNA, 19 nt, Homo sapiens
caagaagaaagaugggaua

SEQ ID NO: 274408 - RNA, 19 nt, Homo sapiens
caaggaaaguaaugaagag

SEQ ID NO: 274409 - RNA, 19 nt, Homo sapiens
auacaucgauauucagcua

SEQ ID NO: 274410 - RNA, 19 nt, Homo sapiens
cgaaagcugugagaccaaa

SEQ ID NO: 274411 - RNA, 19 nt, Homo sapiens
caaacgaauuguuccaaag

SEQ ID NO: 274412 - RNA, 19 nt, Homo sapiens
gaagaggagcaguacgaaa

SEQ ID NO: 274413 - RNA, 19 nt, Homo sapiens
ggauuguccuguucaaagu

SEQ ID NO: 274414 - RNA, 19 nt, Homo sapiens
agagggagauuguuagauc

SEQ ID NO: 274415 - RNA, 19 nt, Homo sapiens
ccagagauauacccaccaa

SEQ ID NO: 274416 - RNA, 19 nt, Homo sapiens
guacaaccaccuaccaaga

SEQ ID NO: 274417 - RNA, 19 nt, Homo sapiens
gguuggcucugacacguuu

SEQ ID NO: 274418 - RNA, 19 nt, Homo sapiens
agaaagaugggauagaauu

SEQ ID NO: 274419 - RNA, 19 nt, Homo sapiens
guacagauaaugcauacau

SEQ ID NO: 274420 - RNA, 19 nt, Homo sapiens
cagagaauaacgcaacuuu

SEQ ID NO: 274421 - RNA, 19 nt, Homo sapiens
gccaaagccuagauugcaa

SEQ ID NO: 274422 - RNA, 19 nt, Homo sapiens
ccaaggaaaguaaugaaga

SEQ ID NO: 274423 - RNA, 19 nt, Homo sapiens
gagggagauuguuagauca

SEQ ID NO: 274424 - RNA, 19 nt, Homo sapiens
cuaagacgguuggcucuga

SEQ ID NO: 274425 - RNA, 19 nt, Homo sapiens
ggaugcugcucugaagaaa

SEQ ID NO: 274426 - RNA, 19 nt, Homo sapiens
acaaccaccuaccaagauu

SEQ ID NO: 274427 - RNA, 19 nt, Homo sapiens
acgaauugcuuccuucuca

SEQ ID NO: 274428 - RNA, 19 nt, Homo sapiens
ggugauaccggugaaugua

SEQ ID NO: 274429 - RNA, 19 nt, Homo sapiens
gaggagcaguacgaaauuc

SEQ ID NO: 274430 - RNA, 19 nt, Homo sapiens
ccaggcuacuacuaaguuu

SEQ ID NO: 274431 - RNA, 19 nt, Homo sapiens
gaauggugauaccggugaa

SEQ ID NO: 274432 - RNA, 19 nt, Homo sapiens
ggugguggcuggauugaac

SEQ ID NO: 274433 - RNA, 19 nt, Homo sapiens
ccgaggaaauugacugcaa

SEQ ID NO: 274434 - RNA, 19 nt, Homo sapiens
gacaggugguggcuggauu

SEQ ID NO: 274435 - RNA, 19 nt, Homo sapiens
ugacugcaaugacaaggau

SEQ ID NO: 274436 - RNA, 19 nt, Homo sapiens
ccaaaguaacaaccaguuu

SEQ ID NO: 274437 - RNA, 19 nt, Homo sapiens
ggaaucacaguccgaggaa

SEQ ID NO: 274438 - RNA, 19 nt, Homo sapiens
gaggagacacugacucaca

SEQ ID NO: 274439 - RNA, 19 nt, Homo sapiens
aaacgaauuguuccaaaga

SEQ ID NO: 274440 - RNA, 19 nt, Homo sapiens
caaccaguuuguauuguac

SEQ ID NO: 274441 - RNA, 19 nt, Homo sapiens
ccaaugggcagaaucuuca

SEQ ID NO: 274442 - RNA, 19 nt, Homo sapiens
aaugaagaguugaccgaaa

SEQ ID NO: 274443 - RNA, 19 nt, Homo sapiens
ugacucacaccaucacaaa

SEQ ID NO: 274444 - RNA, 19 nt, Homo sapiens
gacacggcauucaguacuu

SEQ ID NO: 274445 - RNA, 19 nt, Homo sapiens
gggaagaggagcaguacga

SEQ ID NO: 274446 - RNA, 19 nt, Homo sapiens
gcauaacugaagccacuaa

SEQ ID NO: 274447 - RNA, 19 nt, Homo sapiens
gaaaguaaugaagaguuga

SEQ ID NO: 274448 - RNA, 19 nt, Homo sapiens
augcauacaucgauauuca

SEQ ID NO: 274449 - RNA, 19 nt, Homo sapiens
gaaucacaguccgaggaaa

SEQ ID NO: 274450 - RNA, 19 nt, Homo sapiens
gaggaaggacaagaagaaa

SEQ ID NO: 274451 - RNA, 19 nt, Homo sapiens
ggcauucaguacuuuaaca

SEQ ID NO: 274452 - RNA, 19 nt, Homo sapiens
ggaagaggagcaguacgaa

SEQ ID NO: 274453 - RNA, 19 nt, Homo sapiens
agaggaaggacaagaagaa

SEQ ID NO: 274454 - RNA, 19 nt, Homo sapiens
ccagggaaaccacauguuc

SEQ ID NO: 274455 - RNA, 19 nt, Homo sapiens
gaauuguuccaaagagaau

SEQ ID NO: 274456 - RNA, 19 nt, Homo sapiens
acacggcauucaguacuuu

SEQ ID NO: 274457 - RNA, 19 nt, Homo sapiens
gcaggacugugaguacaag

SEQ ID NO: 274458 - RNA, 19 nt, Homo sapiens
gagaggaaggacaagaaga

SEQ ID NO: 274459 - RNA, 19 nt, Homo sapiens
ugaaaaggccuccagguuu

SEQ ID NO: 274460 - RNA, 19 nt, Homo sapiens
cgaauuguuccaaagagaa

SEQ ID NO: 274461 - RNA, 19 nt, Homo sapiens
gggauuguccuguucaaag

SEQ ID NO: 274462 - RNA, 19 nt, Homo sapiens
cgcugaaguuuauguggua

SEQ ID NO: 274463 - RNA, 19 nt, Homo sapiens
uaacaacaacacucaacau

SEQ ID NO: 274464 - RNA, 19 nt, Homo sapiens
gcauucaguacuuuaacaa

SEQ ID NO: 274465 - RNA, 19 nt, Homo sapiens
gaccuggagcccauucuga

SEQ ID NO: 274466 - RNA, 19 nt, Homo sapiens
aagaggagcaguacgaaau

SEQ ID NO: 274467 - RNA, 19 nt, Homo sapiens
uaacugaagccacuaagac

SEQ ID NO: 274468 - RNA, 19 nt, Homo sapiens
gagauuguuagaucaugaa

SEQ ID NO: 274469 - RNA, 19 nt, Homo sapiens
gggaaugaucucacugaug

SEQ ID NO: 274470 - RNA, 19 nt, Homo sapiens
gcuccaggcuacuacuaag

SEQ ID NO: 274471 - RNA, 19 nt, Homo sapiens
caaccaccuaccaagauuu

SEQ ID NO: 274472 - RNA, 19 nt, Homo sapiens
ugagacacggcauucagua

SEQ ID NO: 274473 - RNA, 19 nt, Homo sapiens
gcucugaagaaauauaaca

SEQ ID NO: 274474 - RNA, 19 nt, Homo sapiens
aaauuuacccuacugucaa

SEQ ID NO: 274475 - RNA, 19 nt, Homo sapiens
gaacugugacauuuaucca

SEQ ID NO: 274476 - RNA, 19 nt, Homo sapiens
ggacugugaguacaaggau

SEQ ID NO: 274477 - RNA, 19 nt, Homo sapiens
ggccaaagccuagauugca

SEQ ID NO: 274478 - RNA, 19 nt, Homo sapiens
cacaccaucacaaagcuua

SEQ ID NO: 274479 - RNA, 19 nt, Homo sapiens
acaacaacacucaacauuc

SEQ ID NO: 274480 - RNA, 19 nt, Homo sapiens
gggagauuguuagaucaug

SEQ ID NO: 274481 - RNA, 19 nt, Homo sapiens
gcaacgcugaaguuuaugu

SEQ ID NO: 274482 - RNA, 19 nt, Homo sapiens
gauugcaacgcugaaguuu

SEQ ID NO: 274483 - RNA, 19 nt, Homo sapiens
agagauauacccaccaaca

SEQ ID NO: 274484 - RNA, 19 nt, Homo sapiens
gaagaaagaugaugaaagu

SEQ ID NO: 274485 - RNA, 19 nt, Homo sapiens
guacaaagccugcaaaguu

SEQ ID NO: 274486 - RNA, 19 nt, Homo sapiens
gaggagaaaucaaacauga

SEQ ID NO: 274487 - RNA, 19 nt, Homo sapiens
gggcaaguaugaagaagua

SEQ ID NO: 274488 - RNA, 19 nt, Homo sapiens
gaagaagcaucuggaguuu

SEQ ID NO: 274489 - RNA, 19 nt, Homo sapiens
ggaagucacuggagauguu

SEQ ID NO: 274490 - RNA, 19 nt, Homo sapiens
cagaaacacuguacaaaga

SEQ ID NO: 274491 - RNA, 19 nt, Homo sapiens
guacagggaucagaauaaa

SEQ ID NO: 274492 - RNA, 19 nt, Homo sapiens
cagcuaaccuacugaauga

SEQ ID NO: 274493 - RNA, 19 nt, Homo sapiens
ccacaaugguguacauaaa

SEQ ID NO: 274494 - RNA, 19 nt, Homo sapiens
gaaacacuguacaaagaga

SEQ ID NO: 274495 - RNA, 19 nt, Homo sapiens
gagcaaggcgaauguauga

SEQ ID NO: 274496 - RNA, 19 nt, Homo sapiens
aagcagagccguuguguaa

SEQ ID NO: 274497 - RNA, 19 nt, Homo sapiens
aaagagcccucgagaucua

SEQ ID NO: 274498 - RNA, 19 nt, Homo sapiens
gcauaggacaugauacuaa

SEQ ID NO: 274499 - RNA, 19 nt, Homo sapiens
uggcagaagugcucaauga

SEQ ID NO: 274500 - RNA, 19 nt, Homo sapiens
agaagcaucuggaguuuau

SEQ ID NO: 274501 - RNA, 19 nt, Homo sapiens
gcuaugaggucucguaaac

SEQ ID NO: 274502 - RNA, 19 nt, Homo sapiens
gaugcaugcugaagaaaga

SEQ ID NO: 274503 - RNA, 19 nt, Homo sapiens
caacguggcuaagacgaaa

SEQ ID NO: 274504 - RNA, 19 nt, Homo sapiens
guaauuugguggaggagaa

SEQ ID NO: 274505 - RNA, 19 nt, Homo sapiens
gcagaaacguuagaagaag

SEQ ID NO: 274506 - RNA, 19 nt, Homo sapiens
uuacagacgucaaggcaaa

SEQ ID NO: 274507 - RNA, 19 nt, Homo sapiens
acagggaucagaauaaaua

SEQ ID NO: 274508 - RNA, 19 nt, Homo sapiens
gcuggaagcuuugaagaau

SEQ ID NO: 274509 - RNA, 19 nt, Homo sapiens
ggaguuugguucuguagau

SEQ ID NO: 274510 - RNA, 19 nt, Homo sapiens
ggacaaagacacugauucu

SEQ ID NO: 274511 - RNA, 19 nt, Homo sapiens
uaaacagggucuugacaau

SEQ ID NO: 274512 - RNA, 19 nt, Homo sapiens
uacaaagccugcaaaguug

SEQ ID NO: 274513 - RNA, 19 nt, Homo sapiens
ucaaagagcccucgagauc

SEQ ID NO: 274514 - RNA, 19 nt, Homo sapiens
uaaaagagcucuggaaauc

SEQ ID NO: 274515 - RNA, 19 nt, Homo sapiens
gaauaaccuugcaguccuu

SEQ ID NO: 274516 - RNA, 19 nt, Homo sapiens
ugaaguguuugaagaaaga

SEQ ID NO: 274517 - RNA, 19 nt, Homo sapiens
gcagaaacacuguacaaag

SEQ ID NO: 274518 - RNA, 19 nt, Homo sapiens
gcagcuaaccuacugaaug

SEQ ID NO: 274519 - RNA, 19 nt, Homo sapiens
cauaggacaugauacuaau

SEQ ID NO: 274520 - RNA, 19 nt, Homo sapiens
gcagagccguuguguaaaa

SEQ ID NO: 274521 - RNA, 19 nt, Homo sapiens
ggaugggacugccgagugu

SEQ ID NO: 274522 - RNA, 19 nt, Homo sapiens
agaaagagaagaaugcaaa

SEQ ID NO: 274523 - RNA, 19 nt, Homo sapiens
gaaagggaguuugguucug

SEQ ID NO: 274524 - RNA, 19 nt, Homo sapiens
caaagaugcagcuaaccua

SEQ ID NO: 274525 - RNA, 19 nt, Homo sapiens
gagaagaaugcaaaggaaa

SEQ ID NO: 274526 - RNA, 19 nt, Homo sapiens
agagaagaaugcaaaggaa

SEQ ID NO: 274527 - RNA, 19 nt, Homo sapiens
uggaagcuuugaagaauga

SEQ ID NO: 274528 - RNA, 19 nt, Homo sapiens
agacaaagcaaguaauuca

SEQ ID NO: 274529 - RNA, 19 nt, Homo sapiens
cauaaaggaagacaaguug

SEQ ID NO: 274530 - RNA, 19 nt, Homo sapiens
agaagaagcaucuggaguu

SEQ ID NO: 274531 - RNA, 19 nt, Homo sapiens
ugugugcgauaacguauuu

SEQ ID NO: 274532 - RNA, 19 nt, Homo sapiens
guaaacagggucuugacaa

SEQ ID NO: 274533 - RNA, 19 nt, Homo sapiens
guacauaaaggaagacaag

SEQ ID NO: 274534 - RNA, 19 nt, Homo sapiens
uaaauaacuuggccuuacu

SEQ ID NO: 274535 - RNA, 19 nt, Homo sapiens
cagcagcaguggccuggaa

SEQ ID NO: 274536 - RNA, 19 nt, Homo sapiens
uuaaauaacuuggccuuac

SEQ ID NO: 274537 - RNA, 19 nt, Homo sapiens
aaagagggaaguacaaaga

SEQ ID NO: 274538 - RNA, 19 nt, Homo sapiens
agacacugauucuaccaaa

SEQ ID NO: 274539 - RNA, 19 nt, Homo sapiens
caucuggaguuuaugaauc

SEQ ID NO: 274540 - RNA, 19 nt, Homo sapiens
gcaaggcgaauguaugaca

SEQ ID NO: 274541 - RNA, 19 nt, Homo sapiens
gggaugaacuggccaacac

SEQ ID NO: 274542 - RNA, 19 nt, Homo sapiens
caaugacccugagaacaug

SEQ ID NO: 274543 - RNA, 19 nt, Homo sapiens
ucaaugacccugagaacau

SEQ ID NO: 274544 - RNA, 19 nt, Homo sapiens
gcaaguaugaagaaguaga

SEQ ID NO: 274545 - RNA, 19 nt, Homo sapiens
gaagcagagccguugugua

SEQ ID NO: 274546 - RNA, 19 nt, Homo sapiens
gggaucagaauaaauacaa

SEQ ID NO: 274547 - RNA, 19 nt, Homo sapiens
ggagcaaggcgaauguaug

SEQ ID NO: 274548 - RNA, 19 nt, Homo sapiens
guaacuuccucacguugug

SEQ ID NO: 274549 - RNA, 19 nt, Homo sapiens
ggagaagcuuacacaggau

SEQ ID NO: 274550 - RNA, 19 nt, Homo sapiens
gcagaagagugagcagucu

SEQ ID NO: 274551 - RNA, 19 nt, Homo sapiens
gaaugcaaaggaaagcaaa

SEQ ID NO: 274552 - RNA, 19 nt, Homo sapiens
caaguaugaagaaguagaa

SEQ ID NO: 274553 - RNA, 19 nt, Homo sapiens
uugccaagcaguuaaauaa

SEQ ID NO: 274554 - RNA, 19 nt, Homo sapiens
uugcaguccuuuaugguaa

SEQ ID NO: 274555 - RNA, 19 nt, Homo sapiens
auacaaagaugcagcuaac

SEQ ID NO: 274556 - RNA, 19 nt, Homo sapiens
aacagggucuugacaaugu

SEQ ID NO: 274557 - RNA, 19 nt, Homo sapiens
ugaagcugcagaaacguua

SEQ ID NO: 274558 - RNA, 19 nt, Homo sapiens
caaauuugaagcugcagaa

SEQ ID NO: 274559 - RNA, 19 nt, Homo sapiens
ggacaucuuuuggagagua

SEQ ID NO: 274560 - RNA, 19 nt, Homo sapiens
ugaaugaugccuuggcuau

SEQ ID NO: 274561 - RNA, 19 nt, Homo sapiens
aaagggaguuugguucugu

SEQ ID NO: 274562 - RNA, 19 nt, Homo sapiens
uaaaggaagacaaguugga

SEQ ID NO: 274563 - RNA, 19 nt, Homo sapiens
aaugaugccuuggcuauuc

SEQ ID NO: 274564 - RNA, 19 nt, Homo sapiens
gaaagagaagaaugcaaag

SEQ ID NO: 274565 - RNA, 19 nt, Homo sapiens
gaagaaagagaagaaugca

SEQ ID NO: 274566 - RNA, 19 nt, Homo sapiens
gaaugaugccuuggcuauu

SEQ ID NO: 274567 - RNA, 19 nt, Homo sapiens
acacugauucuaccaaaga

SEQ ID NO: 274568 - RNA, 19 nt, Homo sapiens
acaaagacacugauucuac

SEQ ID NO: 274569 - RNA, 19 nt, Homo sapiens
ggaggagaaaucaaacaug

SEQ ID NO: 274570 - RNA, 19 nt, Homo sapiens
gcacaugaaagggaguuug

SEQ ID NO: 274571 - RNA, 19 nt, Homo sapiens
gacaaagacacugauucua

SEQ ID NO: 274572 - RNA, 19 nt, Homo sapiens
gacaugauacuaauaacca

SEQ ID NO: 274573 - RNA, 19 nt, Homo sapiens
uaugaggucucguaaacag

SEQ ID NO: 274574 - RNA, 19 nt, Homo sapiens
uaaccuggcauccugcuau

SEQ ID NO: 274575 - RNA, 19 nt, Homo sapiens
gauguugccaagcaguuaa

SEQ ID NO: 274576 - RNA, 19 nt, Homo sapiens
gagaguauggcggcuggua

SEQ ID NO: 274577 - RNA, 19 nt, Homo sapiens
aaaguuugcuggagacacu

SEQ ID NO: 274578 - RNA, 19 nt, Homo sapiens
gaaccagggcaaguaugaa

SEQ ID NO: 274579 - RNA, 19 nt, Homo sapiens
uaaccuugcaguccuuuau

SEQ ID NO: 274580 - RNA, 19 nt, Homo sapiens
gcuaaccuacugaaugaug

SEQ ID NO: 274581 - RNA, 19 nt, Homo sapiens
gcuuacacaggaugaaauu

SEQ ID NO: 274582 - RNA, 19 nt, Homo sapiens
ucuaagacaaagcaaguaa

SEQ ID NO: 274583 - RNA, 19 nt, Homo sapiens
cuggaugcaugcugaagaa

SEQ ID NO: 274584 - RNA, 19 nt, Homo sapiens
gaaggaauauguacaaaga

SEQ ID NO: 274585 - RNA, 19 nt, Homo sapiens
gcagaaaucuaaggauaua

SEQ ID NO: 274586 - RNA, 19 nt, Homo sapiens
caacaaggaugaagucuau

SEQ ID NO: 274587 - RNA, 19 nt, Homo sapiens
caacaucuguccuuagaaa

SEQ ID NO: 274588 - RNA, 19 nt, Homo sapiens
gaauaagccugaagugaau

SEQ ID NO: 274589 - RNA, 19 nt, Homo sapiens
cagcagaaaucuaaggaua

SEQ ID NO: 274590 - RNA, 19 nt, Homo sapiens
gagaagagcuuguuaaaau

SEQ ID NO: 274591 - RNA, 19 nt, Homo sapiens
uaaggcagcucaugagaaa

SEQ ID NO: 274592 - RNA, 19 nt, Homo sapiens
cuagauggcuuucucagua

SEQ ID NO: 274593 - RNA, 19 nt, Homo sapiens
gagcccagaucaaccuuua

SEQ ID NO: 274594 - RNA, 19 nt, Homo sapiens
gaaaggaccaucucauguu

SEQ ID NO: 274595 - RNA, 19 nt, Homo sapiens
gaaaucagauggacguaag

SEQ ID NO: 274596 - RNA, 19 nt, Homo sapiens
gauggcagcucaaagcaaa

SEQ ID NO: 274597 - RNA, 19 nt, Homo sapiens
ggaaaguacugaggagaaa

SEQ ID NO: 274598 - RNA, 19 nt, Homo sapiens
gaaagaaacuacgauugau

SEQ ID NO: 274599 - RNA, 19 nt, Homo sapiens
ggagaggucuaaaguggaa

SEQ ID NO: 274600 - RNA, 19 nt, Homo sapiens
gaaacacucugauaaacuc

SEQ ID NO: 274601 - RNA, 19 nt, Homo sapiens
ucgggaagcuggaaauaua

SEQ ID NO: 274602 - RNA, 19 nt, Homo sapiens
gagaagcucacaaugauuu

SEQ ID NO: 274603 - RNA, 19 nt, Homo sapiens
agacugaucuucuaaguuc

SEQ ID NO: 274604 - RNA, 19 nt, Homo sapiens
ggucauuacugcccuugua

SEQ ID NO: 274605 - RNA, 19 nt, Homo sapiens
gacaguggccgauaagaua

SEQ ID NO: 274606 - RNA, 19 nt, Homo sapiens
gaacuugaccaguguaaau

SEQ ID NO: 274607 - RNA, 19 nt, Homo sapiens
gaauaggguuacagaguug

SEQ ID NO: 274608 - RNA, 19 nt, Homo sapiens
gagcaaagaacauauugaa

SEQ ID NO: 274609 - RNA, 19 nt, Homo sapiens
gacaagagcucaaggaaaa

SEQ ID NO: 274610 - RNA, 19 nt, Homo sapiens
cacaggaacucagaaauuu

SEQ ID NO: 274611 - RNA, 19 nt, Homo sapiens
gcaaguuaaugaaucuuug

SEQ ID NO: 274612 - RNA, 19 nt, Homo sapiens
cuacaggaauugauuaaug

SEQ ID NO: 274613 - RNA, 19 nt, Homo sapiens
gaacuugguugaucuugca

SEQ ID NO: 274614 - RNA, 19 nt, Homo sapiens
cuaaauugaucucguagaa

SEQ ID NO: 274615 - RNA, 19 nt, Homo sapiens
gaacuugagccuuguguau

SEQ ID NO: 274616 - RNA, 19 nt, Homo sapiens
acaggaacuucacaacuua

SEQ ID NO: 274617 - RNA, 19 nt, Homo sapiens
cauaagcgauggauaauac

SEQ ID NO: 274618 - RNA, 19 nt, Homo sapiens
caaaaccuauccuuucuua

SEQ ID NO: 274619 - RNA, 19 nt, Homo sapiens
ggaugaagucuaucaaauu

SEQ ID NO: 274620 - RNA, 19 nt, Homo sapiens
agagaggagugauaauuaa

SEQ ID NO: 274621 - RNA, 19 nt, Homo sapiens
ccacguacccuucaucaaa

SEQ ID NO: 274622 - RNA, 19 nt, Homo sapiens
gcuauaauuucucugcaaa

SEQ ID NO: 274623 - RNA, 19 nt, Homo sapiens
uagagaagcucacaaugau

SEQ ID NO: 274624 - RNA, 19 nt, Homo sapiens
caacaaagaagagacaauu

SEQ ID NO: 274625 - RNA, 19 nt, Homo sapiens
ucaagagacugaacagaga

SEQ ID NO: 274626 - RNA, 19 nt, Homo sapiens
gaauauaucacaucagcuu

SEQ ID NO: 274627 - RNA, 19 nt, Homo sapiens
ugaauaggguuacagaguu

SEQ ID NO: 274628 - RNA, 19 nt, Homo sapiens
ugaaagaaacuacgauuga

SEQ ID NO: 274629 - RNA, 19 nt, Homo sapiens
gacuacagauguuugauga

SEQ ID NO: 274630 - RNA, 19 nt, Homo sapiens
ugaagaaccucuaagucaa

SEQ ID NO: 274631 - RNA, 19 nt, Homo sapiens
gugaacaucuccuugauca

SEQ ID NO: 274632 - RNA, 19 nt, Homo sapiens
gaaacuggauaucccaaca

SEQ ID NO: 274633 - RNA, 19 nt, Homo sapiens
guggguaucuuccuuaaau

SEQ ID NO: 274634 - RNA, 19 nt, Homo sapiens
gaaaaugugucuacucaug

SEQ ID NO: 274635 - RNA, 19 nt, Homo sapiens
gcacuuggaucucucacau

SEQ ID NO: 274636 - RNA, 19 nt, Homo sapiens
gaguguauauuucugaaga

SEQ ID NO: 274637 - RNA, 19 nt, Homo sapiens
gaaauuacaguacacaaca

SEQ ID NO: 274638 - RNA, 19 nt, Homo sapiens
gaggaucccuuggcuggua

SEQ ID NO: 274639 - RNA, 19 nt, Homo sapiens
aaaggaccaucucauguuu

SEQ ID NO: 274640 - RNA, 19 nt, Homo sapiens
gagaaacagcauaacauuu

SEQ ID NO: 274641 - RNA, 19 nt, Homo sapiens
uaagaggccuaacucauuc

SEQ ID NO: 274642 - RNA, 19 nt, Homo sapiens
gauauaaggcaguacugua

SEQ ID NO: 274643 - RNA, 19 nt, Homo sapiens
gaacacaagaacaguuuau

SEQ ID NO: 274644 - RNA, 19 nt, Homo sapiens
ugaauaagccugaagugaa

SEQ ID NO: 274645 - RNA, 19 nt, Homo sapiens
uaacaagagaggagugaua

SEQ ID NO: 274646 - RNA, 19 nt, Homo sapiens
gaaacuuacugauaauggu

SEQ ID NO: 274647 - RNA, 19 nt, Homo sapiens
gaauauaugcuacuucaag

SEQ ID NO: 274648 - RNA, 19 nt, Homo sapiens
caaacccuauugaagaauu

SEQ ID NO: 274649 - RNA, 19 nt, Homo sapiens
ucagaugacuauugaugaa

SEQ ID NO: 274650 - RNA, 19 nt, Homo sapiens
agacaucacugagaaauca

SEQ ID NO: 274651 - RNA, 19 nt, Homo sapiens
gaggaaaagugugaaaaua

SEQ ID NO: 274652 - RNA, 19 nt, Homo sapiens
caauaaagcagacccauuc

SEQ ID NO: 274653 - RNA, 19 nt, Homo sapiens
ggaacuagauggcuuucuc

SEQ ID NO: 274654 - RNA, 19 nt, Homo sapiens
uuacagaguuguuuaugga

SEQ ID NO: 274655 - RNA, 19 nt, Homo sapiens
caagagaggagugauaauu

SEQ ID NO: 274656 - RNA, 19 nt, Homo sapiens
guaaauaucaccaacaucu

SEQ ID NO: 274657 - RNA, 19 nt, Homo sapiens
uaaguucacuggaaaugau

SEQ ID NO: 274658 - RNA, 19 nt, Homo sapiens
caucugacuuugauagcua

SEQ ID NO: 274659 - RNA, 19 nt, Homo sapiens
caauaaaucuaacccuagu

SEQ ID NO: 274660 - RNA, 19 nt, Homo sapiens
auacagaaaccacuuagua

SEQ ID NO: 274661 - RNA, 19 nt, Homo sapiens
gaagaccugaagacaauaa

SEQ ID NO: 274662 - RNA, 19 nt, Homo sapiens
guggaaaccuaacugaaga

SEQ ID NO: 274663 - RNA, 19 nt, Homo sapiens
aagagcagauuguagaauu

SEQ ID NO: 274664 - RNA, 19 nt, Homo sapiens
ggagaucuauaaugaagag

SEQ ID NO: 274665 - RNA, 19 nt, Homo sapiens
ucaccaacaucuguccuua

SEQ ID NO: 274666 - RNA, 19 nt, Homo sapiens
ucacaggaacucagaaauu

SEQ ID NO: 274667 - RNA, 19 nt, Homo sapiens
uaaugaaucuuuggacaga

SEQ ID NO: 274668 - RNA, 19 nt, Homo sapiens
guacuacaggaauugauua

SEQ ID NO: 274669 - RNA, 19 nt, Homo sapiens
caaacuggaucguaagaag

SEQ ID NO: 274670 - RNA, 19 nt, Homo sapiens
ucccuuggcugguauaauu

SEQ ID NO: 274671 - RNA, 19 nt, Homo sapiens
cugaagaccugaagacaau

SEQ ID NO: 274672 - RNA, 19 nt, Homo sapiens
caaucuacaugaacuacaa

SEQ ID NO: 274673 - RNA, 19 nt, Homo sapiens
gaggagaaacuucaugaug

SEQ ID NO: 274674 - RNA, 19 nt, Homo sapiens
uguuggagaucuauaauga

SEQ ID NO: 274675 - RNA, 19 nt, Homo sapiens
ucccuagacuucccuauuu

SEQ ID NO: 274676 - RNA, 19 nt, Homo sapiens
gcacgagaaucacuugaac

SEQ ID NO: 274677 - RNA, 19 nt, Homo sapiens
gugaaucucugaacacaag

SEQ ID NO: 274678 - RNA, 19 nt, Homo sapiens
ccaagaagguacaaaauug

SEQ ID NO: 274679 - RNA, 19 nt, Homo sapiens
cuaaggauauagucaacaa

SEQ ID NO: 274680 - RNA, 19 nt, Homo sapiens
uuaauguacucaagacuga

SEQ ID NO: 274681 - RNA, 19 nt, Homo sapiens
ggagauagaacguuuaaaa

SEQ ID NO: 274682 - RNA, 19 nt, Homo sapiens
cggaggagauagaacguuu

SEQ ID NO: 274683 - RNA, 19 nt, Homo sapiens
guagaaagaacaccucaug

SEQ ID NO: 274684 - RNA, 19 nt, Homo sapiens
ggacuuaaagggucaguua

SEQ ID NO: 274685 - RNA, 19 nt, Homo sapiens
gaacauagaacugaagaga

SEQ ID NO: 274686 - RNA, 19 nt, Homo sapiens
ggcaagaccuucacaaugg

SEQ ID NO: 274687 - RNA, 19 nt, Homo sapiens
ugaccuaaaugcagaacua

SEQ ID NO: 274688 - RNA, 19 nt, Homo sapiens
ggaccgagguggacaugga

SEQ ID NO: 274689 - RNA, 19 nt, Homo sapiens
gcuggagggugcuuuauug

SEQ ID NO: 274690 - RNA, 19 nt, Homo sapiens
ccucaacucucuacgcuuu

SEQ ID NO: 274691 - RNA, 19 nt, Homo sapiens
gugcuaagaugcucauguu

SEQ ID NO: 274692 - RNA, 19 nt, Homo sapiens
gaggaggccugaccagaug

SEQ ID NO: 274693 - RNA, 19 nt, Homo sapiens
ucccagggcuaucaaauaa

SEQ ID NO: 274694 - RNA, 19 nt, Homo sapiens
ucaguuaugugaccuaaau

SEQ ID NO: 274695 - RNA, 19 nt, Homo sapiens
gggaaacacaggccauuaa

SEQ ID NO: 274696 - RNA, 19 nt, Homo sapiens
ggacagagcgcacaacacu

SEQ ID NO: 274697 - RNA, 19 nt, Homo sapiens
gcaagaccuucacaaugga

SEQ ID NO: 274698 - RNA, 19 nt, Homo sapiens
cuaagaugcucauguuugu

SEQ ID NO: 274699 - RNA, 19 nt, Homo sapiens
gcuaagaugcucauguuug

SEQ ID NO: 274700 - RNA, 19 nt, Homo sapiens
ugaaguguuugaagagauu

SEQ ID NO: 274701 - RNA, 19 nt, Homo sapiens
aacaggagcugaagaacuu

SEQ ID NO: 274702 - RNA, 19 nt, Homo sapiens
gaugaaguguuugaagaga

SEQ ID NO: 274703 - RNA, 19 nt, Homo sapiens
uaaagggucaguuauguga

SEQ ID NO: 274704 - RNA, 19 nt, Homo sapiens
gaagaaacccagcaaacgu

SEQ ID NO: 274705 - RNA, 19 nt, Homo sapiens
ggagcucacugucaccaau

SEQ ID NO: 274706 - RNA, 19 nt, Homo sapiens
gaagccaguuccugcuguu

SEQ ID NO: 274707 - RNA, 19 nt, Homo sapiens
gagaagaaacggacaagag

SEQ ID NO: 274708 - RNA, 19 nt, Homo sapiens
cugaagaacuugcgugcuu

SEQ ID NO: 274709 - RNA, 19 nt, Homo sapiens
ccagggcuaucaaauaaag

SEQ ID NO: 274710 - RNA, 19 nt, Homo sapiens
uggacaggaugaaguguuu

SEQ ID NO: 274711 - RNA, 19 nt, Homo sapiens
aaggugaaccaguguguua

SEQ ID NO: 274712 - RNA, 19 nt, Homo sapiens
gaaguggacaggaugaagu

SEQ ID NO: 274713 - RNA, 19 nt, Homo sapiens
ucaggaagcagacucaaga

SEQ ID NO: 274714 - RNA, 19 nt, Homo sapiens
gaaacacaggccauuaaca

SEQ ID NO: 274715 - RNA, 19 nt, Homo sapiens
gugaaccaguguguuauug

SEQ ID NO: 274716 - RNA, 19 nt, Homo sapiens
aggaugaaguguuugaaga

SEQ ID NO: 274717 - RNA, 19 nt, Homo sapiens
agaggaggcugcagacauc

SEQ ID NO: 274718 - RNA, 19 nt, Homo sapiens
ucacgcagccacaguguau

SEQ ID NO: 274719 - RNA, 19 nt, Homo sapiens
gaagcagcccugucaagca

SEQ ID NO: 274720 - RNA, 19 nt, Homo sapiens
cgaguucucuacccugcuu

SEQ ID NO: 274721 - RNA, 19 nt, Homo sapiens
cuuaaagggucaguuaugu

SEQ ID NO: 274722 - RNA, 19 nt, Homo sapiens
agaguuccaucccucacua

SEQ ID NO: 274723 - RNA, 19 nt, Homo sapiens
caccaaugcucgauauguc

SEQ ID NO: 274724 - RNA, 19 nt, Homo sapiens
gagaggaggcugcagacau

SEQ ID NO: 274725 - RNA, 19 nt, Homo sapiens
ggaagaaacccagcaaacg

SEQ ID NO: 274726 - RNA, 19 nt, Homo sapiens
gccuggagccugagaagaa

SEQ ID NO: 274727 - RNA, 19 nt, Homo sapiens
ugaagagauugccaugcuu

SEQ ID NO: 274728 - RNA, 19 nt, Homo sapiens
gggcaacauccguguauuc

SEQ ID NO: 274729 - RNA, 19 nt, Homo sapiens
gccaacaggagcugaagaa

SEQ ID NO: 274730 - RNA, 19 nt, Homo sapiens
gucccagggcuaucaaaua

SEQ ID NO: 274731 - RNA, 19 nt, Homo sapiens
aaacacaggccauuaacag

SEQ ID NO: 274732 - RNA, 19 nt, Homo sapiens
ugucaccaaugcucgauau

SEQ ID NO: 274733 - RNA, 19 nt, Homo sapiens
guaugcaucuuugccuaug

SEQ ID NO: 274734 - RNA, 19 nt, Homo sapiens
uauccaguaugcaucuuug

SEQ ID NO: 274735 - RNA, 19 nt, Homo sapiens
gauccuccaacccgccuua

SEQ ID NO: 274736 - RNA, 19 nt, Homo sapiens
ggugaaccaguguguuauu

SEQ ID NO: 274737 - RNA, 19 nt, Homo sapiens
ggaaacacaggccauuaac

SEQ ID NO: 274738 - RNA, 19 nt, Homo sapiens
ggugcaagagcuucagaaa

SEQ ID NO: 274739 - RNA, 19 nt, Homo sapiens
caacaggagcugaagaacu

SEQ ID NO: 274740 - RNA, 19 nt, Homo sapiens
gacaggaugaaguguuuga

SEQ ID NO: 274741 - RNA, 19 nt, Homo sapiens
gcacaaccagcugcaggaa

SEQ ID NO: 274742 - RNA, 19 nt, Homo sapiens
gaagaacuugcgugcuugu

SEQ ID NO: 274743 - RNA, 19 nt, Homo sapiens
guauuccagcuacagauuu

SEQ ID NO: 274744 - RNA, 19 nt, Homo sapiens
gaacggaggggacugaugu

SEQ ID NO: 274745 - RNA, 19 nt, Homo sapiens
gggaagaaacccagcaaac

SEQ ID NO: 274746 - RNA, 19 nt, Homo sapiens
ccuggagccugagaagaaa

SEQ ID NO: 274747 - RNA, 19 nt, Homo sapiens
cgggaacgccuucgggaaa

SEQ ID NO: 274748 - RNA, 19 nt, Homo sapiens
uggcaagaccuucacaaug

SEQ ID NO: 274749 - RNA, 19 nt, Homo sapiens
acaaccagcugcaggaacu

SEQ ID NO: 274750 - RNA, 19 nt, Homo sapiens
ggccugaccagauggaaga

SEQ ID NO: 274751 - RNA, 19 nt, Homo sapiens
gaccuaaaugcagaacuaa

SEQ ID NO: 274752 - RNA, 19 nt, Homo sapiens
ggccagaccacagcucaaa

SEQ ID NO: 274753 - RNA, 19 nt, Homo sapiens
ccacaucccacccaagagu

SEQ ID NO: 274754 - RNA, 19 nt, Homo sapiens
aagaugcucauguuuguga

SEQ ID NO: 274755 - RNA, 19 nt, Homo sapiens
uaccggaacagcaaacuga

SEQ ID NO: 274756 - RNA, 19 nt, Homo sapiens
ggaacgccuucgggaaaca

SEQ ID NO: 274757 - RNA, 19 nt, Homo sapiens
ggaaguaaaggggaacaua

SEQ ID NO: 274758 - RNA, 19 nt, Homo sapiens
ggaugaaguguuugaagag

SEQ ID NO: 274759 - RNA, 19 nt, Homo sapiens
ccacaguguauuccagcua

SEQ ID NO: 274760 - RNA, 19 nt, Homo sapiens
gggaacauagaacugaaga

SEQ ID NO: 274761 - RNA, 19 nt, Homo sapiens
caagggcaacauccgugua

SEQ ID NO: 274762 - RNA, 19 nt, Homo sapiens
ggaggcugcagacaucaga

SEQ ID NO: 274763 - RNA, 19 nt, Homo sapiens
gaagaaccagaagccaguu

SEQ ID NO: 274764 - RNA, 19 nt, Homo sapiens
ggaacagcaaacugaccua

SEQ ID NO: 274765 - RNA, 19 nt, Homo sapiens
ccgcacagcccagaaugaa

SEQ ID NO: 274766 - RNA, 19 nt, Homo sapiens
uaccacaucccacccaaga

SEQ ID NO: 274767 - RNA, 19 nt, Homo sapiens
cgggaaacacaggccauua

SEQ ID NO: 274768 - RNA, 19 nt, Homo sapiens
uauuccagcuacagauuuc

SEQ ID NO: 274769 - RNA, 19 nt, Homo sapiens
ucauggcccugagcaacaa

SEQ ID NO: 274770 - RNA, 19 nt, Homo sapiens
gagggaagaaacccagcaa

SEQ ID NO: 274771 - RNA, 19 nt, Homo sapiens
uugaagagauugccaugcu

SEQ ID NO: 274772 - RNA, 19 nt, Homo sapiens
ggaaguggacaggaugaag

SEQ ID NO: 274773 - RNA, 19 nt, Homo sapiens
ggaacucaagggcaacauc

SEQ ID NO: 274774 - RNA, 19 nt, Homo sapiens
gcaggagggcuuggugcaa

SEQ ID NO: 274775 - RNA, 19 nt, Homo sapiens
gaaguaaaggggaacauag

SEQ ID NO: 274776 - RNA, 19 nt, Homo sapiens
ugucccaacuagaggagaa

SEQ ID NO: 274777 - RNA, 19 nt, Homo sapiens
gcauuuagccaagguacag

SEQ ID NO: 274778 - RNA, 19 nt, Homo sapiens
cgaccaaaauuaccacauc

SEQ ID NO: 274779 - RNA, 19 nt, Homo sapiens
gggaacgccuucgggaaac

SEQ ID NO: 274780 - RNA, 19 nt, Homo sapiens
ucaccaaugcucgauaugu

SEQ ID NO: 274781 - RNA, 19 nt, Homo sapiens
gagcucacugucaccaaug

SEQ ID NO: 274782 - RNA, 19 nt, Homo sapiens
gucccuaugucuauguauc

SEQ ID NO: 274783 - RNA, 19 nt, Homo sapiens
cuacagugccacagacaca

SEQ ID NO: 274784 - RNA, 19 nt, Homo sapiens
cagagugacuuaggaauua

SEQ ID NO: 274785 - RNA, 19 nt, Homo sapiens
gcauaugugcuuagaaaua

SEQ ID NO: 274786 - RNA, 19 nt, Homo sapiens
aaacaauucuggugaaaug

SEQ ID NO: 274787 - RNA, 19 nt, Homo sapiens
ggaaacaauucuggugaaa

SEQ ID NO: 274788 - RNA, 19 nt, Homo sapiens
ggaaggagccgcagagcuu

SEQ ID NO: 274789 - RNA, 19 nt, Homo sapiens
ugacagcacugcagaccaa

SEQ ID NO: 274790 - RNA, 19 nt, Homo sapiens
ggucucaccugauaauuac

SEQ ID NO: 274791 - RNA, 19 nt, Homo sapiens
gcuuagaaauaaacagguu

SEQ ID NO: 274792 - RNA, 19 nt, Homo sapiens
ggaagaggaggccggauug

SEQ ID NO: 274793 - RNA, 19 nt, Homo sapiens
acauggaccucaggguuua

SEQ ID NO: 274794 - RNA, 19 nt, Homo sapiens
augcauaugugcuuagaaa

SEQ ID NO: 274795 - RNA, 19 nt, Homo sapiens
gccacccucugauugauaa

SEQ ID NO: 274796 - RNA, 19 nt, Homo sapiens
uggaggcgaugcgaaguua

SEQ ID NO: 274797 - RNA, 19 nt, Homo sapiens
caagaagcccaaagguuga

SEQ ID NO: 274798 - RNA, 19 nt, Homo sapiens
gacauggaccucaggguuu

SEQ ID NO: 274799 - RNA, 19 nt, Homo sapiens
caauucuggugaaauguga

SEQ ID NO: 274800 - RNA, 19 nt, Homo sapiens
ccuacucacuucucucuug

SEQ ID NO: 274801 - RNA, 19 nt, Homo sapiens
cgaaguuacuggugauucu

SEQ ID NO: 274802 - RNA, 19 nt, Homo sapiens
gggaagaggaggccggauu

SEQ ID NO: 274803 - RNA, 19 nt, Homo sapiens
ggcagcgccucgaaacuga

SEQ ID NO: 274804 - RNA, 19 nt, Homo sapiens
cggauugaaugcauuaaca

SEQ ID NO: 274805 - RNA, 19 nt, Homo sapiens
uaacgcagcacacaaaguc

SEQ ID NO: 274806 - RNA, 19 nt, Homo sapiens
gaaacaauucuggugaaau

SEQ ID NO: 274807 - RNA, 19 nt, Homo sapiens
gggcuuguguuuaauuaac

SEQ ID NO: 274808 - RNA, 19 nt, Homo sapiens
gaggaggccggauugaaug

SEQ ID NO: 274809 - RNA, 19 nt, Homo sapiens
gaagaggaggccggauuga

SEQ ID NO: 274810 - RNA, 19 nt, Homo sapiens
auaauuacggugacucuaa

SEQ ID NO: 274811 - RNA, 19 nt, Homo sapiens
guggaaguuuacaauaaug

SEQ ID NO: 274812 - RNA, 19 nt, Homo sapiens
ccacagagugacuuaggaa

SEQ ID NO: 274813 - RNA, 19 nt, Homo sapiens
uuggauggguacaauguuu

SEQ ID NO: 274814 - RNA, 19 nt, Homo sapiens
ugacgucguuuuacucuuu

SEQ ID NO: 274815 - RNA, 19 nt, Homo sapiens
ggauugaaugcauuaacaa

SEQ ID NO: 274816 - RNA, 19 nt, Homo sapiens
gugauucucugcauuucuc

SEQ ID NO: 274817 - RNA, 19 nt, Homo sapiens
uaaugcauaugugcuuaga

SEQ ID NO: 274818 - RNA, 19 nt, Homo sapiens
gcccuguucugccgcuuga

SEQ ID NO: 274819 - RNA, 19 nt, Homo sapiens
ucuuguccuugcuuuauaa

SEQ ID NO: 274820 - RNA, 19 nt, Homo sapiens
gcaggaagggcaggaagga

SEQ ID NO: 274821 - RNA, 19 nt, Homo sapiens
acagagugacuuaggaauu

SEQ ID NO: 274822 - RNA, 19 nt, Homo sapiens
aggaaacaauucuggugaa

SEQ ID NO: 274823 - RNA, 19 nt, Homo sapiens
cauaguggaaguuuacaau

SEQ ID NO: 274824 - RNA, 19 nt, Homo sapiens
ggccggauugaaugcauua

SEQ ID NO: 274825 - RNA, 19 nt, Homo sapiens
gcacacaaagucuuaugac

SEQ ID NO: 274826 - RNA, 19 nt, Homo sapiens
gcaggugcaggcucgacua

SEQ ID NO: 274827 - RNA, 19 nt, Homo sapiens
uaauuacggugacucuaac

SEQ ID NO: 274828 - RNA, 19 nt, Homo sapiens
gauaauuacggugacucua

SEQ ID NO: 274829 - RNA, 19 nt, Homo sapiens
ucagagcgcggucuuugga

SEQ ID NO: 274830 - RNA, 19 nt, Homo sapiens
agaggaggccggauugaau

SEQ ID NO: 274831 - RNA, 19 nt, Homo sapiens
ggugcaggcucgacuacag

SEQ ID NO: 274832 - RNA, 19 nt, Homo sapiens
aaagguugaagucuccaua

SEQ ID NO: 274833 - RNA, 19 nt, Homo sapiens
gcggaaagagcuauaccau

SEQ ID NO: 274834 - RNA, 19 nt, Homo sapiens
aauuaacgcagcacacaaa

SEQ ID NO: 274835 - RNA, 19 nt, Homo sapiens
aaagucuuaugacgucguu

SEQ ID NO: 274836 - RNA, 19 nt, Homo sapiens
ggccacccucugauugaua

SEQ ID NO: 274837 - RNA, 19 nt, Homo sapiens
gagcaaacagaggcaggaa

SEQ ID NO: 274838 - RNA, 19 nt, Homo sapiens
gguugaagucuccauagug

SEQ ID NO: 274839 - RNA, 19 nt, Homo sapiens
ugacccacagagugacuua

SEQ ID NO: 274840 - RNA, 19 nt, Homo sapiens
gcuuuauaaugcauaugug

SEQ ID NO: 274841 - RNA, 19 nt, Homo sapiens
uguccuugcuuuauaaugc

SEQ ID NO: 274842 - RNA, 19 nt, Homo sapiens
ucucuuggauggguacaau

SEQ ID NO: 274843 - RNA, 19 nt, Homo sapiens
gauugaaugcauuaacaag

SEQ ID NO: 274844 - RNA, 19 nt, Homo sapiens
cgcagcacacaaagucuua

SEQ ID NO: 274845 - RNA, 19 nt, Homo sapiens
ggccaaagacagcauugca

SEQ ID NO: 274846 - RNA, 19 nt, Homo sapiens
agagugacuuaggaauuau

SEQ ID NO: 274847 - RNA, 19 nt, Homo sapiens
gaggccggauugaaugcau

SEQ ID NO: 274848 - RNA, 19 nt, Homo sapiens
ucucagagcgcggucuuug

SEQ ID NO: 274849 - RNA, 19 nt, Homo sapiens
ccacagccuccugcucuga

SEQ ID NO: 274850 - RNA, 19 nt, Homo sapiens
ggauggacggacagagguu

SEQ ID NO: 274851 - RNA, 19 nt, Homo sapiens
uaauuaacgcagcacacaa

SEQ ID NO: 274852 - RNA, 19 nt, Homo sapiens
ggccuucccagaugacaug

SEQ ID NO: 274853 - RNA, 19 nt, Homo sapiens
ggccuucccagaugacaug

SEQ ID NO: 274854 - RNA, 19 nt, Homo sapiens
cagagugacuuaggaauua

SEQ ID NO: 274855 - RNA, 19 nt, Homo sapiens
gcauaugugcuuagaaaua

SEQ ID NO: 274856 - RNA, 19 nt, Homo sapiens
aaacaauucuggugaaaug

SEQ ID NO: 274857 - RNA, 19 nt, Homo sapiens
ggaaacaauucuggugaaa

SEQ ID NO: 274858 - RNA, 19 nt, Homo sapiens
ggaaggagccgcagagcuu

SEQ ID NO: 274859 - RNA, 19 nt, Homo sapiens
ugacagcacugcagaccaa

SEQ ID NO: 274860 - RNA, 19 nt, Homo sapiens
ggucucaccugauaauuac

SEQ ID NO: 274861 - RNA, 19 nt, Homo sapiens
gcuuagaaauaaacagguu

SEQ ID NO: 274862 - RNA, 19 nt, Homo sapiens
ggaagaggaggccggauug

SEQ ID NO: 274863 - RNA, 19 nt, Homo sapiens
cggaggcgaugcgaaguua

SEQ ID NO: 274864 - RNA, 19 nt, Homo sapiens
acauggaccucaggguuua

SEQ ID NO: 274865 - RNA, 19 nt, Homo sapiens
augcauaugugcuuagaaa

SEQ ID NO: 274866 - RNA, 19 nt, Homo sapiens
gccacccucugauugauaa

SEQ ID NO: 274867 - RNA, 19 nt, Homo sapiens
caagaagcccaaagguuga

SEQ ID NO: 274868 - RNA, 19 nt, Homo sapiens
gacauggaccucaggguuu

SEQ ID NO: 274869 - RNA, 19 nt, Homo sapiens
caauucuggugaaauguga

SEQ ID NO: 274870 - RNA, 19 nt, Homo sapiens
ccuacucacuucucucuug

SEQ ID NO: 274871 - RNA, 19 nt, Homo sapiens
cgaaguuacuggugauucu

SEQ ID NO: 274872 - RNA, 19 nt, Homo sapiens
gggaagaggaggccggauu

SEQ ID NO: 274873 - RNA, 19 nt, Homo sapiens
ggcagcgccucgaaacuga

SEQ ID NO: 274874 - RNA, 19 nt, Homo sapiens
cggauugaaugcauuaaca

SEQ ID NO: 274875 - RNA, 19 nt, Homo sapiens
uaacgcagcacacaaaguc

SEQ ID NO: 274876 - RNA, 19 nt, Homo sapiens
gaaacaauucuggugaaau

SEQ ID NO: 274877 - RNA, 19 nt, Homo sapiens
gggcuuguguuuaauuaac

SEQ ID NO: 274878 - RNA, 19 nt, Homo sapiens
gaggaggccggauugaaug

SEQ ID NO: 274879 - RNA, 19 nt, Homo sapiens
gaagaggaggccggauuga

SEQ ID NO: 274880 - RNA, 19 nt, Homo sapiens
auaauuacggugacucuaa

SEQ ID NO: 274881 - RNA, 19 nt, Homo sapiens
guggaaguuuacaauaaug

SEQ ID NO: 274882 - RNA, 19 nt, Homo sapiens
ccacagagugacuuaggaa

SEQ ID NO: 274883 - RNA, 19 nt, Homo sapiens
uuggauggguacaauguuu

SEQ ID NO: 274884 - RNA, 19 nt, Homo sapiens
ugacgucguuuuacucuuu

SEQ ID NO: 274885 - RNA, 19 nt, Homo sapiens
ugagggagauggcgugcau

SEQ ID NO: 274886 - RNA, 19 nt, Homo sapiens
ggauugaaugcauuaacaa

SEQ ID NO: 274887 - RNA, 19 nt, Homo sapiens
gugauucucugcauuucuc

SEQ ID NO: 274888 - RNA, 19 nt, Homo sapiens
uaaugcauaugugcuuaga

SEQ ID NO: 274889 - RNA, 19 nt, Homo sapiens
gcccuguucugccgcuuga

SEQ ID NO: 274890 - RNA, 19 nt, Homo sapiens
ucuuguccuugcuuuauaa

SEQ ID NO: 274891 - RNA, 19 nt, Homo sapiens
gcaggaagggcaggaagga

SEQ ID NO: 274892 - RNA, 19 nt, Homo sapiens
acagagugacuuaggaauu

SEQ ID NO: 274893 - RNA, 19 nt, Homo sapiens
aggaaacaauucuggugaa

SEQ ID NO: 274894 - RNA, 19 nt, Homo sapiens
cauaguggaaguuuacaau

SEQ ID NO: 274895 - RNA, 19 nt, Homo sapiens
ggccggauugaaugcauua

SEQ ID NO: 274896 - RNA, 19 nt, Homo sapiens
gcacacaaagucuuaugac

SEQ ID NO: 274897 - RNA, 19 nt, Homo sapiens
gcaggugcaggcucgacua

SEQ ID NO: 274898 - RNA, 19 nt, Homo sapiens
cgagugcguuggugugucu

SEQ ID NO: 274899 - RNA, 19 nt, Homo sapiens
uaauuacggugacucuaac

SEQ ID NO: 274900 - RNA, 19 nt, Homo sapiens
gauaauuacggugacucua

SEQ ID NO: 274901 - RNA, 19 nt, Homo sapiens
ucagagcgcggucuuugga

SEQ ID NO: 274902 - RNA, 19 nt, Homo sapiens
agaggaggccggauugaau

SEQ ID NO: 274903 - RNA, 19 nt, Homo sapiens
ggugcaggcucgacuacag

SEQ ID NO: 274904 - RNA, 19 nt, Homo sapiens
aaagguugaagucuccaua

SEQ ID NO: 274905 - RNA, 19 nt, Homo sapiens
gcggaaagagcuauaccau

SEQ ID NO: 274906 - RNA, 19 nt, Homo sapiens
aauuaacgcagcacacaaa

SEQ ID NO: 274907 - RNA, 19 nt, Homo sapiens
aaagucuuaugacgucguu

SEQ ID NO: 274908 - RNA, 19 nt, Homo sapiens
ggccacccucugauugaua

SEQ ID NO: 274909 - RNA, 19 nt, Homo sapiens
gagcaaacagaggcaggaa

SEQ ID NO: 274910 - RNA, 19 nt, Homo sapiens
gguugaagucuccauagug

SEQ ID NO: 274911 - RNA, 19 nt, Homo sapiens
ugacccacagagugacuua

SEQ ID NO: 274912 - RNA, 19 nt, Homo sapiens
gcuuuauaaugcauaugug

SEQ ID NO: 274913 - RNA, 19 nt, Homo sapiens
uguccuugcuuuauaaugc

SEQ ID NO: 274914 - RNA, 19 nt, Homo sapiens
guuggugugucuggaguga

SEQ ID NO: 274915 - RNA, 19 nt, Homo sapiens
ucucuuggauggguacaau

SEQ ID NO: 274916 - RNA, 19 nt, Homo sapiens
gauugaaugcauuaacaag

SEQ ID NO: 274917 - RNA, 19 nt, Homo sapiens
cgcagcacacaaagucuua

SEQ ID NO: 274918 - RNA, 19 nt, Homo sapiens
ggccaaagacagcauugca

SEQ ID NO: 274919 - RNA, 19 nt, Homo sapiens
agagugacuuaggaauuau

SEQ ID NO: 274920 - RNA, 19 nt, Homo sapiens
gaggccggauugaaugcau

SEQ ID NO: 274921 - RNA, 19 nt, Homo sapiens
ucucagagcgcggucuuug

SEQ ID NO: 274922 - RNA, 19 nt, Homo sapiens
ccacagccuccugcucuga

SEQ ID NO: 274923 - RNA, 19 nt, Homo sapiens
ggauggacggacagagguu

SEQ ID NO: 274924 - RNA, 19 nt, Homo sapiens
uaauuaacgcagcacacaa

SEQ ID NO: 274925 - RNA, 19 nt, Homo sapiens
ggccuucccagaugacaug

SEQ ID NO: 274926 - RNA, 19 nt, Homo sapiens
ggccuucccagaugacaug

SEQ ID NO: 274927 - RNA, 19 nt, Homo sapiens
ggaaacagauggaguccuu

SEQ ID NO: 274928 - RNA, 19 nt, Homo sapiens
ggacaucuaugcagguuca

SEQ ID NO: 274929 - RNA, 19 nt, Homo sapiens
caagcucacucgccuauug

SEQ ID NO: 274930 - RNA, 19 nt, Homo sapiens
agaaggaccuagagauuga

SEQ ID NO: 274931 - RNA, 19 nt, Homo sapiens
gcuggucgcugucggcuaa

SEQ ID NO: 274932 - RNA, 19 nt, Homo sapiens
gaacagcgggagcaaguga

SEQ ID NO: 274933 - RNA, 19 nt, Homo sapiens
ccaaggaggugaucaaucg

SEQ ID NO: 274934 - RNA, 19 nt, Homo sapiens
ggaaaacucuaccugauug

SEQ ID NO: 274935 - RNA, 19 nt, Homo sapiens
gaauaaaggccggaagaga

SEQ ID NO: 274936 - RNA, 19 nt, Homo sapiens
gagcggauggugcuaauga

SEQ ID NO: 274937 - RNA, 19 nt, Homo sapiens
guacucagcaggacaucua

SEQ ID NO: 274938 - RNA, 19 nt, Homo sapiens
gagaaggaccuagagauug

SEQ ID NO: 274939 - RNA, 19 nt, Homo sapiens
gaagagaaggaccuagaga

SEQ ID NO: 274940 - RNA, 19 nt, Homo sapiens
ccaguuugaugccuucuau

SEQ ID NO: 274941 - RNA, 19 nt, Homo sapiens
uaagcugucucagaaagaa

SEQ ID NO: 274942 - RNA, 19 nt, Homo sapiens
ccagugugcuugccuaugg

SEQ ID NO: 274943 - RNA, 19 nt, Homo sapiens
aauaaaggccggaagagaa

SEQ ID NO: 274944 - RNA, 19 nt, Homo sapiens
gaacuggaggccaagaugu

SEQ ID NO: 274945 - RNA, 19 nt, Homo sapiens
ugaagacaguagaagagaa

SEQ ID NO: 274946 - RNA, 19 nt, Homo sapiens
gagagcggauggugcuaau

SEQ ID NO: 274947 - RNA, 19 nt, Homo sapiens
caccaugucuuaccuagag

SEQ ID NO: 274948 - RNA, 19 nt, Homo sapiens
uugagaggcuuaagacgaa

SEQ ID NO: 274949 - RNA, 19 nt, Homo sapiens
gaagacaguagaagagaag

SEQ ID NO: 274950 - RNA, 19 nt, Homo sapiens
ugagagacgcuucuaccua

SEQ ID NO: 274951 - RNA, 19 nt, Homo sapiens
gagauugagaggcuuaaga

SEQ ID NO: 274952 - RNA, 19 nt, Homo sapiens
guuaagcugucucagaaag

SEQ ID NO: 274953 - RNA, 19 nt, Homo sapiens
cuguuaagcugucucagaa

SEQ ID NO: 274954 - RNA, 19 nt, Homo sapiens
cgagaucuccgcagucuuc

SEQ ID NO: 274955 - RNA, 19 nt, Homo sapiens
agagaaggaccuagagauu

SEQ ID NO: 274956 - RNA, 19 nt, Homo sapiens
gcagaaugccagugugcuu

SEQ ID NO: 274957 - RNA, 19 nt, Homo sapiens
uaaugaagacaguagaaga

SEQ ID NO: 274958 - RNA, 19 nt, Homo sapiens
gcuaaugaagacaguagaa

SEQ ID NO: 274959 - RNA, 19 nt, Homo sapiens
uccacauccugaagaauaa

SEQ ID NO: 274960 - RNA, 19 nt, Homo sapiens
gcccacaguauccuuauug

SEQ ID NO: 274961 - RNA, 19 nt, Homo sapiens
gcugggagcuacagaucag

SEQ ID NO: 274962 - RNA, 19 nt, Homo sapiens
gagauccacauccugaaga

SEQ ID NO: 274963 - RNA, 19 nt, Homo sapiens
uagaagagaaggaccuaga

SEQ ID NO: 274964 - RNA, 19 nt, Homo sapiens
auaaaggccggaagagaaa

SEQ ID NO: 274965 - RNA, 19 nt, Homo sapiens
ggauggugcuaaugaagac

SEQ ID NO: 274966 - RNA, 19 nt, Homo sapiens
ggaagacgcacacaaugcu

SEQ ID NO: 274967 - RNA, 19 nt, Homo sapiens
caggacaucuaugcagguu

SEQ ID NO: 274968 - RNA, 19 nt, Homo sapiens
cgagauggcggcagcuuca

SEQ ID NO: 274969 - RNA, 19 nt, Homo sapiens
ccaaggagggaguggaaug

SEQ ID NO: 274970 - RNA, 19 nt, Homo sapiens
gagaguggagccaucaaca

SEQ ID NO: 274971 - RNA, 19 nt, Homo sapiens
gacacagucuccgcacuca

SEQ ID NO: 274972 - RNA, 19 nt, Homo sapiens
cuagagauugagaggcuua

SEQ ID NO: 274973 - RNA, 19 nt, Homo sapiens
cccagaagcccaucaguag

SEQ ID NO: 274974 - RNA, 19 nt, Homo sapiens
caacauugccccugagaga

SEQ ID NO: 274975 - RNA, 19 nt, Homo sapiens
aagaauaaaggccggaaga

SEQ ID NO: 274976 - RNA, 19 nt, Homo sapiens
auggacagcugcucucuag

SEQ ID NO: 274977 - RNA, 19 nt, Homo sapiens
ucccagaagcccaucagua

SEQ ID NO: 274978 - RNA, 19 nt, Homo sapiens
auccacauccugaagaaua

SEQ ID NO: 274979 - RNA, 19 nt, Homo sapiens
ucagugcagcccauccuaa

SEQ ID NO: 274980 - RNA, 19 nt, Homo sapiens
gaacgcguggagggcauaa

SEQ ID NO: 274981 - RNA, 19 nt, Homo sapiens
uacuggaucugcugaacga

SEQ ID NO: 274982 - RNA, 19 nt, Homo sapiens
ggaaccaccaggagacucu

SEQ ID NO: 274983 - RNA, 19 nt, Homo sapiens
gggaagacgcacacaaugc

SEQ ID NO: 274984 - RNA, 19 nt, Homo sapiens
ggaguacucagcaggacau

SEQ ID NO: 274985 - RNA, 19 nt, Homo sapiens
gcccaaggagggaguggaa

SEQ ID NO: 274986 - RNA, 19 nt, Homo sapiens
agauccacauccugaagaa

SEQ ID NO: 274987 - RNA, 19 nt, Homo sapiens
ccagaaggcugaggaaaag

SEQ ID NO: 274988 - RNA, 19 nt, Homo sapiens
cgagagcggauggugcuaa

SEQ ID NO: 274989 - RNA, 19 nt, Homo sapiens
ggaccagcgggaacguuug

SEQ ID NO: 274990 - RNA, 19 nt, Homo sapiens
cccuagagccugaggagaa

SEQ ID NO: 274991 - RNA, 19 nt, Homo sapiens
gcugucggcuaagcaagau

SEQ ID NO: 274992 - RNA, 19 nt, Homo sapiens
gguccaaggaggugaucaa

SEQ ID NO: 274993 - RNA, 19 nt, Homo sapiens
gaucagcccggagcuacug

SEQ ID NO: 274994 - RNA, 19 nt, Homo sapiens
cagcuuggaccgucugcuu

SEQ ID NO: 274995 - RNA, 19 nt, Homo sapiens
uauccuuauugccaacauu

SEQ ID NO: 274996 - RNA, 19 nt, Homo sapiens
ccaugggcccuuucuguca

SEQ ID NO: 274997 - RNA, 19 nt, Homo sapiens
ggaacgcguggagggcaua

SEQ ID NO: 274998 - RNA, 19 nt, Homo sapiens
ccuguuaagcugucucaga

SEQ ID NO: 274999 - RNA, 19 nt, Homo sapiens
cucuagagauugcuaacug

SEQ ID NO: 275000 - RNA, 19 nt, Homo sapiens
ucagcccacaguauccuua

SEQ ID NO: 275001 - RNA, 19 nt, Homo sapiens
gggaaaacucuaccugauu

SEQ ID NO: 275002 - RNA, 19 nt, Homo sapiens
uacagaagcuaagcagcau

SEQ ID NO: 275003 - RNA, 19 nt, Homo sapiens
ggaaaaggagaaccauugu

SEQ ID NO: 275004 - RNA, 19 nt, Homo sapiens
cggauggugcuaaugaaga

SEQ ID NO: 275005 - RNA, 19 nt, Homo sapiens
gugcgacugcggccauuug

SEQ ID NO: 275006 - RNA, 19 nt, Homo sapiens
agucuccgcacucaacuuu

SEQ ID NO: 275007 - RNA, 19 nt, Homo sapiens
caggaaugcugaagaauua

SEQ ID NO: 275008 - RNA, 19 nt, Homo sapiens
gcacuggcauuaacccuua

SEQ ID NO: 275009 - RNA, 19 nt, Homo sapiens
gaaccuaacccuccuauug

SEQ ID NO: 275010 - RNA, 19 nt, Homo sapiens
ggagcuaacuucucaaaug

SEQ ID NO: 275011 - RNA, 19 nt, Homo sapiens
gagcagggcacauuuaauu

SEQ ID NO: 275012 - RNA, 19 nt, Homo sapiens
gggauacccuucuaauaaa

SEQ ID NO: 275013 - RNA, 19 nt, Homo sapiens
gcugaagaauuaacacuuu

SEQ ID NO: 275014 - RNA, 19 nt, Homo sapiens
gcacuuacauuagaguuau

SEQ ID NO: 275015 - RNA, 19 nt, Homo sapiens
gcuaacuucucaaauguuu

SEQ ID NO: 275016 - RNA, 19 nt, Homo sapiens
caacauugcuggagauagu

SEQ ID NO: 275017 - RNA, 19 nt, Homo sapiens
ggaagaaggacugcaguua

SEQ ID NO: 275018 - RNA, 19 nt, Homo sapiens
gagcuaacuucucaaaugu

SEQ ID NO: 275019 - RNA, 19 nt, Homo sapiens
gcucagaguuugaagaugu

SEQ ID NO: 275020 - RNA, 19 nt, Homo sapiens
ugaaugugcuuucuaguug

SEQ ID NO: 275021 - RNA, 19 nt, Homo sapiens
gagauccgcacuuacauua

SEQ ID NO: 275022 - RNA, 19 nt, Homo sapiens
gagaagagcaguuauucaa

SEQ ID NO: 275023 - RNA, 19 nt, Homo sapiens
guuuagaccuguugguaua

SEQ ID NO: 275024 - RNA, 19 nt, Homo sapiens
gaacggcacuggcauuaac

SEQ ID NO: 275025 - RNA, 19 nt, Homo sapiens
gaaauaaccaucuucucaa

SEQ ID NO: 275026 - RNA, 19 nt, Homo sapiens
ggaagcauguuggacgaua

SEQ ID NO: 275027 - RNA, 19 nt, Homo sapiens
gggcuguguuucugcauua

SEQ ID NO: 275028 - RNA, 19 nt, Homo sapiens
gauccgcacuuacauuaga

SEQ ID NO: 275029 - RNA, 19 nt, Homo sapiens
gaacagugaucuuauaacc

SEQ ID NO: 275030 - RNA, 19 nt, Homo sapiens
acagugaacccuuggauua

SEQ ID NO: 275031 - RNA, 19 nt, Homo sapiens
gugcagggacuaugucuua

SEQ ID NO: 275032 - RNA, 19 nt, Homo sapiens
gaaaagagaagagcaguua

SEQ ID NO: 275033 - RNA, 19 nt, Homo sapiens
gaucaaguaccuaguagaa

SEQ ID NO: 275034 - RNA, 19 nt, Homo sapiens
gaucaagguccucauuaaa

SEQ ID NO: 275035 - RNA, 19 nt, Homo sapiens
gcauuaauccuuacugaga

SEQ ID NO: 275036 - RNA, 19 nt, Homo sapiens
ugugauagaugccaacauu

SEQ ID NO: 275037 - RNA, 19 nt, Homo sapiens
cuaaauggcuuggaaaaua

SEQ ID NO: 275038 - RNA, 19 nt, Homo sapiens
ggucaucgaugcgggagua

SEQ ID NO: 275039 - RNA, 19 nt, Homo sapiens
aagaagaaguuaugucaga

SEQ ID NO: 275040 - RNA, 19 nt, Homo sapiens
ggucugggcacauuuaauu

SEQ ID NO: 275041 - RNA, 19 nt, Homo sapiens
ggucauggacucuaagauu

SEQ ID NO: 275042 - RNA, 19 nt, Homo sapiens
gaacugcugaugcauaaug

SEQ ID NO: 275043 - RNA, 19 nt, Homo sapiens
ugaaugugcuuuccugguu

SEQ ID NO: 275044 - RNA, 19 nt, Homo sapiens
ugacaugauugagaugaua

SEQ ID NO: 275045 - RNA, 19 nt, Homo sapiens
ggaguucacccuaggcuuu

SEQ ID NO: 275046 - RNA, 19 nt, Homo sapiens
ugaucaagguccucauuaa

SEQ ID NO: 275047 - RNA, 19 nt, Homo sapiens
ugggauacccuucuaauaa

SEQ ID NO: 275048 - RNA, 19 nt, Homo sapiens
cagcugaacagaucaagua

SEQ ID NO: 275049 - RNA, 19 nt, Homo sapiens
ucagauggacccaaugaua

SEQ ID NO: 275050 - RNA, 19 nt, Homo sapiens
gggaugauauucagacaca

SEQ ID NO: 275051 - RNA, 19 nt, Homo sapiens
ccaaaugcaaucaguguaa

SEQ ID NO: 275052 - RNA, 19 nt, Homo sapiens
uaagagcagggcacauuua

SEQ ID NO: 275053 - RNA, 19 nt, Homo sapiens
gcaaagguuucuccauguc

SEQ ID NO: 275054 - RNA, 19 nt, Homo sapiens
uaaccucauuguuuccuaa

SEQ ID NO: 275055 - RNA, 19 nt, Homo sapiens
gcagggcacauuuaauuug

SEQ ID NO: 275056 - RNA, 19 nt, Homo sapiens
gaagcauguuggacgauau

SEQ ID NO: 275057 - RNA, 19 nt, Homo sapiens
cagauggacccaaugauaa

SEQ ID NO: 275058 - RNA, 19 nt, Homo sapiens
ucacguaccugugcucaga

SEQ ID NO: 275059 - RNA, 19 nt, Homo sapiens
uggaacugcugaugcauaa

SEQ ID NO: 275060 - RNA, 19 nt, Homo sapiens
ggaaugcaguaugggcuuu

SEQ ID NO: 275061 - RNA, 19 nt, Homo sapiens
ucauggagcuaacuucuca

SEQ ID NO: 275062 - RNA, 19 nt, Homo sapiens
gucauggacucuaagauug

SEQ ID NO: 275063 - RNA, 19 nt, Homo sapiens
gaagaaggacugcaguuac

SEQ ID NO: 275064 - RNA, 19 nt, Homo sapiens
gguaagagcagggcacauu

SEQ ID NO: 275065 - RNA, 19 nt, Homo sapiens
uugcgcaccugcucucuua

SEQ ID NO: 275066 - RNA, 19 nt, Homo sapiens
cagcuuggguacugacaaa

SEQ ID NO: 275067 - RNA, 19 nt, Homo sapiens
agaagaaacagaagaagaa

SEQ ID NO: 275068 - RNA, 19 nt, Homo sapiens
ggacugcaguuacgaaagc

SEQ ID NO: 275069 - RNA, 19 nt, Homo sapiens
gaugaagacagcagcauug

SEQ ID NO: 275070 - RNA, 19 nt, Homo sapiens
ucacggucauggacucuaa

SEQ ID NO: 275071 - RNA, 19 nt, Homo sapiens
gaaacagaagaagaaguua

SEQ ID NO: 275072 - RNA, 19 nt, Homo sapiens
cuuauaaccucauuguuuc

SEQ ID NO: 275073 - RNA, 19 nt, Homo sapiens
gcgccauucuucagauauu

SEQ ID NO: 275074 - RNA, 19 nt, Homo sapiens
ccaaaggaaucuaucaaaa

SEQ ID NO: 275075 - RNA, 19 nt, Homo sapiens
agacacagguaauucugaa

SEQ ID NO: 275076 - RNA, 19 nt, Homo sapiens
caacacagaaauucaggaa

SEQ ID NO: 275077 - RNA, 19 nt, Homo sapiens
uaugucagauggaggcuuu

SEQ ID NO: 275078 - RNA, 19 nt, Homo sapiens
gcagauaacacauacuuuu

SEQ ID NO: 275079 - RNA, 19 nt, Homo sapiens
uuacugagauuggaugguu

SEQ ID NO: 275080 - RNA, 19 nt, Homo sapiens
ucaggaaauucucuucaga

SEQ ID NO: 275081 - RNA, 19 nt, Homo sapiens
gaucuuauaaccucauugu

SEQ ID NO: 275082 - RNA, 19 nt, Homo sapiens
gggcacauuuaauuuguuc

SEQ ID NO: 275083 - RNA, 19 nt, Homo sapiens
gggcacauuuaauuuguuc

SEQ ID NO: 275084 - RNA, 19 nt, Homo sapiens
gaaugugcuuucuaguugu

SEQ ID NO: 275085 - RNA, 19 nt, Homo sapiens
ggagauguuuagaccuguu

SEQ ID NO: 275086 - RNA, 19 nt, Homo sapiens
cauuagaguuaugggaaua

SEQ ID NO: 275087 - RNA, 19 nt, Homo sapiens
ggagauccgcacuuacauu

SEQ ID NO: 275088 - RNA, 19 nt, Homo sapiens
ccuugagccugaaauauga

SEQ ID NO: 275089 - RNA, 19 nt, Homo sapiens
gcggagaaauguugcuaca

SEQ ID NO: 275090 - RNA, 19 nt, Homo sapiens
guaucaagccgcucuguga

SEQ ID NO: 275091 - RNA, 19 nt, Homo sapiens
cauguuggacgauaucuaa

SEQ ID NO: 275092 - RNA, 19 nt, Homo sapiens
ugaaucagcuuggguacug

SEQ ID NO: 275093 - RNA, 19 nt, Homo sapiens
gaagaaguuaugucagaug

SEQ ID NO: 275094 - RNA, 19 nt, Homo sapiens
ucaaguaccuaguagaacu

SEQ ID NO: 275095 - RNA, 19 nt, Homo sapiens
gauccagacugugauagau

SEQ ID NO: 275096 - RNA, 19 nt, Homo sapiens
aaagagaagagcaguuauu

SEQ ID NO: 275097 - RNA, 19 nt, Homo sapiens
gauauucagacacagguaa

SEQ ID NO: 275098 - RNA, 19 nt, Homo sapiens
guuugaagauguccaggaa

SEQ ID NO: 275099 - RNA, 19 nt, Homo sapiens
agaaacagaagaagaaguu

SEQ ID NO: 275100 - RNA, 19 nt, Homo sapiens
guaagagcagggcacauuu

SEQ ID NO: 275101 - RNA, 19 nt, Homo sapiens
uaguagaacuggguuguau

SEQ ID NO: 275102 - RNA, 19 nt, Homo sapiens
cuucagacccgaauuguga

SEQ ID NO: 275103 - RNA, 19 nt, Homo sapiens
cgaaaaccauauccuguaa

SEQ ID NO: 275104 - RNA, 19 nt, Homo sapiens
gaagguuuccagcuuugaa

SEQ ID NO: 275105 - RNA, 19 nt, Homo sapiens
guaggagacuuguggaacu

SEQ ID NO: 275106 - RNA, 19 nt, Homo sapiens
gcugggcccucucauaucu

SEQ ID NO: 275107 - RNA, 19 nt, Homo sapiens
gaaccaagcuugaucuguu

SEQ ID NO: 275108 - RNA, 19 nt, Homo sapiens
ggacuuauguacagcauuu

SEQ ID NO: 275109 - RNA, 19 nt, Homo sapiens
ggaaggauguacugaaauu

SEQ ID NO: 275110 - RNA, 19 nt, Homo sapiens
ucaaugaccuucagucuuu

SEQ ID NO: 275111 - RNA, 19 nt, Homo sapiens
ucacacagauggaguagua

SEQ ID NO: 275112 - RNA, 19 nt, Homo sapiens
caagauaaauccaaugaga

SEQ ID NO: 275113 - RNA, 19 nt, Homo sapiens
gcacagagcacaugaagga

SEQ ID NO: 275114 - RNA, 19 nt, Homo sapiens
ggaaagaagagccuaguaa

SEQ ID NO: 275115 - RNA, 19 nt, Homo sapiens
gaaggagggucagggauuu

SEQ ID NO: 275116 - RNA, 19 nt, Homo sapiens
gcucaaaccacuaguuaua

SEQ ID NO: 275117 - RNA, 19 nt, Homo sapiens
gaagggagcacuacaguau

SEQ ID NO: 275118 - RNA, 19 nt, Homo sapiens
gcacggaugcugaauguuu

SEQ ID NO: 275119 - RNA, 19 nt, Homo sapiens
guaaacacauacacacaaa

SEQ ID NO: 275120 - RNA, 19 nt, Homo sapiens
gaaguucugucuacugaug

SEQ ID NO: 275121 - RNA, 19 nt, Homo sapiens
gacgagaagucaagaacua

SEQ ID NO: 275122 - RNA, 19 nt, Homo sapiens
cagagcagcuacaagauaa

SEQ ID NO: 275123 - RNA, 19 nt, Homo sapiens
ggaaugagaggaugaguga

SEQ ID NO: 275124 - RNA, 19 nt, Homo sapiens
gggcggagaucgaagacua

SEQ ID NO: 275125 - RNA, 19 nt, Homo sapiens
cugcuuaucuucuucauuu

SEQ ID NO: 275126 - RNA, 19 nt, Homo sapiens
gguuauauuugccaagaua

SEQ ID NO: 275127 - RNA, 19 nt, Homo sapiens
gaagccaucgguuauauuu

SEQ ID NO: 275128 - RNA, 19 nt, Homo sapiens
gugcagagaucccaguaaa

SEQ ID NO: 275129 - RNA, 19 nt, Homo sapiens
gugcaacucuucagaaugu

SEQ ID NO: 275130 - RNA, 19 nt, Homo sapiens
aagaagagccuaguaauaa

SEQ ID NO: 275131 - RNA, 19 nt, Homo sapiens
gaaagaagagccuaguaau

SEQ ID NO: 275132 - RNA, 19 nt, Homo sapiens
acuaugacaugguggauua

SEQ ID NO: 275133 - RNA, 19 nt, Homo sapiens
gguuauggccucccuguua

SEQ ID NO: 275134 - RNA, 19 nt, Homo sapiens
uaauaugguucaacuguga

SEQ ID NO: 275135 - RNA, 19 nt, Homo sapiens
cuggaaaucucccaucuuu

SEQ ID NO: 275136 - RNA, 19 nt, Homo sapiens
gaacugaggaaacugaaga

SEQ ID NO: 275137 - RNA, 19 nt, Homo sapiens
aaagaagagccuaguaaua

SEQ ID NO: 275138 - RNA, 19 nt, Homo sapiens
gaggaguucugcauaugaa

SEQ ID NO: 275139 - RNA, 19 nt, Homo sapiens
agagguggcuugcuauuga

SEQ ID NO: 275140 - RNA, 19 nt, Homo sapiens
uggagaaccugcccacuuu

SEQ ID NO: 275141 - RNA, 19 nt, Homo sapiens
gcaacagguucuucagaug

SEQ ID NO: 275142 - RNA, 19 nt, Homo sapiens
guuauggccucccuguuaa

SEQ ID NO: 275143 - RNA, 19 nt, Homo sapiens
guacauggaggccuuuaaa

SEQ ID NO: 275144 - RNA, 19 nt, Homo sapiens
gauagaauccaguucaaug

SEQ ID NO: 275145 - RNA, 19 nt, Homo sapiens
cagaguggcuucaaaugug

SEQ ID NO: 275146 - RNA, 19 nt, Homo sapiens
aguaagcacugacuucgua

SEQ ID NO: 275147 - RNA, 19 nt, Homo sapiens
ggaaaacacugacgaaugg

SEQ ID NO: 275148 - RNA, 19 nt, Homo sapiens
gguuagauguugcauuuca

SEQ ID NO: 275149 - RNA, 19 nt, Homo sapiens
ggccaaugauccaugaauu

SEQ ID NO: 275150 - RNA, 19 nt, Homo sapiens
cagccucccuuccuucuuu

SEQ ID NO: 275151 - RNA, 19 nt, Homo sapiens
ucacacagacacuaacuaa

SEQ ID NO: 275152 - RNA, 19 nt, Homo sapiens
gaaggauguacugaaauua

SEQ ID NO: 275153 - RNA, 19 nt, Homo sapiens
ggagaucgaagacuaacaa

SEQ ID NO: 275154 - RNA, 19 nt, Homo sapiens
gauauugcccuugcuauug

SEQ ID NO: 275155 - RNA, 19 nt, Homo sapiens
guggugaauuccucaagua

SEQ ID NO: 275156 - RNA, 19 nt, Homo sapiens
gaagucaagaacuauguuu

SEQ ID NO: 275157 - RNA, 19 nt, Homo sapiens
gagcacauccgauagaauc

SEQ ID NO: 275158 - RNA, 19 nt, Homo sapiens
cagcucaaaccacuaguua

SEQ ID NO: 275159 - RNA, 19 nt, Homo sapiens
gaagagccuaguaauaaug

SEQ ID NO: 275160 - RNA, 19 nt, Homo sapiens
ccagagcagcuacaagaua

SEQ ID NO: 275161 - RNA, 19 nt, Homo sapiens
ccgaaguucugucuacuga

SEQ ID NO: 275162 - RNA, 19 nt, Homo sapiens
caccuucgcuguaccuuug

SEQ ID NO: 275163 - RNA, 19 nt, Homo sapiens
gagaugaggaucacacaga

SEQ ID NO: 275164 - RNA, 19 nt, Homo sapiens
gaaagugcaacaucaagau

SEQ ID NO: 275165 - RNA, 19 nt, Homo sapiens
ggaaagugcaacaucaaga

SEQ ID NO: 275166 - RNA, 19 nt, Homo sapiens
uuaugaagcugcagacguu

SEQ ID NO: 275167 - RNA, 19 nt, Homo sapiens
agacagagccggugaaugg

SEQ ID NO: 275168 - RNA, 19 nt, Homo sapiens
aaagaaaacucuggcguua

SEQ ID NO: 275169 - RNA, 19 nt, Homo sapiens
cgaguggaaugccugguuu

SEQ ID NO: 275170 - RNA, 19 nt, Homo sapiens
gcacugacuucguagaaaa

SEQ ID NO: 275171 - RNA, 19 nt, Homo sapiens
aaccaagcuugaucuguua

SEQ ID NO: 275172 - RNA, 19 nt, Homo sapiens
ccacauugcuggagaugag

SEQ ID NO: 275173 - RNA, 19 nt, Homo sapiens
aggaagaaccagcuacuua

SEQ ID NO: 275174 - RNA, 19 nt, Homo sapiens
caacccagaguagaauuua

SEQ ID NO: 275175 - RNA, 19 nt, Homo sapiens
gcuacaagauaaauccaau

SEQ ID NO: 275176 - RNA, 19 nt, Homo sapiens
uaaccgaaguucugucuac

SEQ ID NO: 275177 - RNA, 19 nt, Homo sapiens
gggguuagauguugcauuu

SEQ ID NO: 275178 - RNA, 19 nt, Homo sapiens
ggaaaucucccaucuuuug

SEQ ID NO: 275179 - RNA, 19 nt, Homo sapiens
ugaggaaacugaagaacca

SEQ ID NO: 275180 - RNA, 19 nt, Homo sapiens
ugggaaggauguacugaaa

SEQ ID NO: 275181 - RNA, 19 nt, Homo sapiens
cugcagacguugcugauga

SEQ ID NO: 275182 - RNA, 19 nt, Homo sapiens
caaugucugugaugaggaa

SEQ ID NO: 275183 - RNA, 19 nt, Homo sapiens
gcaaacuucagguaacuau

SEQ ID NO: 275184 - RNA, 19 nt, Homo sapiens
aaauaacgcagacuucaaa

SEQ ID NO: 275185 - RNA, 19 nt, Homo sapiens
uaacaucggccaucuugga

SEQ ID NO: 275186 - RNA, 19 nt, Homo sapiens
gugcacggaugcugaaugu

SEQ ID NO: 275187 - RNA, 19 nt, Homo sapiens
caugguggauuaucugaau

SEQ ID NO: 275188 - RNA, 19 nt, Homo sapiens
aauccaacaucauaccuuu

SEQ ID NO: 275189 - RNA, 19 nt, Homo sapiens
acaagaggaugcccugaug

SEQ ID NO: 275190 - RNA, 19 nt, Homo sapiens
aaacagcaaacuucaggua

SEQ ID NO: 275191 - RNA, 19 nt, Homo sapiens
ugaaugagcuaagggaaag

SEQ ID NO: 275192 - RNA, 19 nt, Homo sapiens
ucaaaccacuaguuauaca

SEQ ID NO: 275193 - RNA, 19 nt, Homo sapiens
agaagagccuaguaauaau

SEQ ID NO: 275194 - RNA, 19 nt, Homo sapiens
cagcuguggugcuuuguug

SEQ ID NO: 275195 - RNA, 19 nt, Homo sapiens
guucagcuguggugcuuug

SEQ ID NO: 275196 - RNA, 19 nt, Homo sapiens
gaucgaagacuaacaaagc

SEQ ID NO: 275197 - RNA, 19 nt, Homo sapiens
gaagggcggagaucgaaga

SEQ ID NO: 275198 - RNA, 19 nt, Homo sapiens
agaacucuuugacaucuaa

SEQ ID NO: 275199 - RNA, 19 nt, Homo sapiens
cugaauaccagguuuguuu

SEQ ID NO: 275200 - RNA, 19 nt, Homo sapiens
cgacuuuggucaucaugga

SEQ ID NO: 275201 - RNA, 19 nt, Homo sapiens
ggaagaaccagcuacuuac

SEQ ID NO: 275202 - RNA, 19 nt, Homo sapiens
gguccaaugucugugauga

SEQ ID NO: 275203 - RNA, 19 nt, Homo sapiens
cuaaagauccagauaucaa

SEQ ID NO: 275204 - RNA, 19 nt, Homo sapiens
guacagcauuugggaagga

SEQ ID NO: 275205 - RNA, 19 nt, Homo sapiens
uuaaggauguuccaaagca

SEQ ID NO: 275206 - RNA, 19 nt, Homo sapiens
caaugaccuucagucuuua

SEQ ID NO: 275207 - RNA, 19 nt, Homo sapiens
ucuaggagcuucugaauug

SEQ ID NO: 275208 - RNA, 19 nt, Homo sapiens
gaaaugaggcgucgcagaa

SEQ ID NO: 275209 - RNA, 19 nt, Homo sapiens
gaagcuacguggacaaugu

SEQ ID NO: 275210 - RNA, 19 nt, Homo sapiens
gcauguggcuacuuacgua

SEQ ID NO: 275211 - RNA, 19 nt, Homo sapiens
aaucuuaccuggacacuuu

SEQ ID NO: 275212 - RNA, 19 nt, Homo sapiens
aaacuaacauucagaagga

SEQ ID NO: 275213 - RNA, 19 nt, Homo sapiens
gcagauucuuccuaccuua

SEQ ID NO: 275214 - RNA, 19 nt, Homo sapiens
uaagaaggaugaccagaug

SEQ ID NO: 275215 - RNA, 19 nt, Homo sapiens
gggcagaacugauuguagu

SEQ ID NO: 275216 - RNA, 19 nt, Homo sapiens
cugacuagguuucuaauuu

SEQ ID NO: 275217 - RNA, 19 nt, Homo sapiens
agacucagguugugauuga

SEQ ID NO: 275218 - RNA, 19 nt, Homo sapiens
ggaaagcuaagaaggauga

SEQ ID NO: 275219 - RNA, 19 nt, Homo sapiens
caacgagaaugcuaauaca

SEQ ID NO: 275220 - RNA, 19 nt, Homo sapiens
gaggaaagcuaagaaggau

SEQ ID NO: 275221 - RNA, 19 nt, Homo sapiens
uaauagaaccguugaugaa

SEQ ID NO: 275222 - RNA, 19 nt, Homo sapiens
ugacuagguuucuaauuuc

SEQ ID NO: 275223 - RNA, 19 nt, Homo sapiens
gaaacugagaaacuuagua

SEQ ID NO: 275224 - RNA, 19 nt, Homo sapiens
guaaauuggucuguugaug

SEQ ID NO: 275225 - RNA, 19 nt, Homo sapiens
gaauuggcaugguggugaa

SEQ ID NO: 275226 - RNA, 19 nt, Homo sapiens
uaaauuggucuguugauga

SEQ ID NO: 275227 - RNA, 19 nt, Homo sapiens
gauaccugcugggcuauuu

SEQ ID NO: 275228 - RNA, 19 nt, Homo sapiens
gaacagacucagguuguga

SEQ ID NO: 275229 - RNA, 19 nt, Homo sapiens
gaaauuuguguccuucuug

SEQ ID NO: 275230 - RNA, 19 nt, Homo sapiens
gagucgagguggacccuuu

SEQ ID NO: 275231 - RNA, 19 nt, Homo sapiens
guagucccauucaguuuga

SEQ ID NO: 275232 - RNA, 19 nt, Homo sapiens
uggaacaguugaacagauu

SEQ ID NO: 275233 - RNA, 19 nt, Homo sapiens
ccugauaugucaucuuuag

SEQ ID NO: 275234 - RNA, 19 nt, Homo sapiens
cgaaauuuguguccuucuu

SEQ ID NO: 275235 - RNA, 19 nt, Homo sapiens
aaugaggcgucgcagaaua

SEQ ID NO: 275236 - RNA, 19 nt, Homo sapiens
ccaagauuauucugguuau

SEQ ID NO: 275237 - RNA, 19 nt, Homo sapiens
gggaauauugucacuggua

SEQ ID NO: 275238 - RNA, 19 nt, Homo sapiens
uaagagccauagggaauau

SEQ ID NO: 275239 - RNA, 19 nt, Homo sapiens
uaugucaucuuuagcaugu

SEQ ID NO: 275240 - RNA, 19 nt, Homo sapiens
ggugaaacugagaaacuua

SEQ ID NO: 275241 - RNA, 19 nt, Homo sapiens
gaccagauacagcaaguug

SEQ ID NO: 275242 - RNA, 19 nt, Homo sapiens
acauucaaguccacccuua

SEQ ID NO: 275243 - RNA, 19 nt, Homo sapiens
ccagggcacuguaaauugg

SEQ ID NO: 275244 - RNA, 19 nt, Homo sapiens
caacaaccagggcacugua

SEQ ID NO: 275245 - RNA, 19 nt, Homo sapiens
cugaagaggagaaauguaa

SEQ ID NO: 275246 - RNA, 19 nt, Homo sapiens
gaaacuauacuugaacagu

SEQ ID NO: 275247 - RNA, 19 nt, Homo sapiens
gcaaaagauaccaagauua

SEQ ID NO: 275248 - RNA, 19 nt, Homo sapiens
gaaaagacaguacagaaau

SEQ ID NO: 275249 - RNA, 19 nt, Homo sapiens
ggaaaagacaguacagaaa

SEQ ID NO: 275250 - RNA, 19 nt, Homo sapiens
acacugaaacuauacuuga

SEQ ID NO: 275251 - RNA, 19 nt, Homo sapiens
uuccgagacuugguuauua

SEQ ID NO: 275252 - RNA, 19 nt, Homo sapiens
guacagaugaacagacuca

SEQ ID NO: 275253 - RNA, 19 nt, Homo sapiens
uuccugauaugucaucuuu

SEQ ID NO: 275254 - RNA, 19 nt, Homo sapiens
cagaauagaggucaaugug

SEQ ID NO: 275255 - RNA, 19 nt, Homo sapiens
cuucacagauucaagaaca

SEQ ID NO: 275256 - RNA, 19 nt, Homo sapiens
uaugaagcuuguccucuga

SEQ ID NO: 275257 - RNA, 19 nt, Homo sapiens
uuacugaugguccaaauga

SEQ ID NO: 275258 - RNA, 19 nt, Homo sapiens
gauaugucaucuuuagcau

SEQ ID NO: 275259 - RNA, 19 nt, Homo sapiens
uccgagacuugguuauuaa

SEQ ID NO: 275260 - RNA, 19 nt, Homo sapiens
gcagcaauguggaaaauca

SEQ ID NO: 275261 - RNA, 19 nt, Homo sapiens
guaagcucauuuccugaug

SEQ ID NO: 275262 - RNA, 19 nt, Homo sapiens
gcugagaaacuaggugaaa

SEQ ID NO: 275263 - RNA, 19 nt, Homo sapiens
uacagcaaguugugaauca

SEQ ID NO: 275264 - RNA, 19 nt, Homo sapiens
cagauuguguaccuuguuc

SEQ ID NO: 275265 - RNA, 19 nt, Homo sapiens
gaacaguugaacagauugu

SEQ ID NO: 275266 - RNA, 19 nt, Homo sapiens
gcauaaauagcagcaaugu

SEQ ID NO: 275267 - RNA, 19 nt, Homo sapiens
cacugaaacuauacuugaa

SEQ ID NO: 275268 - RNA, 19 nt, Homo sapiens
gcuauuuccuaccuuacug

SEQ ID NO: 275269 - RNA, 19 nt, Homo sapiens
ccuggacacuuucuaaucu

SEQ ID NO: 275270 - RNA, 19 nt, Homo sapiens
ggacaucagaacaaaccaa

SEQ ID NO: 275271 - RNA, 19 nt, Homo sapiens
cauaauagaaccguugaug

SEQ ID NO: 275272 - RNA, 19 nt, Homo sapiens
gcagaauagaggucaaugu

SEQ ID NO: 275273 - RNA, 19 nt, Homo sapiens
ccaacgagaaugcuaauac

SEQ ID NO: 275274 - RNA, 19 nt, Homo sapiens
ccaccaacgagaaugcuaa

SEQ ID NO: 275275 - RNA, 19 nt, Homo sapiens
caaccagggcacuguaaau

SEQ ID NO: 275276 - RNA, 19 nt, Homo sapiens
ugaggaaagcuaagaagga

SEQ ID NO: 275277 - RNA, 19 nt, Homo sapiens
ucauaaccauguccaccaa

SEQ ID NO: 275278 - RNA, 19 nt, Homo sapiens
guggaacaguugaacagau

SEQ ID NO: 275279 - RNA, 19 nt, Homo sapiens
ugggcuauuuccuaccuua

SEQ ID NO: 275280 - RNA, 19 nt, Homo sapiens
ggacacuuucuaaucuuug

SEQ ID NO: 275281 - RNA, 19 nt, Homo sapiens
gcagcuuucucccuuuguc

SEQ ID NO: 275282 - RNA, 19 nt, Homo sapiens
gaagcuuguccucugacua

SEQ ID NO: 275283 - RNA, 19 nt, Homo sapiens
ccucugaaggcuacacuuu

SEQ ID NO: 275284 - RNA, 19 nt, Homo sapiens
caggagcacucgccgucuu

SEQ ID NO: 275285 - RNA, 19 nt, Homo sapiens
cuaagagccauagggaaua

SEQ ID NO: 275286 - RNA, 19 nt, Homo sapiens
gauucuuccuaccuuaguu

SEQ ID NO: 275287 - RNA, 19 nt, Homo sapiens
uggacacuuucuaaucuuu

SEQ ID NO: 275288 - RNA, 19 nt, Homo sapiens
uaaguacggugcaguugac

SEQ ID NO: 275289 - RNA, 19 nt, Homo sapiens
caagcugucugggcucuag

SEQ ID NO: 275290 - RNA, 19 nt, Homo sapiens
cugguuugauuccgaaauu

SEQ ID NO: 275291 - RNA, 19 nt, Homo sapiens
cuuguucacuguggcauaa

SEQ ID NO: 275292 - RNA, 19 nt, Homo sapiens
uguucacuguggcauaaua

SEQ ID NO: 275293 - RNA, 19 nt, Homo sapiens
ccagauacagcaaguugug

SEQ ID NO: 275294 - RNA, 19 nt, Homo sapiens
uacucaagcugccaggaaa

SEQ ID NO: 275295 - RNA, 19 nt, Homo sapiens
aaagacaguacagaaauga

SEQ ID NO: 275296 - RNA, 19 nt, Homo sapiens
gaacucuuucuuaaaugug

SEQ ID NO: 275297 - RNA, 19 nt, Homo sapiens
caguugaacagauugugua

SEQ ID NO: 275298 - RNA, 19 nt, Homo sapiens
gauucaagaacaagggaaa

SEQ ID NO: 275299 - RNA, 19 nt, Homo sapiens
ugucugggcucuaggaaac

SEQ ID NO: 275300 - RNA, 19 nt, Homo sapiens
acuguaaauuggucuguug

SEQ ID NO: 275301 - RNA, 19 nt, Homo sapiens
gcaacaaccagggcacugu

SEQ ID NO: 275302 - RNA, 19 nt, Homo sapiens
caagauuauucugguuauc

SEQ ID NO: 275303 - RNA, 19 nt, Homo sapiens
auaauagaaccguugauga

SEQ ID NO: 275304 - RNA, 19 nt, Homo sapiens
ucacuguggcauaauagaa

SEQ ID NO: 275305 - RNA, 19 nt, Homo sapiens
gucaaaggcauaaauagca

SEQ ID NO: 275306 - RNA, 19 nt, Homo sapiens
cuaagaaggaugaccagau

SEQ ID NO: 275307 - RNA, 19 nt, Homo sapiens
caaaagagaugaacacuua

SEQ ID NO: 275308 - RNA, 19 nt, Homo sapiens
gaacagauacagaugguua

SEQ ID NO: 275309 - RNA, 19 nt, Homo sapiens
gaagaucccugccucauuc

SEQ ID NO: 275310 - RNA, 19 nt, Homo sapiens
gaaagauucucaagugguu

SEQ ID NO: 275311 - RNA, 19 nt, Homo sapiens
gaaacaaugcgaagacaua

SEQ ID NO: 275312 - RNA, 19 nt, Homo sapiens
ccagauggcuaccaaauga

SEQ ID NO: 275313 - RNA, 19 nt, Homo sapiens
gaucugagccuccaucauu

SEQ ID NO: 275314 - RNA, 19 nt, Homo sapiens
gcaacaaguucaagcugua

SEQ ID NO: 275315 - RNA, 19 nt, Homo sapiens
gaagcuauauugcagaaug

SEQ ID NO: 275316 - RNA, 19 nt, Homo sapiens
gcauaugcaugauuuccua

SEQ ID NO: 275317 - RNA, 19 nt, Homo sapiens
gucaaucucugcaggaaua

SEQ ID NO: 275318 - RNA, 19 nt, Homo sapiens
gaagaaagucuagaagauu

SEQ ID NO: 275319 - RNA, 19 nt, Homo sapiens
gauaauggccggugaugaa

SEQ ID NO: 275320 - RNA, 19 nt, Homo sapiens
gaacucuccuuaacaaucu

SEQ ID NO: 275321 - RNA, 19 nt, Homo sapiens
gaagcagugugguuccuuu

SEQ ID NO: 275322 - RNA, 19 nt, Homo sapiens
cagccaaccuucaaacaaa

SEQ ID NO: 275323 - RNA, 19 nt, Homo sapiens
gaaaagaucagguugagua

SEQ ID NO: 275324 - RNA, 19 nt, Homo sapiens
gcgaagacauagaaaugaa

SEQ ID NO: 275325 - RNA, 19 nt, Homo sapiens
ucaagacacuuugguauga

SEQ ID NO: 275326 - RNA, 19 nt, Homo sapiens
gaagauaaauaaggaagca

SEQ ID NO: 275327 - RNA, 19 nt, Homo sapiens
cgauagggcuccaagauuc

SEQ ID NO: 275328 - RNA, 19 nt, Homo sapiens
ggagacaguucaggagauu

SEQ ID NO: 275329 - RNA, 19 nt, Homo sapiens
gagaugaacacuuauugaa

SEQ ID NO: 275330 - RNA, 19 nt, Homo sapiens
uaaaguacaagccaaauga

SEQ ID NO: 275331 - RNA, 19 nt, Homo sapiens
aaucucaacuacccuauuu

SEQ ID NO: 275332 - RNA, 19 nt, Homo sapiens
aaacacacaugccucuuug

SEQ ID NO: 275333 - RNA, 19 nt, Homo sapiens
gugaugauauugaugaaga

SEQ ID NO: 275334 - RNA, 19 nt, Homo sapiens
gaugcuggauuaauuccua

SEQ ID NO: 275335 - RNA, 19 nt, Homo sapiens
gcaaucagcaacuuaacaa

SEQ ID NO: 275336 - RNA, 19 nt, Homo sapiens
uuagaacucuccuuaacaa

SEQ ID NO: 275337 - RNA, 19 nt, Homo sapiens
agauacagaugguuauuga

SEQ ID NO: 275338 - RNA, 19 nt, Homo sapiens
ucuagaagauucagauguu

SEQ ID NO: 275339 - RNA, 19 nt, Homo sapiens
agaagaaagucuagaagau

SEQ ID NO: 275340 - RNA, 19 nt, Homo sapiens
cagaaugccacaagugaua

SEQ ID NO: 275341 - RNA, 19 nt, Homo sapiens
ucacaugggucauugucaa

SEQ ID NO: 275342 - RNA, 19 nt, Homo sapiens
gaucaagacacuuugguau

SEQ ID NO: 275343 - RNA, 19 nt, Homo sapiens
gaacgucacaugggucauu

SEQ ID NO: 275344 - RNA, 19 nt, Homo sapiens
ucaaaccucuucuguccuu

SEQ ID NO: 275345 - RNA, 19 nt, Homo sapiens
uaacauagcaucaggaacu

SEQ ID NO: 275346 - RNA, 19 nt, Homo sapiens
uaaagaaagccaugucuca

SEQ ID NO: 275347 - RNA, 19 nt, Homo sapiens
ggagguaccuacaauuuug

SEQ ID NO: 275348 - RNA, 19 nt, Homo sapiens
uauacaaguuggaagacua

SEQ ID NO: 275349 - RNA, 19 nt, Homo sapiens
gcacaauagcugaaauaau

SEQ ID NO: 275350 - RNA, 19 nt, Homo sapiens
guaaugaacagauacagau

SEQ ID NO: 275351 - RNA, 19 nt, Homo sapiens
gguccucaauguagagauu

SEQ ID NO: 275352 - RNA, 19 nt, Homo sapiens
ggcauuaacuaacauagca

SEQ ID NO: 275353 - RNA, 19 nt, Homo sapiens
acaaggagguaccuacaau

SEQ ID NO: 275354 - RNA, 19 nt, Homo sapiens
aagaaagucuagaagauuc

SEQ ID NO: 275355 - RNA, 19 nt, Homo sapiens
caaguuggaagacuaaaga

SEQ ID NO: 275356 - RNA, 19 nt, Homo sapiens
gcauauacaaguuggaaga

SEQ ID NO: 275357 - RNA, 19 nt, Homo sapiens
gauaagaacaacagcaaca

SEQ ID NO: 275358 - RNA, 19 nt, Homo sapiens
agugaaagauucucaagug

SEQ ID NO: 275359 - RNA, 19 nt, Homo sapiens
ccaagaagaaagucuagaa

SEQ ID NO: 275360 - RNA, 19 nt, Homo sapiens
uaauaccaccguucuguaa

SEQ ID NO: 275361 - RNA, 19 nt, Homo sapiens
gagaaccaccgcaucaaga

SEQ ID NO: 275362 - RNA, 19 nt, Homo sapiens
guauuucucuggugaugau

SEQ ID NO: 275363 - RNA, 19 nt, Homo sapiens
guaauaccaccguucugua

SEQ ID NO: 275364 - RNA, 19 nt, Homo sapiens
ucccaaaucucuuaucaca

SEQ ID NO: 275365 - RNA, 19 nt, Homo sapiens
ggaguugugcccuuucuug

SEQ ID NO: 275366 - RNA, 19 nt, Homo sapiens
ggaucaagacacuuuggua

SEQ ID NO: 275367 - RNA, 19 nt, Homo sapiens
ucaaacagcagcccucaga

SEQ ID NO: 275368 - RNA, 19 nt, Homo sapiens
ggaagucaaaguucaaaca

SEQ ID NO: 275369 - RNA, 19 nt, Homo sapiens
uagaagcuauauugcagaa

SEQ ID NO: 275370 - RNA, 19 nt, Homo sapiens
ucaagagcuucaagaacaa

SEQ ID NO: 275371 - RNA, 19 nt, Homo sapiens
ugaugaagcaagcacaaua

SEQ ID NO: 275372 - RNA, 19 nt, Homo sapiens
acacuucccaaaucucuua

SEQ ID NO: 275373 - RNA, 19 nt, Homo sapiens
gguuauugauucaggaguu

SEQ ID NO: 275374 - RNA, 19 nt, Homo sapiens
cauggacuguaaaugcaua

SEQ ID NO: 275375 - RNA, 19 nt, Homo sapiens
acuaucacauggacuguaa

SEQ ID NO: 275376 - RNA, 19 nt, Homo sapiens
cagcaucuuucccacauuc

SEQ ID NO: 275377 - RNA, 19 nt, Homo sapiens
gcaucaagagcuucaagaa

SEQ ID NO: 275378 - RNA, 19 nt, Homo sapiens
agaggaauguggagguuug

SEQ ID NO: 275379 - RNA, 19 nt, Homo sapiens
gugguuccuuuccaacaua

SEQ ID NO: 275380 - RNA, 19 nt, Homo sapiens
caauugugauguccuguca

SEQ ID NO: 275381 - RNA, 19 nt, Homo sapiens
agucuccaguuuagaauaa

SEQ ID NO: 275382 - RNA, 19 nt, Homo sapiens
acacaugccucuuuguuuu

SEQ ID NO: 275383 - RNA, 19 nt, Homo sapiens
uaagaacaacagcaacaaa

SEQ ID NO: 275384 - RNA, 19 nt, Homo sapiens
acauagaaaugaagugaca

SEQ ID NO: 275385 - RNA, 19 nt, Homo sapiens
ggugaugguccucaaugua

SEQ ID NO: 275386 - RNA, 19 nt, Homo sapiens
accgauugaugacuuaaua

SEQ ID NO: 275387 - RNA, 19 nt, Homo sapiens
uggagguaaugaacagaua

SEQ ID NO: 275388 - RNA, 19 nt, Homo sapiens
gaagacauagaaaugaagu

SEQ ID NO: 275389 - RNA, 19 nt, Homo sapiens
ccacugauacuccuuugga

SEQ ID NO: 275390 - RNA, 19 nt, Homo sapiens
gagcagacccagguuguuc

SEQ ID NO: 275391 - RNA, 19 nt, Homo sapiens
uaccaauucuagucaaaug

SEQ ID NO: 275392 - RNA, 19 nt, Homo sapiens
ucacauggacuguaaaugc

SEQ ID NO: 275393 - RNA, 19 nt, Homo sapiens
gaaauaauagaggaaugug

SEQ ID NO: 275394 - RNA, 19 nt, Homo sapiens
auaccaccguucuguaauu

SEQ ID NO: 275395 - RNA, 19 nt, Homo sapiens
aucaagagcuucaagaaca

SEQ ID NO: 275396 - RNA, 19 nt, Homo sapiens
caacaaguucaagcuguaa

SEQ ID NO: 275397 - RNA, 19 nt, Homo sapiens
acagaugguuauugauuca

SEQ ID NO: 275398 - RNA, 19 nt, Homo sapiens
aaggagguaccuacaauuu

SEQ ID NO: 275399 - RNA, 19 nt, Homo sapiens
gaagcaacacaaggaggua

SEQ ID NO: 275400 - RNA, 19 nt, Homo sapiens
gcaagcacaauagcugaaa

SEQ ID NO: 275401 - RNA, 19 nt, Homo sapiens
gaugaagcaagcacaauag

SEQ ID NO: 275402 - RNA, 19 nt, Homo sapiens
uaauucaucagcuugcuaa

SEQ ID NO: 275403 - RNA, 19 nt, Homo sapiens
gguaaugaacagauacaga

SEQ ID NO: 275404 - RNA, 19 nt, Homo sapiens
agucaaaugucuagaaagg

SEQ ID NO: 275405 - RNA, 19 nt, Homo sapiens
caaaugauaagaacaacag

SEQ ID NO: 275406 - RNA, 19 nt, Homo sapiens
gcagcaucuuucccacauu

SEQ ID NO: 275407 - RNA, 19 nt, Homo sapiens
gaacaacaguuugcuauaa

SEQ ID NO: 275408 - RNA, 19 nt, Homo sapiens
gaucauaacucuuuguuga

SEQ ID NO: 275409 - RNA, 19 nt, Homo sapiens
gaaaugaaguuguaguuga

SEQ ID NO: 275410 - RNA, 19 nt, Homo sapiens
gaacaaauacagaugguaa

SEQ ID NO: 275411 - RNA, 19 nt, Homo sapiens
ggaauuuggugcauaugua

SEQ ID NO: 275412 - RNA, 19 nt, Homo sapiens
gguaauagacucuggaaua

SEQ ID NO: 275413 - RNA, 19 nt, Homo sapiens
ggaaagaucaaguggcuua

SEQ ID NO: 275414 - RNA, 19 nt, Homo sapiens
agaauaggcugcccauaua

SEQ ID NO: 275415 - RNA, 19 nt, Homo sapiens
caacaucacugcaggaaau

SEQ ID NO: 275416 - RNA, 19 nt, Homo sapiens
gaaagaacauugacuuacu

SEQ ID NO: 275417 - RNA, 19 nt, Homo sapiens
gagcacaaguguugcauga

SEQ ID NO: 275418 - RNA, 19 nt, Homo sapiens
gaacauugacuuacucuau

SEQ ID NO: 275419 - RNA, 19 nt, Homo sapiens
gaacugugaugcucuuuca

SEQ ID NO: 275420 - RNA, 19 nt, Homo sapiens
ugaacaaacucaagcagua

SEQ ID NO: 275421 - RNA, 19 nt, Homo sapiens
gaauaaagaccgaugaaga

SEQ ID NO: 275422 - RNA, 19 nt, Homo sapiens
gaagacaucuacaaauugg

SEQ ID NO: 275423 - RNA, 19 nt, Homo sapiens
cauauguacugcugaauaa

SEQ ID NO: 275424 - RNA, 19 nt, Homo sapiens
ggacaauguugaaugaaug

SEQ ID NO: 275425 - RNA, 19 nt, Homo sapiens
gagaaagaacauugacuua

SEQ ID NO: 275426 - RNA, 19 nt, Homo sapiens
caauucaucugccaaugua

SEQ ID NO: 275427 - RNA, 19 nt, Homo sapiens
gaagauaucugugaagacu

SEQ ID NO: 275428 - RNA, 19 nt, Homo sapiens
gcagaaaacuagcuuguaa

SEQ ID NO: 275429 - RNA, 19 nt, Homo sapiens
gagaauaggcugcccauau

SEQ ID NO: 275430 - RNA, 19 nt, Homo sapiens
gggaucugcugcugcauua

SEQ ID NO: 275431 - RNA, 19 nt, Homo sapiens
gaaaccauaggcaaucuua

SEQ ID NO: 275432 - RNA, 19 nt, Homo sapiens
guacacaaguugccauaau

SEQ ID NO: 275433 - RNA, 19 nt, Homo sapiens
uuagaaagauguuguggaa

SEQ ID NO: 275434 - RNA, 19 nt, Homo sapiens
ccauauaagucaaaggaaa

SEQ ID NO: 275435 - RNA, 19 nt, Homo sapiens
cagaugauauugaugaaga

SEQ ID NO: 275436 - RNA, 19 nt, Homo sapiens
guaauagacucuggaauag

SEQ ID NO: 275437 - RNA, 19 nt, Homo sapiens
gcauauguacugcugaaua

SEQ ID NO: 275438 - RNA, 19 nt, Homo sapiens
gaaagauguuguggaaguu

SEQ ID NO: 275439 - RNA, 19 nt, Homo sapiens
gaaauccaccaauugauga

SEQ ID NO: 275440 - RNA, 19 nt, Homo sapiens
ugaagacucugauauagau

SEQ ID NO: 275441 - RNA, 19 nt, Homo sapiens
ucagaaacaugguuaaagu

SEQ ID NO: 275442 - RNA, 19 nt, Homo sapiens
ucaaguggcuuaccuuauc

SEQ ID NO: 275443 - RNA, 19 nt, Homo sapiens
gugcuguguuuaaauguua

SEQ ID NO: 275444 - RNA, 19 nt, Homo sapiens
gaacauuugguuucaauuc

SEQ ID NO: 275445 - RNA, 19 nt, Homo sapiens
gaucaaguggcuuaccuua

SEQ ID NO: 275446 - RNA, 19 nt, Homo sapiens
gcacaaguguugcaugaac

SEQ ID NO: 275447 - RNA, 19 nt, Homo sapiens
cauaggcaaucuuauagaa

SEQ ID NO: 275448 - RNA, 19 nt, Homo sapiens
gagaugacaauccuucuuu

SEQ ID NO: 275449 - RNA, 19 nt, Homo sapiens
guaguugaauuaaggaaga

SEQ ID NO: 275450 - RNA, 19 nt, Homo sapiens
ugccuaaucuguucaauug

SEQ ID NO: 275451 - RNA, 19 nt, Homo sapiens
uacacaaguugccauaaua

SEQ ID NO: 275452 - RNA, 19 nt, Homo sapiens
caaauuggccuaugagauc

SEQ ID NO: 275453 - RNA, 19 nt, Homo sapiens
ucaauuaagugcaguucaa

SEQ ID NO: 275454 - RNA, 19 nt, Homo sapiens
gguuugaacaccuuuaaua

SEQ ID NO: 275455 - RNA, 19 nt, Homo sapiens
gaagagguuugaguagaug

SEQ ID NO: 275456 - RNA, 19 nt, Homo sapiens
agaauaccgugcuguguuu

SEQ ID NO: 275457 - RNA, 19 nt, Homo sapiens
aauagacucuggaauaguu

SEQ ID NO: 275458 - RNA, 19 nt, Homo sapiens
gaucgaaauccaccaauug

SEQ ID NO: 275459 - RNA, 19 nt, Homo sapiens
caaaaugcuucaagugaua

SEQ ID NO: 275460 - RNA, 19 nt, Homo sapiens
caaaauaccucucuagaag

SEQ ID NO: 275461 - RNA, 19 nt, Homo sapiens
gcaucuauaucuacuuugu

SEQ ID NO: 275462 - RNA, 19 nt, Homo sapiens
gagccagguucaucuuuga

SEQ ID NO: 275463 - RNA, 19 nt, Homo sapiens
gcagguacaggcaguaauu

SEQ ID NO: 275464 - RNA, 19 nt, Homo sapiens
uaauaugccuaaucuguuc

SEQ ID NO: 275465 - RNA, 19 nt, Homo sapiens
agaaagauguuguggaagu

SEQ ID NO: 275466 - RNA, 19 nt, Homo sapiens
gagaagacaacgaaaugaa

SEQ ID NO: 275467 - RNA, 19 nt, Homo sapiens
gcccaggccuugcuaugaa

SEQ ID NO: 275468 - RNA, 19 nt, Homo sapiens
gaauaggcugcccauauaa

SEQ ID NO: 275469 - RNA, 19 nt, Homo sapiens
gcaguaccgucaucuucaa

SEQ ID NO: 275470 - RNA, 19 nt, Homo sapiens
gaaaucagcagcagguaca

SEQ ID NO: 275471 - RNA, 19 nt, Homo sapiens
accaacggcucaagaauuu

SEQ ID NO: 275472 - RNA, 19 nt, Homo sapiens
gaugaauguuugaugcuau

SEQ ID NO: 275473 - RNA, 19 nt, Homo sapiens
caacagaaggguuccaguu

SEQ ID NO: 275474 - RNA, 19 nt, Homo sapiens
ggaaaccauucaggagauu

SEQ ID NO: 275475 - RNA, 19 nt, Homo sapiens
ugucauaagucuuggaguu

SEQ ID NO: 275476 - RNA, 19 nt, Homo sapiens
ccuaaucuguucaauuguu

SEQ ID NO: 275477 - RNA, 19 nt, Homo sapiens
guaaaucuacagcauaguu

SEQ ID NO: 275478 - RNA, 19 nt, Homo sapiens
gguuaugcacacuaaauua

SEQ ID NO: 275479 - RNA, 19 nt, Homo sapiens
gaguagauguacaaaucaa

SEQ ID NO: 275480 - RNA, 19 nt, Homo sapiens
aaagaccgaugaagagguu

SEQ ID NO: 275481 - RNA, 19 nt, Homo sapiens
caugaaugcuuauuuaggu

SEQ ID NO: 275482 - RNA, 19 nt, Homo sapiens
ugacacaucccaaagagaa

SEQ ID NO: 275483 - RNA, 19 nt, Homo sapiens
gcaaugaacaaauacagau

SEQ ID NO: 275484 - RNA, 19 nt, Homo sapiens
cuucauaaguccaucuauu

SEQ ID NO: 275485 - RNA, 19 nt, Homo sapiens
ucuagaagcuauuguucaa

SEQ ID NO: 275486 - RNA, 19 nt, Homo sapiens
uuuauaagguggcucauug

SEQ ID NO: 275487 - RNA, 19 nt, Homo sapiens
gagguaaaucuacagcaua

SEQ ID NO: 275488 - RNA, 19 nt, Homo sapiens
ucuggaauauugcccauuu

SEQ ID NO: 275489 - RNA, 19 nt, Homo sapiens
ugaagagguuugaguagau

SEQ ID NO: 275490 - RNA, 19 nt, Homo sapiens
caaguugccauaauaguau

SEQ ID NO: 275491 - RNA, 19 nt, Homo sapiens
gaucugcugcugcauuaaa

SEQ ID NO: 275492 - RNA, 19 nt, Homo sapiens
agaugacaauccuucuuua

SEQ ID NO: 275493 - RNA, 19 nt, Homo sapiens
ccauuagcaucuauaucua

SEQ ID NO: 275494 - RNA, 19 nt, Homo sapiens
guaaugguuugaacaccuu

SEQ ID NO: 275495 - RNA, 19 nt, Homo sapiens
cagaaggguuccaguuuua

SEQ ID NO: 275496 - RNA, 19 nt, Homo sapiens
ggagaaaauugaacaacuu

SEQ ID NO: 275497 - RNA, 19 nt, Homo sapiens
gcucaagaauuucaagaac

SEQ ID NO: 275498 - RNA, 19 nt, Homo sapiens
gaagacaacgaaaugaagu

SEQ ID NO: 275499 - RNA, 19 nt, Homo sapiens
gaauggacaauguugaaug

SEQ ID NO: 275500 - RNA, 19 nt, Homo sapiens
guacaaugcagcacugaga

SEQ ID NO: 275501 - RNA, 19 nt, Homo sapiens
ugaagacccuagccuuguu

SEQ ID NO: 275502 - RNA, 19 nt, Homo sapiens
ugaaagagaugacaauccu

SEQ ID NO: 275503 - RNA, 19 nt, Homo sapiens
acaaguugccauaauagua

SEQ ID NO: 275504 - RNA, 19 nt, Homo sapiens
aauggacaauguugaauga

SEQ ID NO: 275505 - RNA, 19 nt, Homo sapiens
gagaaugaguggcaaaaug

SEQ ID NO: 275506 - RNA, 19 nt, Homo sapiens
guucuucucuucagaugau

SEQ ID NO: 275507 - RNA, 19 nt, Homo sapiens
gaauaggcauuaauccaua

SEQ ID NO: 275508 - RNA, 19 nt, Homo sapiens
gaagaaggaauacagcuua

SEQ ID NO: 275509 - RNA, 19 nt, Homo sapiens
gcaugggcauuaacaaaua

SEQ ID NO: 275510 - RNA, 19 nt, Homo sapiens
uaacaucacugcuggaaau

SEQ ID NO: 275511 - RNA, 19 nt, Homo sapiens
ccaaaggagucaauuagaa

SEQ ID NO: 275512 - RNA, 19 nt, Homo sapiens
ggauggauuucaacuuuaa

SEQ ID NO: 275513 - RNA, 19 nt, Homo sapiens
gaacauuacuuugguguag

SEQ ID NO: 275514 - RNA, 19 nt, Homo sapiens
gaaggcauuugaucugauu

SEQ ID NO: 275515 - RNA, 19 nt, Homo sapiens
ggaaauagagcucagauuc

SEQ ID NO: 275516 - RNA, 19 nt, Homo sapiens
ccaaguggcuuuaaaugga

SEQ ID NO: 275517 - RNA, 19 nt, Homo sapiens
gaaauacuuccaccucuuu

SEQ ID NO: 275518 - RNA, 19 nt, Homo sapiens
gaagccugcuggacuguuu

SEQ ID NO: 275519 - RNA, 19 nt, Homo sapiens
ggaaggaguuguuacuaca

SEQ ID NO: 275520 - RNA, 19 nt, Homo sapiens
cuacagauaugguucaaau

SEQ ID NO: 275521 - RNA, 19 nt, Homo sapiens
gauauuaguuccacuguac

SEQ ID NO: 275522 - RNA, 19 nt, Homo sapiens
uaagguauuugguagcuuu

SEQ ID NO: 275523 - RNA, 19 nt, Homo sapiens
gaaggaauacagcuuagaa

SEQ ID NO: 275524 - RNA, 19 nt, Homo sapiens
gaaauagagcucagauuca

SEQ ID NO: 275525 - RNA, 19 nt, Homo sapiens
ucagguaacuccucuuugu

SEQ ID NO: 275526 - RNA, 19 nt, Homo sapiens
caaaggagucaauuagaaa

SEQ ID NO: 275527 - RNA, 19 nt, Homo sapiens
gaagcugcaugggcauuaa

SEQ ID NO: 275528 - RNA, 19 nt, Homo sapiens
gcauuaaaccacuuuguga

SEQ ID NO: 275529 - RNA, 19 nt, Homo sapiens
gaagauugguggaacuuuu

SEQ ID NO: 275530 - RNA, 19 nt, Homo sapiens
gcccagaaaugaugaaucu

SEQ ID NO: 275531 - RNA, 19 nt, Homo sapiens
gaaccuaauccaccaauag

SEQ ID NO: 275532 - RNA, 19 nt, Homo sapiens
uaacagcaacacagaaauu

SEQ ID NO: 275533 - RNA, 19 nt, Homo sapiens
caagagaugcguagacgaa

SEQ ID NO: 275534 - RNA, 19 nt, Homo sapiens
gauucaggcuguuauagau

SEQ ID NO: 275535 - RNA, 19 nt, Homo sapiens
caucacugcuggaaauaga

SEQ ID NO: 275536 - RNA, 19 nt, Homo sapiens
gguuucaccuugcuuaaau

SEQ ID NO: 275537 - RNA, 19 nt, Homo sapiens
cagcuugggcuauaacuaa

SEQ ID NO: 275538 - RNA, 19 nt, Homo sapiens
gugaugauauucaaacaca

SEQ ID NO: 275539 - RNA, 19 nt, Homo sapiens
ugugggcccucucaaauuu

SEQ ID NO: 275540 - RNA, 19 nt, Homo sapiens
ucaaacagacucacaacaa

SEQ ID NO: 275541 - RNA, 19 nt, Homo sapiens
acacagaaauuuagaaagc

SEQ ID NO: 275542 - RNA, 19 nt, Homo sapiens
gcuaacagcaacacagaaa

SEQ ID NO: 275543 - RNA, 19 nt, Homo sapiens
cagaaaugaugaaucuaug

SEQ ID NO: 275544 - RNA, 19 nt, Homo sapiens
gaauaaagcccuaaauccu

SEQ ID NO: 275545 - RNA, 19 nt, Homo sapiens
gcaggaagcaccaauggau

SEQ ID NO: 275546 - RNA, 19 nt, Homo sapiens
ggaauaggcauuaauccau

SEQ ID NO: 275547 - RNA, 19 nt, Homo sapiens
gaauacagcuuagaaaaca

SEQ ID NO: 275548 - RNA, 19 nt, Homo sapiens
uuacuuugguguagaagaa

SEQ ID NO: 275549 - RNA, 19 nt, Homo sapiens
caaacagacucacaacaac

SEQ ID NO: 275550 - RNA, 19 nt, Homo sapiens
gcagagauuuuguuuugaa

SEQ ID NO: 275551 - RNA, 19 nt, Homo sapiens
aagagaagaagaaggaaua

SEQ ID NO: 275552 - RNA, 19 nt, Homo sapiens
cauuugaucugauugaaca

SEQ ID NO: 275553 - RNA, 19 nt, Homo sapiens
ugcauuacccugucucuua

SEQ ID NO: 275554 - RNA, 19 nt, Homo sapiens
gauauucaaacacagguaa

SEQ ID NO: 275555 - RNA, 19 nt, Homo sapiens
uaagggcaguugguaauau

SEQ ID NO: 275556 - RNA, 19 nt, Homo sapiens
ugaaauacuuccaccucuu

SEQ ID NO: 275557 - RNA, 19 nt, Homo sapiens
ccagaaaugaugaaucuau

SEQ ID NO: 275558 - RNA, 19 nt, Homo sapiens
uacccugucucuuacauuu

SEQ ID NO: 275559 - RNA, 19 nt, Homo sapiens
acagaaaccaggaguugua

SEQ ID NO: 275560 - RNA, 19 nt, Homo sapiens
ccaccaauagaucaaguua

SEQ ID NO: 275561 - RNA, 19 nt, Homo sapiens
acagauaugguucaaauga

SEQ ID NO: 275562 - RNA, 19 nt, Homo sapiens
ggaguuguuacuacagaua

SEQ ID NO: 275563 - RNA, 19 nt, Homo sapiens
uggauggauuucaacuuua

SEQ ID NO: 275564 - RNA, 19 nt, Homo sapiens
gaacuuuucugcauaccaa

SEQ ID NO: 275565 - RNA, 19 nt, Homo sapiens
ccuaaauccucaagagaug

SEQ ID NO: 275566 - RNA, 19 nt, Homo sapiens
gcauuacccugucucuuac

SEQ ID NO: 275567 - RNA, 19 nt, Homo sapiens
gaagagaagaagaaggaau

SEQ ID NO: 275568 - RNA, 19 nt, Homo sapiens
gaucaacagcuaacagcaa

SEQ ID NO: 275569 - RNA, 19 nt, Homo sapiens
uaauaaugcugaucaacag

SEQ ID NO: 275570 - RNA, 19 nt, Homo sapiens
auacugugcucucauugaa

SEQ ID NO: 275571 - RNA, 19 nt, Homo sapiens
aaacccuccuccaaacuuu

SEQ ID NO: 275572 - RNA, 19 nt, Homo sapiens
auggauggauuucaacuuu

SEQ ID NO: 275573 - RNA, 19 nt, Homo sapiens
gaagaugaccccagcauug

SEQ ID NO: 275574 - RNA, 19 nt, Homo sapiens
gauugaacauuacuuuggu

SEQ ID NO: 275575 - RNA, 19 nt, Homo sapiens
acaagaaucuaagcagaau

SEQ ID NO: 275576 - RNA, 19 nt, Homo sapiens
gcagugacccagauguguu

SEQ ID NO: 275577 - RNA, 19 nt, Homo sapiens
aagcauauggucuggauaa

SEQ ID NO: 275578 - RNA, 19 nt, Homo sapiens
ccgauggacccaaugauaa

SEQ ID NO: 275579 - RNA, 19 nt, Homo sapiens
ucacgacuguuguuuagca

SEQ ID NO: 275580 - RNA, 19 nt, Homo sapiens
acaaauauagcaucuggaa

SEQ ID NO: 275581 - RNA, 19 nt, Homo sapiens
gcucagauucaggcuguua

SEQ ID NO: 275582 - RNA, 19 nt, Homo sapiens
gcuaguccagggaaagaua

SEQ ID NO: 275583 - RNA, 19 nt, Homo sapiens
ggaguuguacagagauuug

SEQ ID NO: 275584 - RNA, 19 nt, Homo sapiens
agggaaagauaacuauaga

SEQ ID NO: 275585 - RNA, 19 nt, Homo sapiens
ggcuauaacuaaugcaaca

SEQ ID NO: 275586 - RNA, 19 nt, Homo sapiens
ccuccaaacuuuaguaagg

SEQ ID NO: 275587 - RNA, 19 nt, Homo sapiens
gaggaaggaguuguuacua

SEQ ID NO: 275588 - RNA, 19 nt, Homo sapiens
ggcuuuaaauggacuugaa

SEQ ID NO: 275589 - RNA, 19 nt, Homo sapiens
ccucucaaauuuauguaga

SEQ ID NO: 275590 - RNA, 19 nt, Homo sapiens
cagauaugguucaaaugau

SEQ ID NO: 275591 - RNA, 19 nt, Homo sapiens
aaaccacuuugugaucuuu

SEQ ID NO: 275592 - RNA, 19 nt, Homo sapiens
ccucuuuguugccaaugua

SEQ ID NO: 275593 - RNA, 19 nt, Homo sapiens
gaaucuaagcagaauggaa

SEQ ID NO: 275594 - RNA, 19 nt, Homo sapiens
uaaaccacuuugugaucuu

SEQ ID NO: 275595 - RNA, 19 nt, Homo sapiens
aaauagagcucagauucag

SEQ ID NO: 275596 - RNA, 19 nt, Homo sapiens
cgauggacccaaugauaaa

SEQ ID NO: 275597 - RNA, 19 nt, Homo sapiens
guugggcccuuucuuaucu

SEQ ID NO: 275598 - RNA, 19 nt, Homo sapiens
ugucacgacuguuguuuag

SEQ ID NO: 275599 - RNA, 19 nt, Homo sapiens
gcaacacagaaauuuagaa

SEQ ID NO: 275600 - RNA, 19 nt, Homo sapiens
cagcaacacagaaauuuag

SEQ ID NO: 275601 - RNA, 19 nt, Homo sapiens
ccagaggaaggaguuguua

SEQ ID NO: 275602 - RNA, 19 nt, Homo sapiens
ucaggaaauuuaccagaag

SEQ ID NO: 275603 - RNA, 19 nt, Homo sapiens
cauauggucuggauaaaau

SEQ ID NO: 275604 - RNA, 19 nt, Homo sapiens
gcccaaaggagucaauuag

SEQ ID NO: 275605 - RNA, 19 nt, Homo sapiens
uggagucugucgaagauug

SEQ ID NO: 275606 - RNA, 19 nt, Homo sapiens
acagcaacacagaaauuua

SEQ ID NO: 275607 - RNA, 19 nt, Homo sapiens
ggaaauaugucuccaguua

SEQ ID NO: 275608 - RNA, 19 nt, Homo sapiens
gauaguggcucuugauuua

SEQ ID NO: 275609 - RNA, 19 nt, Homo sapiens
gaauuggccugaccucuua

SEQ ID NO: 275610 - RNA, 19 nt, Homo sapiens
guauagagaugcagccuua

SEQ ID NO: 275611 - RNA, 19 nt, Homo sapiens
gaacugcugccacauauuu

SEQ ID NO: 275612 - RNA, 19 nt, Homo sapiens
aaaccaagauggaguauga

SEQ ID NO: 275613 - RNA, 19 nt, Homo sapiens
ccaaagacguuguuagaga

SEQ ID NO: 275614 - RNA, 19 nt, Homo sapiens
guaaauaccagcauaagaa

SEQ ID NO: 275615 - RNA, 19 nt, Homo sapiens
caaccuaaauccagaauuc

SEQ ID NO: 275616 - RNA, 19 nt, Homo sapiens
uaaguugauuccuguguua

SEQ ID NO: 275617 - RNA, 19 nt, Homo sapiens
caucaugauucccaaauuu

SEQ ID NO: 275618 - RNA, 19 nt, Homo sapiens
gcaaauguguaucgugaug

SEQ ID NO: 275619 - RNA, 19 nt, Homo sapiens
uaaggcaucuuccuaaguu

SEQ ID NO: 275620 - RNA, 19 nt, Homo sapiens
caaagacguuguuagagaa

SEQ ID NO: 275621 - RNA, 19 nt, Homo sapiens
caucauggauuaacccaaa

SEQ ID NO: 275622 - RNA, 19 nt, Homo sapiens
caucaugaauggguuguua

SEQ ID NO: 275623 - RNA, 19 nt, Homo sapiens
uggaacaacuuaaucagua

SEQ ID NO: 275624 - RNA, 19 nt, Homo sapiens
ccaguuuccucuucccuua

SEQ ID NO: 275625 - RNA, 19 nt, Homo sapiens
gaaguaacauccugacacu

SEQ ID NO: 275626 - RNA, 19 nt, Homo sapiens
ugaauggguuguuaaagaa

SEQ ID NO: 275627 - RNA, 19 nt, Homo sapiens
gcaaagauguacucguaag

SEQ ID NO: 275628 - RNA, 19 nt, Homo sapiens
uuacaguucuucaagcaua

SEQ ID NO: 275629 - RNA, 19 nt, Homo sapiens
gggaaaauguuacccuuua

SEQ ID NO: 275630 - RNA, 19 nt, Homo sapiens
acacguaccugaagccauu

SEQ ID NO: 275631 - RNA, 19 nt, Homo sapiens
gagcuuauuccucaccuua

SEQ ID NO: 275632 - RNA, 19 nt, Homo sapiens
ggaacaacuuaaucaguau

SEQ ID NO: 275633 - RNA, 19 nt, Homo sapiens
aaacaaugcucaaccagau

SEQ ID NO: 275634 - RNA, 19 nt, Homo sapiens
gacucaagcucuaauguug

SEQ ID NO: 275635 - RNA, 19 nt, Homo sapiens
gaagauuugugaagauucu

SEQ ID NO: 275636 - RNA, 19 nt, Homo sapiens
ucaaauggguauagagaug

SEQ ID NO: 275637 - RNA, 19 nt, Homo sapiens
gcuaaugccuccacugauc

SEQ ID NO: 275638 - RNA, 19 nt, Homo sapiens
ggacaucauuuaaacaaac

SEQ ID NO: 275639 - RNA, 19 nt, Homo sapiens
ggccugaccucuuaccaaa

SEQ ID NO: 275640 - RNA, 19 nt, Homo sapiens
ggaaaaggauucagcauuc

SEQ ID NO: 275641 - RNA, 19 nt, Homo sapiens
gagaauacagcaauaacaa

SEQ ID NO: 275642 - RNA, 19 nt, Homo sapiens
uuucagaacuucccaaaug

SEQ ID NO: 275643 - RNA, 19 nt, Homo sapiens
gcacaagccaugcuaaaca

SEQ ID NO: 275644 - RNA, 19 nt, Homo sapiens
auaacaugcuggacucuua

SEQ ID NO: 275645 - RNA, 19 nt, Homo sapiens
ugaagauucugcugagauu

SEQ ID NO: 275646 - RNA, 19 nt, Homo sapiens
gccguugcaucauggauua

SEQ ID NO: 275647 - RNA, 19 nt, Homo sapiens
auaugaagcuccagauaaa

SEQ ID NO: 275648 - RNA, 19 nt, Homo sapiens
ccagaaauggaacauguua

SEQ ID NO: 275649 - RNA, 19 nt, Homo sapiens
cauaagaaccugcucauuc

SEQ ID NO: 275650 - RNA, 19 nt, Homo sapiens
gggcaugauuccauacuug

SEQ ID NO: 275651 - RNA, 19 nt, Homo sapiens
gaugaacugcugccacaua

SEQ ID NO: 275652 - RNA, 19 nt, Homo sapiens
ugaugaagauggaauugaa

SEQ ID NO: 275653 - RNA, 19 nt, Homo sapiens
uaagggugauguugaagaa

SEQ ID NO: 275654 - RNA, 19 nt, Homo sapiens
uuuagaagccugugaauuu

SEQ ID NO: 275655 - RNA, 19 nt, Homo sapiens
gaacuucccaaauggugua

SEQ ID NO: 275656 - RNA, 19 nt, Homo sapiens
gaagaugaacccacaagau

SEQ ID NO: 275657 - RNA, 19 nt, Homo sapiens
guuagagaauacagcaaua

SEQ ID NO: 275658 - RNA, 19 nt, Homo sapiens
guuaaagaaucaggcauuu

SEQ ID NO: 275659 - RNA, 19 nt, Homo sapiens
augcaaagauguacucgua

SEQ ID NO: 275660 - RNA, 19 nt, Homo sapiens
ugaguggucuuaucuugaa

SEQ ID NO: 275661 - RNA, 19 nt, Homo sapiens
ggacuuggaggcaacauug

SEQ ID NO: 275662 - RNA, 19 nt, Homo sapiens
ucaaccagaucaauaugaa

SEQ ID NO: 275663 - RNA, 19 nt, Homo sapiens
caacaagagaguacaagaa

SEQ ID NO: 275664 - RNA, 19 nt, Homo sapiens
gagcaagggcuucagcaaa

SEQ ID NO: 275665 - RNA, 19 nt, Homo sapiens
gguguaacagacuuuauua

SEQ ID NO: 275666 - RNA, 19 nt, Homo sapiens
agagacauguucuguaaga

SEQ ID NO: 275667 - RNA, 19 nt, Homo sapiens
agaggaggcuuguacagaa

SEQ ID NO: 275668 - RNA, 19 nt, Homo sapiens
gaagaagacgaaacgauuc

SEQ ID NO: 275669 - RNA, 19 nt, Homo sapiens
gaaguacucagacauagau

SEQ ID NO: 275670 - RNA, 19 nt, Homo sapiens
cagaagauuugugaagauu

SEQ ID NO: 275671 - RNA, 19 nt, Homo sapiens
ugacuccucuccucugauu

SEQ ID NO: 275672 - RNA, 19 nt, Homo sapiens
ugaagaagacgaaacgauu

SEQ ID NO: 275673 - RNA, 19 nt, Homo sapiens
uuaagucgauguugggaaa

SEQ ID NO: 275674 - RNA, 19 nt, Homo sapiens
guggaaaccugacgagcaa

SEQ ID NO: 275675 - RNA, 19 nt, Homo sapiens
guacucagacauagauauu

SEQ ID NO: 275676 - RNA, 19 nt, Homo sapiens
ggacucaagaucaagauga

SEQ ID NO: 275677 - RNA, 19 nt, Homo sapiens
ugcauuagcuggugaugaa

SEQ ID NO: 275678 - RNA, 19 nt, Homo sapiens
ggacucaagcucuaauguu

SEQ ID NO: 275679 - RNA, 19 nt, Homo sapiens
gaagaauaaugugaaagca

SEQ ID NO: 275680 - RNA, 19 nt, Homo sapiens
ggaacauguuaaaggauga

SEQ ID NO: 275681 - RNA, 19 nt, Homo sapiens
gcuuauuccucaccuuauu

SEQ ID NO: 275682 - RNA, 19 nt, Homo sapiens
gacgaaacgauuccugaua

SEQ ID NO: 275683 - RNA, 19 nt, Homo sapiens
caaaugguguaacagacuu

SEQ ID NO: 275684 - RNA, 19 nt, Homo sapiens
aaauaugucuccaguuaca

SEQ ID NO: 275685 - RNA, 19 nt, Homo sapiens
uuuaacaucuggagccuuu

SEQ ID NO: 275686 - RNA, 19 nt, Homo sapiens
gaacagccaauaugcaaag

SEQ ID NO: 275687 - RNA, 19 nt, Homo sapiens
uaaucaguauccagacuuu

SEQ ID NO: 275688 - RNA, 19 nt, Homo sapiens
cauaagagacaaugaggaa

SEQ ID NO: 275689 - RNA, 19 nt, Homo sapiens
caauuggucgucuugguua

SEQ ID NO: 275690 - RNA, 19 nt, Homo sapiens
gcaccagcuuguagaaauc

SEQ ID NO: 275691 - RNA, 19 nt, Homo sapiens
gagaugcagccuuauauuc

SEQ ID NO: 275692 - RNA, 19 nt, Homo sapiens
gaacccacaagaucauuga

SEQ ID NO: 275693 - RNA, 19 nt, Homo sapiens
caauaugaagcuccagaua

SEQ ID NO: 275694 - RNA, 19 nt, Homo sapiens
caugaaguacucagacaua

SEQ ID NO: 275695 - RNA, 19 nt, Homo sapiens
acagaggacucaagaucaa

SEQ ID NO: 275696 - RNA, 19 nt, Homo sapiens
gccgagcacuugugauguu

SEQ ID NO: 275697 - RNA, 19 nt, Homo sapiens
uuguauagcugauuucaug

SEQ ID NO: 275698 - RNA, 19 nt, Homo sapiens
gcuaaacaaugcucaacca

SEQ ID NO: 275699 - RNA, 19 nt, Homo sapiens
uuccuuaccuugcuuauau

SEQ ID NO: 275700 - RNA, 19 nt, Homo sapiens
cagccaauaugcaaagaug

SEQ ID NO: 275701 - RNA, 19 nt, Homo sapiens
gcaugugucaaucaguuua

SEQ ID NO: 275702 - RNA, 19 nt, Homo sapiens
gcucuugugcguuccauaa

SEQ ID NO: 275703 - RNA, 19 nt, Homo sapiens
gccaauaugcaaagaugua

SEQ ID NO: 275704 - RNA, 19 nt, Homo sapiens
gacucaagaucaagaugaa

SEQ ID NO: 275705 - RNA, 19 nt, Homo sapiens
gucaaucaguuuaucauca

SEQ ID NO: 275706 - RNA, 19 nt, Homo sapiens
aauaaggucucacgcuguu

SEQ ID NO: 275707 - RNA, 19 nt, Homo sapiens
ggaaauaugucuccaguua

SEQ ID NO: 275708 - RNA, 19 nt, Homo sapiens
gauaguggcucuugauuua

SEQ ID NO: 275709 - RNA, 19 nt, Homo sapiens
gaauuggccugaccucuua

SEQ ID NO: 275710 - RNA, 19 nt, Homo sapiens
guauagagaugcagccuua

SEQ ID NO: 275711 - RNA, 19 nt, Homo sapiens
gaacugcugccacauauuu

SEQ ID NO: 275712 - RNA, 19 nt, Homo sapiens
aaaccaagauggaguauga

SEQ ID NO: 275713 - RNA, 19 nt, Homo sapiens
ccaaagacguuguuagaga

SEQ ID NO: 275714 - RNA, 19 nt, Homo sapiens
guaaauaccagcauaagaa

SEQ ID NO: 275715 - RNA, 19 nt, Homo sapiens
caaccuaaauccagaauuc

SEQ ID NO: 275716 - RNA, 19 nt, Homo sapiens
uaaguugauuccuguguua

SEQ ID NO: 275717 - RNA, 19 nt, Homo sapiens
caucaugauucccaaauuu

SEQ ID NO: 275718 - RNA, 19 nt, Homo sapiens
gcaaauguguaucgugaug

SEQ ID NO: 275719 - RNA, 19 nt, Homo sapiens
uaaggcaucuuccuaaguu

SEQ ID NO: 275720 - RNA, 19 nt, Homo sapiens
caaagacguuguuagagaa

SEQ ID NO: 275721 - RNA, 19 nt, Homo sapiens
caucauggauuaacccaaa

SEQ ID NO: 275722 - RNA, 19 nt, Homo sapiens
caucaugaauggguuguua

SEQ ID NO: 275723 - RNA, 19 nt, Homo sapiens
uggaacaacuuaaucagua

SEQ ID NO: 275724 - RNA, 19 nt, Homo sapiens
ccaguuuccucuucccuua

SEQ ID NO: 275725 - RNA, 19 nt, Homo sapiens
gaaguaacauccugacacu

SEQ ID NO: 275726 - RNA, 19 nt, Homo sapiens
ugaauggguuguuaaagaa

SEQ ID NO: 275727 - RNA, 19 nt, Homo sapiens
gcaaagauguacucguaag

SEQ ID NO: 275728 - RNA, 19 nt, Homo sapiens
uuacaguucuucaagcaua

SEQ ID NO: 275729 - RNA, 19 nt, Homo sapiens
gggaaaauguuacccuuua

SEQ ID NO: 275730 - RNA, 19 nt, Homo sapiens
acacguaccugaagccauu

SEQ ID NO: 275731 - RNA, 19 nt, Homo sapiens
gagcuuauuccucaccuua

SEQ ID NO: 275732 - RNA, 19 nt, Homo sapiens
ggaacaacuuaaucaguau

SEQ ID NO: 275733 - RNA, 19 nt, Homo sapiens
aaacaaugcucaaccagau

SEQ ID NO: 275734 - RNA, 19 nt, Homo sapiens
gacucaagcucuaauguug

SEQ ID NO: 275735 - RNA, 19 nt, Homo sapiens
gaagauuugugaagauucu

SEQ ID NO: 275736 - RNA, 19 nt, Homo sapiens
ucaaauggguauagagaug

SEQ ID NO: 275737 - RNA, 19 nt, Homo sapiens
gcuaaugccuccacugauc

SEQ ID NO: 275738 - RNA, 19 nt, Homo sapiens
ggacaucauuuaaacaaac

SEQ ID NO: 275739 - RNA, 19 nt, Homo sapiens
ggccugaccucuuaccaaa

SEQ ID NO: 275740 - RNA, 19 nt, Homo sapiens
ggaaaaggauucagcauuc

SEQ ID NO: 275741 - RNA, 19 nt, Homo sapiens
gagaauacagcaauaacaa

SEQ ID NO: 275742 - RNA, 19 nt, Homo sapiens
uuucagaacuucccaaaug

SEQ ID NO: 275743 - RNA, 19 nt, Homo sapiens
gcacaagccaugcuaaaca

SEQ ID NO: 275744 - RNA, 19 nt, Homo sapiens
auaacaugcuggacucuua

SEQ ID NO: 275745 - RNA, 19 nt, Homo sapiens
ugaagauucugcugagauu

SEQ ID NO: 275746 - RNA, 19 nt, Homo sapiens
gccguugcaucauggauua

SEQ ID NO: 275747 - RNA, 19 nt, Homo sapiens
auaugaagcuccagauaaa

SEQ ID NO: 275748 - RNA, 19 nt, Homo sapiens
ccagaaauggaacauguua

SEQ ID NO: 275749 - RNA, 19 nt, Homo sapiens
cauaagaaccugcucauuc

SEQ ID NO: 275750 - RNA, 19 nt, Homo sapiens
gggcaugauuccauacuug

SEQ ID NO: 275751 - RNA, 19 nt, Homo sapiens
gaugaacugcugccacaua

SEQ ID NO: 275752 - RNA, 19 nt, Homo sapiens
ugaugaagauggaauugaa

SEQ ID NO: 275753 - RNA, 19 nt, Homo sapiens
uaagggugauguugaagaa

SEQ ID NO: 275754 - RNA, 19 nt, Homo sapiens
uuuagaagccugugaauuu

SEQ ID NO: 275755 - RNA, 19 nt, Homo sapiens
gaacuucccaaauggugua

SEQ ID NO: 275756 - RNA, 19 nt, Homo sapiens
gaagaugaacccacaagau

SEQ ID NO: 275757 - RNA, 19 nt, Homo sapiens
guuagagaauacagcaaua

SEQ ID NO: 275758 - RNA, 19 nt, Homo sapiens
guuaaagaaucaggcauuu

SEQ ID NO: 275759 - RNA, 19 nt, Homo sapiens
augcaaagauguacucgua

SEQ ID NO: 275760 - RNA, 19 nt, Homo sapiens
ugaguggucuuaucuugaa

SEQ ID NO: 275761 - RNA, 19 nt, Homo sapiens
ggacuuggaggcaacauug

SEQ ID NO: 275762 - RNA, 19 nt, Homo sapiens
ucaaccagaucaauaugaa

SEQ ID NO: 275763 - RNA, 19 nt, Homo sapiens
caacaagagaguacaagaa

SEQ ID NO: 275764 - RNA, 19 nt, Homo sapiens
gagcaagggcuucagcaaa

SEQ ID NO: 275765 - RNA, 19 nt, Homo sapiens
gguguaacagacuuuauua

SEQ ID NO: 275766 - RNA, 19 nt, Homo sapiens
agagacauguucuguaaga

SEQ ID NO: 275767 - RNA, 19 nt, Homo sapiens
agaggaggcuuguacagaa

SEQ ID NO: 275768 - RNA, 19 nt, Homo sapiens
gaagaagacgaaacgauuc

SEQ ID NO: 275769 - RNA, 19 nt, Homo sapiens
gaaguacucagacauagau

SEQ ID NO: 275770 - RNA, 19 nt, Homo sapiens
cagaagauuugugaagauu

SEQ ID NO: 275771 - RNA, 19 nt, Homo sapiens
ugacuccucuccucugauu

SEQ ID NO: 275772 - RNA, 19 nt, Homo sapiens
ugaagaagacgaaacgauu

SEQ ID NO: 275773 - RNA, 19 nt, Homo sapiens
uuaagucgauguugggaaa

SEQ ID NO: 275774 - RNA, 19 nt, Homo sapiens
guacucagacauagauauu

SEQ ID NO: 275775 - RNA, 19 nt, Homo sapiens
ggacucaagaucaagauga

SEQ ID NO: 275776 - RNA, 19 nt, Homo sapiens
ugcauuagcuggugaugaa

SEQ ID NO: 275777 - RNA, 19 nt, Homo sapiens
ggacucaagcucuaauguu

SEQ ID NO: 275778 - RNA, 19 nt, Homo sapiens
guggaaaccugacgagcaa

SEQ ID NO: 275779 - RNA, 19 nt, Homo sapiens
gaagaauaaugugaaagca

SEQ ID NO: 275780 - RNA, 19 nt, Homo sapiens
ggaacauguuaaaggauga

SEQ ID NO: 275781 - RNA, 19 nt, Homo sapiens
gcuuauuccucaccuuauu

SEQ ID NO: 275782 - RNA, 19 nt, Homo sapiens
gacgaaacgauuccugaua

SEQ ID NO: 275783 - RNA, 19 nt, Homo sapiens
caaaugguguaacagacuu

SEQ ID NO: 275784 - RNA, 19 nt, Homo sapiens
aaauaugucuccaguuaca

SEQ ID NO: 275785 - RNA, 19 nt, Homo sapiens
uuuaacaucuggagccuuu

SEQ ID NO: 275786 - RNA, 19 nt, Homo sapiens
gaacagccaauaugcaaag

SEQ ID NO: 275787 - RNA, 19 nt, Homo sapiens
cauaagagacaaugaggaa

SEQ ID NO: 275788 - RNA, 19 nt, Homo sapiens
caauuggucgucuugguua

SEQ ID NO: 275789 - RNA, 19 nt, Homo sapiens
gcaccagcuuguagaaauc

SEQ ID NO: 275790 - RNA, 19 nt, Homo sapiens
gagaugcagccuuauauuc

SEQ ID NO: 275791 - RNA, 19 nt, Homo sapiens
uaaucaguauccagacuuu

SEQ ID NO: 275792 - RNA, 19 nt, Homo sapiens
gaacccacaagaucauuga

SEQ ID NO: 275793 - RNA, 19 nt, Homo sapiens
caauaugaagcuccagaua

SEQ ID NO: 275794 - RNA, 19 nt, Homo sapiens
caugaaguacucagacaua

SEQ ID NO: 275795 - RNA, 19 nt, Homo sapiens
acagaggacucaagaucaa

SEQ ID NO: 275796 - RNA, 19 nt, Homo sapiens
gccgagcacuugugauguu

SEQ ID NO: 275797 - RNA, 19 nt, Homo sapiens
uuguauagcugauuucaug

SEQ ID NO: 275798 - RNA, 19 nt, Homo sapiens
gcuaaacaaugcucaacca

SEQ ID NO: 275799 - RNA, 19 nt, Homo sapiens
uuccuuaccuugcuuauau

SEQ ID NO: 275800 - RNA, 19 nt, Homo sapiens
cagccaauaugcaaagaug

SEQ ID NO: 275801 - RNA, 19 nt, Homo sapiens
gcaugugucaaucaguuua

SEQ ID NO: 275802 - RNA, 19 nt, Homo sapiens
gcucuugugcguuccauaa

SEQ ID NO: 275803 - RNA, 19 nt, Homo sapiens
gccaauaugcaaagaugua

SEQ ID NO: 275804 - RNA, 19 nt, Homo sapiens
gacucaagaucaagaugaa

SEQ ID NO: 275805 - RNA, 19 nt, Homo sapiens
gucaaucaguuuaucauca

SEQ ID NO: 275806 - RNA, 19 nt, Homo sapiens
aauaaggucucacgcuguu

SEQ ID NO: 275807 - RNA, 19 nt, Homo sapiens
ggagauggaugccuuaaua

SEQ ID NO: 275808 - RNA, 19 nt, Homo sapiens
gcaugaagauggcauauuu

SEQ ID NO: 275809 - RNA, 19 nt, Homo sapiens
gaacacugcucagaaagua

SEQ ID NO: 275810 - RNA, 19 nt, Homo sapiens
gaaaggaccugcagaagca

SEQ ID NO: 275811 - RNA, 19 nt, Homo sapiens
ggaaagggaaaucaaauua

SEQ ID NO: 275812 - RNA, 19 nt, Homo sapiens
gguaauauuuggagcuuua

SEQ ID NO: 275813 - RNA, 19 nt, Homo sapiens
ggaagcaacucuacagcua

SEQ ID NO: 275814 - RNA, 19 nt, Homo sapiens
gaacagcugcuuccauuaa

SEQ ID NO: 275815 - RNA, 19 nt, Homo sapiens
gaaacacaaucuagcauga

SEQ ID NO: 275816 - RNA, 19 nt, Homo sapiens
caacaacacuauuuagaug

SEQ ID NO: 275817 - RNA, 19 nt, Homo sapiens
gaggaaaccuaugagaaua

SEQ ID NO: 275818 - RNA, 19 nt, Homo sapiens
cagaugcccuucaaauaua

SEQ ID NO: 275819 - RNA, 19 nt, Homo sapiens
gcaaauaaauggucuuggu

SEQ ID NO: 275820 - RNA, 19 nt, Homo sapiens
ccucagaucucuuacauga

SEQ ID NO: 275821 - RNA, 19 nt, Homo sapiens
gaacuggccaggaauuuaa

SEQ ID NO: 275822 - RNA, 19 nt, Homo sapiens
gaagauggcauauuugaug

SEQ ID NO: 275823 - RNA, 19 nt, Homo sapiens
gacugcagcugcuauguua

SEQ ID NO: 275824 - RNA, 19 nt, Homo sapiens
ugaaagaagcgcucuguua

SEQ ID NO: 275825 - RNA, 19 nt, Homo sapiens
gcagaugcccuucaaauau

SEQ ID NO: 275826 - RNA, 19 nt, Homo sapiens
guaaaugacuugcuguugu

SEQ ID NO: 275827 - RNA, 19 nt, Homo sapiens
gauggucccuuuacugaaa

SEQ ID NO: 275828 - RNA, 19 nt, Homo sapiens
guaaugagaggcaaccuua

SEQ ID NO: 275829 - RNA, 19 nt, Homo sapiens
acagaugguuuccuuguua

SEQ ID NO: 275830 - RNA, 19 nt, Homo sapiens
gaaaguaaucauccaauug

SEQ ID NO: 275831 - RNA, 19 nt, Homo sapiens
gaccaaugcuccaauaugu

SEQ ID NO: 275832 - RNA, 19 nt, Homo sapiens
ggagguauauugaaagcaa

SEQ ID NO: 275833 - RNA, 19 nt, Homo sapiens
guuagaaacuuuggcauaa

SEQ ID NO: 275834 - RNA, 19 nt, Homo sapiens
gaaagaagcgcucuguuag

SEQ ID NO: 275835 - RNA, 19 nt, Homo sapiens
gaaaugcacgaggcaauua

SEQ ID NO: 275836 - RNA, 19 nt, Homo sapiens
caaagcagcauauuaaaug

SEQ ID NO: 275837 - RNA, 19 nt, Homo sapiens
uagcaaagcagcauauuaa

SEQ ID NO: 275838 - RNA, 19 nt, Homo sapiens
gaacugggagguauauuga

SEQ ID NO: 275839 - RNA, 19 nt, Homo sapiens
cagaugaacuagaagauga

SEQ ID NO: 275840 - RNA, 19 nt, Homo sapiens
uaagaccaaugcuccaaua

SEQ ID NO: 275841 - RNA, 19 nt, Homo sapiens
gaacuaacugugagaugua

SEQ ID NO: 275842 - RNA, 19 nt, Homo sapiens
uggcacaccugcagaauuu

SEQ ID NO: 275843 - RNA, 19 nt, Homo sapiens
gcaaauggaaggaauucua

SEQ ID NO: 275844 - RNA, 19 nt, Homo sapiens
ucuaagagcucugaaagaa

SEQ ID NO: 275845 - RNA, 19 nt, Homo sapiens
ggacagauggcuacagauu

SEQ ID NO: 275846 - RNA, 19 nt, Homo sapiens
ugaagaggcuagacaaaug

SEQ ID NO: 275847 - RNA, 19 nt, Homo sapiens
gaauaugagugaugaugau

SEQ ID NO: 275848 - RNA, 19 nt, Homo sapiens
gcagcauccuccuugauaa

SEQ ID NO: 275849 - RNA, 19 nt, Homo sapiens
ccuccuaccuuccaguuua

SEQ ID NO: 275850 - RNA, 19 nt, Homo sapiens
ccaaucagcuagagcaaug

SEQ ID NO: 275851 - RNA, 19 nt, Homo sapiens
uaaaugacuugcuguuguu

SEQ ID NO: 275852 - RNA, 19 nt, Homo sapiens
caagaauuacgacaaguua

SEQ ID NO: 275853 - RNA, 19 nt, Homo sapiens
ucagaaaggcaccaaguua

SEQ ID NO: 275854 - RNA, 19 nt, Homo sapiens
uagcaaugaugguugauuu

SEQ ID NO: 275855 - RNA, 19 nt, Homo sapiens
ccaaacgucuggccaaugu

SEQ ID NO: 275856 - RNA, 19 nt, Homo sapiens
guucaagccugacugugua

SEQ ID NO: 275857 - RNA, 19 nt, Homo sapiens
gcaaagugcauugaaguaa

SEQ ID NO: 275858 - RNA, 19 nt, Homo sapiens
gcacuucccucugauguuc

SEQ ID NO: 275859 - RNA, 19 nt, Homo sapiens
guacagaaccagauucaga

SEQ ID NO: 275860 - RNA, 19 nt, Homo sapiens
aaaagaggcuuguguaaaa

SEQ ID NO: 275861 - RNA, 19 nt, Homo sapiens
caaugucguucgccaagua

SEQ ID NO: 275862 - RNA, 19 nt, Homo sapiens
aaacaucugcauuccauua

SEQ ID NO: 275863 - RNA, 19 nt, Homo sapiens
gaaggaauucuaaaugaga

SEQ ID NO: 275864 - RNA, 19 nt, Homo sapiens
gcaaaugagcauaauguug

SEQ ID NO: 275865 - RNA, 19 nt, Homo sapiens
caaagugcauugaaguaau

SEQ ID NO: 275866 - RNA, 19 nt, Homo sapiens
gaacagguugucaaacuga

SEQ ID NO: 275867 - RNA, 19 nt, Homo sapiens
gcaauaccuuccagugguu

SEQ ID NO: 275868 - RNA, 19 nt, Homo sapiens
uaacuuuacugaagacugu

SEQ ID NO: 275869 - RNA, 19 nt, Homo sapiens
uggaaggaauucuaaauga

SEQ ID NO: 275870 - RNA, 19 nt, Homo sapiens
uaaauggucuuggugcaaa

SEQ ID NO: 275871 - RNA, 19 nt, Homo sapiens
gcaaagcagcauauuaaau

SEQ ID NO: 275872 - RNA, 19 nt, Homo sapiens
gaagagcagcgcuguguug

SEQ ID NO: 275873 - RNA, 19 nt, Homo sapiens
ggaaggaauucuaaaugag

SEQ ID NO: 275874 - RNA, 19 nt, Homo sapiens
gaugaggacugggcaaaug

SEQ ID NO: 275875 - RNA, 19 nt, Homo sapiens
gaauguuaguucaguguau

SEQ ID NO: 275876 - RNA, 19 nt, Homo sapiens
uuacaagccaucagaaaua

SEQ ID NO: 275877 - RNA, 19 nt, Homo sapiens
uggcauaacucaauuugga

SEQ ID NO: 275878 - RNA, 19 nt, Homo sapiens
gcaaaccaguagacccaaa

SEQ ID NO: 275879 - RNA, 19 nt, Homo sapiens
aauaaacgcuuacccuuuc

SEQ ID NO: 275880 - RNA, 19 nt, Homo sapiens
aagaagcuguucagacuuu

SEQ ID NO: 275881 - RNA, 19 nt, Homo sapiens
caaauggaaggaauucuaa

SEQ ID NO: 275882 - RNA, 19 nt, Homo sapiens
uaugauaccuauuccauuc

SEQ ID NO: 275883 - RNA, 19 nt, Homo sapiens
ccucagauguuagcaauga

SEQ ID NO: 275884 - RNA, 19 nt, Homo sapiens
cagcugcuauguuaagaaa

SEQ ID NO: 275885 - RNA, 19 nt, Homo sapiens
cggcagaacuggccaggaa

SEQ ID NO: 275886 - RNA, 19 nt, Homo sapiens
gguaguaaaugcuguuagu

SEQ ID NO: 275887 - RNA, 19 nt, Homo sapiens
cccaagacauggagaauau

SEQ ID NO: 275888 - RNA, 19 nt, Homo sapiens
aaaugcagaugaacuagaa

SEQ ID NO: 275889 - RNA, 19 nt, Homo sapiens
gauguaccaugaacuaaca

SEQ ID NO: 275890 - RNA, 19 nt, Homo sapiens
ccuauuccauucacaauug

SEQ ID NO: 275891 - RNA, 19 nt, Homo sapiens
agaagaagcuguucagacu

SEQ ID NO: 275892 - RNA, 19 nt, Homo sapiens
ugaaacaucugcauuccau

SEQ ID NO: 275893 - RNA, 19 nt, Homo sapiens
gcaacaacacuauuuagau

SEQ ID NO: 275894 - RNA, 19 nt, Homo sapiens
gaugaugguugggaauuug

SEQ ID NO: 275895 - RNA, 19 nt, Homo sapiens
gaaguagcccuuuuagaua

SEQ ID NO: 275896 - RNA, 19 nt, Homo sapiens
gaaaggcaccaaguuaguu

SEQ ID NO: 275897 - RNA, 19 nt, Homo sapiens
gacuauuccucagauguua

SEQ ID NO: 275898 - RNA, 19 nt, Homo sapiens
ccaggaauuuaauagauga

SEQ ID NO: 275899 - RNA, 19 nt, Homo sapiens
gagcuacucaugauuauuc

SEQ ID NO: 275900 - RNA, 19 nt, Homo sapiens
ugacagaaccaucaguaaa

SEQ ID NO: 275901 - RNA, 19 nt, Homo sapiens
gaggcaaccuuauaacucu

SEQ ID NO: 275902 - RNA, 19 nt, Homo sapiens
cuagagcaauguaggcuuu

SEQ ID NO: 275903 - RNA, 19 nt, Homo sapiens
gcuaaguuaugauaccuau

SEQ ID NO: 275904 - RNA, 19 nt, Homo sapiens
aaagagaucgguaguguug

SEQ ID NO: 275905 - RNA, 19 nt, Homo sapiens
gguaagaguuauucagucu

SEQ ID NO: 275906 - RNA, 19 nt, Homo sapiens
gaucaaggaacacauuaug

SEQ ID NO: 275907 - RNA, 19 nt, Homo sapiens
cgaauaugauccaacaaua

SEQ ID NO: 275908 - RNA, 19 nt, Homo sapiens
uaaggacucugaagaugua

SEQ ID NO: 275909 - RNA, 19 nt, Homo sapiens
ggacgaauaugauccaaca

SEQ ID NO: 275910 - RNA, 19 nt, Homo sapiens
ggaagcaaguaguaauuga

SEQ ID NO: 275911 - RNA, 19 nt, Homo sapiens
gcaagaaguuauggaauuc

SEQ ID NO: 275912 - RNA, 19 nt, Homo sapiens
gacaaaguguguaauuaug

SEQ ID NO: 275913 - RNA, 19 nt, Homo sapiens
gaugaugccuucuauacau

SEQ ID NO: 275914 - RNA, 19 nt, Homo sapiens
gcucaggacuuagcaagaa

SEQ ID NO: 275915 - RNA, 19 nt, Homo sapiens
gaaacugaauaccuaagau

SEQ ID NO: 275916 - RNA, 19 nt, Homo sapiens
cgauacagcuaauucagaa

SEQ ID NO: 275917 - RNA, 19 nt, Homo sapiens
aaaccugucucuuggauau

SEQ ID NO: 275918 - RNA, 19 nt, Homo sapiens
gaaguuauggaauuccuuu

SEQ ID NO: 275919 - RNA, 19 nt, Homo sapiens
gaacuagcaaugccuguga

SEQ ID NO: 275920 - RNA, 19 nt, Homo sapiens
ggagagaggccugcugaaa

SEQ ID NO: 275921 - RNA, 19 nt, Homo sapiens
ggagggcuuucuuugugua

SEQ ID NO: 275922 - RNA, 19 nt, Homo sapiens
gggcuuucuuuguguauuu

SEQ ID NO: 275923 - RNA, 19 nt, Homo sapiens
guugagaccuucuaauugg

SEQ ID NO: 275924 - RNA, 19 nt, Homo sapiens
gcaugcaguugauuacuuc

SEQ ID NO: 275925 - RNA, 19 nt, Homo sapiens
caagacaggguguugauga

SEQ ID NO: 275926 - RNA, 19 nt, Homo sapiens
gaauaugauccaacaauag

SEQ ID NO: 275927 - RNA, 19 nt, Homo sapiens
caucauguccuauaguuug

SEQ ID NO: 275928 - RNA, 19 nt, Homo sapiens
ggcaucauguccuauaguu

SEQ ID NO: 275929 - RNA, 19 nt, Homo sapiens
ucaaagacaaaguguguaa

SEQ ID NO: 275930 - RNA, 19 nt, Homo sapiens
uuuaugggcuuccugauga

SEQ ID NO: 275931 - RNA, 19 nt, Homo sapiens
ugcaguugauuacuucuua

SEQ ID NO: 275932 - RNA, 19 nt, Homo sapiens
guuaaggacucugaagaug

SEQ ID NO: 275933 - RNA, 19 nt, Homo sapiens
gcaguugauuacuucuuau

SEQ ID NO: 275934 - RNA, 19 nt, Homo sapiens
caugcagacuguuagcuuu

SEQ ID NO: 275935 - RNA, 19 nt, Homo sapiens
agcaagaaguuauggaauu

SEQ ID NO: 275936 - RNA, 19 nt, Homo sapiens
cuagaacaguagacacaaa

SEQ ID NO: 275937 - RNA, 19 nt, Homo sapiens
caagaggaguacagugcaa

SEQ ID NO: 275938 - RNA, 19 nt, Homo sapiens
caguugagaccuucuaauu

SEQ ID NO: 275939 - RNA, 19 nt, Homo sapiens
ugagggaacacaaauuuau

SEQ ID NO: 275940 - RNA, 19 nt, Homo sapiens
aaucaucccuauucugugu

SEQ ID NO: 275941 - RNA, 19 nt, Homo sapiens
acuguuagcuuuuaccuua

SEQ ID NO: 275942 - RNA, 19 nt, Homo sapiens
aaaacaggcucaggacuua

SEQ ID NO: 275943 - RNA, 19 nt, Homo sapiens
gagaccuucuaauugguuu

SEQ ID NO: 275944 - RNA, 19 nt, Homo sapiens
gcaaguaguaauugaugga

SEQ ID NO: 275945 - RNA, 19 nt, Homo sapiens
aaguuacacuguucacaaa

SEQ ID NO: 275946 - RNA, 19 nt, Homo sapiens
gauauucaccauuauagag

SEQ ID NO: 275947 - RNA, 19 nt, Homo sapiens
gaaaccugucucuuggaua

SEQ ID NO: 275948 - RNA, 19 nt, Homo sapiens
uaauuucaguugagaccuu

SEQ ID NO: 275949 - RNA, 19 nt, Homo sapiens
ggugugaaacaaauuaaug

SEQ ID NO: 275950 - RNA, 19 nt, Homo sapiens
gaagcaaguaguaauugau

SEQ ID NO: 275951 - RNA, 19 nt, Homo sapiens
ugauuugccuucuagaaca

SEQ ID NO: 275952 - RNA, 19 nt, Homo sapiens
cgacacagcaggucaagag

SEQ ID NO: 275953 - RNA, 19 nt, Homo sapiens
gagggaacacaaauuuaug

SEQ ID NO: 275954 - RNA, 19 nt, Homo sapiens
gccaguauucccagaguuu

SEQ ID NO: 275955 - RNA, 19 nt, Homo sapiens
ugaaacaucagcaaagaca

SEQ ID NO: 275956 - RNA, 19 nt, Homo sapiens
gggagggcuuucuuugugu

SEQ ID NO: 275957 - RNA, 19 nt, Homo sapiens
aaaguuacacuguucacaa

SEQ ID NO: 275958 - RNA, 19 nt, Homo sapiens
gaauaccuaagauuucugu

SEQ ID NO: 275959 - RNA, 19 nt, Homo sapiens
gaagucaaagacaaagugu

SEQ ID NO: 275960 - RNA, 19 nt, Homo sapiens
caggaagcaaguaguaauu

SEQ ID NO: 275961 - RNA, 19 nt, Homo sapiens
cuagucacauaaauggauu

SEQ ID NO: 275962 - RNA, 19 nt, Homo sapiens
gagagaggccugcugaaaa

SEQ ID NO: 275963 - RNA, 19 nt, Homo sapiens
aguaguaauugauggagaa

SEQ ID NO: 275964 - RNA, 19 nt, Homo sapiens
guuggugugaaacaaauua

SEQ ID NO: 275965 - RNA, 19 nt, Homo sapiens
cauacuaguacaaguggua

SEQ ID NO: 275966 - RNA, 19 nt, Homo sapiens
gacugaauauaaacuugug

SEQ ID NO: 275967 - RNA, 19 nt, Homo sapiens
gcaaugagggaccaguaca

SEQ ID NO: 275968 - RNA, 19 nt, Homo sapiens
cagcaggucaagaggagua

SEQ ID NO: 275969 - RNA, 19 nt, Homo sapiens
aagagugccuugacgauac

SEQ ID NO: 275970 - RNA, 19 nt, Homo sapiens
agaaaccugucucuuggau

SEQ ID NO: 275971 - RNA, 19 nt, Homo sapiens
cgagaaauucgaaaacaua

SEQ ID NO: 275972 - RNA, 19 nt, Homo sapiens
ugugaauguuggugugaaa

SEQ ID NO: 275973 - RNA, 19 nt, Homo sapiens
aagaaaagaugagcaaaga

SEQ ID NO: 275974 - RNA, 19 nt, Homo sapiens
gaggaguacagugcaauga

SEQ ID NO: 275975 - RNA, 19 nt, Homo sapiens
gcaucauguccuauaguuu

SEQ ID NO: 275976 - RNA, 19 nt, Homo sapiens
gacaagacaggguguugau

SEQ ID NO: 275977 - RNA, 19 nt, Homo sapiens
ucaucccuauucuguguuu

SEQ ID NO: 275978 - RNA, 19 nt, Homo sapiens
gaaacaucagcaaagacaa

SEQ ID NO: 275979 - RNA, 19 nt, Homo sapiens
guaccuaugguccuaguag

SEQ ID NO: 275980 - RNA, 19 nt, Homo sapiens
ggggagggcuuucuuugug

SEQ ID NO: 275981 - RNA, 19 nt, Homo sapiens
aaacauugagggaacacaa

SEQ ID NO: 275982 - RNA, 19 nt, Homo sapiens
aaugugauuugccuucuag

SEQ ID NO: 275983 - RNA, 19 nt, Homo sapiens
agauguaccuaugguccua

SEQ ID NO: 275984 - RNA, 19 nt, Homo sapiens
uaucuagucacauaaaugg

SEQ ID NO: 275985 - RNA, 19 nt, Homo sapiens
cugaauaccuaagauuucu

SEQ ID NO: 275986 - RNA, 19 nt, Homo sapiens
gugcaaugagggaccagua

SEQ ID NO: 275987 - RNA, 19 nt, Homo sapiens
acacuguucacaaagguuu

SEQ ID NO: 275988 - RNA, 19 nt, Homo sapiens
ugcaugcaguugauuacuu

SEQ ID NO: 275989 - RNA, 19 nt, Homo sapiens
agaaacugaauaccuaaga

SEQ ID NO: 275990 - RNA, 19 nt, Homo sapiens
agucaaagacaaagugugu

SEQ ID NO: 275991 - RNA, 19 nt, Homo sapiens
ugccuucuauacauuaguu

SEQ ID NO: 275992 - RNA, 19 nt, Homo sapiens
ugaugccuucuauacauua

SEQ ID NO: 275993 - RNA, 19 nt, Homo sapiens
aaacaucagcaaagacaag

SEQ ID NO: 275994 - RNA, 19 nt, Homo sapiens
agagaggccugcugaaaau

SEQ ID NO: 275995 - RNA, 19 nt, Homo sapiens
auugaaacaucagcaaaga

SEQ ID NO: 275996 - RNA, 19 nt, Homo sapiens
ucaccauuauagagaacaa

SEQ ID NO: 275997 - RNA, 19 nt, Homo sapiens
guuacacuguucacaaagg

SEQ ID NO: 275998 - RNA, 19 nt, Homo sapiens
caaaacaggcucaggacuu

SEQ ID NO: 275999 - RNA, 19 nt, Homo sapiens
cuaguacaagugguaauuu

SEQ ID NO: 276000 - RNA, 19 nt, Homo sapiens
gaugccuucuauacauuag

SEQ ID NO: 276001 - RNA, 19 nt, Homo sapiens
aagacaggguguugaugau

SEQ ID NO: 276002 - RNA, 19 nt, Homo sapiens
ugacgauacagcuaauuca

SEQ ID NO: 276003 - RNA, 19 nt, Homo sapiens
aagcaaguaguaauugaug

SEQ ID NO: 276004 - RNA, 19 nt, Homo sapiens
cauguccuauaguuuguca

SEQ ID NO: 276005 - RNA, 19 nt, Homo sapiens
uugagggaacacaaauuua

SEQ ID NO: 276006 - RNA, 19 nt, Homo sapiens
auugagggaacacaaauuu

SEQ ID NO: 276007 - RNA, 19 nt, Homo sapiens
cgaauaugauccaacaaua

SEQ ID NO: 276008 - RNA, 19 nt, Homo sapiens
uaaggacucugaagaugua

SEQ ID NO: 276009 - RNA, 19 nt, Homo sapiens
ggacgaauaugauccaaca

SEQ ID NO: 276010 - RNA, 19 nt, Homo sapiens
ugagagagauccgacaaua

SEQ ID NO: 276011 - RNA, 19 nt, Homo sapiens
ggaagcaaguaguaauuga

SEQ ID NO: 276012 - RNA, 19 nt, Homo sapiens
gcaagaaguuauggaauuc

SEQ ID NO: 276013 - RNA, 19 nt, Homo sapiens
gacaaaguguguaauuaug

SEQ ID NO: 276014 - RNA, 19 nt, Homo sapiens
gaugaugccuucuauacau

SEQ ID NO: 276015 - RNA, 19 nt, Homo sapiens
gcucaggacuuagcaagaa

SEQ ID NO: 276016 - RNA, 19 nt, Homo sapiens
gaaacugaauaccuaagau

SEQ ID NO: 276017 - RNA, 19 nt, Homo sapiens
cgauacagcuaauucagaa

SEQ ID NO: 276018 - RNA, 19 nt, Homo sapiens
aaaccugucucuuggauau

SEQ ID NO: 276019 - RNA, 19 nt, Homo sapiens
gaaguuauggaauuccuuu

SEQ ID NO: 276020 - RNA, 19 nt, Homo sapiens
gaacuagcaaugccuguga

SEQ ID NO: 276021 - RNA, 19 nt, Homo sapiens
ggagagaggccugcugaaa

SEQ ID NO: 276022 - RNA, 19 nt, Homo sapiens
ggagggcuuucuuugugua

SEQ ID NO: 276023 - RNA, 19 nt, Homo sapiens
gggcuuucuuuguguauuu

SEQ ID NO: 276024 - RNA, 19 nt, Homo sapiens
guugagaccuucuaauugg

SEQ ID NO: 276025 - RNA, 19 nt, Homo sapiens
gcaugcaguugauuacuuc

SEQ ID NO: 276026 - RNA, 19 nt, Homo sapiens
gaauaugauccaacaauag

SEQ ID NO: 276027 - RNA, 19 nt, Homo sapiens
caucauguccuauaguuug

SEQ ID NO: 276028 - RNA, 19 nt, Homo sapiens
ggcaucauguccuauaguu

SEQ ID NO: 276029 - RNA, 19 nt, Homo sapiens
ucaaagacaaaguguguaa

SEQ ID NO: 276030 - RNA, 19 nt, Homo sapiens
uuuaugggcuuccugauga

SEQ ID NO: 276031 - RNA, 19 nt, Homo sapiens
ugcaguugauuacuucuua

SEQ ID NO: 276032 - RNA, 19 nt, Homo sapiens
guuaaggacucugaagaug

SEQ ID NO: 276033 - RNA, 19 nt, Homo sapiens
gcaguugauuacuucuuau

SEQ ID NO: 276034 - RNA, 19 nt, Homo sapiens
caugcagacuguuagcuuu

SEQ ID NO: 276035 - RNA, 19 nt, Homo sapiens
agcaagaaguuauggaauu

SEQ ID NO: 276036 - RNA, 19 nt, Homo sapiens
cuagaacaguagacacaaa

SEQ ID NO: 276037 - RNA, 19 nt, Homo sapiens
caagaggaguacagugcaa

SEQ ID NO: 276038 - RNA, 19 nt, Homo sapiens
caguugagaccuucuaauu

SEQ ID NO: 276039 - RNA, 19 nt, Homo sapiens
ugagggaacacaaauuuau

SEQ ID NO: 276040 - RNA, 19 nt, Homo sapiens
aaucaucccuauucugugu

SEQ ID NO: 276041 - RNA, 19 nt, Homo sapiens
acuguuagcuuuuaccuua

SEQ ID NO: 276042 - RNA, 19 nt, Homo sapiens
aaaacaggcucaggacuua

SEQ ID NO: 276043 - RNA, 19 nt, Homo sapiens
gagaccuucuaauugguuu

SEQ ID NO: 276044 - RNA, 19 nt, Homo sapiens
gcaaguaguaauugaugga

SEQ ID NO: 276045 - RNA, 19 nt, Homo sapiens
aaguuacacuguucacaaa

SEQ ID NO: 276046 - RNA, 19 nt, Homo sapiens
gauauucaccauuauagag

SEQ ID NO: 276047 - RNA, 19 nt, Homo sapiens
gaaaccugucucuuggaua

SEQ ID NO: 276048 - RNA, 19 nt, Homo sapiens
uaauuucaguugagaccuu

SEQ ID NO: 276049 - RNA, 19 nt, Homo sapiens
ggugugaaacaaauuaaug

SEQ ID NO: 276050 - RNA, 19 nt, Homo sapiens
gaagcaaguaguaauugau

SEQ ID NO: 276051 - RNA, 19 nt, Homo sapiens
ugauuugccuucuagaaca

SEQ ID NO: 276052 - RNA, 19 nt, Homo sapiens
cgacacagcaggucaagag

SEQ ID NO: 276053 - RNA, 19 nt, Homo sapiens
gagggaacacaaauuuaug

SEQ ID NO: 276054 - RNA, 19 nt, Homo sapiens
aauguaaucuggguguuga

SEQ ID NO: 276055 - RNA, 19 nt, Homo sapiens
agagagauccgacaauaca

SEQ ID NO: 276056 - RNA, 19 nt, Homo sapiens
gccaguauucccagaguuu

SEQ ID NO: 276057 - RNA, 19 nt, Homo sapiens
ugaaacaucagcaaagaca

SEQ ID NO: 276058 - RNA, 19 nt, Homo sapiens
gggagggcuuucuuugugu

SEQ ID NO: 276059 - RNA, 19 nt, Homo sapiens
aaaguuacacuguucacaa

SEQ ID NO: 276060 - RNA, 19 nt, Homo sapiens
gaauaccuaagauuucugu

SEQ ID NO: 276061 - RNA, 19 nt, Homo sapiens
gaagucaaagacaaagugu

SEQ ID NO: 276062 - RNA, 19 nt, Homo sapiens
aguaguaauugauggagaa

SEQ ID NO: 276063 - RNA, 19 nt, Homo sapiens
caggaagcaaguaguaauu

SEQ ID NO: 276064 - RNA, 19 nt, Homo sapiens
cuagucacauaaauggauu

SEQ ID NO: 276065 - RNA, 19 nt, Homo sapiens
gagagaggccugcugaaaa

SEQ ID NO: 276066 - RNA, 19 nt, Homo sapiens
guuggugugaaacaaauua

SEQ ID NO: 276067 - RNA, 19 nt, Homo sapiens
gacugaauauaaacuugug

SEQ ID NO: 276068 - RNA, 19 nt, Homo sapiens
cauacuaguacaaguggua

SEQ ID NO: 276069 - RNA, 19 nt, Homo sapiens
gcaaugagggaccaguaca

SEQ ID NO: 276070 - RNA, 19 nt, Homo sapiens
cagcaggucaagaggagua

SEQ ID NO: 276071 - RNA, 19 nt, Homo sapiens
aagagugccuugacgauac

SEQ ID NO: 276072 - RNA, 19 nt, Homo sapiens
cgagaaauucgaaaacaua

SEQ ID NO: 276073 - RNA, 19 nt, Homo sapiens
agaaaccugucucuuggau

SEQ ID NO: 276074 - RNA, 19 nt, Homo sapiens
uaaucuggguguugaugau

SEQ ID NO: 276075 - RNA, 19 nt, Homo sapiens
ugugaauguuggugugaaa

SEQ ID NO: 276076 - RNA, 19 nt, Homo sapiens
aagaaaagaugagcaaaga

SEQ ID NO: 276077 - RNA, 19 nt, Homo sapiens
gaggaguacagugcaauga

SEQ ID NO: 276078 - RNA, 19 nt, Homo sapiens
gcaucauguccuauaguuu

SEQ ID NO: 276079 - RNA, 19 nt, Homo sapiens
guaaucuggguguugauga

SEQ ID NO: 276080 - RNA, 19 nt, Homo sapiens
ucaucccuauucuguguuu

SEQ ID NO: 276081 - RNA, 19 nt, Homo sapiens
gaaacaucagcaaagacaa

SEQ ID NO: 276082 - RNA, 19 nt, Homo sapiens
guaccuaugguccuaguag

SEQ ID NO: 276083 - RNA, 19 nt, Homo sapiens
ggggagggcuuucuuugug

SEQ ID NO: 276084 - RNA, 19 nt, Homo sapiens
aaacauugagggaacacaa

SEQ ID NO: 276085 - RNA, 19 nt, Homo sapiens
gagagagauccgacaauac

SEQ ID NO: 276086 - RNA, 19 nt, Homo sapiens
aaugugauuugccuucuag

SEQ ID NO: 276087 - RNA, 19 nt, Homo sapiens
agauguaccuaugguccua

SEQ ID NO: 276088 - RNA, 19 nt, Homo sapiens
uaucuagucacauaaaugg

SEQ ID NO: 276089 - RNA, 19 nt, Homo sapiens
cugaauaccuaagauuucu

SEQ ID NO: 276090 - RNA, 19 nt, Homo sapiens
gugcaaugagggaccagua

SEQ ID NO: 276091 - RNA, 19 nt, Homo sapiens
acacuguucacaaagguuu

SEQ ID NO: 276092 - RNA, 19 nt, Homo sapiens
ugcaugcaguugauuacuu

SEQ ID NO: 276093 - RNA, 19 nt, Homo sapiens
agaaacugaauaccuaaga

SEQ ID NO: 276094 - RNA, 19 nt, Homo sapiens
agucaaagacaaagugugu

SEQ ID NO: 276095 - RNA, 19 nt, Homo sapiens
ugccuucuauacauuaguu

SEQ ID NO: 276096 - RNA, 19 nt, Homo sapiens
ugaugccuucuauacauua

SEQ ID NO: 276097 - RNA, 19 nt, Homo sapiens
agagaggccugcugaaaau

SEQ ID NO: 276098 - RNA, 19 nt, Homo sapiens
ggugagagagauccgacaa

SEQ ID NO: 276099 - RNA, 19 nt, Homo sapiens
aaacaucagcaaagacaag

SEQ ID NO: 276100 - RNA, 19 nt, Homo sapiens
auugaaacaucagcaaaga

SEQ ID NO: 276101 - RNA, 19 nt, Homo sapiens
ucaccauuauagagaacaa

SEQ ID NO: 276102 - RNA, 19 nt, Homo sapiens
guuacacuguucacaaagg

SEQ ID NO: 276103 - RNA, 19 nt, Homo sapiens
caaaacaggcucaggacuu

SEQ ID NO: 276104 - RNA, 19 nt, Homo sapiens
cuaguacaagugguaauuu

SEQ ID NO: 276105 - RNA, 19 nt, Homo sapiens
gaugccuucuauacauuag

SEQ ID NO: 276106 - RNA, 19 nt, Homo sapiens
gagauccgacaauacagau

SEQ ID NO: 276107 - RNA, 19 nt, Homo sapiens
gggaggcugugguucuugu

SEQ ID NO: 276108 - RNA, 19 nt, Homo sapiens
caagggaggcugugguucu

SEQ ID NO: 276109 - RNA, 19 nt, Homo sapiens
gcugcaagcccugcuguug

SEQ ID NO: 276110 - RNA, 19 nt, Homo sapiens
gcccugcuguugcucuuca

SEQ ID NO: 276111 - RNA, 19 nt, Homo sapiens
gcugugucccugugugcua

SEQ ID NO: 276112 - RNA, 19 nt, Homo sapiens
gcugugcacccgucuacug

SEQ ID NO: 276113 - RNA, 19 nt, Homo sapiens
aagggaggcugugguucuu

SEQ ID NO: 276114 - RNA, 19 nt, Homo sapiens
gcaauaaacugcauuugaa

SEQ ID NO: 276115 - RNA, 19 nt, Homo sapiens
guagauaccuccacuagaa

SEQ ID NO: 276116 - RNA, 19 nt, Homo sapiens
caacaugagucgacaguuu

SEQ ID NO: 276117 - RNA, 19 nt, Homo sapiens
aaagagcuaugguuaguua

SEQ ID NO: 276118 - RNA, 19 nt, Homo sapiens
gaucugaaaucgacaaugu

SEQ ID NO: 276119 - RNA, 19 nt, Homo sapiens
gaacaaguaugaggaugaa

SEQ ID NO: 276120 - RNA, 19 nt, Homo sapiens
ggacaaaugcagagaauga

SEQ ID NO: 276121 - RNA, 19 nt, Homo sapiens
ggaagucggagucuuguua

SEQ ID NO: 276122 - RNA, 19 nt, Homo sapiens
gaugcccucuguuucauua

SEQ ID NO: 276123 - RNA, 19 nt, Homo sapiens
ccacuagaacccauaauuu

SEQ ID NO: 276124 - RNA, 19 nt, Homo sapiens
caaaucaagucacucaaca

SEQ ID NO: 276125 - RNA, 19 nt, Homo sapiens
caggaugucuggagaaugu

SEQ ID NO: 276126 - RNA, 19 nt, Homo sapiens
cacuagaacccauaauuua

SEQ ID NO: 276127 - RNA, 19 nt, Homo sapiens
ggccaaacuugacaacuug

SEQ ID NO: 276128 - RNA, 19 nt, Homo sapiens
gaaaagagcuaugguuagu

SEQ ID NO: 276129 - RNA, 19 nt, Homo sapiens
ggauguggauggugcuuau

SEQ ID NO: 276130 - RNA, 19 nt, Homo sapiens
ggacagcuccuuagcaucu

SEQ ID NO: 276131 - RNA, 19 nt, Homo sapiens
gagaaaagagcuaugguua

SEQ ID NO: 276132 - RNA, 19 nt, Homo sapiens
guaaccagauaaagagaug

SEQ ID NO: 276133 - RNA, 19 nt, Homo sapiens
ccaagaacaagcugaauga

SEQ ID NO: 276134 - RNA, 19 nt, Homo sapiens
gcuaugacccugcuuuguu

SEQ ID NO: 276135 - RNA, 19 nt, Homo sapiens
uacacuagcucauccuauu

SEQ ID NO: 276136 - RNA, 19 nt, Homo sapiens
agaagcagaucuccaacuu

SEQ ID NO: 276137 - RNA, 19 nt, Homo sapiens
ggaacaaguaugaggauga

SEQ ID NO: 276138 - RNA, 19 nt, Homo sapiens
ccaauuugccuccuucauu

SEQ ID NO: 276139 - RNA, 19 nt, Homo sapiens
gagcaaaucaagucacuca

SEQ ID NO: 276140 - RNA, 19 nt, Homo sapiens
uaauuuagagcccuacuuu

SEQ ID NO: 276141 - RNA, 19 nt, Homo sapiens
gaagucggagucuuguuaa

SEQ ID NO: 276142 - RNA, 19 nt, Homo sapiens
caaaugcagagaaugaauu

SEQ ID NO: 276143 - RNA, 19 nt, Homo sapiens
ggugaagucucgagaaagg

SEQ ID NO: 276144 - RNA, 19 nt, Homo sapiens
ggaguaaccagauaaagag

SEQ ID NO: 276145 - RNA, 19 nt, Homo sapiens
gugagaaauucaaagauag

SEQ ID NO: 276146 - RNA, 19 nt, Homo sapiens
gcagagaaugaauuuguga

SEQ ID NO: 276147 - RNA, 19 nt, Homo sapiens
gcggacaaaugcagagaau

SEQ ID NO: 276148 - RNA, 19 nt, Homo sapiens
gaaaucaacaagcggacaa

SEQ ID NO: 276149 - RNA, 19 nt, Homo sapiens
uacaagaagucacuaucaa

SEQ ID NO: 276150 - RNA, 19 nt, Homo sapiens
agaaacaguucagcaguga

SEQ ID NO: 276151 - RNA, 19 nt, Homo sapiens
ucaagaagcagaucuccaa

SEQ ID NO: 276152 - RNA, 19 nt, Homo sapiens
gggauagugugagaaauuc

SEQ ID NO: 276153 - RNA, 19 nt, Homo sapiens
ucaagucacucaacaacca

SEQ ID NO: 276154 - RNA, 19 nt, Homo sapiens
gaugcagacucaaaucagu

SEQ ID NO: 276155 - RNA, 19 nt, Homo sapiens
caagcagaguugucucaga

SEQ ID NO: 276156 - RNA, 19 nt, Homo sapiens
uaaccuugguggcaguaaa

SEQ ID NO: 276157 - RNA, 19 nt, Homo sapiens
cgugugauccagagacuua

SEQ ID NO: 276158 - RNA, 19 nt, Homo sapiens
cugcugggaucaucaacua

SEQ ID NO: 276159 - RNA, 19 nt, Homo sapiens
gagaaagggagcaaaucaa

SEQ ID NO: 276160 - RNA, 19 nt, Homo sapiens
gaggauauagcccagaaga

SEQ ID NO: 276161 - RNA, 19 nt, Homo sapiens
gugcuuauaugaccaaggu

SEQ ID NO: 276162 - RNA, 19 nt, Homo sapiens
ugaagaacaugcaggacau

SEQ ID NO: 276163 - RNA, 19 nt, Homo sapiens
aaggugaagucucgagaaa

SEQ ID NO: 276164 - RNA, 19 nt, Homo sapiens
ggugguggcuuuggugguu

SEQ ID NO: 276165 - RNA, 19 nt, Homo sapiens
cacaugacauuucaaagca

SEQ ID NO: 276166 - RNA, 19 nt, Homo sapiens
ccacccacaugacauuuca

SEQ ID NO: 276167 - RNA, 19 nt, Homo sapiens
aagcagaguugucucagau

SEQ ID NO: 276168 - RNA, 19 nt, Homo sapiens
ucaaggaugccaagaacaa

SEQ ID NO: 276169 - RNA, 19 nt, Homo sapiens
gaaagggagcaaaucaagu

SEQ ID NO: 276170 - RNA, 19 nt, Homo sapiens
cgagaaagggagcaaauca

SEQ ID NO: 276171 - RNA, 19 nt, Homo sapiens
cauaagguguaagcaaguu

SEQ ID NO: 276172 - RNA, 19 nt, Homo sapiens
guggacagcuccuuagcau

SEQ ID NO: 276173 - RNA, 19 nt, Homo sapiens
agacuuagaucugaaaucg

SEQ ID NO: 276174 - RNA, 19 nt, Homo sapiens
cuaaugucauccucucuau

SEQ ID NO: 276175 - RNA, 19 nt, Homo sapiens
caaaucagugaaacuaaug

SEQ ID NO: 276176 - RNA, 19 nt, Homo sapiens
caagaaggauguggauggu

SEQ ID NO: 276177 - RNA, 19 nt, Homo sapiens
gagaugcccucuguuucau

SEQ ID NO: 276178 - RNA, 19 nt, Homo sapiens
cggaguaaccagauaaaga

SEQ ID NO: 276179 - RNA, 19 nt, Homo sapiens
ggagaagaaagcaggaugu

SEQ ID NO: 276180 - RNA, 19 nt, Homo sapiens
gaagcagaucuccaacuug

SEQ ID NO: 276181 - RNA, 19 nt, Homo sapiens
gaauuugugaccaucaaga

SEQ ID NO: 276182 - RNA, 19 nt, Homo sapiens
guaugaggaugaaaucaac

SEQ ID NO: 276183 - RNA, 19 nt, Homo sapiens
uggaccaacugaagaguga

SEQ ID NO: 276184 - RNA, 19 nt, Homo sapiens
ugacccugcuuuguucuuu

SEQ ID NO: 276185 - RNA, 19 nt, Homo sapiens
gcacaagccacaccaccau

SEQ ID NO: 276186 - RNA, 19 nt, Homo sapiens
gcgagaaugcccucaagga

SEQ ID NO: 276187 - RNA, 19 nt, Homo sapiens
aggauuaccggaacaagua

SEQ ID NO: 276188 - RNA, 19 nt, Homo sapiens
ggagauugacccugagauc

SEQ ID NO: 276189 - RNA, 19 nt, Homo sapiens
cuaugacccugcuuuguuc

SEQ ID NO: 276190 - RNA, 19 nt, Homo sapiens
caucauugcugaggucaag

SEQ ID NO: 276191 - RNA, 19 nt, Homo sapiens
gaccuggacagcaucauug

SEQ ID NO: 276192 - RNA, 19 nt, Homo sapiens
cagugaaacuaaugucauc

SEQ ID NO: 276193 - RNA, 19 nt, Homo sapiens
caacuugcagcaggaaauu

SEQ ID NO: 276194 - RNA, 19 nt, Homo sapiens
aggccaaacuugacaacuu

SEQ ID NO: 276195 - RNA, 19 nt, Homo sapiens
gcaaaucaagucacucaac

SEQ ID NO: 276196 - RNA, 19 nt, Homo sapiens
aaaagcaucuccauaagug

SEQ ID NO: 276197 - RNA, 19 nt, Homo sapiens
cagaguaggaccaguuaga

SEQ ID NO: 276198 - RNA, 19 nt, Homo sapiens
gccagaguaggaccaguua

SEQ ID NO: 276199 - RNA, 19 nt, Homo sapiens
aacaugagucgacaguuua

SEQ ID NO: 276200 - RNA, 19 nt, Homo sapiens
cuagaacccauaauuuaga

SEQ ID NO: 276201 - RNA, 19 nt, Homo sapiens
agaaugaauuugugaccau

SEQ ID NO: 276202 - RNA, 19 nt, Homo sapiens
aggacaugguggaggauua

SEQ ID NO: 276203 - RNA, 19 nt, Homo sapiens
ccucaaggaugccaagaac

SEQ ID NO: 276204 - RNA, 19 nt, Homo sapiens
gauagugugagaaauucaa

SEQ ID NO: 276205 - RNA, 19 nt, Homo sapiens
ggugguagcuaugguucug

SEQ ID NO: 276206 - RNA, 19 nt, Homo sapiens
gccaagaacaagcugaaug

SEQ ID NO: 276207 - RNA, 19 nt, Homo sapiens
caacugaagagugaucaau

SEQ ID NO: 276208 - RNA, 19 nt, Homo sapiens
ucacucaacaaccaauuug

SEQ ID NO: 276209 - RNA, 19 nt, Homo sapiens
gggagcaaaucaagucacu

SEQ ID NO: 276210 - RNA, 19 nt, Homo sapiens
gauugacccugagauccaa

SEQ ID NO: 276211 - RNA, 19 nt, Homo sapiens
acagcuccuuagcaucuua

SEQ ID NO: 276212 - RNA, 19 nt, Homo sapiens
ccacaugacauuucaaagc

SEQ ID NO: 276213 - RNA, 19 nt, Homo sapiens
guaaaagcaucuccauaag

SEQ ID NO: 276214 - RNA, 19 nt, Homo sapiens
gaaagaacaucacagaauu

SEQ ID NO: 276215 - RNA, 19 nt, Homo sapiens
ggacaaugccuacaugaua

SEQ ID NO: 276216 - RNA, 19 nt, Homo sapiens
ugaaagagaucaagauaga

SEQ ID NO: 276217 - RNA, 19 nt, Homo sapiens
gacaaugccuacaugauaa

SEQ ID NO: 276218 - RNA, 19 nt, Homo sapiens
ugaaagaucuucucuccaa

SEQ ID NO: 276219 - RNA, 19 nt, Homo sapiens
gaacaucacagaauucaga

SEQ ID NO: 276220 - RNA, 19 nt, Homo sapiens
guagaagccugucucugua

SEQ ID NO: 276221 - RNA, 19 nt, Homo sapiens
gaagaaguaugaggaugaa

SEQ ID NO: 276222 - RNA, 19 nt, Homo sapiens
ggagacagccugaaagaga

SEQ ID NO: 276223 - RNA, 19 nt, Homo sapiens
guauauagcuccucuuguc

SEQ ID NO: 276224 - RNA, 19 nt, Homo sapiens
ccagggauuucaucucuaa

SEQ ID NO: 276225 - RNA, 19 nt, Homo sapiens
gcagaaagaacaucacaga

SEQ ID NO: 276226 - RNA, 19 nt, Homo sapiens
gaaagaucuucucuccaaa

SEQ ID NO: 276227 - RNA, 19 nt, Homo sapiens
caaauuugccuccuucauu

SEQ ID NO: 276228 - RNA, 19 nt, Homo sapiens
gcagcaccauuucaucaaa

SEQ ID NO: 276229 - RNA, 19 nt, Homo sapiens
ggacuuggauagcaucauc

SEQ ID NO: 276230 - RNA, 19 nt, Homo sapiens
ugucagaucucuugcaaau

SEQ ID NO: 276231 - RNA, 19 nt, Homo sapiens
acaaaggcaucaugaguug

SEQ ID NO: 276232 - RNA, 19 nt, Homo sapiens
caucaaauguggcauccaa

SEQ ID NO: 276233 - RNA, 19 nt, Homo sapiens
ggacaaaggcaucaugagu

SEQ ID NO: 276234 - RNA, 19 nt, Homo sapiens
gaaccaggaaauugaguuu

SEQ ID NO: 276235 - RNA, 19 nt, Homo sapiens
aaauuugccuccuucauug

SEQ ID NO: 276236 - RNA, 19 nt, Homo sapiens
ggauacagcucuggaagca

SEQ ID NO: 276237 - RNA, 19 nt, Homo sapiens
guaugaggaugaaaucaau

SEQ ID NO: 276238 - RNA, 19 nt, Homo sapiens
ccagagauccagaauguga

SEQ ID NO: 276239 - RNA, 19 nt, Homo sapiens
gaccuucucuuuuagauaa

SEQ ID NO: 276240 - RNA, 19 nt, Homo sapiens
gacaaaggcaucaugaguu

SEQ ID NO: 276241 - RNA, 19 nt, Homo sapiens
gaagaagcaguguaagaau

SEQ ID NO: 276242 - RNA, 19 nt, Homo sapiens
ugaauaacaugcaggaucu

SEQ ID NO: 276243 - RNA, 19 nt, Homo sapiens
uugcaaaucucgaggaaga

SEQ ID NO: 276244 - RNA, 19 nt, Homo sapiens
gagacagccugaaagagau

SEQ ID NO: 276245 - RNA, 19 nt, Homo sapiens
ccaagagcaucuccauuag

SEQ ID NO: 276246 - RNA, 19 nt, Homo sapiens
accaagagcaucuccauua

SEQ ID NO: 276247 - RNA, 19 nt, Homo sapiens
uggaggaggugguggcuuu

SEQ ID NO: 276248 - RNA, 19 nt, Homo sapiens
caucaugaguugucagauc

SEQ ID NO: 276249 - RNA, 19 nt, Homo sapiens
ugaagaagcaguguaagaa

SEQ ID NO: 276250 - RNA, 19 nt, Homo sapiens
ggagaucgcacaugugaag

SEQ ID NO: 276251 - RNA, 19 nt, Homo sapiens
gaaaguugacccagagauc

SEQ ID NO: 276252 - RNA, 19 nt, Homo sapiens
ggaggccgcuuuggagguu

SEQ ID NO: 276253 - RNA, 19 nt, Homo sapiens
ggagguagaggguccaguu

SEQ ID NO: 276254 - RNA, 19 nt, Homo sapiens
gaagcuggcccuagaugug

SEQ ID NO: 276255 - RNA, 19 nt, Homo sapiens
agaaagaacaucacagaau

SEQ ID NO: 276256 - RNA, 19 nt, Homo sapiens
ucgacagccucaagagaua

SEQ ID NO: 276257 - RNA, 19 nt, Homo sapiens
gagcugcuacaacaaauga

SEQ ID NO: 276258 - RNA, 19 nt, Homo sapiens
gaucaaaacucucaacaac

SEQ ID NO: 276259 - RNA, 19 nt, Homo sapiens
gaccucagcagcaauguga

SEQ ID NO: 276260 - RNA, 19 nt, Homo sapiens
gugacaagcagcaccauuu

SEQ ID NO: 276261 - RNA, 19 nt, Homo sapiens
ccaggaacaaguugaauga

SEQ ID NO: 276262 - RNA, 19 nt, Homo sapiens
aagaagcaguguaagaaug

SEQ ID NO: 276263 - RNA, 19 nt, Homo sapiens
aaugggagcugcuacaaca

SEQ ID NO: 276264 - RNA, 19 nt, Homo sapiens
ucaaaacucucaacaacaa

SEQ ID NO: 276265 - RNA, 19 nt, Homo sapiens
aagagcaucuccauuagug

SEQ ID NO: 276266 - RNA, 19 nt, Homo sapiens
gcaaugugacugugucugu

SEQ ID NO: 276267 - RNA, 19 nt, Homo sapiens
ugauaaagguggaguugca

SEQ ID NO: 276268 - RNA, 19 nt, Homo sapiens
gaaguaugaggaugaaauc

SEQ ID NO: 276269 - RNA, 19 nt, Homo sapiens
ggagaucaacuuccagcuu

SEQ ID NO: 276270 - RNA, 19 nt, Homo sapiens
acccagagauccagaaugu

SEQ ID NO: 276271 - RNA, 19 nt, Homo sapiens
aaucugugcugucuagguu

SEQ ID NO: 276272 - RNA, 19 nt, Homo sapiens
aaagagaucaagauagaga

SEQ ID NO: 276273 - RNA, 19 nt, Homo sapiens
ucuccaaaccaguuaguua

SEQ ID NO: 276274 - RNA, 19 nt, Homo sapiens
gguggaagccggagaucaa

SEQ ID NO: 276275 - RNA, 19 nt, Homo sapiens
ccugaaagagaucaagaua

SEQ ID NO: 276276 - RNA, 19 nt, Homo sapiens
ccacucugcuuucggaagu

SEQ ID NO: 276277 - RNA, 19 nt, Homo sapiens
gugaagaagcaguguaaga

SEQ ID NO: 276278 - RNA, 19 nt, Homo sapiens
gcagcagaaccagguguua

SEQ ID NO: 276279 - RNA, 19 nt, Homo sapiens
cggaaucugugcugucuag

SEQ ID NO: 276280 - RNA, 19 nt, Homo sapiens
guugucagaucucuugcaa

SEQ ID NO: 276281 - RNA, 19 nt, Homo sapiens
uguagaagccugucucugu

SEQ ID NO: 276282 - RNA, 19 nt, Homo sapiens
ucugaaaguucucuaugau

SEQ ID NO: 276283 - RNA, 19 nt, Homo sapiens
agaagaaguaugaggauga

SEQ ID NO: 276284 - RNA, 19 nt, Homo sapiens
ggagaccucagcagcaaug

SEQ ID NO: 276285 - RNA, 19 nt, Homo sapiens
gaucgccaccuaccgcaaa

SEQ ID NO: 276286 - RNA, 19 nt, Homo sapiens
ggaagccggagaucaacuu

SEQ ID NO: 276287 - RNA, 19 nt, Homo sapiens
cauaauaaaccucauuugc

SEQ ID NO: 276288 - RNA, 19 nt, Homo sapiens
gaucgcacaugugaagaag

SEQ ID NO: 276289 - RNA, 19 nt, Homo sapiens
gggagcugcuacaacaaau

SEQ ID NO: 276290 - RNA, 19 nt, Homo sapiens
ggaggaggagguucuaucu

SEQ ID NO: 276291 - RNA, 19 nt, Homo sapiens
uaacaugcaggaucuugug

SEQ ID NO: 276292 - RNA, 19 nt, Homo sapiens
ugaguugucagaucucuug

SEQ ID NO: 276293 - RNA, 19 nt, Homo sapiens
ggaccaagagcaucuccau

SEQ ID NO: 276294 - RNA, 19 nt, Homo sapiens
ccaaaccaguuaguuagag

SEQ ID NO: 276295 - RNA, 19 nt, Homo sapiens
gcucuggaagcagcaguua

SEQ ID NO: 276296 - RNA, 19 nt, Homo sapiens
gaagcaguguaagaaugug

SEQ ID NO: 276297 - RNA, 19 nt, Homo sapiens
acaacaaauuugccuccuu

SEQ ID NO: 276298 - RNA, 19 nt, Homo sapiens
aggaggagguucuaucucu

SEQ ID NO: 276299 - RNA, 19 nt, Homo sapiens
ggaggauacagcucuggaa

SEQ ID NO: 276300 - RNA, 19 nt, Homo sapiens
gaucuuguggaggauuaua

SEQ ID NO: 276301 - RNA, 19 nt, Homo sapiens
cagaaagaacaucacagaa

SEQ ID NO: 276302 - RNA, 19 nt, Homo sapiens
caaaugggagcugcuacaa

SEQ ID NO: 276303 - RNA, 19 nt, Homo sapiens
gguucuagcucuguaaagg

SEQ ID NO: 276304 - RNA, 19 nt, Homo sapiens
gaucuggugguggcucuaa

SEQ ID NO: 276305 - RNA, 19 nt, Homo sapiens
ggcgaggagugcaggaugu

SEQ ID NO: 276306 - RNA, 19 nt, Homo sapiens
ucgcacaugugaagaagca

SEQ ID NO: 276307 - RNA, 19 nt, Homo sapiens
gccgcaaccuggacuugga

SEQ ID NO: 276308 - RNA, 19 nt, Homo sapiens
gccugucucuguaccucua

SEQ ID NO: 276309 - RNA, 19 nt, Homo sapiens
gaccaagagcaucuccauu

SEQ ID NO: 276310 - RNA, 19 nt, Homo sapiens
agaaguaugaggaugaaau

SEQ ID NO: 276311 - RNA, 19 nt, Homo sapiens
guggaggauuauaagaaga

SEQ ID NO: 276312 - RNA, 19 nt, Homo sapiens
aggaucuuguggaggauua

SEQ ID NO: 276313 - RNA, 19 nt, Homo sapiens
caaccuggagcccaucuuc

SEQ ID NO: 276314 - RNA, 19 nt, Homo sapiens
caaaguggaugccuugaua

SEQ ID NO: 276315 - RNA, 19 nt, Homo sapiens
gaagaaauaugaggaugaa

SEQ ID NO: 276316 - RNA, 19 nt, Homo sapiens
ucauagagcucaacagaau

SEQ ID NO: 276317 - RNA, 19 nt, Homo sapiens
gagaucgacuucuuaagga

SEQ ID NO: 276318 - RNA, 19 nt, Homo sapiens
gaucauagagcucaacaga

SEQ ID NO: 276319 - RNA, 19 nt, Homo sapiens
gaagaaggauguggacagu

SEQ ID NO: 276320 - RNA, 19 nt, Homo sapiens
ucaagacccucaacaacaa

SEQ ID NO: 276321 - RNA, 19 nt, Homo sapiens
gagcggagcagguggcuuu

SEQ ID NO: 276322 - RNA, 19 nt, Homo sapiens
ggagcuaccuggacaacau

SEQ ID NO: 276323 - RNA, 19 nt, Homo sapiens
gaugagaucgacuucuuaa

SEQ ID NO: 276324 - RNA, 19 nt, Homo sapiens
gggcaguccugguggcuuu

SEQ ID NO: 276325 - RNA, 19 nt, Homo sapiens
gaucgagggugucaagaag

SEQ ID NO: 276326 - RNA, 19 nt, Homo sapiens
gaaauaugaggaugaaauc

SEQ ID NO: 276327 - RNA, 19 nt, Homo sapiens
gggcacaaguuccaucuca

SEQ ID NO: 276328 - RNA, 19 nt, Homo sapiens
gaggauaucgcucagagaa

SEQ ID NO: 276329 - RNA, 19 nt, Homo sapiens
uagaugagaucgacuucuu

SEQ ID NO: 276330 - RNA, 19 nt, Homo sapiens
caaguuugccuccuucauu

SEQ ID NO: 276331 - RNA, 19 nt, Homo sapiens
guggaugccuugauagaug

SEQ ID NO: 276332 - RNA, 19 nt, Homo sapiens
ugaaguuggugcacaguau

SEQ ID NO: 276333 - RNA, 19 nt, Homo sapiens
ccacaucagugacacaucu

SEQ ID NO: 276334 - RNA, 19 nt, Homo sapiens
caggaugucuggagagugu

SEQ ID NO: 276335 - RNA, 19 nt, Homo sapiens
ggacagugccuauaugaac

SEQ ID NO: 276336 - RNA, 19 nt, Homo sapiens
gggaugaccuaagaaauac

SEQ ID NO: 276337 - RNA, 19 nt, Homo sapiens
accaggagcugaugaaugu

SEQ ID NO: 276338 - RNA, 19 nt, Homo sapiens
caucauugcugaaguuggu

SEQ ID NO: 276339 - RNA, 19 nt, Homo sapiens
gagcagcugugccuuugca

SEQ ID NO: 276340 - RNA, 19 nt, Homo sapiens
gacagugccuauaugaaca

SEQ ID NO: 276341 - RNA, 19 nt, Homo sapiens
uggaggaccugguggaaga

SEQ ID NO: 276342 - RNA, 19 nt, Homo sapiens
acucugagcugaagaacau

SEQ ID NO: 276343 - RNA, 19 nt, Homo sapiens
ucaacuaccugcggagcua

SEQ ID NO: 276344 - RNA, 19 nt, Homo sapiens
ggaccuggacagcaucauu

SEQ ID NO: 276345 - RNA, 19 nt, Homo sapiens
acaaaguccuggagaccaa

SEQ ID NO: 276346 - RNA, 19 nt, Homo sapiens
gaucaagacccucaacaac

SEQ ID NO: 276347 - RNA, 19 nt, Homo sapiens
ugguggagcugguggcuuu

SEQ ID NO: 276348 - RNA, 19 nt, Homo sapiens
gcgcuacuccagauaaaga

SEQ ID NO: 276349 - RNA, 19 nt, Homo sapiens
caugggcggugguuuagga

SEQ ID NO: 276350 - RNA, 19 nt, Homo sapiens
cuacgacgcugagcuaucu

SEQ ID NO: 276351 - RNA, 19 nt, Homo sapiens
cagcgcuacuccagauaaa

SEQ ID NO: 276352 - RNA, 19 nt, Homo sapiens
ggggaugaccuaagaaaua

SEQ ID NO: 276353 - RNA, 19 nt, Homo sapiens
agaaugaauuugugacucu

SEQ ID NO: 276354 - RNA, 19 nt, Homo sapiens
gaauuugugacucugaaga

SEQ ID NO: 276355 - RNA, 19 nt, Homo sapiens
uucaggaagugacuacuaa

SEQ ID NO: 276356 - RNA, 19 nt, Homo sapiens
gaccuaagaaauaccaaga

SEQ ID NO: 276357 - RNA, 19 nt, Homo sapiens
acaacaaguuugccuccuu

SEQ ID NO: 276358 - RNA, 19 nt, Homo sapiens
gaccuggacagcaucauug

SEQ ID NO: 276359 - RNA, 19 nt, Homo sapiens
gaaguuggugcacaguaug

SEQ ID NO: 276360 - RNA, 19 nt, Homo sapiens
gcauggggaugaccuaaga

SEQ ID NO: 276361 - RNA, 19 nt, Homo sapiens
gcaacaagagcaucuccau

SEQ ID NO: 276362 - RNA, 19 nt, Homo sapiens
aaguuugccuccuucauug

SEQ ID NO: 276363 - RNA, 19 nt, Homo sapiens
aacaagagcaucuccauca

SEQ ID NO: 276364 - RNA, 19 nt, Homo sapiens
cggagcagcugugccuuug

SEQ ID NO: 276365 - RNA, 19 nt, Homo sapiens
gugccuauaugaacaaggu

SEQ ID NO: 276366 - RNA, 19 nt, Homo sapiens
caagaagaaauaugaggau

SEQ ID NO: 276367 - RNA, 19 nt, Homo sapiens
aggcaugggcggugguuua

SEQ ID NO: 276368 - RNA, 19 nt, Homo sapiens
gagagauggcccucaagga

SEQ ID NO: 276369 - RNA, 19 nt, Homo sapiens
gcagagaucgaggguguca

SEQ ID NO: 276370 - RNA, 19 nt, Homo sapiens
ggaaugggagguggcuuug

SEQ ID NO: 276371 - RNA, 19 nt, Homo sapiens
uggaugccuugauagauga

SEQ ID NO: 276372 - RNA, 19 nt, Homo sapiens
agaagaaauaugaggauga

SEQ ID NO: 276373 - RNA, 19 nt, Homo sapiens
cgagcagcauggagagaug

SEQ ID NO: 276374 - RNA, 19 nt, Homo sapiens
gcggagcagcugugccuuu

SEQ ID NO: 276375 - RNA, 19 nt, Homo sapiens
ugagaucgacuucuuaagg

SEQ ID NO: 276376 - RNA, 19 nt, Homo sapiens
gauguggacagugccuaua

SEQ ID NO: 276377 - RNA, 19 nt, Homo sapiens
uggcuuuggugguggcuuu

SEQ ID NO: 276378 - RNA, 19 nt, Homo sapiens
gcucaggcauuggcuuugg

SEQ ID NO: 276379 - RNA, 19 nt, Homo sapiens
agagauggcccucaaggau

SEQ ID NO: 276380 - RNA, 19 nt, Homo sapiens
gcugagaaugaauuuguga

SEQ ID NO: 276381 - RNA, 19 nt, Homo sapiens
gaggaugaaaucaauaaac

SEQ ID NO: 276382 - RNA, 19 nt, Homo sapiens
uccggucugucgccaauaa

SEQ ID NO: 276383 - RNA, 19 nt, Homo sapiens
ccagcgcuacuccagauaa

SEQ ID NO: 276384 - RNA, 19 nt, Homo sapiens
gaaauaccaagagcgagau

SEQ ID NO: 276385 - RNA, 19 nt, Homo sapiens
gagcgggaacagaucaaga

SEQ ID NO: 276386 - RNA, 19 nt, Homo sapiens
caagcccagucacgagaau

SEQ ID NO: 276387 - RNA, 19 nt, Homo sapiens
uuuaggagguggcuucagu

SEQ ID NO: 276388 - RNA, 19 nt, Homo sapiens
guggacagugccuauauga

SEQ ID NO: 276389 - RNA, 19 nt, Homo sapiens
ccaagagcgagaucauaga

SEQ ID NO: 276390 - RNA, 19 nt, Homo sapiens
gugcacaguaugaggauau

SEQ ID NO: 276391 - RNA, 19 nt, Homo sapiens
gacccucaacaacaaguuu

SEQ ID NO: 276392 - RNA, 19 nt, Homo sapiens
agauaaagagcacgcauca

SEQ ID NO: 276393 - RNA, 19 nt, Homo sapiens
agaugagaucgacuucuua

SEQ ID NO: 276394 - RNA, 19 nt, Homo sapiens
ggaauucaggaagugacua

SEQ ID NO: 276395 - RNA, 19 nt, Homo sapiens
ggauguggacagugccuau

SEQ ID NO: 276396 - RNA, 19 nt, Homo sapiens
cagcagcagggcacaaguu

SEQ ID NO: 276397 - RNA, 19 nt, Homo sapiens
gaggaguacagcaggaugu

SEQ ID NO: 276398 - RNA, 19 nt, Homo sapiens
ccaaugccaagcuccaaga

SEQ ID NO: 276399 - RNA, 19 nt, Homo sapiens
cagacaagccagcaagaca

SEQ ID NO: 276400 - RNA, 19 nt, Homo sapiens
caagagcgagaucauagag

SEQ ID NO: 276401 - RNA, 19 nt, Homo sapiens
ccucuacgacgcugagcua

SEQ ID NO: 276402 - RNA, 19 nt, Homo sapiens
cuauggagguggcuuuggu

SEQ ID NO: 276403 - RNA, 19 nt, Homo sapiens
gaauuucaggcucuucucu

SEQ ID NO: 276404 - RNA, 19 nt, Homo sapiens
uggugggucugguggcuuu

SEQ ID NO: 276405 - RNA, 19 nt, Homo sapiens
auagagcucaacagaauga

SEQ ID NO: 276406 - RNA, 19 nt, Homo sapiens
gaauucaggaagugacuac

SEQ ID NO: 276407 - RNA, 19 nt, Homo sapiens
aggaugaaaucaauaaacg

SEQ ID NO: 276408 - RNA, 19 nt, Homo sapiens
aaacaaccuugagccucuu

SEQ ID NO: 276409 - RNA, 19 nt, Homo sapiens
uacagcaggcgaaggauga

SEQ ID NO: 276410 - RNA, 19 nt, Homo sapiens
uaccaagagcgagaucaua

SEQ ID NO: 276411 - RNA, 19 nt, Homo sapiens
gauagaugagaucgacuuc

SEQ ID NO: 276412 - RNA, 19 nt, Homo sapiens
gaaaucaauaaacguacag

SEQ ID NO: 276413 - RNA, 19 nt, Homo sapiens
aaugggagguggcuuuggu

SEQ ID NO: 276414 - RNA, 19 nt, Homo sapiens
ccagagauguuucagauuu

SEQ ID NO: 276415 - RNA, 19 nt, Homo sapiens
ggaaguggcuuuggguuug

SEQ ID NO: 276416 - RNA, 19 nt, Homo sapiens
ggaagcagcuagauaccuu

SEQ ID NO: 276417 - RNA, 19 nt, Homo sapiens
cccacuagauccuguauua

SEQ ID NO: 276418 - RNA, 19 nt, Homo sapiens
gggcucaucuuacuaguau

SEQ ID NO: 276419 - RNA, 19 nt, Homo sapiens
ggaaguggcuccggguuug

SEQ ID NO: 276420 - RNA, 19 nt, Homo sapiens
gcacagcagccgagaauga

SEQ ID NO: 276421 - RNA, 19 nt, Homo sapiens
gggcagagaucgagaacau

SEQ ID NO: 276422 - RNA, 19 nt, Homo sapiens
agugucaucuccagaauua

SEQ ID NO: 276423 - RNA, 19 nt, Homo sapiens
gagaaugcccuuaaagaug

SEQ ID NO: 276424 - RNA, 19 nt, Homo sapiens
gagcaaggcugaggcugaa

SEQ ID NO: 276425 - RNA, 19 nt, Homo sapiens
gguagcuacuucuugauuu

SEQ ID NO: 276426 - RNA, 19 nt, Homo sapiens
gcccagagauguuucagau

SEQ ID NO: 276427 - RNA, 19 nt, Homo sapiens
gaacaccaagagugaaauu

SEQ ID NO: 276428 - RNA, 19 nt, Homo sapiens
gaagagcgcgaacagauca

SEQ ID NO: 276429 - RNA, 19 nt, Homo sapiens
ccaaugccaucucccacua

SEQ ID NO: 276430 - RNA, 19 nt, Homo sapiens
guggaggacuucaagacua

SEQ ID NO: 276431 - RNA, 19 nt, Homo sapiens
guagcuacuucuugauuug

SEQ ID NO: 276432 - RNA, 19 nt, Homo sapiens
gcagagaucgagaacauca

SEQ ID NO: 276433 - RNA, 19 nt, Homo sapiens
gcagaagccucuacaaccu

SEQ ID NO: 276434 - RNA, 19 nt, Homo sapiens
ugaacaagguggaguugga

SEQ ID NO: 276435 - RNA, 19 nt, Homo sapiens
cuagauaccuugggcaaug

SEQ ID NO: 276436 - RNA, 19 nt, Homo sapiens
caucagaaccaaacuacuu

SEQ ID NO: 276437 - RNA, 19 nt, Homo sapiens
gaggugagaaugcccuuaa

SEQ ID NO: 276438 - RNA, 19 nt, Homo sapiens
gugccagacucuucaggua

SEQ ID NO: 276439 - RNA, 19 nt, Homo sapiens
ugaagaacaccaagaguga

SEQ ID NO: 276440 - RNA, 19 nt, Homo sapiens
ggaguuugguagcuacuuc

SEQ ID NO: 276441 - RNA, 19 nt, Homo sapiens
gcagagcucaacaggauga

SEQ ID NO: 276442 - RNA, 19 nt, Homo sapiens
uggaggacuucaagacuaa

SEQ ID NO: 276443 - RNA, 19 nt, Homo sapiens
ccaaacuacuucuccaaca

SEQ ID NO: 276444 - RNA, 19 nt, Homo sapiens
uugcagagcucaacaggau

SEQ ID NO: 276445 - RNA, 19 nt, Homo sapiens
agaucaagcuccucaacaa

SEQ ID NO: 276446 - RNA, 19 nt, Homo sapiens
gaccuggacagcauuauug

SEQ ID NO: 276447 - RNA, 19 nt, Homo sapiens
cgacaaggugcaguucuua

SEQ ID NO: 276448 - RNA, 19 nt, Homo sapiens
guagguguguuuagugaca

SEQ ID NO: 276449 - RNA, 19 nt, Homo sapiens
ggaccuggacagcauuauu

SEQ ID NO: 276450 - RNA, 19 nt, Homo sapiens
gauccuguauuauccaucu

SEQ ID NO: 276451 - RNA, 19 nt, Homo sapiens
gaaugacuuugugguccua

SEQ ID NO: 276452 - RNA, 19 nt, Homo sapiens
gaagaacaccaagagugaa

SEQ ID NO: 276453 - RNA, 19 nt, Homo sapiens
gugagaaugcccuuaaaga

SEQ ID NO: 276454 - RNA, 19 nt, Homo sapiens
gugugaagcuggccuugga

SEQ ID NO: 276455 - RNA, 19 nt, Homo sapiens
ucuuagagcaacagaauaa

SEQ ID NO: 276456 - RNA, 19 nt, Homo sapiens
ccaccacccugaacaagag

SEQ ID NO: 276457 - RNA, 19 nt, Homo sapiens
ucaagcuccucaacaacaa

SEQ ID NO: 276458 - RNA, 19 nt, Homo sapiens
uggcuuuggugguggauuu

SEQ ID NO: 276459 - RNA, 19 nt, Homo sapiens
ugagaaugcccuuaaagau

SEQ ID NO: 276460 - RNA, 19 nt, Homo sapiens
uuugguagcuacuucuuga

SEQ ID NO: 276461 - RNA, 19 nt, Homo sapiens
accaggagcucaugagugu

SEQ ID NO: 276462 - RNA, 19 nt, Homo sapiens
aggaggagcuggcacgaau

SEQ ID NO: 276463 - RNA, 19 nt, Homo sapiens
acaacaaguuugccuccuu

SEQ ID NO: 276464 - RNA, 19 nt, Homo sapiens
ggaagagcgcgaacagauc

SEQ ID NO: 276465 - RNA, 19 nt, Homo sapiens
ggagauugacccugagauc

SEQ ID NO: 276466 - RNA, 19 nt, Homo sapiens
gaucgccaccuaccgcaaa

SEQ ID NO: 276467 - RNA, 19 nt, Homo sapiens
caaguuugccuccuucauc

SEQ ID NO: 276468 - RNA, 19 nt, Homo sapiens
acgacaaggugccugcuuu

SEQ ID NO: 276469 - RNA, 19 nt, Homo sapiens
cccugucacuucucugaua

SEQ ID NO: 276470 - RNA, 19 nt, Homo sapiens
gccagacucuucagguauc

SEQ ID NO: 276471 - RNA, 19 nt, Homo sapiens
gaaauugcagagcucaaca

SEQ ID NO: 276472 - RNA, 19 nt, Homo sapiens
ggugacaaccugaagaaca

SEQ ID NO: 276473 - RNA, 19 nt, Homo sapiens
gaagaggagaucaacaaac

SEQ ID NO: 276474 - RNA, 19 nt, Homo sapiens
ccauucuacuccucucauu

SEQ ID NO: 276475 - RNA, 19 nt, Homo sapiens
ucgagaacaucaagaagca

SEQ ID NO: 276476 - RNA, 19 nt, Homo sapiens
uccugaagguccucuauga

SEQ ID NO: 276477 - RNA, 19 nt, Homo sapiens
aagaggagaucaacaaacg

SEQ ID NO: 276478 - RNA, 19 nt, Homo sapiens
gaccaccaccuccagcaaa

SEQ ID NO: 276479 - RNA, 19 nt, Homo sapiens
ugucaucuccagaauuauu

SEQ ID NO: 276480 - RNA, 19 nt, Homo sapiens
gaaguggcuuuggguuugg

SEQ ID NO: 276481 - RNA, 19 nt, Homo sapiens
aggcaucagcggaggauua

SEQ ID NO: 276482 - RNA, 19 nt, Homo sapiens
acaucgagaucgccaccua

SEQ ID NO: 276483 - RNA, 19 nt, Homo sapiens
gaagcuggccuuggacauc

SEQ ID NO: 276484 - RNA, 19 nt, Homo sapiens
gccaagguggacagucuua

SEQ ID NO: 276485 - RNA, 19 nt, Homo sapiens
uuucggcacugguggcuuu

SEQ ID NO: 276486 - RNA, 19 nt, Homo sapiens
uguaggcgguggcaagaga

SEQ ID NO: 276487 - RNA, 19 nt, Homo sapiens
caaacuacuucuccaacac

SEQ ID NO: 276488 - RNA, 19 nt, Homo sapiens
ggcagugucucuggcaguu

SEQ ID NO: 276489 - RNA, 19 nt, Homo sapiens
caggagcucaugaguguga

SEQ ID NO: 276490 - RNA, 19 nt, Homo sapiens
uuaaagaugcccacagcaa

SEQ ID NO: 276491 - RNA, 19 nt, Homo sapiens
caagguggacagucuuaau

SEQ ID NO: 276492 - RNA, 19 nt, Homo sapiens
ugaagaggagaucaacaaa

SEQ ID NO: 276493 - RNA, 19 nt, Homo sapiens
caucagcggaggauuagga

SEQ ID NO: 276494 - RNA, 19 nt, Homo sapiens
ggcgaggaguacagaaugu

SEQ ID NO: 276495 - RNA, 19 nt, Homo sapiens
gaugcugccuaccugaaca

SEQ ID NO: 276496 - RNA, 19 nt, Homo sapiens
uagauaccuugggcaauga

SEQ ID NO: 276497 - RNA, 19 nt, Homo sapiens
ugaggaagcagcuagauac

SEQ ID NO: 276498 - RNA, 19 nt, Homo sapiens
cggaagagcgcgaacagau

SEQ ID NO: 276499 - RNA, 19 nt, Homo sapiens
caccaagagugaaauugca

SEQ ID NO: 276500 - RNA, 19 nt, Homo sapiens
ucgacaaggugcaguucuu

SEQ ID NO: 276501 - RNA, 19 nt, Homo sapiens
cuacaucagaaccaaacua

SEQ ID NO: 276502 - RNA, 19 nt, Homo sapiens
aaacucaggcugucuaacu

SEQ ID NO: 276503 - RNA, 19 nt, Homo sapiens
gagcagcgaggugagaaug

SEQ ID NO: 276504 - RNA, 19 nt, Homo sapiens
ccagaucucgguugaccaa

SEQ ID NO: 276505 - RNA, 19 nt, Homo sapiens
ucaagacuaaguaugaaga

SEQ ID NO: 276506 - RNA, 19 nt, Homo sapiens
cgacaaggugccugcuuug

SEQ ID NO: 276507 - RNA, 19 nt, Homo sapiens
ggguuuggccugaguagug

SEQ ID NO: 276508 - RNA, 19 nt, Homo sapiens
gcagagcagcgaggugaga

SEQ ID NO: 276509 - RNA, 19 nt, Homo sapiens
gccaagcccagagauguuu

SEQ ID NO: 276510 - RNA, 19 nt, Homo sapiens
gcuccucaacaacaaguuu

SEQ ID NO: 276511 - RNA, 19 nt, Homo sapiens
acccugagauccagaaagu

SEQ ID NO: 276512 - RNA, 19 nt, Homo sapiens
gggcgaggaguacagaaug

SEQ ID NO: 276513 - RNA, 19 nt, Homo sapiens
gugacaaccugaagaacac

SEQ ID NO: 276514 - RNA, 19 nt, Homo sapiens
ucaagacccucaacaauaa

SEQ ID NO: 276515 - RNA, 19 nt, Homo sapiens
gaacaaguaugaggaugaa

SEQ ID NO: 276516 - RNA, 19 nt, Homo sapiens
caaaucagccuucagguuu

SEQ ID NO: 276517 - RNA, 19 nt, Homo sapiens
gcaagucacugccuuccaa

SEQ ID NO: 276518 - RNA, 19 nt, Homo sapiens
gaagaaggauguagaugcu

SEQ ID NO: 276519 - RNA, 19 nt, Homo sapiens
cuaacuaccuccagaaugu

SEQ ID NO: 276520 - RNA, 19 nt, Homo sapiens
uccagaauguguucaauaa

SEQ ID NO: 276521 - RNA, 19 nt, Homo sapiens
gguaucagaccaaguauga

SEQ ID NO: 276522 - RNA, 19 nt, Homo sapiens
gaucaagacccucaacaau

SEQ ID NO: 276523 - RNA, 19 nt, Homo sapiens
gcacugauggaugagauua

SEQ ID NO: 276524 - RNA, 19 nt, Homo sapiens
cuaagaaccugcugcaagu

SEQ ID NO: 276525 - RNA, 19 nt, Homo sapiens
ccauggagauugccucuuc

SEQ ID NO: 276526 - RNA, 19 nt, Homo sapiens
ggagaguagucuagaccaa

SEQ ID NO: 276527 - RNA, 19 nt, Homo sapiens
caagguugaugcacugaug

SEQ ID NO: 276528 - RNA, 19 nt, Homo sapiens
acaauaaguuugccuccuu

SEQ ID NO: 276529 - RNA, 19 nt, Homo sapiens
ggaccuggauagcaucauc

SEQ ID NO: 276530 - RNA, 19 nt, Homo sapiens
caucaccguuccuggguaa

SEQ ID NO: 276531 - RNA, 19 nt, Homo sapiens
ucccaaaucuaaaucauca

SEQ ID NO: 276532 - RNA, 19 nt, Homo sapiens
caccaugucucgccaguca

SEQ ID NO: 276533 - RNA, 19 nt, Homo sapiens
caucaucgcugaggucaag

SEQ ID NO: 276534 - RNA, 19 nt, Homo sapiens
ggaacaagccaccaugucu

SEQ ID NO: 276535 - RNA, 19 nt, Homo sapiens
uggcggagcuggcuuugga

SEQ ID NO: 276536 - RNA, 19 nt, Homo sapiens
guaccacugcugagaauga

SEQ ID NO: 276537 - RNA, 19 nt, Homo sapiens
ggauauccaucagcacuag

SEQ ID NO: 276538 - RNA, 19 nt, Homo sapiens
uugaugcacugauggauga

SEQ ID NO: 276539 - RNA, 19 nt, Homo sapiens
ucaaaucagccuucagguu

SEQ ID NO: 276540 - RNA, 19 nt, Homo sapiens
gaaaucaacaagcguacca

SEQ ID NO: 276541 - RNA, 19 nt, Homo sapiens
guaugaggaugaaaucaac

SEQ ID NO: 276542 - RNA, 19 nt, Homo sapiens
ccaagacugugaggcagaa

SEQ ID NO: 276543 - RNA, 19 nt, Homo sapiens
ggaggcggcuauggcuuug

SEQ ID NO: 276544 - RNA, 19 nt, Homo sapiens
caacccagcccauggagau

SEQ ID NO: 276545 - RNA, 19 nt, Homo sapiens
gcuccagcgucaaauuugu

SEQ ID NO: 276546 - RNA, 19 nt, Homo sapiens
gugccgcaguucuauauuc

SEQ ID NO: 276547 - RNA, 19 nt, Homo sapiens
caagaaacagugcgccaau

SEQ ID NO: 276548 - RNA, 19 nt, Homo sapiens
gccgaguccugguaucaga

SEQ ID NO: 276549 - RNA, 19 nt, Homo sapiens
gcguaccacugcugagaau

SEQ ID NO: 276550 - RNA, 19 nt, Homo sapiens
aucaagacccucaacaaua

SEQ ID NO: 276551 - RNA, 19 nt, Homo sapiens
cagcuccagcgucaaauuu

SEQ ID NO: 276552 - RNA, 19 nt, Homo sapiens
ggcgaggaaugcagacuca

SEQ ID NO: 276553 - RNA, 19 nt, Homo sapiens
caugagaucacagagauga

SEQ ID NO: 276554 - RNA, 19 nt, Homo sapiens
gaugcugccuacaugaaca

SEQ ID NO: 276555 - RNA, 19 nt, Homo sapiens
gcagcuccagcgucaaauu

SEQ ID NO: 276556 - RNA, 19 nt, Homo sapiens
ggagcuggcccucaaggau

SEQ ID NO: 276557 - RNA, 19 nt, Homo sapiens
uccaagaggucacugucaa

SEQ ID NO: 276558 - RNA, 19 nt, Homo sapiens
gcaguguuuccucuggaua

SEQ ID NO: 276559 - RNA, 19 nt, Homo sapiens
cagacucaguggagaagga

SEQ ID NO: 276560 - RNA, 19 nt, Homo sapiens
uaaguuugccuccuucauc

SEQ ID NO: 276561 - RNA, 19 nt, Homo sapiens
gaggagcgcgagcagauca

SEQ ID NO: 276562 - RNA, 19 nt, Homo sapiens
gaccaagccaauugcagaa

SEQ ID NO: 276563 - RNA, 19 nt, Homo sapiens
uagcagcuccagcgucaaa

SEQ ID NO: 276564 - RNA, 19 nt, Homo sapiens
gaaacagugcgccaaucug

SEQ ID NO: 276565 - RNA, 19 nt, Homo sapiens
agaaugaguuugugaugcu

SEQ ID NO: 276566 - RNA, 19 nt, Homo sapiens
caagaacaaguaugaggau

SEQ ID NO: 276567 - RNA, 19 nt, Homo sapiens
ccagaauguguucaauaaa

SEQ ID NO: 276568 - RNA, 19 nt, Homo sapiens
ggcccuggcuuuccugucu

SEQ ID NO: 276569 - RNA, 19 nt, Homo sapiens
gaaggaguuggaccaguca

SEQ ID NO: 276570 - RNA, 19 nt, Homo sapiens
gaagccgaguccugguauc

SEQ ID NO: 276571 - RNA, 19 nt, Homo sapiens
cagaagccgaguccuggua

SEQ ID NO: 276572 - RNA, 19 nt, Homo sapiens
caaguaugaggaugaaauc

SEQ ID NO: 276573 - RNA, 19 nt, Homo sapiens
gacccucaacaauaaguuu

SEQ ID NO: 276574 - RNA, 19 nt, Homo sapiens
ccaagaggauauccaucag

SEQ ID NO: 276575 - RNA, 19 nt, Homo sapiens
aaaucagccuucagguuuc

SEQ ID NO: 276576 - RNA, 19 nt, Homo sapiens
acaaguaugaggaugaaau

SEQ ID NO: 276577 - RNA, 19 nt, Homo sapiens
ccaagcaugagaucacaga

SEQ ID NO: 276578 - RNA, 19 nt, Homo sapiens
agaacaaguaugaggauga

SEQ ID NO: 276579 - RNA, 19 nt, Homo sapiens
gguaguggauuugguuucg

SEQ ID NO: 276580 - RNA, 19 nt, Homo sapiens
ccaauugcagaaccacauu

SEQ ID NO: 276581 - RNA, 19 nt, Homo sapiens
caacaccaagcaugagauc

SEQ ID NO: 276582 - RNA, 19 nt, Homo sapiens
augcggagcugucccagau

SEQ ID NO: 276583 - RNA, 19 nt, Homo sapiens
cugcugagcucuguucucu

SEQ ID NO: 276584 - RNA, 19 nt, Homo sapiens
gcugagaaugaguuuguga

SEQ ID NO: 276585 - RNA, 19 nt, Homo sapiens
ccacugcugagaaugaguu

SEQ ID NO: 276586 - RNA, 19 nt, Homo sapiens
agcaugagaucacagagau

SEQ ID NO: 276587 - RNA, 19 nt, Homo sapiens
gcgaugaccuccgcaacac

SEQ ID NO: 276588 - RNA, 19 nt, Homo sapiens
ggagguagcaguggaagcu

SEQ ID NO: 276589 - RNA, 19 nt, Homo sapiens
ucaaggaugccaggaacaa

SEQ ID NO: 276590 - RNA, 19 nt, Homo sapiens
ggagcuggaggccaagguu

SEQ ID NO: 276591 - RNA, 19 nt, Homo sapiens
ccaccccaaucccaaauuu

SEQ ID NO: 276592 - RNA, 19 nt, Homo sapiens
ggucaaggcccaguaugag

SEQ ID NO: 276593 - RNA, 19 nt, Homo sapiens
gcugaagaaggauguagau

SEQ ID NO: 276594 - RNA, 19 nt, Homo sapiens
ugagaaugaguuugugaug

SEQ ID NO: 276595 - RNA, 19 nt, Homo sapiens
ggcucuggcuucagugcaa

SEQ ID NO: 276596 - RNA, 19 nt, Homo sapiens
uggaggaggcccugcagaa

SEQ ID NO: 276597 - RNA, 19 nt, Homo sapiens
acagagaugaaccggauga

SEQ ID NO: 276598 - RNA, 19 nt, Homo sapiens
gcaacaccaagcaugagau

SEQ ID NO: 276599 - RNA, 19 nt, Homo sapiens
uagaugcugccuacaugaa

SEQ ID NO: 276600 - RNA, 19 nt, Homo sapiens
cuccagaauguguucaaua

SEQ ID NO: 276601 - RNA, 19 nt, Homo sapiens
caagccaauugcagaacca

SEQ ID NO: 276602 - RNA, 19 nt, Homo sapiens
cagcaacccagcccaugga

SEQ ID NO: 276603 - RNA, 19 nt, Homo sapiens
caccaagcaugagaucaca

SEQ ID NO: 276604 - RNA, 19 nt, Homo sapiens
uggaggcggcuauggcuuu

SEQ ID NO: 276605 - RNA, 19 nt, Homo sapiens
ggcccaguaugaggagauu

SEQ ID NO: 276606 - RNA, 19 nt, Homo sapiens
acuagugccugguucucuu

SEQ ID NO: 276607 - RNA, 19 nt, Homo sapiens
gcaccucccaacccacuag

SEQ ID NO: 276608 - RNA, 19 nt, Homo sapiens
uccaagaggauauccauca

SEQ ID NO: 276609 - RNA, 19 nt, Homo sapiens
gguaacagagccaccuucu

SEQ ID NO: 276610 - RNA, 19 nt, Homo sapiens
ugauggaugagauuaacuu

SEQ ID NO: 276611 - RNA, 19 nt, Homo sapiens
aagaaacagugcgccaauc

SEQ ID NO: 276612 - RNA, 19 nt, Homo sapiens
gcugagagccgagauugac

SEQ ID NO: 276613 - RNA, 19 nt, Homo sapiens
ccucagugguccucuccau

SEQ ID NO: 276614 - RNA, 19 nt, Homo sapiens
gaacaaauaugaggaugaa

SEQ ID NO: 276615 - RNA, 19 nt, Homo sapiens
gaacaagguugaacugcaa

SEQ ID NO: 276616 - RNA, 19 nt, Homo sapiens
gagcuucacuguuacuaaa

SEQ ID NO: 276617 - RNA, 19 nt, Homo sapiens
cacuggagcuucacuguua

SEQ ID NO: 276618 - RNA, 19 nt, Homo sapiens
ggaagcagcuacuccuaug

SEQ ID NO: 276619 - RNA, 19 nt, Homo sapiens
gaacaacuuccacuuacuu

SEQ ID NO: 276620 - RNA, 19 nt, Homo sapiens
ucaagacccucaacaacaa

SEQ ID NO: 276621 - RNA, 19 nt, Homo sapiens
gcaguuccaccaucaagua

SEQ ID NO: 276622 - RNA, 19 nt, Homo sapiens
gcacagcagcagagaauga

SEQ ID NO: 276623 - RNA, 19 nt, Homo sapiens
ucagaacaacuuccacuua

SEQ ID NO: 276624 - RNA, 19 nt, Homo sapiens
gcucuucacuguuugcaau

SEQ ID NO: 276625 - RNA, 19 nt, Homo sapiens
ugacuaguccuaugaugua

SEQ ID NO: 276626 - RNA, 19 nt, Homo sapiens
ggagauggcccucaaggau

SEQ ID NO: 276627 - RNA, 19 nt, Homo sapiens
gcacaagugacuaguccua

SEQ ID NO: 276628 - RNA, 19 nt, Homo sapiens
ucucugaggcugagcauua

SEQ ID NO: 276629 - RNA, 19 nt, Homo sapiens
ucucaaacucucuaacuua

SEQ ID NO: 276630 - RNA, 19 nt, Homo sapiens
ggaggcagcuauggcuuug

SEQ ID NO: 276631 - RNA, 19 nt, Homo sapiens
cagaacaacuuccacuuac

SEQ ID NO: 276632 - RNA, 19 nt, Homo sapiens
ucugugcucuucacuguuu

SEQ ID NO: 276633 - RNA, 19 nt, Homo sapiens
gaugauuucugugcucuuc

SEQ ID NO: 276634 - RNA, 19 nt, Homo sapiens
gcagagaaugaauuuguga

SEQ ID NO: 276635 - RNA, 19 nt, Homo sapiens
ggagauugcugagaucaac

SEQ ID NO: 276636 - RNA, 19 nt, Homo sapiens
gaagaaggauguggaugcu

SEQ ID NO: 276637 - RNA, 19 nt, Homo sapiens
caucaucgcugaggucaag

SEQ ID NO: 276638 - RNA, 19 nt, Homo sapiens
cagcagagaaugaauuugu

SEQ ID NO: 276639 - RNA, 19 nt, Homo sapiens
caagugacuaguccuauga

SEQ ID NO: 276640 - RNA, 19 nt, Homo sapiens
gcuucacuguuacuaaauu

SEQ ID NO: 276641 - RNA, 19 nt, Homo sapiens
gcaggagauugcugagauc

SEQ ID NO: 276642 - RNA, 19 nt, Homo sapiens
gaucaagacccucaacaac

SEQ ID NO: 276643 - RNA, 19 nt, Homo sapiens
cgaaggcguuggacaaguc

SEQ ID NO: 276644 - RNA, 19 nt, Homo sapiens
gcgcacagcagcagagaau

SEQ ID NO: 276645 - RNA, 19 nt, Homo sapiens
ggucaaggcccaauaugag

SEQ ID NO: 276646 - RNA, 19 nt, Homo sapiens
caaauaugaggaugaaauc

SEQ ID NO: 276647 - RNA, 19 nt, Homo sapiens
cucaaacucucuaacuuau

SEQ ID NO: 276648 - RNA, 19 nt, Homo sapiens
gcugagaucaaccgcauga

SEQ ID NO: 276649 - RNA, 19 nt, Homo sapiens
agaaugaauuugugacucu

SEQ ID NO: 276650 - RNA, 19 nt, Homo sapiens
gccuguaucucugugauga

SEQ ID NO: 276651 - RNA, 19 nt, Homo sapiens
acaagugacuaguccuaug

SEQ ID NO: 276652 - RNA, 19 nt, Homo sapiens
gaaaauugccaggggcuua

SEQ ID NO: 276653 - RNA, 19 nt, Homo sapiens
aggcugagcauuauaagaa

SEQ ID NO: 276654 - RNA, 19 nt, Homo sapiens
gaauuugugacucugaaga

SEQ ID NO: 276655 - RNA, 19 nt, Homo sapiens
ccaagacugugaggcagaa

SEQ ID NO: 276656 - RNA, 19 nt, Homo sapiens
ggagcuucacuguuacuaa

SEQ ID NO: 276657 - RNA, 19 nt, Homo sapiens
augcagagcugucccagau

SEQ ID NO: 276658 - RNA, 19 nt, Homo sapiens
acaacaaguuugccuccuu

SEQ ID NO: 276659 - RNA, 19 nt, Homo sapiens
ggcugagcauuauaagaaa

SEQ ID NO: 276660 - RNA, 19 nt, Homo sapiens
cugagagccuuguaugaug

SEQ ID NO: 276661 - RNA, 19 nt, Homo sapiens
caaguuugccuccuucauc

SEQ ID NO: 276662 - RNA, 19 nt, Homo sapiens
guaucucugugaugauuuc

SEQ ID NO: 276663 - RNA, 19 nt, Homo sapiens
gaugcugccuacaugaaca

SEQ ID NO: 276664 - RNA, 19 nt, Homo sapiens
gaggagugcaggcugaaug

SEQ ID NO: 276665 - RNA, 19 nt, Homo sapiens
ggcccaauaugaggagauu

SEQ ID NO: 276666 - RNA, 19 nt, Homo sapiens
ccacaucucagacacaucu

SEQ ID NO: 276667 - RNA, 19 nt, Homo sapiens
cagcagcagagaaugaauu

SEQ ID NO: 276668 - RNA, 19 nt, Homo sapiens
caagaacaaauaugaggau

SEQ ID NO: 276669 - RNA, 19 nt, Homo sapiens
cggccuugcugguggcuuu

SEQ ID NO: 276670 - RNA, 19 nt, Homo sapiens
aaucaccacuggagcuuca

SEQ ID NO: 276671 - RNA, 19 nt, Homo sapiens
cuaguccuaugauguacaa

SEQ ID NO: 276672 - RNA, 19 nt, Homo sapiens
gagcgugaacagaucaaga

SEQ ID NO: 276673 - RNA, 19 nt, Homo sapiens
caugaaagcacaagugacu

SEQ ID NO: 276674 - RNA, 19 nt, Homo sapiens
uccaagaggucaccgucaa

SEQ ID NO: 276675 - RNA, 19 nt, Homo sapiens
ucucugugaugauuucugu

SEQ ID NO: 276676 - RNA, 19 nt, Homo sapiens
ugaggagcgugaacagauc

SEQ ID NO: 276677 - RNA, 19 nt, Homo sapiens
gccaggggcuuauuucaga

SEQ ID NO: 276678 - RNA, 19 nt, Homo sapiens
uuucuugccuccaguguuc

SEQ ID NO: 276679 - RNA, 19 nt, Homo sapiens
gcgaaggcguuggacaagu

SEQ ID NO: 276680 - RNA, 19 nt, Homo sapiens
ugaaagcacaagugacuag

SEQ ID NO: 276681 - RNA, 19 nt, Homo sapiens
gcacauccaccaccaucag

SEQ ID NO: 276682 - RNA, 19 nt, Homo sapiens
gaauggcgaaggcguugga

SEQ ID NO: 276683 - RNA, 19 nt, Homo sapiens
gcucucucaucuccuggaa

SEQ ID NO: 276684 - RNA, 19 nt, Homo sapiens
uuucugugcucuucacugu

SEQ ID NO: 276685 - RNA, 19 nt, Homo sapiens
ggaccuggacagcaucauc

SEQ ID NO: 276686 - RNA, 19 nt, Homo sapiens
uguggaugcugccuacaug

SEQ ID NO: 276687 - RNA, 19 nt, Homo sapiens
gacccucaacaacaaguuu

SEQ ID NO: 276688 - RNA, 19 nt, Homo sapiens
ccaggcaguauccaugaaa

SEQ ID NO: 276689 - RNA, 19 nt, Homo sapiens
uccaagaggaucuccauug

SEQ ID NO: 276690 - RNA, 19 nt, Homo sapiens
ccacuggagcuucacuguu

SEQ ID NO: 276691 - RNA, 19 nt, Homo sapiens
caacaccaagcaggagauu

SEQ ID NO: 276692 - RNA, 19 nt, Homo sapiens
cuguaucucugugaugauu

SEQ ID NO: 276693 - RNA, 19 nt, Homo sapiens
gggaguggauuugguuucg

SEQ ID NO: 276694 - RNA, 19 nt, Homo sapiens
gggcuuauuucagaacaac

SEQ ID NO: 276695 - RNA, 19 nt, Homo sapiens
ggcggcaguuccaccauca

SEQ ID NO: 276696 - RNA, 19 nt, Homo sapiens
gcucucaaacucucuaacu

SEQ ID NO: 276697 - RNA, 19 nt, Homo sapiens
aaaaugaccucugcuccuu

SEQ ID NO: 276698 - RNA, 19 nt, Homo sapiens
gaggcugagcauuauaaga

SEQ ID NO: 276699 - RNA, 19 nt, Homo sapiens
ccugagagccuuguaugau

SEQ ID NO: 276700 - RNA, 19 nt, Homo sapiens
gugacuaguccuaugaugu

SEQ ID NO: 276701 - RNA, 19 nt, Homo sapiens
gaaagcacaagugacuagu

SEQ ID NO: 276702 - RNA, 19 nt, Homo sapiens
gggagauggcccucaagga

SEQ ID NO: 276703 - RNA, 19 nt, Homo sapiens
ugaggucaaggcccaauau

SEQ ID NO: 276704 - RNA, 19 nt, Homo sapiens
caucuguggugcuguccau

SEQ ID NO: 276705 - RNA, 19 nt, Homo sapiens
agaacaaauaugaggauga

SEQ ID NO: 276706 - RNA, 19 nt, Homo sapiens
caacuuccacuuacuuucc

SEQ ID NO: 276707 - RNA, 19 nt, Homo sapiens
cuccucagcucucucaucu

SEQ ID NO: 276708 - RNA, 19 nt, Homo sapiens
gcuuauuucagaacaacuu

SEQ ID NO: 276709 - RNA, 19 nt, Homo sapiens
cugaggcugagcauuauaa

SEQ ID NO: 276710 - RNA, 19 nt, Homo sapiens
guaaucaccacuggagcuu

SEQ ID NO: 276711 - RNA, 19 nt, Homo sapiens
gaggucaaggcccaauaug

SEQ ID NO: 276712 - RNA, 19 nt, Homo sapiens
gaaggcguuggacaaguca

SEQ ID NO: 276713 - RNA, 19 nt, Homo sapiens
gaggagcgugaacagauca

SEQ ID NO: 276714 - RNA, 19 nt, Homo sapiens
gaacaaauaugaggaugaa

SEQ ID NO: 276715 - RNA, 19 nt, Homo sapiens
gaacaagguugaacugcaa

SEQ ID NO: 276716 - RNA, 19 nt, Homo sapiens
ggaguccucucuuuaauug

SEQ ID NO: 276717 - RNA, 19 nt, Homo sapiens
ggaagcagcuacuccuaug

SEQ ID NO: 276718 - RNA, 19 nt, Homo sapiens
caagugauguaccuucuga

SEQ ID NO: 276719 - RNA, 19 nt, Homo sapiens
ucaagacccucaacaacaa

SEQ ID NO: 276720 - RNA, 19 nt, Homo sapiens
gcaguuccaccaucaagua

SEQ ID NO: 276721 - RNA, 19 nt, Homo sapiens
gcacagcagcagagaauga

SEQ ID NO: 276722 - RNA, 19 nt, Homo sapiens
ggagauggcccucaaggau

SEQ ID NO: 276723 - RNA, 19 nt, Homo sapiens
ccacugagcuccuguugcu

SEQ ID NO: 276724 - RNA, 19 nt, Homo sapiens
ggaggcagcuauggcuuug

SEQ ID NO: 276725 - RNA, 19 nt, Homo sapiens
uaaccauccugcccauuau

SEQ ID NO: 276726 - RNA, 19 nt, Homo sapiens
cuaaccauccugcccauua

SEQ ID NO: 276727 - RNA, 19 nt, Homo sapiens
gcagagaaugaauuuguga

SEQ ID NO: 276728 - RNA, 19 nt, Homo sapiens
caacaguuaucagcacuca

SEQ ID NO: 276729 - RNA, 19 nt, Homo sapiens
ggagauugcugagaucaac

SEQ ID NO: 276730 - RNA, 19 nt, Homo sapiens
gaagaaggauguggaugcu

SEQ ID NO: 276731 - RNA, 19 nt, Homo sapiens
caucaucgcugaggucaag

SEQ ID NO: 276732 - RNA, 19 nt, Homo sapiens
cagcagagaaugaauuugu

SEQ ID NO: 276733 - RNA, 19 nt, Homo sapiens
accaucaagucaacaguua

SEQ ID NO: 276734 - RNA, 19 nt, Homo sapiens
gaagagcuacaagcacuga

SEQ ID NO: 276735 - RNA, 19 nt, Homo sapiens
gcaggaagagcuacaagca

SEQ ID NO: 276736 - RNA, 19 nt, Homo sapiens
gcaggagauugcugagauc

SEQ ID NO: 276737 - RNA, 19 nt, Homo sapiens
gaucaagacccucaacaac

SEQ ID NO: 276738 - RNA, 19 nt, Homo sapiens
gcugggaugcccucacuuu

SEQ ID NO: 276739 - RNA, 19 nt, Homo sapiens
cgaaggcguuggacaaguc

SEQ ID NO: 276740 - RNA, 19 nt, Homo sapiens
gcgcacagcagcagagaau

SEQ ID NO: 276741 - RNA, 19 nt, Homo sapiens
gagcugggaugcccucacu

SEQ ID NO: 276742 - RNA, 19 nt, Homo sapiens
ggucaaggcccaauaugag

SEQ ID NO: 276743 - RNA, 19 nt, Homo sapiens
caaauaugaggaugaaauc

SEQ ID NO: 276744 - RNA, 19 nt, Homo sapiens
gcugagaucaaccgcauga

SEQ ID NO: 276745 - RNA, 19 nt, Homo sapiens
agaaugaauuugugacucu

SEQ ID NO: 276746 - RNA, 19 nt, Homo sapiens
ugauguaccuucugaugca

SEQ ID NO: 276747 - RNA, 19 nt, Homo sapiens
gaauuugugacucugaaga

SEQ ID NO: 276748 - RNA, 19 nt, Homo sapiens
ccaagacugugaggcagaa

SEQ ID NO: 276749 - RNA, 19 nt, Homo sapiens
augcagagcugucccagau

SEQ ID NO: 276750 - RNA, 19 nt, Homo sapiens
acaacaaguuugccuccuu

SEQ ID NO: 276751 - RNA, 19 nt, Homo sapiens
guccugaucuucucuugca

SEQ ID NO: 276752 - RNA, 19 nt, Homo sapiens
cugagagccuuguaugaug

SEQ ID NO: 276753 - RNA, 19 nt, Homo sapiens
caaguuugccuccuucauc

SEQ ID NO: 276754 - RNA, 19 nt, Homo sapiens
caggaguucucaucugaca

SEQ ID NO: 276755 - RNA, 19 nt, Homo sapiens
ggaguucucaucugacaag

SEQ ID NO: 276756 - RNA, 19 nt, Homo sapiens
gaugcugccuacaugaaca

SEQ ID NO: 276757 - RNA, 19 nt, Homo sapiens
guaucugagucugccauaa

SEQ ID NO: 276758 - RNA, 19 nt, Homo sapiens
acugagcuccuguugcuua

SEQ ID NO: 276759 - RNA, 19 nt, Homo sapiens
gaggagugcaggcugaaug

SEQ ID NO: 276760 - RNA, 19 nt, Homo sapiens
ggcccaauaugaggagauu

SEQ ID NO: 276761 - RNA, 19 nt, Homo sapiens
cagcagcagagaaugaauu

SEQ ID NO: 276762 - RNA, 19 nt, Homo sapiens
uccaagaggucacugucaa

SEQ ID NO: 276763 - RNA, 19 nt, Homo sapiens
caagaacaaauaugaggau

SEQ ID NO: 276764 - RNA, 19 nt, Homo sapiens
gcacucagacaugcgaaug

SEQ ID NO: 276765 - RNA, 19 nt, Homo sapiens
acacauccguggugcuauc

SEQ ID NO: 276766 - RNA, 19 nt, Homo sapiens
cggccuugcugguggcuuu

SEQ ID NO: 276767 - RNA, 19 nt, Homo sapiens
gagcuccuguugcuuacca

SEQ ID NO: 276768 - RNA, 19 nt, Homo sapiens
ccauaagaacugaaacuca

SEQ ID NO: 276769 - RNA, 19 nt, Homo sapiens
acaguuaucagcacucaga

SEQ ID NO: 276770 - RNA, 19 nt, Homo sapiens
uaucugagucugccauaau

SEQ ID NO: 276771 - RNA, 19 nt, Homo sapiens
gcgaaggcguuggacaagu

SEQ ID NO: 276772 - RNA, 19 nt, Homo sapiens
ugcuuucucugcucucuuu

SEQ ID NO: 276773 - RNA, 19 nt, Homo sapiens
cugaauggcaagugaugua

SEQ ID NO: 276774 - RNA, 19 nt, Homo sapiens
gcacauccaccaccaucag

SEQ ID NO: 276775 - RNA, 19 nt, Homo sapiens
gaauggcgaaggcguugga

SEQ ID NO: 276776 - RNA, 19 nt, Homo sapiens
agacacauccguggugcua

SEQ ID NO: 276777 - RNA, 19 nt, Homo sapiens
gagcgugagcagaucaaga

SEQ ID NO: 276778 - RNA, 19 nt, Homo sapiens
ggcaagugauguaccuucu

SEQ ID NO: 276779 - RNA, 19 nt, Homo sapiens
gacccucaacaacaaguuu

SEQ ID NO: 276780 - RNA, 19 nt, Homo sapiens
ggaccuggacagcaucauc

SEQ ID NO: 276781 - RNA, 19 nt, Homo sapiens
uguggaugcugccuacaug

SEQ ID NO: 276782 - RNA, 19 nt, Homo sapiens
gucccugaauggcaaguga

SEQ ID NO: 276783 - RNA, 19 nt, Homo sapiens
uccaagaggaucuccauug

SEQ ID NO: 276784 - RNA, 19 nt, Homo sapiens
gagucugccauaauucuga

SEQ ID NO: 276785 - RNA, 19 nt, Homo sapiens
caacaccaagcaggagauu

SEQ ID NO: 276786 - RNA, 19 nt, Homo sapiens
gggaguggauuugguuucg

SEQ ID NO: 276787 - RNA, 19 nt, Homo sapiens
caucaagucaacaguuauc

SEQ ID NO: 276788 - RNA, 19 nt, Homo sapiens
ggcggcaguuccaccauca

SEQ ID NO: 276789 - RNA, 19 nt, Homo sapiens
gguaucugagucugccaua

SEQ ID NO: 276790 - RNA, 19 nt, Homo sapiens
ucaauaccuguuccacuga

SEQ ID NO: 276791 - RNA, 19 nt, Homo sapiens
gagcuacaagcacugaagu

SEQ ID NO: 276792 - RNA, 19 nt, Homo sapiens
ccugagagccuuguaugau

SEQ ID NO: 276793 - RNA, 19 nt, Homo sapiens
gggagauggcccucaagga

SEQ ID NO: 276794 - RNA, 19 nt, Homo sapiens
ugaggucaaggcccaauau

SEQ ID NO: 276795 - RNA, 19 nt, Homo sapiens
agaacaaauaugaggauga

SEQ ID NO: 276796 - RNA, 19 nt, Homo sapiens
gaggucaaggcccaauaug

SEQ ID NO: 276797 - RNA, 19 nt, Homo sapiens
ccgaggagcgugagcagau

SEQ ID NO: 276798 - RNA, 19 nt, Homo sapiens
gcaagugauguaccuucug

SEQ ID NO: 276799 - RNA, 19 nt, Homo sapiens
cgacaaggugcgguuccua

SEQ ID NO: 276800 - RNA, 19 nt, Homo sapiens
uagagcagcagaacaaggu

SEQ ID NO: 276801 - RNA, 19 nt, Homo sapiens
gaaggcguuggacaaguca

SEQ ID NO: 276802 - RNA, 19 nt, Homo sapiens
guuaucagcacucagacau

SEQ ID NO: 276803 - RNA, 19 nt, Homo sapiens
ucacuuuucuucucaucaa

SEQ ID NO: 276804 - RNA, 19 nt, Homo sapiens
cccggcugcugaaggagua

SEQ ID NO: 276805 - RNA, 19 nt, Homo sapiens
cggaggcagcuauggcuuu

SEQ ID NO: 276806 - RNA, 19 nt, Homo sapiens
gcaacaccaagcaggagau

SEQ ID NO: 276807 - RNA, 19 nt, Homo sapiens
cagaauagcuuccaauaaa

SEQ ID NO: 276808 - RNA, 19 nt, Homo sapiens
ggaaagugaugucagaaua

SEQ ID NO: 276809 - RNA, 19 nt, Homo sapiens
ggaaugagauuucagagau

SEQ ID NO: 276810 - RNA, 19 nt, Homo sapiens
guggaggacuucaagaaua

SEQ ID NO: 276811 - RNA, 19 nt, Homo sapiens
gaauaucucugugaugaau

SEQ ID NO: 276812 - RNA, 19 nt, Homo sapiens
gugaauaucucugugauga

SEQ ID NO: 276813 - RNA, 19 nt, Homo sapiens
gaaccagcgugccaaguug

SEQ ID NO: 276814 - RNA, 19 nt, Homo sapiens
guacgaagaugaaauuaac

SEQ ID NO: 276815 - RNA, 19 nt, Homo sapiens
ucaagacccucaacaacaa

SEQ ID NO: 276816 - RNA, 19 nt, Homo sapiens
gagcagaagucggccaaga

SEQ ID NO: 276817 - RNA, 19 nt, Homo sapiens
gaauaaguacgaagaugaa

SEQ ID NO: 276818 - RNA, 19 nt, Homo sapiens
gaaugagauuucagagaug

SEQ ID NO: 276819 - RNA, 19 nt, Homo sapiens
caagguggaugcccugaau

SEQ ID NO: 276820 - RNA, 19 nt, Homo sapiens
uggaggacuucaagaauaa

SEQ ID NO: 276821 - RNA, 19 nt, Homo sapiens
gaaagugaugucagaauag

SEQ ID NO: 276822 - RNA, 19 nt, Homo sapiens
uggaugcccugaaugauga

SEQ ID NO: 276823 - RNA, 19 nt, Homo sapiens
gaagaaggauguggaugcu

SEQ ID NO: 276824 - RNA, 19 nt, Homo sapiens
ucagaauagcuuccaauaa

SEQ ID NO: 276825 - RNA, 19 nt, Homo sapiens
caucaucgcugaggucaag

SEQ ID NO: 276826 - RNA, 19 nt, Homo sapiens
gaggagagcgagcagauca

SEQ ID NO: 276827 - RNA, 19 nt, Homo sapiens
gaucaagacccucaacaac

SEQ ID NO: 276828 - RNA, 19 nt, Homo sapiens
gagcugcagucccagaucu

SEQ ID NO: 276829 - RNA, 19 nt, Homo sapiens
agaauaaguacgaagauga

SEQ ID NO: 276830 - RNA, 19 nt, Homo sapiens
gauaaaaggugcggagugu

SEQ ID NO: 276831 - RNA, 19 nt, Homo sapiens
gcaaugcccugagcuucuc

SEQ ID NO: 276832 - RNA, 19 nt, Homo sapiens
ucaagaauaaguacgaaga

SEQ ID NO: 276833 - RNA, 19 nt, Homo sapiens
gguaccagaccaaguuuga

SEQ ID NO: 276834 - RNA, 19 nt, Homo sapiens
agaauagcuuccaauaaag

SEQ ID NO: 276835 - RNA, 19 nt, Homo sapiens
augaggagauggccaaaug

SEQ ID NO: 276836 - RNA, 19 nt, Homo sapiens
acaacaaguuugccuccuu

SEQ ID NO: 276837 - RNA, 19 nt, Homo sapiens
gucagaauagcuuccaaua

SEQ ID NO: 276838 - RNA, 19 nt, Homo sapiens
caaguuugccuccuucauc

SEQ ID NO: 276839 - RNA, 19 nt, Homo sapiens
aaugagauuucagagauga

SEQ ID NO: 276840 - RNA, 19 nt, Homo sapiens
gcugagaucgacaacauca

SEQ ID NO: 276841 - RNA, 19 nt, Homo sapiens
aagaauaaguacgaagaug

SEQ ID NO: 276842 - RNA, 19 nt, Homo sapiens
acaucgagaucgccaccua

SEQ ID NO: 276843 - RNA, 19 nt, Homo sapiens
ggaccuggacggcaucauc

SEQ ID NO: 276844 - RNA, 19 nt, Homo sapiens
aggcugagaucgacaacau

SEQ ID NO: 276845 - RNA, 19 nt, Homo sapiens
uccgcgaggucaccauuaa

SEQ ID NO: 276846 - RNA, 19 nt, Homo sapiens
gaagcuggcccuggacauc

SEQ ID NO: 276847 - RNA, 19 nt, Homo sapiens
acaagcugcuggagaccaa

SEQ ID NO: 276848 - RNA, 19 nt, Homo sapiens
gcagcaaugcccugagcuu

SEQ ID NO: 276849 - RNA, 19 nt, Homo sapiens
guggaugcccugaaugaug

SEQ ID NO: 276850 - RNA, 19 nt, Homo sapiens
gguggaggacuucaagaau

SEQ ID NO: 276851 - RNA, 19 nt, Homo sapiens
caagaauaaguacgaagau

SEQ ID NO: 276852 - RNA, 19 nt, Homo sapiens
agaaccagcgugccaaguu

SEQ ID NO: 276853 - RNA, 19 nt, Homo sapiens
gacccucaacaacaaguuu

SEQ ID NO: 276854 - RNA, 19 nt, Homo sapiens
ggaaccaugggcagcaaug

SEQ ID NO: 276855 - RNA, 19 nt, Homo sapiens
gagaucgacaacaucaaga

SEQ ID NO: 276856 - RNA, 19 nt, Homo sapiens
uguggaugcugccuacaug

SEQ ID NO: 276857 - RNA, 19 nt, Homo sapiens
ccugagugauccacgugaa

SEQ ID NO: 276858 - RNA, 19 nt, Homo sapiens
gaggagauggccaaaugca

SEQ ID NO: 276859 - RNA, 19 nt, Homo sapiens
ccacccacaaucacaagaa

SEQ ID NO: 276860 - RNA, 19 nt, Homo sapiens
uaccagaccaaguuugaga

SEQ ID NO: 276861 - RNA, 19 nt, Homo sapiens
caccauguccauccacuuc

SEQ ID NO: 276862 - RNA, 19 nt, Homo sapiens
caucuguggugcuguccau

SEQ ID NO: 276863 - RNA, 19 nt, Homo sapiens
ggagagcgagcagaucaag

SEQ ID NO: 276864 - RNA, 19 nt, Homo sapiens
ugagaucgacaacaucaag

SEQ ID NO: 276865 - RNA, 19 nt, Homo sapiens
cggaaugagauuucagaga

SEQ ID NO: 276866 - RNA, 19 nt, Homo sapiens
aaagugaugucagaauagc

SEQ ID NO: 276867 - RNA, 19 nt, Homo sapiens
cuucaagaauaaguacgaa

SEQ ID NO: 276868 - RNA, 19 nt, Homo sapiens
ccaccacccacaaucacaa

SEQ ID NO: 276869 - RNA, 19 nt, Homo sapiens
cugggcuccugaaggcuua

SEQ ID NO: 276870 - RNA, 19 nt, Homo sapiens
gagagcgagcagaucaaga

SEQ ID NO: 276871 - RNA, 19 nt, Homo sapiens
guggagagcuggccauuaa

SEQ ID NO: 276872 - RNA, 19 nt, Homo sapiens
guacagagauggagaacga

SEQ ID NO: 276873 - RNA, 19 nt, Homo sapiens
gaacgaauuuguccucauc

SEQ ID NO: 276874 - RNA, 19 nt, Homo sapiens
ggaugaagcuuacaugaac

SEQ ID NO: 276875 - RNA, 19 nt, Homo sapiens
gcauguaccagaucaagua

SEQ ID NO: 276876 - RNA, 19 nt, Homo sapiens
ggacauggacagcaucauu

SEQ ID NO: 276877 - RNA, 19 nt, Homo sapiens
caaguuugccuccuucaua

SEQ ID NO: 276878 - RNA, 19 nt, Homo sapiens
gaagcaacauggacaacau

SEQ ID NO: 276879 - RNA, 19 nt, Homo sapiens
ucaagacccucaacaacaa

SEQ ID NO: 276880 - RNA, 19 nt, Homo sapiens
caagaaggauguggaugaa

SEQ ID NO: 276881 - RNA, 19 nt, Homo sapiens
gaauuuguccucaucaaga

SEQ ID NO: 276882 - RNA, 19 nt, Homo sapiens
gaacaaguaugaggaugag

SEQ ID NO: 276883 - RNA, 19 nt, Homo sapiens
gcacaaagacugagaucuc

SEQ ID NO: 276884 - RNA, 19 nt, Homo sapiens
ucaagaaggauguggauga

SEQ ID NO: 276885 - RNA, 19 nt, Homo sapiens
uguaccagaucaaguauga

SEQ ID NO: 276886 - RNA, 19 nt, Homo sapiens
gagagcauguaccagauca

SEQ ID NO: 276887 - RNA, 19 nt, Homo sapiens
ggaggcaucaccgcaguua

SEQ ID NO: 276888 - RNA, 19 nt, Homo sapiens
gcuggagucucgccuggaa

SEQ ID NO: 276889 - RNA, 19 nt, Homo sapiens
ucaauaagcguacagagau

SEQ ID NO: 276890 - RNA, 19 nt, Homo sapiens
ggaaggaggccgcuaugca

SEQ ID NO: 276891 - RNA, 19 nt, Homo sapiens
caauaagcguacagagaug

SEQ ID NO: 276892 - RNA, 19 nt, Homo sapiens
ggauguggaugaagcuuac

SEQ ID NO: 276893 - RNA, 19 nt, Homo sapiens
guggaggacuucaagaaca

SEQ ID NO: 276894 - RNA, 19 nt, Homo sapiens
acaagaugcuggagaccaa

SEQ ID NO: 276895 - RNA, 19 nt, Homo sapiens
gaucaagacccucaacaac

SEQ ID NO: 276896 - RNA, 19 nt, Homo sapiens
gagcugcagucccagaucu

SEQ ID NO: 276897 - RNA, 19 nt, Homo sapiens
augggaagcuggugucuga

SEQ ID NO: 276898 - RNA, 19 nt, Homo sapiens
gggccgugguugugaagaa

SEQ ID NO: 276899 - RNA, 19 nt, Homo sapiens
gacauggacagcaucauug

SEQ ID NO: 276900 - RNA, 19 nt, Homo sapiens
gagaaggagcagaucaaga

SEQ ID NO: 276901 - RNA, 19 nt, Homo sapiens
ggaugcagaacaugaguau

SEQ ID NO: 276902 - RNA, 19 nt, Homo sapiens
gcacaguacgaggauauug

SEQ ID NO: 276903 - RNA, 19 nt, Homo sapiens
gaugaagcuuacaugaaca

SEQ ID NO: 276904 - RNA, 19 nt, Homo sapiens
agagauggagaacgaauuu

SEQ ID NO: 276905 - RNA, 19 nt, Homo sapiens
aagcuuacaugaacaaggu

SEQ ID NO: 276906 - RNA, 19 nt, Homo sapiens
guaugaggaugagaucaau

SEQ ID NO: 276907 - RNA, 19 nt, Homo sapiens
acaacaaguuugccuccuu

SEQ ID NO: 276908 - RNA, 19 nt, Homo sapiens
gcccaugccuccagcuaca

SEQ ID NO: 276909 - RNA, 19 nt, Homo sapiens
caucauugcugaggucaag

SEQ ID NO: 276910 - RNA, 19 nt, Homo sapiens
caaaauaaaaccucagcua

SEQ ID NO: 276911 - RNA, 19 nt, Homo sapiens
acaucgagaucgccaccua

SEQ ID NO: 276912 - RNA, 19 nt, Homo sapiens
uggaggacuucaagaacaa

SEQ ID NO: 276913 - RNA, 19 nt, Homo sapiens
gaagaucgagacacgugau

SEQ ID NO: 276914 - RNA, 19 nt, Homo sapiens
ccagggccgugguugugaa

SEQ ID NO: 276915 - RNA, 19 nt, Homo sapiens
caagaacaaguaugaggau

SEQ ID NO: 276916 - RNA, 19 nt, Homo sapiens
aauuuguccucaucaagaa

SEQ ID NO: 276917 - RNA, 19 nt, Homo sapiens
agaacaaguaugaggauga

SEQ ID NO: 276918 - RNA, 19 nt, Homo sapiens
gacccucaacaacaaguuu

SEQ ID NO: 276919 - RNA, 19 nt, Homo sapiens
ggagagcuggccauuaagg

SEQ ID NO: 276920 - RNA, 19 nt, Homo sapiens
agaaggagcagaucaagac

SEQ ID NO: 276921 - RNA, 19 nt, Homo sapiens
uggaugaagcuuacaugaa

SEQ ID NO: 276922 - RNA, 19 nt, Homo sapiens
acaacauguucgagagcua

SEQ ID NO: 276923 - RNA, 19 nt, Homo sapiens
ucagcuagcucugccaaac

SEQ ID NO: 276924 - RNA, 19 nt, Homo sapiens
augcagaacaugaguauuc

SEQ ID NO: 276925 - RNA, 19 nt, Homo sapiens
gagagcuggccauuaagga

SEQ ID NO: 276926 - RNA, 19 nt, Homo sapiens
gggcugaggcugagagcau

SEQ ID NO: 276927 - RNA, 19 nt, Homo sapiens
ggagaaggagcagaucaag

SEQ ID NO: 276928 - RNA, 19 nt, Homo sapiens
gggaugcagaacaugagua

SEQ ID NO: 276929 - RNA, 19 nt, Homo sapiens
gcuccaggcugagauugag

SEQ ID NO: 276930 - RNA, 19 nt, Homo sapiens
gagcauguaccagaucaag

SEQ ID NO: 276931 - RNA, 19 nt, Homo sapiens
aaguuugccuccuucauag

SEQ ID NO: 276932 - RNA, 19 nt, Homo sapiens
guggaugaagcuuacauga

SEQ ID NO: 276933 - RNA, 19 nt, Homo sapiens
augaggaugagaucaauaa

SEQ ID NO: 276934 - RNA, 19 nt, Homo sapiens
uucgagagcuacaucaaca

SEQ ID NO: 276935 - RNA, 19 nt, Homo sapiens
cagagauggagaacgaauu

SEQ ID NO: 276936 - RNA, 19 nt, Homo sapiens
aggcggagcuuggcaacau

SEQ ID NO: 276937 - RNA, 19 nt, Homo sapiens
caucuguggugcuguccau

SEQ ID NO: 276938 - RNA, 19 nt, Homo sapiens
gauggagaacgaauuuguc

SEQ ID NO: 276939 - RNA, 19 nt, Homo sapiens
cagaagacggcucgaagca

SEQ ID NO: 276940 - RNA, 19 nt, Homo sapiens
caaguaugaggaugagauc

SEQ ID NO: 276941 - RNA, 19 nt, Homo sapiens
ugcagaacaugaguauuca

SEQ ID NO: 276942 - RNA, 19 nt, Homo sapiens
acaaguaugaggaugagau

SEQ ID NO: 276943 - RNA, 19 nt, Homo sapiens
ugacccagaaguccuacaa

SEQ ID NO: 276944 - RNA, 19 nt, Homo sapiens
gaccgacgagaucaacuuc

SEQ ID NO: 276945 - RNA, 19 nt, Homo sapiens
ugaccgacgagaucaacuu

SEQ ID NO: 276946 - RNA, 19 nt, Homo sapiens
acgaauuuguccucaucaa

SEQ ID NO: 276947 - RNA, 19 nt, Homo sapiens
gaaaggacaucgagaauca

SEQ ID NO: 276948 - RNA, 19 nt, Homo sapiens
gaacugacuuggcauaugu

SEQ ID NO: 276949 - RNA, 19 nt, Homo sapiens
gcaaagaucucaccaagac

SEQ ID NO: 276950 - RNA, 19 nt, Homo sapiens
ggaggaggcuauaguaguu

SEQ ID NO: 276951 - RNA, 19 nt, Homo sapiens
gagaagagcuuggaagaca

SEQ ID NO: 276952 - RNA, 19 nt, Homo sapiens
acaacgaccuggagaauaa

SEQ ID NO: 276953 - RNA, 19 nt, Homo sapiens
uaauaaagcuucccuacug

SEQ ID NO: 276954 - RNA, 19 nt, Homo sapiens
gaaagcagcucuggagaag

SEQ ID NO: 276955 - RNA, 19 nt, Homo sapiens
gaagggaccugcugcuauc

SEQ ID NO: 276956 - RNA, 19 nt, Homo sapiens
ggauaaaguuugagaugga

SEQ ID NO: 276957 - RNA, 19 nt, Homo sapiens
ggacaucgagaaucaauau

SEQ ID NO: 276958 - RNA, 19 nt, Homo sapiens
uaacccagaucgagcauga

SEQ ID NO: 276959 - RNA, 19 nt, Homo sapiens
gggaagcucucgugucugu

SEQ ID NO: 276960 - RNA, 19 nt, Homo sapiens
agaaggaaaucgagaccua

SEQ ID NO: 276961 - RNA, 19 nt, Homo sapiens
ugacaacacucgcaugaca

SEQ ID NO: 276962 - RNA, 19 nt, Homo sapiens
ugcacgaucuugacuauaa

SEQ ID NO: 276963 - RNA, 19 nt, Homo sapiens
cgauucagcucuucuagug

SEQ ID NO: 276964 - RNA, 19 nt, Homo sapiens
gcaugacacuggaugacuu

SEQ ID NO: 276965 - RNA, 19 nt, Homo sapiens
gaacaguggagaugucaau

SEQ ID NO: 276966 - RNA, 19 nt, Homo sapiens
cuggaugacuucaggauaa

SEQ ID NO: 276967 - RNA, 19 nt, Homo sapiens
gcuaccagcugugucauga

SEQ ID NO: 276968 - RNA, 19 nt, Homo sapiens
gcagaacaguggagauguc

SEQ ID NO: 276969 - RNA, 19 nt, Homo sapiens
aggaauagcuggcaacaag

SEQ ID NO: 276970 - RNA, 19 nt, Homo sapiens
ggaaguggagguggucaua

SEQ ID NO: 276971 - RNA, 19 nt, Homo sapiens
gagcaugagguauccagua

SEQ ID NO: 276972 - RNA, 19 nt, Homo sapiens
ucaccaagacccucaauga

SEQ ID NO: 276973 - RNA, 19 nt, Homo sapiens
gcacgaucuugacuauaau

SEQ ID NO: 276974 - RNA, 19 nt, Homo sapiens
ccaagacccucaaugacau

SEQ ID NO: 276975 - RNA, 19 nt, Homo sapiens
ucaagaagaaucauaagga

SEQ ID NO: 276976 - RNA, 19 nt, Homo sapiens
aaacucuccuggacauuga

SEQ ID NO: 276977 - RNA, 19 nt, Homo sapiens
gcauaugugcucuggcuuu

SEQ ID NO: 276978 - RNA, 19 nt, Homo sapiens
ggaaguggaggcaguuaug

SEQ ID NO: 276979 - RNA, 19 nt, Homo sapiens
gucaugagcugcagacagu

SEQ ID NO: 276980 - RNA, 19 nt, Homo sapiens
gcucauugcuaagaacaga

SEQ ID NO: 276981 - RNA, 19 nt, Homo sapiens
ugauggcccucaagaagaa

SEQ ID NO: 276982 - RNA, 19 nt, Homo sapiens
gaacuacuccccuuauuau

SEQ ID NO: 276983 - RNA, 19 nt, Homo sapiens
cuacggaggcggugaagaa

SEQ ID NO: 276984 - RNA, 19 nt, Homo sapiens
caugagguauccaguagug

SEQ ID NO: 276985 - RNA, 19 nt, Homo sapiens
ccagaucgagcaugaggua

SEQ ID NO: 276986 - RNA, 19 nt, Homo sapiens
auucucggcuggccucuua

SEQ ID NO: 276987 - RNA, 19 nt, Homo sapiens
gaagagcaccaugcaggaa

SEQ ID NO: 276988 - RNA, 19 nt, Homo sapiens
ggaaguggagguggccaua

SEQ ID NO: 276989 - RNA, 19 nt, Homo sapiens
caacaacgaccuggagaau

SEQ ID NO: 276990 - RNA, 19 nt, Homo sapiens
gugguauucugacugcuaa

SEQ ID NO: 276991 - RNA, 19 nt, Homo sapiens
gagaucgagugccagaauc

SEQ ID NO: 276992 - RNA, 19 nt, Homo sapiens
ggaaguggaggcagcuaug

SEQ ID NO: 276993 - RNA, 19 nt, Homo sapiens
ucacugacguccggcaaga

SEQ ID NO: 276994 - RNA, 19 nt, Homo sapiens
caguggagaugucaaugug

SEQ ID NO: 276995 - RNA, 19 nt, Homo sapiens
gaaaaucaucccauuccua

SEQ ID NO: 276996 - RNA, 19 nt, Homo sapiens
cagcuacgguggaggaagu

SEQ ID NO: 276997 - RNA, 19 nt, Homo sapiens
gagcugauggcccucaaga

SEQ ID NO: 276998 - RNA, 19 nt, Homo sapiens
ggcaggugcuggacaaucu

SEQ ID NO: 276999 - RNA, 19 nt, Homo sapiens
ugaacugacuuggcauaug

SEQ ID NO: 277000 - RNA, 19 nt, Homo sapiens
agucucagcucagcaagaa

SEQ ID NO: 277001 - RNA, 19 nt, Homo sapiens
acagaaaggacaucgagaa

SEQ ID NO: 277002 - RNA, 19 nt, Homo sapiens
gcugauggcccucaagaag

SEQ ID NO: 277003 - RNA, 19 nt, Homo sapiens
gacagugggcaacaacaaa

SEQ ID NO: 277004 - RNA, 19 nt, Homo sapiens
uccaggagcagaucaguaa

SEQ ID NO: 277005 - RNA, 19 nt, Homo sapiens
uggacaaucugaccaugga

SEQ ID NO: 277006 - RNA, 19 nt, Homo sapiens
gccgguagcacuccuauca

SEQ ID NO: 277007 - RNA, 19 nt, Homo sapiens
agacucagauaacccagau

SEQ ID NO: 277008 - RNA, 19 nt, Homo sapiens
caucgagaaucaauaugag

SEQ ID NO: 277009 - RNA, 19 nt, Homo sapiens
caggauaaaguuugagaug

SEQ ID NO: 277010 - RNA, 19 nt, Homo sapiens
gaagaagcgaguggaagug

SEQ ID NO: 277011 - RNA, 19 nt, Homo sapiens
agaugucaauguggagaua

SEQ ID NO: 277012 - RNA, 19 nt, Homo sapiens
gggcagaacaguggagaug

SEQ ID NO: 277013 - RNA, 19 nt, Homo sapiens
cugcugcuauccagaagaa

SEQ ID NO: 277014 - RNA, 19 nt, Homo sapiens
ggugauggugguauucuga

SEQ ID NO: 277015 - RNA, 19 nt, Homo sapiens
cauaugugcucuggcuuuc

SEQ ID NO: 277016 - RNA, 19 nt, Homo sapiens
gggaggccaggaagacuuu

SEQ ID NO: 277017 - RNA, 19 nt, Homo sapiens
agaaagcagcucuggagaa

SEQ ID NO: 277018 - RNA, 19 nt, Homo sapiens
cagaaaggacaucgagaau

SEQ ID NO: 277019 - RNA, 19 nt, Homo sapiens
gcuggccucuuacuuggau

SEQ ID NO: 277020 - RNA, 19 nt, Homo sapiens
ccugcacgaucuugacuau

SEQ ID NO: 277021 - RNA, 19 nt, Homo sapiens
acagaccucuuuccucucu

SEQ ID NO: 277022 - RNA, 19 nt, Homo sapiens
cuuauuggauccugacauc

SEQ ID NO: 277023 - RNA, 19 nt, Homo sapiens
ugaagaagcgaguggaagu

SEQ ID NO: 277024 - RNA, 19 nt, Homo sapiens
uggaggcaguuauggaaga

SEQ ID NO: 277025 - RNA, 19 nt, Homo sapiens
ggccauagcggaggaagug

SEQ ID NO: 277026 - RNA, 19 nt, Homo sapiens
gaggaaguggaggcaguua

SEQ ID NO: 277027 - RNA, 19 nt, Homo sapiens
ggugguauucugacugcua

SEQ ID NO: 277028 - RNA, 19 nt, Homo sapiens
agaugcggcuggagaagga

SEQ ID NO: 277029 - RNA, 19 nt, Homo sapiens
accuggagaugcaguauga

SEQ ID NO: 277030 - RNA, 19 nt, Homo sapiens
uggaugacuucaggauaaa

SEQ ID NO: 277031 - RNA, 19 nt, Homo sapiens
gaccugcugcuauccagaa

SEQ ID NO: 277032 - RNA, 19 nt, Homo sapiens
uagaggaggccaacaacga

SEQ ID NO: 277033 - RNA, 19 nt, Homo sapiens
guauucugacugcuaauga

SEQ ID NO: 277034 - RNA, 19 nt, Homo sapiens
gggaggcgguggcaguuuu

SEQ ID NO: 277035 - RNA, 19 nt, Homo sapiens
ccaggaagacuuugaaucc

SEQ ID NO: 277036 - RNA, 19 nt, Homo sapiens
uaacuuggaggcccagauc

SEQ ID NO: 277037 - RNA, 19 nt, Homo sapiens
acaucgagaaucaauauga

SEQ ID NO: 277038 - RNA, 19 nt, Homo sapiens
gaagaacuacuccccuuau

SEQ ID NO: 277039 - RNA, 19 nt, Homo sapiens
agaagggaccugcugcuau

SEQ ID NO: 277040 - RNA, 19 nt, Homo sapiens
agucugaccuggagaugca

SEQ ID NO: 277041 - RNA, 19 nt, Homo sapiens
uaguuuaggcgguggcuuu

SEQ ID NO: 277042 - RNA, 19 nt, Homo sapiens
ugaccaagaugagacaaaa

SEQ ID NO: 277043 - RNA, 19 nt, Homo sapiens
ggucauaguggaggaagug

SEQ ID NO: 277044 - RNA, 19 nt, Homo sapiens
guggccagcugcagaugau

SEQ ID NO: 277045 - RNA, 19 nt, Homo sapiens
gcagcucauugcuaagaac

SEQ ID NO: 277046 - RNA, 19 nt, Homo sapiens
ugacagugggcaacaacaa

SEQ ID NO: 277047 - RNA, 19 nt, Homo sapiens
gaacagauauccagcuaua

SEQ ID NO: 277048 - RNA, 19 nt, Homo sapiens
gcaaggaacugacuacaga

SEQ ID NO: 277049 - RNA, 19 nt, Homo sapiens
ggagguagcuuucguggaa

SEQ ID NO: 277050 - RNA, 19 nt, Homo sapiens
ugacucaacuucugaauaa

SEQ ID NO: 277051 - RNA, 19 nt, Homo sapiens
ccaagaaacacuacuauua

SEQ ID NO: 277052 - RNA, 19 nt, Homo sapiens
ggaccaagauacuaacaaa

SEQ ID NO: 277053 - RNA, 19 nt, Homo sapiens
ggaacugacuacagaaauu

SEQ ID NO: 277054 - RNA, 19 nt, Homo sapiens
ucacacagaccauuauuua

SEQ ID NO: 277055 - RNA, 19 nt, Homo sapiens
caacaacucacggauauua

SEQ ID NO: 277056 - RNA, 19 nt, Homo sapiens
gaaaccgagugccagaaua

SEQ ID NO: 277057 - RNA, 19 nt, Homo sapiens
caacuggccuugaaacaau

SEQ ID NO: 277058 - RNA, 19 nt, Homo sapiens
aaacaaagucuccaagaaa

SEQ ID NO: 277059 - RNA, 19 nt, Homo sapiens
gauauccgcucuggaagaa

SEQ ID NO: 277060 - RNA, 19 nt, Homo sapiens
gaaucucccuucacacaga

SEQ ID NO: 277061 - RNA, 19 nt, Homo sapiens
gaacaaaaccgcaaagaug

SEQ ID NO: 277062 - RNA, 19 nt, Homo sapiens
aagaauaucuagcuccaaa

SEQ ID NO: 277063 - RNA, 19 nt, Homo sapiens
ggaaauagaccuugaaaau

SEQ ID NO: 277064 - RNA, 19 nt, Homo sapiens
gagcuggccuaucugaaga

SEQ ID NO: 277065 - RNA, 19 nt, Homo sapiens
caucuacgguugaaucaga

SEQ ID NO: 277066 - RNA, 19 nt, Homo sapiens
gugcagcucucacagauuc

SEQ ID NO: 277067 - RNA, 19 nt, Homo sapiens
ugagauuacugaauugaga

SEQ ID NO: 277068 - RNA, 19 nt, Homo sapiens
uguacaagcucuggagaua

SEQ ID NO: 277069 - RNA, 19 nt, Homo sapiens
gaauugagacguaauguac

SEQ ID NO: 277070 - RNA, 19 nt, Homo sapiens
gaacugacuacagaaauug

SEQ ID NO: 277071 - RNA, 19 nt, Homo sapiens
gaagagcuggccuaucuga

SEQ ID NO: 277072 - RNA, 19 nt, Homo sapiens
cugaagagcuggccuaucu

SEQ ID NO: 277073 - RNA, 19 nt, Homo sapiens
ccagaauacugaauaccaa

SEQ ID NO: 277074 - RNA, 19 nt, Homo sapiens
aaacacuucugucuugaug

SEQ ID NO: 277075 - RNA, 19 nt, Homo sapiens
cguggaagcuauggaagua

SEQ ID NO: 277076 - RNA, 19 nt, Homo sapiens
uaagggaccaagauacuaa

SEQ ID NO: 277077 - RNA, 19 nt, Homo sapiens
gcagcaagcaguucucuuc

SEQ ID NO: 277078 - RNA, 19 nt, Homo sapiens
uggccuaucugaagaagaa

SEQ ID NO: 277079 - RNA, 19 nt, Homo sapiens
aaccaucgaugaccuuaaa

SEQ ID NO: 277080 - RNA, 19 nt, Homo sapiens
uacaagcucuggagauaga

SEQ ID NO: 277081 - RNA, 19 nt, Homo sapiens
cuauuaaacugcaugaauc

SEQ ID NO: 277082 - RNA, 19 nt, Homo sapiens
acagauauccagcuauaaa

SEQ ID NO: 277083 - RNA, 19 nt, Homo sapiens
gaacaacuugcugaacaaa

SEQ ID NO: 277084 - RNA, 19 nt, Homo sapiens
gagaaaccaauaugaacaa

SEQ ID NO: 277085 - RNA, 19 nt, Homo sapiens
gaaaauaaggugucuacaa

SEQ ID NO: 277086 - RNA, 19 nt, Homo sapiens
gaaguaugagaaugaggua

SEQ ID NO: 277087 - RNA, 19 nt, Homo sapiens
acaacuuucuguucucauu

SEQ ID NO: 277088 - RNA, 19 nt, Homo sapiens
ccagaguaaucaagacaau

SEQ ID NO: 277089 - RNA, 19 nt, Homo sapiens
gaaaagagcaaggaacuga

SEQ ID NO: 277090 - RNA, 19 nt, Homo sapiens
ugaacaacuugcugaacaa

SEQ ID NO: 277091 - RNA, 19 nt, Homo sapiens
caugagaaaccaauaugaa

SEQ ID NO: 277092 - RNA, 19 nt, Homo sapiens
acacagaccauuauuuaca

SEQ ID NO: 277093 - RNA, 19 nt, Homo sapiens
gggcgagucuucaucuaag

SEQ ID NO: 277094 - RNA, 19 nt, Homo sapiens
gaucugacucaacuucuga

SEQ ID NO: 277095 - RNA, 19 nt, Homo sapiens
caacuucugaauaacauga

SEQ ID NO: 277096 - RNA, 19 nt, Homo sapiens
ggaagaaucaaacuaugag

SEQ ID NO: 277097 - RNA, 19 nt, Homo sapiens
ggccuucucucuggaaaug

SEQ ID NO: 277098 - RNA, 19 nt, Homo sapiens
uuucggagguggcagcuuu

SEQ ID NO: 277099 - RNA, 19 nt, Homo sapiens
gaaaacacuucugucuuga

SEQ ID NO: 277100 - RNA, 19 nt, Homo sapiens
aaaccaagaaacacuacua

SEQ ID NO: 277101 - RNA, 19 nt, Homo sapiens
gccaacauccugcuucaga

SEQ ID NO: 277102 - RNA, 19 nt, Homo sapiens
cuacagcaaauacuacaaa

SEQ ID NO: 277103 - RNA, 19 nt, Homo sapiens
caacucacggauauuaaga

SEQ ID NO: 277104 - RNA, 19 nt, Homo sapiens
accaacaacucacggauau

SEQ ID NO: 277105 - RNA, 19 nt, Homo sapiens
gaagccuccuuggcagaaa

SEQ ID NO: 277106 - RNA, 19 nt, Homo sapiens
ugaauugagacguaaugua

SEQ ID NO: 277107 - RNA, 19 nt, Homo sapiens
aaaauaaggugucuacaag

SEQ ID NO: 277108 - RNA, 19 nt, Homo sapiens
uugauggucuauggaaaua

SEQ ID NO: 277109 - RNA, 19 nt, Homo sapiens
aaucagaaaccaagaaaca

SEQ ID NO: 277110 - RNA, 19 nt, Homo sapiens
ugaauaacaugagaaacca

SEQ ID NO: 277111 - RNA, 19 nt, Homo sapiens
caacuuucuguucucauuu

SEQ ID NO: 277112 - RNA, 19 nt, Homo sapiens
aauaaggugucuacaaggu

SEQ ID NO: 277113 - RNA, 19 nt, Homo sapiens
aaaacaaagucuccaagaa

SEQ ID NO: 277114 - RNA, 19 nt, Homo sapiens
gaaaacaaagucuccaaga

SEQ ID NO: 277115 - RNA, 19 nt, Homo sapiens
cuauggaaguagcagcuuu

SEQ ID NO: 277116 - RNA, 19 nt, Homo sapiens
gaauacugaauaccaacaa

SEQ ID NO: 277117 - RNA, 19 nt, Homo sapiens
uugaacagauauccagcua

SEQ ID NO: 277118 - RNA, 19 nt, Homo sapiens
cagaaaccaagaaacacua

SEQ ID NO: 277119 - RNA, 19 nt, Homo sapiens
ugaaucagaaaccaagaaa

SEQ ID NO: 277120 - RNA, 19 nt, Homo sapiens
aaauugagagccugacuga

SEQ ID NO: 277121 - RNA, 19 nt, Homo sapiens
uaacaaaaccagaguaauc

SEQ ID NO: 277122 - RNA, 19 nt, Homo sapiens
gaauaucuagcuccaaagg

SEQ ID NO: 277123 - RNA, 19 nt, Homo sapiens
gauauccagcuauaaaucu

SEQ ID NO: 277124 - RNA, 19 nt, Homo sapiens
ccaacauccugcuucagau

SEQ ID NO: 277125 - RNA, 19 nt, Homo sapiens
ccucgugacuacagcaaau

SEQ ID NO: 277126 - RNA, 19 nt, Homo sapiens
ugaccagcauggcaacuca

SEQ ID NO: 277127 - RNA, 19 nt, Homo sapiens
aaaguaaccaugcagaauc

SEQ ID NO: 277128 - RNA, 19 nt, Homo sapiens
ggaagccuccuuggcagaa

SEQ ID NO: 277129 - RNA, 19 nt, Homo sapiens
uggaagaaucaaacuauga

SEQ ID NO: 277130 - RNA, 19 nt, Homo sapiens
ccaacuggccuugaaacaa

SEQ ID NO: 277131 - RNA, 19 nt, Homo sapiens
ugagaaaccaauaugaaca

SEQ ID NO: 277132 - RNA, 19 nt, Homo sapiens
gaugugaauguggaaauga

SEQ ID NO: 277133 - RNA, 19 nt, Homo sapiens
uaccaacaacucacggaua

SEQ ID NO: 277134 - RNA, 19 nt, Homo sapiens
uauccgcucuggaagaaca

SEQ ID NO: 277135 - RNA, 19 nt, Homo sapiens
cagaaggucgcuacugugu

SEQ ID NO: 277136 - RNA, 19 nt, Homo sapiens
uugagagccugacugaaga

SEQ ID NO: 277137 - RNA, 19 nt, Homo sapiens
ggccacaaguccuccucuu

SEQ ID NO: 277138 - RNA, 19 nt, Homo sapiens
augaacaacuugcugaaca

SEQ ID NO: 277139 - RNA, 19 nt, Homo sapiens
gugacuacagcaaauacua

SEQ ID NO: 277140 - RNA, 19 nt, Homo sapiens
agguggcuauggaggauua

SEQ ID NO: 277141 - RNA, 19 nt, Homo sapiens
agaccauuauuuacagaug

SEQ ID NO: 277142 - RNA, 19 nt, Homo sapiens
agauccgacuggagaauga

SEQ ID NO: 277143 - RNA, 19 nt, Homo sapiens
acacuucugucuugauggu

SEQ ID NO: 277144 - RNA, 19 nt, Homo sapiens
cgguagaguucuuucaucu

SEQ ID NO: 277145 - RNA, 19 nt, Homo sapiens
cuacggugguggcaguuuc

SEQ ID NO: 277146 - RNA, 19 nt, Homo sapiens
ugaugugaauguggaaaug

SEQ ID NO: 277147 - RNA, 19 nt, Homo sapiens
gaggaaaguuuauuuguga

SEQ ID NO: 277148 - RNA, 19 nt, Homo sapiens
ggagguggcucucuaggua

SEQ ID NO: 277149 - RNA, 19 nt, Homo sapiens
agaguaacaugcuguauua

SEQ ID NO: 277150 - RNA, 19 nt, Homo sapiens
gaaacaauauucagucaca

SEQ ID NO: 277151 - RNA, 19 nt, Homo sapiens
gcgauuacagcaaauauua

SEQ ID NO: 277152 - RNA, 19 nt, Homo sapiens
ggaggaaaguuuauuugug

SEQ ID NO: 277153 - RNA, 19 nt, Homo sapiens
ucaccaggcuccucaauga

SEQ ID NO: 277154 - RNA, 19 nt, Homo sapiens
ucauagagcuuuacucaag

SEQ ID NO: 277155 - RNA, 19 nt, Homo sapiens
ggaagugccuuuggcuuug

SEQ ID NO: 277156 - RNA, 19 nt, Homo sapiens
ggaaauugaagaacuaaug

SEQ ID NO: 277157 - RNA, 19 nt, Homo sapiens
guaaggagauuagcaccaa

SEQ ID NO: 277158 - RNA, 19 nt, Homo sapiens
gaagaccucaggaauaaga

SEQ ID NO: 277159 - RNA, 19 nt, Homo sapiens
ucaggaaauugaagaacua

SEQ ID NO: 277160 - RNA, 19 nt, Homo sapiens
uugaagaccucaggaauaa

SEQ ID NO: 277161 - RNA, 19 nt, Homo sapiens
uagaagaggcuaauacuga

SEQ ID NO: 277162 - RNA, 19 nt, Homo sapiens
gagcuggccuacaugaaga

SEQ ID NO: 277163 - RNA, 19 nt, Homo sapiens
caacugauuccucuaaaga

SEQ ID NO: 277164 - RNA, 19 nt, Homo sapiens
ggaccgaccuggagaugca

SEQ ID NO: 277165 - RNA, 19 nt, Homo sapiens
gccuggagcuggagauuga

SEQ ID NO: 277166 - RNA, 19 nt, Homo sapiens
gaugaaguaugagaaugaa

SEQ ID NO: 277167 - RNA, 19 nt, Homo sapiens
acagagcgauuacagcaaa

SEQ ID NO: 277168 - RNA, 19 nt, Homo sapiens
ggaugaaguaugagaauga

SEQ ID NO: 277169 - RNA, 19 nt, Homo sapiens
gggaagugccuuuggcuuu

SEQ ID NO: 277170 - RNA, 19 nt, Homo sapiens
caacuggaguagucuuuua

SEQ ID NO: 277171 - RNA, 19 nt, Homo sapiens
ggaguagucuuuuaacgaa

SEQ ID NO: 277172 - RNA, 19 nt, Homo sapiens
gagguggucucaucucaag

SEQ ID NO: 277173 - RNA, 19 nt, Homo sapiens
cagcuccucuugcagauug

SEQ ID NO: 277174 - RNA, 19 nt, Homo sapiens
gaagaagaaccacgaggau

SEQ ID NO: 277175 - RNA, 19 nt, Homo sapiens
caucucaaguucaggaaau

SEQ ID NO: 277176 - RNA, 19 nt, Homo sapiens
gguauucucucgggcaaug

SEQ ID NO: 277177 - RNA, 19 nt, Homo sapiens
ggcccaaggugaugguuug

SEQ ID NO: 277178 - RNA, 19 nt, Homo sapiens
gaaaugcccagcuccucuu

SEQ ID NO: 277179 - RNA, 19 nt, Homo sapiens
uggauucccuauucacauu

SEQ ID NO: 277180 - RNA, 19 nt, Homo sapiens
cagaguaacaugcuguauu

SEQ ID NO: 277181 - RNA, 19 nt, Homo sapiens
cagcuucaguccagcaaga

SEQ ID NO: 277182 - RNA, 19 nt, Homo sapiens
agaagaaccacgaggauga

SEQ ID NO: 277183 - RNA, 19 nt, Homo sapiens
gcaaauauuauccacugau

SEQ ID NO: 277184 - RNA, 19 nt, Homo sapiens
cugguaacccggaauauuu

SEQ ID NO: 277185 - RNA, 19 nt, Homo sapiens
gaucauuucagccagcauu

SEQ ID NO: 277186 - RNA, 19 nt, Homo sapiens
gaaccuggagaucgagcua

SEQ ID NO: 277187 - RNA, 19 nt, Homo sapiens
aaucauagagcuuuacuca

SEQ ID NO: 277188 - RNA, 19 nt, Homo sapiens
aauauucagucacaaguca

SEQ ID NO: 277189 - RNA, 19 nt, Homo sapiens
ggaacaagaaauuuacaag

SEQ ID NO: 277190 - RNA, 19 nt, Homo sapiens
uggccuacaugaagaagaa

SEQ ID NO: 277191 - RNA, 19 nt, Homo sapiens
cacaagaucugccccauga

SEQ ID NO: 277192 - RNA, 19 nt, Homo sapiens
ggucucaucucaaguucag

SEQ ID NO: 277193 - RNA, 19 nt, Homo sapiens
ggugaugguuuggaggaaa

SEQ ID NO: 277194 - RNA, 19 nt, Homo sapiens
ccaggcuccucaaugauau

SEQ ID NO: 277195 - RNA, 19 nt, Homo sapiens
ccacgaggaugagcuccaa

SEQ ID NO: 277196 - RNA, 19 nt, Homo sapiens
ggucauguuggucuuugua

SEQ ID NO: 277197 - RNA, 19 nt, Homo sapiens
uaacaugcuguauuacuuc

SEQ ID NO: 277198 - RNA, 19 nt, Homo sapiens
caaaucacaagcacaguca

SEQ ID NO: 277199 - RNA, 19 nt, Homo sapiens
ggagcuggccuacaugaag

SEQ ID NO: 277200 - RNA, 19 nt, Homo sapiens
acgaggagcuggccuacau

SEQ ID NO: 277201 - RNA, 19 nt, Homo sapiens
gcuaauacugagcuagaaa

SEQ ID NO: 277202 - RNA, 19 nt, Homo sapiens
gauggaggccuucuuucug

SEQ ID NO: 277203 - RNA, 19 nt, Homo sapiens
gauucccuauucacauuga

SEQ ID NO: 277204 - RNA, 19 nt, Homo sapiens
gaggagcuggccuacauga

SEQ ID NO: 277205 - RNA, 19 nt, Homo sapiens
gauugaagaccucaggaau

SEQ ID NO: 277206 - RNA, 19 nt, Homo sapiens
gaagugccuuuggcuuugg

SEQ ID NO: 277207 - RNA, 19 nt, Homo sapiens
gagcgauuacagcaaauau

SEQ ID NO: 277208 - RNA, 19 nt, Homo sapiens
cccaggagguggcucucua

SEQ ID NO: 277209 - RNA, 19 nt, Homo sapiens
gacaacuggaguagucuuu

SEQ ID NO: 277210 - RNA, 19 nt, Homo sapiens
gguggucucaucucaaguu

SEQ ID NO: 277211 - RNA, 19 nt, Homo sapiens
ugcaggagauggugaaugg

SEQ ID NO: 277212 - RNA, 19 nt, Homo sapiens
ugacagacuccaaaucaca

SEQ ID NO: 277213 - RNA, 19 nt, Homo sapiens
ccucaggaauaagaucauu

SEQ ID NO: 277214 - RNA, 19 nt, Homo sapiens
cauagagcuuuacucaagu

SEQ ID NO: 277215 - RNA, 19 nt, Homo sapiens
caugcuguauuacuucaau

SEQ ID NO: 277216 - RNA, 19 nt, Homo sapiens
gaggacugggugcugguua

SEQ ID NO: 277217 - RNA, 19 nt, Homo sapiens
gucaacugauuccucuaaa

SEQ ID NO: 277218 - RNA, 19 nt, Homo sapiens
aaccaucgcugagcagaau

SEQ ID NO: 277219 - RNA, 19 nt, Homo sapiens
ggguggagguagcuuugga

SEQ ID NO: 277220 - RNA, 19 nt, Homo sapiens
ucaacugauuccucuaaag

SEQ ID NO: 277221 - RNA, 19 nt, Homo sapiens
ugcagcagcucaucagcaa

SEQ ID NO: 277222 - RNA, 19 nt, Homo sapiens
cgaggucagcguagaaaug

SEQ ID NO: 277223 - RNA, 19 nt, Homo sapiens
cguagaggccgacaucaau

SEQ ID NO: 277224 - RNA, 19 nt, Homo sapiens
ggacugcagaugcuucaca

SEQ ID NO: 277225 - RNA, 19 nt, Homo sapiens
aacgaacuuucuucuggua

SEQ ID NO: 277226 - RNA, 19 nt, Homo sapiens
ggaaaguuuauuugugaca

SEQ ID NO: 277227 - RNA, 19 nt, Homo sapiens
guagaggccgacaucaaug

SEQ ID NO: 277228 - RNA, 19 nt, Homo sapiens
ucaggaauaagaucauuuc

SEQ ID NO: 277229 - RNA, 19 nt, Homo sapiens
aaugauggaggccuucuuu

SEQ ID NO: 277230 - RNA, 19 nt, Homo sapiens
gacagacuccaaaucacaa

SEQ ID NO: 277231 - RNA, 19 nt, Homo sapiens
gcguagaggccgacaucaa

SEQ ID NO: 277232 - RNA, 19 nt, Homo sapiens
gaaguaugagaaugaacug

SEQ ID NO: 277233 - RNA, 19 nt, Homo sapiens
gauaaggugcgagcucuag

SEQ ID NO: 277234 - RNA, 19 nt, Homo sapiens
agacaguugugcaggagau

SEQ ID NO: 277235 - RNA, 19 nt, Homo sapiens
ugugacagacuccaaauca

SEQ ID NO: 277236 - RNA, 19 nt, Homo sapiens
agucccagcucgccaugaa

SEQ ID NO: 277237 - RNA, 19 nt, Homo sapiens
auugaagaccucaggaaua

SEQ ID NO: 277238 - RNA, 19 nt, Homo sapiens
caugucugcuuccaguguu

SEQ ID NO: 277239 - RNA, 19 nt, Homo sapiens
ggacaacuggaguagucuu

SEQ ID NO: 277240 - RNA, 19 nt, Homo sapiens
cuggacaacuggaguaguc

SEQ ID NO: 277241 - RNA, 19 nt, Homo sapiens
gcaugucugcuuccagugu

SEQ ID NO: 277242 - RNA, 19 nt, Homo sapiens
ggcuaauacugagcuagaa

SEQ ID NO: 277243 - RNA, 19 nt, Homo sapiens
uaaggugcgagcucuagaa

SEQ ID NO: 277244 - RNA, 19 nt, Homo sapiens
ggauaaggugcgagcucua

SEQ ID NO: 277245 - RNA, 19 nt, Homo sapiens
cuuauauccuucuggacaa

SEQ ID NO: 277246 - RNA, 19 nt, Homo sapiens
gaggucagcguagaaaugg

SEQ ID NO: 277247 - RNA, 19 nt, Homo sapiens
gugcagagcugaacaagga

SEQ ID NO: 277248 - RNA, 19 nt, Homo sapiens
gaaccaagaguacaagaug

SEQ ID NO: 277249 - RNA, 19 nt, Homo sapiens
aagaggagaugaaggaauu

SEQ ID NO: 277250 - RNA, 19 nt, Homo sapiens
gagcuagccuacaugaaga

SEQ ID NO: 277251 - RNA, 19 nt, Homo sapiens
gaagagcuagccuacauga

SEQ ID NO: 277252 - RNA, 19 nt, Homo sapiens
ggaucucucuccucucuga

SEQ ID NO: 277253 - RNA, 19 nt, Homo sapiens
uaccaacacugccaugauu

SEQ ID NO: 277254 - RNA, 19 nt, Homo sapiens
acaaggaggugucuaccaa

SEQ ID NO: 277255 - RNA, 19 nt, Homo sapiens
gagccugaaugaagagcua

SEQ ID NO: 277256 - RNA, 19 nt, Homo sapiens
gaagaagaaccaugaagag

SEQ ID NO: 277257 - RNA, 19 nt, Homo sapiens
uagccuacaugaagaagaa

SEQ ID NO: 277258 - RNA, 19 nt, Homo sapiens
gaagagcuccgggacaaga

SEQ ID NO: 277259 - RNA, 19 nt, Homo sapiens
gaggagaugaaggaauuua

SEQ ID NO: 277260 - RNA, 19 nt, Homo sapiens
gcaaugagaagaucaccau

SEQ ID NO: 277261 - RNA, 19 nt, Homo sapiens
ugaagaagaaccaugaaga

SEQ ID NO: 277262 - RNA, 19 nt, Homo sapiens
agacugaccuggagaugca

SEQ ID NO: 277263 - RNA, 19 nt, Homo sapiens
gauacgcuuugguuucuca

SEQ ID NO: 277264 - RNA, 19 nt, Homo sapiens
gaagaggagaugaaggaau

SEQ ID NO: 277265 - RNA, 19 nt, Homo sapiens
ucgagagccugaaugaaga

SEQ ID NO: 277266 - RNA, 19 nt, Homo sapiens
gaugagcucacucugucua

SEQ ID NO: 277267 - RNA, 19 nt, Homo sapiens
gagcucacucugucuaaga

SEQ ID NO: 277268 - RNA, 19 nt, Homo sapiens
gauccugaccgccaccauu

SEQ ID NO: 277269 - RNA, 19 nt, Homo sapiens
cugccuuucugcaaacaua

SEQ ID NO: 277270 - RNA, 19 nt, Homo sapiens
gcagaucgagagccugaau

SEQ ID NO: 277271 - RNA, 19 nt, Homo sapiens
gagacggagugccgcuaug

SEQ ID NO: 277272 - RNA, 19 nt, Homo sapiens
uugaagagcuccgggacaa

SEQ ID NO: 277273 - RNA, 19 nt, Homo sapiens
acaagaugcugcuggacau

SEQ ID NO: 277274 - RNA, 19 nt, Homo sapiens
augaagagcuagccuacau

SEQ ID NO: 277275 - RNA, 19 nt, Homo sapiens
cuauggagguggccuugga

SEQ ID NO: 277276 - RNA, 19 nt, Homo sapiens
cuauggagguggccuugga

SEQ ID NO: 277277 - RNA, 19 nt, Homo sapiens
agcaggagaucgccaccua

SEQ ID NO: 277278 - RNA, 19 nt, Homo sapiens
gagaugaaggaauuuagca

SEQ ID NO: 277279 - RNA, 19 nt, Homo sapiens
ugacuuuggugcuugugau

SEQ ID NO: 277280 - RNA, 19 nt, Homo sapiens
gcagauccagggacucauc

SEQ ID NO: 277281 - RNA, 19 nt, Homo sapiens
cguggugucucuaccuguu

SEQ ID NO: 277282 - RNA, 19 nt, Homo sapiens
gaggagagagccggcaguu

SEQ ID NO: 277283 - RNA, 19 nt, Homo sapiens
gaagaucaccaugcagaac

SEQ ID NO: 277284 - RNA, 19 nt, Homo sapiens
gcuuugguuucucaacuuc

SEQ ID NO: 277285 - RNA, 19 nt, Homo sapiens
gcugguggcuuuguugacu

SEQ ID NO: 277286 - RNA, 19 nt, Homo sapiens
gaucgagagccugaaugaa

SEQ ID NO: 277287 - RNA, 19 nt, Homo sapiens
gggucauccuggagauuga

SEQ ID NO: 277288 - RNA, 19 nt, Homo sapiens
cuacaagaccauugaagag

SEQ ID NO: 277289 - RNA, 19 nt, Homo sapiens
uggauacgcuuugguuucu

SEQ ID NO: 277290 - RNA, 19 nt, Homo sapiens
ucggaucucucuccucucu

SEQ ID NO: 277291 - RNA, 19 nt, Homo sapiens
ugaaggaauuuagcaacca

SEQ ID NO: 277292 - RNA, 19 nt, Homo sapiens
ccuuggagguggcuaugga

SEQ ID NO: 277293 - RNA, 19 nt, Homo sapiens
guccguaggccuuaaaucu

SEQ ID NO: 277294 - RNA, 19 nt, Homo sapiens
ggucgccgcacuucugaug

SEQ ID NO: 277295 - RNA, 19 nt, Homo sapiens
gccagaaccaagaguacaa

SEQ ID NO: 277296 - RNA, 19 nt, Homo sapiens
agagcuagccuacaugaag

SEQ ID NO: 277297 - RNA, 19 nt, Homo sapiens
uuuccugccuuucugcaaa

SEQ ID NO: 277298 - RNA, 19 nt, Homo sapiens
caacuucucuaccccaaag

SEQ ID NO: 277299 - RNA, 19 nt, Homo sapiens
cagcagauccagggacuca

SEQ ID NO: 277300 - RNA, 19 nt, Homo sapiens
ccaacacugccaugauuca

SEQ ID NO: 277301 - RNA, 19 nt, Homo sapiens
aaggaggugucuaccaaca

SEQ ID NO: 277302 - RNA, 19 nt, Homo sapiens
cagagaugagggagcagua

SEQ ID NO: 277303 - RNA, 19 nt, Homo sapiens
gaaccaugaagaggagaug

SEQ ID NO: 277304 - RNA, 19 nt, Homo sapiens
cgacuucuagugccucugu

SEQ ID NO: 277305 - RNA, 19 nt, Homo sapiens
gagaacacgguggcagaga

SEQ ID NO: 277306 - RNA, 19 nt, Homo sapiens
ggagaugaaggaauuuagc

SEQ ID NO: 277307 - RNA, 19 nt, Homo sapiens
ucuguuaccacgacuucua

SEQ ID NO: 277308 - RNA, 19 nt, Homo sapiens
gggaugcugaggaaugguu

SEQ ID NO: 277309 - RNA, 19 nt, Homo sapiens
acuacaagaccauugaaga

SEQ ID NO: 277310 - RNA, 19 nt, Homo sapiens
gcacccagaggaggagaga

SEQ ID NO: 277311 - RNA, 19 nt, Homo sapiens
gauguccguaggccuuaaa

SEQ ID NO: 277312 - RNA, 19 nt, Homo sapiens
guuaccaccaccucuaaug

SEQ ID NO: 277313 - RNA, 19 nt, Homo sapiens
agaucgagagccugaauga

SEQ ID NO: 277314 - RNA, 19 nt, Homo sapiens
ggcgugagcugugguuuug

SEQ ID NO: 277315 - RNA, 19 nt, Homo sapiens
augagaagaucaccaugca

SEQ ID NO: 277316 - RNA, 19 nt, Homo sapiens
ugaacaaggaggugucuac

SEQ ID NO: 277317 - RNA, 19 nt, Homo sapiens
ugguggcuuuguugacuuu

SEQ ID NO: 277318 - RNA, 19 nt, Homo sapiens
ccuacuacaagaccauuga

SEQ ID NO: 277319 - RNA, 19 nt, Homo sapiens
ucacuggcaaugagaagau

SEQ ID NO: 277320 - RNA, 19 nt, Homo sapiens
gugcagagcugaacaagga

SEQ ID NO: 277321 - RNA, 19 nt, Homo sapiens
gaaccaagaguacaagaug

SEQ ID NO: 277322 - RNA, 19 nt, Homo sapiens
aagaggagaugaaggaauu

SEQ ID NO: 277323 - RNA, 19 nt, Homo sapiens
gagcuagccuacaugaaga

SEQ ID NO: 277324 - RNA, 19 nt, Homo sapiens
gaagagcuagccuacauga

SEQ ID NO: 277325 - RNA, 19 nt, Homo sapiens
ggaucucucuccucucuga

SEQ ID NO: 277326 - RNA, 19 nt, Homo sapiens
uaccaacacugccaugauu

SEQ ID NO: 277327 - RNA, 19 nt, Homo sapiens
acaaggaggugucuaccaa

SEQ ID NO: 277328 - RNA, 19 nt, Homo sapiens
gagccugaaugaagagcua

SEQ ID NO: 277329 - RNA, 19 nt, Homo sapiens
gaagaagaaccaugaagag

SEQ ID NO: 277330 - RNA, 19 nt, Homo sapiens
uagccuacaugaagaagaa

SEQ ID NO: 277331 - RNA, 19 nt, Homo sapiens
gaagagcuccgggacaaga

SEQ ID NO: 277332 - RNA, 19 nt, Homo sapiens
gaggagaugaaggaauuua

SEQ ID NO: 277333 - RNA, 19 nt, Homo sapiens
gcaaugagaagaucaccau

SEQ ID NO: 277334 - RNA, 19 nt, Homo sapiens
ugaagaagaaccaugaaga

SEQ ID NO: 277335 - RNA, 19 nt, Homo sapiens
agacugaccuggagaugca

SEQ ID NO: 277336 - RNA, 19 nt, Homo sapiens
gauacgcuuugguuucuca

SEQ ID NO: 277337 - RNA, 19 nt, Homo sapiens
gaagaggagaugaaggaau

SEQ ID NO: 277338 - RNA, 19 nt, Homo sapiens
ucgagagccugaaugaaga

SEQ ID NO: 277339 - RNA, 19 nt, Homo sapiens
gaugagcucacucugucua

SEQ ID NO: 277340 - RNA, 19 nt, Homo sapiens
gagcucacucugucuaaga

SEQ ID NO: 277341 - RNA, 19 nt, Homo sapiens
gauccugaccgccaccauu

SEQ ID NO: 277342 - RNA, 19 nt, Homo sapiens
cugccuuucugcaaacaua

SEQ ID NO: 277343 - RNA, 19 nt, Homo sapiens
gcagaucgagagccugaau

SEQ ID NO: 277344 - RNA, 19 nt, Homo sapiens
gagacggagugccgcuaug

SEQ ID NO: 277345 - RNA, 19 nt, Homo sapiens
uugaagagcuccgggacaa

SEQ ID NO: 277346 - RNA, 19 nt, Homo sapiens
ggccaggacgccaagauga

SEQ ID NO: 277347 - RNA, 19 nt, Homo sapiens
acaagaugcugcuggacau

SEQ ID NO: 277348 - RNA, 19 nt, Homo sapiens
augaagagcuagccuacau

SEQ ID NO: 277349 - RNA, 19 nt, Homo sapiens
cuauggagguggccuugga

SEQ ID NO: 277350 - RNA, 19 nt, Homo sapiens
cuauggagguggccuugga

SEQ ID NO: 277351 - RNA, 19 nt, Homo sapiens
agcaggagaucgccaccua

SEQ ID NO: 277352 - RNA, 19 nt, Homo sapiens
gagaugaaggaauuuagca

SEQ ID NO: 277353 - RNA, 19 nt, Homo sapiens
ugacuuuggugcuugugau

SEQ ID NO: 277354 - RNA, 19 nt, Homo sapiens
gcagauccagggacucauc

SEQ ID NO: 277355 - RNA, 19 nt, Homo sapiens
cguggugucucuaccuguu

SEQ ID NO: 277356 - RNA, 19 nt, Homo sapiens
gaggagagagccggcaguu

SEQ ID NO: 277357 - RNA, 19 nt, Homo sapiens
gaagaucaccaugcagaac

SEQ ID NO: 277358 - RNA, 19 nt, Homo sapiens
gcuuugguuucucaacuuc

SEQ ID NO: 277359 - RNA, 19 nt, Homo sapiens
gcugguggcuuuguugacu

SEQ ID NO: 277360 - RNA, 19 nt, Homo sapiens
ccaggacgccaagaugauu

SEQ ID NO: 277361 - RNA, 19 nt, Homo sapiens
gaucgagagccugaaugaa

SEQ ID NO: 277362 - RNA, 19 nt, Homo sapiens
gggucauccuggagauuga

SEQ ID NO: 277363 - RNA, 19 nt, Homo sapiens
cuacaagaccauugaagag

SEQ ID NO: 277364 - RNA, 19 nt, Homo sapiens
uggauacgcuuugguuucu

SEQ ID NO: 277365 - RNA, 19 nt, Homo sapiens
ucggaucucucuccucucu

SEQ ID NO: 277366 - RNA, 19 nt, Homo sapiens
ugaaggaauuuagcaacca

SEQ ID NO: 277367 - RNA, 19 nt, Homo sapiens
ccuuggagguggcuaugga

SEQ ID NO: 277368 - RNA, 19 nt, Homo sapiens
guccguaggccuuaaaucu

SEQ ID NO: 277369 - RNA, 19 nt, Homo sapiens
ggucgccgcacuucugaug

SEQ ID NO: 277370 - RNA, 19 nt, Homo sapiens
gccagaaccaagaguacaa

SEQ ID NO: 277371 - RNA, 19 nt, Homo sapiens
agagcuagccuacaugaag

SEQ ID NO: 277372 - RNA, 19 nt, Homo sapiens
uuuccugccuuucugcaaa

SEQ ID NO: 277373 - RNA, 19 nt, Homo sapiens
caacuucucuaccccaaag

SEQ ID NO: 277374 - RNA, 19 nt, Homo sapiens
cagcagauccagggacuca

SEQ ID NO: 277375 - RNA, 19 nt, Homo sapiens
ccaacacugccaugauuca

SEQ ID NO: 277376 - RNA, 19 nt, Homo sapiens
aaggaggugucuaccaaca

SEQ ID NO: 277377 - RNA, 19 nt, Homo sapiens
cagagaugagggagcagua

SEQ ID NO: 277378 - RNA, 19 nt, Homo sapiens
gaaccaugaagaggagaug

SEQ ID NO: 277379 - RNA, 19 nt, Homo sapiens
cgacuucuagugccucugu

SEQ ID NO: 277380 - RNA, 19 nt, Homo sapiens
gagaacacgguggcagaga

SEQ ID NO: 277381 - RNA, 19 nt, Homo sapiens
ggagaugaaggaauuuagc

SEQ ID NO: 277382 - RNA, 19 nt, Homo sapiens
ucuguuaccacgacuucua

SEQ ID NO: 277383 - RNA, 19 nt, Homo sapiens
gggaugcugaggaaugguu

SEQ ID NO: 277384 - RNA, 19 nt, Homo sapiens
acuacaagaccauugaaga

SEQ ID NO: 277385 - RNA, 19 nt, Homo sapiens
gcacccagaggaggagaga

SEQ ID NO: 277386 - RNA, 19 nt, Homo sapiens
gauguccguaggccuuaaa

SEQ ID NO: 277387 - RNA, 19 nt, Homo sapiens
guuaccaccaccucuaaug

SEQ ID NO: 277388 - RNA, 19 nt, Homo sapiens
ggcgugagcugugguuuug

SEQ ID NO: 277389 - RNA, 19 nt, Homo sapiens
agaucgagagccugaauga

SEQ ID NO: 277390 - RNA, 19 nt, Homo sapiens
augagaagaucaccaugca

SEQ ID NO: 277391 - RNA, 19 nt, Homo sapiens
ugguggcuuuguugacuuu

SEQ ID NO: 277392 - RNA, 19 nt, Homo sapiens
ugaacaaggaggugucuac

SEQ ID NO: 277393 - RNA, 19 nt, Homo sapiens
ccuacuacaagaccauuga

SEQ ID NO: 277394 - RNA, 19 nt, Homo sapiens
ucacuggcaaugagaagau

SEQ ID NO: 277395 - RNA, 19 nt, Homo sapiens
caauacagcuucauuaucu

SEQ ID NO: 277396 - RNA, 19 nt, Homo sapiens
gcaccaaggucauggaugu

SEQ ID NO: 277397 - RNA, 19 nt, Homo sapiens
ggagaugaaugcccugaga

SEQ ID NO: 277398 - RNA, 19 nt, Homo sapiens
gaccugagccgcauucuga

SEQ ID NO: 277399 - RNA, 19 nt, Homo sapiens
gagcugaccuggagaugca

SEQ ID NO: 277400 - RNA, 19 nt, Homo sapiens
gagcuggccuaccugaaga

SEQ ID NO: 277401 - RNA, 19 nt, Homo sapiens
gcaaggaugccgaggaaug

SEQ ID NO: 277402 - RNA, 19 nt, Homo sapiens
cgagaugcgugaccaguau

SEQ ID NO: 277403 - RNA, 19 nt, Homo sapiens
cugcugagaucaaagacua

SEQ ID NO: 277404 - RNA, 19 nt, Homo sapiens
gaguugaaccugcgcauga

SEQ ID NO: 277405 - RNA, 19 nt, Homo sapiens
ugcagaaccuggagauuga

SEQ ID NO: 277406 - RNA, 19 nt, Homo sapiens
uggccuaccugaagaagaa

SEQ ID NO: 277407 - RNA, 19 nt, Homo sapiens
ccgcaaggaugccgaggaa

SEQ ID NO: 277408 - RNA, 19 nt, Homo sapiens
ccaauguccuucugcagau

SEQ ID NO: 277409 - RNA, 19 nt, Homo sapiens
gaaccaggaguacaagauc

SEQ ID NO: 277410 - RNA, 19 nt, Homo sapiens
ggguggagaugucaaugug

SEQ ID NO: 277411 - RNA, 19 nt, Homo sapiens
gcaccaaguaugagacaga

SEQ ID NO: 277412 - RNA, 19 nt, Homo sapiens
ggucauggaugugcacgau

SEQ ID NO: 277413 - RNA, 19 nt, Homo sapiens
gcagggugcuggacgaacu

SEQ ID NO: 277414 - RNA, 19 nt, Homo sapiens
gugagaaggugaccaugca

SEQ ID NO: 277415 - RNA, 19 nt, Homo sapiens
ccaaguaugagacagaguu

SEQ ID NO: 277416 - RNA, 19 nt, Homo sapiens
uggcuugggugguggcuuu

SEQ ID NO: 277417 - RNA, 19 nt, Homo sapiens
gaagauggcagagaagaac

SEQ ID NO: 277418 - RNA, 19 nt, Homo sapiens
cagcuuugguaguggcuuu

SEQ ID NO: 277419 - RNA, 19 nt, Homo sapiens
gagaagauggcagagaaga

SEQ ID NO: 277420 - RNA, 19 nt, Homo sapiens
gaaagcaucccuggagaac

SEQ ID NO: 277421 - RNA, 19 nt, Homo sapiens
augagaagauggcagagaa

SEQ ID NO: 277422 - RNA, 19 nt, Homo sapiens
ggcaaucaauacagcuuca

SEQ ID NO: 277423 - RNA, 19 nt, Homo sapiens
ggagcuggccuaccugaag

SEQ ID NO: 277424 - RNA, 19 nt, Homo sapiens
ccagguggguggagauguc

SEQ ID NO: 277425 - RNA, 19 nt, Homo sapiens
uacagucccuacuucaaga

SEQ ID NO: 277426 - RNA, 19 nt, Homo sapiens
gaagugaagauccgugacu

SEQ ID NO: 277427 - RNA, 19 nt, Homo sapiens
gcagugagaaggugaccau

SEQ ID NO: 277428 - RNA, 19 nt, Homo sapiens
cagcuucauuaucugaguu

SEQ ID NO: 277429 - RNA, 19 nt, Homo sapiens
ccaugcagaaccucaauga

SEQ ID NO: 277430 - RNA, 19 nt, Homo sapiens
caaucaauacagcuucauu

SEQ ID NO: 277431 - RNA, 19 nt, Homo sapiens
agcaggagaucgccaccua

SEQ ID NO: 277432 - RNA, 19 nt, Homo sapiens
aagcaucccuggagaacag

SEQ ID NO: 277433 - RNA, 19 nt, Homo sapiens
gccgaggaaugguucuuca

SEQ ID NO: 277434 - RNA, 19 nt, Homo sapiens
caauguccuucugcagauu

SEQ ID NO: 277435 - RNA, 19 nt, Homo sapiens
gaccugaggaacaagauuc

SEQ ID NO: 277436 - RNA, 19 nt, Homo sapiens
ugaagauccgugacuggua

SEQ ID NO: 277437 - RNA, 19 nt, Homo sapiens
uggcuuuggugguggcuuu

SEQ ID NO: 277438 - RNA, 19 nt, Homo sapiens
ucaauacagcuucauuauc

SEQ ID NO: 277439 - RNA, 19 nt, Homo sapiens
gcccagauccaggagauga

SEQ ID NO: 277440 - RNA, 19 nt, Homo sapiens
gaaccacgaggaggagaug

SEQ ID NO: 277441 - RNA, 19 nt, Homo sapiens
gaucgcagucauccagaga

SEQ ID NO: 277442 - RNA, 19 nt, Homo sapiens
ugaaagcaucccuggagaa

SEQ ID NO: 277443 - RNA, 19 nt, Homo sapiens
uguggaagccgacaucaau

SEQ ID NO: 277444 - RNA, 19 nt, Homo sapiens
ggaccugaggaacaagauu

SEQ ID NO: 277445 - RNA, 19 nt, Homo sapiens
ccaaaggucgcuacugcau

SEQ ID NO: 277446 - RNA, 19 nt, Homo sapiens
ugaccaguaugagaagaug

SEQ ID NO: 277447 - RNA, 19 nt, Homo sapiens
gaccuggagaugcagauug

SEQ ID NO: 277448 - RNA, 19 nt, Homo sapiens
uugaggaccugaggaacaa

SEQ ID NO: 277449 - RNA, 19 nt, Homo sapiens
ccauugaggaccugaggaa

SEQ ID NO: 277450 - RNA, 19 nt, Homo sapiens
cagcagcagcagcagcuuu

SEQ ID NO: 277451 - RNA, 19 nt, Homo sapiens
caaguaugagacagaguug

SEQ ID NO: 277452 - RNA, 19 nt, Homo sapiens
ucccuccucugcaccauga

SEQ ID NO: 277453 - RNA, 19 nt, Homo sapiens
acgccgaccuggaagugaa

SEQ ID NO: 277454 - RNA, 19 nt, Homo sapiens
accuggagaugcagauuga

SEQ ID NO: 277455 - RNA, 19 nt, Homo sapiens
cuacagucccuacuucaag

SEQ ID NO: 277456 - RNA, 19 nt, Homo sapiens
caaggaugccgaggaaugg

SEQ ID NO: 277457 - RNA, 19 nt, Homo sapiens
agaaggugaccaugcagaa

SEQ ID NO: 277458 - RNA, 19 nt, Homo sapiens
caaugccaauguccuucug

SEQ ID NO: 277459 - RNA, 19 nt, Homo sapiens
ccagauccaggagaugauu

SEQ ID NO: 277460 - RNA, 19 nt, Homo sapiens
cagcucagcaugaaagcau

SEQ ID NO: 277461 - RNA, 19 nt, Homo sapiens
cagagaagaaccgcaagga

SEQ ID NO: 277462 - RNA, 19 nt, Homo sapiens
caacgccgaccuggaagug

SEQ ID NO: 277463 - RNA, 19 nt, Homo sapiens
agaagauggcagagaagaa

SEQ ID NO: 277464 - RNA, 19 nt, Homo sapiens
aguaugagacagaguugaa

SEQ ID NO: 277465 - RNA, 19 nt, Homo sapiens
gaggaccugaggaacaaga

SEQ ID NO: 277466 - RNA, 19 nt, Homo sapiens
aggaggagcuggccuaccu

SEQ ID NO: 277467 - RNA, 19 nt, Homo sapiens
gcggccugcugagaucaaa

SEQ ID NO: 277468 - RNA, 19 nt, Homo sapiens
gcaaggagaugcagcugua

SEQ ID NO: 277469 - RNA, 19 nt, Homo sapiens
ggacugaccuggagaugca

SEQ ID NO: 277470 - RNA, 19 nt, Homo sapiens
ccacauuucugcaaacuuc

SEQ ID NO: 277471 - RNA, 19 nt, Homo sapiens
cugaggagcugaacaaaga

SEQ ID NO: 277472 - RNA, 19 nt, Homo sapiens
uagccuaccugaagaagaa

SEQ ID NO: 277473 - RNA, 19 nt, Homo sapiens
gagcuagccuaccugaaga

SEQ ID NO: 277474 - RNA, 19 nt, Homo sapiens
agcaggagaucgcuacuua

SEQ ID NO: 277475 - RNA, 19 nt, Homo sapiens
gccagcaucucuuggguuu

SEQ ID NO: 277476 - RNA, 19 nt, Homo sapiens
ccacaagagagaaaucuaa

SEQ ID NO: 277477 - RNA, 19 nt, Homo sapiens
aagaggagaugaaggaguu

SEQ ID NO: 277478 - RNA, 19 nt, Homo sapiens
ggagguggaagccgaagua

SEQ ID NO: 277479 - RNA, 19 nt, Homo sapiens
gcagcuguauuguguaaca

SEQ ID NO: 277480 - RNA, 19 nt, Homo sapiens
gaaaucuaagugucuauug

SEQ ID NO: 277481 - RNA, 19 nt, Homo sapiens
ggagaucacagaccugaga

SEQ ID NO: 277482 - RNA, 19 nt, Homo sapiens
gaagagcuccgggacaaga

SEQ ID NO: 277483 - RNA, 19 nt, Homo sapiens
caagagagaaaucuaagug

SEQ ID NO: 277484 - RNA, 19 nt, Homo sapiens
gaaccaggaguacaagaug

SEQ ID NO: 277485 - RNA, 19 nt, Homo sapiens
gcagcaauuuccacaucaa

SEQ ID NO: 277486 - RNA, 19 nt, Homo sapiens
ggugguagcagcagcaauu

SEQ ID NO: 277487 - RNA, 19 nt, Homo sapiens
gcaagacggagaucacaga

SEQ ID NO: 277488 - RNA, 19 nt, Homo sapiens
gaagaagaaccacgaagag

SEQ ID NO: 277489 - RNA, 19 nt, Homo sapiens
ggagcuagccuaccugaag

SEQ ID NO: 277490 - RNA, 19 nt, Homo sapiens
cagcagcaauuuccacauc

SEQ ID NO: 277491 - RNA, 19 nt, Homo sapiens
gguggaagccgaaguaucu

SEQ ID NO: 277492 - RNA, 19 nt, Homo sapiens
agagaaaucuaagugucua

SEQ ID NO: 277493 - RNA, 19 nt, Homo sapiens
agaugcagcuguauugugu

SEQ ID NO: 277494 - RNA, 19 nt, Homo sapiens
ugaagaagaaccacgaaga

SEQ ID NO: 277495 - RNA, 19 nt, Homo sapiens
ggccaugaccaccacauuu

SEQ ID NO: 277496 - RNA, 19 nt, Homo sapiens
gggccaggaugccaagaug

SEQ ID NO: 277497 - RNA, 19 nt, Homo sapiens
gcagaucgagggccugaau

SEQ ID NO: 277498 - RNA, 19 nt, Homo sapiens
gaaugcgacuacagccaau

SEQ ID NO: 277499 - RNA, 19 nt, Homo sapiens
gagacagagugccgcuaug

SEQ ID NO: 277500 - RNA, 19 nt, Homo sapiens
gccaauacuucaagaccau

SEQ ID NO: 277501 - RNA, 19 nt, Homo sapiens
gagagaaaucuaagugucu

SEQ ID NO: 277502 - RNA, 19 nt, Homo sapiens
cgacuacagccaauacuuc

SEQ ID NO: 277503 - RNA, 19 nt, Homo sapiens
gagaugcagcuguauugug

SEQ ID NO: 277504 - RNA, 19 nt, Homo sapiens
agaugcugcuugacauaaa

SEQ ID NO: 277505 - RNA, 19 nt, Homo sapiens
uugaagagcuccgggacaa

SEQ ID NO: 277506 - RNA, 19 nt, Homo sapiens
agacugaggagcugaacaa

SEQ ID NO: 277507 - RNA, 19 nt, Homo sapiens
gcaagacugaggagcugaa

SEQ ID NO: 277508 - RNA, 19 nt, Homo sapiens
ugaagauccaugacuggua

SEQ ID NO: 277509 - RNA, 19 nt, Homo sapiens
ggucuccucucuggcaaug

SEQ ID NO: 277510 - RNA, 19 nt, Homo sapiens
gaugcugcuugacauaaag

SEQ ID NO: 277511 - RNA, 19 nt, Homo sapiens
aagcugggcuggagaacuc

SEQ ID NO: 277512 - RNA, 19 nt, Homo sapiens
gaaccacgaagaggagaug

SEQ ID NO: 277513 - RNA, 19 nt, Homo sapiens
ccaugcagaaccucaauga

SEQ ID NO: 277514 - RNA, 19 nt, Homo sapiens
augcagcuguauuguguaa

SEQ ID NO: 277515 - RNA, 19 nt, Homo sapiens
gccaugaccaccacauuuc

SEQ ID NO: 277516 - RNA, 19 nt, Homo sapiens
ugcaggagcuggagaucga

SEQ ID NO: 277517 - RNA, 19 nt, Homo sapiens
cagcaucucuuggguuugc

SEQ ID NO: 277518 - RNA, 19 nt, Homo sapiens
ccaggucaauguggagaug

SEQ ID NO: 277519 - RNA, 19 nt, Homo sapiens
caugagggucuguggcuuu

SEQ ID NO: 277520 - RNA, 19 nt, Homo sapiens
gcucauuuguacagugucu

SEQ ID NO: 277521 - RNA, 19 nt, Homo sapiens
gagggucuguggcuuuggu

SEQ ID NO: 277522 - RNA, 19 nt, Homo sapiens
cgagacagagugccgcuau

SEQ ID NO: 277523 - RNA, 19 nt, Homo sapiens
gaacucacuggccgagaca

SEQ ID NO: 277524 - RNA, 19 nt, Homo sapiens
gucgaggccugguucuuca

SEQ ID NO: 277525 - RNA, 19 nt, Homo sapiens
ugaaagcugggcuggagaa

SEQ ID NO: 277526 - RNA, 19 nt, Homo sapiens
agugucuguucauguaaua

SEQ ID NO: 277527 - RNA, 19 nt, Homo sapiens
aagcucauuuguacagugu

SEQ ID NO: 277528 - RNA, 19 nt, Homo sapiens
uccagucccugccuucaga

SEQ ID NO: 277529 - RNA, 19 nt, Homo sapiens
gggccugaaugaggagcua

SEQ ID NO: 277530 - RNA, 19 nt, Homo sapiens
gacuacagccaauacuuca

SEQ ID NO: 277531 - RNA, 19 nt, Homo sapiens
cugcuagguuugucucuuc

SEQ ID NO: 277532 - RNA, 19 nt, Homo sapiens
ggagaugcagcuguauugu

SEQ ID NO: 277533 - RNA, 19 nt, Homo sapiens
gaccaccacauuucugcaa

SEQ ID NO: 277534 - RNA, 19 nt, Homo sapiens
cgacaacucccgggucauc

SEQ ID NO: 277535 - RNA, 19 nt, Homo sapiens
ccaccaccaucgacaacuc

SEQ ID NO: 277536 - RNA, 19 nt, Homo sapiens
aaaucuaagugucuauugc

SEQ ID NO: 277537 - RNA, 19 nt, Homo sapiens
acgaagaggagaugaagga

SEQ ID NO: 277538 - RNA, 19 nt, Homo sapiens
gcgacuacagccaauacuu

SEQ ID NO: 277539 - RNA, 19 nt, Homo sapiens
gggcuuugcaugcgcucua

SEQ ID NO: 277540 - RNA, 19 nt, Homo sapiens
cagagaugagggagcagua

SEQ ID NO: 277541 - RNA, 19 nt, Homo sapiens
cagugucuguucauguaau

SEQ ID NO: 277542 - RNA, 19 nt, Homo sapiens
gucccucggucuuuuauuu

SEQ ID NO: 277543 - RNA, 19 nt, Homo sapiens
auggacaggugguuucuuc

SEQ ID NO: 277544 - RNA, 19 nt, Homo sapiens
gagcaggagaucgcuacuu

SEQ ID NO: 277545 - RNA, 19 nt, Homo sapiens
gagaaaucuaagugucuau

SEQ ID NO: 277546 - RNA, 19 nt, Homo sapiens
gcucagaaccaggaguaca

SEQ ID NO: 277547 - RNA, 19 nt, Homo sapiens
ccacgaagaggagaugaag

SEQ ID NO: 277548 - RNA, 19 nt, Homo sapiens
aagaugcugcuugacauaa

SEQ ID NO: 277549 - RNA, 19 nt, Homo sapiens
ccaccacauuucugcaaac

SEQ ID NO: 277550 - RNA, 19 nt, Homo sapiens
ccagugagaucaaagacua

SEQ ID NO: 277551 - RNA, 19 nt, Homo sapiens
ccgaggagcugaacaaaga

SEQ ID NO: 277552 - RNA, 19 nt, Homo sapiens
ggacugaccuggagaugca

SEQ ID NO: 277553 - RNA, 19 nt, Homo sapiens
ggagaugcuugcucugaga

SEQ ID NO: 277554 - RNA, 19 nt, Homo sapiens
gcaagcaucuggccaaucc

SEQ ID NO: 277555 - RNA, 19 nt, Homo sapiens
gcaugcagcugucccagau

SEQ ID NO: 277556 - RNA, 19 nt, Homo sapiens
ggccagagcuccuagaacu

SEQ ID NO: 277557 - RNA, 19 nt, Homo sapiens
acaaagaaguggccuccaa

SEQ ID NO: 277558 - RNA, 19 nt, Homo sapiens
gaucauugcggccaccauu

SEQ ID NO: 277559 - RNA, 19 nt, Homo sapiens
gaccaaguaugagcacgaa

SEQ ID NO: 277560 - RNA, 19 nt, Homo sapiens
gaggagaugcuugcucuga

SEQ ID NO: 277561 - RNA, 19 nt, Homo sapiens
gagcaccuuuccuucuuuc

SEQ ID NO: 277562 - RNA, 19 nt, Homo sapiens
gugagaaggugaccaugca

SEQ ID NO: 277563 - RNA, 19 nt, Homo sapiens
uggcuugggugcuggcuuu

SEQ ID NO: 277564 - RNA, 19 nt, Homo sapiens
ccagagcuccuagaacuga

SEQ ID NO: 277565 - RNA, 19 nt, Homo sapiens
aagcugacuuucugguuga

SEQ ID NO: 277566 - RNA, 19 nt, Homo sapiens
ugagcaccuuuccuucuuu

SEQ ID NO: 277567 - RNA, 19 nt, Homo sapiens
gaaagcaucccuggagaac

SEQ ID NO: 277568 - RNA, 19 nt, Homo sapiens
ugagaugcgugaccaguac

SEQ ID NO: 277569 - RNA, 19 nt, Homo sapiens
gcagaucgaaggccugaag

SEQ ID NO: 277570 - RNA, 19 nt, Homo sapiens
gcugguggugggcuaauaa

SEQ ID NO: 277571 - RNA, 19 nt, Homo sapiens
agcaggagauugccaccua

SEQ ID NO: 277572 - RNA, 19 nt, Homo sapiens
ucgaggaccugaggaacaa

SEQ ID NO: 277573 - RNA, 19 nt, Homo sapiens
uacagucccuacuucaaga

SEQ ID NO: 277574 - RNA, 19 nt, Homo sapiens
gaagugaagauccgugacu

SEQ ID NO: 277575 - RNA, 19 nt, Homo sapiens
gcagugagaaggugaccau

SEQ ID NO: 277576 - RNA, 19 nt, Homo sapiens
gcaucuggccaauccuauu

SEQ ID NO: 277577 - RNA, 19 nt, Homo sapiens
ccaugcagaaccucaauga

SEQ ID NO: 277578 - RNA, 19 nt, Homo sapiens
ccagauccagggacugauu

SEQ ID NO: 277579 - RNA, 19 nt, Homo sapiens
aagcaucccuggagaacag

SEQ ID NO: 277580 - RNA, 19 nt, Homo sapiens
acgagcagauggcagagaa

SEQ ID NO: 277581 - RNA, 19 nt, Homo sapiens
ugagccgcauccugaauga

SEQ ID NO: 277582 - RNA, 19 nt, Homo sapiens
uggccuaccugaggaagaa

SEQ ID NO: 277583 - RNA, 19 nt, Homo sapiens
ugaagauccgugacuggua

SEQ ID NO: 277584 - RNA, 19 nt, Homo sapiens
gcaagaccgaggagcugaa

SEQ ID NO: 277585 - RNA, 19 nt, Homo sapiens
gaaccacgaggaggagaug

SEQ ID NO: 277586 - RNA, 19 nt, Homo sapiens
gaccugaggaacaagauca

SEQ ID NO: 277587 - RNA, 19 nt, Homo sapiens
ugaaagcaucccuggagaa

SEQ ID NO: 277588 - RNA, 19 nt, Homo sapiens
cugagcaccuuuccuucuu

SEQ ID NO: 277589 - RNA, 19 nt, Homo sapiens
gcgaggaugcccaccuuuc

SEQ ID NO: 277590 - RNA, 19 nt, Homo sapiens
cagcaagcaucuggccaau

SEQ ID NO: 277591 - RNA, 19 nt, Homo sapiens
cagcagcagcagcagcuuu

SEQ ID NO: 277592 - RNA, 19 nt, Homo sapiens
guggugggcuaauaaagcu

SEQ ID NO: 277593 - RNA, 19 nt, Homo sapiens
caucuggccaauccuauuc

SEQ ID NO: 277594 - RNA, 19 nt, Homo sapiens
ccaaaggccgcuacugcau

SEQ ID NO: 277595 - RNA, 19 nt, Homo sapiens
ucauugcggccaccauuga

SEQ ID NO: 277596 - RNA, 19 nt, Homo sapiens
ggagcugaacaaagaagug

SEQ ID NO: 277597 - RNA, 19 nt, Homo sapiens
agaccugguuccugagcaa

SEQ ID NO: 277598 - RNA, 19 nt, Homo sapiens
acgccgaccuggaagugaa

SEQ ID NO: 277599 - RNA, 19 nt, Homo sapiens
gaccgaggagcugaacaaa

SEQ ID NO: 277600 - RNA, 19 nt, Homo sapiens
cuacagucccuacuucaag

SEQ ID NO: 277601 - RNA, 19 nt, Homo sapiens
uggcgcaguucccagcuau

SEQ ID NO: 277602 - RNA, 19 nt, Homo sapiens
agaaggugaccaugcagaa

SEQ ID NO: 277603 - RNA, 19 nt, Homo sapiens
gggcuaauaaagcugacuu

SEQ ID NO: 277604 - RNA, 19 nt, Homo sapiens
cagcucagcaugaaagcau

SEQ ID NO: 277605 - RNA, 19 nt, Homo sapiens
agaccgaggagcugaacaa

SEQ ID NO: 277606 - RNA, 19 nt, Homo sapiens
gaggaccugaggaacaaga

SEQ ID NO: 277607 - RNA, 19 nt, Homo sapiens
caacgccgaccuggaagug

SEQ ID NO: 277608 - RNA, 19 nt, Homo sapiens
agaucuugcuggaugugaa

SEQ ID NO: 277609 - RNA, 19 nt, Homo sapiens
gagccaggaguaccagauc

SEQ ID NO: 277610 - RNA, 19 nt, Homo sapiens
gagaugugaacguggagau

SEQ ID NO: 277611 - RNA, 19 nt, Homo sapiens
aggaggagcuggccuaccu

SEQ ID NO: 277612 - RNA, 19 nt, Homo sapiens
cugaggaacaagaucauug

SEQ ID NO: 277613 - RNA, 19 nt, Homo sapiens
gcaccaaguuugagacaga

SEQ ID NO: 277614 - RNA, 19 nt, Homo sapiens
acacugagcuggaggugaa

SEQ ID NO: 277615 - RNA, 19 nt, Homo sapiens
gcaaggaugccgaggauug

SEQ ID NO: 277616 - RNA, 19 nt, Homo sapiens
gagcuggccuaccugaaga

SEQ ID NO: 277617 - RNA, 19 nt, Homo sapiens
cgagaugcgugaccaguau

SEQ ID NO: 277618 - RNA, 19 nt, Homo sapiens
gcagaaccaggaauacaaa

SEQ ID NO: 277619 - RNA, 19 nt, Homo sapiens
uugaggagcugcagaacaa

SEQ ID NO: 277620 - RNA, 19 nt, Homo sapiens
uggccuaccugaagaagaa

SEQ ID NO: 277621 - RNA, 19 nt, Homo sapiens
gagccgaccuggagaugca

SEQ ID NO: 277622 - RNA, 19 nt, Homo sapiens
caacauccugcuacagauu

SEQ ID NO: 277623 - RNA, 19 nt, Homo sapiens
ccagguggguggugagauc

SEQ ID NO: 277624 - RNA, 19 nt, Homo sapiens
gccaacauccugcuacaga

SEQ ID NO: 277625 - RNA, 19 nt, Homo sapiens
aauaaagcuuguugacuca

SEQ ID NO: 277626 - RNA, 19 nt, Homo sapiens
gaagauggcagagaagaac

SEQ ID NO: 277627 - RNA, 19 nt, Homo sapiens
gagaagauggcagagaaga

SEQ ID NO: 277628 - RNA, 19 nt, Homo sapiens
ugagaucaauguggagaug

SEQ ID NO: 277629 - RNA, 19 nt, Homo sapiens
caauugaggagcugcagaa

SEQ ID NO: 277630 - RNA, 19 nt, Homo sapiens
gcaagacagaggaacugaa

SEQ ID NO: 277631 - RNA, 19 nt, Homo sapiens
augagaagauggcagagaa

SEQ ID NO: 277632 - RNA, 19 nt, Homo sapiens
gcgugcagcugucccagau

SEQ ID NO: 277633 - RNA, 19 nt, Homo sapiens
ccgcaaggaugccgaggau

SEQ ID NO: 277634 - RNA, 19 nt, Homo sapiens
agcaggagauugccaccua

SEQ ID NO: 277635 - RNA, 19 nt, Homo sapiens
ggagcuggccuaccugaag

SEQ ID NO: 277636 - RNA, 19 nt, Homo sapiens
ccaacauccugcuacagau

SEQ ID NO: 277637 - RNA, 19 nt, Homo sapiens
ugacucaguacaagaaaga

SEQ ID NO: 277638 - RNA, 19 nt, Homo sapiens
uggaggaggccaacacuga

SEQ ID NO: 277639 - RNA, 19 nt, Homo sapiens
ccaugcagaaccucaauga

SEQ ID NO: 277640 - RNA, 19 nt, Homo sapiens
ugaagauccgugacuggua

SEQ ID NO: 277641 - RNA, 19 nt, Homo sapiens
gaaccacgaggaggagaug

SEQ ID NO: 277642 - RNA, 19 nt, Homo sapiens
gaggagcugcagaacaaga

SEQ ID NO: 277643 - RNA, 19 nt, Homo sapiens
caugcaggccuuggagaua

SEQ ID NO: 277644 - RNA, 19 nt, Homo sapiens
caagacagaggaacugaac

SEQ ID NO: 277645 - RNA, 19 nt, Homo sapiens
cgucaggugcguaccauug

SEQ ID NO: 277646 - RNA, 19 nt, Homo sapiens
ugaccaguaugagaagaug

SEQ ID NO: 277647 - RNA, 19 nt, Homo sapiens
gaccuggagaugcagauug

SEQ ID NO: 277648 - RNA, 19 nt, Homo sapiens
gcaccaugcaggccuugga

SEQ ID NO: 277649 - RNA, 19 nt, Homo sapiens
cagaguggcaagagugaga

SEQ ID NO: 277650 - RNA, 19 nt, Homo sapiens
gcagaacaagauccucaca

SEQ ID NO: 277651 - RNA, 19 nt, Homo sapiens
gaaccaggaauacaaaauc

SEQ ID NO: 277652 - RNA, 19 nt, Homo sapiens
gugacuacagccaguacua

SEQ ID NO: 277653 - RNA, 19 nt, Homo sapiens
caugcuuccuugccugaug

SEQ ID NO: 277654 - RNA, 19 nt, Homo sapiens
cagcagaaccaggaauaca

SEQ ID NO: 277655 - RNA, 19 nt, Homo sapiens
gccgaggauugguucuuca

SEQ ID NO: 277656 - RNA, 19 nt, Homo sapiens
ccaccuccauccgccaguu

SEQ ID NO: 277657 - RNA, 19 nt, Homo sapiens
accuggagaugcagauuga

SEQ ID NO: 277658 - RNA, 19 nt, Homo sapiens
agaaggccaccaugcagaa

SEQ ID NO: 277659 - RNA, 19 nt, Homo sapiens
aggauugguucuucagcaa

SEQ ID NO: 277660 - RNA, 19 nt, Homo sapiens
agaucaauguggagaugga

SEQ ID NO: 277661 - RNA, 19 nt, Homo sapiens
ucaggugcguaccauugug

SEQ ID NO: 277662 - RNA, 19 nt, Homo sapiens
gcaaccuggcggagacaga

SEQ ID NO: 277663 - RNA, 19 nt, Homo sapiens
cagcucagcaugaaagcau

SEQ ID NO: 277664 - RNA, 19 nt, Homo sapiens
cagagaagaaccgcaagga

SEQ ID NO: 277665 - RNA, 19 nt, Homo sapiens
agaagauggcagagaagaa

SEQ ID NO: 277666 - RNA, 19 nt, Homo sapiens
gguggguggugagaucaau

SEQ ID NO: 277667 - RNA, 19 nt, Homo sapiens
gugagaaggccaccaugca

SEQ ID NO: 277668 - RNA, 19 nt, Homo sapiens
uuccuugccugaugacaau

SEQ ID NO: 277669 - RNA, 19 nt, Homo sapiens
aggaggagcuggccuaccu

SEQ ID NO: 277670 - RNA, 19 nt, Homo sapiens
cguggacaaugccaacauc

SEQ ID NO: 277671 - RNA, 19 nt, Homo sapiens
gagaggagcuagacaagua

SEQ ID NO: 277672 - RNA, 19 nt, Homo sapiens
gcucagaucuucgcaaaua

SEQ ID NO: 277673 - RNA, 19 nt, Homo sapiens
gauaguggauggcaaagug

SEQ ID NO: 277674 - RNA, 19 nt, Homo sapiens
gaagauggcgaggacuuua

SEQ ID NO: 277675 - RNA, 19 nt, Homo sapiens
guacuggucucagcagauu

SEQ ID NO: 277676 - RNA, 19 nt, Homo sapiens
gaagaaccacgaagaggaa

SEQ ID NO: 277677 - RNA, 19 nt, Homo sapiens
gggcucagaucuucgcaaa

SEQ ID NO: 277678 - RNA, 19 nt, Homo sapiens
caaauacuguggacaaugc

SEQ ID NO: 277679 - RNA, 19 nt, Homo sapiens
gaaccacgaagaggaagua

SEQ ID NO: 277680 - RNA, 19 nt, Homo sapiens
gaagaagaaccacgaagag

SEQ ID NO: 277681 - RNA, 19 nt, Homo sapiens
gcaucguucugcagauuga

SEQ ID NO: 277682 - RNA, 19 nt, Homo sapiens
gggagcaggaggccaauaa

SEQ ID NO: 277683 - RNA, 19 nt, Homo sapiens
gacugcagcuggagacaga

SEQ ID NO: 277684 - RNA, 19 nt, Homo sapiens
gggagcacuuggagaagaa

SEQ ID NO: 277685 - RNA, 19 nt, Homo sapiens
ggaagauggcgaggacuuu

SEQ ID NO: 277686 - RNA, 19 nt, Homo sapiens
gcaacuccaugcaaaccau

SEQ ID NO: 277687 - RNA, 19 nt, Homo sapiens
ugaagaagaaccacgaaga

SEQ ID NO: 277688 - RNA, 19 nt, Homo sapiens
ugagaccaaugacaccaaa

SEQ ID NO: 277689 - RNA, 19 nt, Homo sapiens
aggcugagaucgccaccua

SEQ ID NO: 277690 - RNA, 19 nt, Homo sapiens
gcaaauacuguggacaaug

SEQ ID NO: 277691 - RNA, 19 nt, Homo sapiens
gagaaggagaccaugcaaa

SEQ ID NO: 277692 - RNA, 19 nt, Homo sapiens
gucagagacuggagccauu

SEQ ID NO: 277693 - RNA, 19 nt, Homo sapiens
ggagcaggaggccaauaaa

SEQ ID NO: 277694 - RNA, 19 nt, Homo sapiens
gaagaaccgagaggagcua

SEQ ID NO: 277695 - RNA, 19 nt, Homo sapiens
gaccaaugacaccaaaguu

SEQ ID NO: 277696 - RNA, 19 nt, Homo sapiens
ggauccugcugcaccuuga

SEQ ID NO: 277697 - RNA, 19 nt, Homo sapiens
ccgcaucguucugcagauu

SEQ ID NO: 277698 - RNA, 19 nt, Homo sapiens
cacacagucugcugagguu

SEQ ID NO: 277699 - RNA, 19 nt, Homo sapiens
ccacgaagaggaaguaaaa

SEQ ID NO: 277700 - RNA, 19 nt, Homo sapiens
gacguacaguccaguccuu

SEQ ID NO: 277701 - RNA, 19 nt, Homo sapiens
ucagagacuggagccauua

SEQ ID NO: 277702 - RNA, 19 nt, Homo sapiens
agaaggagaccaugcaaag

SEQ ID NO: 277703 - RNA, 19 nt, Homo sapiens
gcuacgcccuacagaugga

SEQ ID NO: 277704 - RNA, 19 nt, Homo sapiens
ggaccucgccaagaucaug

SEQ ID NO: 277705 - RNA, 19 nt, Homo sapiens
gaaugggaggcauccagaa

SEQ ID NO: 277706 - RNA, 19 nt, Homo sapiens
gccauuacuucaagaucau

SEQ ID NO: 277707 - RNA, 19 nt, Homo sapiens
gagacuggagccauuacuu

SEQ ID NO: 277708 - RNA, 19 nt, Homo sapiens
gccaggcccaggaguauga

SEQ ID NO: 277709 - RNA, 19 nt, Homo sapiens
gaaaucugaaggccagcuu

SEQ ID NO: 277710 - RNA, 19 nt, Homo sapiens
gccagucuguggagaacga

SEQ ID NO: 277711 - RNA, 19 nt, Homo sapiens
acgaccgccuggccucuua

SEQ ID NO: 277712 - RNA, 19 nt, Homo sapiens
ccgcuacgcccuacagaug

SEQ ID NO: 277713 - RNA, 19 nt, Homo sapiens
cgggagcacuuggagaaga

SEQ ID NO: 277714 - RNA, 19 nt, Homo sapiens
cucaggaccucgccaagau

SEQ ID NO: 277715 - RNA, 19 nt, Homo sapiens
agcagcaacuccaugcaaa

SEQ ID NO: 277716 - RNA, 19 nt, Homo sapiens
ccaagaucauggcagacau

SEQ ID NO: 277717 - RNA, 19 nt, Homo sapiens
ucuugcugcugaugacuuu

SEQ ID NO: 277718 - RNA, 19 nt, Homo sapiens
ucgcaaauacuguggacaa

SEQ ID NO: 277719 - RNA, 19 nt, Homo sapiens
agccauuacuucaagauca

SEQ ID NO: 277720 - RNA, 19 nt, Homo sapiens
cagcagcaacuccaugcaa

SEQ ID NO: 277721 - RNA, 19 nt, Homo sapiens
ggaaguaaaaggccuacaa

SEQ ID NO: 277722 - RNA, 19 nt, Homo sapiens
gacuggagccauuacuuca

SEQ ID NO: 277723 - RNA, 19 nt, Homo sapiens
gagcaggaggccaauaaaa

SEQ ID NO: 277724 - RNA, 19 nt, Homo sapiens
gaaccgagaggagcuagac

SEQ ID NO: 277725 - RNA, 19 nt, Homo sapiens
agacuggagccauuacuuc

SEQ ID NO: 277726 - RNA, 19 nt, Homo sapiens
gguugaccguggagguaga

SEQ ID NO: 277727 - RNA, 19 nt, Homo sapiens
gcuccaccuucuccaccaa

SEQ ID NO: 277728 - RNA, 19 nt, Homo sapiens
ggcaaaguggugucugaga

SEQ ID NO: 277729 - RNA, 19 nt, Homo sapiens
gcauccagaacgagaagga

SEQ ID NO: 277730 - RNA, 19 nt, Homo sapiens
aagauggcgaggacuuuaa

SEQ ID NO: 277731 - RNA, 19 nt, Homo sapiens
ccugaguccuguccuuucu

SEQ ID NO: 277732 - RNA, 19 nt, Homo sapiens
caagaucauggcagacauc

SEQ ID NO: 277733 - RNA, 19 nt, Homo sapiens
uaugaggcccugcugaaca

SEQ ID NO: 277734 - RNA, 19 nt, Homo sapiens
ugaaggccagcuuggagaa

SEQ ID NO: 277735 - RNA, 19 nt, Homo sapiens
cgcaaauacuguggacaau

SEQ ID NO: 277736 - RNA, 19 nt, Homo sapiens
gaagaucacuacaacaauu

SEQ ID NO: 277737 - RNA, 19 nt, Homo sapiens
caugaaagcugccuuggaa

SEQ ID NO: 277738 - RNA, 19 nt, Homo sapiens
gaagaaccaugaggaggaa

SEQ ID NO: 277739 - RNA, 19 nt, Homo sapiens
gagcccagcuggcgcauau

SEQ ID NO: 277740 - RNA, 19 nt, Homo sapiens
gcagaugacuuccgaacca

SEQ ID NO: 277741 - RNA, 19 nt, Homo sapiens
gaacaggcucugcgcauga

SEQ ID NO: 277742 - RNA, 19 nt, Homo sapiens
ggaccgaccuggagaugca

SEQ ID NO: 277743 - RNA, 19 nt, Homo sapiens
cagccggacugaagaauug

SEQ ID NO: 277744 - RNA, 19 nt, Homo sapiens
gagcuggccuaccugaaga

SEQ ID NO: 277745 - RNA, 19 nt, Homo sapiens
gaagacacacuggcagaaa

SEQ ID NO: 277746 - RNA, 19 nt, Homo sapiens
uggccuaccugaagaagaa

SEQ ID NO: 277747 - RNA, 19 nt, Homo sapiens
ucgaaggccugaaggaaga

SEQ ID NO: 277748 - RNA, 19 nt, Homo sapiens
agauugagcugcagucaca

SEQ ID NO: 277749 - RNA, 19 nt, Homo sapiens
ucgccaagauccugaguga

SEQ ID NO: 277750 - RNA, 19 nt, Homo sapiens
gaucgaaggccugaaggaa

SEQ ID NO: 277751 - RNA, 19 nt, Homo sapiens
auugagaacuccaggauug

SEQ ID NO: 277752 - RNA, 19 nt, Homo sapiens
ggaagaucacuacaacaau

SEQ ID NO: 277753 - RNA, 19 nt, Homo sapiens
gccaagauccugagugaca

SEQ ID NO: 277754 - RNA, 19 nt, Homo sapiens
acaggaagaucacuacaac

SEQ ID NO: 277755 - RNA, 19 nt, Homo sapiens
ugaaagcugccuuggaaga

SEQ ID NO: 277756 - RNA, 19 nt, Homo sapiens
agucacagcugagcaugaa

SEQ ID NO: 277757 - RNA, 19 nt, Homo sapiens
ggaagacacacuggcagaa

SEQ ID NO: 277758 - RNA, 19 nt, Homo sapiens
gcagguccgagguuacuga

SEQ ID NO: 277759 - RNA, 19 nt, Homo sapiens
gacaggaagaucacuacaa

SEQ ID NO: 277760 - RNA, 19 nt, Homo sapiens
gcagaucgaaggccugaag

SEQ ID NO: 277761 - RNA, 19 nt, Homo sapiens
ggauuguccugcagaucga

SEQ ID NO: 277762 - RNA, 19 nt, Homo sapiens
gcaacgagaagcuaaccau

SEQ ID NO: 277763 - RNA, 19 nt, Homo sapiens
agcaggagauugccaccua

SEQ ID NO: 277764 - RNA, 19 nt, Homo sapiens
gcaugaaagcugccuugga

SEQ ID NO: 277765 - RNA, 19 nt, Homo sapiens
ggaccugcgggacaagauu

SEQ ID NO: 277766 - RNA, 19 nt, Homo sapiens
gaaccggaaggaugcugaa

SEQ ID NO: 277767 - RNA, 19 nt, Homo sapiens
gcgacuacagccacuacua

SEQ ID NO: 277768 - RNA, 19 nt, Homo sapiens
aggaagaucacuacaacaa

SEQ ID NO: 277769 - RNA, 19 nt, Homo sapiens
auagugagcggcagaauca

SEQ ID NO: 277770 - RNA, 19 nt, Homo sapiens
gauagugagcggcagaauc

SEQ ID NO: 277771 - RNA, 19 nt, Homo sapiens
uucagggucuugagauuga

SEQ ID NO: 277772 - RNA, 19 nt, Homo sapiens
gacaugcgaagccaauaug

SEQ ID NO: 277773 - RNA, 19 nt, Homo sapiens
ugacaugcgaagccaauau

SEQ ID NO: 277774 - RNA, 19 nt, Homo sapiens
aggaagagcuggccuaccu

SEQ ID NO: 277775 - RNA, 19 nt, Homo sapiens
acgagaagcuaaccaugca

SEQ ID NO: 277776 - RNA, 19 nt, Homo sapiens
ugaagauccgcgacuggua

SEQ ID NO: 277777 - RNA, 19 nt, Homo sapiens
gaugagcagguccgagguu

SEQ ID NO: 277778 - RNA, 19 nt, Homo sapiens
ggacaggaagaucacuaca

SEQ ID NO: 277779 - RNA, 19 nt, Homo sapiens
cagaugacuuccgaaccaa

SEQ ID NO: 277780 - RNA, 19 nt, Homo sapiens
ccuucagggucuugagauu

SEQ ID NO: 277781 - RNA, 19 nt, Homo sapiens
gaaagcugccuuggaagac

SEQ ID NO: 277782 - RNA, 19 nt, Homo sapiens
augagcagguccgagguua

SEQ ID NO: 277783 - RNA, 19 nt, Homo sapiens
cgacuacagccacuacuac

SEQ ID NO: 277784 - RNA, 19 nt, Homo sapiens
ccaagauccugagugacau

SEQ ID NO: 277785 - RNA, 19 nt, Homo sapiens
gaaccaugaggaggaaauc

SEQ ID NO: 277786 - RNA, 19 nt, Homo sapiens
caugaggaggaaaucagua

SEQ ID NO: 277787 - RNA, 19 nt, Homo sapiens
aaagcugccuuggaagaca

SEQ ID NO: 277788 - RNA, 19 nt, Homo sapiens
gaagcuaaccaugcagaac

SEQ ID NO: 277789 - RNA, 19 nt, Homo sapiens
ggucauggccgagcagaac

SEQ ID NO: 277790 - RNA, 19 nt, Homo sapiens
ggcgaugugcgagcugaua

SEQ ID NO: 277791 - RNA, 19 nt, Homo sapiens
gcgggcaacgagaagcuaa

SEQ ID NO: 277792 - RNA, 19 nt, Homo sapiens
gagcagguccgagguuacu

SEQ ID NO: 277793 - RNA, 19 nt, Homo sapiens
ccagccggacugaagaauu

SEQ ID NO: 277794 - RNA, 19 nt, Homo sapiens
ccaagaaacucacccaaag

SEQ ID NO: 277795 - RNA, 19 nt, Homo sapiens
gcagggaaguggagcaaug

SEQ ID NO: 277796 - RNA, 19 nt, Homo sapiens
cagagcagcugcaguccua

SEQ ID NO: 277797 - RNA, 19 nt, Homo sapiens
ccaguuaccaguccuauuu

SEQ ID NO: 277798 - RNA, 19 nt, Homo sapiens
gcacuaugcccuacaacuu

SEQ ID NO: 277799 - RNA, 19 nt, Homo sapiens
gaaggagacuaugcaguuc

SEQ ID NO: 277800 - RNA, 19 nt, Homo sapiens
gagcugagacgcacaguca

SEQ ID NO: 277801 - RNA, 19 nt, Homo sapiens
ccgaggagcugaacaagca

SEQ ID NO: 277802 - RNA, 19 nt, Homo sapiens
gagggcuccuucaauggua

SEQ ID NO: 277803 - RNA, 19 nt, Homo sapiens
uugaggagcuccagcagaa

SEQ ID NO: 277804 - RNA, 19 nt, Homo sapiens
gagcugacccugugcaagu

SEQ ID NO: 277805 - RNA, 19 nt, Homo sapiens
agaaggagacuaugcaguu

SEQ ID NO: 277806 - RNA, 19 nt, Homo sapiens
gccaagaaacucacccaaa

SEQ ID NO: 277807 - RNA, 19 nt, Homo sapiens
cagaagauccuguguacca

SEQ ID NO: 277808 - RNA, 19 nt, Homo sapiens
cagcagaagauccugugua

SEQ ID NO: 277809 - RNA, 19 nt, Homo sapiens
gaaaacacgcugacagaga

SEQ ID NO: 277810 - RNA, 19 nt, Homo sapiens
ugaaucgggugcugaacga

SEQ ID NO: 277811 - RNA, 19 nt, Homo sapiens
gaggagcuccagcagaaga

SEQ ID NO: 277812 - RNA, 19 nt, Homo sapiens
ggagagcgaggacugcaau

SEQ ID NO: 277813 - RNA, 19 nt, Homo sapiens
ccagugggccucccuuuua

SEQ ID NO: 277814 - RNA, 19 nt, Homo sapiens
guagcgagaaggagacuau

SEQ ID NO: 277815 - RNA, 19 nt, Homo sapiens
ugaccuggcucugguucaa

SEQ ID NO: 277816 - RNA, 19 nt, Homo sapiens
caagcuggcugcggaugau

SEQ ID NO: 277817 - RNA, 19 nt, Homo sapiens
ccagcacuaugcccuacaa

SEQ ID NO: 277818 - RNA, 19 nt, Homo sapiens
ugcgagggcuccuucaaug

SEQ ID NO: 277819 - RNA, 19 nt, Homo sapiens
gaaguggagcaaugguuca

SEQ ID NO: 277820 - RNA, 19 nt, Homo sapiens
caacaaaaggggccugaaa

SEQ ID NO: 277821 - RNA, 19 nt, Homo sapiens
gagcgaggacugcaaucug

SEQ ID NO: 277822 - RNA, 19 nt, Homo sapiens
ucaacgcccuggagaucga

SEQ ID NO: 277823 - RNA, 19 nt, Homo sapiens
guaccaagucugagaaugc

SEQ ID NO: 277824 - RNA, 19 nt, Homo sapiens
gcugugggcccugcaauuc

SEQ ID NO: 277825 - RNA, 19 nt, Homo sapiens
agaccaggagucaguauga

SEQ ID NO: 277826 - RNA, 19 nt, Homo sapiens
gcggaugauuucagaacca

SEQ ID NO: 277827 - RNA, 19 nt, Homo sapiens
gauccuguguaccaagucu

SEQ ID NO: 277828 - RNA, 19 nt, Homo sapiens
guaaggcagccaagaaacu

SEQ ID NO: 277829 - RNA, 19 nt, Homo sapiens
gaugauuucagaaccaagu

SEQ ID NO: 277830 - RNA, 19 nt, Homo sapiens
gacccugucucuccaaucc

SEQ ID NO: 277831 - RNA, 19 nt, Homo sapiens
ggagaucaucgagcugaga

SEQ ID NO: 277832 - RNA, 19 nt, Homo sapiens
ugaacaagcaggugguauc

SEQ ID NO: 277833 - RNA, 19 nt, Homo sapiens
gggaaguggagcaaugguu

SEQ ID NO: 277834 - RNA, 19 nt, Homo sapiens
uccaaucccuguaccucuu

SEQ ID NO: 277835 - RNA, 19 nt, Homo sapiens
gcgagaaggagacuaugca

SEQ ID NO: 277836 - RNA, 19 nt, Homo sapiens
gcacaaccugcgagacucu

SEQ ID NO: 277837 - RNA, 19 nt, Homo sapiens
gaccaggagucaguaugag

SEQ ID NO: 277838 - RNA, 19 nt, Homo sapiens
gcuuggagaccgccucaau

SEQ ID NO: 277839 - RNA, 19 nt, Homo sapiens
agaagauccuguguaccaa

SEQ ID NO: 277840 - RNA, 19 nt, Homo sapiens
gaacaagcaggugguaucc

SEQ ID NO: 277841 - RNA, 19 nt, Homo sapiens
guaugaggcccugguggaa

SEQ ID NO: 277842 - RNA, 19 nt, Homo sapiens
agcagaagauccuguguac

SEQ ID NO: 277843 - RNA, 19 nt, Homo sapiens
ugcagagccugaucaccaa

SEQ ID NO: 277844 - RNA, 19 nt, Homo sapiens
ccaagcuggcugcggauga

SEQ ID NO: 277845 - RNA, 19 nt, Homo sapiens
ucaaugguagcgagaagga

SEQ ID NO: 277846 - RNA, 19 nt, Homo sapiens
gagaccaggagucaguaug

SEQ ID NO: 277847 - RNA, 19 nt, Homo sapiens
cggaugauuucagaaccaa

SEQ ID NO: 277848 - RNA, 19 nt, Homo sapiens
ggcugcggaugauuucaga

SEQ ID NO: 277849 - RNA, 19 nt, Homo sapiens
ccuuuuaaccuccuaauaa

SEQ ID NO: 277850 - RNA, 19 nt, Homo sapiens
cagcacaaccugcgagacu

SEQ ID NO: 277851 - RNA, 19 nt, Homo sapiens
agaccgaggagcugaacaa

SEQ ID NO: 277852 - RNA, 19 nt, Homo sapiens
ugaacgagaccaggaguca

SEQ ID NO: 277853 - RNA, 19 nt, Homo sapiens
ggucuguuccuuccuaugc

SEQ ID NO: 277854 - RNA, 19 nt, Homo sapiens
agacuaugcaguuccugaa

SEQ ID NO: 277855 - RNA, 19 nt, Homo sapiens
gcugaacaagcagguggua

SEQ ID NO: 277856 - RNA, 19 nt, Homo sapiens
acgcggagcuggagaaccu

SEQ ID NO: 277857 - RNA, 19 nt, Homo sapiens
ucaacggucugcgcaggau

SEQ ID NO: 277858 - RNA, 19 nt, Homo sapiens
ccaaugugagcaacugcaa

SEQ ID NO: 277859 - RNA, 19 nt, Homo sapiens
gagcguguguucuuaguua

SEQ ID NO: 277860 - RNA, 19 nt, Homo sapiens
gaaagggccucuccaacau

SEQ ID NO: 277861 - RNA, 19 nt, Homo sapiens
aaauagagcuguacucagu

SEQ ID NO: 277862 - RNA, 19 nt, Homo sapiens
gcagggacguggaggaaug

SEQ ID NO: 277863 - RNA, 19 nt, Homo sapiens
uuaguuaacuggcaaauag

SEQ ID NO: 277864 - RNA, 19 nt, Homo sapiens
gcaacaagcucugauacuc

SEQ ID NO: 277865 - RNA, 19 nt, Homo sapiens
guggaggaaugguucaaua

SEQ ID NO: 277866 - RNA, 19 nt, Homo sapiens
gaaaccaugcaguuccuua

SEQ ID NO: 277867 - RNA, 19 nt, Homo sapiens
gcaaauagagcuguacuca

SEQ ID NO: 277868 - RNA, 19 nt, Homo sapiens
aaaccuaucuauccaguuc

SEQ ID NO: 277869 - RNA, 19 nt, Homo sapiens
uggaggagcuuaaccaaca

SEQ ID NO: 277870 - RNA, 19 nt, Homo sapiens
gaggaaugguucaauaugc

SEQ ID NO: 277871 - RNA, 19 nt, Homo sapiens
ggaugguugugaacauuga

SEQ ID NO: 277872 - RNA, 19 nt, Homo sapiens
gaaggaaaccaugcaguuc

SEQ ID NO: 277873 - RNA, 19 nt, Homo sapiens
gaccguggaucaccugcaa

SEQ ID NO: 277874 - RNA, 19 nt, Homo sapiens
cuacugaagucccuuugug

SEQ ID NO: 277875 - RNA, 19 nt, Homo sapiens
acugcaagcugcccuguaa

SEQ ID NO: 277876 - RNA, 19 nt, Homo sapiens
ggaggaaugguucaauaug

SEQ ID NO: 277877 - RNA, 19 nt, Homo sapiens
gagcugaugugccucaaaa

SEQ ID NO: 277878 - RNA, 19 nt, Homo sapiens
uugaggagcuccagcagaa

SEQ ID NO: 277879 - RNA, 19 nt, Homo sapiens
gcaaugagaaggaaaccau

SEQ ID NO: 277880 - RNA, 19 nt, Homo sapiens
cuuaagcccucaucacuuc

SEQ ID NO: 277881 - RNA, 19 nt, Homo sapiens
agacaucauugaccugaga

SEQ ID NO: 277882 - RNA, 19 nt, Homo sapiens
gaacuaccagucagacauc

SEQ ID NO: 277883 - RNA, 19 nt, Homo sapiens
caaacuggcugccgaugac

SEQ ID NO: 277884 - RNA, 19 nt, Homo sapiens
ucaacacgcuggagaucga

SEQ ID NO: 277885 - RNA, 19 nt, Homo sapiens
caccaugacuccugacuac

SEQ ID NO: 277886 - RNA, 19 nt, Homo sapiens
agaaagggccucuccaaca

SEQ ID NO: 277887 - RNA, 19 nt, Homo sapiens
aaagaaccaugaggaggaa

SEQ ID NO: 277888 - RNA, 19 nt, Homo sapiens
caggaugguugugaacauu

SEQ ID NO: 277889 - RNA, 19 nt, Homo sapiens
uugcaagccucucucaaga

SEQ ID NO: 277890 - RNA, 19 nt, Homo sapiens
gaggagcuccagcagaaga

SEQ ID NO: 277891 - RNA, 19 nt, Homo sapiens
agaaggaaaccaugcaguu

SEQ ID NO: 277892 - RNA, 19 nt, Homo sapiens
gaggagaugcggugucagu

SEQ ID NO: 277893 - RNA, 19 nt, Homo sapiens
gguggaggccgacaucaau

SEQ ID NO: 277894 - RNA, 19 nt, Homo sapiens
caauggcaaugagaaggaa

SEQ ID NO: 277895 - RNA, 19 nt, Homo sapiens
ccucaaagagcguguguuc

SEQ ID NO: 277896 - RNA, 19 nt, Homo sapiens
agggcgagaucaacacgua

SEQ ID NO: 277897 - RNA, 19 nt, Homo sapiens
ccaaacuggcugccgauga

SEQ ID NO: 277898 - RNA, 19 nt, Homo sapiens
ccaggaugguugugaacau

SEQ ID NO: 277899 - RNA, 19 nt, Homo sapiens
aaaccaugcaguuccuuaa

SEQ ID NO: 277900 - RNA, 19 nt, Homo sapiens
gguucaauaugcagaugga

SEQ ID NO: 277901 - RNA, 19 nt, Homo sapiens
ccaugcaguuccuuaacga

SEQ ID NO: 277902 - RNA, 19 nt, Homo sapiens
aagggccucuccaacauga

SEQ ID NO: 277903 - RNA, 19 nt, Homo sapiens
ugaaggaggagcugaugug

SEQ ID NO: 277904 - RNA, 19 nt, Homo sapiens
gauggaggagcuuaaccaa

SEQ ID NO: 277905 - RNA, 19 nt, Homo sapiens
uggaggagaugcgguguca

SEQ ID NO: 277906 - RNA, 19 nt, Homo sapiens
ggagaugcggugucaguac

SEQ ID NO: 277907 - RNA, 19 nt, Homo sapiens
cuaccagucagacaucauu

SEQ ID NO: 277908 - RNA, 19 nt, Homo sapiens
guaccaaggcagagaaugc

SEQ ID NO: 277909 - RNA, 19 nt, Homo sapiens
ugucugugcugccucaaag

SEQ ID NO: 277910 - RNA, 19 nt, Homo sapiens
gggaccgccuuaacaucga

SEQ ID NO: 277911 - RNA, 19 nt, Homo sapiens
ucaauggcaaugagaagga

SEQ ID NO: 277912 - RNA, 19 nt, Homo sapiens
guacucaguggccuugcaa

SEQ ID NO: 277913 - RNA, 19 nt, Homo sapiens
ggaggagcuuaaccaacag

SEQ ID NO: 277914 - RNA, 19 nt, Homo sapiens
aggaaugguucaauaugca

SEQ ID NO: 277915 - RNA, 19 nt, Homo sapiens
ccucaucacuucaaaacug

SEQ ID NO: 277916 - RNA, 19 nt, Homo sapiens
gcaugaucaccaacguuga

SEQ ID NO: 277917 - RNA, 19 nt, Homo sapiens
ggccuucaauggcaaugag

SEQ ID NO: 277918 - RNA, 19 nt, Homo sapiens
ucucuuuggugauguuucu

SEQ ID NO: 277919 - RNA, 19 nt, Homo sapiens
guggaucaccugcaacaag

SEQ ID NO: 277920 - RNA, 19 nt, Homo sapiens
ggagcugaugugccucaaa

SEQ ID NO: 277921 - RNA, 19 nt, Homo sapiens
ucaccaugacuccugacua

SEQ ID NO: 277922 - RNA, 19 nt, Homo sapiens
caacagguggccacaagcu

SEQ ID NO: 277923 - RNA, 19 nt, Homo sapiens
uggaggaaugguucaauau

SEQ ID NO: 277924 - RNA, 19 nt, Homo sapiens
ucucauuucaggaccauug

SEQ ID NO: 277925 - RNA, 19 nt, Homo sapiens
gagcugugccugggcuaug

SEQ ID NO: 277926 - RNA, 19 nt, Homo sapiens
gcagggaaguggagcaaug

SEQ ID NO: 277927 - RNA, 19 nt, Homo sapiens
ccgaggagcugaacaagca

SEQ ID NO: 277928 - RNA, 19 nt, Homo sapiens
cggagcagcugcaguccua

SEQ ID NO: 277929 - RNA, 19 nt, Homo sapiens
gcaacacauuuggguacua

SEQ ID NO: 277930 - RNA, 19 nt, Homo sapiens
caacacauuuggguacuag

SEQ ID NO: 277931 - RNA, 19 nt, Homo sapiens
uugaggagcuccagcagaa

SEQ ID NO: 277932 - RNA, 19 nt, Homo sapiens
ugugagggcuccuucaaug

SEQ ID NO: 277933 - RNA, 19 nt, Homo sapiens
caccaugucuuacaguugu

SEQ ID NO: 277934 - RNA, 19 nt, Homo sapiens
ucaaugcccuggagaucga

SEQ ID NO: 277935 - RNA, 19 nt, Homo sapiens
agaaggagaccaugcaguu

SEQ ID NO: 277936 - RNA, 19 nt, Homo sapiens
gaaaacacgcugacagaga

SEQ ID NO: 277937 - RNA, 19 nt, Homo sapiens
ggcagaaccaggaguauca

SEQ ID NO: 277938 - RNA, 19 nt, Homo sapiens
gaggagcuccagcagaaga

SEQ ID NO: 277939 - RNA, 19 nt, Homo sapiens
gcaccaugucuuacaguug

SEQ ID NO: 277940 - RNA, 19 nt, Homo sapiens
gaaggagaccaugcaguuc

SEQ ID NO: 277941 - RNA, 19 nt, Homo sapiens
ugaaugagaccaggaguca

SEQ ID NO: 277942 - RNA, 19 nt, Homo sapiens
gcagugagaaggagaccau

SEQ ID NO: 277943 - RNA, 19 nt, Homo sapiens
gcagcaagucugagaaugc

SEQ ID NO: 277944 - RNA, 19 nt, Homo sapiens
uaccaguccuacuucaaga

SEQ ID NO: 277945 - RNA, 19 nt, Homo sapiens
agaccaggagucaguauga

SEQ ID NO: 277946 - RNA, 19 nt, Homo sapiens
gcaggagcccuuggugugu

SEQ ID NO: 277947 - RNA, 19 nt, Homo sapiens
caacugcaacugguucugu

SEQ ID NO: 277948 - RNA, 19 nt, Homo sapiens
ggagaucaucgagcugaga

SEQ ID NO: 277949 - RNA, 19 nt, Homo sapiens
ugaacaagcaggugguauc

SEQ ID NO: 277950 - RNA, 19 nt, Homo sapiens
gggaaguggagcaaugguu

SEQ ID NO: 277951 - RNA, 19 nt, Homo sapiens
ugacuucaggaccaaauau

SEQ ID NO: 277952 - RNA, 19 nt, Homo sapiens
cagaugacuucaggaccaa

SEQ ID NO: 277953 - RNA, 19 nt, Homo sapiens
ccagcuaccaguccuacuu

SEQ ID NO: 277954 - RNA, 19 nt, Homo sapiens
ugcagagacugaucaccaa

SEQ ID NO: 277955 - RNA, 19 nt, Homo sapiens
ccaagcuggccucagauga

SEQ ID NO: 277956 - RNA, 19 nt, Homo sapiens
gcacaaccugcgagacucu

SEQ ID NO: 277957 - RNA, 19 nt, Homo sapiens
gaccaggagucaguaugag

SEQ ID NO: 277958 - RNA, 19 nt, Homo sapiens
gaacaagcaggugguaucc

SEQ ID NO: 277959 - RNA, 19 nt, Homo sapiens
guaugaggcccugguggaa

SEQ ID NO: 277960 - RNA, 19 nt, Homo sapiens
accaugagcaggagguuaa

SEQ ID NO: 277961 - RNA, 19 nt, Homo sapiens
ggucaaugcccuggagauc

SEQ ID NO: 277962 - RNA, 19 nt, Homo sapiens
ucaauggcagugagaagga

SEQ ID NO: 277963 - RNA, 19 nt, Homo sapiens
acugggcccuguaucucua

SEQ ID NO: 277964 - RNA, 19 nt, Homo sapiens
gagaccaggagucaguaug

SEQ ID NO: 277965 - RNA, 19 nt, Homo sapiens
gccucaagcagaaccauga

SEQ ID NO: 277966 - RNA, 19 nt, Homo sapiens
gguggagucggacaucaau

SEQ ID NO: 277967 - RNA, 19 nt, Homo sapiens
agaagauccugugcagcaa

SEQ ID NO: 277968 - RNA, 19 nt, Homo sapiens
cagcacaaccugcgagacu

SEQ ID NO: 277969 - RNA, 19 nt, Homo sapiens
agaccgaggagcugaacaa

SEQ ID NO: 277970 - RNA, 19 nt, Homo sapiens
gaugacuucaggaccaaau

SEQ ID NO: 277971 - RNA, 19 nt, Homo sapiens
gcugaacaagcagguggua

SEQ ID NO: 277972 - RNA, 19 nt, Homo sapiens
acgcggagcuggagaaccu

SEQ ID NO: 277973 - RNA, 19 nt, Homo sapiens
ccaaugugagcaacugcaa

SEQ ID NO: 277974 - RNA, 19 nt, Homo sapiens
gaacaaaugcccagcguuu

SEQ ID NO: 277975 - RNA, 19 nt, Homo sapiens
cuaauaaacuuuccucuug

SEQ ID NO: 277976 - RNA, 19 nt, Homo sapiens
gcagggaaguggagcaaug

SEQ ID NO: 277977 - RNA, 19 nt, Homo sapiens
gcagaugacuucagaacca

SEQ ID NO: 277978 - RNA, 19 nt, Homo sapiens
cagcagaaguauagcauga

SEQ ID NO: 277979 - RNA, 19 nt, Homo sapiens
caaaucgccuaauaaacuu

SEQ ID NO: 277980 - RNA, 19 nt, Homo sapiens
ccaaaucgccuaauaaacu

SEQ ID NO: 277981 - RNA, 19 nt, Homo sapiens
gaaggagacuaugcaguuc

SEQ ID NO: 277982 - RNA, 19 nt, Homo sapiens
gcagaaccaugagcaggaa

SEQ ID NO: 277983 - RNA, 19 nt, Homo sapiens
gcagaaguauagcaugaag

SEQ ID NO: 277984 - RNA, 19 nt, Homo sapiens
gagcugagacgcacaguca

SEQ ID NO: 277985 - RNA, 19 nt, Homo sapiens
ccgaggagcugaacaagca

SEQ ID NO: 277986 - RNA, 19 nt, Homo sapiens
cggagcagcugcaguccua

SEQ ID NO: 277987 - RNA, 19 nt, Homo sapiens
gcaacaccuuuggguacua

SEQ ID NO: 277988 - RNA, 19 nt, Homo sapiens
uugaggagcuccagcagaa

SEQ ID NO: 277989 - RNA, 19 nt, Homo sapiens
gcaccaugcccuacaacuu

SEQ ID NO: 277990 - RNA, 19 nt, Homo sapiens
agaaggagacuaugcaguu

SEQ ID NO: 277991 - RNA, 19 nt, Homo sapiens
ucaaugcccuggagaucga

SEQ ID NO: 277992 - RNA, 19 nt, Homo sapiens
gcagcgagaaggagacuau

SEQ ID NO: 277993 - RNA, 19 nt, Homo sapiens
gaaaacacgcugacagaga

SEQ ID NO: 277994 - RNA, 19 nt, Homo sapiens
ggcagaaccaggaguauca

SEQ ID NO: 277995 - RNA, 19 nt, Homo sapiens
gaggagcuccagcagaaga

SEQ ID NO: 277996 - RNA, 19 nt, Homo sapiens
uaaacuuuccucuugcaaa

SEQ ID NO: 277997 - RNA, 19 nt, Homo sapiens
cacaaaucauggucuggaa

SEQ ID NO: 277998 - RNA, 19 nt, Homo sapiens
caacaccuuuggguacuag

SEQ ID NO: 277999 - RNA, 19 nt, Homo sapiens
caagcuggcugcagaugac

SEQ ID NO: 278000 - RNA, 19 nt, Homo sapiens
ugcgagggcuccuucaaug

SEQ ID NO: 278001 - RNA, 19 nt, Homo sapiens
caccaugcccuacaacuuc

SEQ ID NO: 278002 - RNA, 19 nt, Homo sapiens
cccauuggauccuguguca

SEQ ID NO: 278003 - RNA, 19 nt, Homo sapiens
ccuaauaaacuuuccucuu

SEQ ID NO: 278004 - RNA, 19 nt, Homo sapiens
aguauagcaugaagacaga

SEQ ID NO: 278005 - RNA, 19 nt, Homo sapiens
ggcugcagaugacuucaga

SEQ ID NO: 278006 - RNA, 19 nt, Homo sapiens
agaccaggaaucaguauga

SEQ ID NO: 278007 - RNA, 19 nt, Homo sapiens
gcagcaagucugagaaugc

SEQ ID NO: 278008 - RNA, 19 nt, Homo sapiens
ugaacgagaccaggaauca

SEQ ID NO: 278009 - RNA, 19 nt, Homo sapiens
cagaugacuucagaaccaa

SEQ ID NO: 278010 - RNA, 19 nt, Homo sapiens
uaccaguccuacuucaaga

SEQ ID NO: 278011 - RNA, 19 nt, Homo sapiens
cccgaggcaucaccacaaa

SEQ ID NO: 278012 - RNA, 19 nt, Homo sapiens
gauccugugucaccaaucc

SEQ ID NO: 278013 - RNA, 19 nt, Homo sapiens
cauacgagguguuuuguuc

SEQ ID NO: 278014 - RNA, 19 nt, Homo sapiens
caccaccaaugcaugugaa

SEQ ID NO: 278015 - RNA, 19 nt, Homo sapiens
gcacaaccugcgauacucu

SEQ ID NO: 278016 - RNA, 19 nt, Homo sapiens
gaccaggaaucaguaugag

SEQ ID NO: 278017 - RNA, 19 nt, Homo sapiens
cgaggcaucaccacaaauc

SEQ ID NO: 278018 - RNA, 19 nt, Homo sapiens
cugcgauacucucuggaaa

SEQ ID NO: 278019 - RNA, 19 nt, Homo sapiens
gcugagacgcacagucaau

SEQ ID NO: 278020 - RNA, 19 nt, Homo sapiens
ggagaucaucgagcugaga

SEQ ID NO: 278021 - RNA, 19 nt, Homo sapiens
ugaacaagcaggugguauc

SEQ ID NO: 278022 - RNA, 19 nt, Homo sapiens
ccagcuaccaguccuacuu

SEQ ID NO: 278023 - RNA, 19 nt, Homo sapiens
gggaaguggagcaaugguu

SEQ ID NO: 278024 - RNA, 19 nt, Homo sapiens
aauaaacuuuccucuugca

SEQ ID NO: 278025 - RNA, 19 nt, Homo sapiens
ggcaucaccacaaaucaug

SEQ ID NO: 278026 - RNA, 19 nt, Homo sapiens
uaccaucggugggccaguu

SEQ ID NO: 278027 - RNA, 19 nt, Homo sapiens
uagcaugaagacagaacua

SEQ ID NO: 278028 - RNA, 19 nt, Homo sapiens
caccuuuggguacuagaua

SEQ ID NO: 278029 - RNA, 19 nt, Homo sapiens
ccaagcuggcugcagauga

SEQ ID NO: 278030 - RNA, 19 nt, Homo sapiens
gcgagaaggagacuaugca

SEQ ID NO: 278031 - RNA, 19 nt, Homo sapiens
acugcaagcugcccuccaa

SEQ ID NO: 278032 - RNA, 19 nt, Homo sapiens
ucugcugcuucuaccuuua

SEQ ID NO: 278033 - RNA, 19 nt, Homo sapiens
gaacaagcaggugguaucc

SEQ ID NO: 278034 - RNA, 19 nt, Homo sapiens
guaugaggcccugguggaa

SEQ ID NO: 278035 - RNA, 19 nt, Homo sapiens
ucuggaaggagaacaaaug

SEQ ID NO: 278036 - RNA, 19 nt, Homo sapiens
ccaccaccaaugcauguga

SEQ ID NO: 278037 - RNA, 19 nt, Homo sapiens
ugcagagccugaucaccaa

SEQ ID NO: 278038 - RNA, 19 nt, Homo sapiens
cagcacaaccugcgauacu

SEQ ID NO: 278039 - RNA, 19 nt, Homo sapiens
agaagauccugugcagcaa

SEQ ID NO: 278040 - RNA, 19 nt, Homo sapiens
ccagauggagucccugaag

SEQ ID NO: 278041 - RNA, 19 nt, Homo sapiens
agaccgaggagcugaacaa

SEQ ID NO: 278042 - RNA, 19 nt, Homo sapiens
ucaauggcagcgagaagga

SEQ ID NO: 278043 - RNA, 19 nt, Homo sapiens
agacuaugcaguuccugaa

SEQ ID NO: 278044 - RNA, 19 nt, Homo sapiens
ccaaugugagcaacugcaa

SEQ ID NO: 278045 - RNA, 19 nt, Homo sapiens
acgcggagcuggagaaccu

SEQ ID NO: 278046 - RNA, 19 nt, Homo sapiens
gcugaacaagcagguggua

SEQ ID NO: 278047 - RNA, 19 nt, Homo sapiens
gaacgagaccaggaaucag

SEQ ID NO: 278048 - RNA, 19 nt, Homo sapiens
gagcugaucugcuugaaga

SEQ ID NO: 278049 - RNA, 19 nt, Homo sapiens
gagcuccaguuacuacuua

SEQ ID NO: 278050 - RNA, 19 nt, Homo sapiens
gggaggagcugaucugcuu

SEQ ID NO: 278051 - RNA, 19 nt, Homo sapiens
gcaaggaggagacuucauu

SEQ ID NO: 278052 - RNA, 19 nt, Homo sapiens
gaggagacuucauuuacuu

SEQ ID NO: 278053 - RNA, 19 nt, Homo sapiens
gcagggaaguggagcaaug

SEQ ID NO: 278054 - RNA, 19 nt, Homo sapiens
ccaauaaacuucauuucuc

SEQ ID NO: 278055 - RNA, 19 nt, Homo sapiens
gcaaagacacacaucauca

SEQ ID NO: 278056 - RNA, 19 nt, Homo sapiens
caaaaggguugcuguaauu

SEQ ID NO: 278057 - RNA, 19 nt, Homo sapiens
caucuugccucuauguuau

SEQ ID NO: 278058 - RNA, 19 nt, Homo sapiens
gaaggagacuaugcaguuc

SEQ ID NO: 278059 - RNA, 19 nt, Homo sapiens
ggaggagacuucauuuacu

SEQ ID NO: 278060 - RNA, 19 nt, Homo sapiens
agacacacaucaucaacuu

SEQ ID NO: 278061 - RNA, 19 nt, Homo sapiens
ggucgagccuguuuguuuc

SEQ ID NO: 278062 - RNA, 19 nt, Homo sapiens
gagcugagacgcacaguca

SEQ ID NO: 278063 - RNA, 19 nt, Homo sapiens
ccgaggagcugaacaagca

SEQ ID NO: 278064 - RNA, 19 nt, Homo sapiens
acaaagccauuuagaucaa

SEQ ID NO: 278065 - RNA, 19 nt, Homo sapiens
cuacaaagccauuuagauc

SEQ ID NO: 278066 - RNA, 19 nt, Homo sapiens
aaaggaaacuaugcuguau

SEQ ID NO: 278067 - RNA, 19 nt, Homo sapiens
uaaaaggacugcagaggaa

SEQ ID NO: 278068 - RNA, 19 nt, Homo sapiens
gauguucagcucccuguaa

SEQ ID NO: 278069 - RNA, 19 nt, Homo sapiens
gagccuguuuguuucuaaa

SEQ ID NO: 278070 - RNA, 19 nt, Homo sapiens
uugaggagcuccagcagaa

SEQ ID NO: 278071 - RNA, 19 nt, Homo sapiens
ugugagggcuccuucaaug

SEQ ID NO: 278072 - RNA, 19 nt, Homo sapiens
caccaugucuuacaguugu

SEQ ID NO: 278073 - RNA, 19 nt, Homo sapiens
ugaacguacuacugcauuu

SEQ ID NO: 278074 - RNA, 19 nt, Homo sapiens
guaaucugagcuccaguua

SEQ ID NO: 278075 - RNA, 19 nt, Homo sapiens
gagcugacccucugcaagu

SEQ ID NO: 278076 - RNA, 19 nt, Homo sapiens
aaucugagcuccaguuacu

SEQ ID NO: 278077 - RNA, 19 nt, Homo sapiens
gggucgagccuguuuguuu

SEQ ID NO: 278078 - RNA, 19 nt, Homo sapiens
caaagacacacaucaucaa

SEQ ID NO: 278079 - RNA, 19 nt, Homo sapiens
aagcuuguauccucuuuga

SEQ ID NO: 278080 - RNA, 19 nt, Homo sapiens
uggcagagauccgcuguga

SEQ ID NO: 278081 - RNA, 19 nt, Homo sapiens
guaugaggcucugguggaa

SEQ ID NO: 278082 - RNA, 19 nt, Homo sapiens
agaaggagacuaugcaguu

SEQ ID NO: 278083 - RNA, 19 nt, Homo sapiens
ucaccaacguggagucuca

SEQ ID NO: 278084 - RNA, 19 nt, Homo sapiens
caaggaggagacuucauuu

SEQ ID NO: 278085 - RNA, 19 nt, Homo sapiens
acucaaaccugcccacauc

SEQ ID NO: 278086 - RNA, 19 nt, Homo sapiens
caucaucaacuuccaaugu

SEQ ID NO: 278087 - RNA, 19 nt, Homo sapiens
gcagcgagaaggagacuau

SEQ ID NO: 278088 - RNA, 19 nt, Homo sapiens
cuucauuucucuggcauaa

SEQ ID NO: 278089 - RNA, 19 nt, Homo sapiens
gaacguacuacugcauuuc

SEQ ID NO: 278090 - RNA, 19 nt, Homo sapiens
ucaucuugccucuauguua

SEQ ID NO: 278091 - RNA, 19 nt, Homo sapiens
aaccucaucuugccucuau

SEQ ID NO: 278092 - RNA, 19 nt, Homo sapiens
gcucagcugacaucaagaa

SEQ ID NO: 278093 - RNA, 19 nt, Homo sapiens
gaggaaggagagacucaaa

SEQ ID NO: 278094 - RNA, 19 nt, Homo sapiens
aaggguugcuguaauugaa

SEQ ID NO: 278095 - RNA, 19 nt, Homo sapiens
gaggagcuccagcagaaga

SEQ ID NO: 278096 - RNA, 19 nt, Homo sapiens
guuccagcaccaugucuua

SEQ ID NO: 278097 - RNA, 19 nt, Homo sapiens
gcaccaugucuuacaguug

SEQ ID NO: 278098 - RNA, 19 nt, Homo sapiens
gcuugaagaagaaccauga

SEQ ID NO: 278099 - RNA, 19 nt, Homo sapiens
gcuggccucugacgacuuc

SEQ ID NO: 278100 - RNA, 19 nt, Homo sapiens
acgcggagcuggagaaacu

SEQ ID NO: 278101 - RNA, 19 nt, Homo sapiens
aaggaggagacuucauuua

SEQ ID NO: 278102 - RNA, 19 nt, Homo sapiens
acuacugcauuuccuguuu

SEQ ID NO: 278103 - RNA, 19 nt, Homo sapiens
cgagccuguuuguuucuaa

SEQ ID NO: 278104 - RNA, 19 nt, Homo sapiens
ccacccacaauuaauggua

SEQ ID NO: 278105 - RNA, 19 nt, Homo sapiens
gaggcucugguggaaauua

SEQ ID NO: 278106 - RNA, 19 nt, Homo sapiens
ucaaaaggguugcuguaau

SEQ ID NO: 278107 - RNA, 19 nt, Homo sapiens
ucaacgcccuggagaucga

SEQ ID NO: 278108 - RNA, 19 nt, Homo sapiens
gaggagcugaucugcuuga

SEQ ID NO: 278109 - RNA, 19 nt, Homo sapiens
cuucauuuacuucccaaua

SEQ ID NO: 278110 - RNA, 19 nt, Homo sapiens
caagcaaagacacacauca

SEQ ID NO: 278111 - RNA, 19 nt, Homo sapiens
cagcugacaucaagaaacc

SEQ ID NO: 278112 - RNA, 19 nt, Homo sapiens
gcuuguauccucuuugaag

SEQ ID NO: 278113 - RNA, 19 nt, Homo sapiens
uaccaguccuacuucaaga

SEQ ID NO: 278114 - RNA, 19 nt, Homo sapiens
cacccacaauuaaugguau

SEQ ID NO: 278115 - RNA, 19 nt, Homo sapiens
agaccaggagucaguauga

SEQ ID NO: 278116 - RNA, 19 nt, Homo sapiens
cugaucugcuugaagaaga

SEQ ID NO: 278117 - RNA, 19 nt, Homo sapiens
caacugcaacugguucugu

SEQ ID NO: 278118 - RNA, 19 nt, Homo sapiens
gccucuauguuauuucuag

SEQ ID NO: 278119 - RNA, 19 nt, Homo sapiens
uacaaagccauuuagauca

SEQ ID NO: 278120 - RNA, 19 nt, Homo sapiens
agacaucuacaaagccauu

SEQ ID NO: 278121 - RNA, 19 nt, Homo sapiens
aggcucugguggaaauuaa

SEQ ID NO: 278122 - RNA, 19 nt, Homo sapiens
uugaagacaucuacaaagc

SEQ ID NO: 278123 - RNA, 19 nt, Homo sapiens
ggagaucaucgagcugaga

SEQ ID NO: 278124 - RNA, 19 nt, Homo sapiens
ugaacaagcaggugguauc

SEQ ID NO: 278125 - RNA, 19 nt, Homo sapiens
gggaaguggagcaaugguu

SEQ ID NO: 278126 - RNA, 19 nt, Homo sapiens
ccagcuaccaguccuacuu

SEQ ID NO: 278127 - RNA, 19 nt, Homo sapiens
gccuguuuguuucuaaaga

SEQ ID NO: 278128 - RNA, 19 nt, Homo sapiens
gcgagaaggagacuaugca

SEQ ID NO: 278129 - RNA, 19 nt, Homo sapiens
aggaaacuaugcuguaugc

SEQ ID NO: 278130 - RNA, 19 nt, Homo sapiens
ggcugguggugaacauuga

SEQ ID NO: 278131 - RNA, 19 nt, Homo sapiens
gagggucgagccuguuugu

SEQ ID NO: 278132 - RNA, 19 nt, Homo sapiens
aaaggguugcuguaauuga

SEQ ID NO: 278133 - RNA, 19 nt, Homo sapiens
gcacaaccugcgagacucu

SEQ ID NO: 278134 - RNA, 19 nt, Homo sapiens
gaccaggagucaguaugag

SEQ ID NO: 278135 - RNA, 19 nt, Homo sapiens
ugaucugcuugaagaagaa

SEQ ID NO: 278136 - RNA, 19 nt, Homo sapiens
ggaaggagagacucaaacc

SEQ ID NO: 278137 - RNA, 19 nt, Homo sapiens
gaacaagcaggugguaucc

SEQ ID NO: 278138 - RNA, 19 nt, Homo sapiens
cccaauaaacuucauuucu

SEQ ID NO: 278139 - RNA, 19 nt, Homo sapiens
ccuguuuguuucuaaagau

SEQ ID NO: 278140 - RNA, 19 nt, Homo sapiens
caacgcggagcuggagaaa

SEQ ID NO: 278141 - RNA, 19 nt, Homo sapiens
acccacaauuaaugguaua

SEQ ID NO: 278142 - RNA, 19 nt, Homo sapiens
ugcagagccugaucaccaa

SEQ ID NO: 278143 - RNA, 19 nt, Homo sapiens
guucagcucccuguaaucu

SEQ ID NO: 278144 - RNA, 19 nt, Homo sapiens
cuagaaugcugaaaagcuu

SEQ ID NO: 278145 - RNA, 19 nt, Homo sapiens
gagaccaggagucaguaug

SEQ ID NO: 278146 - RNA, 19 nt, Homo sapiens
cagcacaaccugcgagacu

SEQ ID NO: 278147 - RNA, 19 nt, Homo sapiens
agaccgaggagcugaacaa

SEQ ID NO: 278148 - RNA, 19 nt, Homo sapiens
ggagaugagucuugacaua

SEQ ID NO: 278149 - RNA, 19 nt, Homo sapiens
gcaaauacaugcccuaaag

SEQ ID NO: 278150 - RNA, 19 nt, Homo sapiens
gagaugaggugccaguaug

SEQ ID NO: 278151 - RNA, 19 nt, Homo sapiens
ucacugcgcugccaacuug

SEQ ID NO: 278152 - RNA, 19 nt, Homo sapiens
caugagagaugcuuuggaa

SEQ ID NO: 278153 - RNA, 19 nt, Homo sapiens
gaagaaccaugaggaggaa

SEQ ID NO: 278154 - RNA, 19 nt, Homo sapiens
ucgaggagcuccagaagaa

SEQ ID NO: 278155 - RNA, 19 nt, Homo sapiens
gaugagucuugacauagua

SEQ ID NO: 278156 - RNA, 19 nt, Homo sapiens
caaauuggcugcagaugac

SEQ ID NO: 278157 - RNA, 19 nt, Homo sapiens
uaauggggcuccuauuuua

SEQ ID NO: 278158 - RNA, 19 nt, Homo sapiens
ucucagagccugucacaaa

SEQ ID NO: 278159 - RNA, 19 nt, Homo sapiens
ggccauggcuuccaaaugc

SEQ ID NO: 278160 - RNA, 19 nt, Homo sapiens
ccucagagaccuaucaauu

SEQ ID NO: 278161 - RNA, 19 nt, Homo sapiens
aaacccugguggagaauaa

SEQ ID NO: 278162 - RNA, 19 nt, Homo sapiens
gcagaacaauaaagugcau

SEQ ID NO: 278163 - RNA, 19 nt, Homo sapiens
ucucaacuccucaucauuu

SEQ ID NO: 278164 - RNA, 19 nt, Homo sapiens
ugacaggucccuuugaaga

SEQ ID NO: 278165 - RNA, 19 nt, Homo sapiens
ucaaaugacaggucccuuu

SEQ ID NO: 278166 - RNA, 19 nt, Homo sapiens
gacuuggucuucccaguga

SEQ ID NO: 278167 - RNA, 19 nt, Homo sapiens
gaacaauaaagugcauuug

SEQ ID NO: 278168 - RNA, 19 nt, Homo sapiens
ggucaacgcccuggagauu

SEQ ID NO: 278169 - RNA, 19 nt, Homo sapiens
ggagcugcuucucugcuuu

SEQ ID NO: 278170 - RNA, 19 nt, Homo sapiens
ggucucaacuccucaucau

SEQ ID NO: 278171 - RNA, 19 nt, Homo sapiens
ucagagaccuaucaauugc

SEQ ID NO: 278172 - RNA, 19 nt, Homo sapiens
aaugacaggucccuuugaa

SEQ ID NO: 278173 - RNA, 19 nt, Homo sapiens
ggugaccgccucaauguug

SEQ ID NO: 278174 - RNA, 19 nt, Homo sapiens
gcaaugagaaggagaccau

SEQ ID NO: 278175 - RNA, 19 nt, Homo sapiens
ggagaugaggugccaguau

SEQ ID NO: 278176 - RNA, 19 nt, Homo sapiens
cagcacagcaugagagaug

SEQ ID NO: 278177 - RNA, 19 nt, Homo sapiens
ggagaaaacacuuuguaaa

SEQ ID NO: 278178 - RNA, 19 nt, Homo sapiens
gaacugacagggacuuggu

SEQ ID NO: 278179 - RNA, 19 nt, Homo sapiens
gaggagcuccagaagaaga

SEQ ID NO: 278180 - RNA, 19 nt, Homo sapiens
gacaggucccuuugaagaa

SEQ ID NO: 278181 - RNA, 19 nt, Homo sapiens
ggaaacuaaauaacagguu

SEQ ID NO: 278182 - RNA, 19 nt, Homo sapiens
acaggaaacuaaauaacag

SEQ ID NO: 278183 - RNA, 19 nt, Homo sapiens
gagaugagucuugacauag

SEQ ID NO: 278184 - RNA, 19 nt, Homo sapiens
aaauacaugcccuaaaguu

SEQ ID NO: 278185 - RNA, 19 nt, Homo sapiens
gaccugacccugugcaagu

SEQ ID NO: 278186 - RNA, 19 nt, Homo sapiens
acaauaaagugcauuugcu

SEQ ID NO: 278187 - RNA, 19 nt, Homo sapiens
caacuccucaucauuucaa

SEQ ID NO: 278188 - RNA, 19 nt, Homo sapiens
gagagaugcuuuggaaucc

SEQ ID NO: 278189 - RNA, 19 nt, Homo sapiens
ugagagaugcuuuggaauc

SEQ ID NO: 278190 - RNA, 19 nt, Homo sapiens
agaaggagaccaugcaauc

SEQ ID NO: 278191 - RNA, 19 nt, Homo sapiens
gaaacccugguggagaaua

SEQ ID NO: 278192 - RNA, 19 nt, Homo sapiens
guaauggggcuccuauuuu

SEQ ID NO: 278193 - RNA, 19 nt, Homo sapiens
aauacaugcccuaaaguuu

SEQ ID NO: 278194 - RNA, 19 nt, Homo sapiens
augaaacccugguggagaa

SEQ ID NO: 278195 - RNA, 19 nt, Homo sapiens
aauagaaagugguguuaac

SEQ ID NO: 278196 - RNA, 19 nt, Homo sapiens
cacaggaaacuaaauaaca

SEQ ID NO: 278197 - RNA, 19 nt, Homo sapiens
gccagggucucuguucuca

SEQ ID NO: 278198 - RNA, 19 nt, Homo sapiens
cuacucacccuccaaguca

SEQ ID NO: 278199 - RNA, 19 nt, Homo sapiens
auacaugcccuaaaguuuc

SEQ ID NO: 278200 - RNA, 19 nt, Homo sapiens
gagaaggagaccaugcaau

SEQ ID NO: 278201 - RNA, 19 nt, Homo sapiens
agaugagucuugacauagu

SEQ ID NO: 278202 - RNA, 19 nt, Homo sapiens
ugacagggacuuggucuuc

SEQ ID NO: 278203 - RNA, 19 nt, Homo sapiens
caaauacaugcccuaaagu

SEQ ID NO: 278204 - RNA, 19 nt, Homo sapiens
ccacucguguguccgcaau

SEQ ID NO: 278205 - RNA, 19 nt, Homo sapiens
gaagaacugacagggacuu

SEQ ID NO: 278206 - RNA, 19 nt, Homo sapiens
gagcugcuucucugcuuug

SEQ ID NO: 278207 - RNA, 19 nt, Homo sapiens
ccagauggccauggcuauu

SEQ ID NO: 278208 - RNA, 19 nt, Homo sapiens
agucaugccuucccugucu

SEQ ID NO: 278209 - RNA, 19 nt, Homo sapiens
gaggagaaaacacuuugua

SEQ ID NO: 278210 - RNA, 19 nt, Homo sapiens
uccgguggauucugaaaug

SEQ ID NO: 278211 - RNA, 19 nt, Homo sapiens
gguuggacacccagaguga

SEQ ID NO: 278212 - RNA, 19 nt, Homo sapiens
gaugaggugccaguaugaa

SEQ ID NO: 278213 - RNA, 19 nt, Homo sapiens
cagaugacuucaggaccaa

SEQ ID NO: 278214 - RNA, 19 nt, Homo sapiens
agaagacucuaugcagcaa

SEQ ID NO: 278215 - RNA, 19 nt, Homo sapiens
gcuggaggcuucgcuacca

SEQ ID NO: 278216 - RNA, 19 nt, Homo sapiens
gguaaggagcugcuucucu

SEQ ID NO: 278217 - RNA, 19 nt, Homo sapiens
uggccucuacccaaacuua

SEQ ID NO: 278218 - RNA, 19 nt, Homo sapiens
ggcuugaacuuggccucua

SEQ ID NO: 278219 - RNA, 19 nt, Homo sapiens
cagauggccauggcuauug

SEQ ID NO: 278220 - RNA, 19 nt, Homo sapiens
cucagagaccuaucaauug

SEQ ID NO: 278221 - RNA, 19 nt, Homo sapiens
gaauccacccuggcagaga

SEQ ID NO: 278222 - RNA, 19 nt, Homo sapiens
gccugaagaagaaccauga

SEQ ID NO: 278223 - RNA, 19 nt, Homo sapiens
cagaagaagacucuaugca

SEQ ID NO: 278224 - RNA, 19 nt, Homo sapiens
gagagccgcauccgugagu

SEQ ID NO: 278225 - RNA, 19 nt, Homo sapiens
uacaugcccuaaaguuucu

SEQ ID NO: 278226 - RNA, 19 nt, Homo sapiens
gcuugaacuuggccucuac

SEQ ID NO: 278227 - RNA, 19 nt, Homo sapiens
ggcuggugguggagauuga

SEQ ID NO: 278228 - RNA, 19 nt, Homo sapiens
gaaccaugaggaggaagug

SEQ ID NO: 278229 - RNA, 19 nt, Homo sapiens
ggcagcugguggagucaga

SEQ ID NO: 278230 - RNA, 19 nt, Homo sapiens
ucacuggcaaugagaagga

SEQ ID NO: 278231 - RNA, 19 nt, Homo sapiens
agagaccuaucaauugcau

SEQ ID NO: 278232 - RNA, 19 nt, Homo sapiens
agauggccauggcuauugu

SEQ ID NO: 278233 - RNA, 19 nt, Homo sapiens
aaugagggguuuuaauaga

SEQ ID NO: 278234 - RNA, 19 nt, Homo sapiens
cuacaugugcccugacuac

SEQ ID NO: 278235 - RNA, 19 nt, Homo sapiens
gggccauggcuuccaaaug

SEQ ID NO: 278236 - RNA, 19 nt, Homo sapiens
auucugaaaugcaguagag

SEQ ID NO: 278237 - RNA, 19 nt, Homo sapiens
ggccucuacccaaacuuaa

SEQ ID NO: 278238 - RNA, 19 nt, Homo sapiens
uguaaaggccaaccaaugc

SEQ ID NO: 278239 - RNA, 19 nt, Homo sapiens
ucacaggaaacuaaauaac

SEQ ID NO: 278240 - RNA, 19 nt, Homo sapiens
agacaaagcugcaguucua

SEQ ID NO: 278241 - RNA, 19 nt, Homo sapiens
gaacauggacugcaucauu

SEQ ID NO: 278242 - RNA, 19 nt, Homo sapiens
ggaaaggccacccuagaaa

SEQ ID NO: 278243 - RNA, 19 nt, Homo sapiens
ggacauggccugccugauc

SEQ ID NO: 278244 - RNA, 19 nt, Homo sapiens
acaaacugcuggagacaaa

SEQ ID NO: 278245 - RNA, 19 nt, Homo sapiens
gcagcugccggaaauguua

SEQ ID NO: 278246 - RNA, 19 nt, Homo sapiens
gagcagaggcuaugugaag

SEQ ID NO: 278247 - RNA, 19 nt, Homo sapiens
gacauggccugccugauca

SEQ ID NO: 278248 - RNA, 19 nt, Homo sapiens
gcuacaagaagaaguauga

SEQ ID NO: 278249 - RNA, 19 nt, Homo sapiens
gggaaaggccacccuagaa

SEQ ID NO: 278250 - RNA, 19 nt, Homo sapiens
gaggcuaugugaaggcauu

SEQ ID NO: 278251 - RNA, 19 nt, Homo sapiens
gaaaggccacccuagaaag

SEQ ID NO: 278252 - RNA, 19 nt, Homo sapiens
ggaagggccaggaccagaa

SEQ ID NO: 278253 - RNA, 19 nt, Homo sapiens
aacauggacugcaucauug

SEQ ID NO: 278254 - RNA, 19 nt, Homo sapiens
caacagcugagaacgaguu

SEQ ID NO: 278255 - RNA, 19 nt, Homo sapiens
gcaagugugaggagaugaa

SEQ ID NO: 278256 - RNA, 19 nt, Homo sapiens
gcaccaaggaggagaucaa

SEQ ID NO: 278257 - RNA, 19 nt, Homo sapiens
gccgggaccugaacaugga

SEQ ID NO: 278258 - RNA, 19 nt, Homo sapiens
gagcaacagcugagaacga

SEQ ID NO: 278259 - RNA, 19 nt, Homo sapiens
gagauuaaggcacaguaug

SEQ ID NO: 278260 - RNA, 19 nt, Homo sapiens
ggcacaguaugacgacauu

SEQ ID NO: 278261 - RNA, 19 nt, Homo sapiens
gaggaggagguuucucuga

SEQ ID NO: 278262 - RNA, 19 nt, Homo sapiens
gaacaaacugcuggagaca

SEQ ID NO: 278263 - RNA, 19 nt, Homo sapiens
cuggagaagugcucagcua

SEQ ID NO: 278264 - RNA, 19 nt, Homo sapiens
cagaucaagucccucaaca

SEQ ID NO: 278265 - RNA, 19 nt, Homo sapiens
agaaggagcagaucaaguc

SEQ ID NO: 278266 - RNA, 19 nt, Homo sapiens
cagcaagugugaggagaug

SEQ ID NO: 278267 - RNA, 19 nt, Homo sapiens
acaucgagaucgccaccua

SEQ ID NO: 278268 - RNA, 19 nt, Homo sapiens
agauuaaggcacaguauga

SEQ ID NO: 278269 - RNA, 19 nt, Homo sapiens
cuggagggcuacaagaaga

SEQ ID NO: 278270 - RNA, 19 nt, Homo sapiens
cagcugagaacgaguuugu

SEQ ID NO: 278271 - RNA, 19 nt, Homo sapiens
aaaggccacccuagaaaga

SEQ ID NO: 278272 - RNA, 19 nt, Homo sapiens
cugcaucauugccgagauu

SEQ ID NO: 278273 - RNA, 19 nt, Homo sapiens
gcgugaagcaggaggagaa

SEQ ID NO: 278274 - RNA, 19 nt, Homo sapiens
gaggagaaggagcagauca

SEQ ID NO: 278275 - RNA, 19 nt, Homo sapiens
ccaagugccagaacuccaa

SEQ ID NO: 278276 - RNA, 19 nt, Homo sapiens
caacguggaggcccugauc

SEQ ID NO: 278277 - RNA, 19 nt, Homo sapiens
gagaaggagcagaucaagu

SEQ ID NO: 278278 - RNA, 19 nt, Homo sapiens
ugaagcaggaggagaagga

SEQ ID NO: 278279 - RNA, 19 nt, Homo sapiens
gcaucauugccgagauuaa

SEQ ID NO: 278280 - RNA, 19 nt, Homo sapiens
gaggaggagauccgcauuc

SEQ ID NO: 278281 - RNA, 19 nt, Homo sapiens
gaaguaugaggaggagguu

SEQ ID NO: 278282 - RNA, 19 nt, Homo sapiens
ggagacaaagcugcaguuc

SEQ ID NO: 278283 - RNA, 19 nt, Homo sapiens
gcucuugaucuguguuuca

SEQ ID NO: 278284 - RNA, 19 nt, Homo sapiens
ggagaaggagcagaucaag

SEQ ID NO: 278285 - RNA, 19 nt, Homo sapiens
gcgaggagcagaggcuaug

SEQ ID NO: 278286 - RNA, 19 nt, Homo sapiens
cagcgugugcggaggcuuu

SEQ ID NO: 278287 - RNA, 19 nt, Homo sapiens
gaugaaggccacggugauc

SEQ ID NO: 278288 - RNA, 19 nt, Homo sapiens
gcagaucaagucccucaac

SEQ ID NO: 278289 - RNA, 19 nt, Homo sapiens
gagagcaacagcugagaac

SEQ ID NO: 278290 - RNA, 19 nt, Homo sapiens
ggagaagugcucagcuacu

SEQ ID NO: 278291 - RNA, 19 nt, Homo sapiens
gggaguaccaggaggugau

SEQ ID NO: 278292 - RNA, 19 nt, Homo sapiens
gcagcaagugugaggagau

SEQ ID NO: 278293 - RNA, 19 nt, Homo sapiens
cgagauuaaggcacaguau

SEQ ID NO: 278294 - RNA, 19 nt, Homo sapiens
gagacaaagcugcaguucu

SEQ ID NO: 278295 - RNA, 19 nt, Homo sapiens
caaacguccaggaggauca

SEQ ID NO: 278296 - RNA, 19 nt, Homo sapiens
caucauugccgagauuaag

SEQ ID NO: 278297 - RNA, 19 nt, Homo sapiens
ugagagcaacagcugagaa

SEQ ID NO: 278298 - RNA, 19 nt, Homo sapiens
gaggagcagaggcuaugug

SEQ ID NO: 278299 - RNA, 19 nt, Homo sapiens
guuuguggcucugaagaag

SEQ ID NO: 278300 - RNA, 19 nt, Homo sapiens
aaagggauauggaauguuu

SEQ ID NO: 278301 - RNA, 19 nt, Homo sapiens
ggacacagccuuccugaug

SEQ ID NO: 278302 - RNA, 19 nt, Homo sapiens
ggaaaugaauaaacugauc

SEQ ID NO: 278303 - RNA, 19 nt, Homo sapiens
gcaaagggauauggaaugu

SEQ ID NO: 278304 - RNA, 19 nt, Homo sapiens
gcccagcgcugcaaacuug

SEQ ID NO: 278305 - RNA, 19 nt, Homo sapiens
ggagaucgacuuccugaaa

SEQ ID NO: 278306 - RNA, 19 nt, Homo sapiens
gaaguuuccucacaaaguc

SEQ ID NO: 278307 - RNA, 19 nt, Homo sapiens
ccaaaucccacucuaaauu

SEQ ID NO: 278308 - RNA, 19 nt, Homo sapiens
gggcggaaauccagcauga

SEQ ID NO: 278309 - RNA, 19 nt, Homo sapiens
aaauaaaccuacucuguuc

SEQ ID NO: 278310 - RNA, 19 nt, Homo sapiens
caacaaccguuucgcaucu

SEQ ID NO: 278311 - RNA, 19 nt, Homo sapiens
caucugggcuucuguucaa

SEQ ID NO: 278312 - RNA, 19 nt, Homo sapiens
gacacagccuuccugauga

SEQ ID NO: 278313 - RNA, 19 nt, Homo sapiens
uaacaccgccugaaacaug

SEQ ID NO: 278314 - RNA, 19 nt, Homo sapiens
ucacacugcccuuacuuua

SEQ ID NO: 278315 - RNA, 19 nt, Homo sapiens
gaucaucccauggaaguuu

SEQ ID NO: 278316 - RNA, 19 nt, Homo sapiens
agaacgagauccuggaaau

SEQ ID NO: 278317 - RNA, 19 nt, Homo sapiens
caacaucgagcccaucuuc

SEQ ID NO: 278318 - RNA, 19 nt, Homo sapiens
ggaggaggcucugcagaag

SEQ ID NO: 278319 - RNA, 19 nt, Homo sapiens
caagaaaccgagaauguca

SEQ ID NO: 278320 - RNA, 19 nt, Homo sapiens
caucaucgcugagaucaag

SEQ ID NO: 278321 - RNA, 19 nt, Homo sapiens
gggcuucuguucaaaauaa

SEQ ID NO: 278322 - RNA, 19 nt, Homo sapiens
gaacccaaacugugagaau

SEQ ID NO: 278323 - RNA, 19 nt, Homo sapiens
gcucuuaaccgcagaaugg

SEQ ID NO: 278324 - RNA, 19 nt, Homo sapiens
caccagggcugaagacaag

SEQ ID NO: 278325 - RNA, 19 nt, Homo sapiens
gggcacuggugaacucuau

SEQ ID NO: 278326 - RNA, 19 nt, Homo sapiens
gcgaggcggcucucaauga

SEQ ID NO: 278327 - RNA, 19 nt, Homo sapiens
caaaucccacucuaaauuc

SEQ ID NO: 278328 - RNA, 19 nt, Homo sapiens
agauuuacuuucucaggua

SEQ ID NO: 278329 - RNA, 19 nt, Homo sapiens
agagaaagagcaugcauug

SEQ ID NO: 278330 - RNA, 19 nt, Homo sapiens
gcaagaaaccgagaauguc

SEQ ID NO: 278331 - RNA, 19 nt, Homo sapiens
ggacguggacggcaucauc

SEQ ID NO: 278332 - RNA, 19 nt, Homo sapiens
agaaggagcagaucaagug

SEQ ID NO: 278333 - RNA, 19 nt, Homo sapiens
gaagaaggacguggacaca

SEQ ID NO: 278334 - RNA, 19 nt, Homo sapiens
aacccaaacugugagaaua

SEQ ID NO: 278335 - RNA, 19 nt, Homo sapiens
caaaugggcacaccacagu

SEQ ID NO: 278336 - RNA, 19 nt, Homo sapiens
agacaaggauguuccaaaa

SEQ ID NO: 278337 - RNA, 19 nt, Homo sapiens
gccacaagcauuagcauga

SEQ ID NO: 278338 - RNA, 19 nt, Homo sapiens
gaacgagauccuggaaaug

SEQ ID NO: 278339 - RNA, 19 nt, Homo sapiens
ccacaagcauuagcaugau

SEQ ID NO: 278340 - RNA, 19 nt, Homo sapiens
gagaucgacuuccugaaaa

SEQ ID NO: 278341 - RNA, 19 nt, Homo sapiens
acacagccuuccugaugaa

SEQ ID NO: 278342 - RNA, 19 nt, Homo sapiens
uaaagagggaugagaagga

SEQ ID NO: 278343 - RNA, 19 nt, Homo sapiens
ggauauggaauguuuacug

SEQ ID NO: 278344 - RNA, 19 nt, Homo sapiens
cgaggcggcucucaaugau

SEQ ID NO: 278345 - RNA, 19 nt, Homo sapiens
gauuuacuuucucagguau

SEQ ID NO: 278346 - RNA, 19 nt, Homo sapiens
gcgugaggcuagagucaga

SEQ ID NO: 278347 - RNA, 19 nt, Homo sapiens
caaaauaaaccuacucugu

SEQ ID NO: 278348 - RNA, 19 nt, Homo sapiens
gcacuggagggcuacaaga

SEQ ID NO: 278349 - RNA, 19 nt, Homo sapiens
ccuuugggcaguagauuua

SEQ ID NO: 278350 - RNA, 19 nt, Homo sapiens
ccaccucccuuuauugacu

SEQ ID NO: 278351 - RNA, 19 nt, Homo sapiens
cagaucaagugccucaaca

SEQ ID NO: 278352 - RNA, 19 nt, Homo sapiens
acacugcccuuacuuuagg

SEQ ID NO: 278353 - RNA, 19 nt, Homo sapiens
ucaaugaugccaagugcaa

SEQ ID NO: 278354 - RNA, 19 nt, Homo sapiens
gagauccuggaaaugaaua

SEQ ID NO: 278355 - RNA, 19 nt, Homo sapiens
gaaucaagagguggccuuu

SEQ ID NO: 278356 - RNA, 19 nt, Homo sapiens
gcacuggugaacucuaugu

SEQ ID NO: 278357 - RNA, 19 nt, Homo sapiens
gucccuguguugagaauga

SEQ ID NO: 278358 - RNA, 19 nt, Homo sapiens
ucgcaucuuucaucaacaa

SEQ ID NO: 278359 - RNA, 19 nt, Homo sapiens
ggguaaagagggaugagaa

SEQ ID NO: 278360 - RNA, 19 nt, Homo sapiens
gacagacggcagagaaaga

SEQ ID NO: 278361 - RNA, 19 nt, Homo sapiens
acaucgagaucgccaccua

SEQ ID NO: 278362 - RNA, 19 nt, Homo sapiens
caaacuugagggugccaua

SEQ ID NO: 278363 - RNA, 19 nt, Homo sapiens
caaacugugagaauaaauc

SEQ ID NO: 278364 - RNA, 19 nt, Homo sapiens
cccaaacugugagaauaaa

SEQ ID NO: 278365 - RNA, 19 nt, Homo sapiens
aggcugaccuggagaccaa

SEQ ID NO: 278366 - RNA, 19 nt, Homo sapiens
gggcaaagggauauggaau

SEQ ID NO: 278367 - RNA, 19 nt, Homo sapiens
aaagccaagugccacgauu

SEQ ID NO: 278368 - RNA, 19 nt, Homo sapiens
aagcugagccugacuugau

SEQ ID NO: 278369 - RNA, 19 nt, Homo sapiens
uaagaacgagauccuggaa

SEQ ID NO: 278370 - RNA, 19 nt, Homo sapiens
gaucaagugccucaacaac

SEQ ID NO: 278371 - RNA, 19 nt, Homo sapiens
gaugagaaggagcagauca

SEQ ID NO: 278372 - RNA, 19 nt, Homo sapiens
ggcaaagggauauggaaug

SEQ ID NO: 278373 - RNA, 19 nt, Homo sapiens
ggacagacggcagagaaag

SEQ ID NO: 278374 - RNA, 19 nt, Homo sapiens
ccugccugcucaaggaaua

SEQ ID NO: 278375 - RNA, 19 nt, Homo sapiens
ggaagcugagccugacuug

SEQ ID NO: 278376 - RNA, 19 nt, Homo sapiens
acaagcugcuggagaccaa

SEQ ID NO: 278377 - RNA, 19 nt, Homo sapiens
cagagaaagagcaugcauu

SEQ ID NO: 278378 - RNA, 19 nt, Homo sapiens
gggaugagaaggagcagau

SEQ ID NO: 278379 - RNA, 19 nt, Homo sapiens
gguaugaggagcugagagu

SEQ ID NO: 278380 - RNA, 19 nt, Homo sapiens
cagguauguugaacccaaa

SEQ ID NO: 278381 - RNA, 19 nt, Homo sapiens
gagaaggagcagaucaagu

SEQ ID NO: 278382 - RNA, 19 nt, Homo sapiens
gcagcaagaaaccgagaau

SEQ ID NO: 278383 - RNA, 19 nt, Homo sapiens
caucuuucaucaacaaggu

SEQ ID NO: 278384 - RNA, 19 nt, Homo sapiens
acaaccguuucgcaucuuu

SEQ ID NO: 278385 - RNA, 19 nt, Homo sapiens
ccucugcccugaacaucug

SEQ ID NO: 278386 - RNA, 19 nt, Homo sapiens
gggcugaagacaaggaugu

SEQ ID NO: 278387 - RNA, 19 nt, Homo sapiens
cagcugggaaccacuguga

SEQ ID NO: 278388 - RNA, 19 nt, Homo sapiens
agaucaaggcgcaguauga

SEQ ID NO: 278389 - RNA, 19 nt, Homo sapiens
gucagaguuucagcucaua

SEQ ID NO: 278390 - RNA, 19 nt, Homo sapiens
gggacagacggcagagaaa

SEQ ID NO: 278391 - RNA, 19 nt, Homo sapiens
gguguggcagucagaguuu

SEQ ID NO: 278392 - RNA, 19 nt, Homo sapiens
aacgagauccuggaaauga

SEQ ID NO: 278393 - RNA, 19 nt, Homo sapiens
gcagagaaagagcaugcau

SEQ ID NO: 278394 - RNA, 19 nt, Homo sapiens
acgagauccuggaaaugaa

SEQ ID NO: 278395 - RNA, 19 nt, Homo sapiens
gauggucacccacuaugca

SEQ ID NO: 278396 - RNA, 19 nt, Homo sapiens
gaagcugagccugacuuga

SEQ ID NO: 278397 - RNA, 19 nt, Homo sapiens
cacuggcacuggagauaga

SEQ ID NO: 278398 - RNA, 19 nt, Homo sapiens
uggaggaggcucugcagaa

SEQ ID NO: 278399 - RNA, 19 nt, Homo sapiens
agaaaccgagaaugucaaa

SEQ ID NO: 278400 - RNA, 19 nt, Homo sapiens
gaagaaguaugaagaagaa

SEQ ID NO: 278401 - RNA, 19 nt, Homo sapiens
agacaaagcugcaguucua

SEQ ID NO: 278402 - RNA, 19 nt, Homo sapiens
gaacauggacugcaucguu

SEQ ID NO: 278403 - RNA, 19 nt, Homo sapiens
gaaguaugaagaagaagua

SEQ ID NO: 278404 - RNA, 19 nt, Homo sapiens
ccaagccgcugcugcauca

SEQ ID NO: 278405 - RNA, 19 nt, Homo sapiens
gacauggccugccugauca

SEQ ID NO: 278406 - RNA, 19 nt, Homo sapiens
gcuacaagaagaaguauga

SEQ ID NO: 278407 - RNA, 19 nt, Homo sapiens
gagcagaggcugugugaag

SEQ ID NO: 278408 - RNA, 19 nt, Homo sapiens
gaacgaguuuguggcucua

SEQ ID NO: 278409 - RNA, 19 nt, Homo sapiens
caagaagaaguaugaagaa

SEQ ID NO: 278410 - RNA, 19 nt, Homo sapiens
gagaugaaggccacaguga

SEQ ID NO: 278411 - RNA, 19 nt, Homo sapiens
acaagcugcuggagacaaa

SEQ ID NO: 278412 - RNA, 19 nt, Homo sapiens
aaagaaggauguggacugu

SEQ ID NO: 278413 - RNA, 19 nt, Homo sapiens
acaagaagaaguaugaaga

SEQ ID NO: 278414 - RNA, 19 nt, Homo sapiens
gcaagugugaggagaugaa

SEQ ID NO: 278415 - RNA, 19 nt, Homo sapiens
ucaaggcacaguaugauga

SEQ ID NO: 278416 - RNA, 19 nt, Homo sapiens
gcaccaaggaggagaucaa

SEQ ID NO: 278417 - RNA, 19 nt, Homo sapiens
gaugaaggccacagugauc

SEQ ID NO: 278418 - RNA, 19 nt, Homo sapiens
ggcacaguaugaugacauu

SEQ ID NO: 278419 - RNA, 19 nt, Homo sapiens
gaagaagcacugugagacu

SEQ ID NO: 278420 - RNA, 19 nt, Homo sapiens
gccgggaccugaacaugga

SEQ ID NO: 278421 - RNA, 19 nt, Homo sapiens
cagcagagaacgaguuugu

SEQ ID NO: 278422 - RNA, 19 nt, Homo sapiens
gaagcacugugagacuguu

SEQ ID NO: 278423 - RNA, 19 nt, Homo sapiens
agacauggccugccugauc

SEQ ID NO: 278424 - RNA, 19 nt, Homo sapiens
ggugaugaacuccaagcua

SEQ ID NO: 278425 - RNA, 19 nt, Homo sapiens
cuacuccacuguucagaca

SEQ ID NO: 278426 - RNA, 19 nt, Homo sapiens
cagaucaagucccucaaca

SEQ ID NO: 278427 - RNA, 19 nt, Homo sapiens
agaaggagcagaucaaguc

SEQ ID NO: 278428 - RNA, 19 nt, Homo sapiens
gcacaucgcuggcuuuucc

SEQ ID NO: 278429 - RNA, 19 nt, Homo sapiens
cagcaagugugaggagaug

SEQ ID NO: 278430 - RNA, 19 nt, Homo sapiens
guuuguggcucuaaagaag

SEQ ID NO: 278431 - RNA, 19 nt, Homo sapiens
aagcugcaguucuaccaaa

SEQ ID NO: 278432 - RNA, 19 nt, Homo sapiens
cagccgagguggagaaugc

SEQ ID NO: 278433 - RNA, 19 nt, Homo sapiens
agaagaaguaugaagaaga

SEQ ID NO: 278434 - RNA, 19 nt, Homo sapiens
cuggagggcuacaagaaga

SEQ ID NO: 278435 - RNA, 19 nt, Homo sapiens
ugcgagugcugccagagua

SEQ ID NO: 278436 - RNA, 19 nt, Homo sapiens
gaggcugugugaagguguu

SEQ ID NO: 278437 - RNA, 19 nt, Homo sapiens
ccacagcagagaacgaguu

SEQ ID NO: 278438 - RNA, 19 nt, Homo sapiens
cgagaucaaggcacaguau

SEQ ID NO: 278439 - RNA, 19 nt, Homo sapiens
gcgugaagcaggaggagaa

SEQ ID NO: 278440 - RNA, 19 nt, Homo sapiens
gaaggccaagcaagacaug

SEQ ID NO: 278441 - RNA, 19 nt, Homo sapiens
guaugaagaagaaguagca

SEQ ID NO: 278442 - RNA, 19 nt, Homo sapiens
ccaagugccagaacuccaa

SEQ ID NO: 278443 - RNA, 19 nt, Homo sapiens
caacguggaggcccugauc

SEQ ID NO: 278444 - RNA, 19 nt, Homo sapiens
gagaaggagcagaucaagu

SEQ ID NO: 278445 - RNA, 19 nt, Homo sapiens
gaggagaaggagcagauca

SEQ ID NO: 278446 - RNA, 19 nt, Homo sapiens
gccaucuacuccacuguuc

SEQ ID NO: 278447 - RNA, 19 nt, Homo sapiens
cuccuaaccuccgucauga

SEQ ID NO: 278448 - RNA, 19 nt, Homo sapiens
gucaugaccuguggcuuca

SEQ ID NO: 278449 - RNA, 19 nt, Homo sapiens
ugaagcaggaggagaagga

SEQ ID NO: 278450 - RNA, 19 nt, Homo sapiens
ggaaacuucagcugugucu

SEQ ID NO: 278451 - RNA, 19 nt, Homo sapiens
ccuguuugcuggcuacauc

SEQ ID NO: 278452 - RNA, 19 nt, Homo sapiens
auaucgagaucgccaccua

SEQ ID NO: 278453 - RNA, 19 nt, Homo sapiens
gagaucaaggcacaguaug

SEQ ID NO: 278454 - RNA, 19 nt, Homo sapiens
gaggaggagauccgcauuc

SEQ ID NO: 278455 - RNA, 19 nt, Homo sapiens
ggagacaaagcugcaguuc

SEQ ID NO: 278456 - RNA, 19 nt, Homo sapiens
cugccucucuggccucuug

SEQ ID NO: 278457 - RNA, 19 nt, Homo sapiens
ccuggaagaagcacuguga

SEQ ID NO: 278458 - RNA, 19 nt, Homo sapiens
ggagaaggagcagaucaag

SEQ ID NO: 278459 - RNA, 19 nt, Homo sapiens
gaguuuguggcucuaaaga

SEQ ID NO: 278460 - RNA, 19 nt, Homo sapiens
aagaagaaguaugaagaag

SEQ ID NO: 278461 - RNA, 19 nt, Homo sapiens
gaacaagcugcuggagaca

SEQ ID NO: 278462 - RNA, 19 nt, Homo sapiens
gcagaaggccaagcaagac

SEQ ID NO: 278463 - RNA, 19 nt, Homo sapiens
gcgagugcugccagaguaa

SEQ ID NO: 278464 - RNA, 19 nt, Homo sapiens
gugugaagguguugaagcu

SEQ ID NO: 278465 - RNA, 19 nt, Homo sapiens
ugacagccgagguggagaa

SEQ ID NO: 278466 - RNA, 19 nt, Homo sapiens
ccuccuaaccuccgucaug

SEQ ID NO: 278467 - RNA, 19 nt, Homo sapiens
gcagaucaagucccucaac

SEQ ID NO: 278468 - RNA, 19 nt, Homo sapiens
gggaguaccaggaggugau

SEQ ID NO: 278469 - RNA, 19 nt, Homo sapiens
gcagcaagugugaggagau

SEQ ID NO: 278470 - RNA, 19 nt, Homo sapiens
gauccaggagauugacuuc

SEQ ID NO: 278471 - RNA, 19 nt, Homo sapiens
gugccuaccuccgcaaguc

SEQ ID NO: 278472 - RNA, 19 nt, Homo sapiens
aaacuucagcugugucucu

SEQ ID NO: 278473 - RNA, 19 nt, Homo sapiens
gagacaaagcugcaguucu

SEQ ID NO: 278474 - RNA, 19 nt, Homo sapiens
ugucuccccuuuuccaaua

SEQ ID NO: 278475 - RNA, 19 nt, Homo sapiens
agaucaaggcacaguauga

SEQ ID NO: 278476 - RNA, 19 nt, Homo sapiens
cugcaucguugccgagauc

SEQ ID NO: 278477 - RNA, 19 nt, Homo sapiens
ucuccaaucccacaucuca

SEQ ID NO: 278478 - RNA, 19 nt, Homo sapiens
uggaagaagcacugugaga

SEQ ID NO: 278479 - RNA, 19 nt, Homo sapiens
guguugaagcugugaaugu

SEQ ID NO: 278480 - RNA, 19 nt, Homo sapiens
caagcuaggccuggauauc

SEQ ID NO: 278481 - RNA, 19 nt, Homo sapiens
gguaucgcagcaaguguga

SEQ ID NO: 278482 - RNA, 19 nt, Homo sapiens
cacagcagagaacgaguuu

SEQ ID NO: 278483 - RNA, 19 nt, Homo sapiens
gauccgcauucuccaaucc

SEQ ID NO: 278484 - RNA, 19 nt, Homo sapiens
gaagaaguaugaagaggaa

SEQ ID NO: 278485 - RNA, 19 nt, Homo sapiens
ccauguagaugcuccauua

SEQ ID NO: 278486 - RNA, 19 nt, Homo sapiens
ggaaccaccugcaggaugu

SEQ ID NO: 278487 - RNA, 19 nt, Homo sapiens
ucaagacccucaacaacaa

SEQ ID NO: 278488 - RNA, 19 nt, Homo sapiens
gaccaaguaugaagagaug

SEQ ID NO: 278489 - RNA, 19 nt, Homo sapiens
ggaacgagaucaacgaacu

SEQ ID NO: 278490 - RNA, 19 nt, Homo sapiens
gaagaaggauguggaugca

SEQ ID NO: 278491 - RNA, 19 nt, Homo sapiens
gaucacuccucucccuaaa

SEQ ID NO: 278492 - RNA, 19 nt, Homo sapiens
ggaugcagcuuucaugaac

SEQ ID NO: 278493 - RNA, 19 nt, Homo sapiens
caaguuugccuccuucauu

SEQ ID NO: 278494 - RNA, 19 nt, Homo sapiens
gaucauugcugaggucaag

SEQ ID NO: 278495 - RNA, 19 nt, Homo sapiens
ggauguggaugcagcuuuc

SEQ ID NO: 278496 - RNA, 19 nt, Homo sapiens
gccgugaccugaaccuuga

SEQ ID NO: 278497 - RNA, 19 nt, Homo sapiens
caacguggauacccuaacu

SEQ ID NO: 278498 - RNA, 19 nt, Homo sapiens
ucaagaagaaguaugaaga

SEQ ID NO: 278499 - RNA, 19 nt, Homo sapiens
gaagguguuggaccaguaa

SEQ ID NO: 278500 - RNA, 19 nt, Homo sapiens
caacagccgugaccugaac

SEQ ID NO: 278501 - RNA, 19 nt, Homo sapiens
ucagagacgucggucauug

SEQ ID NO: 278502 - RNA, 19 nt, Homo sapiens
cagaauaagcuccuagaga

SEQ ID NO: 278503 - RNA, 19 nt, Homo sapiens
ugaagguguuggaccagua

SEQ ID NO: 278504 - RNA, 19 nt, Homo sapiens
guaugaagaggaaguggua

SEQ ID NO: 278505 - RNA, 19 nt, Homo sapiens
gguaccagaccaaguauga

SEQ ID NO: 278506 - RNA, 19 nt, Homo sapiens
ugacaagguucgguuccua

SEQ ID NO: 278507 - RNA, 19 nt, Homo sapiens
agacgucggucauugugaa

SEQ ID NO: 278508 - RNA, 19 nt, Homo sapiens
gggccaaugcugagaauga

SEQ ID NO: 278509 - RNA, 19 nt, Homo sapiens
uacccuaacucaggaaauu

SEQ ID NO: 278510 - RNA, 19 nt, Homo sapiens
gagaaggagcaaaucaaga

SEQ ID NO: 278511 - RNA, 19 nt, Homo sapiens
ugaagaaggaugagaagga

SEQ ID NO: 278512 - RNA, 19 nt, Homo sapiens
caauuucuguccuuuggau

SEQ ID NO: 278513 - RNA, 19 nt, Homo sapiens
gaugagaaggagcaaauca

SEQ ID NO: 278514 - RNA, 19 nt, Homo sapiens
uggaggugcuggucaguga

SEQ ID NO: 278515 - RNA, 19 nt, Homo sapiens
ggaucacuccucucccuaa

SEQ ID NO: 278516 - RNA, 19 nt, Homo sapiens
ggugacagcuggccaacac

SEQ ID NO: 278517 - RNA, 19 nt, Homo sapiens
aggaagccaucaugucuug

SEQ ID NO: 278518 - RNA, 19 nt, Homo sapiens
caacuucagcucuuguuca

SEQ ID NO: 278519 - RNA, 19 nt, Homo sapiens
uccaagagcagaaauguau

SEQ ID NO: 278520 - RNA, 19 nt, Homo sapiens
gcaguggcauuggcuaugg

SEQ ID NO: 278521 - RNA, 19 nt, Homo sapiens
ggccuuggcagcuuuggua

SEQ ID NO: 278522 - RNA, 19 nt, Homo sapiens
gacccucagugaugccaaa

SEQ ID NO: 278523 - RNA, 19 nt, Homo sapiens
acaacaaguuugccuccuu

SEQ ID NO: 278524 - RNA, 19 nt, Homo sapiens
caacauacggaacgagauc

SEQ ID NO: 278525 - RNA, 19 nt, Homo sapiens
ugacaaccugcgcaacaua

SEQ ID NO: 278526 - RNA, 19 nt, Homo sapiens
ggagugucaucaccuuugg

SEQ ID NO: 278527 - RNA, 19 nt, Homo sapiens
guuccuggguuuucaauaa

SEQ ID NO: 278528 - RNA, 19 nt, Homo sapiens
agaaauguaucaggagcaa

SEQ ID NO: 278529 - RNA, 19 nt, Homo sapiens
caagagcagaaauguauca

SEQ ID NO: 278530 - RNA, 19 nt, Homo sapiens
uccuagagcagcagaauaa

SEQ ID NO: 278531 - RNA, 19 nt, Homo sapiens
aaguuugccuccuucauug

SEQ ID NO: 278532 - RNA, 19 nt, Homo sapiens
ggcauuggcuauggcuuug

SEQ ID NO: 278533 - RNA, 19 nt, Homo sapiens
gugcacuacucuuuguguu

SEQ ID NO: 278534 - RNA, 19 nt, Homo sapiens
acaucgagaucgccaccua

SEQ ID NO: 278535 - RNA, 19 nt, Homo sapiens
gaacgagaucaacgaacug

SEQ ID NO: 278536 - RNA, 19 nt, Homo sapiens
ccaggaagccaucaugucu

SEQ ID NO: 278537 - RNA, 19 nt, Homo sapiens
aaugcaagcuggcagaucu

SEQ ID NO: 278538 - RNA, 19 nt, Homo sapiens
caagaagaaguaugaagag

SEQ ID NO: 278539 - RNA, 19 nt, Homo sapiens
gcagcagaauaagcuccua

SEQ ID NO: 278540 - RNA, 19 nt, Homo sapiens
accaggagcugaugaaugc

SEQ ID NO: 278541 - RNA, 19 nt, Homo sapiens
caaccaggaagccaucaug

SEQ ID NO: 278542 - RNA, 19 nt, Homo sapiens
cccagagggugaagaagga

SEQ ID NO: 278543 - RNA, 19 nt, Homo sapiens
gcuggcagaucuggagugu

SEQ ID NO: 278544 - RNA, 19 nt, Homo sapiens
ccaaugcugagaaugaguu

SEQ ID NO: 278545 - RNA, 19 nt, Homo sapiens
caaaucaagacccucaaca

SEQ ID NO: 278546 - RNA, 19 nt, Homo sapiens
uggcuuugguuacagaguu

SEQ ID NO: 278547 - RNA, 19 nt, Homo sapiens
ccucagugaugccaaaugc

SEQ ID NO: 278548 - RNA, 19 nt, Homo sapiens
uaacucaggaaauugacuu

SEQ ID NO: 278549 - RNA, 19 nt, Homo sapiens
cagcuuucaugaacaaguc

SEQ ID NO: 278550 - RNA, 19 nt, Homo sapiens
gugaacaagagccuacuga

SEQ ID NO: 278551 - RNA, 19 nt, Homo sapiens
ucagugaugccaaaugcaa

SEQ ID NO: 278552 - RNA, 19 nt, Homo sapiens
gaugcagcuuucaugaaca

SEQ ID NO: 278553 - RNA, 19 nt, Homo sapiens
gaaguaugaagaggaagug

SEQ ID NO: 278554 - RNA, 19 nt, Homo sapiens
aaaucaagacccucaacaa

SEQ ID NO: 278555 - RNA, 19 nt, Homo sapiens
ggagcuggcaguggcauug

SEQ ID NO: 278556 - RNA, 19 nt, Homo sapiens
gugggcaacuucagcucuu

SEQ ID NO: 278557 - RNA, 19 nt, Homo sapiens
gacccucaacaacaaguuu

SEQ ID NO: 278558 - RNA, 19 nt, Homo sapiens
gggugaagaaggaugagaa

SEQ ID NO: 278559 - RNA, 19 nt, Homo sapiens
gugacaaccugcgcaacau

SEQ ID NO: 278560 - RNA, 19 nt, Homo sapiens
ggucaaggcccaguaugag

SEQ ID NO: 278561 - RNA, 19 nt, Homo sapiens
ggccaaugcugagaaugag

SEQ ID NO: 278562 - RNA, 19 nt, Homo sapiens
aaauguaucaggagcaauc

SEQ ID NO: 278563 - RNA, 19 nt, Homo sapiens
gcaaaucaagacccucaac

SEQ ID NO: 278564 - RNA, 19 nt, Homo sapiens
gaagaggaagugguauguc

SEQ ID NO: 278565 - RNA, 19 nt, Homo sapiens
ugagaaggagcaaaucaag

SEQ ID NO: 278566 - RNA, 19 nt, Homo sapiens
cagcucuuguucagcaaug

SEQ ID NO: 278567 - RNA, 19 nt, Homo sapiens
ggcccuggcuuugguuaca

SEQ ID NO: 278568 - RNA, 19 nt, Homo sapiens
ugacaccacagaaccugaa

SEQ ID NO: 278569 - RNA, 19 nt, Homo sapiens
uggcauuggcuauggcuuu

SEQ ID NO: 278570 - RNA, 19 nt, Homo sapiens
ugugugcacuacucuuugu

SEQ ID NO: 278571 - RNA, 19 nt, Homo sapiens
ccugugugcacuacucuuu

SEQ ID NO: 278572 - RNA, 19 nt, Homo sapiens
gcgaguaccaggagcugau

SEQ ID NO: 278573 - RNA, 19 nt, Homo sapiens
gcaacauacggaacgagau

SEQ ID NO: 278574 - RNA, 19 nt, Homo sapiens
cagcaaugacaccacagaa

SEQ ID NO: 278575 - RNA, 19 nt, Homo sapiens
guggaugcagcuuucauga

SEQ ID NO: 278576 - RNA, 19 nt, Homo sapiens
ggcuuaaggcagagauuga

SEQ ID NO: 278577 - RNA, 19 nt, Homo sapiens
cgaacugacccgccugauc

SEQ ID NO: 278578 - RNA, 19 nt, Homo sapiens
cgucggucauugugaagau

SEQ ID NO: 278579 - RNA, 19 nt, Homo sapiens
gcaacuucagcucuuguuc

SEQ ID NO: 278580 - RNA, 19 nt, Homo sapiens
ugaagaggaagugguaugu

SEQ ID NO: 278581 - RNA, 19 nt, Homo sapiens
gcagaauaagcuccuagag

SEQ ID NO: 278582 - RNA, 19 nt, Homo sapiens
ggcuuugguuacagaguug

SEQ ID NO: 278583 - RNA, 19 nt, Homo sapiens
ggugaugggagagguguug

SEQ ID NO: 278584 - RNA, 19 nt, Homo sapiens
ggacaggucuugcuauuca

SEQ ID NO: 278585 - RNA, 19 nt, Homo sapiens
gaacauggacugcaucauc

SEQ ID NO: 278586 - RNA, 19 nt, Homo sapiens
ccucagagcucaaccaugu

SEQ ID NO: 278587 - RNA, 19 nt, Homo sapiens
ucacuuaacuccuacuuag

SEQ ID NO: 278588 - RNA, 19 nt, Homo sapiens
ggagaugcauccuaguugu

SEQ ID NO: 278589 - RNA, 19 nt, Homo sapiens
gaaugaguuugucguucua

SEQ ID NO: 278590 - RNA, 19 nt, Homo sapiens
gcccuucacuuaacuccua

SEQ ID NO: 278591 - RNA, 19 nt, Homo sapiens
caugugaccucgcaguuga

SEQ ID NO: 278592 - RNA, 19 nt, Homo sapiens
gcuacaagaagaaguauga

SEQ ID NO: 278593 - RNA, 19 nt, Homo sapiens
gcacuugccuguucauucc

SEQ ID NO: 278594 - RNA, 19 nt, Homo sapiens
gccgagaccugaacaugga

SEQ ID NO: 278595 - RNA, 19 nt, Homo sapiens
gaucaaggcucaguaugac

SEQ ID NO: 278596 - RNA, 19 nt, Homo sapiens
ggcaaccgcugcugcauca

SEQ ID NO: 278597 - RNA, 19 nt, Homo sapiens
caucaucgcugagaucaag

SEQ ID NO: 278598 - RNA, 19 nt, Homo sapiens
gaaccuuuguacauuucaa

SEQ ID NO: 278599 - RNA, 19 nt, Homo sapiens
gcaguugagaagcccauua

SEQ ID NO: 278600 - RNA, 19 nt, Homo sapiens
cagugaaccuuuguacauu

SEQ ID NO: 278601 - RNA, 19 nt, Homo sapiens
cuacuuagcuccaaaauac

SEQ ID NO: 278602 - RNA, 19 nt, Homo sapiens
gaaggugugggcucuguga

SEQ ID NO: 278603 - RNA, 19 nt, Homo sapiens
ggugugggcucugugaaug

SEQ ID NO: 278604 - RNA, 19 nt, Homo sapiens
cagcagagaaugaguuugu

SEQ ID NO: 278605 - RNA, 19 nt, Homo sapiens
acaagaagaaguaugaaga

SEQ ID NO: 278606 - RNA, 19 nt, Homo sapiens
cgaucuguguuucaauaaa

SEQ ID NO: 278607 - RNA, 19 nt, Homo sapiens
gcaagugugaggagaugaa

SEQ ID NO: 278608 - RNA, 19 nt, Homo sapiens
gcaccaaggaggagaucaa

SEQ ID NO: 278609 - RNA, 19 nt, Homo sapiens
cucgaucuguguuucaaua

SEQ ID NO: 278610 - RNA, 19 nt, Homo sapiens
ucagacaccucggucauag

SEQ ID NO: 278611 - RNA, 19 nt, Homo sapiens
gaguuugucguucuaaaga

SEQ ID NO: 278612 - RNA, 19 nt, Homo sapiens
cuacagagggaaagaccua

SEQ ID NO: 278613 - RNA, 19 nt, Homo sapiens
gcacugaauggcaugugaa

SEQ ID NO: 278614 - RNA, 19 nt, Homo sapiens
caauaaaugccgcugcaau

SEQ ID NO: 278615 - RNA, 19 nt, Homo sapiens
agugaaccuuuguacauuu

SEQ ID NO: 278616 - RNA, 19 nt, Homo sapiens
ucagugaaccuuuguacau

SEQ ID NO: 278617 - RNA, 19 nt, Homo sapiens
cagaucaagucccucaaca

SEQ ID NO: 278618 - RNA, 19 nt, Homo sapiens
agaaggagcagaucaaguc

SEQ ID NO: 278619 - RNA, 19 nt, Homo sapiens
gguggaggcgccauccuaa

SEQ ID NO: 278620 - RNA, 19 nt, Homo sapiens
gggagaugcauccuaguug

SEQ ID NO: 278621 - RNA, 19 nt, Homo sapiens
gugaaccuuuguacauuuc

SEQ ID NO: 278622 - RNA, 19 nt, Homo sapiens
gaccagggaggaucagaga

SEQ ID NO: 278623 - RNA, 19 nt, Homo sapiens
ccacagcagagaaugaguu

SEQ ID NO: 278624 - RNA, 19 nt, Homo sapiens
acaucgagaucgccaccua

SEQ ID NO: 278625 - RNA, 19 nt, Homo sapiens
cuggagggcuacaagaaga

SEQ ID NO: 278626 - RNA, 19 nt, Homo sapiens
cuucugggcuaaccuguuc

SEQ ID NO: 278627 - RNA, 19 nt, Homo sapiens
ccagggaggaucagagaga

SEQ ID NO: 278628 - RNA, 19 nt, Homo sapiens
aauaaaugccgcugcaaug

SEQ ID NO: 278629 - RNA, 19 nt, Homo sapiens
uagcaagugugaggagaug

SEQ ID NO: 278630 - RNA, 19 nt, Homo sapiens
gagccacagcagagaauga

SEQ ID NO: 278631 - RNA, 19 nt, Homo sapiens
caagaagaaguaugaagag

SEQ ID NO: 278632 - RNA, 19 nt, Homo sapiens
gcgugaagcaggaggagaa

SEQ ID NO: 278633 - RNA, 19 nt, Homo sapiens
gcaugugaauggaaaaugu

SEQ ID NO: 278634 - RNA, 19 nt, Homo sapiens
aauggcaugugaauggaaa

SEQ ID NO: 278635 - RNA, 19 nt, Homo sapiens
ugaauggcaugugaaugga

SEQ ID NO: 278636 - RNA, 19 nt, Homo sapiens
agaucaaggcucaguauga

SEQ ID NO: 278637 - RNA, 19 nt, Homo sapiens
gugccuaccugcggaaauc

SEQ ID NO: 278638 - RNA, 19 nt, Homo sapiens
acaagcugcuggagaccaa

SEQ ID NO: 278639 - RNA, 19 nt, Homo sapiens
uuggacaggucuugcuauu

SEQ ID NO: 278640 - RNA, 19 nt, Homo sapiens
cggccgagauugagaaugc

SEQ ID NO: 278641 - RNA, 19 nt, Homo sapiens
gcacuuuggacaggucuug

SEQ ID NO: 278642 - RNA, 19 nt, Homo sapiens
gagaaggagcagaucaagu

SEQ ID NO: 278643 - RNA, 19 nt, Homo sapiens
gaggagaaggagcagauca

SEQ ID NO: 278644 - RNA, 19 nt, Homo sapiens
caaccuggagccacuguuc

SEQ ID NO: 278645 - RNA, 19 nt, Homo sapiens
ccaaguggcaguucuacca

SEQ ID NO: 278646 - RNA, 19 nt, Homo sapiens
cuccauggcugcuccagau

SEQ ID NO: 278647 - RNA, 19 nt, Homo sapiens
auucccagcccuucacuua

SEQ ID NO: 278648 - RNA, 19 nt, Homo sapiens
gaauggcaugugaauggaa

SEQ ID NO: 278649 - RNA, 19 nt, Homo sapiens
acaccucggucauagucaa

SEQ ID NO: 278650 - RNA, 19 nt, Homo sapiens
gagaccaaguggcaguucu

SEQ ID NO: 278651 - RNA, 19 nt, Homo sapiens
ugaagcaggaggagaagga

SEQ ID NO: 278652 - RNA, 19 nt, Homo sapiens
ucuccaagcccacaucuca

SEQ ID NO: 278653 - RNA, 19 nt, Homo sapiens
gugcuugcuuccagaaucu

SEQ ID NO: 278654 - RNA, 19 nt, Homo sapiens
gugaaggugugggcucugu

SEQ ID NO: 278655 - RNA, 19 nt, Homo sapiens
gagaucaaggcucaguaug

SEQ ID NO: 278656 - RNA, 19 nt, Homo sapiens
gagagccacagcagagaau

SEQ ID NO: 278657 - RNA, 19 nt, Homo sapiens
ggagaaggagcagaucaag

SEQ ID NO: 278658 - RNA, 19 nt, Homo sapiens
gccauaggcggcagcauca

SEQ ID NO: 278659 - RNA, 19 nt, Homo sapiens
cugggucuccuucuuauga

SEQ ID NO: 278660 - RNA, 19 nt, Homo sapiens
acagagaguuaagccacuu

SEQ ID NO: 278661 - RNA, 19 nt, Homo sapiens
gguccgcuuugccuaguag

SEQ ID NO: 278662 - RNA, 19 nt, Homo sapiens
gaugaaggccacggugauc

SEQ ID NO: 278663 - RNA, 19 nt, Homo sapiens
caguugagaagcccauuau

SEQ ID NO: 278664 - RNA, 19 nt, Homo sapiens
ccuccuggcugggaagaau

SEQ ID NO: 278665 - RNA, 19 nt, Homo sapiens
cugaauggcaugugaaugg

SEQ ID NO: 278666 - RNA, 19 nt, Homo sapiens
uggccugccugcucaagga

SEQ ID NO: 278667 - RNA, 19 nt, Homo sapiens
gaggcugacggccgagauu

SEQ ID NO: 278668 - RNA, 19 nt, Homo sapiens
gcagaucaagucccucaac

SEQ ID NO: 278669 - RNA, 19 nt, Homo sapiens
aaagaaggacguggacugu

SEQ ID NO: 278670 - RNA, 19 nt, Homo sapiens
cacagcagagaaugaguuu

SEQ ID NO: 278671 - RNA, 19 nt, Homo sapiens
ccucguuccuccagcuuca

SEQ ID NO: 278672 - RNA, 19 nt, Homo sapiens
ccugccugcucaaggagua

SEQ ID NO: 278673 - RNA, 19 nt, Homo sapiens
guugagaagcccauuaucg

SEQ ID NO: 278674 - RNA, 19 nt, Homo sapiens
gagaaucagggagaaaguc

SEQ ID NO: 278675 - RNA, 19 nt, Homo sapiens
caacagccgagaccugaac

SEQ ID NO: 278676 - RNA, 19 nt, Homo sapiens
gaggcgccauccuaaccau

SEQ ID NO: 278677 - RNA, 19 nt, Homo sapiens
agacaaagcugcaguucua

SEQ ID NO: 278678 - RNA, 19 nt, Homo sapiens
gaacauggacugcaucauu

SEQ ID NO: 278679 - RNA, 19 nt, Homo sapiens
ggacauggccugccugauc

SEQ ID NO: 278680 - RNA, 19 nt, Homo sapiens
acaaacugcuggagacaaa

SEQ ID NO: 278681 - RNA, 19 nt, Homo sapiens
gccauggucucucucugua

SEQ ID NO: 278682 - RNA, 19 nt, Homo sapiens
gacauggccugccugauca

SEQ ID NO: 278683 - RNA, 19 nt, Homo sapiens
gcuacaagaagaaguauga

SEQ ID NO: 278684 - RNA, 19 nt, Homo sapiens
ggacgucuccauccucaga

SEQ ID NO: 278685 - RNA, 19 nt, Homo sapiens
ucuguagccuuuccuggua

SEQ ID NO: 278686 - RNA, 19 nt, Homo sapiens
ggucuugccugagcucuuc

SEQ ID NO: 278687 - RNA, 19 nt, Homo sapiens
aacauggacugcaucauug

SEQ ID NO: 278688 - RNA, 19 nt, Homo sapiens
caacagcugagaacgaguu

SEQ ID NO: 278689 - RNA, 19 nt, Homo sapiens
gcaagugugaggagaugaa

SEQ ID NO: 278690 - RNA, 19 nt, Homo sapiens
caccaugacuuguggaucu

SEQ ID NO: 278691 - RNA, 19 nt, Homo sapiens
gcaccaaggaggagaucaa

SEQ ID NO: 278692 - RNA, 19 nt, Homo sapiens
gccgggaccugaacaugga

SEQ ID NO: 278693 - RNA, 19 nt, Homo sapiens
gagcaacagcugagaacga

SEQ ID NO: 278694 - RNA, 19 nt, Homo sapiens
ucaaggcacaguacgauga

SEQ ID NO: 278695 - RNA, 19 nt, Homo sapiens
gcgccuaccuccgcaaauc

SEQ ID NO: 278696 - RNA, 19 nt, Homo sapiens
gaggaggagguuucucuga

SEQ ID NO: 278697 - RNA, 19 nt, Homo sapiens
gaacaaacugcuggagaca

SEQ ID NO: 278698 - RNA, 19 nt, Homo sapiens
cggcugagguggagaaugc

SEQ ID NO: 278699 - RNA, 19 nt, Homo sapiens
cagaucaagucccucaaca

SEQ ID NO: 278700 - RNA, 19 nt, Homo sapiens
agaaggagcagaucaaguc

SEQ ID NO: 278701 - RNA, 19 nt, Homo sapiens
uaaacucauuguagcgaau

SEQ ID NO: 278702 - RNA, 19 nt, Homo sapiens
ggacucugcccaugugcuu

SEQ ID NO: 278703 - RNA, 19 nt, Homo sapiens
cagcaagugugaggagaug

SEQ ID NO: 278704 - RNA, 19 nt, Homo sapiens
gaucaaggcacaguacgau

SEQ ID NO: 278705 - RNA, 19 nt, Homo sapiens
guaccucgcgccaggagaa

SEQ ID NO: 278706 - RNA, 19 nt, Homo sapiens
acaucgagaucgccaccua

SEQ ID NO: 278707 - RNA, 19 nt, Homo sapiens
cucagaaccuccucucuuc

SEQ ID NO: 278708 - RNA, 19 nt, Homo sapiens
cuggagggcuacaagaaga

SEQ ID NO: 278709 - RNA, 19 nt, Homo sapiens
cacucuguguuuccaauaa

SEQ ID NO: 278710 - RNA, 19 nt, Homo sapiens
gagacgcggacccuggaua

SEQ ID NO: 278711 - RNA, 19 nt, Homo sapiens
gcacaguacgaugacauug

SEQ ID NO: 278712 - RNA, 19 nt, Homo sapiens
ccaagugccagaauuccaa

SEQ ID NO: 278713 - RNA, 19 nt, Homo sapiens
cagcugagaacgaguuugu

SEQ ID NO: 278714 - RNA, 19 nt, Homo sapiens
gcgugaagcaggaggagaa

SEQ ID NO: 278715 - RNA, 19 nt, Homo sapiens
ccucagaaccuccucucuu

SEQ ID NO: 278716 - RNA, 19 nt, Homo sapiens
gaggagaaggagcagauca

SEQ ID NO: 278717 - RNA, 19 nt, Homo sapiens
gaucucugcgccuccacua

SEQ ID NO: 278718 - RNA, 19 nt, Homo sapiens
gagaaggagcagaucaagu

SEQ ID NO: 278719 - RNA, 19 nt, Homo sapiens
ugccuucuccuuugucuuu

SEQ ID NO: 278720 - RNA, 19 nt, Homo sapiens
acucuguguuuccaauaaa

SEQ ID NO: 278721 - RNA, 19 nt, Homo sapiens
ugaagcaggaggagaagga

SEQ ID NO: 278722 - RNA, 19 nt, Homo sapiens
gaaguaugaggaggagguu

SEQ ID NO: 278723 - RNA, 19 nt, Homo sapiens
ggagacaaagcugcaguuc

SEQ ID NO: 278724 - RNA, 19 nt, Homo sapiens
gucccgaggauucaucuuu

SEQ ID NO: 278725 - RNA, 19 nt, Homo sapiens
cccgcugccugcacucuaa

SEQ ID NO: 278726 - RNA, 19 nt, Homo sapiens
ggagaaggagcagaucaag

SEQ ID NO: 278727 - RNA, 19 nt, Homo sapiens
cagcgugugcggaggcuuu

SEQ ID NO: 278728 - RNA, 19 nt, Homo sapiens
gaugaaggccacggugauc

SEQ ID NO: 278729 - RNA, 19 nt, Homo sapiens
gcagaucaagucccucaac

SEQ ID NO: 278730 - RNA, 19 nt, Homo sapiens
aaugccaagugccagaauu

SEQ ID NO: 278731 - RNA, 19 nt, Homo sapiens
gagagcaacagcugagaac

SEQ ID NO: 278732 - RNA, 19 nt, Homo sapiens
ucacucuguguuuccaaua

SEQ ID NO: 278733 - RNA, 19 nt, Homo sapiens
gggaguaccaggaggugau

SEQ ID NO: 278734 - RNA, 19 nt, Homo sapiens
gcagcaagugugaggagau

SEQ ID NO: 278735 - RNA, 19 nt, Homo sapiens
gagacaaagcugcaguucu

SEQ ID NO: 278736 - RNA, 19 nt, Homo sapiens
ugucuuuguuucacucugu

SEQ ID NO: 278737 - RNA, 19 nt, Homo sapiens
gucucucucuguagccuuu

SEQ ID NO: 278738 - RNA, 19 nt, Homo sapiens
gaggcgccauggucucucu

SEQ ID NO: 278739 - RNA, 19 nt, Homo sapiens
ucugcugccuucuccuuug

SEQ ID NO: 278740 - RNA, 19 nt, Homo sapiens
ccugguagucaauuuguug

SEQ ID NO: 278741 - RNA, 19 nt, Homo sapiens
ugagagcaacagcugagaa

SEQ ID NO: 278742 - RNA, 19 nt, Homo sapiens
gcgaugcccgcugcaaguu

SEQ ID NO: 278743 - RNA, 19 nt, Homo sapiens
gaaugccaagugccagaau

SEQ ID NO: 278744 - RNA, 19 nt, Homo sapiens
ggcacaguacgaugacauu

SEQ ID NO: 278745 - RNA, 19 nt, Homo sapiens
guuuguggcucugaagaag

SEQ ID NO: 278746 - RNA, 19 nt, Homo sapiens
gaaagaagcugaugaaaug

SEQ ID NO: 278747 - RNA, 19 nt, Homo sapiens
ggagaagucugguguaaua

SEQ ID NO: 278748 - RNA, 19 nt, Homo sapiens
gaagguagcuggugauuug

SEQ ID NO: 278749 - RNA, 19 nt, Homo sapiens
guagacaccuucagaguuu

SEQ ID NO: 278750 - RNA, 19 nt, Homo sapiens
guaauggcgucacaaauaa

SEQ ID NO: 278751 - RNA, 19 nt, Homo sapiens
gcaagcagcuacucaguug

SEQ ID NO: 278752 - RNA, 19 nt, Homo sapiens
gcuuaaaccugaccaagua

SEQ ID NO: 278753 - RNA, 19 nt, Homo sapiens
agagagagguuauugauuu

SEQ ID NO: 278754 - RNA, 19 nt, Homo sapiens
ugaaugagcugacugagaa

SEQ ID NO: 278755 - RNA, 19 nt, Homo sapiens
gaagagaacgagaacauuu

SEQ ID NO: 278756 - RNA, 19 nt, Homo sapiens
gaccgaaacugacaaagaa

SEQ ID NO: 278757 - RNA, 19 nt, Homo sapiens
gaaagaagcaaugugguua

SEQ ID NO: 278758 - RNA, 19 nt, Homo sapiens
gcauaaggcucaacaguca

SEQ ID NO: 278759 - RNA, 19 nt, Homo sapiens
gcaguuccauucccagaua

SEQ ID NO: 278760 - RNA, 19 nt, Homo sapiens
gguggaagcuguugaguug

SEQ ID NO: 278761 - RNA, 19 nt, Homo sapiens
gagauuguguugaaagaaa

SEQ ID NO: 278762 - RNA, 19 nt, Homo sapiens
ugaaaaggcucaacaguua

SEQ ID NO: 278763 - RNA, 19 nt, Homo sapiens
gaagaggaacuuaaggaua

SEQ ID NO: 278764 - RNA, 19 nt, Homo sapiens
gguggaaacucucauggua

SEQ ID NO: 278765 - RNA, 19 nt, Homo sapiens
gaguguaccucgagacuuu

SEQ ID NO: 278766 - RNA, 19 nt, Homo sapiens
gcagaagaauuacauaaag

SEQ ID NO: 278767 - RNA, 19 nt, Homo sapiens
caaagaaagugacgcauca

SEQ ID NO: 278768 - RNA, 19 nt, Homo sapiens
gggaagaaguucagagcua

SEQ ID NO: 278769 - RNA, 19 nt, Homo sapiens
caaaucaacuggaaagcaa

SEQ ID NO: 278770 - RNA, 19 nt, Homo sapiens
gaaaguggaucagggaaga

SEQ ID NO: 278771 - RNA, 19 nt, Homo sapiens
ggaacgaucuaccuauguu

SEQ ID NO: 278772 - RNA, 19 nt, Homo sapiens
ugacuacgcuuauacauca

SEQ ID NO: 278773 - RNA, 19 nt, Homo sapiens
gaacagaugaauaccauga

SEQ ID NO: 278774 - RNA, 19 nt, Homo sapiens
gaucaagucuguagaagag

SEQ ID NO: 278775 - RNA, 19 nt, Homo sapiens
gaaagugacgcaucaaaga

SEQ ID NO: 278776 - RNA, 19 nt, Homo sapiens
gcucaacaguuaucuauca

SEQ ID NO: 278777 - RNA, 19 nt, Homo sapiens
uaaagacuguggaagaauu

SEQ ID NO: 278778 - RNA, 19 nt, Homo sapiens
ggaaauguccagcuugaaa

SEQ ID NO: 278779 - RNA, 19 nt, Homo sapiens
gaaacggagucuucugaga

SEQ ID NO: 278780 - RNA, 19 nt, Homo sapiens
ccaagagacuaaacaagaa

SEQ ID NO: 278781 - RNA, 19 nt, Homo sapiens
gcacaugaauuggagaaga

SEQ ID NO: 278782 - RNA, 19 nt, Homo sapiens
gaacagaguuuugucuuuu

SEQ ID NO: 278783 - RNA, 19 nt, Homo sapiens
gagaaagaccuagccaaua

SEQ ID NO: 278784 - RNA, 19 nt, Homo sapiens
ugagaaagauggaaagauc

SEQ ID NO: 278785 - RNA, 19 nt, Homo sapiens
caggaaagcuacagcaaga

SEQ ID NO: 278786 - RNA, 19 nt, Homo sapiens
gcagauggaggcagagaua

SEQ ID NO: 278787 - RNA, 19 nt, Homo sapiens
uaauaaggauguuguggaa

SEQ ID NO: 278788 - RNA, 19 nt, Homo sapiens
aagaggaacuuaaggauau

SEQ ID NO: 278789 - RNA, 19 nt, Homo sapiens
guaaagaagaggaacuuaa

SEQ ID NO: 278790 - RNA, 19 nt, Homo sapiens
agagauagcucacuugaag

SEQ ID NO: 278791 - RNA, 19 nt, Homo sapiens
uuaagaaagugauccauga

SEQ ID NO: 278792 - RNA, 19 nt, Homo sapiens
gaaagugauccaugagaaa

SEQ ID NO: 278793 - RNA, 19 nt, Homo sapiens
gcaacuacaacaugaaauu

SEQ ID NO: 278794 - RNA, 19 nt, Homo sapiens
gcaaugugguuauaacaag

SEQ ID NO: 278795 - RNA, 19 nt, Homo sapiens
agaaagaaauccagaaugg

SEQ ID NO: 278796 - RNA, 19 nt, Homo sapiens
gaaucacacaagacuauua

SEQ ID NO: 278797 - RNA, 19 nt, Homo sapiens
uaaguggucucuggaauga

SEQ ID NO: 278798 - RNA, 19 nt, Homo sapiens
ggagcugaaugcaauaaga

SEQ ID NO: 278799 - RNA, 19 nt, Homo sapiens
gaagagcaacuacaacaug

SEQ ID NO: 278800 - RNA, 19 nt, Homo sapiens
ucaagagacucaacagaug

SEQ ID NO: 278801 - RNA, 19 nt, Homo sapiens
gagagagguuauugauuug

SEQ ID NO: 278802 - RNA, 19 nt, Homo sapiens
caaguccugugguagauaa

SEQ ID NO: 278803 - RNA, 19 nt, Homo sapiens
gagcacaaguugaaagaag

SEQ ID NO: 278804 - RNA, 19 nt, Homo sapiens
caacaguuaucuaucacuu

SEQ ID NO: 278805 - RNA, 19 nt, Homo sapiens
ggaaagaucaagucuguag

SEQ ID NO: 278806 - RNA, 19 nt, Homo sapiens
gaacuuaaggauauacaga

SEQ ID NO: 278807 - RNA, 19 nt, Homo sapiens
cagcaagauuuacagagua

SEQ ID NO: 278808 - RNA, 19 nt, Homo sapiens
ggauaaugcugacucaagu

SEQ ID NO: 278809 - RNA, 19 nt, Homo sapiens
gagcaggucaucaaagaaa

SEQ ID NO: 278810 - RNA, 19 nt, Homo sapiens
uguaauggcgucacaaaua

SEQ ID NO: 278811 - RNA, 19 nt, Homo sapiens
agaaagaccuagccaauac

SEQ ID NO: 278812 - RNA, 19 nt, Homo sapiens
aagcugaagugcagaaauu

SEQ ID NO: 278813 - RNA, 19 nt, Homo sapiens
cgugaucguuuaacaagua

SEQ ID NO: 278814 - RNA, 19 nt, Homo sapiens
gaccuccgcuucaguucua

SEQ ID NO: 278815 - RNA, 19 nt, Homo sapiens
ggaagaugcugcugcuaca

SEQ ID NO: 278816 - RNA, 19 nt, Homo sapiens
gaacaaaagcuuauuccua

SEQ ID NO: 278817 - RNA, 19 nt, Homo sapiens
gaacgaucuaccuauguua

SEQ ID NO: 278818 - RNA, 19 nt, Homo sapiens
guuaaagacuguggaagaa

SEQ ID NO: 278819 - RNA, 19 nt, Homo sapiens
gaaaaugucuucguagaug

SEQ ID NO: 278820 - RNA, 19 nt, Homo sapiens
ccucgagacuuuaaauuau

SEQ ID NO: 278821 - RNA, 19 nt, Homo sapiens
ugaguuagauucuuugaag

SEQ ID NO: 278822 - RNA, 19 nt, Homo sapiens
gaagcaaugugguuauaac

SEQ ID NO: 278823 - RNA, 19 nt, Homo sapiens
gcagcugccucgaagaaga

SEQ ID NO: 278824 - RNA, 19 nt, Homo sapiens
aguagaagaugaucaaguu

SEQ ID NO: 278825 - RNA, 19 nt, Homo sapiens
cagaaacacugaacagagu

SEQ ID NO: 278826 - RNA, 19 nt, Homo sapiens
ggaaguagcacaacauaac

SEQ ID NO: 278827 - RNA, 19 nt, Homo sapiens
guggaagaauuacuugaaa

SEQ ID NO: 278828 - RNA, 19 nt, Homo sapiens
gcaaagacuaaugcaguua

SEQ ID NO: 278829 - RNA, 19 nt, Homo sapiens
uagaagggauccagaaauc

SEQ ID NO: 278830 - RNA, 19 nt, Homo sapiens
gaacgagaacauuuggaaa

SEQ ID NO: 278831 - RNA, 19 nt, Homo sapiens
gcaguuaacccaggaaaug

SEQ ID NO: 278832 - RNA, 19 nt, Homo sapiens
gaagcgaugaccaggauaa

SEQ ID NO: 278833 - RNA, 19 nt, Homo sapiens
gaaccugucccaguuacua

SEQ ID NO: 278834 - RNA, 19 nt, Homo sapiens
agagugaucuuucuagcaa

SEQ ID NO: 278835 - RNA, 19 nt, Homo sapiens
aagaggagcugaaugcaau

SEQ ID NO: 278836 - RNA, 19 nt, Homo sapiens
gaaagcuucaucaaagaaa

SEQ ID NO: 278837 - RNA, 19 nt, Homo sapiens
gaaacacucacaaaacuua

SEQ ID NO: 278838 - RNA, 19 nt, Homo sapiens
gcagaaacagaaggaauuu

SEQ ID NO: 278839 - RNA, 19 nt, Homo sapiens
ggagaaaacuguucaggau

SEQ ID NO: 278840 - RNA, 19 nt, Homo sapiens
agaaagugauccaugagaa

SEQ ID NO: 278841 - RNA, 19 nt, Homo sapiens
gcagagauagcucacuuga

SEQ ID NO: 278842 - RNA, 19 nt, Homo sapiens
agaauugacuacgcuuaua

SEQ ID NO: 278843 - RNA, 19 nt, Homo sapiens
uuaaagaagucaaguaagg

SEQ ID NO: 278844 - RNA, 19 nt, Homo sapiens
aacaagagcuagagcgauu

SEQ ID NO: 278845 - RNA, 19 nt, Homo sapiens
uugaagaacuugagauugu

SEQ ID NO: 278846 - RNA, 19 nt, Homo sapiens
gaaaugagaccaccaauau

SEQ ID NO: 278847 - RNA, 19 nt, Homo sapiens
caagagacauauccacaaa

SEQ ID NO: 278848 - RNA, 19 nt, Homo sapiens
gaacggcaaccucuacuuu

SEQ ID NO: 278849 - RNA, 19 nt, Homo sapiens
ggaaaugagaccaccaaua

SEQ ID NO: 278850 - RNA, 19 nt, Homo sapiens
gaggaugguucguucauug

SEQ ID NO: 278851 - RNA, 19 nt, Homo sapiens
gaagaacccuguggaugug

SEQ ID NO: 278852 - RNA, 19 nt, Homo sapiens
gcagagaggcugugguuug

SEQ ID NO: 278853 - RNA, 19 nt, Homo sapiens
gaaagggucuccgaaaugc

SEQ ID NO: 278854 - RNA, 19 nt, Homo sapiens
uggaggagcuggccaaaga

SEQ ID NO: 278855 - RNA, 19 nt, Homo sapiens
gcagcacaaucgagaagaa

SEQ ID NO: 278856 - RNA, 19 nt, Homo sapiens
cacuacaccuuuaggguua

SEQ ID NO: 278857 - RNA, 19 nt, Homo sapiens
gauacaaugugacguacug

SEQ ID NO: 278858 - RNA, 19 nt, Homo sapiens
agagacauauccacaaaga

SEQ ID NO: 278859 - RNA, 19 nt, Homo sapiens
gaccagaaguaccggauuc

SEQ ID NO: 278860 - RNA, 19 nt, Homo sapiens
gcaaauacucagugaagga

SEQ ID NO: 278861 - RNA, 19 nt, Homo sapiens
gagauccacuuguuuaagg

SEQ ID NO: 278862 - RNA, 19 nt, Homo sapiens
caucauggcuaaccugaag

SEQ ID NO: 278863 - RNA, 19 nt, Homo sapiens
cagcguggauguucaguuc

SEQ ID NO: 278864 - RNA, 19 nt, Homo sapiens
ggacgaggaugggacaaca

SEQ ID NO: 278865 - RNA, 19 nt, Homo sapiens
gcaagagacauauccacaa

SEQ ID NO: 278866 - RNA, 19 nt, Homo sapiens
ggaccaucauucagaagga

SEQ ID NO: 278867 - RNA, 19 nt, Homo sapiens
ccaggaccaucauucagaa

SEQ ID NO: 278868 - RNA, 19 nt, Homo sapiens
cgaaagggucuccgaaaug

SEQ ID NO: 278869 - RNA, 19 nt, Homo sapiens
ccgaaagggucuccgaaau

SEQ ID NO: 278870 - RNA, 19 nt, Homo sapiens
guucaaagccuugggagaa

SEQ ID NO: 278871 - RNA, 19 nt, Homo sapiens
acacaauggugacccaaug

SEQ ID NO: 278872 - RNA, 19 nt, Homo sapiens
ucuccgaaaugcugucuuu

SEQ ID NO: 278873 - RNA, 19 nt, Homo sapiens
aauacucagugaaggauaa

SEQ ID NO: 278874 - RNA, 19 nt, Homo sapiens
gcaacuguccuucaaccuu

SEQ ID NO: 278875 - RNA, 19 nt, Homo sapiens
gcggauacaaugugacgua

SEQ ID NO: 278876 - RNA, 19 nt, Homo sapiens
gcaccaggaccaucauuca

SEQ ID NO: 278877 - RNA, 19 nt, Homo sapiens
gaaauccucaacucaagug

SEQ ID NO: 278878 - RNA, 19 nt, Homo sapiens
uauguccacuacaccuuua

SEQ ID NO: 278879 - RNA, 19 nt, Homo sapiens
gggcaacaacagcaacuuu

SEQ ID NO: 278880 - RNA, 19 nt, Homo sapiens
gggcagagaggcugugguu

SEQ ID NO: 278881 - RNA, 19 nt, Homo sapiens
acgacagccuggccgauua

SEQ ID NO: 278882 - RNA, 19 nt, Homo sapiens
uacgagauccacuuguuua

SEQ ID NO: 278883 - RNA, 19 nt, Homo sapiens
ggaggaugauggcgaguac

SEQ ID NO: 278884 - RNA, 19 nt, Homo sapiens
gagggaugguguccacuuc

SEQ ID NO: 278885 - RNA, 19 nt, Homo sapiens
aagcacagcaagagacaua

SEQ ID NO: 278886 - RNA, 19 nt, Homo sapiens
ggcaaucccugagcuggaa

SEQ ID NO: 278887 - RNA, 19 nt, Homo sapiens
gggcaucuaccgcugcuuu

SEQ ID NO: 278888 - RNA, 19 nt, Homo sapiens
gggaugguguccacuucaa

SEQ ID NO: 278889 - RNA, 19 nt, Homo sapiens
caaagagggcccuggugaa

SEQ ID NO: 278890 - RNA, 19 nt, Homo sapiens
ccaccuucgugcccuauga

SEQ ID NO: 278891 - RNA, 19 nt, Homo sapiens
agaagaacccuguggaugu

SEQ ID NO: 278892 - RNA, 19 nt, Homo sapiens
gagcuggaaggcauugaaa

SEQ ID NO: 278893 - RNA, 19 nt, Homo sapiens
gauccugacugcggacaau

SEQ ID NO: 278894 - RNA, 19 nt, Homo sapiens
ggaccaggguuggcaccuu

SEQ ID NO: 278895 - RNA, 19 nt, Homo sapiens
ugaaggacaccaugugaug

SEQ ID NO: 278896 - RNA, 19 nt, Homo sapiens
gcaacgugcagcccaguga

SEQ ID NO: 278897 - RNA, 19 nt, Homo sapiens
gaccaucauucagaaggaa

SEQ ID NO: 278898 - RNA, 19 nt, Homo sapiens
cccaccaucugcugucuuu

SEQ ID NO: 278899 - RNA, 19 nt, Homo sapiens
gaaagugggcgaggaggau

SEQ ID NO: 278900 - RNA, 19 nt, Homo sapiens
gcguggauguucaguucaa

SEQ ID NO: 278901 - RNA, 19 nt, Homo sapiens
uuccauaucuuguucaaag

SEQ ID NO: 278902 - RNA, 19 nt, Homo sapiens
cgaggaugguucguucauu

SEQ ID NO: 278903 - RNA, 19 nt, Homo sapiens
caagugccgugcuggucaa

SEQ ID NO: 278904 - RNA, 19 nt, Homo sapiens
gcagcccagugacacaaug

SEQ ID NO: 278905 - RNA, 19 nt, Homo sapiens
cagagaggcugugguuugg

SEQ ID NO: 278906 - RNA, 19 nt, Homo sapiens
acuacgagauccacuuguu

SEQ ID NO: 278907 - RNA, 19 nt, Homo sapiens
ccaccaacagcaugauuga

SEQ ID NO: 278908 - RNA, 19 nt, Homo sapiens
caucugcugucuuuucuuu

SEQ ID NO: 278909 - RNA, 19 nt, Homo sapiens
ugacaucagccucaagugu

SEQ ID NO: 278910 - RNA, 19 nt, Homo sapiens
ccaguacaguggcaagaag

SEQ ID NO: 278911 - RNA, 19 nt, Homo sapiens
cacaguaugucagcuacaa

SEQ ID NO: 278912 - RNA, 19 nt, Homo sapiens
ucaaagccuugggagaaga

SEQ ID NO: 278913 - RNA, 19 nt, Homo sapiens
gugcaucgccgagggcuuu

SEQ ID NO: 278914 - RNA, 19 nt, Homo sapiens
acaucagccucaaguguga

SEQ ID NO: 278915 - RNA, 19 nt, Homo sapiens
ggcaacaacagcaacuuug

SEQ ID NO: 278916 - RNA, 19 nt, Homo sapiens
gcacagcaagagacauauc

SEQ ID NO: 278917 - RNA, 19 nt, Homo sapiens
gcuggaaggcauugaaauc

SEQ ID NO: 278918 - RNA, 19 nt, Homo sapiens
ugacaaguacuucauagag

SEQ ID NO: 278919 - RNA, 19 nt, Homo sapiens
cuacgagauccacuuguuu

SEQ ID NO: 278920 - RNA, 19 nt, Homo sapiens
ccaaggagggccagugcaa

SEQ ID NO: 278921 - RNA, 19 nt, Homo sapiens
ggccuugucugggaucuca

SEQ ID NO: 278922 - RNA, 19 nt, Homo sapiens
ggaagcacagcaagagaca

SEQ ID NO: 278923 - RNA, 19 nt, Homo sapiens
ggacagugacaaguacuuc

SEQ ID NO: 278924 - RNA, 19 nt, Homo sapiens
uaccagaaccacaacaaga

SEQ ID NO: 278925 - RNA, 19 nt, Homo sapiens
cuccggaucuacuggauga

SEQ ID NO: 278926 - RNA, 19 nt, Homo sapiens
ggccaaaggagacagugaa

SEQ ID NO: 278927 - RNA, 19 nt, Homo sapiens
uucaggagcuccauacaca

SEQ ID NO: 278928 - RNA, 19 nt, Homo sapiens
cccgaccgaugaaagauga

SEQ ID NO: 278929 - RNA, 19 nt, Homo sapiens
caacuucagguuccauauc

SEQ ID NO: 278930 - RNA, 19 nt, Homo sapiens
cacacaaccugaccgaucu

SEQ ID NO: 278931 - RNA, 19 nt, Homo sapiens
caauggugacccaauguga

SEQ ID NO: 278932 - RNA, 19 nt, Homo sapiens
cggcaugcguacuauguca

SEQ ID NO: 278933 - RNA, 19 nt, Homo sapiens
cgacaaccacucagacuac

SEQ ID NO: 278934 - RNA, 19 nt, Homo sapiens
cagguuccauaucuuguuc

SEQ ID NO: 278935 - RNA, 19 nt, Homo sapiens
gugccgugcuggucaagug

SEQ ID NO: 278936 - RNA, 19 nt, Homo sapiens
ccagggaaccagaccucua

SEQ ID NO: 278937 - RNA, 19 nt, Homo sapiens
gaauuugaggacaaggaaa

SEQ ID NO: 278938 - RNA, 19 nt, Homo sapiens
gacaaccacucagacuaca

SEQ ID NO: 278939 - RNA, 19 nt, Homo sapiens
ggaugaacagcaagaucuu

SEQ ID NO: 278940 - RNA, 19 nt, Homo sapiens
uaugaaggacaccauguga

SEQ ID NO: 278941 - RNA, 19 nt, Homo sapiens
ggcggcaaauacucaguga

SEQ ID NO: 278942 - RNA, 19 nt, Homo sapiens
guucaucggcuuugugagu

SEQ ID NO: 278943 - RNA, 19 nt, Homo sapiens
aaauggcugugaagaccaa

SEQ ID NO: 278944 - RNA, 19 nt, Homo sapiens
gcuacgugcucuccuacca

SEQ ID NO: 278945 - RNA, 19 nt, Homo sapiens
gaggaagcacagcaagaga

SEQ ID NO: 278946 - RNA, 19 nt, Homo sapiens
gaaaugagaccaccaauau

SEQ ID NO: 278947 - RNA, 19 nt, Homo sapiens
caagagacauauccacaaa

SEQ ID NO: 278948 - RNA, 19 nt, Homo sapiens
gaacggcaaccucuacuuu

SEQ ID NO: 278949 - RNA, 19 nt, Homo sapiens
ggaaaugagaccaccaaua

SEQ ID NO: 278950 - RNA, 19 nt, Homo sapiens
gaggaugguucguucauug

SEQ ID NO: 278951 - RNA, 19 nt, Homo sapiens
gaagaacccuguggaugug

SEQ ID NO: 278952 - RNA, 19 nt, Homo sapiens
gcagagaggcugugguuug

SEQ ID NO: 278953 - RNA, 19 nt, Homo sapiens
gaaagggucuccgaaaugc

SEQ ID NO: 278954 - RNA, 19 nt, Homo sapiens
uggaggagcuggccaaaga

SEQ ID NO: 278955 - RNA, 19 nt, Homo sapiens
gcagcacaaucgagaagaa

SEQ ID NO: 278956 - RNA, 19 nt, Homo sapiens
cacuacaccuuuaggguua

SEQ ID NO: 278957 - RNA, 19 nt, Homo sapiens
gauacaaugugacguacug

SEQ ID NO: 278958 - RNA, 19 nt, Homo sapiens
agagacauauccacaaaga

SEQ ID NO: 278959 - RNA, 19 nt, Homo sapiens
gaccagaaguaccggauuc

SEQ ID NO: 278960 - RNA, 19 nt, Homo sapiens
gcaaauacucagugaagga

SEQ ID NO: 278961 - RNA, 19 nt, Homo sapiens
gagauccacuuguuuaagg

SEQ ID NO: 278962 - RNA, 19 nt, Homo sapiens
caucauggcuaaccugaag

SEQ ID NO: 278963 - RNA, 19 nt, Homo sapiens
cagcguggauguucaguuc

SEQ ID NO: 278964 - RNA, 19 nt, Homo sapiens
ggacgaggaugggacaaca

SEQ ID NO: 278965 - RNA, 19 nt, Homo sapiens
gcaagagacauauccacaa

SEQ ID NO: 278966 - RNA, 19 nt, Homo sapiens
ggaccaucauucagaagga

SEQ ID NO: 278967 - RNA, 19 nt, Homo sapiens
ccaggaccaucauucagaa

SEQ ID NO: 278968 - RNA, 19 nt, Homo sapiens
cgaaagggucuccgaaaug

SEQ ID NO: 278969 - RNA, 19 nt, Homo sapiens
ccgaaagggucuccgaaau

SEQ ID NO: 278970 - RNA, 19 nt, Homo sapiens
guucaaagccuugggagaa

SEQ ID NO: 278971 - RNA, 19 nt, Homo sapiens
acacaauggugacccaaug

SEQ ID NO: 278972 - RNA, 19 nt, Homo sapiens
ucuccgaaaugcugucuuu

SEQ ID NO: 278973 - RNA, 19 nt, Homo sapiens
aauacucagugaaggauaa

SEQ ID NO: 278974 - RNA, 19 nt, Homo sapiens
gcaacuguccuucaaccuu

SEQ ID NO: 278975 - RNA, 19 nt, Homo sapiens
gcggauacaaugugacgua

SEQ ID NO: 278976 - RNA, 19 nt, Homo sapiens
gcaccaggaccaucauuca

SEQ ID NO: 278977 - RNA, 19 nt, Homo sapiens
gaaauccucaacucaagug

SEQ ID NO: 278978 - RNA, 19 nt, Homo sapiens
uauguccacuacaccuuua

SEQ ID NO: 278979 - RNA, 19 nt, Homo sapiens
gggcaacaacagcaacuuu

SEQ ID NO: 278980 - RNA, 19 nt, Homo sapiens
gggcagagaggcugugguu

SEQ ID NO: 278981 - RNA, 19 nt, Homo sapiens
acgacagccuggccgauua

SEQ ID NO: 278982 - RNA, 19 nt, Homo sapiens
uacgagauccacuuguuua

SEQ ID NO: 278983 - RNA, 19 nt, Homo sapiens
ggaggaugauggcgaguac

SEQ ID NO: 278984 - RNA, 19 nt, Homo sapiens
gagggaugguguccacuuc

SEQ ID NO: 278985 - RNA, 19 nt, Homo sapiens
aagcacagcaagagacaua

SEQ ID NO: 278986 - RNA, 19 nt, Homo sapiens
ggcaaucccugagcuggaa

SEQ ID NO: 278987 - RNA, 19 nt, Homo sapiens
gggcaucuaccgcugcuuu

SEQ ID NO: 278988 - RNA, 19 nt, Homo sapiens
gggaugguguccacuucaa

SEQ ID NO: 278989 - RNA, 19 nt, Homo sapiens
caaagagggcccuggugaa

SEQ ID NO: 278990 - RNA, 19 nt, Homo sapiens
ccaccuucgugcccuauga

SEQ ID NO: 278991 - RNA, 19 nt, Homo sapiens
agaagaacccuguggaugu

SEQ ID NO: 278992 - RNA, 19 nt, Homo sapiens
gagcuggaaggcauugaaa

SEQ ID NO: 278993 - RNA, 19 nt, Homo sapiens
gauccugacugcggacaau

SEQ ID NO: 278994 - RNA, 19 nt, Homo sapiens
ggaccaggguuggcaccuu

SEQ ID NO: 278995 - RNA, 19 nt, Homo sapiens
ugaaggacaccaugugaug

SEQ ID NO: 278996 - RNA, 19 nt, Homo sapiens
gcaacgugcagcccaguga

SEQ ID NO: 278997 - RNA, 19 nt, Homo sapiens
gaccaucauucagaaggaa

SEQ ID NO: 278998 - RNA, 19 nt, Homo sapiens
cccaccaucugcugucuuu

SEQ ID NO: 278999 - RNA, 19 nt, Homo sapiens
gaaagugggcgaggaggau

SEQ ID NO: 279000 - RNA, 19 nt, Homo sapiens
gcguggauguucaguucaa

SEQ ID NO: 279001 - RNA, 19 nt, Homo sapiens
uuccauaucuuguucaaag

SEQ ID NO: 279002 - RNA, 19 nt, Homo sapiens
cgaggaugguucguucauu

SEQ ID NO: 279003 - RNA, 19 nt, Homo sapiens
caagugccgugcuggucaa

SEQ ID NO: 279004 - RNA, 19 nt, Homo sapiens
gcagcccagugacacaaug

SEQ ID NO: 279005 - RNA, 19 nt, Homo sapiens
cagagaggcugugguuugg

SEQ ID NO: 279006 - RNA, 19 nt, Homo sapiens
acuacgagauccacuuguu

SEQ ID NO: 279007 - RNA, 19 nt, Homo sapiens
ccaccaacagcaugauuga

SEQ ID NO: 279008 - RNA, 19 nt, Homo sapiens
caucugcugucuuuucuuu

SEQ ID NO: 279009 - RNA, 19 nt, Homo sapiens
ugacaucagccucaagugu

SEQ ID NO: 279010 - RNA, 19 nt, Homo sapiens
ccaguacaguggcaagaag

SEQ ID NO: 279011 - RNA, 19 nt, Homo sapiens
cacaguaugucagcuacaa

SEQ ID NO: 279012 - RNA, 19 nt, Homo sapiens
ucaaagccuugggagaaga

SEQ ID NO: 279013 - RNA, 19 nt, Homo sapiens
gugcaucgccgagggcuuu

SEQ ID NO: 279014 - RNA, 19 nt, Homo sapiens
acaucagccucaaguguga

SEQ ID NO: 279015 - RNA, 19 nt, Homo sapiens
ggcaacaacagcaacuuug

SEQ ID NO: 279016 - RNA, 19 nt, Homo sapiens
gcacagcaagagacauauc

SEQ ID NO: 279017 - RNA, 19 nt, Homo sapiens
gcuggaaggcauugaaauc

SEQ ID NO: 279018 - RNA, 19 nt, Homo sapiens
ugacaaguacuucauagag

SEQ ID NO: 279019 - RNA, 19 nt, Homo sapiens
cuacgagauccacuuguuu

SEQ ID NO: 279020 - RNA, 19 nt, Homo sapiens
ccaaggagggccagugcaa

SEQ ID NO: 279021 - RNA, 19 nt, Homo sapiens
ggccuugucugggaucuca

SEQ ID NO: 279022 - RNA, 19 nt, Homo sapiens
ggaagcacagcaagagaca

SEQ ID NO: 279023 - RNA, 19 nt, Homo sapiens
ggacagugacaaguacuuc

SEQ ID NO: 279024 - RNA, 19 nt, Homo sapiens
uaccagaaccacaacaaga

SEQ ID NO: 279025 - RNA, 19 nt, Homo sapiens
cuccggaucuacuggauga

SEQ ID NO: 279026 - RNA, 19 nt, Homo sapiens
ggccaaaggagacagugaa

SEQ ID NO: 279027 - RNA, 19 nt, Homo sapiens
uucaggagcuccauacaca

SEQ ID NO: 279028 - RNA, 19 nt, Homo sapiens
cccgaccgaugaaagauga

SEQ ID NO: 279029 - RNA, 19 nt, Homo sapiens
caacuucagguuccauauc

SEQ ID NO: 279030 - RNA, 19 nt, Homo sapiens
cacacaaccugaccgaucu

SEQ ID NO: 279031 - RNA, 19 nt, Homo sapiens
caauggugacccaauguga

SEQ ID NO: 279032 - RNA, 19 nt, Homo sapiens
cggcaugcguacuauguca

SEQ ID NO: 279033 - RNA, 19 nt, Homo sapiens
cgacaaccacucagacuac

SEQ ID NO: 279034 - RNA, 19 nt, Homo sapiens
cagguuccauaucuuguuc

SEQ ID NO: 279035 - RNA, 19 nt, Homo sapiens
gugccgugcuggucaagug

SEQ ID NO: 279036 - RNA, 19 nt, Homo sapiens
ccagggaaccagaccucua

SEQ ID NO: 279037 - RNA, 19 nt, Homo sapiens
gaauuugaggacaaggaaa

SEQ ID NO: 279038 - RNA, 19 nt, Homo sapiens
gacaaccacucagacuaca

SEQ ID NO: 279039 - RNA, 19 nt, Homo sapiens
ggaugaacagcaagaucuu

SEQ ID NO: 279040 - RNA, 19 nt, Homo sapiens
uaugaaggacaccauguga

SEQ ID NO: 279041 - RNA, 19 nt, Homo sapiens
ggcggcaaauacucaguga

SEQ ID NO: 279042 - RNA, 19 nt, Homo sapiens
guucaucggcuuugugagu

SEQ ID NO: 279043 - RNA, 19 nt, Homo sapiens
aaauggcugugaagaccaa

SEQ ID NO: 279044 - RNA, 19 nt, Homo sapiens
gcuacgugcucuccuacca

SEQ ID NO: 279045 - RNA, 19 nt, Homo sapiens
gaggaagcacagcaagaga

SEQ ID NO: 279046 - RNA, 19 nt, Homo sapiens
gagagaagcuggagagaua

SEQ ID NO: 279047 - RNA, 19 nt, Homo sapiens
gaaggaggcuggugucuga

SEQ ID NO: 279048 - RNA, 19 nt, Homo sapiens
ggaaggaucugauaaacuc

SEQ ID NO: 279049 - RNA, 19 nt, Homo sapiens
gcaagugccucuuugucua

SEQ ID NO: 279050 - RNA, 19 nt, Homo sapiens
gcaugaagcucccagacaa

SEQ ID NO: 279051 - RNA, 19 nt, Homo sapiens
gcacugggcucaggaagga

SEQ ID NO: 279052 - RNA, 19 nt, Homo sapiens
gagauaagcggccauguga

SEQ ID NO: 279053 - RNA, 19 nt, Homo sapiens
ccacuuacccuuucucuga

SEQ ID NO: 279054 - RNA, 19 nt, Homo sapiens
ggaugaaacccaagaaaga

SEQ ID NO: 279055 - RNA, 19 nt, Homo sapiens
gcacuggccucagagaaga

SEQ ID NO: 279056 - RNA, 19 nt, Homo sapiens
agaaacagcucagagaaga

SEQ ID NO: 279057 - RNA, 19 nt, Homo sapiens
gcagcacccuuuccucuca

SEQ ID NO: 279058 - RNA, 19 nt, Homo sapiens
caaccaagcuaggaacauc

SEQ ID NO: 279059 - RNA, 19 nt, Homo sapiens
gaaccaaccaagcuaggaa

SEQ ID NO: 279060 - RNA, 19 nt, Homo sapiens
ggccugggcugcaaucaau

SEQ ID NO: 279061 - RNA, 19 nt, Homo sapiens
gaugaaacccaagaaagaa

SEQ ID NO: 279062 - RNA, 19 nt, Homo sapiens
ggaggaagaggcagauaug

SEQ ID NO: 279063 - RNA, 19 nt, Homo sapiens
gcuggacgcugagguguga

SEQ ID NO: 279064 - RNA, 19 nt, Homo sapiens
gugaggaggaucaucauuu

SEQ ID NO: 279065 - RNA, 19 nt, Homo sapiens
gauaagcggccaugugauc

SEQ ID NO: 279066 - RNA, 19 nt, Homo sapiens
agaaggugcuggccucaga

SEQ ID NO: 279067 - RNA, 19 nt, Homo sapiens
gcaagcgccaccucuuuga

SEQ ID NO: 279068 - RNA, 19 nt, Homo sapiens
ggaggcuggugucugagaa

SEQ ID NO: 279069 - RNA, 19 nt, Homo sapiens
gaaagggguuccagaaaag

SEQ ID NO: 279070 - RNA, 19 nt, Homo sapiens
gauagcagugucagagaaa

SEQ ID NO: 279071 - RNA, 19 nt, Homo sapiens
cagcaagcgccaccucuuu

SEQ ID NO: 279072 - RNA, 19 nt, Homo sapiens
gaagaaagggguuccagaa

SEQ ID NO: 279073 - RNA, 19 nt, Homo sapiens
gaaacagcucagagaagaa

SEQ ID NO: 279074 - RNA, 19 nt, Homo sapiens
aaagaaacagcucagagaa

SEQ ID NO: 279075 - RNA, 19 nt, Homo sapiens
aagcuuccaucuuugagaa

SEQ ID NO: 279076 - RNA, 19 nt, Homo sapiens
agaaagggguuccagaaaa

SEQ ID NO: 279077 - RNA, 19 nt, Homo sapiens
gaagagcccaacugcagau

SEQ ID NO: 279078 - RNA, 19 nt, Homo sapiens
ugaggaggaucaucauuuu

SEQ ID NO: 279079 - RNA, 19 nt, Homo sapiens
cuggaggccuugcuuucua

SEQ ID NO: 279080 - RNA, 19 nt, Homo sapiens
gugcaaccacuuacccuuu

SEQ ID NO: 279081 - RNA, 19 nt, Homo sapiens
cuacagcagcucccucaaa

SEQ ID NO: 279082 - RNA, 19 nt, Homo sapiens
agagacugaugagaccuua

SEQ ID NO: 279083 - RNA, 19 nt, Homo sapiens
aaagaaaacucggaaacaa

SEQ ID NO: 279084 - RNA, 19 nt, Homo sapiens
agauagcagugucagagaa

SEQ ID NO: 279085 - RNA, 19 nt, Homo sapiens
ucagccuggugcccuguua

SEQ ID NO: 279086 - RNA, 19 nt, Homo sapiens
cagaagagaggaagaaagg

SEQ ID NO: 279087 - RNA, 19 nt, Homo sapiens
ccaagaaggaacuggaaau

SEQ ID NO: 279088 - RNA, 19 nt, Homo sapiens
aagcugugguuuacaacuu

SEQ ID NO: 279089 - RNA, 19 nt, Homo sapiens
ucucacagcagcacccuuu

SEQ ID NO: 279090 - RNA, 19 nt, Homo sapiens
ggagagaagcuggagagau

SEQ ID NO: 279091 - RNA, 19 nt, Homo sapiens
gagccuggucuccgauaaa

SEQ ID NO: 279092 - RNA, 19 nt, Homo sapiens
gagcuuggagcauggugaa

SEQ ID NO: 279093 - RNA, 19 nt, Homo sapiens
caagugccucuuugucuau

SEQ ID NO: 279094 - RNA, 19 nt, Homo sapiens
gugcuggccucagagaaga

SEQ ID NO: 279095 - RNA, 19 nt, Homo sapiens
caggaaggaucugauaaac

SEQ ID NO: 279096 - RNA, 19 nt, Homo sapiens
gaagcucccagacaacaca

SEQ ID NO: 279097 - RNA, 19 nt, Homo sapiens
caagaaggaacuggaaauc

SEQ ID NO: 279098 - RNA, 19 nt, Homo sapiens
ggugaaccaucagagaauc

SEQ ID NO: 279099 - RNA, 19 nt, Homo sapiens
ccuauguccugcccagaga

SEQ ID NO: 279100 - RNA, 19 nt, Homo sapiens
acagugaaguugggagaga

SEQ ID NO: 279101 - RNA, 19 nt, Homo sapiens
aagaagacggcaccugaaa

SEQ ID NO: 279102 - RNA, 19 nt, Homo sapiens
caagacagaccugcaaguc

SEQ ID NO: 279103 - RNA, 19 nt, Homo sapiens
ugagauaagcggccaugug

SEQ ID NO: 279104 - RNA, 19 nt, Homo sapiens
gaaagaaaacucggaaaca

SEQ ID NO: 279105 - RNA, 19 nt, Homo sapiens
gagcccaacugcagaugcu

SEQ ID NO: 279106 - RNA, 19 nt, Homo sapiens
gagacuaccgagcguggaa

SEQ ID NO: 279107 - RNA, 19 nt, Homo sapiens
gaucaucauuuuccucauc

SEQ ID NO: 279108 - RNA, 19 nt, Homo sapiens
gcaaccacuuacccuuucu

SEQ ID NO: 279109 - RNA, 19 nt, Homo sapiens
gcuccuuccugcucacauc

SEQ ID NO: 279110 - RNA, 19 nt, Homo sapiens
uacagcagcucccucaaac

SEQ ID NO: 279111 - RNA, 19 nt, Homo sapiens
aaagaagacggcaccugaa

SEQ ID NO: 279112 - RNA, 19 nt, Homo sapiens
gacugggaacugccacaua

SEQ ID NO: 279113 - RNA, 19 nt, Homo sapiens
agacugaugagaccuuaga

SEQ ID NO: 279114 - RNA, 19 nt, Homo sapiens
cagagucaccugucucauc

SEQ ID NO: 279115 - RNA, 19 nt, Homo sapiens
ggaauauuugcaagacuca

SEQ ID NO: 279116 - RNA, 19 nt, Homo sapiens
gccuugcacugaguuauuc

SEQ ID NO: 279117 - RNA, 19 nt, Homo sapiens
ggucugccuugcacugagu

SEQ ID NO: 279118 - RNA, 19 nt, Homo sapiens
cuucagacccuccgacugu

SEQ ID NO: 279119 - RNA, 19 nt, Homo sapiens
gaucagcaggacccaggaa

SEQ ID NO: 279120 - RNA, 19 nt, Homo sapiens
gcccaacugcagaugcuaa

SEQ ID NO: 279121 - RNA, 19 nt, Homo sapiens
ccacaucccagaggccauu

SEQ ID NO: 279122 - RNA, 19 nt, Homo sapiens
cacuuacccuuucucugaa

SEQ ID NO: 279123 - RNA, 19 nt, Homo sapiens
ucaggaauauuugcaagac

SEQ ID NO: 279124 - RNA, 19 nt, Homo sapiens
gagauaccacacggccaua

SEQ ID NO: 279125 - RNA, 19 nt, Homo sapiens
cagacaacacagugaaguu

SEQ ID NO: 279126 - RNA, 19 nt, Homo sapiens
acugggaacugccacauac

SEQ ID NO: 279127 - RNA, 19 nt, Homo sapiens
ugaagugugugaggaggau

SEQ ID NO: 279128 - RNA, 19 nt, Homo sapiens
ccaggucacagcacaagug

SEQ ID NO: 279129 - RNA, 19 nt, Homo sapiens
cagugaaguugggagagaa

SEQ ID NO: 279130 - RNA, 19 nt, Homo sapiens
ccaccucuuugagaaggaa

SEQ ID NO: 279131 - RNA, 19 nt, Homo sapiens
ccacacagcgaaccuacag

SEQ ID NO: 279132 - RNA, 19 nt, Homo sapiens
gaagacggcaccugaaaag

SEQ ID NO: 279133 - RNA, 19 nt, Homo sapiens
ccacucagcaguccuagcu

SEQ ID NO: 279134 - RNA, 19 nt, Homo sapiens
ucauuuacucucaggugua

SEQ ID NO: 279135 - RNA, 19 nt, Homo sapiens
ugcaaccacuuacccuuuc

SEQ ID NO: 279136 - RNA, 19 nt, Homo sapiens
ggacccacccaucuuuguc

SEQ ID NO: 279137 - RNA, 19 nt, Homo sapiens
cugcucacauccacaguca

SEQ ID NO: 279138 - RNA, 19 nt, Homo sapiens
gcuccaccacggacgauga

SEQ ID NO: 279139 - RNA, 19 nt, Homo sapiens
gaggaagaggcagauaugu

SEQ ID NO: 279140 - RNA, 19 nt, Homo sapiens
agagccuggucuccgauaa

SEQ ID NO: 279141 - RNA, 19 nt, Homo sapiens
cccagcaagugccucuuug

SEQ ID NO: 279142 - RNA, 19 nt, Homo sapiens
ggaggcacagaaagcauca

SEQ ID NO: 279143 - RNA, 19 nt, Homo sapiens
ggccauacggagaucagaa

SEQ ID NO: 279144 - RNA, 19 nt, Homo sapiens
agaagacaucucuaucaga

SEQ ID NO: 279145 - RNA, 19 nt, Homo sapiens
ucuagaaccaaccaagcua

SEQ ID NO: 279146 - RNA, 19 nt, Homo sapiens
gaaagcagcucacaacaau

SEQ ID NO: 279147 - RNA, 19 nt, Homo sapiens
gcaagaagcuaaacgaaug

SEQ ID NO: 279148 - RNA, 19 nt, Homo sapiens
gcaaaccacugcaacauga

SEQ ID NO: 279149 - RNA, 19 nt, Homo sapiens
gaagaugaccuuaagcuaa

SEQ ID NO: 279150 - RNA, 19 nt, Homo sapiens
ggaccacgcuguaaaguau

SEQ ID NO: 279151 - RNA, 19 nt, Homo sapiens
gaagcagcauugucguuua

SEQ ID NO: 279152 - RNA, 19 nt, Homo sapiens
gaaauaauccgggagauga

SEQ ID NO: 279153 - RNA, 19 nt, Homo sapiens
caguagagcucaucaggua

SEQ ID NO: 279154 - RNA, 19 nt, Homo sapiens
gagaguagaucuggagaaa

SEQ ID NO: 279155 - RNA, 19 nt, Homo sapiens
aaacuugucuucgaugaua

SEQ ID NO: 279156 - RNA, 19 nt, Homo sapiens
gaacuucucuccccucuaa

SEQ ID NO: 279157 - RNA, 19 nt, Homo sapiens
gacaauggcacaucgaaua

SEQ ID NO: 279158 - RNA, 19 nt, Homo sapiens
gaugauggcacguuuaauu

SEQ ID NO: 279159 - RNA, 19 nt, Homo sapiens
gaagaaaucaagaaacuca

SEQ ID NO: 279160 - RNA, 19 nt, Homo sapiens
guaaaggcgugaagcagaa

SEQ ID NO: 279161 - RNA, 19 nt, Homo sapiens
gaaagaacgagaaagaaga

SEQ ID NO: 279162 - RNA, 19 nt, Homo sapiens
cuaaacgaaugaagcauaa

SEQ ID NO: 279163 - RNA, 19 nt, Homo sapiens
ucaagaaacucaacaggau

SEQ ID NO: 279164 - RNA, 19 nt, Homo sapiens
acaaacaacuggcugcauu

SEQ ID NO: 279165 - RNA, 19 nt, Homo sapiens
gaauccaaaucuccuuauu

SEQ ID NO: 279166 - RNA, 19 nt, Homo sapiens
gcagaaacuugucuucgau

SEQ ID NO: 279167 - RNA, 19 nt, Homo sapiens
ggucagagagcaaucagua

SEQ ID NO: 279168 - RNA, 19 nt, Homo sapiens
gaaccggcauccucuaaca

SEQ ID NO: 279169 - RNA, 19 nt, Homo sapiens
caagaucgaugaacauuuu

SEQ ID NO: 279170 - RNA, 19 nt, Homo sapiens
gcacguuuaauucuaguua

SEQ ID NO: 279171 - RNA, 19 nt, Homo sapiens
cuuauuaccugauguauuc

SEQ ID NO: 279172 - RNA, 19 nt, Homo sapiens
cagcuguguugaagaaaua

SEQ ID NO: 279173 - RNA, 19 nt, Homo sapiens
gcacaucgaauacaucaau

SEQ ID NO: 279174 - RNA, 19 nt, Homo sapiens
gauggcacguuuaauucua

SEQ ID NO: 279175 - RNA, 19 nt, Homo sapiens
gaggaaagaacgagaaaga

SEQ ID NO: 279176 - RNA, 19 nt, Homo sapiens
caucaacaguguggcaaua

SEQ ID NO: 279177 - RNA, 19 nt, Homo sapiens
ggauaaauggcuaaacaaa

SEQ ID NO: 279178 - RNA, 19 nt, Homo sapiens
ccagaacacuuuaggcaau

SEQ ID NO: 279179 - RNA, 19 nt, Homo sapiens
gcacuaaucgacuauuuca

SEQ ID NO: 279180 - RNA, 19 nt, Homo sapiens
acaacuggcugcauuaugu

SEQ ID NO: 279181 - RNA, 19 nt, Homo sapiens
gcuaaacgaaugaagcaua

SEQ ID NO: 279182 - RNA, 19 nt, Homo sapiens
uaaggacucucagcuugua

SEQ ID NO: 279183 - RNA, 19 nt, Homo sapiens
caucagguaugcuaugaga

SEQ ID NO: 279184 - RNA, 19 nt, Homo sapiens
ggaguacccucuguccaaa

SEQ ID NO: 279185 - RNA, 19 nt, Homo sapiens
ccacaagccuccuauucug

SEQ ID NO: 279186 - RNA, 19 nt, Homo sapiens
ucaagcaccuggcaaagug

SEQ ID NO: 279187 - RNA, 19 nt, Homo sapiens
ggaagaugaccuuaagcua

SEQ ID NO: 279188 - RNA, 19 nt, Homo sapiens
ccaaacaagugugcaaugu

SEQ ID NO: 279189 - RNA, 19 nt, Homo sapiens
ugaacaagaucgaugaaca

SEQ ID NO: 279190 - RNA, 19 nt, Homo sapiens
ggaaagaacgagaaagaag

SEQ ID NO: 279191 - RNA, 19 nt, Homo sapiens
gaacgagaaagaagaaauc

SEQ ID NO: 279192 - RNA, 19 nt, Homo sapiens
caaacaacuggcugcauua

SEQ ID NO: 279193 - RNA, 19 nt, Homo sapiens
ggaaugggaccucgaguca

SEQ ID NO: 279194 - RNA, 19 nt, Homo sapiens
gaacaagaucgaugaacau

SEQ ID NO: 279195 - RNA, 19 nt, Homo sapiens
guuacucucucuucaguga

SEQ ID NO: 279196 - RNA, 19 nt, Homo sapiens
caaaagcacuaaucgacua

SEQ ID NO: 279197 - RNA, 19 nt, Homo sapiens
ggacacaccugcagaaaag

SEQ ID NO: 279198 - RNA, 19 nt, Homo sapiens
ccagugacaucgccaagga

SEQ ID NO: 279199 - RNA, 19 nt, Homo sapiens
gcuggaagaugaccuuaag

SEQ ID NO: 279200 - RNA, 19 nt, Homo sapiens
agacugcggugaacauuuc

SEQ ID NO: 279201 - RNA, 19 nt, Homo sapiens
gcggauguuucgacucaaa

SEQ ID NO: 279202 - RNA, 19 nt, Homo sapiens
ggcagaaacuugucuucga

SEQ ID NO: 279203 - RNA, 19 nt, Homo sapiens
gcuaagcagugaugaagag

SEQ ID NO: 279204 - RNA, 19 nt, Homo sapiens
gccaagcucuccaaguuca

SEQ ID NO: 279205 - RNA, 19 nt, Homo sapiens
gaccuaauggcaacaguuu

SEQ ID NO: 279206 - RNA, 19 nt, Homo sapiens
gaaaugcauuacggaggaa

SEQ ID NO: 279207 - RNA, 19 nt, Homo sapiens
acaaguggcagcuggauaa

SEQ ID NO: 279208 - RNA, 19 nt, Homo sapiens
caaaguggaaccaaccaaa

SEQ ID NO: 279209 - RNA, 19 nt, Homo sapiens
gagcucaucagguaugcua

SEQ ID NO: 279210 - RNA, 19 nt, Homo sapiens
gcggagaccucacgaaagc

SEQ ID NO: 279211 - RNA, 19 nt, Homo sapiens
ugaugcaucuaaacacaaa

SEQ ID NO: 279212 - RNA, 19 nt, Homo sapiens
gaaagccacgggucagaga

SEQ ID NO: 279213 - RNA, 19 nt, Homo sapiens
aggccaagcucuccaaguu

SEQ ID NO: 279214 - RNA, 19 nt, Homo sapiens
aagcacuaaucgacuauuu

SEQ ID NO: 279215 - RNA, 19 nt, Homo sapiens
gcucacaacaauucugaaa

SEQ ID NO: 279216 - RNA, 19 nt, Homo sapiens
guggcaauaccaauaaaua

SEQ ID NO: 279217 - RNA, 19 nt, Homo sapiens
acagggagaucaagaaguc

SEQ ID NO: 279218 - RNA, 19 nt, Homo sapiens
auacaucaaugcuggaaga

SEQ ID NO: 279219 - RNA, 19 nt, Homo sapiens
caacagagagcaacacaac

SEQ ID NO: 279220 - RNA, 19 nt, Homo sapiens
cuaaucgacuauuucaaga

SEQ ID NO: 279221 - RNA, 19 nt, Homo sapiens
gauaaauggcuaaacaaag

SEQ ID NO: 279222 - RNA, 19 nt, Homo sapiens
gaguagaucuggagaaacc

SEQ ID NO: 279223 - RNA, 19 nt, Homo sapiens
gcagaaaccgaccgcguau

SEQ ID NO: 279224 - RNA, 19 nt, Homo sapiens
gguaugcuaugagacuaaa

SEQ ID NO: 279225 - RNA, 19 nt, Homo sapiens
gaacaaggccccauggaau

SEQ ID NO: 279226 - RNA, 19 nt, Homo sapiens
cgaaagcagcucacaacaa

SEQ ID NO: 279227 - RNA, 19 nt, Homo sapiens
ggacacaauaauccaaaga

SEQ ID NO: 279228 - RNA, 19 nt, Homo sapiens
ccacagauggcucaacguu

SEQ ID NO: 279229 - RNA, 19 nt, Homo sapiens
uucaagaacucaucuaaag

SEQ ID NO: 279230 - RNA, 19 nt, Homo sapiens
gauguauucagaaacagua

SEQ ID NO: 279231 - RNA, 19 nt, Homo sapiens
gcgaggacuuaacuucuuc

SEQ ID NO: 279232 - RNA, 19 nt, Homo sapiens
gcaagugugacaacgaaga

SEQ ID NO: 279233 - RNA, 19 nt, Homo sapiens
cauggacagcuucgacuua

SEQ ID NO: 279234 - RNA, 19 nt, Homo sapiens
agaaacuugucuucgauga

SEQ ID NO: 279235 - RNA, 19 nt, Homo sapiens
cgagaaagaagaaaucaag

SEQ ID NO: 279236 - RNA, 19 nt, Homo sapiens
gagacagagucgucaucuu

SEQ ID NO: 279237 - RNA, 19 nt, Homo sapiens
aguggcagcuggauaaaug

SEQ ID NO: 279238 - RNA, 19 nt, Homo sapiens
cagaacacuuuaggcaauu

SEQ ID NO: 279239 - RNA, 19 nt, Homo sapiens
acagauggcucaacguuuu

SEQ ID NO: 279240 - RNA, 19 nt, Homo sapiens
gaaaucaagaaacucaaca

SEQ ID NO: 279241 - RNA, 19 nt, Homo sapiens
gagaaagaagaaaucaaga

SEQ ID NO: 279242 - RNA, 19 nt, Homo sapiens
agacagagucgucaucuuc

SEQ ID NO: 279243 - RNA, 19 nt, Homo sapiens
gagagaaggagaucaagag

SEQ ID NO: 279244 - RNA, 19 nt, Homo sapiens
ccgacaaccuggccaagga

SEQ ID NO: 279245 - RNA, 19 nt, Homo sapiens
cuggauaaauggcuaaaca

SEQ ID NO: 279246 - RNA, 19 nt, Homo sapiens
uagaggagcuggagcaaga

SEQ ID NO: 279247 - RNA, 19 nt, Homo sapiens
caaauaaacguccugucua

SEQ ID NO: 279248 - RNA, 19 nt, Homo sapiens
cagcagcccaguccaaaua

SEQ ID NO: 279249 - RNA, 19 nt, Homo sapiens
cuacagagauggcuucaac

SEQ ID NO: 279250 - RNA, 19 nt, Homo sapiens
aaauaaacguccugucuag

SEQ ID NO: 279251 - RNA, 19 nt, Homo sapiens
gccuuuggcuuucaccuuu

SEQ ID NO: 279252 - RNA, 19 nt, Homo sapiens
caacgucuccaucauguau

SEQ ID NO: 279253 - RNA, 19 nt, Homo sapiens
ccaacucccuugacagugu

SEQ ID NO: 279254 - RNA, 19 nt, Homo sapiens
gcagcccaguccaaauaaa

SEQ ID NO: 279255 - RNA, 19 nt, Homo sapiens
caacucccuugacagugua

SEQ ID NO: 279256 - RNA, 19 nt, Homo sapiens
ccaaauaaacguccugucu

SEQ ID NO: 279257 - RNA, 19 nt, Homo sapiens
ugaggugacuccaguaucu

SEQ ID NO: 279258 - RNA, 19 nt, Homo sapiens
uggagacaauggcgacuuu

SEQ ID NO: 279259 - RNA, 19 nt, Homo sapiens
caucaccacuuagcggaaa

SEQ ID NO: 279260 - RNA, 19 nt, Homo sapiens
cgacuuuacccuucgacua

SEQ ID NO: 279261 - RNA, 19 nt, Homo sapiens
uguauaaccucacuguucu

SEQ ID NO: 279262 - RNA, 19 nt, Homo sapiens
ggaccuacaccugccauau

SEQ ID NO: 279263 - RNA, 19 nt, Homo sapiens
ggagacaauggcgacuuua

SEQ ID NO: 279264 - RNA, 19 nt, Homo sapiens
gagcagcaguguacuucac

SEQ ID NO: 279265 - RNA, 19 nt, Homo sapiens
agaagacaguggcgaccaa

SEQ ID NO: 279266 - RNA, 19 nt, Homo sapiens
ccuggugacuggagacaau

SEQ ID NO: 279267 - RNA, 19 nt, Homo sapiens
ccauauccaucugcaggaa

SEQ ID NO: 279268 - RNA, 19 nt, Homo sapiens
cagccucugugcauugguu

SEQ ID NO: 279269 - RNA, 19 nt, Homo sapiens
gaccuacaccugccauauc

SEQ ID NO: 279270 - RNA, 19 nt, Homo sapiens
gacuuuacccuucgacuag

SEQ ID NO: 279271 - RNA, 19 nt, Homo sapiens
caucauguauaaccucacu

SEQ ID NO: 279272 - RNA, 19 nt, Homo sapiens
uuuggugacuggagccuuu

SEQ ID NO: 279273 - RNA, 19 nt, Homo sapiens
cagccacgacggccacuuu

SEQ ID NO: 279274 - RNA, 19 nt, Homo sapiens
ugccugaucugcccagcuu

SEQ ID NO: 279275 - RNA, 19 nt, Homo sapiens
gcucaaugccacugucaca

SEQ ID NO: 279276 - RNA, 19 nt, Homo sapiens
gaugugggaggcucaguuc

SEQ ID NO: 279277 - RNA, 19 nt, Homo sapiens
cacagugacucccaaaucc

SEQ ID NO: 279278 - RNA, 19 nt, Homo sapiens
gcaggaacagcagcucaau

SEQ ID NO: 279279 - RNA, 19 nt, Homo sapiens
gcccagaccauaggagaga

SEQ ID NO: 279280 - RNA, 19 nt, Homo sapiens
gagacaauggcgacuuuac

SEQ ID NO: 279281 - RNA, 19 nt, Homo sapiens
acgucuccaucauguauaa

SEQ ID NO: 279282 - RNA, 19 nt, Homo sapiens
gaagagcaggggucacuug

SEQ ID NO: 279283 - RNA, 19 nt, Homo sapiens
gcuuucaccuuuggagaag

SEQ ID NO: 279284 - RNA, 19 nt, Homo sapiens
cuccuggucucccuucuuc

SEQ ID NO: 279285 - RNA, 19 nt, Homo sapiens
ccuggucucccuucuucua

SEQ ID NO: 279286 - RNA, 19 nt, Homo sapiens
gacggccacuuugcucugu

SEQ ID NO: 279287 - RNA, 19 nt, Homo sapiens
gcccagccucugugcauug

SEQ ID NO: 279288 - RNA, 19 nt, Homo sapiens
gauagaggagcuggagcaa

SEQ ID NO: 279289 - RNA, 19 nt, Homo sapiens
uuccugggcuugcuguuuc

SEQ ID NO: 279290 - RNA, 19 nt, Homo sapiens
gaagaugugucucaagcua

SEQ ID NO: 279291 - RNA, 19 nt, Homo sapiens
gaaagucacucuaggaaaa

SEQ ID NO: 279292 - RNA, 19 nt, Homo sapiens
gaucaggauuguacguaaa

SEQ ID NO: 279293 - RNA, 19 nt, Homo sapiens
gagcuagccuugagacugu

SEQ ID NO: 279294 - RNA, 19 nt, Homo sapiens
ucaauggacuuccugagaa

SEQ ID NO: 279295 - RNA, 19 nt, Homo sapiens
gagcaucuguauauucuca

SEQ ID NO: 279296 - RNA, 19 nt, Homo sapiens
ggacaacagucacaaugag

SEQ ID NO: 279297 - RNA, 19 nt, Homo sapiens
ccacauacaaugauacuga

SEQ ID NO: 279298 - RNA, 19 nt, Homo sapiens
ugaccuggcuguugauguu

SEQ ID NO: 279299 - RNA, 19 nt, Homo sapiens
ggccugaccuggcuguuga

SEQ ID NO: 279300 - RNA, 19 nt, Homo sapiens
cagagacuuugcuguaauu

SEQ ID NO: 279301 - RNA, 19 nt, Homo sapiens
gaggccagauuccgcauug

SEQ ID NO: 279302 - RNA, 19 nt, Homo sapiens
agacuuugcuguaauuauc

SEQ ID NO: 279303 - RNA, 19 nt, Homo sapiens
ggauuccucuucaucuaga

SEQ ID NO: 279304 - RNA, 19 nt, Homo sapiens
guagauccacauacaauga

SEQ ID NO: 279305 - RNA, 19 nt, Homo sapiens
aagcugagcaucuguauau

SEQ ID NO: 279306 - RNA, 19 nt, Homo sapiens
ccuuaucgcugcaucuauu

SEQ ID NO: 279307 - RNA, 19 nt, Homo sapiens
ccagagacuuugcuguaau

SEQ ID NO: 279308 - RNA, 19 nt, Homo sapiens
uaaagucaccugccuguuc

SEQ ID NO: 279309 - RNA, 19 nt, Homo sapiens
ccuaaagaccuuccuagaa

SEQ ID NO: 279310 - RNA, 19 nt, Homo sapiens
gcaaggacgaggagcagaa

SEQ ID NO: 279311 - RNA, 19 nt, Homo sapiens
ucaccugccuguucuaaag

SEQ ID NO: 279312 - RNA, 19 nt, Homo sapiens
gguggucccuucuacaauc

SEQ ID NO: 279313 - RNA, 19 nt, Homo sapiens
cuagagacccagcuuuauu

SEQ ID NO: 279314 - RNA, 19 nt, Homo sapiens
gaaagcugagcaucuguau

SEQ ID NO: 279315 - RNA, 19 nt, Homo sapiens
ugaucaggauuguacguaa

SEQ ID NO: 279316 - RNA, 19 nt, Homo sapiens
cuccacgcaucaauaaaua

SEQ ID NO: 279317 - RNA, 19 nt, Homo sapiens
ggagacuggagguuucuaa

SEQ ID NO: 279318 - RNA, 19 nt, Homo sapiens
caaugauacugaagaugug

SEQ ID NO: 279319 - RNA, 19 nt, Homo sapiens
gcuggagacuggagguuuc

SEQ ID NO: 279320 - RNA, 19 nt, Homo sapiens
gcagugaugccaccuccaa

SEQ ID NO: 279321 - RNA, 19 nt, Homo sapiens
gcauccagaagguucguua

SEQ ID NO: 279322 - RNA, 19 nt, Homo sapiens
ccagagacccagcuaaagu

SEQ ID NO: 279323 - RNA, 19 nt, Homo sapiens
gagcugcuggugaaagaaa

SEQ ID NO: 279324 - RNA, 19 nt, Homo sapiens
acaaugauacugaagaugu

SEQ ID NO: 279325 - RNA, 19 nt, Homo sapiens
cccagagacuuugcuguaa

SEQ ID NO: 279326 - RNA, 19 nt, Homo sapiens
cacauacaaugauacugaa

SEQ ID NO: 279327 - RNA, 19 nt, Homo sapiens
uuacuccacgcaucaauaa

SEQ ID NO: 279328 - RNA, 19 nt, Homo sapiens
agacaaggccacagucaau

SEQ ID NO: 279329 - RNA, 19 nt, Homo sapiens
uaaccagcauccagaaggu

SEQ ID NO: 279330 - RNA, 19 nt, Homo sapiens
gcagacaaggccacaguca

SEQ ID NO: 279331 - RNA, 19 nt, Homo sapiens
ccugaaagcugagcaucug

SEQ ID NO: 279332 - RNA, 19 nt, Homo sapiens
ugaaagcugagcaucugua

SEQ ID NO: 279333 - RNA, 19 nt, Homo sapiens
gcauugacucaguaaguga

SEQ ID NO: 279334 - RNA, 19 nt, Homo sapiens
gccuugagacugugcuaua

SEQ ID NO: 279335 - RNA, 19 nt, Homo sapiens
aaagucaccugccuguucu

SEQ ID NO: 279336 - RNA, 19 nt, Homo sapiens
uuuauucaccugacuguuu

SEQ ID NO: 279337 - RNA, 19 nt, Homo sapiens
gcugagcaucuguauauuc

SEQ ID NO: 279338 - RNA, 19 nt, Homo sapiens
uaucgcugcaucuauuaua

SEQ ID NO: 279339 - RNA, 19 nt, Homo sapiens
ccacgcaucaauaaauaau

SEQ ID NO: 279340 - RNA, 19 nt, Homo sapiens
ucaguggucuuccucuucu

SEQ ID NO: 279341 - RNA, 19 nt, Homo sapiens
uggagcugcuggugaaaga

SEQ ID NO: 279342 - RNA, 19 nt, Homo sapiens
ccagagacccagcuacagu

SEQ ID NO: 279343 - RNA, 19 nt, Homo sapiens
gcaucuguauauucucauc

SEQ ID NO: 279344 - RNA, 19 nt, Homo sapiens
uaauugaucaggauuguac

SEQ ID NO: 279345 - RNA, 19 nt, Homo sapiens
agauccacauacaaugaua

SEQ ID NO: 279346 - RNA, 19 nt, Homo sapiens
gagacuuugcuguaauuau

SEQ ID NO: 279347 - RNA, 19 nt, Homo sapiens
uagagacccagcuuuauuc

SEQ ID NO: 279348 - RNA, 19 nt, Homo sapiens
ccuguuggauuccucuuca

SEQ ID NO: 279349 - RNA, 19 nt, Homo sapiens
gucaauggacuuccugaga

SEQ ID NO: 279350 - RNA, 19 nt, Homo sapiens
gccagaaucagauaaagca

SEQ ID NO: 279351 - RNA, 19 nt, Homo sapiens
cugagcaucuguauauucu

SEQ ID NO: 279352 - RNA, 19 nt, Homo sapiens
gagccaagcccaguucucu

SEQ ID NO: 279353 - RNA, 19 nt, Homo sapiens
uuauucaccugacuguuuc

SEQ ID NO: 279354 - RNA, 19 nt, Homo sapiens
gccagacacugaccccaua

SEQ ID NO: 279355 - RNA, 19 nt, Homo sapiens
cucaguaagugaaggaaau

SEQ ID NO: 279356 - RNA, 19 nt, Homo sapiens
uccuagaagucaagagcua

SEQ ID NO: 279357 - RNA, 19 nt, Homo sapiens
cuaggugucugcugugaac

SEQ ID NO: 279358 - RNA, 19 nt, Homo sapiens
ccgauuuccugagcaguga

SEQ ID NO: 279359 - RNA, 19 nt, Homo sapiens
uuggauuccucuucaucua

SEQ ID NO: 279360 - RNA, 19 nt, Homo sapiens
cccaggaggugacguaugc

SEQ ID NO: 279361 - RNA, 19 nt, Homo sapiens
cauacaaugauacugaaga

SEQ ID NO: 279362 - RNA, 19 nt, Homo sapiens
cagguggucccuucuacaa

SEQ ID NO: 279363 - RNA, 19 nt, Homo sapiens
agaaagucacucuaggaaa

SEQ ID NO: 279364 - RNA, 19 nt, Homo sapiens
gcaccugaggguagaaagu

SEQ ID NO: 279365 - RNA, 19 nt, Homo sapiens
caagcuaguccaucugagu

SEQ ID NO: 279366 - RNA, 19 nt, Homo sapiens
cagagacccagcuacaguu

SEQ ID NO: 279367 - RNA, 19 nt, Homo sapiens
ggagccaugugacuuucgu

SEQ ID NO: 279368 - RNA, 19 nt, Homo sapiens
caaagcugagugagggaaa

SEQ ID NO: 279369 - RNA, 19 nt, Homo sapiens
cgcauugacucaguaagug

SEQ ID NO: 279370 - RNA, 19 nt, Homo sapiens
gacaaggccacagucaaug

SEQ ID NO: 279371 - RNA, 19 nt, Homo sapiens
cggacaacagucacaauga

SEQ ID NO: 279372 - RNA, 19 nt, Homo sapiens
gacccacucucugccuuca

SEQ ID NO: 279373 - RNA, 19 nt, Homo sapiens
ggccuuaucgcugcaucua

SEQ ID NO: 279374 - RNA, 19 nt, Homo sapiens
agaugugucucaagcuagu

SEQ ID NO: 279375 - RNA, 19 nt, Homo sapiens
gaggguagaaagucacucu

SEQ ID NO: 279376 - RNA, 19 nt, Homo sapiens
ccgaguccaucacguaugc

SEQ ID NO: 279377 - RNA, 19 nt, Homo sapiens
ucucaguggucuuccucuu

SEQ ID NO: 279378 - RNA, 19 nt, Homo sapiens
cuucacaguuguucaaagc

SEQ ID NO: 279379 - RNA, 19 nt, Homo sapiens
gcccagcuacagccaauca

SEQ ID NO: 279380 - RNA, 19 nt, Homo sapiens
gccagguggucccuucuac

SEQ ID NO: 279381 - RNA, 19 nt, Homo sapiens
uucuagagacccagcuuua

SEQ ID NO: 279382 - RNA, 19 nt, Homo sapiens
ugagucagaggccagauuc

SEQ ID NO: 279383 - RNA, 19 nt, Homo sapiens
ccgcauugacucaguaagu

SEQ ID NO: 279384 - RNA, 19 nt, Homo sapiens
caaggccacagucaaugga

SEQ ID NO: 279385 - RNA, 19 nt, Homo sapiens
cagacaaggccacagucaa

SEQ ID NO: 279386 - RNA, 19 nt, Homo sapiens
cagcagacaaggccacagu

SEQ ID NO: 279387 - RNA, 19 nt, Homo sapiens
aaagcugagcaucuguaua

SEQ ID NO: 279388 - RNA, 19 nt, Homo sapiens
gaagaugugucucaagcua

SEQ ID NO: 279389 - RNA, 19 nt, Homo sapiens
gaaagucacucuaggaaaa

SEQ ID NO: 279390 - RNA, 19 nt, Homo sapiens
gagcuagccuugagacugu

SEQ ID NO: 279391 - RNA, 19 nt, Homo sapiens
ucaauggacuuccugagaa

SEQ ID NO: 279392 - RNA, 19 nt, Homo sapiens
gagcaucuguauauucuca

SEQ ID NO: 279393 - RNA, 19 nt, Homo sapiens
ggacaacagucacaaugag

SEQ ID NO: 279394 - RNA, 19 nt, Homo sapiens
ccacauacaaugauacuga

SEQ ID NO: 279395 - RNA, 19 nt, Homo sapiens
ugaccuggcuguugauguu

SEQ ID NO: 279396 - RNA, 19 nt, Homo sapiens
ggccugaccuggcuguuga

SEQ ID NO: 279397 - RNA, 19 nt, Homo sapiens
cagagacuuugcuguaauu

SEQ ID NO: 279398 - RNA, 19 nt, Homo sapiens
gaggccagauuccgcauug

SEQ ID NO: 279399 - RNA, 19 nt, Homo sapiens
agacuuugcuguaauuauc

SEQ ID NO: 279400 - RNA, 19 nt, Homo sapiens
ggauuccucuucaucuaga

SEQ ID NO: 279401 - RNA, 19 nt, Homo sapiens
guagauccacauacaauga

SEQ ID NO: 279402 - RNA, 19 nt, Homo sapiens
aagcugagcaucuguauau

SEQ ID NO: 279403 - RNA, 19 nt, Homo sapiens
ccuuaucgcugcaucuauu

SEQ ID NO: 279404 - RNA, 19 nt, Homo sapiens
ccagagacuuugcuguaau

SEQ ID NO: 279405 - RNA, 19 nt, Homo sapiens
uaaagucaccugccuguuc

SEQ ID NO: 279406 - RNA, 19 nt, Homo sapiens
ccuaaagaccuuccuagaa

SEQ ID NO: 279407 - RNA, 19 nt, Homo sapiens
gcaaggacgaggagcagaa

SEQ ID NO: 279408 - RNA, 19 nt, Homo sapiens
ucaccugccuguucuaaag

SEQ ID NO: 279409 - RNA, 19 nt, Homo sapiens
gguggucccuucuacaauc

SEQ ID NO: 279410 - RNA, 19 nt, Homo sapiens
cuagagacccagcuuuauu

SEQ ID NO: 279411 - RNA, 19 nt, Homo sapiens
gaaagcugagcaucuguau

SEQ ID NO: 279412 - RNA, 19 nt, Homo sapiens
cuccacgcaucaauaaaua

SEQ ID NO: 279413 - RNA, 19 nt, Homo sapiens
ggagacuggagguuucuaa

SEQ ID NO: 279414 - RNA, 19 nt, Homo sapiens
caaugauacugaagaugug

SEQ ID NO: 279415 - RNA, 19 nt, Homo sapiens
gcuggagacuggagguuuc

SEQ ID NO: 279416 - RNA, 19 nt, Homo sapiens
gcagugaugccaccuccaa

SEQ ID NO: 279417 - RNA, 19 nt, Homo sapiens
gcauccagaagguucguua

SEQ ID NO: 279418 - RNA, 19 nt, Homo sapiens
ccagagacccagcuaaagu

SEQ ID NO: 279419 - RNA, 19 nt, Homo sapiens
acaaugauacugaagaugu

SEQ ID NO: 279420 - RNA, 19 nt, Homo sapiens
cccagagacuuugcuguaa

SEQ ID NO: 279421 - RNA, 19 nt, Homo sapiens
cacauacaaugauacugaa

SEQ ID NO: 279422 - RNA, 19 nt, Homo sapiens
uuacuccacgcaucaauaa

SEQ ID NO: 279423 - RNA, 19 nt, Homo sapiens
agacaaggccacagucaau

SEQ ID NO: 279424 - RNA, 19 nt, Homo sapiens
uaaccagcauccagaaggu

SEQ ID NO: 279425 - RNA, 19 nt, Homo sapiens
gcagacaaggccacaguca

SEQ ID NO: 279426 - RNA, 19 nt, Homo sapiens
ccugaaagcugagcaucug

SEQ ID NO: 279427 - RNA, 19 nt, Homo sapiens
ugaaagcugagcaucugua

SEQ ID NO: 279428 - RNA, 19 nt, Homo sapiens
gcauugacucaguaaguga

SEQ ID NO: 279429 - RNA, 19 nt, Homo sapiens
gccuugagacugugcuaua

SEQ ID NO: 279430 - RNA, 19 nt, Homo sapiens
aaagucaccugccuguucu

SEQ ID NO: 279431 - RNA, 19 nt, Homo sapiens
uuuauucaccugacuguuu

SEQ ID NO: 279432 - RNA, 19 nt, Homo sapiens
gcugagcaucuguauauuc

SEQ ID NO: 279433 - RNA, 19 nt, Homo sapiens
uaucgcugcaucuauuaua

SEQ ID NO: 279434 - RNA, 19 nt, Homo sapiens
ccacgcaucaauaaauaau

SEQ ID NO: 279435 - RNA, 19 nt, Homo sapiens
ucaguggucuuccucuucu

SEQ ID NO: 279436 - RNA, 19 nt, Homo sapiens
ccagagacccagcuacagu

SEQ ID NO: 279437 - RNA, 19 nt, Homo sapiens
gcaucuguauauucucauc

SEQ ID NO: 279438 - RNA, 19 nt, Homo sapiens
uaauugaucaggauuguac

SEQ ID NO: 279439 - RNA, 19 nt, Homo sapiens
gagacuuugcuguaauuau

SEQ ID NO: 279440 - RNA, 19 nt, Homo sapiens
uagagacccagcuuuauuc

SEQ ID NO: 279441 - RNA, 19 nt, Homo sapiens
agauccacauacaaugaua

SEQ ID NO: 279442 - RNA, 19 nt, Homo sapiens
ccuguuggauuccucuuca

SEQ ID NO: 279443 - RNA, 19 nt, Homo sapiens
gucaauggacuuccugaga

SEQ ID NO: 279444 - RNA, 19 nt, Homo sapiens
gccagaaucagauaaagca

SEQ ID NO: 279445 - RNA, 19 nt, Homo sapiens
cugagcaucuguauauucu

SEQ ID NO: 279446 - RNA, 19 nt, Homo sapiens
gagccaagcccaguucucu

SEQ ID NO: 279447 - RNA, 19 nt, Homo sapiens
uuauucaccugacuguuuc

SEQ ID NO: 279448 - RNA, 19 nt, Homo sapiens
gccagacacugaccccaua

SEQ ID NO: 279449 - RNA, 19 nt, Homo sapiens
cucaguaagugaaggaaau

SEQ ID NO: 279450 - RNA, 19 nt, Homo sapiens
uccuagaagucaagagcua

SEQ ID NO: 279451 - RNA, 19 nt, Homo sapiens
cuaggugucugcugugaac

SEQ ID NO: 279452 - RNA, 19 nt, Homo sapiens
ccgauuuccugagcaguga

SEQ ID NO: 279453 - RNA, 19 nt, Homo sapiens
uuggauuccucuucaucua

SEQ ID NO: 279454 - RNA, 19 nt, Homo sapiens
cccaggaggugacguaugc

SEQ ID NO: 279455 - RNA, 19 nt, Homo sapiens
cauacaaugauacugaaga

SEQ ID NO: 279456 - RNA, 19 nt, Homo sapiens
caagcuaguccaucugagu

SEQ ID NO: 279457 - RNA, 19 nt, Homo sapiens
cagguggucccuucuacaa

SEQ ID NO: 279458 - RNA, 19 nt, Homo sapiens
agaaagucacucuaggaaa

SEQ ID NO: 279459 - RNA, 19 nt, Homo sapiens
gcaccugaggguagaaagu

SEQ ID NO: 279460 - RNA, 19 nt, Homo sapiens
ggagccaugugacuuucgu

SEQ ID NO: 279461 - RNA, 19 nt, Homo sapiens
cagagacccagcuacaguu

SEQ ID NO: 279462 - RNA, 19 nt, Homo sapiens
caaagcugagugagggaaa

SEQ ID NO: 279463 - RNA, 19 nt, Homo sapiens
cgcauugacucaguaagug

SEQ ID NO: 279464 - RNA, 19 nt, Homo sapiens
gacaaggccacagucaaug

SEQ ID NO: 279465 - RNA, 19 nt, Homo sapiens
cggacaacagucacaauga

SEQ ID NO: 279466 - RNA, 19 nt, Homo sapiens
gacccacucucugccuuca

SEQ ID NO: 279467 - RNA, 19 nt, Homo sapiens
ggccuuaucgcugcaucua

SEQ ID NO: 279468 - RNA, 19 nt, Homo sapiens
gaggguagaaagucacucu

SEQ ID NO: 279469 - RNA, 19 nt, Homo sapiens
ccgaguccaucacguaugc

SEQ ID NO: 279470 - RNA, 19 nt, Homo sapiens
ucucaguggucuuccucuu

SEQ ID NO: 279471 - RNA, 19 nt, Homo sapiens
agaugugucucaagcuagu

SEQ ID NO: 279472 - RNA, 19 nt, Homo sapiens
cuucacaguuguucaaagc

SEQ ID NO: 279473 - RNA, 19 nt, Homo sapiens
gcccagcuacagccaauca

SEQ ID NO: 279474 - RNA, 19 nt, Homo sapiens
gccagguggucccuucuac

SEQ ID NO: 279475 - RNA, 19 nt, Homo sapiens
ccgcauugacucaguaagu

SEQ ID NO: 279476 - RNA, 19 nt, Homo sapiens
ugagucagaggccagauuc

SEQ ID NO: 279477 - RNA, 19 nt, Homo sapiens
uucuagagacccagcuuua

SEQ ID NO: 279478 - RNA, 19 nt, Homo sapiens
caaggccacagucaaugga

SEQ ID NO: 279479 - RNA, 19 nt, Homo sapiens
cagacaaggccacagucaa

SEQ ID NO: 279480 - RNA, 19 nt, Homo sapiens
cagcagacaaggccacagu

SEQ ID NO: 279481 - RNA, 19 nt, Homo sapiens
aaagcugagcaucuguaua

SEQ ID NO: 279482 - RNA, 19 nt, Homo sapiens
gaagaugugucucaagcua

SEQ ID NO: 279483 - RNA, 19 nt, Homo sapiens
ucaauggacuuccugagaa

SEQ ID NO: 279484 - RNA, 19 nt, Homo sapiens
gagcaucuguauauucuca

SEQ ID NO: 279485 - RNA, 19 nt, Homo sapiens
ggacaacagucacaaugag

SEQ ID NO: 279486 - RNA, 19 nt, Homo sapiens
ccacauacaaugauacuga

SEQ ID NO: 279487 - RNA, 19 nt, Homo sapiens
ugaccuggcuguugauguu

SEQ ID NO: 279488 - RNA, 19 nt, Homo sapiens
ggccugaccuggcuguuga

SEQ ID NO: 279489 - RNA, 19 nt, Homo sapiens
gaggccagauuccgcauug

SEQ ID NO: 279490 - RNA, 19 nt, Homo sapiens
guagauccacauacaauga

SEQ ID NO: 279491 - RNA, 19 nt, Homo sapiens
aagcugagcaucuguauau

SEQ ID NO: 279492 - RNA, 19 nt, Homo sapiens
ccuuaucgcugcaucuauu

SEQ ID NO: 279493 - RNA, 19 nt, Homo sapiens
gcaaggacgaggagcagaa

SEQ ID NO: 279494 - RNA, 19 nt, Homo sapiens
gaaagcugagcaucuguau

SEQ ID NO: 279495 - RNA, 19 nt, Homo sapiens
caaugauacugaagaugug

SEQ ID NO: 279496 - RNA, 19 nt, Homo sapiens
gagcugcuggugaaagaaa

SEQ ID NO: 279497 - RNA, 19 nt, Homo sapiens
ccccugagguucacuuuua

SEQ ID NO: 279498 - RNA, 19 nt, Homo sapiens
acaaugauacugaagaugu

SEQ ID NO: 279499 - RNA, 19 nt, Homo sapiens
cacauacaaugauacugaa

SEQ ID NO: 279500 - RNA, 19 nt, Homo sapiens
agacaaggccacagucaau

SEQ ID NO: 279501 - RNA, 19 nt, Homo sapiens
gcagacaaggccacaguca

SEQ ID NO: 279502 - RNA, 19 nt, Homo sapiens
ccugaaagcugagcaucug

SEQ ID NO: 279503 - RNA, 19 nt, Homo sapiens
ugaaagcugagcaucugua

SEQ ID NO: 279504 - RNA, 19 nt, Homo sapiens
gcauugacucaguaaguga

SEQ ID NO: 279505 - RNA, 19 nt, Homo sapiens
gcugagcaucuguauauuc

SEQ ID NO: 279506 - RNA, 19 nt, Homo sapiens
uaucgcugcaucuauuaua

SEQ ID NO: 279507 - RNA, 19 nt, Homo sapiens
ucaguggucuuccucuucu

SEQ ID NO: 279508 - RNA, 19 nt, Homo sapiens
uggagcugcuggugaaaga

SEQ ID NO: 279509 - RNA, 19 nt, Homo sapiens
gcaucuguauauucucauc

SEQ ID NO: 279510 - RNA, 19 nt, Homo sapiens
gucaauggacuuccugaga

SEQ ID NO: 279511 - RNA, 19 nt, Homo sapiens
gccagaaucagauaaagca

SEQ ID NO: 279512 - RNA, 19 nt, Homo sapiens
cugagcaucuguauauucu

SEQ ID NO: 279513 - RNA, 19 nt, Homo sapiens
agauccacauacaaugaua

SEQ ID NO: 279514 - RNA, 19 nt, Homo sapiens
cucaguaagugaaggaaau

SEQ ID NO: 279515 - RNA, 19 nt, Homo sapiens
cccaggaggugacguaugc

SEQ ID NO: 279516 - RNA, 19 nt, Homo sapiens
cauacaaugauacugaaga

SEQ ID NO: 279517 - RNA, 19 nt, Homo sapiens
caagcuaguccaucugagu

SEQ ID NO: 279518 - RNA, 19 nt, Homo sapiens
ggagccaugugacuuucgu

SEQ ID NO: 279519 - RNA, 19 nt, Homo sapiens
gacaaggccacagucaaug

SEQ ID NO: 279520 - RNA, 19 nt, Homo sapiens
cggacaacagucacaauga

SEQ ID NO: 279521 - RNA, 19 nt, Homo sapiens
cgcauugacucaguaagug

SEQ ID NO: 279522 - RNA, 19 nt, Homo sapiens
ggccuuaucgcugcaucua

SEQ ID NO: 279523 - RNA, 19 nt, Homo sapiens
ccgaguccaucacguaugc

SEQ ID NO: 279524 - RNA, 19 nt, Homo sapiens
ucucaguggucuuccucuu

SEQ ID NO: 279525 - RNA, 19 nt, Homo sapiens
agaugugucucaagcuagu

SEQ ID NO: 279526 - RNA, 19 nt, Homo sapiens
caaggccacagucaaugga

SEQ ID NO: 279527 - RNA, 19 nt, Homo sapiens
cagacaaggccacagucaa

SEQ ID NO: 279528 - RNA, 19 nt, Homo sapiens
cagcagacaaggccacagu

SEQ ID NO: 279529 - RNA, 19 nt, Homo sapiens
aaagcugagcaucuguaua

SEQ ID NO: 279530 - RNA, 19 nt, Homo sapiens
ccgcauugacucaguaagu

SEQ ID NO: 279531 - RNA, 19 nt, Homo sapiens
ugagucagaggccagauuc

SEQ ID NO: 279532 - RNA, 19 nt, Homo sapiens
gaaauggccucccgucuug

SEQ ID NO: 279533 - RNA, 19 nt, Homo sapiens
gcacagaugccuauacaua

SEQ ID NO: 279534 - RNA, 19 nt, Homo sapiens
caauagaaaugcacagaug

SEQ ID NO: 279535 - RNA, 19 nt, Homo sapiens
uauaauguguuucgacuug

SEQ ID NO: 279536 - RNA, 19 nt, Homo sapiens
gaaaugcacagaugccuau

SEQ ID NO: 279537 - RNA, 19 nt, Homo sapiens
ccaaguacaaagauaguua

SEQ ID NO: 279538 - RNA, 19 nt, Homo sapiens
ggauagagccaaguacaaa

SEQ ID NO: 279539 - RNA, 19 nt, Homo sapiens
gcacugaagccuccggauu

SEQ ID NO: 279540 - RNA, 19 nt, Homo sapiens
gaggccagauuccacauug

SEQ ID NO: 279541 - RNA, 19 nt, Homo sapiens
agaaugagcaauagaaaug

SEQ ID NO: 279542 - RNA, 19 nt, Homo sapiens
gaacuucaauggggagaaa

SEQ ID NO: 279543 - RNA, 19 nt, Homo sapiens
cggauuugaugcaccauga

SEQ ID NO: 279544 - RNA, 19 nt, Homo sapiens
acagaugccuauacauaca

SEQ ID NO: 279545 - RNA, 19 nt, Homo sapiens
gagcugcuggugaaagaaa

SEQ ID NO: 279546 - RNA, 19 nt, Homo sapiens
ccacauugacucaguaagu

SEQ ID NO: 279547 - RNA, 19 nt, Homo sapiens
caccaugaaugaggagaaa

SEQ ID NO: 279548 - RNA, 19 nt, Homo sapiens
uaucgcugccucuauuaua

SEQ ID NO: 279549 - RNA, 19 nt, Homo sapiens
gggaggauagagccaagua

SEQ ID NO: 279550 - RNA, 19 nt, Homo sapiens
gcaauagaaaugcacagau

SEQ ID NO: 279551 - RNA, 19 nt, Homo sapiens
cacugaagccuccggauuu

SEQ ID NO: 279552 - RNA, 19 nt, Homo sapiens
cuuuaucgcugccucuauu

SEQ ID NO: 279553 - RNA, 19 nt, Homo sapiens
agagccaaguacaaagaua

SEQ ID NO: 279554 - RNA, 19 nt, Homo sapiens
gaggauagagccaaguaca

SEQ ID NO: 279555 - RNA, 19 nt, Homo sapiens
cacauugacucaguaagug

SEQ ID NO: 279556 - RNA, 19 nt, Homo sapiens
agaaauggccucccgucuu

SEQ ID NO: 279557 - RNA, 19 nt, Homo sapiens
ggagccaugugacuuucau

SEQ ID NO: 279558 - RNA, 19 nt, Homo sapiens
uggagcugcuggugaaaga

SEQ ID NO: 279559 - RNA, 19 nt, Homo sapiens
gagccaaguacaaagauag

SEQ ID NO: 279560 - RNA, 19 nt, Homo sapiens
agaugccuauacauacaua

SEQ ID NO: 279561 - RNA, 19 nt, Homo sapiens
gcaccaugaaugaggagaa

SEQ ID NO: 279562 - RNA, 19 nt, Homo sapiens
ggucugagcacagugacuu

SEQ ID NO: 279563 - RNA, 19 nt, Homo sapiens
gauggucugagcacaguga

SEQ ID NO: 279564 - RNA, 19 nt, Homo sapiens
ccaugaaugaggagaaaug

SEQ ID NO: 279565 - RNA, 19 nt, Homo sapiens
cucaguaagugaaggaaau

SEQ ID NO: 279566 - RNA, 19 nt, Homo sapiens
ggggagaaauaauuagaau

SEQ ID NO: 279567 - RNA, 19 nt, Homo sapiens
caauggggagaaauaauua

SEQ ID NO: 279568 - RNA, 19 nt, Homo sapiens
gauagagccaaguacaaag

SEQ ID NO: 279569 - RNA, 19 nt, Homo sapiens
gauuugaugcaccaugaau

SEQ ID NO: 279570 - RNA, 19 nt, Homo sapiens
gauuccacauugacucagu

SEQ ID NO: 279571 - RNA, 19 nt, Homo sapiens
augcacagaugccuauaca

SEQ ID NO: 279572 - RNA, 19 nt, Homo sapiens
gggagaaauaauuagaaug

SEQ ID NO: 279573 - RNA, 19 nt, Homo sapiens
ccucccgucuugugaacuu

SEQ ID NO: 279574 - RNA, 19 nt, Homo sapiens
acugaagccuccggauuug

SEQ ID NO: 279575 - RNA, 19 nt, Homo sapiens
gcugagccaggcacuguga

SEQ ID NO: 279576 - RNA, 19 nt, Homo sapiens
cgacuugguccaucugagu

SEQ ID NO: 279577 - RNA, 19 nt, Homo sapiens
aucgcugccucuauuauaa

SEQ ID NO: 279578 - RNA, 19 nt, Homo sapiens
ucaauggggagaaauaauu

SEQ ID NO: 279579 - RNA, 19 nt, Homo sapiens
uuugaugcaccaugaauga

SEQ ID NO: 279580 - RNA, 19 nt, Homo sapiens
uccuggagcugcuggugaa

SEQ ID NO: 279581 - RNA, 19 nt, Homo sapiens
ggauuugaugcaccaugaa

SEQ ID NO: 279582 - RNA, 19 nt, Homo sapiens
gaagccuccggauuugaug

SEQ ID NO: 279583 - RNA, 19 nt, Homo sapiens
ugaagccuccggauuugau

SEQ ID NO: 279584 - RNA, 19 nt, Homo sapiens
ugagucagaggccagauuc

SEQ ID NO: 279585 - RNA, 19 nt, Homo sapiens
gaaauggccucccgucuug

SEQ ID NO: 279586 - RNA, 19 nt, Homo sapiens
gcacagaugccuauacaua

SEQ ID NO: 279587 - RNA, 19 nt, Homo sapiens
caauagaaaugcacagaug

SEQ ID NO: 279588 - RNA, 19 nt, Homo sapiens
uauaauguguuucgacuug

SEQ ID NO: 279589 - RNA, 19 nt, Homo sapiens
gaaaugcacagaugccuau

SEQ ID NO: 279590 - RNA, 19 nt, Homo sapiens
ccaaguacaaagauaguua

SEQ ID NO: 279591 - RNA, 19 nt, Homo sapiens
ggauagagccaaguacaaa

SEQ ID NO: 279592 - RNA, 19 nt, Homo sapiens
gcacugaagccuccggauu

SEQ ID NO: 279593 - RNA, 19 nt, Homo sapiens
gaggccagauuccacauug

SEQ ID NO: 279594 - RNA, 19 nt, Homo sapiens
agaaugagcaauagaaaug

SEQ ID NO: 279595 - RNA, 19 nt, Homo sapiens
gaacuucaauggggagaaa

SEQ ID NO: 279596 - RNA, 19 nt, Homo sapiens
cggauuugaugcaccauga

SEQ ID NO: 279597 - RNA, 19 nt, Homo sapiens
acagaugccuauacauaca

SEQ ID NO: 279598 - RNA, 19 nt, Homo sapiens
ccacauugacucaguaagu

SEQ ID NO: 279599 - RNA, 19 nt, Homo sapiens
caccaugaaugaggagaaa

SEQ ID NO: 279600 - RNA, 19 nt, Homo sapiens
uaucgcugccucuauuaua

SEQ ID NO: 279601 - RNA, 19 nt, Homo sapiens
gggaggauagagccaagua

SEQ ID NO: 279602 - RNA, 19 nt, Homo sapiens
gcaauagaaaugcacagau

SEQ ID NO: 279603 - RNA, 19 nt, Homo sapiens
cacugaagccuccggauuu

SEQ ID NO: 279604 - RNA, 19 nt, Homo sapiens
cuuuaucgcugccucuauu

SEQ ID NO: 279605 - RNA, 19 nt, Homo sapiens
agagccaaguacaaagaua

SEQ ID NO: 279606 - RNA, 19 nt, Homo sapiens
gaggauagagccaaguaca

SEQ ID NO: 279607 - RNA, 19 nt, Homo sapiens
cacauugacucaguaagug

SEQ ID NO: 279608 - RNA, 19 nt, Homo sapiens
agaaauggccucccgucuu

SEQ ID NO: 279609 - RNA, 19 nt, Homo sapiens
ggagccaugugacuuucau

SEQ ID NO: 279610 - RNA, 19 nt, Homo sapiens
gagccaaguacaaagauag

SEQ ID NO: 279611 - RNA, 19 nt, Homo sapiens
agaugccuauacauacaua

SEQ ID NO: 279612 - RNA, 19 nt, Homo sapiens
gcaccaugaaugaggagaa

SEQ ID NO: 279613 - RNA, 19 nt, Homo sapiens
ggucugagcacagugacuu

SEQ ID NO: 279614 - RNA, 19 nt, Homo sapiens
gauggucugagcacaguga

SEQ ID NO: 279615 - RNA, 19 nt, Homo sapiens
ccaugaaugaggagaaaug

SEQ ID NO: 279616 - RNA, 19 nt, Homo sapiens
cucaguaagugaaggaaau

SEQ ID NO: 279617 - RNA, 19 nt, Homo sapiens
ggggagaaauaauuagaau

SEQ ID NO: 279618 - RNA, 19 nt, Homo sapiens
caauggggagaaauaauua

SEQ ID NO: 279619 - RNA, 19 nt, Homo sapiens
gauagagccaaguacaaag

SEQ ID NO: 279620 - RNA, 19 nt, Homo sapiens
gauuugaugcaccaugaau

SEQ ID NO: 279621 - RNA, 19 nt, Homo sapiens
gauuccacauugacucagu

SEQ ID NO: 279622 - RNA, 19 nt, Homo sapiens
gcugagccaggcacuguga

SEQ ID NO: 279623 - RNA, 19 nt, Homo sapiens
augcacagaugccuauaca

SEQ ID NO: 279624 - RNA, 19 nt, Homo sapiens
gggagaaauaauuagaaug

SEQ ID NO: 279625 - RNA, 19 nt, Homo sapiens
ccucccgucuugugaacuu

SEQ ID NO: 279626 - RNA, 19 nt, Homo sapiens
acugaagccuccggauuug

SEQ ID NO: 279627 - RNA, 19 nt, Homo sapiens
cgacuugguccaucugagu

SEQ ID NO: 279628 - RNA, 19 nt, Homo sapiens
aucgcugccucuauuauaa

SEQ ID NO: 279629 - RNA, 19 nt, Homo sapiens
ucaauggggagaaauaauu

SEQ ID NO: 279630 - RNA, 19 nt, Homo sapiens
uuugaugcaccaugaauga

SEQ ID NO: 279631 - RNA, 19 nt, Homo sapiens
uccuggagcugcuggugaa

SEQ ID NO: 279632 - RNA, 19 nt, Homo sapiens
ggauuugaugcaccaugaa

SEQ ID NO: 279633 - RNA, 19 nt, Homo sapiens
gaagccuccggauuugaug

SEQ ID NO: 279634 - RNA, 19 nt, Homo sapiens
ugaagccuccggauuugau

SEQ ID NO: 279635 - RNA, 19 nt, Homo sapiens
ugagucagaggccagauuc

SEQ ID NO: 279636 - RNA, 19 nt, Homo sapiens
gaauugaucuguaccaugu

SEQ ID NO: 279637 - RNA, 19 nt, Homo sapiens
ugaaagacauagaugguua

SEQ ID NO: 279638 - RNA, 19 nt, Homo sapiens
ugacauuacugaugacaua

SEQ ID NO: 279639 - RNA, 19 nt, Homo sapiens
gaauaccucuucccuaaug

SEQ ID NO: 279640 - RNA, 19 nt, Homo sapiens
guaauaagcuuuggugcaa

SEQ ID NO: 279641 - RNA, 19 nt, Homo sapiens
gaacaguggcuuugugaga

SEQ ID NO: 279642 - RNA, 19 nt, Homo sapiens
ucaccucugucuugaauaa

SEQ ID NO: 279643 - RNA, 19 nt, Homo sapiens
ugacaucaccgaauucuug

SEQ ID NO: 279644 - RNA, 19 nt, Homo sapiens
caccucaguuuguuucuuu

SEQ ID NO: 279645 - RNA, 19 nt, Homo sapiens
acaaguuccuggaugauga

SEQ ID NO: 279646 - RNA, 19 nt, Homo sapiens
gcacugagaagcuggaaca

SEQ ID NO: 279647 - RNA, 19 nt, Homo sapiens
gaugaugacauuacugaug

SEQ ID NO: 279648 - RNA, 19 nt, Homo sapiens
guuccuggaugaugacauu

SEQ ID NO: 279649 - RNA, 19 nt, Homo sapiens
gugacaaguuccuggauga

SEQ ID NO: 279650 - RNA, 19 nt, Homo sapiens
acaaugaaagcacggaaua

SEQ ID NO: 279651 - RNA, 19 nt, Homo sapiens
uuaaaggaauugacuacug

SEQ ID NO: 279652 - RNA, 19 nt, Homo sapiens
cauaaugugugccaagaag

SEQ ID NO: 279653 - RNA, 19 nt, Homo sapiens
gaaagacauagaugguuau

SEQ ID NO: 279654 - RNA, 19 nt, Homo sapiens
auaaagcccucugcacuga

SEQ ID NO: 279655 - RNA, 19 nt, Homo sapiens
ccagaucaguaauaagcuu

SEQ ID NO: 279656 - RNA, 19 nt, Homo sapiens
gauuucaccucugucuuga

SEQ ID NO: 279657 - RNA, 19 nt, Homo sapiens
acugagcucuagacccuua

SEQ ID NO: 279658 - RNA, 19 nt, Homo sapiens
gugagugucugcuguccuu

SEQ ID NO: 279659 - RNA, 19 nt, Homo sapiens
ccuaaugccaccucaguuu

SEQ ID NO: 279660 - RNA, 19 nt, Homo sapiens
ggacucuuccagaucagua

SEQ ID NO: 279661 - RNA, 19 nt, Homo sapiens
ugugagaaguugugagugu

SEQ ID NO: 279662 - RNA, 19 nt, Homo sapiens
augaugacauuacugauga

SEQ ID NO: 279663 - RNA, 19 nt, Homo sapiens
ucugugacaucuccuguga

SEQ ID NO: 279664 - RNA, 19 nt, Homo sapiens
gcaucgcuuugccugaauu

SEQ ID NO: 279665 - RNA, 19 nt, Homo sapiens
ugacaucuccugugacaag

SEQ ID NO: 279666 - RNA, 19 nt, Homo sapiens
aauaagcuuuggugcaaga

SEQ ID NO: 279667 - RNA, 19 nt, Homo sapiens
caaggaacaucugugacau

SEQ ID NO: 279668 - RNA, 19 nt, Homo sapiens
cacggaauauggacucuuc

SEQ ID NO: 279669 - RNA, 19 nt, Homo sapiens
ugaaagcacggaauaugga

SEQ ID NO: 279670 - RNA, 19 nt, Homo sapiens
ugacacacaagccauaguu

SEQ ID NO: 279671 - RNA, 19 nt, Homo sapiens
ucaaggaacaucugugaca

SEQ ID NO: 279672 - RNA, 19 nt, Homo sapiens
caucuccugugacaaguuc

SEQ ID NO: 279673 - RNA, 19 nt, Homo sapiens
acacacaagccauaguuga

SEQ ID NO: 279674 - RNA, 19 nt, Homo sapiens
ucaguuuguuucuuucugu

SEQ ID NO: 279675 - RNA, 19 nt, Homo sapiens
cgauggcacuuucacuaca

SEQ ID NO: 279676 - RNA, 19 nt, Homo sapiens
ugugacaucuccugugaca

SEQ ID NO: 279677 - RNA, 19 nt, Homo sapiens
aacaguggcuuugugagaa

SEQ ID NO: 279678 - RNA, 19 nt, Homo sapiens
acacaagccauaguugaaa

SEQ ID NO: 279679 - RNA, 19 nt, Homo sapiens
aaagcccucugcacugaga

SEQ ID NO: 279680 - RNA, 19 nt, Homo sapiens
cacacaagccauaguugaa

SEQ ID NO: 279681 - RNA, 19 nt, Homo sapiens
gccaagcaauucacaaaau

SEQ ID NO: 279682 - RNA, 19 nt, Homo sapiens
ccaagcaauucacaaaaug

SEQ ID NO: 279683 - RNA, 19 nt, Homo sapiens
gacaucaccgaauucuuga

SEQ ID NO: 279684 - RNA, 19 nt, Homo sapiens
acuacugguuggcccauaa

SEQ ID NO: 279685 - RNA, 19 nt, Homo sapiens
gcugaaagacauagauggu

SEQ ID NO: 279686 - RNA, 19 nt, Homo sapiens
gaucaguaauaagcuuugg

SEQ ID NO: 279687 - RNA, 19 nt, Homo sapiens
caaugaaagcacggaauau

SEQ ID NO: 279688 - RNA, 19 nt, Homo sapiens
agauuucaccucugucuug

SEQ ID NO: 279689 - RNA, 19 nt, Homo sapiens
gauggcacuuucacuacag

SEQ ID NO: 279690 - RNA, 19 nt, Homo sapiens
ccaccucaguuuguuucuu

SEQ ID NO: 279691 - RNA, 19 nt, Homo sapiens
uggaugaugacauuacuga

SEQ ID NO: 279692 - RNA, 19 nt, Homo sapiens
ucuuccagaucaguaauaa

SEQ ID NO: 279693 - RNA, 19 nt, Homo sapiens
auugaucuguaccauguuu

SEQ ID NO: 279694 - RNA, 19 nt, Homo sapiens
cuaaugccaccucaguuug

SEQ ID NO: 279695 - RNA, 19 nt, Homo sapiens
aaugaaagcacggaauaug

SEQ ID NO: 279696 - RNA, 19 nt, Homo sapiens
gacaaguuccuggaugaug

SEQ ID NO: 279697 - RNA, 19 nt, Homo sapiens
agucaaggaacaucuguga

SEQ ID NO: 279698 - RNA, 19 nt, Homo sapiens
ccccaaagcuuaucugucu

SEQ ID NO: 279699 - RNA, 19 nt, Homo sapiens
ccacacuccuggaauaccu

SEQ ID NO: 279700 - RNA, 19 nt, Homo sapiens
gacauuacugaugacauaa

SEQ ID NO: 279701 - RNA, 19 nt, Homo sapiens
cagaucaguaauaagcuuu

SEQ ID NO: 279702 - RNA, 19 nt, Homo sapiens
uggccaagcaauucacaaa

SEQ ID NO: 279703 - RNA, 19 nt, Homo sapiens
ucacuacagcacagauuuc

SEQ ID NO: 279704 - RNA, 19 nt, Homo sapiens
guggugcacugagcucuag

SEQ ID NO: 279705 - RNA, 19 nt, Homo sapiens
gacuacugguuggcccaua

SEQ ID NO: 279706 - RNA, 19 nt, Homo sapiens
uaaugugugccaagaagau

SEQ ID NO: 279707 - RNA, 19 nt, Homo sapiens
guuauggaggcaucgcuuu

SEQ ID NO: 279708 - RNA, 19 nt, Homo sapiens
gacacacaagccauaguug

SEQ ID NO: 279709 - RNA, 19 nt, Homo sapiens
caguuuguuucuuucuguu

SEQ ID NO: 279710 - RNA, 19 nt, Homo sapiens
aggaacaucugugacaucu

SEQ ID NO: 279711 - RNA, 19 nt, Homo sapiens
uaaugccaccucaguuugu

SEQ ID NO: 279712 - RNA, 19 nt, Homo sapiens
uugccugaauugaucugua

SEQ ID NO: 279713 - RNA, 19 nt, Homo sapiens
uggaacaguggcuuuguga

SEQ ID NO: 279714 - RNA, 19 nt, Homo sapiens
gagaaugccugaacuguaa

SEQ ID NO: 279715 - RNA, 19 nt, Homo sapiens
ccaaagaucuugcacauga

SEQ ID NO: 279716 - RNA, 19 nt, Homo sapiens
gaagaaaucugaguuugaa

SEQ ID NO: 279717 - RNA, 19 nt, Homo sapiens
gaaaucaacuccaucauag

SEQ ID NO: 279718 - RNA, 19 nt, Homo sapiens
ggagguagcugaacaagga

SEQ ID NO: 279719 - RNA, 19 nt, Homo sapiens
gaaagcagaugacaaaaua

SEQ ID NO: 279720 - RNA, 19 nt, Homo sapiens
ggaggacaguugacauuua

SEQ ID NO: 279721 - RNA, 19 nt, Homo sapiens
cgacacagcuaaagaugua

SEQ ID NO: 279722 - RNA, 19 nt, Homo sapiens
ugacagugcuugcgaauuu

SEQ ID NO: 279723 - RNA, 19 nt, Homo sapiens
ggaaacaacuuuggucuug

SEQ ID NO: 279724 - RNA, 19 nt, Homo sapiens
gaagaaugcuauuaugaug

SEQ ID NO: 279725 - RNA, 19 nt, Homo sapiens
gagaauguuuacacaguua

SEQ ID NO: 279726 - RNA, 19 nt, Homo sapiens
gaaguuagcaaaugaugua

SEQ ID NO: 279727 - RNA, 19 nt, Homo sapiens
gcaaugacauacucgauga

SEQ ID NO: 279728 - RNA, 19 nt, Homo sapiens
gaaaggaauuuaugacagu

SEQ ID NO: 279729 - RNA, 19 nt, Homo sapiens
aaagaaggcugaugcugua

SEQ ID NO: 279730 - RNA, 19 nt, Homo sapiens
uuacagagcuccaccagaa

SEQ ID NO: 279731 - RNA, 19 nt, Homo sapiens
cugaggagcuuaaugauaa

SEQ ID NO: 279732 - RNA, 19 nt, Homo sapiens
gaacuacccucgcugcaau

SEQ ID NO: 279733 - RNA, 19 nt, Homo sapiens
gcaagaggauaauuggaaa

SEQ ID NO: 279734 - RNA, 19 nt, Homo sapiens
gcaagccacuggagguuaa

SEQ ID NO: 279735 - RNA, 19 nt, Homo sapiens
ccaagaaguuagcaaauga

SEQ ID NO: 279736 - RNA, 19 nt, Homo sapiens
ucagaaauauuccuccuuu

SEQ ID NO: 279737 - RNA, 19 nt, Homo sapiens
gaaaucaaccugucauuca

SEQ ID NO: 279738 - RNA, 19 nt, Homo sapiens
gaauauacguggaaaguac

SEQ ID NO: 279739 - RNA, 19 nt, Homo sapiens
caaaggcugucuucagaaa

SEQ ID NO: 279740 - RNA, 19 nt, Homo sapiens
caaacuaaauugccaccua

SEQ ID NO: 279741 - RNA, 19 nt, Homo sapiens
gguaaugacuugagcauca

SEQ ID NO: 279742 - RNA, 19 nt, Homo sapiens
cauaugaccuugaagaaga

SEQ ID NO: 279743 - RNA, 19 nt, Homo sapiens
caaaugcuauugauggaaa

SEQ ID NO: 279744 - RNA, 19 nt, Homo sapiens
gaaauguacugcaaauugg

SEQ ID NO: 279745 - RNA, 19 nt, Homo sapiens
ggaaauugcugaagaugag

SEQ ID NO: 279746 - RNA, 19 nt, Homo sapiens
gagauugaccagaugauua

SEQ ID NO: 279747 - RNA, 19 nt, Homo sapiens
gaaagagauugaccagaug

SEQ ID NO: 279748 - RNA, 19 nt, Homo sapiens
gcaccuggauccugucauu

SEQ ID NO: 279749 - RNA, 19 nt, Homo sapiens
gaaauggauugcccuacuu

SEQ ID NO: 279750 - RNA, 19 nt, Homo sapiens
gaaacuccgugaagaugaa

SEQ ID NO: 279751 - RNA, 19 nt, Homo sapiens
gaaggugacugcaaaggau

SEQ ID NO: 279752 - RNA, 19 nt, Homo sapiens
ggaggugacugcauucgaa

SEQ ID NO: 279753 - RNA, 19 nt, Homo sapiens
ugagaaaguugccaaagaa

SEQ ID NO: 279754 - RNA, 19 nt, Homo sapiens
gaagacauccaaacuaaau

SEQ ID NO: 279755 - RNA, 19 nt, Homo sapiens
ucaaacagaugucagaguu

SEQ ID NO: 279756 - RNA, 19 nt, Homo sapiens
caagaacuccguacaauau

SEQ ID NO: 279757 - RNA, 19 nt, Homo sapiens
caacuuuggucuugacuug

SEQ ID NO: 279758 - RNA, 19 nt, Homo sapiens
gagagaagccacagauaaa

SEQ ID NO: 279759 - RNA, 19 nt, Homo sapiens
gcuccugucugauauguaa

SEQ ID NO: 279760 - RNA, 19 nt, Homo sapiens
uaucagcuauuccaaauga

SEQ ID NO: 279761 - RNA, 19 nt, Homo sapiens
gaacuuugaaugacacuuu

SEQ ID NO: 279762 - RNA, 19 nt, Homo sapiens
uaucaaagcuacuuaugga

SEQ ID NO: 279763 - RNA, 19 nt, Homo sapiens
gaagagaguccuccuacaa

SEQ ID NO: 279764 - RNA, 19 nt, Homo sapiens
gcacugggccaccgucaua

SEQ ID NO: 279765 - RNA, 19 nt, Homo sapiens
gaaagcaaggccagaagua

SEQ ID NO: 279766 - RNA, 19 nt, Homo sapiens
cgagugcucuucugaugua

SEQ ID NO: 279767 - RNA, 19 nt, Homo sapiens
ggagaaacauacuuugaca

SEQ ID NO: 279768 - RNA, 19 nt, Homo sapiens
caaaguaucugugucuuca

SEQ ID NO: 279769 - RNA, 19 nt, Homo sapiens
ggaaacaagccaauucuau

SEQ ID NO: 279770 - RNA, 19 nt, Homo sapiens
gccaaaggcugucuucaga

SEQ ID NO: 279771 - RNA, 19 nt, Homo sapiens
gaugaccucucccaagaaa

SEQ ID NO: 279772 - RNA, 19 nt, Homo sapiens
cagaaggacuugacgacua

SEQ ID NO: 279773 - RNA, 19 nt, Homo sapiens
gcaaauugguagaacaugu

SEQ ID NO: 279774 - RNA, 19 nt, Homo sapiens
cugagaaacuugaguauga

SEQ ID NO: 279775 - RNA, 19 nt, Homo sapiens
gaaacuuccagaacaauuu

SEQ ID NO: 279776 - RNA, 19 nt, Homo sapiens
ggacgugggugacucugaa

SEQ ID NO: 279777 - RNA, 19 nt, Homo sapiens
ccaauugguuccuuaaaug

SEQ ID NO: 279778 - RNA, 19 nt, Homo sapiens
gccuaacgcuuuacaauau

SEQ ID NO: 279779 - RNA, 19 nt, Homo sapiens
cagaugaccucaagcaguu

SEQ ID NO: 279780 - RNA, 19 nt, Homo sapiens
gauguucccuggagaaugu

SEQ ID NO: 279781 - RNA, 19 nt, Homo sapiens
auaaaugucuuccugguuu

SEQ ID NO: 279782 - RNA, 19 nt, Homo sapiens
ccagugaccuauagcauug

SEQ ID NO: 279783 - RNA, 19 nt, Homo sapiens
acaggaagcuugcugagaa

SEQ ID NO: 279784 - RNA, 19 nt, Homo sapiens
agaaagagauugaccagau

SEQ ID NO: 279785 - RNA, 19 nt, Homo sapiens
ggacguggaacaacaauga

SEQ ID NO: 279786 - RNA, 19 nt, Homo sapiens
ucacacagguggcccauau

SEQ ID NO: 279787 - RNA, 19 nt, Homo sapiens
gaagaaucauuuaccauac

SEQ ID NO: 279788 - RNA, 19 nt, Homo sapiens
ggaagaagauacagaacgu

SEQ ID NO: 279789 - RNA, 19 nt, Homo sapiens
ggucaaggauauuucaguu

SEQ ID NO: 279790 - RNA, 19 nt, Homo sapiens
uuacauggcucgcaucaau

SEQ ID NO: 279791 - RNA, 19 nt, Homo sapiens
ggagaauguuuacacaguu

SEQ ID NO: 279792 - RNA, 19 nt, Homo sapiens
ggaaaguuaucagcuauuc

SEQ ID NO: 279793 - RNA, 19 nt, Homo sapiens
gacaaggcaugaaauugaa

SEQ ID NO: 279794 - RNA, 19 nt, Homo sapiens
guucucaucuggguaauaa

SEQ ID NO: 279795 - RNA, 19 nt, Homo sapiens
ugucgaaucugcaaucaaa

SEQ ID NO: 279796 - RNA, 19 nt, Homo sapiens
caaagcaguugguggauuc

SEQ ID NO: 279797 - RNA, 19 nt, Homo sapiens
gaacauacaaaccagaaau

SEQ ID NO: 279798 - RNA, 19 nt, Homo sapiens
uuaaagauccuuccaagaa

SEQ ID NO: 279799 - RNA, 19 nt, Homo sapiens
ugaaaucaacuccaucaua

SEQ ID NO: 279800 - RNA, 19 nt, Homo sapiens
gaagagaguggacaauguu

SEQ ID NO: 279801 - RNA, 19 nt, Homo sapiens
gcucugugcugauggauau

SEQ ID NO: 279802 - RNA, 19 nt, Homo sapiens
ggagaaugccugaacugua

SEQ ID NO: 279803 - RNA, 19 nt, Homo sapiens
cgaguuaacggcacuauuu

SEQ ID NO: 279804 - RNA, 19 nt, Homo sapiens
gaucagugcuguccaggau

SEQ ID NO: 279805 - RNA, 19 nt, Homo sapiens
cagauucacugcugucuau

SEQ ID NO: 279806 - RNA, 19 nt, Homo sapiens
gaacagccuaucgaaguua

SEQ ID NO: 279807 - RNA, 19 nt, Homo sapiens
gaaacaacuuuggucuuga

SEQ ID NO: 279808 - RNA, 19 nt, Homo sapiens
ggaagugccaaauuuauug

SEQ ID NO: 279809 - RNA, 19 nt, Homo sapiens
gaccagggcuaccaaagug

SEQ ID NO: 279810 - RNA, 19 nt, Homo sapiens
gaugugcucuuggauacua

SEQ ID NO: 279811 - RNA, 19 nt, Homo sapiens
gaacaaggacguggaacaa

SEQ ID NO: 279812 - RNA, 19 nt, Homo sapiens
ggaaauuucaugcgacaaa

SEQ ID NO: 279813 - RNA, 19 nt, Homo sapiens
gaaacaagccaauucuauc

SEQ ID NO: 279814 - RNA, 19 nt, Homo sapiens
gcaauacacuccuuaauuu

SEQ ID NO: 279815 - RNA, 19 nt, Homo sapiens
gcagauaacucggugaaua

SEQ ID NO: 279816 - RNA, 19 nt, Homo sapiens
aaagagaacugacugauuu

SEQ ID NO: 279817 - RNA, 19 nt, Homo sapiens
gcacaaacauuaaacaaca

SEQ ID NO: 279818 - RNA, 19 nt, Homo sapiens
gggaagcacuuauguguuu

SEQ ID NO: 279819 - RNA, 19 nt, Homo sapiens
gaaaugcaaugaugggaaa

SEQ ID NO: 279820 - RNA, 19 nt, Homo sapiens
uaaauucccugcagaguga

SEQ ID NO: 279821 - RNA, 19 nt, Homo sapiens
uaagagaacuuuccagauc

SEQ ID NO: 279822 - RNA, 19 nt, Homo sapiens
aaaauuagcugccaguuua

SEQ ID NO: 279823 - RNA, 19 nt, Homo sapiens
aaacaucucugacaacaug

SEQ ID NO: 279824 - RNA, 19 nt, Homo sapiens
gaacuaagugacaaaguaa

SEQ ID NO: 279825 - RNA, 19 nt, Homo sapiens
gaauugagcaccagcgaua

SEQ ID NO: 279826 - RNA, 19 nt, Homo sapiens
gaagaugguuacauugaau

SEQ ID NO: 279827 - RNA, 19 nt, Homo sapiens
ggaagaugguuacauugaa

SEQ ID NO: 279828 - RNA, 19 nt, Homo sapiens
caaagagcauggucagaaa

SEQ ID NO: 279829 - RNA, 19 nt, Homo sapiens
caaagcagcuggaagagau

SEQ ID NO: 279830 - RNA, 19 nt, Homo sapiens
gaaggaagagucagacaaa

SEQ ID NO: 279831 - RNA, 19 nt, Homo sapiens
ugaauuagaugaccucaau

SEQ ID NO: 279832 - RNA, 19 nt, Homo sapiens
gaacuggaugugaagauua

SEQ ID NO: 279833 - RNA, 19 nt, Homo sapiens
caacggacauucaaaucaa

SEQ ID NO: 279834 - RNA, 19 nt, Homo sapiens
cagcaaacccugaauauug

SEQ ID NO: 279835 - RNA, 19 nt, Homo sapiens
gaaagagaacugacugauu

SEQ ID NO: 279836 - RNA, 19 nt, Homo sapiens
caacgucggucacaccaaa

SEQ ID NO: 279837 - RNA, 19 nt, Homo sapiens
caauugaguuucacugauu

SEQ ID NO: 279838 - RNA, 19 nt, Homo sapiens
gagaauauguuugugaugu

SEQ ID NO: 279839 - RNA, 19 nt, Homo sapiens
ggaaacaucucugacaaca

SEQ ID NO: 279840 - RNA, 19 nt, Homo sapiens
uggaagagaucaagagaaa

SEQ ID NO: 279841 - RNA, 19 nt, Homo sapiens
gaucauaaaggcuuguaua

SEQ ID NO: 279842 - RNA, 19 nt, Homo sapiens
gcacuaagaacuccuuuau

SEQ ID NO: 279843 - RNA, 19 nt, Homo sapiens
ggagguagcugccaaccau

SEQ ID NO: 279844 - RNA, 19 nt, Homo sapiens
gucguuagauugaaugaua

SEQ ID NO: 279845 - RNA, 19 nt, Homo sapiens
agaacuaagugacaaagua

SEQ ID NO: 279846 - RNA, 19 nt, Homo sapiens
gcagaagaaugugaugauu

SEQ ID NO: 279847 - RNA, 19 nt, Homo sapiens
ugacauggaugguagaaau

SEQ ID NO: 279848 - RNA, 19 nt, Homo sapiens
gcaaagagcauggucagaa

SEQ ID NO: 279849 - RNA, 19 nt, Homo sapiens
guccagagguuaucacuga

SEQ ID NO: 279850 - RNA, 19 nt, Homo sapiens
gauuugggcuuaccaccua

SEQ ID NO: 279851 - RNA, 19 nt, Homo sapiens
ugauguaccuuggaaauaa

SEQ ID NO: 279852 - RNA, 19 nt, Homo sapiens
agacguauauggaugguuu

SEQ ID NO: 279853 - RNA, 19 nt, Homo sapiens
ggauaaauguggacguuca

SEQ ID NO: 279854 - RNA, 19 nt, Homo sapiens
gaggugauauugaugcuau

SEQ ID NO: 279855 - RNA, 19 nt, Homo sapiens
gcauauguguuaacuguca

SEQ ID NO: 279856 - RNA, 19 nt, Homo sapiens
caucagacauggacaagga

SEQ ID NO: 279857 - RNA, 19 nt, Homo sapiens
ggacagaauacgagaacua

SEQ ID NO: 279858 - RNA, 19 nt, Homo sapiens
ccaaggaccugaggaauca

SEQ ID NO: 279859 - RNA, 19 nt, Homo sapiens
gcauuuauuucucugaaga

SEQ ID NO: 279860 - RNA, 19 nt, Homo sapiens
ggaggacaauugaguuuca

SEQ ID NO: 279861 - RNA, 19 nt, Homo sapiens
aggaagaucugccaagaaa

SEQ ID NO: 279862 - RNA, 19 nt, Homo sapiens
caacuaccguucugccauu

SEQ ID NO: 279863 - RNA, 19 nt, Homo sapiens
cuacacagcuggacagauc

SEQ ID NO: 279864 - RNA, 19 nt, Homo sapiens
agacagauguggaaagaau

SEQ ID NO: 279865 - RNA, 19 nt, Homo sapiens
caaaagaacuggaugugaa

SEQ ID NO: 279866 - RNA, 19 nt, Homo sapiens
ucaacccaguggcauauua

SEQ ID NO: 279867 - RNA, 19 nt, Homo sapiens
gcagagaccauucgauuca

SEQ ID NO: 279868 - RNA, 19 nt, Homo sapiens
gauagaggcuugcuguucu

SEQ ID NO: 279869 - RNA, 19 nt, Homo sapiens
ggaagcacuuauguguuua

SEQ ID NO: 279870 - RNA, 19 nt, Homo sapiens
gagggaaguuugccuggaa

SEQ ID NO: 279871 - RNA, 19 nt, Homo sapiens
gugaauaaguuaaccaaca

SEQ ID NO: 279872 - RNA, 19 nt, Homo sapiens
gaugguagaaauagcaaua

SEQ ID NO: 279873 - RNA, 19 nt, Homo sapiens
uggaagauuugaaaggaua

SEQ ID NO: 279874 - RNA, 19 nt, Homo sapiens
cgucuuggcucacucugua

SEQ ID NO: 279875 - RNA, 19 nt, Homo sapiens
uaaagguucuaccagguuu

SEQ ID NO: 279876 - RNA, 19 nt, Homo sapiens
gaaguggagccuuguagaa

SEQ ID NO: 279877 - RNA, 19 nt, Homo sapiens
gauguaccuuggaaauaaa

SEQ ID NO: 279878 - RNA, 19 nt, Homo sapiens
uacaagagcuggcaaagca

SEQ ID NO: 279879 - RNA, 19 nt, Homo sapiens
cagaaaagcacaaacauua

SEQ ID NO: 279880 - RNA, 19 nt, Homo sapiens
uagaaggccuggaaagaga

SEQ ID NO: 279881 - RNA, 19 nt, Homo sapiens
guauauggaugguuuacug

SEQ ID NO: 279882 - RNA, 19 nt, Homo sapiens
ccagagaugcugccaguaa

SEQ ID NO: 279883 - RNA, 19 nt, Homo sapiens
ccagacagauguggaaaga

SEQ ID NO: 279884 - RNA, 19 nt, Homo sapiens
ggaaagcaccucagagaag

SEQ ID NO: 279885 - RNA, 19 nt, Homo sapiens
acuaagaacuccuuuaugg

SEQ ID NO: 279886 - RNA, 19 nt, Homo sapiens
cgaguuauguggaguuuag

SEQ ID NO: 279887 - RNA, 19 nt, Homo sapiens
cagaauacgagaacuaauu

SEQ ID NO: 279888 - RNA, 19 nt, Homo sapiens
acagagaggugauauugau

SEQ ID NO: 279889 - RNA, 19 nt, Homo sapiens
gaagcaagacaagaacuaa

SEQ ID NO: 279890 - RNA, 19 nt, Homo sapiens
ggaauauucaugucaauca

SEQ ID NO: 279891 - RNA, 19 nt, Homo sapiens
gaggaucccuguguggaaa

SEQ ID NO: 279892 - RNA, 19 nt, Homo sapiens
guucugagcuuguacaacu

SEQ ID NO: 279893 - RNA, 19 nt, Homo sapiens
guacugagaauauguuugu

SEQ ID NO: 279894 - RNA, 19 nt, Homo sapiens
auacaucucuguccuuguu

SEQ ID NO: 279895 - RNA, 19 nt, Homo sapiens
gacaagaacuaagugacaa

SEQ ID NO: 279896 - RNA, 19 nt, Homo sapiens
gagacaagugaaagaaaua

SEQ ID NO: 279897 - RNA, 19 nt, Homo sapiens
gcaaggagaaaugcaauga

SEQ ID NO: 279898 - RNA, 19 nt, Homo sapiens
aagcguauguggauaaaug

SEQ ID NO: 279899 - RNA, 19 nt, Homo sapiens
ucuggaagaugguuacauu

SEQ ID NO: 279900 - RNA, 19 nt, Homo sapiens
ccaguggugucguuagauu

SEQ ID NO: 279901 - RNA, 19 nt, Homo sapiens
cagauaacucggugaauaa

SEQ ID NO: 279902 - RNA, 19 nt, Homo sapiens
gauaaggaccuggcagaaa

SEQ ID NO: 279903 - RNA, 19 nt, Homo sapiens
gcccauguccucacacuaa

SEQ ID NO: 279904 - RNA, 19 nt, Homo sapiens
caaagcagucucuguguga

SEQ ID NO: 279905 - RNA, 19 nt, Homo sapiens
gcaggucacucuggaagau

SEQ ID NO: 279906 - RNA, 19 nt, Homo sapiens
gagguucaaugguaaaucu

SEQ ID NO: 279907 - RNA, 19 nt, Homo sapiens
ggacacagaacgaagacuu

SEQ ID NO: 279908 - RNA, 19 nt, Homo sapiens
ucacugggauccuaauaca

SEQ ID NO: 279909 - RNA, 19 nt, Homo sapiens
gaauuaaggacaccuaugg

SEQ ID NO: 279910 - RNA, 19 nt, Homo sapiens
aaaggaagaucugccaaga

SEQ ID NO: 279911 - RNA, 19 nt, Homo sapiens
caggauggcucaggcauau

SEQ ID NO: 279912 - RNA, 19 nt, Homo sapiens
gcaacggacauucaaauca

SEQ ID NO: 279913 - RNA, 19 nt, Homo sapiens
agaaaaggcucaaguaaau

SEQ ID NO: 279914 - RNA, 19 nt, Homo sapiens
gagcacagcugcccaaaua

SEQ ID NO: 279915 - RNA, 19 nt, Homo sapiens
gaagagacuuacuaacuua

SEQ ID NO: 279916 - RNA, 19 nt, Homo sapiens
ggacagagcuucauugcuu

SEQ ID NO: 279917 - RNA, 19 nt, Homo sapiens
gaacaggacuuaaacgaau

SEQ ID NO: 279918 - RNA, 19 nt, Homo sapiens
gaacaccacugaccgaauu

SEQ ID NO: 279919 - RNA, 19 nt, Homo sapiens
acaacaagaugcucuauua

SEQ ID NO: 279920 - RNA, 19 nt, Homo sapiens
caacagcccuagagcaaua

SEQ ID NO: 279921 - RNA, 19 nt, Homo sapiens
gaccggauauuucuuauuu

SEQ ID NO: 279922 - RNA, 19 nt, Homo sapiens
gaagauacguuaaagaaag

SEQ ID NO: 279923 - RNA, 19 nt, Homo sapiens
uagaagggauuccaaauaa

SEQ ID NO: 279924 - RNA, 19 nt, Homo sapiens
gauaugaacugauaguaga

SEQ ID NO: 279925 - RNA, 19 nt, Homo sapiens
acaagaagcuaaugaauug

SEQ ID NO: 279926 - RNA, 19 nt, Homo sapiens
gcacagaauuacaguuauu

SEQ ID NO: 279927 - RNA, 19 nt, Homo sapiens
ccagaagacucacuuauau

SEQ ID NO: 279928 - RNA, 19 nt, Homo sapiens
gaacuggccacuuugaaua

SEQ ID NO: 279929 - RNA, 19 nt, Homo sapiens
gaagaugcuugaagagauu

SEQ ID NO: 279930 - RNA, 19 nt, Homo sapiens
gaaaugcaaugcuggauuc

SEQ ID NO: 279931 - RNA, 19 nt, Homo sapiens
ggaagcaccuguaagaaau

SEQ ID NO: 279932 - RNA, 19 nt, Homo sapiens
cacaagauaugaacugaua

SEQ ID NO: 279933 - RNA, 19 nt, Homo sapiens
cacagaaucuucaacauuu

SEQ ID NO: 279934 - RNA, 19 nt, Homo sapiens
ccagagaacugcaagcaaa

SEQ ID NO: 279935 - RNA, 19 nt, Homo sapiens
ccaagaguuugaacacuua

SEQ ID NO: 279936 - RNA, 19 nt, Homo sapiens
agaaauagauggagccaaa

SEQ ID NO: 279937 - RNA, 19 nt, Homo sapiens
gaagagcacuacuggaugu

SEQ ID NO: 279938 - RNA, 19 nt, Homo sapiens
ccagugagcuucaguaaag

SEQ ID NO: 279939 - RNA, 19 nt, Homo sapiens
ggauugaaguuugaaauug

SEQ ID NO: 279940 - RNA, 19 nt, Homo sapiens
gcaggaaguugcacaguuc

SEQ ID NO: 279941 - RNA, 19 nt, Homo sapiens
ggaaacaggaacuuacuuu

SEQ ID NO: 279942 - RNA, 19 nt, Homo sapiens
ucaagagcauggauaauga

SEQ ID NO: 279943 - RNA, 19 nt, Homo sapiens
ugaagagacuuacuaacuu

SEQ ID NO: 279944 - RNA, 19 nt, Homo sapiens
gauaucaacuucagaggau

SEQ ID NO: 279945 - RNA, 19 nt, Homo sapiens
cuacauguguucuaugauu

SEQ ID NO: 279946 - RNA, 19 nt, Homo sapiens
ggacuuaaacgaaucauca

SEQ ID NO: 279947 - RNA, 19 nt, Homo sapiens
uaauuucacuggcugcaua

SEQ ID NO: 279948 - RNA, 19 nt, Homo sapiens
caaugaaacagcagaauuu

SEQ ID NO: 279949 - RNA, 19 nt, Homo sapiens
uaaguaaccucagccauga

SEQ ID NO: 279950 - RNA, 19 nt, Homo sapiens
ggaccuaacugugaaagau

SEQ ID NO: 279951 - RNA, 19 nt, Homo sapiens
ucaagggucccauuuauuu

SEQ ID NO: 279952 - RNA, 19 nt, Homo sapiens
ggauagagauguggagguu

SEQ ID NO: 279953 - RNA, 19 nt, Homo sapiens
caaauggguuacuauucua

SEQ ID NO: 279954 - RNA, 19 nt, Homo sapiens
ccaaauggguuacuauucu

SEQ ID NO: 279955 - RNA, 19 nt, Homo sapiens
gaggauacgugguucuaga

SEQ ID NO: 279956 - RNA, 19 nt, Homo sapiens
gaagauuuccaacgguaua

SEQ ID NO: 279957 - RNA, 19 nt, Homo sapiens
gauaagcaguacaaugaug

SEQ ID NO: 279958 - RNA, 19 nt, Homo sapiens
gaaccaguauggaugacuu

SEQ ID NO: 279959 - RNA, 19 nt, Homo sapiens
ggcaugaugugauauuuau

SEQ ID NO: 279960 - RNA, 19 nt, Homo sapiens
uagauaagcaguacaauga

SEQ ID NO: 279961 - RNA, 19 nt, Homo sapiens
gaaugaaugugagaaggaa

SEQ ID NO: 279962 - RNA, 19 nt, Homo sapiens
gaagugcacucgagaacca

SEQ ID NO: 279963 - RNA, 19 nt, Homo sapiens
gcuguucggugcauuugua

SEQ ID NO: 279964 - RNA, 19 nt, Homo sapiens
guuuauagcugaaguuauc

SEQ ID NO: 279965 - RNA, 19 nt, Homo sapiens
caacagccgccaagaguuu

SEQ ID NO: 279966 - RNA, 19 nt, Homo sapiens
uagaagccgucaaccauuu

SEQ ID NO: 279967 - RNA, 19 nt, Homo sapiens
cgacaacgcuuuuccuuuu

SEQ ID NO: 279968 - RNA, 19 nt, Homo sapiens
ccaagaagcuauugaccau

SEQ ID NO: 279969 - RNA, 19 nt, Homo sapiens
ugacuacaaugcuaaguug

SEQ ID NO: 279970 - RNA, 19 nt, Homo sapiens
guagaggaauuaguugaaa

SEQ ID NO: 279971 - RNA, 19 nt, Homo sapiens
ccagaaaucuuacaaucca

SEQ ID NO: 279972 - RNA, 19 nt, Homo sapiens
gaacuuagccccaaggaaa

SEQ ID NO: 279973 - RNA, 19 nt, Homo sapiens
ggaauuaguugaaaaggaa

SEQ ID NO: 279974 - RNA, 19 nt, Homo sapiens
gcggcuagauucucagauu

SEQ ID NO: 279975 - RNA, 19 nt, Homo sapiens
gauggcagauggcacagaa

SEQ ID NO: 279976 - RNA, 19 nt, Homo sapiens
gaacuuacuuuucaacaga

SEQ ID NO: 279977 - RNA, 19 nt, Homo sapiens
ucucagacauucaguguga

SEQ ID NO: 279978 - RNA, 19 nt, Homo sapiens
gaagcuaccuggaaaauca

SEQ ID NO: 279979 - RNA, 19 nt, Homo sapiens
gggaguaccuaaauguuca

SEQ ID NO: 279980 - RNA, 19 nt, Homo sapiens
gauacgugguucuagauga

SEQ ID NO: 279981 - RNA, 19 nt, Homo sapiens
gagcacgccuaucaauaug

SEQ ID NO: 279982 - RNA, 19 nt, Homo sapiens
gguccacacuucucuuuau

SEQ ID NO: 279983 - RNA, 19 nt, Homo sapiens
gcaauuccaacgaguguuu

SEQ ID NO: 279984 - RNA, 19 nt, Homo sapiens
gauguggacucugaaguga

SEQ ID NO: 279985 - RNA, 19 nt, Homo sapiens
aaucaagggucccauuuau

SEQ ID NO: 279986 - RNA, 19 nt, Homo sapiens
gaguaagaauccuaccaaa

SEQ ID NO: 279987 - RNA, 19 nt, Homo sapiens
uaaagggaaucaaaguuca

SEQ ID NO: 279988 - RNA, 19 nt, Homo sapiens
gcucagaccagaaguguug

SEQ ID NO: 279989 - RNA, 19 nt, Homo sapiens
cacaggaccuucaacaaga

SEQ ID NO: 279990 - RNA, 19 nt, Homo sapiens
gcacaggaccuucaacaag

SEQ ID NO: 279991 - RNA, 19 nt, Homo sapiens
gcagcuggaugacuacaau

SEQ ID NO: 279992 - RNA, 19 nt, Homo sapiens
agaugaggcuuacgaacua

SEQ ID NO: 279993 - RNA, 19 nt, Homo sapiens
gccaagaguuugaacacuu

SEQ ID NO: 279994 - RNA, 19 nt, Homo sapiens
aaucaaaguucagucagua

SEQ ID NO: 279995 - RNA, 19 nt, Homo sapiens
gaaucaaaguucagucagu

SEQ ID NO: 279996 - RNA, 19 nt, Homo sapiens
gagauaagcuggccuucac

SEQ ID NO: 279997 - RNA, 19 nt, Homo sapiens
gaacuaaagauguggagau

SEQ ID NO: 279998 - RNA, 19 nt, Homo sapiens
ccacugaccgaauuuauga

SEQ ID NO: 279999 - RNA, 19 nt, Homo sapiens
ugaacgggcugguacagaa

SEQ ID NO: 280000 - RNA, 19 nt, Homo sapiens
uaaccucagccaugauuua

SEQ ID NO: 280001 - RNA, 19 nt, Homo sapiens
gacaacaccucgucuaacu

SEQ ID NO: 280002 - RNA, 19 nt, Homo sapiens
gcacgugaaugaaaucaac

SEQ ID NO: 280003 - RNA, 19 nt, Homo sapiens
ggaaaccccuuacucauug

SEQ ID NO: 280004 - RNA, 19 nt, Homo sapiens
cagaucaguuuauccugua

SEQ ID NO: 280005 - RNA, 19 nt, Homo sapiens
aaaagugucuggaugguua

SEQ ID NO: 280006 - RNA, 19 nt, Homo sapiens
ggcaugaucuucuaugucu

SEQ ID NO: 280007 - RNA, 19 nt, Homo sapiens
gcacgccuaucaauaugga

SEQ ID NO: 280008 - RNA, 19 nt, Homo sapiens
cuaaagcaagucagaauaa

SEQ ID NO: 280009 - RNA, 19 nt, Homo sapiens
guaagaauccuaccaaagg

SEQ ID NO: 280010 - RNA, 19 nt, Homo sapiens
aaaguucagucaguagaua

SEQ ID NO: 280011 - RNA, 19 nt, Homo sapiens
guaaagggaaucaaaguuc

SEQ ID NO: 280012 - RNA, 19 nt, Homo sapiens
guauaugggucuugcaauc

SEQ ID NO: 280013 - RNA, 19 nt, Homo sapiens
ggagaaugcuuggaagaag

SEQ ID NO: 280014 - RNA, 19 nt, Homo sapiens
ggacaggacucuccaguuu

SEQ ID NO: 280015 - RNA, 19 nt, Homo sapiens
caacagcacugcacuagaa

SEQ ID NO: 280016 - RNA, 19 nt, Homo sapiens
gcaaguauguggaccucaa

SEQ ID NO: 280017 - RNA, 19 nt, Homo sapiens
gcaaggcgauccagguguu

SEQ ID NO: 280018 - RNA, 19 nt, Homo sapiens
guuaugaacugcacucaga

SEQ ID NO: 280019 - RNA, 19 nt, Homo sapiens
gagcuacacugccugaugu

SEQ ID NO: 280020 - RNA, 19 nt, Homo sapiens
gaggaucgcuuugugaugu

SEQ ID NO: 280021 - RNA, 19 nt, Homo sapiens
gcagauccgugcccucuuc

SEQ ID NO: 280022 - RNA, 19 nt, Homo sapiens
gcgaggagcucaugauggu

SEQ ID NO: 280023 - RNA, 19 nt, Homo sapiens
gagaacgucuacagcuuug

SEQ ID NO: 280024 - RNA, 19 nt, Homo sapiens
caucacugguuccuccuua

SEQ ID NO: 280025 - RNA, 19 nt, Homo sapiens
acacugcccucaaguucua

SEQ ID NO: 280026 - RNA, 19 nt, Homo sapiens
cugcaaggauggcuucuuu

SEQ ID NO: 280027 - RNA, 19 nt, Homo sapiens
ccugaggacugaagugaaa

SEQ ID NO: 280028 - RNA, 19 nt, Homo sapiens
ggacccagcuccgagaugu

SEQ ID NO: 280029 - RNA, 19 nt, Homo sapiens
gcacggagccugccuucau

SEQ ID NO: 280030 - RNA, 19 nt, Homo sapiens
ggucacacccugcaucuug

SEQ ID NO: 280031 - RNA, 19 nt, Homo sapiens
gcaacugcguggcaucaau

SEQ ID NO: 280032 - RNA, 19 nt, Homo sapiens
ccacuucguugcacagaug

SEQ ID NO: 280033 - RNA, 19 nt, Homo sapiens
ggacugaagugaaaacuca

SEQ ID NO: 280034 - RNA, 19 nt, Homo sapiens
acagugcccugcucuacua

SEQ ID NO: 280035 - RNA, 19 nt, Homo sapiens
gccaggaguucguggauau

SEQ ID NO: 280036 - RNA, 19 nt, Homo sapiens
ggugacagaucuuguuucu

SEQ ID NO: 280037 - RNA, 19 nt, Homo sapiens
cugaagaugguuuaaguua

SEQ ID NO: 280038 - RNA, 19 nt, Homo sapiens
gagccuggauggcaccuau

SEQ ID NO: 280039 - RNA, 19 nt, Homo sapiens
ccgaggaccuuuacugcaa

SEQ ID NO: 280040 - RNA, 19 nt, Homo sapiens
ugacugaggccugcacaua

SEQ ID NO: 280041 - RNA, 19 nt, Homo sapiens
gaggaagcccugcaaagga

SEQ ID NO: 280042 - RNA, 19 nt, Homo sapiens
ccacagcgcguauuugauc

SEQ ID NO: 280043 - RNA, 19 nt, Homo sapiens
gcuccuggaugaccuggaa

SEQ ID NO: 280044 - RNA, 19 nt, Homo sapiens
ugagagauuugucaccaau

SEQ ID NO: 280045 - RNA, 19 nt, Homo sapiens
ugaggaggcuggcggugaa

SEQ ID NO: 280046 - RNA, 19 nt, Homo sapiens
gcccacagcgcguauuuga

SEQ ID NO: 280047 - RNA, 19 nt, Homo sapiens
gcguggagcaggacaauga

SEQ ID NO: 280048 - RNA, 19 nt, Homo sapiens
aagcaucgaugaggacauu

SEQ ID NO: 280049 - RNA, 19 nt, Homo sapiens
gauaaauccuaugacuuca

SEQ ID NO: 280050 - RNA, 19 nt, Homo sapiens
ccaccggcgucaacuguga

SEQ ID NO: 280051 - RNA, 19 nt, Homo sapiens
gagcaauggccacuucguu

SEQ ID NO: 280052 - RNA, 19 nt, Homo sapiens
ucaaggugcccaugaaguu

SEQ ID NO: 280053 - RNA, 19 nt, Homo sapiens
gaccagcuccagcagauga

SEQ ID NO: 280054 - RNA, 19 nt, Homo sapiens
aggaagcccugcaaaggaa

SEQ ID NO: 280055 - RNA, 19 nt, Homo sapiens
gccagauugugaauuguga

SEQ ID NO: 280056 - RNA, 19 nt, Homo sapiens
gccaugccaccgacuguua

SEQ ID NO: 280057 - RNA, 19 nt, Homo sapiens
gagauggacacgcugaaug

SEQ ID NO: 280058 - RNA, 19 nt, Homo sapiens
ggaggaagcccugcaaagg

SEQ ID NO: 280059 - RNA, 19 nt, Homo sapiens
ggaguacgccaaugaggau

SEQ ID NO: 280060 - RNA, 19 nt, Homo sapiens
gcaaggauggcuucuuugg

SEQ ID NO: 280061 - RNA, 19 nt, Homo sapiens
ggagcggugugacgugugu

SEQ ID NO: 280062 - RNA, 19 nt, Homo sapiens
uauuacagcaucaaggaua

SEQ ID NO: 280063 - RNA, 19 nt, Homo sapiens
agccacagcuccaaacuuc

SEQ ID NO: 280064 - RNA, 19 nt, Homo sapiens
ccgagacuccuaccaguuu

SEQ ID NO: 280065 - RNA, 19 nt, Homo sapiens
ggacgucaaaggucucuuc

SEQ ID NO: 280066 - RNA, 19 nt, Homo sapiens
ugagaacgucuacagcuuu

SEQ ID NO: 280067 - RNA, 19 nt, Homo sapiens
ucacucuggugcccauuga

SEQ ID NO: 280068 - RNA, 19 nt, Homo sapiens
gaaccugggcagcgucaau

SEQ ID NO: 280069 - RNA, 19 nt, Homo sapiens
gugggacccuccguuauga

SEQ ID NO: 280070 - RNA, 19 nt, Homo sapiens
gggaggagccccuggauaa

SEQ ID NO: 280071 - RNA, 19 nt, Homo sapiens
ccggccagauugugaauug

SEQ ID NO: 280072 - RNA, 19 nt, Homo sapiens
ucaaucagcagccguggaa

SEQ ID NO: 280073 - RNA, 19 nt, Homo sapiens
ggagcuacacugccugaug

SEQ ID NO: 280074 - RNA, 19 nt, Homo sapiens
cccauuacgucgccuucua

SEQ ID NO: 280075 - RNA, 19 nt, Homo sapiens
gaaggugcacuggguguau

SEQ ID NO: 280076 - RNA, 19 nt, Homo sapiens
ggacucaugccaggaaugu

SEQ ID NO: 280077 - RNA, 19 nt, Homo sapiens
ggacguccagcuucaagug

SEQ ID NO: 280078 - RNA, 19 nt, Homo sapiens
ccacgggagucuggcugua

SEQ ID NO: 280079 - RNA, 19 nt, Homo sapiens
agacagaugauccaggaaa

SEQ ID NO: 280080 - RNA, 19 nt, Homo sapiens
ggugggacccuccguuaug

SEQ ID NO: 280081 - RNA, 19 nt, Homo sapiens
gggaccgggugucauccua

SEQ ID NO: 280082 - RNA, 19 nt, Homo sapiens
guuauagcuucuuaaacga

SEQ ID NO: 280083 - RNA, 19 nt, Homo sapiens
ggagggacauuuugguuuc

SEQ ID NO: 280084 - RNA, 19 nt, Homo sapiens
gccgaugugucccuuguca

SEQ ID NO: 280085 - RNA, 19 nt, Homo sapiens
gugcaaacccaacuuccaa

SEQ ID NO: 280086 - RNA, 19 nt, Homo sapiens
aguuauagcuucuuaaacg

SEQ ID NO: 280087 - RNA, 19 nt, Homo sapiens
gugucuauuuggacucuaa

SEQ ID NO: 280088 - RNA, 19 nt, Homo sapiens
ggacagugcccugcucuac

SEQ ID NO: 280089 - RNA, 19 nt, Homo sapiens
ggcucuggcuggauuaugu

SEQ ID NO: 280090 - RNA, 19 nt, Homo sapiens
gccucgugcuguuguauga

SEQ ID NO: 280091 - RNA, 19 nt, Homo sapiens
gacgagacaagcaagaaga

SEQ ID NO: 280092 - RNA, 19 nt, Homo sapiens
caacugcguggcaucaaug

SEQ ID NO: 280093 - RNA, 19 nt, Homo sapiens
gggccgaugugucccuugu

SEQ ID NO: 280094 - RNA, 19 nt, Homo sapiens
caacugcacagcacagagu

SEQ ID NO: 280095 - RNA, 19 nt, Homo sapiens
gagcugugaccgcugcaaa

SEQ ID NO: 280096 - RNA, 19 nt, Homo sapiens
acaggacucuccaguuugg

SEQ ID NO: 280097 - RNA, 19 nt, Homo sapiens
ggccagcgucuucagauug

SEQ ID NO: 280098 - RNA, 19 nt, Homo sapiens
ccuacguccucaucaaguu

SEQ ID NO: 280099 - RNA, 19 nt, Homo sapiens
gauccgugcccucuucuca

SEQ ID NO: 280100 - RNA, 19 nt, Homo sapiens
gagagcccuuugugcugaa

SEQ ID NO: 280101 - RNA, 19 nt, Homo sapiens
ccugagcaauggccacuuc

SEQ ID NO: 280102 - RNA, 19 nt, Homo sapiens
cgagacuccuaccaguuug

SEQ ID NO: 280103 - RNA, 19 nt, Homo sapiens
cgaacaggcacgcuucuuc

SEQ ID NO: 280104 - RNA, 19 nt, Homo sapiens
gacagaugauccaggaaac

SEQ ID NO: 280105 - RNA, 19 nt, Homo sapiens
gacccuccguuaugaacug

SEQ ID NO: 280106 - RNA, 19 nt, Homo sapiens
cccucucccucuucuauaa

SEQ ID NO: 280107 - RNA, 19 nt, Homo sapiens
cagcagcucaucccuguuc

SEQ ID NO: 280108 - RNA, 19 nt, Homo sapiens
ucacugguuccuccuuaaa

SEQ ID NO: 280109 - RNA, 19 nt, Homo sapiens
ggaccacccgagacuccua

SEQ ID NO: 280110 - RNA, 19 nt, Homo sapiens
gccugagucuggcaccauu

SEQ ID NO: 280111 - RNA, 19 nt, Homo sapiens
gcaucagcuucgacaguca

SEQ ID NO: 280112 - RNA, 19 nt, Homo sapiens
ggucagccucuacaacuuc

SEQ ID NO: 280113 - RNA, 19 nt, Homo sapiens
agauggacacgcugaauga

SEQ ID NO: 280114 - RNA, 19 nt, Homo sapiens
gaaagugugucuguaauua

SEQ ID NO: 280115 - RNA, 19 nt, Homo sapiens
gcucaaagauuuagaaaga

SEQ ID NO: 280116 - RNA, 19 nt, Homo sapiens
gaaauuaucugacacaacu

SEQ ID NO: 280117 - RNA, 19 nt, Homo sapiens
gaacuugacagaagauaua

SEQ ID NO: 280118 - RNA, 19 nt, Homo sapiens
gaagacaaaugcuaccaaa

SEQ ID NO: 280119 - RNA, 19 nt, Homo sapiens
gaaagaacuugcugaacaa

SEQ ID NO: 280120 - RNA, 19 nt, Homo sapiens
gagauaaccuucuggauuc

SEQ ID NO: 280121 - RNA, 19 nt, Homo sapiens
gagcugagauguuguuaga

SEQ ID NO: 280122 - RNA, 19 nt, Homo sapiens
cagagaaacugauuaaaga

SEQ ID NO: 280123 - RNA, 19 nt, Homo sapiens
gcagaaacaucaucuuuag

SEQ ID NO: 280124 - RNA, 19 nt, Homo sapiens
ggaaauugcuucugcuaug

SEQ ID NO: 280125 - RNA, 19 nt, Homo sapiens
gaagugaaauuaucugaca

SEQ ID NO: 280126 - RNA, 19 nt, Homo sapiens
ggaagaaccugcaacagau

SEQ ID NO: 280127 - RNA, 19 nt, Homo sapiens
gaagauccauuugguugua

SEQ ID NO: 280128 - RNA, 19 nt, Homo sapiens
uaacuucgauugagucuga

SEQ ID NO: 280129 - RNA, 19 nt, Homo sapiens
ccaagauccuguuacuuua

SEQ ID NO: 280130 - RNA, 19 nt, Homo sapiens
guaaaucacuggacaucuu

SEQ ID NO: 280131 - RNA, 19 nt, Homo sapiens
ggugauauuucgugcuuua

SEQ ID NO: 280132 - RNA, 19 nt, Homo sapiens
ugaaagaacuugcugaaca

SEQ ID NO: 280133 - RNA, 19 nt, Homo sapiens
ggagauaaccuucuggauu

SEQ ID NO: 280134 - RNA, 19 nt, Homo sapiens
gauauaagccagaaaguug

SEQ ID NO: 280135 - RNA, 19 nt, Homo sapiens
gcauagugcugcugacauu

SEQ ID NO: 280136 - RNA, 19 nt, Homo sapiens
gaacuggauucucuacaga

SEQ ID NO: 280137 - RNA, 19 nt, Homo sapiens
uaaagucacugcagauaug

SEQ ID NO: 280138 - RNA, 19 nt, Homo sapiens
uagcauuucugcccuguua

SEQ ID NO: 280139 - RNA, 19 nt, Homo sapiens
ccagaaaguugcuguguau

SEQ ID NO: 280140 - RNA, 19 nt, Homo sapiens
gcccaaggauacagaauuu

SEQ ID NO: 280141 - RNA, 19 nt, Homo sapiens
acaaagugcugaagacauu

SEQ ID NO: 280142 - RNA, 19 nt, Homo sapiens
ccaaaccgccuuaagauuu

SEQ ID NO: 280143 - RNA, 19 nt, Homo sapiens
gaagcaaagugcagaagau

SEQ ID NO: 280144 - RNA, 19 nt, Homo sapiens
ggacagcauugaagcaguu

SEQ ID NO: 280145 - RNA, 19 nt, Homo sapiens
gacaaaugcuaccaaagaa

SEQ ID NO: 280146 - RNA, 19 nt, Homo sapiens
gaaaggugcuuggcugguu

SEQ ID NO: 280147 - RNA, 19 nt, Homo sapiens
gguuggagcugccucagua

SEQ ID NO: 280148 - RNA, 19 nt, Homo sapiens
gaaguccguucacuccuaa

SEQ ID NO: 280149 - RNA, 19 nt, Homo sapiens
aaaggaagcucuggaagaa

SEQ ID NO: 280150 - RNA, 19 nt, Homo sapiens
gcaaugaggagcugagaaa

SEQ ID NO: 280151 - RNA, 19 nt, Homo sapiens
gcagcgaccuggaaggauu

SEQ ID NO: 280152 - RNA, 19 nt, Homo sapiens
gaagauaaagcucaagaau

SEQ ID NO: 280153 - RNA, 19 nt, Homo sapiens
aaugauggcucaaguagaa

SEQ ID NO: 280154 - RNA, 19 nt, Homo sapiens
ggucagugcuugugucuuc

SEQ ID NO: 280155 - RNA, 19 nt, Homo sapiens
ugacagauguuugcagaaa

SEQ ID NO: 280156 - RNA, 19 nt, Homo sapiens
ggauuucuaccaugauuua

SEQ ID NO: 280157 - RNA, 19 nt, Homo sapiens
cauaaugacuuucaagaca

SEQ ID NO: 280158 - RNA, 19 nt, Homo sapiens
gugcuuggcugguuacuau

SEQ ID NO: 280159 - RNA, 19 nt, Homo sapiens
gcaauucccaagauccuua

SEQ ID NO: 280160 - RNA, 19 nt, Homo sapiens
acaagcagaugaagacauu

SEQ ID NO: 280161 - RNA, 19 nt, Homo sapiens
gaacaacuggaauuuauca

SEQ ID NO: 280162 - RNA, 19 nt, Homo sapiens
gcagagaaacugauuaaag

SEQ ID NO: 280163 - RNA, 19 nt, Homo sapiens
agacaggccuggcuuguga

SEQ ID NO: 280164 - RNA, 19 nt, Homo sapiens
gcugaucgauucucuuguu

SEQ ID NO: 280165 - RNA, 19 nt, Homo sapiens
caguacaccuccucugaua

SEQ ID NO: 280166 - RNA, 19 nt, Homo sapiens
uuacagaacuugacagaag

SEQ ID NO: 280167 - RNA, 19 nt, Homo sapiens
gaagcagaauuccauuuua

SEQ ID NO: 280168 - RNA, 19 nt, Homo sapiens
gcagaaagccauggacuug

SEQ ID NO: 280169 - RNA, 19 nt, Homo sapiens
gaaaugaccuguggaacac

SEQ ID NO: 280170 - RNA, 19 nt, Homo sapiens
caacagcacagccaaagaa

SEQ ID NO: 280171 - RNA, 19 nt, Homo sapiens
gaaaugauggcucaaguag

SEQ ID NO: 280172 - RNA, 19 nt, Homo sapiens
gcaaagugcagaagauguu

SEQ ID NO: 280173 - RNA, 19 nt, Homo sapiens
aggcuaaacuuucuaauuc

SEQ ID NO: 280174 - RNA, 19 nt, Homo sapiens
cagcagagaaggcaauuaa

SEQ ID NO: 280175 - RNA, 19 nt, Homo sapiens
ugagaaaucuaaucaagca

SEQ ID NO: 280176 - RNA, 19 nt, Homo sapiens
agacaacacugugaaagaa

SEQ ID NO: 280177 - RNA, 19 nt, Homo sapiens
ggucauaacugugaaaggu

SEQ ID NO: 280178 - RNA, 19 nt, Homo sapiens
gcagugugaucggugcuua

SEQ ID NO: 280179 - RNA, 19 nt, Homo sapiens
uaagaagacuuuagauggu

SEQ ID NO: 280180 - RNA, 19 nt, Homo sapiens
gacagaagauauacgugaa

SEQ ID NO: 280181 - RNA, 19 nt, Homo sapiens
ugacagccaucucauugaa

SEQ ID NO: 280182 - RNA, 19 nt, Homo sapiens
gcugagaaaucuaaucaag

SEQ ID NO: 280183 - RNA, 19 nt, Homo sapiens
gcagucagcccucaugaga

SEQ ID NO: 280184 - RNA, 19 nt, Homo sapiens
gaggaaagucagcgagaua

SEQ ID NO: 280185 - RNA, 19 nt, Homo sapiens
gaggugauauuucgugcuu

SEQ ID NO: 280186 - RNA, 19 nt, Homo sapiens
gaagacauucuguugaaga

SEQ ID NO: 280187 - RNA, 19 nt, Homo sapiens
aaacaccgaugacagaugu

SEQ ID NO: 280188 - RNA, 19 nt, Homo sapiens
ucaccaggcucaagauaug

SEQ ID NO: 280189 - RNA, 19 nt, Homo sapiens
ggaguacgacauccuaauu

SEQ ID NO: 280190 - RNA, 19 nt, Homo sapiens
gagaaucaaguuugugaaa

SEQ ID NO: 280191 - RNA, 19 nt, Homo sapiens
gccagaaaguugcugugua

SEQ ID NO: 280192 - RNA, 19 nt, Homo sapiens
gacuuuagauggugaacuu

SEQ ID NO: 280193 - RNA, 19 nt, Homo sapiens
cugaacaacuggaauuuau

SEQ ID NO: 280194 - RNA, 19 nt, Homo sapiens
gcaggacugucgaaagugu

SEQ ID NO: 280195 - RNA, 19 nt, Homo sapiens
cauccgagauccuaauuuc

SEQ ID NO: 280196 - RNA, 19 nt, Homo sapiens
gcugagauguuguuagaag

SEQ ID NO: 280197 - RNA, 19 nt, Homo sapiens
cagugucgguguaaauuaa

SEQ ID NO: 280198 - RNA, 19 nt, Homo sapiens
gaaauugcuucugcuaugg

SEQ ID NO: 280199 - RNA, 19 nt, Homo sapiens
agacaaaugcuaccaaaga

SEQ ID NO: 280200 - RNA, 19 nt, Homo sapiens
caacaggacacacagauuc

SEQ ID NO: 280201 - RNA, 19 nt, Homo sapiens
gaaaggaagacgggaagaa

SEQ ID NO: 280202 - RNA, 19 nt, Homo sapiens
cugcagaacugacgaagga

SEQ ID NO: 280203 - RNA, 19 nt, Homo sapiens
uagaagacgugaugaugga

SEQ ID NO: 280204 - RNA, 19 nt, Homo sapiens
uggauagcauuaccaagua

SEQ ID NO: 280205 - RNA, 19 nt, Homo sapiens
gcaauccucugggaacaau

SEQ ID NO: 280206 - RNA, 19 nt, Homo sapiens
gauauuucgugcuuuagau

SEQ ID NO: 280207 - RNA, 19 nt, Homo sapiens
uaaaggauauaagccagaa

SEQ ID NO: 280208 - RNA, 19 nt, Homo sapiens
cagaagauguuaagaagac

SEQ ID NO: 280209 - RNA, 19 nt, Homo sapiens
gagcugagaaaucuaauca

SEQ ID NO: 280210 - RNA, 19 nt, Homo sapiens
gagaaucccaguucaagga

SEQ ID NO: 280211 - RNA, 19 nt, Homo sapiens
gaagcagagaaacugauua

SEQ ID NO: 280212 - RNA, 19 nt, Homo sapiens
gcaauggccacgccgauga

SEQ ID NO: 280213 - RNA, 19 nt, Homo sapiens
ugugacagcuauacugauu

SEQ ID NO: 280214 - RNA, 19 nt, Homo sapiens
gagauaggcuugcacuuaa

SEQ ID NO: 280215 - RNA, 19 nt, Homo sapiens
ggacagaccugggaacuga

SEQ ID NO: 280216 - RNA, 19 nt, Homo sapiens
gaacuuauccagaguguga

SEQ ID NO: 280217 - RNA, 19 nt, Homo sapiens
gagcugaccucaagggaaa

SEQ ID NO: 280218 - RNA, 19 nt, Homo sapiens
ugacagaugugcaagauga

SEQ ID NO: 280219 - RNA, 19 nt, Homo sapiens
gcucaaacauucaaacuuc

SEQ ID NO: 280220 - RNA, 19 nt, Homo sapiens
gcacugggaugauguaguc

SEQ ID NO: 280221 - RNA, 19 nt, Homo sapiens
gcaaugggcaugcagauga

SEQ ID NO: 280222 - RNA, 19 nt, Homo sapiens
ggauggagcugaccucaag

SEQ ID NO: 280223 - RNA, 19 nt, Homo sapiens
cgagauaggcuugcacuua

SEQ ID NO: 280224 - RNA, 19 nt, Homo sapiens
guacuacuaugcccucuau

SEQ ID NO: 280225 - RNA, 19 nt, Homo sapiens
gaacuucaaugccaaccau

SEQ ID NO: 280226 - RNA, 19 nt, Homo sapiens
ugaaagggcucggcaguug

SEQ ID NO: 280227 - RNA, 19 nt, Homo sapiens
gaccuggccugcucauuga

SEQ ID NO: 280228 - RNA, 19 nt, Homo sapiens
ggagggagauccgagagaa

SEQ ID NO: 280229 - RNA, 19 nt, Homo sapiens
guaccgauauuucuccuau

SEQ ID NO: 280230 - RNA, 19 nt, Homo sapiens
ggaaggcaccuaugaggaa

SEQ ID NO: 280231 - RNA, 19 nt, Homo sapiens
gcaaacacauggccaacca

SEQ ID NO: 280232 - RNA, 19 nt, Homo sapiens
gggaugauguagucuguga

SEQ ID NO: 280233 - RNA, 19 nt, Homo sapiens
caacggcacuuugcuacuu

SEQ ID NO: 280234 - RNA, 19 nt, Homo sapiens
ggaccuggccugcucauug

SEQ ID NO: 280235 - RNA, 19 nt, Homo sapiens
gaaggcaccuaugaggaaa

SEQ ID NO: 280236 - RNA, 19 nt, Homo sapiens
cgacugggccuacugcuaa

SEQ ID NO: 280237 - RNA, 19 nt, Homo sapiens
ggacagaggcacugaugga

SEQ ID NO: 280238 - RNA, 19 nt, Homo sapiens
cagaacaacugcgggauga

SEQ ID NO: 280239 - RNA, 19 nt, Homo sapiens
gcgcaggaguugcaacaga

SEQ ID NO: 280240 - RNA, 19 nt, Homo sapiens
cgacguggguggugcuuug

SEQ ID NO: 280241 - RNA, 19 nt, Homo sapiens
gauugugacucucguggaa

SEQ ID NO: 280242 - RNA, 19 nt, Homo sapiens
gccaaugccugcgcuguuu

SEQ ID NO: 280243 - RNA, 19 nt, Homo sapiens
gugcaagccuggagugguu

SEQ ID NO: 280244 - RNA, 19 nt, Homo sapiens
ugugauggaugucagcaua

SEQ ID NO: 280245 - RNA, 19 nt, Homo sapiens
aaaggugcauugcugguuu

SEQ ID NO: 280246 - RNA, 19 nt, Homo sapiens
gaaccugacucgucuacac

SEQ ID NO: 280247 - RNA, 19 nt, Homo sapiens
gcagaacgucgugccaaua

SEQ ID NO: 280248 - RNA, 19 nt, Homo sapiens
ccuacaagcugcaucugaa

SEQ ID NO: 280249 - RNA, 19 nt, Homo sapiens
ggccgaaccuggcaugugu

SEQ ID NO: 280250 - RNA, 19 nt, Homo sapiens
gaauguagucaccagcuuu

SEQ ID NO: 280251 - RNA, 19 nt, Homo sapiens
ccaggaacuucaagaacuu

SEQ ID NO: 280252 - RNA, 19 nt, Homo sapiens
cuacaacaccugccaguga

SEQ ID NO: 280253 - RNA, 19 nt, Homo sapiens
gaaacgggcaggaaauagu

SEQ ID NO: 280254 - RNA, 19 nt, Homo sapiens
cgaccagcaucuugacuug

SEQ ID NO: 280255 - RNA, 19 nt, Homo sapiens
gagggaaacaggccaaaga

SEQ ID NO: 280256 - RNA, 19 nt, Homo sapiens
caaugucucugucgaacug

SEQ ID NO: 280257 - RNA, 19 nt, Homo sapiens
gagggcaggugcucgaugu

SEQ ID NO: 280258 - RNA, 19 nt, Homo sapiens
ggugcaaccuggcuacuuc

SEQ ID NO: 280259 - RNA, 19 nt, Homo sapiens
ggaccuggaggcugaguuu

SEQ ID NO: 280260 - RNA, 19 nt, Homo sapiens
ggaauuggaaggcaccuau

SEQ ID NO: 280261 - RNA, 19 nt, Homo sapiens
cagagggccuggagggaaa

SEQ ID NO: 280262 - RNA, 19 nt, Homo sapiens
gaauauucccagcagauug

SEQ ID NO: 280263 - RNA, 19 nt, Homo sapiens
caacacacguggccucaac

SEQ ID NO: 280264 - RNA, 19 nt, Homo sapiens
gcaagccgcucaggacaag

SEQ ID NO: 280265 - RNA, 19 nt, Homo sapiens
aggcagaccugacagaugu

SEQ ID NO: 280266 - RNA, 19 nt, Homo sapiens
gcaagacuucucccucuga

SEQ ID NO: 280267 - RNA, 19 nt, Homo sapiens
ggaacaggccaaccaggaa

SEQ ID NO: 280268 - RNA, 19 nt, Homo sapiens
gguacuugauauuuccuaa

SEQ ID NO: 280269 - RNA, 19 nt, Homo sapiens
gcaaugggcagaguuggaa

SEQ ID NO: 280270 - RNA, 19 nt, Homo sapiens
ccuggaggcucugaaauug

SEQ ID NO: 280271 - RNA, 19 nt, Homo sapiens
gcaaccugcugggcacaaa

SEQ ID NO: 280272 - RNA, 19 nt, Homo sapiens
cagaaccuguugaagauca

SEQ ID NO: 280273 - RNA, 19 nt, Homo sapiens
uggaggcucugaaauugaa

SEQ ID NO: 280274 - RNA, 19 nt, Homo sapiens
caaccaggaacuucaagaa

SEQ ID NO: 280275 - RNA, 19 nt, Homo sapiens
gaaaggugcauugcugguu

SEQ ID NO: 280276 - RNA, 19 nt, Homo sapiens
ggaagugcccagccugaga

SEQ ID NO: 280277 - RNA, 19 nt, Homo sapiens
ccacaugccagguacuuga

SEQ ID NO: 280278 - RNA, 19 nt, Homo sapiens
gaguaaggcagcccaguug

SEQ ID NO: 280279 - RNA, 19 nt, Homo sapiens
gauccuggcacguacugua

SEQ ID NO: 280280 - RNA, 19 nt, Homo sapiens
gagcugcggcgugaaauug

SEQ ID NO: 280281 - RNA, 19 nt, Homo sapiens
gccagguacuugauauuuc

SEQ ID NO: 280282 - RNA, 19 nt, Homo sapiens
ccacggcacugggaugaug

SEQ ID NO: 280283 - RNA, 19 nt, Homo sapiens
gaggcugaguuucauuuca

SEQ ID NO: 280284 - RNA, 19 nt, Homo sapiens
ggagcugggcugaggauga

SEQ ID NO: 280285 - RNA, 19 nt, Homo sapiens
gagcugggcugaggaugag

SEQ ID NO: 280286 - RNA, 19 nt, Homo sapiens
agaauccgcuccggccuuu

SEQ ID NO: 280287 - RNA, 19 nt, Homo sapiens
gaggagcugcggcgugaaa

SEQ ID NO: 280288 - RNA, 19 nt, Homo sapiens
gcagugccaugccugugau

SEQ ID NO: 280289 - RNA, 19 nt, Homo sapiens
ugacucgucuacacacguu

SEQ ID NO: 280290 - RNA, 19 nt, Homo sapiens
gggcugaggaugagaaaca

SEQ ID NO: 280291 - RNA, 19 nt, Homo sapiens
gagccugacagacauaaau

SEQ ID NO: 280292 - RNA, 19 nt, Homo sapiens
ggacuuggcagcccguaca

SEQ ID NO: 280293 - RNA, 19 nt, Homo sapiens
gggcggacuuguucugagu

SEQ ID NO: 280294 - RNA, 19 nt, Homo sapiens
ccuggcauguguaccgaua

SEQ ID NO: 280295 - RNA, 19 nt, Homo sapiens
ggugagcacugugaaaggu

SEQ ID NO: 280296 - RNA, 19 nt, Homo sapiens
uggcauguguaccgauauu

SEQ ID NO: 280297 - RNA, 19 nt, Homo sapiens
gaugcgauccuggcacgua

SEQ ID NO: 280298 - RNA, 19 nt, Homo sapiens
ucaagaacuuauccagagu

SEQ ID NO: 280299 - RNA, 19 nt, Homo sapiens
ggaggugugugugauggau

SEQ ID NO: 280300 - RNA, 19 nt, Homo sapiens
gaggacggccauagucaug

SEQ ID NO: 280301 - RNA, 19 nt, Homo sapiens
gcgagcagugucaggauuu

SEQ ID NO: 280302 - RNA, 19 nt, Homo sapiens
gcauguguaccgauauuuc

SEQ ID NO: 280303 - RNA, 19 nt, Homo sapiens
gggcugauccugauagcau

SEQ ID NO: 280304 - RNA, 19 nt, Homo sapiens
gcccgugcguucucaggaa

SEQ ID NO: 280305 - RNA, 19 nt, Homo sapiens
gggcugcgaugugaagcuu

SEQ ID NO: 280306 - RNA, 19 nt, Homo sapiens
gcugugauucccaugauga

SEQ ID NO: 280307 - RNA, 19 nt, Homo sapiens
ccaauaaaccagugugaac

SEQ ID NO: 280308 - RNA, 19 nt, Homo sapiens
gaaacagaaggcagagaca

SEQ ID NO: 280309 - RNA, 19 nt, Homo sapiens
aggagaagcugggcauugu

SEQ ID NO: 280310 - RNA, 19 nt, Homo sapiens
ccaaugccugcgcuguuua

SEQ ID NO: 280311 - RNA, 19 nt, Homo sapiens
gugugccgcuccugugauu

SEQ ID NO: 280312 - RNA, 19 nt, Homo sapiens
agucaugccuguaggaagu

SEQ ID NO: 280313 - RNA, 19 nt, Homo sapiens
ugaaggcgaggucaucuau

SEQ ID NO: 280314 - RNA, 19 nt, Homo sapiens
ggugucagcugcacuauuu

SEQ ID NO: 280315 - RNA, 19 nt, Homo sapiens
caacuuaaccuuauggauu

SEQ ID NO: 280316 - RNA, 19 nt, Homo sapiens
ggacaggguugcugagguu

SEQ ID NO: 280317 - RNA, 19 nt, Homo sapiens
gguaagaccuggcgagugu

SEQ ID NO: 280318 - RNA, 19 nt, Homo sapiens
ggagggacaugccguguga

SEQ ID NO: 280319 - RNA, 19 nt, Homo sapiens
ccacucaucugccgccuuu

SEQ ID NO: 280320 - RNA, 19 nt, Homo sapiens
ggagagcgcugugaccuau

SEQ ID NO: 280321 - RNA, 19 nt, Homo sapiens
acuaagagcucucaaguca

SEQ ID NO: 280322 - RNA, 19 nt, Homo sapiens
ugaaagacauggaguugga

SEQ ID NO: 280323 - RNA, 19 nt, Homo sapiens
agacaaagaugguggagau

SEQ ID NO: 280324 - RNA, 19 nt, Homo sapiens
caagagggauuugagagaa

SEQ ID NO: 280325 - RNA, 19 nt, Homo sapiens
gauccuagaugcaaagagu

SEQ ID NO: 280326 - RNA, 19 nt, Homo sapiens
ucagagacaugucacuuug

SEQ ID NO: 280327 - RNA, 19 nt, Homo sapiens
uaagagcucucaagucaag

SEQ ID NO: 280328 - RNA, 19 nt, Homo sapiens
ggcaugccauugaaacuaa

SEQ ID NO: 280329 - RNA, 19 nt, Homo sapiens
gcagauccgugaccacauc

SEQ ID NO: 280330 - RNA, 19 nt, Homo sapiens
guguguagcuaguaagauu

SEQ ID NO: 280331 - RNA, 19 nt, Homo sapiens
ggaagagggagcaguuuga

SEQ ID NO: 280332 - RNA, 19 nt, Homo sapiens
ggaggugugugugacaauu

SEQ ID NO: 280333 - RNA, 19 nt, Homo sapiens
caggcgaucuggagaaaga

SEQ ID NO: 280334 - RNA, 19 nt, Homo sapiens
gaugaaaugcugcaagugu

SEQ ID NO: 280335 - RNA, 19 nt, Homo sapiens
caaagaugguggagauugg

SEQ ID NO: 280336 - RNA, 19 nt, Homo sapiens
gagcagauccgagcaguuc

SEQ ID NO: 280337 - RNA, 19 nt, Homo sapiens
ugaccaagccugagaccua

SEQ ID NO: 280338 - RNA, 19 nt, Homo sapiens
gaacacacagcaaggaaag

SEQ ID NO: 280339 - RNA, 19 nt, Homo sapiens
agaguaagauugagcagau

SEQ ID NO: 280340 - RNA, 19 nt, Homo sapiens
ccaagcagcugggugacuu

SEQ ID NO: 280341 - RNA, 19 nt, Homo sapiens
ugacaagcaugaccaagca

SEQ ID NO: 280342 - RNA, 19 nt, Homo sapiens
gagagugggcgcugccuuu

SEQ ID NO: 280343 - RNA, 19 nt, Homo sapiens
cagaugaaaugcugcaagu

SEQ ID NO: 280344 - RNA, 19 nt, Homo sapiens
ggacugaccaagccugaga

SEQ ID NO: 280345 - RNA, 19 nt, Homo sapiens
ggagaucacaaacuugaga

SEQ ID NO: 280346 - RNA, 19 nt, Homo sapiens
gcgaguggcagaugaaaug

SEQ ID NO: 280347 - RNA, 19 nt, Homo sapiens
gaugaaagacauggaguug

SEQ ID NO: 280348 - RNA, 19 nt, Homo sapiens
gaagagggagcaguuugaa

SEQ ID NO: 280349 - RNA, 19 nt, Homo sapiens
ggaccaggcagaugauuag

SEQ ID NO: 280350 - RNA, 19 nt, Homo sapiens
agagggauuugagagaaua

SEQ ID NO: 280351 - RNA, 19 nt, Homo sapiens
uagagaauguggcuucauc

SEQ ID NO: 280352 - RNA, 19 nt, Homo sapiens
gaaacuaagagcucucaag

SEQ ID NO: 280353 - RNA, 19 nt, Homo sapiens
cagaaaagcuggugacaag

SEQ ID NO: 280354 - RNA, 19 nt, Homo sapiens
gagauuccagcuucaagaa

SEQ ID NO: 280355 - RNA, 19 nt, Homo sapiens
cagcgaggcuacugcaauc

SEQ ID NO: 280356 - RNA, 19 nt, Homo sapiens
ggagauuccagcuucaaga

SEQ ID NO: 280357 - RNA, 19 nt, Homo sapiens
gagaaagaacggcagaaca

SEQ ID NO: 280358 - RNA, 19 nt, Homo sapiens
gagaugauggacaggauga

SEQ ID NO: 280359 - RNA, 19 nt, Homo sapiens
uaacagaccccgacacuga

SEQ ID NO: 280360 - RNA, 19 nt, Homo sapiens
cagcugagccugagccaau

SEQ ID NO: 280361 - RNA, 19 nt, Homo sapiens
ggcuggagaugucuucguu

SEQ ID NO: 280362 - RNA, 19 nt, Homo sapiens
ggacaggagauuccagcuu

SEQ ID NO: 280363 - RNA, 19 nt, Homo sapiens
gaaagaacggcagaacaca

SEQ ID NO: 280364 - RNA, 19 nt, Homo sapiens
gaagcugggcugggcagua

SEQ ID NO: 280365 - RNA, 19 nt, Homo sapiens
aaacuaagagcucucaagu

SEQ ID NO: 280366 - RNA, 19 nt, Homo sapiens
gggagaccauggagaugau

SEQ ID NO: 280367 - RNA, 19 nt, Homo sapiens
agacucagcuacuguucug

SEQ ID NO: 280368 - RNA, 19 nt, Homo sapiens
uccgacagcucgcgccuuu

SEQ ID NO: 280369 - RNA, 19 nt, Homo sapiens
ggauuuagugucugggauu

SEQ ID NO: 280370 - RNA, 19 nt, Homo sapiens
gcagaacacacagcaagga

SEQ ID NO: 280371 - RNA, 19 nt, Homo sapiens
ggaugaaagacauggaguu

SEQ ID NO: 280372 - RNA, 19 nt, Homo sapiens
ccaagagggauuugagaga

SEQ ID NO: 280373 - RNA, 19 nt, Homo sapiens
gauuagggcagccgaggaa

SEQ ID NO: 280374 - RNA, 19 nt, Homo sapiens
cagcggaccaggcagauga

SEQ ID NO: 280375 - RNA, 19 nt, Homo sapiens
gaugcaaagaguaagauug

SEQ ID NO: 280376 - RNA, 19 nt, Homo sapiens
gcccaugaaugccaaaggu

SEQ ID NO: 280377 - RNA, 19 nt, Homo sapiens
gaugauggacaggaugaaa

SEQ ID NO: 280378 - RNA, 19 nt, Homo sapiens
aagcugggcugggcaguau

SEQ ID NO: 280379 - RNA, 19 nt, Homo sapiens
ugcagaagaugaaugagau

SEQ ID NO: 280380 - RNA, 19 nt, Homo sapiens
ucccaaaugugaccagugu

SEQ ID NO: 280381 - RNA, 19 nt, Homo sapiens
gguccaacuuaaccuuaug

SEQ ID NO: 280382 - RNA, 19 nt, Homo sapiens
cauucuuccucuuguguuu

SEQ ID NO: 280383 - RNA, 19 nt, Homo sapiens
gauggaggaagaugucaga

SEQ ID NO: 280384 - RNA, 19 nt, Homo sapiens
cgacugcaaugggcacuca

SEQ ID NO: 280385 - RNA, 19 nt, Homo sapiens
gcagguccacgaugucugu

SEQ ID NO: 280386 - RNA, 19 nt, Homo sapiens
aagaagucaugauggaguu

SEQ ID NO: 280387 - RNA, 19 nt, Homo sapiens
caguuacacuugacagaca

SEQ ID NO: 280388 - RNA, 19 nt, Homo sapiens
ccugguguguagcuaguaa

SEQ ID NO: 280389 - RNA, 19 nt, Homo sapiens
gcccggauccagaguguga

SEQ ID NO: 280390 - RNA, 19 nt, Homo sapiens
acaaaaguaugcugaguug

SEQ ID NO: 280391 - RNA, 19 nt, Homo sapiens
gcugugcacccuucuacaa

SEQ ID NO: 280392 - RNA, 19 nt, Homo sapiens
ggacaggaugaaagacaug

SEQ ID NO: 280393 - RNA, 19 nt, Homo sapiens
aaaguaugcugaguugaag

SEQ ID NO: 280394 - RNA, 19 nt, Homo sapiens
gggauuccagcaacucaaa

SEQ ID NO: 280395 - RNA, 19 nt, Homo sapiens
ccuaaugcacgccuaaaug

SEQ ID NO: 280396 - RNA, 19 nt, Homo sapiens
uggagagucuugacagaag

SEQ ID NO: 280397 - RNA, 19 nt, Homo sapiens
caaaggugcgacugcaaug

SEQ ID NO: 280398 - RNA, 19 nt, Homo sapiens
ccaaaggugcgacugcaau

SEQ ID NO: 280399 - RNA, 19 nt, Homo sapiens
ugaaaugcugcaaguguga

SEQ ID NO: 280400 - RNA, 19 nt, Homo sapiens
gauuuagugucugggauuc

SEQ ID NO: 280401 - RNA, 19 nt, Homo sapiens
caucugccgccuuugcuuu

SEQ ID NO: 280402 - RNA, 19 nt, Homo sapiens
gugcacccuucuacaacaa

SEQ ID NO: 280403 - RNA, 19 nt, Homo sapiens
ccuuauggauuuagugucu

SEQ ID NO: 280404 - RNA, 19 nt, Homo sapiens
gaccauucuuccucuugug

SEQ ID NO: 280405 - RNA, 19 nt, Homo sapiens
ggcugaagaugagaccauu

SEQ ID NO: 280406 - RNA, 19 nt, Homo sapiens
acaaagaugguggagauug

SEQ ID NO: 280407 - RNA, 19 nt, Homo sapiens
gagaccauucuuccucuug

SEQ ID NO: 280408 - RNA, 19 nt, Homo sapiens
ggccugcuauccaccuguu

SEQ ID NO: 280409 - RNA, 19 nt, Homo sapiens
gaggaagagggagcaguuu

SEQ ID NO: 280410 - RNA, 19 nt, Homo sapiens
augcaaagaguaagauuga

SEQ ID NO: 280411 - RNA, 19 nt, Homo sapiens
ccaggacgcccaugaaugc

SEQ ID NO: 280412 - RNA, 19 nt, Homo sapiens
gauccagagugugaagaca

SEQ ID NO: 280413 - RNA, 19 nt, Homo sapiens
cggaccaggcagaugauua

SEQ ID NO: 280414 - RNA, 19 nt, Homo sapiens
gcaagcagguguugaguua

SEQ ID NO: 280415 - RNA, 19 nt, Homo sapiens
gaacauggcugaagauuuu

SEQ ID NO: 280416 - RNA, 19 nt, Homo sapiens
uuacagaucuggauaauga

SEQ ID NO: 280417 - RNA, 19 nt, Homo sapiens
gagaagugcuggauauuug

SEQ ID NO: 280418 - RNA, 19 nt, Homo sapiens
caagaggacugaagauuga

SEQ ID NO: 280419 - RNA, 19 nt, Homo sapiens
ggaaagaaaccuauuauca

SEQ ID NO: 280420 - RNA, 19 nt, Homo sapiens
ggacguggcauccuacuua

SEQ ID NO: 280421 - RNA, 19 nt, Homo sapiens
gaacuaguguuaaguaucu

SEQ ID NO: 280422 - RNA, 19 nt, Homo sapiens
ucaacaaccugaaagauuu

SEQ ID NO: 280423 - RNA, 19 nt, Homo sapiens
gcaaagacagccaaugaua

SEQ ID NO: 280424 - RNA, 19 nt, Homo sapiens
caaauuagccguuuacaga

SEQ ID NO: 280425 - RNA, 19 nt, Homo sapiens
gagugaagcuccaggaauu

SEQ ID NO: 280426 - RNA, 19 nt, Homo sapiens
gaagauguguuugcaaaga

SEQ ID NO: 280427 - RNA, 19 nt, Homo sapiens
ucacagaguuuaaagagaa

SEQ ID NO: 280428 - RNA, 19 nt, Homo sapiens
gaucaagccuucgaggaua

SEQ ID NO: 280429 - RNA, 19 nt, Homo sapiens
gaugugagcucugugauga

SEQ ID NO: 280430 - RNA, 19 nt, Homo sapiens
ggagcuggcuuaagaguau

SEQ ID NO: 280431 - RNA, 19 nt, Homo sapiens
caaagguauuggucauuua

SEQ ID NO: 280432 - RNA, 19 nt, Homo sapiens
ugagggagcuggcuuaaga

SEQ ID NO: 280433 - RNA, 19 nt, Homo sapiens
gaacaaggaauuuauguag

SEQ ID NO: 280434 - RNA, 19 nt, Homo sapiens
acaggaagcugaugacauu

SEQ ID NO: 280435 - RNA, 19 nt, Homo sapiens
gagaacaguuaaucccuaa

SEQ ID NO: 280436 - RNA, 19 nt, Homo sapiens
uaaagugucucuuccauca

SEQ ID NO: 280437 - RNA, 19 nt, Homo sapiens
gaaguucacuccagcaagu

SEQ ID NO: 280438 - RNA, 19 nt, Homo sapiens
ugaagaagcugcaaagaag

SEQ ID NO: 280439 - RNA, 19 nt, Homo sapiens
cagcauagaugaauguaau

SEQ ID NO: 280440 - RNA, 19 nt, Homo sapiens
gagaugaaguguuuaacga

SEQ ID NO: 280441 - RNA, 19 nt, Homo sapiens
gcaaagaagggacgggaua

SEQ ID NO: 280442 - RNA, 19 nt, Homo sapiens
ugaagagacuggaaacuug

SEQ ID NO: 280443 - RNA, 19 nt, Homo sapiens
gggaugagauggugacaga

SEQ ID NO: 280444 - RNA, 19 nt, Homo sapiens
gaagagaaacuccuaaucu

SEQ ID NO: 280445 - RNA, 19 nt, Homo sapiens
uugauaagcugguguguaa

SEQ ID NO: 280446 - RNA, 19 nt, Homo sapiens
ccaaaguucucaaguccua

SEQ ID NO: 280447 - RNA, 19 nt, Homo sapiens
aaacaaagccaaagaugaa

SEQ ID NO: 280448 - RNA, 19 nt, Homo sapiens
uaacacugcuggcuucuau

SEQ ID NO: 280449 - RNA, 19 nt, Homo sapiens
gcaagaggacugaagauug

SEQ ID NO: 280450 - RNA, 19 nt, Homo sapiens
ggagaggugguguaacuua

SEQ ID NO: 280451 - RNA, 19 nt, Homo sapiens
ugaauaagcuaaacgagau

SEQ ID NO: 280452 - RNA, 19 nt, Homo sapiens
gauaaugaggugaacaaua

SEQ ID NO: 280453 - RNA, 19 nt, Homo sapiens
uugaagagcuuaauaggaa

SEQ ID NO: 280454 - RNA, 19 nt, Homo sapiens
gaaccucuccuucuccuuu

SEQ ID NO: 280455 - RNA, 19 nt, Homo sapiens
gaugauaccuuaauuacac

SEQ ID NO: 280456 - RNA, 19 nt, Homo sapiens
cuaaacaacuugaccucua

SEQ ID NO: 280457 - RNA, 19 nt, Homo sapiens
gguggcagauguaaaugua

SEQ ID NO: 280458 - RNA, 19 nt, Homo sapiens
ugucugaccuggagaauga

SEQ ID NO: 280459 - RNA, 19 nt, Homo sapiens
ugacaaagcuguggagauc

SEQ ID NO: 280460 - RNA, 19 nt, Homo sapiens
aaacagcauuugagauuga

SEQ ID NO: 280461 - RNA, 19 nt, Homo sapiens
ccaaacaacaugacucuuu

SEQ ID NO: 280462 - RNA, 19 nt, Homo sapiens
gccuauaacuuugacaaua

SEQ ID NO: 280463 - RNA, 19 nt, Homo sapiens
caacacagccauuauuuua

SEQ ID NO: 280464 - RNA, 19 nt, Homo sapiens
gaacuuacacagaagaaau

SEQ ID NO: 280465 - RNA, 19 nt, Homo sapiens
gaaggcagcaucccucuga

SEQ ID NO: 280466 - RNA, 19 nt, Homo sapiens
gcaggcaccuccuccgauu

SEQ ID NO: 280467 - RNA, 19 nt, Homo sapiens
ugagagaagugcuggauau

SEQ ID NO: 280468 - RNA, 19 nt, Homo sapiens
ccgaagaccuugugcuuga

SEQ ID NO: 280469 - RNA, 19 nt, Homo sapiens
guagauauacuuaguccua

SEQ ID NO: 280470 - RNA, 19 nt, Homo sapiens
aaauggaacuuacacagaa

SEQ ID NO: 280471 - RNA, 19 nt, Homo sapiens
ucaguacucuuguuucuau

SEQ ID NO: 280472 - RNA, 19 nt, Homo sapiens
cagagugccuugacacaaa

SEQ ID NO: 280473 - RNA, 19 nt, Homo sapiens
ccggagagcuuugccauuu

SEQ ID NO: 280474 - RNA, 19 nt, Homo sapiens
acacuggugcuauuaauua

SEQ ID NO: 280475 - RNA, 19 nt, Homo sapiens
ggagagaugagacauuuga

SEQ ID NO: 280476 - RNA, 19 nt, Homo sapiens
uaagguugcugaucauaga

SEQ ID NO: 280477 - RNA, 19 nt, Homo sapiens
gugaaugccugcccuguga

SEQ ID NO: 280478 - RNA, 19 nt, Homo sapiens
uuaaguggcuacauccuaa

SEQ ID NO: 280479 - RNA, 19 nt, Homo sapiens
gacaagcuaugguaggauu

SEQ ID NO: 280480 - RNA, 19 nt, Homo sapiens
acagagcgguugauugaaa

SEQ ID NO: 280481 - RNA, 19 nt, Homo sapiens
gcaagcgaguguaugaaga

SEQ ID NO: 280482 - RNA, 19 nt, Homo sapiens
gcccagcgccuauaacuuu

SEQ ID NO: 280483 - RNA, 19 nt, Homo sapiens
gcacuuagggcaucaggaa

SEQ ID NO: 280484 - RNA, 19 nt, Homo sapiens
uugggcagcugauaauuua

SEQ ID NO: 280485 - RNA, 19 nt, Homo sapiens
gaacaaaggguuuuaucua

SEQ ID NO: 280486 - RNA, 19 nt, Homo sapiens
gaaguuacagaucuggaua

SEQ ID NO: 280487 - RNA, 19 nt, Homo sapiens
ccacagaggccaagaacaa

SEQ ID NO: 280488 - RNA, 19 nt, Homo sapiens
gaagauuccugccaucaac

SEQ ID NO: 280489 - RNA, 19 nt, Homo sapiens
gcauacaaccugcuucuga

SEQ ID NO: 280490 - RNA, 19 nt, Homo sapiens
acacagagcgguugauuga

SEQ ID NO: 280491 - RNA, 19 nt, Homo sapiens
gaacacagagcgguugauu

SEQ ID NO: 280492 - RNA, 19 nt, Homo sapiens
gagaaggcuuugugggaaa

SEQ ID NO: 280493 - RNA, 19 nt, Homo sapiens
uaaauccacucuaaaccuu

SEQ ID NO: 280494 - RNA, 19 nt, Homo sapiens
gggauaugauaaccacuaa

SEQ ID NO: 280495 - RNA, 19 nt, Homo sapiens
gaagaaauagggauaugau

SEQ ID NO: 280496 - RNA, 19 nt, Homo sapiens
gaccaucacugaagccaau

SEQ ID NO: 280497 - RNA, 19 nt, Homo sapiens
ggaagcugaugacauuguu

SEQ ID NO: 280498 - RNA, 19 nt, Homo sapiens
ccagagaacuugagaaagc

SEQ ID NO: 280499 - RNA, 19 nt, Homo sapiens
uaaacaacuugaccucuau

SEQ ID NO: 280500 - RNA, 19 nt, Homo sapiens
gauaagcugguguguaauu

SEQ ID NO: 280501 - RNA, 19 nt, Homo sapiens
ggacacacuggugcuauua

SEQ ID NO: 280502 - RNA, 19 nt, Homo sapiens
ccaaggcccucgcugaaga

SEQ ID NO: 280503 - RNA, 19 nt, Homo sapiens
ccaaugauacgucaacuga

SEQ ID NO: 280504 - RNA, 19 nt, Homo sapiens
ugagggaucucuuucacuu

SEQ ID NO: 280505 - RNA, 19 nt, Homo sapiens
gcaccuguccugugggaua

SEQ ID NO: 280506 - RNA, 19 nt, Homo sapiens
gaagaacgaauuugauaag

SEQ ID NO: 280507 - RNA, 19 nt, Homo sapiens
uuaaucgccugaacacuuu

SEQ ID NO: 280508 - RNA, 19 nt, Homo sapiens
acaaagcuguggagaucua

SEQ ID NO: 280509 - RNA, 19 nt, Homo sapiens
gaucucagacagcuacuuu

SEQ ID NO: 280510 - RNA, 19 nt, Homo sapiens
uaggaaaguuugcugaaga

SEQ ID NO: 280511 - RNA, 19 nt, Homo sapiens
cuagugggcuucucaacuu

SEQ ID NO: 280512 - RNA, 19 nt, Homo sapiens
ucagcgaucuugauaggaa

SEQ ID NO: 280513 - RNA, 19 nt, Homo sapiens
gagauugaagagcuuaaua

SEQ ID NO: 280514 - RNA, 19 nt, Homo sapiens
ccaaagaaaucaagacugu

SEQ ID NO: 280515 - RNA, 19 nt, Homo sapiens
ccaagaacaugaccuuuga

SEQ ID NO: 280516 - RNA, 19 nt, Homo sapiens
gguggaagguggccaguuu

SEQ ID NO: 280517 - RNA, 19 nt, Homo sapiens
caaggaauccaguugaaua

SEQ ID NO: 280518 - RNA, 19 nt, Homo sapiens
cagaguaacuaucgaaaug

SEQ ID NO: 280519 - RNA, 19 nt, Homo sapiens
ugacaaggcuucucaacau

SEQ ID NO: 280520 - RNA, 19 nt, Homo sapiens
ggacauacacucacucuca

SEQ ID NO: 280521 - RNA, 19 nt, Homo sapiens
uaaauuggcuccauaucau

SEQ ID NO: 280522 - RNA, 19 nt, Homo sapiens
gcucuaaauuggcuccaua

SEQ ID NO: 280523 - RNA, 19 nt, Homo sapiens
ccagagacccugccuuuaa

SEQ ID NO: 280524 - RNA, 19 nt, Homo sapiens
gcguucagcucaugaguuu

SEQ ID NO: 280525 - RNA, 19 nt, Homo sapiens
ggaauccaguugaauacaa

SEQ ID NO: 280526 - RNA, 19 nt, Homo sapiens
cagaggaacuccagagaug

SEQ ID NO: 280527 - RNA, 19 nt, Homo sapiens
gcacccagguccacaugaa

SEQ ID NO: 280528 - RNA, 19 nt, Homo sapiens
cguaaugcauugccuguaa

SEQ ID NO: 280529 - RNA, 19 nt, Homo sapiens
gggaccagcucacguaaug

SEQ ID NO: 280530 - RNA, 19 nt, Homo sapiens
cagagacccugccuuuaaa

SEQ ID NO: 280531 - RNA, 19 nt, Homo sapiens
gcaaacguuucucaaaucu

SEQ ID NO: 280532 - RNA, 19 nt, Homo sapiens
caaaucugcuucauccaau

SEQ ID NO: 280533 - RNA, 19 nt, Homo sapiens
ucaagacuguggaaucuau

SEQ ID NO: 280534 - RNA, 19 nt, Homo sapiens
cgagaaaugcaacacguua

SEQ ID NO: 280535 - RNA, 19 nt, Homo sapiens
uuacugcacucagauuuaa

SEQ ID NO: 280536 - RNA, 19 nt, Homo sapiens
gaauccaguugaauacaau

SEQ ID NO: 280537 - RNA, 19 nt, Homo sapiens
cggcuucaguucagcuuua

SEQ ID NO: 280538 - RNA, 19 nt, Homo sapiens
gaggcacacuuucugcaaa

SEQ ID NO: 280539 - RNA, 19 nt, Homo sapiens
aaugcgagcuccaaagaaa

SEQ ID NO: 280540 - RNA, 19 nt, Homo sapiens
gcucacacauuacaacagu

SEQ ID NO: 280541 - RNA, 19 nt, Homo sapiens
gguguuugguuucuucauu

SEQ ID NO: 280542 - RNA, 19 nt, Homo sapiens
ggaaugccgcugucucuga

SEQ ID NO: 280543 - RNA, 19 nt, Homo sapiens
cugacaugcucacacauua

SEQ ID NO: 280544 - RNA, 19 nt, Homo sapiens
cgaaaugacgguguuaauu

SEQ ID NO: 280545 - RNA, 19 nt, Homo sapiens
cuucuucgcugccgacgua

SEQ ID NO: 280546 - RNA, 19 nt, Homo sapiens
gacauacacucacucucaa

SEQ ID NO: 280547 - RNA, 19 nt, Homo sapiens
caacagaguaacuaucgaa

SEQ ID NO: 280548 - RNA, 19 nt, Homo sapiens
ggaagaggacauacacuca

SEQ ID NO: 280549 - RNA, 19 nt, Homo sapiens
cagggcagauauagauaaa

SEQ ID NO: 280550 - RNA, 19 nt, Homo sapiens
ugacaucagggcagauaua

SEQ ID NO: 280551 - RNA, 19 nt, Homo sapiens
gaacuacgacaccaagagu

SEQ ID NO: 280552 - RNA, 19 nt, Homo sapiens
cugcaaacguuucucaaau

SEQ ID NO: 280553 - RNA, 19 nt, Homo sapiens
aaauacagauguguuagug

SEQ ID NO: 280554 - RNA, 19 nt, Homo sapiens
caucagggcagauauagau

SEQ ID NO: 280555 - RNA, 19 nt, Homo sapiens
gcucaagggcuggcacuuu

SEQ ID NO: 280556 - RNA, 19 nt, Homo sapiens
caacgggaccgcgugcaua

SEQ ID NO: 280557 - RNA, 19 nt, Homo sapiens
gagacacgcugugaacaag

SEQ ID NO: 280558 - RNA, 19 nt, Homo sapiens
cagcucacguaaugcauug

SEQ ID NO: 280559 - RNA, 19 nt, Homo sapiens
gguaacgcgcugucucuaa

SEQ ID NO: 280560 - RNA, 19 nt, Homo sapiens
uacaaggaauccaguugaa

SEQ ID NO: 280561 - RNA, 19 nt, Homo sapiens
gacaaggcuucucaacauc

SEQ ID NO: 280562 - RNA, 19 nt, Homo sapiens
guaacgcgcugucucuaac

SEQ ID NO: 280563 - RNA, 19 nt, Homo sapiens
cuaaauuggcuccauauca

SEQ ID NO: 280564 - RNA, 19 nt, Homo sapiens
ccaaugcgagcuccaaaga

SEQ ID NO: 280565 - RNA, 19 nt, Homo sapiens
gcucaugaguuuuguuuau

SEQ ID NO: 280566 - RNA, 19 nt, Homo sapiens
gcacguccuuggcgucucu

SEQ ID NO: 280567 - RNA, 19 nt, Homo sapiens
caaggcuucucaacaucaa

SEQ ID NO: 280568 - RNA, 19 nt, Homo sapiens
ucuaaugucugcagcucaa

SEQ ID NO: 280569 - RNA, 19 nt, Homo sapiens
gcugacaugcucacacauu

SEQ ID NO: 280570 - RNA, 19 nt, Homo sapiens
gcacaacagaguaacuauc

SEQ ID NO: 280571 - RNA, 19 nt, Homo sapiens
ggagagacacgcugugaac

SEQ ID NO: 280572 - RNA, 19 nt, Homo sapiens
ccuuugaccugccaucaga

SEQ ID NO: 280573 - RNA, 19 nt, Homo sapiens
ucaaaucugcuucauccaa

SEQ ID NO: 280574 - RNA, 19 nt, Homo sapiens
cuacaaggaauccaguuga

SEQ ID NO: 280575 - RNA, 19 nt, Homo sapiens
gcaccaccguccugcucuu

SEQ ID NO: 280576 - RNA, 19 nt, Homo sapiens
cagcugaaccucaccuaug

SEQ ID NO: 280577 - RNA, 19 nt, Homo sapiens
aaucaagacuguggaaucu

SEQ ID NO: 280578 - RNA, 19 nt, Homo sapiens
aaccgcagcuccuguggaa

SEQ ID NO: 280579 - RNA, 19 nt, Homo sapiens
gggaaaauccuaagacaga

SEQ ID NO: 280580 - RNA, 19 nt, Homo sapiens
cauaauggccaacuucucu

SEQ ID NO: 280581 - RNA, 19 nt, Homo sapiens
caucuugcagcauuuacua

SEQ ID NO: 280582 - RNA, 19 nt, Homo sapiens
ggaggcacacuuucugcaa

SEQ ID NO: 280583 - RNA, 19 nt, Homo sapiens
guuccuuucucugggcuua

SEQ ID NO: 280584 - RNA, 19 nt, Homo sapiens
uacacucacucucaauuuc

SEQ ID NO: 280585 - RNA, 19 nt, Homo sapiens
ggucuucuguugacauucg

SEQ ID NO: 280586 - RNA, 19 nt, Homo sapiens
guuuaggguucugguguuu

SEQ ID NO: 280587 - RNA, 19 nt, Homo sapiens
ugcaaacguuucucaaauc

SEQ ID NO: 280588 - RNA, 19 nt, Homo sapiens
cgccagagacccugccuuu

SEQ ID NO: 280589 - RNA, 19 nt, Homo sapiens
gaguaacuaucgaaaugac

SEQ ID NO: 280590 - RNA, 19 nt, Homo sapiens
gggaugaaugcaaguucua

SEQ ID NO: 280591 - RNA, 19 nt, Homo sapiens
ucagggcagauauagauaa

SEQ ID NO: 280592 - RNA, 19 nt, Homo sapiens
gaaaucaagacuguggaau

SEQ ID NO: 280593 - RNA, 19 nt, Homo sapiens
ccagucucgugauugcuuu

SEQ ID NO: 280594 - RNA, 19 nt, Homo sapiens
aaguucaucuugcagcauu

SEQ ID NO: 280595 - RNA, 19 nt, Homo sapiens
gccagagacccugccuuua

SEQ ID NO: 280596 - RNA, 19 nt, Homo sapiens
agcugaaccucaccuauga

SEQ ID NO: 280597 - RNA, 19 nt, Homo sapiens
uuacagcguucagcucaug

SEQ ID NO: 280598 - RNA, 19 nt, Homo sapiens
gcaauuccuacaagugcaa

SEQ ID NO: 280599 - RNA, 19 nt, Homo sapiens
gaccguaacgcuccaugau

SEQ ID NO: 280600 - RNA, 19 nt, Homo sapiens
caagacuguggaaucuaua

SEQ ID NO: 280601 - RNA, 19 nt, Homo sapiens
cauacacucacucucaauu

SEQ ID NO: 280602 - RNA, 19 nt, Homo sapiens
guaaugcauugccuguaac

SEQ ID NO: 280603 - RNA, 19 nt, Homo sapiens
gacagaggaacuccagaga

SEQ ID NO: 280604 - RNA, 19 nt, Homo sapiens
guguuugguuucuucauuc

SEQ ID NO: 280605 - RNA, 19 nt, Homo sapiens
cuccauaucauugaguuua

SEQ ID NO: 280606 - RNA, 19 nt, Homo sapiens
ggguucugguguuugguuu

SEQ ID NO: 280607 - RNA, 19 nt, Homo sapiens
cgucagcagccauguuuau

SEQ ID NO: 280608 - RNA, 19 nt, Homo sapiens
guucaucuugcagcauuua

SEQ ID NO: 280609 - RNA, 19 nt, Homo sapiens
ggcuuaggguccugucgaa

SEQ ID NO: 280610 - RNA, 19 nt, Homo sapiens
ucugcugccuucucaguga

SEQ ID NO: 280611 - RNA, 19 nt, Homo sapiens
cccaagaacaugaccuuug

SEQ ID NO: 280612 - RNA, 19 nt, Homo sapiens
guccuuggcgucucuaaug

SEQ ID NO: 280613 - RNA, 19 nt, Homo sapiens
gagggaaaauccuaagaca

SEQ ID NO: 280614 - RNA, 19 nt, Homo sapiens
ggaaggagcuggaguuuga

SEQ ID NO: 280615 - RNA, 19 nt, Homo sapiens
gcaaagaggaucaaacaaa

SEQ ID NO: 280616 - RNA, 19 nt, Homo sapiens
gcagauguuugccucauaa

SEQ ID NO: 280617 - RNA, 19 nt, Homo sapiens
gacaagugcuguugggaua

SEQ ID NO: 280618 - RNA, 19 nt, Homo sapiens
gcaccuguauuccuuguaa

SEQ ID NO: 280619 - RNA, 19 nt, Homo sapiens
ggacuggccucucugaaga

SEQ ID NO: 280620 - RNA, 19 nt, Homo sapiens
cauagucucugcccucaua

SEQ ID NO: 280621 - RNA, 19 nt, Homo sapiens
gaacauguuuaauggguau

SEQ ID NO: 280622 - RNA, 19 nt, Homo sapiens
gaagcugccauaaauauuu

SEQ ID NO: 280623 - RNA, 19 nt, Homo sapiens
caaagcaaauguugggaaa

SEQ ID NO: 280624 - RNA, 19 nt, Homo sapiens
caagaugacuguggaaaga

SEQ ID NO: 280625 - RNA, 19 nt, Homo sapiens
ugacaacacugauggcauu

SEQ ID NO: 280626 - RNA, 19 nt, Homo sapiens
ggaccagccucucagugua

SEQ ID NO: 280627 - RNA, 19 nt, Homo sapiens
gaaaucagaucagcugcuu

SEQ ID NO: 280628 - RNA, 19 nt, Homo sapiens
ggcaugacauccuuucuuu

SEQ ID NO: 280629 - RNA, 19 nt, Homo sapiens
ggaaggcuguccaacgaaa

SEQ ID NO: 280630 - RNA, 19 nt, Homo sapiens
caacuuagagauugcauuu

SEQ ID NO: 280631 - RNA, 19 nt, Homo sapiens
gcacagagggcaaagaaug

SEQ ID NO: 280632 - RNA, 19 nt, Homo sapiens
ggcaugaaauucuuccuaa

SEQ ID NO: 280633 - RNA, 19 nt, Homo sapiens
ggacaguggugacauaguc

SEQ ID NO: 280634 - RNA, 19 nt, Homo sapiens
cagcagcucuuacagaaug

SEQ ID NO: 280635 - RNA, 19 nt, Homo sapiens
ggaagucugugauugcaau

SEQ ID NO: 280636 - RNA, 19 nt, Homo sapiens
gaauauggaugcaguacag

SEQ ID NO: 280637 - RNA, 19 nt, Homo sapiens
aaggagagcuggaaaggaa

SEQ ID NO: 280638 - RNA, 19 nt, Homo sapiens
gaaguugagagcauccuua

SEQ ID NO: 280639 - RNA, 19 nt, Homo sapiens
cgaaaugggucuccugcaa

SEQ ID NO: 280640 - RNA, 19 nt, Homo sapiens
ggagaacgcugugauaggu

SEQ ID NO: 280641 - RNA, 19 nt, Homo sapiens
ggagggaagucugugauug

SEQ ID NO: 280642 - RNA, 19 nt, Homo sapiens
cagugaagcugccauaaau

SEQ ID NO: 280643 - RNA, 19 nt, Homo sapiens
gcacaagaagcacugagua

SEQ ID NO: 280644 - RNA, 19 nt, Homo sapiens
uaagaucaccucuaccuuu

SEQ ID NO: 280645 - RNA, 19 nt, Homo sapiens
caagugcuguugggauaua

SEQ ID NO: 280646 - RNA, 19 nt, Homo sapiens
agaauagacuggauggaaa

SEQ ID NO: 280647 - RNA, 19 nt, Homo sapiens
ccaggugguugucuuauug

SEQ ID NO: 280648 - RNA, 19 nt, Homo sapiens
gaaaugggucuccugcaaa

SEQ ID NO: 280649 - RNA, 19 nt, Homo sapiens
gcagguguuugaaguguau

SEQ ID NO: 280650 - RNA, 19 nt, Homo sapiens
gaaauucuuccuaauguca

SEQ ID NO: 280651 - RNA, 19 nt, Homo sapiens
caaagaggaucaaacaaaa

SEQ ID NO: 280652 - RNA, 19 nt, Homo sapiens
cacaggagauuguuauuca

SEQ ID NO: 280653 - RNA, 19 nt, Homo sapiens
gagcauccaagcaauaauu

SEQ ID NO: 280654 - RNA, 19 nt, Homo sapiens
uaaaugagcauccaagcaa

SEQ ID NO: 280655 - RNA, 19 nt, Homo sapiens
gaagaagugagcaguguug

SEQ ID NO: 280656 - RNA, 19 nt, Homo sapiens
uaaguggaguccuggaauu

SEQ ID NO: 280657 - RNA, 19 nt, Homo sapiens
gcacagcagcucuuacaga

SEQ ID NO: 280658 - RNA, 19 nt, Homo sapiens
caccaagacuuacacauuc

SEQ ID NO: 280659 - RNA, 19 nt, Homo sapiens
ggaaucaacaggugagcua

SEQ ID NO: 280660 - RNA, 19 nt, Homo sapiens
gaacuucacagacaaacug

SEQ ID NO: 280661 - RNA, 19 nt, Homo sapiens
ucacauccaucccuccauu

SEQ ID NO: 280662 - RNA, 19 nt, Homo sapiens
ggauauagucaacuuauuc

SEQ ID NO: 280663 - RNA, 19 nt, Homo sapiens
cacagcagcucuuacagaa

SEQ ID NO: 280664 - RNA, 19 nt, Homo sapiens
gaauggaggcccugauuuc

SEQ ID NO: 280665 - RNA, 19 nt, Homo sapiens
caacacagccggcaucuac

SEQ ID NO: 280666 - RNA, 19 nt, Homo sapiens
ggguucagcugcucaguga

SEQ ID NO: 280667 - RNA, 19 nt, Homo sapiens
cagaauacaguguccauaa

SEQ ID NO: 280668 - RNA, 19 nt, Homo sapiens
caagugguguuuauugcaa

SEQ ID NO: 280669 - RNA, 19 nt, Homo sapiens
ucagaguuccuccuacuua

SEQ ID NO: 280670 - RNA, 19 nt, Homo sapiens
ucaggaggccacaagauua

SEQ ID NO: 280671 - RNA, 19 nt, Homo sapiens
cauccauccuuccaacaua

SEQ ID NO: 280672 - RNA, 19 nt, Homo sapiens
gggauauagucaacuuauu

SEQ ID NO: 280673 - RNA, 19 nt, Homo sapiens
gcacugggugugagaauga

SEQ ID NO: 280674 - RNA, 19 nt, Homo sapiens
gaauacaguguccauaaga

SEQ ID NO: 280675 - RNA, 19 nt, Homo sapiens
ggagagagaaaucagauca

SEQ ID NO: 280676 - RNA, 19 nt, Homo sapiens
gagaauggaggcccugauu

SEQ ID NO: 280677 - RNA, 19 nt, Homo sapiens
cagacaaacugguaaugga

SEQ ID NO: 280678 - RNA, 19 nt, Homo sapiens
gaucagaguuccuccuacu

SEQ ID NO: 280679 - RNA, 19 nt, Homo sapiens
gcaaauguugggaaaguau

SEQ ID NO: 280680 - RNA, 19 nt, Homo sapiens
gcaugaaauucuuccuaau

SEQ ID NO: 280681 - RNA, 19 nt, Homo sapiens
caacugaccugaccccauu

SEQ ID NO: 280682 - RNA, 19 nt, Homo sapiens
caacagugaagcugccaua

SEQ ID NO: 280683 - RNA, 19 nt, Homo sapiens
gugaagaacuuggagaaca

SEQ ID NO: 280684 - RNA, 19 nt, Homo sapiens
gcaggcccauucagagcua

SEQ ID NO: 280685 - RNA, 19 nt, Homo sapiens
gauguuugccucauaauag

SEQ ID NO: 280686 - RNA, 19 nt, Homo sapiens
caagggaaacugaggacua

SEQ ID NO: 280687 - RNA, 19 nt, Homo sapiens
ucaccaagacuuacacauu

SEQ ID NO: 280688 - RNA, 19 nt, Homo sapiens
uaaccaggcauauggauga

SEQ ID NO: 280689 - RNA, 19 nt, Homo sapiens
ggacggugcuguggugcaa

SEQ ID NO: 280690 - RNA, 19 nt, Homo sapiens
cauccgagcuacauaugga

SEQ ID NO: 280691 - RNA, 19 nt, Homo sapiens
gaagguuacugcggaaucu

SEQ ID NO: 280692 - RNA, 19 nt, Homo sapiens
ucacaagugguguuuauug

SEQ ID NO: 280693 - RNA, 19 nt, Homo sapiens
gcauauggaugaguucaag

SEQ ID NO: 280694 - RNA, 19 nt, Homo sapiens
uggaggcccugauuucaaa

SEQ ID NO: 280695 - RNA, 19 nt, Homo sapiens
ucagauggaucaguuuaug

SEQ ID NO: 280696 - RNA, 19 nt, Homo sapiens
gugcaaagcaggcuacuuc

SEQ ID NO: 280697 - RNA, 19 nt, Homo sapiens
ggucacagcgccaucaaga

SEQ ID NO: 280698 - RNA, 19 nt, Homo sapiens
gugggacaguggugacaua

SEQ ID NO: 280699 - RNA, 19 nt, Homo sapiens
aagagaauguuccuacuca

SEQ ID NO: 280700 - RNA, 19 nt, Homo sapiens
guaaugugacuaaaggaaa

SEQ ID NO: 280701 - RNA, 19 nt, Homo sapiens
caacugcaaugacaacacu

SEQ ID NO: 280702 - RNA, 19 nt, Homo sapiens
gcaguacagauggugauua

SEQ ID NO: 280703 - RNA, 19 nt, Homo sapiens
ccaggcauauggaugaguu

SEQ ID NO: 280704 - RNA, 19 nt, Homo sapiens
gccacaagauuagcagaaa

SEQ ID NO: 280705 - RNA, 19 nt, Homo sapiens
gaagugauggcaccugugu

SEQ ID NO: 280706 - RNA, 19 nt, Homo sapiens
gaggagguggugugcaaua

SEQ ID NO: 280707 - RNA, 19 nt, Homo sapiens
caguguauauguccuguug

SEQ ID NO: 280708 - RNA, 19 nt, Homo sapiens
gaaagggaccgcuguuugc

SEQ ID NO: 280709 - RNA, 19 nt, Homo sapiens
cugccuugcuucuguauuu

SEQ ID NO: 280710 - RNA, 19 nt, Homo sapiens
gauaacaccagugggaauu

SEQ ID NO: 280711 - RNA, 19 nt, Homo sapiens
ugucacaagugguguuuau

SEQ ID NO: 280712 - RNA, 19 nt, Homo sapiens
ugaguaaugugacuaaagg

SEQ ID NO: 280713 - RNA, 19 nt, Homo sapiens
ugaggacuauuccaaacaa

SEQ ID NO: 280714 - RNA, 19 nt, Homo sapiens
ggaaggagcuggaguuuga

SEQ ID NO: 280715 - RNA, 19 nt, Homo sapiens
gcaaagaggaucaaacaaa

SEQ ID NO: 280716 - RNA, 19 nt, Homo sapiens
ggaauaacaucaccacugu

SEQ ID NO: 280717 - RNA, 19 nt, Homo sapiens
gcaccuguauuccuuguaa

SEQ ID NO: 280718 - RNA, 19 nt, Homo sapiens
ggacuggccucucugaaga

SEQ ID NO: 280719 - RNA, 19 nt, Homo sapiens
gaaacccugucucuacuaa

SEQ ID NO: 280720 - RNA, 19 nt, Homo sapiens
gaacagguguauauaagca

SEQ ID NO: 280721 - RNA, 19 nt, Homo sapiens
gggaagaugugaaggaaga

SEQ ID NO: 280722 - RNA, 19 nt, Homo sapiens
ccaaagaacagguguauau

SEQ ID NO: 280723 - RNA, 19 nt, Homo sapiens
caagaugacuguggaaaga

SEQ ID NO: 280724 - RNA, 19 nt, Homo sapiens
ugacaacacugauggcauu

SEQ ID NO: 280725 - RNA, 19 nt, Homo sapiens
gaaaucagaucagcugcuu

SEQ ID NO: 280726 - RNA, 19 nt, Homo sapiens
gcagguucccuuacauuua

SEQ ID NO: 280727 - RNA, 19 nt, Homo sapiens
ggaaggcuguccaacgaaa

SEQ ID NO: 280728 - RNA, 19 nt, Homo sapiens
caguaaaugugcuuuguuu

SEQ ID NO: 280729 - RNA, 19 nt, Homo sapiens
gcacagagggcaaagaaug

SEQ ID NO: 280730 - RNA, 19 nt, Homo sapiens
gaaggcagguugagacuac

SEQ ID NO: 280731 - RNA, 19 nt, Homo sapiens
gcucacgccuguaauucua

SEQ ID NO: 280732 - RNA, 19 nt, Homo sapiens
uaacaucaccacuguauau

SEQ ID NO: 280733 - RNA, 19 nt, Homo sapiens
cagcagcucuuacagaaug

SEQ ID NO: 280734 - RNA, 19 nt, Homo sapiens
ggaagucugugauugcaau

SEQ ID NO: 280735 - RNA, 19 nt, Homo sapiens
gaauauggaugcaguacag

SEQ ID NO: 280736 - RNA, 19 nt, Homo sapiens
aaggagagcuggaaaggaa

SEQ ID NO: 280737 - RNA, 19 nt, Homo sapiens
gaaguugagagcauccuua

SEQ ID NO: 280738 - RNA, 19 nt, Homo sapiens
cgaaaugggucuccugcaa

SEQ ID NO: 280739 - RNA, 19 nt, Homo sapiens
ggagaacgcugugauaggu

SEQ ID NO: 280740 - RNA, 19 nt, Homo sapiens
ggagggaagucugugauug

SEQ ID NO: 280741 - RNA, 19 nt, Homo sapiens
gcacaagaagcacugagua

SEQ ID NO: 280742 - RNA, 19 nt, Homo sapiens
uaagaucaccucuaccuuu

SEQ ID NO: 280743 - RNA, 19 nt, Homo sapiens
uaagaugggucacugaaca

SEQ ID NO: 280744 - RNA, 19 nt, Homo sapiens
gaaaugggucuccugcaaa

SEQ ID NO: 280745 - RNA, 19 nt, Homo sapiens
caucaccacuguauauuuc

SEQ ID NO: 280746 - RNA, 19 nt, Homo sapiens
gcagguguuugaaguguau

SEQ ID NO: 280747 - RNA, 19 nt, Homo sapiens
caaagaggaucaaacaaaa

SEQ ID NO: 280748 - RNA, 19 nt, Homo sapiens
cacaggagauuguuauuca

SEQ ID NO: 280749 - RNA, 19 nt, Homo sapiens
gagcauccaagcaauaauu

SEQ ID NO: 280750 - RNA, 19 nt, Homo sapiens
uaaaugagcauccaagcaa

SEQ ID NO: 280751 - RNA, 19 nt, Homo sapiens
caaagaacagguguauaua

SEQ ID NO: 280752 - RNA, 19 nt, Homo sapiens
gcacagcagcucuuacaga

SEQ ID NO: 280753 - RNA, 19 nt, Homo sapiens
caccaagacuuacacauuc

SEQ ID NO: 280754 - RNA, 19 nt, Homo sapiens
ggaaucaacaggugagcua

SEQ ID NO: 280755 - RNA, 19 nt, Homo sapiens
gaacuucacagacaaacug

SEQ ID NO: 280756 - RNA, 19 nt, Homo sapiens
cacagcagcucuuacagaa

SEQ ID NO: 280757 - RNA, 19 nt, Homo sapiens
gaauggaggcccugauuuc

SEQ ID NO: 280758 - RNA, 19 nt, Homo sapiens
caacacagccggcaucuac

SEQ ID NO: 280759 - RNA, 19 nt, Homo sapiens
ggguucagcugcucaguga

SEQ ID NO: 280760 - RNA, 19 nt, Homo sapiens
cagaauacaguguccauaa

SEQ ID NO: 280761 - RNA, 19 nt, Homo sapiens
ucaggaggccacaagauua

SEQ ID NO: 280762 - RNA, 19 nt, Homo sapiens
gaauacaguguccauaaga

SEQ ID NO: 280763 - RNA, 19 nt, Homo sapiens
ggagagagaaaucagauca

SEQ ID NO: 280764 - RNA, 19 nt, Homo sapiens
gagaauggaggcccugauu

SEQ ID NO: 280765 - RNA, 19 nt, Homo sapiens
cagacaaacugguaaugga

SEQ ID NO: 280766 - RNA, 19 nt, Homo sapiens
caagggaaacugaggacua

SEQ ID NO: 280767 - RNA, 19 nt, Homo sapiens
ucaccaagacuuacacauu

SEQ ID NO: 280768 - RNA, 19 nt, Homo sapiens
gagacuacuuaagauauug

SEQ ID NO: 280769 - RNA, 19 nt, Homo sapiens
uaaccaggcauauggauga

SEQ ID NO: 280770 - RNA, 19 nt, Homo sapiens
ggacggugcuguggugcaa

SEQ ID NO: 280771 - RNA, 19 nt, Homo sapiens
cauccgagcuacauaugga

SEQ ID NO: 280772 - RNA, 19 nt, Homo sapiens
gaagguuacugcggaaucu

SEQ ID NO: 280773 - RNA, 19 nt, Homo sapiens
gcauauggaugaguucaag

SEQ ID NO: 280774 - RNA, 19 nt, Homo sapiens
uggaggcccugauuucaaa

SEQ ID NO: 280775 - RNA, 19 nt, Homo sapiens
ucagauggaucaguuuaug

SEQ ID NO: 280776 - RNA, 19 nt, Homo sapiens
gugcaaagcaggcuacuuc

SEQ ID NO: 280777 - RNA, 19 nt, Homo sapiens
ggucacagcgccaucaaga

SEQ ID NO: 280778 - RNA, 19 nt, Homo sapiens
aagaacagguguauauaag

SEQ ID NO: 280779 - RNA, 19 nt, Homo sapiens
gcaguacagauggugauua

SEQ ID NO: 280780 - RNA, 19 nt, Homo sapiens
ccaggcauauggaugaguu

SEQ ID NO: 280781 - RNA, 19 nt, Homo sapiens
gccacaagauuagcagaaa

SEQ ID NO: 280782 - RNA, 19 nt, Homo sapiens
gaagugauggcaccugugu

SEQ ID NO: 280783 - RNA, 19 nt, Homo sapiens
gaggagguggugugcaaua

SEQ ID NO: 280784 - RNA, 19 nt, Homo sapiens
caguguauauguccuguug

SEQ ID NO: 280785 - RNA, 19 nt, Homo sapiens
gaaagggaccgcuguuugc

SEQ ID NO: 280786 - RNA, 19 nt, Homo sapiens
caacugcaaugacaacacu

SEQ ID NO: 280787 - RNA, 19 nt, Homo sapiens
ugaggacuauuccaaacaa

SEQ ID NO: 280788 - RNA, 19 nt, Homo sapiens
gacaaugugacccugauuu

SEQ ID NO: 280789 - RNA, 19 nt, Homo sapiens
agaagccaguggacaguuu

SEQ ID NO: 280790 - RNA, 19 nt, Homo sapiens
aagacacacucaacacauu

SEQ ID NO: 280791 - RNA, 19 nt, Homo sapiens
gauggaguaguaccugaua

SEQ ID NO: 280792 - RNA, 19 nt, Homo sapiens
ggguggugauggaguagua

SEQ ID NO: 280793 - RNA, 19 nt, Homo sapiens
ucaggguggugauggagua

SEQ ID NO: 280794 - RNA, 19 nt, Homo sapiens
gagaaagggaccgcuguuu

SEQ ID NO: 280795 - RNA, 19 nt, Homo sapiens
gcagaaagccacguugagu

SEQ ID NO: 280796 - RNA, 19 nt, Homo sapiens
gagaugcccagauuucaga

SEQ ID NO: 280797 - RNA, 19 nt, Homo sapiens
gaucaccucuaccuuucau

SEQ ID NO: 280798 - RNA, 19 nt, Homo sapiens
aauuguaacuccaaagguu

SEQ ID NO: 280799 - RNA, 19 nt, Homo sapiens
ucugugaagucaagaauca

SEQ ID NO: 280800 - RNA, 19 nt, Homo sapiens
cagcugagccuggcagaaa

SEQ ID NO: 280801 - RNA, 19 nt, Homo sapiens
ucgaucagguuacuauaau

SEQ ID NO: 280802 - RNA, 19 nt, Homo sapiens
gaagugcaagaauggcuuu

SEQ ID NO: 280803 - RNA, 19 nt, Homo sapiens
ggaaguccaggcaguguau

SEQ ID NO: 280804 - RNA, 19 nt, Homo sapiens
gcaggagaaucgcuugaac

SEQ ID NO: 280805 - RNA, 19 nt, Homo sapiens
agacacacucaacacauua

SEQ ID NO: 280806 - RNA, 19 nt, Homo sapiens
gaagaagcaaagaggauca

SEQ ID NO: 280807 - RNA, 19 nt, Homo sapiens
ggugaaacccugucucuac

SEQ ID NO: 280808 - RNA, 19 nt, Homo sapiens
caagaagcacugaguaugg

SEQ ID NO: 280809 - RNA, 19 nt, Homo sapiens
aaacugaggacuauuccaa

SEQ ID NO: 280810 - RNA, 19 nt, Homo sapiens
gagcaacugacaagggaaa

SEQ ID NO: 280811 - RNA, 19 nt, Homo sapiens
uaacauggagcaacugaca

SEQ ID NO: 280812 - RNA, 19 nt, Homo sapiens
cggaggagguggugugcaa

SEQ ID NO: 280813 - RNA, 19 nt, Homo sapiens
caggugagcuaugggcaaa

SEQ ID NO: 280814 - RNA, 19 nt, Homo sapiens
caaaugaguuccuguguga

SEQ ID NO: 280815 - RNA, 19 nt, Homo sapiens
gcuggaaccuauucaguua

SEQ ID NO: 280816 - RNA, 19 nt, Homo sapiens
ugaaacacuuugcuucuua

SEQ ID NO: 280817 - RNA, 19 nt, Homo sapiens
gaaacacuuugcuucuuaa

SEQ ID NO: 280818 - RNA, 19 nt, Homo sapiens
gaacaucacucaggauaag

SEQ ID NO: 280819 - RNA, 19 nt, Homo sapiens
uaacauggccauuauaaga

SEQ ID NO: 280820 - RNA, 19 nt, Homo sapiens
uaagguugcuucaguuauu

SEQ ID NO: 280821 - RNA, 19 nt, Homo sapiens
cuacugggauguucuugua

SEQ ID NO: 280822 - RNA, 19 nt, Homo sapiens
gcaaccugauugauuauau

SEQ ID NO: 280823 - RNA, 19 nt, Homo sapiens
aagaagcccuggccaaauu

SEQ ID NO: 280824 - RNA, 19 nt, Homo sapiens
ucugcaaccugauugauua

SEQ ID NO: 280825 - RNA, 19 nt, Homo sapiens
ggauaagguugcuucaguu

SEQ ID NO: 280826 - RNA, 19 nt, Homo sapiens
gauaagguugcuucaguua

SEQ ID NO: 280827 - RNA, 19 nt, Homo sapiens
gcacagugagcacaaauga

SEQ ID NO: 280828 - RNA, 19 nt, Homo sapiens
uauaaaugcccaucagaua

SEQ ID NO: 280829 - RNA, 19 nt, Homo sapiens
caaauaacaaucucagcua

SEQ ID NO: 280830 - RNA, 19 nt, Homo sapiens
ucaaugugccuuugcauaa

SEQ ID NO: 280831 - RNA, 19 nt, Homo sapiens
ggacuauagugauuuaaac

SEQ ID NO: 280832 - RNA, 19 nt, Homo sapiens
gcauguauuugguuaaugg

SEQ ID NO: 280833 - RNA, 19 nt, Homo sapiens
gcaucuacuuauucaauug

SEQ ID NO: 280834 - RNA, 19 nt, Homo sapiens
caaugugccuuugcauaaa

SEQ ID NO: 280835 - RNA, 19 nt, Homo sapiens
uaguguugcuggcuuauuu

SEQ ID NO: 280836 - RNA, 19 nt, Homo sapiens
cucaauagcagcaccauua

SEQ ID NO: 280837 - RNA, 19 nt, Homo sapiens
caacacuggugauaacaca

SEQ ID NO: 280838 - RNA, 19 nt, Homo sapiens
guaguugugucuuaaugga

SEQ ID NO: 280839 - RNA, 19 nt, Homo sapiens
gcaccaucaugcuggauau

SEQ ID NO: 280840 - RNA, 19 nt, Homo sapiens
caacuuccuugugcccaua

SEQ ID NO: 280841 - RNA, 19 nt, Homo sapiens
guucagccuuucaauguga

SEQ ID NO: 280842 - RNA, 19 nt, Homo sapiens
gauaaaggaauucuuacug

SEQ ID NO: 280843 - RNA, 19 nt, Homo sapiens
aaagaaugauguuguccaa

SEQ ID NO: 280844 - RNA, 19 nt, Homo sapiens
ggugauaacacaacauuuc

SEQ ID NO: 280845 - RNA, 19 nt, Homo sapiens
ccaaggcagcaucuacuua

SEQ ID NO: 280846 - RNA, 19 nt, Homo sapiens
gcagcaccauuaaguaucu

SEQ ID NO: 280847 - RNA, 19 nt, Homo sapiens
gaaaaugccacuugccuuu

SEQ ID NO: 280848 - RNA, 19 nt, Homo sapiens
gcauuggaacuuaauuuga

SEQ ID NO: 280849 - RNA, 19 nt, Homo sapiens
caaagugucauauuuacug

SEQ ID NO: 280850 - RNA, 19 nt, Homo sapiens
acaaagagcagacuguuuc

SEQ ID NO: 280851 - RNA, 19 nt, Homo sapiens
cuacaacaccuacuccaaa

SEQ ID NO: 280852 - RNA, 19 nt, Homo sapiens
cuacaacacuggugauaac

SEQ ID NO: 280853 - RNA, 19 nt, Homo sapiens
guucuuauaugugcaacaa

SEQ ID NO: 280854 - RNA, 19 nt, Homo sapiens
caaggcagcaucuacuuau

SEQ ID NO: 280855 - RNA, 19 nt, Homo sapiens
uguugcagcuguuguugua

SEQ ID NO: 280856 - RNA, 19 nt, Homo sapiens
uaaaugcccaucagauaug

SEQ ID NO: 280857 - RNA, 19 nt, Homo sapiens
ggcagcaucuacuuauuca

SEQ ID NO: 280858 - RNA, 19 nt, Homo sapiens
gcaguucggaccuggcuuu

SEQ ID NO: 280859 - RNA, 19 nt, Homo sapiens
ucagaauggucccaaaaua

SEQ ID NO: 280860 - RNA, 19 nt, Homo sapiens
gccuugaacuuauuaacau

SEQ ID NO: 280861 - RNA, 19 nt, Homo sapiens
gcaggaguacuuauucuag

SEQ ID NO: 280862 - RNA, 19 nt, Homo sapiens
cagcauguauuugguuaau

SEQ ID NO: 280863 - RNA, 19 nt, Homo sapiens
caacaccuacuccaaagga

SEQ ID NO: 280864 - RNA, 19 nt, Homo sapiens
uuuccuggauugcgaauuu

SEQ ID NO: 280865 - RNA, 19 nt, Homo sapiens
cuacuuagacucaauagca

SEQ ID NO: 280866 - RNA, 19 nt, Homo sapiens
ccugggaaguucuuauaug

SEQ ID NO: 280867 - RNA, 19 nt, Homo sapiens
aaggaauucuuacuguuga

SEQ ID NO: 280868 - RNA, 19 nt, Homo sapiens
aaaugccacuugccuuuau

SEQ ID NO: 280869 - RNA, 19 nt, Homo sapiens
gacuuugucuuugcuguga

SEQ ID NO: 280870 - RNA, 19 nt, Homo sapiens
ucaauagcagcaccauuaa

SEQ ID NO: 280871 - RNA, 19 nt, Homo sapiens
aagguugcuucaguuauua

SEQ ID NO: 280872 - RNA, 19 nt, Homo sapiens
ggaaaagaaugauguuguc

SEQ ID NO: 280873 - RNA, 19 nt, Homo sapiens
aaaggaauucuuacuguug

SEQ ID NO: 280874 - RNA, 19 nt, Homo sapiens
gcaacaaagagcagacugu

SEQ ID NO: 280875 - RNA, 19 nt, Homo sapiens
uaacacaacauuuccugau

SEQ ID NO: 280876 - RNA, 19 nt, Homo sapiens
cagcaucuacuuauucaau

SEQ ID NO: 280877 - RNA, 19 nt, Homo sapiens
ucuuaugcauuggaacuua

SEQ ID NO: 280878 - RNA, 19 nt, Homo sapiens
cuuauuaacauggccauua

SEQ ID NO: 280879 - RNA, 19 nt, Homo sapiens
ggguucagccuuucaaugu

SEQ ID NO: 280880 - RNA, 19 nt, Homo sapiens
gcacugugacauauaaugg

SEQ ID NO: 280881 - RNA, 19 nt, Homo sapiens
cugggaaguucuuauaugu

SEQ ID NO: 280882 - RNA, 19 nt, Homo sapiens
ugaaggaagugaacaucag

SEQ ID NO: 280883 - RNA, 19 nt, Homo sapiens
uagcagcaccauuaaguau

SEQ ID NO: 280884 - RNA, 19 nt, Homo sapiens
uaauggcaaugauacuugu

SEQ ID NO: 280885 - RNA, 19 nt, Homo sapiens
caauugacagcgucucauu

SEQ ID NO: 280886 - RNA, 19 nt, Homo sapiens
ccauggcacugugacauau

SEQ ID NO: 280887 - RNA, 19 nt, Homo sapiens
guauaaaugcccaucagau

SEQ ID NO: 280888 - RNA, 19 nt, Homo sapiens
uuucuuaccucucaguugu

SEQ ID NO: 280889 - RNA, 19 nt, Homo sapiens
uucagugucuggagcauuu

SEQ ID NO: 280890 - RNA, 19 nt, Homo sapiens
gaaguucuuauaugugcaa

SEQ ID NO: 280891 - RNA, 19 nt, Homo sapiens
aggauaagguugcuucagu

SEQ ID NO: 280892 - RNA, 19 nt, Homo sapiens
gaauucuuacuguugauga

SEQ ID NO: 280893 - RNA, 19 nt, Homo sapiens
uuaagaagcccuggccaaa

SEQ ID NO: 280894 - RNA, 19 nt, Homo sapiens
aaccuguucucuuuaauca

SEQ ID NO: 280895 - RNA, 19 nt, Homo sapiens
aaugaguuccugugugaua

SEQ ID NO: 280896 - RNA, 19 nt, Homo sapiens
cauggccauuauaagaaua

SEQ ID NO: 280897 - RNA, 19 nt, Homo sapiens
ugggagcugugcggucuua

SEQ ID NO: 280898 - RNA, 19 nt, Homo sapiens
auaaaugcccaucagauau

SEQ ID NO: 280899 - RNA, 19 nt, Homo sapiens
gcugugcggucuuaugcau

SEQ ID NO: 280900 - RNA, 19 nt, Homo sapiens
caggaguacuuauucuagu

SEQ ID NO: 280901 - RNA, 19 nt, Homo sapiens
cauuggaacuuaauuugac

SEQ ID NO: 280902 - RNA, 19 nt, Homo sapiens
ggaacuuaauuugacagau

SEQ ID NO: 280903 - RNA, 19 nt, Homo sapiens
ccaucagaauuccauugaa

SEQ ID NO: 280904 - RNA, 19 nt, Homo sapiens
gccaucagaauuccauuga

SEQ ID NO: 280905 - RNA, 19 nt, Homo sapiens
cuuaugcauuggaacuuaa

SEQ ID NO: 280906 - RNA, 19 nt, Homo sapiens
gauuuuaucugaaggaagu

SEQ ID NO: 280907 - RNA, 19 nt, Homo sapiens
uggaaccuauucaguuaau

SEQ ID NO: 280908 - RNA, 19 nt, Homo sapiens
caaaauagcagugcaguuc

SEQ ID NO: 280909 - RNA, 19 nt, Homo sapiens
gguauaaaugcccaucaga

SEQ ID NO: 280910 - RNA, 19 nt, Homo sapiens
ucauuucacuacugguguu

SEQ ID NO: 280911 - RNA, 19 nt, Homo sapiens
uaagaagcccuggccaaau

SEQ ID NO: 280912 - RNA, 19 nt, Homo sapiens
gaguacuuauucuaguguu

SEQ ID NO: 280913 - RNA, 19 nt, Homo sapiens
ggcaggaguacuuauucua

SEQ ID NO: 280914 - RNA, 19 nt, Homo sapiens
caaaugaguuccuguguga

SEQ ID NO: 280915 - RNA, 19 nt, Homo sapiens
gcuggaaccuauucaguua

SEQ ID NO: 280916 - RNA, 19 nt, Homo sapiens
uaaagaaacugguccaugu

SEQ ID NO: 280917 - RNA, 19 nt, Homo sapiens
gcuacaacaucacuaauuu

SEQ ID NO: 280918 - RNA, 19 nt, Homo sapiens
gaaccuagauaacgaagug

SEQ ID NO: 280919 - RNA, 19 nt, Homo sapiens
gaacaucacucaggauaag

SEQ ID NO: 280920 - RNA, 19 nt, Homo sapiens
caaauuaguugccugacuu

SEQ ID NO: 280921 - RNA, 19 nt, Homo sapiens
uggaauggcugagcaaaua

SEQ ID NO: 280922 - RNA, 19 nt, Homo sapiens
uaagguugcuucaguuauu

SEQ ID NO: 280923 - RNA, 19 nt, Homo sapiens
gaauguaggccuuaacuau

SEQ ID NO: 280924 - RNA, 19 nt, Homo sapiens
aaacgaaacuccaucuuca

SEQ ID NO: 280925 - RNA, 19 nt, Homo sapiens
gauauuugccugucuguuu

SEQ ID NO: 280926 - RNA, 19 nt, Homo sapiens
aaacacuucuuagggauua

SEQ ID NO: 280927 - RNA, 19 nt, Homo sapiens
cuacugggauguucuugua

SEQ ID NO: 280928 - RNA, 19 nt, Homo sapiens
caaaagaugugcaaaauca

SEQ ID NO: 280929 - RNA, 19 nt, Homo sapiens
uacaucagcuugguaguua

SEQ ID NO: 280930 - RNA, 19 nt, Homo sapiens
gaugaugacaccauucuaa

SEQ ID NO: 280931 - RNA, 19 nt, Homo sapiens
ggauaagguugcuucaguu

SEQ ID NO: 280932 - RNA, 19 nt, Homo sapiens
gauaagguugcuucaguua

SEQ ID NO: 280933 - RNA, 19 nt, Homo sapiens
gcacagugagcacaaauga

SEQ ID NO: 280934 - RNA, 19 nt, Homo sapiens
cagauuauaugccugauuc

SEQ ID NO: 280935 - RNA, 19 nt, Homo sapiens
ucugagagauguaccaauu

SEQ ID NO: 280936 - RNA, 19 nt, Homo sapiens
guaacgcucuaucugguuu

SEQ ID NO: 280937 - RNA, 19 nt, Homo sapiens
gcauggcacugacugaaug

SEQ ID NO: 280938 - RNA, 19 nt, Homo sapiens
caaauaacaaucucagcua

SEQ ID NO: 280939 - RNA, 19 nt, Homo sapiens
gaaacugguccauguaaau

SEQ ID NO: 280940 - RNA, 19 nt, Homo sapiens
gggcugguauuauuauguu

SEQ ID NO: 280941 - RNA, 19 nt, Homo sapiens
gcaauacuggucaacuuaa

SEQ ID NO: 280942 - RNA, 19 nt, Homo sapiens
gcauguauuugguuaaugg

SEQ ID NO: 280943 - RNA, 19 nt, Homo sapiens
gaaaugccaguguguccua

SEQ ID NO: 280944 - RNA, 19 nt, Homo sapiens
uggcauugcugcauauuug

SEQ ID NO: 280945 - RNA, 19 nt, Homo sapiens
gcaucuacuuauucaauug

SEQ ID NO: 280946 - RNA, 19 nt, Homo sapiens
gauuuguacuugcuccuuu

SEQ ID NO: 280947 - RNA, 19 nt, Homo sapiens
guucuaccguggauuugua

SEQ ID NO: 280948 - RNA, 19 nt, Homo sapiens
aaacuugcaucuuaaccaa

SEQ ID NO: 280949 - RNA, 19 nt, Homo sapiens
uuuaggugcuuuagagaua

SEQ ID NO: 280950 - RNA, 19 nt, Homo sapiens
agugauugcuuacguaauu

SEQ ID NO: 280951 - RNA, 19 nt, Homo sapiens
cucaauagcagcaccauua

SEQ ID NO: 280952 - RNA, 19 nt, Homo sapiens
caacacuggugauaacaca

SEQ ID NO: 280953 - RNA, 19 nt, Homo sapiens
cagcuugcauugauugcua

SEQ ID NO: 280954 - RNA, 19 nt, Homo sapiens
guucagccuuucaauguga

SEQ ID NO: 280955 - RNA, 19 nt, Homo sapiens
gauaaaggaauucuuacug

SEQ ID NO: 280956 - RNA, 19 nt, Homo sapiens
aaacugguccauguaaaua

SEQ ID NO: 280957 - RNA, 19 nt, Homo sapiens
ugagagauguaccaauugu

SEQ ID NO: 280958 - RNA, 19 nt, Homo sapiens
uaaauuggccucuguaugc

SEQ ID NO: 280959 - RNA, 19 nt, Homo sapiens
caaguuccaacaugcaaua

SEQ ID NO: 280960 - RNA, 19 nt, Homo sapiens
aaagaaugauguuguccaa

SEQ ID NO: 280961 - RNA, 19 nt, Homo sapiens
ggugauaacacaacauuuc

SEQ ID NO: 280962 - RNA, 19 nt, Homo sapiens
ccaaggcagcaucuacuua

SEQ ID NO: 280963 - RNA, 19 nt, Homo sapiens
gcacaaugcauggcacuga

SEQ ID NO: 280964 - RNA, 19 nt, Homo sapiens
cuuguaagauggauaaugu

SEQ ID NO: 280965 - RNA, 19 nt, Homo sapiens
acacauauauaggcaguug

SEQ ID NO: 280966 - RNA, 19 nt, Homo sapiens
guauuuauguggcuguaau

SEQ ID NO: 280967 - RNA, 19 nt, Homo sapiens
cagguuaacuuagcuacuu

SEQ ID NO: 280968 - RNA, 19 nt, Homo sapiens
uauagugauugcuuacgua

SEQ ID NO: 280969 - RNA, 19 nt, Homo sapiens
gcagcaccauuaaguaucu

SEQ ID NO: 280970 - RNA, 19 nt, Homo sapiens
gaaaaugccacuugccuuu

SEQ ID NO: 280971 - RNA, 19 nt, Homo sapiens
gcauuggaacuuaauuuga

SEQ ID NO: 280972 - RNA, 19 nt, Homo sapiens
gauguaugguaucuuuaga

SEQ ID NO: 280973 - RNA, 19 nt, Homo sapiens
uuaaaugguucugugcuaa

SEQ ID NO: 280974 - RNA, 19 nt, Homo sapiens
ccaauugagggcauuagua

SEQ ID NO: 280975 - RNA, 19 nt, Homo sapiens
cugcauauuugaccuuuga

SEQ ID NO: 280976 - RNA, 19 nt, Homo sapiens
acaaagagcagacuguuuc

SEQ ID NO: 280977 - RNA, 19 nt, Homo sapiens
cuacaacaccuacuccaaa

SEQ ID NO: 280978 - RNA, 19 nt, Homo sapiens
cuacaacacuggugauaac

SEQ ID NO: 280979 - RNA, 19 nt, Homo sapiens
guccagcucuuuagaaugg

SEQ ID NO: 280980 - RNA, 19 nt, Homo sapiens
gcaaguacaaguuccaaca

SEQ ID NO: 280981 - RNA, 19 nt, Homo sapiens
guucuuauaugugcaacaa

SEQ ID NO: 280982 - RNA, 19 nt, Homo sapiens
caaggcagcaucuacuuau

SEQ ID NO: 280983 - RNA, 19 nt, Homo sapiens
uguugcagcuguuguugua

SEQ ID NO: 280984 - RNA, 19 nt, Homo sapiens
gcaggagaaucacuugaac

SEQ ID NO: 280985 - RNA, 19 nt, Homo sapiens
cuggucaacuuaagguaua

SEQ ID NO: 280986 - RNA, 19 nt, Homo sapiens
caauacgugaucucuguua

SEQ ID NO: 280987 - RNA, 19 nt, Homo sapiens
uuacguaauuggcagaaga

SEQ ID NO: 280988 - RNA, 19 nt, Homo sapiens
ccuuaacuauuucacauga

SEQ ID NO: 280989 - RNA, 19 nt, Homo sapiens
aguguucgcuggaugauga

SEQ ID NO: 280990 - RNA, 19 nt, Homo sapiens
caaggaaaguauucuacag

SEQ ID NO: 280991 - RNA, 19 nt, Homo sapiens
ggcagcaucuacuuauuca

SEQ ID NO: 280992 - RNA, 19 nt, Homo sapiens
gcaguucggaccuggcuuu

SEQ ID NO: 280993 - RNA, 19 nt, Homo sapiens
ucagaauggucccaaaaua

SEQ ID NO: 280994 - RNA, 19 nt, Homo sapiens
agaaacugguccauguaaa

SEQ ID NO: 280995 - RNA, 19 nt, Homo sapiens
uuacaugggccaguuuaua

SEQ ID NO: 280996 - RNA, 19 nt, Homo sapiens
acacacacacagacauaua

SEQ ID NO: 280997 - RNA, 19 nt, Homo sapiens
gaauggcugagcaaauauu

SEQ ID NO: 280998 - RNA, 19 nt, Homo sapiens
cagcauguauuugguuaau

SEQ ID NO: 280999 - RNA, 19 nt, Homo sapiens
caacaccuacuccaaagga

SEQ ID NO: 281000 - RNA, 19 nt, Homo sapiens
uuuccuggauugcgaauuu

SEQ ID NO: 281001 - RNA, 19 nt, Homo sapiens
ucacaugagucaaaacaaa

SEQ ID NO: 281002 - RNA, 19 nt, Homo sapiens
ggccuuaacuauuucacau

SEQ ID NO: 281003 - RNA, 19 nt, Homo sapiens
auguaggccuuaacuauuu

SEQ ID NO: 281004 - RNA, 19 nt, Homo sapiens
cuacuuagacucaauagca

SEQ ID NO: 281005 - RNA, 19 nt, Homo sapiens
gacugaaugcuguuaauau

SEQ ID NO: 281006 - RNA, 19 nt, Homo sapiens
guaagauggauaaugugua

SEQ ID NO: 281007 - RNA, 19 nt, Homo sapiens
gaauggaucaauacacaca

SEQ ID NO: 281008 - RNA, 19 nt, Homo sapiens
uaauucacgugcuuugugu

SEQ ID NO: 281009 - RNA, 19 nt, Homo sapiens
gcagguaguugaguugaac

SEQ ID NO: 281010 - RNA, 19 nt, Homo sapiens
gcuggaugaugacaccauu

SEQ ID NO: 281011 - RNA, 19 nt, Homo sapiens
ccugggaaguucuuauaug

SEQ ID NO: 281012 - RNA, 19 nt, Homo sapiens
aaaugccacuugccuuuau

SEQ ID NO: 281013 - RNA, 19 nt, Homo sapiens
aaggaauucuuacuguuga

SEQ ID NO: 281014 - RNA, 19 nt, Homo sapiens
ggauucccgucguaacuua

SEQ ID NO: 281015 - RNA, 19 nt, Homo sapiens
cuacagagauccugaagag

SEQ ID NO: 281016 - RNA, 19 nt, Homo sapiens
ggucaugccugaucuguac

SEQ ID NO: 281017 - RNA, 19 nt, Homo sapiens
ugacuggucuuaagcuguu

SEQ ID NO: 281018 - RNA, 19 nt, Homo sapiens
gcaauucccuacugaagac

SEQ ID NO: 281019 - RNA, 19 nt, Homo sapiens
cagagauccugaagagauu

SEQ ID NO: 281020 - RNA, 19 nt, Homo sapiens
cuuaagcuguucuugcaua

SEQ ID NO: 281021 - RNA, 19 nt, Homo sapiens
gcgcaugcguggcaccauu

SEQ ID NO: 281022 - RNA, 19 nt, Homo sapiens
gaugcuggcucgggaaguu

SEQ ID NO: 281023 - RNA, 19 nt, Homo sapiens
caacaagggagcucacuca

SEQ ID NO: 281024 - RNA, 19 nt, Homo sapiens
ugccugaucuguacuucua

SEQ ID NO: 281025 - RNA, 19 nt, Homo sapiens
ggaacaguacaucuauaaa

SEQ ID NO: 281026 - RNA, 19 nt, Homo sapiens
guucuugcauaggcucuua

SEQ ID NO: 281027 - RNA, 19 nt, Homo sapiens
gcuccugaguucacugcua

SEQ ID NO: 281028 - RNA, 19 nt, Homo sapiens
ccagagggcugugcugaag

SEQ ID NO: 281029 - RNA, 19 nt, Homo sapiens
agaaggcagugaccaagga

SEQ ID NO: 281030 - RNA, 19 nt, Homo sapiens
guucuggauucccgucgua

SEQ ID NO: 281031 - RNA, 19 nt, Homo sapiens
uggaacaguacaucuauaa

SEQ ID NO: 281032 - RNA, 19 nt, Homo sapiens
acagagauccugaagagau

SEQ ID NO: 281033 - RNA, 19 nt, Homo sapiens
gggcugugcugaaguuugc

SEQ ID NO: 281034 - RNA, 19 nt, Homo sapiens
agagggcugugcugaaguu

SEQ ID NO: 281035 - RNA, 19 nt, Homo sapiens
cuugauguccugcaaauga

SEQ ID NO: 281036 - RNA, 19 nt, Homo sapiens
gcucuuaagcagcauggaa

SEQ ID NO: 281037 - RNA, 19 nt, Homo sapiens
gucuuaagcuguucuugca

SEQ ID NO: 281038 - RNA, 19 nt, Homo sapiens
ugaccaaggaggaauuuca

SEQ ID NO: 281039 - RNA, 19 nt, Homo sapiens
guuaaccuaccuaccauug

SEQ ID NO: 281040 - RNA, 19 nt, Homo sapiens
gaaccuucacuaaccagau

SEQ ID NO: 281041 - RNA, 19 nt, Homo sapiens
gcagcucgugcaauuguug

SEQ ID NO: 281042 - RNA, 19 nt, Homo sapiens
gcaaaugaaggaggaggau

SEQ ID NO: 281043 - RNA, 19 nt, Homo sapiens
gauccugaagagauugaaa

SEQ ID NO: 281044 - RNA, 19 nt, Homo sapiens
caagaggaccugggagaag

SEQ ID NO: 281045 - RNA, 19 nt, Homo sapiens
uugauguccugcaaaugaa

SEQ ID NO: 281046 - RNA, 19 nt, Homo sapiens
cagcaauucccuacugaag

SEQ ID NO: 281047 - RNA, 19 nt, Homo sapiens
uauguuaaccuaccuacca

SEQ ID NO: 281048 - RNA, 19 nt, Homo sapiens
ugaaaacccugcugauguc

SEQ ID NO: 281049 - RNA, 19 nt, Homo sapiens
aaaugaaggaggaggaugu

SEQ ID NO: 281050 - RNA, 19 nt, Homo sapiens
uugcauaggcucuuaagca

SEQ ID NO: 281051 - RNA, 19 nt, Homo sapiens
gagauccugaagagauuga

SEQ ID NO: 281052 - RNA, 19 nt, Homo sapiens
gggaggucaugccugaucu

SEQ ID NO: 281053 - RNA, 19 nt, Homo sapiens
ucaagaggaccugggagaa

SEQ ID NO: 281054 - RNA, 19 nt, Homo sapiens
auggaacaguacaucuaua

SEQ ID NO: 281055 - RNA, 19 nt, Homo sapiens
gucguaacuuaaagggaaa

SEQ ID NO: 281056 - RNA, 19 nt, Homo sapiens
auacggcguuguucuggau

SEQ ID NO: 281057 - RNA, 19 nt, Homo sapiens
gccaucccaugcaacaaca

SEQ ID NO: 281058 - RNA, 19 nt, Homo sapiens
ccuggaaccuucacuaacc

SEQ ID NO: 281059 - RNA, 19 nt, Homo sapiens
guccggagcccuugauguc

SEQ ID NO: 281060 - RNA, 19 nt, Homo sapiens
aaccuucacuaaccagauc

SEQ ID NO: 281061 - RNA, 19 nt, Homo sapiens
ggacuugaaugguuaauaa

SEQ ID NO: 281062 - RNA, 19 nt, Homo sapiens
gaaauuagaagcugcagaa

SEQ ID NO: 281063 - RNA, 19 nt, Homo sapiens
gcacaagcguguuucuaga

SEQ ID NO: 281064 - RNA, 19 nt, Homo sapiens
guuaauggcuaguacugua

SEQ ID NO: 281065 - RNA, 19 nt, Homo sapiens
gggagaaacugaaaguguu

SEQ ID NO: 281066 - RNA, 19 nt, Homo sapiens
gaaacgagagcacgagaaa

SEQ ID NO: 281067 - RNA, 19 nt, Homo sapiens
gaaccgagaggcacaaaug

SEQ ID NO: 281068 - RNA, 19 nt, Homo sapiens
ggaggaaauucagaagaaa

SEQ ID NO: 281069 - RNA, 19 nt, Homo sapiens
gauccagacuguaagaugu

SEQ ID NO: 281070 - RNA, 19 nt, Homo sapiens
gagaacaguugagagagaa

SEQ ID NO: 281071 - RNA, 19 nt, Homo sapiens
cuacuggacuugaaugguu

SEQ ID NO: 281072 - RNA, 19 nt, Homo sapiens
ccaugaagcugaggucuug

SEQ ID NO: 281073 - RNA, 19 nt, Homo sapiens
gggcauguccucauccuuu

SEQ ID NO: 281074 - RNA, 19 nt, Homo sapiens
auuagaagcugcagaagaa

SEQ ID NO: 281075 - RNA, 19 nt, Homo sapiens
ggucagcuguuacuuucuu

SEQ ID NO: 281076 - RNA, 19 nt, Homo sapiens
gccuaucgcuugucuucua

SEQ ID NO: 281077 - RNA, 19 nt, Homo sapiens
acuguuagaugcugaauau

SEQ ID NO: 281078 - RNA, 19 nt, Homo sapiens
uggaggaaauucagaagaa

SEQ ID NO: 281079 - RNA, 19 nt, Homo sapiens
gcuguuacuuucuuucaga

SEQ ID NO: 281080 - RNA, 19 nt, Homo sapiens
gaagaagugcggaagaaca

SEQ ID NO: 281081 - RNA, 19 nt, Homo sapiens
caggucagcuguuacuuuc

SEQ ID NO: 281082 - RNA, 19 nt, Homo sapiens
ccaauucugucccaaucuu

SEQ ID NO: 281083 - RNA, 19 nt, Homo sapiens
cuaaauauccaaagacugu

SEQ ID NO: 281084 - RNA, 19 nt, Homo sapiens
aagagaaacugacccacaa

SEQ ID NO: 281085 - RNA, 19 nt, Homo sapiens
gcuaauguaggacuguaua

SEQ ID NO: 281086 - RNA, 19 nt, Homo sapiens
gaaauacccaacgcacaaa

SEQ ID NO: 281087 - RNA, 19 nt, Homo sapiens
cacgagaaucagaauauua

SEQ ID NO: 281088 - RNA, 19 nt, Homo sapiens
gacacgagaaucagaauau

SEQ ID NO: 281089 - RNA, 19 nt, Homo sapiens
agagaacaguugagagaga

SEQ ID NO: 281090 - RNA, 19 nt, Homo sapiens
gaauaucuguucacuuuuc

SEQ ID NO: 281091 - RNA, 19 nt, Homo sapiens
caccauggcuucuucugau

SEQ ID NO: 281092 - RNA, 19 nt, Homo sapiens
uagaagagaacaacaacuu

SEQ ID NO: 281093 - RNA, 19 nt, Homo sapiens
ggauaagcacauugaagaa

SEQ ID NO: 281094 - RNA, 19 nt, Homo sapiens
caauagaagagaacaacaa

SEQ ID NO: 281095 - RNA, 19 nt, Homo sapiens
gcacaaaugaccgcacguu

SEQ ID NO: 281096 - RNA, 19 nt, Homo sapiens
guguuggucuuucuaaugu

SEQ ID NO: 281097 - RNA, 19 nt, Homo sapiens
aauggaagcuaauaaagag

SEQ ID NO: 281098 - RNA, 19 nt, Homo sapiens
aagcugaggucuugaagca

SEQ ID NO: 281099 - RNA, 19 nt, Homo sapiens
acacgagaaucagaauauu

SEQ ID NO: 281100 - RNA, 19 nt, Homo sapiens
cuagagaacaguugagaga

SEQ ID NO: 281101 - RNA, 19 nt, Homo sapiens
ccaggucagcuguuacuuu

SEQ ID NO: 281102 - RNA, 19 nt, Homo sapiens
ggacugagcaggacuuucc

SEQ ID NO: 281103 - RNA, 19 nt, Homo sapiens
agaaauacccaacgcacaa

SEQ ID NO: 281104 - RNA, 19 nt, Homo sapiens
agagaaggauaagcacauu

SEQ ID NO: 281105 - RNA, 19 nt, Homo sapiens
gaaacugacccacaaaaug

SEQ ID NO: 281106 - RNA, 19 nt, Homo sapiens
agaaggcaauagaagagaa

SEQ ID NO: 281107 - RNA, 19 nt, Homo sapiens
guugauacuuguuccagau

SEQ ID NO: 281108 - RNA, 19 nt, Homo sapiens
guaggacuguauagguaga

SEQ ID NO: 281109 - RNA, 19 nt, Homo sapiens
gaaggauaagcacauugaa

SEQ ID NO: 281110 - RNA, 19 nt, Homo sapiens
agaaggauaagcacauuga

SEQ ID NO: 281111 - RNA, 19 nt, Homo sapiens
gagagaaggauaagcacau

SEQ ID NO: 281112 - RNA, 19 nt, Homo sapiens
gaggaaauucagaagaaau

SEQ ID NO: 281113 - RNA, 19 nt, Homo sapiens
gauucuacuuggugguuug

SEQ ID NO: 281114 - RNA, 19 nt, Homo sapiens
acaagcguguuucuagaga

SEQ ID NO: 281115 - RNA, 19 nt, Homo sapiens
guuacuuucuuucagaugu

SEQ ID NO: 281116 - RNA, 19 nt, Homo sapiens
uacuggacuugaaugguua

SEQ ID NO: 281117 - RNA, 19 nt, Homo sapiens
uaagcacauugaagaagug

SEQ ID NO: 281118 - RNA, 19 nt, Homo sapiens
caauucugucccaaucuua

SEQ ID NO: 281119 - RNA, 19 nt, Homo sapiens
caaaugaccgcacguucuc

SEQ ID NO: 281120 - RNA, 19 nt, Homo sapiens
uugaagaagugcggaagaa

SEQ ID NO: 281121 - RNA, 19 nt, Homo sapiens
gauaagcacauugaagaag

SEQ ID NO: 281122 - RNA, 19 nt, Homo sapiens
aggauaagcacauugaaga

SEQ ID NO: 281123 - RNA, 19 nt, Homo sapiens
cuucugauauccaggugaa

SEQ ID NO: 281124 - RNA, 19 nt, Homo sapiens
cuuccuaaauauccaaaga

SEQ ID NO: 281125 - RNA, 19 nt, Homo sapiens
cagaauacacugccuaucg

SEQ ID NO: 281126 - RNA, 19 nt, Homo sapiens
gcagaagaaagacgcaagu

SEQ ID NO: 281127 - RNA, 19 nt, Homo sapiens
ugacacgagaaucagaaua

SEQ ID NO: 281128 - RNA, 19 nt, Homo sapiens
ggcauguccucauccuuuc

SEQ ID NO: 281129 - RNA, 19 nt, Homo sapiens
aguauguaguggcuucuuu

SEQ ID NO: 281130 - RNA, 19 nt, Homo sapiens
auguaggacuguauaggua

SEQ ID NO: 281131 - RNA, 19 nt, Homo sapiens
gagaaggauaagcacauug

SEQ ID NO: 281132 - RNA, 19 nt, Homo sapiens
gcaauagaagagaacaaca

SEQ ID NO: 281133 - RNA, 19 nt, Homo sapiens
aacgagagcacgagaaaga

SEQ ID NO: 281134 - RNA, 19 nt, Homo sapiens
auaagcacauugaagaagu

SEQ ID NO: 281135 - RNA, 19 nt, Homo sapiens
agacgcaagucccaugaag

SEQ ID NO: 281136 - RNA, 19 nt, Homo sapiens
gaacaguugagagagaauc

SEQ ID NO: 281137 - RNA, 19 nt, Homo sapiens
uaucgcuugucuucuauuc

SEQ ID NO: 281138 - RNA, 19 nt, Homo sapiens
aagcuaauguaggacugua

SEQ ID NO: 281139 - RNA, 19 nt, Homo sapiens
guuggucuuucuaauguag

SEQ ID NO: 281140 - RNA, 19 nt, Homo sapiens
ggaagcuaauaaagagaac

SEQ ID NO: 281141 - RNA, 19 nt, Homo sapiens
uaaaagcacaagcguguuu

SEQ ID NO: 281142 - RNA, 19 nt, Homo sapiens
cuuccacaaugacugcuuu

SEQ ID NO: 281143 - RNA, 19 nt, Homo sapiens
ccagugugguuugcauugu

SEQ ID NO: 281144 - RNA, 19 nt, Homo sapiens
gcagugacuucuuuugagu

SEQ ID NO: 281145 - RNA, 19 nt, Homo sapiens
uguaguggcuucuuuugaa

SEQ ID NO: 281146 - RNA, 19 nt, Homo sapiens
cccaguugauugugcagaa

SEQ ID NO: 281147 - RNA, 19 nt, Homo sapiens
accauggcuucuucugaua

SEQ ID NO: 281148 - RNA, 19 nt, Homo sapiens
ugguggcagugacuucuuu

SEQ ID NO: 281149 - RNA, 19 nt, Homo sapiens
cacuugguguacuggguua

SEQ ID NO: 281150 - RNA, 19 nt, Homo sapiens
ccagauccagacuguaaga

SEQ ID NO: 281151 - RNA, 19 nt, Homo sapiens
ucaccauggcuucuucuga

SEQ ID NO: 281152 - RNA, 19 nt, Homo sapiens
ccuaucgcuugucuucuau

SEQ ID NO: 281153 - RNA, 19 nt, Homo sapiens
cauccuuuccugccauaaa

SEQ ID NO: 281154 - RNA, 19 nt, Homo sapiens
caguugauugugcagaaua

SEQ ID NO: 281155 - RNA, 19 nt, Homo sapiens
uuucuaaaguguuggucuu

SEQ ID NO: 281156 - RNA, 19 nt, Homo sapiens
aagaagugcggaagaacaa

SEQ ID NO: 281157 - RNA, 19 nt, Homo sapiens
cuggaacguuugcgagaga

SEQ ID NO: 281158 - RNA, 19 nt, Homo sapiens
ccaguugauugugcagaau

SEQ ID NO: 281159 - RNA, 19 nt, Homo sapiens
acaaaugaccgcacguucu

SEQ ID NO: 281160 - RNA, 19 nt, Homo sapiens
ucagaaggcaauagaagag

SEQ ID NO: 281161 - RNA, 19 nt, Homo sapiens
gcaaagagcucccgaggaa

SEQ ID NO: 281162 - RNA, 19 nt, Homo sapiens
gaaaugaccacgugaaauu

SEQ ID NO: 281163 - RNA, 19 nt, Homo sapiens
caucaaagcuagaauguga

SEQ ID NO: 281164 - RNA, 19 nt, Homo sapiens
gaaagaggcaucaaagcua

SEQ ID NO: 281165 - RNA, 19 nt, Homo sapiens
gcaaguggaauaucuuaua

SEQ ID NO: 281166 - RNA, 19 nt, Homo sapiens
guucuugccuuucuuaauu

SEQ ID NO: 281167 - RNA, 19 nt, Homo sapiens
gcagagaaguuccuuaggu

SEQ ID NO: 281168 - RNA, 19 nt, Homo sapiens
gauaaguucuggcauaaag

SEQ ID NO: 281169 - RNA, 19 nt, Homo sapiens
gaaagacggugcuauaucc

SEQ ID NO: 281170 - RNA, 19 nt, Homo sapiens
gaaauuugccucuguccaa

SEQ ID NO: 281171 - RNA, 19 nt, Homo sapiens
ggaggaagcccaccaaucu

SEQ ID NO: 281172 - RNA, 19 nt, Homo sapiens
gaaccacaagugaaucuuu

SEQ ID NO: 281173 - RNA, 19 nt, Homo sapiens
agagugagcuccagaguca

SEQ ID NO: 281174 - RNA, 19 nt, Homo sapiens
gggccaauacuaagaauaa

SEQ ID NO: 281175 - RNA, 19 nt, Homo sapiens
gaacaagggcaaagguuuc

SEQ ID NO: 281176 - RNA, 19 nt, Homo sapiens
aaggugaacugucuggaua

SEQ ID NO: 281177 - RNA, 19 nt, Homo sapiens
cagagaaguuccuuagguu

SEQ ID NO: 281178 - RNA, 19 nt, Homo sapiens
gaagggaggagcagcaaga

SEQ ID NO: 281179 - RNA, 19 nt, Homo sapiens
ggaggcaaguggaauaucu

SEQ ID NO: 281180 - RNA, 19 nt, Homo sapiens
gucaacugcuuguuaauug

SEQ ID NO: 281181 - RNA, 19 nt, Homo sapiens
acauaaagcucccuugaag

SEQ ID NO: 281182 - RNA, 19 nt, Homo sapiens
gcuagaaugugaauauaac

SEQ ID NO: 281183 - RNA, 19 nt, Homo sapiens
ggaaagacggugcuauauc

SEQ ID NO: 281184 - RNA, 19 nt, Homo sapiens
gcaagccagucauggaauc

SEQ ID NO: 281185 - RNA, 19 nt, Homo sapiens
uaauucuccuucccagaua

SEQ ID NO: 281186 - RNA, 19 nt, Homo sapiens
cuggauaaguucuggcaua

SEQ ID NO: 281187 - RNA, 19 nt, Homo sapiens
ggaaagaggcaucaaagcu

SEQ ID NO: 281188 - RNA, 19 nt, Homo sapiens
gcaagaagcagccuguuuu

SEQ ID NO: 281189 - RNA, 19 nt, Homo sapiens
cgaaugagagguugaggaa

SEQ ID NO: 281190 - RNA, 19 nt, Homo sapiens
caaaauaccacccuacaaa

SEQ ID NO: 281191 - RNA, 19 nt, Homo sapiens
cugcccagcuccucacaua

SEQ ID NO: 281192 - RNA, 19 nt, Homo sapiens
gcagcagccucaccacauc

SEQ ID NO: 281193 - RNA, 19 nt, Homo sapiens
agaagaagcccuacugcaa

SEQ ID NO: 281194 - RNA, 19 nt, Homo sapiens
uggauaaguucuggcauaa

SEQ ID NO: 281195 - RNA, 19 nt, Homo sapiens
ugcgagaccugcaagauga

SEQ ID NO: 281196 - RNA, 19 nt, Homo sapiens
gaagcccaguggugaggaa

SEQ ID NO: 281197 - RNA, 19 nt, Homo sapiens
gaacaugaagaacuacaag

SEQ ID NO: 281198 - RNA, 19 nt, Homo sapiens
aggaggaguuugagaagaa

SEQ ID NO: 281199 - RNA, 19 nt, Homo sapiens
uaucuuauauugggcgauu

SEQ ID NO: 281200 - RNA, 19 nt, Homo sapiens
ccaccaaucugcccuuugc

SEQ ID NO: 281201 - RNA, 19 nt, Homo sapiens
cacugaacaugaagaacua

SEQ ID NO: 281202 - RNA, 19 nt, Homo sapiens
ugacaacccuggccucacu

SEQ ID NO: 281203 - RNA, 19 nt, Homo sapiens
ggacuuggagcugcacaaa

SEQ ID NO: 281204 - RNA, 19 nt, Homo sapiens
cagaaaugaccacgugaaa

SEQ ID NO: 281205 - RNA, 19 nt, Homo sapiens
cggagaaggugaacugucu

SEQ ID NO: 281206 - RNA, 19 nt, Homo sapiens
gaaggugaacugucuggau

SEQ ID NO: 281207 - RNA, 19 nt, Homo sapiens
agaauaggguggcagaagu

SEQ ID NO: 281208 - RNA, 19 nt, Homo sapiens
agaugacacugaacaugaa

SEQ ID NO: 281209 - RNA, 19 nt, Homo sapiens
gaagaacaagggcaaaggu

SEQ ID NO: 281210 - RNA, 19 nt, Homo sapiens
ucuuucagcucauuuaauc

SEQ ID NO: 281211 - RNA, 19 nt, Homo sapiens
gguggaggcaaguggaaua

SEQ ID NO: 281212 - RNA, 19 nt, Homo sapiens
guucaacaaucagucauca

SEQ ID NO: 281213 - RNA, 19 nt, Homo sapiens
gcuacaaggaggaguuuga

SEQ ID NO: 281214 - RNA, 19 nt, Homo sapiens
gcugggcgucuguucuuua

SEQ ID NO: 281215 - RNA, 19 nt, Homo sapiens
gggaaagacggugcuauau

SEQ ID NO: 281216 - RNA, 19 nt, Homo sapiens
cagcagggaccacuaaauc

SEQ ID NO: 281217 - RNA, 19 nt, Homo sapiens
uuugucaacugcuuguuaa

SEQ ID NO: 281218 - RNA, 19 nt, Homo sapiens
gaauaggguggcagaagug

SEQ ID NO: 281219 - RNA, 19 nt, Homo sapiens
gggcagagaaguuccuuag

SEQ ID NO: 281220 - RNA, 19 nt, Homo sapiens
gcaaagguuucagcguagu

SEQ ID NO: 281221 - RNA, 19 nt, Homo sapiens
gaacauuugacuugaacca

SEQ ID NO: 281222 - RNA, 19 nt, Homo sapiens
ucaacaaucagucaucaug

SEQ ID NO: 281223 - RNA, 19 nt, Homo sapiens
aagaugacacugaacauga

SEQ ID NO: 281224 - RNA, 19 nt, Homo sapiens
ggaggaaggcucugucacu

SEQ ID NO: 281225 - RNA, 19 nt, Homo sapiens
ggacucugccgcuguguag

SEQ ID NO: 281226 - RNA, 19 nt, Homo sapiens
acaaggaggaguuugagaa

SEQ ID NO: 281227 - RNA, 19 nt, Homo sapiens
uugcuuaauuucugccuuu

SEQ ID NO: 281228 - RNA, 19 nt, Homo sapiens
ccaggaaagaggcaucaaa

SEQ ID NO: 281229 - RNA, 19 nt, Homo sapiens
gaagguauuggccuguuca

SEQ ID NO: 281230 - RNA, 19 nt, Homo sapiens
gcacagcuugggucagguu

SEQ ID NO: 281231 - RNA, 19 nt, Homo sapiens
gaugggcucuaccucucuu

SEQ ID NO: 281232 - RNA, 19 nt, Homo sapiens
uaaaauaccaugaggaguu

SEQ ID NO: 281233 - RNA, 19 nt, Homo sapiens
gagagaggagggacuguca

SEQ ID NO: 281234 - RNA, 19 nt, Homo sapiens
uuacauaaagcucccuuga

SEQ ID NO: 281235 - RNA, 19 nt, Homo sapiens
caugaggaguuugagaaga

SEQ ID NO: 281236 - RNA, 19 nt, Homo sapiens
caagaugacacugaacaug

SEQ ID NO: 281237 - RNA, 19 nt, Homo sapiens
gggcgucuguucuuuacca

SEQ ID NO: 281238 - RNA, 19 nt, Homo sapiens
ggcccucccucuacucuuc

SEQ ID NO: 281239 - RNA, 19 nt, Homo sapiens
gcauucuguuuccucuuga

SEQ ID NO: 281240 - RNA, 19 nt, Homo sapiens
aaugagagguugaggaaaa

SEQ ID NO: 281241 - RNA, 19 nt, Homo sapiens
agggaaagacggugcuaua

SEQ ID NO: 281242 - RNA, 19 nt, Homo sapiens
cgcccgagcuccagagaau

SEQ ID NO: 281243 - RNA, 19 nt, Homo sapiens
agaacaagggcaaagguuu

SEQ ID NO: 281244 - RNA, 19 nt, Homo sapiens
gaccugaguuugggagagu

SEQ ID NO: 281245 - RNA, 19 nt, Homo sapiens
gcgcuggugcauucuguuu

SEQ ID NO: 281246 - RNA, 19 nt, Homo sapiens
ccacggagaaggugaacug

SEQ ID NO: 281247 - RNA, 19 nt, Homo sapiens
uacaagggcuacgagaaga

SEQ ID NO: 281248 - RNA, 19 nt, Homo sapiens
gggcuaagcgguggaggaa

SEQ ID NO: 281249 - RNA, 19 nt, Homo sapiens
aaacauuucauccgugugu

SEQ ID NO: 281250 - RNA, 19 nt, Homo sapiens
ggucuuucagcucauuuaa

SEQ ID NO: 281251 - RNA, 19 nt, Homo sapiens
gccauggucccgaagugua

SEQ ID NO: 281252 - RNA, 19 nt, Homo sapiens
ccucacauacccacacauu

SEQ ID NO: 281253 - RNA, 19 nt, Homo sapiens
ccugcaagaugacacugaa

SEQ ID NO: 281254 - RNA, 19 nt, Homo sapiens
cagggaaaaugacuuuauu

SEQ ID NO: 281255 - RNA, 19 nt, Homo sapiens
ccuuagaggaccugaguuu

SEQ ID NO: 281256 - RNA, 19 nt, Homo sapiens
gcagggaccacuaaaucuc

SEQ ID NO: 281257 - RNA, 19 nt, Homo sapiens
cgacagcuugugauuccua

SEQ ID NO: 281258 - RNA, 19 nt, Homo sapiens
cccaggaccagaucaguaa

SEQ ID NO: 281259 - RNA, 19 nt, Homo sapiens
ucugaacauuugacuugaa

SEQ ID NO: 281260 - RNA, 19 nt, Homo sapiens
ggauaaguucuggcauaaa

SEQ ID NO: 281261 - RNA, 19 nt, Homo sapiens
caacagagauugacaguuu

SEQ ID NO: 281262 - RNA, 19 nt, Homo sapiens
cgacauugauuauagcuua

SEQ ID NO: 281263 - RNA, 19 nt, Homo sapiens
caaguucaaugauaaguug

SEQ ID NO: 281264 - RNA, 19 nt, Homo sapiens
cuacagggcuccuuugaug

SEQ ID NO: 281265 - RNA, 19 nt, Homo sapiens
uggaagcgcuccucaacua

SEQ ID NO: 281266 - RNA, 19 nt, Homo sapiens
uaucugaacuucuccauca

SEQ ID NO: 281267 - RNA, 19 nt, Homo sapiens
ggacaugucgggagacuug

SEQ ID NO: 281268 - RNA, 19 nt, Homo sapiens
guuuaagggugaaaucuuu

SEQ ID NO: 281269 - RNA, 19 nt, Homo sapiens
gcgaaaugauccagaaauc

SEQ ID NO: 281270 - RNA, 19 nt, Homo sapiens
aagcgcuccucaacuauua

SEQ ID NO: 281271 - RNA, 19 nt, Homo sapiens
gcaagucauucuucaaacu

SEQ ID NO: 281272 - RNA, 19 nt, Homo sapiens
ggaaggugcgcaagucauu

SEQ ID NO: 281273 - RNA, 19 nt, Homo sapiens
gaacuucuccaucacagau

SEQ ID NO: 281274 - RNA, 19 nt, Homo sapiens
ccuccgaucuacagccuua

SEQ ID NO: 281275 - RNA, 19 nt, Homo sapiens
gcgcaagucauucuucaaa

SEQ ID NO: 281276 - RNA, 19 nt, Homo sapiens
gaagcgcuccucaacuauu

SEQ ID NO: 281277 - RNA, 19 nt, Homo sapiens
ggaucacgcugccugacuu

SEQ ID NO: 281278 - RNA, 19 nt, Homo sapiens
cugaaagaauccaaaguug

SEQ ID NO: 281279 - RNA, 19 nt, Homo sapiens
gaacugaaagaauccaaag

SEQ ID NO: 281280 - RNA, 19 nt, Homo sapiens
gcagauccauaaggacuuc

SEQ ID NO: 281281 - RNA, 19 nt, Homo sapiens
gaacuucagcccugggaau

SEQ ID NO: 281282 - RNA, 19 nt, Homo sapiens
uaaccaccguucuccaguu

SEQ ID NO: 281283 - RNA, 19 nt, Homo sapiens
caagucauucuucaaacua

SEQ ID NO: 281284 - RNA, 19 nt, Homo sapiens
ccucaacuauuacauccuu

SEQ ID NO: 281285 - RNA, 19 nt, Homo sapiens
aaccaccguucuccaguua

SEQ ID NO: 281286 - RNA, 19 nt, Homo sapiens
guacuggagagcaggauuu

SEQ ID NO: 281287 - RNA, 19 nt, Homo sapiens
gucaagggcaucagcauuu

SEQ ID NO: 281288 - RNA, 19 nt, Homo sapiens
ugauaccgccugacucuaa

SEQ ID NO: 281289 - RNA, 19 nt, Homo sapiens
gaggaaggauaucugaacu

SEQ ID NO: 281290 - RNA, 19 nt, Homo sapiens
caaacuacagggcuccuuu

SEQ ID NO: 281291 - RNA, 19 nt, Homo sapiens
gagagcaggauuugcgaaa

SEQ ID NO: 281292 - RNA, 19 nt, Homo sapiens
cugcuggcauugcugcuua

SEQ ID NO: 281293 - RNA, 19 nt, Homo sapiens
aaaguuggacuauucaaug

SEQ ID NO: 281294 - RNA, 19 nt, Homo sapiens
acaagggacugcaguaugc

SEQ ID NO: 281295 - RNA, 19 nt, Homo sapiens
gauaccgccugacucuaau

SEQ ID NO: 281296 - RNA, 19 nt, Homo sapiens
ggaacugaaagaauccaaa

SEQ ID NO: 281297 - RNA, 19 nt, Homo sapiens
gacaagggacugcaguaug

SEQ ID NO: 281298 - RNA, 19 nt, Homo sapiens
aaggauaucugaacuucuc

SEQ ID NO: 281299 - RNA, 19 nt, Homo sapiens
acaaccagauugaguccaa

SEQ ID NO: 281300 - RNA, 19 nt, Homo sapiens
caaaguuggacuauucaau

SEQ ID NO: 281301 - RNA, 19 nt, Homo sapiens
caacaaaauggucuacuuu

SEQ ID NO: 281302 - RNA, 19 nt, Homo sapiens
ugcuggaggugauguuuaa

SEQ ID NO: 281303 - RNA, 19 nt, Homo sapiens
cuacagccuuaucuccaaa

SEQ ID NO: 281304 - RNA, 19 nt, Homo sapiens
ucgccgacauugauuauag

SEQ ID NO: 281305 - RNA, 19 nt, Homo sapiens
aaguggaacugaaagaauc

SEQ ID NO: 281306 - RNA, 19 nt, Homo sapiens
gguggaaggugcgcaaguc

SEQ ID NO: 281307 - RNA, 19 nt, Homo sapiens
ucaagggcaucagcauuuc

SEQ ID NO: 281308 - RNA, 19 nt, Homo sapiens
gugcgcaagucauucuuca

SEQ ID NO: 281309 - RNA, 19 nt, Homo sapiens
ggaagcgcuccucaacuau

SEQ ID NO: 281310 - RNA, 19 nt, Homo sapiens
ggcugcagauccauaagga

SEQ ID NO: 281311 - RNA, 19 nt, Homo sapiens
uccaauacaugagaguuug

SEQ ID NO: 281312 - RNA, 19 nt, Homo sapiens
ccaaguucaaugauaaguu

SEQ ID NO: 281313 - RNA, 19 nt, Homo sapiens
acugaaagaauccaaaguu

SEQ ID NO: 281314 - RNA, 19 nt, Homo sapiens
cgacaagggacugcaguau

SEQ ID NO: 281315 - RNA, 19 nt, Homo sapiens
gacauugauuauagcuuag

SEQ ID NO: 281316 - RNA, 19 nt, Homo sapiens
uguugaaccucuuccacaa

SEQ ID NO: 281317 - RNA, 19 nt, Homo sapiens
guccaauacaugagaguuu

SEQ ID NO: 281318 - RNA, 19 nt, Homo sapiens
cagcaaggagccugucuuc

SEQ ID NO: 281319 - RNA, 19 nt, Homo sapiens
cugcuccgcuccugaacuu

SEQ ID NO: 281320 - RNA, 19 nt, Homo sapiens
caugaggaaggauaucuga

SEQ ID NO: 281321 - RNA, 19 nt, Homo sapiens
ccuccuugcugcagucaug

SEQ ID NO: 281322 - RNA, 19 nt, Homo sapiens
gcaucagcauuucggucaa

SEQ ID NO: 281323 - RNA, 19 nt, Homo sapiens
aaaguggaacugaaagaau

SEQ ID NO: 281324 - RNA, 19 nt, Homo sapiens
ucuacagccuuaucuccaa

SEQ ID NO: 281325 - RNA, 19 nt, Homo sapiens
uccgggaggcccacaguua

SEQ ID NO: 281326 - RNA, 19 nt, Homo sapiens
gguaaaaguggaacugaaa

SEQ ID NO: 281327 - RNA, 19 nt, Homo sapiens
agccuuaucuccaaacucu

SEQ ID NO: 281328 - RNA, 19 nt, Homo sapiens
ccaguuacaacagagauug

SEQ ID NO: 281329 - RNA, 19 nt, Homo sapiens
ccagauugaguccaaguuc

SEQ ID NO: 281330 - RNA, 19 nt, Homo sapiens
caacaugaaccuggaacuc

SEQ ID NO: 281331 - RNA, 19 nt, Homo sapiens
caugauaccgccugacucu

SEQ ID NO: 281332 - RNA, 19 nt, Homo sapiens
gaaggugcgcaagucauuc

SEQ ID NO: 281333 - RNA, 19 nt, Homo sapiens
cguccauacugcuggcauu

SEQ ID NO: 281334 - RNA, 19 nt, Homo sapiens
aaacuacagggcuccuuug

SEQ ID NO: 281335 - RNA, 19 nt, Homo sapiens
gaugcuggaggugauguuu

SEQ ID NO: 281336 - RNA, 19 nt, Homo sapiens
aguccaaguuccagaaagu

SEQ ID NO: 281337 - RNA, 19 nt, Homo sapiens
ccaauacaugagaguuuga

SEQ ID NO: 281338 - RNA, 19 nt, Homo sapiens
ugacaguuucgccgacauu

SEQ ID NO: 281339 - RNA, 19 nt, Homo sapiens
gaguccaaguuccagaaag

SEQ ID NO: 281340 - RNA, 19 nt, Homo sapiens
gaagcguguucagcucuac

SEQ ID NO: 281341 - RNA, 19 nt, Homo sapiens
ccugguuuaucaugaggaa

SEQ ID NO: 281342 - RNA, 19 nt, Homo sapiens
acaacaaaauggucuacuu

SEQ ID NO: 281343 - RNA, 19 nt, Homo sapiens
gggcuccuuugaugucagu

SEQ ID NO: 281344 - RNA, 19 nt, Homo sapiens
acuauuacauccuuaacac

SEQ ID NO: 281345 - RNA, 19 nt, Homo sapiens
gcuccucaacuauuacauc

SEQ ID NO: 281346 - RNA, 19 nt, Homo sapiens
gacaugauaccgccugacu

SEQ ID NO: 281347 - RNA, 19 nt, Homo sapiens
gaacagagcuugaauugaa

SEQ ID NO: 281348 - RNA, 19 nt, Homo sapiens
gaagaagacucaaguauag

SEQ ID NO: 281349 - RNA, 19 nt, Homo sapiens
ggaguucacuuuauuauga

SEQ ID NO: 281350 - RNA, 19 nt, Homo sapiens
guaaaggagugcugucuua

SEQ ID NO: 281351 - RNA, 19 nt, Homo sapiens
uaagguagcuuuagcaauu

SEQ ID NO: 281352 - RNA, 19 nt, Homo sapiens
gaaauagcaucagcagaua

SEQ ID NO: 281353 - RNA, 19 nt, Homo sapiens
ggaagaagacucaaguaua

SEQ ID NO: 281354 - RNA, 19 nt, Homo sapiens
gaagaaugcuauugauguu

SEQ ID NO: 281355 - RNA, 19 nt, Homo sapiens
gaaggaaggacauuaaauu

SEQ ID NO: 281356 - RNA, 19 nt, Homo sapiens
ccaauggcuucucuaauua

SEQ ID NO: 281357 - RNA, 19 nt, Homo sapiens
ggaaggacauuaaauucuu

SEQ ID NO: 281358 - RNA, 19 nt, Homo sapiens
ggagggaaguggaaguuaa

SEQ ID NO: 281359 - RNA, 19 nt, Homo sapiens
gaaacuuugugguuaugua

SEQ ID NO: 281360 - RNA, 19 nt, Homo sapiens
gaaggaacgccucuuauug

SEQ ID NO: 281361 - RNA, 19 nt, Homo sapiens
ggaaauagcaucagcagau

SEQ ID NO: 281362 - RNA, 19 nt, Homo sapiens
gauaucagcuacacuuugu

SEQ ID NO: 281363 - RNA, 19 nt, Homo sapiens
gaauuucccuccuccuuug

SEQ ID NO: 281364 - RNA, 19 nt, Homo sapiens
gaagagaagaagucaaauu

SEQ ID NO: 281365 - RNA, 19 nt, Homo sapiens
ggaaguggaaguuaaauug

SEQ ID NO: 281366 - RNA, 19 nt, Homo sapiens
gcaguuggcuuaaccucaa

SEQ ID NO: 281367 - RNA, 19 nt, Homo sapiens
gaaagcaguuacauagcaa

SEQ ID NO: 281368 - RNA, 19 nt, Homo sapiens
caagaaagcaguuacauag

SEQ ID NO: 281369 - RNA, 19 nt, Homo sapiens
guaaggaugugagaauuug

SEQ ID NO: 281370 - RNA, 19 nt, Homo sapiens
gagcuugaauugaaagaga

SEQ ID NO: 281371 - RNA, 19 nt, Homo sapiens
gaugugagaauuugcauuu

SEQ ID NO: 281372 - RNA, 19 nt, Homo sapiens
cuaaugcucuucuggcuuu

SEQ ID NO: 281373 - RNA, 19 nt, Homo sapiens
uaaauugacuccgcugauu

SEQ ID NO: 281374 - RNA, 19 nt, Homo sapiens
uaaauucuuucccugguaa

SEQ ID NO: 281375 - RNA, 19 nt, Homo sapiens
gaaauuugccgauggugaa

SEQ ID NO: 281376 - RNA, 19 nt, Homo sapiens
guagaaggaacgccucuua

SEQ ID NO: 281377 - RNA, 19 nt, Homo sapiens
aaagaagggccuauauuaa

SEQ ID NO: 281378 - RNA, 19 nt, Homo sapiens
gacagcaccucccagcuuu

SEQ ID NO: 281379 - RNA, 19 nt, Homo sapiens
ucaauacagugcugcaauu

SEQ ID NO: 281380 - RNA, 19 nt, Homo sapiens
auccaaagcuugcacauuu

SEQ ID NO: 281381 - RNA, 19 nt, Homo sapiens
uaaaggagaccauuuguag

SEQ ID NO: 281382 - RNA, 19 nt, Homo sapiens
gugagaaccuuugaaguga

SEQ ID NO: 281383 - RNA, 19 nt, Homo sapiens
gaaguggaaguuaaauuga

SEQ ID NO: 281384 - RNA, 19 nt, Homo sapiens
guucagaguuaaauuguuc

SEQ ID NO: 281385 - RNA, 19 nt, Homo sapiens
aggaguaccugguguguuu

SEQ ID NO: 281386 - RNA, 19 nt, Homo sapiens
gaggaaggaaggacauuaa

SEQ ID NO: 281387 - RNA, 19 nt, Homo sapiens
uguaauauauggugacuuc

SEQ ID NO: 281388 - RNA, 19 nt, Homo sapiens
gcaguuacauagcaacaca

SEQ ID NO: 281389 - RNA, 19 nt, Homo sapiens
guauguaacuuagcuuaug

SEQ ID NO: 281390 - RNA, 19 nt, Homo sapiens
gauaugcaguguuaauucu

SEQ ID NO: 281391 - RNA, 19 nt, Homo sapiens
ucucaguacuuucaaugua

SEQ ID NO: 281392 - RNA, 19 nt, Homo sapiens
aagaagggccuauauuaaa

SEQ ID NO: 281393 - RNA, 19 nt, Homo sapiens
gugcugcaauuucuggaua

SEQ ID NO: 281394 - RNA, 19 nt, Homo sapiens
uaauagaugugcauaaggu

SEQ ID NO: 281395 - RNA, 19 nt, Homo sapiens
gaguaccacuguaagaaga

SEQ ID NO: 281396 - RNA, 19 nt, Homo sapiens
aaaccugacucccuguaaa

SEQ ID NO: 281397 - RNA, 19 nt, Homo sapiens
agaagggccuauauuaaau

SEQ ID NO: 281398 - RNA, 19 nt, Homo sapiens
ggaaaugcugucuaugauu

SEQ ID NO: 281399 - RNA, 19 nt, Homo sapiens
ggaggaaggaaggacauua

SEQ ID NO: 281400 - RNA, 19 nt, Homo sapiens
aaacauaggaaggguauuu

SEQ ID NO: 281401 - RNA, 19 nt, Homo sapiens
ccgguagucuuuaaacauu

SEQ ID NO: 281402 - RNA, 19 nt, Homo sapiens
uuaaugcagucaugaaguu

SEQ ID NO: 281403 - RNA, 19 nt, Homo sapiens
ugacuccgcugauucugaa

SEQ ID NO: 281404 - RNA, 19 nt, Homo sapiens
ggaaggaaggacauuaaau

SEQ ID NO: 281405 - RNA, 19 nt, Homo sapiens
ggcuuaaccucaacuucua

SEQ ID NO: 281406 - RNA, 19 nt, Homo sapiens
aaaagaagggccuauauua

SEQ ID NO: 281407 - RNA, 19 nt, Homo sapiens
uuaaccacauucugccuua

SEQ ID NO: 281408 - RNA, 19 nt, Homo sapiens
ggaaugaggaagcguuguu

SEQ ID NO: 281409 - RNA, 19 nt, Homo sapiens
gcacuugcggccacuguuu

SEQ ID NO: 281410 - RNA, 19 nt, Homo sapiens
ccaguuggcuuuucuuaaa

SEQ ID NO: 281411 - RNA, 19 nt, Homo sapiens
gguguggguucccuuuauu

SEQ ID NO: 281412 - RNA, 19 nt, Homo sapiens
uuacauagcaacacaguau

SEQ ID NO: 281413 - RNA, 19 nt, Homo sapiens
acaagaaagcaguuacaua

SEQ ID NO: 281414 - RNA, 19 nt, Homo sapiens
gcauuugaaguguauguaa

SEQ ID NO: 281415 - RNA, 19 nt, Homo sapiens
ucacuaaacuuuuguguuc

SEQ ID NO: 281416 - RNA, 19 nt, Homo sapiens
caaguaaggaugugagaau

SEQ ID NO: 281417 - RNA, 19 nt, Homo sapiens
uccaaagcuugcacauuua

SEQ ID NO: 281418 - RNA, 19 nt, Homo sapiens
gggcaaaggacuuggaguu

SEQ ID NO: 281419 - RNA, 19 nt, Homo sapiens
agaaagcaguuacauagca

SEQ ID NO: 281420 - RNA, 19 nt, Homo sapiens
ggaaagguggcucaacuuc

SEQ ID NO: 281421 - RNA, 19 nt, Homo sapiens
uaauuguccuguaauggaa

SEQ ID NO: 281422 - RNA, 19 nt, Homo sapiens
guauagaagaugcuguuaa

SEQ ID NO: 281423 - RNA, 19 nt, Homo sapiens
uuggaugggugguuauuaa

SEQ ID NO: 281424 - RNA, 19 nt, Homo sapiens
guugauguguaaacagaaa

SEQ ID NO: 281425 - RNA, 19 nt, Homo sapiens
ccugggaguucacuuuauu

SEQ ID NO: 281426 - RNA, 19 nt, Homo sapiens
aagaagagaagaagucaaa

SEQ ID NO: 281427 - RNA, 19 nt, Homo sapiens
uaugagccauuuagauaug

SEQ ID NO: 281428 - RNA, 19 nt, Homo sapiens
gaucgguguuugaaaauuu

SEQ ID NO: 281429 - RNA, 19 nt, Homo sapiens
ccgaguaguugaucuuuua

SEQ ID NO: 281430 - RNA, 19 nt, Homo sapiens
ccaaagcuugcacauuuaa

SEQ ID NO: 281431 - RNA, 19 nt, Homo sapiens
gaagggccuauauuaaaug

SEQ ID NO: 281432 - RNA, 19 nt, Homo sapiens
ugaagaaugcuauugaugu

SEQ ID NO: 281433 - RNA, 19 nt, Homo sapiens
ugaagugucuuggccaaug

SEQ ID NO: 281434 - RNA, 19 nt, Homo sapiens
uggcgcagguuaauuauag

SEQ ID NO: 281435 - RNA, 19 nt, Homo sapiens
ggauaucagcuacacuuug

SEQ ID NO: 281436 - RNA, 19 nt, Homo sapiens
uuaaauucuuucccuggua

SEQ ID NO: 281437 - RNA, 19 nt, Homo sapiens
cuagugaaguugauauagu

SEQ ID NO: 281438 - RNA, 19 nt, Homo sapiens
cuguuaagcuuaugcaguu

SEQ ID NO: 281439 - RNA, 19 nt, Homo sapiens
gagaccauuuguagcaguu

SEQ ID NO: 281440 - RNA, 19 nt, Homo sapiens
agaaggaacgccucuuauu

SEQ ID NO: 281441 - RNA, 19 nt, Homo sapiens
gagcauauugagagaaaug

SEQ ID NO: 281442 - RNA, 19 nt, Homo sapiens
gagggaaguggaaguuaaa

SEQ ID NO: 281443 - RNA, 19 nt, Homo sapiens
ugaaguugauauagucuca

SEQ ID NO: 281444 - RNA, 19 nt, Homo sapiens
gaauuuggcuuugcuaccu

SEQ ID NO: 281445 - RNA, 19 nt, Homo sapiens
gaagugucuuggccaaugg

SEQ ID NO: 281446 - RNA, 19 nt, Homo sapiens
cuacaugcgcucuuugaaa

SEQ ID NO: 281447 - RNA, 19 nt, Homo sapiens
gaggaaggcugguacaugu

SEQ ID NO: 281448 - RNA, 19 nt, Homo sapiens
ggaaggaccgcuuuauuga

SEQ ID NO: 281449 - RNA, 19 nt, Homo sapiens
guagacugcuggaucgaua

SEQ ID NO: 281450 - RNA, 19 nt, Homo sapiens
gcucugggcucguguccaa

SEQ ID NO: 281451 - RNA, 19 nt, Homo sapiens
ggaaguauacugucuuuac

SEQ ID NO: 281452 - RNA, 19 nt, Homo sapiens
gaaagaggagcagcgcaua

SEQ ID NO: 281453 - RNA, 19 nt, Homo sapiens
gauacagcaucucaacaug

SEQ ID NO: 281454 - RNA, 19 nt, Homo sapiens
guggaaguauacugucuuu

SEQ ID NO: 281455 - RNA, 19 nt, Homo sapiens
gaaguauacugucuuuacg

SEQ ID NO: 281456 - RNA, 19 nt, Homo sapiens
gaggaccacguguucauuu

SEQ ID NO: 281457 - RNA, 19 nt, Homo sapiens
ugucuacacuugcucuauu

SEQ ID NO: 281458 - RNA, 19 nt, Homo sapiens
aaggaccgcuuuauugaug

SEQ ID NO: 281459 - RNA, 19 nt, Homo sapiens
ggauacagcaucucaacau

SEQ ID NO: 281460 - RNA, 19 nt, Homo sapiens
ggcuggaucucaacauguu

SEQ ID NO: 281461 - RNA, 19 nt, Homo sapiens
gaaggaccgcuuuauugau

SEQ ID NO: 281462 - RNA, 19 nt, Homo sapiens
uggaaggaccgcuuuauug

SEQ ID NO: 281463 - RNA, 19 nt, Homo sapiens
ggagaugcacgcugccuau

SEQ ID NO: 281464 - RNA, 19 nt, Homo sapiens
ugcagaaccuggucaacaa

SEQ ID NO: 281465 - RNA, 19 nt, Homo sapiens
aagccugucuuccucauug

SEQ ID NO: 281466 - RNA, 19 nt, Homo sapiens
ccucggcugucuacacuug

SEQ ID NO: 281467 - RNA, 19 nt, Homo sapiens
acacccagcuucaacuaca

SEQ ID NO: 281468 - RNA, 19 nt, Homo sapiens
gucuacacuugcucuauuu

SEQ ID NO: 281469 - RNA, 19 nt, Homo sapiens
gaggacuucuucaccaucu

SEQ ID NO: 281470 - RNA, 19 nt, Homo sapiens
aaagaggagcagcgcauaa

SEQ ID NO: 281471 - RNA, 19 nt, Homo sapiens
ccacacccagcuucaacua

SEQ ID NO: 281472 - RNA, 19 nt, Homo sapiens
ucaacauggucuucagcaa

SEQ ID NO: 281473 - RNA, 19 nt, Homo sapiens
cagauguggugaacuggau

SEQ ID NO: 281474 - RNA, 19 nt, Homo sapiens
ccaucuggcuggaucucaa

SEQ ID NO: 281475 - RNA, 19 nt, Homo sapiens
gcagaaccuggucaacaau

SEQ ID NO: 281476 - RNA, 19 nt, Homo sapiens
cagaggacuucuucaccau

SEQ ID NO: 281477 - RNA, 19 nt, Homo sapiens
gauccgcgucccuggcuuu

SEQ ID NO: 281478 - RNA, 19 nt, Homo sapiens
ccuucuggcuccucaaugu

SEQ ID NO: 281479 - RNA, 19 nt, Homo sapiens
gccagcaggaggaguacua

SEQ ID NO: 281480 - RNA, 19 nt, Homo sapiens
uggaugugcuaccgcaaga

SEQ ID NO: 281481 - RNA, 19 nt, Homo sapiens
gaccacguguucauuucca

SEQ ID NO: 281482 - RNA, 19 nt, Homo sapiens
gugcagaaccuggucaaca

SEQ ID NO: 281483 - RNA, 19 nt, Homo sapiens
uacagcaucucaacauggu

SEQ ID NO: 281484 - RNA, 19 nt, Homo sapiens
gcuccucaaugugcucuuc

SEQ ID NO: 281485 - RNA, 19 nt, Homo sapiens
caucauguccagcaucaag

SEQ ID NO: 281486 - RNA, 19 nt, Homo sapiens
gauaacaccaggguugucu

SEQ ID NO: 281487 - RNA, 19 nt, Homo sapiens
ugaggaaggcugguacaug

SEQ ID NO: 281488 - RNA, 19 nt, Homo sapiens
cccaucauguccagcauca

SEQ ID NO: 281489 - RNA, 19 nt, Homo sapiens
aagccaagcuggacaaacc

SEQ ID NO: 281490 - RNA, 19 nt, Homo sapiens
guacauguggcugcaguca

SEQ ID NO: 281491 - RNA, 19 nt, Homo sapiens
gaugugcuaccgcaagaca

SEQ ID NO: 281492 - RNA, 19 nt, Homo sapiens
gucccuggcuuuggcaaga

SEQ ID NO: 281493 - RNA, 19 nt, Homo sapiens
ucaagcccaugcuggucuu

SEQ ID NO: 281494 - RNA, 19 nt, Homo sapiens
cuggaaggaccgcuuuauu

SEQ ID NO: 281495 - RNA, 19 nt, Homo sapiens
gaggagcagcgcauaacca

SEQ ID NO: 281496 - RNA, 19 nt, Homo sapiens
cugugggugugcucuauga

SEQ ID NO: 281497 - RNA, 19 nt, Homo sapiens
gaagaugacuggauggaaa

SEQ ID NO: 281498 - RNA, 19 nt, Homo sapiens
gaacugccauuaucccaua

SEQ ID NO: 281499 - RNA, 19 nt, Homo sapiens
gagagguggugaaacauua

SEQ ID NO: 281500 - RNA, 19 nt, Homo sapiens
ggacauggcagcccaaauu

SEQ ID NO: 281501 - RNA, 19 nt, Homo sapiens
gccaggacuuuaucuaaua

SEQ ID NO: 281502 - RNA, 19 nt, Homo sapiens
ggacaacgguggcuucuac

SEQ ID NO: 281503 - RNA, 19 nt, Homo sapiens
caucaucacugaauacaug

SEQ ID NO: 281504 - RNA, 19 nt, Homo sapiens
gggccaaguuucccauuaa

SEQ ID NO: 281505 - RNA, 19 nt, Homo sapiens
caucaggaguucaauaaau

SEQ ID NO: 281506 - RNA, 19 nt, Homo sapiens
gcacgcugcucauccgaaa

SEQ ID NO: 281507 - RNA, 19 nt, Homo sapiens
ggugaaacauuacaagauc

SEQ ID NO: 281508 - RNA, 19 nt, Homo sapiens
cgacggagaucugggcuuu

SEQ ID NO: 281509 - RNA, 19 nt, Homo sapiens
caauaaaugucuguugaug

SEQ ID NO: 281510 - RNA, 19 nt, Homo sapiens
gaacugguccgccauuaca

SEQ ID NO: 281511 - RNA, 19 nt, Homo sapiens
gcagugugcuggaggacuu

SEQ ID NO: 281512 - RNA, 19 nt, Homo sapiens
gcacacaucaggaguucaa

SEQ ID NO: 281513 - RNA, 19 nt, Homo sapiens
gcucacacccggaagauga

SEQ ID NO: 281514 - RNA, 19 nt, Homo sapiens
ggccaggacuuuaucuaau

SEQ ID NO: 281515 - RNA, 19 nt, Homo sapiens
cagaggagcuguaccaacu

SEQ ID NO: 281516 - RNA, 19 nt, Homo sapiens
ccaacauucuggugucuga

SEQ ID NO: 281517 - RNA, 19 nt, Homo sapiens
gggagaagccugggauuga

SEQ ID NO: 281518 - RNA, 19 nt, Homo sapiens
gaaggcauggcauucauug

SEQ ID NO: 281519 - RNA, 19 nt, Homo sapiens
gaaugggagucuaguggau

SEQ ID NO: 281520 - RNA, 19 nt, Homo sapiens
gagcccaucuacaucauca

SEQ ID NO: 281521 - RNA, 19 nt, Homo sapiens
ugacacauaugcaccuugu

SEQ ID NO: 281522 - RNA, 19 nt, Homo sapiens
acacgaagguggcggugaa

SEQ ID NO: 281523 - RNA, 19 nt, Homo sapiens
ggagagguggugaaacauu

SEQ ID NO: 281524 - RNA, 19 nt, Homo sapiens
acccugagcugcaagauug

SEQ ID NO: 281525 - RNA, 19 nt, Homo sapiens
uugaagagcggaauuauau

SEQ ID NO: 281526 - RNA, 19 nt, Homo sapiens
ccaucuacaucaucacuga

SEQ ID NO: 281527 - RNA, 19 nt, Homo sapiens
gggccaggacuuuaucuaa

SEQ ID NO: 281528 - RNA, 19 nt, Homo sapiens
ugugagaacugccauuauc

SEQ ID NO: 281529 - RNA, 19 nt, Homo sapiens
gaggagcuguaccaacuca

SEQ ID NO: 281530 - RNA, 19 nt, Homo sapiens
ucaacaaacuccuggacau

SEQ ID NO: 281531 - RNA, 19 nt, Homo sapiens
ggacucugcacaugucuug

SEQ ID NO: 281532 - RNA, 19 nt, Homo sapiens
uauggacucugcacaugaa

SEQ ID NO: 281533 - RNA, 19 nt, Homo sapiens
agucagauguguggucuuu

SEQ ID NO: 281534 - RNA, 19 nt, Homo sapiens
cugaauacauggagaaugg

SEQ ID NO: 281535 - RNA, 19 nt, Homo sapiens
gcagaaggcauggcauuca

SEQ ID NO: 281536 - RNA, 19 nt, Homo sapiens
cacaucaggaguucaauaa

SEQ ID NO: 281537 - RNA, 19 nt, Homo sapiens
cauauggacucugcacaug

SEQ ID NO: 281538 - RNA, 19 nt, Homo sapiens
gugcgggacccacugguua

SEQ ID NO: 281539 - RNA, 19 nt, Homo sapiens
guaccagccucagccuuga

SEQ ID NO: 281540 - RNA, 19 nt, Homo sapiens
gggacccacugguuaccua

SEQ ID NO: 281541 - RNA, 19 nt, Homo sapiens
ggagaucugggcuuugaga

SEQ ID NO: 281542 - RNA, 19 nt, Homo sapiens
ucacauggccuaugcacau

SEQ ID NO: 281543 - RNA, 19 nt, Homo sapiens
ggacauucaccaucaaguc

SEQ ID NO: 281544 - RNA, 19 nt, Homo sapiens
caacaaacuccuggacaug

SEQ ID NO: 281545 - RNA, 19 nt, Homo sapiens
gagcuguaccaacucauga

SEQ ID NO: 281546 - RNA, 19 nt, Homo sapiens
ccaaguuucccauuaagug

SEQ ID NO: 281547 - RNA, 19 nt, Homo sapiens
agggagagguggugaaaca

SEQ ID NO: 281548 - RNA, 19 nt, Homo sapiens
ggagaagccugggauugac

SEQ ID NO: 281549 - RNA, 19 nt, Homo sapiens
gaaucccacccacauguga

SEQ ID NO: 281550 - RNA, 19 nt, Homo sapiens
acacaucaggaguucaaua

SEQ ID NO: 281551 - RNA, 19 nt, Homo sapiens
cgccagaagccauuaacua

SEQ ID NO: 281552 - RNA, 19 nt, Homo sapiens
auaaaugucuguugaugac

SEQ ID NO: 281553 - RNA, 19 nt, Homo sapiens
ggaagaugacuggauggaa

SEQ ID NO: 281554 - RNA, 19 nt, Homo sapiens
acggagaucugggcuuuga

SEQ ID NO: 281555 - RNA, 19 nt, Homo sapiens
ucauugaggacaacgagua

SEQ ID NO: 281556 - RNA, 19 nt, Homo sapiens
cagaaggcauggcauucau

SEQ ID NO: 281557 - RNA, 19 nt, Homo sapiens
ucaugaggcugugcuggaa

SEQ ID NO: 281558 - RNA, 19 nt, Homo sapiens
gacauucaccaucaaguca

SEQ ID NO: 281559 - RNA, 19 nt, Homo sapiens
ucauugaagagcggaauua

SEQ ID NO: 281560 - RNA, 19 nt, Homo sapiens
ucuacaucaucacugaaua

SEQ ID NO: 281561 - RNA, 19 nt, Homo sapiens
ucaagggccaggacuuuau

SEQ ID NO: 281562 - RNA, 19 nt, Homo sapiens
ggugcgcccugacaacugu

SEQ ID NO: 281563 - RNA, 19 nt, Homo sapiens
gccagaagccauuaacuac

SEQ ID NO: 281564 - RNA, 19 nt, Homo sapiens
gacauggcagcccaaauug

SEQ ID NO: 281565 - RNA, 19 nt, Homo sapiens
cuuucuggcucucccauuu

SEQ ID NO: 281566 - RNA, 19 nt, Homo sapiens
ccacagagggccaguacca

SEQ ID NO: 281567 - RNA, 19 nt, Homo sapiens
acccggaggugauucagaa

SEQ ID NO: 281568 - RNA, 19 nt, Homo sapiens
uuacaccaaugcuucagau

SEQ ID NO: 281569 - RNA, 19 nt, Homo sapiens
caacgguggcuucuacauc

SEQ ID NO: 281570 - RNA, 19 nt, Homo sapiens
ccaggacuuuaucuaauac

SEQ ID NO: 281571 - RNA, 19 nt, Homo sapiens
ggagcuguaccaacucaug

SEQ ID NO: 281572 - RNA, 19 nt, Homo sapiens
ggccaaguuucccauuaag

SEQ ID NO: 281573 - RNA, 19 nt, Homo sapiens
uguguagccugugcaugua

SEQ ID NO: 281574 - RNA, 19 nt, Homo sapiens
uacgggacauucaccauca

SEQ ID NO: 281575 - RNA, 19 nt, Homo sapiens
ccuucgggcugccaacauu

SEQ ID NO: 281576 - RNA, 19 nt, Homo sapiens
gguccgccauuacaccaau

SEQ ID NO: 281577 - RNA, 19 nt, Homo sapiens
aucaggaguucaauaaaug

SEQ ID NO: 281578 - RNA, 19 nt, Homo sapiens
ccucaagggccaggacuuu

SEQ ID NO: 281579 - RNA, 19 nt, Homo sapiens
ccucagaucauccagaagu

SEQ ID NO: 281580 - RNA, 19 nt, Homo sapiens
gaccaacccggaggugauu

SEQ ID NO: 281581 - RNA, 19 nt, Homo sapiens
ucacugaauacauggagaa

SEQ ID NO: 281582 - RNA, 19 nt, Homo sapiens
ucagauguguggucuuuug

SEQ ID NO: 281583 - RNA, 19 nt, Homo sapiens
ucacggcuccuuccucauc

SEQ ID NO: 281584 - RNA, 19 nt, Homo sapiens
gcagcucacacccggaaga

SEQ ID NO: 281585 - RNA, 19 nt, Homo sapiens
ggagaaugggagucuagug

SEQ ID NO: 281586 - RNA, 19 nt, Homo sapiens
ccagggagagguggugaaa

SEQ ID NO: 281587 - RNA, 19 nt, Homo sapiens
ugugugagaacugccauua

SEQ ID NO: 281588 - RNA, 19 nt, Homo sapiens
guucaauaaaugucuguug

SEQ ID NO: 281589 - RNA, 19 nt, Homo sapiens
ccugagaccaccagagaga

SEQ ID NO: 281590 - RNA, 19 nt, Homo sapiens
ggggccaaguuucccauua

SEQ ID NO: 281591 - RNA, 19 nt, Homo sapiens
ugaagagcggaauuauauu

SEQ ID NO: 281592 - RNA, 19 nt, Homo sapiens
auaugcaccuugugucugu

SEQ ID NO: 281593 - RNA, 19 nt, Homo sapiens
uuaucgcucugcacagcua

SEQ ID NO: 281594 - RNA, 19 nt, Homo sapiens
caggagcccaucuacauca

SEQ ID NO: 281595 - RNA, 19 nt, Homo sapiens
ucaugaagcagcugcaaca

SEQ ID NO: 281596 - RNA, 19 nt, Homo sapiens
aggccaaccucaugaagca

SEQ ID NO: 281597 - RNA, 19 nt, Homo sapiens
auaaagagcuucagcaguu

SEQ ID NO: 281598 - RNA, 19 nt, Homo sapiens
gaaggaccacuacaucuuu

SEQ ID NO: 281599 - RNA, 19 nt, Homo sapiens
uaaagagcuucagcaguua

SEQ ID NO: 281600 - RNA, 19 nt, Homo sapiens
gcaagcacguggcauacau

SEQ ID NO: 281601 - RNA, 19 nt, Homo sapiens
ggaguucccugagaugaau

SEQ ID NO: 281602 - RNA, 19 nt, Homo sapiens
gcacguggcauacaucauc

SEQ ID NO: 281603 - RNA, 19 nt, Homo sapiens
ggacucagacuccggagau

SEQ ID NO: 281604 - RNA, 19 nt, Homo sapiens
ugaaggccguccuggagaa

SEQ ID NO: 281605 - RNA, 19 nt, Homo sapiens
caaggucaccaugcugaua

SEQ ID NO: 281606 - RNA, 19 nt, Homo sapiens
acgaggagauucaggaugu

SEQ ID NO: 281607 - RNA, 19 nt, Homo sapiens
gcagagaccccaagaacaa

SEQ ID NO: 281608 - RNA, 19 nt, Homo sapiens
cgucagccuuggccucauu

SEQ ID NO: 281609 - RNA, 19 nt, Homo sapiens
ugaaggaccacuacaucuu

SEQ ID NO: 281610 - RNA, 19 nt, Homo sapiens
gcacggagagcauccucau

SEQ ID NO: 281611 - RNA, 19 nt, Homo sapiens
aaacugacgagccgggaaa

SEQ ID NO: 281612 - RNA, 19 nt, Homo sapiens
ggagauucaggauguguca

SEQ ID NO: 281613 - RNA, 19 nt, Homo sapiens
ucuccugguucuccauaaa

SEQ ID NO: 281614 - RNA, 19 nt, Homo sapiens
gaaggccguccuggagaaa

SEQ ID NO: 281615 - RNA, 19 nt, Homo sapiens
gcacgugaaggaccacuac

SEQ ID NO: 281616 - RNA, 19 nt, Homo sapiens
ucaggucgcacgugaagga

SEQ ID NO: 281617 - RNA, 19 nt, Homo sapiens
aaagagcuucagcaguuaa

SEQ ID NO: 281618 - RNA, 19 nt, Homo sapiens
aaggucaccaugcugauaa

SEQ ID NO: 281619 - RNA, 19 nt, Homo sapiens
caucaggucgcacgugaag

SEQ ID NO: 281620 - RNA, 19 nt, Homo sapiens
ggaagccuuggaggacuuu

SEQ ID NO: 281621 - RNA, 19 nt, Homo sapiens
uggaagccuuggaggacuu

SEQ ID NO: 281622 - RNA, 19 nt, Homo sapiens
gugaaggaccacuacaucu

SEQ ID NO: 281623 - RNA, 19 nt, Homo sapiens
ucuaugagcugaaagaaga

SEQ ID NO: 281624 - RNA, 19 nt, Homo sapiens
gagcugacuucggaacuaa

SEQ ID NO: 281625 - RNA, 19 nt, Homo sapiens
ggagcugacuucggaacua

SEQ ID NO: 281626 - RNA, 19 nt, Homo sapiens
gaaccaaggagcugacuuc

SEQ ID NO: 281627 - RNA, 19 nt, Homo sapiens
uaagaguuacccuggauua

SEQ ID NO: 281628 - RNA, 19 nt, Homo sapiens
gaagacaagagcuacaaug

SEQ ID NO: 281629 - RNA, 19 nt, Homo sapiens
ugggcaacauuaagaguua

SEQ ID NO: 281630 - RNA, 19 nt, Homo sapiens
gaacuaaaggagaacuuca

SEQ ID NO: 281631 - RNA, 19 nt, Homo sapiens
ugaaagaagacaagagcua

SEQ ID NO: 281632 - RNA, 19 nt, Homo sapiens
gaacuuccaggacaaccaa

SEQ ID NO: 281633 - RNA, 19 nt, Homo sapiens
uaucugggccucccugaaa

SEQ ID NO: 281634 - RNA, 19 nt, Homo sapiens
gaagacaaagacccgcaaa

SEQ ID NO: 281635 - RNA, 19 nt, Homo sapiens
cuucggaacuaaaggagaa

SEQ ID NO: 281636 - RNA, 19 nt, Homo sapiens
caccaucuaugagcugaaa

SEQ ID NO: 281637 - RNA, 19 nt, Homo sapiens
cgucuucccugucccaauc

SEQ ID NO: 281638 - RNA, 19 nt, Homo sapiens
ggaacuaaaggagaacuuc

SEQ ID NO: 281639 - RNA, 19 nt, Homo sapiens
ucaccuccguccuguuuag

SEQ ID NO: 281640 - RNA, 19 nt, Homo sapiens
uacccuggauuaacgaguu

SEQ ID NO: 281641 - RNA, 19 nt, Homo sapiens
gaucaggacuuuuguucca

SEQ ID NO: 281642 - RNA, 19 nt, Homo sapiens
ugucaccuccguccuguuu

SEQ ID NO: 281643 - RNA, 19 nt, Homo sapiens
uguaugccaccaucuauga

SEQ ID NO: 281644 - RNA, 19 nt, Homo sapiens
ucauccgcuucuccaaaua

SEQ ID NO: 281645 - RNA, 19 nt, Homo sapiens
gacaaagacccgcaaaaga

SEQ ID NO: 281646 - RNA, 19 nt, Homo sapiens
agggaguacuucaagauca

SEQ ID NO: 281647 - RNA, 19 nt, Homo sapiens
acuacuggaucaggacuuu

SEQ ID NO: 281648 - RNA, 19 nt, Homo sapiens
ugacuucggaacuaaagga

SEQ ID NO: 281649 - RNA, 19 nt, Homo sapiens
aagacaagagcuacaaugu

SEQ ID NO: 281650 - RNA, 19 nt, Homo sapiens
gagcugaaagaagacaaga

SEQ ID NO: 281651 - RNA, 19 nt, Homo sapiens
gggaguacuucaagaucac

SEQ ID NO: 281652 - RNA, 19 nt, Homo sapiens
ucacgcugggcaacauuaa

SEQ ID NO: 281653 - RNA, 19 nt, Homo sapiens
acaaagacccgcaaaagau

SEQ ID NO: 281654 - RNA, 19 nt, Homo sapiens
cauccgcuucuccaaauau

SEQ ID NO: 281655 - RNA, 19 nt, Homo sapiens
ccaucuaugagcugaaaga

SEQ ID NO: 281656 - RNA, 19 nt, Homo sapiens
gauagaagcugcaguggua

SEQ ID NO: 281657 - RNA, 19 nt, Homo sapiens
ugaagaagcuugagaauug

SEQ ID NO: 281658 - RNA, 19 nt, Homo sapiens
gcuaauaccugucaacauu

SEQ ID NO: 281659 - RNA, 19 nt, Homo sapiens
gaauguuacugccuuaaua

SEQ ID NO: 281660 - RNA, 19 nt, Homo sapiens
gaaguaagccucaucauca

SEQ ID NO: 281661 - RNA, 19 nt, Homo sapiens
ucaaugagguaucuucuuu

SEQ ID NO: 281662 - RNA, 19 nt, Homo sapiens
ggcauuagcccucacauua

SEQ ID NO: 281663 - RNA, 19 nt, Homo sapiens
ccaaggagguguaauggaa

SEQ ID NO: 281664 - RNA, 19 nt, Homo sapiens
gaucuaacaucuugaauac

SEQ ID NO: 281665 - RNA, 19 nt, Homo sapiens
gagcuuagcauaucugauu

SEQ ID NO: 281666 - RNA, 19 nt, Homo sapiens
gaacuuggcucugaacucu

SEQ ID NO: 281667 - RNA, 19 nt, Homo sapiens
cgaaugaucucuuuaaugc

SEQ ID NO: 281668 - RNA, 19 nt, Homo sapiens
uaaaccaacugaaggcuaa

SEQ ID NO: 281669 - RNA, 19 nt, Homo sapiens
aaacacgaaugaucucuuu

SEQ ID NO: 281670 - RNA, 19 nt, Homo sapiens
caaguagccucuccuguau

SEQ ID NO: 281671 - RNA, 19 nt, Homo sapiens
gccagaaggucaaugauga

SEQ ID NO: 281672 - RNA, 19 nt, Homo sapiens
gaagguauacacugaauau

SEQ ID NO: 281673 - RNA, 19 nt, Homo sapiens
guucauccaucucuaguuu

SEQ ID NO: 281674 - RNA, 19 nt, Homo sapiens
gaaggaaaccgcacucuca

SEQ ID NO: 281675 - RNA, 19 nt, Homo sapiens
gcacagauguugccaagac

SEQ ID NO: 281676 - RNA, 19 nt, Homo sapiens
ugagguaucuucuuuagug

SEQ ID NO: 281677 - RNA, 19 nt, Homo sapiens
ccaaguagccucuccugua

SEQ ID NO: 281678 - RNA, 19 nt, Homo sapiens
gagaagagcggacauuuag

SEQ ID NO: 281679 - RNA, 19 nt, Homo sapiens
uagcauaucugauuguugu

SEQ ID NO: 281680 - RNA, 19 nt, Homo sapiens
gauaagaaaugguggaacu

SEQ ID NO: 281681 - RNA, 19 nt, Homo sapiens
gaggaucaguguccgauga

SEQ ID NO: 281682 - RNA, 19 nt, Homo sapiens
caagaucuguuaccuaaag

SEQ ID NO: 281683 - RNA, 19 nt, Homo sapiens
cagaagaccugguugaagu

SEQ ID NO: 281684 - RNA, 19 nt, Homo sapiens
gaauacaaauugguugguu

SEQ ID NO: 281685 - RNA, 19 nt, Homo sapiens
gaacucagcagaaaugaag

SEQ ID NO: 281686 - RNA, 19 nt, Homo sapiens
ugcaagaucuguuaccuaa

SEQ ID NO: 281687 - RNA, 19 nt, Homo sapiens
gaaaugcauugcucuggau

SEQ ID NO: 281688 - RNA, 19 nt, Homo sapiens
ggcccaaccuccuauauau

SEQ ID NO: 281689 - RNA, 19 nt, Homo sapiens
ggaagaaucaagcgaaguu

SEQ ID NO: 281690 - RNA, 19 nt, Homo sapiens
gugagagccuggaggauuu

SEQ ID NO: 281691 - RNA, 19 nt, Homo sapiens
gaauauccucgaagaaauu

SEQ ID NO: 281692 - RNA, 19 nt, Homo sapiens
gagaagguauacacugaau

SEQ ID NO: 281693 - RNA, 19 nt, Homo sapiens
gaagagcggacauuuagga

SEQ ID NO: 281694 - RNA, 19 nt, Homo sapiens
gagauggcauuguccuuug

SEQ ID NO: 281695 - RNA, 19 nt, Homo sapiens
cuaauuuacuggacaaaga

SEQ ID NO: 281696 - RNA, 19 nt, Homo sapiens
ucuagagccuucagccuua

SEQ ID NO: 281697 - RNA, 19 nt, Homo sapiens
guacaagucugccuguucu

SEQ ID NO: 281698 - RNA, 19 nt, Homo sapiens
ucuguuaccuaaagcaaua

SEQ ID NO: 281699 - RNA, 19 nt, Homo sapiens
ccaggaagaaagaauguua

SEQ ID NO: 281700 - RNA, 19 nt, Homo sapiens
gcauggagcuauaacuaag

SEQ ID NO: 281701 - RNA, 19 nt, Homo sapiens
cagguuccauuaacuauga

SEQ ID NO: 281702 - RNA, 19 nt, Homo sapiens
gaagaagcuugagaauugu

SEQ ID NO: 281703 - RNA, 19 nt, Homo sapiens
agacacaauugaugaaaga

SEQ ID NO: 281704 - RNA, 19 nt, Homo sapiens
gcauugcucuggaucuguu

SEQ ID NO: 281705 - RNA, 19 nt, Homo sapiens
gacaaagaauuccaaagca

SEQ ID NO: 281706 - RNA, 19 nt, Homo sapiens
aaucuaugcuggauaagaa

SEQ ID NO: 281707 - RNA, 19 nt, Homo sapiens
ugaauacucugcccucuag

SEQ ID NO: 281708 - RNA, 19 nt, Homo sapiens
aaacuggagucccaaaugu

SEQ ID NO: 281709 - RNA, 19 nt, Homo sapiens
ucaaucauuuguacaguga

SEQ ID NO: 281710 - RNA, 19 nt, Homo sapiens
caggugaucuggaccaaga

SEQ ID NO: 281711 - RNA, 19 nt, Homo sapiens
aaagaauguuacugccuua

SEQ ID NO: 281712 - RNA, 19 nt, Homo sapiens
caaagaauuccaaagcaaa

SEQ ID NO: 281713 - RNA, 19 nt, Homo sapiens
ggacaaagaauuccaaagc

SEQ ID NO: 281714 - RNA, 19 nt, Homo sapiens
gaaaugaagcucugauugc

SEQ ID NO: 281715 - RNA, 19 nt, Homo sapiens
ggagauggcauuguccuuu

SEQ ID NO: 281716 - RNA, 19 nt, Homo sapiens
acaaagaauuccaaagcaa

SEQ ID NO: 281717 - RNA, 19 nt, Homo sapiens
gaaugaaucuaugcuggau

SEQ ID NO: 281718 - RNA, 19 nt, Homo sapiens
gugaaaagcuccaucaaug

SEQ ID NO: 281719 - RNA, 19 nt, Homo sapiens
cauuagaucuaguuacugu

SEQ ID NO: 281720 - RNA, 19 nt, Homo sapiens
cagguacccuucucgcuuu

SEQ ID NO: 281721 - RNA, 19 nt, Homo sapiens
ugaauauccucgaagaaau

SEQ ID NO: 281722 - RNA, 19 nt, Homo sapiens
gaugaaagaacaaucaaca

SEQ ID NO: 281723 - RNA, 19 nt, Homo sapiens
guauagaguacgagaaauu

SEQ ID NO: 281724 - RNA, 19 nt, Homo sapiens
gagcuaauuuacuggacaa

SEQ ID NO: 281725 - RNA, 19 nt, Homo sapiens
uaauaccugucaacauuug

SEQ ID NO: 281726 - RNA, 19 nt, Homo sapiens
caucagagccuuuccucaa

SEQ ID NO: 281727 - RNA, 19 nt, Homo sapiens
gagcggacauuuaggaacu

SEQ ID NO: 281728 - RNA, 19 nt, Homo sapiens
gagagaagagcggacauuu

SEQ ID NO: 281729 - RNA, 19 nt, Homo sapiens
gcaagacgcccucuaucau

SEQ ID NO: 281730 - RNA, 19 nt, Homo sapiens
ggaacugcguuaugaagag

SEQ ID NO: 281731 - RNA, 19 nt, Homo sapiens
caucacaccugcccuaaac

SEQ ID NO: 281732 - RNA, 19 nt, Homo sapiens
aaucugaacuuggcucuga

SEQ ID NO: 281733 - RNA, 19 nt, Homo sapiens
cauuagcccucacauuaga

SEQ ID NO: 281734 - RNA, 19 nt, Homo sapiens
cggcaggcauggagcuaua

SEQ ID NO: 281735 - RNA, 19 nt, Homo sapiens
aaacugggaggcaauauga

SEQ ID NO: 281736 - RNA, 19 nt, Homo sapiens
agagaagagcggacauuua

SEQ ID NO: 281737 - RNA, 19 nt, Homo sapiens
caucaagauuggguuguuu

SEQ ID NO: 281738 - RNA, 19 nt, Homo sapiens
gcagugguauuaauuuuga

SEQ ID NO: 281739 - RNA, 19 nt, Homo sapiens
caacaaaauuggcaacuuc

SEQ ID NO: 281740 - RNA, 19 nt, Homo sapiens
acaaagcccuggaaaauga

SEQ ID NO: 281741 - RNA, 19 nt, Homo sapiens
gauccaaggagguguaaug

SEQ ID NO: 281742 - RNA, 19 nt, Homo sapiens
ggucagcauuugaucuguu

SEQ ID NO: 281743 - RNA, 19 nt, Homo sapiens
aguagccucuccuguauuu

SEQ ID NO: 281744 - RNA, 19 nt, Homo sapiens
gcagguggcuccaaaagga

SEQ ID NO: 281745 - RNA, 19 nt, Homo sapiens
guuguuugcugacauugaa

SEQ ID NO: 281746 - RNA, 19 nt, Homo sapiens
ggaaaaugauccugauugu

SEQ ID NO: 281747 - RNA, 19 nt, Homo sapiens
guacgagaaauuacagaaa

SEQ ID NO: 281748 - RNA, 19 nt, Homo sapiens
caaagcaauugaaaugcau

SEQ ID NO: 281749 - RNA, 19 nt, Homo sapiens
ucaaggacccgaagauuag

SEQ ID NO: 281750 - RNA, 19 nt, Homo sapiens
gcaauaugaagaagcuuga

SEQ ID NO: 281751 - RNA, 19 nt, Homo sapiens
ggauacaucagcuucaaug

SEQ ID NO: 281752 - RNA, 19 nt, Homo sapiens
acacgaaugaucucuuuaa

SEQ ID NO: 281753 - RNA, 19 nt, Homo sapiens
ugaguugaaugacuuguuc

SEQ ID NO: 281754 - RNA, 19 nt, Homo sapiens
gcacccaacacuccuauuc

SEQ ID NO: 281755 - RNA, 19 nt, Homo sapiens
ggccauauuaucaauguuu

SEQ ID NO: 281756 - RNA, 19 nt, Homo sapiens
ucaagaagcucaacuauaa

SEQ ID NO: 281757 - RNA, 19 nt, Homo sapiens
gaagagagaaugaugaaga

SEQ ID NO: 281758 - RNA, 19 nt, Homo sapiens
gaaggaaagucaaguuuac

SEQ ID NO: 281759 - RNA, 19 nt, Homo sapiens
ggaggaagagaauucauua

SEQ ID NO: 281760 - RNA, 19 nt, Homo sapiens
gaagaagacgauuaugaaa

SEQ ID NO: 281761 - RNA, 19 nt, Homo sapiens
gacaaacacuuaggacuga

SEQ ID NO: 281762 - RNA, 19 nt, Homo sapiens
aaaccaggauggcacauuu

SEQ ID NO: 281763 - RNA, 19 nt, Homo sapiens
caacagaccaccuaucaga

SEQ ID NO: 281764 - RNA, 19 nt, Homo sapiens
ggaggaugauggagacuau

SEQ ID NO: 281765 - RNA, 19 nt, Homo sapiens
agaaggcagugaagaagua

SEQ ID NO: 281766 - RNA, 19 nt, Homo sapiens
ccuaugagcuccaacacuu

SEQ ID NO: 281767 - RNA, 19 nt, Homo sapiens
aaacaacaaccaauccaua

SEQ ID NO: 281768 - RNA, 19 nt, Homo sapiens
gaacccagcagaagcagaa

SEQ ID NO: 281769 - RNA, 19 nt, Homo sapiens
ggaaagaaaccaccauuuu

SEQ ID NO: 281770 - RNA, 19 nt, Homo sapiens
ugaagaagacgauuaugaa

SEQ ID NO: 281771 - RNA, 19 nt, Homo sapiens
gagagaaugaugaagauga

SEQ ID NO: 281772 - RNA, 19 nt, Homo sapiens
agaagacgauuaugaaagu

SEQ ID NO: 281773 - RNA, 19 nt, Homo sapiens
aaugaagacugucaacuau

SEQ ID NO: 281774 - RNA, 19 nt, Homo sapiens
gcucccugcuccuucaaua

SEQ ID NO: 281775 - RNA, 19 nt, Homo sapiens
ggaagaggcacccguggaa

SEQ ID NO: 281776 - RNA, 19 nt, Homo sapiens
gaagagaggaggagcaucu

SEQ ID NO: 281777 - RNA, 19 nt, Homo sapiens
gucaggaaaucaacaagaa

SEQ ID NO: 281778 - RNA, 19 nt, Homo sapiens
caacaaccaauccauaugu

SEQ ID NO: 281779 - RNA, 19 nt, Homo sapiens
uaaguuaagucaggaaauc

SEQ ID NO: 281780 - RNA, 19 nt, Homo sapiens
gaagaaguaccacaucgau

SEQ ID NO: 281781 - RNA, 19 nt, Homo sapiens
aaaugaagacugucaacua

SEQ ID NO: 281782 - RNA, 19 nt, Homo sapiens
agaaggaaagucaaguuua

SEQ ID NO: 281783 - RNA, 19 nt, Homo sapiens
agagaacccuucacacuag

SEQ ID NO: 281784 - RNA, 19 nt, Homo sapiens
gaagaacccagcagaagca

SEQ ID NO: 281785 - RNA, 19 nt, Homo sapiens
gucaauggacaaacacuua

SEQ ID NO: 281786 - RNA, 19 nt, Homo sapiens
gugguacguuucuuauauu

SEQ ID NO: 281787 - RNA, 19 nt, Homo sapiens
ucaaggcccuagcaacaga

SEQ ID NO: 281788 - RNA, 19 nt, Homo sapiens
uagagaacccuucacacua

SEQ ID NO: 281789 - RNA, 19 nt, Homo sapiens
gaagaugacgcggauuaug

SEQ ID NO: 281790 - RNA, 19 nt, Homo sapiens
gaaaagacaucggcuccaa

SEQ ID NO: 281791 - RNA, 19 nt, Homo sapiens
cagauaccagugcacauua

SEQ ID NO: 281792 - RNA, 19 nt, Homo sapiens
ccagauccguuaucagaag

SEQ ID NO: 281793 - RNA, 19 nt, Homo sapiens
aaugaagagugguacguuu

SEQ ID NO: 281794 - RNA, 19 nt, Homo sapiens
aaaaugacauccagaaguu

SEQ ID NO: 281795 - RNA, 19 nt, Homo sapiens
cagaaggaaagucaaguuu

SEQ ID NO: 281796 - RNA, 19 nt, Homo sapiens
cagaagcugcucuuagaaa

SEQ ID NO: 281797 - RNA, 19 nt, Homo sapiens
agugguacguuucuuauau

SEQ ID NO: 281798 - RNA, 19 nt, Homo sapiens
gaggaagagaauucauuaa

SEQ ID NO: 281799 - RNA, 19 nt, Homo sapiens
gugccucccugccaccaua

SEQ ID NO: 281800 - RNA, 19 nt, Homo sapiens
uggaagaugacgcggauua

SEQ ID NO: 281801 - RNA, 19 nt, Homo sapiens
ggucguccuuugaagaaga

SEQ ID NO: 281802 - RNA, 19 nt, Homo sapiens
gggugccgauucucaguaa

SEQ ID NO: 281803 - RNA, 19 nt, Homo sapiens
ccuccgagcucuggauuug

SEQ ID NO: 281804 - RNA, 19 nt, Homo sapiens
gcaaagcucccugcuccuu

SEQ ID NO: 281805 - RNA, 19 nt, Homo sapiens
ggaaaucaacaagaacgaa

SEQ ID NO: 281806 - RNA, 19 nt, Homo sapiens
agauaccagugcacauuaa

SEQ ID NO: 281807 - RNA, 19 nt, Homo sapiens
cagaagagagaaugaugaa

SEQ ID NO: 281808 - RNA, 19 nt, Homo sapiens
ggaccagacagaagagaga

SEQ ID NO: 281809 - RNA, 19 nt, Homo sapiens
gaagccaccugugccaaag

SEQ ID NO: 281810 - RNA, 19 nt, Homo sapiens
ccagauaccagugcacauu

SEQ ID NO: 281811 - RNA, 19 nt, Homo sapiens
cauauguccucaugguguu

SEQ ID NO: 281812 - RNA, 19 nt, Homo sapiens
gagcauuuacccaagauuc

SEQ ID NO: 281813 - RNA, 19 nt, Homo sapiens
cgaggaagcucugcagaac

SEQ ID NO: 281814 - RNA, 19 nt, Homo sapiens
aagaugacgcggauuauga

SEQ ID NO: 281815 - RNA, 19 nt, Homo sapiens
gagaggaggagcaucuuca

SEQ ID NO: 281816 - RNA, 19 nt, Homo sapiens
caauccauauguccucaug

SEQ ID NO: 281817 - RNA, 19 nt, Homo sapiens
ugaugaagaugaugugcau

SEQ ID NO: 281818 - RNA, 19 nt, Homo sapiens
gugagaaggcagugaagaa

SEQ ID NO: 281819 - RNA, 19 nt, Homo sapiens
agagaaugaugaagaugau

SEQ ID NO: 281820 - RNA, 19 nt, Homo sapiens
aagagagaaugaugaagau

SEQ ID NO: 281821 - RNA, 19 nt, Homo sapiens
ccacuucugcucauugaug

SEQ ID NO: 281822 - RNA, 19 nt, Homo sapiens
gagugguacguuucuuaua

SEQ ID NO: 281823 - RNA, 19 nt, Homo sapiens
gcucaacuauaaggacugu

SEQ ID NO: 281824 - RNA, 19 nt, Homo sapiens
ggaagaugacgcggauuau

SEQ ID NO: 281825 - RNA, 19 nt, Homo sapiens
gacagaagagagaaugaug

SEQ ID NO: 281826 - RNA, 19 nt, Homo sapiens
uaugaaagucccaaugaug

SEQ ID NO: 281827 - RNA, 19 nt, Homo sapiens
gaaaaugacauccagaagu

SEQ ID NO: 281828 - RNA, 19 nt, Homo sapiens
ucaaucagccuuggucaau

SEQ ID NO: 281829 - RNA, 19 nt, Homo sapiens
ccauggcacugaggaaugu

SEQ ID NO: 281830 - RNA, 19 nt, Homo sapiens
guacguuucuuauauuacc

SEQ ID NO: 281831 - RNA, 19 nt, Homo sapiens
ccaccauacuucucucaag

SEQ ID NO: 281832 - RNA, 19 nt, Homo sapiens
ucaacuauaaggacuguga

SEQ ID NO: 281833 - RNA, 19 nt, Homo sapiens
gaagacgauuaugaaaguc

SEQ ID NO: 281834 - RNA, 19 nt, Homo sapiens
agacagaaagccacgaaga

SEQ ID NO: 281835 - RNA, 19 nt, Homo sapiens
gaaaugaagacugucaacu

SEQ ID NO: 281836 - RNA, 19 nt, Homo sapiens
aagaggacuuucugucugu

SEQ ID NO: 281837 - RNA, 19 nt, Homo sapiens
caacauccagauccguuau

SEQ ID NO: 281838 - RNA, 19 nt, Homo sapiens
agaagcugcucuuagaaag

SEQ ID NO: 281839 - RNA, 19 nt, Homo sapiens
ccgauucucaguaaguuaa

SEQ ID NO: 281840 - RNA, 19 nt, Homo sapiens
ugaagacugucaacuaucc

SEQ ID NO: 281841 - RNA, 19 nt, Homo sapiens
gguuuuauccuuuccuuua

SEQ ID NO: 281842 - RNA, 19 nt, Homo sapiens
caaucagccuuggucaaug

SEQ ID NO: 281843 - RNA, 19 nt, Homo sapiens
ccagcacuacuuccuauga

SEQ ID NO: 281844 - RNA, 19 nt, Homo sapiens
uagcuccguuugauagaga

SEQ ID NO: 281845 - RNA, 19 nt, Homo sapiens
aaagcucccugcuccuuca

SEQ ID NO: 281846 - RNA, 19 nt, Homo sapiens
ccaacuccauguacaucga

SEQ ID NO: 281847 - RNA, 19 nt, Homo sapiens
uugaagaagacgauuauga

SEQ ID NO: 281848 - RNA, 19 nt, Homo sapiens
gcgguuuccugaagagaca

SEQ ID NO: 281849 - RNA, 19 nt, Homo sapiens
ucagaaggaaagucaaguu

SEQ ID NO: 281850 - RNA, 19 nt, Homo sapiens
ucaugguguuguacaaaga

SEQ ID NO: 281851 - RNA, 19 nt, Homo sapiens
gagaaggcagugaagaagu

SEQ ID NO: 281852 - RNA, 19 nt, Homo sapiens
gagcaucuucacacgcaaa

SEQ ID NO: 281853 - RNA, 19 nt, Homo sapiens
acacuuaggacugaacuga

SEQ ID NO: 281854 - RNA, 19 nt, Homo sapiens
gguguuguacaaagauaaa

SEQ ID NO: 281855 - RNA, 19 nt, Homo sapiens
cagaaaguaacagcaguuu

SEQ ID NO: 281856 - RNA, 19 nt, Homo sapiens
ggagugcgauggacaauuu

SEQ ID NO: 281857 - RNA, 19 nt, Homo sapiens
caggaaaucugccuacuuu

SEQ ID NO: 281858 - RNA, 19 nt, Homo sapiens
ccagucagaucacccauua

SEQ ID NO: 281859 - RNA, 19 nt, Homo sapiens
gaaaucaacuccauugcau

SEQ ID NO: 281860 - RNA, 19 nt, Homo sapiens
ggaggauacugauaggaua

SEQ ID NO: 281861 - RNA, 19 nt, Homo sapiens
gaucacccauuauaaggua

SEQ ID NO: 281862 - RNA, 19 nt, Homo sapiens
gaagaaaucaacuccauug

SEQ ID NO: 281863 - RNA, 19 nt, Homo sapiens
gaaaggcucugcugauuuu

SEQ ID NO: 281864 - RNA, 19 nt, Homo sapiens
acaaugacccuccaauuua

SEQ ID NO: 281865 - RNA, 19 nt, Homo sapiens
ggcagaagcugaguaaauu

SEQ ID NO: 281866 - RNA, 19 nt, Homo sapiens
ggaagccgcugaccgaaug

SEQ ID NO: 281867 - RNA, 19 nt, Homo sapiens
gcucaaggcuaucaaggaa

SEQ ID NO: 281868 - RNA, 19 nt, Homo sapiens
ccacuuuccugccagaaua

SEQ ID NO: 281869 - RNA, 19 nt, Homo sapiens
gaacuuggcaccacuacaa

SEQ ID NO: 281870 - RNA, 19 nt, Homo sapiens
ccacugccaucucuucuuu

SEQ ID NO: 281871 - RNA, 19 nt, Homo sapiens
caacggcaccuaugacuuu

SEQ ID NO: 281872 - RNA, 19 nt, Homo sapiens
gaauggagauuacaaugag

SEQ ID NO: 281873 - RNA, 19 nt, Homo sapiens
ggagauauguucaguucau

SEQ ID NO: 281874 - RNA, 19 nt, Homo sapiens
agaaacagcucuaucaaca

SEQ ID NO: 281875 - RNA, 19 nt, Homo sapiens
uaaggaggcuguugcaguu

SEQ ID NO: 281876 - RNA, 19 nt, Homo sapiens
gagagcagauggcaaagga

SEQ ID NO: 281877 - RNA, 19 nt, Homo sapiens
acacagaggucauuaccaa

SEQ ID NO: 281878 - RNA, 19 nt, Homo sapiens
ggaagacucuguggauguu

SEQ ID NO: 281879 - RNA, 19 nt, Homo sapiens
caauuuaugucacagagaa

SEQ ID NO: 281880 - RNA, 19 nt, Homo sapiens
caaugacccuccaauuuau

SEQ ID NO: 281881 - RNA, 19 nt, Homo sapiens
cgaaagagauuuguucuac

SEQ ID NO: 281882 - RNA, 19 nt, Homo sapiens
gggcucagguguacaaguu

SEQ ID NO: 281883 - RNA, 19 nt, Homo sapiens
ggaagaguauggugacauc

SEQ ID NO: 281884 - RNA, 19 nt, Homo sapiens
uuaaugaguuucugaguug

SEQ ID NO: 281885 - RNA, 19 nt, Homo sapiens
ggaagaaacagaccucaau

SEQ ID NO: 281886 - RNA, 19 nt, Homo sapiens
gaagagaagagguucauca

SEQ ID NO: 281887 - RNA, 19 nt, Homo sapiens
gaugauuccuuaagaguag

SEQ ID NO: 281888 - RNA, 19 nt, Homo sapiens
uaaaggaggaauacaauga

SEQ ID NO: 281889 - RNA, 19 nt, Homo sapiens
guaaauugcagaccauuga

SEQ ID NO: 281890 - RNA, 19 nt, Homo sapiens
gaacuacagugacccuucu

SEQ ID NO: 281891 - RNA, 19 nt, Homo sapiens
ugacaguuaucacaagauu

SEQ ID NO: 281892 - RNA, 19 nt, Homo sapiens
ggagcaaugugaaagacaa

SEQ ID NO: 281893 - RNA, 19 nt, Homo sapiens
ccauuggguuugauauuaa

SEQ ID NO: 281894 - RNA, 19 nt, Homo sapiens
ggaggauccugaacugguu

SEQ ID NO: 281895 - RNA, 19 nt, Homo sapiens
caggagauauguucaguuc

SEQ ID NO: 281896 - RNA, 19 nt, Homo sapiens
gauuucgacuugcugagua

SEQ ID NO: 281897 - RNA, 19 nt, Homo sapiens
gcuaccaccuaauacagua

SEQ ID NO: 281898 - RNA, 19 nt, Homo sapiens
gugaaaaucucuuugauga

SEQ ID NO: 281899 - RNA, 19 nt, Homo sapiens
ggagcugucuuggcaugua

SEQ ID NO: 281900 - RNA, 19 nt, Homo sapiens
ggacccagauccaacagau

SEQ ID NO: 281901 - RNA, 19 nt, Homo sapiens
gggaagcauuugccaauca

SEQ ID NO: 281902 - RNA, 19 nt, Homo sapiens
gaaacagaccucaaugaca

SEQ ID NO: 281903 - RNA, 19 nt, Homo sapiens
gaaggcugcugaacuggau

SEQ ID NO: 281904 - RNA, 19 nt, Homo sapiens
aaacagcucuaucaacagu

SEQ ID NO: 281905 - RNA, 19 nt, Homo sapiens
gauuuccucucucuugauu

SEQ ID NO: 281906 - RNA, 19 nt, Homo sapiens
caacgaagccaacaggaau

SEQ ID NO: 281907 - RNA, 19 nt, Homo sapiens
ucuacuaccuucggacuua

SEQ ID NO: 281908 - RNA, 19 nt, Homo sapiens
gaagaaacagaccucaaug

SEQ ID NO: 281909 - RNA, 19 nt, Homo sapiens
ucucuuugaugauuccuua

SEQ ID NO: 281910 - RNA, 19 nt, Homo sapiens
uacaaugacccuccaauuu

SEQ ID NO: 281911 - RNA, 19 nt, Homo sapiens
ggcaaaggacucagcauuu

SEQ ID NO: 281912 - RNA, 19 nt, Homo sapiens
acacguacgaugagaaaua

SEQ ID NO: 281913 - RNA, 19 nt, Homo sapiens
ucaaggcuaucaaggaaga

SEQ ID NO: 281914 - RNA, 19 nt, Homo sapiens
gaacucagacugggcagaa

SEQ ID NO: 281915 - RNA, 19 nt, Homo sapiens
acagacagcuuuguacguu

SEQ ID NO: 281916 - RNA, 19 nt, Homo sapiens
gcugaggccuggcaucugu

SEQ ID NO: 281917 - RNA, 19 nt, Homo sapiens
guaggaggcugggagaaug

SEQ ID NO: 281918 - RNA, 19 nt, Homo sapiens
ugagaacgaugccauugga

SEQ ID NO: 281919 - RNA, 19 nt, Homo sapiens
ggauacugauaggauauuu

SEQ ID NO: 281920 - RNA, 19 nt, Homo sapiens
ugaacuggaucaaggaaga

SEQ ID NO: 281921 - RNA, 19 nt, Homo sapiens
gaaaagccuaugagauuua

SEQ ID NO: 281922 - RNA, 19 nt, Homo sapiens
gcaggaagcacccagaauc

SEQ ID NO: 281923 - RNA, 19 nt, Homo sapiens
cguuagagaugacuuuaau

SEQ ID NO: 281924 - RNA, 19 nt, Homo sapiens
ucaaagcugugcaggacaa

SEQ ID NO: 281925 - RNA, 19 nt, Homo sapiens
ugacagcuacgcagacuuu

SEQ ID NO: 281926 - RNA, 19 nt, Homo sapiens
gggagaaacagcucuauca

SEQ ID NO: 281927 - RNA, 19 nt, Homo sapiens
ccaaugacuugcugcacaa

SEQ ID NO: 281928 - RNA, 19 nt, Homo sapiens
cacagacgcuccaagaugu

SEQ ID NO: 281929 - RNA, 19 nt, Homo sapiens
uuauugcccugcuaaguuu

SEQ ID NO: 281930 - RNA, 19 nt, Homo sapiens
acaacaggcugaucaaugg

SEQ ID NO: 281931 - RNA, 19 nt, Homo sapiens
ggagaaacagcucuaucaa

SEQ ID NO: 281932 - RNA, 19 nt, Homo sapiens
agacugcuaccaccuaaua

SEQ ID NO: 281933 - RNA, 19 nt, Homo sapiens
aaagacugcuaccaccuaa

SEQ ID NO: 281934 - RNA, 19 nt, Homo sapiens
agaagcagcuccugaaagg

SEQ ID NO: 281935 - RNA, 19 nt, Homo sapiens
guuaccaccucaaguucua

SEQ ID NO: 281936 - RNA, 19 nt, Homo sapiens
gcauuucugucauacaagu

SEQ ID NO: 281937 - RNA, 19 nt, Homo sapiens
ccacuguccucgccuacaa

SEQ ID NO: 281938 - RNA, 19 nt, Homo sapiens
gagacaaggugaaguuuug

SEQ ID NO: 281939 - RNA, 19 nt, Homo sapiens
ccacagacgcuccaagaug

SEQ ID NO: 281940 - RNA, 19 nt, Homo sapiens
gcuaaagucguuugggaaa

SEQ ID NO: 281941 - RNA, 19 nt, Homo sapiens
gucaaggacucccaggaaa

SEQ ID NO: 281942 - RNA, 19 nt, Homo sapiens
accauuggguuugauauua

SEQ ID NO: 281943 - RNA, 19 nt, Homo sapiens
caaacaccuuagggucuua

SEQ ID NO: 281944 - RNA, 19 nt, Homo sapiens
ggcugaagaugacgccuuu

SEQ ID NO: 281945 - RNA, 19 nt, Homo sapiens
acaaugaggugaugaagac

SEQ ID NO: 281946 - RNA, 19 nt, Homo sapiens
agucagaucacccauuaua

SEQ ID NO: 281947 - RNA, 19 nt, Homo sapiens
ccaaacaccuuagggucuu

SEQ ID NO: 281948 - RNA, 19 nt, Homo sapiens
gucaugggguugauuauua

SEQ ID NO: 281949 - RNA, 19 nt, Homo sapiens
cugaaaggcucugcugauu

SEQ ID NO: 281950 - RNA, 19 nt, Homo sapiens
gagagucugggaagcauuu

SEQ ID NO: 281951 - RNA, 19 nt, Homo sapiens
cagaaaagccuaugagauu

SEQ ID NO: 281952 - RNA, 19 nt, Homo sapiens
gcuuggcauuucugucaua

SEQ ID NO: 281953 - RNA, 19 nt, Homo sapiens
aaagagauuuguucuacca

SEQ ID NO: 281954 - RNA, 19 nt, Homo sapiens
caaggaagacucuguggau

SEQ ID NO: 281955 - RNA, 19 nt, Homo sapiens
uaaggaguaugcagaugug

SEQ ID NO: 281956 - RNA, 19 nt, Homo sapiens
ggagaaagccgucuuaauu

SEQ ID NO: 281957 - RNA, 19 nt, Homo sapiens
ggaaagagguucacaagca

SEQ ID NO: 281958 - RNA, 19 nt, Homo sapiens
gaacaugccuaguccaaca

SEQ ID NO: 281959 - RNA, 19 nt, Homo sapiens
gagaaagccgucuuaauuu

SEQ ID NO: 281960 - RNA, 19 nt, Homo sapiens
gaugaugucuuccuuagug

SEQ ID NO: 281961 - RNA, 19 nt, Homo sapiens
ggcaaagacuauaauguaa

SEQ ID NO: 281962 - RNA, 19 nt, Homo sapiens
gaagaagagugcagauaca

SEQ ID NO: 281963 - RNA, 19 nt, Homo sapiens
gaagaggcccguuugaaga

SEQ ID NO: 281964 - RNA, 19 nt, Homo sapiens
cuacguggcuuggaagaua

SEQ ID NO: 281965 - RNA, 19 nt, Homo sapiens
guauuaaucuuguguaguc

SEQ ID NO: 281966 - RNA, 19 nt, Homo sapiens
agaaagccgucuuaauuug

SEQ ID NO: 281967 - RNA, 19 nt, Homo sapiens
gcaaccaacuauccaagug

SEQ ID NO: 281968 - RNA, 19 nt, Homo sapiens
ggacuuggcagaugaacuu

SEQ ID NO: 281969 - RNA, 19 nt, Homo sapiens
gcagagaguauaaugaaga

SEQ ID NO: 281970 - RNA, 19 nt, Homo sapiens
cagaugaacuugcucuugu

SEQ ID NO: 281971 - RNA, 19 nt, Homo sapiens
aauaaaggaugaugucuuc

SEQ ID NO: 281972 - RNA, 19 nt, Homo sapiens
aaagucuucugaugucaua

SEQ ID NO: 281973 - RNA, 19 nt, Homo sapiens
uggcaaagacuauaaugua

SEQ ID NO: 281974 - RNA, 19 nt, Homo sapiens
ugaaggacuuggcagauga

SEQ ID NO: 281975 - RNA, 19 nt, Homo sapiens
caaguguuauaccaacuaa

SEQ ID NO: 281976 - RNA, 19 nt, Homo sapiens
ugagccagguggauguuua

SEQ ID NO: 281977 - RNA, 19 nt, Homo sapiens
gaauguugcuggugucucu

SEQ ID NO: 281978 - RNA, 19 nt, Homo sapiens
ggaagaggcccguuugaag

SEQ ID NO: 281979 - RNA, 19 nt, Homo sapiens
gaauaaaggaugaugucuu

SEQ ID NO: 281980 - RNA, 19 nt, Homo sapiens
ccacagcuauauccugaug

SEQ ID NO: 281981 - RNA, 19 nt, Homo sapiens
gcuggugucucucugaaga

SEQ ID NO: 281982 - RNA, 19 nt, Homo sapiens
gaugcuggaugguauuaau

SEQ ID NO: 281983 - RNA, 19 nt, Homo sapiens
gggaaaggcugggaguuca

SEQ ID NO: 281984 - RNA, 19 nt, Homo sapiens
cagagaguauaaugaagaa

SEQ ID NO: 281985 - RNA, 19 nt, Homo sapiens
cagaauaagauuacaguug

SEQ ID NO: 281986 - RNA, 19 nt, Homo sapiens
caaacaaugcaaccaacua

SEQ ID NO: 281987 - RNA, 19 nt, Homo sapiens
uaagggucuuuacggaaua

SEQ ID NO: 281988 - RNA, 19 nt, Homo sapiens
caacuauccaaguguuaua

SEQ ID NO: 281989 - RNA, 19 nt, Homo sapiens
cgacgugcauucccgauuc

SEQ ID NO: 281990 - RNA, 19 nt, Homo sapiens
ggacugauaaagauaagga

SEQ ID NO: 281991 - RNA, 19 nt, Homo sapiens
acuccaagcuggucauuau

SEQ ID NO: 281992 - RNA, 19 nt, Homo sapiens
aauccaauaucaugucuug

SEQ ID NO: 281993 - RNA, 19 nt, Homo sapiens
ggauguuuaccguguguua

SEQ ID NO: 281994 - RNA, 19 nt, Homo sapiens
uuaauuugguccagcguaa

SEQ ID NO: 281995 - RNA, 19 nt, Homo sapiens
ugaccuacguggcuuggaa

SEQ ID NO: 281996 - RNA, 19 nt, Homo sapiens
ccaguuuccaccaugauua

SEQ ID NO: 281997 - RNA, 19 nt, Homo sapiens
gagggagaaagccgucuua

SEQ ID NO: 281998 - RNA, 19 nt, Homo sapiens
gggauccaguguauaaauc

SEQ ID NO: 281999 - RNA, 19 nt, Homo sapiens
uuaagggucuuuacggaau

SEQ ID NO: 282000 - RNA, 19 nt, Homo sapiens
gagaguauaaugaagaauc

SEQ ID NO: 282001 - RNA, 19 nt, Homo sapiens
caguggauaucuugaccua

SEQ ID NO: 282002 - RNA, 19 nt, Homo sapiens
gcagaugaacuugcucuug

SEQ ID NO: 282003 - RNA, 19 nt, Homo sapiens
cauaucauuucacugucua

SEQ ID NO: 282004 - RNA, 19 nt, Homo sapiens
gaugucauaucauuucacu

SEQ ID NO: 282005 - RNA, 19 nt, Homo sapiens
gauaagugguuuucccaaa

SEQ ID NO: 282006 - RNA, 19 nt, Homo sapiens
gaaagccgucuuaauuugg

SEQ ID NO: 282007 - RNA, 19 nt, Homo sapiens
ucaacugguuagugugaaa

SEQ ID NO: 282008 - RNA, 19 nt, Homo sapiens
cuccugaaguuagaaauaa

SEQ ID NO: 282009 - RNA, 19 nt, Homo sapiens
gauucuagguggagguugu

SEQ ID NO: 282010 - RNA, 19 nt, Homo sapiens
gggacagaauggaaucuca

SEQ ID NO: 282011 - RNA, 19 nt, Homo sapiens
uggcaacucuaaaggauca

SEQ ID NO: 282012 - RNA, 19 nt, Homo sapiens
ugaacuugcucuuguugau

SEQ ID NO: 282013 - RNA, 19 nt, Homo sapiens
aaacaaugcaaccaacuau

SEQ ID NO: 282014 - RNA, 19 nt, Homo sapiens
ccaauaaaccuugaacagu

SEQ ID NO: 282015 - RNA, 19 nt, Homo sapiens
gcuauuggacucucuguag

SEQ ID NO: 282016 - RNA, 19 nt, Homo sapiens
caaauugaagggagagaug

SEQ ID NO: 282017 - RNA, 19 nt, Homo sapiens
gaacuugcucuuguugaug

SEQ ID NO: 282018 - RNA, 19 nt, Homo sapiens
gaauggaaucucagaccuu

SEQ ID NO: 282019 - RNA, 19 nt, Homo sapiens
cuuaugaggugaucaaacu

SEQ ID NO: 282020 - RNA, 19 nt, Homo sapiens
gggagaaagccgucuuaau

SEQ ID NO: 282021 - RNA, 19 nt, Homo sapiens
ugucauaucauuucacugu

SEQ ID NO: 282022 - RNA, 19 nt, Homo sapiens
uauggcaacucuaaaggau

SEQ ID NO: 282023 - RNA, 19 nt, Homo sapiens
caauauggcaacucuaaag

SEQ ID NO: 282024 - RNA, 19 nt, Homo sapiens
uggcagagaguauaaugaa

SEQ ID NO: 282025 - RNA, 19 nt, Homo sapiens
ccagauuuagggacugaua

SEQ ID NO: 282026 - RNA, 19 nt, Homo sapiens
ccaucaguaucuuaaugaa

SEQ ID NO: 282027 - RNA, 19 nt, Homo sapiens
gugcauucccgauuccuuu

SEQ ID NO: 282028 - RNA, 19 nt, Homo sapiens
gcaaagacuauaauguaac

SEQ ID NO: 282029 - RNA, 19 nt, Homo sapiens
aaacaucaacuccugaagu

SEQ ID NO: 282030 - RNA, 19 nt, Homo sapiens
ggaguucacccauuaagcu

SEQ ID NO: 282031 - RNA, 19 nt, Homo sapiens
ccaaguguuauaccaacua

SEQ ID NO: 282032 - RNA, 19 nt, Homo sapiens
guaguguacauuaccauau

SEQ ID NO: 282033 - RNA, 19 nt, Homo sapiens
ucacugaacaugccuaguc

SEQ ID NO: 282034 - RNA, 19 nt, Homo sapiens
gaggaagaggcccguuuga

SEQ ID NO: 282035 - RNA, 19 nt, Homo sapiens
gacucugacuucugaggaa

SEQ ID NO: 282036 - RNA, 19 nt, Homo sapiens
gaaggacuuggcagaugaa

SEQ ID NO: 282037 - RNA, 19 nt, Homo sapiens
ccgauuccguuaccugaug

SEQ ID NO: 282038 - RNA, 19 nt, Homo sapiens
gccaucaguaucuuaauga

SEQ ID NO: 282039 - RNA, 19 nt, Homo sapiens
gaugaacuugcucuuguug

SEQ ID NO: 282040 - RNA, 19 nt, Homo sapiens
uuuaaagucuucugauguc

SEQ ID NO: 282041 - RNA, 19 nt, Homo sapiens
ugaagaagagugcagauac

SEQ ID NO: 282042 - RNA, 19 nt, Homo sapiens
gaucuacauacaaacaaug

SEQ ID NO: 282043 - RNA, 19 nt, Homo sapiens
uaucaguaguguacauuac

SEQ ID NO: 282044 - RNA, 19 nt, Homo sapiens
gauaaggaacaguggaaag

SEQ ID NO: 282045 - RNA, 19 nt, Homo sapiens
uguauggaguggaaugaau

SEQ ID NO: 282046 - RNA, 19 nt, Homo sapiens
ccuuagaacaccaaagauu

SEQ ID NO: 282047 - RNA, 19 nt, Homo sapiens
uccaauauggcaacucuaa

SEQ ID NO: 282048 - RNA, 19 nt, Homo sapiens
gauuuggcagagaguauaa

SEQ ID NO: 282049 - RNA, 19 nt, Homo sapiens
caucgaagacaaauugaag

SEQ ID NO: 282050 - RNA, 19 nt, Homo sapiens
gaggcccguuugaagaaga

SEQ ID NO: 282051 - RNA, 19 nt, Homo sapiens
ugccaucaguaucuuaaug

SEQ ID NO: 282052 - RNA, 19 nt, Homo sapiens
agaugaacuugcucuuguu

SEQ ID NO: 282053 - RNA, 19 nt, Homo sapiens
cuuagaacaccaaagauug

SEQ ID NO: 282054 - RNA, 19 nt, Homo sapiens
aaccaacuauccaaguguu

SEQ ID NO: 282055 - RNA, 19 nt, Homo sapiens
uggaugguauuaaucuugu

SEQ ID NO: 282056 - RNA, 19 nt, Homo sapiens
caacugggcuauuggauua

SEQ ID NO: 282057 - RNA, 19 nt, Homo sapiens
gaaagucucuggcugauga

SEQ ID NO: 282058 - RNA, 19 nt, Homo sapiens
ggaauugaauccagaaaug

SEQ ID NO: 282059 - RNA, 19 nt, Homo sapiens
guacauggaucacaguuug

SEQ ID NO: 282060 - RNA, 19 nt, Homo sapiens
ggaaggaagugcauaagau

SEQ ID NO: 282061 - RNA, 19 nt, Homo sapiens
gaacugacaaugauaguga

SEQ ID NO: 282062 - RNA, 19 nt, Homo sapiens
uauguuaccuggaaacuaa

SEQ ID NO: 282063 - RNA, 19 nt, Homo sapiens
gugauuaacucgagccuuu

SEQ ID NO: 282064 - RNA, 19 nt, Homo sapiens
gcuaaaggaugaugagguu

SEQ ID NO: 282065 - RNA, 19 nt, Homo sapiens
gcagagaaauguuaauguc

SEQ ID NO: 282066 - RNA, 19 nt, Homo sapiens
gcacgcagcugacuuuguc

SEQ ID NO: 282067 - RNA, 19 nt, Homo sapiens
caugggagcuuauuucuuc

SEQ ID NO: 282068 - RNA, 19 nt, Homo sapiens
caacaguuccaaacaauaa

SEQ ID NO: 282069 - RNA, 19 nt, Homo sapiens
aaucugagcucuugaacaa

SEQ ID NO: 282070 - RNA, 19 nt, Homo sapiens
gaaagugccuaugaaguca

SEQ ID NO: 282071 - RNA, 19 nt, Homo sapiens
gaacauggcgacucaagug

SEQ ID NO: 282072 - RNA, 19 nt, Homo sapiens
ggaagaagaggcaacaguu

SEQ ID NO: 282073 - RNA, 19 nt, Homo sapiens
gagcuuauuucuucagaca

SEQ ID NO: 282074 - RNA, 19 nt, Homo sapiens
gaaggaagugcauaagaug

SEQ ID NO: 282075 - RNA, 19 nt, Homo sapiens
gagaaauguuaaugucuuc

SEQ ID NO: 282076 - RNA, 19 nt, Homo sapiens
gcaacaguuccaaacaaua

SEQ ID NO: 282077 - RNA, 19 nt, Homo sapiens
uuacguauguuaccuggaa

SEQ ID NO: 282078 - RNA, 19 nt, Homo sapiens
acaauaagaucacuguagu

SEQ ID NO: 282079 - RNA, 19 nt, Homo sapiens
aaagaccugugacuaguga

SEQ ID NO: 282080 - RNA, 19 nt, Homo sapiens
caguggacauucuuacgua

SEQ ID NO: 282081 - RNA, 19 nt, Homo sapiens
gaagaagaggcaacaguuc

SEQ ID NO: 282082 - RNA, 19 nt, Homo sapiens
uggcugaucuuauugaauc

SEQ ID NO: 282083 - RNA, 19 nt, Homo sapiens
gaauuugggcucacagaau

SEQ ID NO: 282084 - RNA, 19 nt, Homo sapiens
gaccgccaauucuaagauu

SEQ ID NO: 282085 - RNA, 19 nt, Homo sapiens
ggcaacaguuccaaacaau

SEQ ID NO: 282086 - RNA, 19 nt, Homo sapiens
gaaaugggaacugacaaug

SEQ ID NO: 282087 - RNA, 19 nt, Homo sapiens
gguugaaagugccuaugaa

SEQ ID NO: 282088 - RNA, 19 nt, Homo sapiens
gauuggaaguggauguaau

SEQ ID NO: 282089 - RNA, 19 nt, Homo sapiens
accagaagcuaaaggauga

SEQ ID NO: 282090 - RNA, 19 nt, Homo sapiens
aaguguggcugaucuuauu

SEQ ID NO: 282091 - RNA, 19 nt, Homo sapiens
ucugagcucuugaacaaau

SEQ ID NO: 282092 - RNA, 19 nt, Homo sapiens
ugcauaagauggugguuga

SEQ ID NO: 282093 - RNA, 19 nt, Homo sapiens
guguuucucuccaggaauu

SEQ ID NO: 282094 - RNA, 19 nt, Homo sapiens
aauggcaacucuuaaggaa

SEQ ID NO: 282095 - RNA, 19 nt, Homo sapiens
aaacaccgcgugauuggaa

SEQ ID NO: 282096 - RNA, 19 nt, Homo sapiens
gauuaaguguggcugaucu

SEQ ID NO: 282097 - RNA, 19 nt, Homo sapiens
uauaccaacugggcuauug

SEQ ID NO: 282098 - RNA, 19 nt, Homo sapiens
ugaaagugccuaugaaguc

SEQ ID NO: 282099 - RNA, 19 nt, Homo sapiens
ucaaguacaguccugauug

SEQ ID NO: 282100 - RNA, 19 nt, Homo sapiens
caaacaauaagaucacugu

SEQ ID NO: 282101 - RNA, 19 nt, Homo sapiens
aaugggaacugacaaugau

SEQ ID NO: 282102 - RNA, 19 nt, Homo sapiens
ucuggauucugcuagauuu

SEQ ID NO: 282103 - RNA, 19 nt, Homo sapiens
cugaugaacuugcucuugu

SEQ ID NO: 282104 - RNA, 19 nt, Homo sapiens
gguauggcgugugcuauca

SEQ ID NO: 282105 - RNA, 19 nt, Homo sapiens
gaucuucuucaauauguga

SEQ ID NO: 282106 - RNA, 19 nt, Homo sapiens
ggauguauggcauugagaa

SEQ ID NO: 282107 - RNA, 19 nt, Homo sapiens
gaauguggcagguguuucu

SEQ ID NO: 282108 - RNA, 19 nt, Homo sapiens
cuaaguggauuacccaaac

SEQ ID NO: 282109 - RNA, 19 nt, Homo sapiens
gcuuaaaggagaaaugaug

SEQ ID NO: 282110 - RNA, 19 nt, Homo sapiens
ugaacuugcucuuguggau

SEQ ID NO: 282111 - RNA, 19 nt, Homo sapiens
caaguacaguccugauugc

SEQ ID NO: 282112 - RNA, 19 nt, Homo sapiens
uuccucagaucgucaagua

SEQ ID NO: 282113 - RNA, 19 nt, Homo sapiens
ggaagauaagcuuaaagga

SEQ ID NO: 282114 - RNA, 19 nt, Homo sapiens
guuaucaaccagaagcuaa

SEQ ID NO: 282115 - RNA, 19 nt, Homo sapiens
gggaaagucucuggcugau

SEQ ID NO: 282116 - RNA, 19 nt, Homo sapiens
cuuauugaauccauguuga

SEQ ID NO: 282117 - RNA, 19 nt, Homo sapiens
aaggagaaaugauggaucu

SEQ ID NO: 282118 - RNA, 19 nt, Homo sapiens
uuuaaugcuugcaaucuga

SEQ ID NO: 282119 - RNA, 19 nt, Homo sapiens
cauaagauggugguugaaa

SEQ ID NO: 282120 - RNA, 19 nt, Homo sapiens
aggcaacaguuccaaacaa

SEQ ID NO: 282121 - RNA, 19 nt, Homo sapiens
agauuucgcuaccuuaugg

SEQ ID NO: 282122 - RNA, 19 nt, Homo sapiens
gggagcuuauuucuucaga

SEQ ID NO: 282123 - RNA, 19 nt, Homo sapiens
aaaugggaacugacaauga

SEQ ID NO: 282124 - RNA, 19 nt, Homo sapiens
uguaguggguguuggacaa

SEQ ID NO: 282125 - RNA, 19 nt, Homo sapiens
gcuagauuucgcuaccuua

SEQ ID NO: 282126 - RNA, 19 nt, Homo sapiens
uaaguggauuacccaaaca

SEQ ID NO: 282127 - RNA, 19 nt, Homo sapiens
cuaaaauuguggcagauaa

SEQ ID NO: 282128 - RNA, 19 nt, Homo sapiens
cagcaugggagcuuauuuc

SEQ ID NO: 282129 - RNA, 19 nt, Homo sapiens
uggcaacucuuaaggaaaa

SEQ ID NO: 282130 - RNA, 19 nt, Homo sapiens
gccuaugcuugguuuaaug

SEQ ID NO: 282131 - RNA, 19 nt, Homo sapiens
guuuaaugcuugcaaucug

SEQ ID NO: 282132 - RNA, 19 nt, Homo sapiens
ucacagaaucaaagccuau

SEQ ID NO: 282133 - RNA, 19 nt, Homo sapiens
uaagauggugguugaaagu

SEQ ID NO: 282134 - RNA, 19 nt, Homo sapiens
gaauugaauccagaaaugg

SEQ ID NO: 282135 - RNA, 19 nt, Homo sapiens
gacgcacgcagcugacuuu

SEQ ID NO: 282136 - RNA, 19 nt, Homo sapiens
gcagcaugggagcuuauuu

SEQ ID NO: 282137 - RNA, 19 nt, Homo sapiens
aauuugggcucacagaauc

SEQ ID NO: 282138 - RNA, 19 nt, Homo sapiens
uaaaagaccugugacuagu

SEQ ID NO: 282139 - RNA, 19 nt, Homo sapiens
ugugggacauccagaagga

SEQ ID NO: 282140 - RNA, 19 nt, Homo sapiens
gaucuuauugaauccaugu

SEQ ID NO: 282141 - RNA, 19 nt, Homo sapiens
ucaucaagcuaaaaggaua

SEQ ID NO: 282142 - RNA, 19 nt, Homo sapiens
ccagaaaugggaacugaca

SEQ ID NO: 282143 - RNA, 19 nt, Homo sapiens
gcagcugacuuugucuucu

SEQ ID NO: 282144 - RNA, 19 nt, Homo sapiens
gaagaggcaacaguuccaa

SEQ ID NO: 282145 - RNA, 19 nt, Homo sapiens
cuucuccgcacgacuguua

SEQ ID NO: 282146 - RNA, 19 nt, Homo sapiens
gaagcuaaaggaugaugag

SEQ ID NO: 282147 - RNA, 19 nt, Homo sapiens
gcaaaauggcaacucuuaa

SEQ ID NO: 282148 - RNA, 19 nt, Homo sapiens
ccuggaaacuaaguggauu

SEQ ID NO: 282149 - RNA, 19 nt, Homo sapiens
ucauaauugugguuuccaa

SEQ ID NO: 282150 - RNA, 19 nt, Homo sapiens
gcaucauaauugugguuuc

SEQ ID NO: 282151 - RNA, 19 nt, Homo sapiens
ggacauccagaaggaccua

SEQ ID NO: 282152 - RNA, 19 nt, Homo sapiens
gugcagagaaauguuaaug

SEQ ID NO: 282153 - RNA, 19 nt, Homo sapiens
gcaugggagcuuauuucuu

SEQ ID NO: 282154 - RNA, 19 nt, Homo sapiens
ugaugaacuugcucuugug

SEQ ID NO: 282155 - RNA, 19 nt, Homo sapiens
ccagcguuaucaaccagaa

SEQ ID NO: 282156 - RNA, 19 nt, Homo sapiens
caaagugccuaugaaauua

SEQ ID NO: 282157 - RNA, 19 nt, Homo sapiens
gaagauagcaggcugugua

SEQ ID NO: 282158 - RNA, 19 nt, Homo sapiens
gcagaaacacuuuggaaua

SEQ ID NO: 282159 - RNA, 19 nt, Homo sapiens
gaaacacuuuggaauauuc

SEQ ID NO: 282160 - RNA, 19 nt, Homo sapiens
ggauuuggcugaugaacuu

SEQ ID NO: 282161 - RNA, 19 nt, Homo sapiens
gauagcaggcuguguauuu

SEQ ID NO: 282162 - RNA, 19 nt, Homo sapiens
ggaagugguuguaaucuag

SEQ ID NO: 282163 - RNA, 19 nt, Homo sapiens
gaaagcauuuguucuccaa

SEQ ID NO: 282164 - RNA, 19 nt, Homo sapiens
cagaaacacuuuggaauau

SEQ ID NO: 282165 - RNA, 19 nt, Homo sapiens
guuaagggauuauauggaa

SEQ ID NO: 282166 - RNA, 19 nt, Homo sapiens
ggaauggugucucagaugu

SEQ ID NO: 282167 - RNA, 19 nt, Homo sapiens
ugaagacucuggacccuaa

SEQ ID NO: 282168 - RNA, 19 nt, Homo sapiens
ucaaagugccuaugaaauu

SEQ ID NO: 282169 - RNA, 19 nt, Homo sapiens
ugacauauauagucuggaa

SEQ ID NO: 282170 - RNA, 19 nt, Homo sapiens
caagaagagugcagaaaca

SEQ ID NO: 282171 - RNA, 19 nt, Homo sapiens
gagaaaugauggaucuuca

SEQ ID NO: 282172 - RNA, 19 nt, Homo sapiens
ugaaggauuuggcugauga

SEQ ID NO: 282173 - RNA, 19 nt, Homo sapiens
gaugaaaacucccagugua

SEQ ID NO: 282174 - RNA, 19 nt, Homo sapiens
gaacuugcccuuguugaug

SEQ ID NO: 282175 - RNA, 19 nt, Homo sapiens
gaacggauucagauaagga

SEQ ID NO: 282176 - RNA, 19 nt, Homo sapiens
caguaucccuugugucuug

SEQ ID NO: 282177 - RNA, 19 nt, Homo sapiens
ugucucagauguugugaaa

SEQ ID NO: 282178 - RNA, 19 nt, Homo sapiens
gaacauggugauucuagug

SEQ ID NO: 282179 - RNA, 19 nt, Homo sapiens
guaucuuacugaaggauuu

SEQ ID NO: 282180 - RNA, 19 nt, Homo sapiens
aggcauggcuugugcuauu

SEQ ID NO: 282181 - RNA, 19 nt, Homo sapiens
gcuauuggacugucuguga

SEQ ID NO: 282182 - RNA, 19 nt, Homo sapiens
caacguaauguggcuauaa

SEQ ID NO: 282183 - RNA, 19 nt, Homo sapiens
ggcauggcuugugcuauua

SEQ ID NO: 282184 - RNA, 19 nt, Homo sapiens
caccaugguuaagggauua

SEQ ID NO: 282185 - RNA, 19 nt, Homo sapiens
guaauguggcuauaaugaa

SEQ ID NO: 282186 - RNA, 19 nt, Homo sapiens
uuaaagccuucuaauguuc

SEQ ID NO: 282187 - RNA, 19 nt, Homo sapiens
gacucuggacccuaaauua

SEQ ID NO: 282188 - RNA, 19 nt, Homo sapiens
ugccaugguuggauuauug

SEQ ID NO: 282189 - RNA, 19 nt, Homo sapiens
uggaagugguuguaaucua

SEQ ID NO: 282190 - RNA, 19 nt, Homo sapiens
ccaccaugguuaagggauu

SEQ ID NO: 282191 - RNA, 19 nt, Homo sapiens
gaauguugcugguguugcu

SEQ ID NO: 282192 - RNA, 19 nt, Homo sapiens
guaauuggaagugguugua

SEQ ID NO: 282193 - RNA, 19 nt, Homo sapiens
caaagauuacuucuggaaa

SEQ ID NO: 282194 - RNA, 19 nt, Homo sapiens
ugggucaucuguacugauu

SEQ ID NO: 282195 - RNA, 19 nt, Homo sapiens
gaagcuaauugaggaugau

SEQ ID NO: 282196 - RNA, 19 nt, Homo sapiens
ucacuucugugccuuccuu

SEQ ID NO: 282197 - RNA, 19 nt, Homo sapiens
cccacaagcugccaugguu

SEQ ID NO: 282198 - RNA, 19 nt, Homo sapiens
ggagaaaugauggaucuuc

SEQ ID NO: 282199 - RNA, 19 nt, Homo sapiens
guacugauugcgccaagaa

SEQ ID NO: 282200 - RNA, 19 nt, Homo sapiens
guacuucaaagauuacuuc

SEQ ID NO: 282201 - RNA, 19 nt, Homo sapiens
gggcuuagcgccucaacug

SEQ ID NO: 282202 - RNA, 19 nt, Homo sapiens
uaggaacggauucagauaa

SEQ ID NO: 282203 - RNA, 19 nt, Homo sapiens
ucaaagauuacuucuggaa

SEQ ID NO: 282204 - RNA, 19 nt, Homo sapiens
aaacugaagggagaaauga

SEQ ID NO: 282205 - RNA, 19 nt, Homo sapiens
guauaccucuugggcuauu

SEQ ID NO: 282206 - RNA, 19 nt, Homo sapiens
cguaauguggcuauaauga

SEQ ID NO: 282207 - RNA, 19 nt, Homo sapiens
gcauggcagucuuuucuuu

SEQ ID NO: 282208 - RNA, 19 nt, Homo sapiens
aggagcagcuaauugagaa

SEQ ID NO: 282209 - RNA, 19 nt, Homo sapiens
ggagagugcacccaguuuc

SEQ ID NO: 282210 - RNA, 19 nt, Homo sapiens
ccuaugaaauuaucaagcu

SEQ ID NO: 282211 - RNA, 19 nt, Homo sapiens
cugaugaacuugcccuugu

SEQ ID NO: 282212 - RNA, 19 nt, Homo sapiens
gcggaauggugucucagau

SEQ ID NO: 282213 - RNA, 19 nt, Homo sapiens
ccaguuuccaccaugguua

SEQ ID NO: 282214 - RNA, 19 nt, Homo sapiens
gccaagaaagcauuuguuc

SEQ ID NO: 282215 - RNA, 19 nt, Homo sapiens
cuccaaaugucaacuguca

SEQ ID NO: 282216 - RNA, 19 nt, Homo sapiens
gcuaauugaggaugaugaa

SEQ ID NO: 282217 - RNA, 19 nt, Homo sapiens
cuucuaauguuccacuguu

SEQ ID NO: 282218 - RNA, 19 nt, Homo sapiens
accuguaacucguguaauu

SEQ ID NO: 282219 - RNA, 19 nt, Homo sapiens
aaucauuccugccauaguc

SEQ ID NO: 282220 - RNA, 19 nt, Homo sapiens
caaacugaagggagaaaug

SEQ ID NO: 282221 - RNA, 19 nt, Homo sapiens
gaaaacucccaguguaaaa

SEQ ID NO: 282222 - RNA, 19 nt, Homo sapiens
gugcagaaacacuuuggaa

SEQ ID NO: 282223 - RNA, 19 nt, Homo sapiens
ccguuuccguuaccuaauu

SEQ ID NO: 282224 - RNA, 19 nt, Homo sapiens
gaagugguuguaaucuaga

SEQ ID NO: 282225 - RNA, 19 nt, Homo sapiens
agaagcuaauugaggauga

SEQ ID NO: 282226 - RNA, 19 nt, Homo sapiens
ggugaauguugcugguguu

SEQ ID NO: 282227 - RNA, 19 nt, Homo sapiens
caguggauauuuugacaua

SEQ ID NO: 282228 - RNA, 19 nt, Homo sapiens
ggucaucuguacugauugc

SEQ ID NO: 282229 - RNA, 19 nt, Homo sapiens
ugaugaacuugcccuuguu

SEQ ID NO: 282230 - RNA, 19 nt, Homo sapiens
aagcugccaugguuggauu

SEQ ID NO: 282231 - RNA, 19 nt, Homo sapiens
ccaacguaauguggcuaua

SEQ ID NO: 282232 - RNA, 19 nt, Homo sapiens
aauggugucucagauguug

SEQ ID NO: 282233 - RNA, 19 nt, Homo sapiens
gaauggugucucagauguu

SEQ ID NO: 282234 - RNA, 19 nt, Homo sapiens
ucuagacucugcccguuuc

SEQ ID NO: 282235 - RNA, 19 nt, Homo sapiens
cauuauaguccugauugua

SEQ ID NO: 282236 - RNA, 19 nt, Homo sapiens
gaugaacuugcccuuguug

SEQ ID NO: 282237 - RNA, 19 nt, Homo sapiens
cagauaaggaacacuggaa

SEQ ID NO: 282238 - RNA, 19 nt, Homo sapiens
uaaauuaggaacggauuca

SEQ ID NO: 282239 - RNA, 19 nt, Homo sapiens
aaugauggaucuucagcau

SEQ ID NO: 282240 - RNA, 19 nt, Homo sapiens
gaagggagaaaugauggau

SEQ ID NO: 282241 - RNA, 19 nt, Homo sapiens
ucucagauguugugaaaau

SEQ ID NO: 282242 - RNA, 19 nt, Homo sapiens
aacugucguugguguauuu

SEQ ID NO: 282243 - RNA, 19 nt, Homo sapiens
guaacucguguaauuggaa

SEQ ID NO: 282244 - RNA, 19 nt, Homo sapiens
ccaaaugucaacugucaag

SEQ ID NO: 282245 - RNA, 19 nt, Homo sapiens
ggacaaacugaagggagaa

SEQ ID NO: 282246 - RNA, 19 nt, Homo sapiens
aacguaauguggcuauaau

SEQ ID NO: 282247 - RNA, 19 nt, Homo sapiens
gguaggauccauuuugaaa

SEQ ID NO: 282248 - RNA, 19 nt, Homo sapiens
ggaacggauucagauaagg

SEQ ID NO: 282249 - RNA, 19 nt, Homo sapiens
gcccguuuccguuaccuaa

SEQ ID NO: 282250 - RNA, 19 nt, Homo sapiens
ccauuauaguccugauugu

SEQ ID NO: 282251 - RNA, 19 nt, Homo sapiens
ucaagaagagugcagaaac

SEQ ID NO: 282252 - RNA, 19 nt, Homo sapiens
ugugauggaucugguagga

SEQ ID NO: 282253 - RNA, 19 nt, Homo sapiens
uuccugccauaguccauua

SEQ ID NO: 282254 - RNA, 19 nt, Homo sapiens
ggcagucuuuucuuuagua

SEQ ID NO: 282255 - RNA, 19 nt, Homo sapiens
ccuuguugauguugcauug

SEQ ID NO: 282256 - RNA, 19 nt, Homo sapiens
caaagugccuaugaaauua

SEQ ID NO: 282257 - RNA, 19 nt, Homo sapiens
gaagauagcaggcugugua

SEQ ID NO: 282258 - RNA, 19 nt, Homo sapiens
gcagaaacacuuuggaaua

SEQ ID NO: 282259 - RNA, 19 nt, Homo sapiens
gaaacacuuuggaauauuc

SEQ ID NO: 282260 - RNA, 19 nt, Homo sapiens
ggauuuggcugaugaacuu

SEQ ID NO: 282261 - RNA, 19 nt, Homo sapiens
gauagcaggcuguguauuu

SEQ ID NO: 282262 - RNA, 19 nt, Homo sapiens
ggaagugguuguaaucuag

SEQ ID NO: 282263 - RNA, 19 nt, Homo sapiens
cagaaacacuuuggaauau

SEQ ID NO: 282264 - RNA, 19 nt, Homo sapiens
guuaagggauuauauggaa

SEQ ID NO: 282265 - RNA, 19 nt, Homo sapiens
ggaauggugucucagaugu

SEQ ID NO: 282266 - RNA, 19 nt, Homo sapiens
ugaagacucuggacccuaa

SEQ ID NO: 282267 - RNA, 19 nt, Homo sapiens
ucaaagugccuaugaaauu

SEQ ID NO: 282268 - RNA, 19 nt, Homo sapiens
ugacauauauagucuggaa

SEQ ID NO: 282269 - RNA, 19 nt, Homo sapiens
caagaagagugcagaaaca

SEQ ID NO: 282270 - RNA, 19 nt, Homo sapiens
gagaaaugauggaucuuca

SEQ ID NO: 282271 - RNA, 19 nt, Homo sapiens
ugaaggauuuggcugauga

SEQ ID NO: 282272 - RNA, 19 nt, Homo sapiens
gaugaaaacucccagugua

SEQ ID NO: 282273 - RNA, 19 nt, Homo sapiens
gaacuugcccuuguugaug

SEQ ID NO: 282274 - RNA, 19 nt, Homo sapiens
cuucaaagguucuccaaau

SEQ ID NO: 282275 - RNA, 19 nt, Homo sapiens
gaacggauucagauaagga

SEQ ID NO: 282276 - RNA, 19 nt, Homo sapiens
caguaucccuugugucuug

SEQ ID NO: 282277 - RNA, 19 nt, Homo sapiens
ugucucagauguugugaaa

SEQ ID NO: 282278 - RNA, 19 nt, Homo sapiens
gaacauggugauucuagug

SEQ ID NO: 282279 - RNA, 19 nt, Homo sapiens
guaucuuacugaaggauuu

SEQ ID NO: 282280 - RNA, 19 nt, Homo sapiens
caaagguucuccaaauguc

SEQ ID NO: 282281 - RNA, 19 nt, Homo sapiens
aggcauggcuugugcuauu

SEQ ID NO: 282282 - RNA, 19 nt, Homo sapiens
gcuauuggacugucuguga

SEQ ID NO: 282283 - RNA, 19 nt, Homo sapiens
caacguaauguggcuauaa

SEQ ID NO: 282284 - RNA, 19 nt, Homo sapiens
ggcauggcuugugcuauua

SEQ ID NO: 282285 - RNA, 19 nt, Homo sapiens
caccaugguuaagggauua

SEQ ID NO: 282286 - RNA, 19 nt, Homo sapiens
guaauguggcuauaaugaa

SEQ ID NO: 282287 - RNA, 19 nt, Homo sapiens
uuaaagccuucuaauguuc

SEQ ID NO: 282288 - RNA, 19 nt, Homo sapiens
gacucuggacccuaaauua

SEQ ID NO: 282289 - RNA, 19 nt, Homo sapiens
ugccaugguuggauuauug

SEQ ID NO: 282290 - RNA, 19 nt, Homo sapiens
uggaagugguuguaaucua

SEQ ID NO: 282291 - RNA, 19 nt, Homo sapiens
ccaccaugguuaagggauu

SEQ ID NO: 282292 - RNA, 19 nt, Homo sapiens
gaauguugcugguguugcu

SEQ ID NO: 282293 - RNA, 19 nt, Homo sapiens
gaagcuaauugaggaugau

SEQ ID NO: 282294 - RNA, 19 nt, Homo sapiens
guaauuggaagugguugua

SEQ ID NO: 282295 - RNA, 19 nt, Homo sapiens
caaagauuacuucuggaaa

SEQ ID NO: 282296 - RNA, 19 nt, Homo sapiens
ucacuucugugccuuccuu

SEQ ID NO: 282297 - RNA, 19 nt, Homo sapiens
cccacaagcugccaugguu

SEQ ID NO: 282298 - RNA, 19 nt, Homo sapiens
ggagaaaugauggaucuuc

SEQ ID NO: 282299 - RNA, 19 nt, Homo sapiens
guacuucaaagauuacuuc

SEQ ID NO: 282300 - RNA, 19 nt, Homo sapiens
uaggaacggauucagauaa

SEQ ID NO: 282301 - RNA, 19 nt, Homo sapiens
ucaaagauuacuucuggaa

SEQ ID NO: 282302 - RNA, 19 nt, Homo sapiens
aaacugaagggagaaauga

SEQ ID NO: 282303 - RNA, 19 nt, Homo sapiens
aggagcagcuaauugagaa

SEQ ID NO: 282304 - RNA, 19 nt, Homo sapiens
guauaccucuugggcuauu

SEQ ID NO: 282305 - RNA, 19 nt, Homo sapiens
cguaauguggcuauaauga

SEQ ID NO: 282306 - RNA, 19 nt, Homo sapiens
gcauggcagucuuuucuuu

SEQ ID NO: 282307 - RNA, 19 nt, Homo sapiens
ggagagugcacccaguuuc

SEQ ID NO: 282308 - RNA, 19 nt, Homo sapiens
ccuaugaaauuaucaagcu

SEQ ID NO: 282309 - RNA, 19 nt, Homo sapiens
ucaaagguucuccaaaugu

SEQ ID NO: 282310 - RNA, 19 nt, Homo sapiens
cugaugaacuugcccuugu

SEQ ID NO: 282311 - RNA, 19 nt, Homo sapiens
gcggaauggugucucagau

SEQ ID NO: 282312 - RNA, 19 nt, Homo sapiens
cuccaaaugucaacuguca

SEQ ID NO: 282313 - RNA, 19 nt, Homo sapiens
ccaguuuccaccaugguua

SEQ ID NO: 282314 - RNA, 19 nt, Homo sapiens
gcuaauugaggaugaugaa

SEQ ID NO: 282315 - RNA, 19 nt, Homo sapiens
cuucuaauguuccacuguu

SEQ ID NO: 282316 - RNA, 19 nt, Homo sapiens
accuguaacucguguaauu

SEQ ID NO: 282317 - RNA, 19 nt, Homo sapiens
aaucauuccugccauaguc

SEQ ID NO: 282318 - RNA, 19 nt, Homo sapiens
gaaaacucccaguguaaaa

SEQ ID NO: 282319 - RNA, 19 nt, Homo sapiens
caaacugaagggagaaaug

SEQ ID NO: 282320 - RNA, 19 nt, Homo sapiens
gugcagaaacacuuuggaa

SEQ ID NO: 282321 - RNA, 19 nt, Homo sapiens
agaagcuaauugaggauga

SEQ ID NO: 282322 - RNA, 19 nt, Homo sapiens
ccguuuccguuaccuaauu

SEQ ID NO: 282323 - RNA, 19 nt, Homo sapiens
gaagugguuguaaucuaga

SEQ ID NO: 282324 - RNA, 19 nt, Homo sapiens
ggugaauguugcugguguu

SEQ ID NO: 282325 - RNA, 19 nt, Homo sapiens
caguggauauuuugacaua

SEQ ID NO: 282326 - RNA, 19 nt, Homo sapiens
ugaugaacuugcccuuguu

SEQ ID NO: 282327 - RNA, 19 nt, Homo sapiens
aagcugccaugguuggauu

SEQ ID NO: 282328 - RNA, 19 nt, Homo sapiens
ccaacguaauguggcuaua

SEQ ID NO: 282329 - RNA, 19 nt, Homo sapiens
aauggugucucagauguug

SEQ ID NO: 282330 - RNA, 19 nt, Homo sapiens
gaauggugucucagauguu

SEQ ID NO: 282331 - RNA, 19 nt, Homo sapiens
ucuagacucugcccguuuc

SEQ ID NO: 282332 - RNA, 19 nt, Homo sapiens
cauuauaguccugauugua

SEQ ID NO: 282333 - RNA, 19 nt, Homo sapiens
gaugaacuugcccuuguug

SEQ ID NO: 282334 - RNA, 19 nt, Homo sapiens
cagauaaggaacacuggaa

SEQ ID NO: 282335 - RNA, 19 nt, Homo sapiens
uaaauuaggaacggauuca

SEQ ID NO: 282336 - RNA, 19 nt, Homo sapiens
aaugauggaucuucagcau

SEQ ID NO: 282337 - RNA, 19 nt, Homo sapiens
gaagggagaaaugauggau

SEQ ID NO: 282338 - RNA, 19 nt, Homo sapiens
ucucagauguugugaaaau

SEQ ID NO: 282339 - RNA, 19 nt, Homo sapiens
uucaaagguucuccaaaug

SEQ ID NO: 282340 - RNA, 19 nt, Homo sapiens
ccaaaugucaacugucaag

SEQ ID NO: 282341 - RNA, 19 nt, Homo sapiens
guaacucguguaauuggaa

SEQ ID NO: 282342 - RNA, 19 nt, Homo sapiens
ggacaaacugaagggagaa

SEQ ID NO: 282343 - RNA, 19 nt, Homo sapiens
aacguaauguggcuauaau

SEQ ID NO: 282344 - RNA, 19 nt, Homo sapiens
gguaggauccauuuugaaa

SEQ ID NO: 282345 - RNA, 19 nt, Homo sapiens
ggaacggauucagauaagg

SEQ ID NO: 282346 - RNA, 19 nt, Homo sapiens
gcccguuuccguuaccuaa

SEQ ID NO: 282347 - RNA, 19 nt, Homo sapiens
ccauuauaguccugauugu

SEQ ID NO: 282348 - RNA, 19 nt, Homo sapiens
ucaagaagagugcagaaac

SEQ ID NO: 282349 - RNA, 19 nt, Homo sapiens
ugugauggaucugguagga

SEQ ID NO: 282350 - RNA, 19 nt, Homo sapiens
uuccugccauaguccauua

SEQ ID NO: 282351 - RNA, 19 nt, Homo sapiens
ggcagucuuuucuuuagua

SEQ ID NO: 282352 - RNA, 19 nt, Homo sapiens
ccuuguugauguugcauug

SEQ ID NO: 282353 - RNA, 19 nt, Homo sapiens
guaggcauggcuugugcua

SEQ ID NO: 282354 - RNA, 19 nt, Homo sapiens
uuaggaacggauucagaua

SEQ ID NO: 282355 - RNA, 19 nt, Homo sapiens
acauauauagucuggaaga

SEQ ID NO: 282356 - RNA, 19 nt, Homo sapiens
ggacaaaucugacgaggaa

SEQ ID NO: 282357 - RNA, 19 nt, Homo sapiens
gaaaugaucuggcugaauc

SEQ ID NO: 282358 - RNA, 19 nt, Homo sapiens
ggacagauaucaucaacga

SEQ ID NO: 282359 - RNA, 19 nt, Homo sapiens
gcaaguggcuuucaacaca

SEQ ID NO: 282360 - RNA, 19 nt, Homo sapiens
gaaguuggcugcguuaaug

SEQ ID NO: 282361 - RNA, 19 nt, Homo sapiens
ggagugaacuggugugaga

SEQ ID NO: 282362 - RNA, 19 nt, Homo sapiens
ggaaaugcaucuccuacaa

SEQ ID NO: 282363 - RNA, 19 nt, Homo sapiens
ugaaaugccucuucuuuau

SEQ ID NO: 282364 - RNA, 19 nt, Homo sapiens
ggaaagcccgugucaauga

SEQ ID NO: 282365 - RNA, 19 nt, Homo sapiens
gcaaggacaugagcgauga

SEQ ID NO: 282366 - RNA, 19 nt, Homo sapiens
gaagauggcucggaugagu

SEQ ID NO: 282367 - RNA, 19 nt, Homo sapiens
ggacaaagucugcaacaug

SEQ ID NO: 282368 - RNA, 19 nt, Homo sapiens
gaaagcccgugucaaugaa

SEQ ID NO: 282369 - RNA, 19 nt, Homo sapiens
cagcgaagaugcgaagaua

SEQ ID NO: 282370 - RNA, 19 nt, Homo sapiens
ccucaaacauggaagauga

SEQ ID NO: 282371 - RNA, 19 nt, Homo sapiens
ggacaugagcgaugaaguu

SEQ ID NO: 282372 - RNA, 19 nt, Homo sapiens
gaagaugucacaagggauu

SEQ ID NO: 282373 - RNA, 19 nt, Homo sapiens
gaacugccauugucgucuu

SEQ ID NO: 282374 - RNA, 19 nt, Homo sapiens
gguuugagcucaggcauuu

SEQ ID NO: 282375 - RNA, 19 nt, Homo sapiens
ugauaagccuuucugguuu

SEQ ID NO: 282376 - RNA, 19 nt, Homo sapiens
gcacugauguccggagaga

SEQ ID NO: 282377 - RNA, 19 nt, Homo sapiens
ggacagugcccaugcaaug

SEQ ID NO: 282378 - RNA, 19 nt, Homo sapiens
cgacagaugugaaagaaac

SEQ ID NO: 282379 - RNA, 19 nt, Homo sapiens
guucagaguuguacacugu

SEQ ID NO: 282380 - RNA, 19 nt, Homo sapiens
ccaacaaguucaaguguca

SEQ ID NO: 282381 - RNA, 19 nt, Homo sapiens
ggagaugggugucacuuuu

SEQ ID NO: 282382 - RNA, 19 nt, Homo sapiens
gaaaugccucuucuuuaug

SEQ ID NO: 282383 - RNA, 19 nt, Homo sapiens
gauaagccuuucugguuuc

SEQ ID NO: 282384 - RNA, 19 nt, Homo sapiens
gugauaagccuuucugguu

SEQ ID NO: 282385 - RNA, 19 nt, Homo sapiens
aaacuucacuccaucucaa

SEQ ID NO: 282386 - RNA, 19 nt, Homo sapiens
ugaaugguguggacaucua

SEQ ID NO: 282387 - RNA, 19 nt, Homo sapiens
gucuuacugugaucaauua

SEQ ID NO: 282388 - RNA, 19 nt, Homo sapiens
guauauugguugaaacugu

SEQ ID NO: 282389 - RNA, 19 nt, Homo sapiens
guaaaugcgucccuguaca

SEQ ID NO: 282390 - RNA, 19 nt, Homo sapiens
gcagaggaaaugagaagaa

SEQ ID NO: 282391 - RNA, 19 nt, Homo sapiens
gaggugcgauggccaagug

SEQ ID NO: 282392 - RNA, 19 nt, Homo sapiens
ucacuugaguucaggaguu

SEQ ID NO: 282393 - RNA, 19 nt, Homo sapiens
ucaaagccgugaucgugaa

SEQ ID NO: 282394 - RNA, 19 nt, Homo sapiens
gaugacaccuccauuucuc

SEQ ID NO: 282395 - RNA, 19 nt, Homo sapiens
ccaagggcgugaagaggaa

SEQ ID NO: 282396 - RNA, 19 nt, Homo sapiens
gaauuccagugcucugaug

SEQ ID NO: 282397 - RNA, 19 nt, Homo sapiens
gaaaucgccguguuacugu

SEQ ID NO: 282398 - RNA, 19 nt, Homo sapiens
gaccaggccugagcaacaa

SEQ ID NO: 282399 - RNA, 19 nt, Homo sapiens
guugauggguauguguuua

SEQ ID NO: 282400 - RNA, 19 nt, Homo sapiens
acauuuggcauuuguguua

SEQ ID NO: 282401 - RNA, 19 nt, Homo sapiens
cggucacccuuaauauuua

SEQ ID NO: 282402 - RNA, 19 nt, Homo sapiens
aggaugagguccacauuug

SEQ ID NO: 282403 - RNA, 19 nt, Homo sapiens
cagagaagaccaaagcauu

SEQ ID NO: 282404 - RNA, 19 nt, Homo sapiens
ggagguggccagcaauaga

SEQ ID NO: 282405 - RNA, 19 nt, Homo sapiens
ggacacagcaggucgugau

SEQ ID NO: 282406 - RNA, 19 nt, Homo sapiens
cugaaaugccucuucuuua

SEQ ID NO: 282407 - RNA, 19 nt, Homo sapiens
gaggaugagguccacauuu

SEQ ID NO: 282408 - RNA, 19 nt, Homo sapiens
ccaauggcaucacccuaga

SEQ ID NO: 282409 - RNA, 19 nt, Homo sapiens
acacggagguggccagcaa

SEQ ID NO: 282410 - RNA, 19 nt, Homo sapiens
gcaucacccuggacaaagu

SEQ ID NO: 282411 - RNA, 19 nt, Homo sapiens
aaaugccucuucuuuaugu

SEQ ID NO: 282412 - RNA, 19 nt, Homo sapiens
cgaggcggguggaucauga

SEQ ID NO: 282413 - RNA, 19 nt, Homo sapiens
gacacaauccucaaacaug

SEQ ID NO: 282414 - RNA, 19 nt, Homo sapiens
ggaccacccugagcaaugg

SEQ ID NO: 282415 - RNA, 19 nt, Homo sapiens
ucuacucgcuggugacuga

SEQ ID NO: 282416 - RNA, 19 nt, Homo sapiens
gcgaagauggcucggauga

SEQ ID NO: 282417 - RNA, 19 nt, Homo sapiens
aggcugagcuggaucacuu

SEQ ID NO: 282418 - RNA, 19 nt, Homo sapiens
ggcgacagaugugaaagaa

SEQ ID NO: 282419 - RNA, 19 nt, Homo sapiens
ucaccggucacccuuaaua

SEQ ID NO: 282420 - RNA, 19 nt, Homo sapiens
ugagggcucuguccauugu

SEQ ID NO: 282421 - RNA, 19 nt, Homo sapiens
gcgagggacccaacaaguu

SEQ ID NO: 282422 - RNA, 19 nt, Homo sapiens
caacagaugaagacccuau

SEQ ID NO: 282423 - RNA, 19 nt, Homo sapiens
ccggucacccuuaauauuu

SEQ ID NO: 282424 - RNA, 19 nt, Homo sapiens
ccaaacucauucaccaaau

SEQ ID NO: 282425 - RNA, 19 nt, Homo sapiens
caucaacagcaucaacuuu

SEQ ID NO: 282426 - RNA, 19 nt, Homo sapiens
gaacaucaacagcaucaac

SEQ ID NO: 282427 - RNA, 19 nt, Homo sapiens
guuccgaugucaacuuguu

SEQ ID NO: 282428 - RNA, 19 nt, Homo sapiens
gaaaugcaucuccuacaag

SEQ ID NO: 282429 - RNA, 19 nt, Homo sapiens
gcgaagaugcgaagauauc

SEQ ID NO: 282430 - RNA, 19 nt, Homo sapiens
gguugaaacuguuaucacu

SEQ ID NO: 282431 - RNA, 19 nt, Homo sapiens
gcaggagaauggugugaac

SEQ ID NO: 282432 - RNA, 19 nt, Homo sapiens
gaaaccccgucucuacuaa

SEQ ID NO: 282433 - RNA, 19 nt, Homo sapiens
ggucacccuuaauauuuau

SEQ ID NO: 282434 - RNA, 19 nt, Homo sapiens
gaugaaguuggcugcguua

SEQ ID NO: 282435 - RNA, 19 nt, Homo sapiens
augcgucccuguacagaua

SEQ ID NO: 282436 - RNA, 19 nt, Homo sapiens
caggaugacaccuccauuu

SEQ ID NO: 282437 - RNA, 19 nt, Homo sapiens
ucugaaaugccucuucuuu

SEQ ID NO: 282438 - RNA, 19 nt, Homo sapiens
gguuauugccucugaaaug

SEQ ID NO: 282439 - RNA, 19 nt, Homo sapiens
gugcaucucucggcaguuc

SEQ ID NO: 282440 - RNA, 19 nt, Homo sapiens
ccugguugcuguauuuguu

SEQ ID NO: 282441 - RNA, 19 nt, Homo sapiens
uuaagaacaucaacagcau

SEQ ID NO: 282442 - RNA, 19 nt, Homo sapiens
gagguggccagcaauagaa

SEQ ID NO: 282443 - RNA, 19 nt, Homo sapiens
aaaugcaucuccuacaagu

SEQ ID NO: 282444 - RNA, 19 nt, Homo sapiens
gcaguucgucugugacuca

SEQ ID NO: 282445 - RNA, 19 nt, Homo sapiens
caggauggcucugaugagu

SEQ ID NO: 282446 - RNA, 19 nt, Homo sapiens
ccauuucucuccaggaagu

SEQ ID NO: 282447 - RNA, 19 nt, Homo sapiens
ccagugcucugauggaaac

SEQ ID NO: 282448 - RNA, 19 nt, Homo sapiens
ugacgggacuucagguucu

SEQ ID NO: 282449 - RNA, 19 nt, Homo sapiens
guguuuaccucuucuaugc

SEQ ID NO: 282450 - RNA, 19 nt, Homo sapiens
cgugagggcucuguccauu

SEQ ID NO: 282451 - RNA, 19 nt, Homo sapiens
guuugcacuuuguauauug

SEQ ID NO: 282452 - RNA, 19 nt, Homo sapiens
ugaaaucgccguguuacug

SEQ ID NO: 282453 - RNA, 19 nt, Homo sapiens
gaucgugaauaucgagaac

SEQ ID NO: 282454 - RNA, 19 nt, Homo sapiens
gacaugagcgaugaaguug

SEQ ID NO: 282455 - RNA, 19 nt, Homo sapiens
ggacugugugcaacgcuuu

SEQ ID NO: 282456 - RNA, 19 nt, Homo sapiens
gaaaguuuauccuggcaua

SEQ ID NO: 282457 - RNA, 19 nt, Homo sapiens
ggucagaucuucaaaauaa

SEQ ID NO: 282458 - RNA, 19 nt, Homo sapiens
ggaagaaacuaaaggaagu

SEQ ID NO: 282459 - RNA, 19 nt, Homo sapiens
ucaaauagcuauccaugga

SEQ ID NO: 282460 - RNA, 19 nt, Homo sapiens
caauaaugguguucgaaua

SEQ ID NO: 282461 - RNA, 19 nt, Homo sapiens
ggacaguacucugcucaaa

SEQ ID NO: 282462 - RNA, 19 nt, Homo sapiens
cuaaauagcuaggaaguau

SEQ ID NO: 282463 - RNA, 19 nt, Homo sapiens
guauaaagguccuauuaag

SEQ ID NO: 282464 - RNA, 19 nt, Homo sapiens
gcagggccaugggcuaaua

SEQ ID NO: 282465 - RNA, 19 nt, Homo sapiens
ucacguaccucauaaacau

SEQ ID NO: 282466 - RNA, 19 nt, Homo sapiens
aaugagagaugcagaauuc

SEQ ID NO: 282467 - RNA, 19 nt, Homo sapiens
gagagaugcagaauucuaa

SEQ ID NO: 282468 - RNA, 19 nt, Homo sapiens
gccaugggcuaauauaugu

SEQ ID NO: 282469 - RNA, 19 nt, Homo sapiens
cgagugacccuacugcaua

SEQ ID NO: 282470 - RNA, 19 nt, Homo sapiens
ggagaaaccuuaucaaaac

SEQ ID NO: 282471 - RNA, 19 nt, Homo sapiens
gcuaggaaguauucauuca

SEQ ID NO: 282472 - RNA, 19 nt, Homo sapiens
acaguacucugcucaaaga

SEQ ID NO: 282473 - RNA, 19 nt, Homo sapiens
caugauaaaugcaagaaag

SEQ ID NO: 282474 - RNA, 19 nt, Homo sapiens
gaagaaacuaaaggaagua

SEQ ID NO: 282475 - RNA, 19 nt, Homo sapiens
caucucacguaccucauaa

SEQ ID NO: 282476 - RNA, 19 nt, Homo sapiens
gcagaauucuaaggcuaaa

SEQ ID NO: 282477 - RNA, 19 nt, Homo sapiens
uauggaaucugagugguuu

SEQ ID NO: 282478 - RNA, 19 nt, Homo sapiens
gaaggccaauggucagauc

SEQ ID NO: 282479 - RNA, 19 nt, Homo sapiens
guacucugcucaaagaagu

SEQ ID NO: 282480 - RNA, 19 nt, Homo sapiens
caggagaaaccuuaucaaa

SEQ ID NO: 282481 - RNA, 19 nt, Homo sapiens
cauggaauauuagaacuug

SEQ ID NO: 282482 - RNA, 19 nt, Homo sapiens
agaaugcuaucaauaaugg

SEQ ID NO: 282483 - RNA, 19 nt, Homo sapiens
gaaaugagagaugcagaau

SEQ ID NO: 282484 - RNA, 19 nt, Homo sapiens
guaaaucgaaggccaaugg

SEQ ID NO: 282485 - RNA, 19 nt, Homo sapiens
cugcauaccuguaaaucga

SEQ ID NO: 282486 - RNA, 19 nt, Homo sapiens
uaaagguccuauuaagaag

SEQ ID NO: 282487 - RNA, 19 nt, Homo sapiens
aaucagaggaagaaacuaa

SEQ ID NO: 282488 - RNA, 19 nt, Homo sapiens
gcuccauccucuuaaacuu

SEQ ID NO: 282489 - RNA, 19 nt, Homo sapiens
agcuauccauggaauauua

SEQ ID NO: 282490 - RNA, 19 nt, Homo sapiens
acaccuauguacccacaaa

SEQ ID NO: 282491 - RNA, 19 nt, Homo sapiens
gcuggcaagucuuccaaug

SEQ ID NO: 282492 - RNA, 19 nt, Homo sapiens
ugucaccuauggaaucuga

SEQ ID NO: 282493 - RNA, 19 nt, Homo sapiens
ggccaugggcuaauauaug

SEQ ID NO: 282494 - RNA, 19 nt, Homo sapiens
aaauagcuauccauggaau

SEQ ID NO: 282495 - RNA, 19 nt, Homo sapiens
gaggaagaaacuaaaggaa

SEQ ID NO: 282496 - RNA, 19 nt, Homo sapiens
gacuugcuccauccucuua

SEQ ID NO: 282497 - RNA, 19 nt, Homo sapiens
ugagagaugcagaauucua

SEQ ID NO: 282498 - RNA, 19 nt, Homo sapiens
ggaaguauucauucaaacu

SEQ ID NO: 282499 - RNA, 19 nt, Homo sapiens
uauaugugcuggcaagucu

SEQ ID NO: 282500 - RNA, 19 nt, Homo sapiens
ucuuugaucugucaccuau

SEQ ID NO: 282501 - RNA, 19 nt, Homo sapiens
acacauugcaugccuguau

SEQ ID NO: 282502 - RNA, 19 nt, Homo sapiens
gcaagucuuccaaugagau

SEQ ID NO: 282503 - RNA, 19 nt, Homo sapiens
gaaucugagugguuuuauu

SEQ ID NO: 282504 - RNA, 19 nt, Homo sapiens
uaacucauugucacucuga

SEQ ID NO: 282505 - RNA, 19 nt, Homo sapiens
ccaauggucagaucuucaa

SEQ ID NO: 282506 - RNA, 19 nt, Homo sapiens
uagcuaggaaguauucauu

SEQ ID NO: 282507 - RNA, 19 nt, Homo sapiens
caaauagcuauccauggaa

SEQ ID NO: 282508 - RNA, 19 nt, Homo sapiens
gaacucuauugcccuugca

SEQ ID NO: 282509 - RNA, 19 nt, Homo sapiens
uauuagaacuugacuugcu

SEQ ID NO: 282510 - RNA, 19 nt, Homo sapiens
uggcaagucuuccaaugag

SEQ ID NO: 282511 - RNA, 19 nt, Homo sapiens
gcauacccuucucuucaag

SEQ ID NO: 282512 - RNA, 19 nt, Homo sapiens
uggcuggucugauuucuac

SEQ ID NO: 282513 - RNA, 19 nt, Homo sapiens
ggccaauggucagaucuuc

SEQ ID NO: 282514 - RNA, 19 nt, Homo sapiens
gagugacccuacugcauac

SEQ ID NO: 282515 - RNA, 19 nt, Homo sapiens
gaauaucuggaagagguuu

SEQ ID NO: 282516 - RNA, 19 nt, Homo sapiens
guucgaauaucuggaagag

SEQ ID NO: 282517 - RNA, 19 nt, Homo sapiens
ucaauaaugguguucgaau

SEQ ID NO: 282518 - RNA, 19 nt, Homo sapiens
uaucaauaaugguguucga

SEQ ID NO: 282519 - RNA, 19 nt, Homo sapiens
ggcaagucuuccaaugaga

SEQ ID NO: 282520 - RNA, 19 nt, Homo sapiens
gcuucgggcucuuugaucu

SEQ ID NO: 282521 - RNA, 19 nt, Homo sapiens
caaaacaucucacguaccu

SEQ ID NO: 282522 - RNA, 19 nt, Homo sapiens
uaucaaaacaucucacgua

SEQ ID NO: 282523 - RNA, 19 nt, Homo sapiens
gguguucgaauaucuggaa

SEQ ID NO: 282524 - RNA, 19 nt, Homo sapiens
uaaugguguucgaauaucu

SEQ ID NO: 282525 - RNA, 19 nt, Homo sapiens
agaaaugagagaugcagaa

SEQ ID NO: 282526 - RNA, 19 nt, Homo sapiens
gccaggagaaaccuuauca

SEQ ID NO: 282527 - RNA, 19 nt, Homo sapiens
ucaagaaauuuguguucac

SEQ ID NO: 282528 - RNA, 19 nt, Homo sapiens
ugcauacccuucucuucaa

SEQ ID NO: 282529 - RNA, 19 nt, Homo sapiens
ggaaguaaaaccagauguu

SEQ ID NO: 282530 - RNA, 19 nt, Homo sapiens
cuauugcccuugcagaaag

SEQ ID NO: 282531 - RNA, 19 nt, Homo sapiens
gagaaaccuuaucaaaaca

SEQ ID NO: 282532 - RNA, 19 nt, Homo sapiens
acacuaaagaaaugagaga

SEQ ID NO: 282533 - RNA, 19 nt, Homo sapiens
gaauucuaaggcuaaauag

SEQ ID NO: 282534 - RNA, 19 nt, Homo sapiens
guucuacauuaagccaauu

SEQ ID NO: 282535 - RNA, 19 nt, Homo sapiens
gaucugucaccuauggaau

SEQ ID NO: 282536 - RNA, 19 nt, Homo sapiens
gaugcauacccuucucuuc

SEQ ID NO: 282537 - RNA, 19 nt, Homo sapiens
gauugugggccaggagaaa

SEQ ID NO: 282538 - RNA, 19 nt, Homo sapiens
gacaguacucugcucaaag

SEQ ID NO: 282539 - RNA, 19 nt, Homo sapiens
agaggaagaaacuaaagga

SEQ ID NO: 282540 - RNA, 19 nt, Homo sapiens
uugcaugccuguaucaaaa

SEQ ID NO: 282541 - RNA, 19 nt, Homo sapiens
cacauugcaugccuguauc

SEQ ID NO: 282542 - RNA, 19 nt, Homo sapiens
gauaccccauuuuccauga

SEQ ID NO: 282543 - RNA, 19 nt, Homo sapiens
gggccaugggcuaauauau

SEQ ID NO: 282544 - RNA, 19 nt, Homo sapiens
cguaccucauaaacauaua

SEQ ID NO: 282545 - RNA, 19 nt, Homo sapiens
ccuacugcauaccuguaaa

SEQ ID NO: 282546 - RNA, 19 nt, Homo sapiens
ccagauguuuuccaccaaa

SEQ ID NO: 282547 - RNA, 19 nt, Homo sapiens
cuaggaaguauucauucaa

SEQ ID NO: 282548 - RNA, 19 nt, Homo sapiens
aaacuuggaacucuauugc

SEQ ID NO: 282549 - RNA, 19 nt, Homo sapiens
uuugaucugucaccuaugg

SEQ ID NO: 282550 - RNA, 19 nt, Homo sapiens
ggaugcauacccuucucuu

SEQ ID NO: 282551 - RNA, 19 nt, Homo sapiens
cuaaucagaggaagaaacu

SEQ ID NO: 282552 - RNA, 19 nt, Homo sapiens
aaaugagagaugcagaauu

SEQ ID NO: 282553 - RNA, 19 nt, Homo sapiens
ggaagcacauguuuauuua

SEQ ID NO: 282554 - RNA, 19 nt, Homo sapiens
gaaacaagauaacugagaa

SEQ ID NO: 282555 - RNA, 19 nt, Homo sapiens
aaagguggcucuccaguua

SEQ ID NO: 282556 - RNA, 19 nt, Homo sapiens
ucaaauccauccagaauaa

SEQ ID NO: 282557 - RNA, 19 nt, Homo sapiens
ggagaaggaucuagaaugu

SEQ ID NO: 282558 - RNA, 19 nt, Homo sapiens
caacagauccucaccagua

SEQ ID NO: 282559 - RNA, 19 nt, Homo sapiens
ggaguggucuuuccuauca

SEQ ID NO: 282560 - RNA, 19 nt, Homo sapiens
uggagaagcucacccaaua

SEQ ID NO: 282561 - RNA, 19 nt, Homo sapiens
ccagguaucuccaggauug

SEQ ID NO: 282562 - RNA, 19 nt, Homo sapiens
ccaguuaguucucucguaa

SEQ ID NO: 282563 - RNA, 19 nt, Homo sapiens
agagcgagauuccgucuua

SEQ ID NO: 282564 - RNA, 19 nt, Homo sapiens
gaagaaaacuccuuuagca

SEQ ID NO: 282565 - RNA, 19 nt, Homo sapiens
ccaaggaguuccaugaaga

SEQ ID NO: 282566 - RNA, 19 nt, Homo sapiens
aaagaggaguuucgaggua

SEQ ID NO: 282567 - RNA, 19 nt, Homo sapiens
ccagaaacgugauccaaau

SEQ ID NO: 282568 - RNA, 19 nt, Homo sapiens
ccacaucccuuugaaacaa

SEQ ID NO: 282569 - RNA, 19 nt, Homo sapiens
gaacccugcuugcacuuug

SEQ ID NO: 282570 - RNA, 19 nt, Homo sapiens
ucucguaacugguuucauu

SEQ ID NO: 282571 - RNA, 19 nt, Homo sapiens
gaaacgugauccaaauauc

SEQ ID NO: 282572 - RNA, 19 nt, Homo sapiens
gggcuugcaugccaaauug

SEQ ID NO: 282573 - RNA, 19 nt, Homo sapiens
ugaggugucuuaagccuuu

SEQ ID NO: 282574 - RNA, 19 nt, Homo sapiens
guaacugguuucauuucua

SEQ ID NO: 282575 - RNA, 19 nt, Homo sapiens
ugaauugccugcagagaga

SEQ ID NO: 282576 - RNA, 19 nt, Homo sapiens
gagaagcucacccaauaaa

SEQ ID NO: 282577 - RNA, 19 nt, Homo sapiens
ggaaggagugagaucauuu

SEQ ID NO: 282578 - RNA, 19 nt, Homo sapiens
uggcugagcugaacccauu

SEQ ID NO: 282579 - RNA, 19 nt, Homo sapiens
ccaggacucugucaauuuc

SEQ ID NO: 282580 - RNA, 19 nt, Homo sapiens
gcaauugcuuaggauguuu

SEQ ID NO: 282581 - RNA, 19 nt, Homo sapiens
agaaggaucuagaaugugu

SEQ ID NO: 282582 - RNA, 19 nt, Homo sapiens
gaagggagaaggaucuaga

SEQ ID NO: 282583 - RNA, 19 nt, Homo sapiens
gaagcucacccaauaaaca

SEQ ID NO: 282584 - RNA, 19 nt, Homo sapiens
gaggucacauucaggaaga

SEQ ID NO: 282585 - RNA, 19 nt, Homo sapiens
gcucacccaauaaacauua

SEQ ID NO: 282586 - RNA, 19 nt, Homo sapiens
ggagaagcucacccaauaa

SEQ ID NO: 282587 - RNA, 19 nt, Homo sapiens
caaagagccuggagaagcu

SEQ ID NO: 282588 - RNA, 19 nt, Homo sapiens
uagcccagguccucugaua

SEQ ID NO: 282589 - RNA, 19 nt, Homo sapiens
gcuggaagcacauguuuau

SEQ ID NO: 282590 - RNA, 19 nt, Homo sapiens
gcuugaaaccaaagauaua

SEQ ID NO: 282591 - RNA, 19 nt, Homo sapiens
guguggagaugcagaggua

SEQ ID NO: 282592 - RNA, 19 nt, Homo sapiens
gcuauaggcuggagaagcu

SEQ ID NO: 282593 - RNA, 19 nt, Homo sapiens
ggagugagaucauuuucuu

SEQ ID NO: 282594 - RNA, 19 nt, Homo sapiens
uggaagcacauguuuauuu

SEQ ID NO: 282595 - RNA, 19 nt, Homo sapiens
ugaaggaggugagggaugu

SEQ ID NO: 282596 - RNA, 19 nt, Homo sapiens
gcacuuuguaacauguuua

SEQ ID NO: 282597 - RNA, 19 nt, Homo sapiens
uaacugguuucauuucuac

SEQ ID NO: 282598 - RNA, 19 nt, Homo sapiens
ggguaaagaaguuugauau

SEQ ID NO: 282599 - RNA, 19 nt, Homo sapiens
aaaccgcacucacccaugu

SEQ ID NO: 282600 - RNA, 19 nt, Homo sapiens
cagaaacgugauccaaaua

SEQ ID NO: 282601 - RNA, 19 nt, Homo sapiens
gagcgagauuccgucuuaa

SEQ ID NO: 282602 - RNA, 19 nt, Homo sapiens
gaaggguaaagaaguuuga

SEQ ID NO: 282603 - RNA, 19 nt, Homo sapiens
gagagaagccuguuuuguu

SEQ ID NO: 282604 - RNA, 19 nt, Homo sapiens
gggagaaggaucuagaaug

SEQ ID NO: 282605 - RNA, 19 nt, Homo sapiens
ccaguaugccuuccagaaa

SEQ ID NO: 282606 - RNA, 19 nt, Homo sapiens
gaaaccccgucucuacuaa

SEQ ID NO: 282607 - RNA, 19 nt, Homo sapiens
ggaccagguuauuuuaaaa

SEQ ID NO: 282608 - RNA, 19 nt, Homo sapiens
aacagaaagucaccgguuu

SEQ ID NO: 282609 - RNA, 19 nt, Homo sapiens
aauuguaguucuugucuga

SEQ ID NO: 282610 - RNA, 19 nt, Homo sapiens
ugucaagugucauauguag

SEQ ID NO: 282611 - RNA, 19 nt, Homo sapiens
gcagucagucuccuccaaa

SEQ ID NO: 282612 - RNA, 19 nt, Homo sapiens
gagacaggagaaucgcuua

SEQ ID NO: 282613 - RNA, 19 nt, Homo sapiens
gaucacaaggucacuagau

SEQ ID NO: 282614 - RNA, 19 nt, Homo sapiens
cgagguagaguuugaagga

SEQ ID NO: 282615 - RNA, 19 nt, Homo sapiens
gaguuucgagguagaguuu

SEQ ID NO: 282616 - RNA, 19 nt, Homo sapiens
ggagugcaguuuccaaucc

SEQ ID NO: 282617 - RNA, 19 nt, Homo sapiens
gaaucaaagcaguuaacuu

SEQ ID NO: 282618 - RNA, 19 nt, Homo sapiens
gaagaugaaagaggagguu

SEQ ID NO: 282619 - RNA, 19 nt, Homo sapiens
gguuucauuucuacuguga

SEQ ID NO: 282620 - RNA, 19 nt, Homo sapiens
agcaagagcuggcaaaggu

SEQ ID NO: 282621 - RNA, 19 nt, Homo sapiens
gcuaauucccagaguguga

SEQ ID NO: 282622 - RNA, 19 nt, Homo sapiens
ugaaacaagauaacugaga

SEQ ID NO: 282623 - RNA, 19 nt, Homo sapiens
caaagguggcucuccaguu

SEQ ID NO: 282624 - RNA, 19 nt, Homo sapiens
ggaguuaagaguagcaagu

SEQ ID NO: 282625 - RNA, 19 nt, Homo sapiens
cuugaaggguaaagaaguu

SEQ ID NO: 282626 - RNA, 19 nt, Homo sapiens
aguccaagaugacaccaaa

SEQ ID NO: 282627 - RNA, 19 nt, Homo sapiens
gcagagagaagccuguuuu

SEQ ID NO: 282628 - RNA, 19 nt, Homo sapiens
cagggcaucuuagcuucua

SEQ ID NO: 282629 - RNA, 19 nt, Homo sapiens
uuacuccaguggugaagaa

SEQ ID NO: 282630 - RNA, 19 nt, Homo sapiens
ugaucacacucuggguuua

SEQ ID NO: 282631 - RNA, 19 nt, Homo sapiens
ggugugacccucugaaugg

SEQ ID NO: 282632 - RNA, 19 nt, Homo sapiens
gacaggagaaucgcuuaaa

SEQ ID NO: 282633 - RNA, 19 nt, Homo sapiens
gacagcaggugggaaaugg

SEQ ID NO: 282634 - RNA, 19 nt, Homo sapiens
uaucuucugcaauugcuua

SEQ ID NO: 282635 - RNA, 19 nt, Homo sapiens
gcagaagggagaaggaucu

SEQ ID NO: 282636 - RNA, 19 nt, Homo sapiens
gggcaagggccaugcugaa

SEQ ID NO: 282637 - RNA, 19 nt, Homo sapiens
guuggaagguuuggugugu

SEQ ID NO: 282638 - RNA, 19 nt, Homo sapiens
ccauccugcugcuguguuu

SEQ ID NO: 282639 - RNA, 19 nt, Homo sapiens
gaccaggggugauuucaga

SEQ ID NO: 282640 - RNA, 19 nt, Homo sapiens
cuaagccacucuuccaaag

SEQ ID NO: 282641 - RNA, 19 nt, Homo sapiens
cacaaaaccuggcacaaug

SEQ ID NO: 282642 - RNA, 19 nt, Homo sapiens
gcgagaggcagagaaagaa

SEQ ID NO: 282643 - RNA, 19 nt, Homo sapiens
guaaaagugugagcaguga

SEQ ID NO: 282644 - RNA, 19 nt, Homo sapiens
cagcaggugggaaauggua

SEQ ID NO: 282645 - RNA, 19 nt, Homo sapiens
ucacacucuggguuuauua

SEQ ID NO: 282646 - RNA, 19 nt, Homo sapiens
ggaacucccagcaacacaa

SEQ ID NO: 282647 - RNA, 19 nt, Homo sapiens
ccaacgaccuggagaaccu

SEQ ID NO: 282648 - RNA, 19 nt, Homo sapiens
gagaggcagagaaagaaga

SEQ ID NO: 282649 - RNA, 19 nt, Homo sapiens
agagaagccuguuuuguug

SEQ ID NO: 282650 - RNA, 19 nt, Homo sapiens
caaauuguaguucuugucu

SEQ ID NO: 282651 - RNA, 19 nt, Homo sapiens
uggaaggagugagaucauu

SEQ ID NO: 282652 - RNA, 19 nt, Homo sapiens
ucaccaggaucaaugacau

SEQ ID NO: 282653 - RNA, 19 nt, Homo sapiens
gaacaagggcuuauaaaua

SEQ ID NO: 282654 - RNA, 19 nt, Homo sapiens
gaaguaagaugauuuguca

SEQ ID NO: 282655 - RNA, 19 nt, Homo sapiens
gaggaaaguuuaccuauga

SEQ ID NO: 282656 - RNA, 19 nt, Homo sapiens
cagagaagcugacaagauu

SEQ ID NO: 282657 - RNA, 19 nt, Homo sapiens
gauagaaacugcuccuuau

SEQ ID NO: 282658 - RNA, 19 nt, Homo sapiens
ggacugggauauuggagua

SEQ ID NO: 282659 - RNA, 19 nt, Homo sapiens
gaagaacaagggcuuauaa

SEQ ID NO: 282660 - RNA, 19 nt, Homo sapiens
gaaaccagaguccaaauuu

SEQ ID NO: 282661 - RNA, 19 nt, Homo sapiens
gaagauguaugagguuuau

SEQ ID NO: 282662 - RNA, 19 nt, Homo sapiens
gcuggacucucaaagaaua

SEQ ID NO: 282663 - RNA, 19 nt, Homo sapiens
gaaggaaagacauuuguuu

SEQ ID NO: 282664 - RNA, 19 nt, Homo sapiens
ugaccuaacuguguaauuu

SEQ ID NO: 282665 - RNA, 19 nt, Homo sapiens
gaaguacaauggaagaugu

SEQ ID NO: 282666 - RNA, 19 nt, Homo sapiens
caacgacacucuccuuaug

SEQ ID NO: 282667 - RNA, 19 nt, Homo sapiens
gaagccugauccaccauua

SEQ ID NO: 282668 - RNA, 19 nt, Homo sapiens
aaacagcaguugugugauu

SEQ ID NO: 282669 - RNA, 19 nt, Homo sapiens
ccagagugaugcagguuua

SEQ ID NO: 282670 - RNA, 19 nt, Homo sapiens
gaaaauaucuugggaaaag

SEQ ID NO: 282671 - RNA, 19 nt, Homo sapiens
caucuuacaugccucaauu

SEQ ID NO: 282672 - RNA, 19 nt, Homo sapiens
gaaggauucuuucucuaau

SEQ ID NO: 282673 - RNA, 19 nt, Homo sapiens
guucagagauaugugauaa

SEQ ID NO: 282674 - RNA, 19 nt, Homo sapiens
gugcuucuguugcaaauuu

SEQ ID NO: 282675 - RNA, 19 nt, Homo sapiens
gagcaagcacauacuguua

SEQ ID NO: 282676 - RNA, 19 nt, Homo sapiens
gaaaagaaguacaauggaa

SEQ ID NO: 282677 - RNA, 19 nt, Homo sapiens
gaugcagguuuauauguaa

SEQ ID NO: 282678 - RNA, 19 nt, Homo sapiens
ggaaaucacacgaaauuca

SEQ ID NO: 282679 - RNA, 19 nt, Homo sapiens
aaucacaucugguggagua

SEQ ID NO: 282680 - RNA, 19 nt, Homo sapiens
cagccaaucuuccuauuau

SEQ ID NO: 282681 - RNA, 19 nt, Homo sapiens
gaucauguuagcaaaguua

SEQ ID NO: 282682 - RNA, 19 nt, Homo sapiens
cacagaugaugguaauuua

SEQ ID NO: 282683 - RNA, 19 nt, Homo sapiens
ggagugagcaagauagaaa

SEQ ID NO: 282684 - RNA, 19 nt, Homo sapiens
acucagugcuuauccuuua

SEQ ID NO: 282685 - RNA, 19 nt, Homo sapiens
guucugauauuccaucuau

SEQ ID NO: 282686 - RNA, 19 nt, Homo sapiens
aacaagggcuuauaaauag

SEQ ID NO: 282687 - RNA, 19 nt, Homo sapiens
gauauuccaucuauucauc

SEQ ID NO: 282688 - RNA, 19 nt, Homo sapiens
gagauuguuugguggauga

SEQ ID NO: 282689 - RNA, 19 nt, Homo sapiens
caauugagguaucauagga

SEQ ID NO: 282690 - RNA, 19 nt, Homo sapiens
cacaagaugucauauacuu

SEQ ID NO: 282691 - RNA, 19 nt, Homo sapiens
agacagcuguugaaccuaa

SEQ ID NO: 282692 - RNA, 19 nt, Homo sapiens
ggacaguugcucacacuuu

SEQ ID NO: 282693 - RNA, 19 nt, Homo sapiens
gaugugccuuagaggauua

SEQ ID NO: 282694 - RNA, 19 nt, Homo sapiens
cagauucgcuaugguuuaa

SEQ ID NO: 282695 - RNA, 19 nt, Homo sapiens
ggagcagccuuuacuguuc

SEQ ID NO: 282696 - RNA, 19 nt, Homo sapiens
caacaacuguggucucucu

SEQ ID NO: 282697 - RNA, 19 nt, Homo sapiens
uagaaucucuucaucuguu

SEQ ID NO: 282698 - RNA, 19 nt, Homo sapiens
ugaaacugauggguacuua

SEQ ID NO: 282699 - RNA, 19 nt, Homo sapiens
uuaaagcucucguggcauu

SEQ ID NO: 282700 - RNA, 19 nt, Homo sapiens
cuacaacaguuaucagaga

SEQ ID NO: 282701 - RNA, 19 nt, Homo sapiens
gacaguugcucacacuuug

SEQ ID NO: 282702 - RNA, 19 nt, Homo sapiens
gaaaaggguucuguuugua

SEQ ID NO: 282703 - RNA, 19 nt, Homo sapiens
ugaugcagguuuauaugua

SEQ ID NO: 282704 - RNA, 19 nt, Homo sapiens
gcaguugugugauuguuuc

SEQ ID NO: 282705 - RNA, 19 nt, Homo sapiens
gaucagcaucccaacauaa

SEQ ID NO: 282706 - RNA, 19 nt, Homo sapiens
gauagaggcccaggcauuu

SEQ ID NO: 282707 - RNA, 19 nt, Homo sapiens
ggacagagcaagcacauac

SEQ ID NO: 282708 - RNA, 19 nt, Homo sapiens
cagaagaugugggaaauca

SEQ ID NO: 282709 - RNA, 19 nt, Homo sapiens
caucauacuuccugcaaug

SEQ ID NO: 282710 - RNA, 19 nt, Homo sapiens
ccacacaagaugucauaua

SEQ ID NO: 282711 - RNA, 19 nt, Homo sapiens
caaauucaaccuaugacua

SEQ ID NO: 282712 - RNA, 19 nt, Homo sapiens
uuacaugccucaauuccaa

SEQ ID NO: 282713 - RNA, 19 nt, Homo sapiens
cagaagauaucaguguuga

SEQ ID NO: 282714 - RNA, 19 nt, Homo sapiens
ucgcuaugcugaauuauau

SEQ ID NO: 282715 - RNA, 19 nt, Homo sapiens
ucaucgcuaugcugaauua

SEQ ID NO: 282716 - RNA, 19 nt, Homo sapiens
ucauauacuuuccaccuaa

SEQ ID NO: 282717 - RNA, 19 nt, Homo sapiens
gaugcaaacuggaacauac

SEQ ID NO: 282718 - RNA, 19 nt, Homo sapiens
uauuuccucuuccaucuua

SEQ ID NO: 282719 - RNA, 19 nt, Homo sapiens
uaugagaggaccugaauuu

SEQ ID NO: 282720 - RNA, 19 nt, Homo sapiens
gcacuuugcaauugaggua

SEQ ID NO: 282721 - RNA, 19 nt, Homo sapiens
gcaauugcaguguucauga

SEQ ID NO: 282722 - RNA, 19 nt, Homo sapiens
caagaugugugaccuaacu

SEQ ID NO: 282723 - RNA, 19 nt, Homo sapiens
ugaaggauucuuucucuaa

SEQ ID NO: 282724 - RNA, 19 nt, Homo sapiens
ggaagauguaugagguuua

SEQ ID NO: 282725 - RNA, 19 nt, Homo sapiens
ucacuugacucuccaccaa

SEQ ID NO: 282726 - RNA, 19 nt, Homo sapiens
ccuauuaucuggcuacaca

SEQ ID NO: 282727 - RNA, 19 nt, Homo sapiens
cgaggaaaguuuaccuaug

SEQ ID NO: 282728 - RNA, 19 nt, Homo sapiens
gcguuuaacuugucauauc

SEQ ID NO: 282729 - RNA, 19 nt, Homo sapiens
aaaccagaguccaaauuug

SEQ ID NO: 282730 - RNA, 19 nt, Homo sapiens
gaguacuccucgugucuuu

SEQ ID NO: 282731 - RNA, 19 nt, Homo sapiens
gagaauucuacaacaguua

SEQ ID NO: 282732 - RNA, 19 nt, Homo sapiens
ucacagaugaugguaauuu

SEQ ID NO: 282733 - RNA, 19 nt, Homo sapiens
ucaugaauguugugaaugu

SEQ ID NO: 282734 - RNA, 19 nt, Homo sapiens
cagacaacauugaaggaaa

SEQ ID NO: 282735 - RNA, 19 nt, Homo sapiens
gauaacugcguuuaacuug

SEQ ID NO: 282736 - RNA, 19 nt, Homo sapiens
cagcaucccaacauaauuu

SEQ ID NO: 282737 - RNA, 19 nt, Homo sapiens
guucagucuuuacccaaua

SEQ ID NO: 282738 - RNA, 19 nt, Homo sapiens
uuaaacagcaguuguguga

SEQ ID NO: 282739 - RNA, 19 nt, Homo sapiens
uagauggacugggauauug

SEQ ID NO: 282740 - RNA, 19 nt, Homo sapiens
caauugcaguguucaugaa

SEQ ID NO: 282741 - RNA, 19 nt, Homo sapiens
gagagagaguggugugcuu

SEQ ID NO: 282742 - RNA, 19 nt, Homo sapiens
cuuauugcuuggaacauua

SEQ ID NO: 282743 - RNA, 19 nt, Homo sapiens
gaaaccaaaccucgaggaa

SEQ ID NO: 282744 - RNA, 19 nt, Homo sapiens
ggaugaauuuagcugagaa

SEQ ID NO: 282745 - RNA, 19 nt, Homo sapiens
ucaguucagcccauaaaua

SEQ ID NO: 282746 - RNA, 19 nt, Homo sapiens
ugaaacuggugaagaacaa

SEQ ID NO: 282747 - RNA, 19 nt, Homo sapiens
aaaggguucuguuuguauu

SEQ ID NO: 282748 - RNA, 19 nt, Homo sapiens
ggaugugccuuagaggauu

SEQ ID NO: 282749 - RNA, 19 nt, Homo sapiens
caaacuuguucuacucaga

SEQ ID NO: 282750 - RNA, 19 nt, Homo sapiens
aagugaaacuggugaagaa

SEQ ID NO: 282751 - RNA, 19 nt, Homo sapiens
gcagguuuauauguaauug

SEQ ID NO: 282752 - RNA, 19 nt, Homo sapiens
caucaucgcuaugcugaau

SEQ ID NO: 282753 - RNA, 19 nt, Homo sapiens
gaaagcagcugcacucaga

SEQ ID NO: 282754 - RNA, 19 nt, Homo sapiens
gaucugcgcugaccucuuc

SEQ ID NO: 282755 - RNA, 19 nt, Homo sapiens
caagcaggcuagucaauga

SEQ ID NO: 282756 - RNA, 19 nt, Homo sapiens
ggaccuugauuucuagauu

SEQ ID NO: 282757 - RNA, 19 nt, Homo sapiens
gaccuugauuucuagauuu

SEQ ID NO: 282758 - RNA, 19 nt, Homo sapiens
gagauggccuugaagaaca

SEQ ID NO: 282759 - RNA, 19 nt, Homo sapiens
cucaguggcucaucuaaua

SEQ ID NO: 282760 - RNA, 19 nt, Homo sapiens
ucagagacuuccauaauca

SEQ ID NO: 282761 - RNA, 19 nt, Homo sapiens
ccagguggcugagauugua

SEQ ID NO: 282762 - RNA, 19 nt, Homo sapiens
ccaaagacuucucuguguu

SEQ ID NO: 282763 - RNA, 19 nt, Homo sapiens
gcacaggcguccaggaaag

SEQ ID NO: 282764 - RNA, 19 nt, Homo sapiens
guagagaagucccucaagu

SEQ ID NO: 282765 - RNA, 19 nt, Homo sapiens
ucgcagaggugaagagcua

SEQ ID NO: 282766 - RNA, 19 nt, Homo sapiens
gguuucagcuuucaguuau

SEQ ID NO: 282767 - RNA, 19 nt, Homo sapiens
gggagaacgucaucagugu

SEQ ID NO: 282768 - RNA, 19 nt, Homo sapiens
ccaaagagaaggcagagaa

SEQ ID NO: 282769 - RNA, 19 nt, Homo sapiens
gcgagcagguggacaacaa

SEQ ID NO: 282770 - RNA, 19 nt, Homo sapiens
ugauugagcugguggacaa

SEQ ID NO: 282771 - RNA, 19 nt, Homo sapiens
agaagucacucaccaagga

SEQ ID NO: 282772 - RNA, 19 nt, Homo sapiens
caaagacuucucuguguuu

SEQ ID NO: 282773 - RNA, 19 nt, Homo sapiens
ccauggagauucagucugu

SEQ ID NO: 282774 - RNA, 19 nt, Homo sapiens
aggaagagaucacgaagga

SEQ ID NO: 282775 - RNA, 19 nt, Homo sapiens
uggacgagcugaagcacua

SEQ ID NO: 282776 - RNA, 19 nt, Homo sapiens
ccgcagaggugguggugaa

SEQ ID NO: 282777 - RNA, 19 nt, Homo sapiens
uaaaucagagacuuccaua

SEQ ID NO: 282778 - RNA, 19 nt, Homo sapiens
ggaauaaaucagagacuuc

SEQ ID NO: 282779 - RNA, 19 nt, Homo sapiens
ggagaaggccaaagagaag

SEQ ID NO: 282780 - RNA, 19 nt, Homo sapiens
ucccagagauuguggcaaa

SEQ ID NO: 282781 - RNA, 19 nt, Homo sapiens
ggagcucuuucucggcuuu

SEQ ID NO: 282782 - RNA, 19 nt, Homo sapiens
acacaguccugcagucaga

SEQ ID NO: 282783 - RNA, 19 nt, Homo sapiens
gcgaucaccucggcuguug

SEQ ID NO: 282784 - RNA, 19 nt, Homo sapiens
uuccagagguuucagcuuu

SEQ ID NO: 282785 - RNA, 19 nt, Homo sapiens
gcuagucaaugaggcauga

SEQ ID NO: 282786 - RNA, 19 nt, Homo sapiens
ucgaggagauggccuugaa

SEQ ID NO: 282787 - RNA, 19 nt, Homo sapiens
cagaggugguggugaagaa

SEQ ID NO: 282788 - RNA, 19 nt, Homo sapiens
gaacaagaagcuggaggaa

SEQ ID NO: 282789 - RNA, 19 nt, Homo sapiens
agaagucccucaaguccuu

SEQ ID NO: 282790 - RNA, 19 nt, Homo sapiens
ucaagaaggaacuuucaaa

SEQ ID NO: 282791 - RNA, 19 nt, Homo sapiens
gaucaagaaggaacuuuca

SEQ ID NO: 282792 - RNA, 19 nt, Homo sapiens
aaucagagacuuccauaau

SEQ ID NO: 282793 - RNA, 19 nt, Homo sapiens
ccacaucgcugcucauccu

SEQ ID NO: 282794 - RNA, 19 nt, Homo sapiens
uuccugcgcuuccagcuua

SEQ ID NO: 282795 - RNA, 19 nt, Homo sapiens
gggagaggcccagcaauga

SEQ ID NO: 282796 - RNA, 19 nt, Homo sapiens
gcaagcaggcuagucaaug

SEQ ID NO: 282797 - RNA, 19 nt, Homo sapiens
ugaaggacaagaacaagaa

SEQ ID NO: 282798 - RNA, 19 nt, Homo sapiens
aggagaggcugaagaagga

SEQ ID NO: 282799 - RNA, 19 nt, Homo sapiens
aggagaagguggaggagaa

SEQ ID NO: 282800 - RNA, 19 nt, Homo sapiens
ggacaaagaagauguucac

SEQ ID NO: 282801 - RNA, 19 nt, Homo sapiens
gaggagauggccuugaaga

SEQ ID NO: 282802 - RNA, 19 nt, Homo sapiens
ggcugaagaugccuccauu

SEQ ID NO: 282803 - RNA, 19 nt, Homo sapiens
agaaggagaaggccaaaga

SEQ ID NO: 282804 - RNA, 19 nt, Homo sapiens
uugaggaacugccugaaug

SEQ ID NO: 282805 - RNA, 19 nt, Homo sapiens
ugcaggagaucaagaagga

SEQ ID NO: 282806 - RNA, 19 nt, Homo sapiens
aaaggaagcacaggugaaa

SEQ ID NO: 282807 - RNA, 19 nt, Homo sapiens
acuugaagcuucuuucugu

SEQ ID NO: 282808 - RNA, 19 nt, Homo sapiens
cagcugcacucagacaaug

SEQ ID NO: 282809 - RNA, 19 nt, Homo sapiens
ugagggcgauugcuuugug

SEQ ID NO: 282810 - RNA, 19 nt, Homo sapiens
gagcagaagaagucacuca

SEQ ID NO: 282811 - RNA, 19 nt, Homo sapiens
guucagccauuaaagaaac

SEQ ID NO: 282812 - RNA, 19 nt, Homo sapiens
aagcauaggauuuggaaga

SEQ ID NO: 282813 - RNA, 19 nt, Homo sapiens
gauuguagcaacacuggaa

SEQ ID NO: 282814 - RNA, 19 nt, Homo sapiens
ucaagcacauucccgaaag

SEQ ID NO: 282815 - RNA, 19 nt, Homo sapiens
ggacuacagcgaggacuug

SEQ ID NO: 282816 - RNA, 19 nt, Homo sapiens
caaaggaagcacaggugaa

SEQ ID NO: 282817 - RNA, 19 nt, Homo sapiens
cggcugcgcuccauaaagg

SEQ ID NO: 282818 - RNA, 19 nt, Homo sapiens
cuuuguagcuucuaaugug

SEQ ID NO: 282819 - RNA, 19 nt, Homo sapiens
gaaucuaaagccagcaaga

SEQ ID NO: 282820 - RNA, 19 nt, Homo sapiens
gcgaggacuugcaggagau

SEQ ID NO: 282821 - RNA, 19 nt, Homo sapiens
caagcugauugcugaggaa

SEQ ID NO: 282822 - RNA, 19 nt, Homo sapiens
gcagacgacaagcugauug

SEQ ID NO: 282823 - RNA, 19 nt, Homo sapiens
ggagauggccuugaagaac

SEQ ID NO: 282824 - RNA, 19 nt, Homo sapiens
uggaauaaaucagagacuu

SEQ ID NO: 282825 - RNA, 19 nt, Homo sapiens
gaagcaagucaagcacauu

SEQ ID NO: 282826 - RNA, 19 nt, Homo sapiens
cuucuaaugugagguuuga

SEQ ID NO: 282827 - RNA, 19 nt, Homo sapiens
cuguggaccuugauuucua

SEQ ID NO: 282828 - RNA, 19 nt, Homo sapiens
aggaggaugugcaggacua

SEQ ID NO: 282829 - RNA, 19 nt, Homo sapiens
cauaaaggcagacgacaag

SEQ ID NO: 282830 - RNA, 19 nt, Homo sapiens
gcuuucaguuauuugagaa

SEQ ID NO: 282831 - RNA, 19 nt, Homo sapiens
uuucucggcuuucuauuuc

SEQ ID NO: 282832 - RNA, 19 nt, Homo sapiens
ugaagcaagucaagcacau

SEQ ID NO: 282833 - RNA, 19 nt, Homo sapiens
cuaaagccagcaagagauu

SEQ ID NO: 282834 - RNA, 19 nt, Homo sapiens
gaaggaggaaaucgacauc

SEQ ID NO: 282835 - RNA, 19 nt, Homo sapiens
cagagauuguggcaaagga

SEQ ID NO: 282836 - RNA, 19 nt, Homo sapiens
agauuucagugucaauaga

SEQ ID NO: 282837 - RNA, 19 nt, Homo sapiens
accaaagacuucucugugu

SEQ ID NO: 282838 - RNA, 19 nt, Homo sapiens
gcauaggauuuggaagaca

SEQ ID NO: 282839 - RNA, 19 nt, Homo sapiens
cgagugccuucgcauagug

SEQ ID NO: 282840 - RNA, 19 nt, Homo sapiens
cagaaaugccugacacagu

SEQ ID NO: 282841 - RNA, 19 nt, Homo sapiens
gcagacccucccagagauu

SEQ ID NO: 282842 - RNA, 19 nt, Homo sapiens
gcccagcaaugaggaaauc

SEQ ID NO: 282843 - RNA, 19 nt, Homo sapiens
ccagagguuucagcuuuca

SEQ ID NO: 282844 - RNA, 19 nt, Homo sapiens
ccaggggccuccaagcaua

SEQ ID NO: 282845 - RNA, 19 nt, Homo sapiens
gaaggagaaggccaaagag

SEQ ID NO: 282846 - RNA, 19 nt, Homo sapiens
ccgcagcacuggaugaaaa

SEQ ID NO: 282847 - RNA, 19 nt, Homo sapiens
gugagaaggagcugcagaa

SEQ ID NO: 282848 - RNA, 19 nt, Homo sapiens
ccagcaagagauugacaaa

SEQ ID NO: 282849 - RNA, 19 nt, Homo sapiens
ucaaagacuggugaagaaa

SEQ ID NO: 282850 - RNA, 19 nt, Homo sapiens
ccauaaaggcagacgacaa

SEQ ID NO: 282851 - RNA, 19 nt, Homo sapiens
ucagcaagcaggcuaguca

SEQ ID NO: 282852 - RNA, 19 nt, Homo sapiens
ucaacgccaugaagcaagu

SEQ ID NO: 282853 - RNA, 19 nt, Homo sapiens
gaucaaauguguggccuuu

SEQ ID NO: 282854 - RNA, 19 nt, Homo sapiens
gacggugacuucaagauca

SEQ ID NO: 282855 - RNA, 19 nt, Homo sapiens
ccagcaaccugaaucucaa

SEQ ID NO: 282856 - RNA, 19 nt, Homo sapiens
ccagauggauacgaauuca

SEQ ID NO: 282857 - RNA, 19 nt, Homo sapiens
gcugccagauggauacgaa

SEQ ID NO: 282858 - RNA, 19 nt, Homo sapiens
gaacauccuccuggacuca

SEQ ID NO: 282859 - RNA, 19 nt, Homo sapiens
gcaaagacagcaacaaccu

SEQ ID NO: 282860 - RNA, 19 nt, Homo sapiens
gggcaaagacagcaacaac

SEQ ID NO: 282861 - RNA, 19 nt, Homo sapiens
caaccugaaucucaaaccu

SEQ ID NO: 282862 - RNA, 19 nt, Homo sapiens
gccagcaaccugaaucuca

SEQ ID NO: 282863 - RNA, 19 nt, Homo sapiens
cuaagagcuucgugcugaa

SEQ ID NO: 282864 - RNA, 19 nt, Homo sapiens
ucaagcugccagauggaua

SEQ ID NO: 282865 - RNA, 19 nt, Homo sapiens
cuucaacccucgcuucaac

SEQ ID NO: 282866 - RNA, 19 nt, Homo sapiens
ugacuucaagaucaaaugu

SEQ ID NO: 282867 - RNA, 19 nt, Homo sapiens
guguggccuuugacugaaa

SEQ ID NO: 282868 - RNA, 19 nt, Homo sapiens
acuucaagaucaaaugugu

SEQ ID NO: 282869 - RNA, 19 nt, Homo sapiens
ugacggugacuucaagauc

SEQ ID NO: 282870 - RNA, 19 nt, Homo sapiens
uggaggccaucaacuacau

SEQ ID NO: 282871 - RNA, 19 nt, Homo sapiens
acugauggcuuuguaauua

SEQ ID NO: 282872 - RNA, 19 nt, Homo sapiens
cauguccucuuucaaguua

SEQ ID NO: 282873 - RNA, 19 nt, Homo sapiens
caacauguccucuuucaag

SEQ ID NO: 282874 - RNA, 19 nt, Homo sapiens
cgauggcacugauggcuuu

SEQ ID NO: 282875 - RNA, 19 nt, Homo sapiens
gguucaacauguccucuuu

SEQ ID NO: 282876 - RNA, 19 nt, Homo sapiens
gaacuugagguuaagaaca

SEQ ID NO: 282877 - RNA, 19 nt, Homo sapiens
ggucagaggucaaguucac

SEQ ID NO: 282878 - RNA, 19 nt, Homo sapiens
gcacugauggcuuuguaau

SEQ ID NO: 282879 - RNA, 19 nt, Homo sapiens
gggaagaucaccugugcuu

SEQ ID NO: 282880 - RNA, 19 nt, Homo sapiens
cugauggcuuuguaauuaa

SEQ ID NO: 282881 - RNA, 19 nt, Homo sapiens
ggucaacccugaagaucac

SEQ ID NO: 282882 - RNA, 19 nt, Homo sapiens
uggcacugauggcuuugua

SEQ ID NO: 282883 - RNA, 19 nt, Homo sapiens
gcaagaacaacgggaagau

SEQ ID NO: 282884 - RNA, 19 nt, Homo sapiens
ggacagacaagcugaaccu

SEQ ID NO: 282885 - RNA, 19 nt, Homo sapiens
uguccucuuucaaguuaaa

SEQ ID NO: 282886 - RNA, 19 nt, Homo sapiens
cagugaccuuugagaguga

SEQ ID NO: 282887 - RNA, 19 nt, Homo sapiens
aagaacaacgggaagauca

SEQ ID NO: 282888 - RNA, 19 nt, Homo sapiens
gagcugacuuuucccaaca

SEQ ID NO: 282889 - RNA, 19 nt, Homo sapiens
caagaacaacgggaagauc

SEQ ID NO: 282890 - RNA, 19 nt, Homo sapiens
uucaacauguccucuuuca

SEQ ID NO: 282891 - RNA, 19 nt, Homo sapiens
aacuugagguuaagaacau

SEQ ID NO: 282892 - RNA, 19 nt, Homo sapiens
cagcgaauccaccauuguc

SEQ ID NO: 282893 - RNA, 19 nt, Homo sapiens
gacaagcugaaccugcauu

SEQ ID NO: 282894 - RNA, 19 nt, Homo sapiens
gggaacuugagguuaagaa

SEQ ID NO: 282895 - RNA, 19 nt, Homo sapiens
aauccaccauugucugcaa

SEQ ID NO: 282896 - RNA, 19 nt, Homo sapiens
gauguugccuuccacuuua

SEQ ID NO: 282897 - RNA, 19 nt, Homo sapiens
gaaugaugcucacuuguug

SEQ ID NO: 282898 - RNA, 19 nt, Homo sapiens
gaagaaagacagucgguuu

SEQ ID NO: 282899 - RNA, 19 nt, Homo sapiens
cagaauugcuuuagauuuc

SEQ ID NO: 282900 - RNA, 19 nt, Homo sapiens
caauaucccucuuguaagu

SEQ ID NO: 282901 - RNA, 19 nt, Homo sapiens
gcaauacaaagcuggauaa

SEQ ID NO: 282902 - RNA, 19 nt, Homo sapiens
caaacagaauugcuuuaga

SEQ ID NO: 282903 - RNA, 19 nt, Homo sapiens
gaacaacaggagagucauu

SEQ ID NO: 282904 - RNA, 19 nt, Homo sapiens
guguaaagguuucauguuc

SEQ ID NO: 282905 - RNA, 19 nt, Homo sapiens
ggagagucauuguuugcaa

SEQ ID NO: 282906 - RNA, 19 nt, Homo sapiens
guacaaucaucggguuaaa

SEQ ID NO: 282907 - RNA, 19 nt, Homo sapiens
ggccacugauugugccuua

SEQ ID NO: 282908 - RNA, 19 nt, Homo sapiens
gaagcccaaugcaaacaga

SEQ ID NO: 282909 - RNA, 19 nt, Homo sapiens
gaaagugggaaaccauuca

SEQ ID NO: 282910 - RNA, 19 nt, Homo sapiens
gagaacaacaggagaguca

SEQ ID NO: 282911 - RNA, 19 nt, Homo sapiens
ccacugauugugccuuaua

SEQ ID NO: 282912 - RNA, 19 nt, Homo sapiens
ccaaagagggaaugauguu

SEQ ID NO: 282913 - RNA, 19 nt, Homo sapiens
ugaaugaugcucacuuguu

SEQ ID NO: 282914 - RNA, 19 nt, Homo sapiens
ucaaugaaaucagcaaacu

SEQ ID NO: 282915 - RNA, 19 nt, Homo sapiens
ccucaccagugcuucauau

SEQ ID NO: 282916 - RNA, 19 nt, Homo sapiens
acaggagagucauuguuug

SEQ ID NO: 282917 - RNA, 19 nt, Homo sapiens
aucaauaucccucuuguaa

SEQ ID NO: 282918 - RNA, 19 nt, Homo sapiens
ugauguugccuuccacuuu

SEQ ID NO: 282919 - RNA, 19 nt, Homo sapiens
gugccucgcaugcugauaa

SEQ ID NO: 282920 - RNA, 19 nt, Homo sapiens
uggagcaccuggagcuuau

SEQ ID NO: 282921 - RNA, 19 nt, Homo sapiens
aacccacgcuucaaugaga

SEQ ID NO: 282922 - RNA, 19 nt, Homo sapiens
gggaaaccauucaaaauac

SEQ ID NO: 282923 - RNA, 19 nt, Homo sapiens
cacugauugugccuuauaa

SEQ ID NO: 282924 - RNA, 19 nt, Homo sapiens
caaagagggaaugauguug

SEQ ID NO: 282925 - RNA, 19 nt, Homo sapiens
caucaauaucccucuugua

SEQ ID NO: 282926 - RNA, 19 nt, Homo sapiens
ggaaaccauucaaaauaca

SEQ ID NO: 282927 - RNA, 19 nt, Homo sapiens
gacagucgguuuucccauu

SEQ ID NO: 282928 - RNA, 19 nt, Homo sapiens
gcccaaugcaaacagaauu

SEQ ID NO: 282929 - RNA, 19 nt, Homo sapiens
gaauugcuuuagauuucca

SEQ ID NO: 282930 - RNA, 19 nt, Homo sapiens
cggugaagcccaaugcaaa

SEQ ID NO: 282931 - RNA, 19 nt, Homo sapiens
ucaucaauaucccucuugu

SEQ ID NO: 282932 - RNA, 19 nt, Homo sapiens
ugaaaggggcagauuaaaa

SEQ ID NO: 282933 - RNA, 19 nt, Homo sapiens
ugggaaaccauucaaaaua

SEQ ID NO: 282934 - RNA, 19 nt, Homo sapiens
ucaagguugcagugaauga

SEQ ID NO: 282935 - RNA, 19 nt, Homo sapiens
ggaagggaagaaagacagu

SEQ ID NO: 282936 - RNA, 19 nt, Homo sapiens
aaacccaaacccucaagga

SEQ ID NO: 282937 - RNA, 19 nt, Homo sapiens
gcaugcugauaacaauucu

SEQ ID NO: 282938 - RNA, 19 nt, Homo sapiens
caaagcuggauaauaacug

SEQ ID NO: 282939 - RNA, 19 nt, Homo sapiens
gcacggugaagcccaaugc

SEQ ID NO: 282940 - RNA, 19 nt, Homo sapiens
ugaaagugggaaaccauuc

SEQ ID NO: 282941 - RNA, 19 nt, Homo sapiens
gcuccaugaugcguuaucu

SEQ ID NO: 282942 - RNA, 19 nt, Homo sapiens
gagaagcucugccuacagu

SEQ ID NO: 282943 - RNA, 19 nt, Homo sapiens
ggucaaauauucuucugau

SEQ ID NO: 282944 - RNA, 19 nt, Homo sapiens
ccacagaccugcuccaacu

SEQ ID NO: 282945 - RNA, 19 nt, Homo sapiens
uggcagacgucaccgauuu

SEQ ID NO: 282946 - RNA, 19 nt, Homo sapiens
ucacuggucugaggucauu

SEQ ID NO: 282947 - RNA, 19 nt, Homo sapiens
agucacaacuggucuauca

SEQ ID NO: 282948 - RNA, 19 nt, Homo sapiens
ggagugccuuugugacaga

SEQ ID NO: 282949 - RNA, 19 nt, Homo sapiens
ggucugaggucauuaaaau

SEQ ID NO: 282950 - RNA, 19 nt, Homo sapiens
gaguguggaugcugagugu

SEQ ID NO: 282951 - RNA, 19 nt, Homo sapiens
gcucagcuucaagaaauua

SEQ ID NO: 282952 - RNA, 19 nt, Homo sapiens
aggcucagcuucaagaaau

SEQ ID NO: 282953 - RNA, 19 nt, Homo sapiens
cgugaacgauggugacaug

SEQ ID NO: 282954 - RNA, 19 nt, Homo sapiens
ggaccuguaugccuaugca

SEQ ID NO: 282955 - RNA, 19 nt, Homo sapiens
gcagcaaugucaccaugag

SEQ ID NO: 282956 - RNA, 19 nt, Homo sapiens
cggcucagaucgcaccauu

SEQ ID NO: 282957 - RNA, 19 nt, Homo sapiens
ggaagucacaacuggucua

SEQ ID NO: 282958 - RNA, 19 nt, Homo sapiens
gaagcucugccuacaguuc

SEQ ID NO: 282959 - RNA, 19 nt, Homo sapiens
caagcuggccucugccuau

SEQ ID NO: 282960 - RNA, 19 nt, Homo sapiens
cuacugcgcaagccucuuu

SEQ ID NO: 282961 - RNA, 19 nt, Homo sapiens
gcaaugucaccaugagugu

SEQ ID NO: 282962 - RNA, 19 nt, Homo sapiens
cccaccaccucaccaguuu

SEQ ID NO: 282963 - RNA, 19 nt, Homo sapiens
gaagucacaacuggucuau

SEQ ID NO: 282964 - RNA, 19 nt, Homo sapiens
ggccaaggguggugagaac

SEQ ID NO: 282965 - RNA, 19 nt, Homo sapiens
gcguggagaucuucuacag

SEQ ID NO: 282966 - RNA, 19 nt, Homo sapiens
ccagaugucgcccuacuca

SEQ ID NO: 282967 - RNA, 19 nt, Homo sapiens
ggagugcacggaagucaca

SEQ ID NO: 282968 - RNA, 19 nt, Homo sapiens
ucccugggcuggcugaaga

SEQ ID NO: 282969 - RNA, 19 nt, Homo sapiens
gcucagaucgcaccauugc

SEQ ID NO: 282970 - RNA, 19 nt, Homo sapiens
caacugcaggcacgagaga

SEQ ID NO: 282971 - RNA, 19 nt, Homo sapiens
acgaggcccuguuccagaa

SEQ ID NO: 282972 - RNA, 19 nt, Homo sapiens
ucaccgaggauaccuacaa

SEQ ID NO: 282973 - RNA, 19 nt, Homo sapiens
gaacccaaggcgugaacga

SEQ ID NO: 282974 - RNA, 19 nt, Homo sapiens
uggagaagcucugccuaca

SEQ ID NO: 282975 - RNA, 19 nt, Homo sapiens
ggagaggcuucugggucaa

SEQ ID NO: 282976 - RNA, 19 nt, Homo sapiens
gaggcccuguuccagaaga

SEQ ID NO: 282977 - RNA, 19 nt, Homo sapiens
gcccuuggccagaucuuug

SEQ ID NO: 282978 - RNA, 19 nt, Homo sapiens
cgaagagcaccuccuccuu

SEQ ID NO: 282979 - RNA, 19 nt, Homo sapiens
ugucgucagucaagugcuu

SEQ ID NO: 282980 - RNA, 19 nt, Homo sapiens
ccucagguguggacuagac

SEQ ID NO: 282981 - RNA, 19 nt, Homo sapiens
caccuggagugccuuugug

SEQ ID NO: 282982 - RNA, 19 nt, Homo sapiens
gagaggcuucugggucaaa

SEQ ID NO: 282983 - RNA, 19 nt, Homo sapiens
gcugcgaccuguccaucag

SEQ ID NO: 282984 - RNA, 19 nt, Homo sapiens
gacaccaacagcucgaaga

SEQ ID NO: 282985 - RNA, 19 nt, Homo sapiens
caccgaggauaccuacaag

SEQ ID NO: 282986 - RNA, 19 nt, Homo sapiens
aguucaaccugucccugua

SEQ ID NO: 282987 - RNA, 19 nt, Homo sapiens
ggcucagcuucaagaaauu

SEQ ID NO: 282988 - RNA, 19 nt, Homo sapiens
ugggcuggcugaagagcaa

SEQ ID NO: 282989 - RNA, 19 nt, Homo sapiens
cgagcuggcccuacugaag

SEQ ID NO: 282990 - RNA, 19 nt, Homo sapiens
ggagaagcucugccuacag

SEQ ID NO: 282991 - RNA, 19 nt, Homo sapiens
ggacauagcucugcacauu

SEQ ID NO: 282992 - RNA, 19 nt, Homo sapiens
ggaaaucccuucuaugagu

SEQ ID NO: 282993 - RNA, 19 nt, Homo sapiens
gaagaaccaucaucaucaa

SEQ ID NO: 282994 - RNA, 19 nt, Homo sapiens
gaaaucccuucuaugagua

SEQ ID NO: 282995 - RNA, 19 nt, Homo sapiens
ggaacagccuucugaaugg

SEQ ID NO: 282996 - RNA, 19 nt, Homo sapiens
acauagcucugcacauuaa

SEQ ID NO: 282997 - RNA, 19 nt, Homo sapiens
gagcuuugcuaucaacuuc

SEQ ID NO: 282998 - RNA, 19 nt, Homo sapiens
agaagaagaucacccacaa

SEQ ID NO: 282999 - RNA, 19 nt, Homo sapiens
gaugucaccuuguccuaug

SEQ ID NO: 283000 - RNA, 19 nt, Homo sapiens
aaauggaaaucccuucuau

SEQ ID NO: 283001 - RNA, 19 nt, Homo sapiens
caacuucaaucaaucaacu

SEQ ID NO: 283002 - RNA, 19 nt, Homo sapiens
gggacaagguggucuucaa

SEQ ID NO: 283003 - RNA, 19 nt, Homo sapiens
cgaagaaccaucaucauca

SEQ ID NO: 283004 - RNA, 19 nt, Homo sapiens
uuggaucgcuucaagguuu

SEQ ID NO: 283005 - RNA, 19 nt, Homo sapiens
gacauagcucugcacauua

SEQ ID NO: 283006 - RNA, 19 nt, Homo sapiens
ccacuucaauccgcgguuu

SEQ ID NO: 283007 - RNA, 19 nt, Homo sapiens
gccagcaccucuuugacuu

SEQ ID NO: 283008 - RNA, 19 nt, Homo sapiens
cggaacagccuucugaaug

SEQ ID NO: 283009 - RNA, 19 nt, Homo sapiens
gaucacccacaacccauuu

SEQ ID NO: 283010 - RNA, 19 nt, Homo sapiens
gcucgaagaaccaucauca

SEQ ID NO: 283011 - RNA, 19 nt, Homo sapiens
cagcaccucuuugacuuug

SEQ ID NO: 283012 - RNA, 19 nt, Homo sapiens
caagagcuuugcuaucaac

SEQ ID NO: 283013 - RNA, 19 nt, Homo sapiens
gaucugcaacuucaaucaa

SEQ ID NO: 283014 - RNA, 19 nt, Homo sapiens
uaaauggaaaucccuucua

SEQ ID NO: 283015 - RNA, 19 nt, Homo sapiens
gcucagacgucgccuucca

SEQ ID NO: 283016 - RNA, 19 nt, Homo sapiens
acccgacgcugccuuacua

SEQ ID NO: 283017 - RNA, 19 nt, Homo sapiens
gcuaccagcccaccuacaa

SEQ ID NO: 283018 - RNA, 19 nt, Homo sapiens
gauccgaggagaagaagau

SEQ ID NO: 283019 - RNA, 19 nt, Homo sapiens
caacccgccugugccauau

SEQ ID NO: 283020 - RNA, 19 nt, Homo sapiens
gcacuacaaggugguggua

SEQ ID NO: 283021 - RNA, 19 nt, Homo sapiens
agacgucgccuuccacuuc

SEQ ID NO: 283022 - RNA, 19 nt, Homo sapiens
uguccuauguccagaucua

SEQ ID NO: 283023 - RNA, 19 nt, Homo sapiens
acaagguggugguaaaugg

SEQ ID NO: 283024 - RNA, 19 nt, Homo sapiens
acuacaagguggugguaaa

SEQ ID NO: 283025 - RNA, 19 nt, Homo sapiens
auggaaaucccuucuauga

SEQ ID NO: 283026 - RNA, 19 nt, Homo sapiens
ggaaauccagggugauguc

SEQ ID NO: 283027 - RNA, 19 nt, Homo sapiens
ucaacccgccugugccaua

SEQ ID NO: 283028 - RNA, 19 nt, Homo sapiens
gcuuugcuaucaacuucaa

SEQ ID NO: 283029 - RNA, 19 nt, Homo sapiens
gauggucacccaccugcaa

SEQ ID NO: 283030 - RNA, 19 nt, Homo sapiens
uggaucgcuucaagguuua

SEQ ID NO: 283031 - RNA, 19 nt, Homo sapiens
ccuuugagcuggucuucau

SEQ ID NO: 283032 - RNA, 19 nt, Homo sapiens
ggacaagguggucuucaac

SEQ ID NO: 283033 - RNA, 19 nt, Homo sapiens
gaggguggacacauuggaa

SEQ ID NO: 283034 - RNA, 19 nt, Homo sapiens
guucuuugaucuguccauu

SEQ ID NO: 283035 - RNA, 19 nt, Homo sapiens
ccagaggguggacacauug

SEQ ID NO: 283036 - RNA, 19 nt, Homo sapiens
ucacaggaccagccacuag

SEQ ID NO: 283037 - RNA, 19 nt, Homo sapiens
gacgucgccuuccacuuca

SEQ ID NO: 283038 - RNA, 19 nt, Homo sapiens
caauggccagcaccucuuu

SEQ ID NO: 283039 - RNA, 19 nt, Homo sapiens
gaggagcaugcccuucaaa

SEQ ID NO: 283040 - RNA, 19 nt, Homo sapiens
cuucaagguuuacgccaau

SEQ ID NO: 283041 - RNA, 19 nt, Homo sapiens
gaaauccagggugauguca

SEQ ID NO: 283042 - RNA, 19 nt, Homo sapiens
guccggaacagccuucuga

SEQ ID NO: 283043 - RNA, 19 nt, Homo sapiens
acgugggaaugucuguuua

SEQ ID NO: 283044 - RNA, 19 nt, Homo sapiens
ucgaagaaccaucaucauc

SEQ ID NO: 283045 - RNA, 19 nt, Homo sapiens
gggcucacagcucgaagaa

SEQ ID NO: 283046 - RNA, 19 nt, Homo sapiens
ugaacagccugcccaccau

SEQ ID NO: 283047 - RNA, 19 nt, Homo sapiens
ccggacaguucuuugaucu

SEQ ID NO: 283048 - RNA, 19 nt, Homo sapiens
guaaauggaaaucccuucu

SEQ ID NO: 283049 - RNA, 19 nt, Homo sapiens
acaacccgacgcugccuua

SEQ ID NO: 283050 - RNA, 19 nt, Homo sapiens
agaggagcaugcccuucaa

SEQ ID NO: 283051 - RNA, 19 nt, Homo sapiens
gugggaaugucuguuuaca

SEQ ID NO: 283052 - RNA, 19 nt, Homo sapiens
gaagaagaucacccacaac

SEQ ID NO: 283053 - RNA, 19 nt, Homo sapiens
aagaggagcaugcccuuca

SEQ ID NO: 283054 - RNA, 19 nt, Homo sapiens
ggagggcucacagcucgaa

SEQ ID NO: 283055 - RNA, 19 nt, Homo sapiens
gacaagguggucuucaaca

SEQ ID NO: 283056 - RNA, 19 nt, Homo sapiens
ccagcaccucuuugacuuu

SEQ ID NO: 283057 - RNA, 19 nt, Homo sapiens
ggaucugcaacuucaauca

SEQ ID NO: 283058 - RNA, 19 nt, Homo sapiens
caagguggugguaaaugga

SEQ ID NO: 283059 - RNA, 19 nt, Homo sapiens
acccgccugugccauauuu

SEQ ID NO: 283060 - RNA, 19 nt, Homo sapiens
ucccggacauugccaucaa

SEQ ID NO: 283061 - RNA, 19 nt, Homo sapiens
gggcucaacgugggaaugu

SEQ ID NO: 283062 - RNA, 19 nt, Homo sapiens
caucaucaagggcuaugug

SEQ ID NO: 283063 - RNA, 19 nt, Homo sapiens
uggcugagcacuacaaggu

SEQ ID NO: 283064 - RNA, 19 nt, Homo sapiens
ggccuuggcuggcaaauaa

SEQ ID NO: 283065 - RNA, 19 nt, Homo sapiens
gccagcagguuccauguaa

SEQ ID NO: 283066 - RNA, 19 nt, Homo sapiens
gcuggcaaauaaagcguua

SEQ ID NO: 283067 - RNA, 19 nt, Homo sapiens
cgucggagguggucuucaa

SEQ ID NO: 283068 - RNA, 19 nt, Homo sapiens
ccagcagguuccauguaaa

SEQ ID NO: 283069 - RNA, 19 nt, Homo sapiens
gagaauucgcggcuugguu

SEQ ID NO: 283070 - RNA, 19 nt, Homo sapiens
gggccuuggcuggcaaaua

SEQ ID NO: 283071 - RNA, 19 nt, Homo sapiens
gcacuuagcugcugacaaa

SEQ ID NO: 283072 - RNA, 19 nt, Homo sapiens
gcacagaaauuaaggcaaa

SEQ ID NO: 283073 - RNA, 19 nt, Homo sapiens
gggaagagaucaccuauga

SEQ ID NO: 283074 - RNA, 19 nt, Homo sapiens
gaacuuugauugugauaug

SEQ ID NO: 283075 - RNA, 19 nt, Homo sapiens
ggauauugcucuacacuug

SEQ ID NO: 283076 - RNA, 19 nt, Homo sapiens
gaaaguguacgccaacuaa

SEQ ID NO: 283077 - RNA, 19 nt, Homo sapiens
caaaguaaggucaggauua

SEQ ID NO: 283078 - RNA, 19 nt, Homo sapiens
gaacuuagggcaaaucaga

SEQ ID NO: 283079 - RNA, 19 nt, Homo sapiens
gaacugacagagauaagua

SEQ ID NO: 283080 - RNA, 19 nt, Homo sapiens
caaggcagcugauuucugu

SEQ ID NO: 283081 - RNA, 19 nt, Homo sapiens
ggacugauguugacugaca

SEQ ID NO: 283082 - RNA, 19 nt, Homo sapiens
gagcuaggauauauacuug

SEQ ID NO: 283083 - RNA, 19 nt, Homo sapiens
uuaaagagcucagcaguau

SEQ ID NO: 283084 - RNA, 19 nt, Homo sapiens
caacacuuauagccaguua

SEQ ID NO: 283085 - RNA, 19 nt, Homo sapiens
agaaugauguuguccuuaa

SEQ ID NO: 283086 - RNA, 19 nt, Homo sapiens
ggauuagacuucaggcauu

SEQ ID NO: 283087 - RNA, 19 nt, Homo sapiens
gaagagaucaccuaugaca

SEQ ID NO: 283088 - RNA, 19 nt, Homo sapiens
ggaaauuaauggagacauc

SEQ ID NO: 283089 - RNA, 19 nt, Homo sapiens
caaaggauauugcucuaca

SEQ ID NO: 283090 - RNA, 19 nt, Homo sapiens
gauguggccuuucauuuca

SEQ ID NO: 283091 - RNA, 19 nt, Homo sapiens
ucaaagcacucuuccacuu

SEQ ID NO: 283092 - RNA, 19 nt, Homo sapiens
gccaaaagcuuuaauguug

SEQ ID NO: 283093 - RNA, 19 nt, Homo sapiens
gaaugauguuguccuuaaa

SEQ ID NO: 283094 - RNA, 19 nt, Homo sapiens
gcaagaugcauucaauuug

SEQ ID NO: 283095 - RNA, 19 nt, Homo sapiens
ggagaagaagagagaaaua

SEQ ID NO: 283096 - RNA, 19 nt, Homo sapiens
gaggcaagaugcauucaau

SEQ ID NO: 283097 - RNA, 19 nt, Homo sapiens
acaaauacauggugcugaa

SEQ ID NO: 283098 - RNA, 19 nt, Homo sapiens
ggcauuacaucaacuccua

SEQ ID NO: 283099 - RNA, 19 nt, Homo sapiens
gcaucucacugucauucua

SEQ ID NO: 283100 - RNA, 19 nt, Homo sapiens
gcaggaaaaucaaaggaua

SEQ ID NO: 283101 - RNA, 19 nt, Homo sapiens
ugacagagauaaguagaga

SEQ ID NO: 283102 - RNA, 19 nt, Homo sapiens
ccagguggcuguaaaugga

SEQ ID NO: 283103 - RNA, 19 nt, Homo sapiens
ccaagcaucuagucuggaa

SEQ ID NO: 283104 - RNA, 19 nt, Homo sapiens
ggcaagaugcauucaauuu

SEQ ID NO: 283105 - RNA, 19 nt, Homo sapiens
gaacugucgucguuaaagg

SEQ ID NO: 283106 - RNA, 19 nt, Homo sapiens
gaggacugauguugacuga

SEQ ID NO: 283107 - RNA, 19 nt, Homo sapiens
gauguacuuugagaugaua

SEQ ID NO: 283108 - RNA, 19 nt, Homo sapiens
ggucauggcucugaaacau

SEQ ID NO: 283109 - RNA, 19 nt, Homo sapiens
acaagaagcuggaaaagaa

SEQ ID NO: 283110 - RNA, 19 nt, Homo sapiens
gauuaguccaucaucauua

SEQ ID NO: 283111 - RNA, 19 nt, Homo sapiens
gcugcaagcuuuaccaagu

SEQ ID NO: 283112 - RNA, 19 nt, Homo sapiens
gagaagaagagagaaauau

SEQ ID NO: 283113 - RNA, 19 nt, Homo sapiens
ggauauauacuuggugaaa

SEQ ID NO: 283114 - RNA, 19 nt, Homo sapiens
gaguacaaacacagauuua

SEQ ID NO: 283115 - RNA, 19 nt, Homo sapiens
ggaguacaaacacagauuu

SEQ ID NO: 283116 - RNA, 19 nt, Homo sapiens
caacuaagggacccacaaa

SEQ ID NO: 283117 - RNA, 19 nt, Homo sapiens
ggaagaggcaagaugcauu

SEQ ID NO: 283118 - RNA, 19 nt, Homo sapiens
cuacacagcugcuacaaaa

SEQ ID NO: 283119 - RNA, 19 nt, Homo sapiens
gagccgauguggccuuuca

SEQ ID NO: 283120 - RNA, 19 nt, Homo sapiens
uauguucccuguucucuug

SEQ ID NO: 283121 - RNA, 19 nt, Homo sapiens
uauuaccucuuucccauuu

SEQ ID NO: 283122 - RNA, 19 nt, Homo sapiens
uagacacucugggcauuua

SEQ ID NO: 283123 - RNA, 19 nt, Homo sapiens
gaagaggcaagaugcauuc

SEQ ID NO: 283124 - RNA, 19 nt, Homo sapiens
cagaauggcagcaguguga

SEQ ID NO: 283125 - RNA, 19 nt, Homo sapiens
aaaguaaggucaggauuag

SEQ ID NO: 283126 - RNA, 19 nt, Homo sapiens
gcugauuucuguguauuug

SEQ ID NO: 283127 - RNA, 19 nt, Homo sapiens
gcagcugauuucuguguau

SEQ ID NO: 283128 - RNA, 19 nt, Homo sapiens
gugcugaaauuaacuugau

SEQ ID NO: 283129 - RNA, 19 nt, Homo sapiens
aaagagcucagcaguauug

SEQ ID NO: 283130 - RNA, 19 nt, Homo sapiens
aaggagaagugaaugcaaa

SEQ ID NO: 283131 - RNA, 19 nt, Homo sapiens
aaagaaugauguuguccuu

SEQ ID NO: 283132 - RNA, 19 nt, Homo sapiens
caucaucauuagcaacuga

SEQ ID NO: 283133 - RNA, 19 nt, Homo sapiens
acacagacgccuacagaaa

SEQ ID NO: 283134 - RNA, 19 nt, Homo sapiens
uaauaaacauguggcucua

SEQ ID NO: 283135 - RNA, 19 nt, Homo sapiens
uugacacgcuggaaauuaa

SEQ ID NO: 283136 - RNA, 19 nt, Homo sapiens
ggauguacuuugagaugau

SEQ ID NO: 283137 - RNA, 19 nt, Homo sapiens
gggauguacuuugagauga

SEQ ID NO: 283138 - RNA, 19 nt, Homo sapiens
gggcauuuauggcaaagug

SEQ ID NO: 283139 - RNA, 19 nt, Homo sapiens
auaaacauguggcucuauu

SEQ ID NO: 283140 - RNA, 19 nt, Homo sapiens
guccugggauguacuuuga

SEQ ID NO: 283141 - RNA, 19 nt, Homo sapiens
gagaaaauguuccaaaguc

SEQ ID NO: 283142 - RNA, 19 nt, Homo sapiens
caaaguacccaagcaucua

SEQ ID NO: 283143 - RNA, 19 nt, Homo sapiens
aaagauuaguccaucauca

SEQ ID NO: 283144 - RNA, 19 nt, Homo sapiens
uaaacauguggcucuauua

SEQ ID NO: 283145 - RNA, 19 nt, Homo sapiens
aacccacgccugaauauua

SEQ ID NO: 283146 - RNA, 19 nt, Homo sapiens
ucugaaacauucuguagug

SEQ ID NO: 283147 - RNA, 19 nt, Homo sapiens
cccaugaaaucaccaauca

SEQ ID NO: 283148 - RNA, 19 nt, Homo sapiens
gcaaaucagagucuacaca

SEQ ID NO: 283149 - RNA, 19 nt, Homo sapiens
cugcaagcuuuaccaagua

SEQ ID NO: 283150 - RNA, 19 nt, Homo sapiens
ucacugucauucuauuguu

SEQ ID NO: 283151 - RNA, 19 nt, Homo sapiens
gauacuggccuugcugaaa

SEQ ID NO: 283152 - RNA, 19 nt, Homo sapiens
gagcucagcaguauugaca

SEQ ID NO: 283153 - RNA, 19 nt, Homo sapiens
gcaaaugccaaaagcuuua

SEQ ID NO: 283154 - RNA, 19 nt, Homo sapiens
ucauggcucugaaacauuc

SEQ ID NO: 283155 - RNA, 19 nt, Homo sapiens
ucaaaccuguaucagcaaa

SEQ ID NO: 283156 - RNA, 19 nt, Homo sapiens
gccugaauauuaaagcauu

SEQ ID NO: 283157 - RNA, 19 nt, Homo sapiens
aggcagagguaaugcagaa

SEQ ID NO: 283158 - RNA, 19 nt, Homo sapiens
gaagagagaaauauuaccu

SEQ ID NO: 283159 - RNA, 19 nt, Homo sapiens
agacuccaaucgacaagaa

SEQ ID NO: 283160 - RNA, 19 nt, Homo sapiens
uuucaauccucguuucaaa

SEQ ID NO: 283161 - RNA, 19 nt, Homo sapiens
gcagagguaaugcagaaau

SEQ ID NO: 283162 - RNA, 19 nt, Homo sapiens
gcuaggauauauacuuggu

SEQ ID NO: 283163 - RNA, 19 nt, Homo sapiens
ccuggaacuuugauuguga

SEQ ID NO: 283164 - RNA, 19 nt, Homo sapiens
gauccuggaacuuugauug

SEQ ID NO: 283165 - RNA, 19 nt, Homo sapiens
gauuagacuucaggcauuc

SEQ ID NO: 283166 - RNA, 19 nt, Homo sapiens
cuacacagacgccuacaga

SEQ ID NO: 283167 - RNA, 19 nt, Homo sapiens
aauacauggugcugaaauu

SEQ ID NO: 283168 - RNA, 19 nt, Homo sapiens
cagaagagacuccaaucga

SEQ ID NO: 283169 - RNA, 19 nt, Homo sapiens
acucuucugugcucuauug

SEQ ID NO: 283170 - RNA, 19 nt, Homo sapiens
acacuuauagccaguuaaa

SEQ ID NO: 283171 - RNA, 19 nt, Homo sapiens
gcucagagguuccacauca

SEQ ID NO: 283172 - RNA, 19 nt, Homo sapiens
ggacagauguucucuacuc

SEQ ID NO: 283173 - RNA, 19 nt, Homo sapiens
ggccagagcuucucagugu

SEQ ID NO: 283174 - RNA, 19 nt, Homo sapiens
gugcagagcucagauuuca

SEQ ID NO: 283175 - RNA, 19 nt, Homo sapiens
gucagcaccuguuugaaua

SEQ ID NO: 283176 - RNA, 19 nt, Homo sapiens
gaaaaugcuuguuggcaaa

SEQ ID NO: 283177 - RNA, 19 nt, Homo sapiens
gacauugccuuccacuuca

SEQ ID NO: 283178 - RNA, 19 nt, Homo sapiens
acacaugccuuuccagaag

SEQ ID NO: 283179 - RNA, 19 nt, Homo sapiens
gaggguacguggugugcaa

SEQ ID NO: 283180 - RNA, 19 nt, Homo sapiens
ggucagcaccuguuugaau

SEQ ID NO: 283181 - RNA, 19 nt, Homo sapiens
gcucagauuucaaggugau

SEQ ID NO: 283182 - RNA, 19 nt, Homo sapiens
cagguuugcugugaacuuu

SEQ ID NO: 283183 - RNA, 19 nt, Homo sapiens
gaaaugaaaaugcuuguug

SEQ ID NO: 283184 - RNA, 19 nt, Homo sapiens
ccugggaucugggcuuuaa

SEQ ID NO: 283185 - RNA, 19 nt, Homo sapiens
gugcagcuguccuacauca

SEQ ID NO: 283186 - RNA, 19 nt, Homo sapiens
ugacauugccuuccacuuc

SEQ ID NO: 283187 - RNA, 19 nt, Homo sapiens
gcaccuguuugaauacuac

SEQ ID NO: 283188 - RNA, 19 nt, Homo sapiens
gcagagcucagauuucaag

SEQ ID NO: 283189 - RNA, 19 nt, Homo sapiens
ggacuucagaucacuguca

SEQ ID NO: 283190 - RNA, 19 nt, Homo sapiens
ugaggaaccugcccaccau

SEQ ID NO: 283191 - RNA, 19 nt, Homo sapiens
gcggagagauggccuucag

SEQ ID NO: 283192 - RNA, 19 nt, Homo sapiens
gcagaggccauguccuugu

SEQ ID NO: 283193 - RNA, 19 nt, Homo sapiens
gacaccaucuucgucaaug

SEQ ID NO: 283194 - RNA, 19 nt, Homo sapiens
ggacaccaucuucgucaau

SEQ ID NO: 283195 - RNA, 19 nt, Homo sapiens
ggacggacuucagaucacu

SEQ ID NO: 283196 - RNA, 19 nt, Homo sapiens
ggagugggcagugaagaug

SEQ ID NO: 283197 - RNA, 19 nt, Homo sapiens
gcaacacccagaucgacaa

SEQ ID NO: 283198 - RNA, 19 nt, Homo sapiens
ccaguguccuuaaaauaaa

SEQ ID NO: 283199 - RNA, 19 nt, Homo sapiens
gacuucagaucacugucaa

SEQ ID NO: 283200 - RNA, 19 nt, Homo sapiens
ccgccuauccgaugccuuu

SEQ ID NO: 283201 - RNA, 19 nt, Homo sapiens
gcucugugcagcuguccua

SEQ ID NO: 283202 - RNA, 19 nt, Homo sapiens
agacagucauccacacagu

SEQ ID NO: 283203 - RNA, 19 nt, Homo sapiens
gccaacccggcucccauua

SEQ ID NO: 283204 - RNA, 19 nt, Homo sapiens
gaaccugcccaccaucaac

SEQ ID NO: 283205 - RNA, 19 nt, Homo sapiens
ggaaccugcccaccaucaa

SEQ ID NO: 283206 - RNA, 19 nt, Homo sapiens
cagaggccauguccuuguc

SEQ ID NO: 283207 - RNA, 19 nt, Homo sapiens
cuggacagauguucucuac

SEQ ID NO: 283208 - RNA, 19 nt, Homo sapiens
acacccagaucgacaacuc

SEQ ID NO: 283209 - RNA, 19 nt, Homo sapiens
ggauggucagcaccuguuu

SEQ ID NO: 283210 - RNA, 19 nt, Homo sapiens
gaguccagcuguccccuuu

SEQ ID NO: 283211 - RNA, 19 nt, Homo sapiens
cuggaaagcaggccugaug

SEQ ID NO: 283212 - RNA, 19 nt, Homo sapiens
ccaccugaccagaguguuc

SEQ ID NO: 283213 - RNA, 19 nt, Homo sapiens
caggacggacuucagauca

SEQ ID NO: 283214 - RNA, 19 nt, Homo sapiens
gaaccuccguuuugaugag

SEQ ID NO: 283215 - RNA, 19 nt, Homo sapiens
ggagggcuguacccaucca

SEQ ID NO: 283216 - RNA, 19 nt, Homo sapiens
caacccggcucccauuacc

SEQ ID NO: 283217 - RNA, 19 nt, Homo sapiens
gagugggcagugaagauga

SEQ ID NO: 283218 - RNA, 19 nt, Homo sapiens
gggaggagugggcagugaa

SEQ ID NO: 283219 - RNA, 19 nt, Homo sapiens
gauggucagcaccuguuug

SEQ ID NO: 283220 - RNA, 19 nt, Homo sapiens
ugaacgggauccucuucgu

SEQ ID NO: 283221 - RNA, 19 nt, Homo sapiens
ggauccucuucgugcagua

SEQ ID NO: 283222 - RNA, 19 nt, Homo sapiens
gcucagagguuccacauca

SEQ ID NO: 283223 - RNA, 19 nt, Homo sapiens
ggacagauguucucuacuc

SEQ ID NO: 283224 - RNA, 19 nt, Homo sapiens
ggccagagcuucucagugu

SEQ ID NO: 283225 - RNA, 19 nt, Homo sapiens
gugcagagcucagauuuca

SEQ ID NO: 283226 - RNA, 19 nt, Homo sapiens
gucagcaccuguuugaaua

SEQ ID NO: 283227 - RNA, 19 nt, Homo sapiens
gacauugccuuccacuuca

SEQ ID NO: 283228 - RNA, 19 nt, Homo sapiens
acacaugccuuuccagaag

SEQ ID NO: 283229 - RNA, 19 nt, Homo sapiens
gaggguacguggugugcaa

SEQ ID NO: 283230 - RNA, 19 nt, Homo sapiens
ggucagcaccuguuugaau

SEQ ID NO: 283231 - RNA, 19 nt, Homo sapiens
gcucagauuucaaggugau

SEQ ID NO: 283232 - RNA, 19 nt, Homo sapiens
cagguuugcugugaacuuu

SEQ ID NO: 283233 - RNA, 19 nt, Homo sapiens
gaaaugaaaaugcuuguug

SEQ ID NO: 283234 - RNA, 19 nt, Homo sapiens
ccugggaucugggcuuuaa

SEQ ID NO: 283235 - RNA, 19 nt, Homo sapiens
gugcagcuguccuacauca

SEQ ID NO: 283236 - RNA, 19 nt, Homo sapiens
ugacauugccuuccacuuc

SEQ ID NO: 283237 - RNA, 19 nt, Homo sapiens
gcaccuguuugaauacuac

SEQ ID NO: 283238 - RNA, 19 nt, Homo sapiens
caguguggaucuuguguga

SEQ ID NO: 283239 - RNA, 19 nt, Homo sapiens
gcagagcucagauuucaag

SEQ ID NO: 283240 - RNA, 19 nt, Homo sapiens
ggacuucagaucacuguca

SEQ ID NO: 283241 - RNA, 19 nt, Homo sapiens
ugaggaaccugcccaccau

SEQ ID NO: 283242 - RNA, 19 nt, Homo sapiens
gcggagagauggccuucag

SEQ ID NO: 283243 - RNA, 19 nt, Homo sapiens
gcagaggccauguccuugu

SEQ ID NO: 283244 - RNA, 19 nt, Homo sapiens
ggacggacuucagaucacu

SEQ ID NO: 283245 - RNA, 19 nt, Homo sapiens
ggagugggcagugaagaug

SEQ ID NO: 283246 - RNA, 19 nt, Homo sapiens
guguggaucuugugugaag

SEQ ID NO: 283247 - RNA, 19 nt, Homo sapiens
gcaacacccagaucgacaa

SEQ ID NO: 283248 - RNA, 19 nt, Homo sapiens
gacaccaucuccgucaaug

SEQ ID NO: 283249 - RNA, 19 nt, Homo sapiens
ggacaccaucuccgucaau

SEQ ID NO: 283250 - RNA, 19 nt, Homo sapiens
ccaguguccuuaaaauaaa

SEQ ID NO: 283251 - RNA, 19 nt, Homo sapiens
ucucccagccugucuguuu

SEQ ID NO: 283252 - RNA, 19 nt, Homo sapiens
gacuucagaucacugucaa

SEQ ID NO: 283253 - RNA, 19 nt, Homo sapiens
ccgccuauccgaugccuuu

SEQ ID NO: 283254 - RNA, 19 nt, Homo sapiens
gcucugugcagcuguccua

SEQ ID NO: 283255 - RNA, 19 nt, Homo sapiens
agacagucauccacacagu

SEQ ID NO: 283256 - RNA, 19 nt, Homo sapiens
gccaacccggcucccauua

SEQ ID NO: 283257 - RNA, 19 nt, Homo sapiens
gaaccugcccaccaucaac

SEQ ID NO: 283258 - RNA, 19 nt, Homo sapiens
ggaaccugcccaccaucaa

SEQ ID NO: 283259 - RNA, 19 nt, Homo sapiens
cagaggccauguccuuguc

SEQ ID NO: 283260 - RNA, 19 nt, Homo sapiens
cuggacagauguucucuac

SEQ ID NO: 283261 - RNA, 19 nt, Homo sapiens
acacccagaucgacaacuc

SEQ ID NO: 283262 - RNA, 19 nt, Homo sapiens
gaguccagcuguccccuuu

SEQ ID NO: 283263 - RNA, 19 nt, Homo sapiens
ggauggucagcaccuguuu

SEQ ID NO: 283264 - RNA, 19 nt, Homo sapiens
cuggaaagcaggccugaug

SEQ ID NO: 283265 - RNA, 19 nt, Homo sapiens
ccaccugaccagaguguuc

SEQ ID NO: 283266 - RNA, 19 nt, Homo sapiens
ggagggcuguacccaucca

SEQ ID NO: 283267 - RNA, 19 nt, Homo sapiens
caacccggcucccauuacc

SEQ ID NO: 283268 - RNA, 19 nt, Homo sapiens
caggacggacuucagauca

SEQ ID NO: 283269 - RNA, 19 nt, Homo sapiens
gagugggcagugaagauga

SEQ ID NO: 283270 - RNA, 19 nt, Homo sapiens
gggaggagugggcagugaa

SEQ ID NO: 283271 - RNA, 19 nt, Homo sapiens
gauggucagcaccuguuug

SEQ ID NO: 283272 - RNA, 19 nt, Homo sapiens
ugaacgggauccucuucgu

SEQ ID NO: 283273 - RNA, 19 nt, Homo sapiens
ggauccucuucgugcagua

SEQ ID NO: 283274 - RNA, 19 nt, Homo sapiens
caauaaaggcuucucaauc

SEQ ID NO: 283275 - RNA, 19 nt, Homo sapiens
aauaaaggcuucucaaucc

SEQ ID NO: 283276 - RNA, 19 nt, Homo sapiens
ggccuccucuuccucuaaa

SEQ ID NO: 283277 - RNA, 19 nt, Homo sapiens
cauccuggcugucgagaag

SEQ ID NO: 283278 - RNA, 19 nt, Homo sapiens
acaauaaaggcuucucaau

SEQ ID NO: 283279 - RNA, 19 nt, Homo sapiens
ccacaauaaaggcuucuca

SEQ ID NO: 283280 - RNA, 19 nt, Homo sapiens
ccgauccucccacaauaaa

SEQ ID NO: 283281 - RNA, 19 nt, Homo sapiens
ccgcagcaccucugacugu

SEQ ID NO: 283282 - RNA, 19 nt, Homo sapiens
gauccucccacaauaaagg

SEQ ID NO: 283283 - RNA, 19 nt, Homo sapiens
cgucaacaccaccaucugu

SEQ ID NO: 283284 - RNA, 19 nt, Homo sapiens
cacaauaaaggcuucucaa

SEQ ID NO: 283285 - RNA, 19 nt, Homo sapiens
gauagaagcuaaugccuuu

SEQ ID NO: 283286 - RNA, 19 nt, Homo sapiens
cuacaaaugugcugaguua

SEQ ID NO: 283287 - RNA, 19 nt, Homo sapiens
gcacagacacagaauauuu

SEQ ID NO: 283288 - RNA, 19 nt, Homo sapiens
caaaguaccucuuaucaca

SEQ ID NO: 283289 - RNA, 19 nt, Homo sapiens
gagaugcacuguucaauuc

SEQ ID NO: 283290 - RNA, 19 nt, Homo sapiens
gaauuacucugaaguuaug

SEQ ID NO: 283291 - RNA, 19 nt, Homo sapiens
caaauaagccuucucaauc

SEQ ID NO: 283292 - RNA, 19 nt, Homo sapiens
ggaaaccacucucucacaa

SEQ ID NO: 283293 - RNA, 19 nt, Homo sapiens
guacagcucuccuagacaa

SEQ ID NO: 283294 - RNA, 19 nt, Homo sapiens
caucucagcugccuucaaa

SEQ ID NO: 283295 - RNA, 19 nt, Homo sapiens
ugaauaugguuucugcuua

SEQ ID NO: 283296 - RNA, 19 nt, Homo sapiens
caaaugugcugaguuagaa

SEQ ID NO: 283297 - RNA, 19 nt, Homo sapiens
gaauuaauggcuaccaaua

SEQ ID NO: 283298 - RNA, 19 nt, Homo sapiens
gggcugaacuuuauagaag

SEQ ID NO: 283299 - RNA, 19 nt, Homo sapiens
cgucaucacucuagaaaga

SEQ ID NO: 283300 - RNA, 19 nt, Homo sapiens
ggauauuucuuccaccaaa

SEQ ID NO: 283301 - RNA, 19 nt, Homo sapiens
caaacuauauggaaaugga

SEQ ID NO: 283302 - RNA, 19 nt, Homo sapiens
agacaugccauucugauua

SEQ ID NO: 283303 - RNA, 19 nt, Homo sapiens
gagaaacauuugucaaucu

SEQ ID NO: 283304 - RNA, 19 nt, Homo sapiens
ugacuucacuggagcuaaa

SEQ ID NO: 283305 - RNA, 19 nt, Homo sapiens
aaaauuaccuguaccagua

SEQ ID NO: 283306 - RNA, 19 nt, Homo sapiens
gcucauagccucaguugau

SEQ ID NO: 283307 - RNA, 19 nt, Homo sapiens
ggacagcacagacacagaa

SEQ ID NO: 283308 - RNA, 19 nt, Homo sapiens
guccugauuuggcugauua

SEQ ID NO: 283309 - RNA, 19 nt, Homo sapiens
ggacgacacugacuucacu

SEQ ID NO: 283310 - RNA, 19 nt, Homo sapiens
gcacauuucagccuauuug

SEQ ID NO: 283311 - RNA, 19 nt, Homo sapiens
aaauguaguuucucaguug

SEQ ID NO: 283312 - RNA, 19 nt, Homo sapiens
guucauaacagaucagaaa

SEQ ID NO: 283313 - RNA, 19 nt, Homo sapiens
gugguggccuucuucauaa

SEQ ID NO: 283314 - RNA, 19 nt, Homo sapiens
gacaugccauucugauuau

SEQ ID NO: 283315 - RNA, 19 nt, Homo sapiens
ccaagggccaguacuauaa

SEQ ID NO: 283316 - RNA, 19 nt, Homo sapiens
acauuaagcuguagacugu

SEQ ID NO: 283317 - RNA, 19 nt, Homo sapiens
gcauggcaccuaucucuuu

SEQ ID NO: 283318 - RNA, 19 nt, Homo sapiens
gaauaugguuucugcuuac

SEQ ID NO: 283319 - RNA, 19 nt, Homo sapiens
uaacauaaaggguuggauu

SEQ ID NO: 283320 - RNA, 19 nt, Homo sapiens
gaucaaauaagccuucuca

SEQ ID NO: 283321 - RNA, 19 nt, Homo sapiens
ucaaagugaucccaucuca

SEQ ID NO: 283322 - RNA, 19 nt, Homo sapiens
gaagaaguacaaagucaug

SEQ ID NO: 283323 - RNA, 19 nt, Homo sapiens
gcacuacguuucaaguucu

SEQ ID NO: 283324 - RNA, 19 nt, Homo sapiens
gaucccaucucaagcuuuc

SEQ ID NO: 283325 - RNA, 19 nt, Homo sapiens
uuagaaacuugccaacaaa

SEQ ID NO: 283326 - RNA, 19 nt, Homo sapiens
agacaagacucgcuacaca

SEQ ID NO: 283327 - RNA, 19 nt, Homo sapiens
uaaggaaagugaguaacaa

SEQ ID NO: 283328 - RNA, 19 nt, Homo sapiens
ucaaauaagccuucucaau

SEQ ID NO: 283329 - RNA, 19 nt, Homo sapiens
uggaaaggauagaagcuaa

SEQ ID NO: 283330 - RNA, 19 nt, Homo sapiens
gaggauggcucuuuucuuc

SEQ ID NO: 283331 - RNA, 19 nt, Homo sapiens
acauugcacugucaaggua

SEQ ID NO: 283332 - RNA, 19 nt, Homo sapiens
gaaaggauagaagcuaaug

SEQ ID NO: 283333 - RNA, 19 nt, Homo sapiens
uuuagaaacuugccaacaa

SEQ ID NO: 283334 - RNA, 19 nt, Homo sapiens
ggucuucuccucugaauca

SEQ ID NO: 283335 - RNA, 19 nt, Homo sapiens
aauaugaaguugagagugu

SEQ ID NO: 283336 - RNA, 19 nt, Homo sapiens
caucaauucuugugccaau

SEQ ID NO: 283337 - RNA, 19 nt, Homo sapiens
guucgaaacccagaauuaa

SEQ ID NO: 283338 - RNA, 19 nt, Homo sapiens
aaauugccaucaagagaaa

SEQ ID NO: 283339 - RNA, 19 nt, Homo sapiens
gaaauacugauccagaaca

SEQ ID NO: 283340 - RNA, 19 nt, Homo sapiens
agugaaacauuaagcugua

SEQ ID NO: 283341 - RNA, 19 nt, Homo sapiens
cagccuauuugcuuaguga

SEQ ID NO: 283342 - RNA, 19 nt, Homo sapiens
aaauuuggcugcuguaaac

SEQ ID NO: 283343 - RNA, 19 nt, Homo sapiens
caaauuuggcugcuguaaa

SEQ ID NO: 283344 - RNA, 19 nt, Homo sapiens
caugugcaaucucuccuuu

SEQ ID NO: 283345 - RNA, 19 nt, Homo sapiens
ccugacaagucguuacaaa

SEQ ID NO: 283346 - RNA, 19 nt, Homo sapiens
ccgaaaaccuuggauauuu

SEQ ID NO: 283347 - RNA, 19 nt, Homo sapiens
gccaauccauuucuguaug

SEQ ID NO: 283348 - RNA, 19 nt, Homo sapiens
guaaggaaagugaguaaca

SEQ ID NO: 283349 - RNA, 19 nt, Homo sapiens
ugaaagcacaguaaggaaa

SEQ ID NO: 283350 - RNA, 19 nt, Homo sapiens
uggagaagaugcacaaugg

SEQ ID NO: 283351 - RNA, 19 nt, Homo sapiens
cuguaacacucaaacuaua

SEQ ID NO: 283352 - RNA, 19 nt, Homo sapiens
cagcacagacacagaauau

SEQ ID NO: 283353 - RNA, 19 nt, Homo sapiens
ucacaguaaccaacucuaa

SEQ ID NO: 283354 - RNA, 19 nt, Homo sapiens
guacuauaaccaugccaua

SEQ ID NO: 283355 - RNA, 19 nt, Homo sapiens
gaaagugaguaacaaaaca

SEQ ID NO: 283356 - RNA, 19 nt, Homo sapiens
acacaggcaucagaaaguu

SEQ ID NO: 283357 - RNA, 19 nt, Homo sapiens
aaaccacucucucacaagu

SEQ ID NO: 283358 - RNA, 19 nt, Homo sapiens
aagcugcgauuaagacaug

SEQ ID NO: 283359 - RNA, 19 nt, Homo sapiens
gaaagcacaguaaggaaag

SEQ ID NO: 283360 - RNA, 19 nt, Homo sapiens
gcaaugguacacuacaaau

SEQ ID NO: 283361 - RNA, 19 nt, Homo sapiens
acaaagucaugcauucaau

SEQ ID NO: 283362 - RNA, 19 nt, Homo sapiens
gcaaauuuggcugcuguaa

SEQ ID NO: 283363 - RNA, 19 nt, Homo sapiens
cuaagacauuccaaagaga

SEQ ID NO: 283364 - RNA, 19 nt, Homo sapiens
gcucuuuucuucucuaauu

SEQ ID NO: 283365 - RNA, 19 nt, Homo sapiens
aaaccaagggccaguacua

SEQ ID NO: 283366 - RNA, 19 nt, Homo sapiens
cuaccucccugucaaagug

SEQ ID NO: 283367 - RNA, 19 nt, Homo sapiens
gagcccggagcauuuauaa

SEQ ID NO: 283368 - RNA, 19 nt, Homo sapiens
acucugaaguuaugaaaca

SEQ ID NO: 283369 - RNA, 19 nt, Homo sapiens
gaaaguucuaucuguucua

SEQ ID NO: 283370 - RNA, 19 nt, Homo sapiens
cagaauuaauggcuaccaa

SEQ ID NO: 283371 - RNA, 19 nt, Homo sapiens
acaugaaggucaguauuug

SEQ ID NO: 283372 - RNA, 19 nt, Homo sapiens
guaggaacccugucucagu

SEQ ID NO: 283373 - RNA, 19 nt, Homo sapiens
uggcuucacuggaucaaau

SEQ ID NO: 283374 - RNA, 19 nt, Homo sapiens
gcugaacuuuauagaagga

SEQ ID NO: 283375 - RNA, 19 nt, Homo sapiens
ugugguggccuucuucaua

SEQ ID NO: 283376 - RNA, 19 nt, Homo sapiens
cugaaauacugauccagaa

SEQ ID NO: 283377 - RNA, 19 nt, Homo sapiens
agagaaacauuugucaauc

SEQ ID NO: 283378 - RNA, 19 nt, Homo sapiens
caagagaaacauuugucaa

SEQ ID NO: 283379 - RNA, 19 nt, Homo sapiens
ggccuagaguccauucaga

SEQ ID NO: 283380 - RNA, 19 nt, Homo sapiens
ggaugaauaaugaaucugu

SEQ ID NO: 283381 - RNA, 19 nt, Homo sapiens
uaaccaccauaccaggaaa

SEQ ID NO: 283382 - RNA, 19 nt, Homo sapiens
gaggagguauuuugcauau

SEQ ID NO: 283383 - RNA, 19 nt, Homo sapiens
caauccaccuugaaguugu

SEQ ID NO: 283384 - RNA, 19 nt, Homo sapiens
uacaugaaggucaguauuu

SEQ ID NO: 283385 - RNA, 19 nt, Homo sapiens
guacagaaaugaaccuuua

SEQ ID NO: 283386 - RNA, 19 nt, Homo sapiens
caaagaggauuaccuaagu

SEQ ID NO: 283387 - RNA, 19 nt, Homo sapiens
gcacacagucgcccucaua

SEQ ID NO: 283388 - RNA, 19 nt, Homo sapiens
caacagcaaucaacaccaa

SEQ ID NO: 283389 - RNA, 19 nt, Homo sapiens
aaagaggauuaccuaagua

SEQ ID NO: 283390 - RNA, 19 nt, Homo sapiens
gcaaagaggauuaccuaag

SEQ ID NO: 283391 - RNA, 19 nt, Homo sapiens
gcgaggaacucuacaucau

SEQ ID NO: 283392 - RNA, 19 nt, Homo sapiens
ucaccugcaugauguguaa

SEQ ID NO: 283393 - RNA, 19 nt, Homo sapiens
agaauaaguucgucugcaa

SEQ ID NO: 283394 - RNA, 19 nt, Homo sapiens
ggcaaacucuacugcaaga

SEQ ID NO: 283395 - RNA, 19 nt, Homo sapiens
guucgugguuguacagaaa

SEQ ID NO: 283396 - RNA, 19 nt, Homo sapiens
gcagaugcacuuugacuuc

SEQ ID NO: 283397 - RNA, 19 nt, Homo sapiens
gagauuaccagagcgagua

SEQ ID NO: 283398 - RNA, 19 nt, Homo sapiens
ccagugcugugaauguaaa

SEQ ID NO: 283399 - RNA, 19 nt, Homo sapiens
gcgcgaugccggcaguuua

SEQ ID NO: 283400 - RNA, 19 nt, Homo sapiens
acacaaacacuucuccaaa

SEQ ID NO: 283401 - RNA, 19 nt, Homo sapiens
gaauaaguucgucugcaaa

SEQ ID NO: 283402 - RNA, 19 nt, Homo sapiens
ccgaguguguguccucuuu

SEQ ID NO: 283403 - RNA, 19 nt, Homo sapiens
caucagaccaaaccaaaga

SEQ ID NO: 283404 - RNA, 19 nt, Homo sapiens
gcucuccacuggcgaggaa

SEQ ID NO: 283405 - RNA, 19 nt, Homo sapiens
gagcagaagggucgcauuc

SEQ ID NO: 283406 - RNA, 19 nt, Homo sapiens
ggaguugucccucucuguu

SEQ ID NO: 283407 - RNA, 19 nt, Homo sapiens
gaugcacuuugacuucuga

SEQ ID NO: 283408 - RNA, 19 nt, Homo sapiens
gcaaucaacaccaagaucu

SEQ ID NO: 283409 - RNA, 19 nt, Homo sapiens
guccagugcugugaaugua

SEQ ID NO: 283410 - RNA, 19 nt, Homo sapiens
gcugcacacuucacugaga

SEQ ID NO: 283411 - RNA, 19 nt, Homo sapiens
ggagaccggccucaacaug

SEQ ID NO: 283412 - RNA, 19 nt, Homo sapiens
cguagugccucccgaagga

SEQ ID NO: 283413 - RNA, 19 nt, Homo sapiens
gggcaacuacgacuucuuc

SEQ ID NO: 283414 - RNA, 19 nt, Homo sapiens
ccaaggagcggaggaugaa

SEQ ID NO: 283415 - RNA, 19 nt, Homo sapiens
gcaacaacagcaaucaaca

SEQ ID NO: 283416 - RNA, 19 nt, Homo sapiens
ccaauggucccuucuccuu

SEQ ID NO: 283417 - RNA, 19 nt, Homo sapiens
cacaaacacuucuccaaaa

SEQ ID NO: 283418 - RNA, 19 nt, Homo sapiens
ucugacagcucuaccucaa

SEQ ID NO: 283419 - RNA, 19 nt, Homo sapiens
ggagagcgcggagcaaagu

SEQ ID NO: 283420 - RNA, 19 nt, Homo sapiens
aaugcaaccugaccgagaa

SEQ ID NO: 283421 - RNA, 19 nt, Homo sapiens
gaguugucccucucuguuu

SEQ ID NO: 283422 - RNA, 19 nt, Homo sapiens
ggaaaccuaagcaacaaca

SEQ ID NO: 283423 - RNA, 19 nt, Homo sapiens
cuggaccgcuuucucuuga

SEQ ID NO: 283424 - RNA, 19 nt, Homo sapiens
ccuccacccuacuuugauu

SEQ ID NO: 283425 - RNA, 19 nt, Homo sapiens
cugcaaagaggauuaccua

SEQ ID NO: 283426 - RNA, 19 nt, Homo sapiens
ccaaagagaacagccuuca

SEQ ID NO: 283427 - RNA, 19 nt, Homo sapiens
gcaguguugccaaagagaa

SEQ ID NO: 283428 - RNA, 19 nt, Homo sapiens
aaggcaaacucuacugcaa

SEQ ID NO: 283429 - RNA, 19 nt, Homo sapiens
ucacugugccggcugcaaa

SEQ ID NO: 283430 - RNA, 19 nt, Homo sapiens
gagaagccagcccguagug

SEQ ID NO: 283431 - RNA, 19 nt, Homo sapiens
ucucgucgcugucggucaa

SEQ ID NO: 283432 - RNA, 19 nt, Homo sapiens
acagcaguguugccaaaga

SEQ ID NO: 283433 - RNA, 19 nt, Homo sapiens
ggaccgcuuucucuugaac

SEQ ID NO: 283434 - RNA, 19 nt, Homo sapiens
caaaagcggggaaaccuaa

SEQ ID NO: 283435 - RNA, 19 nt, Homo sapiens
caaagcuucucugcuccuu

SEQ ID NO: 283436 - RNA, 19 nt, Homo sapiens
gacacaaacacuucuccaa

SEQ ID NO: 283437 - RNA, 19 nt, Homo sapiens
cagcaguguugccaaagag

SEQ ID NO: 283438 - RNA, 19 nt, Homo sapiens
aaagagaacagccuucacu

SEQ ID NO: 283439 - RNA, 19 nt, Homo sapiens
gcgagucgucgucuucuuc

SEQ ID NO: 283440 - RNA, 19 nt, Homo sapiens
cagaugcacuuugacuucu

SEQ ID NO: 283441 - RNA, 19 nt, Homo sapiens
gacaaaagcagaugcacuu

SEQ ID NO: 283442 - RNA, 19 nt, Homo sapiens
caacaugcgcgucauucag

SEQ ID NO: 283443 - RNA, 19 nt, Homo sapiens
ccagggaaggcaaacucua

SEQ ID NO: 283444 - RNA, 19 nt, Homo sapiens
caaucaacaccaagaucuu

SEQ ID NO: 283445 - RNA, 19 nt, Homo sapiens
cuacaucaucgacgagaau

SEQ ID NO: 283446 - RNA, 19 nt, Homo sapiens
ccaaagaccaugguucacu

SEQ ID NO: 283447 - RNA, 19 nt, Homo sapiens
ccagacaccaguggaccua

SEQ ID NO: 283448 - RNA, 19 nt, Homo sapiens
caggagaccggccucaaca

SEQ ID NO: 283449 - RNA, 19 nt, Homo sapiens
uaaguucgucugcaaagag

SEQ ID NO: 283450 - RNA, 19 nt, Homo sapiens
cgaggaacucuacaucauc

SEQ ID NO: 283451 - RNA, 19 nt, Homo sapiens
gcaaccugaccgagaagug

SEQ ID NO: 283452 - RNA, 19 nt, Homo sapiens
cggcugcacacuucacuga

SEQ ID NO: 283453 - RNA, 19 nt, Homo sapiens
aagcuucucugcuccuuuu

SEQ ID NO: 283454 - RNA, 19 nt, Homo sapiens
cgauugacacaaacacuuc

SEQ ID NO: 283455 - RNA, 19 nt, Homo sapiens
caucaucgacgagaauaag

SEQ ID NO: 283456 - RNA, 19 nt, Homo sapiens
caacaacagcaaucaacac

SEQ ID NO: 283457 - RNA, 19 nt, Homo sapiens
cugcggaguucgugguugu

SEQ ID NO: 283458 - RNA, 19 nt, Homo sapiens
caucgacgagaauaaguuc

SEQ ID NO: 283459 - RNA, 19 nt, Homo sapiens
caaacucuacugcaagaac

SEQ ID NO: 283460 - RNA, 19 nt, Homo sapiens
gcucgugccgauugucuuc

SEQ ID NO: 283461 - RNA, 19 nt, Homo sapiens
ggggaaaccuaagcaacaa

SEQ ID NO: 283462 - RNA, 19 nt, Homo sapiens
caccaagaucuuccuccua

SEQ ID NO: 283463 - RNA, 19 nt, Homo sapiens
ggcgaggaacucuacauca

SEQ ID NO: 283464 - RNA, 19 nt, Homo sapiens
gagcgcggagcaaaguguu

SEQ ID NO: 283465 - RNA, 19 nt, Homo sapiens
gaaacgcccuccagucuga

SEQ ID NO: 283466 - RNA, 19 nt, Homo sapiens
guaaggaugucuuccagaa

SEQ ID NO: 283467 - RNA, 19 nt, Homo sapiens
ggauguggcuguugagaug

SEQ ID NO: 283468 - RNA, 19 nt, Homo sapiens
ggagaggccuggaaagcuu

SEQ ID NO: 283469 - RNA, 19 nt, Homo sapiens
gggcaucgcuaaacccaaa

SEQ ID NO: 283470 - RNA, 19 nt, Homo sapiens
gaugauggcucccgacaca

SEQ ID NO: 283471 - RNA, 19 nt, Homo sapiens
gaagugcagcccauaauga

SEQ ID NO: 283472 - RNA, 19 nt, Homo sapiens
gaacaaacuacacaaguca

SEQ ID NO: 283473 - RNA, 19 nt, Homo sapiens
gaaggaggcagcagaguug

SEQ ID NO: 283474 - RNA, 19 nt, Homo sapiens
gcagaaguuuccagaagga

SEQ ID NO: 283475 - RNA, 19 nt, Homo sapiens
cgucugaccuggcaugauu

SEQ ID NO: 283476 - RNA, 19 nt, Homo sapiens
gcaguguucuggcuucuuc

SEQ ID NO: 283477 - RNA, 19 nt, Homo sapiens
cuacacaagucaucuacaa

SEQ ID NO: 283478 - RNA, 19 nt, Homo sapiens
ggaguuggguccagaugug

SEQ ID NO: 283479 - RNA, 19 nt, Homo sapiens
ggguaaaggucuguaagaa

SEQ ID NO: 283480 - RNA, 19 nt, Homo sapiens
uaagucaggugcagagguu

SEQ ID NO: 283481 - RNA, 19 nt, Homo sapiens
ggucggaucugagagaaug

SEQ ID NO: 283482 - RNA, 19 nt, Homo sapiens
gaccuggcaugauuucuau

SEQ ID NO: 283483 - RNA, 19 nt, Homo sapiens
gggcuaggaucccaaagga

SEQ ID NO: 283484 - RNA, 19 nt, Homo sapiens
ccaaugcccucuuuauucu

SEQ ID NO: 283485 - RNA, 19 nt, Homo sapiens
ggacuucugccucuacuug

SEQ ID NO: 283486 - RNA, 19 nt, Homo sapiens
cgagggaucucaggaguug

SEQ ID NO: 283487 - RNA, 19 nt, Homo sapiens
ggccuugggugacaaauuc

SEQ ID NO: 283488 - RNA, 19 nt, Homo sapiens
ggaaggaggcagcagaguu

SEQ ID NO: 283489 - RNA, 19 nt, Homo sapiens
ggaggucacuuggcauuca

SEQ ID NO: 283490 - RNA, 19 nt, Homo sapiens
agaagaagcugggcuguca

SEQ ID NO: 283491 - RNA, 19 nt, Homo sapiens
aguagcagcucacaucuga

SEQ ID NO: 283492 - RNA, 19 nt, Homo sapiens
ucagagaacuugggcauag

SEQ ID NO: 283493 - RNA, 19 nt, Homo sapiens
guucugcacuggaaacaug

SEQ ID NO: 283494 - RNA, 19 nt, Homo sapiens
gagaaacgcccuccagucu

SEQ ID NO: 283495 - RNA, 19 nt, Homo sapiens
gcacuguuccuggcagaua

SEQ ID NO: 283496 - RNA, 19 nt, Homo sapiens
gaacuugggcauaggaaca

SEQ ID NO: 283497 - RNA, 19 nt, Homo sapiens
caacgccaccugugccaua

SEQ ID NO: 283498 - RNA, 19 nt, Homo sapiens
ucacucacuuugcaccuuu

SEQ ID NO: 283499 - RNA, 19 nt, Homo sapiens
gggcccuuauuuauuauuu

SEQ ID NO: 283500 - RNA, 19 nt, Homo sapiens
caagaugaugguacuaauu

SEQ ID NO: 283501 - RNA, 19 nt, Homo sapiens
gaaauagcgcccuggaaca

SEQ ID NO: 283502 - RNA, 19 nt, Homo sapiens
ugaacaaacuacacaaguc

SEQ ID NO: 283503 - RNA, 19 nt, Homo sapiens
gccaaugcccucuuuauuc

SEQ ID NO: 283504 - RNA, 19 nt, Homo sapiens
ggaugggcuucgagaaaga

SEQ ID NO: 283505 - RNA, 19 nt, Homo sapiens
caagggaacagcagaacuu

SEQ ID NO: 283506 - RNA, 19 nt, Homo sapiens
gacaagaugaugguacuaa

SEQ ID NO: 283507 - RNA, 19 nt, Homo sapiens
gggaucagcugcccauugc

SEQ ID NO: 283508 - RNA, 19 nt, Homo sapiens
guuucauacugacagauua

SEQ ID NO: 283509 - RNA, 19 nt, Homo sapiens
gagagaguuuaccaagaga

SEQ ID NO: 283510 - RNA, 19 nt, Homo sapiens
agagagaguuuaccaagag

SEQ ID NO: 283511 - RNA, 19 nt, Homo sapiens
gcacagcaucacugaauca

SEQ ID NO: 283512 - RNA, 19 nt, Homo sapiens
gaaaccagaguugcugauu

SEQ ID NO: 283513 - RNA, 19 nt, Homo sapiens
gcagggaacccgaucucuu

SEQ ID NO: 283514 - RNA, 19 nt, Homo sapiens
ggaagucgacaauguuaca

SEQ ID NO: 283515 - RNA, 19 nt, Homo sapiens
ccaacaaccuggacaagcu

SEQ ID NO: 283516 - RNA, 19 nt, Homo sapiens
gcauuucccugcagauggu

SEQ ID NO: 283517 - RNA, 19 nt, Homo sapiens
aaaccagaguugcugauuc

SEQ ID NO: 283518 - RNA, 19 nt, Homo sapiens
gcagaucaucgccguguug

SEQ ID NO: 283519 - RNA, 19 nt, Homo sapiens
guucuggcuucuucucaaa

SEQ ID NO: 283520 - RNA, 19 nt, Homo sapiens
agagaagggucggaucuga

SEQ ID NO: 283521 - RNA, 19 nt, Homo sapiens
acaacaaccucaugaacca

SEQ ID NO: 283522 - RNA, 19 nt, Homo sapiens
acagagccuuugcgugaaa

SEQ ID NO: 283523 - RNA, 19 nt, Homo sapiens
gaaaacugccggcaucuga

SEQ ID NO: 283524 - RNA, 19 nt, Homo sapiens
gaugaugguacuaauuaug

SEQ ID NO: 283525 - RNA, 19 nt, Homo sapiens
acacaagucaucuacaaga

SEQ ID NO: 283526 - RNA, 19 nt, Homo sapiens
gcagugaacaaacuacaca

SEQ ID NO: 283527 - RNA, 19 nt, Homo sapiens
ggaaguauaagcagaucau

SEQ ID NO: 283528 - RNA, 19 nt, Homo sapiens
aagagagaguuuaccaaga

SEQ ID NO: 283529 - RNA, 19 nt, Homo sapiens
ggaagagagaguuuaccaa

SEQ ID NO: 283530 - RNA, 19 nt, Homo sapiens
caggaugggcuucgagaaa

SEQ ID NO: 283531 - RNA, 19 nt, Homo sapiens
ccaugcugccucugaaaua

SEQ ID NO: 283532 - RNA, 19 nt, Homo sapiens
gggcugggcugugaugaag

SEQ ID NO: 283533 - RNA, 19 nt, Homo sapiens
caacaaccuggacaagcua

SEQ ID NO: 283534 - RNA, 19 nt, Homo sapiens
ccaaguuccuccgacaaga

SEQ ID NO: 283535 - RNA, 19 nt, Homo sapiens
uggcagaaguuuccagaag

SEQ ID NO: 283536 - RNA, 19 nt, Homo sapiens
gauguuucauacugacaga

SEQ ID NO: 283537 - RNA, 19 nt, Homo sapiens
uacagauguuccugccuua

SEQ ID NO: 283538 - RNA, 19 nt, Homo sapiens
acaagaugaugguacuaau

SEQ ID NO: 283539 - RNA, 19 nt, Homo sapiens
gaacccgaucucuuccuuu

SEQ ID NO: 283540 - RNA, 19 nt, Homo sapiens
cuggcaugauuucuauuua

SEQ ID NO: 283541 - RNA, 19 nt, Homo sapiens
cagaguagcagcucacauc

SEQ ID NO: 283542 - RNA, 19 nt, Homo sapiens
gcaccucccugggcaacau

SEQ ID NO: 283543 - RNA, 19 nt, Homo sapiens
gcacugcuaguuuacuugu

SEQ ID NO: 283544 - RNA, 19 nt, Homo sapiens
ggucuuggcggcaggaguu

SEQ ID NO: 283545 - RNA, 19 nt, Homo sapiens
ugaccuggcaugauuucua

SEQ ID NO: 283546 - RNA, 19 nt, Homo sapiens
ugaugaagcugagcagagu

SEQ ID NO: 283547 - RNA, 19 nt, Homo sapiens
cagaguagacauagugugu

SEQ ID NO: 283548 - RNA, 19 nt, Homo sapiens
gaugguacuaauuauggua

SEQ ID NO: 283549 - RNA, 19 nt, Homo sapiens
aaacuacacaagucaucua

SEQ ID NO: 283550 - RNA, 19 nt, Homo sapiens
gggccacacucacccuugu

SEQ ID NO: 283551 - RNA, 19 nt, Homo sapiens
gguaaaggucuguaagaag

SEQ ID NO: 283552 - RNA, 19 nt, Homo sapiens
gagaguuuaccaagagaga

SEQ ID NO: 283553 - RNA, 19 nt, Homo sapiens
ggaggaagagagaguuuac

SEQ ID NO: 283554 - RNA, 19 nt, Homo sapiens
aacccgaucucuuccuuug

SEQ ID NO: 283555 - RNA, 19 nt, Homo sapiens
cagggaacccgaucucuuc

SEQ ID NO: 283556 - RNA, 19 nt, Homo sapiens
ggcccacccuguccuuguu

SEQ ID NO: 283557 - RNA, 19 nt, Homo sapiens
gcacggagaaggccaagcu

SEQ ID NO: 283558 - RNA, 19 nt, Homo sapiens
acgaggauguggcuguuga

SEQ ID NO: 283559 - RNA, 19 nt, Homo sapiens
gaauaagcuuacgggugaa

SEQ ID NO: 283560 - RNA, 19 nt, Homo sapiens
caauguuacaaguggaaua

SEQ ID NO: 283561 - RNA, 19 nt, Homo sapiens
gggaacagcagaacuuagg

SEQ ID NO: 283562 - RNA, 19 nt, Homo sapiens
cuggaaagcuuugguaggu

SEQ ID NO: 283563 - RNA, 19 nt, Homo sapiens
gcccugacaccucggguaa

SEQ ID NO: 283564 - RNA, 19 nt, Homo sapiens
ccuccuuccuuuccacuga

SEQ ID NO: 283565 - RNA, 19 nt, Homo sapiens
gaaauuagaugcuacauug

SEQ ID NO: 283566 - RNA, 19 nt, Homo sapiens
ccacaccgcucaaauguua

SEQ ID NO: 283567 - RNA, 19 nt, Homo sapiens
gaacuucacuacauguuaa

SEQ ID NO: 283568 - RNA, 19 nt, Homo sapiens
ggaaguccaugcuccauua

SEQ ID NO: 283569 - RNA, 19 nt, Homo sapiens
ugacagcgauuuaguguuu

SEQ ID NO: 283570 - RNA, 19 nt, Homo sapiens
gcagagauacgacuugaua

SEQ ID NO: 283571 - RNA, 19 nt, Homo sapiens
gaugaagacucuccuaaau

SEQ ID NO: 283572 - RNA, 19 nt, Homo sapiens
ggacugcacagguuauuua

SEQ ID NO: 283573 - RNA, 19 nt, Homo sapiens
gaugauggauauuuacgua

SEQ ID NO: 283574 - RNA, 19 nt, Homo sapiens
ggagggauccugugaagua

SEQ ID NO: 283575 - RNA, 19 nt, Homo sapiens
ccagagaucuugaauuugu

SEQ ID NO: 283576 - RNA, 19 nt, Homo sapiens
gaauuugucugcugauuuc

SEQ ID NO: 283577 - RNA, 19 nt, Homo sapiens
caagggcuguuucuuagua

SEQ ID NO: 283578 - RNA, 19 nt, Homo sapiens
gagaauugcugaucuucaa

SEQ ID NO: 283579 - RNA, 19 nt, Homo sapiens
gaaagagacacaucuaaga

SEQ ID NO: 283580 - RNA, 19 nt, Homo sapiens
uaugugagaugacuacuaa

SEQ ID NO: 283581 - RNA, 19 nt, Homo sapiens
caacaugacuugcgacuac

SEQ ID NO: 283582 - RNA, 19 nt, Homo sapiens
ggaagaacuuagaggcuuu

SEQ ID NO: 283583 - RNA, 19 nt, Homo sapiens
gcacagaugauggauauuu

SEQ ID NO: 283584 - RNA, 19 nt, Homo sapiens
gagaauggauuaaagaaac

SEQ ID NO: 283585 - RNA, 19 nt, Homo sapiens
cuccagagaucuugaauuu

SEQ ID NO: 283586 - RNA, 19 nt, Homo sapiens
gaagaggacuuagauaaaa

SEQ ID NO: 283587 - RNA, 19 nt, Homo sapiens
gaaaccuucuacccugaua

SEQ ID NO: 283588 - RNA, 19 nt, Homo sapiens
gcacugaaacuguaauaga

SEQ ID NO: 283589 - RNA, 19 nt, Homo sapiens
ucaguugguugcccuaaua

SEQ ID NO: 283590 - RNA, 19 nt, Homo sapiens
gccaaagaauucucaugua

SEQ ID NO: 283591 - RNA, 19 nt, Homo sapiens
ugacaaguauccuuugcua

SEQ ID NO: 283592 - RNA, 19 nt, Homo sapiens
gaacgugucucugcugcaa

SEQ ID NO: 283593 - RNA, 19 nt, Homo sapiens
gaacaaaacguuuccuuaa

SEQ ID NO: 283594 - RNA, 19 nt, Homo sapiens
cagaagaggacuuagauaa

SEQ ID NO: 283595 - RNA, 19 nt, Homo sapiens
guauguauguggugacaaa

SEQ ID NO: 283596 - RNA, 19 nt, Homo sapiens
agaauuggcucccauuguu

SEQ ID NO: 283597 - RNA, 19 nt, Homo sapiens
gcaaagauacacuucauca

SEQ ID NO: 283598 - RNA, 19 nt, Homo sapiens
ucaaguaaauagccagaaa

SEQ ID NO: 283599 - RNA, 19 nt, Homo sapiens
cacagaugauggauauuua

SEQ ID NO: 283600 - RNA, 19 nt, Homo sapiens
caaauaauguugagguucu

SEQ ID NO: 283601 - RNA, 19 nt, Homo sapiens
ggaaaauucugugggauua

SEQ ID NO: 283602 - RNA, 19 nt, Homo sapiens
ggugagcugugcagaauug

SEQ ID NO: 283603 - RNA, 19 nt, Homo sapiens
gcaaguaguggaacaaaug

SEQ ID NO: 283604 - RNA, 19 nt, Homo sapiens
gcauuuaccaggcaacuuu

SEQ ID NO: 283605 - RNA, 19 nt, Homo sapiens
gcuacaagcuacacuuuag

SEQ ID NO: 283606 - RNA, 19 nt, Homo sapiens
ccaaagaauucucauguac

SEQ ID NO: 283607 - RNA, 19 nt, Homo sapiens
gaaacgagaauggauuaaa

SEQ ID NO: 283608 - RNA, 19 nt, Homo sapiens
cagaagacacugagaauug

SEQ ID NO: 283609 - RNA, 19 nt, Homo sapiens
gagaaagagacacaucuaa

SEQ ID NO: 283610 - RNA, 19 nt, Homo sapiens
ggagaaaaguucccucaaa

SEQ ID NO: 283611 - RNA, 19 nt, Homo sapiens
gcacaaagcagagauacga

SEQ ID NO: 283612 - RNA, 19 nt, Homo sapiens
gaggacugcuucaaauuuc

SEQ ID NO: 283613 - RNA, 19 nt, Homo sapiens
gaaugaggacugcuucaaa

SEQ ID NO: 283614 - RNA, 19 nt, Homo sapiens
gcaagaccauuaucaacuc

SEQ ID NO: 283615 - RNA, 19 nt, Homo sapiens
ugaagacucuccuaaaucu

SEQ ID NO: 283616 - RNA, 19 nt, Homo sapiens
guauggagcucguaaaauu

SEQ ID NO: 283617 - RNA, 19 nt, Homo sapiens
gaaagcacccucuggaaca

SEQ ID NO: 283618 - RNA, 19 nt, Homo sapiens
guggaaauuuggaaugaaa

SEQ ID NO: 283619 - RNA, 19 nt, Homo sapiens
gcacagauuuuaaaacuuc

SEQ ID NO: 283620 - RNA, 19 nt, Homo sapiens
ggcaguggcugucauuguu

SEQ ID NO: 283621 - RNA, 19 nt, Homo sapiens
ggagaaagagacacaucua

SEQ ID NO: 283622 - RNA, 19 nt, Homo sapiens
gaacaggccgugguacuga

SEQ ID NO: 283623 - RNA, 19 nt, Homo sapiens
ccaaguaacaggugaaguu

SEQ ID NO: 283624 - RNA, 19 nt, Homo sapiens
ggaagccuuuacccauuaa

SEQ ID NO: 283625 - RNA, 19 nt, Homo sapiens
gaaaacaggucccguucuu

SEQ ID NO: 283626 - RNA, 19 nt, Homo sapiens
gauuugaaguguguaacua

SEQ ID NO: 283627 - RNA, 19 nt, Homo sapiens
ggagggugguccuuuacaa

SEQ ID NO: 283628 - RNA, 19 nt, Homo sapiens
gaggauacuucugcagauu

SEQ ID NO: 283629 - RNA, 19 nt, Homo sapiens
gauacgacuugauaagaau

SEQ ID NO: 283630 - RNA, 19 nt, Homo sapiens
uggaagccuuuacccauua

SEQ ID NO: 283631 - RNA, 19 nt, Homo sapiens
gcuuccaaaucaagaaaua

SEQ ID NO: 283632 - RNA, 19 nt, Homo sapiens
cauuauaccuaaaguggaa

SEQ ID NO: 283633 - RNA, 19 nt, Homo sapiens
gggauccugugaaguauug

SEQ ID NO: 283634 - RNA, 19 nt, Homo sapiens
agauauagcugcagaagag

SEQ ID NO: 283635 - RNA, 19 nt, Homo sapiens
caucauugaggaagaaaua

SEQ ID NO: 283636 - RNA, 19 nt, Homo sapiens
gcagugcucuuaaaacauu

SEQ ID NO: 283637 - RNA, 19 nt, Homo sapiens
aaacgagaauggauuaaag

SEQ ID NO: 283638 - RNA, 19 nt, Homo sapiens
caaguuaaauccauacacu

SEQ ID NO: 283639 - RNA, 19 nt, Homo sapiens
cgaucacaaucaacaauuu

SEQ ID NO: 283640 - RNA, 19 nt, Homo sapiens
ggauucagcuaaauuucug

SEQ ID NO: 283641 - RNA, 19 nt, Homo sapiens
ucagguugccuauguauuu

SEQ ID NO: 283642 - RNA, 19 nt, Homo sapiens
gcacagguuauuuacauug

SEQ ID NO: 283643 - RNA, 19 nt, Homo sapiens
uugcugaucuucaagguaa

SEQ ID NO: 283644 - RNA, 19 nt, Homo sapiens
cacugaaacuguaauagaa

SEQ ID NO: 283645 - RNA, 19 nt, Homo sapiens
uaugaucuguggaaauuug

SEQ ID NO: 283646 - RNA, 19 nt, Homo sapiens
caaaguauagugacucaga

SEQ ID NO: 283647 - RNA, 19 nt, Homo sapiens
gcagaagaggacuuagaua

SEQ ID NO: 283648 - RNA, 19 nt, Homo sapiens
ucugugggauuaauuauug

SEQ ID NO: 283649 - RNA, 19 nt, Homo sapiens
gcagauucgauauuaguaa

SEQ ID NO: 283650 - RNA, 19 nt, Homo sapiens
gagcaaauggagcaauaaa

SEQ ID NO: 283651 - RNA, 19 nt, Homo sapiens
ugaagcaccuacaaacgaa

SEQ ID NO: 283652 - RNA, 19 nt, Homo sapiens
ggaaauuagaugcuacauu

SEQ ID NO: 283653 - RNA, 19 nt, Homo sapiens
aguaacaggugaaguuuau

SEQ ID NO: 283654 - RNA, 19 nt, Homo sapiens
gggagaaaauguccaagua

SEQ ID NO: 283655 - RNA, 19 nt, Homo sapiens
gggauuaauuauugccauu

SEQ ID NO: 283656 - RNA, 19 nt, Homo sapiens
uuauuacgcuccaugauug

SEQ ID NO: 283657 - RNA, 19 nt, Homo sapiens
gcgacuacgucauuaagug

SEQ ID NO: 283658 - RNA, 19 nt, Homo sapiens
aagcuacacuuuaguugaa

SEQ ID NO: 283659 - RNA, 19 nt, Homo sapiens
ggaguugggccucagauau

SEQ ID NO: 283660 - RNA, 19 nt, Homo sapiens
gugauacagugacagcuuu

SEQ ID NO: 283661 - RNA, 19 nt, Homo sapiens
ucagucagccaucucaaua

SEQ ID NO: 283662 - RNA, 19 nt, Homo sapiens
caaacgaaagcuaucaauu

SEQ ID NO: 283663 - RNA, 19 nt, Homo sapiens
gaacauuucuuggauaccu

SEQ ID NO: 283664 - RNA, 19 nt, Homo sapiens
gcugauuucucaaccucua

SEQ ID NO: 283665 - RNA, 19 nt, Homo sapiens
gaagauagacaucaucaaa

SEQ ID NO: 283666 - RNA, 19 nt, Homo sapiens
gaacaaugcuucccucucu

SEQ ID NO: 283667 - RNA, 19 nt, Homo sapiens
caaagaagccugagaagga

SEQ ID NO: 283668 - RNA, 19 nt, Homo sapiens
gaaagaggguaaagcaaag

SEQ ID NO: 283669 - RNA, 19 nt, Homo sapiens
gaagaugccugcuggaaac

SEQ ID NO: 283670 - RNA, 19 nt, Homo sapiens
gcaaggagcagcugacaga

SEQ ID NO: 283671 - RNA, 19 nt, Homo sapiens
gaaaagugcuggacaggaa

SEQ ID NO: 283672 - RNA, 19 nt, Homo sapiens
ggaagcagcucccgaaacg

SEQ ID NO: 283673 - RNA, 19 nt, Homo sapiens
ugaagacccuggauguuga

SEQ ID NO: 283674 - RNA, 19 nt, Homo sapiens
ggagacagagggcgaguuu

SEQ ID NO: 283675 - RNA, 19 nt, Homo sapiens
ggaagaaggaggaggaaga

SEQ ID NO: 283676 - RNA, 19 nt, Homo sapiens
gagaaggaggcauccaaua

SEQ ID NO: 283677 - RNA, 19 nt, Homo sapiens
ggaagaugccugcuggaaa

SEQ ID NO: 283678 - RNA, 19 nt, Homo sapiens
ggacaggaagggagaauuc

SEQ ID NO: 283679 - RNA, 19 nt, Homo sapiens
gaagaaggaggaggaagaa

SEQ ID NO: 283680 - RNA, 19 nt, Homo sapiens
ccaaggacaucgagcagau

SEQ ID NO: 283681 - RNA, 19 nt, Homo sapiens
ccaagaagauagacaucau

SEQ ID NO: 283682 - RNA, 19 nt, Homo sapiens
caacuaucaucccguggaa

SEQ ID NO: 283683 - RNA, 19 nt, Homo sapiens
ggauccaucugguuacaau

SEQ ID NO: 283684 - RNA, 19 nt, Homo sapiens
gaccucaucuaccucaaug

SEQ ID NO: 283685 - RNA, 19 nt, Homo sapiens
agaagcagauccagccauu

SEQ ID NO: 283686 - RNA, 19 nt, Homo sapiens
ggaaguacccggacaucau

SEQ ID NO: 283687 - RNA, 19 nt, Homo sapiens
gaaacggaccauucaggaa

SEQ ID NO: 283688 - RNA, 19 nt, Homo sapiens
gcagcgaaguaucauguca

SEQ ID NO: 283689 - RNA, 19 nt, Homo sapiens
guacagggcaugaguugga

SEQ ID NO: 283690 - RNA, 19 nt, Homo sapiens
caagaaagaggguaaagca

SEQ ID NO: 283691 - RNA, 19 nt, Homo sapiens
gcaggaaucaggaagacaa

SEQ ID NO: 283692 - RNA, 19 nt, Homo sapiens
agaaagaggguaaagcaaa

SEQ ID NO: 283693 - RNA, 19 nt, Homo sapiens
ccaagacgcucagcagcuu

SEQ ID NO: 283694 - RNA, 19 nt, Homo sapiens
gccaagagaucgcacaacu

SEQ ID NO: 283695 - RNA, 19 nt, Homo sapiens
cgaaagaaagccucacaga

SEQ ID NO: 283696 - RNA, 19 nt, Homo sapiens
acaacuggcucaagcugaa

SEQ ID NO: 283697 - RNA, 19 nt, Homo sapiens
caauggagagucccuggua

SEQ ID NO: 283698 - RNA, 19 nt, Homo sapiens
ggaagcaaagucagauuca

SEQ ID NO: 283699 - RNA, 19 nt, Homo sapiens
gauagauggcgcugugauu

SEQ ID NO: 283700 - RNA, 19 nt, Homo sapiens
gaaguacccggacaucauc

SEQ ID NO: 283701 - RNA, 19 nt, Homo sapiens
guuacaauccugccaagaa

SEQ ID NO: 283702 - RNA, 19 nt, Homo sapiens
aaagucagauucagaacca

SEQ ID NO: 283703 - RNA, 19 nt, Homo sapiens
ggcucaagcugaagaagga

SEQ ID NO: 283704 - RNA, 19 nt, Homo sapiens
gcucugacccugaagauac

SEQ ID NO: 283705 - RNA, 19 nt, Homo sapiens
gugaagacccuggauguug

SEQ ID NO: 283706 - RNA, 19 nt, Homo sapiens
ccaccucccuggacaccaa

SEQ ID NO: 283707 - RNA, 19 nt, Homo sapiens
cgaaguaucaugucauuuu

SEQ ID NO: 283708 - RNA, 19 nt, Homo sapiens
gcagcugacagacgaagaa

SEQ ID NO: 283709 - RNA, 19 nt, Homo sapiens
ggagaacuuuguggagaca

SEQ ID NO: 283710 - RNA, 19 nt, Homo sapiens
gaaggaggaggaagaagag

SEQ ID NO: 283711 - RNA, 19 nt, Homo sapiens
agauagacaucaucaaagg

SEQ ID NO: 283712 - RNA, 19 nt, Homo sapiens
caaaggcggcacugaagga

SEQ ID NO: 283713 - RNA, 19 nt, Homo sapiens
agacaacacugggaaguac

SEQ ID NO: 283714 - RNA, 19 nt, Homo sapiens
gaagacaacacugggaagu

SEQ ID NO: 283715 - RNA, 19 nt, Homo sapiens
gaggagaccccgaaagaaa

SEQ ID NO: 283716 - RNA, 19 nt, Homo sapiens
cccugaagauaccuacuaa

SEQ ID NO: 283717 - RNA, 19 nt, Homo sapiens
gaagcaaagucagauucag

SEQ ID NO: 283718 - RNA, 19 nt, Homo sapiens
agacagagggcgaguuugu

SEQ ID NO: 283719 - RNA, 19 nt, Homo sapiens
gccaacaugcagcgaagua

SEQ ID NO: 283720 - RNA, 19 nt, Homo sapiens
ccacagccaagaagauaga

SEQ ID NO: 283721 - RNA, 19 nt, Homo sapiens
aagcaaagaagccugagaa

SEQ ID NO: 283722 - RNA, 19 nt, Homo sapiens
gaaggaggcauccaauagc

SEQ ID NO: 283723 - RNA, 19 nt, Homo sapiens
agaaggaggcauccaauag

SEQ ID NO: 283724 - RNA, 19 nt, Homo sapiens
gcagauccagccauuccaa

SEQ ID NO: 283725 - RNA, 19 nt, Homo sapiens
caggaagggagaauucuga

SEQ ID NO: 283726 - RNA, 19 nt, Homo sapiens
gcagagaccccgacggaaa

SEQ ID NO: 283727 - RNA, 19 nt, Homo sapiens
agaaggaggaggaagaaga

SEQ ID NO: 283728 - RNA, 19 nt, Homo sapiens
acagagaagccaagaggaa

SEQ ID NO: 283729 - RNA, 19 nt, Homo sapiens
cccgucauuucuuucaaua

SEQ ID NO: 283730 - RNA, 19 nt, Homo sapiens
ucgagcagaucgccgaguu

SEQ ID NO: 283731 - RNA, 19 nt, Homo sapiens
gcccggacguuugagaaga

SEQ ID NO: 283732 - RNA, 19 nt, Homo sapiens
gagaagccaagaggaagaa

SEQ ID NO: 283733 - RNA, 19 nt, Homo sapiens
ucgcuucccucgguuuauu

SEQ ID NO: 283734 - RNA, 19 nt, Homo sapiens
gcccuuacgugcggauaga

SEQ ID NO: 283735 - RNA, 19 nt, Homo sapiens
uggagacgcugagcaacuu

SEQ ID NO: 283736 - RNA, 19 nt, Homo sapiens
aggcugaaguggcaacaga

SEQ ID NO: 283737 - RNA, 19 nt, Homo sapiens
caccugcgaauacaaauau

SEQ ID NO: 283738 - RNA, 19 nt, Homo sapiens
gaagaucgaggaggugucu

SEQ ID NO: 283739 - RNA, 19 nt, Homo sapiens
uccaauagcagcagagaga

SEQ ID NO: 283740 - RNA, 19 nt, Homo sapiens
caacaugcagcgaaguauc

SEQ ID NO: 283741 - RNA, 19 nt, Homo sapiens
ccuacgagaucgccaagag

SEQ ID NO: 283742 - RNA, 19 nt, Homo sapiens
gauccagccauuccaagug

SEQ ID NO: 283743 - RNA, 19 nt, Homo sapiens
gagcuuggcgugggugaug

SEQ ID NO: 283744 - RNA, 19 nt, Homo sapiens
uuacaauccugccaagaac

SEQ ID NO: 283745 - RNA, 19 nt, Homo sapiens
ucaccugcgaauacaaaua

SEQ ID NO: 283746 - RNA, 19 nt, Homo sapiens
gcuuugaggaggcagcuuu

SEQ ID NO: 283747 - RNA, 19 nt, Homo sapiens
gccaagaacaacuaucauc

SEQ ID NO: 283748 - RNA, 19 nt, Homo sapiens
ccuaaagaccuccaaagca

SEQ ID NO: 283749 - RNA, 19 nt, Homo sapiens
gaauucugacgccaacaug

SEQ ID NO: 283750 - RNA, 19 nt, Homo sapiens
aagcaaagucagauucaga

SEQ ID NO: 283751 - RNA, 19 nt, Homo sapiens
gugaugguguccuucucaa

SEQ ID NO: 283752 - RNA, 19 nt, Homo sapiens
uggcggaucugaguguguu

SEQ ID NO: 283753 - RNA, 19 nt, Homo sapiens
gcgaggggcugauggugaa

SEQ ID NO: 283754 - RNA, 19 nt, Homo sapiens
ucccaucggucacauccuu

SEQ ID NO: 283755 - RNA, 19 nt, Homo sapiens
ggugaagacccuggauguu

SEQ ID NO: 283756 - RNA, 19 nt, Homo sapiens
agacagcagaggccagaaa

SEQ ID NO: 283757 - RNA, 19 nt, Homo sapiens
agcgaaguaucaugucauu

SEQ ID NO: 283758 - RNA, 19 nt, Homo sapiens
ggguacagggcaugaguug

SEQ ID NO: 283759 - RNA, 19 nt, Homo sapiens
caagaagauagacaucauc

SEQ ID NO: 283760 - RNA, 19 nt, Homo sapiens
agccugagguggccacgaa

SEQ ID NO: 283761 - RNA, 19 nt, Homo sapiens
ccaacaaggcgaggacuca

SEQ ID NO: 283762 - RNA, 19 nt, Homo sapiens
agaacuuuguggagacaga

SEQ ID NO: 283763 - RNA, 19 nt, Homo sapiens
aaggaggcauccaauagca

SEQ ID NO: 283764 - RNA, 19 nt, Homo sapiens
cgaccuggaccgaauuauc

SEQ ID NO: 283765 - RNA, 19 nt, Homo sapiens
ggacuuggcugacaugaua

SEQ ID NO: 283766 - RNA, 19 nt, Homo sapiens
gggaagagcuggaagauaa

SEQ ID NO: 283767 - RNA, 19 nt, Homo sapiens
gggagaagcuggccacaaa

SEQ ID NO: 283768 - RNA, 19 nt, Homo sapiens
gaaagccuguucuaucauu

SEQ ID NO: 283769 - RNA, 19 nt, Homo sapiens
cagcaaagauggcaacaug

SEQ ID NO: 283770 - RNA, 19 nt, Homo sapiens
gaucuuggauucugaagug

SEQ ID NO: 283771 - RNA, 19 nt, Homo sapiens
gcuaaugucugccuguuug

SEQ ID NO: 283772 - RNA, 19 nt, Homo sapiens
gauaaggacuggaaaucug

SEQ ID NO: 283773 - RNA, 19 nt, Homo sapiens
uugcagaucugucuucuaa

SEQ ID NO: 283774 - RNA, 19 nt, Homo sapiens
gaaaagaacugugccuauu

SEQ ID NO: 283775 - RNA, 19 nt, Homo sapiens
gcaaagccuuccgcuauga

SEQ ID NO: 283776 - RNA, 19 nt, Homo sapiens
gaaagcagccuuccaggau

SEQ ID NO: 283777 - RNA, 19 nt, Homo sapiens
gaccuuaaaugcaucauca

SEQ ID NO: 283778 - RNA, 19 nt, Homo sapiens
ccaaugaccuuaaaugcau

SEQ ID NO: 283779 - RNA, 19 nt, Homo sapiens
gaucuacuauccugacuuc

SEQ ID NO: 283780 - RNA, 19 nt, Homo sapiens
ccaauggcauguucucuga

SEQ ID NO: 283781 - RNA, 19 nt, Homo sapiens
gagcaaaggcggcaugaug

SEQ ID NO: 283782 - RNA, 19 nt, Homo sapiens
gacauugccuccaggugua

SEQ ID NO: 283783 - RNA, 19 nt, Homo sapiens
guuuacaacuugaacgaua

SEQ ID NO: 283784 - RNA, 19 nt, Homo sapiens
gaaaggcgccucauuuguc

SEQ ID NO: 283785 - RNA, 19 nt, Homo sapiens
gcagaucugucuucuaagg

SEQ ID NO: 283786 - RNA, 19 nt, Homo sapiens
gcggaaagcugcugaugag

SEQ ID NO: 283787 - RNA, 19 nt, Homo sapiens
gcaaguccguugaguaugc

SEQ ID NO: 283788 - RNA, 19 nt, Homo sapiens
uuaaaugcaucaucagguu

SEQ ID NO: 283789 - RNA, 19 nt, Homo sapiens
gcauaaggacugucugcua

SEQ ID NO: 283790 - RNA, 19 nt, Homo sapiens
gcagguacaccaaagaaga

SEQ ID NO: 283791 - RNA, 19 nt, Homo sapiens
gggcugaauucuccaaauc

SEQ ID NO: 283792 - RNA, 19 nt, Homo sapiens
gaaaugaagcgagucacaa

SEQ ID NO: 283793 - RNA, 19 nt, Homo sapiens
gaacuagacauggugaaga

SEQ ID NO: 283794 - RNA, 19 nt, Homo sapiens
ucagguugaucaaacauga

SEQ ID NO: 283795 - RNA, 19 nt, Homo sapiens
ggaagauaaugagaaggaa

SEQ ID NO: 283796 - RNA, 19 nt, Homo sapiens
gagcagagaggaagaacug

SEQ ID NO: 283797 - RNA, 19 nt, Homo sapiens
uaagacuguuuacaacuug

SEQ ID NO: 283798 - RNA, 19 nt, Homo sapiens
gcaaaguggugcccaaucc

SEQ ID NO: 283799 - RNA, 19 nt, Homo sapiens
gaugagacgcugugccaaa

SEQ ID NO: 283800 - RNA, 19 nt, Homo sapiens
gcagaagggaagcugagua

SEQ ID NO: 283801 - RNA, 19 nt, Homo sapiens
guccaggccucgcugauga

SEQ ID NO: 283802 - RNA, 19 nt, Homo sapiens
gaacucaggugcaaaacau

SEQ ID NO: 283803 - RNA, 19 nt, Homo sapiens
guacagccaaugaccuuaa

SEQ ID NO: 283804 - RNA, 19 nt, Homo sapiens
gacaaucagagucuucuuu

SEQ ID NO: 283805 - RNA, 19 nt, Homo sapiens
gaagggaagcugaguaacu

SEQ ID NO: 283806 - RNA, 19 nt, Homo sapiens
cagaagggaagcugaguaa

SEQ ID NO: 283807 - RNA, 19 nt, Homo sapiens
gaguccaggugcauaagaa

SEQ ID NO: 283808 - RNA, 19 nt, Homo sapiens
uguccaagcucaccaagga

SEQ ID NO: 283809 - RNA, 19 nt, Homo sapiens
caaucagagucuucuuuga

SEQ ID NO: 283810 - RNA, 19 nt, Homo sapiens
gaaaggcucagcaggagau

SEQ ID NO: 283811 - RNA, 19 nt, Homo sapiens
ggugacuucuccagugaaa

SEQ ID NO: 283812 - RNA, 19 nt, Homo sapiens
gagacgcugugccaaacaa

SEQ ID NO: 283813 - RNA, 19 nt, Homo sapiens
gcaaagauggcaacaugca

SEQ ID NO: 283814 - RNA, 19 nt, Homo sapiens
gagaugauaaggacuggaa

SEQ ID NO: 283815 - RNA, 19 nt, Homo sapiens
cagaaguggugcacaguca

SEQ ID NO: 283816 - RNA, 19 nt, Homo sapiens
ccaagagccuccuuaccau

SEQ ID NO: 283817 - RNA, 19 nt, Homo sapiens
gcacauugcagaucugucu

SEQ ID NO: 283818 - RNA, 19 nt, Homo sapiens
gcuggaagauaaugagaag

SEQ ID NO: 283819 - RNA, 19 nt, Homo sapiens
gugaaaggcgccucauuug

SEQ ID NO: 283820 - RNA, 19 nt, Homo sapiens
gaagggcguaugccgaauu

SEQ ID NO: 283821 - RNA, 19 nt, Homo sapiens
aaagucuucuccagugaaa

SEQ ID NO: 283822 - RNA, 19 nt, Homo sapiens
ucaacaagaucuacuaucc

SEQ ID NO: 283823 - RNA, 19 nt, Homo sapiens
cagauaacccagcacauug

SEQ ID NO: 283824 - RNA, 19 nt, Homo sapiens
uaagaucacgugccaccua

SEQ ID NO: 283825 - RNA, 19 nt, Homo sapiens
gaaaucugccacuaaccuu

SEQ ID NO: 283826 - RNA, 19 nt, Homo sapiens
gauguguaccuaacaguga

SEQ ID NO: 283827 - RNA, 19 nt, Homo sapiens
caggugacuucuccaguga

SEQ ID NO: 283828 - RNA, 19 nt, Homo sapiens
gaaacagaucugcuucaug

SEQ ID NO: 283829 - RNA, 19 nt, Homo sapiens
agaaugaacuagacauggu

SEQ ID NO: 283830 - RNA, 19 nt, Homo sapiens
gcagaaugaacuagacaug

SEQ ID NO: 283831 - RNA, 19 nt, Homo sapiens
gaaauuccaaaccggauca

SEQ ID NO: 283832 - RNA, 19 nt, Homo sapiens
gcaugaucuuggauucuga

SEQ ID NO: 283833 - RNA, 19 nt, Homo sapiens
ggagaccacuucagcuacu

SEQ ID NO: 283834 - RNA, 19 nt, Homo sapiens
aaaggcgccucauuuguca

SEQ ID NO: 283835 - RNA, 19 nt, Homo sapiens
ccagggaagccaucuaaga

SEQ ID NO: 283836 - RNA, 19 nt, Homo sapiens
caaggaggaugagcagcaa

SEQ ID NO: 283837 - RNA, 19 nt, Homo sapiens
acaaagucuucuccaguga

SEQ ID NO: 283838 - RNA, 19 nt, Homo sapiens
gccaagagccuccuuacca

SEQ ID NO: 283839 - RNA, 19 nt, Homo sapiens
cuacgggaguuucgaaagu

SEQ ID NO: 283840 - RNA, 19 nt, Homo sapiens
caaagaagaaagcuguugu

SEQ ID NO: 283841 - RNA, 19 nt, Homo sapiens
cugcaaagccuuccgcuau

SEQ ID NO: 283842 - RNA, 19 nt, Homo sapiens
cuacuauccugacuucauc

SEQ ID NO: 283843 - RNA, 19 nt, Homo sapiens
caacaagacaggcaaacca

SEQ ID NO: 283844 - RNA, 19 nt, Homo sapiens
aguaugcaaugaagaaaug

SEQ ID NO: 283845 - RNA, 19 nt, Homo sapiens
ccacggugauguguaccua

SEQ ID NO: 283846 - RNA, 19 nt, Homo sapiens
acagauaacccagcacauu

SEQ ID NO: 283847 - RNA, 19 nt, Homo sapiens
ggguagcagugaagagaau

SEQ ID NO: 283848 - RNA, 19 nt, Homo sapiens
gcacccgaauccgagauga

SEQ ID NO: 283849 - RNA, 19 nt, Homo sapiens
aaaugaagcgagucacaaa

SEQ ID NO: 283850 - RNA, 19 nt, Homo sapiens
cgcaggagguggagaagga

SEQ ID NO: 283851 - RNA, 19 nt, Homo sapiens
cauuaagacuguuuacaac

SEQ ID NO: 283852 - RNA, 19 nt, Homo sapiens
augaagaaaugucccaaug

SEQ ID NO: 283853 - RNA, 19 nt, Homo sapiens
agugaaaggcgccucauuu

SEQ ID NO: 283854 - RNA, 19 nt, Homo sapiens
uaaugagaaggaacagaua

SEQ ID NO: 283855 - RNA, 19 nt, Homo sapiens
gaagcuggccacaaagucu

SEQ ID NO: 283856 - RNA, 19 nt, Homo sapiens
ccaaggagaaggcagacuu

SEQ ID NO: 283857 - RNA, 19 nt, Homo sapiens
aagaugaacucaggugcaa

SEQ ID NO: 283858 - RNA, 19 nt, Homo sapiens
gaagagcuggaagauaaug

SEQ ID NO: 283859 - RNA, 19 nt, Homo sapiens
gaugauaaggacuggaaau

SEQ ID NO: 283860 - RNA, 19 nt, Homo sapiens
gagaagcuggccacaaagu

SEQ ID NO: 283861 - RNA, 19 nt, Homo sapiens
gcuauaugucuuuggcuuu

SEQ ID NO: 283862 - RNA, 19 nt, Homo sapiens
acgggaguuucgaaaguua

SEQ ID NO: 283863 - RNA, 19 nt, Homo sapiens
agaggcagcuauaugucuu

SEQ ID NO: 283864 - RNA, 19 nt, Homo sapiens
ggaaaucugccacuaaccu

SEQ ID NO: 283865 - RNA, 19 nt, Homo sapiens
ggacuuggcugacaugaua

SEQ ID NO: 283866 - RNA, 19 nt, Homo sapiens
gggaagagcuggaagauaa

SEQ ID NO: 283867 - RNA, 19 nt, Homo sapiens
gggagaagcuggccacaaa

SEQ ID NO: 283868 - RNA, 19 nt, Homo sapiens
gaaagccuguucuaucauu

SEQ ID NO: 283869 - RNA, 19 nt, Homo sapiens
guacaggaauuugauauga

SEQ ID NO: 283870 - RNA, 19 nt, Homo sapiens
cagcaaagauggcaacaug

SEQ ID NO: 283871 - RNA, 19 nt, Homo sapiens
gaucuuggauucugaagug

SEQ ID NO: 283872 - RNA, 19 nt, Homo sapiens
gcuaaugucugccuguuug

SEQ ID NO: 283873 - RNA, 19 nt, Homo sapiens
gauaaggacuggaaaucug

SEQ ID NO: 283874 - RNA, 19 nt, Homo sapiens
uugcagaucugucuucuaa

SEQ ID NO: 283875 - RNA, 19 nt, Homo sapiens
gaaaagaacugugccuauu

SEQ ID NO: 283876 - RNA, 19 nt, Homo sapiens
gcagauagacacaguauag

SEQ ID NO: 283877 - RNA, 19 nt, Homo sapiens
gcaaagccuuccgcuauga

SEQ ID NO: 283878 - RNA, 19 nt, Homo sapiens
gaaagcagccuuccaggau

SEQ ID NO: 283879 - RNA, 19 nt, Homo sapiens
gaccuuaaaugcaucauca

SEQ ID NO: 283880 - RNA, 19 nt, Homo sapiens
ccaaugaccuuaaaugcau

SEQ ID NO: 283881 - RNA, 19 nt, Homo sapiens
gaucuacuauccugacuuc

SEQ ID NO: 283882 - RNA, 19 nt, Homo sapiens
ccaauggcauguucucuga

SEQ ID NO: 283883 - RNA, 19 nt, Homo sapiens
gagcaaaggcggcaugaug

SEQ ID NO: 283884 - RNA, 19 nt, Homo sapiens
gacauugccuccaggugua

SEQ ID NO: 283885 - RNA, 19 nt, Homo sapiens
guuuacaacuugaacgaua

SEQ ID NO: 283886 - RNA, 19 nt, Homo sapiens
gaaaggcgccucauuuguc

SEQ ID NO: 283887 - RNA, 19 nt, Homo sapiens
gcagaucugucuucuaagg

SEQ ID NO: 283888 - RNA, 19 nt, Homo sapiens
gcggaaagcugcugaugag

SEQ ID NO: 283889 - RNA, 19 nt, Homo sapiens
gcaaguccguugaguaugc

SEQ ID NO: 283890 - RNA, 19 nt, Homo sapiens
uuaaaugcaucaucagguu

SEQ ID NO: 283891 - RNA, 19 nt, Homo sapiens
gcauaaggacugucugcua

SEQ ID NO: 283892 - RNA, 19 nt, Homo sapiens
gcagguacaccaaagaaga

SEQ ID NO: 283893 - RNA, 19 nt, Homo sapiens
gggcugaauucuccaaauc

SEQ ID NO: 283894 - RNA, 19 nt, Homo sapiens
gaaaugaagcgagucacaa

SEQ ID NO: 283895 - RNA, 19 nt, Homo sapiens
gaacuagacauggugaaga

SEQ ID NO: 283896 - RNA, 19 nt, Homo sapiens
ucagguugaucaaacauga

SEQ ID NO: 283897 - RNA, 19 nt, Homo sapiens
ggaagauaaugagaaggaa

SEQ ID NO: 283898 - RNA, 19 nt, Homo sapiens
uaagacuguuuacaacuug

SEQ ID NO: 283899 - RNA, 19 nt, Homo sapiens
gcaaaguggugcccaaucc

SEQ ID NO: 283900 - RNA, 19 nt, Homo sapiens
gaugagacgcugugccaaa

SEQ ID NO: 283901 - RNA, 19 nt, Homo sapiens
gcagaagggaagcugagua

SEQ ID NO: 283902 - RNA, 19 nt, Homo sapiens
guccaggccucgcugauga

SEQ ID NO: 283903 - RNA, 19 nt, Homo sapiens
gaacucaggugcaaaacau

SEQ ID NO: 283904 - RNA, 19 nt, Homo sapiens
guacagccaaugaccuuaa

SEQ ID NO: 283905 - RNA, 19 nt, Homo sapiens
gacaaucagagucuucuuu

SEQ ID NO: 283906 - RNA, 19 nt, Homo sapiens
caguuugucuugcugguuu

SEQ ID NO: 283907 - RNA, 19 nt, Homo sapiens
ggaggcagauagacacagu

SEQ ID NO: 283908 - RNA, 19 nt, Homo sapiens
gaagggaagcugaguaacu

SEQ ID NO: 283909 - RNA, 19 nt, Homo sapiens
cagaagggaagcugaguaa

SEQ ID NO: 283910 - RNA, 19 nt, Homo sapiens
gaguccaggugcauaagaa

SEQ ID NO: 283911 - RNA, 19 nt, Homo sapiens
uguccaagcucaccaagga

SEQ ID NO: 283912 - RNA, 19 nt, Homo sapiens
caaucagagucuucuuuga

SEQ ID NO: 283913 - RNA, 19 nt, Homo sapiens
gaaaggcucagcaggagau

SEQ ID NO: 283914 - RNA, 19 nt, Homo sapiens
ggugacuucuccagugaaa

SEQ ID NO: 283915 - RNA, 19 nt, Homo sapiens
gaagucaguuugucuugcu

SEQ ID NO: 283916 - RNA, 19 nt, Homo sapiens
gagacgcugugccaaacaa

SEQ ID NO: 283917 - RNA, 19 nt, Homo sapiens
gcaaagauggcaacaugca

SEQ ID NO: 283918 - RNA, 19 nt, Homo sapiens
gagaugauaaggacuggaa

SEQ ID NO: 283919 - RNA, 19 nt, Homo sapiens
cagaaguggugcacaguca

SEQ ID NO: 283920 - RNA, 19 nt, Homo sapiens
ccaagagccuccuuaccau

SEQ ID NO: 283921 - RNA, 19 nt, Homo sapiens
gcacauugcagaucugucu

SEQ ID NO: 283922 - RNA, 19 nt, Homo sapiens
gcuggaagauaaugagaag

SEQ ID NO: 283923 - RNA, 19 nt, Homo sapiens
gugaaaggcgccucauuug

SEQ ID NO: 283924 - RNA, 19 nt, Homo sapiens
gaagggcguaugccgaauu

SEQ ID NO: 283925 - RNA, 19 nt, Homo sapiens
cauacucuccuuuaccaua

SEQ ID NO: 283926 - RNA, 19 nt, Homo sapiens
ggaauuugauaugacuuca

SEQ ID NO: 283927 - RNA, 19 nt, Homo sapiens
aaagucuucuccagugaaa

SEQ ID NO: 283928 - RNA, 19 nt, Homo sapiens
ucaacaagaucuacuaucc

SEQ ID NO: 283929 - RNA, 19 nt, Homo sapiens
cagauaacccagcacauug

SEQ ID NO: 283930 - RNA, 19 nt, Homo sapiens
uaagaucacgugccaccua

SEQ ID NO: 283931 - RNA, 19 nt, Homo sapiens
gaaaucugccacuaaccuu

SEQ ID NO: 283932 - RNA, 19 nt, Homo sapiens
gauguguaccuaacaguga

SEQ ID NO: 283933 - RNA, 19 nt, Homo sapiens
caggugacuucuccaguga

SEQ ID NO: 283934 - RNA, 19 nt, Homo sapiens
gaaacagaucugcuucaug

SEQ ID NO: 283935 - RNA, 19 nt, Homo sapiens
agaaugaacuagacauggu

SEQ ID NO: 283936 - RNA, 19 nt, Homo sapiens
gcagaaugaacuagacaug

SEQ ID NO: 283937 - RNA, 19 nt, Homo sapiens
gaaauuccaaaccggauca

SEQ ID NO: 283938 - RNA, 19 nt, Homo sapiens
gcaugaucuuggauucuga

SEQ ID NO: 283939 - RNA, 19 nt, Homo sapiens
ggagaccacuucagcuacu

SEQ ID NO: 283940 - RNA, 19 nt, Homo sapiens
aaaggcgccucauuuguca

SEQ ID NO: 283941 - RNA, 19 nt, Homo sapiens
ccagggaagccaucuaaga

SEQ ID NO: 283942 - RNA, 19 nt, Homo sapiens
caaggaggaugagcagcaa

SEQ ID NO: 283943 - RNA, 19 nt, Homo sapiens
acaaagucuucuccaguga

SEQ ID NO: 283944 - RNA, 19 nt, Homo sapiens
gccaagagccuccuuacca

SEQ ID NO: 283945 - RNA, 19 nt, Homo sapiens
cuacgggaguuucgaaagu

SEQ ID NO: 283946 - RNA, 19 nt, Homo sapiens
caaagaagaaagcuguugu

SEQ ID NO: 283947 - RNA, 19 nt, Homo sapiens
gaguggauuugggcaugua

SEQ ID NO: 283948 - RNA, 19 nt, Homo sapiens
cugcaaagccuuccgcuau

SEQ ID NO: 283949 - RNA, 19 nt, Homo sapiens
cuacuauccugacuucauc

SEQ ID NO: 283950 - RNA, 19 nt, Homo sapiens
caacaagacaggcaaacca

SEQ ID NO: 283951 - RNA, 19 nt, Homo sapiens
aguaugcaaugaagaaaug

SEQ ID NO: 283952 - RNA, 19 nt, Homo sapiens
ccacggugauguguaccua

SEQ ID NO: 283953 - RNA, 19 nt, Homo sapiens
acagauaacccagcacauu

SEQ ID NO: 283954 - RNA, 19 nt, Homo sapiens
gccauacucuccuuuacca

SEQ ID NO: 283955 - RNA, 19 nt, Homo sapiens
ggguagcagugaagagaau

SEQ ID NO: 283956 - RNA, 19 nt, Homo sapiens
gcacccgaauccgagauga

SEQ ID NO: 283957 - RNA, 19 nt, Homo sapiens
aaaugaagcgagucacaaa

SEQ ID NO: 283958 - RNA, 19 nt, Homo sapiens
cgcaggagguggagaagga

SEQ ID NO: 283959 - RNA, 19 nt, Homo sapiens
cauuaagacuguuuacaac

SEQ ID NO: 283960 - RNA, 19 nt, Homo sapiens
augaagaaaugucccaaug

SEQ ID NO: 283961 - RNA, 19 nt, Homo sapiens
agugaaaggcgccucauuu

SEQ ID NO: 283962 - RNA, 19 nt, Homo sapiens
uaaugagaaggaacagaua

SEQ ID NO: 283963 - RNA, 19 nt, Homo sapiens
gaagcuggccacaaagucu

SEQ ID NO: 283964 - RNA, 19 nt, Homo sapiens
ccaaggagaaggcagacuu

SEQ ID NO: 283965 - RNA, 19 nt, Homo sapiens
gcacaaagauggagaugua

SEQ ID NO: 283966 - RNA, 19 nt, Homo sapiens
gaaaggaaguuuaaccaua

SEQ ID NO: 283967 - RNA, 19 nt, Homo sapiens
gggagugucucauguaaua

SEQ ID NO: 283968 - RNA, 19 nt, Homo sapiens
ggacaagguuagcuauuaa

SEQ ID NO: 283969 - RNA, 19 nt, Homo sapiens
gggacaagguuagcuauua

SEQ ID NO: 283970 - RNA, 19 nt, Homo sapiens
gaaauggcuucucugauug

SEQ ID NO: 283971 - RNA, 19 nt, Homo sapiens
gaauagaaauagugcagaa

SEQ ID NO: 283972 - RNA, 19 nt, Homo sapiens
gagaauggccuauggaauu

SEQ ID NO: 283973 - RNA, 19 nt, Homo sapiens
gcaaugagacuaauucuuc

SEQ ID NO: 283974 - RNA, 19 nt, Homo sapiens
gaagauucaucaccgcuuu

SEQ ID NO: 283975 - RNA, 19 nt, Homo sapiens
ugaaagaacuguaugaucu

SEQ ID NO: 283976 - RNA, 19 nt, Homo sapiens
gguaugagauucuuaguag

SEQ ID NO: 283977 - RNA, 19 nt, Homo sapiens
gaagagggaauuaugguaa

SEQ ID NO: 283978 - RNA, 19 nt, Homo sapiens
gccaagauguuuacagaaa

SEQ ID NO: 283979 - RNA, 19 nt, Homo sapiens
gaacagauagccagccaaa

SEQ ID NO: 283980 - RNA, 19 nt, Homo sapiens
caaagcagauauacaaauc

SEQ ID NO: 283981 - RNA, 19 nt, Homo sapiens
ggauauaacuacacugauc

SEQ ID NO: 283982 - RNA, 19 nt, Homo sapiens
ggacucguaugcuguuauu

SEQ ID NO: 283983 - RNA, 19 nt, Homo sapiens
ggugauaguuauuucauug

SEQ ID NO: 283984 - RNA, 19 nt, Homo sapiens
ccaaagaugaagaaaguua

SEQ ID NO: 283985 - RNA, 19 nt, Homo sapiens
gaacagagaagccagaagu

SEQ ID NO: 283986 - RNA, 19 nt, Homo sapiens
gaacuguauugccugcuuu

SEQ ID NO: 283987 - RNA, 19 nt, Homo sapiens
gagggagugucucauguaa

SEQ ID NO: 283988 - RNA, 19 nt, Homo sapiens
gcagacuccugaagaaaug

SEQ ID NO: 283989 - RNA, 19 nt, Homo sapiens
ugaaguaauugaugcauug

SEQ ID NO: 283990 - RNA, 19 nt, Homo sapiens
agaauggccuauggaauua

SEQ ID NO: 283991 - RNA, 19 nt, Homo sapiens
gcagauuuguguucaacuu

SEQ ID NO: 283992 - RNA, 19 nt, Homo sapiens
cugguaagcucgcaucuaa

SEQ ID NO: 283993 - RNA, 19 nt, Homo sapiens
aaacacaagcucauacuaa

SEQ ID NO: 283994 - RNA, 19 nt, Homo sapiens
acacaaacuuucaugcaaa

SEQ ID NO: 283995 - RNA, 19 nt, Homo sapiens
gugagaugauggccuauaa

SEQ ID NO: 283996 - RNA, 19 nt, Homo sapiens
gcguacauguugauucuuu

SEQ ID NO: 283997 - RNA, 19 nt, Homo sapiens
cguaugcuguuauuaauga

SEQ ID NO: 283998 - RNA, 19 nt, Homo sapiens
guaauucugucauuguuca

SEQ ID NO: 283999 - RNA, 19 nt, Homo sapiens
agaaggauaugaaacauca

SEQ ID NO: 284000 - RNA, 19 nt, Homo sapiens
agacaagugugaauuacaa

SEQ ID NO: 284001 - RNA, 19 nt, Homo sapiens
cagagaagccagaaguaua

SEQ ID NO: 284002 - RNA, 19 nt, Homo sapiens
uuggguaacugauucaaua

SEQ ID NO: 284003 - RNA, 19 nt, Homo sapiens
gcaaacuuguuauuguguu

SEQ ID NO: 284004 - RNA, 19 nt, Homo sapiens
aagaaacuaugcuugcuaa

SEQ ID NO: 284005 - RNA, 19 nt, Homo sapiens
gaagaaaaccaguauuuga

SEQ ID NO: 284006 - RNA, 19 nt, Homo sapiens
cgaaauggauauaacuaca

SEQ ID NO: 284007 - RNA, 19 nt, Homo sapiens
uaaugaugcugcugaguug

SEQ ID NO: 284008 - RNA, 19 nt, Homo sapiens
ucacaaacuucacaaacug

SEQ ID NO: 284009 - RNA, 19 nt, Homo sapiens
cagccucgcuuuaugauuc

SEQ ID NO: 284010 - RNA, 19 nt, Homo sapiens
gauguagaguuuuguguua

SEQ ID NO: 284011 - RNA, 19 nt, Homo sapiens
gcuggagacuuugcaauga

SEQ ID NO: 284012 - RNA, 19 nt, Homo sapiens
gaacgaauacagaaaagua

SEQ ID NO: 284013 - RNA, 19 nt, Homo sapiens
ucugauugcugauuuagaa

SEQ ID NO: 284014 - RNA, 19 nt, Homo sapiens
gaugaugaaccacaagaaa

SEQ ID NO: 284015 - RNA, 19 nt, Homo sapiens
gagagagaauggccuaugg

SEQ ID NO: 284016 - RNA, 19 nt, Homo sapiens
ggaacuguauugccugcuu

SEQ ID NO: 284017 - RNA, 19 nt, Homo sapiens
gaagccagaaguauacauu

SEQ ID NO: 284018 - RNA, 19 nt, Homo sapiens
ugaaauuggccaaguauug

SEQ ID NO: 284019 - RNA, 19 nt, Homo sapiens
gaucuggguuugaaauugg

SEQ ID NO: 284020 - RNA, 19 nt, Homo sapiens
cauacucucucucguguug

SEQ ID NO: 284021 - RNA, 19 nt, Homo sapiens
gagaaagagguaugagauu

SEQ ID NO: 284022 - RNA, 19 nt, Homo sapiens
cgagcagacuccugaagaa

SEQ ID NO: 284023 - RNA, 19 nt, Homo sapiens
gauuuaaagcuugguguua

SEQ ID NO: 284024 - RNA, 19 nt, Homo sapiens
ggaugaucauaaaggauuu

SEQ ID NO: 284025 - RNA, 19 nt, Homo sapiens
uaauuuaccuagagaugga

SEQ ID NO: 284026 - RNA, 19 nt, Homo sapiens
gaagaucauagucguguug

SEQ ID NO: 284027 - RNA, 19 nt, Homo sapiens
gagcaaaaguaguuucuug

SEQ ID NO: 284028 - RNA, 19 nt, Homo sapiens
agaaagagguaugagauuc

SEQ ID NO: 284029 - RNA, 19 nt, Homo sapiens
aaaggaaguuuaaccauac

SEQ ID NO: 284030 - RNA, 19 nt, Homo sapiens
uggagaugcuggagacuuu

SEQ ID NO: 284031 - RNA, 19 nt, Homo sapiens
cauaagaaccacaaagaug

SEQ ID NO: 284032 - RNA, 19 nt, Homo sapiens
cagcugggauucucugguu

SEQ ID NO: 284033 - RNA, 19 nt, Homo sapiens
ggauugcucuccucucagu

SEQ ID NO: 284034 - RNA, 19 nt, Homo sapiens
ggaauuauugagcacuuaa

SEQ ID NO: 284035 - RNA, 19 nt, Homo sapiens
guaugucaguggacuaaug

SEQ ID NO: 284036 - RNA, 19 nt, Homo sapiens
caaagauggagauguauau

SEQ ID NO: 284037 - RNA, 19 nt, Homo sapiens
gauaugaaacaucagaguu

SEQ ID NO: 284038 - RNA, 19 nt, Homo sapiens
ggcaugagacucugagaaa

SEQ ID NO: 284039 - RNA, 19 nt, Homo sapiens
gcugugcucuucaucuaga

SEQ ID NO: 284040 - RNA, 19 nt, Homo sapiens
ccaucaagaucucauuuua

SEQ ID NO: 284041 - RNA, 19 nt, Homo sapiens
uaugauugcuauggugaua

SEQ ID NO: 284042 - RNA, 19 nt, Homo sapiens
uaaagcagcagagaucgua

SEQ ID NO: 284043 - RNA, 19 nt, Homo sapiens
gauuaaagcagcagagauc

SEQ ID NO: 284044 - RNA, 19 nt, Homo sapiens
aagccaagauguuuacaga

SEQ ID NO: 284045 - RNA, 19 nt, Homo sapiens
ggugaaauaaacagucuaa

SEQ ID NO: 284046 - RNA, 19 nt, Homo sapiens
guuaugaguggaacagaua

SEQ ID NO: 284047 - RNA, 19 nt, Homo sapiens
guuugaaauuggccaagua

SEQ ID NO: 284048 - RNA, 19 nt, Homo sapiens
gcaggaaaccaucaagauc

SEQ ID NO: 284049 - RNA, 19 nt, Homo sapiens
gagaagccaucuguguuuc

SEQ ID NO: 284050 - RNA, 19 nt, Homo sapiens
ugagaagccaucuguguuu

SEQ ID NO: 284051 - RNA, 19 nt, Homo sapiens
auucugaucugcaaacuug

SEQ ID NO: 284052 - RNA, 19 nt, Homo sapiens
gguagaggauucugaucug

SEQ ID NO: 284053 - RNA, 19 nt, Homo sapiens
caagcuagauggugaacgu

SEQ ID NO: 284054 - RNA, 19 nt, Homo sapiens
gagcaaaaguggcuuauac

SEQ ID NO: 284055 - RNA, 19 nt, Homo sapiens
uaaacagucuaaagaagag

SEQ ID NO: 284056 - RNA, 19 nt, Homo sapiens
gcucgcaucuaaacaccuu

SEQ ID NO: 284057 - RNA, 19 nt, Homo sapiens
gaucugcaaacuuguuauu

SEQ ID NO: 284058 - RNA, 19 nt, Homo sapiens
gcaaaugcacaaagaugga

SEQ ID NO: 284059 - RNA, 19 nt, Homo sapiens
gaauuuggugguuauauag

SEQ ID NO: 284060 - RNA, 19 nt, Homo sapiens
gacaaggaguggcaugagu

SEQ ID NO: 284061 - RNA, 19 nt, Homo sapiens
uaaacgagaagauucauca

SEQ ID NO: 284062 - RNA, 19 nt, Homo sapiens
gagaugauggccuauaauc

SEQ ID NO: 284063 - RNA, 19 nt, Homo sapiens
guaggacucagugauauuu

SEQ ID NO: 284064 - RNA, 19 nt, Homo sapiens
cacaaacuguugcaucuca

SEQ ID NO: 284065 - RNA, 19 nt, Homo sapiens
ccacucagaucaccaugua

SEQ ID NO: 284066 - RNA, 19 nt, Homo sapiens
ggagggagcugagaagacu

SEQ ID NO: 284067 - RNA, 19 nt, Homo sapiens
gaacucugcggcucaaaga

SEQ ID NO: 284068 - RNA, 19 nt, Homo sapiens
gcuggaaggaggaagaaua

SEQ ID NO: 284069 - RNA, 19 nt, Homo sapiens
ggagaacucugcggcucaa

SEQ ID NO: 284070 - RNA, 19 nt, Homo sapiens
ggacaccuguauuccagau

SEQ ID NO: 284071 - RNA, 19 nt, Homo sapiens
gauccugucugcccuaugc

SEQ ID NO: 284072 - RNA, 19 nt, Homo sapiens
uggcagugcucaugacguu

SEQ ID NO: 284073 - RNA, 19 nt, Homo sapiens
ccgcugagcccaaaugugu

SEQ ID NO: 284074 - RNA, 19 nt, Homo sapiens
ggacuauccauuagagcaa

SEQ ID NO: 284075 - RNA, 19 nt, Homo sapiens
guucuggacuguggguuug

SEQ ID NO: 284076 - RNA, 19 nt, Homo sapiens
gcagggauuuucuacaugu

SEQ ID NO: 284077 - RNA, 19 nt, Homo sapiens
caucuggaaguuaaaguga

SEQ ID NO: 284078 - RNA, 19 nt, Homo sapiens
caacagaccacuggaugca

SEQ ID NO: 284079 - RNA, 19 nt, Homo sapiens
gagcaacccaagcauacug

SEQ ID NO: 284080 - RNA, 19 nt, Homo sapiens
ccugaaauccugguuccua

SEQ ID NO: 284081 - RNA, 19 nt, Homo sapiens
gggagcaacccaagcauac

SEQ ID NO: 284082 - RNA, 19 nt, Homo sapiens
caucauggccuucgcucau

SEQ ID NO: 284083 - RNA, 19 nt, Homo sapiens
gcccaaggacaccuguauu

SEQ ID NO: 284084 - RNA, 19 nt, Homo sapiens
caugggugguggccuguuc

SEQ ID NO: 284085 - RNA, 19 nt, Homo sapiens
ggaggaggagggucuagag

SEQ ID NO: 284086 - RNA, 19 nt, Homo sapiens
caacccaagcauacuggaa

SEQ ID NO: 284087 - RNA, 19 nt, Homo sapiens
caaggacaccuguauucca

SEQ ID NO: 284088 - RNA, 19 nt, Homo sapiens
agugcuaccugcagacaga

SEQ ID NO: 284089 - RNA, 19 nt, Homo sapiens
gcagugcucaugacguucu

SEQ ID NO: 284090 - RNA, 19 nt, Homo sapiens
aaagggagcaacccaagca

SEQ ID NO: 284091 - RNA, 19 nt, Homo sapiens
ggucuagaggccugaaauc

SEQ ID NO: 284092 - RNA, 19 nt, Homo sapiens
cuucucugcuggcaucaug

SEQ ID NO: 284093 - RNA, 19 nt, Homo sapiens
cccaaggacaccuguauuc

SEQ ID NO: 284094 - RNA, 19 nt, Homo sapiens
gcaacuuucuggggccuaa

SEQ ID NO: 284095 - RNA, 19 nt, Homo sapiens
ccuaccgggugcaugaaug

SEQ ID NO: 284096 - RNA, 19 nt, Homo sapiens
ggcccaaggacaccuguau

SEQ ID NO: 284097 - RNA, 19 nt, Homo sapiens
gcucaucagccuaccuucu

SEQ ID NO: 284098 - RNA, 19 nt, Homo sapiens
gcaaaugacuuagcuauua

SEQ ID NO: 284099 - RNA, 19 nt, Homo sapiens
gaaagagacugauuguuga

SEQ ID NO: 284100 - RNA, 19 nt, Homo sapiens
caacucagcuucacauauu

SEQ ID NO: 284101 - RNA, 19 nt, Homo sapiens
gaacaggaaugaaaggaaa

SEQ ID NO: 284102 - RNA, 19 nt, Homo sapiens
gaugugagcugcuuacuga

SEQ ID NO: 284103 - RNA, 19 nt, Homo sapiens
ggaccuggcuggcaaauga

SEQ ID NO: 284104 - RNA, 19 nt, Homo sapiens
ggaaaggucaucucuguua

SEQ ID NO: 284105 - RNA, 19 nt, Homo sapiens
gaucauauaugcauacguu

SEQ ID NO: 284106 - RNA, 19 nt, Homo sapiens
caacaucacuuccuucaug

SEQ ID NO: 284107 - RNA, 19 nt, Homo sapiens
gggcugugcuuaagaauuu

SEQ ID NO: 284108 - RNA, 19 nt, Homo sapiens
cagaagauaucaucaaguu

SEQ ID NO: 284109 - RNA, 19 nt, Homo sapiens
ggaaauccaugccaagaug

SEQ ID NO: 284110 - RNA, 19 nt, Homo sapiens
gaaagcaaauguuuagaag

SEQ ID NO: 284111 - RNA, 19 nt, Homo sapiens
auaaagaacugaacccuaa

SEQ ID NO: 284112 - RNA, 19 nt, Homo sapiens
gaacguccagaucuuauua

SEQ ID NO: 284113 - RNA, 19 nt, Homo sapiens
guacagacuuguccaauca

SEQ ID NO: 284114 - RNA, 19 nt, Homo sapiens
cauaggaccugacaugaaa

SEQ ID NO: 284115 - RNA, 19 nt, Homo sapiens
gaccaaagguggacagaga

SEQ ID NO: 284116 - RNA, 19 nt, Homo sapiens
gcagugauaccaacuuaua

SEQ ID NO: 284117 - RNA, 19 nt, Homo sapiens
ggacuacucucgugugugu

SEQ ID NO: 284118 - RNA, 19 nt, Homo sapiens
guaagccacuuuauuauca

SEQ ID NO: 284119 - RNA, 19 nt, Homo sapiens
gaagcucucugaguucuuu

SEQ ID NO: 284120 - RNA, 19 nt, Homo sapiens
uaagggaacuacccaacua

SEQ ID NO: 284121 - RNA, 19 nt, Homo sapiens
ccacaugccugcaaugaga

SEQ ID NO: 284122 - RNA, 19 nt, Homo sapiens
aagaagagauggagaaaga

SEQ ID NO: 284123 - RNA, 19 nt, Homo sapiens
uaaaucagcucccacuaau

SEQ ID NO: 284124 - RNA, 19 nt, Homo sapiens
gaucaaggaaucaacauuu

SEQ ID NO: 284125 - RNA, 19 nt, Homo sapiens
gaacagaaagagacugauu

SEQ ID NO: 284126 - RNA, 19 nt, Homo sapiens
caagaagcauggcguagaa

SEQ ID NO: 284127 - RNA, 19 nt, Homo sapiens
caacagagggcgaaacaaa

SEQ ID NO: 284128 - RNA, 19 nt, Homo sapiens
gaaucaacauuuaccgaaa

SEQ ID NO: 284129 - RNA, 19 nt, Homo sapiens
guccagaucuuauuaccua

SEQ ID NO: 284130 - RNA, 19 nt, Homo sapiens
gcaaccagauguucacaga

SEQ ID NO: 284131 - RNA, 19 nt, Homo sapiens
gagauagaguuaaugaguu

SEQ ID NO: 284132 - RNA, 19 nt, Homo sapiens
ggaagaugguggaaggaaa

SEQ ID NO: 284133 - RNA, 19 nt, Homo sapiens
gggcagcucuguuugaaug

SEQ ID NO: 284134 - RNA, 19 nt, Homo sapiens
gagaggaaauguaucuuca

SEQ ID NO: 284135 - RNA, 19 nt, Homo sapiens
caaaguagacuccuucgaa

SEQ ID NO: 284136 - RNA, 19 nt, Homo sapiens
gcaaugauguacuuuaagg

SEQ ID NO: 284137 - RNA, 19 nt, Homo sapiens
gcaccaaauauuaggauua

SEQ ID NO: 284138 - RNA, 19 nt, Homo sapiens
ggaaggggauuguauauau

SEQ ID NO: 284139 - RNA, 19 nt, Homo sapiens
caagaugccugccuuccuu

SEQ ID NO: 284140 - RNA, 19 nt, Homo sapiens
gaccaaacauuuccacauc

SEQ ID NO: 284141 - RNA, 19 nt, Homo sapiens
agaaaugcauugccagaaa

SEQ ID NO: 284142 - RNA, 19 nt, Homo sapiens
gcauccaacuugagaagaa

SEQ ID NO: 284143 - RNA, 19 nt, Homo sapiens
agaaagagacugauuguug

SEQ ID NO: 284144 - RNA, 19 nt, Homo sapiens
ucucugaguucuuugauuu

SEQ ID NO: 284145 - RNA, 19 nt, Homo sapiens
gaaaugcauugccagaaag

SEQ ID NO: 284146 - RNA, 19 nt, Homo sapiens
gcccagcucugucgaauuc

SEQ ID NO: 284147 - RNA, 19 nt, Homo sapiens
ccacagaccuggcaaugag

SEQ ID NO: 284148 - RNA, 19 nt, Homo sapiens
caaggcaauuuaugacauu

SEQ ID NO: 284149 - RNA, 19 nt, Homo sapiens
ugaauaaaguugugugcuu

SEQ ID NO: 284150 - RNA, 19 nt, Homo sapiens
cauugaagcucucugaguu

SEQ ID NO: 284151 - RNA, 19 nt, Homo sapiens
gauaccaacuuauagcaau

SEQ ID NO: 284152 - RNA, 19 nt, Homo sapiens
gcagaugaaaugucaauau

SEQ ID NO: 284153 - RNA, 19 nt, Homo sapiens
gaaagccacccaucuacaa

SEQ ID NO: 284154 - RNA, 19 nt, Homo sapiens
ggaaacaugggcauaauca

SEQ ID NO: 284155 - RNA, 19 nt, Homo sapiens
gaacaaaagcucugaaguu

SEQ ID NO: 284156 - RNA, 19 nt, Homo sapiens
gaauaugagccuaggguuu

SEQ ID NO: 284157 - RNA, 19 nt, Homo sapiens
caaaugacuuagcuauuag

SEQ ID NO: 284158 - RNA, 19 nt, Homo sapiens
gaaaggucaucucuguuag

SEQ ID NO: 284159 - RNA, 19 nt, Homo sapiens
gaaagaagagauggagaaa

SEQ ID NO: 284160 - RNA, 19 nt, Homo sapiens
gcagagaggaagaugauga

SEQ ID NO: 284161 - RNA, 19 nt, Homo sapiens
guaacagcguugauccuuu

SEQ ID NO: 284162 - RNA, 19 nt, Homo sapiens
ucacugcacuccuuuguca

SEQ ID NO: 284163 - RNA, 19 nt, Homo sapiens
caacaauuucugaagcuua

SEQ ID NO: 284164 - RNA, 19 nt, Homo sapiens
ggagauaggaagagcauug

SEQ ID NO: 284165 - RNA, 19 nt, Homo sapiens
cuucaaggcuccaccguuu

SEQ ID NO: 284166 - RNA, 19 nt, Homo sapiens
ccucaaagagauagaguua

SEQ ID NO: 284167 - RNA, 19 nt, Homo sapiens
gaagagcauugggaaacuu

SEQ ID NO: 284168 - RNA, 19 nt, Homo sapiens
gaucaagagugaggcuaaa

SEQ ID NO: 284169 - RNA, 19 nt, Homo sapiens
aaacaagucccauguccua

SEQ ID NO: 284170 - RNA, 19 nt, Homo sapiens
caagaagagcaauuaauga

SEQ ID NO: 284171 - RNA, 19 nt, Homo sapiens
agaggaagaugaugaggaa

SEQ ID NO: 284172 - RNA, 19 nt, Homo sapiens
ggaggcaggugacaaacau

SEQ ID NO: 284173 - RNA, 19 nt, Homo sapiens
gaaaagcugugucguguuc

SEQ ID NO: 284174 - RNA, 19 nt, Homo sapiens
uaaguuggguuuauggaau

SEQ ID NO: 284175 - RNA, 19 nt, Homo sapiens
agagaaaccuucacuuugg

SEQ ID NO: 284176 - RNA, 19 nt, Homo sapiens
acacuagauucgaauauga

SEQ ID NO: 284177 - RNA, 19 nt, Homo sapiens
gagcaaguccucagaagau

SEQ ID NO: 284178 - RNA, 19 nt, Homo sapiens
gaggaaauguaucuucaag

SEQ ID NO: 284179 - RNA, 19 nt, Homo sapiens
gcugcuuacugaucauaua

SEQ ID NO: 284180 - RNA, 19 nt, Homo sapiens
cuagguaagucuuucuaaa

SEQ ID NO: 284181 - RNA, 19 nt, Homo sapiens
ccagacaugugcagaugaa

SEQ ID NO: 284182 - RNA, 19 nt, Homo sapiens
gaaacaaaauccucagaga

SEQ ID NO: 284183 - RNA, 19 nt, Homo sapiens
gaagagauggagaaagaga

SEQ ID NO: 284184 - RNA, 19 nt, Homo sapiens
gagcaauuaaugaagcuua

SEQ ID NO: 284185 - RNA, 19 nt, Homo sapiens
ucaagaagagcaauuaaug

SEQ ID NO: 284186 - RNA, 19 nt, Homo sapiens
ggaagaugaugaggaacuu

SEQ ID NO: 284187 - RNA, 19 nt, Homo sapiens
gcaaagucaccucaucuga

SEQ ID NO: 284188 - RNA, 19 nt, Homo sapiens
ggaacuacccaacuauguu

SEQ ID NO: 284189 - RNA, 19 nt, Homo sapiens
gagauuauuugggacuuga

SEQ ID NO: 284190 - RNA, 19 nt, Homo sapiens
cagagaagccugucauuca

SEQ ID NO: 284191 - RNA, 19 nt, Homo sapiens
gcugaugacuccgcauuga

SEQ ID NO: 284192 - RNA, 19 nt, Homo sapiens
ggcagaggcuggagcaguu

SEQ ID NO: 284193 - RNA, 19 nt, Homo sapiens
ucacauaaacuuccuguuc

SEQ ID NO: 284194 - RNA, 19 nt, Homo sapiens
aggguaagccacuuuauua

SEQ ID NO: 284195 - RNA, 19 nt, Homo sapiens
gaagcauggcguagaaauu

SEQ ID NO: 284196 - RNA, 19 nt, Homo sapiens
gaauguccauacaggaguu

SEQ ID NO: 284197 - RNA, 19 nt, Homo sapiens
ggacauccucggaaaguau

SEQ ID NO: 284198 - RNA, 19 nt, Homo sapiens
gcaaaugacuuagcuauua

SEQ ID NO: 284199 - RNA, 19 nt, Homo sapiens
caacucagcuucacauauu

SEQ ID NO: 284200 - RNA, 19 nt, Homo sapiens
gaacaggaaugaaaggaaa

SEQ ID NO: 284201 - RNA, 19 nt, Homo sapiens
gaugugagcugcuuacuga

SEQ ID NO: 284202 - RNA, 19 nt, Homo sapiens
ggaccuggcuggcaaauga

SEQ ID NO: 284203 - RNA, 19 nt, Homo sapiens
ggaaaggucaucucuguua

SEQ ID NO: 284204 - RNA, 19 nt, Homo sapiens
gaucauauaugcauacguu

SEQ ID NO: 284205 - RNA, 19 nt, Homo sapiens
caacaucacuuccuucaug

SEQ ID NO: 284206 - RNA, 19 nt, Homo sapiens
gggcugugcuuaagaauuu

SEQ ID NO: 284207 - RNA, 19 nt, Homo sapiens
cagaagauaucaucaaguu

SEQ ID NO: 284208 - RNA, 19 nt, Homo sapiens
gaaagcaaauguuuagaag

SEQ ID NO: 284209 - RNA, 19 nt, Homo sapiens
auaaagaacugaacccuaa

SEQ ID NO: 284210 - RNA, 19 nt, Homo sapiens
gaacguccagaucuuauua

SEQ ID NO: 284211 - RNA, 19 nt, Homo sapiens
guacagacuuguccaauca

SEQ ID NO: 284212 - RNA, 19 nt, Homo sapiens
cauaggaccugacaugaaa

SEQ ID NO: 284213 - RNA, 19 nt, Homo sapiens
gaccaaagguggacagaga

SEQ ID NO: 284214 - RNA, 19 nt, Homo sapiens
gcagugauaccaacuuaua

SEQ ID NO: 284215 - RNA, 19 nt, Homo sapiens
ggacuacucucgugugugu

SEQ ID NO: 284216 - RNA, 19 nt, Homo sapiens
guaagccacuuuauuauca

SEQ ID NO: 284217 - RNA, 19 nt, Homo sapiens
gaagcucucugaguucuuu

SEQ ID NO: 284218 - RNA, 19 nt, Homo sapiens
uaagggaacuacccaacua

SEQ ID NO: 284219 - RNA, 19 nt, Homo sapiens
ccacaugccugcaaugaga

SEQ ID NO: 284220 - RNA, 19 nt, Homo sapiens
aagaagagauggagaaaga

SEQ ID NO: 284221 - RNA, 19 nt, Homo sapiens
uaaaucagcucccacuaau

SEQ ID NO: 284222 - RNA, 19 nt, Homo sapiens
gaucaaggaaucaacauuu

SEQ ID NO: 284223 - RNA, 19 nt, Homo sapiens
caagaagcauggcguagaa

SEQ ID NO: 284224 - RNA, 19 nt, Homo sapiens
caacagagggcgaaacaaa

SEQ ID NO: 284225 - RNA, 19 nt, Homo sapiens
gaaucaacauuuaccgaaa

SEQ ID NO: 284226 - RNA, 19 nt, Homo sapiens
guccagaucuuauuaccua

SEQ ID NO: 284227 - RNA, 19 nt, Homo sapiens
gcaaccagauguucacaga

SEQ ID NO: 284228 - RNA, 19 nt, Homo sapiens
gagauagaguuaaugaguu

SEQ ID NO: 284229 - RNA, 19 nt, Homo sapiens
ggaagaugguggaaggaaa

SEQ ID NO: 284230 - RNA, 19 nt, Homo sapiens
gggcagcucuguuugaaug

SEQ ID NO: 284231 - RNA, 19 nt, Homo sapiens
gagaggaaauguaucuuca

SEQ ID NO: 284232 - RNA, 19 nt, Homo sapiens
caaaguagacuccuucgaa

SEQ ID NO: 284233 - RNA, 19 nt, Homo sapiens
gcaaugauguacuuuaagg

SEQ ID NO: 284234 - RNA, 19 nt, Homo sapiens
gcaccaaauauuaggauua

SEQ ID NO: 284235 - RNA, 19 nt, Homo sapiens
ggaaggggauuguauauau

SEQ ID NO: 284236 - RNA, 19 nt, Homo sapiens
agaaaugcauugccagaaa

SEQ ID NO: 284237 - RNA, 19 nt, Homo sapiens
gcauccaacuugagaagaa

SEQ ID NO: 284238 - RNA, 19 nt, Homo sapiens
ucucugaguucuuugauuu

SEQ ID NO: 284239 - RNA, 19 nt, Homo sapiens
gaaaugcauugccagaaag

SEQ ID NO: 284240 - RNA, 19 nt, Homo sapiens
gcccagcucugucgaauuc

SEQ ID NO: 284241 - RNA, 19 nt, Homo sapiens
ccacagaccuggcaaugag

SEQ ID NO: 284242 - RNA, 19 nt, Homo sapiens
caaggcaauuuaugacauu

SEQ ID NO: 284243 - RNA, 19 nt, Homo sapiens
ugaauaaaguugugugcuu

SEQ ID NO: 284244 - RNA, 19 nt, Homo sapiens
cauugaagcucucugaguu

SEQ ID NO: 284245 - RNA, 19 nt, Homo sapiens
gauaccaacuuauagcaau

SEQ ID NO: 284246 - RNA, 19 nt, Homo sapiens
gcagaugaaaugucaauau

SEQ ID NO: 284247 - RNA, 19 nt, Homo sapiens
gaaagccacccaucuacaa

SEQ ID NO: 284248 - RNA, 19 nt, Homo sapiens
ggaaacaugggcauaauca

SEQ ID NO: 284249 - RNA, 19 nt, Homo sapiens
gaacaaaagcucugaaguu

SEQ ID NO: 284250 - RNA, 19 nt, Homo sapiens
gaauaugagccuaggguuu

SEQ ID NO: 284251 - RNA, 19 nt, Homo sapiens
caaaugacuuagcuauuag

SEQ ID NO: 284252 - RNA, 19 nt, Homo sapiens
gaaaggucaucucuguuag

SEQ ID NO: 284253 - RNA, 19 nt, Homo sapiens
gaaagaagagauggagaaa

SEQ ID NO: 284254 - RNA, 19 nt, Homo sapiens
gcagagaggaagaugauga

SEQ ID NO: 284255 - RNA, 19 nt, Homo sapiens
ucacugcacuccuuuguca

SEQ ID NO: 284256 - RNA, 19 nt, Homo sapiens
caacaauuucugaagcuua

SEQ ID NO: 284257 - RNA, 19 nt, Homo sapiens
ggagauaggaagagcauug

SEQ ID NO: 284258 - RNA, 19 nt, Homo sapiens
cuucaaggcuccaccguuu

SEQ ID NO: 284259 - RNA, 19 nt, Homo sapiens
ccucaaagagauagaguua

SEQ ID NO: 284260 - RNA, 19 nt, Homo sapiens
gaagagcauugggaaacuu

SEQ ID NO: 284261 - RNA, 19 nt, Homo sapiens
gaucaagagugaggcuaaa

SEQ ID NO: 284262 - RNA, 19 nt, Homo sapiens
aaacaagucccauguccua

SEQ ID NO: 284263 - RNA, 19 nt, Homo sapiens
caagaagagcaauuaauga

SEQ ID NO: 284264 - RNA, 19 nt, Homo sapiens
agaggaagaugaugaggaa

SEQ ID NO: 284265 - RNA, 19 nt, Homo sapiens
ggaggcaggugacaaacau

SEQ ID NO: 284266 - RNA, 19 nt, Homo sapiens
gaaaagcugugucguguuc

SEQ ID NO: 284267 - RNA, 19 nt, Homo sapiens
uaaguuggguuuauggaau

SEQ ID NO: 284268 - RNA, 19 nt, Homo sapiens
agagaaaccuucacuuugg

SEQ ID NO: 284269 - RNA, 19 nt, Homo sapiens
acacuagauucgaauauga

SEQ ID NO: 284270 - RNA, 19 nt, Homo sapiens
gagcaaguccucagaagau

SEQ ID NO: 284271 - RNA, 19 nt, Homo sapiens
gaggaaauguaucuucaag

SEQ ID NO: 284272 - RNA, 19 nt, Homo sapiens
gcugcuuacugaucauaua

SEQ ID NO: 284273 - RNA, 19 nt, Homo sapiens
cuagguaagucuuucuaaa

SEQ ID NO: 284274 - RNA, 19 nt, Homo sapiens
ccagacaugugcagaugaa

SEQ ID NO: 284275 - RNA, 19 nt, Homo sapiens
gaaacaaaauccucagaga

SEQ ID NO: 284276 - RNA, 19 nt, Homo sapiens
gaagagauggagaaagaga

SEQ ID NO: 284277 - RNA, 19 nt, Homo sapiens
gagcaauuaaugaagcuua

SEQ ID NO: 284278 - RNA, 19 nt, Homo sapiens
ucaagaagagcaauuaaug

SEQ ID NO: 284279 - RNA, 19 nt, Homo sapiens
ggaagaugaugaggaacuu

SEQ ID NO: 284280 - RNA, 19 nt, Homo sapiens
ggaacuacccaacuauguu

SEQ ID NO: 284281 - RNA, 19 nt, Homo sapiens
gagauuauuugggacuuga

SEQ ID NO: 284282 - RNA, 19 nt, Homo sapiens
gcugaugacuccgcauuga

SEQ ID NO: 284283 - RNA, 19 nt, Homo sapiens
ggcagaggcuggagcaguu

SEQ ID NO: 284284 - RNA, 19 nt, Homo sapiens
ucacauaaacuuccuguuc

SEQ ID NO: 284285 - RNA, 19 nt, Homo sapiens
aggguaagccacuuuauua

SEQ ID NO: 284286 - RNA, 19 nt, Homo sapiens
gaagcauggcguagaaauu

SEQ ID NO: 284287 - RNA, 19 nt, Homo sapiens
gaauguccauacaggaguu

SEQ ID NO: 284288 - RNA, 19 nt, Homo sapiens
ggacauccucggaaaguau

SEQ ID NO: 284289 - RNA, 19 nt, Homo sapiens
ggacuaccagggacucuuu

SEQ ID NO: 284290 - RNA, 19 nt, Homo sapiens
ccacaaaacugauguucuu

SEQ ID NO: 284291 - RNA, 19 nt, Homo sapiens
guaauugaguggugguugu

SEQ ID NO: 284292 - RNA, 19 nt, Homo sapiens
caacuuauagcaaugaugu

SEQ ID NO: 284293 - RNA, 19 nt, Homo sapiens
ccaauucugucaucuccaa

SEQ ID NO: 284294 - RNA, 19 nt, Homo sapiens
uggagaggauggugcauuu

SEQ ID NO: 284295 - RNA, 19 nt, Homo sapiens
aaccuucccuuaacucuuu

SEQ ID NO: 284296 - RNA, 19 nt, Homo sapiens
cccauaggaugucauauug

SEQ ID NO: 284297 - RNA, 19 nt, Homo sapiens
ggaaauaugaaagcaaaug

SEQ ID NO: 284298 - RNA, 19 nt, Homo sapiens
gcaaaugacuuagcuauua

SEQ ID NO: 284299 - RNA, 19 nt, Homo sapiens
caacucagcuucacauauu

SEQ ID NO: 284300 - RNA, 19 nt, Homo sapiens
gaacaggaaugaaaggaaa

SEQ ID NO: 284301 - RNA, 19 nt, Homo sapiens
gaugugagcugcuuacuga

SEQ ID NO: 284302 - RNA, 19 nt, Homo sapiens
ggaccuggcuggcaaauga

SEQ ID NO: 284303 - RNA, 19 nt, Homo sapiens
ggaaaggucaucucuguua

SEQ ID NO: 284304 - RNA, 19 nt, Homo sapiens
gaucauauaugcauacguu

SEQ ID NO: 284305 - RNA, 19 nt, Homo sapiens
caacaucacuuccuucaug

SEQ ID NO: 284306 - RNA, 19 nt, Homo sapiens
gggcugugcuuaagaauuu

SEQ ID NO: 284307 - RNA, 19 nt, Homo sapiens
cagaagauaucaucaaguu

SEQ ID NO: 284308 - RNA, 19 nt, Homo sapiens
gaaagcaaauguuuagaag

SEQ ID NO: 284309 - RNA, 19 nt, Homo sapiens
auaaagaacugaacccuaa

SEQ ID NO: 284310 - RNA, 19 nt, Homo sapiens
gaacguccagaucuuauua

SEQ ID NO: 284311 - RNA, 19 nt, Homo sapiens
guacagacuuguccaauca

SEQ ID NO: 284312 - RNA, 19 nt, Homo sapiens
cauaggaccugacaugaaa

SEQ ID NO: 284313 - RNA, 19 nt, Homo sapiens
gaccaaagguggacagaga

SEQ ID NO: 284314 - RNA, 19 nt, Homo sapiens
gcagugauaccaacuuaua

SEQ ID NO: 284315 - RNA, 19 nt, Homo sapiens
ggacuacucucgugugugu

SEQ ID NO: 284316 - RNA, 19 nt, Homo sapiens
guaagccacuuuauuauca

SEQ ID NO: 284317 - RNA, 19 nt, Homo sapiens
gaagcucucugaguucuuu

SEQ ID NO: 284318 - RNA, 19 nt, Homo sapiens
uaagggaacuacccaacua

SEQ ID NO: 284319 - RNA, 19 nt, Homo sapiens
ccacaugccugcaaugaga

SEQ ID NO: 284320 - RNA, 19 nt, Homo sapiens
aagaagagauggagaaaga

SEQ ID NO: 284321 - RNA, 19 nt, Homo sapiens
uaaaucagcucccacuaau

SEQ ID NO: 284322 - RNA, 19 nt, Homo sapiens
gaucaaggaaucaacauuu

SEQ ID NO: 284323 - RNA, 19 nt, Homo sapiens
caagaagcauggcguagaa

SEQ ID NO: 284324 - RNA, 19 nt, Homo sapiens
caacagagggcgaaacaaa

SEQ ID NO: 284325 - RNA, 19 nt, Homo sapiens
gaaucaacauuuaccgaaa

SEQ ID NO: 284326 - RNA, 19 nt, Homo sapiens
guccagaucuuauuaccua

SEQ ID NO: 284327 - RNA, 19 nt, Homo sapiens
gcaaccagauguucacaga

SEQ ID NO: 284328 - RNA, 19 nt, Homo sapiens
gagauagaguuaaugaguu

SEQ ID NO: 284329 - RNA, 19 nt, Homo sapiens
ggaagaugguggaaggaaa

SEQ ID NO: 284330 - RNA, 19 nt, Homo sapiens
gggcagcucuguuugaaug

SEQ ID NO: 284331 - RNA, 19 nt, Homo sapiens
gagaggaaauguaucuuca

SEQ ID NO: 284332 - RNA, 19 nt, Homo sapiens
caaaguagacuccuucgaa

SEQ ID NO: 284333 - RNA, 19 nt, Homo sapiens
gcaaugauguacuuuaagg

SEQ ID NO: 284334 - RNA, 19 nt, Homo sapiens
gcaccaaauauuaggauua

SEQ ID NO: 284335 - RNA, 19 nt, Homo sapiens
ggaaggggauuguauauau

SEQ ID NO: 284336 - RNA, 19 nt, Homo sapiens
agaaaugcauugccagaaa

SEQ ID NO: 284337 - RNA, 19 nt, Homo sapiens
gcauccaacuugagaagaa

SEQ ID NO: 284338 - RNA, 19 nt, Homo sapiens
ucucugaguucuuugauuu

SEQ ID NO: 284339 - RNA, 19 nt, Homo sapiens
gaaaugcauugccagaaag

SEQ ID NO: 284340 - RNA, 19 nt, Homo sapiens
ggaacagaauuagaagaaa

SEQ ID NO: 284341 - RNA, 19 nt, Homo sapiens
gcccagcucugucgaauuc

SEQ ID NO: 284342 - RNA, 19 nt, Homo sapiens
ccaaggaacagaauuagaa

SEQ ID NO: 284343 - RNA, 19 nt, Homo sapiens
ccacagaccuggcaaugag

SEQ ID NO: 284344 - RNA, 19 nt, Homo sapiens
caaggcaauuuaugacauu

SEQ ID NO: 284345 - RNA, 19 nt, Homo sapiens
ugaauaaaguugugugcuu

SEQ ID NO: 284346 - RNA, 19 nt, Homo sapiens
cauugaagcucucugaguu

SEQ ID NO: 284347 - RNA, 19 nt, Homo sapiens
gauaccaacuuauagcaau

SEQ ID NO: 284348 - RNA, 19 nt, Homo sapiens
gcagaugaaaugucaauau

SEQ ID NO: 284349 - RNA, 19 nt, Homo sapiens
gaaagccacccaucuacaa

SEQ ID NO: 284350 - RNA, 19 nt, Homo sapiens
ggaaacaugggcauaauca

SEQ ID NO: 284351 - RNA, 19 nt, Homo sapiens
gaacaaaagcucugaaguu

SEQ ID NO: 284352 - RNA, 19 nt, Homo sapiens
gaauaugagccuaggguuu

SEQ ID NO: 284353 - RNA, 19 nt, Homo sapiens
caaaugacuuagcuauuag

SEQ ID NO: 284354 - RNA, 19 nt, Homo sapiens
gaaaggucaucucuguuag

SEQ ID NO: 284355 - RNA, 19 nt, Homo sapiens
gaaagaagagauggagaaa

SEQ ID NO: 284356 - RNA, 19 nt, Homo sapiens
gcagagaggaagaugauga

SEQ ID NO: 284357 - RNA, 19 nt, Homo sapiens
ucacugcacuccuuuguca

SEQ ID NO: 284358 - RNA, 19 nt, Homo sapiens
caacaauuucugaagcuua

SEQ ID NO: 284359 - RNA, 19 nt, Homo sapiens
ggagauaggaagagcauug

SEQ ID NO: 284360 - RNA, 19 nt, Homo sapiens
cuucaaggcuccaccguuu

SEQ ID NO: 284361 - RNA, 19 nt, Homo sapiens
ccucaaagagauagaguua

SEQ ID NO: 284362 - RNA, 19 nt, Homo sapiens
gaagagcauugggaaacuu

SEQ ID NO: 284363 - RNA, 19 nt, Homo sapiens
gaucaagagugaggcuaaa

SEQ ID NO: 284364 - RNA, 19 nt, Homo sapiens
aaacaagucccauguccua

SEQ ID NO: 284365 - RNA, 19 nt, Homo sapiens
caagaagagcaauuaauga

SEQ ID NO: 284366 - RNA, 19 nt, Homo sapiens
agaggaagaugaugaggaa

SEQ ID NO: 284367 - RNA, 19 nt, Homo sapiens
gaaaagcugugucguguuc

SEQ ID NO: 284368 - RNA, 19 nt, Homo sapiens
uaaguuggguuuauggaau

SEQ ID NO: 284369 - RNA, 19 nt, Homo sapiens
agagaaaccuucacuuugg

SEQ ID NO: 284370 - RNA, 19 nt, Homo sapiens
acacuagauucgaauauga

SEQ ID NO: 284371 - RNA, 19 nt, Homo sapiens
gagcaaguccucagaagau

SEQ ID NO: 284372 - RNA, 19 nt, Homo sapiens
gaggaaauguaucuucaag

SEQ ID NO: 284373 - RNA, 19 nt, Homo sapiens
gcugcuuacugaucauaua

SEQ ID NO: 284374 - RNA, 19 nt, Homo sapiens
cuagguaagucuuucuaaa

SEQ ID NO: 284375 - RNA, 19 nt, Homo sapiens
ccagacaugugcagaugaa

SEQ ID NO: 284376 - RNA, 19 nt, Homo sapiens
gaaacaaaauccucagaga

SEQ ID NO: 284377 - RNA, 19 nt, Homo sapiens
gaagagauggagaaagaga

SEQ ID NO: 284378 - RNA, 19 nt, Homo sapiens
gagcaauuaaugaagcuua

SEQ ID NO: 284379 - RNA, 19 nt, Homo sapiens
ucaagaagagcaauuaaug

SEQ ID NO: 284380 - RNA, 19 nt, Homo sapiens
ggaagaugaugaggaacuu

SEQ ID NO: 284381 - RNA, 19 nt, Homo sapiens
ggaacuacccaacuauguu

SEQ ID NO: 284382 - RNA, 19 nt, Homo sapiens
gagauuauuugggacuuga

SEQ ID NO: 284383 - RNA, 19 nt, Homo sapiens
gcugaugacuccgcauuga

SEQ ID NO: 284384 - RNA, 19 nt, Homo sapiens
ggcagaggcuggagcaguu

SEQ ID NO: 284385 - RNA, 19 nt, Homo sapiens
ucacauaaacuuccuguuc

SEQ ID NO: 284386 - RNA, 19 nt, Homo sapiens
aggguaagccacuuuauua

SEQ ID NO: 284387 - RNA, 19 nt, Homo sapiens
gaagcauggcguagaaauu

SEQ ID NO: 284388 - RNA, 19 nt, Homo sapiens
gaauguccauacaggaguu

SEQ ID NO: 284389 - RNA, 19 nt, Homo sapiens
ggacauccucggaaaguau

SEQ ID NO: 284390 - RNA, 19 nt, Homo sapiens
ccacaaaacugauguucuu

SEQ ID NO: 284391 - RNA, 19 nt, Homo sapiens
guaauugaguggugguugu

SEQ ID NO: 284392 - RNA, 19 nt, Homo sapiens
caacuuauagcaaugaugu

SEQ ID NO: 284393 - RNA, 19 nt, Homo sapiens
ccaauucugucaucuccaa

SEQ ID NO: 284394 - RNA, 19 nt, Homo sapiens
uggagaggauggugcauuu

SEQ ID NO: 284395 - RNA, 19 nt, Homo sapiens
aaccuucccuuaacucuuu

SEQ ID NO: 284396 - RNA, 19 nt, Homo sapiens
cccauaggaugucauauug

SEQ ID NO: 284397 - RNA, 19 nt, Homo sapiens
ggaaauaugaaagcaaaug

SEQ ID NO: 284398 - RNA, 19 nt, Homo sapiens
gagcaucuaggaaguauua

SEQ ID NO: 284399 - RNA, 19 nt, Homo sapiens
gagcaugacccucacgaua

SEQ ID NO: 284400 - RNA, 19 nt, Homo sapiens
gcccagaugugaagaauuc

SEQ ID NO: 284401 - RNA, 19 nt, Homo sapiens
gagaagaggccauccuuug

SEQ ID NO: 284402 - RNA, 19 nt, Homo sapiens
gaccggaucuuggaaauca

SEQ ID NO: 284403 - RNA, 19 nt, Homo sapiens
gaacgcagacccugacuac

SEQ ID NO: 284404 - RNA, 19 nt, Homo sapiens
gagauugaccugcugauuc

SEQ ID NO: 284405 - RNA, 19 nt, Homo sapiens
gaagaggccauccuuugug

SEQ ID NO: 284406 - RNA, 19 nt, Homo sapiens
gcaugacccucacgauaca

SEQ ID NO: 284407 - RNA, 19 nt, Homo sapiens
gguugacgcuacuuuguug

SEQ ID NO: 284408 - RNA, 19 nt, Homo sapiens
gacaagaggcucaacuuca

SEQ ID NO: 284409 - RNA, 19 nt, Homo sapiens
ggacaagaggcucaacuuc

SEQ ID NO: 284410 - RNA, 19 nt, Homo sapiens
ccaccugucugguccauag

SEQ ID NO: 284411 - RNA, 19 nt, Homo sapiens
acaagaggcucaacuucau

SEQ ID NO: 284412 - RNA, 19 nt, Homo sapiens
gaucuaugauggccaguac

SEQ ID NO: 284413 - RNA, 19 nt, Homo sapiens
agauugaccugcugauuca

SEQ ID NO: 284414 - RNA, 19 nt, Homo sapiens
ccaagggacugguuauggu

SEQ ID NO: 284415 - RNA, 19 nt, Homo sapiens
gagaccggaucuuggaaau

SEQ ID NO: 284416 - RNA, 19 nt, Homo sapiens
ggagggccugugugaguua

SEQ ID NO: 284417 - RNA, 19 nt, Homo sapiens
ucaacuucaucacugagua

SEQ ID NO: 284418 - RNA, 19 nt, Homo sapiens
ucaaggaggugaaggucau

SEQ ID NO: 284419 - RNA, 19 nt, Homo sapiens
gcacgcccauccgaaaugu

SEQ ID NO: 284420 - RNA, 19 nt, Homo sapiens
gaaccgugacguccaagga

SEQ ID NO: 284421 - RNA, 19 nt, Homo sapiens
guggauguguucuccuuug

SEQ ID NO: 284422 - RNA, 19 nt, Homo sapiens
gagcccagaugugaagaau

SEQ ID NO: 284423 - RNA, 19 nt, Homo sapiens
aagaggccauccuuuguga

SEQ ID NO: 284424 - RNA, 19 nt, Homo sapiens
ccauggagccagagaguga

SEQ ID NO: 284425 - RNA, 19 nt, Homo sapiens
ugagacaggugaggugaug

SEQ ID NO: 284426 - RNA, 19 nt, Homo sapiens
cccagacgcagaacaauaa

SEQ ID NO: 284427 - RNA, 19 nt, Homo sapiens
gauggcaccugagaugauc

SEQ ID NO: 284428 - RNA, 19 nt, Homo sapiens
gaccucaacucccacaacu

SEQ ID NO: 284429 - RNA, 19 nt, Homo sapiens
ggagaccggaucuuggaaa

SEQ ID NO: 284430 - RNA, 19 nt, Homo sapiens
gcaucuaggaaguauuaaa

SEQ ID NO: 284431 - RNA, 19 nt, Homo sapiens
ggccagaggaucuaugaug

SEQ ID NO: 284432 - RNA, 19 nt, Homo sapiens
gugaggugauggugaugaa

SEQ ID NO: 284433 - RNA, 19 nt, Homo sapiens
caggugaggugauggugau

SEQ ID NO: 284434 - RNA, 19 nt, Homo sapiens
ccaacgugcucaaguucau

SEQ ID NO: 284435 - RNA, 19 nt, Homo sapiens
gaagccagaccgcaagaag

SEQ ID NO: 284436 - RNA, 19 nt, Homo sapiens
caggaaccgugacguccaa

SEQ ID NO: 284437 - RNA, 19 nt, Homo sapiens
ggccgcagcuaugaugaga

SEQ ID NO: 284438 - RNA, 19 nt, Homo sapiens
uggcaagcguggacuuuca

SEQ ID NO: 284439 - RNA, 19 nt, Homo sapiens
gagguugacgcuacuuugu

SEQ ID NO: 284440 - RNA, 19 nt, Homo sapiens
cgagaagaggccauccuuu

SEQ ID NO: 284441 - RNA, 19 nt, Homo sapiens
ccgcagcuaugaugagaag

SEQ ID NO: 284442 - RNA, 19 nt, Homo sapiens
gagcauggacagccaguac

SEQ ID NO: 284443 - RNA, 19 nt, Homo sapiens
gagugagcuuugccaagga

SEQ ID NO: 284444 - RNA, 19 nt, Homo sapiens
gcaccaguacuaugagaag

SEQ ID NO: 284445 - RNA, 19 nt, Homo sapiens
aaacccagacgcagaacaa

SEQ ID NO: 284446 - RNA, 19 nt, Homo sapiens
ggauggcaccugagaugau

SEQ ID NO: 284447 - RNA, 19 nt, Homo sapiens
gggcagaggccaaguucca

SEQ ID NO: 284448 - RNA, 19 nt, Homo sapiens
agaagaggccauccuuugu

SEQ ID NO: 284449 - RNA, 19 nt, Homo sapiens
gcacugcuacuaccagacu

SEQ ID NO: 284450 - RNA, 19 nt, Homo sapiens
augagaagguggauguguu

SEQ ID NO: 284451 - RNA, 19 nt, Homo sapiens
ugucgcaccaguacuauga

SEQ ID NO: 284452 - RNA, 19 nt, Homo sapiens
cccgugggaccaugacuua

SEQ ID NO: 284453 - RNA, 19 nt, Homo sapiens
cuucaucacugaguacauc

SEQ ID NO: 284454 - RNA, 19 nt, Homo sapiens
ggucaugcgaugccuggaa

SEQ ID NO: 284455 - RNA, 19 nt, Homo sapiens
ccaguacuaugagaaggau

SEQ ID NO: 284456 - RNA, 19 nt, Homo sapiens
gaugagaagguggaugugu

SEQ ID NO: 284457 - RNA, 19 nt, Homo sapiens
cccaguggcugagcaaaca

SEQ ID NO: 284458 - RNA, 19 nt, Homo sapiens
gagcagcuggacagagguu

SEQ ID NO: 284459 - RNA, 19 nt, Homo sapiens
cgagauugaccugcugauu

SEQ ID NO: 284460 - RNA, 19 nt, Homo sapiens
gcaugagcccagaugugaa

SEQ ID NO: 284461 - RNA, 19 nt, Homo sapiens
aaacugugaagcuuucuca

SEQ ID NO: 284462 - RNA, 19 nt, Homo sapiens
gccaggggcuugggauuuu

SEQ ID NO: 284463 - RNA, 19 nt, Homo sapiens
uaccaagccucagggugaa

SEQ ID NO: 284464 - RNA, 19 nt, Homo sapiens
gcagcuaugaugagaaggu

SEQ ID NO: 284465 - RNA, 19 nt, Homo sapiens
gcggccagaggaucuauga

SEQ ID NO: 284466 - RNA, 19 nt, Homo sapiens
ggcagaaaccugucuugag

SEQ ID NO: 284467 - RNA, 19 nt, Homo sapiens
ccugagcucuccggcuuau

SEQ ID NO: 284468 - RNA, 19 nt, Homo sapiens
guaucgaggacucuccaaa

SEQ ID NO: 284469 - RNA, 19 nt, Homo sapiens
gcccugcuguaaccucugu

SEQ ID NO: 284470 - RNA, 19 nt, Homo sapiens
gcaugagguugacgcuacu

SEQ ID NO: 284471 - RNA, 19 nt, Homo sapiens
ggcucaacuucaucacuga

SEQ ID NO: 284472 - RNA, 19 nt, Homo sapiens
ucacgugugggaccuuuau

SEQ ID NO: 284473 - RNA, 19 nt, Homo sapiens
ugcaugagcccagauguga

SEQ ID NO: 284474 - RNA, 19 nt, Homo sapiens
ccucacgugugggaccuuu

SEQ ID NO: 284475 - RNA, 19 nt, Homo sapiens
ugacguccaaggaaccaaa

SEQ ID NO: 284476 - RNA, 19 nt, Homo sapiens
ggaucuaugauggccagua

SEQ ID NO: 284477 - RNA, 19 nt, Homo sapiens
gggcuugggauuuuauuuu

SEQ ID NO: 284478 - RNA, 19 nt, Homo sapiens
uggagggccugugugaguu

SEQ ID NO: 284479 - RNA, 19 nt, Homo sapiens
gaggccauccuuugugaag

SEQ ID NO: 284480 - RNA, 19 nt, Homo sapiens
ugagaagguggauguguuc

SEQ ID NO: 284481 - RNA, 19 nt, Homo sapiens
uaccuccacuccaugaaca

SEQ ID NO: 284482 - RNA, 19 nt, Homo sapiens
cgucggagaccggaucuug

SEQ ID NO: 284483 - RNA, 19 nt, Homo sapiens
acccagacgcagaacaaua

SEQ ID NO: 284484 - RNA, 19 nt, Homo sapiens
ggaaguauuaaaacuguga

SEQ ID NO: 284485 - RNA, 19 nt, Homo sapiens
ccaaguuccaggugucugu

SEQ ID NO: 284486 - RNA, 19 nt, Homo sapiens
cggcagaaaccugucuuga

SEQ ID NO: 284487 - RNA, 19 nt, Homo sapiens
gcacuuugaaccuggaaaa

SEQ ID NO: 284488 - RNA, 19 nt, Homo sapiens
guugagcaucuaggaagua

SEQ ID NO: 284489 - RNA, 19 nt, Homo sapiens
ucgcaccaguacuaugaga

SEQ ID NO: 284490 - RNA, 19 nt, Homo sapiens
gcagcuggacagagguuuc

SEQ ID NO: 284491 - RNA, 19 nt, Homo sapiens
ggccauccuuugugaagcu

SEQ ID NO: 284492 - RNA, 19 nt, Homo sapiens
agaggaaggaagcgaguug

SEQ ID NO: 284493 - RNA, 19 nt, Homo sapiens
gagcaucuaggaaguauua

SEQ ID NO: 284494 - RNA, 19 nt, Homo sapiens
gagcaugacccucacgaua

SEQ ID NO: 284495 - RNA, 19 nt, Homo sapiens
gcccagaugugaagaauuc

SEQ ID NO: 284496 - RNA, 19 nt, Homo sapiens
gagaagaggccauccuuug

SEQ ID NO: 284497 - RNA, 19 nt, Homo sapiens
gaccggaucuuggaaauca

SEQ ID NO: 284498 - RNA, 19 nt, Homo sapiens
gaacgcagacccugacuac

SEQ ID NO: 284499 - RNA, 19 nt, Homo sapiens
gagauugaccugcugauuc

SEQ ID NO: 284500 - RNA, 19 nt, Homo sapiens
gaagaggccauccuuugug

SEQ ID NO: 284501 - RNA, 19 nt, Homo sapiens
gcaugacccucacgauaca

SEQ ID NO: 284502 - RNA, 19 nt, Homo sapiens
gguugacgcuacuuuguug

SEQ ID NO: 284503 - RNA, 19 nt, Homo sapiens
gacaagaggcucaacuuca

SEQ ID NO: 284504 - RNA, 19 nt, Homo sapiens
ggacaagaggcucaacuuc

SEQ ID NO: 284505 - RNA, 19 nt, Homo sapiens
ccaccugucugguccauag

SEQ ID NO: 284506 - RNA, 19 nt, Homo sapiens
acaagaggcucaacuucau

SEQ ID NO: 284507 - RNA, 19 nt, Homo sapiens
gaucuaugauggccaguac

SEQ ID NO: 284508 - RNA, 19 nt, Homo sapiens
agauugaccugcugauuca

SEQ ID NO: 284509 - RNA, 19 nt, Homo sapiens
ccaagggacugguuauggu

SEQ ID NO: 284510 - RNA, 19 nt, Homo sapiens
gagaccggaucuuggaaau

SEQ ID NO: 284511 - RNA, 19 nt, Homo sapiens
ggagggccugugugaguua

SEQ ID NO: 284512 - RNA, 19 nt, Homo sapiens
ucaacuucaucacugagua

SEQ ID NO: 284513 - RNA, 19 nt, Homo sapiens
ucaaggaggugaaggucau

SEQ ID NO: 284514 - RNA, 19 nt, Homo sapiens
gcacgcccauccgaaaugu

SEQ ID NO: 284515 - RNA, 19 nt, Homo sapiens
gaaccgugacguccaagga

SEQ ID NO: 284516 - RNA, 19 nt, Homo sapiens
guggauguguucuccuuug

SEQ ID NO: 284517 - RNA, 19 nt, Homo sapiens
gagcccagaugugaagaau

SEQ ID NO: 284518 - RNA, 19 nt, Homo sapiens
aagaggccauccuuuguga

SEQ ID NO: 284519 - RNA, 19 nt, Homo sapiens
ccauggagccagagaguga

SEQ ID NO: 284520 - RNA, 19 nt, Homo sapiens
ugagacaggugaggugaug

SEQ ID NO: 284521 - RNA, 19 nt, Homo sapiens
cccagacgcagaacaauaa

SEQ ID NO: 284522 - RNA, 19 nt, Homo sapiens
gauggcaccugagaugauc

SEQ ID NO: 284523 - RNA, 19 nt, Homo sapiens
gaccucaacucccacaacu

SEQ ID NO: 284524 - RNA, 19 nt, Homo sapiens
ggagaccggaucuuggaaa

SEQ ID NO: 284525 - RNA, 19 nt, Homo sapiens
gcaucuaggaaguauuaaa

SEQ ID NO: 284526 - RNA, 19 nt, Homo sapiens
ggccagaggaucuaugaug

SEQ ID NO: 284527 - RNA, 19 nt, Homo sapiens
gugaggugauggugaugaa

SEQ ID NO: 284528 - RNA, 19 nt, Homo sapiens
aaaccugucuucgcaagga

SEQ ID NO: 284529 - RNA, 19 nt, Homo sapiens
caggugaggugauggugau

SEQ ID NO: 284530 - RNA, 19 nt, Homo sapiens
ccaacgugcucaaguucau

SEQ ID NO: 284531 - RNA, 19 nt, Homo sapiens
gaagccagaccgcaagaag

SEQ ID NO: 284532 - RNA, 19 nt, Homo sapiens
caggaaccgugacguccaa

SEQ ID NO: 284533 - RNA, 19 nt, Homo sapiens
ggccgcagcuaugaugaga

SEQ ID NO: 284534 - RNA, 19 nt, Homo sapiens
uggcaagcguggacuuuca

SEQ ID NO: 284535 - RNA, 19 nt, Homo sapiens
gagguugacgcuacuuugu

SEQ ID NO: 284536 - RNA, 19 nt, Homo sapiens
cgagaagaggccauccuuu

SEQ ID NO: 284537 - RNA, 19 nt, Homo sapiens
ccgcagcuaugaugagaag

SEQ ID NO: 284538 - RNA, 19 nt, Homo sapiens
gagcauggacagccaguac

SEQ ID NO: 284539 - RNA, 19 nt, Homo sapiens
gagugagcuuugccaagga

SEQ ID NO: 284540 - RNA, 19 nt, Homo sapiens
gcaccaguacuaugagaag

SEQ ID NO: 284541 - RNA, 19 nt, Homo sapiens
aaacccagacgcagaacaa

SEQ ID NO: 284542 - RNA, 19 nt, Homo sapiens
ggauggcaccugagaugau

SEQ ID NO: 284543 - RNA, 19 nt, Homo sapiens
gggcagaggccaaguucca

SEQ ID NO: 284544 - RNA, 19 nt, Homo sapiens
agaagaggccauccuuugu

SEQ ID NO: 284545 - RNA, 19 nt, Homo sapiens
gcacugcuacuaccagacu

SEQ ID NO: 284546 - RNA, 19 nt, Homo sapiens
augagaagguggauguguu

SEQ ID NO: 284547 - RNA, 19 nt, Homo sapiens
cccgugggaccaugacuua

SEQ ID NO: 284548 - RNA, 19 nt, Homo sapiens
ugucgcaccaguacuauga

SEQ ID NO: 284549 - RNA, 19 nt, Homo sapiens
cuucaucacugaguacauc

SEQ ID NO: 284550 - RNA, 19 nt, Homo sapiens
ggucaugcgaugccuggaa

SEQ ID NO: 284551 - RNA, 19 nt, Homo sapiens
ccaguacuaugagaaggau

SEQ ID NO: 284552 - RNA, 19 nt, Homo sapiens
gaugagaagguggaugugu

SEQ ID NO: 284553 - RNA, 19 nt, Homo sapiens
cccaguggcugagcaaaca

SEQ ID NO: 284554 - RNA, 19 nt, Homo sapiens
gagcagcuggacagagguu

SEQ ID NO: 284555 - RNA, 19 nt, Homo sapiens
cgagauugaccugcugauu

SEQ ID NO: 284556 - RNA, 19 nt, Homo sapiens
gcaugagcccagaugugaa

SEQ ID NO: 284557 - RNA, 19 nt, Homo sapiens
aaacugugaagcuuucuca

SEQ ID NO: 284558 - RNA, 19 nt, Homo sapiens
gccaggggcuugggauuuu

SEQ ID NO: 284559 - RNA, 19 nt, Homo sapiens
uaccaagccucagggugaa

SEQ ID NO: 284560 - RNA, 19 nt, Homo sapiens
gcagcuaugaugagaaggu

SEQ ID NO: 284561 - RNA, 19 nt, Homo sapiens
gcggccagaggaucuauga

SEQ ID NO: 284562 - RNA, 19 nt, Homo sapiens
ccugagcucuccggcuuau

SEQ ID NO: 284563 - RNA, 19 nt, Homo sapiens
guaucgaggacucuccaaa

SEQ ID NO: 284564 - RNA, 19 nt, Homo sapiens
gcccugcuguaaccucugu

SEQ ID NO: 284565 - RNA, 19 nt, Homo sapiens
gcaugagguugacgcuacu

SEQ ID NO: 284566 - RNA, 19 nt, Homo sapiens
ggcucaacuucaucacuga

SEQ ID NO: 284567 - RNA, 19 nt, Homo sapiens
ucacgugugggaccuuuau

SEQ ID NO: 284568 - RNA, 19 nt, Homo sapiens
ugcaugagcccagauguga

SEQ ID NO: 284569 - RNA, 19 nt, Homo sapiens
ccucacgugugggaccuuu

SEQ ID NO: 284570 - RNA, 19 nt, Homo sapiens
ugacguccaaggaaccaaa

SEQ ID NO: 284571 - RNA, 19 nt, Homo sapiens
ggaucuaugauggccagua

SEQ ID NO: 284572 - RNA, 19 nt, Homo sapiens
gggcuugggauuuuauuuu

SEQ ID NO: 284573 - RNA, 19 nt, Homo sapiens
uggagggccugugugaguu

SEQ ID NO: 284574 - RNA, 19 nt, Homo sapiens
gaggccauccuuugugaag

SEQ ID NO: 284575 - RNA, 19 nt, Homo sapiens
ugagaagguggauguguuc

SEQ ID NO: 284576 - RNA, 19 nt, Homo sapiens
uaccuccacuccaugaaca

SEQ ID NO: 284577 - RNA, 19 nt, Homo sapiens
cgucggagaccggaucuug

SEQ ID NO: 284578 - RNA, 19 nt, Homo sapiens
acccagacgcagaacaaua

SEQ ID NO: 284579 - RNA, 19 nt, Homo sapiens
ggaaguauuaaaacuguga

SEQ ID NO: 284580 - RNA, 19 nt, Homo sapiens
ccaaguuccaggugucugu

SEQ ID NO: 284581 - RNA, 19 nt, Homo sapiens
gcacuuugaaccuggaaaa

SEQ ID NO: 284582 - RNA, 19 nt, Homo sapiens
guugagcaucuaggaagua

SEQ ID NO: 284583 - RNA, 19 nt, Homo sapiens
gcagcuggacagagguuuc

SEQ ID NO: 284584 - RNA, 19 nt, Homo sapiens
ggccauccuuugugaagcu

SEQ ID NO: 284585 - RNA, 19 nt, Homo sapiens
agaggaaggaagcgaguug

SEQ ID NO: 284586 - RNA, 19 nt, Homo sapiens
ucgcaccaguacuaugaga

SEQ ID NO: 284587 - RNA, 19 nt, Homo sapiens
gaacaagccauuccuauua

SEQ ID NO: 284588 - RNA, 19 nt, Homo sapiens
ggaaagagcuaugaugaga

SEQ ID NO: 284589 - RNA, 19 nt, Homo sapiens
gagacuggcugagaacuua

SEQ ID NO: 284590 - RNA, 19 nt, Homo sapiens
gcaaagugauggucaugaa

SEQ ID NO: 284591 - RNA, 19 nt, Homo sapiens
ggucagaguuuacuugcua

SEQ ID NO: 284592 - RNA, 19 nt, Homo sapiens
ggagagugguugcuguuaa

SEQ ID NO: 284593 - RNA, 19 nt, Homo sapiens
gcacaucagucccaacaau

SEQ ID NO: 284594 - RNA, 19 nt, Homo sapiens
ggugguaugugaaauauug

SEQ ID NO: 284595 - RNA, 19 nt, Homo sapiens
caacauccuuucugucuga

SEQ ID NO: 284596 - RNA, 19 nt, Homo sapiens
cuagaaagcucagaucuug

SEQ ID NO: 284597 - RNA, 19 nt, Homo sapiens
ugaaagcugugaagaagaa

SEQ ID NO: 284598 - RNA, 19 nt, Homo sapiens
gcugagaacuuacggacaa

SEQ ID NO: 284599 - RNA, 19 nt, Homo sapiens
gaagagucccuuaauaugu

SEQ ID NO: 284600 - RNA, 19 nt, Homo sapiens
gaacaggccaggaguuaga

SEQ ID NO: 284601 - RNA, 19 nt, Homo sapiens
guggauaucuucuccuuug

SEQ ID NO: 284602 - RNA, 19 nt, Homo sapiens
gaccagcauucucgaaauu

SEQ ID NO: 284603 - RNA, 19 nt, Homo sapiens
acauagaccugaugaguug

SEQ ID NO: 284604 - RNA, 19 nt, Homo sapiens
ccauugaucagacuaaaua

SEQ ID NO: 284605 - RNA, 19 nt, Homo sapiens
ucacaggccuagagucuga

SEQ ID NO: 284606 - RNA, 19 nt, Homo sapiens
gagcaagguugagggagua

SEQ ID NO: 284607 - RNA, 19 nt, Homo sapiens
gaucugaacucgcacaacu

SEQ ID NO: 284608 - RNA, 19 nt, Homo sapiens
gagcuugcaccauauuuaa

SEQ ID NO: 284609 - RNA, 19 nt, Homo sapiens
gcugcaaggugaucauuga

SEQ ID NO: 284610 - RNA, 19 nt, Homo sapiens
aaauguaucuccacagguu

SEQ ID NO: 284611 - RNA, 19 nt, Homo sapiens
gagagugguugcuguuaau

SEQ ID NO: 284612 - RNA, 19 nt, Homo sapiens
cugcagagcuggaggaguu

SEQ ID NO: 284613 - RNA, 19 nt, Homo sapiens
caacuagauuugccucuuc

SEQ ID NO: 284614 - RNA, 19 nt, Homo sapiens
gcagcacaguucagcauug

SEQ ID NO: 284615 - RNA, 19 nt, Homo sapiens
agacuguacuuauguguga

SEQ ID NO: 284616 - RNA, 19 nt, Homo sapiens
gaguuuacuugcuauauag

SEQ ID NO: 284617 - RNA, 19 nt, Homo sapiens
gaacucuucaucacaacua

SEQ ID NO: 284618 - RNA, 19 nt, Homo sapiens
gaggagacguucccuaagg

SEQ ID NO: 284619 - RNA, 19 nt, Homo sapiens
ugacugaggugaaagugau

SEQ ID NO: 284620 - RNA, 19 nt, Homo sapiens
aagcugagaugcugagaga

SEQ ID NO: 284621 - RNA, 19 nt, Homo sapiens
uuugaagagucccuuaaua

SEQ ID NO: 284622 - RNA, 19 nt, Homo sapiens
gaaguuuguucccacagau

SEQ ID NO: 284623 - RNA, 19 nt, Homo sapiens
ucuauugggugguauguga

SEQ ID NO: 284624 - RNA, 19 nt, Homo sapiens
gaaccugccugugaacucu

SEQ ID NO: 284625 - RNA, 19 nt, Homo sapiens
cagaaucccuucguuguuc

SEQ ID NO: 284626 - RNA, 19 nt, Homo sapiens
ccagagugcuuugccugua

SEQ ID NO: 284627 - RNA, 19 nt, Homo sapiens
uaggaacucuucaucacaa

SEQ ID NO: 284628 - RNA, 19 nt, Homo sapiens
ccaaugugcucaaguucau

SEQ ID NO: 284629 - RNA, 19 nt, Homo sapiens
gcagaacaagccauuccua

SEQ ID NO: 284630 - RNA, 19 nt, Homo sapiens
cuaaggcgcaguaacagua

SEQ ID NO: 284631 - RNA, 19 nt, Homo sapiens
cacuucagcuguugauuga

SEQ ID NO: 284632 - RNA, 19 nt, Homo sapiens
ggagguggaggaugcaauu

SEQ ID NO: 284633 - RNA, 19 nt, Homo sapiens
guacauagaccugaugagu

SEQ ID NO: 284634 - RNA, 19 nt, Homo sapiens
gcuacacgguggugggaaa

SEQ ID NO: 284635 - RNA, 19 nt, Homo sapiens
gaaggccaccaccaagaaa

SEQ ID NO: 284636 - RNA, 19 nt, Homo sapiens
gagaaggccaccaccaaga

SEQ ID NO: 284637 - RNA, 19 nt, Homo sapiens
gcacaacugccucaucaag

SEQ ID NO: 284638 - RNA, 19 nt, Homo sapiens
gagagugccugcuccaacu

SEQ ID NO: 284639 - RNA, 19 nt, Homo sapiens
ugaagagucccuuaauaug

SEQ ID NO: 284640 - RNA, 19 nt, Homo sapiens
ucgcacaacugccucauca

SEQ ID NO: 284641 - RNA, 19 nt, Homo sapiens
ggaaucgccuccggaaugg

SEQ ID NO: 284642 - RNA, 19 nt, Homo sapiens
ggugugcuguacaaggaua

SEQ ID NO: 284643 - RNA, 19 nt, Homo sapiens
guaacaguaucuccaaguc

SEQ ID NO: 284644 - RNA, 19 nt, Homo sapiens
gggugaaccugccugugaa

SEQ ID NO: 284645 - RNA, 19 nt, Homo sapiens
ccugaaagcugugaagaag

SEQ ID NO: 284646 - RNA, 19 nt, Homo sapiens
uggauuggcggaauguuua

SEQ ID NO: 284647 - RNA, 19 nt, Homo sapiens
gaacggaaagagcuaugau

SEQ ID NO: 284648 - RNA, 19 nt, Homo sapiens
ccuccggaauggccuauuu

SEQ ID NO: 284649 - RNA, 19 nt, Homo sapiens
gccagacacuucagcuguu

SEQ ID NO: 284650 - RNA, 19 nt, Homo sapiens
gaacugggccauugaucag

SEQ ID NO: 284651 - RNA, 19 nt, Homo sapiens
cuuaauaugugguggaaca

SEQ ID NO: 284652 - RNA, 19 nt, Homo sapiens
aagagucccuuaauaugug

SEQ ID NO: 284653 - RNA, 19 nt, Homo sapiens
gcaagaacgaccgcaagaa

SEQ ID NO: 284654 - RNA, 19 nt, Homo sapiens
gcaguaacaguaucuccaa

SEQ ID NO: 284655 - RNA, 19 nt, Homo sapiens
gcugagaugcugagagaga

SEQ ID NO: 284656 - RNA, 19 nt, Homo sapiens
ucagaugccuaaaacauuu

SEQ ID NO: 284657 - RNA, 19 nt, Homo sapiens
gaauggguuugggguauua

SEQ ID NO: 284658 - RNA, 19 nt, Homo sapiens
ucagcaaucucuuggucuu

SEQ ID NO: 284659 - RNA, 19 nt, Homo sapiens
caagaacgaccgcaagaag

SEQ ID NO: 284660 - RNA, 19 nt, Homo sapiens
caaagugauggucaugaaa

SEQ ID NO: 284661 - RNA, 19 nt, Homo sapiens
ugagcuugcaccauauuua

SEQ ID NO: 284662 - RNA, 19 nt, Homo sapiens
cgggugggcuccuuaguca

SEQ ID NO: 284663 - RNA, 19 nt, Homo sapiens
aaacaaacagucacaagca

SEQ ID NO: 284664 - RNA, 19 nt, Homo sapiens
ggucaugaaagaguuaauu

SEQ ID NO: 284665 - RNA, 19 nt, Homo sapiens
cagcugcccuacucuguca

SEQ ID NO: 284666 - RNA, 19 nt, Homo sapiens
cagagugcuuugccuguau

SEQ ID NO: 284667 - RNA, 19 nt, Homo sapiens
agugguugcuguuaauauu

SEQ ID NO: 284668 - RNA, 19 nt, Homo sapiens
gagcugggccaucugacuu

SEQ ID NO: 284669 - RNA, 19 nt, Homo sapiens
ucaaguguguggacgaaag

SEQ ID NO: 284670 - RNA, 19 nt, Homo sapiens
agaacaagccauuccuauu

SEQ ID NO: 284671 - RNA, 19 nt, Homo sapiens
agauuugccucuucuaagu

SEQ ID NO: 284672 - RNA, 19 nt, Homo sapiens
ugugggaggcucuugcuua

SEQ ID NO: 284673 - RNA, 19 nt, Homo sapiens
gaaagaguuaauucgaugu

SEQ ID NO: 284674 - RNA, 19 nt, Homo sapiens
caacugguacuaugagaag

SEQ ID NO: 284675 - RNA, 19 nt, Homo sapiens
ggccauugaucagacuaaa

SEQ ID NO: 284676 - RNA, 19 nt, Homo sapiens
gugguugcuguuaauauua

SEQ ID NO: 284677 - RNA, 19 nt, Homo sapiens
ucccagagcucuaggaacu

SEQ ID NO: 284678 - RNA, 19 nt, Homo sapiens
uugaagagucccuuaauau

SEQ ID NO: 284679 - RNA, 19 nt, Homo sapiens
gggccuaguuacugucugu

SEQ ID NO: 284680 - RNA, 19 nt, Homo sapiens
ggcggaauguuuagaagca

SEQ ID NO: 284681 - RNA, 19 nt, Homo sapiens
gauggucaugaaagaguua

SEQ ID NO: 284682 - RNA, 19 nt, Homo sapiens
ccagacacuucagcuguug

SEQ ID NO: 284683 - RNA, 19 nt, Homo sapiens
cagcacaguucagcauugu

SEQ ID NO: 284684 - RNA, 19 nt, Homo sapiens
uggaacaggccaggaguua

SEQ ID NO: 284685 - RNA, 19 nt, Homo sapiens
ccugugaacucugaaguca

SEQ ID NO: 284686 - RNA, 19 nt, Homo sapiens
gcucuugcuuacacuaauc

SEQ ID NO: 284687 - RNA, 19 nt, Homo sapiens
gaacaagccauuccuauua

SEQ ID NO: 284688 - RNA, 19 nt, Homo sapiens
ggaaagagcuaugaugaga

SEQ ID NO: 284689 - RNA, 19 nt, Homo sapiens
gagacuggcugagaacuua

SEQ ID NO: 284690 - RNA, 19 nt, Homo sapiens
gcaaagugauggucaugaa

SEQ ID NO: 284691 - RNA, 19 nt, Homo sapiens
ggucagaguuuacuugcua

SEQ ID NO: 284692 - RNA, 19 nt, Homo sapiens
ggagagugguugcuguuaa

SEQ ID NO: 284693 - RNA, 19 nt, Homo sapiens
gcacaucagucccaacaau

SEQ ID NO: 284694 - RNA, 19 nt, Homo sapiens
ggugguaugugaaauauug

SEQ ID NO: 284695 - RNA, 19 nt, Homo sapiens
caacauccuuucugucuga

SEQ ID NO: 284696 - RNA, 19 nt, Homo sapiens
cuagaaagcucagaucuug

SEQ ID NO: 284697 - RNA, 19 nt, Homo sapiens
ugaaagcugugaagaagaa

SEQ ID NO: 284698 - RNA, 19 nt, Homo sapiens
ggaagaagauggggaguua

SEQ ID NO: 284699 - RNA, 19 nt, Homo sapiens
gcugagaacuuacggacaa

SEQ ID NO: 284700 - RNA, 19 nt, Homo sapiens
gaagagucccuuaauaugu

SEQ ID NO: 284701 - RNA, 19 nt, Homo sapiens
gaacaggccaggaguuaga

SEQ ID NO: 284702 - RNA, 19 nt, Homo sapiens
guggauaucuucuccuuug

SEQ ID NO: 284703 - RNA, 19 nt, Homo sapiens
gaccagcauucucgaaauu

SEQ ID NO: 284704 - RNA, 19 nt, Homo sapiens
acauagaccugaugaguug

SEQ ID NO: 284705 - RNA, 19 nt, Homo sapiens
ccauugaucagacuaaaua

SEQ ID NO: 284706 - RNA, 19 nt, Homo sapiens
ucacaggccuagagucuga

SEQ ID NO: 284707 - RNA, 19 nt, Homo sapiens
gagcaagguugagggagua

SEQ ID NO: 284708 - RNA, 19 nt, Homo sapiens
gaucugaacucgcacaacu

SEQ ID NO: 284709 - RNA, 19 nt, Homo sapiens
gagcuugcaccauauuuaa

SEQ ID NO: 284710 - RNA, 19 nt, Homo sapiens
gcugcaaggugaucauuga

SEQ ID NO: 284711 - RNA, 19 nt, Homo sapiens
aaauguaucuccacagguu

SEQ ID NO: 284712 - RNA, 19 nt, Homo sapiens
gagagugguugcuguuaau

SEQ ID NO: 284713 - RNA, 19 nt, Homo sapiens
cugcagagcuggaggaguu

SEQ ID NO: 284714 - RNA, 19 nt, Homo sapiens
caacuagauuugccucuuc

SEQ ID NO: 284715 - RNA, 19 nt, Homo sapiens
gcagcacaguucagcauug

SEQ ID NO: 284716 - RNA, 19 nt, Homo sapiens
agacuguacuuauguguga

SEQ ID NO: 284717 - RNA, 19 nt, Homo sapiens
gaguuuacuugcuauauag

SEQ ID NO: 284718 - RNA, 19 nt, Homo sapiens
gaacucuucaucacaacua

SEQ ID NO: 284719 - RNA, 19 nt, Homo sapiens
gaggagacguucccuaagg

SEQ ID NO: 284720 - RNA, 19 nt, Homo sapiens
ugacugaggugaaagugau

SEQ ID NO: 284721 - RNA, 19 nt, Homo sapiens
aagcugagaugcugagaga

SEQ ID NO: 284722 - RNA, 19 nt, Homo sapiens
uuugaagagucccuuaaua

SEQ ID NO: 284723 - RNA, 19 nt, Homo sapiens
gaaguuuguucccacagau

SEQ ID NO: 284724 - RNA, 19 nt, Homo sapiens
ucuauugggugguauguga

SEQ ID NO: 284725 - RNA, 19 nt, Homo sapiens
gaaccugccugugaacucu

SEQ ID NO: 284726 - RNA, 19 nt, Homo sapiens
cagaaucccuucguuguuc

SEQ ID NO: 284727 - RNA, 19 nt, Homo sapiens
ccagagugcuuugccugua

SEQ ID NO: 284728 - RNA, 19 nt, Homo sapiens
uaggaacucuucaucacaa

SEQ ID NO: 284729 - RNA, 19 nt, Homo sapiens
ccaaugugcucaaguucau

SEQ ID NO: 284730 - RNA, 19 nt, Homo sapiens
cagcugagccugucuaucu

SEQ ID NO: 284731 - RNA, 19 nt, Homo sapiens
gcagaacaagccauuccua

SEQ ID NO: 284732 - RNA, 19 nt, Homo sapiens
cuaaggcgcaguaacagua

SEQ ID NO: 284733 - RNA, 19 nt, Homo sapiens
cacuucagcuguugauuga

SEQ ID NO: 284734 - RNA, 19 nt, Homo sapiens
ggagguggaggaugcaauu

SEQ ID NO: 284735 - RNA, 19 nt, Homo sapiens
guacauagaccugaugagu

SEQ ID NO: 284736 - RNA, 19 nt, Homo sapiens
gcuacacgguggugggaaa

SEQ ID NO: 284737 - RNA, 19 nt, Homo sapiens
gaaggccaccaccaagaaa

SEQ ID NO: 284738 - RNA, 19 nt, Homo sapiens
gagaaggccaccaccaaga

SEQ ID NO: 284739 - RNA, 19 nt, Homo sapiens
gcacaacugccucaucaag

SEQ ID NO: 284740 - RNA, 19 nt, Homo sapiens
gagagugccugcuccaacu

SEQ ID NO: 284741 - RNA, 19 nt, Homo sapiens
ugaagagucccuuaauaug

SEQ ID NO: 284742 - RNA, 19 nt, Homo sapiens
ucgcacaacugccucauca

SEQ ID NO: 284743 - RNA, 19 nt, Homo sapiens
ggaaucgccuccggaaugg

SEQ ID NO: 284744 - RNA, 19 nt, Homo sapiens
ggugugcuguacaaggaua

SEQ ID NO: 284745 - RNA, 19 nt, Homo sapiens
guaacaguaucuccaaguc

SEQ ID NO: 284746 - RNA, 19 nt, Homo sapiens
gggugaaccugccugugaa

SEQ ID NO: 284747 - RNA, 19 nt, Homo sapiens
ccugaaagcugugaagaag

SEQ ID NO: 284748 - RNA, 19 nt, Homo sapiens
uggauuggcggaauguuua

SEQ ID NO: 284749 - RNA, 19 nt, Homo sapiens
gaacggaaagagcuaugau

SEQ ID NO: 284750 - RNA, 19 nt, Homo sapiens
ccuccggaauggccuauuu

SEQ ID NO: 284751 - RNA, 19 nt, Homo sapiens
gccagacacuucagcuguu

SEQ ID NO: 284752 - RNA, 19 nt, Homo sapiens
gaacugggccauugaucag

SEQ ID NO: 284753 - RNA, 19 nt, Homo sapiens
cuuaauaugugguggaaca

SEQ ID NO: 284754 - RNA, 19 nt, Homo sapiens
aagagucccuuaauaugug

SEQ ID NO: 284755 - RNA, 19 nt, Homo sapiens
gcaagaacgaccgcaagaa

SEQ ID NO: 284756 - RNA, 19 nt, Homo sapiens
gcaguaacaguaucuccaa

SEQ ID NO: 284757 - RNA, 19 nt, Homo sapiens
gcugagaugcugagagaga

SEQ ID NO: 284758 - RNA, 19 nt, Homo sapiens
ucagaugccuaaaacauuu

SEQ ID NO: 284759 - RNA, 19 nt, Homo sapiens
gaauggguuugggguauua

SEQ ID NO: 284760 - RNA, 19 nt, Homo sapiens
ucagcaaucucuuggucuu

SEQ ID NO: 284761 - RNA, 19 nt, Homo sapiens
gaaugccagugugugugua

SEQ ID NO: 284762 - RNA, 19 nt, Homo sapiens
caagaacgaccgcaagaag

SEQ ID NO: 284763 - RNA, 19 nt, Homo sapiens
caaagugauggucaugaaa

SEQ ID NO: 284764 - RNA, 19 nt, Homo sapiens
ugagcuugcaccauauuua

SEQ ID NO: 284765 - RNA, 19 nt, Homo sapiens
cgggugggcuccuuaguca

SEQ ID NO: 284766 - RNA, 19 nt, Homo sapiens
aaacaaacagucacaagca

SEQ ID NO: 284767 - RNA, 19 nt, Homo sapiens
caagaaugccagugugugu

SEQ ID NO: 284768 - RNA, 19 nt, Homo sapiens
ggucaugaaagaguuaauu

SEQ ID NO: 284769 - RNA, 19 nt, Homo sapiens
cagcugcccuacucuguca

SEQ ID NO: 284770 - RNA, 19 nt, Homo sapiens
cagagugcuuugccuguau

SEQ ID NO: 284771 - RNA, 19 nt, Homo sapiens
agugguugcuguuaauauu

SEQ ID NO: 284772 - RNA, 19 nt, Homo sapiens
gagcugggccaucugacuu

SEQ ID NO: 284773 - RNA, 19 nt, Homo sapiens
ucaaguguguggacgaaag

SEQ ID NO: 284774 - RNA, 19 nt, Homo sapiens
agaacaagccauuccuauu

SEQ ID NO: 284775 - RNA, 19 nt, Homo sapiens
agauuugccucuucuaagu

SEQ ID NO: 284776 - RNA, 19 nt, Homo sapiens
ugugggaggcucuugcuua

SEQ ID NO: 284777 - RNA, 19 nt, Homo sapiens
gaaagaguuaauucgaugu

SEQ ID NO: 284778 - RNA, 19 nt, Homo sapiens
caacugguacuaugagaag

SEQ ID NO: 284779 - RNA, 19 nt, Homo sapiens
ggccauugaucagacuaaa

SEQ ID NO: 284780 - RNA, 19 nt, Homo sapiens
gugguugcuguuaauauua

SEQ ID NO: 284781 - RNA, 19 nt, Homo sapiens
ucccagagcucuaggaacu

SEQ ID NO: 284782 - RNA, 19 nt, Homo sapiens
uugaagagucccuuaauau

SEQ ID NO: 284783 - RNA, 19 nt, Homo sapiens
gggccuaguuacugucugu

SEQ ID NO: 284784 - RNA, 19 nt, Homo sapiens
ggcggaauguuuagaagca

SEQ ID NO: 284785 - RNA, 19 nt, Homo sapiens
gauggucaugaaagaguua

SEQ ID NO: 284786 - RNA, 19 nt, Homo sapiens
ccagacacuucagcuguug

SEQ ID NO: 284787 - RNA, 19 nt, Homo sapiens
gaaacuagcugagaccuua

SEQ ID NO: 284788 - RNA, 19 nt, Homo sapiens
ggaaaggccuggcauauug

SEQ ID NO: 284789 - RNA, 19 nt, Homo sapiens
gauaagagauuaccaacau

SEQ ID NO: 284790 - RNA, 19 nt, Homo sapiens
gaagugcuaugagaaauuu

SEQ ID NO: 284791 - RNA, 19 nt, Homo sapiens
ggaccuauaugaaugguuu

SEQ ID NO: 284792 - RNA, 19 nt, Homo sapiens
gagaagaggaccuauauga

SEQ ID NO: 284793 - RNA, 19 nt, Homo sapiens
gagaagaucgugaacagua

SEQ ID NO: 284794 - RNA, 19 nt, Homo sapiens
ccacugcaaucguguuaua

SEQ ID NO: 284795 - RNA, 19 nt, Homo sapiens
gaaaugccaugcuaucauc

SEQ ID NO: 284796 - RNA, 19 nt, Homo sapiens
gauguggucucugcucuua

SEQ ID NO: 284797 - RNA, 19 nt, Homo sapiens
gaagaggaccuauaugaau

SEQ ID NO: 284798 - RNA, 19 nt, Homo sapiens
ccagaggccuugggaaaua

SEQ ID NO: 284799 - RNA, 19 nt, Homo sapiens
ggacaucgccauuaugaga

SEQ ID NO: 284800 - RNA, 19 nt, Homo sapiens
caacauuacuugucuugau

SEQ ID NO: 284801 - RNA, 19 nt, Homo sapiens
gaauaaguuuguggaguuu

SEQ ID NO: 284802 - RNA, 19 nt, Homo sapiens
gaaaguacugugaacauga

SEQ ID NO: 284803 - RNA, 19 nt, Homo sapiens
gagagaagaggaccuauau

SEQ ID NO: 284804 - RNA, 19 nt, Homo sapiens
gcagauaucggguuuguca

SEQ ID NO: 284805 - RNA, 19 nt, Homo sapiens
gaaguucuguacaguuuag

SEQ ID NO: 284806 - RNA, 19 nt, Homo sapiens
agaauaaguuuguggaguu

SEQ ID NO: 284807 - RNA, 19 nt, Homo sapiens
ggaagaaaguacugugaac

SEQ ID NO: 284808 - RNA, 19 nt, Homo sapiens
uguaagaagugcuaugaga

SEQ ID NO: 284809 - RNA, 19 nt, Homo sapiens
caaagcaguugagagaaga

SEQ ID NO: 284810 - RNA, 19 nt, Homo sapiens
uaagaagugcuaugagaaa

SEQ ID NO: 284811 - RNA, 19 nt, Homo sapiens
gagauuaccaacauuacuu

SEQ ID NO: 284812 - RNA, 19 nt, Homo sapiens
caaagauaauucgcaguga

SEQ ID NO: 284813 - RNA, 19 nt, Homo sapiens
agaagaucgugaacaguaa

SEQ ID NO: 284814 - RNA, 19 nt, Homo sapiens
aggaaguucuguacaguuu

SEQ ID NO: 284815 - RNA, 19 nt, Homo sapiens
aagaggaccuauaugaaug

SEQ ID NO: 284816 - RNA, 19 nt, Homo sapiens
aagcuaagaugaggaaguu

SEQ ID NO: 284817 - RNA, 19 nt, Homo sapiens
guaagaagugcuaugagaa

SEQ ID NO: 284818 - RNA, 19 nt, Homo sapiens
gauaucggguuugucaaga

SEQ ID NO: 284819 - RNA, 19 nt, Homo sapiens
gaucuacccauauuuaaag

SEQ ID NO: 284820 - RNA, 19 nt, Homo sapiens
caagauaagagauuaccaa

SEQ ID NO: 284821 - RNA, 19 nt, Homo sapiens
cuacccauauuuaaagcua

SEQ ID NO: 284822 - RNA, 19 nt, Homo sapiens
uaugagaaauuuccauugg

SEQ ID NO: 284823 - RNA, 19 nt, Homo sapiens
caacagagacaaagcuaag

SEQ ID NO: 284824 - RNA, 19 nt, Homo sapiens
guacugugaacaugacuuu

SEQ ID NO: 284825 - RNA, 19 nt, Homo sapiens
gaggaaaggccuggcauau

SEQ ID NO: 284826 - RNA, 19 nt, Homo sapiens
ggaaguucuguacaguuua

SEQ ID NO: 284827 - RNA, 19 nt, Homo sapiens
ucaaagccaugaauaacag

SEQ ID NO: 284828 - RNA, 19 nt, Homo sapiens
gaugagcagccucugauau

SEQ ID NO: 284829 - RNA, 19 nt, Homo sapiens
gaagaaaguacugugaaca

SEQ ID NO: 284830 - RNA, 19 nt, Homo sapiens
ugagagaagaggaccuaua

SEQ ID NO: 284831 - RNA, 19 nt, Homo sapiens
aaagcuauaucucaaagca

SEQ ID NO: 284832 - RNA, 19 nt, Homo sapiens
aaagauaauucgcagugau

SEQ ID NO: 284833 - RNA, 19 nt, Homo sapiens
gcuaugagaaauuuccauu

SEQ ID NO: 284834 - RNA, 19 nt, Homo sapiens
acaugaagccagucuguaa

SEQ ID NO: 284835 - RNA, 19 nt, Homo sapiens
cugcaacacuaaauuaaca

SEQ ID NO: 284836 - RNA, 19 nt, Homo sapiens
ugccagaaaugccaugcua

SEQ ID NO: 284837 - RNA, 19 nt, Homo sapiens
agaaaguacugugaacaug

SEQ ID NO: 284838 - RNA, 19 nt, Homo sapiens
ccagcuauuuggugauguu

SEQ ID NO: 284839 - RNA, 19 nt, Homo sapiens
guuaucaaagccaugaaua

SEQ ID NO: 284840 - RNA, 19 nt, Homo sapiens
cuugaucuacccauauuua

SEQ ID NO: 284841 - RNA, 19 nt, Homo sapiens
ggccuggcauauugugaaa

SEQ ID NO: 284842 - RNA, 19 nt, Homo sapiens
ggagcugacugccgaugca

SEQ ID NO: 284843 - RNA, 19 nt, Homo sapiens
agaagaggaccuauaugaa

SEQ ID NO: 284844 - RNA, 19 nt, Homo sapiens
uaccugcaacacuaaauua

SEQ ID NO: 284845 - RNA, 19 nt, Homo sapiens
gaaaggccuggcauauugu

SEQ ID NO: 284846 - RNA, 19 nt, Homo sapiens
gagcagccucugauauuca

SEQ ID NO: 284847 - RNA, 19 nt, Homo sapiens
gacaacagagacaaagcua

SEQ ID NO: 284848 - RNA, 19 nt, Homo sapiens
gaagaucgugaacaguaau

SEQ ID NO: 284849 - RNA, 19 nt, Homo sapiens
uuuaggaaauagaggcuuu

SEQ ID NO: 284850 - RNA, 19 nt, Homo sapiens
gucuugaucuacccauauu

SEQ ID NO: 284851 - RNA, 19 nt, Homo sapiens
auaaguuuguggaguuuga

SEQ ID NO: 284852 - RNA, 19 nt, Homo sapiens
cugcaaucguguuauagaa

SEQ ID NO: 284853 - RNA, 19 nt, Homo sapiens
gcuauuuggugauguuugc

SEQ ID NO: 284854 - RNA, 19 nt, Homo sapiens
gaggaaguucuguacaguu

SEQ ID NO: 284855 - RNA, 19 nt, Homo sapiens
uguggugaauucaucauug

SEQ ID NO: 284856 - RNA, 19 nt, Homo sapiens
uuaccaacauuacuugucu

SEQ ID NO: 284857 - RNA, 19 nt, Homo sapiens
cuguacaguuuaggaaaua

SEQ ID NO: 284858 - RNA, 19 nt, Homo sapiens
ugaagccagucuguaagaa

SEQ ID NO: 284859 - RNA, 19 nt, Homo sapiens
ugagcagccucugauauuc

SEQ ID NO: 284860 - RNA, 19 nt, Homo sapiens
ucaguguggugaauucauc

SEQ ID NO: 284861 - RNA, 19 nt, Homo sapiens
ucaagacaacagagacaaa

SEQ ID NO: 284862 - RNA, 19 nt, Homo sapiens
gagcugaagaaaagacuua

SEQ ID NO: 284863 - RNA, 19 nt, Homo sapiens
ccagaaaugccaugcuauc

SEQ ID NO: 284864 - RNA, 19 nt, Homo sapiens
gaagccagucuguaagaag

SEQ ID NO: 284865 - RNA, 19 nt, Homo sapiens
gacaugaagccagucugua

SEQ ID NO: 284866 - RNA, 19 nt, Homo sapiens
uguggucucugcucuuaau

SEQ ID NO: 284867 - RNA, 19 nt, Homo sapiens
ucacuauaaccagcuauuu

SEQ ID NO: 284868 - RNA, 19 nt, Homo sapiens
uaucggguuugucaagaau

SEQ ID NO: 284869 - RNA, 19 nt, Homo sapiens
uggcagauaucggguuugu

SEQ ID NO: 284870 - RNA, 19 nt, Homo sapiens
aagaagugcuaugagaaau

SEQ ID NO: 284871 - RNA, 19 nt, Homo sapiens
acaaagcuaagaugaggaa

SEQ ID NO: 284872 - RNA, 19 nt, Homo sapiens
cacuauaaccagcuauuug

SEQ ID NO: 284873 - RNA, 19 nt, Homo sapiens
agagacaaagcuaagauga

SEQ ID NO: 284874 - RNA, 19 nt, Homo sapiens
aguggcauguggagcauuu

SEQ ID NO: 284875 - RNA, 19 nt, Homo sapiens
ugaggaaguucuguacagu

SEQ ID NO: 284876 - RNA, 19 nt, Homo sapiens
ucaucaguguggugaauuc

SEQ ID NO: 284877 - RNA, 19 nt, Homo sapiens
cugagaagaucgugaacag

SEQ ID NO: 284878 - RNA, 19 nt, Homo sapiens
ucuguacaguuuaggaaau

SEQ ID NO: 284879 - RNA, 19 nt, Homo sapiens
gagacaaagcuaagaugag

SEQ ID NO: 284880 - RNA, 19 nt, Homo sapiens
ucuuggacaucgccauuau

SEQ ID NO: 284881 - RNA, 19 nt, Homo sapiens
cgaguuaucaaagccauga

SEQ ID NO: 284882 - RNA, 19 nt, Homo sapiens
guggugaauucaucauugg

SEQ ID NO: 284883 - RNA, 19 nt, Homo sapiens
guacaguuuaggaaauaga

SEQ ID NO: 284884 - RNA, 19 nt, Homo sapiens
cccaagcccugauaacaac

SEQ ID NO: 284885 - RNA, 19 nt, Homo sapiens
gcuaagaugaggaaguucu

SEQ ID NO: 284886 - RNA, 19 nt, Homo sapiens
cauuggagcugaagaaaag

SEQ ID NO: 284887 - RNA, 19 nt, Homo sapiens
gaagauggauauauucugu

SEQ ID NO: 284888 - RNA, 19 nt, Homo sapiens
gacagaagauggauauauu

SEQ ID NO: 284889 - RNA, 19 nt, Homo sapiens
caggacagcuccagaauga

SEQ ID NO: 284890 - RNA, 19 nt, Homo sapiens
gaagcagugccaagaauua

SEQ ID NO: 284891 - RNA, 19 nt, Homo sapiens
gaauaaaacuggccaagaa

SEQ ID NO: 284892 - RNA, 19 nt, Homo sapiens
gccaagaacaaguguauua

SEQ ID NO: 284893 - RNA, 19 nt, Homo sapiens
gcacucaugucauacugaa

SEQ ID NO: 284894 - RNA, 19 nt, Homo sapiens
ggacagcuccagaaugaaa

SEQ ID NO: 284895 - RNA, 19 nt, Homo sapiens
ggauauauucugugccuua

SEQ ID NO: 284896 - RNA, 19 nt, Homo sapiens
ugaaggagcucuguggaaa

SEQ ID NO: 284897 - RNA, 19 nt, Homo sapiens
uaaaugcuuugaagacuga

SEQ ID NO: 284898 - RNA, 19 nt, Homo sapiens
cauaagacacucucaguuu

SEQ ID NO: 284899 - RNA, 19 nt, Homo sapiens
gauauauucugugccuuaa

SEQ ID NO: 284900 - RNA, 19 nt, Homo sapiens
gaaugugagugaaauuauc

SEQ ID NO: 284901 - RNA, 19 nt, Homo sapiens
ucacaaaccuugccaacag

SEQ ID NO: 284902 - RNA, 19 nt, Homo sapiens
ugacaaaggucccaaacca

SEQ ID NO: 284903 - RNA, 19 nt, Homo sapiens
gaaccauucugacaaaggu

SEQ ID NO: 284904 - RNA, 19 nt, Homo sapiens
guaauaaggaugcuaacaa

SEQ ID NO: 284905 - RNA, 19 nt, Homo sapiens
ccaguucacucuaguuuca

SEQ ID NO: 284906 - RNA, 19 nt, Homo sapiens
ugacucagaucaccaacuu

SEQ ID NO: 284907 - RNA, 19 nt, Homo sapiens
gcagugccaagaauuauuu

SEQ ID NO: 284908 - RNA, 19 nt, Homo sapiens
uccauuaacuucauucuga

SEQ ID NO: 284909 - RNA, 19 nt, Homo sapiens
gggcgaauacuacuuugua

SEQ ID NO: 284910 - RNA, 19 nt, Homo sapiens
gcagggcgaauacuacuuu

SEQ ID NO: 284911 - RNA, 19 nt, Homo sapiens
aaacucagcucagggauuc

SEQ ID NO: 284912 - RNA, 19 nt, Homo sapiens
agaguuauccucccacaua

SEQ ID NO: 284913 - RNA, 19 nt, Homo sapiens
ggccauaguucuacuuauc

SEQ ID NO: 284914 - RNA, 19 nt, Homo sapiens
gcugugauuugacacguuu

SEQ ID NO: 284915 - RNA, 19 nt, Homo sapiens
guccauauuugucugcuuu

SEQ ID NO: 284916 - RNA, 19 nt, Homo sapiens
gcaaaucccuguggagacu

SEQ ID NO: 284917 - RNA, 19 nt, Homo sapiens
gggaagcagugccaagaau

SEQ ID NO: 284918 - RNA, 19 nt, Homo sapiens
guugggaaguccauauuug

SEQ ID NO: 284919 - RNA, 19 nt, Homo sapiens
ugagauuaauguacucuug

SEQ ID NO: 284920 - RNA, 19 nt, Homo sapiens
ggacaaaguaauauaugug

SEQ ID NO: 284921 - RNA, 19 nt, Homo sapiens
gaggaaauaucagugaaag

SEQ ID NO: 284922 - RNA, 19 nt, Homo sapiens
ggcgaauacuacuuuguaa

SEQ ID NO: 284923 - RNA, 19 nt, Homo sapiens
cuacuuaucugagaagcaa

SEQ ID NO: 284924 - RNA, 19 nt, Homo sapiens
ugacagcugugauuugaca

SEQ ID NO: 284925 - RNA, 19 nt, Homo sapiens
gcaggugcauagucaaauc

SEQ ID NO: 284926 - RNA, 19 nt, Homo sapiens
ugacuuaagcgagguauaa

SEQ ID NO: 284927 - RNA, 19 nt, Homo sapiens
ggcaacagcagaggaaaua

SEQ ID NO: 284928 - RNA, 19 nt, Homo sapiens
caaugcuuguuaaugguua

SEQ ID NO: 284929 - RNA, 19 nt, Homo sapiens
cagcaucauuuccuuacaa

SEQ ID NO: 284930 - RNA, 19 nt, Homo sapiens
ccauaguauugucucuuua

SEQ ID NO: 284931 - RNA, 19 nt, Homo sapiens
cguuugcacucaugucaua

SEQ ID NO: 284932 - RNA, 19 nt, Homo sapiens
ggccaaauuaggacgauua

SEQ ID NO: 284933 - RNA, 19 nt, Homo sapiens
ggaagcagugccaagaauu

SEQ ID NO: 284934 - RNA, 19 nt, Homo sapiens
ucaaccaucuauauucaug

SEQ ID NO: 284935 - RNA, 19 nt, Homo sapiens
ccuuggaggcuuuauaaua

SEQ ID NO: 284936 - RNA, 19 nt, Homo sapiens
gucauuauauccauucugu

SEQ ID NO: 284937 - RNA, 19 nt, Homo sapiens
gccagugucucaaccauag

SEQ ID NO: 284938 - RNA, 19 nt, Homo sapiens
ccaagucaaugauuauguc

SEQ ID NO: 284939 - RNA, 19 nt, Homo sapiens
gaccuaccagcuuccauua

SEQ ID NO: 284940 - RNA, 19 nt, Homo sapiens
ggauucauuuugugucuua

SEQ ID NO: 284941 - RNA, 19 nt, Homo sapiens
ugugacagcugugauuuga

SEQ ID NO: 284942 - RNA, 19 nt, Homo sapiens
aauuagggcuggaauagga

SEQ ID NO: 284943 - RNA, 19 nt, Homo sapiens
ugucuagaguggauguaua

SEQ ID NO: 284944 - RNA, 19 nt, Homo sapiens
gcucagguuaaaugaaaua

SEQ ID NO: 284945 - RNA, 19 nt, Homo sapiens
gggagcaucuugacuucau

SEQ ID NO: 284946 - RNA, 19 nt, Homo sapiens
cuacgacgucaauaucuua

SEQ ID NO: 284947 - RNA, 19 nt, Homo sapiens
caaauuaggacgauuacca

SEQ ID NO: 284948 - RNA, 19 nt, Homo sapiens
ccgcuacugucguuauuga

SEQ ID NO: 284949 - RNA, 19 nt, Homo sapiens
uugcucagguuaaaugaaa

SEQ ID NO: 284950 - RNA, 19 nt, Homo sapiens
ggaaauaucagugaaagcu

SEQ ID NO: 284951 - RNA, 19 nt, Homo sapiens
caagaacaaguguauuaug

SEQ ID NO: 284952 - RNA, 19 nt, Homo sapiens
ggagcccgcuacugucguu

SEQ ID NO: 284953 - RNA, 19 nt, Homo sapiens
ccaguaauaaggaugcuaa

SEQ ID NO: 284954 - RNA, 19 nt, Homo sapiens
uaagcgagguauaaaagua

SEQ ID NO: 284955 - RNA, 19 nt, Homo sapiens
gaacuucugugcaaaacau

SEQ ID NO: 284956 - RNA, 19 nt, Homo sapiens
gaagugugaacgugauguu

SEQ ID NO: 284957 - RNA, 19 nt, Homo sapiens
gaaacugacagcuguggau

SEQ ID NO: 284958 - RNA, 19 nt, Homo sapiens
gaagacugauacacucaac

SEQ ID NO: 284959 - RNA, 19 nt, Homo sapiens
gagcaucuugacuucauuu

SEQ ID NO: 284960 - RNA, 19 nt, Homo sapiens
cgacgucaauaucuuacug

SEQ ID NO: 284961 - RNA, 19 nt, Homo sapiens
auaagacacucucaguuuc

SEQ ID NO: 284962 - RNA, 19 nt, Homo sapiens
ggagcaucuugacuucauu

SEQ ID NO: 284963 - RNA, 19 nt, Homo sapiens
aaauaugucuagaguggau

SEQ ID NO: 284964 - RNA, 19 nt, Homo sapiens
acucaaccaucuauauuca

SEQ ID NO: 284965 - RNA, 19 nt, Homo sapiens
gucuaacggucuuguaguu

SEQ ID NO: 284966 - RNA, 19 nt, Homo sapiens
gugaaauuaucucuuacug

SEQ ID NO: 284967 - RNA, 19 nt, Homo sapiens
caucauuuccuuacaauac

SEQ ID NO: 284968 - RNA, 19 nt, Homo sapiens
gcucagggauucauuuugu

SEQ ID NO: 284969 - RNA, 19 nt, Homo sapiens
acacucaaccaucuauauu

SEQ ID NO: 284970 - RNA, 19 nt, Homo sapiens
ugagacagaagauggauau

SEQ ID NO: 284971 - RNA, 19 nt, Homo sapiens
gaaggagcucuguggaaau

SEQ ID NO: 284972 - RNA, 19 nt, Homo sapiens
caaggcaccacuauagguu

SEQ ID NO: 284973 - RNA, 19 nt, Homo sapiens
cuacugucguuauugauca

SEQ ID NO: 284974 - RNA, 19 nt, Homo sapiens
aguauugucucuuuaaguc

SEQ ID NO: 284975 - RNA, 19 nt, Homo sapiens
agugaaagcuggacuugag

SEQ ID NO: 284976 - RNA, 19 nt, Homo sapiens
gcaggacagcuccagaaug

SEQ ID NO: 284977 - RNA, 19 nt, Homo sapiens
uuucuucuguguggauuua

SEQ ID NO: 284978 - RNA, 19 nt, Homo sapiens
gauccugaaacaaacauga

SEQ ID NO: 284979 - RNA, 19 nt, Homo sapiens
ggagacuauaccacuauuu

SEQ ID NO: 284980 - RNA, 19 nt, Homo sapiens
uaauugcucagguuaaaug

SEQ ID NO: 284981 - RNA, 19 nt, Homo sapiens
accauaguauugucucuuu

SEQ ID NO: 284982 - RNA, 19 nt, Homo sapiens
agacagaagauggauauau

SEQ ID NO: 284983 - RNA, 19 nt, Homo sapiens
auucugggcuuucaguuau

SEQ ID NO: 284984 - RNA, 19 nt, Homo sapiens
gcagcaucauuuccuuaca

SEQ ID NO: 284985 - RNA, 19 nt, Homo sapiens
caaacucagcucagggauu

SEQ ID NO: 284986 - RNA, 19 nt, Homo sapiens
gcccaguucacucuaguuu

SEQ ID NO: 284987 - RNA, 19 nt, Homo sapiens
aaacacagaugaccuacua

SEQ ID NO: 284988 - RNA, 19 nt, Homo sapiens
ggagaaacccagcaaagaa

SEQ ID NO: 284989 - RNA, 19 nt, Homo sapiens
ggaggaaucuguucaacuc

SEQ ID NO: 284990 - RNA, 19 nt, Homo sapiens
cgaaagaucagaugagauu

SEQ ID NO: 284991 - RNA, 19 nt, Homo sapiens
gaucagaugagauuuaaug

SEQ ID NO: 284992 - RNA, 19 nt, Homo sapiens
cagaugagauuuaaugaag

SEQ ID NO: 284993 - RNA, 19 nt, Homo sapiens
caaaggaauugcuaguaau

SEQ ID NO: 284994 - RNA, 19 nt, Homo sapiens
cuucagaaauuaccaagaa

SEQ ID NO: 284995 - RNA, 19 nt, Homo sapiens
uaaugaagacccaguguaa

SEQ ID NO: 284996 - RNA, 19 nt, Homo sapiens
gcacacgugucaggauuug

SEQ ID NO: 284997 - RNA, 19 nt, Homo sapiens
gacccaguguaaagaauaa

SEQ ID NO: 284998 - RNA, 19 nt, Homo sapiens
cgugaaaugugaaauaaag

SEQ ID NO: 284999 - RNA, 19 nt, Homo sapiens
gaagccauguucaccuaau

SEQ ID NO: 285000 - RNA, 19 nt, Homo sapiens
gaagacccaguguaaagaa

SEQ ID NO: 285001 - RNA, 19 nt, Homo sapiens
gagaaacccagcaaagaau

SEQ ID NO: 285002 - RNA, 19 nt, Homo sapiens
ccagagccauuuggaagaa

SEQ ID NO: 285003 - RNA, 19 nt, Homo sapiens
gaaacccagcaaagaauga

SEQ ID NO: 285004 - RNA, 19 nt, Homo sapiens
gugcacacgugucaggauu

SEQ ID NO: 285005 - RNA, 19 nt, Homo sapiens
uuaaagauccaguucauca

SEQ ID NO: 285006 - RNA, 19 nt, Homo sapiens
aaacugagacgccaauaca

SEQ ID NO: 285007 - RNA, 19 nt, Homo sapiens
gaaaccagagccauuugga

SEQ ID NO: 285008 - RNA, 19 nt, Homo sapiens
gaugagauuuaaugaagac

SEQ ID NO: 285009 - RNA, 19 nt, Homo sapiens
ggaugccauucauaccuuu

SEQ ID NO: 285010 - RNA, 19 nt, Homo sapiens
gcaacacgcugggcuacca

SEQ ID NO: 285011 - RNA, 19 nt, Homo sapiens
ucgaagccauguucaccua

SEQ ID NO: 285012 - RNA, 19 nt, Homo sapiens
ccagauuccugcucuuugg

SEQ ID NO: 285013 - RNA, 19 nt, Homo sapiens
gaagacgaucagagucaaa

SEQ ID NO: 285014 - RNA, 19 nt, Homo sapiens
ucaaucauccggacacguu

SEQ ID NO: 285015 - RNA, 19 nt, Homo sapiens
ggaaucuguucaacucucu

SEQ ID NO: 285016 - RNA, 19 nt, Homo sapiens
gaccagauuccugcucuuu

SEQ ID NO: 285017 - RNA, 19 nt, Homo sapiens
gaaagaucagaugagauuu

SEQ ID NO: 285018 - RNA, 19 nt, Homo sapiens
acagaugaccuacuacuuc

SEQ ID NO: 285019 - RNA, 19 nt, Homo sapiens
gagcucuacagacauauug

SEQ ID NO: 285020 - RNA, 19 nt, Homo sapiens
caucaaacagcccauagga

SEQ ID NO: 285021 - RNA, 19 nt, Homo sapiens
cucuuuggcuucagaaauu

SEQ ID NO: 285022 - RNA, 19 nt, Homo sapiens
guggugacaugaacagcuu

SEQ ID NO: 285023 - RNA, 19 nt, Homo sapiens
ggagaaauggacacaaguc

SEQ ID NO: 285024 - RNA, 19 nt, Homo sapiens
gccaucacccagaccauaa

SEQ ID NO: 285025 - RNA, 19 nt, Homo sapiens
gagaaaaugcagaaaauuc

SEQ ID NO: 285026 - RNA, 19 nt, Homo sapiens
ugaagacgaucagagucaa

SEQ ID NO: 285027 - RNA, 19 nt, Homo sapiens
acaaaacgcugcaugagau

SEQ ID NO: 285028 - RNA, 19 nt, Homo sapiens
gcaggagaaacccagcaaa

SEQ ID NO: 285029 - RNA, 19 nt, Homo sapiens
caaaagagaaaaugcagaa

SEQ ID NO: 285030 - RNA, 19 nt, Homo sapiens
gaacaaaagagaaaaugca

SEQ ID NO: 285031 - RNA, 19 nt, Homo sapiens
cuucgugaaaugugaaaua

SEQ ID NO: 285032 - RNA, 19 nt, Homo sapiens
caaacaacuuuuaccaugu

SEQ ID NO: 285033 - RNA, 19 nt, Homo sapiens
uuaaugaagacccagugua

SEQ ID NO: 285034 - RNA, 19 nt, Homo sapiens
gauaucggcgagcugauca

SEQ ID NO: 285035 - RNA, 19 nt, Homo sapiens
uaaagauccaguucaucaa

SEQ ID NO: 285036 - RNA, 19 nt, Homo sapiens
gguggaacgcacaagauug

SEQ ID NO: 285037 - RNA, 19 nt, Homo sapiens
ccugaaaccagagccauuu

SEQ ID NO: 285038 - RNA, 19 nt, Homo sapiens
agacccaguguaaagaaua

SEQ ID NO: 285039 - RNA, 19 nt, Homo sapiens
caaagcgaaagaucagaug

SEQ ID NO: 285040 - RNA, 19 nt, Homo sapiens
ucggcgagcugaucaugau

SEQ ID NO: 285041 - RNA, 19 nt, Homo sapiens
cuccagaugaugccaauuu

SEQ ID NO: 285042 - RNA, 19 nt, Homo sapiens
aagccauguucaccuaauu

SEQ ID NO: 285043 - RNA, 19 nt, Homo sapiens
ucuuuggcuucagaaauua

SEQ ID NO: 285044 - RNA, 19 nt, Homo sapiens
ugaagacccaguguaaaga

SEQ ID NO: 285045 - RNA, 19 nt, Homo sapiens
aaaucuucgugaaauguga

SEQ ID NO: 285046 - RNA, 19 nt, Homo sapiens
acguauuccuuucuuauca

SEQ ID NO: 285047 - RNA, 19 nt, Homo sapiens
gaugccauucauaccuuua

SEQ ID NO: 285048 - RNA, 19 nt, Homo sapiens
uggaugccauucauaccuu

SEQ ID NO: 285049 - RNA, 19 nt, Homo sapiens
aaucgucuuucuccagaug

SEQ ID NO: 285050 - RNA, 19 nt, Homo sapiens
gcaucuuuauccaaucaag

SEQ ID NO: 285051 - RNA, 19 nt, Homo sapiens
caucaaagcgaaagaucag

SEQ ID NO: 285052 - RNA, 19 nt, Homo sapiens
gcagaaaauucccaucacu

SEQ ID NO: 285053 - RNA, 19 nt, Homo sapiens
gagacgccaauacaaacaa

SEQ ID NO: 285054 - RNA, 19 nt, Homo sapiens
acugagacgccaauacaaa

SEQ ID NO: 285055 - RNA, 19 nt, Homo sapiens
gcccagcacggcuucaaug

SEQ ID NO: 285056 - RNA, 19 nt, Homo sapiens
aaaccagagccauuuggaa

SEQ ID NO: 285057 - RNA, 19 nt, Homo sapiens
guggacggcgugcuagaaa

SEQ ID NO: 285058 - RNA, 19 nt, Homo sapiens
caaucauccggacacguua

SEQ ID NO: 285059 - RNA, 19 nt, Homo sapiens
caaacaaaacgcugcauga

SEQ ID NO: 285060 - RNA, 19 nt, Homo sapiens
acggagaaauggacacaag

SEQ ID NO: 285061 - RNA, 19 nt, Homo sapiens
aguuaaagauccaguucau

SEQ ID NO: 285062 - RNA, 19 nt, Homo sapiens
gagaaucacagggcuggau

SEQ ID NO: 285063 - RNA, 19 nt, Homo sapiens
cgggugaaacggagaaaug

SEQ ID NO: 285064 - RNA, 19 nt, Homo sapiens
agcgaaagaucagaugaga

SEQ ID NO: 285065 - RNA, 19 nt, Homo sapiens
ucaaagcgaaagaucagau

SEQ ID NO: 285066 - RNA, 19 nt, Homo sapiens
aaacgcugcaugagaugaa

SEQ ID NO: 285067 - RNA, 19 nt, Homo sapiens
caggagaaacccagcaaag

SEQ ID NO: 285068 - RNA, 19 nt, Homo sapiens
ggauaucggcgagcugauc

SEQ ID NO: 285069 - RNA, 19 nt, Homo sapiens
ugucacuacucggaacaaa

SEQ ID NO: 285070 - RNA, 19 nt, Homo sapiens
ccaguuaaagauccaguuc

SEQ ID NO: 285071 - RNA, 19 nt, Homo sapiens
aggacacuaugacuucuau

SEQ ID NO: 285072 - RNA, 19 nt, Homo sapiens
ccaguguaaagaauaaaug

SEQ ID NO: 285073 - RNA, 19 nt, Homo sapiens
ccacucaggccucguucug

SEQ ID NO: 285074 - RNA, 19 nt, Homo sapiens
gagcgaucggugcaccuuu

SEQ ID NO: 285075 - RNA, 19 nt, Homo sapiens
aaacaucaaagcgaaagau

SEQ ID NO: 285076 - RNA, 19 nt, Homo sapiens
caaacugagacgccaauac

SEQ ID NO: 285077 - RNA, 19 nt, Homo sapiens
ccgcggagcaagagcaaga

SEQ ID NO: 285078 - RNA, 19 nt, Homo sapiens
guggaacgcacaagauugg

SEQ ID NO: 285079 - RNA, 19 nt, Homo sapiens
ucagaaauuaccaagaaag

SEQ ID NO: 285080 - RNA, 19 nt, Homo sapiens
uuacaggagugcggcuuca

SEQ ID NO: 285081 - RNA, 19 nt, Homo sapiens
aaagcgaaagaucagauga

SEQ ID NO: 285082 - RNA, 19 nt, Homo sapiens
aggagaaacccagcaaaga

SEQ ID NO: 285083 - RNA, 19 nt, Homo sapiens
ggugaaacggagaaaugga

SEQ ID NO: 285084 - RNA, 19 nt, Homo sapiens
agagccauuuggaagaaga

SEQ ID NO: 285085 - RNA, 19 nt, Homo sapiens
gcacagaguucauuacuua

SEQ ID NO: 285086 - RNA, 19 nt, Homo sapiens
gauagaaccuggaagauca

SEQ ID NO: 285087 - RNA, 19 nt, Homo sapiens
gcaaucaccuuacauccaa

SEQ ID NO: 285088 - RNA, 19 nt, Homo sapiens
gagcugggauuucuaacaa

SEQ ID NO: 285089 - RNA, 19 nt, Homo sapiens
ggaagaggcugaggccaaa

SEQ ID NO: 285090 - RNA, 19 nt, Homo sapiens
gaagugccaucaugaggaa

SEQ ID NO: 285091 - RNA, 19 nt, Homo sapiens
acaagaagcugaaucaaca

SEQ ID NO: 285092 - RNA, 19 nt, Homo sapiens
gaucagcccuagaguggaa

SEQ ID NO: 285093 - RNA, 19 nt, Homo sapiens
gaaccuagagcccaacaaa

SEQ ID NO: 285094 - RNA, 19 nt, Homo sapiens
gaaccuggaagaucaauau

SEQ ID NO: 285095 - RNA, 19 nt, Homo sapiens
gaugucaacuucuuauuac

SEQ ID NO: 285096 - RNA, 19 nt, Homo sapiens
gaaucuacgucccaagaga

SEQ ID NO: 285097 - RNA, 19 nt, Homo sapiens
ugacagagcugggauuucu

SEQ ID NO: 285098 - RNA, 19 nt, Homo sapiens
ugagagaucugugaagaga

SEQ ID NO: 285099 - RNA, 19 nt, Homo sapiens
cgaugucaacuucuuauua

SEQ ID NO: 285100 - RNA, 19 nt, Homo sapiens
gagccagcauugagacaaa

SEQ ID NO: 285101 - RNA, 19 nt, Homo sapiens
ggagccagguucuaaguca

SEQ ID NO: 285102 - RNA, 19 nt, Homo sapiens
gcacggauucccucaagaa

SEQ ID NO: 285103 - RNA, 19 nt, Homo sapiens
gaagaugucggagcccaua

SEQ ID NO: 285104 - RNA, 19 nt, Homo sapiens
ccucaaggcucauccacaa

SEQ ID NO: 285105 - RNA, 19 nt, Homo sapiens
ggacgucgccacaugagaa

SEQ ID NO: 285106 - RNA, 19 nt, Homo sapiens
auaaagugaugucaggaua

SEQ ID NO: 285107 - RNA, 19 nt, Homo sapiens
ccucauggcucaacuccuu

SEQ ID NO: 285108 - RNA, 19 nt, Homo sapiens
gggaucaucuucagacaca

SEQ ID NO: 285109 - RNA, 19 nt, Homo sapiens
ccacagcaaucaccuuaca

SEQ ID NO: 285110 - RNA, 19 nt, Homo sapiens
agagacaccugaacaguca

SEQ ID NO: 285111 - RNA, 19 nt, Homo sapiens
gcaggucgguuugguuugu

SEQ ID NO: 285112 - RNA, 19 nt, Homo sapiens
ggacgugcacuucuggaaa

SEQ ID NO: 285113 - RNA, 19 nt, Homo sapiens
gaaagaggcacagaguuca

SEQ ID NO: 285114 - RNA, 19 nt, Homo sapiens
cacagacacuaccaggaua

SEQ ID NO: 285115 - RNA, 19 nt, Homo sapiens
aaagggugcugcucacuca

SEQ ID NO: 285116 - RNA, 19 nt, Homo sapiens
caauggagccagguucuaa

SEQ ID NO: 285117 - RNA, 19 nt, Homo sapiens
agagaucugugaagagaga

SEQ ID NO: 285118 - RNA, 19 nt, Homo sapiens
ucagugugcucuccaagug

SEQ ID NO: 285119 - RNA, 19 nt, Homo sapiens
uaacaaaacuucaggaacu

SEQ ID NO: 285120 - RNA, 19 nt, Homo sapiens
gcauugagacaaagacaug

SEQ ID NO: 285121 - RNA, 19 nt, Homo sapiens
gauccaauacccaacagaa

SEQ ID NO: 285122 - RNA, 19 nt, Homo sapiens
gagugaaacccaagaggaa

SEQ ID NO: 285123 - RNA, 19 nt, Homo sapiens
gggcgcaagucccagaaga

SEQ ID NO: 285124 - RNA, 19 nt, Homo sapiens
ggaaagccuucuggaacau

SEQ ID NO: 285125 - RNA, 19 nt, Homo sapiens
ccauugggcugguguccuu

SEQ ID NO: 285126 - RNA, 19 nt, Homo sapiens
aaugagagaucugugaaga

SEQ ID NO: 285127 - RNA, 19 nt, Homo sapiens
ggaaaagaaucuauaacuc

SEQ ID NO: 285128 - RNA, 19 nt, Homo sapiens
gcugcucacucaacaggaa

SEQ ID NO: 285129 - RNA, 19 nt, Homo sapiens
caccacagcaaucaccuua

SEQ ID NO: 285130 - RNA, 19 nt, Homo sapiens
caacaggagccagcauuga

SEQ ID NO: 285131 - RNA, 19 nt, Homo sapiens
ccacaccagaggccuauaa

SEQ ID NO: 285132 - RNA, 19 nt, Homo sapiens
aagaggaagugccaucaug

SEQ ID NO: 285133 - RNA, 19 nt, Homo sapiens
uggaaagccuucuggaaca

SEQ ID NO: 285134 - RNA, 19 nt, Homo sapiens
ggacaacauagccuucuuc

SEQ ID NO: 285135 - RNA, 19 nt, Homo sapiens
gaacagucagacaagcaaa

SEQ ID NO: 285136 - RNA, 19 nt, Homo sapiens
ggauagaaccuggaagauc

SEQ ID NO: 285137 - RNA, 19 nt, Homo sapiens
gggcacggauucccucaag

SEQ ID NO: 285138 - RNA, 19 nt, Homo sapiens
ccaacugccagcugccuua

SEQ ID NO: 285139 - RNA, 19 nt, Homo sapiens
gacgugcacuucuggaaag

SEQ ID NO: 285140 - RNA, 19 nt, Homo sapiens
agaaagaggcacagaguuc

SEQ ID NO: 285141 - RNA, 19 nt, Homo sapiens
ucaacaagaagcugaauca

SEQ ID NO: 285142 - RNA, 19 nt, Homo sapiens
ugagggaaauaacaaugga

SEQ ID NO: 285143 - RNA, 19 nt, Homo sapiens
agaaucagaugugggauca

SEQ ID NO: 285144 - RNA, 19 nt, Homo sapiens
cagaguucauuacuuagug

SEQ ID NO: 285145 - RNA, 19 nt, Homo sapiens
uaucgucucuggccaacau

SEQ ID NO: 285146 - RNA, 19 nt, Homo sapiens
gaaccuggacgugcacuuc

SEQ ID NO: 285147 - RNA, 19 nt, Homo sapiens
ccucuacuccucacccaua

SEQ ID NO: 285148 - RNA, 19 nt, Homo sapiens
gugaaggacaggacaguga

SEQ ID NO: 285149 - RNA, 19 nt, Homo sapiens
ucacagacacuaccaggau

SEQ ID NO: 285150 - RNA, 19 nt, Homo sapiens
gguuugguuuguuguaaau

SEQ ID NO: 285151 - RNA, 19 nt, Homo sapiens
gcaagucccagaagauguc

SEQ ID NO: 285152 - RNA, 19 nt, Homo sapiens
gaaaaccagugcucggaau

SEQ ID NO: 285153 - RNA, 19 nt, Homo sapiens
aaagaaagaggcacagagu

SEQ ID NO: 285154 - RNA, 19 nt, Homo sapiens
aaagugaugucaggauaca

SEQ ID NO: 285155 - RNA, 19 nt, Homo sapiens
ggcacagaguucauuacuu

SEQ ID NO: 285156 - RNA, 19 nt, Homo sapiens
gaucaucuucagacacaga

SEQ ID NO: 285157 - RNA, 19 nt, Homo sapiens
ccacacagaugccccucua

SEQ ID NO: 285158 - RNA, 19 nt, Homo sapiens
cuaauccucccaccaaaga

SEQ ID NO: 285159 - RNA, 19 nt, Homo sapiens
ccucacccauagucaagaa

SEQ ID NO: 285160 - RNA, 19 nt, Homo sapiens
gcgcaagucccagaagaug

SEQ ID NO: 285161 - RNA, 19 nt, Homo sapiens
gcgcaccuccugcacaaau

SEQ ID NO: 285162 - RNA, 19 nt, Homo sapiens
cugagugggucacagauuc

SEQ ID NO: 285163 - RNA, 19 nt, Homo sapiens
acagagcugggauuucuaa

SEQ ID NO: 285164 - RNA, 19 nt, Homo sapiens
augcuaggauggagugaaa

SEQ ID NO: 285165 - RNA, 19 nt, Homo sapiens
cacgagcccuaccucaaga

SEQ ID NO: 285166 - RNA, 19 nt, Homo sapiens
cugcagaccaucuccauug

SEQ ID NO: 285167 - RNA, 19 nt, Homo sapiens
ucaaugagagaucugugaa

SEQ ID NO: 285168 - RNA, 19 nt, Homo sapiens
caacgagacaggccucagu

SEQ ID NO: 285169 - RNA, 19 nt, Homo sapiens
caagagacaccugaacagu

SEQ ID NO: 285170 - RNA, 19 nt, Homo sapiens
ccuccgaugucaacuucuu

SEQ ID NO: 285171 - RNA, 19 nt, Homo sapiens
caacaagaagcugaaucaa

SEQ ID NO: 285172 - RNA, 19 nt, Homo sapiens
ccacgagcccuaccucaag

SEQ ID NO: 285173 - RNA, 19 nt, Homo sapiens
gcugggauuucuaacaaaa

SEQ ID NO: 285174 - RNA, 19 nt, Homo sapiens
gccgccagcucucucuuca

SEQ ID NO: 285175 - RNA, 19 nt, Homo sapiens
aaggauagaaccuggaaga

SEQ ID NO: 285176 - RNA, 19 nt, Homo sapiens
gaagcccgcaccacagcaa

SEQ ID NO: 285177 - RNA, 19 nt, Homo sapiens
ggccauuccugcagaccau

SEQ ID NO: 285178 - RNA, 19 nt, Homo sapiens
uggcgcaccuccugcacaa

SEQ ID NO: 285179 - RNA, 19 nt, Homo sapiens
caacugccagcugccuuaa

SEQ ID NO: 285180 - RNA, 19 nt, Homo sapiens
cgguuugguuuguuguaaa

SEQ ID NO: 285181 - RNA, 19 nt, Homo sapiens
ucgguuugguuuguuguaa

SEQ ID NO: 285182 - RNA, 19 nt, Homo sapiens
caucaucuccaucgacuac

SEQ ID NO: 285183 - RNA, 19 nt, Homo sapiens
cuacaaacgcaacgagaca

SEQ ID NO: 285184 - RNA, 19 nt, Homo sapiens
agaggaagugccaucauga

SEQ ID NO: 285185 - RNA, 19 nt, Homo sapiens
gagaguugcuggcuauuua

SEQ ID NO: 285186 - RNA, 19 nt, Homo sapiens
acaaagacauggaagauua

SEQ ID NO: 285187 - RNA, 19 nt, Homo sapiens
gaaagcaacugguuugugu

SEQ ID NO: 285188 - RNA, 19 nt, Homo sapiens
acaaagacauggaagguua

SEQ ID NO: 285189 - RNA, 19 nt, Homo sapiens
ggaagagauuuaacacuaa

SEQ ID NO: 285190 - RNA, 19 nt, Homo sapiens
uuacuuagcuggagaacua

SEQ ID NO: 285191 - RNA, 19 nt, Homo sapiens
auaaagagcugacagauga

SEQ ID NO: 285192 - RNA, 19 nt, Homo sapiens
gaagagaaccucaaacuag

SEQ ID NO: 285193 - RNA, 19 nt, Homo sapiens
caaauaggcuuuagaagag

SEQ ID NO: 285194 - RNA, 19 nt, Homo sapiens
gcacaaauacuucuuccua

SEQ ID NO: 285195 - RNA, 19 nt, Homo sapiens
gagcugagaucacgccauu

SEQ ID NO: 285196 - RNA, 19 nt, Homo sapiens
gagcagaugggacaaguua

SEQ ID NO: 285197 - RNA, 19 nt, Homo sapiens
gagcaagacuccauuucaa

SEQ ID NO: 285198 - RNA, 19 nt, Homo sapiens
uagcagaagugaccaaauu

SEQ ID NO: 285199 - RNA, 19 nt, Homo sapiens
ugacacagaugaaccauau

SEQ ID NO: 285200 - RNA, 19 nt, Homo sapiens
caaauccacugacagauau

SEQ ID NO: 285201 - RNA, 19 nt, Homo sapiens
gggcaaaggucaagacugu

SEQ ID NO: 285202 - RNA, 19 nt, Homo sapiens
caacaugcaucccuucuuc

SEQ ID NO: 285203 - RNA, 19 nt, Homo sapiens
ccaaauaggcuuuagaaga

SEQ ID NO: 285204 - RNA, 19 nt, Homo sapiens
ggucaagacugugguauug

SEQ ID NO: 285205 - RNA, 19 nt, Homo sapiens
uaacagcaaggaaacauua

SEQ ID NO: 285206 - RNA, 19 nt, Homo sapiens
ccacaagucugccuucaau

SEQ ID NO: 285207 - RNA, 19 nt, Homo sapiens
ggaaccaucugcuacauca

SEQ ID NO: 285208 - RNA, 19 nt, Homo sapiens
gcagaagauuuagauguuu

SEQ ID NO: 285209 - RNA, 19 nt, Homo sapiens
gaggagcgguggcuaguga

SEQ ID NO: 285210 - RNA, 19 nt, Homo sapiens
gacuuggccuggaugauua

SEQ ID NO: 285211 - RNA, 19 nt, Homo sapiens
ggacaaugccacuauaguu

SEQ ID NO: 285212 - RNA, 19 nt, Homo sapiens
ggugcuagcucuuaccaaa

SEQ ID NO: 285213 - RNA, 19 nt, Homo sapiens
aggaagagauuuaacacua

SEQ ID NO: 285214 - RNA, 19 nt, Homo sapiens
ucacuuaugugccacuauu

SEQ ID NO: 285215 - RNA, 19 nt, Homo sapiens
gcaaagacccagacaucaa

SEQ ID NO: 285216 - RNA, 19 nt, Homo sapiens
gagggacaaugccacuaua

SEQ ID NO: 285217 - RNA, 19 nt, Homo sapiens
gggcagcucuggcuagaug

SEQ ID NO: 285218 - RNA, 19 nt, Homo sapiens
uaugaacucucuccugauu

SEQ ID NO: 285219 - RNA, 19 nt, Homo sapiens
ucaaauccacugacagaua

SEQ ID NO: 285220 - RNA, 19 nt, Homo sapiens
gacaaugccacuauaguuu

SEQ ID NO: 285221 - RNA, 19 nt, Homo sapiens
ggacuuggccuggaugauu

SEQ ID NO: 285222 - RNA, 19 nt, Homo sapiens
guaucuaacucuucuggaa

SEQ ID NO: 285223 - RNA, 19 nt, Homo sapiens
cacaaauacuucuuccuaa

SEQ ID NO: 285224 - RNA, 19 nt, Homo sapiens
agaaugggcugcagaagau

SEQ ID NO: 285225 - RNA, 19 nt, Homo sapiens
cuaggcauauugaucauuu

SEQ ID NO: 285226 - RNA, 19 nt, Homo sapiens
cagaacaguuugugauuuc

SEQ ID NO: 285227 - RNA, 19 nt, Homo sapiens
gagagaaccaggaggguaa

SEQ ID NO: 285228 - RNA, 19 nt, Homo sapiens
caaugccacuauaguuuaa

SEQ ID NO: 285229 - RNA, 19 nt, Homo sapiens
uaaaucaggcccaauauca

SEQ ID NO: 285230 - RNA, 19 nt, Homo sapiens
acacagauuucggucauaa

SEQ ID NO: 285231 - RNA, 19 nt, Homo sapiens
ccuaaggcauguugggaua

SEQ ID NO: 285232 - RNA, 19 nt, Homo sapiens
ggagcagaaagauuaaaua

SEQ ID NO: 285233 - RNA, 19 nt, Homo sapiens
cagcaugaauuccaacuca

SEQ ID NO: 285234 - RNA, 19 nt, Homo sapiens
gaucucaaauccacugaca

SEQ ID NO: 285235 - RNA, 19 nt, Homo sapiens
cauggaagauuagagguuu

SEQ ID NO: 285236 - RNA, 19 nt, Homo sapiens
gagagcaaacauaggaaua

SEQ ID NO: 285237 - RNA, 19 nt, Homo sapiens
ucagcucacugguccauuu

SEQ ID NO: 285238 - RNA, 19 nt, Homo sapiens
ucacaucccuaugaaguug

SEQ ID NO: 285239 - RNA, 19 nt, Homo sapiens
gauuagagguuugucaaca

SEQ ID NO: 285240 - RNA, 19 nt, Homo sapiens
ggagagguuugucaacaca

SEQ ID NO: 285241 - RNA, 19 nt, Homo sapiens
caccucaacuuccagauug

SEQ ID NO: 285242 - RNA, 19 nt, Homo sapiens
cauggaagguuagagguuu

SEQ ID NO: 285243 - RNA, 19 nt, Homo sapiens
gaucacuucauacuucuaa

SEQ ID NO: 285244 - RNA, 19 nt, Homo sapiens
gcagguaguuggugaacag

SEQ ID NO: 285245 - RNA, 19 nt, Homo sapiens
gaagaaguauaugaacucu

SEQ ID NO: 285246 - RNA, 19 nt, Homo sapiens
ggaagaaugggcugcagaa

SEQ ID NO: 285247 - RNA, 19 nt, Homo sapiens
ucucuuacauggccacaaa

SEQ ID NO: 285248 - RNA, 19 nt, Homo sapiens
gaacaguuugugauuucua

SEQ ID NO: 285249 - RNA, 19 nt, Homo sapiens
acagaacaguuugugauuu

SEQ ID NO: 285250 - RNA, 19 nt, Homo sapiens
caaggaaacauuaaugcuu

SEQ ID NO: 285251 - RNA, 19 nt, Homo sapiens
gguaguuggugaacagaga

SEQ ID NO: 285252 - RNA, 19 nt, Homo sapiens
gacucaaacuccucccuuu

SEQ ID NO: 285253 - RNA, 19 nt, Homo sapiens
gugcugauccuuccuauuc

SEQ ID NO: 285254 - RNA, 19 nt, Homo sapiens
gcuuugagcccaccaagaa

SEQ ID NO: 285255 - RNA, 19 nt, Homo sapiens
gagaagagaaccucaaacu

SEQ ID NO: 285256 - RNA, 19 nt, Homo sapiens
agaaguauaugaacucucu

SEQ ID NO: 285257 - RNA, 19 nt, Homo sapiens
ggaaaccaaauaggcuuua

SEQ ID NO: 285258 - RNA, 19 nt, Homo sapiens
ucaaguaucuaacucuucu

SEQ ID NO: 285259 - RNA, 19 nt, Homo sapiens
agauuucggucauaaagaa

SEQ ID NO: 285260 - RNA, 19 nt, Homo sapiens
agagagaguugcuggcuau

SEQ ID NO: 285261 - RNA, 19 nt, Homo sapiens
acaaugccacuauaguuua

SEQ ID NO: 285262 - RNA, 19 nt, Homo sapiens
gacaucauccacucacuaa

SEQ ID NO: 285263 - RNA, 19 nt, Homo sapiens
gcaguguggucucuuacau

SEQ ID NO: 285264 - RNA, 19 nt, Homo sapiens
acagcaguguggucucuua

SEQ ID NO: 285265 - RNA, 19 nt, Homo sapiens
agacagagccuccacuuag

SEQ ID NO: 285266 - RNA, 19 nt, Homo sapiens
guggcaggauuacuacuuu

SEQ ID NO: 285267 - RNA, 19 nt, Homo sapiens
ccagagagcaaacauagga

SEQ ID NO: 285268 - RNA, 19 nt, Homo sapiens
uguaagggcuauaaguaga

SEQ ID NO: 285269 - RNA, 19 nt, Homo sapiens
uaaagaauguaagggcuau

SEQ ID NO: 285270 - RNA, 19 nt, Homo sapiens
gaacccagagucaggaaga

SEQ ID NO: 285271 - RNA, 19 nt, Homo sapiens
gaaccaggaggguaacaga

SEQ ID NO: 285272 - RNA, 19 nt, Homo sapiens
guuaucacaucccuaugaa

SEQ ID NO: 285273 - RNA, 19 nt, Homo sapiens
ggccaaccaugucuucuuc

SEQ ID NO: 285274 - RNA, 19 nt, Homo sapiens
ccuguaaucccaacacuuu

SEQ ID NO: 285275 - RNA, 19 nt, Homo sapiens
ugcagaagauuuagauguu

SEQ ID NO: 285276 - RNA, 19 nt, Homo sapiens
gacagagccuccacuuagu

SEQ ID NO: 285277 - RNA, 19 nt, Homo sapiens
augccuaucuucaccaaua

SEQ ID NO: 285278 - RNA, 19 nt, Homo sapiens
ccagguggcaggauuacua

SEQ ID NO: 285279 - RNA, 19 nt, Homo sapiens
gaaaccaaauaggcuuuag

SEQ ID NO: 285280 - RNA, 19 nt, Homo sapiens
gcaagaauuauaacagcaa

SEQ ID NO: 285281 - RNA, 19 nt, Homo sapiens
uaacucuucuggaaaccaa

SEQ ID NO: 285282 - RNA, 19 nt, Homo sapiens
gagcaggagcagaaagauu

SEQ ID NO: 285283 - RNA, 19 nt, Homo sapiens
gaauguaagggcuauaagu

SEQ ID NO: 285284 - RNA, 19 nt, Homo sapiens
acauaaagccucugacuca

SEQ ID NO: 285285 - RNA, 19 nt, Homo sapiens
gcaaagcgauuaccagaau

SEQ ID NO: 285286 - RNA, 19 nt, Homo sapiens
ggucaauguugcacaguuu

SEQ ID NO: 285287 - RNA, 19 nt, Homo sapiens
gacaacagccugcaccuuu

SEQ ID NO: 285288 - RNA, 19 nt, Homo sapiens
aaacaccuauuaccucuug

SEQ ID NO: 285289 - RNA, 19 nt, Homo sapiens
gugccaagcugaaguugaa

SEQ ID NO: 285290 - RNA, 19 nt, Homo sapiens
gagcacacacuacuacuga

SEQ ID NO: 285291 - RNA, 19 nt, Homo sapiens
ccaaggagauccagcugau

SEQ ID NO: 285292 - RNA, 19 nt, Homo sapiens
ucaagucccucaagaaguc

SEQ ID NO: 285293 - RNA, 19 nt, Homo sapiens
gcagacggccuucgacuuc

SEQ ID NO: 285294 - RNA, 19 nt, Homo sapiens
gaucucacccucggaguuu

SEQ ID NO: 285295 - RNA, 19 nt, Homo sapiens
caacuggcguucacaucga

SEQ ID NO: 285296 - RNA, 19 nt, Homo sapiens
ggcggcaggucuuuguuaa

SEQ ID NO: 285297 - RNA, 19 nt, Homo sapiens
gcugugggcuggcaccaau

SEQ ID NO: 285298 - RNA, 19 nt, Homo sapiens
gcacacacuacuacugaug

SEQ ID NO: 285299 - RNA, 19 nt, Homo sapiens
cgggaccuguuccaguuua

SEQ ID NO: 285300 - RNA, 19 nt, Homo sapiens
guagugggcuggguuuuaa

SEQ ID NO: 285301 - RNA, 19 nt, Homo sapiens
acaacagccugcaccuuug

SEQ ID NO: 285302 - RNA, 19 nt, Homo sapiens
caucccggcuuccacaaug

SEQ ID NO: 285303 - RNA, 19 nt, Homo sapiens
gcgcucugcucagugauga

SEQ ID NO: 285304 - RNA, 19 nt, Homo sapiens
cggcaggucuuuguuaagu

SEQ ID NO: 285305 - RNA, 19 nt, Homo sapiens
ccauggcuuuggccucuuu

SEQ ID NO: 285306 - RNA, 19 nt, Homo sapiens
uggcuucucugcacuguuc

SEQ ID NO: 285307 - RNA, 19 nt, Homo sapiens
cgaaguggcccaugaucug

SEQ ID NO: 285308 - RNA, 19 nt, Homo sapiens
gugaccagcuggccuugga

SEQ ID NO: 285309 - RNA, 19 nt, Homo sapiens
gacuucaccucccguguca

SEQ ID NO: 285310 - RNA, 19 nt, Homo sapiens
cccaugaucugucgaagag

SEQ ID NO: 285311 - RNA, 19 nt, Homo sapiens
cagaggagcaguucaaggu

SEQ ID NO: 285312 - RNA, 19 nt, Homo sapiens
cggcugcucuacaaacuca

SEQ ID NO: 285313 - RNA, 19 nt, Homo sapiens
cggcuucacuguccucaca

SEQ ID NO: 285314 - RNA, 19 nt, Homo sapiens
gaugagcacacacuacuac

SEQ ID NO: 285315 - RNA, 19 nt, Homo sapiens
uaucagaggagcaguucaa

SEQ ID NO: 285316 - RNA, 19 nt, Homo sapiens
cgagaguggcaacguguuu

SEQ ID NO: 285317 - RNA, 19 nt, Homo sapiens
gggaccuguuccaguuuaa

SEQ ID NO: 285318 - RNA, 19 nt, Homo sapiens
gaaguggcccaugaucugu

SEQ ID NO: 285319 - RNA, 19 nt, Homo sapiens
aggaggagcugguggugau

SEQ ID NO: 285320 - RNA, 19 nt, Homo sapiens
ggaccgccacugcaucuca

SEQ ID NO: 285321 - RNA, 19 nt, Homo sapiens
cagcagaaaccaagaacca

SEQ ID NO: 285322 - RNA, 19 nt, Homo sapiens
aagaaguccuugcgucagu

SEQ ID NO: 285323 - RNA, 19 nt, Homo sapiens
ccuuggcccugcacucuga

SEQ ID NO: 285324 - RNA, 19 nt, Homo sapiens
caauggcggagcagaguga

SEQ ID NO: 285325 - RNA, 19 nt, Homo sapiens
gagccgagccaggaacuca

SEQ ID NO: 285326 - RNA, 19 nt, Homo sapiens
ucacccugcuggaugacaa

SEQ ID NO: 285327 - RNA, 19 nt, Homo sapiens
uuugagcgcuucucucucu

SEQ ID NO: 285328 - RNA, 19 nt, Homo sapiens
guccggacccuguacuuug

SEQ ID NO: 285329 - RNA, 19 nt, Homo sapiens
ucuacaaacucagcacugu

SEQ ID NO: 285330 - RNA, 19 nt, Homo sapiens
ggguugcccuucaccaucu

SEQ ID NO: 285331 - RNA, 19 nt, Homo sapiens
gggugcagccucagcaaug

SEQ ID NO: 285332 - RNA, 19 nt, Homo sapiens
gcuucucucucuccaccaa

SEQ ID NO: 285333 - RNA, 19 nt, Homo sapiens
cgaagagcccugacaugca

SEQ ID NO: 285334 - RNA, 19 nt, Homo sapiens
gcgaugagcacacacuacu

SEQ ID NO: 285335 - RNA, 19 nt, Homo sapiens
gaugagagagcggcaacug

SEQ ID NO: 285336 - RNA, 19 nt, Homo sapiens
gcuuucagcccuucguguu

SEQ ID NO: 285337 - RNA, 19 nt, Homo sapiens
gccugcggcugcucuacaa

SEQ ID NO: 285338 - RNA, 19 nt, Homo sapiens
gagaguggcaacguguuug

SEQ ID NO: 285339 - RNA, 19 nt, Homo sapiens
cgucaagucccucaagaag

SEQ ID NO: 285340 - RNA, 19 nt, Homo sapiens
gcucaagcgggaccuguuc

SEQ ID NO: 285341 - RNA, 19 nt, Homo sapiens
ccauggaguggccaauuga

SEQ ID NO: 285342 - RNA, 19 nt, Homo sapiens
accauggaguggccaauug

SEQ ID NO: 285343 - RNA, 19 nt, Homo sapiens
gcucucaccacgucuccaa

SEQ ID NO: 285344 - RNA, 19 nt, Homo sapiens
gggcugcagacuaagcaaa

SEQ ID NO: 285345 - RNA, 19 nt, Homo sapiens
caaggcuucuaccugaucu

SEQ ID NO: 285346 - RNA, 19 nt, Homo sapiens
gaucuuccucugcaaguac

SEQ ID NO: 285347 - RNA, 19 nt, Homo sapiens
uccgcagccucgugccuua

SEQ ID NO: 285348 - RNA, 19 nt, Homo sapiens
uaacugccucugggugaaa

SEQ ID NO: 285349 - RNA, 19 nt, Homo sapiens
gggcuggguuuuaaguuau

SEQ ID NO: 285350 - RNA, 19 nt, Homo sapiens
uuauugcucccaucccuuu

SEQ ID NO: 285351 - RNA, 19 nt, Homo sapiens
agcgggaccuguuccaguu

SEQ ID NO: 285352 - RNA, 19 nt, Homo sapiens
cccggugucugguggauuc

SEQ ID NO: 285353 - RNA, 19 nt, Homo sapiens
gccaaggcuucuaccugau

SEQ ID NO: 285354 - RNA, 19 nt, Homo sapiens
ccugcgucuucaccaaaua

SEQ ID NO: 285355 - RNA, 19 nt, Homo sapiens
ggcaggucuuuguuaagug

SEQ ID NO: 285356 - RNA, 19 nt, Homo sapiens
gcaggugcugguacuggaa

SEQ ID NO: 285357 - RNA, 19 nt, Homo sapiens
ucuccaacaucccgcugaa

SEQ ID NO: 285358 - RNA, 19 nt, Homo sapiens
gcgcgaugagcacacacua

SEQ ID NO: 285359 - RNA, 19 nt, Homo sapiens
gcccaugaucugucgaaga

SEQ ID NO: 285360 - RNA, 19 nt, Homo sapiens
gaaguccuugcgucaguca

SEQ ID NO: 285361 - RNA, 19 nt, Homo sapiens
gaggagcugguggugauug

SEQ ID NO: 285362 - RNA, 19 nt, Homo sapiens
acaacgcugugacgcagau

SEQ ID NO: 285363 - RNA, 19 nt, Homo sapiens
ggugcagccucagcaaugg

SEQ ID NO: 285364 - RNA, 19 nt, Homo sapiens
caggagaacaacgcuguga

SEQ ID NO: 285365 - RNA, 19 nt, Homo sapiens
cagagcaggccaaggagau

SEQ ID NO: 285366 - RNA, 19 nt, Homo sapiens
caacagccugcaccuuugg

SEQ ID NO: 285367 - RNA, 19 nt, Homo sapiens
gcgucaagucccucaagaa

SEQ ID NO: 285368 - RNA, 19 nt, Homo sapiens
agaucuuccucugcaagua

SEQ ID NO: 285369 - RNA, 19 nt, Homo sapiens
gaagaagucuggugacauc

SEQ ID NO: 285370 - RNA, 19 nt, Homo sapiens
gcagauaccuacccuacaa

SEQ ID NO: 285371 - RNA, 19 nt, Homo sapiens
gaagaaacgcagauaccua

SEQ ID NO: 285372 - RNA, 19 nt, Homo sapiens
gugcuggccuggcuccuua

SEQ ID NO: 285373 - RNA, 19 nt, Homo sapiens
gugcugcucuucuuuguug

SEQ ID NO: 285374 - RNA, 19 nt, Homo sapiens
gcaagaagaaacgcagaua

SEQ ID NO: 285375 - RNA, 19 nt, Homo sapiens
ggagucauccgucgaguau

SEQ ID NO: 285376 - RNA, 19 nt, Homo sapiens
ggaaccacguggcccagaa

SEQ ID NO: 285377 - RNA, 19 nt, Homo sapiens
ucacacagaugaaccacau

SEQ ID NO: 285378 - RNA, 19 nt, Homo sapiens
ggccaugccuccaucuuca

SEQ ID NO: 285379 - RNA, 19 nt, Homo sapiens
acaaguggcuggucaucga

SEQ ID NO: 285380 - RNA, 19 nt, Homo sapiens
ggaagaacccagccaggau

SEQ ID NO: 285381 - RNA, 19 nt, Homo sapiens
gacaugaagcuguuugaug

SEQ ID NO: 285382 - RNA, 19 nt, Homo sapiens
ccuggugucugcagcauga

SEQ ID NO: 285383 - RNA, 19 nt, Homo sapiens
ggagaucggccacgagaag

SEQ ID NO: 285384 - RNA, 19 nt, Homo sapiens
ggccucagcuacgaaguga

SEQ ID NO: 285385 - RNA, 19 nt, Homo sapiens
uggccuggcuccuuaucua

SEQ ID NO: 285386 - RNA, 19 nt, Homo sapiens
ccgaggacaugaagcuguu

SEQ ID NO: 285387 - RNA, 19 nt, Homo sapiens
ccaucaagaucucaauuuu

SEQ ID NO: 285388 - RNA, 19 nt, Homo sapiens
cccaacaucuuccacaaag

SEQ ID NO: 285389 - RNA, 19 nt, Homo sapiens
gaucgagcaccaccucuuc

SEQ ID NO: 285390 - RNA, 19 nt, Homo sapiens
ccacguggcccagaaguuc

SEQ ID NO: 285391 - RNA, 19 nt, Homo sapiens
caccuucuuugcuuuccua

SEQ ID NO: 285392 - RNA, 19 nt, Homo sapiens
caacguggagcccucacuu

SEQ ID NO: 285393 - RNA, 19 nt, Homo sapiens
gcaugcagugggcggauuu

SEQ ID NO: 285394 - RNA, 19 nt, Homo sapiens
gcaccucaacuuccagauc

SEQ ID NO: 285395 - RNA, 19 nt, Homo sapiens
cuucuuugcuuuccuacug

SEQ ID NO: 285396 - RNA, 19 nt, Homo sapiens
uaugcccgcuucuucuuau

SEQ ID NO: 285397 - RNA, 19 nt, Homo sapiens
gggagucauccgucgagua

SEQ ID NO: 285398 - RNA, 19 nt, Homo sapiens
gcccaacaucuuccacaaa

SEQ ID NO: 285399 - RNA, 19 nt, Homo sapiens
ggacaugaagcuguuugau

SEQ ID NO: 285400 - RNA, 19 nt, Homo sapiens
caagaagaaacgcagauac

SEQ ID NO: 285401 - RNA, 19 nt, Homo sapiens
gagggaaggugagcauagc

SEQ ID NO: 285402 - RNA, 19 nt, Homo sapiens
guauucagcagcccuaugg

SEQ ID NO: 285403 - RNA, 19 nt, Homo sapiens
gggacugggucagcucuca

SEQ ID NO: 285404 - RNA, 19 nt, Homo sapiens
agucauccgucgaguaugg

SEQ ID NO: 285405 - RNA, 19 nt, Homo sapiens
ucaagaaguccugguggaa

SEQ ID NO: 285406 - RNA, 19 nt, Homo sapiens
gggugcugcucuucuuugu

SEQ ID NO: 285407 - RNA, 19 nt, Homo sapiens
acaaccagcagcaccugua

SEQ ID NO: 285408 - RNA, 19 nt, Homo sapiens
gaaggugagcauagcacau

SEQ ID NO: 285409 - RNA, 19 nt, Homo sapiens
gcacggccucagcuacgaa

SEQ ID NO: 285410 - RNA, 19 nt, Homo sapiens
gcgggcaccucaacuucca

SEQ ID NO: 285411 - RNA, 19 nt, Homo sapiens
cgucgaguauggcaagaag

SEQ ID NO: 285412 - RNA, 19 nt, Homo sapiens
ccaagcacggccucagcua

SEQ ID NO: 285413 - RNA, 19 nt, Homo sapiens
cagcagcaccuguacuucu

SEQ ID NO: 285414 - RNA, 19 nt, Homo sapiens
ucgaguauggcaagaagaa

SEQ ID NO: 285415 - RNA, 19 nt, Homo sapiens
cugaagaagucuggugaca

SEQ ID NO: 285416 - RNA, 19 nt, Homo sapiens
uauccuaccuccccuucua

SEQ ID NO: 285417 - RNA, 19 nt, Homo sapiens
gaggacaugaagcuguuug

SEQ ID NO: 285418 - RNA, 19 nt, Homo sapiens
gaaccacguggcccagaag

SEQ ID NO: 285419 - RNA, 19 nt, Homo sapiens
gggccaugccuccaucuuc

SEQ ID NO: 285420 - RNA, 19 nt, Homo sapiens
aaggugagcauagcacauu

SEQ ID NO: 285421 - RNA, 19 nt, Homo sapiens
ggaugccgagacacaacua

SEQ ID NO: 285422 - RNA, 19 nt, Homo sapiens
cuaugcccgcuucuucuua

SEQ ID NO: 285423 - RNA, 19 nt, Homo sapiens
uggaaaaucuggcguacau

SEQ ID NO: 285424 - RNA, 19 nt, Homo sapiens
guagagggaaggugagcau

SEQ ID NO: 285425 - RNA, 19 nt, Homo sapiens
uccaucaagaucucaauuu

SEQ ID NO: 285426 - RNA, 19 nt, Homo sapiens
gccagucccaccuucuuug

SEQ ID NO: 285427 - RNA, 19 nt, Homo sapiens
gucccaccuucuuugcuuu

SEQ ID NO: 285428 - RNA, 19 nt, Homo sapiens
gagcacagcuggccucuuc

SEQ ID NO: 285429 - RNA, 19 nt, Homo sapiens
gcaagaagcgggcugcuaa

SEQ ID NO: 285430 - RNA, 19 nt, Homo sapiens
ccacaaagauucucauugg

SEQ ID NO: 285431 - RNA, 19 nt, Homo sapiens
gcaaggccauuaacaagau

SEQ ID NO: 285432 - RNA, 19 nt, Homo sapiens
uggaagaugugaaggauuu

SEQ ID NO: 285433 - RNA, 19 nt, Homo sapiens
gcaaggaggugcagcugau

SEQ ID NO: 285434 - RNA, 19 nt, Homo sapiens
ggaagaagcacucaguuuc

SEQ ID NO: 285435 - RNA, 19 nt, Homo sapiens
gaacgcuucucccuaagug

SEQ ID NO: 285436 - RNA, 19 nt, Homo sapiens
ucacacagaugcacuucuu

SEQ ID NO: 285437 - RNA, 19 nt, Homo sapiens
ugaggaaccuggcagaaga

SEQ ID NO: 285438 - RNA, 19 nt, Homo sapiens
ugaggaaccuggcagaaga

SEQ ID NO: 285439 - RNA, 19 nt, Homo sapiens
ccacagagccuugauggaa

SEQ ID NO: 285440 - RNA, 19 nt, Homo sapiens
ugaagucucucaagaaguc

SEQ ID NO: 285441 - RNA, 19 nt, Homo sapiens
gggcagcagugucuucuuc

SEQ ID NO: 285442 - RNA, 19 nt, Homo sapiens
gggagauuguccaccauaa

SEQ ID NO: 285443 - RNA, 19 nt, Homo sapiens
ggugaagucucucaagaag

SEQ ID NO: 285444 - RNA, 19 nt, Homo sapiens
acacagcgauggcagcuau

SEQ ID NO: 285445 - RNA, 19 nt, Homo sapiens
gcucugcucucuggacauu

SEQ ID NO: 285446 - RNA, 19 nt, Homo sapiens
caacaagacuguggagcau

SEQ ID NO: 285447 - RNA, 19 nt, Homo sapiens
gagauuguccaccauaaug

SEQ ID NO: 285448 - RNA, 19 nt, Homo sapiens
uuugaacgcuucucccuaa

SEQ ID NO: 285449 - RNA, 19 nt, Homo sapiens
caacucaggcucuguguuc

SEQ ID NO: 285450 - RNA, 19 nt, Homo sapiens
gcacuccucugcaaucacu

SEQ ID NO: 285451 - RNA, 19 nt, Homo sapiens
ccacgccuguugcaucuga

SEQ ID NO: 285452 - RNA, 19 nt, Homo sapiens
gagcauggcuuccccaauc

SEQ ID NO: 285453 - RNA, 19 nt, Homo sapiens
gccuugagcuggcccauca

SEQ ID NO: 285454 - RNA, 19 nt, Homo sapiens
uguugcaucugaucaauga

SEQ ID NO: 285455 - RNA, 19 nt, Homo sapiens
gaaccaggccucgcagugu

SEQ ID NO: 285456 - RNA, 19 nt, Homo sapiens
gcgcgaagaccaaguucaa

SEQ ID NO: 285457 - RNA, 19 nt, Homo sapiens
gcaaguauacagcccagau

SEQ ID NO: 285458 - RNA, 19 nt, Homo sapiens
ggugaccgccacuguguaa

SEQ ID NO: 285459 - RNA, 19 nt, Homo sapiens
guacuggagcuuagugaug

SEQ ID NO: 285460 - RNA, 19 nt, Homo sapiens
gcccgaggaugaauuugau

SEQ ID NO: 285461 - RNA, 19 nt, Homo sapiens
ucugcucucuggacauuaa

SEQ ID NO: 285462 - RNA, 19 nt, Homo sapiens
gcgagggcuucacauggaa

SEQ ID NO: 285463 - RNA, 19 nt, Homo sapiens
caucaucgacuucuucaca

SEQ ID NO: 285464 - RNA, 19 nt, Homo sapiens
caaggccauuaacaagauu

SEQ ID NO: 285465 - RNA, 19 nt, Homo sapiens
cagagaagaaccugaggaa

SEQ ID NO: 285466 - RNA, 19 nt, Homo sapiens
cgggugaagucucucaaga

SEQ ID NO: 285467 - RNA, 19 nt, Homo sapiens
ggagauuguccaccauaau

SEQ ID NO: 285468 - RNA, 19 nt, Homo sapiens
gcugcacucucacccaugu

SEQ ID NO: 285469 - RNA, 19 nt, Homo sapiens
agaacuauccgcugaggaa

SEQ ID NO: 285470 - RNA, 19 nt, Homo sapiens
uggaagaagcacucaguuu

SEQ ID NO: 285471 - RNA, 19 nt, Homo sapiens
acacagaugcacuucuuga

SEQ ID NO: 285472 - RNA, 19 nt, Homo sapiens
uggcugugcugcuggaaga

SEQ ID NO: 285473 - RNA, 19 nt, Homo sapiens
gaagaagcacucaguuucc

SEQ ID NO: 285474 - RNA, 19 nt, Homo sapiens
ggacgucacaguggaagau

SEQ ID NO: 285475 - RNA, 19 nt, Homo sapiens
cuaagugcccggaacauca

SEQ ID NO: 285476 - RNA, 19 nt, Homo sapiens
gggugaagucucucaagaa

SEQ ID NO: 285477 - RNA, 19 nt, Homo sapiens
uggcaccagucauggcuuu

SEQ ID NO: 285478 - RNA, 19 nt, Homo sapiens
cgcgagggcuucacaugga

SEQ ID NO: 285479 - RNA, 19 nt, Homo sapiens
gcuaugcugucuggucugu

SEQ ID NO: 285480 - RNA, 19 nt, Homo sapiens
gcuucgaucccuacaguga

SEQ ID NO: 285481 - RNA, 19 nt, Homo sapiens
gaggaaggcagaacuaucc

SEQ ID NO: 285482 - RNA, 19 nt, Homo sapiens
gcccacgccuguugcaucu

SEQ ID NO: 285483 - RNA, 19 nt, Homo sapiens
gugcguugccuauacuuug

SEQ ID NO: 285484 - RNA, 19 nt, Homo sapiens
gcuaaugccagcagcaagu

SEQ ID NO: 285485 - RNA, 19 nt, Homo sapiens
ggaugcagccacugucaca

SEQ ID NO: 285486 - RNA, 19 nt, Homo sapiens
caucugaggagcaguucaa

SEQ ID NO: 285487 - RNA, 19 nt, Homo sapiens
caaggugggcugcuucgau

SEQ ID NO: 285488 - RNA, 19 nt, Homo sapiens
gauauccccaucagaauuu

SEQ ID NO: 285489 - RNA, 19 nt, Homo sapiens
gccauuaacaagauucugu

SEQ ID NO: 285490 - RNA, 19 nt, Homo sapiens
ggcccgaggaugaauuuga

SEQ ID NO: 285491 - RNA, 19 nt, Homo sapiens
uacuggagcuuagugaugu

SEQ ID NO: 285492 - RNA, 19 nt, Homo sapiens
caaguauacagcccagaug

SEQ ID NO: 285493 - RNA, 19 nt, Homo sapiens
gcagcgugccagacgacua

SEQ ID NO: 285494 - RNA, 19 nt, Homo sapiens
cgacacauuccuucgagau

SEQ ID NO: 285495 - RNA, 19 nt, Homo sapiens
ucauggcuuuggccucuug

SEQ ID NO: 285496 - RNA, 19 nt, Homo sapiens
acccgaggcugcacucuca

SEQ ID NO: 285497 - RNA, 19 nt, Homo sapiens
gcucuguguucgccuaugc

SEQ ID NO: 285498 - RNA, 19 nt, Homo sapiens
agaagaaccugaggaaccu

SEQ ID NO: 285499 - RNA, 19 nt, Homo sapiens
gguggccauugccguguug

SEQ ID NO: 285500 - RNA, 19 nt, Homo sapiens
auacuuugccgacacauuc

SEQ ID NO: 285501 - RNA, 19 nt, Homo sapiens
ugucgugcguugccuauac

SEQ ID NO: 285502 - RNA, 19 nt, Homo sapiens
gugcugguacuggagcuua

SEQ ID NO: 285503 - RNA, 19 nt, Homo sapiens
gggccacuuuaucaucuuc

SEQ ID NO: 285504 - RNA, 19 nt, Homo sapiens
caagaagcgggcugcuaau

SEQ ID NO: 285505 - RNA, 19 nt, Homo sapiens
ggcaagaagcgggcugcua

SEQ ID NO: 285506 - RNA, 19 nt, Homo sapiens
cugcuucgaucccuacagu

SEQ ID NO: 285507 - RNA, 19 nt, Homo sapiens
gcuucgagccgagacauug

SEQ ID NO: 285508 - RNA, 19 nt, Homo sapiens
gcaccuggcguggaguuca

SEQ ID NO: 285509 - RNA, 19 nt, Homo sapiens
gacacauuccuucgagaug

SEQ ID NO: 285510 - RNA, 19 nt, Homo sapiens
ccuauacuuugccgacaca

SEQ ID NO: 285511 - RNA, 19 nt, Homo sapiens
gcacagcuggccucuucca

SEQ ID NO: 285512 - RNA, 19 nt, Homo sapiens
ccgaggaugaauuugauga

SEQ ID NO: 285513 - RNA, 19 nt, Homo sapiens
uggcggaacugugaaucug

SEQ ID NO: 285514 - RNA, 19 nt, Homo sapiens
cgguagccaccacaccuua

SEQ ID NO: 285515 - RNA, 19 nt, Homo sapiens
gcugugcccaccuggaaga

SEQ ID NO: 285516 - RNA, 19 nt, Homo sapiens
agucgugucucuggcaaga

SEQ ID NO: 285517 - RNA, 19 nt, Homo sapiens
gacuucacuucccgcauca

SEQ ID NO: 285518 - RNA, 19 nt, Homo sapiens
ccugcaaggccauuaacaa

SEQ ID NO: 285519 - RNA, 19 nt, Homo sapiens
gagcaaagauuaccuauua

SEQ ID NO: 285520 - RNA, 19 nt, Homo sapiens
ggacauagauaacuuagug

SEQ ID NO: 285521 - RNA, 19 nt, Homo sapiens
gagcagauauugaccagua

SEQ ID NO: 285522 - RNA, 19 nt, Homo sapiens
gcagauuacucaacaagaa

SEQ ID NO: 285523 - RNA, 19 nt, Homo sapiens
gugaagcacuuguuaguaa

SEQ ID NO: 285524 - RNA, 19 nt, Homo sapiens
gaaauaugccaucaaauga

SEQ ID NO: 285525 - RNA, 19 nt, Homo sapiens
ggaaauauuugagagugua

SEQ ID NO: 285526 - RNA, 19 nt, Homo sapiens
gaaugguguuggaauauuu

SEQ ID NO: 285527 - RNA, 19 nt, Homo sapiens
caacacagcacuucauuga

SEQ ID NO: 285528 - RNA, 19 nt, Homo sapiens
guaaagagggacauagaua

SEQ ID NO: 285529 - RNA, 19 nt, Homo sapiens
guucacagcugauuuauac

SEQ ID NO: 285530 - RNA, 19 nt, Homo sapiens
gaacagagaagauaugucu

SEQ ID NO: 285531 - RNA, 19 nt, Homo sapiens
ccucaugccucccagaaua

SEQ ID NO: 285532 - RNA, 19 nt, Homo sapiens
gcaagaagcagcugccaaa

SEQ ID NO: 285533 - RNA, 19 nt, Homo sapiens
gaggugacauuucgaguga

SEQ ID NO: 285534 - RNA, 19 nt, Homo sapiens
gauguaaauucacgucaaa

SEQ ID NO: 285535 - RNA, 19 nt, Homo sapiens
ugacaaugauggaaagaaa

SEQ ID NO: 285536 - RNA, 19 nt, Homo sapiens
uuaaggaucugguaauaga

SEQ ID NO: 285537 - RNA, 19 nt, Homo sapiens
ggugcaaacuguauuauuc

SEQ ID NO: 285538 - RNA, 19 nt, Homo sapiens
ggaaugguguuggaauauu

SEQ ID NO: 285539 - RNA, 19 nt, Homo sapiens
gcacuuguuaguaaacuua

SEQ ID NO: 285540 - RNA, 19 nt, Homo sapiens
gaucugaggauuuaaauuc

SEQ ID NO: 285541 - RNA, 19 nt, Homo sapiens
ucgaugaucugaggauuua

SEQ ID NO: 285542 - RNA, 19 nt, Homo sapiens
cgaaauaugccaucaaaug

SEQ ID NO: 285543 - RNA, 19 nt, Homo sapiens
ccaguaagaggguaaauaa

SEQ ID NO: 285544 - RNA, 19 nt, Homo sapiens
ggaggaauuugagcacuuu

SEQ ID NO: 285545 - RNA, 19 nt, Homo sapiens
gaacuaagacauugugaag

SEQ ID NO: 285546 - RNA, 19 nt, Homo sapiens
guaagaggguaaauaaagu

SEQ ID NO: 285547 - RNA, 19 nt, Homo sapiens
caaggaggcuguaguagag

SEQ ID NO: 285548 - RNA, 19 nt, Homo sapiens
gccacuacauucugguuua

SEQ ID NO: 285549 - RNA, 19 nt, Homo sapiens
cugcaguccuuucaucuua

SEQ ID NO: 285550 - RNA, 19 nt, Homo sapiens
uaaagagggacauagauaa

SEQ ID NO: 285551 - RNA, 19 nt, Homo sapiens
agauaugucucuuccuuaa

SEQ ID NO: 285552 - RNA, 19 nt, Homo sapiens
uaaugcaacuuccuuugaa

SEQ ID NO: 285553 - RNA, 19 nt, Homo sapiens
gcccagaacuaccaccauu

SEQ ID NO: 285554 - RNA, 19 nt, Homo sapiens
gcaguuagauaugauucuu

SEQ ID NO: 285555 - RNA, 19 nt, Homo sapiens
guggaaugguguuggaaua

SEQ ID NO: 285556 - RNA, 19 nt, Homo sapiens
gcugauggccuagcaauuu

SEQ ID NO: 285557 - RNA, 19 nt, Homo sapiens
ggucagacuuccuaaucaa

SEQ ID NO: 285558 - RNA, 19 nt, Homo sapiens
gugaauuucuggucaguau

SEQ ID NO: 285559 - RNA, 19 nt, Homo sapiens
gcaacuuccuuugaaauca

SEQ ID NO: 285560 - RNA, 19 nt, Homo sapiens
cagaauaugaggucuaauu

SEQ ID NO: 285561 - RNA, 19 nt, Homo sapiens
guauaggucucagcaagaa

SEQ ID NO: 285562 - RNA, 19 nt, Homo sapiens
acacagcacuucauugaca

SEQ ID NO: 285563 - RNA, 19 nt, Homo sapiens
gaucaauaauggcuuuaca

SEQ ID NO: 285564 - RNA, 19 nt, Homo sapiens
gcaauuugguaugcagaaa

SEQ ID NO: 285565 - RNA, 19 nt, Homo sapiens
gagaauggcuuuuauaggu

SEQ ID NO: 285566 - RNA, 19 nt, Homo sapiens
aacaagaacuggauacugu

SEQ ID NO: 285567 - RNA, 19 nt, Homo sapiens
gaauuucuggucaguauga

SEQ ID NO: 285568 - RNA, 19 nt, Homo sapiens
uguaggagaucgagagcua

SEQ ID NO: 285569 - RNA, 19 nt, Homo sapiens
gagauucugagacaaguaa

SEQ ID NO: 285570 - RNA, 19 nt, Homo sapiens
ucgaguagcaccaucuuua

SEQ ID NO: 285571 - RNA, 19 nt, Homo sapiens
cagcugauuuauacugauu

SEQ ID NO: 285572 - RNA, 19 nt, Homo sapiens
gaagucccaucagguuuau

SEQ ID NO: 285573 - RNA, 19 nt, Homo sapiens
uaagaagucccaucagguu

SEQ ID NO: 285574 - RNA, 19 nt, Homo sapiens
guaauuauaggcaacaaug

SEQ ID NO: 285575 - RNA, 19 nt, Homo sapiens
uggaagaggucgaauugga

SEQ ID NO: 285576 - RNA, 19 nt, Homo sapiens
aaacacacuugcccucaug

SEQ ID NO: 285577 - RNA, 19 nt, Homo sapiens
gcacuuucaacaagaauug

SEQ ID NO: 285578 - RNA, 19 nt, Homo sapiens
ugaagcacuuguuaguaaa

SEQ ID NO: 285579 - RNA, 19 nt, Homo sapiens
gcaaagacaaccacauuuu

SEQ ID NO: 285580 - RNA, 19 nt, Homo sapiens
gaugaucugaggauuuaaa

SEQ ID NO: 285581 - RNA, 19 nt, Homo sapiens
caaagagcaccugcacaua

SEQ ID NO: 285582 - RNA, 19 nt, Homo sapiens
caaagacaaccacauuuua

SEQ ID NO: 285583 - RNA, 19 nt, Homo sapiens
gaaaugcccagaacuacca

SEQ ID NO: 285584 - RNA, 19 nt, Homo sapiens
cagcugaucuguggaaugg

SEQ ID NO: 285585 - RNA, 19 nt, Homo sapiens
gguaauagacuucaaaaug

SEQ ID NO: 285586 - RNA, 19 nt, Homo sapiens
gaaguugaggugacauuuc

SEQ ID NO: 285587 - RNA, 19 nt, Homo sapiens
agaagucccaucagguuua

SEQ ID NO: 285588 - RNA, 19 nt, Homo sapiens
gaacuaccaccauuuccau

SEQ ID NO: 285589 - RNA, 19 nt, Homo sapiens
gagggacauagauaacuua

SEQ ID NO: 285590 - RNA, 19 nt, Homo sapiens
cacaccagauaaagaaauu

SEQ ID NO: 285591 - RNA, 19 nt, Homo sapiens
cgaguagcaccaucuuuaa

SEQ ID NO: 285592 - RNA, 19 nt, Homo sapiens
gcaguccuuucaucuuaau

SEQ ID NO: 285593 - RNA, 19 nt, Homo sapiens
cccuaagucuccaauauug

SEQ ID NO: 285594 - RNA, 19 nt, Homo sapiens
gaguagcaccaucuuuaaa

SEQ ID NO: 285595 - RNA, 19 nt, Homo sapiens
guacaaauacagcuucaag

SEQ ID NO: 285596 - RNA, 19 nt, Homo sapiens
ggagggcccuguguuugga

SEQ ID NO: 285597 - RNA, 19 nt, Homo sapiens
cuuuaaggaucugguaaua

SEQ ID NO: 285598 - RNA, 19 nt, Homo sapiens
ucuccaauauugcagguuu

SEQ ID NO: 285599 - RNA, 19 nt, Homo sapiens
gagcaccugcacauaguaa

SEQ ID NO: 285600 - RNA, 19 nt, Homo sapiens
accaugauguccuuucuuu

SEQ ID NO: 285601 - RNA, 19 nt, Homo sapiens
uggaauaucugcugcaacu

SEQ ID NO: 285602 - RNA, 19 nt, Homo sapiens
ucaaggaggcuguaguaga

SEQ ID NO: 285603 - RNA, 19 nt, Homo sapiens
aaucaaggaggcuguagua

SEQ ID NO: 285604 - RNA, 19 nt, Homo sapiens
aagcaaagacaaccacauu

SEQ ID NO: 285605 - RNA, 19 nt, Homo sapiens
gggcagcaugggcagauua

SEQ ID NO: 285606 - RNA, 19 nt, Homo sapiens
cuggaggucuugcagauga

SEQ ID NO: 285607 - RNA, 19 nt, Homo sapiens
cagagggacuuccgcaaca

SEQ ID NO: 285608 - RNA, 19 nt, Homo sapiens
acaaauccauuaugaccau

SEQ ID NO: 285609 - RNA, 19 nt, Homo sapiens
ggaaguugaggugacauuu

SEQ ID NO: 285610 - RNA, 19 nt, Homo sapiens
gaggucagacuuccuaauc

SEQ ID NO: 285611 - RNA, 19 nt, Homo sapiens
ucaaagagcaccugcacau

SEQ ID NO: 285612 - RNA, 19 nt, Homo sapiens
acuaagacauugugaagca

SEQ ID NO: 285613 - RNA, 19 nt, Homo sapiens
cagugaauacuucuaauug

SEQ ID NO: 285614 - RNA, 19 nt, Homo sapiens
guuagugaccauuugcaua

SEQ ID NO: 285615 - RNA, 19 nt, Homo sapiens
cgauguaaauucacgucaa

SEQ ID NO: 285616 - RNA, 19 nt, Homo sapiens
cccagaauaugaggucuaa

SEQ ID NO: 285617 - RNA, 19 nt, Homo sapiens
gccgaaaugcccagaacua

SEQ ID NO: 285618 - RNA, 19 nt, Homo sapiens
gacaacacagcacuucauu

SEQ ID NO: 285619 - RNA, 19 nt, Homo sapiens
gaaggagggugaccugaua

SEQ ID NO: 285620 - RNA, 19 nt, Homo sapiens
ggaagcagcgugaguuuga

SEQ ID NO: 285621 - RNA, 19 nt, Homo sapiens
agaagaacaucuacaguga

SEQ ID NO: 285622 - RNA, 19 nt, Homo sapiens
gaugaucccuugcugacuu

SEQ ID NO: 285623 - RNA, 19 nt, Homo sapiens
caaagugcgugaggaguuu

SEQ ID NO: 285624 - RNA, 19 nt, Homo sapiens
gagcugaaagcgcgcaaua

SEQ ID NO: 285625 - RNA, 19 nt, Homo sapiens
gcaaagugcgugaggaguu

SEQ ID NO: 285626 - RNA, 19 nt, Homo sapiens
guacggcucucaucaacuc

SEQ ID NO: 285627 - RNA, 19 nt, Homo sapiens
agaaggagcuggagaagac

SEQ ID NO: 285628 - RNA, 19 nt, Homo sapiens
cuaccgaccugguguggaa

SEQ ID NO: 285629 - RNA, 19 nt, Homo sapiens
ggaugaggagggcaaguuu

SEQ ID NO: 285630 - RNA, 19 nt, Homo sapiens
ugaaagcgcgcaauaccaa

SEQ ID NO: 285631 - RNA, 19 nt, Homo sapiens
cgugugcgcucgcuggaaa

SEQ ID NO: 285632 - RNA, 19 nt, Homo sapiens
ucacccggcugcaggagaa

SEQ ID NO: 285633 - RNA, 19 nt, Homo sapiens
cgacgaggaugaggaugga

SEQ ID NO: 285634 - RNA, 19 nt, Homo sapiens
ucacagcacgcacgcacua

SEQ ID NO: 285635 - RNA, 19 nt, Homo sapiens
ggacgacgaggaugaggau

SEQ ID NO: 285636 - RNA, 19 nt, Homo sapiens
gcagaucaagcgccagaau

SEQ ID NO: 285637 - RNA, 19 nt, Homo sapiens
ucagccagcuccagaagca

SEQ ID NO: 285638 - RNA, 19 nt, Homo sapiens
ggaugaggauggagaugac

SEQ ID NO: 285639 - RNA, 19 nt, Homo sapiens
agaacaggcugcagaccau

SEQ ID NO: 285640 - RNA, 19 nt, Homo sapiens
gaugaggagggcaaguuug

SEQ ID NO: 285641 - RNA, 19 nt, Homo sapiens
cugccaagcuggacaaugc

SEQ ID NO: 285642 - RNA, 19 nt, Homo sapiens
gagcuggagaagacuuauu

SEQ ID NO: 285643 - RNA, 19 nt, Homo sapiens
gcguacggcucucaucaac

SEQ ID NO: 285644 - RNA, 19 nt, Homo sapiens
cggaugcgcugcaggaacu

SEQ ID NO: 285645 - RNA, 19 nt, Homo sapiens
gcgccagaauggagaugau

SEQ ID NO: 285646 - RNA, 19 nt, Homo sapiens
gaccagguggagcaguaua

SEQ ID NO: 285647 - RNA, 19 nt, Homo sapiens
aggaccagguggagcagua

SEQ ID NO: 285648 - RNA, 19 nt, Homo sapiens
gcggguggaugcugagaac

SEQ ID NO: 285649 - RNA, 19 nt, Homo sapiens
gaucaagcgccagaaugga

SEQ ID NO: 285650 - RNA, 19 nt, Homo sapiens
auaagaaggagcuggagaa

SEQ ID NO: 285651 - RNA, 19 nt, Homo sapiens
gaagcagcgugaguuugag

SEQ ID NO: 285652 - RNA, 19 nt, Homo sapiens
gcuuggcggucuacaucga

SEQ ID NO: 285653 - RNA, 19 nt, Homo sapiens
gcaagcuggugcgcucagu

SEQ ID NO: 285654 - RNA, 19 nt, Homo sapiens
caacuccacuggggaagaa

SEQ ID NO: 285655 - RNA, 19 nt, Homo sapiens
ggacgaguaccaggagcuu

SEQ ID NO: 285656 - RNA, 19 nt, Homo sapiens
cagaucaagcgccagaaug

SEQ ID NO: 285657 - RNA, 19 nt, Homo sapiens
caagcuggcccuggacaug

SEQ ID NO: 285658 - RNA, 19 nt, Homo sapiens
agaccaagcgccgucauga

SEQ ID NO: 285659 - RNA, 19 nt, Homo sapiens
gagaccaagcgccgucaug

SEQ ID NO: 285660 - RNA, 19 nt, Homo sapiens
ugaaggaggaacuggacuu

SEQ ID NO: 285661 - RNA, 19 nt, Homo sapiens
augaucccuugcugacuua

SEQ ID NO: 285662 - RNA, 19 nt, Homo sapiens
gggaagcagcgugaguuug

SEQ ID NO: 285663 - RNA, 19 nt, Homo sapiens
gcaacuucaggaugagaug

SEQ ID NO: 285664 - RNA, 19 nt, Homo sapiens
uggaggcucugcugaacuc

SEQ ID NO: 285665 - RNA, 19 nt, Homo sapiens
cgagguguccggcaucaag

SEQ ID NO: 285666 - RNA, 19 nt, Homo sapiens
ccagaagaacaucuacagu

SEQ ID NO: 285667 - RNA, 19 nt, Homo sapiens
ggaguuuaaggagcugaaa

SEQ ID NO: 285668 - RNA, 19 nt, Homo sapiens
uaggugaggccaagaagca

SEQ ID NO: 285669 - RNA, 19 nt, Homo sapiens
gaaggagggugaccugaua

SEQ ID NO: 285670 - RNA, 19 nt, Homo sapiens
gaagaaaggugaguuugag

SEQ ID NO: 285671 - RNA, 19 nt, Homo sapiens
ccaaaucaauacacuaguu

SEQ ID NO: 285672 - RNA, 19 nt, Homo sapiens
ggaagcagcgugaguuuga

SEQ ID NO: 285673 - RNA, 19 nt, Homo sapiens
gaacugcagcaucauguaa

SEQ ID NO: 285674 - RNA, 19 nt, Homo sapiens
agaagaacaucuacaguga

SEQ ID NO: 285675 - RNA, 19 nt, Homo sapiens
gaugaucccuugcugacuu

SEQ ID NO: 285676 - RNA, 19 nt, Homo sapiens
gcaucuaucucaucuaucu

SEQ ID NO: 285677 - RNA, 19 nt, Homo sapiens
caaagugcgugaggaguuu

SEQ ID NO: 285678 - RNA, 19 nt, Homo sapiens
ggagaagaaaggugaguuu

SEQ ID NO: 285679 - RNA, 19 nt, Homo sapiens
ucaucuaucucaauccuaa

SEQ ID NO: 285680 - RNA, 19 nt, Homo sapiens
gagcugaaagcgcgcaaua

SEQ ID NO: 285681 - RNA, 19 nt, Homo sapiens
gcaaagugcgugaggaguu

SEQ ID NO: 285682 - RNA, 19 nt, Homo sapiens
guacggcucucaucaacuc

SEQ ID NO: 285683 - RNA, 19 nt, Homo sapiens
aagcaucuaucucaucuau

SEQ ID NO: 285684 - RNA, 19 nt, Homo sapiens
agaaggagcuggagaagac

SEQ ID NO: 285685 - RNA, 19 nt, Homo sapiens
ucaauacacuaguuguuuc

SEQ ID NO: 285686 - RNA, 19 nt, Homo sapiens
agagggaggucacuggaaa

SEQ ID NO: 285687 - RNA, 19 nt, Homo sapiens
ccaggaaacuccacaucug

SEQ ID NO: 285688 - RNA, 19 nt, Homo sapiens
cuaccgaccugguguggaa

SEQ ID NO: 285689 - RNA, 19 nt, Homo sapiens
gaagaagggagaagaaagg

SEQ ID NO: 285690 - RNA, 19 nt, Homo sapiens
gaggcuagcuucugcuuuu

SEQ ID NO: 285691 - RNA, 19 nt, Homo sapiens
gacaagagaugggaaugag

SEQ ID NO: 285692 - RNA, 19 nt, Homo sapiens
aaacuccacaucugccuua

SEQ ID NO: 285693 - RNA, 19 nt, Homo sapiens
ggaugaggagggcaaguuu

SEQ ID NO: 285694 - RNA, 19 nt, Homo sapiens
ugaaagcgcgcaauaccaa

SEQ ID NO: 285695 - RNA, 19 nt, Homo sapiens
caaaucaauacacuaguug

SEQ ID NO: 285696 - RNA, 19 nt, Homo sapiens
ggaagaagggagaagaaag

SEQ ID NO: 285697 - RNA, 19 nt, Homo sapiens
cgugugcgcucgcuggaaa

SEQ ID NO: 285698 - RNA, 19 nt, Homo sapiens
uaucucaucuaucucaauc

SEQ ID NO: 285699 - RNA, 19 nt, Homo sapiens
gagaagaaaggugaguuug

SEQ ID NO: 285700 - RNA, 19 nt, Homo sapiens
ucacccggcugcaggagaa

SEQ ID NO: 285701 - RNA, 19 nt, Homo sapiens
agaagaaaggugaguuuga

SEQ ID NO: 285702 - RNA, 19 nt, Homo sapiens
cgacgaggaugaggaugga

SEQ ID NO: 285703 - RNA, 19 nt, Homo sapiens
ucacagcacgcacgcacua

SEQ ID NO: 285704 - RNA, 19 nt, Homo sapiens
ggacgacgaggaugaggau

SEQ ID NO: 285705 - RNA, 19 nt, Homo sapiens
gcagaucaagcgccagaau

SEQ ID NO: 285706 - RNA, 19 nt, Homo sapiens
ucagccagcuccagaagca

SEQ ID NO: 285707 - RNA, 19 nt, Homo sapiens
ggcuuggccugcugugauu

SEQ ID NO: 285708 - RNA, 19 nt, Homo sapiens
ggaugaggauggagaugac

SEQ ID NO: 285709 - RNA, 19 nt, Homo sapiens
agaacaggcugcagaccau

SEQ ID NO: 285710 - RNA, 19 nt, Homo sapiens
ggugggcucugugcaguca

SEQ ID NO: 285711 - RNA, 19 nt, Homo sapiens
gaugaggagggcaaguuug

SEQ ID NO: 285712 - RNA, 19 nt, Homo sapiens
cugccaagcuggacaaugc

SEQ ID NO: 285713 - RNA, 19 nt, Homo sapiens
gagcuggagaagacuuauu

SEQ ID NO: 285714 - RNA, 19 nt, Homo sapiens
gcguacggcucucaucaac

SEQ ID NO: 285715 - RNA, 19 nt, Homo sapiens
cggaugcgcugcaggaacu

SEQ ID NO: 285716 - RNA, 19 nt, Homo sapiens
gagagggaggucacuggaa

SEQ ID NO: 285717 - RNA, 19 nt, Homo sapiens
gcgccagaauggagaugau

SEQ ID NO: 285718 - RNA, 19 nt, Homo sapiens
gaccagguggagcaguaua

SEQ ID NO: 285719 - RNA, 19 nt, Homo sapiens
aggaccagguggagcagua

SEQ ID NO: 285720 - RNA, 19 nt, Homo sapiens
gggcuuggccugcugugau

SEQ ID NO: 285721 - RNA, 19 nt, Homo sapiens
gcggguggaugcugagaac

SEQ ID NO: 285722 - RNA, 19 nt, Homo sapiens
gaucaagcgccagaaugga

SEQ ID NO: 285723 - RNA, 19 nt, Homo sapiens
auaagaaggagcuggagaa

SEQ ID NO: 285724 - RNA, 19 nt, Homo sapiens
gaagcagcgugaguuugag

SEQ ID NO: 285725 - RNA, 19 nt, Homo sapiens
agacaagagaugggaauga

SEQ ID NO: 285726 - RNA, 19 nt, Homo sapiens
gcuuggcggucuacaucga

SEQ ID NO: 285727 - RNA, 19 nt, Homo sapiens
cuaucucaauccuaauuuc

SEQ ID NO: 285728 - RNA, 19 nt, Homo sapiens
gcucuucugccuccagugu

SEQ ID NO: 285729 - RNA, 19 nt, Homo sapiens
caucuccucuggcucuucu

SEQ ID NO: 285730 - RNA, 19 nt, Homo sapiens
gcaagcuggugcgcucagu

SEQ ID NO: 285731 - RNA, 19 nt, Homo sapiens
caacuccacuggggaagaa

SEQ ID NO: 285732 - RNA, 19 nt, Homo sapiens
ggacgaguaccaggagcuu

SEQ ID NO: 285733 - RNA, 19 nt, Homo sapiens
ccagaacugcagcaucaug

SEQ ID NO: 285734 - RNA, 19 nt, Homo sapiens
cagaucaagcgccagaaug

SEQ ID NO: 285735 - RNA, 19 nt, Homo sapiens
caagcuggcccuggacaug

SEQ ID NO: 285736 - RNA, 19 nt, Homo sapiens
agaccaagcgccgucauga

SEQ ID NO: 285737 - RNA, 19 nt, Homo sapiens
gagagagagaggacagcuu

SEQ ID NO: 285738 - RNA, 19 nt, Homo sapiens
cgagagggagagagagaga

SEQ ID NO: 285739 - RNA, 19 nt, Homo sapiens
gagaccaagcgccgucaug

SEQ ID NO: 285740 - RNA, 19 nt, Homo sapiens
ugaaggaggaacuggacuu

SEQ ID NO: 285741 - RNA, 19 nt, Homo sapiens
guggaagaagggagaagaa

SEQ ID NO: 285742 - RNA, 19 nt, Homo sapiens
gaggugggagguggaagaa

SEQ ID NO: 285743 - RNA, 19 nt, Homo sapiens
uaccagcugcgcuugcuuu

SEQ ID NO: 285744 - RNA, 19 nt, Homo sapiens
gagagagaggacagcuuga

SEQ ID NO: 285745 - RNA, 19 nt, Homo sapiens
cuccacaucugccuuaaaa

SEQ ID NO: 285746 - RNA, 19 nt, Homo sapiens
uggaggcucugcugaacuc

SEQ ID NO: 285747 - RNA, 19 nt, Homo sapiens
augaucccuugcugacuua

SEQ ID NO: 285748 - RNA, 19 nt, Homo sapiens
gggaagcagcgugaguuug

SEQ ID NO: 285749 - RNA, 19 nt, Homo sapiens
gcaacuucaggaugagaug

SEQ ID NO: 285750 - RNA, 19 nt, Homo sapiens
cgagguguccggcaucaag

SEQ ID NO: 285751 - RNA, 19 nt, Homo sapiens
cagaacugcagcaucaugu

SEQ ID NO: 285752 - RNA, 19 nt, Homo sapiens
ggaguuuaaggagcugaaa

SEQ ID NO: 285753 - RNA, 19 nt, Homo sapiens
gggagaagaaaggugaguu

SEQ ID NO: 285754 - RNA, 19 nt, Homo sapiens
gguggaagaagggagaaga

SEQ ID NO: 285755 - RNA, 19 nt, Homo sapiens
cagcugcgcuugcuuuucu

SEQ ID NO: 285756 - RNA, 19 nt, Homo sapiens
uaggugaggccaagaagca

SEQ ID NO: 285757 - RNA, 19 nt, Homo sapiens
ccccagaacugcagcauca

SEQ ID NO: 285758 - RNA, 19 nt, Homo sapiens
ccagaagaacaucuacagu

SEQ ID NO: 285759 - RNA, 19 nt, Homo sapiens
gaaggagggugaccugaua

SEQ ID NO: 285760 - RNA, 19 nt, Homo sapiens
gaagaaaggugaguuugag

SEQ ID NO: 285761 - RNA, 19 nt, Homo sapiens
ccaaaucaauacacuaguu

SEQ ID NO: 285762 - RNA, 19 nt, Homo sapiens
ggaagcagcgugaguuuga

SEQ ID NO: 285763 - RNA, 19 nt, Homo sapiens
gaacugcagcaucauguaa

SEQ ID NO: 285764 - RNA, 19 nt, Homo sapiens
agaagaacaucuacaguga

SEQ ID NO: 285765 - RNA, 19 nt, Homo sapiens
gaugaucccuugcugacuu

SEQ ID NO: 285766 - RNA, 19 nt, Homo sapiens
gcaucuaucucaucuaucu

SEQ ID NO: 285767 - RNA, 19 nt, Homo sapiens
caaagugcgugaggaguuu

SEQ ID NO: 285768 - RNA, 19 nt, Homo sapiens
ggagaagaaaggugaguuu

SEQ ID NO: 285769 - RNA, 19 nt, Homo sapiens
ucaucuaucucaauccuaa

SEQ ID NO: 285770 - RNA, 19 nt, Homo sapiens
gagcugaaagcgcgcaaua

SEQ ID NO: 285771 - RNA, 19 nt, Homo sapiens
gcaaagugcgugaggaguu

SEQ ID NO: 285772 - RNA, 19 nt, Homo sapiens
guacggcucucaucaacuc

SEQ ID NO: 285773 - RNA, 19 nt, Homo sapiens
aagcaucuaucucaucuau

SEQ ID NO: 285774 - RNA, 19 nt, Homo sapiens
agaaggagcuggagaagac

SEQ ID NO: 285775 - RNA, 19 nt, Homo sapiens
ucaauacacuaguuguuuc

SEQ ID NO: 285776 - RNA, 19 nt, Homo sapiens
agagggaggucacuggaaa

SEQ ID NO: 285777 - RNA, 19 nt, Homo sapiens
ccaggaaacuccacaucug

SEQ ID NO: 285778 - RNA, 19 nt, Homo sapiens
cuaccgaccugguguggaa

SEQ ID NO: 285779 - RNA, 19 nt, Homo sapiens
gaagaagggagaagaaagg

SEQ ID NO: 285780 - RNA, 19 nt, Homo sapiens
gaggcuagcuucugcuuuu

SEQ ID NO: 285781 - RNA, 19 nt, Homo sapiens
gacaagagaugggaaugag

SEQ ID NO: 285782 - RNA, 19 nt, Homo sapiens
aaacuccacaucugccuua

SEQ ID NO: 285783 - RNA, 19 nt, Homo sapiens
ggaugaggagggcaaguuu

SEQ ID NO: 285784 - RNA, 19 nt, Homo sapiens
ugaaagcgcgcaauaccaa

SEQ ID NO: 285785 - RNA, 19 nt, Homo sapiens
caaaucaauacacuaguug

SEQ ID NO: 285786 - RNA, 19 nt, Homo sapiens
ggaagaagggagaagaaag

SEQ ID NO: 285787 - RNA, 19 nt, Homo sapiens
cgugugcgcucgcuggaaa

SEQ ID NO: 285788 - RNA, 19 nt, Homo sapiens
uaucucaucuaucucaauc

SEQ ID NO: 285789 - RNA, 19 nt, Homo sapiens
gagaagaaaggugaguuug

SEQ ID NO: 285790 - RNA, 19 nt, Homo sapiens
ucacccggcugcaggagaa

SEQ ID NO: 285791 - RNA, 19 nt, Homo sapiens
agaagaaaggugaguuuga

SEQ ID NO: 285792 - RNA, 19 nt, Homo sapiens
ucacagcacgcacgcacua

SEQ ID NO: 285793 - RNA, 19 nt, Homo sapiens
gcagaucaagcgccagaau

SEQ ID NO: 285794 - RNA, 19 nt, Homo sapiens
ucagccagcuccagaagca

SEQ ID NO: 285795 - RNA, 19 nt, Homo sapiens
ggcuuggccugcugugauu

SEQ ID NO: 285796 - RNA, 19 nt, Homo sapiens
agaacaggcugcagaccau

SEQ ID NO: 285797 - RNA, 19 nt, Homo sapiens
ggugggcucugugcaguca

SEQ ID NO: 285798 - RNA, 19 nt, Homo sapiens
gaugaggagggcaaguuug

SEQ ID NO: 285799 - RNA, 19 nt, Homo sapiens
cugccaagcuggacaaugc

SEQ ID NO: 285800 - RNA, 19 nt, Homo sapiens
gagcuggagaagacuuauu

SEQ ID NO: 285801 - RNA, 19 nt, Homo sapiens
gcguacggcucucaucaac

SEQ ID NO: 285802 - RNA, 19 nt, Homo sapiens
cggaugcgcugcaggaacu

SEQ ID NO: 285803 - RNA, 19 nt, Homo sapiens
gagagggaggucacuggaa

SEQ ID NO: 285804 - RNA, 19 nt, Homo sapiens
gcgccagaauggagaugau

SEQ ID NO: 285805 - RNA, 19 nt, Homo sapiens
gaccagguggagcaguaua

SEQ ID NO: 285806 - RNA, 19 nt, Homo sapiens
aggaccagguggagcagua

SEQ ID NO: 285807 - RNA, 19 nt, Homo sapiens
gggcuuggccugcugugau

SEQ ID NO: 285808 - RNA, 19 nt, Homo sapiens
gcggguggaugcugagaac

SEQ ID NO: 285809 - RNA, 19 nt, Homo sapiens
gaucaagcgccagaaugga

SEQ ID NO: 285810 - RNA, 19 nt, Homo sapiens
auaagaaggagcuggagaa

SEQ ID NO: 285811 - RNA, 19 nt, Homo sapiens
gaagcagcgugaguuugag

SEQ ID NO: 285812 - RNA, 19 nt, Homo sapiens
agacaagagaugggaauga

SEQ ID NO: 285813 - RNA, 19 nt, Homo sapiens
gcuuggcggucuacaucga

SEQ ID NO: 285814 - RNA, 19 nt, Homo sapiens
cuaucucaauccuaauuuc

SEQ ID NO: 285815 - RNA, 19 nt, Homo sapiens
gcucuucugccuccagugu

SEQ ID NO: 285816 - RNA, 19 nt, Homo sapiens
caucuccucuggcucuucu

SEQ ID NO: 285817 - RNA, 19 nt, Homo sapiens
ggacgaguaccaggagcuu

SEQ ID NO: 285818 - RNA, 19 nt, Homo sapiens
ccagaacugcagcaucaug

SEQ ID NO: 285819 - RNA, 19 nt, Homo sapiens
cagaucaagcgccagaaug

SEQ ID NO: 285820 - RNA, 19 nt, Homo sapiens
caagcuggcccuggacaug

SEQ ID NO: 285821 - RNA, 19 nt, Homo sapiens
agaccaagcgccgucauga

SEQ ID NO: 285822 - RNA, 19 nt, Homo sapiens
gagagagagaggacagcuu

SEQ ID NO: 285823 - RNA, 19 nt, Homo sapiens
cgagagggagagagagaga

SEQ ID NO: 285824 - RNA, 19 nt, Homo sapiens
gagaccaagcgccgucaug

SEQ ID NO: 285825 - RNA, 19 nt, Homo sapiens
ugaaggaggaacuggacuu

SEQ ID NO: 285826 - RNA, 19 nt, Homo sapiens
guggaagaagggagaagaa

SEQ ID NO: 285827 - RNA, 19 nt, Homo sapiens
gaggugggagguggaagaa

SEQ ID NO: 285828 - RNA, 19 nt, Homo sapiens
uaccagcugcgcuugcuuu

SEQ ID NO: 285829 - RNA, 19 nt, Homo sapiens
gagagagaggacagcuuga

SEQ ID NO: 285830 - RNA, 19 nt, Homo sapiens
cuccacaucugccuuaaaa

SEQ ID NO: 285831 - RNA, 19 nt, Homo sapiens
augaucccuugcugacuua

SEQ ID NO: 285832 - RNA, 19 nt, Homo sapiens
gggaagcagcgugaguuug

SEQ ID NO: 285833 - RNA, 19 nt, Homo sapiens
uggaggcucugcugaacuc

SEQ ID NO: 285834 - RNA, 19 nt, Homo sapiens
gcaacuucaggaugagaug

SEQ ID NO: 285835 - RNA, 19 nt, Homo sapiens
cgagguguccggcaucaag

SEQ ID NO: 285836 - RNA, 19 nt, Homo sapiens
cagaacugcagcaucaugu

SEQ ID NO: 285837 - RNA, 19 nt, Homo sapiens
gggagaagaaaggugaguu

SEQ ID NO: 285838 - RNA, 19 nt, Homo sapiens
gguggaagaagggagaaga

SEQ ID NO: 285839 - RNA, 19 nt, Homo sapiens
cagcugcgcuugcuuuucu

SEQ ID NO: 285840 - RNA, 19 nt, Homo sapiens
uaggugaggccaagaagca

SEQ ID NO: 285841 - RNA, 19 nt, Homo sapiens
ccccagaacugcagcauca

SEQ ID NO: 285842 - RNA, 19 nt, Homo sapiens
ggaguuuaaggagcugaaa

SEQ ID NO: 285843 - RNA, 19 nt, Homo sapiens
ccagaagaacaucuacagu

SEQ ID NO: 285844 - RNA, 19 nt, Homo sapiens
gaaggaaucugaucuuaau

SEQ ID NO: 285845 - RNA, 19 nt, Homo sapiens
gggaaggguuucucuauua

SEQ ID NO: 285846 - RNA, 19 nt, Homo sapiens
aauagaagcugugcaauua

SEQ ID NO: 285847 - RNA, 19 nt, Homo sapiens
caacugaccucaucuggaa

SEQ ID NO: 285848 - RNA, 19 nt, Homo sapiens
ggaaggguuucucuauuaa

SEQ ID NO: 285849 - RNA, 19 nt, Homo sapiens
gaagaggguugauguggaa

SEQ ID NO: 285850 - RNA, 19 nt, Homo sapiens
gaaagagucuagagcaugu

SEQ ID NO: 285851 - RNA, 19 nt, Homo sapiens
guuagcagaugaaacuuua

SEQ ID NO: 285852 - RNA, 19 nt, Homo sapiens
gcagaugaaacuuuacuua

SEQ ID NO: 285853 - RNA, 19 nt, Homo sapiens
gcacugaauucgaaagaug

SEQ ID NO: 285854 - RNA, 19 nt, Homo sapiens
gaucaagcuucgagaauau

SEQ ID NO: 285855 - RNA, 19 nt, Homo sapiens
ggaaauaagggaucaaaug

SEQ ID NO: 285856 - RNA, 19 nt, Homo sapiens
gaaagccgcaugagaauug

SEQ ID NO: 285857 - RNA, 19 nt, Homo sapiens
ggacuugcuugcuaaagaa

SEQ ID NO: 285858 - RNA, 19 nt, Homo sapiens
gggaagaacugauggaaag

SEQ ID NO: 285859 - RNA, 19 nt, Homo sapiens
gcugggagaugaucagaaa

SEQ ID NO: 285860 - RNA, 19 nt, Homo sapiens
gcgaagaugugaagguuau

SEQ ID NO: 285861 - RNA, 19 nt, Homo sapiens
gaacacuucugaacaggau

SEQ ID NO: 285862 - RNA, 19 nt, Homo sapiens
gagaggagguugcucaaag

SEQ ID NO: 285863 - RNA, 19 nt, Homo sapiens
acacugaacuuaauaacug

SEQ ID NO: 285864 - RNA, 19 nt, Homo sapiens
gaaaucauguccauacacu

SEQ ID NO: 285865 - RNA, 19 nt, Homo sapiens
ccaagagcauccaauagaa

SEQ ID NO: 285866 - RNA, 19 nt, Homo sapiens
acacaucagucaguuauaa

SEQ ID NO: 285867 - RNA, 19 nt, Homo sapiens
gaacagcuucuugauguaa

SEQ ID NO: 285868 - RNA, 19 nt, Homo sapiens
guaauaagcaaucaagguu

SEQ ID NO: 285869 - RNA, 19 nt, Homo sapiens
ugcaagaugugaauuauug

SEQ ID NO: 285870 - RNA, 19 nt, Homo sapiens
ggagguugcucaaagaagu

SEQ ID NO: 285871 - RNA, 19 nt, Homo sapiens
agaagcagcuggagugguu

SEQ ID NO: 285872 - RNA, 19 nt, Homo sapiens
gaaugacuaugaacagcuu

SEQ ID NO: 285873 - RNA, 19 nt, Homo sapiens
cuagcaaucucuucauuau

SEQ ID NO: 285874 - RNA, 19 nt, Homo sapiens
ggaaauuuauccgcuugaa

SEQ ID NO: 285875 - RNA, 19 nt, Homo sapiens
ucgaagaaauugauguuga

SEQ ID NO: 285876 - RNA, 19 nt, Homo sapiens
agagagagauggcggaaau

SEQ ID NO: 285877 - RNA, 19 nt, Homo sapiens
caauagaagcugugcaauu

SEQ ID NO: 285878 - RNA, 19 nt, Homo sapiens
ggagacacaucagucaguu

SEQ ID NO: 285879 - RNA, 19 nt, Homo sapiens
gaaauaagggaucaaaugc

SEQ ID NO: 285880 - RNA, 19 nt, Homo sapiens
uaauaacuguguacuguuc

SEQ ID NO: 285881 - RNA, 19 nt, Homo sapiens
aaacaaccauaccugaaga

SEQ ID NO: 285882 - RNA, 19 nt, Homo sapiens
aaucagugcuuacaggaaa

SEQ ID NO: 285883 - RNA, 19 nt, Homo sapiens
uuagaggacuugcuugcua

SEQ ID NO: 285884 - RNA, 19 nt, Homo sapiens
gcaaaagcauguaugaaga

SEQ ID NO: 285885 - RNA, 19 nt, Homo sapiens
aagcagcacugaauucgaa

SEQ ID NO: 285886 - RNA, 19 nt, Homo sapiens
cgaagaaauugauguugau

SEQ ID NO: 285887 - RNA, 19 nt, Homo sapiens
gcuucuugauguaaaguua

SEQ ID NO: 285888 - RNA, 19 nt, Homo sapiens
gcaacaugaugcccaagug

SEQ ID NO: 285889 - RNA, 19 nt, Homo sapiens
gcaugaaacgcgcuuggua

SEQ ID NO: 285890 - RNA, 19 nt, Homo sapiens
caacuaugcuaagaaggaa

SEQ ID NO: 285891 - RNA, 19 nt, Homo sapiens
ggacuuggaguuucgcaaa

SEQ ID NO: 285892 - RNA, 19 nt, Homo sapiens
agaucaagcuucgagaaua

SEQ ID NO: 285893 - RNA, 19 nt, Homo sapiens
gacuagcaaucucuucauu

SEQ ID NO: 285894 - RNA, 19 nt, Homo sapiens
agaaguaugguaauccuua

SEQ ID NO: 285895 - RNA, 19 nt, Homo sapiens
gagcauguuuggaaaggau

SEQ ID NO: 285896 - RNA, 19 nt, Homo sapiens
caucccagcuuucuaaucu

SEQ ID NO: 285897 - RNA, 19 nt, Homo sapiens
caaaucugauggccuuaau

SEQ ID NO: 285898 - RNA, 19 nt, Homo sapiens
uagaagcugugcaauuaug

SEQ ID NO: 285899 - RNA, 19 nt, Homo sapiens
gaugugaagguuauauuga

SEQ ID NO: 285900 - RNA, 19 nt, Homo sapiens
gccagacuguuacaauuug

SEQ ID NO: 285901 - RNA, 19 nt, Homo sapiens
gaaggcaauauuaaccuaa

SEQ ID NO: 285902 - RNA, 19 nt, Homo sapiens
ugaacaggaucaaccaaug

SEQ ID NO: 285903 - RNA, 19 nt, Homo sapiens
uagaggacuugcuugcuaa

SEQ ID NO: 285904 - RNA, 19 nt, Homo sapiens
gcgccaagcugcagaucga

SEQ ID NO: 285905 - RNA, 19 nt, Homo sapiens
agcaacagcugaaugacua

SEQ ID NO: 285906 - RNA, 19 nt, Homo sapiens
gauaguguaacuugcuuaa

SEQ ID NO: 285907 - RNA, 19 nt, Homo sapiens
agcaaucucuucauuauuc

SEQ ID NO: 285908 - RNA, 19 nt, Homo sapiens
gauguugaugggaaauuua

SEQ ID NO: 285909 - RNA, 19 nt, Homo sapiens
gaggcgaguaguaguguua

SEQ ID NO: 285910 - RNA, 19 nt, Homo sapiens
gaauugagagccuuucauc

SEQ ID NO: 285911 - RNA, 19 nt, Homo sapiens
gcaagcccuucaugagaug

SEQ ID NO: 285912 - RNA, 19 nt, Homo sapiens
gagauuaacgagaccagaa

SEQ ID NO: 285913 - RNA, 19 nt, Homo sapiens
gagggaaggguuucucuau

SEQ ID NO: 285914 - RNA, 19 nt, Homo sapiens
cuuaauaacuguguacugu

SEQ ID NO: 285915 - RNA, 19 nt, Homo sapiens
ucagaagcacagaauauuu

SEQ ID NO: 285916 - RNA, 19 nt, Homo sapiens
gaagcugugcaauuaugua

SEQ ID NO: 285917 - RNA, 19 nt, Homo sapiens
gcgcaagcccuucaugaga

SEQ ID NO: 285918 - RNA, 19 nt, Homo sapiens
gcaaaucugauggccuuaa

SEQ ID NO: 285919 - RNA, 19 nt, Homo sapiens
ggccagacuguuacaauuu

SEQ ID NO: 285920 - RNA, 19 nt, Homo sapiens
gaaggguuucucuauuaaa

SEQ ID NO: 285921 - RNA, 19 nt, Homo sapiens
agaaggcaauauuaaccua

SEQ ID NO: 285922 - RNA, 19 nt, Homo sapiens
gaacaggaucaaccaaugg

SEQ ID NO: 285923 - RNA, 19 nt, Homo sapiens
guacguacaacuagaggaa

SEQ ID NO: 285924 - RNA, 19 nt, Homo sapiens
ugaacagcuucuugaugua

SEQ ID NO: 285925 - RNA, 19 nt, Homo sapiens
caagugaggcuguauaagg

SEQ ID NO: 285926 - RNA, 19 nt, Homo sapiens
aaucauguccauacacuuu

SEQ ID NO: 285927 - RNA, 19 nt, Homo sapiens
aaccauaccugaagaagag

SEQ ID NO: 285928 - RNA, 19 nt, Homo sapiens
gaagaugugaagguuauau

SEQ ID NO: 285929 - RNA, 19 nt, Homo sapiens
aaauuuauccgcuugaaga

SEQ ID NO: 285930 - RNA, 19 nt, Homo sapiens
cgagcauccucaagucgua

SEQ ID NO: 285931 - RNA, 19 nt, Homo sapiens
acauggaaaucagugcuua

SEQ ID NO: 285932 - RNA, 19 nt, Homo sapiens
augaacagcuucuugaugu

SEQ ID NO: 285933 - RNA, 19 nt, Homo sapiens
gggaucaaaugcagcaaca

SEQ ID NO: 285934 - RNA, 19 nt, Homo sapiens
gaugagagagcaacaugau

SEQ ID NO: 285935 - RNA, 19 nt, Homo sapiens
cuccuuagcugcagccaaa

SEQ ID NO: 285936 - RNA, 19 nt, Homo sapiens
aaucugauggccuuaauuu

SEQ ID NO: 285937 - RNA, 19 nt, Homo sapiens
cagcuggagugguuguuga

SEQ ID NO: 285938 - RNA, 19 nt, Homo sapiens
caacaugaugcccaaguga

SEQ ID NO: 285939 - RNA, 19 nt, Homo sapiens
ccaguuggaagccuccuua

SEQ ID NO: 285940 - RNA, 19 nt, Homo sapiens
aaagaaaucauguccauac

SEQ ID NO: 285941 - RNA, 19 nt, Homo sapiens
gcucaaagaaguacagucu

SEQ ID NO: 285942 - RNA, 19 nt, Homo sapiens
gaggguugauguggaagaa

SEQ ID NO: 285943 - RNA, 19 nt, Homo sapiens
gagaugagagagcaacaug

SEQ ID NO: 285944 - RNA, 19 nt, Homo sapiens
gcaauuacauuaagacaga

SEQ ID NO: 285945 - RNA, 19 nt, Homo sapiens
gagacaggguuaugagcua

SEQ ID NO: 285946 - RNA, 19 nt, Homo sapiens
ugaaggcauuggacaagua

SEQ ID NO: 285947 - RNA, 19 nt, Homo sapiens
ugagaaauguaaugcgauu

SEQ ID NO: 285948 - RNA, 19 nt, Homo sapiens
gaacuucuccguccucgau

SEQ ID NO: 285949 - RNA, 19 nt, Homo sapiens
guuaugagcuaucaaaugc

SEQ ID NO: 285950 - RNA, 19 nt, Homo sapiens
gcacgaagacugccucaag

SEQ ID NO: 285951 - RNA, 19 nt, Homo sapiens
ugagugcaaucuagguuaa

SEQ ID NO: 285952 - RNA, 19 nt, Homo sapiens
gcuaucaaaugcaauuaca

SEQ ID NO: 285953 - RNA, 19 nt, Homo sapiens
gagacaaauucuuccugaa

SEQ ID NO: 285954 - RNA, 19 nt, Homo sapiens
ggacaagcggguaauuaga

SEQ ID NO: 285955 - RNA, 19 nt, Homo sapiens
aacaugaucuugugucaga

SEQ ID NO: 285956 - RNA, 19 nt, Homo sapiens
gcuaucugcugaaggcauu

SEQ ID NO: 285957 - RNA, 19 nt, Homo sapiens
caaagaaacggcucugauc

SEQ ID NO: 285958 - RNA, 19 nt, Homo sapiens
ugugucagauggacuauga

SEQ ID NO: 285959 - RNA, 19 nt, Homo sapiens
aaacggcucugauccucuu

SEQ ID NO: 285960 - RNA, 19 nt, Homo sapiens
gaucccagccuucgagaug

SEQ ID NO: 285961 - RNA, 19 nt, Homo sapiens
gaaggugagaaucaaagaa

SEQ ID NO: 285962 - RNA, 19 nt, Homo sapiens
ccgcucuccugccacauua

SEQ ID NO: 285963 - RNA, 19 nt, Homo sapiens
guucguaguuccuuccaau

SEQ ID NO: 285964 - RNA, 19 nt, Homo sapiens
uaaauugcaguucguaguu

SEQ ID NO: 285965 - RNA, 19 nt, Homo sapiens
cagucugucuucuguauau

SEQ ID NO: 285966 - RNA, 19 nt, Homo sapiens
ggacaaguacuggcacgaa

SEQ ID NO: 285967 - RNA, 19 nt, Homo sapiens
gauuauacugggcaaauug

SEQ ID NO: 285968 - RNA, 19 nt, Homo sapiens
ucagauggacuaugaggaa

SEQ ID NO: 285969 - RNA, 19 nt, Homo sapiens
uggcguggauuaaacuuau

SEQ ID NO: 285970 - RNA, 19 nt, Homo sapiens
gcuccacccucuacaccaa

SEQ ID NO: 285971 - RNA, 19 nt, Homo sapiens
gaucaaggaccgcuaucug

SEQ ID NO: 285972 - RNA, 19 nt, Homo sapiens
uaugagcuaucaaaugcaa

SEQ ID NO: 285973 - RNA, 19 nt, Homo sapiens
gggagacggccacgagauu

SEQ ID NO: 285974 - RNA, 19 nt, Homo sapiens
ugauggugcuggacaagga

SEQ ID NO: 285975 - RNA, 19 nt, Homo sapiens
gagcuaucaaaugcaauua

SEQ ID NO: 285976 - RNA, 19 nt, Homo sapiens
gguuaugagcuaucaaaug

SEQ ID NO: 285977 - RNA, 19 nt, Homo sapiens
gaggaagggcagcucaaug

SEQ ID NO: 285978 - RNA, 19 nt, Homo sapiens
uguaucaccucgacugcuu

SEQ ID NO: 285979 - RNA, 19 nt, Homo sapiens
cacgaagacugccucaagu

SEQ ID NO: 285980 - RNA, 19 nt, Homo sapiens
caagaucaaggaccgcuau

SEQ ID NO: 285981 - RNA, 19 nt, Homo sapiens
ucaaagaaacggcucugau

SEQ ID NO: 285982 - RNA, 19 nt, Homo sapiens
cucccucucucucuaaauu

SEQ ID NO: 285983 - RNA, 19 nt, Homo sapiens
gcuguaaccgcaagaucaa

SEQ ID NO: 285984 - RNA, 19 nt, Homo sapiens
ccggacaagcggguaauua

SEQ ID NO: 285985 - RNA, 19 nt, Homo sapiens
aaggugagaaucaaagaaa

SEQ ID NO: 285986 - RNA, 19 nt, Homo sapiens
cgaagacugccucaagugu

SEQ ID NO: 285987 - RNA, 19 nt, Homo sapiens
ggaccgcuaucugcugaag

SEQ ID NO: 285988 - RNA, 19 nt, Homo sapiens
gacaagcggguaauuagag

SEQ ID NO: 285989 - RNA, 19 nt, Homo sapiens
ccauuuagaaggugagaau

SEQ ID NO: 285990 - RNA, 19 nt, Homo sapiens
agauuauacugggcaaauu

SEQ ID NO: 285991 - RNA, 19 nt, Homo sapiens
uuacuggcguggauuaaac

SEQ ID NO: 285992 - RNA, 19 nt, Homo sapiens
gcgacuaccugaggcucuu

SEQ ID NO: 285993 - RNA, 19 nt, Homo sapiens
ggagacggccacgagauuc

SEQ ID NO: 285994 - RNA, 19 nt, Homo sapiens
ugagcuaucaaaugcaauu

SEQ ID NO: 285995 - RNA, 19 nt, Homo sapiens
gcugugucguugccagaga

SEQ ID NO: 285996 - RNA, 19 nt, Homo sapiens
agacaggguuaugagcuau

SEQ ID NO: 285997 - RNA, 19 nt, Homo sapiens
uuuagaaggugagaaucaa

SEQ ID NO: 285998 - RNA, 19 nt, Homo sapiens
cccaucucuuugaauauaa

SEQ ID NO: 285999 - RNA, 19 nt, Homo sapiens
ccccaucucuuugaauaua

SEQ ID NO: 286000 - RNA, 19 nt, Homo sapiens
cagauuauacugggcaaau

SEQ ID NO: 286001 - RNA, 19 nt, Homo sapiens
gaaggcauuggacaaguac

SEQ ID NO: 286002 - RNA, 19 nt, Homo sapiens
aaauugcaguucguaguuc

SEQ ID NO: 286003 - RNA, 19 nt, Homo sapiens
cggacaagcggguaauuag

SEQ ID NO: 286004 - RNA, 19 nt, Homo sapiens
gccagagacaggguuauga

SEQ ID NO: 286005 - RNA, 19 nt, Homo sapiens
uuauuacuggcguggauua

SEQ ID NO: 286006 - RNA, 19 nt, Homo sapiens
ggcuguaaccgcaagauca

SEQ ID NO: 286007 - RNA, 19 nt, Homo sapiens
gagccggacaagcggguaa

SEQ ID NO: 286008 - RNA, 19 nt, Homo sapiens
gcugagugcaaucuagguu

SEQ ID NO: 286009 - RNA, 19 nt, Homo sapiens
caccaaggccaaccucauc

SEQ ID NO: 286010 - RNA, 19 nt, Homo sapiens
cuaaauugcaguucguagu

SEQ ID NO: 286011 - RNA, 19 nt, Homo sapiens
gcucuccugccacauuaga

SEQ ID NO: 286012 - RNA, 19 nt, Homo sapiens
cugagugcaaucuagguua

SEQ ID NO: 286013 - RNA, 19 nt, Homo sapiens
aaacagcucugcaggcuua

SEQ ID NO: 286014 - RNA, 19 nt, Homo sapiens
cauaguaacugacaugauu

SEQ ID NO: 286015 - RNA, 19 nt, Homo sapiens
gcaauuagcccagaaggua

SEQ ID NO: 286016 - RNA, 19 nt, Homo sapiens
gaucacaagucuccacauu

SEQ ID NO: 286017 - RNA, 19 nt, Homo sapiens
gaauggaaaccacaacuuu

SEQ ID NO: 286018 - RNA, 19 nt, Homo sapiens
gauagagaguuguugugua

SEQ ID NO: 286019 - RNA, 19 nt, Homo sapiens
caacgggccuugagcagaa

SEQ ID NO: 286020 - RNA, 19 nt, Homo sapiens
cagaagaaaggaacauuua

SEQ ID NO: 286021 - RNA, 19 nt, Homo sapiens
caucaacucugacauagug

SEQ ID NO: 286022 - RNA, 19 nt, Homo sapiens
caaaguguaucaccuggaa

SEQ ID NO: 286023 - RNA, 19 nt, Homo sapiens
gaaaugaaacagagacaga

SEQ ID NO: 286024 - RNA, 19 nt, Homo sapiens
gggaggaguuccacagauu

SEQ ID NO: 286025 - RNA, 19 nt, Homo sapiens
uaagugggcuuugcuauuc

SEQ ID NO: 286026 - RNA, 19 nt, Homo sapiens
gaacuagagaugugcaauu

SEQ ID NO: 286027 - RNA, 19 nt, Homo sapiens
uguaacaacugcucugaaa

SEQ ID NO: 286028 - RNA, 19 nt, Homo sapiens
gcagaagaaaggaacauuu

SEQ ID NO: 286029 - RNA, 19 nt, Homo sapiens
ccacagcccauccauagua

SEQ ID NO: 286030 - RNA, 19 nt, Homo sapiens
uguaucaccuggaauguuu

SEQ ID NO: 286031 - RNA, 19 nt, Homo sapiens
acagauaccuccucaucaa

SEQ ID NO: 286032 - RNA, 19 nt, Homo sapiens
gagcagaauugagaaggaa

SEQ ID NO: 286033 - RNA, 19 nt, Homo sapiens
ggagacgcauuucgguuga

SEQ ID NO: 286034 - RNA, 19 nt, Homo sapiens
ggaauuucauaucuacaga

SEQ ID NO: 286035 - RNA, 19 nt, Homo sapiens
gagggaagccugagccaaa

SEQ ID NO: 286036 - RNA, 19 nt, Homo sapiens
gcauccaaguggcauaauu

SEQ ID NO: 286037 - RNA, 19 nt, Homo sapiens
ucacaagucuccacauucu

SEQ ID NO: 286038 - RNA, 19 nt, Homo sapiens
ugaaggccaucgaccagua

SEQ ID NO: 286039 - RNA, 19 nt, Homo sapiens
gcaacauccucaaagaaca

SEQ ID NO: 286040 - RNA, 19 nt, Homo sapiens
gaugugcaauugauuucuu

SEQ ID NO: 286041 - RNA, 19 nt, Homo sapiens
guacagacuuguugugacu

SEQ ID NO: 286042 - RNA, 19 nt, Homo sapiens
gauggaauuucauaucuac

SEQ ID NO: 286043 - RNA, 19 nt, Homo sapiens
ggugaaagacaaaguguau

SEQ ID NO: 286044 - RNA, 19 nt, Homo sapiens
ggaguuccacagauuguuu

SEQ ID NO: 286045 - RNA, 19 nt, Homo sapiens
cuagagaugugcaauugau

SEQ ID NO: 286046 - RNA, 19 nt, Homo sapiens
cugcagggcuugcuaagga

SEQ ID NO: 286047 - RNA, 19 nt, Homo sapiens
gaagaaaggaacauuuagg

SEQ ID NO: 286048 - RNA, 19 nt, Homo sapiens
gcccauccauaguaacuga

SEQ ID NO: 286049 - RNA, 19 nt, Homo sapiens
gaacagcaacgggccuuga

SEQ ID NO: 286050 - RNA, 19 nt, Homo sapiens
gcgcugugcuaucaugaug

SEQ ID NO: 286051 - RNA, 19 nt, Homo sapiens
ccaccaggauuacaucauc

SEQ ID NO: 286052 - RNA, 19 nt, Homo sapiens
gugcaaagcaggcaauuag

SEQ ID NO: 286053 - RNA, 19 nt, Homo sapiens
uauuggguaucaagacaua

SEQ ID NO: 286054 - RNA, 19 nt, Homo sapiens
ccucaucaacucugacaua

SEQ ID NO: 286055 - RNA, 19 nt, Homo sapiens
ggugaaggcuccgcccuau

SEQ ID NO: 286056 - RNA, 19 nt, Homo sapiens
gaugguagaccuuuauugg

SEQ ID NO: 286057 - RNA, 19 nt, Homo sapiens
ugacaugauuagcagaaga

SEQ ID NO: 286058 - RNA, 19 nt, Homo sapiens
ugacaaugcgggugaaaga

SEQ ID NO: 286059 - RNA, 19 nt, Homo sapiens
gaggaagcccggagagaga

SEQ ID NO: 286060 - RNA, 19 nt, Homo sapiens
cccaaggccuuaagcuuug

SEQ ID NO: 286061 - RNA, 19 nt, Homo sapiens
ugaaagacaaaguguauca

SEQ ID NO: 286062 - RNA, 19 nt, Homo sapiens
cagaggaaccaguggauga

SEQ ID NO: 286063 - RNA, 19 nt, Homo sapiens
gugcuaucaugauggaauu

SEQ ID NO: 286064 - RNA, 19 nt, Homo sapiens
gcaggcaauuagcccagaa

SEQ ID NO: 286065 - RNA, 19 nt, Homo sapiens
caccugcccucagccguua

SEQ ID NO: 286066 - RNA, 19 nt, Homo sapiens
ugacagauaccuccucauc

SEQ ID NO: 286067 - RNA, 19 nt, Homo sapiens
aggaugagggucugaguua

SEQ ID NO: 286068 - RNA, 19 nt, Homo sapiens
gggcuuugcuauucacaag

SEQ ID NO: 286069 - RNA, 19 nt, Homo sapiens
ccacagauuguuucuauac

SEQ ID NO: 286070 - RNA, 19 nt, Homo sapiens
acagacuuguugugacuuu

SEQ ID NO: 286071 - RNA, 19 nt, Homo sapiens
cacagcccauccauaguaa

SEQ ID NO: 286072 - RNA, 19 nt, Homo sapiens
ggccacagcccauccauag

SEQ ID NO: 286073 - RNA, 19 nt, Homo sapiens
ugaaggcuccgcccuauca

SEQ ID NO: 286074 - RNA, 19 nt, Homo sapiens
cagcucugcaggcuuaaua

SEQ ID NO: 286075 - RNA, 19 nt, Homo sapiens
guauuugucguguguagaa

SEQ ID NO: 286076 - RNA, 19 nt, Homo sapiens
uuccacagauuguuucuau

SEQ ID NO: 286077 - RNA, 19 nt, Homo sapiens
ggaggaguuccacagauug

SEQ ID NO: 286078 - RNA, 19 nt, Homo sapiens
cuuugacgcuugcgaacua

SEQ ID NO: 286079 - RNA, 19 nt, Homo sapiens
gagaguuguuguguacaga

SEQ ID NO: 286080 - RNA, 19 nt, Homo sapiens
gcugugcuaucaugaugga

SEQ ID NO: 286081 - RNA, 19 nt, Homo sapiens
caaugcgggugaaagacaa

SEQ ID NO: 286082 - RNA, 19 nt, Homo sapiens
auagagaguuguuguguac

SEQ ID NO: 286083 - RNA, 19 nt, Homo sapiens
aaacugaggaucacaaguc

SEQ ID NO: 286084 - RNA, 19 nt, Homo sapiens
gaacuugcaguagcuagug

SEQ ID NO: 286085 - RNA, 19 nt, Homo sapiens
caacugcucugaaaagaag

SEQ ID NO: 286086 - RNA, 19 nt, Homo sapiens
ucccaaggccuuaagcuuu

SEQ ID NO: 286087 - RNA, 19 nt, Homo sapiens
aacuagagaugugcaauug

SEQ ID NO: 286088 - RNA, 19 nt, Homo sapiens
gacaugauuagcagaagaa

SEQ ID NO: 286089 - RNA, 19 nt, Homo sapiens
uggaugaggugcugcagau

SEQ ID NO: 286090 - RNA, 19 nt, Homo sapiens
gagaugugcaauugauuuc

SEQ ID NO: 286091 - RNA, 19 nt, Homo sapiens
agagaugugcaauugauuu

SEQ ID NO: 286092 - RNA, 19 nt, Homo sapiens
ccuggacccuucagaggaa

SEQ ID NO: 286093 - RNA, 19 nt, Homo sapiens
acaagucuccacauucuga

SEQ ID NO: 286094 - RNA, 19 nt, Homo sapiens
gcucugcaggcuuaauaaa

SEQ ID NO: 286095 - RNA, 19 nt, Homo sapiens
uuagacaccuucauuuuga

SEQ ID NO: 286096 - RNA, 19 nt, Homo sapiens
ucacuguccuccacacaag

SEQ ID NO: 286097 - RNA, 19 nt, Homo sapiens
ggaugagggucugaguuag

SEQ ID NO: 286098 - RNA, 19 nt, Homo sapiens
ugagcagaauugagaagga

SEQ ID NO: 286099 - RNA, 19 nt, Homo sapiens
guuguuguguacagacuug

SEQ ID NO: 286100 - RNA, 19 nt, Homo sapiens
guagaccuuuauuggguau

SEQ ID NO: 286101 - RNA, 19 nt, Homo sapiens
cgaguggacuaagaucaau

SEQ ID NO: 286102 - RNA, 19 nt, Homo sapiens
gcagaauugagaaggaaau

SEQ ID NO: 286103 - RNA, 19 nt, Homo sapiens
gcgaacaggacaucuacga

SEQ ID NO: 286104 - RNA, 19 nt, Homo sapiens
ccucggccaucgaaaggaa

SEQ ID NO: 286105 - RNA, 19 nt, Homo sapiens
gaagccaccaggauuacau

SEQ ID NO: 286106 - RNA, 19 nt, Homo sapiens
uuaagugggcuuugcuauu

SEQ ID NO: 286107 - RNA, 19 nt, Homo sapiens
cacaagggaaggacagaaa

SEQ ID NO: 286108 - RNA, 19 nt, Homo sapiens
cagaauugagaaggaaaua

SEQ ID NO: 286109 - RNA, 19 nt, Homo sapiens
ggugcaaagcaggcaauua

SEQ ID NO: 286110 - RNA, 19 nt, Homo sapiens
cuacagauagagaguuguu

SEQ ID NO: 286111 - RNA, 19 nt, Homo sapiens
guaacugacaugauuagca

SEQ ID NO: 286112 - RNA, 19 nt, Homo sapiens
caagcggauucgugccuau

SEQ ID NO: 286113 - RNA, 19 nt, Homo sapiens
agaaagaucugccagcauu

SEQ ID NO: 286114 - RNA, 19 nt, Homo sapiens
gaucacuucugcugcuuug

SEQ ID NO: 286115 - RNA, 19 nt, Homo sapiens
caaccuaagucauaaaucc

SEQ ID NO: 286116 - RNA, 19 nt, Homo sapiens
aagcagacgucgccacuau

SEQ ID NO: 286117 - RNA, 19 nt, Homo sapiens
gagcagguauaucaauuuu

SEQ ID NO: 286118 - RNA, 19 nt, Homo sapiens
ggagcagguauaucaauuu

SEQ ID NO: 286119 - RNA, 19 nt, Homo sapiens
ggucagacucggaaucuug

SEQ ID NO: 286120 - RNA, 19 nt, Homo sapiens
gaccgcugcuucugcugua

SEQ ID NO: 286121 - RNA, 19 nt, Homo sapiens
cggagcagguauaucaauu

SEQ ID NO: 286122 - RNA, 19 nt, Homo sapiens
ccuacaaccuaagucauaa

SEQ ID NO: 286123 - RNA, 19 nt, Homo sapiens
caucagagaccaccaccaa

SEQ ID NO: 286124 - RNA, 19 nt, Homo sapiens
gcagacgucgccacuauca

SEQ ID NO: 286125 - RNA, 19 nt, Homo sapiens
gcgacccucuggugucuga

SEQ ID NO: 286126 - RNA, 19 nt, Homo sapiens
guacugcacagcacuggaa

SEQ ID NO: 286127 - RNA, 19 nt, Homo sapiens
gcuccauucuccagucaga

SEQ ID NO: 286128 - RNA, 19 nt, Homo sapiens
gcacaucggccuggaccaa

SEQ ID NO: 286129 - RNA, 19 nt, Homo sapiens
caucaugugucggcuaauc

SEQ ID NO: 286130 - RNA, 19 nt, Homo sapiens
gaaagaucugccagcauug

SEQ ID NO: 286131 - RNA, 19 nt, Homo sapiens
acacugcaauggagaccuu

SEQ ID NO: 286132 - RNA, 19 nt, Homo sapiens
ugguugaccucaucuacuu

SEQ ID NO: 286133 - RNA, 19 nt, Homo sapiens
ggaccuggaacgcaucaug

SEQ ID NO: 286134 - RNA, 19 nt, Homo sapiens
gaacugcaucguggcuuga

SEQ ID NO: 286135 - RNA, 19 nt, Homo sapiens
ggaugauggcuucuuccua

SEQ ID NO: 286136 - RNA, 19 nt, Homo sapiens
gaucugccagcauugcaaa

SEQ ID NO: 286137 - RNA, 19 nt, Homo sapiens
ggagggcagcgcuauguca

SEQ ID NO: 286138 - RNA, 19 nt, Homo sapiens
cgcaucaugugucggcuaa

SEQ ID NO: 286139 - RNA, 19 nt, Homo sapiens
ccaagccugugacgagauc

SEQ ID NO: 286140 - RNA, 19 nt, Homo sapiens
ggaagaggaggaaaagaaa

SEQ ID NO: 286141 - RNA, 19 nt, Homo sapiens
caauggagaccuucaacuc

SEQ ID NO: 286142 - RNA, 19 nt, Homo sapiens
agaggaugauggcuucuuc

SEQ ID NO: 286143 - RNA, 19 nt, Homo sapiens
agaaauacaggaucaagca

SEQ ID NO: 286144 - RNA, 19 nt, Homo sapiens
ggagaaauacaggaucaag

SEQ ID NO: 286145 - RNA, 19 nt, Homo sapiens
caacaguccuggggagaaa

SEQ ID NO: 286146 - RNA, 19 nt, Homo sapiens
cccuacaaccuaagucaua

SEQ ID NO: 286147 - RNA, 19 nt, Homo sapiens
agacgucgccacuaucaau

SEQ ID NO: 286148 - RNA, 19 nt, Homo sapiens
ucagagaccaccaccaaag

SEQ ID NO: 286149 - RNA, 19 nt, Homo sapiens
gggcuccauucuccaguca

SEQ ID NO: 286150 - RNA, 19 nt, Homo sapiens
gaccuggaacgcaucaugu

SEQ ID NO: 286151 - RNA, 19 nt, Homo sapiens
ccaaaggcaccagcacaga

SEQ ID NO: 286152 - RNA, 19 nt, Homo sapiens
ucaucuacuucuaccaugu

SEQ ID NO: 286153 - RNA, 19 nt, Homo sapiens
gcaauggagaccuucaacu

SEQ ID NO: 286154 - RNA, 19 nt, Homo sapiens
gagaaagaucugccagcau

SEQ ID NO: 286155 - RNA, 19 nt, Homo sapiens
gccaccaucaucauaauca

SEQ ID NO: 286156 - RNA, 19 nt, Homo sapiens
aaccugcgcccagaugaua

SEQ ID NO: 286157 - RNA, 19 nt, Homo sapiens
gccgaggccuaaucuucug

SEQ ID NO: 286158 - RNA, 19 nt, Homo sapiens
caguuccaguuccgaauca

SEQ ID NO: 286159 - RNA, 19 nt, Homo sapiens
ccgccaccaucaucauaau

SEQ ID NO: 286160 - RNA, 19 nt, Homo sapiens
caucuacuucuaccauguu

SEQ ID NO: 286161 - RNA, 19 nt, Homo sapiens
ggagugcggaaagcagauu

SEQ ID NO: 286162 - RNA, 19 nt, Homo sapiens
gcugugcaucggaggagua

SEQ ID NO: 286163 - RNA, 19 nt, Homo sapiens
ggaucacuucugcugcuuu

SEQ ID NO: 286164 - RNA, 19 nt, Homo sapiens
ggggagaaauacaggauca

SEQ ID NO: 286165 - RNA, 19 nt, Homo sapiens
cuacaaccuaagucauaaa

SEQ ID NO: 286166 - RNA, 19 nt, Homo sapiens
gcucaggacacugcaaugg

SEQ ID NO: 286167 - RNA, 19 nt, Homo sapiens
uaagucauaaauccucuuc

SEQ ID NO: 286168 - RNA, 19 nt, Homo sapiens
auaaucaccaucaccauca

SEQ ID NO: 286169 - RNA, 19 nt, Homo sapiens
gagcccucccgcuuucuga

SEQ ID NO: 286170 - RNA, 19 nt, Homo sapiens
cuacugaacuggaugauua

SEQ ID NO: 286171 - RNA, 19 nt, Homo sapiens
gaugauuacuccacaaaua

SEQ ID NO: 286172 - RNA, 19 nt, Homo sapiens
ccagaaauguugcuaagua

SEQ ID NO: 286173 - RNA, 19 nt, Homo sapiens
gaaagaagccgcaggauca

SEQ ID NO: 286174 - RNA, 19 nt, Homo sapiens
ggaaucaacuuguguuuca

SEQ ID NO: 286175 - RNA, 19 nt, Homo sapiens
ggaaacaucagucagaaua

SEQ ID NO: 286176 - RNA, 19 nt, Homo sapiens
gaaacaaaguggauugaug

SEQ ID NO: 286177 - RNA, 19 nt, Homo sapiens
uaagagaacuccaaacaau

SEQ ID NO: 286178 - RNA, 19 nt, Homo sapiens
guauuuaccuguugaauuc

SEQ ID NO: 286179 - RNA, 19 nt, Homo sapiens
uaaacuugcugaugcauuu

SEQ ID NO: 286180 - RNA, 19 nt, Homo sapiens
gaacaaggaagcucugauu

SEQ ID NO: 286181 - RNA, 19 nt, Homo sapiens
ucaagaaacuggacaccua

SEQ ID NO: 286182 - RNA, 19 nt, Homo sapiens
ccaaagaaaucaauggaau

SEQ ID NO: 286183 - RNA, 19 nt, Homo sapiens
gaacaccccuucacaauga

SEQ ID NO: 286184 - RNA, 19 nt, Homo sapiens
gacuuuggguuuacaauaa

SEQ ID NO: 286185 - RNA, 19 nt, Homo sapiens
caacuuauccuucagaaau

SEQ ID NO: 286186 - RNA, 19 nt, Homo sapiens
gaagacaacagugagcuua

SEQ ID NO: 286187 - RNA, 19 nt, Homo sapiens
gaagcuaccuggagugaag

SEQ ID NO: 286188 - RNA, 19 nt, Homo sapiens
gaugaugcuuggaaguaua

SEQ ID NO: 286189 - RNA, 19 nt, Homo sapiens
cuucagaguucuaauauug

SEQ ID NO: 286190 - RNA, 19 nt, Homo sapiens
gaacaaagcccagccucuu

SEQ ID NO: 286191 - RNA, 19 nt, Homo sapiens
gagccuuucuguucaauug

SEQ ID NO: 286192 - RNA, 19 nt, Homo sapiens
gagaagcucuaagacguuu

SEQ ID NO: 286193 - RNA, 19 nt, Homo sapiens
gaaagaacaaguaccauca

SEQ ID NO: 286194 - RNA, 19 nt, Homo sapiens
caacagugagcuuagaaua

SEQ ID NO: 286195 - RNA, 19 nt, Homo sapiens
cagaaauguugcuaaguaa

SEQ ID NO: 286196 - RNA, 19 nt, Homo sapiens
cgaaagcacuguugcagau

SEQ ID NO: 286197 - RNA, 19 nt, Homo sapiens
gcacacaaauggaaucaac

SEQ ID NO: 286198 - RNA, 19 nt, Homo sapiens
gaugaagggagcucuauuu

SEQ ID NO: 286199 - RNA, 19 nt, Homo sapiens
caaaugugcuuucuguauc

SEQ ID NO: 286200 - RNA, 19 nt, Homo sapiens
gaucuaguuugacuuucua

SEQ ID NO: 286201 - RNA, 19 nt, Homo sapiens
gaucuuacacgauggauga

SEQ ID NO: 286202 - RNA, 19 nt, Homo sapiens
caaauggaaucaacuugug

SEQ ID NO: 286203 - RNA, 19 nt, Homo sapiens
caaaggagccgccaugauc

SEQ ID NO: 286204 - RNA, 19 nt, Homo sapiens
gaagggagcucuauuuucu

SEQ ID NO: 286205 - RNA, 19 nt, Homo sapiens
caucuggucuugauuuaau

SEQ ID NO: 286206 - RNA, 19 nt, Homo sapiens
ggugguugcugcucaugua

SEQ ID NO: 286207 - RNA, 19 nt, Homo sapiens
ucaaacagcaugucucuga

SEQ ID NO: 286208 - RNA, 19 nt, Homo sapiens
ugagagugaugaauuguug

SEQ ID NO: 286209 - RNA, 19 nt, Homo sapiens
ucuaagacguuuaaggaaa

SEQ ID NO: 286210 - RNA, 19 nt, Homo sapiens
gcuaaguaauucccaauag

SEQ ID NO: 286211 - RNA, 19 nt, Homo sapiens
gauguaagccuccauacga

SEQ ID NO: 286212 - RNA, 19 nt, Homo sapiens
aggaucagcuuguuauuga

SEQ ID NO: 286213 - RNA, 19 nt, Homo sapiens
aaauucagcuuccuucuca

SEQ ID NO: 286214 - RNA, 19 nt, Homo sapiens
cuucagaaauucccaaaga

SEQ ID NO: 286215 - RNA, 19 nt, Homo sapiens
aagaggaaguuguucauga

SEQ ID NO: 286216 - RNA, 19 nt, Homo sapiens
agagagagaauuccaagua

SEQ ID NO: 286217 - RNA, 19 nt, Homo sapiens
gaaacuggacaccuaguga

SEQ ID NO: 286218 - RNA, 19 nt, Homo sapiens
aagcuuaucuagccagaaa

SEQ ID NO: 286219 - RNA, 19 nt, Homo sapiens
gcucuaagacguuuaagga

SEQ ID NO: 286220 - RNA, 19 nt, Homo sapiens
ccauuuauuugcuugauga

SEQ ID NO: 286221 - RNA, 19 nt, Homo sapiens
aaagagaggacccguguaa

SEQ ID NO: 286222 - RNA, 19 nt, Homo sapiens
gggagcaacuuauccuuca

SEQ ID NO: 286223 - RNA, 19 nt, Homo sapiens
guguauaccuucgaaacua

SEQ ID NO: 286224 - RNA, 19 nt, Homo sapiens
cuaaguaauucccaauaga

SEQ ID NO: 286225 - RNA, 19 nt, Homo sapiens
ggggaaaagugcaguauuu

SEQ ID NO: 286226 - RNA, 19 nt, Homo sapiens
cagaggagauccaagaaag

SEQ ID NO: 286227 - RNA, 19 nt, Homo sapiens
aggaauaaauccagaucua

SEQ ID NO: 286228 - RNA, 19 nt, Homo sapiens
gaugcaacuucuggaauuu

SEQ ID NO: 286229 - RNA, 19 nt, Homo sapiens
guaaauaaacuugcugaug

SEQ ID NO: 286230 - RNA, 19 nt, Homo sapiens
ccaaaugugcuuucuguau

SEQ ID NO: 286231 - RNA, 19 nt, Homo sapiens
caaccgccaugugauguaa

SEQ ID NO: 286232 - RNA, 19 nt, Homo sapiens
ggaggccuguugauuccua

SEQ ID NO: 286233 - RNA, 19 nt, Homo sapiens
gaaaugggagcaacagcuu

SEQ ID NO: 286234 - RNA, 19 nt, Homo sapiens
gagagagaauuccaaguac

SEQ ID NO: 286235 - RNA, 19 nt, Homo sapiens
ccgaaagccuucagaguuc

SEQ ID NO: 286236 - RNA, 19 nt, Homo sapiens
ugaugcaacuucuggaauu

SEQ ID NO: 286237 - RNA, 19 nt, Homo sapiens
ggagauauugaagacauua

SEQ ID NO: 286238 - RNA, 19 nt, Homo sapiens
gaucagaaaccaccaacug

SEQ ID NO: 286239 - RNA, 19 nt, Homo sapiens
acaaagagccuguuagucu

SEQ ID NO: 286240 - RNA, 19 nt, Homo sapiens
ccacaucuggucuugauuu

SEQ ID NO: 286241 - RNA, 19 nt, Homo sapiens
ggaugaugcuuggaaguau

SEQ ID NO: 286242 - RNA, 19 nt, Homo sapiens
gaaauucccaaagaagauu

SEQ ID NO: 286243 - RNA, 19 nt, Homo sapiens
gaaaucaauggaauucaug

SEQ ID NO: 286244 - RNA, 19 nt, Homo sapiens
cacaucuggucuugauuua

SEQ ID NO: 286245 - RNA, 19 nt, Homo sapiens
ucaaaguccuguggaagaa

SEQ ID NO: 286246 - RNA, 19 nt, Homo sapiens
gaagcucuaagacguuuaa

SEQ ID NO: 286247 - RNA, 19 nt, Homo sapiens
uagaagcauuguagucuug

SEQ ID NO: 286248 - RNA, 19 nt, Homo sapiens
gaugugaggcgcuauggaa

SEQ ID NO: 286249 - RNA, 19 nt, Homo sapiens
ggaaguauaauggagauau

SEQ ID NO: 286250 - RNA, 19 nt, Homo sapiens
cuaagacguuuaaggaaau

SEQ ID NO: 286251 - RNA, 19 nt, Homo sapiens
gagaagaaauugaaaagca

SEQ ID NO: 286252 - RNA, 19 nt, Homo sapiens
uaaaaucuauccccaaaug

SEQ ID NO: 286253 - RNA, 19 nt, Homo sapiens
caucugaauccauuucuuu

SEQ ID NO: 286254 - RNA, 19 nt, Homo sapiens
gcagguagcccagcagaau

SEQ ID NO: 286255 - RNA, 19 nt, Homo sapiens
acagugagcuuagaauauc

SEQ ID NO: 286256 - RNA, 19 nt, Homo sapiens
gaaagcacuguugcagaua

SEQ ID NO: 286257 - RNA, 19 nt, Homo sapiens
ucagaaaccaccaacugua

SEQ ID NO: 286258 - RNA, 19 nt, Homo sapiens
uuaaguguguugccuguga

SEQ ID NO: 286259 - RNA, 19 nt, Homo sapiens
gaggagauccaagaaagaa

SEQ ID NO: 286260 - RNA, 19 nt, Homo sapiens
ucacagaggagauccaaga

SEQ ID NO: 286261 - RNA, 19 nt, Homo sapiens
gaaacaucagucagaauau

SEQ ID NO: 286262 - RNA, 19 nt, Homo sapiens
guacuuggaugaggaacug

SEQ ID NO: 286263 - RNA, 19 nt, Homo sapiens
gagagaauuccaaguacuu

SEQ ID NO: 286264 - RNA, 19 nt, Homo sapiens
ggaauuuacaacucagaaa

SEQ ID NO: 286265 - RNA, 19 nt, Homo sapiens
ucaguucagugauaugaga

SEQ ID NO: 286266 - RNA, 19 nt, Homo sapiens
ggaaaucuccccacaaaga

SEQ ID NO: 286267 - RNA, 19 nt, Homo sapiens
ucaagaaggagaauguauu

SEQ ID NO: 286268 - RNA, 19 nt, Homo sapiens
gaagagaagggagcaacuu

SEQ ID NO: 286269 - RNA, 19 nt, Homo sapiens
caacgacugcuaucucaga

SEQ ID NO: 286270 - RNA, 19 nt, Homo sapiens
cuacugaacuggaugauua

SEQ ID NO: 286271 - RNA, 19 nt, Homo sapiens
gaugauuacuccacaaaua

SEQ ID NO: 286272 - RNA, 19 nt, Homo sapiens
ccagaaauguugcuaagua

SEQ ID NO: 286273 - RNA, 19 nt, Homo sapiens
gaaagaagccgcaggauca

SEQ ID NO: 286274 - RNA, 19 nt, Homo sapiens
ggaaucaacuuguguuuca

SEQ ID NO: 286275 - RNA, 19 nt, Homo sapiens
ggaaacaucagucagaaua

SEQ ID NO: 286276 - RNA, 19 nt, Homo sapiens
gaaacaaaguggauugaug

SEQ ID NO: 286277 - RNA, 19 nt, Homo sapiens
uaagagaacuccaaacaau

SEQ ID NO: 286278 - RNA, 19 nt, Homo sapiens
guauuuaccuguugaauuc

SEQ ID NO: 286279 - RNA, 19 nt, Homo sapiens
uaaacuugcugaugcauuu

SEQ ID NO: 286280 - RNA, 19 nt, Homo sapiens
gaacaaggaagcucugauu

SEQ ID NO: 286281 - RNA, 19 nt, Homo sapiens
ucaagaaacuggacaccua

SEQ ID NO: 286282 - RNA, 19 nt, Homo sapiens
ccaaagaaaucaauggaau

SEQ ID NO: 286283 - RNA, 19 nt, Homo sapiens
gaacaccccuucacaauga

SEQ ID NO: 286284 - RNA, 19 nt, Homo sapiens
gacuuuggguuuacaauaa

SEQ ID NO: 286285 - RNA, 19 nt, Homo sapiens
caacuuauccuucagaaau

SEQ ID NO: 286286 - RNA, 19 nt, Homo sapiens
gaagacaacagugagcuua

SEQ ID NO: 286287 - RNA, 19 nt, Homo sapiens
gaagcuaccuggagugaag

SEQ ID NO: 286288 - RNA, 19 nt, Homo sapiens
gaugaugcuuggaaguaua

SEQ ID NO: 286289 - RNA, 19 nt, Homo sapiens
cuucagaguucuaauauug

SEQ ID NO: 286290 - RNA, 19 nt, Homo sapiens
gaacaaagcccagccucuu

SEQ ID NO: 286291 - RNA, 19 nt, Homo sapiens
gagccuuucuguucaauug

SEQ ID NO: 286292 - RNA, 19 nt, Homo sapiens
gagaagcucuaagacguuu

SEQ ID NO: 286293 - RNA, 19 nt, Homo sapiens
gaaagaacaaguaccauca

SEQ ID NO: 286294 - RNA, 19 nt, Homo sapiens
caacagugagcuuagaaua

SEQ ID NO: 286295 - RNA, 19 nt, Homo sapiens
cagaaauguugcuaaguaa

SEQ ID NO: 286296 - RNA, 19 nt, Homo sapiens
cgaaagcacuguugcagau

SEQ ID NO: 286297 - RNA, 19 nt, Homo sapiens
gcacacaaauggaaucaac

SEQ ID NO: 286298 - RNA, 19 nt, Homo sapiens
gaugaagggagcucuauuu

SEQ ID NO: 286299 - RNA, 19 nt, Homo sapiens
caaaugugcuuucuguauc

SEQ ID NO: 286300 - RNA, 19 nt, Homo sapiens
gaucuaguuugacuuucua

SEQ ID NO: 286301 - RNA, 19 nt, Homo sapiens
gaucuuacacgauggauga

SEQ ID NO: 286302 - RNA, 19 nt, Homo sapiens
caaauggaaucaacuugug

SEQ ID NO: 286303 - RNA, 19 nt, Homo sapiens
gaagggagcucuauuuucu

SEQ ID NO: 286304 - RNA, 19 nt, Homo sapiens
caucuggucuugauuuaau

SEQ ID NO: 286305 - RNA, 19 nt, Homo sapiens
ggugguugcugcucaugua

SEQ ID NO: 286306 - RNA, 19 nt, Homo sapiens
ucaaacagcaugucucuga

SEQ ID NO: 286307 - RNA, 19 nt, Homo sapiens
ugagagugaugaauuguug

SEQ ID NO: 286308 - RNA, 19 nt, Homo sapiens
ucuaagacguuuaaggaaa

SEQ ID NO: 286309 - RNA, 19 nt, Homo sapiens
gcuaaguaauucccaauag

SEQ ID NO: 286310 - RNA, 19 nt, Homo sapiens
gauguaagccuccauacga

SEQ ID NO: 286311 - RNA, 19 nt, Homo sapiens
aggaucagcuuguuauuga

SEQ ID NO: 286312 - RNA, 19 nt, Homo sapiens
aaauucagcuuccuucuca

SEQ ID NO: 286313 - RNA, 19 nt, Homo sapiens
cuucagaaauucccaaaga

SEQ ID NO: 286314 - RNA, 19 nt, Homo sapiens
aagaggaaguuguucauga

SEQ ID NO: 286315 - RNA, 19 nt, Homo sapiens
agagagagaauuccaagua

SEQ ID NO: 286316 - RNA, 19 nt, Homo sapiens
gaaacuggacaccuaguga

SEQ ID NO: 286317 - RNA, 19 nt, Homo sapiens
aagcuuaucuagccagaaa

SEQ ID NO: 286318 - RNA, 19 nt, Homo sapiens
gcucuaagacguuuaagga

SEQ ID NO: 286319 - RNA, 19 nt, Homo sapiens
ccauuuauuugcuugauga

SEQ ID NO: 286320 - RNA, 19 nt, Homo sapiens
aaagagaggacccguguaa

SEQ ID NO: 286321 - RNA, 19 nt, Homo sapiens
gggagcaacuuauccuuca

SEQ ID NO: 286322 - RNA, 19 nt, Homo sapiens
guguauaccuucgaaacua

SEQ ID NO: 286323 - RNA, 19 nt, Homo sapiens
cuaaguaauucccaauaga

SEQ ID NO: 286324 - RNA, 19 nt, Homo sapiens
ggggaaaagugcaguauuu

SEQ ID NO: 286325 - RNA, 19 nt, Homo sapiens
cagaggagauccaagaaag

SEQ ID NO: 286326 - RNA, 19 nt, Homo sapiens
aggaauaaauccagaucua

SEQ ID NO: 286327 - RNA, 19 nt, Homo sapiens
gaugcaacuucuggaauuu

SEQ ID NO: 286328 - RNA, 19 nt, Homo sapiens
guaaauaaacuugcugaug

SEQ ID NO: 286329 - RNA, 19 nt, Homo sapiens
ccaaaugugcuuucuguau

SEQ ID NO: 286330 - RNA, 19 nt, Homo sapiens
caaccgccaugugauguaa

SEQ ID NO: 286331 - RNA, 19 nt, Homo sapiens
ggaggccuguugauuccua

SEQ ID NO: 286332 - RNA, 19 nt, Homo sapiens
gaaaugggagcaacagcuu

SEQ ID NO: 286333 - RNA, 19 nt, Homo sapiens
gagagagaauuccaaguac

SEQ ID NO: 286334 - RNA, 19 nt, Homo sapiens
ccgaaagccuucagaguuc

SEQ ID NO: 286335 - RNA, 19 nt, Homo sapiens
ugaugcaacuucuggaauu

SEQ ID NO: 286336 - RNA, 19 nt, Homo sapiens
ggagauauugaagacauua

SEQ ID NO: 286337 - RNA, 19 nt, Homo sapiens
gaucagaaaccaccaacug

SEQ ID NO: 286338 - RNA, 19 nt, Homo sapiens
acaaagagccuguuagucu

SEQ ID NO: 286339 - RNA, 19 nt, Homo sapiens
ccacaucuggucuugauuu

SEQ ID NO: 286340 - RNA, 19 nt, Homo sapiens
ggaugaugcuuggaaguau

SEQ ID NO: 286341 - RNA, 19 nt, Homo sapiens
gaaauucccaaagaagauu

SEQ ID NO: 286342 - RNA, 19 nt, Homo sapiens
gaaaucaauggaauucaug

SEQ ID NO: 286343 - RNA, 19 nt, Homo sapiens
cacaucuggucuugauuua

SEQ ID NO: 286344 - RNA, 19 nt, Homo sapiens
ucaaaguccuguggaagaa

SEQ ID NO: 286345 - RNA, 19 nt, Homo sapiens
gaagcucuaagacguuuaa

SEQ ID NO: 286346 - RNA, 19 nt, Homo sapiens
uagaagcauuguagucuug

SEQ ID NO: 286347 - RNA, 19 nt, Homo sapiens
gaugugaggcgcuauggaa

SEQ ID NO: 286348 - RNA, 19 nt, Homo sapiens
ggaaguauaauggagauau

SEQ ID NO: 286349 - RNA, 19 nt, Homo sapiens
cuaagacguuuaaggaaau

SEQ ID NO: 286350 - RNA, 19 nt, Homo sapiens
gagaagaaauugaaaagca

SEQ ID NO: 286351 - RNA, 19 nt, Homo sapiens
uaaaaucuauccccaaaug

SEQ ID NO: 286352 - RNA, 19 nt, Homo sapiens
caucugaauccauuucuuu

SEQ ID NO: 286353 - RNA, 19 nt, Homo sapiens
gcagguagcccagcagaau

SEQ ID NO: 286354 - RNA, 19 nt, Homo sapiens
acagugagcuuagaauauc

SEQ ID NO: 286355 - RNA, 19 nt, Homo sapiens
gaaagcacuguugcagaua

SEQ ID NO: 286356 - RNA, 19 nt, Homo sapiens
ucagaaaccaccaacugua

SEQ ID NO: 286357 - RNA, 19 nt, Homo sapiens
gaggagauccaagaaagaa

SEQ ID NO: 286358 - RNA, 19 nt, Homo sapiens
ucacagaggagauccaaga

SEQ ID NO: 286359 - RNA, 19 nt, Homo sapiens
ucaagaaggagaauguauu

SEQ ID NO: 286360 - RNA, 19 nt, Homo sapiens
gaaacaucagucagaauau

SEQ ID NO: 286361 - RNA, 19 nt, Homo sapiens
guacuuggaugaggaacug

SEQ ID NO: 286362 - RNA, 19 nt, Homo sapiens
gagagaauuccaaguacuu

SEQ ID NO: 286363 - RNA, 19 nt, Homo sapiens
ggaauuuacaacucagaaa

SEQ ID NO: 286364 - RNA, 19 nt, Homo sapiens
ucaguucagugauaugaga

SEQ ID NO: 286365 - RNA, 19 nt, Homo sapiens
ggaaaucuccccacaaaga

SEQ ID NO: 286366 - RNA, 19 nt, Homo sapiens
gaagagaagggagcaacuu

SEQ ID NO: 286367 - RNA, 19 nt, Homo sapiens
caacgacugcuaucucaga

SEQ ID NO: 286368 - RNA, 19 nt, Homo sapiens
caagaaagaacaaguacca

SEQ ID NO: 286369 - RNA, 19 nt, Homo sapiens
ggauauuccugggaucuuc

SEQ ID NO: 286370 - RNA, 19 nt, Homo sapiens
cuacugaacuggaugauua

SEQ ID NO: 286371 - RNA, 19 nt, Homo sapiens
gaugauuacuccacaaaua

SEQ ID NO: 286372 - RNA, 19 nt, Homo sapiens
ccagaaauguugcuaagua

SEQ ID NO: 286373 - RNA, 19 nt, Homo sapiens
gaaagaagccgcaggauca

SEQ ID NO: 286374 - RNA, 19 nt, Homo sapiens
ggaaucaacuuguguuuca

SEQ ID NO: 286375 - RNA, 19 nt, Homo sapiens
ggaaacaucagucagaaua

SEQ ID NO: 286376 - RNA, 19 nt, Homo sapiens
gaaacaaaguggauugaug

SEQ ID NO: 286377 - RNA, 19 nt, Homo sapiens
uaagagaacuccaaacaau

SEQ ID NO: 286378 - RNA, 19 nt, Homo sapiens
guauuuaccuguugaauuc

SEQ ID NO: 286379 - RNA, 19 nt, Homo sapiens
uaaacuugcugaugcauuu

SEQ ID NO: 286380 - RNA, 19 nt, Homo sapiens
gaacaaggaagcucugauu

SEQ ID NO: 286381 - RNA, 19 nt, Homo sapiens
ucaagaaacuggacaccua

SEQ ID NO: 286382 - RNA, 19 nt, Homo sapiens
ccaaagaaaucaauggaau

SEQ ID NO: 286383 - RNA, 19 nt, Homo sapiens
gaacaccccuucacaauga

SEQ ID NO: 286384 - RNA, 19 nt, Homo sapiens
gacuuuggguuuacaauaa

SEQ ID NO: 286385 - RNA, 19 nt, Homo sapiens
caacuuauccuucagaaau

SEQ ID NO: 286386 - RNA, 19 nt, Homo sapiens
gaagacaacagugagcuua

SEQ ID NO: 286387 - RNA, 19 nt, Homo sapiens
gaagcuaccuggagugaag

SEQ ID NO: 286388 - RNA, 19 nt, Homo sapiens
gaugaugcuuggaaguaua

SEQ ID NO: 286389 - RNA, 19 nt, Homo sapiens
cuucagaguucuaauauug

SEQ ID NO: 286390 - RNA, 19 nt, Homo sapiens
gaacaaagcccagccucuu

SEQ ID NO: 286391 - RNA, 19 nt, Homo sapiens
gagccuuucuguucaauug

SEQ ID NO: 286392 - RNA, 19 nt, Homo sapiens
gagaagcucuaagacguuu

SEQ ID NO: 286393 - RNA, 19 nt, Homo sapiens
gaaagaacaaguaccauca

SEQ ID NO: 286394 - RNA, 19 nt, Homo sapiens
caacagugagcuuagaaua

SEQ ID NO: 286395 - RNA, 19 nt, Homo sapiens
cagaaauguugcuaaguaa

SEQ ID NO: 286396 - RNA, 19 nt, Homo sapiens
cgaaagcacuguugcagau

SEQ ID NO: 286397 - RNA, 19 nt, Homo sapiens
gcacacaaauggaaucaac

SEQ ID NO: 286398 - RNA, 19 nt, Homo sapiens
gaugaagggagcucuauuu

SEQ ID NO: 286399 - RNA, 19 nt, Homo sapiens
caaaugugcuuucuguauc

SEQ ID NO: 286400 - RNA, 19 nt, Homo sapiens
gaucuaguuugacuuucua

SEQ ID NO: 286401 - RNA, 19 nt, Homo sapiens
gaucuuacacgauggauga

SEQ ID NO: 286402 - RNA, 19 nt, Homo sapiens
caaauggaaucaacuugug

SEQ ID NO: 286403 - RNA, 19 nt, Homo sapiens
gaagggagcucuauuuucu

SEQ ID NO: 286404 - RNA, 19 nt, Homo sapiens
caucuggucuugauuuaau

SEQ ID NO: 286405 - RNA, 19 nt, Homo sapiens
ggugguugcugcucaugua

SEQ ID NO: 286406 - RNA, 19 nt, Homo sapiens
ucaaacagcaugucucuga

SEQ ID NO: 286407 - RNA, 19 nt, Homo sapiens
ugagagugaugaauuguug

SEQ ID NO: 286408 - RNA, 19 nt, Homo sapiens
ucuaagacguuuaaggaaa

SEQ ID NO: 286409 - RNA, 19 nt, Homo sapiens
gcuaaguaauucccaauag

SEQ ID NO: 286410 - RNA, 19 nt, Homo sapiens
gauguaagccuccauacga

SEQ ID NO: 286411 - RNA, 19 nt, Homo sapiens
aggaucagcuuguuauuga

SEQ ID NO: 286412 - RNA, 19 nt, Homo sapiens
aaauucagcuuccuucuca

SEQ ID NO: 286413 - RNA, 19 nt, Homo sapiens
cuucagaaauucccaaaga

SEQ ID NO: 286414 - RNA, 19 nt, Homo sapiens
aagaggaaguuguucauga

SEQ ID NO: 286415 - RNA, 19 nt, Homo sapiens
agagagagaauuccaagua

SEQ ID NO: 286416 - RNA, 19 nt, Homo sapiens
gaaacuggacaccuaguga

SEQ ID NO: 286417 - RNA, 19 nt, Homo sapiens
aagcuuaucuagccagaaa

SEQ ID NO: 286418 - RNA, 19 nt, Homo sapiens
gcucuaagacguuuaagga

SEQ ID NO: 286419 - RNA, 19 nt, Homo sapiens
ccauuuauuugcuugauga

SEQ ID NO: 286420 - RNA, 19 nt, Homo sapiens
aaagagaggacccguguaa

SEQ ID NO: 286421 - RNA, 19 nt, Homo sapiens
gggagcaacuuauccuuca

SEQ ID NO: 286422 - RNA, 19 nt, Homo sapiens
guguauaccuucgaaacua

SEQ ID NO: 286423 - RNA, 19 nt, Homo sapiens
cuaaguaauucccaauaga

SEQ ID NO: 286424 - RNA, 19 nt, Homo sapiens
ggggaaaagugcaguauuu

SEQ ID NO: 286425 - RNA, 19 nt, Homo sapiens
cagaggagauccaagaaag

SEQ ID NO: 286426 - RNA, 19 nt, Homo sapiens
aggaauaaauccagaucua

SEQ ID NO: 286427 - RNA, 19 nt, Homo sapiens
gaugcaacuucuggaauuu

SEQ ID NO: 286428 - RNA, 19 nt, Homo sapiens
guaaauaaacuugcugaug

SEQ ID NO: 286429 - RNA, 19 nt, Homo sapiens
ccaaaugugcuuucuguau

SEQ ID NO: 286430 - RNA, 19 nt, Homo sapiens
caaccgccaugugauguaa

SEQ ID NO: 286431 - RNA, 19 nt, Homo sapiens
ggaggccuguugauuccua

SEQ ID NO: 286432 - RNA, 19 nt, Homo sapiens
gaaaugggagcaacagcuu

SEQ ID NO: 286433 - RNA, 19 nt, Homo sapiens
gagagagaauuccaaguac

SEQ ID NO: 286434 - RNA, 19 nt, Homo sapiens
ccgaaagccuucagaguuc

SEQ ID NO: 286435 - RNA, 19 nt, Homo sapiens
ugaugcaacuucuggaauu

SEQ ID NO: 286436 - RNA, 19 nt, Homo sapiens
ggagauauugaagacauua

SEQ ID NO: 286437 - RNA, 19 nt, Homo sapiens
acaaagagccuguuagucu

SEQ ID NO: 286438 - RNA, 19 nt, Homo sapiens
ccacaucuggucuugauuu

SEQ ID NO: 286439 - RNA, 19 nt, Homo sapiens
ggaugaugcuuggaaguau

SEQ ID NO: 286440 - RNA, 19 nt, Homo sapiens
gaaauucccaaagaagauu

SEQ ID NO: 286441 - RNA, 19 nt, Homo sapiens
gaaaucaauggaauucaug

SEQ ID NO: 286442 - RNA, 19 nt, Homo sapiens
cacaucuggucuugauuua

SEQ ID NO: 286443 - RNA, 19 nt, Homo sapiens
ucaaaguccuguggaagaa

SEQ ID NO: 286444 - RNA, 19 nt, Homo sapiens
gaagcucuaagacguuuaa

SEQ ID NO: 286445 - RNA, 19 nt, Homo sapiens
uagaagcauuguagucuug

SEQ ID NO: 286446 - RNA, 19 nt, Homo sapiens
gaugugaggcgcuauggaa

SEQ ID NO: 286447 - RNA, 19 nt, Homo sapiens
ggaaguauaauggagauau

SEQ ID NO: 286448 - RNA, 19 nt, Homo sapiens
cuaagacguuuaaggaaau

SEQ ID NO: 286449 - RNA, 19 nt, Homo sapiens
gagaagaaauugaaaagca

SEQ ID NO: 286450 - RNA, 19 nt, Homo sapiens
uaaaaucuauccccaaaug

SEQ ID NO: 286451 - RNA, 19 nt, Homo sapiens
caucugaauccauuucuuu

SEQ ID NO: 286452 - RNA, 19 nt, Homo sapiens
gcagguagcccagcagaau

SEQ ID NO: 286453 - RNA, 19 nt, Homo sapiens
acagugagcuuagaauauc

SEQ ID NO: 286454 - RNA, 19 nt, Homo sapiens
gaaagcacuguugcagaua

SEQ ID NO: 286455 - RNA, 19 nt, Homo sapiens
gaggagauccaagaaagaa

SEQ ID NO: 286456 - RNA, 19 nt, Homo sapiens
ucacagaggagauccaaga

SEQ ID NO: 286457 - RNA, 19 nt, Homo sapiens
ucaagaaggagaauguauu

SEQ ID NO: 286458 - RNA, 19 nt, Homo sapiens
gaaacaucagucagaauau

SEQ ID NO: 286459 - RNA, 19 nt, Homo sapiens
guacuuggaugaggaacug

SEQ ID NO: 286460 - RNA, 19 nt, Homo sapiens
gagagaauuccaaguacuu

SEQ ID NO: 286461 - RNA, 19 nt, Homo sapiens
ggaauuuacaacucagaaa

SEQ ID NO: 286462 - RNA, 19 nt, Homo sapiens
ucaguucagugauaugaga

SEQ ID NO: 286463 - RNA, 19 nt, Homo sapiens
ggaaaucuccccacaaaga

SEQ ID NO: 286464 - RNA, 19 nt, Homo sapiens
gaagagaagggagcaacuu

SEQ ID NO: 286465 - RNA, 19 nt, Homo sapiens
caagaaagaacaaguacca

SEQ ID NO: 286466 - RNA, 19 nt, Homo sapiens
ggauauuccugggaucuuc

SEQ ID NO: 286467 - RNA, 19 nt, Homo sapiens
ggacccguguaacaacuga

SEQ ID NO: 286468 - RNA, 19 nt, Homo sapiens
gagaggacccguguaacaa

SEQ ID NO: 286469 - RNA, 19 nt, Homo sapiens
gaagcgccaggcagagaua

SEQ ID NO: 286470 - RNA, 19 nt, Homo sapiens
cgacagcgauaccuccuua

SEQ ID NO: 286471 - RNA, 19 nt, Homo sapiens
gagcaaagaugaagaagcu

SEQ ID NO: 286472 - RNA, 19 nt, Homo sapiens
gaagagcgaggaugaagau

SEQ ID NO: 286473 - RNA, 19 nt, Homo sapiens
gaaacuguacugcaaacaa

SEQ ID NO: 286474 - RNA, 19 nt, Homo sapiens
gaaccaaagagcaaagaug

SEQ ID NO: 286475 - RNA, 19 nt, Homo sapiens
gcaaacaagacuaccaaca

SEQ ID NO: 286476 - RNA, 19 nt, Homo sapiens
aaacuguacugcaaacaag

SEQ ID NO: 286477 - RNA, 19 nt, Homo sapiens
gaacgacuccaucuuccau

SEQ ID NO: 286478 - RNA, 19 nt, Homo sapiens
gcaagggugacuacgagaa

SEQ ID NO: 286479 - RNA, 19 nt, Homo sapiens
caaacaagacuaccaacag

SEQ ID NO: 286480 - RNA, 19 nt, Homo sapiens
gcagaucguggccauggaa

SEQ ID NO: 286481 - RNA, 19 nt, Homo sapiens
aaagagcaaagaugaagaa

SEQ ID NO: 286482 - RNA, 19 nt, Homo sapiens
aaccaaagagcaaagauga

SEQ ID NO: 286483 - RNA, 19 nt, Homo sapiens
ccaaagagcaaagaugaag

SEQ ID NO: 286484 - RNA, 19 nt, Homo sapiens
caaagagcaaagaugaaga

SEQ ID NO: 286485 - RNA, 19 nt, Homo sapiens
cgucgaagccuugccgaaa

SEQ ID NO: 286486 - RNA, 19 nt, Homo sapiens
caugcagaguuccuacuuc

SEQ ID NO: 286487 - RNA, 19 nt, Homo sapiens
gucgaagccuugccgaaag

SEQ ID NO: 286488 - RNA, 19 nt, Homo sapiens
gacuccaucuuccaugaca

SEQ ID NO: 286489 - RNA, 19 nt, Homo sapiens
ggaugaagauggggacaug

SEQ ID NO: 286490 - RNA, 19 nt, Homo sapiens
gcggcugcauggagaagau

SEQ ID NO: 286491 - RNA, 19 nt, Homo sapiens
guacugcaaacaagacuac

SEQ ID NO: 286492 - RNA, 19 nt, Homo sapiens
acgacuccaucuuccauga

SEQ ID NO: 286493 - RNA, 19 nt, Homo sapiens
acgcaagggcgacgaauuc

SEQ ID NO: 286494 - RNA, 19 nt, Homo sapiens
ugaagagcgaggaugaaga

SEQ ID NO: 286495 - RNA, 19 nt, Homo sapiens
agcgauaccuccuuaacca

SEQ ID NO: 286496 - RNA, 19 nt, Homo sapiens
caagggugacuacgagaag

SEQ ID NO: 286497 - RNA, 19 nt, Homo sapiens
uuucagaaccaaagagcaa

SEQ ID NO: 286498 - RNA, 19 nt, Homo sapiens
ggaauaagcuuguacagaa

SEQ ID NO: 286499 - RNA, 19 nt, Homo sapiens
gaaauucaguacccacuua

SEQ ID NO: 286500 - RNA, 19 nt, Homo sapiens
agacagaccucaucuauaa

SEQ ID NO: 286501 - RNA, 19 nt, Homo sapiens
gaaaucaggugucaucaau

SEQ ID NO: 286502 - RNA, 19 nt, Homo sapiens
ggaaugugguacaaaguua

SEQ ID NO: 286503 - RNA, 19 nt, Homo sapiens
gaaauucagccuucagaua

SEQ ID NO: 286504 - RNA, 19 nt, Homo sapiens
auagaaagcuggugacuaa

SEQ ID NO: 286505 - RNA, 19 nt, Homo sapiens
gcacuuacuugguugcuuu

SEQ ID NO: 286506 - RNA, 19 nt, Homo sapiens
uaagggaucuucucucuug

SEQ ID NO: 286507 - RNA, 19 nt, Homo sapiens
ggaaaguucuacccuaaga

SEQ ID NO: 286508 - RNA, 19 nt, Homo sapiens
ggacagaucgccauuguug

SEQ ID NO: 286509 - RNA, 19 nt, Homo sapiens
caacaaacuuggacugaug

SEQ ID NO: 286510 - RNA, 19 nt, Homo sapiens
ggcaguauguaguuauuua

SEQ ID NO: 286511 - RNA, 19 nt, Homo sapiens
gagccaaccuuaucaacaa

SEQ ID NO: 286512 - RNA, 19 nt, Homo sapiens
gaugagcacuuacuugguu

SEQ ID NO: 286513 - RNA, 19 nt, Homo sapiens
caaagaaggcugccauaaa

SEQ ID NO: 286514 - RNA, 19 nt, Homo sapiens
ggaaacaacugugaagcuu

SEQ ID NO: 286515 - RNA, 19 nt, Homo sapiens
aagcugagauccuggaaua

SEQ ID NO: 286516 - RNA, 19 nt, Homo sapiens
gaacuggaauaagcuugua

SEQ ID NO: 286517 - RNA, 19 nt, Homo sapiens
caagagggccuuugauuug

SEQ ID NO: 286518 - RNA, 19 nt, Homo sapiens
ggaaugaccuauggcuaaa

SEQ ID NO: 286519 - RNA, 19 nt, Homo sapiens
gcaauacaccgcuuuauca

SEQ ID NO: 286520 - RNA, 19 nt, Homo sapiens
gauaagaaaucagguguca

SEQ ID NO: 286521 - RNA, 19 nt, Homo sapiens
uagcacaggucauaauauu

SEQ ID NO: 286522 - RNA, 19 nt, Homo sapiens
caaagagccuuguuuacau

SEQ ID NO: 286523 - RNA, 19 nt, Homo sapiens
ugaagaauaugguaacgaa

SEQ ID NO: 286524 - RNA, 19 nt, Homo sapiens
ccacuuucauggaguauuu

SEQ ID NO: 286525 - RNA, 19 nt, Homo sapiens
guacaaaguuagcucugaa

SEQ ID NO: 286526 - RNA, 19 nt, Homo sapiens
ggagauaacuuccgaacac

SEQ ID NO: 286527 - RNA, 19 nt, Homo sapiens
aaacuuaccuuagugaaga

SEQ ID NO: 286528 - RNA, 19 nt, Homo sapiens
caggaucgcugccaaguug

SEQ ID NO: 286529 - RNA, 19 nt, Homo sapiens
gcacuaauccaucaguuga

SEQ ID NO: 286530 - RNA, 19 nt, Homo sapiens
gaucuucucucuuguugau

SEQ ID NO: 286531 - RNA, 19 nt, Homo sapiens
gcacaggucauaauauuuc

SEQ ID NO: 286532 - RNA, 19 nt, Homo sapiens
caauaaagcaugcacugua

SEQ ID NO: 286533 - RNA, 19 nt, Homo sapiens
caaguuguuugcacucuuu

SEQ ID NO: 286534 - RNA, 19 nt, Homo sapiens
ggucagcccugcuagaguu

SEQ ID NO: 286535 - RNA, 19 nt, Homo sapiens
aauaaagcaugcacuguaa

SEQ ID NO: 286536 - RNA, 19 nt, Homo sapiens
aaaguuagcucugaagaau

SEQ ID NO: 286537 - RNA, 19 nt, Homo sapiens
caaagacacauuuaucuga

SEQ ID NO: 286538 - RNA, 19 nt, Homo sapiens
caacaaagacacauuuauc

SEQ ID NO: 286539 - RNA, 19 nt, Homo sapiens
ucaaagagaacuggaauaa

SEQ ID NO: 286540 - RNA, 19 nt, Homo sapiens
ugaagaggauuaugaguca

SEQ ID NO: 286541 - RNA, 19 nt, Homo sapiens
cugaugagguggaauauga

SEQ ID NO: 286542 - RNA, 19 nt, Homo sapiens
gcggaagcuuuacugguua

SEQ ID NO: 286543 - RNA, 19 nt, Homo sapiens
ucacagcuaugcaucuauu

SEQ ID NO: 286544 - RNA, 19 nt, Homo sapiens
uggaucaacuuaccuguuu

SEQ ID NO: 286545 - RNA, 19 nt, Homo sapiens
aaagagaacuggaauaagc

SEQ ID NO: 286546 - RNA, 19 nt, Homo sapiens
gggaagcacuaauccauca

SEQ ID NO: 286547 - RNA, 19 nt, Homo sapiens
uuucuuagaugcucgauuu

SEQ ID NO: 286548 - RNA, 19 nt, Homo sapiens
gcacaaccgcaccucauuu

SEQ ID NO: 286549 - RNA, 19 nt, Homo sapiens
gaagaugagcacuuacuug

SEQ ID NO: 286550 - RNA, 19 nt, Homo sapiens
gaagucaucagucguucua

SEQ ID NO: 286551 - RNA, 19 nt, Homo sapiens
cuacacagaugaaaguaau

SEQ ID NO: 286552 - RNA, 19 nt, Homo sapiens
aaagaaggcugccauaaaa

SEQ ID NO: 286553 - RNA, 19 nt, Homo sapiens
ugacaacuguguucaaagu

SEQ ID NO: 286554 - RNA, 19 nt, Homo sapiens
ggaggaggaugaagaggau

SEQ ID NO: 286555 - RNA, 19 nt, Homo sapiens
aaggaaaguucuacccuaa

SEQ ID NO: 286556 - RNA, 19 nt, Homo sapiens
gaagcugucuuuuaucauu

SEQ ID NO: 286557 - RNA, 19 nt, Homo sapiens
caucaucuguucagucuuc

SEQ ID NO: 286558 - RNA, 19 nt, Homo sapiens
uauauaugcuguaccagaa

SEQ ID NO: 286559 - RNA, 19 nt, Homo sapiens
gaauaagcuuguacagaag

SEQ ID NO: 286560 - RNA, 19 nt, Homo sapiens
gaacagugggucgacauuu

SEQ ID NO: 286561 - RNA, 19 nt, Homo sapiens
caugacaacuguguucaaa

SEQ ID NO: 286562 - RNA, 19 nt, Homo sapiens
caagcuaccuguggcauau

SEQ ID NO: 286563 - RNA, 19 nt, Homo sapiens
gaugaucugugggauaguu

SEQ ID NO: 286564 - RNA, 19 nt, Homo sapiens
acaaugaagugguggaaug

SEQ ID NO: 286565 - RNA, 19 nt, Homo sapiens
gugugaagaugagcacuua

SEQ ID NO: 286566 - RNA, 19 nt, Homo sapiens
ccaaagagccuuguuuaca

SEQ ID NO: 286567 - RNA, 19 nt, Homo sapiens
aagcuuuacugguuaauga

SEQ ID NO: 286568 - RNA, 19 nt, Homo sapiens
gagaggagacacuucugua

SEQ ID NO: 286569 - RNA, 19 nt, Homo sapiens
auacaccgcuuuaucaaau

SEQ ID NO: 286570 - RNA, 19 nt, Homo sapiens
caacaucuuugaacuugca

SEQ ID NO: 286571 - RNA, 19 nt, Homo sapiens
ucaggugucaucaaucuua

SEQ ID NO: 286572 - RNA, 19 nt, Homo sapiens
gcaaucugguaacaaugaa

SEQ ID NO: 286573 - RNA, 19 nt, Homo sapiens
aaaccaaacacuagaugua

SEQ ID NO: 286574 - RNA, 19 nt, Homo sapiens
caguaacacuucuucaaug

SEQ ID NO: 286575 - RNA, 19 nt, Homo sapiens
aggagacacuucuguauga

SEQ ID NO: 286576 - RNA, 19 nt, Homo sapiens
uuacuugguugcuuucauu

SEQ ID NO: 286577 - RNA, 19 nt, Homo sapiens
caacaacaucuuugaacuu

SEQ ID NO: 286578 - RNA, 19 nt, Homo sapiens
gauguaaagagaaugauga

SEQ ID NO: 286579 - RNA, 19 nt, Homo sapiens
caaauaugccuaagaaguc

SEQ ID NO: 286580 - RNA, 19 nt, Homo sapiens
cggcaaauauaucuaguuc

SEQ ID NO: 286581 - RNA, 19 nt, Homo sapiens
ggacuaauucagccauuug

SEQ ID NO: 286582 - RNA, 19 nt, Homo sapiens
ccagaaaguuacugacaca

SEQ ID NO: 286583 - RNA, 19 nt, Homo sapiens
ccucaagacuggugacuag

SEQ ID NO: 286584 - RNA, 19 nt, Homo sapiens
ccacuacgcuaugaacuca

SEQ ID NO: 286585 - RNA, 19 nt, Homo sapiens
gguacaaaguuagcucuga

SEQ ID NO: 286586 - RNA, 19 nt, Homo sapiens
gacaaaggcuggucauucc

SEQ ID NO: 286587 - RNA, 19 nt, Homo sapiens
gggucaaagugaauauaaa

SEQ ID NO: 286588 - RNA, 19 nt, Homo sapiens
ccaauaucaucaucuguuc

SEQ ID NO: 286589 - RNA, 19 nt, Homo sapiens
cuuagaugcucgauuuaaa

SEQ ID NO: 286590 - RNA, 19 nt, Homo sapiens
gggaacugcucuacuacug

SEQ ID NO: 286591 - RNA, 19 nt, Homo sapiens
ugucaucaaucuuacagaa

SEQ ID NO: 286592 - RNA, 19 nt, Homo sapiens
uaagaaaucaggugucauc

SEQ ID NO: 286593 - RNA, 19 nt, Homo sapiens
ggucacaaaccaaacacua

SEQ ID NO: 286594 - RNA, 19 nt, Homo sapiens
gggaucuucucucuuguug

SEQ ID NO: 286595 - RNA, 19 nt, Homo sapiens
gaaccuaaccucgaugaca

SEQ ID NO: 286596 - RNA, 19 nt, Homo sapiens
uaacgaagacaauaaagca

SEQ ID NO: 286597 - RNA, 19 nt, Homo sapiens
uuaaugaggucacaaacca

SEQ ID NO: 286598 - RNA, 19 nt, Homo sapiens
gaaccuauguguccucuaa

SEQ ID NO: 286599 - RNA, 19 nt, Homo sapiens
gaagaucaaccaucaaaua

SEQ ID NO: 286600 - RNA, 19 nt, Homo sapiens
gauguguucuuguguauua

SEQ ID NO: 286601 - RNA, 19 nt, Homo sapiens
gaaguaugccucaaauaua

SEQ ID NO: 286602 - RNA, 19 nt, Homo sapiens
gacaugaacuacagacuaa

SEQ ID NO: 286603 - RNA, 19 nt, Homo sapiens
aaagaugcauugaaccuua

SEQ ID NO: 286604 - RNA, 19 nt, Homo sapiens
gaugaagacucugcuguuu

SEQ ID NO: 286605 - RNA, 19 nt, Homo sapiens
caacauaugcccucagaaa

SEQ ID NO: 286606 - RNA, 19 nt, Homo sapiens
gaugauguguucuugugua

SEQ ID NO: 286607 - RNA, 19 nt, Homo sapiens
gaggggaacuuauguguua

SEQ ID NO: 286608 - RNA, 19 nt, Homo sapiens
ggagaaguaugccucaaau

SEQ ID NO: 286609 - RNA, 19 nt, Homo sapiens
gaagccaggucauuugaug

SEQ ID NO: 286610 - RNA, 19 nt, Homo sapiens
gaaguacacucagcaaaca

SEQ ID NO: 286611 - RNA, 19 nt, Homo sapiens
gcugaagaguuuaccuaua

SEQ ID NO: 286612 - RNA, 19 nt, Homo sapiens
agacuuggguugaacuaua

SEQ ID NO: 286613 - RNA, 19 nt, Homo sapiens
gauugcagcauuuauguua

SEQ ID NO: 286614 - RNA, 19 nt, Homo sapiens
gaaaggccuuacacucuga

SEQ ID NO: 286615 - RNA, 19 nt, Homo sapiens
ugaaacaccuuaagaaguc

SEQ ID NO: 286616 - RNA, 19 nt, Homo sapiens
gaaguuacagacacguuua

SEQ ID NO: 286617 - RNA, 19 nt, Homo sapiens
gcacuuaccgcauuaggaa

SEQ ID NO: 286618 - RNA, 19 nt, Homo sapiens
gacuaaagauugcagcauu

SEQ ID NO: 286619 - RNA, 19 nt, Homo sapiens
gaacuacagacuaaagauu

SEQ ID NO: 286620 - RNA, 19 nt, Homo sapiens
ggauuuggcucuuccuaug

SEQ ID NO: 286621 - RNA, 19 nt, Homo sapiens
gugaguuucuauccaaaua

SEQ ID NO: 286622 - RNA, 19 nt, Homo sapiens
gccaacaucuggaucaaug

SEQ ID NO: 286623 - RNA, 19 nt, Homo sapiens
gguaugaguuuggaagaaa

SEQ ID NO: 286624 - RNA, 19 nt, Homo sapiens
ccuauaggcuguuauuuca

SEQ ID NO: 286625 - RNA, 19 nt, Homo sapiens
caucugcaauggugaguuu

SEQ ID NO: 286626 - RNA, 19 nt, Homo sapiens
ccagggaugucuucucuug

SEQ ID NO: 286627 - RNA, 19 nt, Homo sapiens
gaaccuauucccuuucuug

SEQ ID NO: 286628 - RNA, 19 nt, Homo sapiens
ggaccuuccugauucauuc

SEQ ID NO: 286629 - RNA, 19 nt, Homo sapiens
agagaaugcuugaauuaga

SEQ ID NO: 286630 - RNA, 19 nt, Homo sapiens
gaagaaaauuguagcagaa

SEQ ID NO: 286631 - RNA, 19 nt, Homo sapiens
gacuuggguugaacuauaa

SEQ ID NO: 286632 - RNA, 19 nt, Homo sapiens
guuagagaaugcuugaauu

SEQ ID NO: 286633 - RNA, 19 nt, Homo sapiens
ucaaauaccuguggagagu

SEQ ID NO: 286634 - RNA, 19 nt, Homo sapiens
ccaccaggccuucuuauug

SEQ ID NO: 286635 - RNA, 19 nt, Homo sapiens
ggaguuagagggaaguuga

SEQ ID NO: 286636 - RNA, 19 nt, Homo sapiens
gagaaugcuugaauuagag

SEQ ID NO: 286637 - RNA, 19 nt, Homo sapiens
gcaccacuccagaacauuu

SEQ ID NO: 286638 - RNA, 19 nt, Homo sapiens
gaagauaccauccagaaaa

SEQ ID NO: 286639 - RNA, 19 nt, Homo sapiens
ggacguggaacuccugauu

SEQ ID NO: 286640 - RNA, 19 nt, Homo sapiens
guuauaaggccaagacauu

SEQ ID NO: 286641 - RNA, 19 nt, Homo sapiens
cugaagaguuuaccuauag

SEQ ID NO: 286642 - RNA, 19 nt, Homo sapiens
acguggaacuccugauuua

SEQ ID NO: 286643 - RNA, 19 nt, Homo sapiens
gccaagauccuagguauga

SEQ ID NO: 286644 - RNA, 19 nt, Homo sapiens
caagacuucugcucagguu

SEQ ID NO: 286645 - RNA, 19 nt, Homo sapiens
gcucccagcuguccugaau

SEQ ID NO: 286646 - RNA, 19 nt, Homo sapiens
gacuauuucuacccuuuaa

SEQ ID NO: 286647 - RNA, 19 nt, Homo sapiens
cagcauuuauguuagagaa

SEQ ID NO: 286648 - RNA, 19 nt, Homo sapiens
ccugggaucugaaugaaga

SEQ ID NO: 286649 - RNA, 19 nt, Homo sapiens
gcaagacuuuugaggauaa

SEQ ID NO: 286650 - RNA, 19 nt, Homo sapiens
agaaguaugccucaaauau

SEQ ID NO: 286651 - RNA, 19 nt, Homo sapiens
ugaagacucugcuguuuac

SEQ ID NO: 286652 - RNA, 19 nt, Homo sapiens
ucacagcuuucauugcuau

SEQ ID NO: 286653 - RNA, 19 nt, Homo sapiens
gcacuucuguggccuacuc

SEQ ID NO: 286654 - RNA, 19 nt, Homo sapiens
gacaguugccuuaauguga

SEQ ID NO: 286655 - RNA, 19 nt, Homo sapiens
guacaaccuacaugucuuu

SEQ ID NO: 286656 - RNA, 19 nt, Homo sapiens
gagaaguaugccucaaaua

SEQ ID NO: 286657 - RNA, 19 nt, Homo sapiens
aaauaccuguggagaguuu

SEQ ID NO: 286658 - RNA, 19 nt, Homo sapiens
cagaagaucaaccaucaaa

SEQ ID NO: 286659 - RNA, 19 nt, Homo sapiens
uaucagggccauacuggua

SEQ ID NO: 286660 - RNA, 19 nt, Homo sapiens
gauccuagguaugaguuug

SEQ ID NO: 286661 - RNA, 19 nt, Homo sapiens
gaucaaccaucaaauaccu

SEQ ID NO: 286662 - RNA, 19 nt, Homo sapiens
gcgugaacauuuacgaguu

SEQ ID NO: 286663 - RNA, 19 nt, Homo sapiens
ugacaugaacuacagacua

SEQ ID NO: 286664 - RNA, 19 nt, Homo sapiens
gugaugauguguucuugug

SEQ ID NO: 286665 - RNA, 19 nt, Homo sapiens
uagccaagauccuagguau

SEQ ID NO: 286666 - RNA, 19 nt, Homo sapiens
ccuugagucuggugucaua

SEQ ID NO: 286667 - RNA, 19 nt, Homo sapiens
cgugaacauuuacgaguuu

SEQ ID NO: 286668 - RNA, 19 nt, Homo sapiens
ccaaauaucccagaagauc

SEQ ID NO: 286669 - RNA, 19 nt, Homo sapiens
cugguaagcuugcguagga

SEQ ID NO: 286670 - RNA, 19 nt, Homo sapiens
aaacaggugacaugaacua

SEQ ID NO: 286671 - RNA, 19 nt, Homo sapiens
ugugaaagcugcuauuacu

SEQ ID NO: 286672 - RNA, 19 nt, Homo sapiens
ggugacauuuccucuacaa

SEQ ID NO: 286673 - RNA, 19 nt, Homo sapiens
gaauacaggcagccaagga

SEQ ID NO: 286674 - RNA, 19 nt, Homo sapiens
gagauguuccucuuuaauc

SEQ ID NO: 286675 - RNA, 19 nt, Homo sapiens
acuaaagauugcagcauuu

SEQ ID NO: 286676 - RNA, 19 nt, Homo sapiens
aaacauucauaggcaguaa

SEQ ID NO: 286677 - RNA, 19 nt, Homo sapiens
cccagaaccuauucccuuu

SEQ ID NO: 286678 - RNA, 19 nt, Homo sapiens
gcaaugguaaggacuugaa

SEQ ID NO: 286679 - RNA, 19 nt, Homo sapiens
ucaauaaggagcucaacaa

SEQ ID NO: 286680 - RNA, 19 nt, Homo sapiens
gaggauaaggugacauuuc

SEQ ID NO: 286681 - RNA, 19 nt, Homo sapiens
agagacaacaggagaagua

SEQ ID NO: 286682 - RNA, 19 nt, Homo sapiens
ggaugaagacucugcuguu

SEQ ID NO: 286683 - RNA, 19 nt, Homo sapiens
cccagaagaucaaccauca

SEQ ID NO: 286684 - RNA, 19 nt, Homo sapiens
caccauagauucccagcau

SEQ ID NO: 286685 - RNA, 19 nt, Homo sapiens
acaguugccuuaaugugaa

SEQ ID NO: 286686 - RNA, 19 nt, Homo sapiens
ggguugaacuauaacuguu

SEQ ID NO: 286687 - RNA, 19 nt, Homo sapiens
aagaagugccuuuaauuug

SEQ ID NO: 286688 - RNA, 19 nt, Homo sapiens
aaugggagcuucuggaaag

SEQ ID NO: 286689 - RNA, 19 nt, Homo sapiens
gaagauaaaaugccaauca

SEQ ID NO: 286690 - RNA, 19 nt, Homo sapiens
gaugucaaccucaccauuc

SEQ ID NO: 286691 - RNA, 19 nt, Homo sapiens
guggagaguuuaucuuucu

SEQ ID NO: 286692 - RNA, 19 nt, Homo sapiens
gaccugcccuacacacuca

SEQ ID NO: 286693 - RNA, 19 nt, Homo sapiens
gcagucacccugaaguaug

SEQ ID NO: 286694 - RNA, 19 nt, Homo sapiens
gaugucuucucuugcaaug

SEQ ID NO: 286695 - RNA, 19 nt, Homo sapiens
cuuaagaagucuauaaugc

SEQ ID NO: 286696 - RNA, 19 nt, Homo sapiens
gaguuucuauccaaauauc

SEQ ID NO: 286697 - RNA, 19 nt, Homo sapiens
uggaacuccugauuuacua

SEQ ID NO: 286698 - RNA, 19 nt, Homo sapiens
gcaaauccuucaugucuua

SEQ ID NO: 286699 - RNA, 19 nt, Homo sapiens
gcuuagagcucucaugaug

SEQ ID NO: 286700 - RNA, 19 nt, Homo sapiens
cgaaggaguuggagguguu

SEQ ID NO: 286701 - RNA, 19 nt, Homo sapiens
cuaccuggccguccaaaua

SEQ ID NO: 286702 - RNA, 19 nt, Homo sapiens
gcaucuaguucugcuguuu

SEQ ID NO: 286703 - RNA, 19 nt, Homo sapiens
gugccucagucaauaaauu

SEQ ID NO: 286704 - RNA, 19 nt, Homo sapiens
gggcuuagagcucucauga

SEQ ID NO: 286705 - RNA, 19 nt, Homo sapiens
ccacggaggcgaaggaguu

SEQ ID NO: 286706 - RNA, 19 nt, Homo sapiens
caucuaguucugcuguuua

SEQ ID NO: 286707 - RNA, 19 nt, Homo sapiens
cccagugccucagucaaua

SEQ ID NO: 286708 - RNA, 19 nt, Homo sapiens
uguuuagccucuuugguuu

SEQ ID NO: 286709 - RNA, 19 nt, Homo sapiens
ugucuuaaccuaccuggaa

SEQ ID NO: 286710 - RNA, 19 nt, Homo sapiens
gggcaccgaugggcuuaga

SEQ ID NO: 286711 - RNA, 19 nt, Homo sapiens
gggcucuccuuccuucuca

SEQ ID NO: 286712 - RNA, 19 nt, Homo sapiens
gaaggaguuggagguguuu

SEQ ID NO: 286713 - RNA, 19 nt, Homo sapiens
ccagugccucagucaauaa

SEQ ID NO: 286714 - RNA, 19 nt, Homo sapiens
uuugguuucuguacaacua

SEQ ID NO: 286715 - RNA, 19 nt, Homo sapiens
guuugcaaauccuucaugu

SEQ ID NO: 286716 - RNA, 19 nt, Homo sapiens
uuagagcucucaugaugcu

SEQ ID NO: 286717 - RNA, 19 nt, Homo sapiens
uugcaaauccuucaugucu

SEQ ID NO: 286718 - RNA, 19 nt, Homo sapiens
ccucuuugguuucuguaca

SEQ ID NO: 286719 - RNA, 19 nt, Homo sapiens
cuguuuagccucuuugguu

SEQ ID NO: 286720 - RNA, 19 nt, Homo sapiens
uacccgagguuugcaaauc

SEQ ID NO: 286721 - RNA, 19 nt, Homo sapiens
guaccacggaggcgaagga

SEQ ID NO: 286722 - RNA, 19 nt, Homo sapiens
gcucuccggcugcaucuag

SEQ ID NO: 286723 - RNA, 19 nt, Homo sapiens
gagcuacggaggcgucucu

SEQ ID NO: 286724 - RNA, 19 nt, Homo sapiens
ugccucagucaauaaauuu

SEQ ID NO: 286725 - RNA, 19 nt, Homo sapiens
ccggugggagcgucaagua

SEQ ID NO: 286726 - RNA, 19 nt, Homo sapiens
uagccucuuugguuucugu

SEQ ID NO: 286727 - RNA, 19 nt, Homo sapiens
ugcaaauccuucaugucuu

SEQ ID NO: 286728 - RNA, 19 nt, Homo sapiens
ccucgcagcaggucacuca

SEQ ID NO: 286729 - RNA, 19 nt, Homo sapiens
gcacauaacuggauuuuga

SEQ ID NO: 286730 - RNA, 19 nt, Homo sapiens
gggcagaugucagagauua

SEQ ID NO: 286731 - RNA, 19 nt, Homo sapiens
gaaacuauauccuaaaggu

SEQ ID NO: 286732 - RNA, 19 nt, Homo sapiens
ggauugauauuacagaugu

SEQ ID NO: 286733 - RNA, 19 nt, Homo sapiens
gcacaauuucaccguauua

SEQ ID NO: 286734 - RNA, 19 nt, Homo sapiens
cgacaacccuuauuacaac

SEQ ID NO: 286735 - RNA, 19 nt, Homo sapiens
caucauuacuugggaaauu

SEQ ID NO: 286736 - RNA, 19 nt, Homo sapiens
caaagcacauaacuggauu

SEQ ID NO: 286737 - RNA, 19 nt, Homo sapiens
uagacuaacuucaguagga

SEQ ID NO: 286738 - RNA, 19 nt, Homo sapiens
caaagcaaguuucugucuu

SEQ ID NO: 286739 - RNA, 19 nt, Homo sapiens
ccacaaagcaaguuucugu

SEQ ID NO: 286740 - RNA, 19 nt, Homo sapiens
gcaaaacucccaauggaua

SEQ ID NO: 286741 - RNA, 19 nt, Homo sapiens
ccuggaaacuauauccuaa

SEQ ID NO: 286742 - RNA, 19 nt, Homo sapiens
aguccuggcuguuaugaua

SEQ ID NO: 286743 - RNA, 19 nt, Homo sapiens
caauuucaccguauuagaa

SEQ ID NO: 286744 - RNA, 19 nt, Homo sapiens
ugcagaagauguccaugua

SEQ ID NO: 286745 - RNA, 19 nt, Homo sapiens
cuacuacgauacuuaugaa

SEQ ID NO: 286746 - RNA, 19 nt, Homo sapiens
caucaacauuaccacagua

SEQ ID NO: 286747 - RNA, 19 nt, Homo sapiens
cagaagauguccauguaca

SEQ ID NO: 286748 - RNA, 19 nt, Homo sapiens
gaaucugacuauaccaaca

SEQ ID NO: 286749 - RNA, 19 nt, Homo sapiens
caacuacuacgauacuuau

SEQ ID NO: 286750 - RNA, 19 nt, Homo sapiens
caaguacucugacgacaac

SEQ ID NO: 286751 - RNA, 19 nt, Homo sapiens
ggaacuuuagugaaacaua

SEQ ID NO: 286752 - RNA, 19 nt, Homo sapiens
gcacuccgauccugcugau

SEQ ID NO: 286753 - RNA, 19 nt, Homo sapiens
acagggugcugcucagauu

SEQ ID NO: 286754 - RNA, 19 nt, Homo sapiens
ggucaguauuaucuaaaug

SEQ ID NO: 286755 - RNA, 19 nt, Homo sapiens
gauugaguccuggcuguua

SEQ ID NO: 286756 - RNA, 19 nt, Homo sapiens
gaacagaaaacaacaaaag

SEQ ID NO: 286757 - RNA, 19 nt, Homo sapiens
gccaguggauugauauuac

SEQ ID NO: 286758 - RNA, 19 nt, Homo sapiens
gcaaaauggucaguauuau

SEQ ID NO: 286759 - RNA, 19 nt, Homo sapiens
cacaggacaucaugcguau

SEQ ID NO: 286760 - RNA, 19 nt, Homo sapiens
gaaguuccugcgcucagua

SEQ ID NO: 286761 - RNA, 19 nt, Homo sapiens
uguaaaaccuggaaacuau

SEQ ID NO: 286762 - RNA, 19 nt, Homo sapiens
caacauuaccacaguaugg

SEQ ID NO: 286763 - RNA, 19 nt, Homo sapiens
caagggacaucagauuucu

SEQ ID NO: 286764 - RNA, 19 nt, Homo sapiens
gcagaugucagagauuaug

SEQ ID NO: 286765 - RNA, 19 nt, Homo sapiens
gaacgcuuaagucaucauu

SEQ ID NO: 286766 - RNA, 19 nt, Homo sapiens
cacaggcgauuugcaugua

SEQ ID NO: 286767 - RNA, 19 nt, Homo sapiens
ccuccuugguugaagauuu

SEQ ID NO: 286768 - RNA, 19 nt, Homo sapiens
gcacacacacagggauuga

SEQ ID NO: 286769 - RNA, 19 nt, Homo sapiens
ggaugaguuuagccacuau

SEQ ID NO: 286770 - RNA, 19 nt, Homo sapiens
auacggcacuggcuacuuc

SEQ ID NO: 286771 - RNA, 19 nt, Homo sapiens
cuacgauacuuaugaaagg

SEQ ID NO: 286772 - RNA, 19 nt, Homo sapiens
uuugaacgcuuaagucauc

SEQ ID NO: 286773 - RNA, 19 nt, Homo sapiens
gcucagauuuccccaaaga

SEQ ID NO: 286774 - RNA, 19 nt, Homo sapiens
acaacuacuacgauacuua

SEQ ID NO: 286775 - RNA, 19 nt, Homo sapiens
agggacaucagauuucuua

SEQ ID NO: 286776 - RNA, 19 nt, Homo sapiens
ccaagggacaucagauuuc

SEQ ID NO: 286777 - RNA, 19 nt, Homo sapiens
ugcuggaacuuuagugaaa

SEQ ID NO: 286778 - RNA, 19 nt, Homo sapiens
gaaauuguagugcaaaaug

SEQ ID NO: 286779 - RNA, 19 nt, Homo sapiens
guugugcgcugugacauuc

SEQ ID NO: 286780 - RNA, 19 nt, Homo sapiens
gaauggcacaguugucauc

SEQ ID NO: 286781 - RNA, 19 nt, Homo sapiens
gacgacaacccuuauuaca

SEQ ID NO: 286782 - RNA, 19 nt, Homo sapiens
gacuuugaacugaaacuuu

SEQ ID NO: 286783 - RNA, 19 nt, Homo sapiens
ccaaauuucucauguuccu

SEQ ID NO: 286784 - RNA, 19 nt, Homo sapiens
ccaguggauugauauuaca

SEQ ID NO: 286785 - RNA, 19 nt, Homo sapiens
caagcuggcuacucgacau

SEQ ID NO: 286786 - RNA, 19 nt, Homo sapiens
gcugaaggccacaaagcaa

SEQ ID NO: 286787 - RNA, 19 nt, Homo sapiens
gggaauggcacaguuguca

SEQ ID NO: 286788 - RNA, 19 nt, Homo sapiens
guuccugaaucugacuaua

SEQ ID NO: 286789 - RNA, 19 nt, Homo sapiens
uggaaacuauauccuaaag

SEQ ID NO: 286790 - RNA, 19 nt, Homo sapiens
uggaugaguuuagccacua

SEQ ID NO: 286791 - RNA, 19 nt, Homo sapiens
cagggcagaugucagagau

SEQ ID NO: 286792 - RNA, 19 nt, Homo sapiens
gcuggcuacucgacaucua

SEQ ID NO: 286793 - RNA, 19 nt, Homo sapiens
ugucagagauuaugaucac

SEQ ID NO: 286794 - RNA, 19 nt, Homo sapiens
auacagggcagaugucaga

SEQ ID NO: 286795 - RNA, 19 nt, Homo sapiens
gaagauguccauguacaac

SEQ ID NO: 286796 - RNA, 19 nt, Homo sapiens
ccacaguauggaugaguuu

SEQ ID NO: 286797 - RNA, 19 nt, Homo sapiens
cugacgacaacccuuauua

SEQ ID NO: 286798 - RNA, 19 nt, Homo sapiens
cuccuucccucacgugauu

SEQ ID NO: 286799 - RNA, 19 nt, Homo sapiens
cagcauacagggcagaugu

SEQ ID NO: 286800 - RNA, 19 nt, Homo sapiens
acgcuuaagucaucauuac

SEQ ID NO: 286801 - RNA, 19 nt, Homo sapiens
acaaagcacauaacuggau

SEQ ID NO: 286802 - RNA, 19 nt, Homo sapiens
gaaucccacccuuggcauu

SEQ ID NO: 286803 - RNA, 19 nt, Homo sapiens
ccacaggcgauuugcaugu

SEQ ID NO: 286804 - RNA, 19 nt, Homo sapiens
aagcaaaacucccaaugga

SEQ ID NO: 286805 - RNA, 19 nt, Homo sapiens
cuaccugguuccugaaucu

SEQ ID NO: 286806 - RNA, 19 nt, Homo sapiens
gugcagaagauguccaugu

SEQ ID NO: 286807 - RNA, 19 nt, Homo sapiens
guggauugauauuacagau

SEQ ID NO: 286808 - RNA, 19 nt, Homo sapiens
caacccuuauuacaacuac

SEQ ID NO: 286809 - RNA, 19 nt, Homo sapiens
gcuguuaugauaccuaugg

SEQ ID NO: 286810 - RNA, 19 nt, Homo sapiens
ucaucaacauuaccacagu

SEQ ID NO: 286811 - RNA, 19 nt, Homo sapiens
gagaacagaaaacaacaaa

SEQ ID NO: 286812 - RNA, 19 nt, Homo sapiens
agacuaacuucaguaggau

SEQ ID NO: 286813 - RNA, 19 nt, Homo sapiens
uaaaucagugccugguguu

SEQ ID NO: 286814 - RNA, 19 nt, Homo sapiens
cugcacaauuucaccguau

SEQ ID NO: 286815 - RNA, 19 nt, Homo sapiens
gaaggccacaaagcaaguu

SEQ ID NO: 286816 - RNA, 19 nt, Homo sapiens
cuaaaugaaugagccaaaa

SEQ ID NO: 286817 - RNA, 19 nt, Homo sapiens
gcauacagggcagauguca

SEQ ID NO: 286818 - RNA, 19 nt, Homo sapiens
gcagaagauguccauguac

SEQ ID NO: 286819 - RNA, 19 nt, Homo sapiens
acucugacgacaacccuua

SEQ ID NO: 286820 - RNA, 19 nt, Homo sapiens
cguauuagaaggcaaagca

SEQ ID NO: 286821 - RNA, 19 nt, Homo sapiens
gaugucagagauuaugauc

SEQ ID NO: 286822 - RNA, 19 nt, Homo sapiens
acgacaacccuuauuacaa

SEQ ID NO: 286823 - RNA, 19 nt, Homo sapiens
auccaaauuucucauguuc

SEQ ID NO: 286824 - RNA, 19 nt, Homo sapiens
caaaacucccaauggauaa

SEQ ID NO: 286825 - RNA, 19 nt, Homo sapiens
uauuagaaggcaaagcaaa

SEQ ID NO: 286826 - RNA, 19 nt, Homo sapiens
uccuaaaggucaguguaaa

SEQ ID NO: 286827 - RNA, 19 nt, Homo sapiens
uauccuaaaggucagugua

SEQ ID NO: 286828 - RNA, 19 nt, Homo sapiens
uggcuguuaugauaccuau

SEQ ID NO: 286829 - RNA, 19 nt, Homo sapiens
gcgaagagcugcccgagua

SEQ ID NO: 286830 - RNA, 19 nt, Homo sapiens
gcaacaaacugcaaaauug

SEQ ID NO: 286831 - RNA, 19 nt, Homo sapiens
gcagagagcccaccuguac

SEQ ID NO: 286832 - RNA, 19 nt, Homo sapiens
ggaacuacauccucaaggu

SEQ ID NO: 286833 - RNA, 19 nt, Homo sapiens
cuacacaggucgcuacguu

SEQ ID NO: 286834 - RNA, 19 nt, Homo sapiens
gcacgugaacccaaaguau

SEQ ID NO: 286835 - RNA, 19 nt, Homo sapiens
ccucagcgcuccgagagua

SEQ ID NO: 286836 - RNA, 19 nt, Homo sapiens
guggugagaugcaacauuc

SEQ ID NO: 286837 - RNA, 19 nt, Homo sapiens
ccaacaacguggugagaug

SEQ ID NO: 286838 - RNA, 19 nt, Homo sapiens
gaacccaaaguauauuguu

SEQ ID NO: 286839 - RNA, 19 nt, Homo sapiens
gugcaagcauccacuuaug

SEQ ID NO: 286840 - RNA, 19 nt, Homo sapiens
gagcgaacguggaugaaaa

SEQ ID NO: 286841 - RNA, 19 nt, Homo sapiens
gcaagcauccacuuaugug

SEQ ID NO: 286842 - RNA, 19 nt, Homo sapiens
ggaccuacgaccaggguuu

SEQ ID NO: 286843 - RNA, 19 nt, Homo sapiens
cacgugaacccaaaguaua

SEQ ID NO: 286844 - RNA, 19 nt, Homo sapiens
cgaccaggguuucguguac

SEQ ID NO: 286845 - RNA, 19 nt, Homo sapiens
gaacaacgggcagguguac

SEQ ID NO: 286846 - RNA, 19 nt, Homo sapiens
ggagcgaacguggaugaaa

SEQ ID NO: 286847 - RNA, 19 nt, Homo sapiens
gcuaugacaccuacaaugc

SEQ ID NO: 286848 - RNA, 19 nt, Homo sapiens
ccacuacgaccuacuggau

SEQ ID NO: 286849 - RNA, 19 nt, Homo sapiens
guguacagcuugcucaacu

SEQ ID NO: 286850 - RNA, 19 nt, Homo sapiens
ggucugggcugaauaaaac

SEQ ID NO: 286851 - RNA, 19 nt, Homo sapiens
gaugcaacauucacuacac

SEQ ID NO: 286852 - RNA, 19 nt, Homo sapiens
guucagccacuacgaccua

SEQ ID NO: 286853 - RNA, 19 nt, Homo sapiens
ugagaugcaacauucacua

SEQ ID NO: 286854 - RNA, 19 nt, Homo sapiens
gccaguggaucgacauaac

SEQ ID NO: 286855 - RNA, 19 nt, Homo sapiens
gccuugaaaugcugucauc

SEQ ID NO: 286856 - RNA, 19 nt, Homo sapiens
cagcauggacaaagcuaga

SEQ ID NO: 286857 - RNA, 19 nt, Homo sapiens
gaugaaaaccacagggauu

SEQ ID NO: 286858 - RNA, 19 nt, Homo sapiens
acacaggucgcuacguuuc

SEQ ID NO: 286859 - RNA, 19 nt, Homo sapiens
gagaugcaacauucacuac

SEQ ID NO: 286860 - RNA, 19 nt, Homo sapiens
cuacaguguuguuuuguug

SEQ ID NO: 286861 - RNA, 19 nt, Homo sapiens
ucgcuacguuucugcaaca

SEQ ID NO: 286862 - RNA, 19 nt, Homo sapiens
ccacagcauggacgaguuc

SEQ ID NO: 286863 - RNA, 19 nt, Homo sapiens
ccagggcacagcagacuuc

SEQ ID NO: 286864 - RNA, 19 nt, Homo sapiens
gugaacccaaaguauauug

SEQ ID NO: 286865 - RNA, 19 nt, Homo sapiens
ccuccuacccgcagcaguu

SEQ ID NO: 286866 - RNA, 19 nt, Homo sapiens
gcacaaauuuauuggcauu

SEQ ID NO: 286867 - RNA, 19 nt, Homo sapiens
ggaguugccugcucagaaa

SEQ ID NO: 286868 - RNA, 19 nt, Homo sapiens
gaaacccuccagucuauua

SEQ ID NO: 286869 - RNA, 19 nt, Homo sapiens
ucacagacacuuacacaua

SEQ ID NO: 286870 - RNA, 19 nt, Homo sapiens
ccaccgagcucaccacaga

SEQ ID NO: 286871 - RNA, 19 nt, Homo sapiens
ccaacaacaucaugaaaug

SEQ ID NO: 286872 - RNA, 19 nt, Homo sapiens
gcagagagcugggcuuugg

SEQ ID NO: 286873 - RNA, 19 nt, Homo sapiens
gcaaccggcuccugaguau

SEQ ID NO: 286874 - RNA, 19 nt, Homo sapiens
cagcaaacuugaauaucua

SEQ ID NO: 286875 - RNA, 19 nt, Homo sapiens
ggaggaugcuggugugaga

SEQ ID NO: 286876 - RNA, 19 nt, Homo sapiens
ggguggagguguacuauga

SEQ ID NO: 286877 - RNA, 19 nt, Homo sapiens
gagaagggcccaucugguu

SEQ ID NO: 286878 - RNA, 19 nt, Homo sapiens
ggacauacaauaccaaagu

SEQ ID NO: 286879 - RNA, 19 nt, Homo sapiens
ggagacauccagaagaauu

SEQ ID NO: 286880 - RNA, 19 nt, Homo sapiens
gcggaucccugaaaccaaa

SEQ ID NO: 286881 - RNA, 19 nt, Homo sapiens
ggaagcagaucugugacaa

SEQ ID NO: 286882 - RNA, 19 nt, Homo sapiens
gagacauccagaagaauua

SEQ ID NO: 286883 - RNA, 19 nt, Homo sapiens
gccaugggcuugcagaaga

SEQ ID NO: 286884 - RNA, 19 nt, Homo sapiens
gcacuucagcgggcucuua

SEQ ID NO: 286885 - RNA, 19 nt, Homo sapiens
ccagaagaauuacgagugu

SEQ ID NO: 286886 - RNA, 19 nt, Homo sapiens
ucagcaaacuugaauaucu

SEQ ID NO: 286887 - RNA, 19 nt, Homo sapiens
gaaggagacauccagaaga

SEQ ID NO: 286888 - RNA, 19 nt, Homo sapiens
ugacucaucuuccuguugu

SEQ ID NO: 286889 - RNA, 19 nt, Homo sapiens
aaggagacauccagaagaa

SEQ ID NO: 286890 - RNA, 19 nt, Homo sapiens
gucaucagcuugucccauu

SEQ ID NO: 286891 - RNA, 19 nt, Homo sapiens
ucagcgggcucuuaaacaa

SEQ ID NO: 286892 - RNA, 19 nt, Homo sapiens
gagccauccucucaaccua

SEQ ID NO: 286893 - RNA, 19 nt, Homo sapiens
aaaccaacccacuguguaa

SEQ ID NO: 286894 - RNA, 19 nt, Homo sapiens
agaagaagcugcgccugaa

SEQ ID NO: 286895 - RNA, 19 nt, Homo sapiens
gaaugucaccugcgagaau

SEQ ID NO: 286896 - RNA, 19 nt, Homo sapiens
gcacagaggcccacaucuc

SEQ ID NO: 286897 - RNA, 19 nt, Homo sapiens
gagaggacauacaauacca

SEQ ID NO: 286898 - RNA, 19 nt, Homo sapiens
ugucuaagcucaggaggaa

SEQ ID NO: 286899 - RNA, 19 nt, Homo sapiens
caacugagucugaacgaau

SEQ ID NO: 286900 - RNA, 19 nt, Homo sapiens
ggucaugaguggagugaag

SEQ ID NO: 286901 - RNA, 19 nt, Homo sapiens
agaccucucuuccaaugaa

SEQ ID NO: 286902 - RNA, 19 nt, Homo sapiens
gacauacaauaccaaagug

SEQ ID NO: 286903 - RNA, 19 nt, Homo sapiens
cuagaccucucuuccaaug

SEQ ID NO: 286904 - RNA, 19 nt, Homo sapiens
gcacuggacggccaagaau

SEQ ID NO: 286905 - RNA, 19 nt, Homo sapiens
agaaacgggucccuugugu

SEQ ID NO: 286906 - RNA, 19 nt, Homo sapiens
caaguucaaugccgagucu

SEQ ID NO: 286907 - RNA, 19 nt, Homo sapiens
uagagaaccugaauaucca

SEQ ID NO: 286908 - RNA, 19 nt, Homo sapiens
ggacaaaugcgggcucauc

SEQ ID NO: 286909 - RNA, 19 nt, Homo sapiens
gcaagcacacggaggaugu

SEQ ID NO: 286910 - RNA, 19 nt, Homo sapiens
uagacaaucuccacuguac

SEQ ID NO: 286911 - RNA, 19 nt, Homo sapiens
guggucaacuccugucuuc

SEQ ID NO: 286912 - RNA, 19 nt, Homo sapiens
cauuauagacugcaaguuc

SEQ ID NO: 286913 - RNA, 19 nt, Homo sapiens
agauagagaaccugaauau

SEQ ID NO: 286914 - RNA, 19 nt, Homo sapiens
guuagacaaucuccacugu

SEQ ID NO: 286915 - RNA, 19 nt, Homo sapiens
guaagugacucaucuuccu

SEQ ID NO: 286916 - RNA, 19 nt, Homo sapiens
gcacaggcaaugagaaguc

SEQ ID NO: 286917 - RNA, 19 nt, Homo sapiens
cacagacacuuacacauac

SEQ ID NO: 286918 - RNA, 19 nt, Homo sapiens
gggcccaucugguuagaca

SEQ ID NO: 286919 - RNA, 19 nt, Homo sapiens
agaagggcccaucugguua

SEQ ID NO: 286920 - RNA, 19 nt, Homo sapiens
augaaacccuccagucuau

SEQ ID NO: 286921 - RNA, 19 nt, Homo sapiens
guacaacugccacauaggu

SEQ ID NO: 286922 - RNA, 19 nt, Homo sapiens
cgagauuccggaaagcaua

SEQ ID NO: 286923 - RNA, 19 nt, Homo sapiens
gaggacauacaauaccaaa

SEQ ID NO: 286924 - RNA, 19 nt, Homo sapiens
ggacugccagcuccuccua

SEQ ID NO: 286925 - RNA, 19 nt, Homo sapiens
uuacgagugugccaacuuc

SEQ ID NO: 286926 - RNA, 19 nt, Homo sapiens
gagaaacgggucccuugug

SEQ ID NO: 286927 - RNA, 19 nt, Homo sapiens
gaagggcccaucugguuag

SEQ ID NO: 286928 - RNA, 19 nt, Homo sapiens
ccacugcggaucccugaaa

SEQ ID NO: 286929 - RNA, 19 nt, Homo sapiens
ggacaucugggcccuugga

SEQ ID NO: 286930 - RNA, 19 nt, Homo sapiens
ccuggaagcagaucuguga

SEQ ID NO: 286931 - RNA, 19 nt, Homo sapiens
ccagauagagaaccugaau

SEQ ID NO: 286932 - RNA, 19 nt, Homo sapiens
caaugaaacccuccagucu

SEQ ID NO: 286933 - RNA, 19 nt, Homo sapiens
gacaaaugcgggcucauca

SEQ ID NO: 286934 - RNA, 19 nt, Homo sapiens
gggaugaggcccacagaca

SEQ ID NO: 286935 - RNA, 19 nt, Homo sapiens
gaaaugcaggagccgcuau

SEQ ID NO: 286936 - RNA, 19 nt, Homo sapiens
ggagaugucaacagcaaca

SEQ ID NO: 286937 - RNA, 19 nt, Homo sapiens
gauaauggugccacguguu

SEQ ID NO: 286938 - RNA, 19 nt, Homo sapiens
aaugaaacccuccagucua

SEQ ID NO: 286939 - RNA, 19 nt, Homo sapiens
ggaggaagcagcgcuacug

SEQ ID NO: 286940 - RNA, 19 nt, Homo sapiens
uacacauacuugaaacuug

SEQ ID NO: 286941 - RNA, 19 nt, Homo sapiens
uguuccagguuguuauuaa

SEQ ID NO: 286942 - RNA, 19 nt, Homo sapiens
ccucccagauccacaacaa

SEQ ID NO: 286943 - RNA, 19 nt, Homo sapiens
gggaugguguguggccaaa

SEQ ID NO: 286944 - RNA, 19 nt, Homo sapiens
gacaaucuccacuguacug

SEQ ID NO: 286945 - RNA, 19 nt, Homo sapiens
acacuuacacauacuugaa

SEQ ID NO: 286946 - RNA, 19 nt, Homo sapiens
ccaugggcuugcagaagaa

SEQ ID NO: 286947 - RNA, 19 nt, Homo sapiens
cgugugcgaugacgacuuc

SEQ ID NO: 286948 - RNA, 19 nt, Homo sapiens
guggagguguacuaugaug

SEQ ID NO: 286949 - RNA, 19 nt, Homo sapiens
agugacacguggacaaaug

SEQ ID NO: 286950 - RNA, 19 nt, Homo sapiens
gggaucaucagcccgaaga

SEQ ID NO: 286951 - RNA, 19 nt, Homo sapiens
ugacggacccucgagauuc

SEQ ID NO: 286952 - RNA, 19 nt, Homo sapiens
ggggagaggacauacaaua

SEQ ID NO: 286953 - RNA, 19 nt, Homo sapiens
cagauagagaaccugaaua

SEQ ID NO: 286954 - RNA, 19 nt, Homo sapiens
ggauuccuggguucaaauu

SEQ ID NO: 286955 - RNA, 19 nt, Homo sapiens
gugcuucccucuccacaac

SEQ ID NO: 286956 - RNA, 19 nt, Homo sapiens
gaccucucuuccaaugaaa

SEQ ID NO: 286957 - RNA, 19 nt, Homo sapiens
gauucgagccauccucuca

SEQ ID NO: 286958 - RNA, 19 nt, Homo sapiens
caucacagacacuuacaca

SEQ ID NO: 286959 - RNA, 19 nt, Homo sapiens
auaauggugccacguguuu

SEQ ID NO: 286960 - RNA, 19 nt, Homo sapiens
ccagugacacguggacaaa

SEQ ID NO: 286961 - RNA, 19 nt, Homo sapiens
ugaaggagacauccagaag

SEQ ID NO: 286962 - RNA, 19 nt, Homo sapiens
gcgcuucuccucccagauc

SEQ ID NO: 286963 - RNA, 19 nt, Homo sapiens
acggagaugucaacagcaa

SEQ ID NO: 286964 - RNA, 19 nt, Homo sapiens
gcagcugccuggcuaugcu

SEQ ID NO: 286965 - RNA, 19 nt, Homo sapiens
gggagaggacauacaauac

SEQ ID NO: 286966 - RNA, 19 nt, Homo sapiens
ggaaggaccugucaaucuu

SEQ ID NO: 286967 - RNA, 19 nt, Homo sapiens
gcacauacuucauuacugu

SEQ ID NO: 286968 - RNA, 19 nt, Homo sapiens
ggaagaaccugccaagcuu

SEQ ID NO: 286969 - RNA, 19 nt, Homo sapiens
ggaagaaccugccaagcuu

SEQ ID NO: 286970 - RNA, 19 nt, Homo sapiens
ggaagaaccugccaagcuu

SEQ ID NO: 286971 - RNA, 19 nt, Homo sapiens
ggaagaaccugccaagcuu

SEQ ID NO: 286972 - RNA, 19 nt, Homo sapiens
ggaagaaccugccaagcuu

SEQ ID NO: 286973 - RNA, 19 nt, Homo sapiens
ggaagaaccugccaagcuu

SEQ ID NO: 286974 - RNA, 19 nt, Homo sapiens
ggaagaaccugccaagcuu

SEQ ID NO: 286975 - RNA, 19 nt, Homo sapiens
ggaagaaccugccaagcuu

SEQ ID NO: 286976 - RNA, 19 nt, Homo sapiens
ggaagaaccugccaagcuu

SEQ ID NO: 286977 - RNA, 19 nt, Homo sapiens
ggaagaaccugccaagcuu

SEQ ID NO: 286978 - RNA, 19 nt, Homo sapiens
ggaagaaccugccaagcuu

SEQ ID NO: 286979 - RNA, 19 nt, Homo sapiens
ggaagaaccugccaagcuu

SEQ ID NO: 286980 - RNA, 19 nt, Homo sapiens
ggaagaaccugccaagcuu

SEQ ID NO: 286981 - RNA, 19 nt, Homo sapiens
ggaagaaccugccaagcuu

SEQ ID NO: 286982 - RNA, 19 nt, Homo sapiens
ggaagaaccugccaagcuu

SEQ ID NO: 286983 - RNA, 19 nt, Homo sapiens
ggaagaaccugccaagcuu

SEQ ID NO: 286984 - RNA, 19 nt, Homo sapiens
ggaagaaccugccaagcuu

SEQ ID NO: 286985 - RNA, 19 nt, Homo sapiens
ggaagaaccugccaagcuu

SEQ ID NO: 286986 - RNA, 19 nt, Homo sapiens
ggaagaaccugccaagcuu

SEQ ID NO: 286987 - RNA, 19 nt, Homo sapiens
ggaagaaccugccaagcuu

SEQ ID NO: 286988 - RNA, 19 nt, Homo sapiens
ggaagaaccugccaagcuu

SEQ ID NO: 286989 - RNA, 19 nt, Homo sapiens
ggaagaaccugccaagcuu

SEQ ID NO: 286990 - RNA, 19 nt, Homo sapiens
ggaagaaccugccaagcuu

SEQ ID NO: 286991 - RNA, 19 nt, Homo sapiens
ggaagaaccugccaagcuu

SEQ ID NO: 286992 - RNA, 19 nt, Homo sapiens
ggaagaaccugccaagcuu

SEQ ID NO: 286993 - RNA, 19 nt, Homo sapiens
ggaagaaccugccaagcuu

SEQ ID NO: 286994 - RNA, 19 nt, Homo sapiens
ggaagaaccugccaagcuu

SEQ ID NO: 286995 - RNA, 19 nt, Homo sapiens
ggaagaaccugccaagcuu

SEQ ID NO: 286996 - RNA, 19 nt, Homo sapiens
ggaagaaccugccaagcuu

SEQ ID NO: 286997 - RNA, 19 nt, Homo sapiens
ggaagaaccugccaagcuu

SEQ ID NO: 286998 - RNA, 19 nt, Homo sapiens
ggaaggaccugccaagcuu

SEQ ID NO: 286999 - RNA, 19 nt, Homo sapiens
ggaaggacaugucaaucuu

SEQ ID NO: 287000 - RNA, 19 nt, Homo sapiens
caaggcacauacuucauua

SEQ ID NO: 287001 - RNA, 19 nt, Homo sapiens
ggaaucaacucuccucaca

SEQ ID NO: 287002 - RNA, 19 nt, Homo sapiens
gaagaagcaccaacugaaa

SEQ ID NO: 287003 - RNA, 19 nt, Homo sapiens
gaacaagguuuggaaagca

SEQ ID NO: 287004 - RNA, 19 nt, Homo sapiens
ggaaggacaugucagucuu

SEQ ID NO: 287005 - RNA, 19 nt, Homo sapiens
ggaaggacaugucagucuu

SEQ ID NO: 287006 - RNA, 19 nt, Homo sapiens
gaacaagcaccaccugaga

SEQ ID NO: 287007 - RNA, 19 nt, Homo sapiens
aaacguggguaaggauuua

SEQ ID NO: 287008 - RNA, 19 nt, Homo sapiens
gagggaaugaugagaaaua

SEQ ID NO: 287009 - RNA, 19 nt, Homo sapiens
gcaagucagucucagaaca

SEQ ID NO: 287010 - RNA, 19 nt, Homo sapiens
ggauuuagcaugcuggaaa

SEQ ID NO: 287011 - RNA, 19 nt, Homo sapiens
uaucgaggcucauucucua

SEQ ID NO: 287012 - RNA, 19 nt, Homo sapiens
gaaauggacagaguuauca

SEQ ID NO: 287013 - RNA, 19 nt, Homo sapiens
gauauugccuugcuaaagc

SEQ ID NO: 287014 - RNA, 19 nt, Homo sapiens
gcauggaggcucauucuga

SEQ ID NO: 287015 - RNA, 19 nt, Homo sapiens
uggcagcuccuuauuguua

SEQ ID NO: 287016 - RNA, 19 nt, Homo sapiens
uggcagcuccuuauuguua

SEQ ID NO: 287017 - RNA, 19 nt, Homo sapiens
uggcagcuccuuauuguua

SEQ ID NO: 287018 - RNA, 19 nt, Homo sapiens
uggcagcuccuuauuguua

SEQ ID NO: 287019 - RNA, 19 nt, Homo sapiens
uggcagcuccuuauuguua

SEQ ID NO: 287020 - RNA, 19 nt, Homo sapiens
uggcagcuccuuauuguua

SEQ ID NO: 287021 - RNA, 19 nt, Homo sapiens
uggcagcuccuuauuguua

SEQ ID NO: 287022 - RNA, 19 nt, Homo sapiens
uggcagcuccuuauuguua

SEQ ID NO: 287023 - RNA, 19 nt, Homo sapiens
uggcagcuccuuauuguua

SEQ ID NO: 287024 - RNA, 19 nt, Homo sapiens
uggcagcuccuuauuguua

SEQ ID NO: 287025 - RNA, 19 nt, Homo sapiens
uggcagcuccuuauuguua

SEQ ID NO: 287026 - RNA, 19 nt, Homo sapiens
uggcagcuccuuauuguua

SEQ ID NO: 287027 - RNA, 19 nt, Homo sapiens
uggcagcuccuuauuguua

SEQ ID NO: 287028 - RNA, 19 nt, Homo sapiens
uggcagcuccuuauuguua

SEQ ID NO: 287029 - RNA, 19 nt, Homo sapiens
uggcagcuccuuauuguua

SEQ ID NO: 287030 - RNA, 19 nt, Homo sapiens
uggcagcuccuuauuguua

SEQ ID NO: 287031 - RNA, 19 nt, Homo sapiens
uggcagcuccuuauuguua

SEQ ID NO: 287032 - RNA, 19 nt, Homo sapiens
uggcagcuccuuauuguua

SEQ ID NO: 287033 - RNA, 19 nt, Homo sapiens
uggcagcuccuuauuguua

SEQ ID NO: 287034 - RNA, 19 nt, Homo sapiens
uggcagcuccuuauuguua

SEQ ID NO: 287035 - RNA, 19 nt, Homo sapiens
uggcagcuccuuauuguua

SEQ ID NO: 287036 - RNA, 19 nt, Homo sapiens
cauaauaggaccacagaaa

SEQ ID NO: 287037 - RNA, 19 nt, Homo sapiens
uggcagcuccuuauuguua

SEQ ID NO: 287038 - RNA, 19 nt, Homo sapiens
uggcagcuccuuauuguua

SEQ ID NO: 287039 - RNA, 19 nt, Homo sapiens
uggcagcuccuuauuguua

SEQ ID NO: 287040 - RNA, 19 nt, Homo sapiens
uggcagcuccuuauuguua

SEQ ID NO: 287041 - RNA, 19 nt, Homo sapiens
uggcagcuccuuauuguua

SEQ ID NO: 287042 - RNA, 19 nt, Homo sapiens
uggcagcuccuuauuguua

SEQ ID NO: 287043 - RNA, 19 nt, Homo sapiens
uggcagcuccuuauuguua

SEQ ID NO: 287044 - RNA, 19 nt, Homo sapiens
uggcagcuccuuauuguua

SEQ ID NO: 287045 - RNA, 19 nt, Homo sapiens
gacaaauucuguauuaagg

SEQ ID NO: 287046 - RNA, 19 nt, Homo sapiens
ccgaagaaauguccuggaa

SEQ ID NO: 287047 - RNA, 19 nt, Homo sapiens
ggacugcuacuaccauuau

SEQ ID NO: 287048 - RNA, 19 nt, Homo sapiens
gcagauauugccuugcuaa

SEQ ID NO: 287049 - RNA, 19 nt, Homo sapiens
gcagcuccuuauuguuaua

SEQ ID NO: 287050 - RNA, 19 nt, Homo sapiens
gcagcuccuuauuguuaua

SEQ ID NO: 287051 - RNA, 19 nt, Homo sapiens
gcagcuccuuauuguuaua

SEQ ID NO: 287052 - RNA, 19 nt, Homo sapiens
gcagcuccuuauuguuaua

SEQ ID NO: 287053 - RNA, 19 nt, Homo sapiens
gcagcuccuuauuguuaua

SEQ ID NO: 287054 - RNA, 19 nt, Homo sapiens
gcagcuccuuauuguuaua

SEQ ID NO: 287055 - RNA, 19 nt, Homo sapiens
gcagcuccuuauuguuaua

SEQ ID NO: 287056 - RNA, 19 nt, Homo sapiens
gcagcuccuuauuguuaua

SEQ ID NO: 287057 - RNA, 19 nt, Homo sapiens
gcagcuccuuauuguuaua

SEQ ID NO: 287058 - RNA, 19 nt, Homo sapiens
gcagcuccuuauuguuaua

SEQ ID NO: 287059 - RNA, 19 nt, Homo sapiens
gcagcuccuuauuguuaua

SEQ ID NO: 287060 - RNA, 19 nt, Homo sapiens
gcagcuccuuauuguuaua

SEQ ID NO: 287061 - RNA, 19 nt, Homo sapiens
gcagcuccuuauuguuaua

SEQ ID NO: 287062 - RNA, 19 nt, Homo sapiens
gcagcuccuuauuguuaua

SEQ ID NO: 287063 - RNA, 19 nt, Homo sapiens
gcagcuccuuauuguuaua

SEQ ID NO: 287064 - RNA, 19 nt, Homo sapiens
gcagcuccuuauuguuaua

SEQ ID NO: 287065 - RNA, 19 nt, Homo sapiens
gcagcuccuuauuguuaua

SEQ ID NO: 287066 - RNA, 19 nt, Homo sapiens
gaaaguaugugauaucuga

SEQ ID NO: 287067 - RNA, 19 nt, Homo sapiens
gaagagugauucauacuuu

SEQ ID NO: 287068 - RNA, 19 nt, Homo sapiens
gaaaguaaauuugcccuaa

SEQ ID NO: 287069 - RNA, 19 nt, Homo sapiens
ggaccaauguugugauuaa

SEQ ID NO: 287070 - RNA, 19 nt, Homo sapiens
gaaaugggcuuuaacaaaa

SEQ ID NO: 287071 - RNA, 19 nt, Homo sapiens
gaagaaagggucugauaaa

SEQ ID NO: 287072 - RNA, 19 nt, Homo sapiens
gcaacaaucugggcuauga

SEQ ID NO: 287073 - RNA, 19 nt, Homo sapiens
caggaagucugaccaauaa

SEQ ID NO: 287074 - RNA, 19 nt, Homo sapiens
gaaccagacuccaauguca

SEQ ID NO: 287075 - RNA, 19 nt, Homo sapiens
gagaugaucgugccuauaa

SEQ ID NO: 287076 - RNA, 19 nt, Homo sapiens
gcccuacccuuguuaguua

SEQ ID NO: 287077 - RNA, 19 nt, Homo sapiens
guacuuaacugugugaaga

SEQ ID NO: 287078 - RNA, 19 nt, Homo sapiens
gaacccgacugugaaagua

SEQ ID NO: 287079 - RNA, 19 nt, Homo sapiens
gaaacguacuuaacugugu

SEQ ID NO: 287080 - RNA, 19 nt, Homo sapiens
gcaggaagucugaccaaua

SEQ ID NO: 287081 - RNA, 19 nt, Homo sapiens
ccaacucacucuuaugaaa

SEQ ID NO: 287082 - RNA, 19 nt, Homo sapiens
acaagucucugaauaagaa

SEQ ID NO: 287083 - RNA, 19 nt, Homo sapiens
gaaaugccaugacaagucu

SEQ ID NO: 287084 - RNA, 19 nt, Homo sapiens
gaaagaaacguacuuaacu

SEQ ID NO: 287085 - RNA, 19 nt, Homo sapiens
ucaaggauguucuggcuuu

SEQ ID NO: 287086 - RNA, 19 nt, Homo sapiens
gacaguuacucuucaguuu

SEQ ID NO: 287087 - RNA, 19 nt, Homo sapiens
gaaagggucugauaaacac

SEQ ID NO: 287088 - RNA, 19 nt, Homo sapiens
caugacaagucucugaaua

SEQ ID NO: 287089 - RNA, 19 nt, Homo sapiens
ccuacaaagucuuccauua

SEQ ID NO: 287090 - RNA, 19 nt, Homo sapiens
gaaauggaaucagcuuuua

SEQ ID NO: 287091 - RNA, 19 nt, Homo sapiens
guggcuaucugcauuuaua

SEQ ID NO: 287092 - RNA, 19 nt, Homo sapiens
gaaaggucauuguggcuau

SEQ ID NO: 287093 - RNA, 19 nt, Homo sapiens
gaacaugucggaguagaaa

SEQ ID NO: 287094 - RNA, 19 nt, Homo sapiens
gaaaggcaccugcgguauu

SEQ ID NO: 287095 - RNA, 19 nt, Homo sapiens
guuagaaccuccuauuuua

SEQ ID NO: 287096 - RNA, 19 nt, Homo sapiens
caagaaagaaacguacuua

SEQ ID NO: 287097 - RNA, 19 nt, Homo sapiens
gggcgaaucuacagaacaa

SEQ ID NO: 287098 - RNA, 19 nt, Homo sapiens
gagaacuacucauguugaa

SEQ ID NO: 287099 - RNA, 19 nt, Homo sapiens
ggaccuaacuuugaguaug

SEQ ID NO: 287100 - RNA, 19 nt, Homo sapiens
ugaaaugggcuuuaacaaa

SEQ ID NO: 287101 - RNA, 19 nt, Homo sapiens
caaauaagaccuacuccuu

SEQ ID NO: 287102 - RNA, 19 nt, Homo sapiens
ggaaagcugcccacuucua

SEQ ID NO: 287103 - RNA, 19 nt, Homo sapiens
aaaggcaccugcgguauuu

SEQ ID NO: 287104 - RNA, 19 nt, Homo sapiens
gaaagaaccgcugcaacaa

SEQ ID NO: 287105 - RNA, 19 nt, Homo sapiens
gcacauccuccaacguuaa

SEQ ID NO: 287106 - RNA, 19 nt, Homo sapiens
gaccuacuccuuccuaauu

SEQ ID NO: 287107 - RNA, 19 nt, Homo sapiens
gaaguuuccacaaauaaga

SEQ ID NO: 287108 - RNA, 19 nt, Homo sapiens
ccugaaguuuccacaaaua

SEQ ID NO: 287109 - RNA, 19 nt, Homo sapiens
gggcucugcuugaguugua

SEQ ID NO: 287110 - RNA, 19 nt, Homo sapiens
gaacuucgacccuuucucu

SEQ ID NO: 287111 - RNA, 19 nt, Homo sapiens
aaagauagguuugaguuca

SEQ ID NO: 287112 - RNA, 19 nt, Homo sapiens
gaacaaagaacggcaugug

SEQ ID NO: 287113 - RNA, 19 nt, Homo sapiens
gaagacucguucucagaug

SEQ ID NO: 287114 - RNA, 19 nt, Homo sapiens
gagaaagggcucugcuuga

SEQ ID NO: 287115 - RNA, 19 nt, Homo sapiens
ggauggaggaggaguuuaa

SEQ ID NO: 287116 - RNA, 19 nt, Homo sapiens
cgaagaaagggucugauaa

SEQ ID NO: 287117 - RNA, 19 nt, Homo sapiens
ggagaacuacucauguuga

SEQ ID NO: 287118 - RNA, 19 nt, Homo sapiens
gagagaugaucgugccuau

SEQ ID NO: 287119 - RNA, 19 nt, Homo sapiens
aaggugaucuucuguucua

SEQ ID NO: 287120 - RNA, 19 nt, Homo sapiens
cuagaaagcucugcaugug

SEQ ID NO: 287121 - RNA, 19 nt, Homo sapiens
ccauuggccugcaucauga

SEQ ID NO: 287122 - RNA, 19 nt, Homo sapiens
aaagggcucugcuugaguu

SEQ ID NO: 287123 - RNA, 19 nt, Homo sapiens
gaaaccaguugggcauguu

SEQ ID NO: 287124 - RNA, 19 nt, Homo sapiens
aaagaaacguacuuaacug

SEQ ID NO: 287125 - RNA, 19 nt, Homo sapiens
acacagagguagauauugg

SEQ ID NO: 287126 - RNA, 19 nt, Homo sapiens
gaagcuauccgcgugauug

SEQ ID NO: 287127 - RNA, 19 nt, Homo sapiens
ggaagucugaccaauaaga

SEQ ID NO: 287128 - RNA, 19 nt, Homo sapiens
uaacuacccucuggacaau

SEQ ID NO: 287129 - RNA, 19 nt, Homo sapiens
gauguaugauuuguuguug

SEQ ID NO: 287130 - RNA, 19 nt, Homo sapiens
gaaagcugcccacuucuag

SEQ ID NO: 287131 - RNA, 19 nt, Homo sapiens
gcacgaaucagacucaucu

SEQ ID NO: 287132 - RNA, 19 nt, Homo sapiens
gaggccuucucaaacuuua

SEQ ID NO: 287133 - RNA, 19 nt, Homo sapiens
gagaggacuuggagaugug

SEQ ID NO: 287134 - RNA, 19 nt, Homo sapiens
gaagucugaccaauaagaa

SEQ ID NO: 287135 - RNA, 19 nt, Homo sapiens
gaagaaauggaaucagcuu

SEQ ID NO: 287136 - RNA, 19 nt, Homo sapiens
agagguagauauuggagaa

SEQ ID NO: 287137 - RNA, 19 nt, Homo sapiens
guucucagaugcccuacaa

SEQ ID NO: 287138 - RNA, 19 nt, Homo sapiens
caaggauguucuggcuuua

SEQ ID NO: 287139 - RNA, 19 nt, Homo sapiens
gaaugaaguggaggaagua

SEQ ID NO: 287140 - RNA, 19 nt, Homo sapiens
aagagugagugaacaacua

SEQ ID NO: 287141 - RNA, 19 nt, Homo sapiens
gaaaagauagguuugaguu

SEQ ID NO: 287142 - RNA, 19 nt, Homo sapiens
uaauuugaauggugcagaa

SEQ ID NO: 287143 - RNA, 19 nt, Homo sapiens
uaaacagucccuaccauug

SEQ ID NO: 287144 - RNA, 19 nt, Homo sapiens
ugacaagucucugaauaag

SEQ ID NO: 287145 - RNA, 19 nt, Homo sapiens
agggaaagcugcccacuuc

SEQ ID NO: 287146 - RNA, 19 nt, Homo sapiens
ucgacucucuguugaauga

SEQ ID NO: 287147 - RNA, 19 nt, Homo sapiens
gccagaacuucgacccuuu

SEQ ID NO: 287148 - RNA, 19 nt, Homo sapiens
gcugacacauaauuugaau

SEQ ID NO: 287149 - RNA, 19 nt, Homo sapiens
cuacacagcaguaugaaug

SEQ ID NO: 287150 - RNA, 19 nt, Homo sapiens
ggaagagugauucauacuu

SEQ ID NO: 287151 - RNA, 19 nt, Homo sapiens
gguagauauuggagaacua

SEQ ID NO: 287152 - RNA, 19 nt, Homo sapiens
ccuacuccuuccuaauuua

SEQ ID NO: 287153 - RNA, 19 nt, Homo sapiens
agucuuccauuaccaagua

SEQ ID NO: 287154 - RNA, 19 nt, Homo sapiens
cuaacuguaugugucuuua

SEQ ID NO: 287155 - RNA, 19 nt, Homo sapiens
guaaaaggguggagagguu

SEQ ID NO: 287156 - RNA, 19 nt, Homo sapiens
guagacgucuuacacacau

SEQ ID NO: 287157 - RNA, 19 nt, Homo sapiens
gcugggaacccgacuguga

SEQ ID NO: 287158 - RNA, 19 nt, Homo sapiens
ugugugagcuucuacagau

SEQ ID NO: 287159 - RNA, 19 nt, Homo sapiens
guuccuggcuuugacauga

SEQ ID NO: 287160 - RNA, 19 nt, Homo sapiens
caucuacacagcaguauga

SEQ ID NO: 287161 - RNA, 19 nt, Homo sapiens
agaaugaaguggaggaagu

SEQ ID NO: 287162 - RNA, 19 nt, Homo sapiens
gcaugugaauucugugaag

SEQ ID NO: 287163 - RNA, 19 nt, Homo sapiens
caaagaacggcaugugaau

SEQ ID NO: 287164 - RNA, 19 nt, Homo sapiens
cuuaugaaaugggcuuuaa

SEQ ID NO: 287165 - RNA, 19 nt, Homo sapiens
gcacauagcacugggaacu

SEQ ID NO: 287166 - RNA, 19 nt, Homo sapiens
caaccaagcuucaauauuu

SEQ ID NO: 287167 - RNA, 19 nt, Homo sapiens
gaaaggauccuacaauauu

SEQ ID NO: 287168 - RNA, 19 nt, Homo sapiens
gaaauucucuuuaggacaa

SEQ ID NO: 287169 - RNA, 19 nt, Homo sapiens
gcacugaccuuuagauuca

SEQ ID NO: 287170 - RNA, 19 nt, Homo sapiens
caauagggcugauaaugua

SEQ ID NO: 287171 - RNA, 19 nt, Homo sapiens
ccacagagcuccacugguu

SEQ ID NO: 287172 - RNA, 19 nt, Homo sapiens
gaagugauguucagauuuc

SEQ ID NO: 287173 - RNA, 19 nt, Homo sapiens
gaucaaggcuaauuggaaa

SEQ ID NO: 287174 - RNA, 19 nt, Homo sapiens
caagaagucuacauugaaa

SEQ ID NO: 287175 - RNA, 19 nt, Homo sapiens
uaacauaaccucagaguau

SEQ ID NO: 287176 - RNA, 19 nt, Homo sapiens
gaacauguuucacuuaagg

SEQ ID NO: 287177 - RNA, 19 nt, Homo sapiens
gauuguaucucuuaaagug

SEQ ID NO: 287178 - RNA, 19 nt, Homo sapiens
gcagagaguccaauuuauu

SEQ ID NO: 287179 - RNA, 19 nt, Homo sapiens
gaacaagcccaaauuuaau

SEQ ID NO: 287180 - RNA, 19 nt, Homo sapiens
gaagaacgaacacaagaaa

SEQ ID NO: 287181 - RNA, 19 nt, Homo sapiens
cuacuucucuuaucuuuga

SEQ ID NO: 287182 - RNA, 19 nt, Homo sapiens
gcccauagcuaauaaguag

SEQ ID NO: 287183 - RNA, 19 nt, Homo sapiens
guaauucuguguaacaaga

SEQ ID NO: 287184 - RNA, 19 nt, Homo sapiens
ggaggagacuguccguauu

SEQ ID NO: 287185 - RNA, 19 nt, Homo sapiens
ccacagagauguuuauggu

SEQ ID NO: 287186 - RNA, 19 nt, Homo sapiens
cauacugucugcugauaua

SEQ ID NO: 287187 - RNA, 19 nt, Homo sapiens
cacuauagcucauccuuaa

SEQ ID NO: 287188 - RNA, 19 nt, Homo sapiens
caacaaggucacccaaaua

SEQ ID NO: 287189 - RNA, 19 nt, Homo sapiens
gcuaauaaguagugacaga

SEQ ID NO: 287190 - RNA, 19 nt, Homo sapiens
ggaaaggauccuacaauau

SEQ ID NO: 287191 - RNA, 19 nt, Homo sapiens
guaacauucuacuugcuua

SEQ ID NO: 287192 - RNA, 19 nt, Homo sapiens
agaacaagcccaaauuuaa

SEQ ID NO: 287193 - RNA, 19 nt, Homo sapiens
guagaaagcuugaaaagau

SEQ ID NO: 287194 - RNA, 19 nt, Homo sapiens
gagcccugcuacauuaaua

SEQ ID NO: 287195 - RNA, 19 nt, Homo sapiens
gcaaaucagagcauacaaa

SEQ ID NO: 287196 - RNA, 19 nt, Homo sapiens
gaccagugaucaaggcuaa

SEQ ID NO: 287197 - RNA, 19 nt, Homo sapiens
ggaucgagauuuccauguu

SEQ ID NO: 287198 - RNA, 19 nt, Homo sapiens
aagcagagaguccaauuua

SEQ ID NO: 287199 - RNA, 19 nt, Homo sapiens
caaguagcacugacuauuu

SEQ ID NO: 287200 - RNA, 19 nt, Homo sapiens
ggaccaacuucucugauca

SEQ ID NO: 287201 - RNA, 19 nt, Homo sapiens
agacaaacuugauuucuuc

SEQ ID NO: 287202 - RNA, 19 nt, Homo sapiens
gguauuugcugucacauag

SEQ ID NO: 287203 - RNA, 19 nt, Homo sapiens
gccaagccauacuuauuaa

SEQ ID NO: 287204 - RNA, 19 nt, Homo sapiens
uagaacaagcccaaauuua

SEQ ID NO: 287205 - RNA, 19 nt, Homo sapiens
guuaggcuguaaagaauuu

SEQ ID NO: 287206 - RNA, 19 nt, Homo sapiens
cccaaggacuuccacauuu

SEQ ID NO: 287207 - RNA, 19 nt, Homo sapiens
gauagucucuguucuucau

SEQ ID NO: 287208 - RNA, 19 nt, Homo sapiens
ccagugcccuuccaucuau

SEQ ID NO: 287209 - RNA, 19 nt, Homo sapiens
ccaagaaaauugccuuuaa

SEQ ID NO: 287210 - RNA, 19 nt, Homo sapiens
ucucuuaucuuugaucgua

SEQ ID NO: 287211 - RNA, 19 nt, Homo sapiens
ucaaaucucccacaaguau

SEQ ID NO: 287212 - RNA, 19 nt, Homo sapiens
cagacaaacuugauuucuu

SEQ ID NO: 287213 - RNA, 19 nt, Homo sapiens
gcccagcccucauuauaug

SEQ ID NO: 287214 - RNA, 19 nt, Homo sapiens
ccaauguaccguuuccuua

SEQ ID NO: 287215 - RNA, 19 nt, Homo sapiens
caaacuugauuucuucuag

SEQ ID NO: 287216 - RNA, 19 nt, Homo sapiens
gaaauuacaggugggauau

SEQ ID NO: 287217 - RNA, 19 nt, Homo sapiens
gagaagaacgaacacaaga

SEQ ID NO: 287218 - RNA, 19 nt, Homo sapiens
ucaacaaggucacccaaau

SEQ ID NO: 287219 - RNA, 19 nt, Homo sapiens
caaccaagaagucuacauu

SEQ ID NO: 287220 - RNA, 19 nt, Homo sapiens
guacaacccauacaaacaa

SEQ ID NO: 287221 - RNA, 19 nt, Homo sapiens
ggagaccacccauuccuuu

SEQ ID NO: 287222 - RNA, 19 nt, Homo sapiens
caacuucucugaucaaaau

SEQ ID NO: 287223 - RNA, 19 nt, Homo sapiens
gacaaucacugaaacaaaa

SEQ ID NO: 287224 - RNA, 19 nt, Homo sapiens
caacgcaacuaucaaaauu

SEQ ID NO: 287225 - RNA, 19 nt, Homo sapiens
ucgaacauguuucacuuaa

SEQ ID NO: 287226 - RNA, 19 nt, Homo sapiens
ucaaagacaaucacugaaa

SEQ ID NO: 287227 - RNA, 19 nt, Homo sapiens
gcgguggucuccugucuga

SEQ ID NO: 287228 - RNA, 19 nt, Homo sapiens
gaucgagauuuccauguuc

SEQ ID NO: 287229 - RNA, 19 nt, Homo sapiens
gaagaccuauaucacagau

SEQ ID NO: 287230 - RNA, 19 nt, Homo sapiens
agacagagcagaagacaga

SEQ ID NO: 287231 - RNA, 19 nt, Homo sapiens
cuauuaaccuugccuuaga

SEQ ID NO: 287232 - RNA, 19 nt, Homo sapiens
gcacugagaagaacgaaca

SEQ ID NO: 287233 - RNA, 19 nt, Homo sapiens
caagaagaccuauaucaca

SEQ ID NO: 287234 - RNA, 19 nt, Homo sapiens
gaauuccugucuuccaaau

SEQ ID NO: 287235 - RNA, 19 nt, Homo sapiens
caaagacaaucacugaaac

SEQ ID NO: 287236 - RNA, 19 nt, Homo sapiens
ggacuuccacaagaaauuu

SEQ ID NO: 287237 - RNA, 19 nt, Homo sapiens
ugcgagcccugcuacauua

SEQ ID NO: 287238 - RNA, 19 nt, Homo sapiens
ccaagaagucuacauugaa

SEQ ID NO: 287239 - RNA, 19 nt, Homo sapiens
gaaagauuccacagagaug

SEQ ID NO: 287240 - RNA, 19 nt, Homo sapiens
guaaucggcuugaauuuug

SEQ ID NO: 287241 - RNA, 19 nt, Homo sapiens
caaauuagccagacauggu

SEQ ID NO: 287242 - RNA, 19 nt, Homo sapiens
gacaagaucggccugaaga

SEQ ID NO: 287243 - RNA, 19 nt, Homo sapiens
ucaacugugucucugaauu

SEQ ID NO: 287244 - RNA, 19 nt, Homo sapiens
ggaaugaucauaaaaguga

SEQ ID NO: 287245 - RNA, 19 nt, Homo sapiens
auaauuacauccuccaaug

SEQ ID NO: 287246 - RNA, 19 nt, Homo sapiens
ccuaauacccaguuuaaga

SEQ ID NO: 287247 - RNA, 19 nt, Homo sapiens
guucgaacauguuucacuu

SEQ ID NO: 287248 - RNA, 19 nt, Homo sapiens
cuugaaaucuccauccuau

SEQ ID NO: 287249 - RNA, 19 nt, Homo sapiens
gagcuccacugguucaaca

SEQ ID NO: 287250 - RNA, 19 nt, Homo sapiens
gaggcaaugucaacugugu

SEQ ID NO: 287251 - RNA, 19 nt, Homo sapiens
gaaccuggucuucugauuc

SEQ ID NO: 287252 - RNA, 19 nt, Homo sapiens
ugaaaucuccauccuauca

SEQ ID NO: 287253 - RNA, 19 nt, Homo sapiens
gcgauagucucuguucuuc

SEQ ID NO: 287254 - RNA, 19 nt, Homo sapiens
cagcccagcccucauuaua

SEQ ID NO: 287255 - RNA, 19 nt, Homo sapiens
ggcaugcgcuuguuuaaaa

SEQ ID NO: 287256 - RNA, 19 nt, Homo sapiens
aggaaaagcuguaagaaaa

SEQ ID NO: 287257 - RNA, 19 nt, Homo sapiens
cuucaaaucucccacaagu

SEQ ID NO: 287258 - RNA, 19 nt, Homo sapiens
ggagagacaccuagcuuag

SEQ ID NO: 287259 - RNA, 19 nt, Homo sapiens
ccacaauauuaccuuaaga

SEQ ID NO: 287260 - RNA, 19 nt, Homo sapiens
gauauucuucucuugcuuu

SEQ ID NO: 287261 - RNA, 19 nt, Homo sapiens
ggauaugaaacucuacauu

SEQ ID NO: 287262 - RNA, 19 nt, Homo sapiens
gagucucacuggccaagaa

SEQ ID NO: 287263 - RNA, 19 nt, Homo sapiens
gaaaagcuguaagaaaaug

SEQ ID NO: 287264 - RNA, 19 nt, Homo sapiens
ugccaagccauacuuauua

SEQ ID NO: 287265 - RNA, 19 nt, Homo sapiens
gcaaccaucagaauucaga

SEQ ID NO: 287266 - RNA, 19 nt, Homo sapiens
gaugaugacugccaaauua

SEQ ID NO: 287267 - RNA, 19 nt, Homo sapiens
gaaacucgcucuguaagaa

SEQ ID NO: 287268 - RNA, 19 nt, Homo sapiens
ggagaagaguauaaaguuu

SEQ ID NO: 287269 - RNA, 19 nt, Homo sapiens
caacggaaccuucaaacua

SEQ ID NO: 287270 - RNA, 19 nt, Homo sapiens
ggacgucucuagaacauau

SEQ ID NO: 287271 - RNA, 19 nt, Homo sapiens
caaagagcacgcugaauua

SEQ ID NO: 287272 - RNA, 19 nt, Homo sapiens
ggaagagaaugguguugaa

SEQ ID NO: 287273 - RNA, 19 nt, Homo sapiens
gaagagaggucccgugacu

SEQ ID NO: 287274 - RNA, 19 nt, Homo sapiens
ggaugucucuucaguuuau

SEQ ID NO: 287275 - RNA, 19 nt, Homo sapiens
ccaaagagcacgcugaauu

SEQ ID NO: 287276 - RNA, 19 nt, Homo sapiens
uagcuuacauuuccucuuu

SEQ ID NO: 287277 - RNA, 19 nt, Homo sapiens
ucaagcaguuggcguauuu

SEQ ID NO: 287278 - RNA, 19 nt, Homo sapiens
gcccacauauggagaagua

SEQ ID NO: 287279 - RNA, 19 nt, Homo sapiens
gaagcaguguugccacaaa

SEQ ID NO: 287280 - RNA, 19 nt, Homo sapiens
gaacaacggaaccuucaaa

SEQ ID NO: 287281 - RNA, 19 nt, Homo sapiens
gcacuccauugcuuucuuu

SEQ ID NO: 287282 - RNA, 19 nt, Homo sapiens
ccuaauauauggaucuuga

SEQ ID NO: 287283 - RNA, 19 nt, Homo sapiens
gcacaaguccagcucauga

SEQ ID NO: 287284 - RNA, 19 nt, Homo sapiens
gaaaucgguuaacguuaga

SEQ ID NO: 287285 - RNA, 19 nt, Homo sapiens
gaaagaggaggauacaaga

SEQ ID NO: 287286 - RNA, 19 nt, Homo sapiens
gggaaaguauagcaugaaa

SEQ ID NO: 287287 - RNA, 19 nt, Homo sapiens
gcacaggaaaucauuaaga

SEQ ID NO: 287288 - RNA, 19 nt, Homo sapiens
gaacgcguguguccugaga

SEQ ID NO: 287289 - RNA, 19 nt, Homo sapiens
ugaacaccgucccucauua

SEQ ID NO: 287290 - RNA, 19 nt, Homo sapiens
uaaagcaguugaagugaug

SEQ ID NO: 287291 - RNA, 19 nt, Homo sapiens
cacaggaaaucauuaagaa

SEQ ID NO: 287292 - RNA, 19 nt, Homo sapiens
gaacacuucugcuaaugag

SEQ ID NO: 287293 - RNA, 19 nt, Homo sapiens
ugaaaucgguuaacguuag

SEQ ID NO: 287294 - RNA, 19 nt, Homo sapiens
uuaagaagcuggagaagag

SEQ ID NO: 287295 - RNA, 19 nt, Homo sapiens
ggagguggaggcagaauuu

SEQ ID NO: 287296 - RNA, 19 nt, Homo sapiens
caaggaaacugaagaagcu

SEQ ID NO: 287297 - RNA, 19 nt, Homo sapiens
gaagcaagaauacaucaga

SEQ ID NO: 287298 - RNA, 19 nt, Homo sapiens
ugggaugucucuucaguuu

SEQ ID NO: 287299 - RNA, 19 nt, Homo sapiens
gaagccaagucuuucugaa

SEQ ID NO: 287300 - RNA, 19 nt, Homo sapiens
ggcagaugcugaagaagaa

SEQ ID NO: 287301 - RNA, 19 nt, Homo sapiens
aaugaucgauucaguagaa

SEQ ID NO: 287302 - RNA, 19 nt, Homo sapiens
guaaagcaguugaagugau

SEQ ID NO: 287303 - RNA, 19 nt, Homo sapiens
caggaaagccggguuagua

SEQ ID NO: 287304 - RNA, 19 nt, Homo sapiens
ggauggugcuuuggaugua

SEQ ID NO: 287305 - RNA, 19 nt, Homo sapiens
aaacauacgugcugguaca

SEQ ID NO: 287306 - RNA, 19 nt, Homo sapiens
caaacuauaugguggucaa

SEQ ID NO: 287307 - RNA, 19 nt, Homo sapiens
agaaagaaaucacuaacuc

SEQ ID NO: 287308 - RNA, 19 nt, Homo sapiens
ggaaucaacaccuuucuca

SEQ ID NO: 287309 - RNA, 19 nt, Homo sapiens
gaagaaacaguagaaagga

SEQ ID NO: 287310 - RNA, 19 nt, Homo sapiens
agagcacgcugaauuagaa

SEQ ID NO: 287311 - RNA, 19 nt, Homo sapiens
cauaucuuguggccauuua

SEQ ID NO: 287312 - RNA, 19 nt, Homo sapiens
cuacgaagagugacuauug

SEQ ID NO: 287313 - RNA, 19 nt, Homo sapiens
gagaagaguauaaaguuuc

SEQ ID NO: 287314 - RNA, 19 nt, Homo sapiens
cucauuaccucgauuuauu

SEQ ID NO: 287315 - RNA, 19 nt, Homo sapiens
ggaaagccggguuaguaaa

SEQ ID NO: 287316 - RNA, 19 nt, Homo sapiens
guacacaccucugcuggau

SEQ ID NO: 287317 - RNA, 19 nt, Homo sapiens
caagccaucuucucuacga

SEQ ID NO: 287318 - RNA, 19 nt, Homo sapiens
gaggauguaugccaaagag

SEQ ID NO: 287319 - RNA, 19 nt, Homo sapiens
agaggaaccagaaacaaua

SEQ ID NO: 287320 - RNA, 19 nt, Homo sapiens
gaugaaugaugacccaagu

SEQ ID NO: 287321 - RNA, 19 nt, Homo sapiens
ggaagcaauuucggaacaa

SEQ ID NO: 287322 - RNA, 19 nt, Homo sapiens
ucagaaugaccguaagaua

SEQ ID NO: 287323 - RNA, 19 nt, Homo sapiens
gaggguaaagcaauauauu

SEQ ID NO: 287324 - RNA, 19 nt, Homo sapiens
acaaggaagccaagucuuu

SEQ ID NO: 287325 - RNA, 19 nt, Homo sapiens
gggcagaugcugaagaaga

SEQ ID NO: 287326 - RNA, 19 nt, Homo sapiens
cuugugaccuugacagaaa

SEQ ID NO: 287327 - RNA, 19 nt, Homo sapiens
gccaggcacuucagcagaa

SEQ ID NO: 287328 - RNA, 19 nt, Homo sapiens
ccagaaauauuggaaaugc

SEQ ID NO: 287329 - RNA, 19 nt, Homo sapiens
gaaagaaaucacuaacucu

SEQ ID NO: 287330 - RNA, 19 nt, Homo sapiens
aaagugggaugucucuuca

SEQ ID NO: 287331 - RNA, 19 nt, Homo sapiens
aguagaaggucaagcaguu

SEQ ID NO: 287332 - RNA, 19 nt, Homo sapiens
gaagaggauguaugccaaa

SEQ ID NO: 287333 - RNA, 19 nt, Homo sapiens
gaaagccggguuaguaaag

SEQ ID NO: 287334 - RNA, 19 nt, Homo sapiens
agaagagagugaagcuuga

SEQ ID NO: 287335 - RNA, 19 nt, Homo sapiens
gauggugcuuuggauguaa

SEQ ID NO: 287336 - RNA, 19 nt, Homo sapiens
cagaagacaaggaaacuga

SEQ ID NO: 287337 - RNA, 19 nt, Homo sapiens
cagaaugaccguaagauag

SEQ ID NO: 287338 - RNA, 19 nt, Homo sapiens
gagaagaaacaguagaaag

SEQ ID NO: 287339 - RNA, 19 nt, Homo sapiens
ggaaaauaaugaucgauuc

SEQ ID NO: 287340 - RNA, 19 nt, Homo sapiens
caguagggcugagauguug

SEQ ID NO: 287341 - RNA, 19 nt, Homo sapiens
cuacgucuuuacugcauaa

SEQ ID NO: 287342 - RNA, 19 nt, Homo sapiens
caaagaggaaccagaaaca

SEQ ID NO: 287343 - RNA, 19 nt, Homo sapiens
caaagugggaugucucuuc

SEQ ID NO: 287344 - RNA, 19 nt, Homo sapiens
ggacaaggaagccaagucu

SEQ ID NO: 287345 - RNA, 19 nt, Homo sapiens
gaagaaagaaaucacuaac

SEQ ID NO: 287346 - RNA, 19 nt, Homo sapiens
ucaggagacucugugguuu

SEQ ID NO: 287347 - RNA, 19 nt, Homo sapiens
gaacaugcuucaggagacu

SEQ ID NO: 287348 - RNA, 19 nt, Homo sapiens
cagaaacaauagaagaaca

SEQ ID NO: 287349 - RNA, 19 nt, Homo sapiens
ggaaccagaaacaauagaa

SEQ ID NO: 287350 - RNA, 19 nt, Homo sapiens
aacggaaccuucaaacuau

SEQ ID NO: 287351 - RNA, 19 nt, Homo sapiens
gugaaaggcccacauaugg

SEQ ID NO: 287352 - RNA, 19 nt, Homo sapiens
gcaauucaacaaccucuuc

SEQ ID NO: 287353 - RNA, 19 nt, Homo sapiens
gaacaccgucccucauuac

SEQ ID NO: 287354 - RNA, 19 nt, Homo sapiens
cagcuucucuaaacuccaa

SEQ ID NO: 287355 - RNA, 19 nt, Homo sapiens
caaguccagcucaugauaa

SEQ ID NO: 287356 - RNA, 19 nt, Homo sapiens
agagccaucuggagaagaa

SEQ ID NO: 287357 - RNA, 19 nt, Homo sapiens
aaacuaaagaugacucaga

SEQ ID NO: 287358 - RNA, 19 nt, Homo sapiens
ccacauauggagaaguaaa

SEQ ID NO: 287359 - RNA, 19 nt, Homo sapiens
gaaaguauagcaugaaacc

SEQ ID NO: 287360 - RNA, 19 nt, Homo sapiens
ccucacaggccaauuauuc

SEQ ID NO: 287361 - RNA, 19 nt, Homo sapiens
ggaagccaagucuuucuga

SEQ ID NO: 287362 - RNA, 19 nt, Homo sapiens
ggagaagaaacaguagaaa

SEQ ID NO: 287363 - RNA, 19 nt, Homo sapiens
gcaguguugccacaaacua

SEQ ID NO: 287364 - RNA, 19 nt, Homo sapiens
ggucaaagcagagugaaca

SEQ ID NO: 287365 - RNA, 19 nt, Homo sapiens
gaagagagugaagcuugaa

SEQ ID NO: 287366 - RNA, 19 nt, Homo sapiens
ggaagaauguggagaguuu

SEQ ID NO: 287367 - RNA, 19 nt, Homo sapiens
gagaggaucuauauuugua

SEQ ID NO: 287368 - RNA, 19 nt, Homo sapiens
ggaaaugagucaacagaug

SEQ ID NO: 287369 - RNA, 19 nt, Homo sapiens
ccacuuggcuccauucaga

SEQ ID NO: 287370 - RNA, 19 nt, Homo sapiens
gaaaugagucaacagauga

SEQ ID NO: 287371 - RNA, 19 nt, Homo sapiens
gcagcgaccacccgaauua

SEQ ID NO: 287372 - RNA, 19 nt, Homo sapiens
ucaaguauuuguccacaga

SEQ ID NO: 287373 - RNA, 19 nt, Homo sapiens
ucaguacgcugcccgaaga

SEQ ID NO: 287374 - RNA, 19 nt, Homo sapiens
gaugaugggcucccugaaa

SEQ ID NO: 287375 - RNA, 19 nt, Homo sapiens
gaugagaaggacuuaauga

SEQ ID NO: 287376 - RNA, 19 nt, Homo sapiens
ggaaggauagccucuugaa

SEQ ID NO: 287377 - RNA, 19 nt, Homo sapiens
cuucacaucuucaaguauu

SEQ ID NO: 287378 - RNA, 19 nt, Homo sapiens
gggcuaaauuaucucuauu

SEQ ID NO: 287379 - RNA, 19 nt, Homo sapiens
ugagucaacagaugaauuu

SEQ ID NO: 287380 - RNA, 19 nt, Homo sapiens
agagugggcugguuguguu

SEQ ID NO: 287381 - RNA, 19 nt, Homo sapiens
ugucaccucccuucuguua

SEQ ID NO: 287382 - RNA, 19 nt, Homo sapiens
ccucaaggcucggaagaau

SEQ ID NO: 287383 - RNA, 19 nt, Homo sapiens
gagacccugugcagauuga

SEQ ID NO: 287384 - RNA, 19 nt, Homo sapiens
cacaacggcucgccuaagu

SEQ ID NO: 287385 - RNA, 19 nt, Homo sapiens
gagguggucuggaaaugag

SEQ ID NO: 287386 - RNA, 19 nt, Homo sapiens
ggaacuguguggccucucu

SEQ ID NO: 287387 - RNA, 19 nt, Homo sapiens
ucaccucccuucuguuauc

SEQ ID NO: 287388 - RNA, 19 nt, Homo sapiens
gucccuaucucuguguaua

SEQ ID NO: 287389 - RNA, 19 nt, Homo sapiens
gcaagagguggucuggaaa

SEQ ID NO: 287390 - RNA, 19 nt, Homo sapiens
gagcagcgaccacccgaau

SEQ ID NO: 287391 - RNA, 19 nt, Homo sapiens
agcaagagguggucuggaa

SEQ ID NO: 287392 - RNA, 19 nt, Homo sapiens
gccuggauuucuccuguaa

SEQ ID NO: 287393 - RNA, 19 nt, Homo sapiens
ggaggaaccagcucaguac

SEQ ID NO: 287394 - RNA, 19 nt, Homo sapiens
agaaggacuuaaugacuca

SEQ ID NO: 287395 - RNA, 19 nt, Homo sapiens
ggaaacuucacaucuucaa

SEQ ID NO: 287396 - RNA, 19 nt, Homo sapiens
cagaugagaaggacuuaau

SEQ ID NO: 287397 - RNA, 19 nt, Homo sapiens
ggguggcccucagguguaa

SEQ ID NO: 287398 - RNA, 19 nt, Homo sapiens
cuaccacaauugccugaga

SEQ ID NO: 287399 - RNA, 19 nt, Homo sapiens
ucaaggcucggaagaaugu

SEQ ID NO: 287400 - RNA, 19 nt, Homo sapiens
ucacagcccucaccuaccu

SEQ ID NO: 287401 - RNA, 19 nt, Homo sapiens
cggagacccugugcagauu

SEQ ID NO: 287402 - RNA, 19 nt, Homo sapiens
cggaggaaccagcucagua

SEQ ID NO: 287403 - RNA, 19 nt, Homo sapiens
gagcugucauuccggaucu

SEQ ID NO: 287404 - RNA, 19 nt, Homo sapiens
ugucgcaggugucguguca

SEQ ID NO: 287405 - RNA, 19 nt, Homo sapiens
cccuuccucucuauuuaua

SEQ ID NO: 287406 - RNA, 19 nt, Homo sapiens
caagagguggucuggaaau

SEQ ID NO: 287407 - RNA, 19 nt, Homo sapiens
cgugucaccucccuucugu

SEQ ID NO: 287408 - RNA, 19 nt, Homo sapiens
ucaugcugcugcucuaugu

SEQ ID NO: 287409 - RNA, 19 nt, Homo sapiens
ggacccugaaccugucuaa

SEQ ID NO: 287410 - RNA, 19 nt, Homo sapiens
ccacagggcacuggaaugg

SEQ ID NO: 287411 - RNA, 19 nt, Homo sapiens
cauucuggccgcuguauga

SEQ ID NO: 287412 - RNA, 19 nt, Homo sapiens
gaaggauagccucuugaag

SEQ ID NO: 287413 - RNA, 19 nt, Homo sapiens
gcacaacggcucgccuaag

SEQ ID NO: 287414 - RNA, 19 nt, Homo sapiens
ggugugcugugaagauguc

SEQ ID NO: 287415 - RNA, 19 nt, Homo sapiens
ugucgugucagccgcaaua

SEQ ID NO: 287416 - RNA, 19 nt, Homo sapiens
uucccuuccucucuauuua

SEQ ID NO: 287417 - RNA, 19 nt, Homo sapiens
gaccaaacagcuuccucuu

SEQ ID NO: 287418 - RNA, 19 nt, Homo sapiens
ccacucaagccaugcacaa

SEQ ID NO: 287419 - RNA, 19 nt, Homo sapiens
gggccucuguuuccggaau

SEQ ID NO: 287420 - RNA, 19 nt, Homo sapiens
cccuaucucuguguauaaa

SEQ ID NO: 287421 - RNA, 19 nt, Homo sapiens
cauugucccugcuggagau

SEQ ID NO: 287422 - RNA, 19 nt, Homo sapiens
ugagaaggacuuaaugacu

SEQ ID NO: 287423 - RNA, 19 nt, Homo sapiens
ggagacccugugcagauug

SEQ ID NO: 287424 - RNA, 19 nt, Homo sapiens
guugauaguggcagcaaga

SEQ ID NO: 287425 - RNA, 19 nt, Homo sapiens
guggugugcugugaagaug

SEQ ID NO: 287426 - RNA, 19 nt, Homo sapiens
gccugagccucuaccacaa

SEQ ID NO: 287427 - RNA, 19 nt, Homo sapiens
ggccucuguuuccggaauu

SEQ ID NO: 287428 - RNA, 19 nt, Homo sapiens
ggggcuaaauuaucucuau

SEQ ID NO: 287429 - RNA, 19 nt, Homo sapiens
cugagccucuaccacaauu

SEQ ID NO: 287430 - RNA, 19 nt, Homo sapiens
gaaacuucacaucuucaag

SEQ ID NO: 287431 - RNA, 19 nt, Homo sapiens
ggggaaacuucacaucuuc

SEQ ID NO: 287432 - RNA, 19 nt, Homo sapiens
gaaucccagucuccuucug

SEQ ID NO: 287433 - RNA, 19 nt, Homo sapiens
guaaccgcgucucccgaau

SEQ ID NO: 287434 - RNA, 19 nt, Homo sapiens
acagcuuucuugcgucuca

SEQ ID NO: 287435 - RNA, 19 nt, Homo sapiens
gaacuguguggccucucuu

SEQ ID NO: 287436 - RNA, 19 nt, Homo sapiens
ccaagagccccuucccaua

SEQ ID NO: 287437 - RNA, 19 nt, Homo sapiens
cagcgaccacccgaauuaa

SEQ ID NO: 287438 - RNA, 19 nt, Homo sapiens
gcagcaacgagcuccaauc

SEQ ID NO: 287439 - RNA, 19 nt, Homo sapiens
uuucuugcgucucauuugu

SEQ ID NO: 287440 - RNA, 19 nt, Homo sapiens
ucuagaagccugucgaaaa

SEQ ID NO: 287441 - RNA, 19 nt, Homo sapiens
guagcuacgaccugucaga

SEQ ID NO: 287442 - RNA, 19 nt, Homo sapiens
aagagguggucuggaaaug

SEQ ID NO: 287443 - RNA, 19 nt, Homo sapiens
ccucugguccgccuggauu

SEQ ID NO: 287444 - RNA, 19 nt, Homo sapiens
uaccacaauugccugagau

SEQ ID NO: 287445 - RNA, 19 nt, Homo sapiens
caaguaugaagccaaagca

SEQ ID NO: 287446 - RNA, 19 nt, Homo sapiens
gguguaacugugucugaga

SEQ ID NO: 287447 - RNA, 19 nt, Homo sapiens
caauaaacagaagccagaa

SEQ ID NO: 287448 - RNA, 19 nt, Homo sapiens
agagaggaucuauauuugu

SEQ ID NO: 287449 - RNA, 19 nt, Homo sapiens
gcggcuucgucgucuucua

SEQ ID NO: 287450 - RNA, 19 nt, Homo sapiens
cgccuggauuucuccugua

SEQ ID NO: 287451 - RNA, 19 nt, Homo sapiens
ucacaucuucaaguauuug

SEQ ID NO: 287452 - RNA, 19 nt, Homo sapiens
gcaagaagccggagcauga

SEQ ID NO: 287453 - RNA, 19 nt, Homo sapiens
caaauaaccuguaucucaa

SEQ ID NO: 287454 - RNA, 19 nt, Homo sapiens
gaacaaacacacuggcuaa

SEQ ID NO: 287455 - RNA, 19 nt, Homo sapiens
gcuaugaguuuaagaaguu

SEQ ID NO: 287456 - RNA, 19 nt, Homo sapiens
ggcaagaccugcaaagauu

SEQ ID NO: 287457 - RNA, 19 nt, Homo sapiens
gcgcaucgaucuucacaaa

SEQ ID NO: 287458 - RNA, 19 nt, Homo sapiens
ggagugguauucugguaua

SEQ ID NO: 287459 - RNA, 19 nt, Homo sapiens
ugacuguguuugagaauua

SEQ ID NO: 287460 - RNA, 19 nt, Homo sapiens
gcuauugacuucccugaaa

SEQ ID NO: 287461 - RNA, 19 nt, Homo sapiens
ggacaucccgcacaucuuu

SEQ ID NO: 287462 - RNA, 19 nt, Homo sapiens
gcugaauucuuuacaacua

SEQ ID NO: 287463 - RNA, 19 nt, Homo sapiens
caacauggauggcagcaau

SEQ ID NO: 287464 - RNA, 19 nt, Homo sapiens
gaaagaauaagaacagaga

SEQ ID NO: 287465 - RNA, 19 nt, Homo sapiens
caaagaggaugacugugaa

SEQ ID NO: 287466 - RNA, 19 nt, Homo sapiens
gacaaugacugugaggaua

SEQ ID NO: 287467 - RNA, 19 nt, Homo sapiens
cauauagccuccauccuaa

SEQ ID NO: 287468 - RNA, 19 nt, Homo sapiens
gcaaccaguuuguggauug

SEQ ID NO: 287469 - RNA, 19 nt, Homo sapiens
ucaaauaaccuguaucuca

SEQ ID NO: 287470 - RNA, 19 nt, Homo sapiens
gcaccauucucaagaguau

SEQ ID NO: 287471 - RNA, 19 nt, Homo sapiens
gcacagaccggaagauugu

SEQ ID NO: 287472 - RNA, 19 nt, Homo sapiens
gcaaagacaagaaggaguu

SEQ ID NO: 287473 - RNA, 19 nt, Homo sapiens
gaagugcgauggcgaggau

SEQ ID NO: 287474 - RNA, 19 nt, Homo sapiens
ugacuucccugaaagcaaa

SEQ ID NO: 287475 - RNA, 19 nt, Homo sapiens
gcugauggcucccgacaau

SEQ ID NO: 287476 - RNA, 19 nt, Homo sapiens
ggagaaaggguacuuguuc

SEQ ID NO: 287477 - RNA, 19 nt, Homo sapiens
gagaucaaauaaccuguau

SEQ ID NO: 287478 - RNA, 19 nt, Homo sapiens
gcaagcgagcacaguauua

SEQ ID NO: 287479 - RNA, 19 nt, Homo sapiens
ccucugacgugguccuuua

SEQ ID NO: 287480 - RNA, 19 nt, Homo sapiens
gcucagaggcccaguuuga

SEQ ID NO: 287481 - RNA, 19 nt, Homo sapiens
gcaaagacaaugccacaga

SEQ ID NO: 287482 - RNA, 19 nt, Homo sapiens
ucaugaagcuccacaagga

SEQ ID NO: 287483 - RNA, 19 nt, Homo sapiens
ggugugaggugaacaagug

SEQ ID NO: 287484 - RNA, 19 nt, Homo sapiens
gaccagggcuuugauguca

SEQ ID NO: 287485 - RNA, 19 nt, Homo sapiens
gcacaaacccugccuucau

SEQ ID NO: 287486 - RNA, 19 nt, Homo sapiens
caacagcugugaacucucu

SEQ ID NO: 287487 - RNA, 19 nt, Homo sapiens
gcacaggcguggagacagu

SEQ ID NO: 287488 - RNA, 19 nt, Homo sapiens
gcgggaagcugcuggacaa

SEQ ID NO: 287489 - RNA, 19 nt, Homo sapiens
gaaacaaaguccauuaacc

SEQ ID NO: 287490 - RNA, 19 nt, Homo sapiens
ggacagaccagggcuuuga

SEQ ID NO: 287491 - RNA, 19 nt, Homo sapiens
gaggaugacugugaacaug

SEQ ID NO: 287492 - RNA, 19 nt, Homo sapiens
gccaauguccugacccuua

SEQ ID NO: 287493 - RNA, 19 nt, Homo sapiens
uuaagaaguuccugcugua

SEQ ID NO: 287494 - RNA, 19 nt, Homo sapiens
gcgaaggcauuguguguuc

SEQ ID NO: 287495 - RNA, 19 nt, Homo sapiens
ccacagguaucugcacaaa

SEQ ID NO: 287496 - RNA, 19 nt, Homo sapiens
gcuaugacaccaauaagaa

SEQ ID NO: 287497 - RNA, 19 nt, Homo sapiens
gcucggaacucuaccucuu

SEQ ID NO: 287498 - RNA, 19 nt, Homo sapiens
ccgcugcacugccuacuuu

SEQ ID NO: 287499 - RNA, 19 nt, Homo sapiens
caacacccauggcagcuau

SEQ ID NO: 287500 - RNA, 19 nt, Homo sapiens
gacaaagacugugcugaug

SEQ ID NO: 287501 - RNA, 19 nt, Homo sapiens
uaaagggcuucguggauga

SEQ ID NO: 287502 - RNA, 19 nt, Homo sapiens
acagacggcuccuucauau

SEQ ID NO: 287503 - RNA, 19 nt, Homo sapiens
gcggagagccugaugaugu

SEQ ID NO: 287504 - RNA, 19 nt, Homo sapiens
ggacaacaccaccugcuau

SEQ ID NO: 287505 - RNA, 19 nt, Homo sapiens
agacgaggcugcucacugu

SEQ ID NO: 287506 - RNA, 19 nt, Homo sapiens
caagcuaugacaccaauaa

SEQ ID NO: 287507 - RNA, 19 nt, Homo sapiens
gcaucgaucuucacaaagg

SEQ ID NO: 287508 - RNA, 19 nt, Homo sapiens
gcaaagcguggguguguga

SEQ ID NO: 287509 - RNA, 19 nt, Homo sapiens
ggaccgcucugaugagucu

SEQ ID NO: 287510 - RNA, 19 nt, Homo sapiens
gaucaaauaaccuguaucu

SEQ ID NO: 287511 - RNA, 19 nt, Homo sapiens
gcugcaacauguucgauga

SEQ ID NO: 287512 - RNA, 19 nt, Homo sapiens
ggagugugauggcgagaau

SEQ ID NO: 287513 - RNA, 19 nt, Homo sapiens
acaaagaggaugacuguga

SEQ ID NO: 287514 - RNA, 19 nt, Homo sapiens
gcugugacauggaccaguu

SEQ ID NO: 287515 - RNA, 19 nt, Homo sapiens
ggacugcccugaguucaag

SEQ ID NO: 287516 - RNA, 19 nt, Homo sapiens
gggaaacaaaguccauuaa

SEQ ID NO: 287517 - RNA, 19 nt, Homo sapiens
ccaagcacuucguguguga

SEQ ID NO: 287518 - RNA, 19 nt, Homo sapiens
gacaagcuaugacaccaau

SEQ ID NO: 287519 - RNA, 19 nt, Homo sapiens
gagaagcgcauccuuugga

SEQ ID NO: 287520 - RNA, 19 nt, Homo sapiens
caguuuaccugcaacaaug

SEQ ID NO: 287521 - RNA, 19 nt, Homo sapiens
acauauagccuccauccua

SEQ ID NO: 287522 - RNA, 19 nt, Homo sapiens
ggaugggacugaugaagag

SEQ ID NO: 287523 - RNA, 19 nt, Homo sapiens
caaggaagagugugaugaa

SEQ ID NO: 287524 - RNA, 19 nt, Homo sapiens
ggauggcucugacgagauc

SEQ ID NO: 287525 - RNA, 19 nt, Homo sapiens
gagcacaagaugaguuuga

SEQ ID NO: 287526 - RNA, 19 nt, Homo sapiens
ccaauguccugacccuuau

SEQ ID NO: 287527 - RNA, 19 nt, Homo sapiens
gacgggaagucaugcaaga

SEQ ID NO: 287528 - RNA, 19 nt, Homo sapiens
gcaagaccugcaaagauuu

SEQ ID NO: 287529 - RNA, 19 nt, Homo sapiens
gagaguguccgcauugaug

SEQ ID NO: 287530 - RNA, 19 nt, Homo sapiens
cgagaaagcggccuacugu

SEQ ID NO: 287531 - RNA, 19 nt, Homo sapiens
gaguuccgcugcaaggauu

SEQ ID NO: 287532 - RNA, 19 nt, Homo sapiens
gcaaugggcaggacaacug

SEQ ID NO: 287533 - RNA, 19 nt, Homo sapiens
ccaacuacacguuacuuaa

SEQ ID NO: 287534 - RNA, 19 nt, Homo sapiens
ccaggaggaucaccauugu

SEQ ID NO: 287535 - RNA, 19 nt, Homo sapiens
gaccagacguggcgugaag

SEQ ID NO: 287536 - RNA, 19 nt, Homo sapiens
ggagugggcuggaggucau

SEQ ID NO: 287537 - RNA, 19 nt, Homo sapiens
aaagcaaacucuacuggau

SEQ ID NO: 287538 - RNA, 19 nt, Homo sapiens
gagaguaaccuggaucaga

SEQ ID NO: 287539 - RNA, 19 nt, Homo sapiens
caucucaaaugcagccaaa

SEQ ID NO: 287540 - RNA, 19 nt, Homo sapiens
gcucagacccgcaagacuu

SEQ ID NO: 287541 - RNA, 19 nt, Homo sapiens
gcagcagccaggacauaua

SEQ ID NO: 287542 - RNA, 19 nt, Homo sapiens
ucacccaccucaacauuuc

SEQ ID NO: 287543 - RNA, 19 nt, Homo sapiens
gaggaaccguuucugaucu

SEQ ID NO: 287544 - RNA, 19 nt, Homo sapiens
ugacaaagaggaugacugu

SEQ ID NO: 287545 - RNA, 19 nt, Homo sapiens
ucacagugcuagacuacga

SEQ ID NO: 287546 - RNA, 19 nt, Homo sapiens
agaguaaccuggaucagau

SEQ ID NO: 287547 - RNA, 19 nt, Homo sapiens
gaggagccaugccugugaa

SEQ ID NO: 287548 - RNA, 19 nt, Homo sapiens
acaggcaacuucuacuuug

SEQ ID NO: 287549 - RNA, 19 nt, Homo sapiens
caucaauaaucgugucuuc

SEQ ID NO: 287550 - RNA, 19 nt, Homo sapiens
ggccguggauuaucacaau

SEQ ID NO: 287551 - RNA, 19 nt, Homo sapiens
gcaccuguguguccaacug

SEQ ID NO: 287552 - RNA, 19 nt, Homo sapiens
gaagaugacuguaaagaua

SEQ ID NO: 287553 - RNA, 19 nt, Homo sapiens
gcagaugugugcccaauua

SEQ ID NO: 287554 - RNA, 19 nt, Homo sapiens
gagaaaggcuguggcauua

SEQ ID NO: 287555 - RNA, 19 nt, Homo sapiens
ggucagaugucaagaauaa

SEQ ID NO: 287556 - RNA, 19 nt, Homo sapiens
gaacaugccuagcugauga

SEQ ID NO: 287557 - RNA, 19 nt, Homo sapiens
gaacagugcuugugucaga

SEQ ID NO: 287558 - RNA, 19 nt, Homo sapiens
ggacugugcugauuaguaa

SEQ ID NO: 287559 - RNA, 19 nt, Homo sapiens
ggaaagaccugccggcaaa

SEQ ID NO: 287560 - RNA, 19 nt, Homo sapiens
caagauugcucacaaagua

SEQ ID NO: 287561 - RNA, 19 nt, Homo sapiens
gaaaucaacugcacugaga

SEQ ID NO: 287562 - RNA, 19 nt, Homo sapiens
gcacaguaguucaguauuu

SEQ ID NO: 287563 - RNA, 19 nt, Homo sapiens
guagacaacugccaugaua

SEQ ID NO: 287564 - RNA, 19 nt, Homo sapiens
ggaaagaacugucaugucu

SEQ ID NO: 287565 - RNA, 19 nt, Homo sapiens
gauggaagcuaucggguua

SEQ ID NO: 287566 - RNA, 19 nt, Homo sapiens
gaaaugugauggacagaaa

SEQ ID NO: 287567 - RNA, 19 nt, Homo sapiens
gaaagcagaugguggagaa

SEQ ID NO: 287568 - RNA, 19 nt, Homo sapiens
ggaguaagcuuauuugaag

SEQ ID NO: 287569 - RNA, 19 nt, Homo sapiens
gaaauuggcugcgcuguug

SEQ ID NO: 287570 - RNA, 19 nt, Homo sapiens
cauaaacccuucugagaua

SEQ ID NO: 287571 - RNA, 19 nt, Homo sapiens
gaaagaacaugugcugaaa

SEQ ID NO: 287572 - RNA, 19 nt, Homo sapiens
gagaagagauuguauugga

SEQ ID NO: 287573 - RNA, 19 nt, Homo sapiens
gaacagauaaugaugguuu

SEQ ID NO: 287574 - RNA, 19 nt, Homo sapiens
ggagaaguauggaaacaaa

SEQ ID NO: 287575 - RNA, 19 nt, Homo sapiens
ggacuuguguugauauuga

SEQ ID NO: 287576 - RNA, 19 nt, Homo sapiens
gugcauaccucgugaguuu

SEQ ID NO: 287577 - RNA, 19 nt, Homo sapiens
caacaacccuugcuuggaa

SEQ ID NO: 287578 - RNA, 19 nt, Homo sapiens
gggaacagcugcucagauu

SEQ ID NO: 287579 - RNA, 19 nt, Homo sapiens
uaaagaagacucugaagua

SEQ ID NO: 287580 - RNA, 19 nt, Homo sapiens
gcaaacaaguucacagaga

SEQ ID NO: 287581 - RNA, 19 nt, Homo sapiens
ggauuuaucugcuccugua

SEQ ID NO: 287582 - RNA, 19 nt, Homo sapiens
gaacgggacugugagauga

SEQ ID NO: 287583 - RNA, 19 nt, Homo sapiens
gauaaucuccaccaaguua

SEQ ID NO: 287584 - RNA, 19 nt, Homo sapiens
ggaagcagcccauaauauu

SEQ ID NO: 287585 - RNA, 19 nt, Homo sapiens
gaagaagacugggccauau

SEQ ID NO: 287586 - RNA, 19 nt, Homo sapiens
gaacuggguugcaauaaag

SEQ ID NO: 287587 - RNA, 19 nt, Homo sapiens
gcauugcuguucagaauuu

SEQ ID NO: 287588 - RNA, 19 nt, Homo sapiens
gaaguugucugaagguaau

SEQ ID NO: 287589 - RNA, 19 nt, Homo sapiens
caaaggaaguuaugagugu

SEQ ID NO: 287590 - RNA, 19 nt, Homo sapiens
gaaaggcuguggcauuaau

SEQ ID NO: 287591 - RNA, 19 nt, Homo sapiens
gacgaugcaucuccauuua

SEQ ID NO: 287592 - RNA, 19 nt, Homo sapiens
gggcagaucuuaacaugga

SEQ ID NO: 287593 - RNA, 19 nt, Homo sapiens
gaggguagcucuccuuugu

SEQ ID NO: 287594 - RNA, 19 nt, Homo sapiens
aacaaucgcugcauuuaua

SEQ ID NO: 287595 - RNA, 19 nt, Homo sapiens
gacaaugacuguggagaua

SEQ ID NO: 287596 - RNA, 19 nt, Homo sapiens
ggacuggguuaauaauaaa

SEQ ID NO: 287597 - RNA, 19 nt, Homo sapiens
gcaggauucuuccacuaua

SEQ ID NO: 287598 - RNA, 19 nt, Homo sapiens
gcaaagugauggcaagaau

SEQ ID NO: 287599 - RNA, 19 nt, Homo sapiens
caacaagucugugauaauc

SEQ ID NO: 287600 - RNA, 19 nt, Homo sapiens
caacaacaccuucugcuuu

SEQ ID NO: 287601 - RNA, 19 nt, Homo sapiens
gaagugauggcuacguuua

SEQ ID NO: 287602 - RNA, 19 nt, Homo sapiens
ugagguugguuguguauua

SEQ ID NO: 287603 - RNA, 19 nt, Homo sapiens
ugacggaucucaccucuug

SEQ ID NO: 287604 - RNA, 19 nt, Homo sapiens
ggacaacagugaugagcaa

SEQ ID NO: 287605 - RNA, 19 nt, Homo sapiens
guuacaagcucaugucuga

SEQ ID NO: 287606 - RNA, 19 nt, Homo sapiens
ggacaauggugaacgaugu

SEQ ID NO: 287607 - RNA, 19 nt, Homo sapiens
cagcagaggucaacaacaa

SEQ ID NO: 287608 - RNA, 19 nt, Homo sapiens
guucagaauuuccucauuu

SEQ ID NO: 287609 - RNA, 19 nt, Homo sapiens
gaucacaacugcacagaca

SEQ ID NO: 287610 - RNA, 19 nt, Homo sapiens
gaaguucugcggaucaaua

SEQ ID NO: 287611 - RNA, 19 nt, Homo sapiens
ucaaauggcuguagcaaca

SEQ ID NO: 287612 - RNA, 19 nt, Homo sapiens
gaagaggagugauugaaag

SEQ ID NO: 287613 - RNA, 19 nt, Homo sapiens
ggagcaguguggcuuauuu

SEQ ID NO: 287614 - RNA, 19 nt, Homo sapiens
gaaugaggcuggcuuccaa

SEQ ID NO: 287615 - RNA, 19 nt, Homo sapiens
gagauaugcuugcacaaug

SEQ ID NO: 287616 - RNA, 19 nt, Homo sapiens
gcacugaaguugucugaag

SEQ ID NO: 287617 - RNA, 19 nt, Homo sapiens
gaauauaaguguggcaaug

SEQ ID NO: 287618 - RNA, 19 nt, Homo sapiens
gauaauaacacuucagaug

SEQ ID NO: 287619 - RNA, 19 nt, Homo sapiens
gacaguauuugcuucuaua

SEQ ID NO: 287620 - RNA, 19 nt, Homo sapiens
gaaaagaacugcaauucga

SEQ ID NO: 287621 - RNA, 19 nt, Homo sapiens
cgaugcaucuccauuuaua

SEQ ID NO: 287622 - RNA, 19 nt, Homo sapiens
uauccaagcuguugauuau

SEQ ID NO: 287623 - RNA, 19 nt, Homo sapiens
gaacagcagucuggucaug

SEQ ID NO: 287624 - RNA, 19 nt, Homo sapiens
caagagcaauuguguuaga

SEQ ID NO: 287625 - RNA, 19 nt, Homo sapiens
uaagaccugugaagacaua

SEQ ID NO: 287626 - RNA, 19 nt, Homo sapiens
gugagcagcuuacuuguga

SEQ ID NO: 287627 - RNA, 19 nt, Homo sapiens
caaaguacaugcucaaguc

SEQ ID NO: 287628 - RNA, 19 nt, Homo sapiens
ggacauaggccucaguguu

SEQ ID NO: 287629 - RNA, 19 nt, Homo sapiens
ggacagaagagugguauuu

SEQ ID NO: 287630 - RNA, 19 nt, Homo sapiens
caucauauuuccacuguga

SEQ ID NO: 287631 - RNA, 19 nt, Homo sapiens
guaauaaacacuacucuug

SEQ ID NO: 287632 - RNA, 19 nt, Homo sapiens
gaagcagcccauaauauuu

SEQ ID NO: 287633 - RNA, 19 nt, Homo sapiens
caacucagauacaauaagu

SEQ ID NO: 287634 - RNA, 19 nt, Homo sapiens
gaaaugugauggcgaugau

SEQ ID NO: 287635 - RNA, 19 nt, Homo sapiens
gaacugaaaugcgauggau

SEQ ID NO: 287636 - RNA, 19 nt, Homo sapiens
caagaggacuagcauuaga

SEQ ID NO: 287637 - RNA, 19 nt, Homo sapiens
gaacucaggugacaaaaug

SEQ ID NO: 287638 - RNA, 19 nt, Homo sapiens
ggcaaugagugaagacuuu

SEQ ID NO: 287639 - RNA, 19 nt, Homo sapiens
ggacguuauugaaaccaua

SEQ ID NO: 287640 - RNA, 19 nt, Homo sapiens
gcugauggcuucacgucua

SEQ ID NO: 287641 - RNA, 19 nt, Homo sapiens
ggacaacagcgaugagaaa

SEQ ID NO: 287642 - RNA, 19 nt, Homo sapiens
gaucuucucugaugaacau

SEQ ID NO: 287643 - RNA, 19 nt, Homo sapiens
ggacaguauuugcuucuau

SEQ ID NO: 287644 - RNA, 19 nt, Homo sapiens
gaacagcugcucagauuuc

SEQ ID NO: 287645 - RNA, 19 nt, Homo sapiens
ccaggaagaugucaugguu

SEQ ID NO: 287646 - RNA, 19 nt, Homo sapiens
gaacaugcuugcaacuauc

SEQ ID NO: 287647 - RNA, 19 nt, Homo sapiens
uuaccgagcuaacaaauau

SEQ ID NO: 287648 - RNA, 19 nt, Homo sapiens
gaagugugauuggaaaguu

SEQ ID NO: 287649 - RNA, 19 nt, Homo sapiens
cagaaagacugcucagaug

SEQ ID NO: 287650 - RNA, 19 nt, Homo sapiens
caacugcacagacaccuua

SEQ ID NO: 287651 - RNA, 19 nt, Homo sapiens
ccaccuagaugacuguuug

SEQ ID NO: 287652 - RNA, 19 nt, Homo sapiens
guaccaaccugugcaucuu

SEQ ID NO: 287653 - RNA, 19 nt, Homo sapiens
gcacagccaugcggagaca

SEQ ID NO: 287654 - RNA, 19 nt, Homo sapiens
ugugauggcugguggcauu

SEQ ID NO: 287655 - RNA, 19 nt, Homo sapiens
cagaugaguuccgcuguga

SEQ ID NO: 287656 - RNA, 19 nt, Homo sapiens
cgaccguggugacaugauu

SEQ ID NO: 287657 - RNA, 19 nt, Homo sapiens
gaacugcggcugggcuaug

SEQ ID NO: 287658 - RNA, 19 nt, Homo sapiens
caucagcuuccgcaacuuu

SEQ ID NO: 287659 - RNA, 19 nt, Homo sapiens
gaccguggugacaugauua

SEQ ID NO: 287660 - RNA, 19 nt, Homo sapiens
acgacuacgugcagguaua

SEQ ID NO: 287661 - RNA, 19 nt, Homo sapiens
caucccaccugccuucauc

SEQ ID NO: 287662 - RNA, 19 nt, Homo sapiens
ccgcgaccaugucuggauu

SEQ ID NO: 287663 - RNA, 19 nt, Homo sapiens
ggagcaguagugacaguga

SEQ ID NO: 287664 - RNA, 19 nt, Homo sapiens
cagcuucuacggcuccuuu

SEQ ID NO: 287665 - RNA, 19 nt, Homo sapiens
gcaguggucugugcuacac

SEQ ID NO: 287666 - RNA, 19 nt, Homo sapiens
gaugaguuccgcugugaca

SEQ ID NO: 287667 - RNA, 19 nt, Homo sapiens
gaccaugucuggauuuucu

SEQ ID NO: 287668 - RNA, 19 nt, Homo sapiens
cagugcgguuccugccuua

SEQ ID NO: 287669 - RNA, 19 nt, Homo sapiens
gcugggcuaugacgacuac

SEQ ID NO: 287670 - RNA, 19 nt, Homo sapiens
cagggaauacacagucauu

SEQ ID NO: 287671 - RNA, 19 nt, Homo sapiens
gauggcugguggcauugug

SEQ ID NO: 287672 - RNA, 19 nt, Homo sapiens
guggagacggcucugauga

SEQ ID NO: 287673 - RNA, 19 nt, Homo sapiens
ggacggcagcgaugagcau

SEQ ID NO: 287674 - RNA, 19 nt, Homo sapiens
cgaccagggcugcuucuca

SEQ ID NO: 287675 - RNA, 19 nt, Homo sapiens
ugacgacuacgugcaggua

SEQ ID NO: 287676 - RNA, 19 nt, Homo sapiens
ccuggaggcugaguuugug

SEQ ID NO: 287677 - RNA, 19 nt, Homo sapiens
gcgaugaugaggcccuguu

SEQ ID NO: 287678 - RNA, 19 nt, Homo sapiens
ccuucaagcucuacucacu

SEQ ID NO: 287679 - RNA, 19 nt, Homo sapiens
caacugcagcugguacauc

SEQ ID NO: 287680 - RNA, 19 nt, Homo sapiens
gcugugacggccaggaaga

SEQ ID NO: 287681 - RNA, 19 nt, Homo sapiens
gguaccaaccugugcaucu

SEQ ID NO: 287682 - RNA, 19 nt, Homo sapiens
ucaagucgcuucauuauaa

SEQ ID NO: 287683 - RNA, 19 nt, Homo sapiens
cagaugaacuggauuguua

SEQ ID NO: 287684 - RNA, 19 nt, Homo sapiens
ggacagaccucgagccauu

SEQ ID NO: 287685 - RNA, 19 nt, Homo sapiens
gcagauaucagacgaauuu

SEQ ID NO: 287686 - RNA, 19 nt, Homo sapiens
ggacagaccuggacaccaa

SEQ ID NO: 287687 - RNA, 19 nt, Homo sapiens
ggagggagcuauuagagaa

SEQ ID NO: 287688 - RNA, 19 nt, Homo sapiens
gaagugcuuuguuuaauug

SEQ ID NO: 287689 - RNA, 19 nt, Homo sapiens
gcaaacggccuaacuauug

SEQ ID NO: 287690 - RNA, 19 nt, Homo sapiens
ccacagagcgaucacauua

SEQ ID NO: 287691 - RNA, 19 nt, Homo sapiens
gggaaacuaugacuaauga

SEQ ID NO: 287692 - RNA, 19 nt, Homo sapiens
gcucaaccgugaaguuaua

SEQ ID NO: 287693 - RNA, 19 nt, Homo sapiens
gaacucaauuguccuguau

SEQ ID NO: 287694 - RNA, 19 nt, Homo sapiens
ggaaaggucuccuaaaauu

SEQ ID NO: 287695 - RNA, 19 nt, Homo sapiens
gagaaaggguauauguauu

SEQ ID NO: 287696 - RNA, 19 nt, Homo sapiens
gaagaacugugaagugcuu

SEQ ID NO: 287697 - RNA, 19 nt, Homo sapiens
agacagagcugcaauggau

SEQ ID NO: 287698 - RNA, 19 nt, Homo sapiens
gauagaacgugcuggaaug

SEQ ID NO: 287699 - RNA, 19 nt, Homo sapiens
caaagagaaugcuacgauu

SEQ ID NO: 287700 - RNA, 19 nt, Homo sapiens
gaagaagccauuaaacgaa

SEQ ID NO: 287701 - RNA, 19 nt, Homo sapiens
ggagauauuuguacagaag

SEQ ID NO: 287702 - RNA, 19 nt, Homo sapiens
caagaagugugaucauaau

SEQ ID NO: 287703 - RNA, 19 nt, Homo sapiens
ggcagaccauguacaguua

SEQ ID NO: 287704 - RNA, 19 nt, Homo sapiens
gaagugugaucauaaugug

SEQ ID NO: 287705 - RNA, 19 nt, Homo sapiens
gcuuugaacucaucaguga

SEQ ID NO: 287706 - RNA, 19 nt, Homo sapiens
gccauacgccguucauuua

SEQ ID NO: 287707 - RNA, 19 nt, Homo sapiens
ccagugacuugaacuauga

SEQ ID NO: 287708 - RNA, 19 nt, Homo sapiens
ccaggaaugucucgaggua

SEQ ID NO: 287709 - RNA, 19 nt, Homo sapiens
acacaaagcaugccuuaaa

SEQ ID NO: 287710 - RNA, 19 nt, Homo sapiens
ggacaaaucagaugagaag

SEQ ID NO: 287711 - RNA, 19 nt, Homo sapiens
aaugguggcuguucacaua

SEQ ID NO: 287712 - RNA, 19 nt, Homo sapiens
caaacggccuaacuauuga

SEQ ID NO: 287713 - RNA, 19 nt, Homo sapiens
ugaggaagaucuugauuuc

SEQ ID NO: 287714 - RNA, 19 nt, Homo sapiens
caacagaggcagccaaaug

SEQ ID NO: 287715 - RNA, 19 nt, Homo sapiens
cagcagagccuuuaugaau

SEQ ID NO: 287716 - RNA, 19 nt, Homo sapiens
ccucacauauuuggauuua

SEQ ID NO: 287717 - RNA, 19 nt, Homo sapiens
ggacuggguugcacgaaau

SEQ ID NO: 287718 - RNA, 19 nt, Homo sapiens
ggacaccaacuuaauagaa

SEQ ID NO: 287719 - RNA, 19 nt, Homo sapiens
gcaaagagaaugcuacgau

SEQ ID NO: 287720 - RNA, 19 nt, Homo sapiens
uaugaaagcugcccaccuu

SEQ ID NO: 287721 - RNA, 19 nt, Homo sapiens
gcacuuacuucccugcaau

SEQ ID NO: 287722 - RNA, 19 nt, Homo sapiens
uaacucaguaccaagauua

SEQ ID NO: 287723 - RNA, 19 nt, Homo sapiens
caaagauggugccacagaa

SEQ ID NO: 287724 - RNA, 19 nt, Homo sapiens
gaagugaacguacuaccuu

SEQ ID NO: 287725 - RNA, 19 nt, Homo sapiens
cggcuuagauuauccagaa

SEQ ID NO: 287726 - RNA, 19 nt, Homo sapiens
cgaauuuauuggacugaua

SEQ ID NO: 287727 - RNA, 19 nt, Homo sapiens
ccuaaaggcuacaaauguu

SEQ ID NO: 287728 - RNA, 19 nt, Homo sapiens
acccagagcuauugccuua

SEQ ID NO: 287729 - RNA, 19 nt, Homo sapiens
ccacagugaugaacucaau

SEQ ID NO: 287730 - RNA, 19 nt, Homo sapiens
gauaaacagcagcaaauga

SEQ ID NO: 287731 - RNA, 19 nt, Homo sapiens
gggcagcaccgacaaguuu

SEQ ID NO: 287732 - RNA, 19 nt, Homo sapiens
gcaaagauggugccacaga

SEQ ID NO: 287733 - RNA, 19 nt, Homo sapiens
ggacugacuuuggauuaug

SEQ ID NO: 287734 - RNA, 19 nt, Homo sapiens
ugaagcaacugaguacaaa

SEQ ID NO: 287735 - RNA, 19 nt, Homo sapiens
cagcagaggagaacuauga

SEQ ID NO: 287736 - RNA, 19 nt, Homo sapiens
ugaaagcagugaucucuca

SEQ ID NO: 287737 - RNA, 19 nt, Homo sapiens
ucacucaucucgacaguca

SEQ ID NO: 287738 - RNA, 19 nt, Homo sapiens
gcagagccuuuaugaaugg

SEQ ID NO: 287739 - RNA, 19 nt, Homo sapiens
cuacuggacugaugaugaa

SEQ ID NO: 287740 - RNA, 19 nt, Homo sapiens
gcgguggacuuuguguuua

SEQ ID NO: 287741 - RNA, 19 nt, Homo sapiens
caagucagaugaacuggau

SEQ ID NO: 287742 - RNA, 19 nt, Homo sapiens
ggacuuacuguguuugaaa

SEQ ID NO: 287743 - RNA, 19 nt, Homo sapiens
gagcagauaucagacgaau

SEQ ID NO: 287744 - RNA, 19 nt, Homo sapiens
gcagaggcguagcauugaa

SEQ ID NO: 287745 - RNA, 19 nt, Homo sapiens
ggacagacacuggcacuga

SEQ ID NO: 287746 - RNA, 19 nt, Homo sapiens
cauacgccguucauuuaua

SEQ ID NO: 287747 - RNA, 19 nt, Homo sapiens
gacuuuggauuaugaagaa

SEQ ID NO: 287748 - RNA, 19 nt, Homo sapiens
ucaaguaguucuucaagca

SEQ ID NO: 287749 - RNA, 19 nt, Homo sapiens
gacaccaacuuaauagaau

SEQ ID NO: 287750 - RNA, 19 nt, Homo sapiens
gccgaaggauuuauguauu

SEQ ID NO: 287751 - RNA, 19 nt, Homo sapiens
cagacaagauugagguuau

SEQ ID NO: 287752 - RNA, 19 nt, Homo sapiens
ggauuaugaugaaggcaaa

SEQ ID NO: 287753 - RNA, 19 nt, Homo sapiens
ggaagaucuugauuucaga

SEQ ID NO: 287754 - RNA, 19 nt, Homo sapiens
ccgaugggcuggcauguga

SEQ ID NO: 287755 - RNA, 19 nt, Homo sapiens
ggagugaugucagcgaaga

SEQ ID NO: 287756 - RNA, 19 nt, Homo sapiens
gaacuaugauucagaaccu

SEQ ID NO: 287757 - RNA, 19 nt, Homo sapiens
ccgaaggauuuauguauug

SEQ ID NO: 287758 - RNA, 19 nt, Homo sapiens
ugaaauccauucugacauc

SEQ ID NO: 287759 - RNA, 19 nt, Homo sapiens
ccagagcuauugccuuaga

SEQ ID NO: 287760 - RNA, 19 nt, Homo sapiens
ggaaacaggaauaauaaag

SEQ ID NO: 287761 - RNA, 19 nt, Homo sapiens
gcaacugaguacaaaggaa

SEQ ID NO: 287762 - RNA, 19 nt, Homo sapiens
acaggagcaucaucaagua

SEQ ID NO: 287763 - RNA, 19 nt, Homo sapiens
aagcaacucuauuggauug

SEQ ID NO: 287764 - RNA, 19 nt, Homo sapiens
gaauucggcuuagauuauc

SEQ ID NO: 287765 - RNA, 19 nt, Homo sapiens
agacauuguucugcaguua

SEQ ID NO: 287766 - RNA, 19 nt, Homo sapiens
ggaacuguauacuuuaucu

SEQ ID NO: 287767 - RNA, 19 nt, Homo sapiens
gucuggaacuguauacuuu

SEQ ID NO: 287768 - RNA, 19 nt, Homo sapiens
gcaccugguucuacuucaa

SEQ ID NO: 287769 - RNA, 19 nt, Homo sapiens
gaccucagcauugauauuu

SEQ ID NO: 287770 - RNA, 19 nt, Homo sapiens
ugacagacaaccgaauuua

SEQ ID NO: 287771 - RNA, 19 nt, Homo sapiens
cgaagaagccauuaaacga

SEQ ID NO: 287772 - RNA, 19 nt, Homo sapiens
caacugaguacaaaggaaa

SEQ ID NO: 287773 - RNA, 19 nt, Homo sapiens
gcgauggguuuacugaaug

SEQ ID NO: 287774 - RNA, 19 nt, Homo sapiens
ccauuuggauuaugugaug

SEQ ID NO: 287775 - RNA, 19 nt, Homo sapiens
gcauugagcgugccaacaa

SEQ ID NO: 287776 - RNA, 19 nt, Homo sapiens
ggaugguucugaccgugua

SEQ ID NO: 287777 - RNA, 19 nt, Homo sapiens
gaagugacaaggcucaaug

SEQ ID NO: 287778 - RNA, 19 nt, Homo sapiens
gcacgaaaucuuuauugga

SEQ ID NO: 287779 - RNA, 19 nt, Homo sapiens
gacguuauuugaggacaua

SEQ ID NO: 287780 - RNA, 19 nt, Homo sapiens
gggagaagugccaaagaua

SEQ ID NO: 287781 - RNA, 19 nt, Homo sapiens
ggaugaggcagaccaugua

SEQ ID NO: 287782 - RNA, 19 nt, Homo sapiens
ucaaagccaucgacuauga

SEQ ID NO: 287783 - RNA, 19 nt, Homo sapiens
ugagaaaugugaacuguga

SEQ ID NO: 287784 - RNA, 19 nt, Homo sapiens
guacagcgauuauaucuac

SEQ ID NO: 287785 - RNA, 19 nt, Homo sapiens
gcaagcaucucuacuggau

SEQ ID NO: 287786 - RNA, 19 nt, Homo sapiens
ccaacgaccucaccauuga

SEQ ID NO: 287787 - RNA, 19 nt, Homo sapiens
gcucaaagcugugaaugug

SEQ ID NO: 287788 - RNA, 19 nt, Homo sapiens
guucuacucuucaaacauu

SEQ ID NO: 287789 - RNA, 19 nt, Homo sapiens
ggaccgaccuggacaccaa

SEQ ID NO: 287790 - RNA, 19 nt, Homo sapiens
guacaggcccuacaucauu

SEQ ID NO: 287791 - RNA, 19 nt, Homo sapiens
gcacgaaggccacgcugua

SEQ ID NO: 287792 - RNA, 19 nt, Homo sapiens
gcaugacgcugguggacaa

SEQ ID NO: 287793 - RNA, 19 nt, Homo sapiens
gacaagcucccgcacauuu

SEQ ID NO: 287794 - RNA, 19 nt, Homo sapiens
gcaaguacuaccuggauuu

SEQ ID NO: 287795 - RNA, 19 nt, Homo sapiens
ccgacgagcucauguguga

SEQ ID NO: 287796 - RNA, 19 nt, Homo sapiens
ccucagcccuggacuuuga

SEQ ID NO: 287797 - RNA, 19 nt, Homo sapiens
cgucauggguggugucuau

SEQ ID NO: 287798 - RNA, 19 nt, Homo sapiens
gagcucaugugugaaauca

SEQ ID NO: 287799 - RNA, 19 nt, Homo sapiens
gccuggagcugcugaguga

SEQ ID NO: 287800 - RNA, 19 nt, Homo sapiens
ggaaggccagcaaguacua

SEQ ID NO: 287801 - RNA, 19 nt, Homo sapiens
cgucaaagccaucgacuau

SEQ ID NO: 287802 - RNA, 19 nt, Homo sapiens
ggacggaccuacggaggau

SEQ ID NO: 287803 - RNA, 19 nt, Homo sapiens
gcacagcccggaucucauc

SEQ ID NO: 287804 - RNA, 19 nt, Homo sapiens
ggacauguucuacucuuca

SEQ ID NO: 287805 - RNA, 19 nt, Homo sapiens
gccgggacgucaucauuga

SEQ ID NO: 287806 - RNA, 19 nt, Homo sapiens
caugagaaaugugaacugu

SEQ ID NO: 287807 - RNA, 19 nt, Homo sapiens
aguacuaccuggauuugaa

SEQ ID NO: 287808 - RNA, 19 nt, Homo sapiens
gaucgagucguccaacaug

SEQ ID NO: 287809 - RNA, 19 nt, Homo sapiens
guacaguggaacaaauauu

SEQ ID NO: 287810 - RNA, 19 nt, Homo sapiens
gacgagcucaugugugaaa

SEQ ID NO: 287811 - RNA, 19 nt, Homo sapiens
ggagcuacuuccaucucuu

SEQ ID NO: 287812 - RNA, 19 nt, Homo sapiens
gaccugaagcgcauugaga

SEQ ID NO: 287813 - RNA, 19 nt, Homo sapiens
aaucgagugugccaacuug

SEQ ID NO: 287814 - RNA, 19 nt, Homo sapiens
gacauguucuacucuucaa

SEQ ID NO: 287815 - RNA, 19 nt, Homo sapiens
gcaguacagcgauuauauc

SEQ ID NO: 287816 - RNA, 19 nt, Homo sapiens
gaccuggacaccaacauga

SEQ ID NO: 287817 - RNA, 19 nt, Homo sapiens
gacaacggcaggacgugua

SEQ ID NO: 287818 - RNA, 19 nt, Homo sapiens
ccucgccgcuccugcuauu

SEQ ID NO: 287819 - RNA, 19 nt, Homo sapiens
ccaccaagggcuacaucua

SEQ ID NO: 287820 - RNA, 19 nt, Homo sapiens
cagacaagaucgaggugau

SEQ ID NO: 287821 - RNA, 19 nt, Homo sapiens
gcacaacaacgggcagugu

SEQ ID NO: 287822 - RNA, 19 nt, Homo sapiens
gcauggccguugacuggau

SEQ ID NO: 287823 - RNA, 19 nt, Homo sapiens
ggacaagcucccgcacauu

SEQ ID NO: 287824 - RNA, 19 nt, Homo sapiens
gauggcagcacccggaaga

SEQ ID NO: 287825 - RNA, 19 nt, Homo sapiens
gcgacugggugggcaagaa

SEQ ID NO: 287826 - RNA, 19 nt, Homo sapiens
gcgaggaggccaucaagca

SEQ ID NO: 287827 - RNA, 19 nt, Homo sapiens
gcagccaccugugcuucuu

SEQ ID NO: 287828 - RNA, 19 nt, Homo sapiens
aagcgagccuuucuacaca

SEQ ID NO: 287829 - RNA, 19 nt, Homo sapiens
cagacgaggcggacuguga

SEQ ID NO: 287830 - RNA, 19 nt, Homo sapiens
ggacccagcccuuuguuuu

SEQ ID NO: 287831 - RNA, 19 nt, Homo sapiens
ggccaacgaccucaccauu

SEQ ID NO: 287832 - RNA, 19 nt, Homo sapiens
gauccugagugcccucuac

SEQ ID NO: 287833 - RNA, 19 nt, Homo sapiens
guucucagcccacccaugu

SEQ ID NO: 287834 - RNA, 19 nt, Homo sapiens
ccaccucacuggcauccau

SEQ ID NO: 287835 - RNA, 19 nt, Homo sapiens
ggaaucugcacagcauuga

SEQ ID NO: 287836 - RNA, 19 nt, Homo sapiens
gccaacgaccucaccauug

SEQ ID NO: 287837 - RNA, 19 nt, Homo sapiens
gcccuggacuuugaugugu

SEQ ID NO: 287838 - RNA, 19 nt, Homo sapiens
ggccucagcccuggacuuu

SEQ ID NO: 287839 - RNA, 19 nt, Homo sapiens
gagcuacuuccaucucuuc

SEQ ID NO: 287840 - RNA, 19 nt, Homo sapiens
ucaagcagaccuaccugaa

SEQ ID NO: 287841 - RNA, 19 nt, Homo sapiens
gccaguguguccucaucaa

SEQ ID NO: 287842 - RNA, 19 nt, Homo sapiens
gggcugggagaacuuugua

SEQ ID NO: 287843 - RNA, 19 nt, Homo sapiens
caaguacuaccuggauuug

SEQ ID NO: 287844 - RNA, 19 nt, Homo sapiens
ccaacaaccacaucuacug

SEQ ID NO: 287845 - RNA, 19 nt, Homo sapiens
ugaugggccucauguacug

SEQ ID NO: 287846 - RNA, 19 nt, Homo sapiens
ugggagaacuuuguacagu

SEQ ID NO: 287847 - RNA, 19 nt, Homo sapiens
ugcggaaaguccaugauga

SEQ ID NO: 287848 - RNA, 19 nt, Homo sapiens
gaucgagcguguggagaag

SEQ ID NO: 287849 - RNA, 19 nt, Homo sapiens
cagcacagcccggaucuca

SEQ ID NO: 287850 - RNA, 19 nt, Homo sapiens
ugacgcaguacagcgauua

SEQ ID NO: 287851 - RNA, 19 nt, Homo sapiens
ggacggacucagagaccaa

SEQ ID NO: 287852 - RNA, 19 nt, Homo sapiens
gcaucgagcgggugcacaa

SEQ ID NO: 287853 - RNA, 19 nt, Homo sapiens
ggagagaacccuaaaaucg

SEQ ID NO: 287854 - RNA, 19 nt, Homo sapiens
gcgagccuuucuacacaug

SEQ ID NO: 287855 - RNA, 19 nt, Homo sapiens
uacaggcccuacaucauuc

SEQ ID NO: 287856 - RNA, 19 nt, Homo sapiens
ccaccuggacuucgugaug

SEQ ID NO: 287857 - RNA, 19 nt, Homo sapiens
caagcgagccuuucuacac

SEQ ID NO: 287858 - RNA, 19 nt, Homo sapiens
gcagggcugggagaacuuu

SEQ ID NO: 287859 - RNA, 19 nt, Homo sapiens
ccauugccaucgacuacga

SEQ ID NO: 287860 - RNA, 19 nt, Homo sapiens
gcaucauccucucucucuu

SEQ ID NO: 287861 - RNA, 19 nt, Homo sapiens
gacgggaccaacugcauga

SEQ ID NO: 287862 - RNA, 19 nt, Homo sapiens
ggaguuuggccuugacuac

SEQ ID NO: 287863 - RNA, 19 nt, Homo sapiens
cgacauccggcacgccauu

SEQ ID NO: 287864 - RNA, 19 nt, Homo sapiens
caggggagaucgacuguau

SEQ ID NO: 287865 - RNA, 19 nt, Homo sapiens
uggacaaguucaucuacug

SEQ ID NO: 287866 - RNA, 19 nt, Homo sapiens
ccaccaccuucuugcuguu

SEQ ID NO: 287867 - RNA, 19 nt, Homo sapiens
gcugugaggaggacaaugg

SEQ ID NO: 287868 - RNA, 19 nt, Homo sapiens
gcacgugccccucaauuuc

SEQ ID NO: 287869 - RNA, 19 nt, Homo sapiens
ucauggguggugucuauuu

SEQ ID NO: 287870 - RNA, 19 nt, Homo sapiens
caucauccucucucucuuc

SEQ ID NO: 287871 - RNA, 19 nt, Homo sapiens
ccagggccaucgucgucaa

SEQ ID NO: 287872 - RNA, 19 nt, Homo sapiens
cguucggucugacgcagua

SEQ ID NO: 287873 - RNA, 19 nt, Homo sapiens
cagccgggacgucaucauu

SEQ ID NO: 287874 - RNA, 19 nt, Homo sapiens
cagcaaguacuaccuggau

SEQ ID NO: 287875 - RNA, 19 nt, Homo sapiens
ggcagcacccggaagauca

SEQ ID NO: 287876 - RNA, 19 nt, Homo sapiens
ggacugaggaacgucaaag

SEQ ID NO: 287877 - RNA, 19 nt, Homo sapiens
caggauggccucaaugacu

SEQ ID NO: 287878 - RNA, 19 nt, Homo sapiens
gcacccggaagaucauugu

SEQ ID NO: 287879 - RNA, 19 nt, Homo sapiens
uggagcacgugguggaguu

SEQ ID NO: 287880 - RNA, 19 nt, Homo sapiens
gcagcaccgacguguguga

SEQ ID NO: 287881 - RNA, 19 nt, Homo sapiens
gcggaaaguccaugaugag

SEQ ID NO: 287882 - RNA, 19 nt, Homo sapiens
ggaagaaacuaaagcuuga

SEQ ID NO: 287883 - RNA, 19 nt, Homo sapiens
gaaggaagcgagacucaua

SEQ ID NO: 287884 - RNA, 19 nt, Homo sapiens
gaaauaccaugcacagagu

SEQ ID NO: 287885 - RNA, 19 nt, Homo sapiens
gaagaccucugggaaauuc

SEQ ID NO: 287886 - RNA, 19 nt, Homo sapiens
acacggagcugaaggagaa

SEQ ID NO: 287887 - RNA, 19 nt, Homo sapiens
gggaggagcucaagcacuu

SEQ ID NO: 287888 - RNA, 19 nt, Homo sapiens
gcgaagaccucugggaaau

SEQ ID NO: 287889 - RNA, 19 nt, Homo sapiens
aagagaaaguucacgagua

SEQ ID NO: 287890 - RNA, 19 nt, Homo sapiens
gcgaagaacuggacaagcu

SEQ ID NO: 287891 - RNA, 19 nt, Homo sapiens
gaacucgccuggaagaaac

SEQ ID NO: 287892 - RNA, 19 nt, Homo sapiens
ugaaggaccugggcucuug

SEQ ID NO: 287893 - RNA, 19 nt, Homo sapiens
ccgaagaaauccacgagaa

SEQ ID NO: 287894 - RNA, 19 nt, Homo sapiens
gagcaggaccgaagaaauc

SEQ ID NO: 287895 - RNA, 19 nt, Homo sapiens
gggacgaacucgccuggaa

SEQ ID NO: 287896 - RNA, 19 nt, Homo sapiens
gcucuuggccguggcauuu

SEQ ID NO: 287897 - RNA, 19 nt, Homo sapiens
gcacaaccacuaccagaag

SEQ ID NO: 287898 - RNA, 19 nt, Homo sapiens
gcuccacgcugaucugaag

SEQ ID NO: 287899 - RNA, 19 nt, Homo sapiens
agagaaaguucacgaguac

SEQ ID NO: 287900 - RNA, 19 nt, Homo sapiens
gagaggaguuccgcaugga

SEQ ID NO: 287901 - RNA, 19 nt, Homo sapiens
ggaagaggccagcgugaag

SEQ ID NO: 287902 - RNA, 19 nt, Homo sapiens
agaagcagcuggagauugc

SEQ ID NO: 287903 - RNA, 19 nt, Homo sapiens
gggaguuccugcaucacaa

SEQ ID NO: 287904 - RNA, 19 nt, Homo sapiens
ugaaccagcugugggagaa

SEQ ID NO: 287905 - RNA, 19 nt, Homo sapiens
gcuacacggugaagaagca

SEQ ID NO: 287906 - RNA, 19 nt, Homo sapiens
ccaaggagcugggcuacac

SEQ ID NO: 287907 - RNA, 19 nt, Homo sapiens
gagaaggaagcgagacuca

SEQ ID NO: 287908 - RNA, 19 nt, Homo sapiens
gaggcaggaaggauuguuu

SEQ ID NO: 287909 - RNA, 19 nt, Homo sapiens
ucgagaagcacaaccacua

SEQ ID NO: 287910 - RNA, 19 nt, Homo sapiens
aguauggucuggacggaaa

SEQ ID NO: 287911 - RNA, 19 nt, Homo sapiens
cgaacucgccuggaagaaa

SEQ ID NO: 287912 - RNA, 19 nt, Homo sapiens
ggagauugcgcacgagaag

SEQ ID NO: 287913 - RNA, 19 nt, Homo sapiens
ggcgggaguuccugcauca

SEQ ID NO: 287914 - RNA, 19 nt, Homo sapiens
ccgccaaccucacggacaa

SEQ ID NO: 287915 - RNA, 19 nt, Homo sapiens
gcaaguacucgcgggagaa

SEQ ID NO: 287916 - RNA, 19 nt, Homo sapiens
ggaguuccugcaucacaaa

SEQ ID NO: 287917 - RNA, 19 nt, Homo sapiens
gggaagaggccagcgugaa

SEQ ID NO: 287918 - RNA, 19 nt, Homo sapiens
gcccagcgacugcaucuuc

SEQ ID NO: 287919 - RNA, 19 nt, Homo sapiens
acacaucugccaccggaaa

SEQ ID NO: 287920 - RNA, 19 nt, Homo sapiens
ggcgaagaccucugggaaa

SEQ ID NO: 287921 - RNA, 19 nt, Homo sapiens
ggacgaagauggggagaag

SEQ ID NO: 287922 - RNA, 19 nt, Homo sapiens
gacgaacucgccuggaaga

SEQ ID NO: 287923 - RNA, 19 nt, Homo sapiens
gcuugguggugguagcauu

SEQ ID NO: 287924 - RNA, 19 nt, Homo sapiens
gcauggagaaguugaacca

SEQ ID NO: 287925 - RNA, 19 nt, Homo sapiens
gcaggcacacggagcugaa

SEQ ID NO: 287926 - RNA, 19 nt, Homo sapiens
gaggagcccagggugauug

SEQ ID NO: 287927 - RNA, 19 nt, Homo sapiens
agaaaguucacgaguacaa

SEQ ID NO: 287928 - RNA, 19 nt, Homo sapiens
gcaggaaggauuguuucug

SEQ ID NO: 287929 - RNA, 19 nt, Homo sapiens
ggaccugagcgacaucaag

SEQ ID NO: 287930 - RNA, 19 nt, Homo sapiens
cgaagaccucugggaaauu

SEQ ID NO: 287931 - RNA, 19 nt, Homo sapiens
ccagagcucggcacaacga

SEQ ID NO: 287932 - RNA, 19 nt, Homo sapiens
cagaagcagcuggagauug

SEQ ID NO: 287933 - RNA, 19 nt, Homo sapiens
ggagcucaagcacuucgaa

SEQ ID NO: 287934 - RNA, 19 nt, Homo sapiens
gaccagcaacucccucagu

SEQ ID NO: 287935 - RNA, 19 nt, Homo sapiens
caucacaaagagaaaguuc

SEQ ID NO: 287936 - RNA, 19 nt, Homo sapiens
gagcuccacgcugaucuga

SEQ ID NO: 287937 - RNA, 19 nt, Homo sapiens
ggaaauucuccggcgaaga

SEQ ID NO: 287938 - RNA, 19 nt, Homo sapiens
guuccugcaucacaaagag

SEQ ID NO: 287939 - RNA, 19 nt, Homo sapiens
gcacuucgaagccaaaauc

SEQ ID NO: 287940 - RNA, 19 nt, Homo sapiens
cgaagaaauccacgagaac

SEQ ID NO: 287941 - RNA, 19 nt, Homo sapiens
ugucgaggcaggaaggauu

SEQ ID NO: 287942 - RNA, 19 nt, Homo sapiens
gaaaguucacgaguacaac

SEQ ID NO: 287943 - RNA, 19 nt, Homo sapiens
ccaauggccuugagauuaa

SEQ ID NO: 287944 - RNA, 19 nt, Homo sapiens
caccaaagaucuccaauau

SEQ ID NO: 287945 - RNA, 19 nt, Homo sapiens
gaagguggaugucuaugau

SEQ ID NO: 287946 - RNA, 19 nt, Homo sapiens
gaaacgccauucucuggaa

SEQ ID NO: 287947 - RNA, 19 nt, Homo sapiens
guacaagucccaccaaaga

SEQ ID NO: 287948 - RNA, 19 nt, Homo sapiens
cccaagaccucccaaguuu

SEQ ID NO: 287949 - RNA, 19 nt, Homo sapiens
gaacuauccucccacuauc

SEQ ID NO: 287950 - RNA, 19 nt, Homo sapiens
ugaaggagaagaagaauau

SEQ ID NO: 287951 - RNA, 19 nt, Homo sapiens
gaugacacuaggauaaaua

SEQ ID NO: 287952 - RNA, 19 nt, Homo sapiens
acgacaagcuucacucaaa

SEQ ID NO: 287953 - RNA, 19 nt, Homo sapiens
cgacaagcuucacucaaau

SEQ ID NO: 287954 - RNA, 19 nt, Homo sapiens
gaugaggguuccuacacuu

SEQ ID NO: 287955 - RNA, 19 nt, Homo sapiens
ggaauuugaaggagaagaa

SEQ ID NO: 287956 - RNA, 19 nt, Homo sapiens
acucaaagguggccugguu

SEQ ID NO: 287957 - RNA, 19 nt, Homo sapiens
ggaugacacuaggauaaau

SEQ ID NO: 287958 - RNA, 19 nt, Homo sapiens
caccugacuuugaguggua

SEQ ID NO: 287959 - RNA, 19 nt, Homo sapiens
ccaccaaagaucuccaaua

SEQ ID NO: 287960 - RNA, 19 nt, Homo sapiens
gaauacagccuccgaaucc

SEQ ID NO: 287961 - RNA, 19 nt, Homo sapiens
ugaacuauccucccacuau

SEQ ID NO: 287962 - RNA, 19 nt, Homo sapiens
caacuggaagggaauuuga

SEQ ID NO: 287963 - RNA, 19 nt, Homo sapiens
ggagcagucaggcaaauau

SEQ ID NO: 287964 - RNA, 19 nt, Homo sapiens
ccaagaccucccaaguuua

SEQ ID NO: 287965 - RNA, 19 nt, Homo sapiens
uagaagacaagaacucaaa

SEQ ID NO: 287966 - RNA, 19 nt, Homo sapiens
ggauaaauagugccaaugg

SEQ ID NO: 287967 - RNA, 19 nt, Homo sapiens
gcccaagaccucccaaguu

SEQ ID NO: 287968 - RNA, 19 nt, Homo sapiens
gcucugccuucucagcaaa

SEQ ID NO: 287969 - RNA, 19 nt, Homo sapiens
ggaauacagccuccgaauc

SEQ ID NO: 287970 - RNA, 19 nt, Homo sapiens
ucaggugcguucuagaaga

SEQ ID NO: 287971 - RNA, 19 nt, Homo sapiens
ggacgacaagcuucacuca

SEQ ID NO: 287972 - RNA, 19 nt, Homo sapiens
ggguugagcuggagaaacg

SEQ ID NO: 287973 - RNA, 19 nt, Homo sapiens
gggaugacacuaggauaaa

SEQ ID NO: 287974 - RNA, 19 nt, Homo sapiens
ucucugcucugccuucuca

SEQ ID NO: 287975 - RNA, 19 nt, Homo sapiens
uaggauaaauagugccaau

SEQ ID NO: 287976 - RNA, 19 nt, Homo sapiens
ucacagaauccaagagcaa

SEQ ID NO: 287977 - RNA, 19 nt, Homo sapiens
agauugcucugccuucuuc

SEQ ID NO: 287978 - RNA, 19 nt, Homo sapiens
aggcaaauaugagugcaaa

SEQ ID NO: 287979 - RNA, 19 nt, Homo sapiens
cgggaugacacuaggauaa

SEQ ID NO: 287980 - RNA, 19 nt, Homo sapiens
cggcggaugucaaacaagu

SEQ ID NO: 287981 - RNA, 19 nt, Homo sapiens
caagaccucccaaguuuac

SEQ ID NO: 287982 - RNA, 19 nt, Homo sapiens
ccacugguccuacugagau

SEQ ID NO: 287983 - RNA, 19 nt, Homo sapiens
gaagacaagaacucaaagg

SEQ ID NO: 287984 - RNA, 19 nt, Homo sapiens
gcaaauaugagugcaaagc

SEQ ID NO: 287985 - RNA, 19 nt, Homo sapiens
aagggaauuugaaggagaa

SEQ ID NO: 287986 - RNA, 19 nt, Homo sapiens
ccagaagguggaugucuau

SEQ ID NO: 287987 - RNA, 19 nt, Homo sapiens
ggugagaggaauaaaugga

SEQ ID NO: 287988 - RNA, 19 nt, Homo sapiens
ccucaggugcguucuagaa

SEQ ID NO: 287989 - RNA, 19 nt, Homo sapiens
gacaagcuucacucaaaug

SEQ ID NO: 287990 - RNA, 19 nt, Homo sapiens
gggagcagucaggcaaaua

SEQ ID NO: 287991 - RNA, 19 nt, Homo sapiens
cagaauccaagagcaauga

SEQ ID NO: 287992 - RNA, 19 nt, Homo sapiens
gagcagucaggcaaauaug

SEQ ID NO: 287993 - RNA, 19 nt, Homo sapiens
agaagguggaugucuauga

SEQ ID NO: 287994 - RNA, 19 nt, Homo sapiens
caccuuacaccaacuggaa

SEQ ID NO: 287995 - RNA, 19 nt, Homo sapiens
agguggaugucuaugauga

SEQ ID NO: 287996 - RNA, 19 nt, Homo sapiens
gcagucaggcaaauaugag

SEQ ID NO: 287997 - RNA, 19 nt, Homo sapiens
gcggaugucaaacaaguca

SEQ ID NO: 287998 - RNA, 19 nt, Homo sapiens
caaagguggccugguugaa

SEQ ID NO: 287999 - RNA, 19 nt, Homo sapiens
gagauugcucugccuucuu

SEQ ID NO: 288000 - RNA, 19 nt, Homo sapiens
ucggugagaggaauaaaug

SEQ ID NO: 288001 - RNA, 19 nt, Homo sapiens
uggaagggaauuugaagga

SEQ ID NO: 288002 - RNA, 19 nt, Homo sapiens
ugagauugcucugccuucu

SEQ ID NO: 288003 - RNA, 19 nt, Homo sapiens
uuccuacacuugcucaguu

SEQ ID NO: 288004 - RNA, 19 nt, Homo sapiens
gaggagcacuacggcaacu

SEQ ID NO: 288005 - RNA, 19 nt, Homo sapiens
ucguacaagucccaccaaa

SEQ ID NO: 288006 - RNA, 19 nt, Homo sapiens
caaauaugagugcaaagcu

SEQ ID NO: 288007 - RNA, 19 nt, Homo sapiens
ugaugaggguuccuacacu

SEQ ID NO: 288008 - RNA, 19 nt, Homo sapiens
gagcuggagaaacgccauu

SEQ ID NO: 288009 - RNA, 19 nt, Homo sapiens
gaaagaaacuccugaucau

SEQ ID NO: 288010 - RNA, 19 nt, Homo sapiens
uaauaaagcucccugugua

SEQ ID NO: 288011 - RNA, 19 nt, Homo sapiens
gggaagagguauaaguuug

SEQ ID NO: 288012 - RNA, 19 nt, Homo sapiens
ggaaagaaacuccugauca

SEQ ID NO: 288013 - RNA, 19 nt, Homo sapiens
gaccuacccucgccucuuu

SEQ ID NO: 288014 - RNA, 19 nt, Homo sapiens
cuaaaccgcuccauagaga

SEQ ID NO: 288015 - RNA, 19 nt, Homo sapiens
guaacagugugaagaaauc

SEQ ID NO: 288016 - RNA, 19 nt, Homo sapiens
gaagagguauaaguuugug

SEQ ID NO: 288017 - RNA, 19 nt, Homo sapiens
uccaagaccucaucaacaa

SEQ ID NO: 288018 - RNA, 19 nt, Homo sapiens
ggaggacagugaugaaguc

SEQ ID NO: 288019 - RNA, 19 nt, Homo sapiens
gagaagaguaacaguguga

SEQ ID NO: 288020 - RNA, 19 nt, Homo sapiens
uaaaagcagccaccaauua

SEQ ID NO: 288021 - RNA, 19 nt, Homo sapiens
gaguaacagugugaagaaa

SEQ ID NO: 288022 - RNA, 19 nt, Homo sapiens
caagaccucaucaacaauu

SEQ ID NO: 288023 - RNA, 19 nt, Homo sapiens
gcaggucaagggcugauaa

SEQ ID NO: 288024 - RNA, 19 nt, Homo sapiens
aagaaacuccugaucauug

SEQ ID NO: 288025 - RNA, 19 nt, Homo sapiens
gaaaucccagccagacuug

SEQ ID NO: 288026 - RNA, 19 nt, Homo sapiens
ggaagagguauaaguuugu

SEQ ID NO: 288027 - RNA, 19 nt, Homo sapiens
uauuguggcuggagacaug

SEQ ID NO: 288028 - RNA, 19 nt, Homo sapiens
ccagcuccgcuucuuguua

SEQ ID NO: 288029 - RNA, 19 nt, Homo sapiens
aagaccucaucaacaauua

SEQ ID NO: 288030 - RNA, 19 nt, Homo sapiens
uaaagcucccuguguauuc

SEQ ID NO: 288031 - RNA, 19 nt, Homo sapiens
gcagccaccaauuaagaaa

SEQ ID NO: 288032 - RNA, 19 nt, Homo sapiens
cagcuccgcuucuuguuac

SEQ ID NO: 288033 - RNA, 19 nt, Homo sapiens
caucugggaagagguauaa

SEQ ID NO: 288034 - RNA, 19 nt, Homo sapiens
ccaagacuccguccugcaa

SEQ ID NO: 288035 - RNA, 19 nt, Homo sapiens
ccacccagcuccgcuucuu

SEQ ID NO: 288036 - RNA, 19 nt, Homo sapiens
aaagaaacuccugaucauu

SEQ ID NO: 288037 - RNA, 19 nt, Homo sapiens
gaaagccacagcacguaca

SEQ ID NO: 288038 - RNA, 19 nt, Homo sapiens
uagagaagaguaacagugu

SEQ ID NO: 288039 - RNA, 19 nt, Homo sapiens
ccugagcccuaccaccaaa

SEQ ID NO: 288040 - RNA, 19 nt, Homo sapiens
agaaacuccugaucauugg

SEQ ID NO: 288041 - RNA, 19 nt, Homo sapiens
ccaccgggcaugggaagua

SEQ ID NO: 288042 - RNA, 19 nt, Homo sapiens
aagcagccaccaauuaaga

SEQ ID NO: 288043 - RNA, 19 nt, Homo sapiens
cuggaggaguugagucuga

SEQ ID NO: 288044 - RNA, 19 nt, Homo sapiens
agaguaacagugugaagaa

SEQ ID NO: 288045 - RNA, 19 nt, Homo sapiens
gaagaguaacagugugaag

SEQ ID NO: 288046 - RNA, 19 nt, Homo sapiens
aaaagcagccaccaauuaa

SEQ ID NO: 288047 - RNA, 19 nt, Homo sapiens
ggcccuggcuaagaaguug

SEQ ID NO: 288048 - RNA, 19 nt, Homo sapiens
gggcaugggaaguaugaga

SEQ ID NO: 288049 - RNA, 19 nt, Homo sapiens
cuggagacaugagcaagaa

SEQ ID NO: 288050 - RNA, 19 nt, Homo sapiens
uggcggaggcuucgaguga

SEQ ID NO: 288051 - RNA, 19 nt, Homo sapiens
ggaugaggacgagggcuuu

SEQ ID NO: 288052 - RNA, 19 nt, Homo sapiens
ggaggagcaccagaaaugu

SEQ ID NO: 288053 - RNA, 19 nt, Homo sapiens
aggaggagcaccagaaaug

SEQ ID NO: 288054 - RNA, 19 nt, Homo sapiens
cagccagacuugcccaucu

SEQ ID NO: 288055 - RNA, 19 nt, Homo sapiens
agaaaucccagccagacuu

SEQ ID NO: 288056 - RNA, 19 nt, Homo sapiens
auaauaaagcucccugugu

SEQ ID NO: 288057 - RNA, 19 nt, Homo sapiens
gcuggagacaugagcaaga

SEQ ID NO: 288058 - RNA, 19 nt, Homo sapiens
gaggagcaccagaaauguc

SEQ ID NO: 288059 - RNA, 19 nt, Homo sapiens
aaaggaggacagugaugaa

SEQ ID NO: 288060 - RNA, 19 nt, Homo sapiens
ggcaugggaaguaugagaa

SEQ ID NO: 288061 - RNA, 19 nt, Homo sapiens
cugaggagcgggaagaguu

SEQ ID NO: 288062 - RNA, 19 nt, Homo sapiens
auaaagcucccuguguauu

SEQ ID NO: 288063 - RNA, 19 nt, Homo sapiens
gauaacggccaugcaggau

SEQ ID NO: 288064 - RNA, 19 nt, Homo sapiens
ugagaaggugcuuguggaa

SEQ ID NO: 288065 - RNA, 19 nt, Homo sapiens
ugggaagagguauaaguuu

SEQ ID NO: 288066 - RNA, 19 nt, Homo sapiens
gcuccaagaccucaucaac

SEQ ID NO: 288067 - RNA, 19 nt, Homo sapiens
ggagacaugagcaagaaaa

SEQ ID NO: 288068 - RNA, 19 nt, Homo sapiens
aauaaagcucccuguguau

SEQ ID NO: 288069 - RNA, 19 nt, Homo sapiens
aagaaagccacagcacgua

SEQ ID NO: 288070 - RNA, 19 nt, Homo sapiens
gucccuaaaccgcuccaua

SEQ ID NO: 288071 - RNA, 19 nt, Homo sapiens
acaggaggagcaccagaaa

SEQ ID NO: 288072 - RNA, 19 nt, Homo sapiens
aaagcucccuguguauucu

SEQ ID NO: 288073 - RNA, 19 nt, Homo sapiens
gaaaaggaggacagugaug

SEQ ID NO: 288074 - RNA, 19 nt, Homo sapiens
cugggaagagguauaaguu

SEQ ID NO: 288075 - RNA, 19 nt, Homo sapiens
gugggagacgggugaggua

SEQ ID NO: 288076 - RNA, 19 nt, Homo sapiens
gcuccauagagaagaguaa

SEQ ID NO: 288077 - RNA, 19 nt, Homo sapiens
cggccugcaugccuacgaa

SEQ ID NO: 288078 - RNA, 19 nt, Homo sapiens
ggacugcgcucaacuaugu

SEQ ID NO: 288079 - RNA, 19 nt, Homo sapiens
gcagaaggcucaugaguuc

SEQ ID NO: 288080 - RNA, 19 nt, Homo sapiens
gaagcuguaugaacacauu

SEQ ID NO: 288081 - RNA, 19 nt, Homo sapiens
ggaguccggugucuacuug

SEQ ID NO: 288082 - RNA, 19 nt, Homo sapiens
gggcagaccuaccgagaug

SEQ ID NO: 288083 - RNA, 19 nt, Homo sapiens
ugcaggcgcuuaaguauuu

SEQ ID NO: 288084 - RNA, 19 nt, Homo sapiens
ucucacaggucccagauaa

SEQ ID NO: 288085 - RNA, 19 nt, Homo sapiens
ggacaggguggguggcuua

SEQ ID NO: 288086 - RNA, 19 nt, Homo sapiens
agacugauauucuggaaga

SEQ ID NO: 288087 - RNA, 19 nt, Homo sapiens
gagcaugucuccagaaucc

SEQ ID NO: 288088 - RNA, 19 nt, Homo sapiens
ccagagauguggcuguuuc

SEQ ID NO: 288089 - RNA, 19 nt, Homo sapiens
ugacgauccugaccuggua

SEQ ID NO: 288090 - RNA, 19 nt, Homo sapiens
ggauaaguccaccguguuu

SEQ ID NO: 288091 - RNA, 19 nt, Homo sapiens
gcgaggagcggcguuauuu

SEQ ID NO: 288092 - RNA, 19 nt, Homo sapiens
agacugauaggcagauuua

SEQ ID NO: 288093 - RNA, 19 nt, Homo sapiens
gcacuggacgggugauuau

SEQ ID NO: 288094 - RNA, 19 nt, Homo sapiens
gggcaacccugugacaaug

SEQ ID NO: 288095 - RNA, 19 nt, Homo sapiens
ggagacugauauucuggaa

SEQ ID NO: 288096 - RNA, 19 nt, Homo sapiens
uaacaaacacauagucugu

SEQ ID NO: 288097 - RNA, 19 nt, Homo sapiens
ggacaccaagaauuacuuu

SEQ ID NO: 288098 - RNA, 19 nt, Homo sapiens
gaagacugauaggcagauu

SEQ ID NO: 288099 - RNA, 19 nt, Homo sapiens
gugccugugugauuccuua

SEQ ID NO: 288100 - RNA, 19 nt, Homo sapiens
uggcuuagacucuugauuu

SEQ ID NO: 288101 - RNA, 19 nt, Homo sapiens
uggcuguccugaauguuua

SEQ ID NO: 288102 - RNA, 19 nt, Homo sapiens
cuaugugucucucagaauu

SEQ ID NO: 288103 - RNA, 19 nt, Homo sapiens
ugaggugucuacaggguuu

SEQ ID NO: 288104 - RNA, 19 nt, Homo sapiens
accaauagcugaguucuug

SEQ ID NO: 288105 - RNA, 19 nt, Homo sapiens
gaaguacuaccgccagaug

SEQ ID NO: 288106 - RNA, 19 nt, Homo sapiens
cagauaacccucccgacua

SEQ ID NO: 288107 - RNA, 19 nt, Homo sapiens
gacgaccgauucaccaaga

SEQ ID NO: 288108 - RNA, 19 nt, Homo sapiens
ugaacgggaugacauuuua

SEQ ID NO: 288109 - RNA, 19 nt, Homo sapiens
gcggcuggaucguuucuga

SEQ ID NO: 288110 - RNA, 19 nt, Homo sapiens
ugcagaagcuguaugaaca

SEQ ID NO: 288111 - RNA, 19 nt, Homo sapiens
guacgagcccggaacauuc

SEQ ID NO: 288112 - RNA, 19 nt, Homo sapiens
ggcuggacaccaagaauua

SEQ ID NO: 288113 - RNA, 19 nt, Homo sapiens
gaacaugagaaauccagau

SEQ ID NO: 288114 - RNA, 19 nt, Homo sapiens
gacugcggcuggaucguuu

SEQ ID NO: 288115 - RNA, 19 nt, Homo sapiens
gaauuacuuuaaggacuug

SEQ ID NO: 288116 - RNA, 19 nt, Homo sapiens
gguggcuucuccuucagua

SEQ ID NO: 288117 - RNA, 19 nt, Homo sapiens
caccaagaauuacuuuaag

SEQ ID NO: 288118 - RNA, 19 nt, Homo sapiens
guugugagcucgccugcau

SEQ ID NO: 288119 - RNA, 19 nt, Homo sapiens
gguacgagcccggaacauu

SEQ ID NO: 288120 - RNA, 19 nt, Homo sapiens
gcuuaaguauuuccacaag

SEQ ID NO: 288121 - RNA, 19 nt, Homo sapiens
gaugcaggcgcuuaaguau

SEQ ID NO: 288122 - RNA, 19 nt, Homo sapiens
gccugcacauugaggauaa

SEQ ID NO: 288123 - RNA, 19 nt, Homo sapiens
ccaagaauuacuuuaagga

SEQ ID NO: 288124 - RNA, 19 nt, Homo sapiens
gggcuggacaccaagaauu

SEQ ID NO: 288125 - RNA, 19 nt, Homo sapiens
cagcugugccugugugauu

SEQ ID NO: 288126 - RNA, 19 nt, Homo sapiens
ccucaaccucuaucucaua

SEQ ID NO: 288127 - RNA, 19 nt, Homo sapiens
ugaugcaggcgcuuaagua

SEQ ID NO: 288128 - RNA, 19 nt, Homo sapiens
gggacaucaugauugacua

SEQ ID NO: 288129 - RNA, 19 nt, Homo sapiens
ggacugcggcuggaucguu

SEQ ID NO: 288130 - RNA, 19 nt, Homo sapiens
gcaccacaggcccgaguuu

SEQ ID NO: 288131 - RNA, 19 nt, Homo sapiens
ggacacuuacggacacaga

SEQ ID NO: 288132 - RNA, 19 nt, Homo sapiens
cauggaacaucccaagucu

SEQ ID NO: 288133 - RNA, 19 nt, Homo sapiens
ucauggguguggagacuga

SEQ ID NO: 288134 - RNA, 19 nt, Homo sapiens
gucgugagcucgccugagu

SEQ ID NO: 288135 - RNA, 19 nt, Homo sapiens
guagugaggcuaggagguu

SEQ ID NO: 288136 - RNA, 19 nt, Homo sapiens
agaaacagcuccccaaugg

SEQ ID NO: 288137 - RNA, 19 nt, Homo sapiens
ggugucuacuugagaaaca

SEQ ID NO: 288138 - RNA, 19 nt, Homo sapiens
gaucugggacaccgcauuc

SEQ ID NO: 288139 - RNA, 19 nt, Homo sapiens
cugauaggcagauuuacua

SEQ ID NO: 288140 - RNA, 19 nt, Homo sapiens
gcacggcugaggccuugaa

SEQ ID NO: 288141 - RNA, 19 nt, Homo sapiens
uauaugcgcuccucaaccu

SEQ ID NO: 288142 - RNA, 19 nt, Homo sapiens
guaaaaggccagcauuaga

SEQ ID NO: 288143 - RNA, 19 nt, Homo sapiens
ggacuucgccagcauugac

SEQ ID NO: 288144 - RNA, 19 nt, Homo sapiens
uuuaaggacuugcccaaag

SEQ ID NO: 288145 - RNA, 19 nt, Homo sapiens
acuguagguucauuucuga

SEQ ID NO: 288146 - RNA, 19 nt, Homo sapiens
uacacgagcuacaggaaca

SEQ ID NO: 288147 - RNA, 19 nt, Homo sapiens
gcugugcugcugaacauga

SEQ ID NO: 288148 - RNA, 19 nt, Homo sapiens
ccgacuaccagaaguacua

SEQ ID NO: 288149 - RNA, 19 nt, Homo sapiens
agauaacccucccgacuac

SEQ ID NO: 288150 - RNA, 19 nt, Homo sapiens
gcucauggguguggagacu

SEQ ID NO: 288151 - RNA, 19 nt, Homo sapiens
ugcagggucugucauggaa

SEQ ID NO: 288152 - RNA, 19 nt, Homo sapiens
gcauaugcagggucuguca

SEQ ID NO: 288153 - RNA, 19 nt, Homo sapiens
gaggguucgccaccuauga

SEQ ID NO: 288154 - RNA, 19 nt, Homo sapiens
cguggaaugcuguuuguga

SEQ ID NO: 288155 - RNA, 19 nt, Homo sapiens
gagaggaguccggugucua

SEQ ID NO: 288156 - RNA, 19 nt, Homo sapiens
gacaccaagaauuacuuua

SEQ ID NO: 288157 - RNA, 19 nt, Homo sapiens
ggaggacuucgccagcauu

SEQ ID NO: 288158 - RNA, 19 nt, Homo sapiens
gcacaccccuccacacucu

SEQ ID NO: 288159 - RNA, 19 nt, Homo sapiens
caacuaugugucucucaga

SEQ ID NO: 288160 - RNA, 19 nt, Homo sapiens
ggauacagagaagagauug

SEQ ID NO: 288161 - RNA, 19 nt, Homo sapiens
uggaacaucccaagucugu

SEQ ID NO: 288162 - RNA, 19 nt, Homo sapiens
guagugugcauccgugaau

SEQ ID NO: 288163 - RNA, 19 nt, Homo sapiens
gaggagcggcguuauuugc

SEQ ID NO: 288164 - RNA, 19 nt, Homo sapiens
ucacgcagggcuuagaguu

SEQ ID NO: 288165 - RNA, 19 nt, Homo sapiens
gcaccaacggcucacagau

SEQ ID NO: 288166 - RNA, 19 nt, Homo sapiens
gucuacaggguuuauagua

SEQ ID NO: 288167 - RNA, 19 nt, Homo sapiens
cagggucugucauggaaca

SEQ ID NO: 288168 - RNA, 19 nt, Homo sapiens
uagugugcauccgugaaua

SEQ ID NO: 288169 - RNA, 19 nt, Homo sapiens
ccugugugauuccuuagug

SEQ ID NO: 288170 - RNA, 19 nt, Homo sapiens
gcucugaacgggaugacau

SEQ ID NO: 288171 - RNA, 19 nt, Homo sapiens
caugauugacuacaccuau

SEQ ID NO: 288172 - RNA, 19 nt, Homo sapiens
ggcacuggacgggugauua

SEQ ID NO: 288173 - RNA, 19 nt, Homo sapiens
ccagaaucccggacuaucu

SEQ ID NO: 288174 - RNA, 19 nt, Homo sapiens
gcccagucccagauccaua

SEQ ID NO: 288175 - RNA, 19 nt, Homo sapiens
ggacaucaugauugacuac

SEQ ID NO: 288176 - RNA, 19 nt, Homo sapiens
gauaaguccaccguguuug

SEQ ID NO: 288177 - RNA, 19 nt, Homo sapiens
caucgaggcccaggagaga

SEQ ID NO: 288178 - RNA, 19 nt, Homo sapiens
gaacacccauaucucuuua

SEQ ID NO: 288179 - RNA, 19 nt, Homo sapiens
caaauaugcucuuggagaa

SEQ ID NO: 288180 - RNA, 19 nt, Homo sapiens
gagacugaaucuaugcuua

SEQ ID NO: 288181 - RNA, 19 nt, Homo sapiens
ggacacuccuucugugaaa

SEQ ID NO: 288182 - RNA, 19 nt, Homo sapiens
caaggaagaaugaaguuua

SEQ ID NO: 288183 - RNA, 19 nt, Homo sapiens
ccacagaccugaaggaucu

SEQ ID NO: 288184 - RNA, 19 nt, Homo sapiens
gaacuuugguguggucuga

SEQ ID NO: 288185 - RNA, 19 nt, Homo sapiens
gagcaauccuuccuuguca

SEQ ID NO: 288186 - RNA, 19 nt, Homo sapiens
uuaaagaccugcguauuga

SEQ ID NO: 288187 - RNA, 19 nt, Homo sapiens
gaacugguggcacuuauga

SEQ ID NO: 288188 - RNA, 19 nt, Homo sapiens
gauggcaacugaacaagga

SEQ ID NO: 288189 - RNA, 19 nt, Homo sapiens
gacaagaagucaaauaugc

SEQ ID NO: 288190 - RNA, 19 nt, Homo sapiens
gaacaaggaagaaugaagu

SEQ ID NO: 288191 - RNA, 19 nt, Homo sapiens
gaagggcuuugcuuuacuu

SEQ ID NO: 288192 - RNA, 19 nt, Homo sapiens
gagaagggcuuugcuuuac

SEQ ID NO: 288193 - RNA, 19 nt, Homo sapiens
aaagucugcuuaugaguuu

SEQ ID NO: 288194 - RNA, 19 nt, Homo sapiens
agaaacaccugacccagaa

SEQ ID NO: 288195 - RNA, 19 nt, Homo sapiens
ugauguagcuuauucuuca

SEQ ID NO: 288196 - RNA, 19 nt, Homo sapiens
gagaauccuugccuuacuu

SEQ ID NO: 288197 - RNA, 19 nt, Homo sapiens
acaagucacucuccaaugu

SEQ ID NO: 288198 - RNA, 19 nt, Homo sapiens
ggaacacccauaucucuuu

SEQ ID NO: 288199 - RNA, 19 nt, Homo sapiens
gaagucaaauaugcucuug

SEQ ID NO: 288200 - RNA, 19 nt, Homo sapiens
gcacauaaagcgaaugcaa

SEQ ID NO: 288201 - RNA, 19 nt, Homo sapiens
gagcauaacuacugaugac

SEQ ID NO: 288202 - RNA, 19 nt, Homo sapiens
ugagaagggcuuugcuuua

SEQ ID NO: 288203 - RNA, 19 nt, Homo sapiens
uuagaaagcaggcaaauug

SEQ ID NO: 288204 - RNA, 19 nt, Homo sapiens
ugacaaaucccaugaucaa

SEQ ID NO: 288205 - RNA, 19 nt, Homo sapiens
uguauugccuuaagucaaa

SEQ ID NO: 288206 - RNA, 19 nt, Homo sapiens
aagcuuauguugagaaguu

SEQ ID NO: 288207 - RNA, 19 nt, Homo sapiens
ggaaggaacacccauaucu

SEQ ID NO: 288208 - RNA, 19 nt, Homo sapiens
ggagaaagacaaaguuaca

SEQ ID NO: 288209 - RNA, 19 nt, Homo sapiens
agaauucgguaaagacauu

SEQ ID NO: 288210 - RNA, 19 nt, Homo sapiens
ggacaagaagucaaauaug

SEQ ID NO: 288211 - RNA, 19 nt, Homo sapiens
gcaauuccuuuggcgcuaa

SEQ ID NO: 288212 - RNA, 19 nt, Homo sapiens
gggacaguaugaccuauug

SEQ ID NO: 288213 - RNA, 19 nt, Homo sapiens
gauaugacucugacaaaug

SEQ ID NO: 288214 - RNA, 19 nt, Homo sapiens
gaacuacagaauucgguaa

SEQ ID NO: 288215 - RNA, 19 nt, Homo sapiens
ggacgauuguuuggugaaa

SEQ ID NO: 288216 - RNA, 19 nt, Homo sapiens
gcacaaagcaagcaugcau

SEQ ID NO: 288217 - RNA, 19 nt, Homo sapiens
cuacagaauucgguaaaga

SEQ ID NO: 288218 - RNA, 19 nt, Homo sapiens
ccauaucucuuuagucagu

SEQ ID NO: 288219 - RNA, 19 nt, Homo sapiens
ugccaaagaagaugauuua

SEQ ID NO: 288220 - RNA, 19 nt, Homo sapiens
ggaaucuagugaccaacaa

SEQ ID NO: 288221 - RNA, 19 nt, Homo sapiens
agucaaagauggauuacug

SEQ ID NO: 288222 - RNA, 19 nt, Homo sapiens
uauaagagcauaacuacug

SEQ ID NO: 288223 - RNA, 19 nt, Homo sapiens
ccugauugcuuuaguuguu

SEQ ID NO: 288224 - RNA, 19 nt, Homo sapiens
ugcaagagguguacaacuu

SEQ ID NO: 288225 - RNA, 19 nt, Homo sapiens
ggaucucucuucucaucaa

SEQ ID NO: 288226 - RNA, 19 nt, Homo sapiens
ggagaauccuugccuuacu

SEQ ID NO: 288227 - RNA, 19 nt, Homo sapiens
guaggucgcugugcugugu

SEQ ID NO: 288228 - RNA, 19 nt, Homo sapiens
caagagguguacaacuuca

SEQ ID NO: 288229 - RNA, 19 nt, Homo sapiens
agauauagacccugaugua

SEQ ID NO: 288230 - RNA, 19 nt, Homo sapiens
acccauaucucuuuaguca

SEQ ID NO: 288231 - RNA, 19 nt, Homo sapiens
gacauacuguguacuugga

SEQ ID NO: 288232 - RNA, 19 nt, Homo sapiens
ccugcuaccugauugcuuu

SEQ ID NO: 288233 - RNA, 19 nt, Homo sapiens
caagggaucgccaauggaa

SEQ ID NO: 288234 - RNA, 19 nt, Homo sapiens
guacuuggaacgccacauu

SEQ ID NO: 288235 - RNA, 19 nt, Homo sapiens
gaaccuaccaagagcacaa

SEQ ID NO: 288236 - RNA, 19 nt, Homo sapiens
ggaaaagucugcuuaugag

SEQ ID NO: 288237 - RNA, 19 nt, Homo sapiens
agaggugucugucccuaaa

SEQ ID NO: 288238 - RNA, 19 nt, Homo sapiens
cgcuaaagauggcaacuga

SEQ ID NO: 288239 - RNA, 19 nt, Homo sapiens
gacugaaucuaugcuuaaa

SEQ ID NO: 288240 - RNA, 19 nt, Homo sapiens
gaaauaaagaugagcuacu

SEQ ID NO: 288241 - RNA, 19 nt, Homo sapiens
gcaagagguguacaacuuc

SEQ ID NO: 288242 - RNA, 19 nt, Homo sapiens
gacacauccuuucaccaaa

SEQ ID NO: 288243 - RNA, 19 nt, Homo sapiens
agucaaauaugcucuugga

SEQ ID NO: 288244 - RNA, 19 nt, Homo sapiens
cagggaaucuagugaccaa

SEQ ID NO: 288245 - RNA, 19 nt, Homo sapiens
gauuaaagaccugcguauu

SEQ ID NO: 288246 - RNA, 19 nt, Homo sapiens
gccauuaacaauucugaaa

SEQ ID NO: 288247 - RNA, 19 nt, Homo sapiens
aagauaagguugauguucu

SEQ ID NO: 288248 - RNA, 19 nt, Homo sapiens
uaaaugagggacauacugu

SEQ ID NO: 288249 - RNA, 19 nt, Homo sapiens
caagugggaggacgcaauu

SEQ ID NO: 288250 - RNA, 19 nt, Homo sapiens
ugauaugacucugacaaau

SEQ ID NO: 288251 - RNA, 19 nt, Homo sapiens
guugagaaguuuuccuaua

SEQ ID NO: 288252 - RNA, 19 nt, Homo sapiens
ccaccauccuucccuuaug

SEQ ID NO: 288253 - RNA, 19 nt, Homo sapiens
agacugaaucuaugcuuaa

SEQ ID NO: 288254 - RNA, 19 nt, Homo sapiens
gaaggaacacccauaucuc

SEQ ID NO: 288255 - RNA, 19 nt, Homo sapiens
caauggacaagaagucaaa

SEQ ID NO: 288256 - RNA, 19 nt, Homo sapiens
aaggaucucucuucucauc

SEQ ID NO: 288257 - RNA, 19 nt, Homo sapiens
agacacauccuuucaccaa

SEQ ID NO: 288258 - RNA, 19 nt, Homo sapiens
ggggagaacuacagaauuc

SEQ ID NO: 288259 - RNA, 19 nt, Homo sapiens
uacaagggaucgccaaugg

SEQ ID NO: 288260 - RNA, 19 nt, Homo sapiens
aaagauggcaacugaacaa

SEQ ID NO: 288261 - RNA, 19 nt, Homo sapiens
ucucucuucucaucaauug

SEQ ID NO: 288262 - RNA, 19 nt, Homo sapiens
gauguucucaaucaaguug

SEQ ID NO: 288263 - RNA, 19 nt, Homo sapiens
acugaugacuggaaggauu

SEQ ID NO: 288264 - RNA, 19 nt, Homo sapiens
auaagagcauaacuacuga

SEQ ID NO: 288265 - RNA, 19 nt, Homo sapiens
gauauagacccugauguag

SEQ ID NO: 288266 - RNA, 19 nt, Homo sapiens
caaaucccaugaucaagcu

SEQ ID NO: 288267 - RNA, 19 nt, Homo sapiens
agugaucaauggacaagaa

SEQ ID NO: 288268 - RNA, 19 nt, Homo sapiens
ggauuacugccaaagaaga

SEQ ID NO: 288269 - RNA, 19 nt, Homo sapiens
gggaggaccguauguaugg

SEQ ID NO: 288270 - RNA, 19 nt, Homo sapiens
cuaccugauugcuuuaguu

SEQ ID NO: 288271 - RNA, 19 nt, Homo sapiens
ccagagccaugcccgagau

SEQ ID NO: 288272 - RNA, 19 nt, Homo sapiens
gagaaagacaaaguuacaa

SEQ ID NO: 288273 - RNA, 19 nt, Homo sapiens
ccacauuugcggacgauug

SEQ ID NO: 288274 - RNA, 19 nt, Homo sapiens
gaaucuagugaccaacaaa

SEQ ID NO: 288275 - RNA, 19 nt, Homo sapiens
cgacaagucacucuccaau

SEQ ID NO: 288276 - RNA, 19 nt, Homo sapiens
aaagaacugguggcacuua

SEQ ID NO: 288277 - RNA, 19 nt, Homo sapiens
gaaugcaagagguguacaa

SEQ ID NO: 288278 - RNA, 19 nt, Homo sapiens
cccaagagaugaagaguga

SEQ ID NO: 288279 - RNA, 19 nt, Homo sapiens
gcucaagucuucccugauc

SEQ ID NO: 288280 - RNA, 19 nt, Homo sapiens
gaacauccaaggagaaaca

SEQ ID NO: 288281 - RNA, 19 nt, Homo sapiens
gaagaacauccaaggagaa

SEQ ID NO: 288282 - RNA, 19 nt, Homo sapiens
gcagggaaaggcucugaaa

SEQ ID NO: 288283 - RNA, 19 nt, Homo sapiens
uccaacagcucaagucuuc

SEQ ID NO: 288284 - RNA, 19 nt, Homo sapiens
gggccuagauccacacaca

SEQ ID NO: 288285 - RNA, 19 nt, Homo sapiens
gagacaggcccaagagaug

SEQ ID NO: 288286 - RNA, 19 nt, Homo sapiens
gcagggaggggacuauuua

SEQ ID NO: 288287 - RNA, 19 nt, Homo sapiens
caauaaaccucuuuucucu

SEQ ID NO: 288288 - RNA, 19 nt, Homo sapiens
caagagaugaagagugaga

SEQ ID NO: 288289 - RNA, 19 nt, Homo sapiens
uuucaagccugccuaggaa

SEQ ID NO: 288290 - RNA, 19 nt, Homo sapiens
gagaaagaaguaggcauga

SEQ ID NO: 288291 - RNA, 19 nt, Homo sapiens
ggaggggacuauuuaugaa

SEQ ID NO: 288292 - RNA, 19 nt, Homo sapiens
cauucugccuccauucuga

SEQ ID NO: 288293 - RNA, 19 nt, Homo sapiens
ggagagaggggaauaauag

SEQ ID NO: 288294 - RNA, 19 nt, Homo sapiens
cccuaguacugucuucuuu

SEQ ID NO: 288295 - RNA, 19 nt, Homo sapiens
ggaauaauagaagaacauc

SEQ ID NO: 288296 - RNA, 19 nt, Homo sapiens
gggaauaauagaagaacau

SEQ ID NO: 288297 - RNA, 19 nt, Homo sapiens
cuccucagcucccagaaga

SEQ ID NO: 288298 - RNA, 19 nt, Homo sapiens
ggaauucccagcccaaagc

SEQ ID NO: 288299 - RNA, 19 nt, Homo sapiens
ucaagucaccggagcuuuc

SEQ ID NO: 288300 - RNA, 19 nt, Homo sapiens
cacucuaccuggcccauga

SEQ ID NO: 288301 - RNA, 19 nt, Homo sapiens
gaagcccaauaaaccucuu

SEQ ID NO: 288302 - RNA, 19 nt, Homo sapiens
cuaguacugucuucuuugg

SEQ ID NO: 288303 - RNA, 19 nt, Homo sapiens
gcaucuacuucgucuacuc

SEQ ID NO: 288304 - RNA, 19 nt, Homo sapiens
ugagagggcaugcgcacaa

SEQ ID NO: 288305 - RNA, 19 nt, Homo sapiens
ccaaggagaaacagagaca

SEQ ID NO: 288306 - RNA, 19 nt, Homo sapiens
agucuucccugaucaaguc

SEQ ID NO: 288307 - RNA, 19 nt, Homo sapiens
gcucuucuccucccaguac

SEQ ID NO: 288308 - RNA, 19 nt, Homo sapiens
accaagagagaaagaagua

SEQ ID NO: 288309 - RNA, 19 nt, Homo sapiens
gagagggcaugcgcacaag

SEQ ID NO: 288310 - RNA, 19 nt, Homo sapiens
gaucaagucaccggagcuu

SEQ ID NO: 288311 - RNA, 19 nt, Homo sapiens
ccucgaugaagcccaauaa

SEQ ID NO: 288312 - RNA, 19 nt, Homo sapiens
gggaggggacuauuuauga

SEQ ID NO: 288313 - RNA, 19 nt, Homo sapiens
ggaccacaccucccugaac

SEQ ID NO: 288314 - RNA, 19 nt, Homo sapiens
cccaugagguccagcucuu

SEQ ID NO: 288315 - RNA, 19 nt, Homo sapiens
ucaagccugccuaggaauu

SEQ ID NO: 288316 - RNA, 19 nt, Homo sapiens
ccuccauucugaccauuuc

SEQ ID NO: 288317 - RNA, 19 nt, Homo sapiens
gcccgugcuucgugcuuug

SEQ ID NO: 288318 - RNA, 19 nt, Homo sapiens
cccagaagaugguguaucc

SEQ ID NO: 288319 - RNA, 19 nt, Homo sapiens
gcucccagaagauggugua

SEQ ID NO: 288320 - RNA, 19 nt, Homo sapiens
agacaggcccaagagauga

SEQ ID NO: 288321 - RNA, 19 nt, Homo sapiens
cgaugaagcccaauaaacc

SEQ ID NO: 288322 - RNA, 19 nt, Homo sapiens
agaaagaaguaggcaugag

SEQ ID NO: 288323 - RNA, 19 nt, Homo sapiens
gccuagauccacacacaga

SEQ ID NO: 288324 - RNA, 19 nt, Homo sapiens
aagaacauccaaggagaaa

SEQ ID NO: 288325 - RNA, 19 nt, Homo sapiens
cgucaccaccucuccuuug

SEQ ID NO: 288326 - RNA, 19 nt, Homo sapiens
gcuauccacccacacagau

SEQ ID NO: 288327 - RNA, 19 nt, Homo sapiens
gacaggcccaagagaugaa

SEQ ID NO: 288328 - RNA, 19 nt, Homo sapiens
caagucaccggagcuuuca

SEQ ID NO: 288329 - RNA, 19 nt, Homo sapiens
ccaguggcaucuacuucgu

SEQ ID NO: 288330 - RNA, 19 nt, Homo sapiens
gaugaagcccaauaaaccu

SEQ ID NO: 288331 - RNA, 19 nt, Homo sapiens
agagacaggcccaagagau

SEQ ID NO: 288332 - RNA, 19 nt, Homo sapiens
ccuucgcucuguagaacuu

SEQ ID NO: 288333 - RNA, 19 nt, Homo sapiens
guccucagcccuaguacug

SEQ ID NO: 288334 - RNA, 19 nt, Homo sapiens
guaggagacuguuuggaaa

SEQ ID NO: 288335 - RNA, 19 nt, Homo sapiens
ccacuucucuggugaccuu

SEQ ID NO: 288336 - RNA, 19 nt, Homo sapiens
gaucagggaggacugguaa

SEQ ID NO: 288337 - RNA, 19 nt, Homo sapiens
gagacuguuuggaaauuga

SEQ ID NO: 288338 - RNA, 19 nt, Homo sapiens
ggagacuguuuggaaauug

SEQ ID NO: 288339 - RNA, 19 nt, Homo sapiens
cuucagugcugccgauaaa

SEQ ID NO: 288340 - RNA, 19 nt, Homo sapiens
gguacgggccucucuggua

SEQ ID NO: 288341 - RNA, 19 nt, Homo sapiens
ucuauuaccucuacugucu

SEQ ID NO: 288342 - RNA, 19 nt, Homo sapiens
gcgagaggguguacgucaa

SEQ ID NO: 288343 - RNA, 19 nt, Homo sapiens
gcgagugcgugaauauugg

SEQ ID NO: 288344 - RNA, 19 nt, Homo sapiens
gcugggagacgacgaagga

SEQ ID NO: 288345 - RNA, 19 nt, Homo sapiens
gcaggacggccucuauuac

SEQ ID NO: 288346 - RNA, 19 nt, Homo sapiens
uguaggagacuguuuggaa

SEQ ID NO: 288347 - RNA, 19 nt, Homo sapiens
cgcaggacggccucuauua

SEQ ID NO: 288348 - RNA, 19 nt, Homo sapiens
cgaaggaacaggcguuucu

SEQ ID NO: 288349 - RNA, 19 nt, Homo sapiens
cauaggcgcuccgcugaag

SEQ ID NO: 288350 - RNA, 19 nt, Homo sapiens
ggaggagccagaaacagau

SEQ ID NO: 288351 - RNA, 19 nt, Homo sapiens
uaaagaauggaaagcuuca

SEQ ID NO: 288352 - RNA, 19 nt, Homo sapiens
aaauguaggagacuguuug

SEQ ID NO: 288353 - RNA, 19 nt, Homo sapiens
aggagacuguuuggaaauu

SEQ ID NO: 288354 - RNA, 19 nt, Homo sapiens
ggaucagggaggacuggua

SEQ ID NO: 288355 - RNA, 19 nt, Homo sapiens
gggagacgacgaaggaaca

SEQ ID NO: 288356 - RNA, 19 nt, Homo sapiens
gagaggguguacgucaaca

SEQ ID NO: 288357 - RNA, 19 nt, Homo sapiens
ggugcgagugcgugaauau

SEQ ID NO: 288358 - RNA, 19 nt, Homo sapiens
gaggguguacgucaacauc

SEQ ID NO: 288359 - RNA, 19 nt, Homo sapiens
aggaggagccagaaacaga

SEQ ID NO: 288360 - RNA, 19 nt, Homo sapiens
gaaggaacaggcguuucug

SEQ ID NO: 288361 - RNA, 19 nt, Homo sapiens
uggcugugcuggccuuagu

SEQ ID NO: 288362 - RNA, 19 nt, Homo sapiens
gacgaaggaacaggcguuu

SEQ ID NO: 288363 - RNA, 19 nt, Homo sapiens
ccgcaggacggccucuauu

SEQ ID NO: 288364 - RNA, 19 nt, Homo sapiens
ccagaggaggagccagaaa

SEQ ID NO: 288365 - RNA, 19 nt, Homo sapiens
guaggagacuguuuggaaa

SEQ ID NO: 288366 - RNA, 19 nt, Homo sapiens
ccacuucucuggugaccuu

SEQ ID NO: 288367 - RNA, 19 nt, Homo sapiens
gagacuguuuggaaauuga

SEQ ID NO: 288368 - RNA, 19 nt, Homo sapiens
ggagacuguuuggaaauug

SEQ ID NO: 288369 - RNA, 19 nt, Homo sapiens
cuucagugcugccgauaaa

SEQ ID NO: 288370 - RNA, 19 nt, Homo sapiens
ggacuggguuucagaagcu

SEQ ID NO: 288371 - RNA, 19 nt, Homo sapiens
gguacgggccucucuggua

SEQ ID NO: 288372 - RNA, 19 nt, Homo sapiens
ucuauuaccucuacugucu

SEQ ID NO: 288373 - RNA, 19 nt, Homo sapiens
gcgagaggguguacgucaa

SEQ ID NO: 288374 - RNA, 19 nt, Homo sapiens
gcgagugcgugaauauugg

SEQ ID NO: 288375 - RNA, 19 nt, Homo sapiens
gcugggagacgacgaagga

SEQ ID NO: 288376 - RNA, 19 nt, Homo sapiens
gcaggacggccucuauuac

SEQ ID NO: 288377 - RNA, 19 nt, Homo sapiens
uguaggagacuguuuggaa

SEQ ID NO: 288378 - RNA, 19 nt, Homo sapiens
cgcaggacggccucuauua

SEQ ID NO: 288379 - RNA, 19 nt, Homo sapiens
ggaggacuggguuucagaa

SEQ ID NO: 288380 - RNA, 19 nt, Homo sapiens
cgaaggaacaggcguuucu

SEQ ID NO: 288381 - RNA, 19 nt, Homo sapiens
cauaggcgcuccgcugaag

SEQ ID NO: 288382 - RNA, 19 nt, Homo sapiens
ggaggagccagaaacagau

SEQ ID NO: 288383 - RNA, 19 nt, Homo sapiens
uaaagaauggaaagcuuca

SEQ ID NO: 288384 - RNA, 19 nt, Homo sapiens
aaauguaggagacuguuug

SEQ ID NO: 288385 - RNA, 19 nt, Homo sapiens
aggagacuguuuggaaauu

SEQ ID NO: 288386 - RNA, 19 nt, Homo sapiens
gggagacgacgaaggaaca

SEQ ID NO: 288387 - RNA, 19 nt, Homo sapiens
gagaggguguacgucaaca

SEQ ID NO: 288388 - RNA, 19 nt, Homo sapiens
ggugcgagugcgugaauau

SEQ ID NO: 288389 - RNA, 19 nt, Homo sapiens
gaggguguacgucaacauc

SEQ ID NO: 288390 - RNA, 19 nt, Homo sapiens
aggaggagccagaaacaga

SEQ ID NO: 288391 - RNA, 19 nt, Homo sapiens
gaaggaacaggcguuucug

SEQ ID NO: 288392 - RNA, 19 nt, Homo sapiens
gggaggacuggguuucaga

SEQ ID NO: 288393 - RNA, 19 nt, Homo sapiens
uggcugugcuggccuuagu

SEQ ID NO: 288394 - RNA, 19 nt, Homo sapiens
gacgaaggaacaggcguuu

SEQ ID NO: 288395 - RNA, 19 nt, Homo sapiens
ccagaggaggagccagaaa

SEQ ID NO: 288396 - RNA, 19 nt, Homo sapiens
ccgcaggacggccucuauu

SEQ ID NO: 288397 - RNA, 19 nt, Homo sapiens
ggauaaaucugguucguuu

SEQ ID NO: 288398 - RNA, 19 nt, Homo sapiens
ggaagaaguuguccgauga

SEQ ID NO: 288399 - RNA, 19 nt, Homo sapiens
gaaaccacgucucuauuaa

SEQ ID NO: 288400 - RNA, 19 nt, Homo sapiens
uauaggaacucuuugcuua

SEQ ID NO: 288401 - RNA, 19 nt, Homo sapiens
uaacagcaaugagaacuua

SEQ ID NO: 288402 - RNA, 19 nt, Homo sapiens
ucaaucaucugcucauuaa

SEQ ID NO: 288403 - RNA, 19 nt, Homo sapiens
aaagugaggccuagaauua

SEQ ID NO: 288404 - RNA, 19 nt, Homo sapiens
ccuagucacuguugcauua

SEQ ID NO: 288405 - RNA, 19 nt, Homo sapiens
ugaggagacuuaauaauga

SEQ ID NO: 288406 - RNA, 19 nt, Homo sapiens
gaacugugguuuaacuguu

SEQ ID NO: 288407 - RNA, 19 nt, Homo sapiens
gaagagauguauaguggau

SEQ ID NO: 288408 - RNA, 19 nt, Homo sapiens
gagguaucauuaucaguua

SEQ ID NO: 288409 - RNA, 19 nt, Homo sapiens
gcaggagaaucacuugaaa

SEQ ID NO: 288410 - RNA, 19 nt, Homo sapiens
ggaccuagauagugaugaa

SEQ ID NO: 288411 - RNA, 19 nt, Homo sapiens
acauagacuuccuguauua

SEQ ID NO: 288412 - RNA, 19 nt, Homo sapiens
gaauugggauuucugugaa

SEQ ID NO: 288413 - RNA, 19 nt, Homo sapiens
gagcaucuuuccaugauau

SEQ ID NO: 288414 - RNA, 19 nt, Homo sapiens
ggaccuauaccuucuauga

SEQ ID NO: 288415 - RNA, 19 nt, Homo sapiens
uguagaaacucaauuguug

SEQ ID NO: 288416 - RNA, 19 nt, Homo sapiens
ggugugaacugugguuuaa

SEQ ID NO: 288417 - RNA, 19 nt, Homo sapiens
ccaguuugauaguuuguua

SEQ ID NO: 288418 - RNA, 19 nt, Homo sapiens
gggagaaggugacauuuua

SEQ ID NO: 288419 - RNA, 19 nt, Homo sapiens
gaagggagaaggugacauu

SEQ ID NO: 288420 - RNA, 19 nt, Homo sapiens
ugaaaccacgucucuauua

SEQ ID NO: 288421 - RNA, 19 nt, Homo sapiens
ccagcuaauuguuguauuu

SEQ ID NO: 288422 - RNA, 19 nt, Homo sapiens
caucagaggccaugacuuu

SEQ ID NO: 288423 - RNA, 19 nt, Homo sapiens
gcugacaccuuuauguuug

SEQ ID NO: 288424 - RNA, 19 nt, Homo sapiens
gguaagacuucucagcauu

SEQ ID NO: 288425 - RNA, 19 nt, Homo sapiens
agaagagucuguucaauca

SEQ ID NO: 288426 - RNA, 19 nt, Homo sapiens
agcaauagaugcacagaua

SEQ ID NO: 288427 - RNA, 19 nt, Homo sapiens
gaaacggaauugguucuug

SEQ ID NO: 288428 - RNA, 19 nt, Homo sapiens
caucaagccugugcucuuu

SEQ ID NO: 288429 - RNA, 19 nt, Homo sapiens
guaagacuucucagcauua

SEQ ID NO: 288430 - RNA, 19 nt, Homo sapiens
cauguuauacguacacuua

SEQ ID NO: 288431 - RNA, 19 nt, Homo sapiens
gaaaacaccccaagcuaua

SEQ ID NO: 288432 - RNA, 19 nt, Homo sapiens
gaagcccagugaauauauu

SEQ ID NO: 288433 - RNA, 19 nt, Homo sapiens
ggagaagcccagugaauau

SEQ ID NO: 288434 - RNA, 19 nt, Homo sapiens
gaacaggccaaucugaaga

SEQ ID NO: 288435 - RNA, 19 nt, Homo sapiens
gaaccuugaaugcaugaua

SEQ ID NO: 288436 - RNA, 19 nt, Homo sapiens
gaaaugugucuucagcuuu

SEQ ID NO: 288437 - RNA, 19 nt, Homo sapiens
gguguacaaugcuaauaaa

SEQ ID NO: 288438 - RNA, 19 nt, Homo sapiens
ggaugaaccuugaaugcau

SEQ ID NO: 288439 - RNA, 19 nt, Homo sapiens
gcaucugcaucguguuuaa

SEQ ID NO: 288440 - RNA, 19 nt, Homo sapiens
ggagguugaugcaggagaa

SEQ ID NO: 288441 - RNA, 19 nt, Homo sapiens
gcauaucccugagauuuua

SEQ ID NO: 288442 - RNA, 19 nt, Homo sapiens
gagaagcccagugaauaua

SEQ ID NO: 288443 - RNA, 19 nt, Homo sapiens
gagcacaucagccucauga

SEQ ID NO: 288444 - RNA, 19 nt, Homo sapiens
aaucugaggagacuuaaua

SEQ ID NO: 288445 - RNA, 19 nt, Homo sapiens
gagaagagucuguucaauc

SEQ ID NO: 288446 - RNA, 19 nt, Homo sapiens
ggagaagagucuguucaau

SEQ ID NO: 288447 - RNA, 19 nt, Homo sapiens
ggagugcgguggcaugauc

SEQ ID NO: 288448 - RNA, 19 nt, Homo sapiens
uagaaugguugaaauagug

SEQ ID NO: 288449 - RNA, 19 nt, Homo sapiens
ugacaggggugccuaauuu

SEQ ID NO: 288450 - RNA, 19 nt, Homo sapiens
gagcugaguucugcagaga

SEQ ID NO: 288451 - RNA, 19 nt, Homo sapiens
agacuucucagcauuauuu

SEQ ID NO: 288452 - RNA, 19 nt, Homo sapiens
gauggagucucgcucuguu

SEQ ID NO: 288453 - RNA, 19 nt, Homo sapiens
gcuauuacagcucauauau

SEQ ID NO: 288454 - RNA, 19 nt, Homo sapiens
gaaggaccgugagccuaaa

SEQ ID NO: 288455 - RNA, 19 nt, Homo sapiens
gaggagcgacugcuaauca

SEQ ID NO: 288456 - RNA, 19 nt, Homo sapiens
gauauccaauuguuucaca

SEQ ID NO: 288457 - RNA, 19 nt, Homo sapiens
ucgauuguuugccuucuua

SEQ ID NO: 288458 - RNA, 19 nt, Homo sapiens
cagauauuccuguaagaua

SEQ ID NO: 288459 - RNA, 19 nt, Homo sapiens
agcagaagcugacaccuuu

SEQ ID NO: 288460 - RNA, 19 nt, Homo sapiens
caaaggacaaggucuucua

SEQ ID NO: 288461 - RNA, 19 nt, Homo sapiens
ccauauauaggaacucuuu

SEQ ID NO: 288462 - RNA, 19 nt, Homo sapiens
ggacuucauugauguacuc

SEQ ID NO: 288463 - RNA, 19 nt, Homo sapiens
gaggagacuuaauaaugau

SEQ ID NO: 288464 - RNA, 19 nt, Homo sapiens
uaagauacaggugugguua

SEQ ID NO: 288465 - RNA, 19 nt, Homo sapiens
caucuggauucuucacaaa

SEQ ID NO: 288466 - RNA, 19 nt, Homo sapiens
gcacuaaaugcuauugaau

SEQ ID NO: 288467 - RNA, 19 nt, Homo sapiens
gaagcugacaccuuuaugu

SEQ ID NO: 288468 - RNA, 19 nt, Homo sapiens
gagcagaagcugacaccuu

SEQ ID NO: 288469 - RNA, 19 nt, Homo sapiens
aaaugugucuucagcuuug

SEQ ID NO: 288470 - RNA, 19 nt, Homo sapiens
agaaaugugucuucagcuu

SEQ ID NO: 288471 - RNA, 19 nt, Homo sapiens
ggugaaaccacgucucuau

SEQ ID NO: 288472 - RNA, 19 nt, Homo sapiens
acaaggugcuccugacaga

SEQ ID NO: 288473 - RNA, 19 nt, Homo sapiens
ccaaagugcugggauuaca

SEQ ID NO: 288474 - RNA, 19 nt, Homo sapiens
ugaacaagcagaccacuga

SEQ ID NO: 288475 - RNA, 19 nt, Homo sapiens
ggaacucuuugcuuaacug

SEQ ID NO: 288476 - RNA, 19 nt, Homo sapiens
gcaugauacugaaugaaag

SEQ ID NO: 288477 - RNA, 19 nt, Homo sapiens
ugaaggaccgugagccuaa

SEQ ID NO: 288478 - RNA, 19 nt, Homo sapiens
ggaugaagaugggaagaag

SEQ ID NO: 288479 - RNA, 19 nt, Homo sapiens
gugcacgacuucacagaug

SEQ ID NO: 288480 - RNA, 19 nt, Homo sapiens
ugacagucuugcacauauu

SEQ ID NO: 288481 - RNA, 19 nt, Homo sapiens
uugcaaagcacccggaaua

SEQ ID NO: 288482 - RNA, 19 nt, Homo sapiens
cagcugccauuguaccaaa

SEQ ID NO: 288483 - RNA, 19 nt, Homo sapiens
ccugauaggguuugaauug

SEQ ID NO: 288484 - RNA, 19 nt, Homo sapiens
guugaaauuuggguggaua

SEQ ID NO: 288485 - RNA, 19 nt, Homo sapiens
agagauguauaguggauug

SEQ ID NO: 288486 - RNA, 19 nt, Homo sapiens
gcagauccuccuguacaua

SEQ ID NO: 288487 - RNA, 19 nt, Homo sapiens
uaacguaugagaauucuag

SEQ ID NO: 288488 - RNA, 19 nt, Homo sapiens
gugagcaucuuuccaugau

SEQ ID NO: 288489 - RNA, 19 nt, Homo sapiens
ugagugcacuaaaugcuau

SEQ ID NO: 288490 - RNA, 19 nt, Homo sapiens
guacagcugagaauuuaau

SEQ ID NO: 288491 - RNA, 19 nt, Homo sapiens
ugaauugggauuucuguga

SEQ ID NO: 288492 - RNA, 19 nt, Homo sapiens
gggaauccuucaacuacau

SEQ ID NO: 288493 - RNA, 19 nt, Homo sapiens
uuuauggacuggacguuaa

SEQ ID NO: 288494 - RNA, 19 nt, Homo sapiens
gcaauagaugcacagauau

SEQ ID NO: 288495 - RNA, 19 nt, Homo sapiens
gcaggagaaucgcuugaac

SEQ ID NO: 288496 - RNA, 19 nt, Homo sapiens
uaagacuucucagcauuau

SEQ ID NO: 288497 - RNA, 19 nt, Homo sapiens
gaaauuuccuccuaacaua

SEQ ID NO: 288498 - RNA, 19 nt, Homo sapiens
ggaaauaccuucauuggau

SEQ ID NO: 288499 - RNA, 19 nt, Homo sapiens
ggaaauguguggauauuga

SEQ ID NO: 288500 - RNA, 19 nt, Homo sapiens
ggaaguuucuugugcauuu

SEQ ID NO: 288501 - RNA, 19 nt, Homo sapiens
gcagaugaaugccuacuuu

SEQ ID NO: 288502 - RNA, 19 nt, Homo sapiens
auacuaagcugauguguuu

SEQ ID NO: 288503 - RNA, 19 nt, Homo sapiens
acacauaccuugccucuga

SEQ ID NO: 288504 - RNA, 19 nt, Homo sapiens
ggaagaguuuauaagcuua

SEQ ID NO: 288505 - RNA, 19 nt, Homo sapiens
guagagauauugaugaaug

SEQ ID NO: 288506 - RNA, 19 nt, Homo sapiens
gcaaguucauggauacuaa

SEQ ID NO: 288507 - RNA, 19 nt, Homo sapiens
gcaagggaaucuaugugua

SEQ ID NO: 288508 - RNA, 19 nt, Homo sapiens
ugacagaaaucaaugaaug

SEQ ID NO: 288509 - RNA, 19 nt, Homo sapiens
gaauaccgccuugaauuua

SEQ ID NO: 288510 - RNA, 19 nt, Homo sapiens
agaggagacugcauuaaua

SEQ ID NO: 288511 - RNA, 19 nt, Homo sapiens
ggagaccacugugaagaua

SEQ ID NO: 288512 - RNA, 19 nt, Homo sapiens
cacaagcacuguagagaua

SEQ ID NO: 288513 - RNA, 19 nt, Homo sapiens
aaacugcagugcuuugaua

SEQ ID NO: 288514 - RNA, 19 nt, Homo sapiens
gcauagauguugacgaaug

SEQ ID NO: 288515 - RNA, 19 nt, Homo sapiens
caagaggacugcuguggaa

SEQ ID NO: 288516 - RNA, 19 nt, Homo sapiens
ggaauggguuauacgguuu

SEQ ID NO: 288517 - RNA, 19 nt, Homo sapiens
guacuaugauccugugaaa

SEQ ID NO: 288518 - RNA, 19 nt, Homo sapiens
ggugagaacuauaaagaug

SEQ ID NO: 288519 - RNA, 19 nt, Homo sapiens
uaaaggaccuguauuuguc

SEQ ID NO: 288520 - RNA, 19 nt, Homo sapiens
gccaagauauuaaugaaug

SEQ ID NO: 288521 - RNA, 19 nt, Homo sapiens
caaggcaaguucauggaua

SEQ ID NO: 288522 - RNA, 19 nt, Homo sapiens
aaacaagaaugcugcugua

SEQ ID NO: 288523 - RNA, 19 nt, Homo sapiens
gugaagauauugaugaaug

SEQ ID NO: 288524 - RNA, 19 nt, Homo sapiens
gugaagauaucaaugaaug

SEQ ID NO: 288525 - RNA, 19 nt, Homo sapiens
aaacugaugucuaccaaga

SEQ ID NO: 288526 - RNA, 19 nt, Homo sapiens
gaggaaauguguggauauu

SEQ ID NO: 288527 - RNA, 19 nt, Homo sapiens
ggacgcaugucauccauuc

SEQ ID NO: 288528 - RNA, 19 nt, Homo sapiens
ggauauugaugaauguuug

SEQ ID NO: 288529 - RNA, 19 nt, Homo sapiens
gguacuaacugcauagaug

SEQ ID NO: 288530 - RNA, 19 nt, Homo sapiens
aaagugaaauuuccuccua

SEQ ID NO: 288531 - RNA, 19 nt, Homo sapiens
ucacugaaauggaagaguu

SEQ ID NO: 288532 - RNA, 19 nt, Homo sapiens
ucagcuagaugacaauaaa

SEQ ID NO: 288533 - RNA, 19 nt, Homo sapiens
gaacaccaccacucucauu

SEQ ID NO: 288534 - RNA, 19 nt, Homo sapiens
gaugaccuguuucgaugua

SEQ ID NO: 288535 - RNA, 19 nt, Homo sapiens
caagaaugcugcuguacau

SEQ ID NO: 288536 - RNA, 19 nt, Homo sapiens
ccagugagauauaccugua

SEQ ID NO: 288537 - RNA, 19 nt, Homo sapiens
caucagguuucaagaauug

SEQ ID NO: 288538 - RNA, 19 nt, Homo sapiens
acagugaccuggagugaaa

SEQ ID NO: 288539 - RNA, 19 nt, Homo sapiens
cuauaaagaugcagaugaa

SEQ ID NO: 288540 - RNA, 19 nt, Homo sapiens
ggaggguacuaacugcaua

SEQ ID NO: 288541 - RNA, 19 nt, Homo sapiens
guaaaggaccuguauuugu

SEQ ID NO: 288542 - RNA, 19 nt, Homo sapiens
caagguguaugcccuaaug

SEQ ID NO: 288543 - RNA, 19 nt, Homo sapiens
gaccauacauuccacauac

SEQ ID NO: 288544 - RNA, 19 nt, Homo sapiens
caacaggccagaagacaaa

SEQ ID NO: 288545 - RNA, 19 nt, Homo sapiens
gcaaggagucaaagugaaa

SEQ ID NO: 288546 - RNA, 19 nt, Homo sapiens
gccaauccaucaccaugua

SEQ ID NO: 288547 - RNA, 19 nt, Homo sapiens
gaaacagaaucuacauaac

SEQ ID NO: 288548 - RNA, 19 nt, Homo sapiens
agaagaaacugaugucuac

SEQ ID NO: 288549 - RNA, 19 nt, Homo sapiens
gagaggagacugcauuaau

SEQ ID NO: 288550 - RNA, 19 nt, Homo sapiens
caagggaaucuauguguaa

SEQ ID NO: 288551 - RNA, 19 nt, Homo sapiens
gugaggauauugaugaaug

SEQ ID NO: 288552 - RNA, 19 nt, Homo sapiens
cugcauagauguugacgaa

SEQ ID NO: 288553 - RNA, 19 nt, Homo sapiens
cauauacucugcacugugu

SEQ ID NO: 288554 - RNA, 19 nt, Homo sapiens
ggaugucucucugcaagaa

SEQ ID NO: 288555 - RNA, 19 nt, Homo sapiens
uaaauagcuuugaggaguu

SEQ ID NO: 288556 - RNA, 19 nt, Homo sapiens
ugaauucuccuggaucuua

SEQ ID NO: 288557 - RNA, 19 nt, Homo sapiens
ccgagcaucuguaaaguga

SEQ ID NO: 288558 - RNA, 19 nt, Homo sapiens
caaguccucugaagacaau

SEQ ID NO: 288559 - RNA, 19 nt, Homo sapiens
caagaccguuuucuaaaua

SEQ ID NO: 288560 - RNA, 19 nt, Homo sapiens
gaugagcagugugugaauu

SEQ ID NO: 288561 - RNA, 19 nt, Homo sapiens
cagaggaaauguguggaua

SEQ ID NO: 288562 - RNA, 19 nt, Homo sapiens
ugaauaccgccuugaauuu

SEQ ID NO: 288563 - RNA, 19 nt, Homo sapiens
gauggccaguguguuaaua

SEQ ID NO: 288564 - RNA, 19 nt, Homo sapiens
ccacagauuuagauguaga

SEQ ID NO: 288565 - RNA, 19 nt, Homo sapiens
gaacaacagaggaaaugug

SEQ ID NO: 288566 - RNA, 19 nt, Homo sapiens
uggaaugccuaccggguua

SEQ ID NO: 288567 - RNA, 19 nt, Homo sapiens
gaaacagcauggaguugca

SEQ ID NO: 288568 - RNA, 19 nt, Homo sapiens
ugagucaaacgaacaaaua

SEQ ID NO: 288569 - RNA, 19 nt, Homo sapiens
ccaaacgucugcgcaaaug

SEQ ID NO: 288570 - RNA, 19 nt, Homo sapiens
gauccuaccuuuucaaguu

SEQ ID NO: 288571 - RNA, 19 nt, Homo sapiens
ggaugugaaugaaugugaa

SEQ ID NO: 288572 - RNA, 19 nt, Homo sapiens
ggccguacgugugaagaua

SEQ ID NO: 288573 - RNA, 19 nt, Homo sapiens
gauuucagcuagaugacaa

SEQ ID NO: 288574 - RNA, 19 nt, Homo sapiens
caagaguguuugccagaga

SEQ ID NO: 288575 - RNA, 19 nt, Homo sapiens
ccagauacaucagguuuca

SEQ ID NO: 288576 - RNA, 19 nt, Homo sapiens
guauacacauuuggagaaa

SEQ ID NO: 288577 - RNA, 19 nt, Homo sapiens
gaagacaaugagaggauuu

SEQ ID NO: 288578 - RNA, 19 nt, Homo sapiens
gaccuggagugaaacagaa

SEQ ID NO: 288579 - RNA, 19 nt, Homo sapiens
gggagugccuaaacacaga

SEQ ID NO: 288580 - RNA, 19 nt, Homo sapiens
guacuuguccggauggauu

SEQ ID NO: 288581 - RNA, 19 nt, Homo sapiens
gaugaauguuugaauccaa

SEQ ID NO: 288582 - RNA, 19 nt, Homo sapiens
gaagagaaagggcccuguu

SEQ ID NO: 288583 - RNA, 19 nt, Homo sapiens
caucuuccauguaugaaug

SEQ ID NO: 288584 - RNA, 19 nt, Homo sapiens
gaacuuccgagugguaauu

SEQ ID NO: 288585 - RNA, 19 nt, Homo sapiens
uggaagaguuuauaagcuu

SEQ ID NO: 288586 - RNA, 19 nt, Homo sapiens
aaauagcuuugaggaguua

SEQ ID NO: 288587 - RNA, 19 nt, Homo sapiens
gcaucaagguggucuuuac

SEQ ID NO: 288588 - RNA, 19 nt, Homo sapiens
gaaggauucagaugacuau

SEQ ID NO: 288589 - RNA, 19 nt, Homo sapiens
gcuuugauauggaugaaug

SEQ ID NO: 288590 - RNA, 19 nt, Homo sapiens
agauguagaucaacccaaa

SEQ ID NO: 288591 - RNA, 19 nt, Homo sapiens
aauggugaguguuugaaua

SEQ ID NO: 288592 - RNA, 19 nt, Homo sapiens
ucagugcccuccaaauuuc

SEQ ID NO: 288593 - RNA, 19 nt, Homo sapiens
guaaaugaaugcgaugagu

SEQ ID NO: 288594 - RNA, 19 nt, Homo sapiens
ggguaugaaugcuacugua

SEQ ID NO: 288595 - RNA, 19 nt, Homo sapiens
cuccacagauuuagaugua

SEQ ID NO: 288596 - RNA, 19 nt, Homo sapiens
caagaugaccuguuucgau

SEQ ID NO: 288597 - RNA, 19 nt, Homo sapiens
gauauuagcuuguugaaug

SEQ ID NO: 288598 - RNA, 19 nt, Homo sapiens
gaacaaagagccugagaaa

SEQ ID NO: 288599 - RNA, 19 nt, Homo sapiens
gagaagggcugccaagaug

SEQ ID NO: 288600 - RNA, 19 nt, Homo sapiens
gaaauggccuccagucaca

SEQ ID NO: 288601 - RNA, 19 nt, Homo sapiens
gaaggagccuggacguuug

SEQ ID NO: 288602 - RNA, 19 nt, Homo sapiens
aaaggacacugccaagaua

SEQ ID NO: 288603 - RNA, 19 nt, Homo sapiens
gcacagaggccuucagaga

SEQ ID NO: 288604 - RNA, 19 nt, Homo sapiens
ggccagagguuuccaauca

SEQ ID NO: 288605 - RNA, 19 nt, Homo sapiens
gaaugagugugaugacuug

SEQ ID NO: 288606 - RNA, 19 nt, Homo sapiens
gagaguguguggauauuga

SEQ ID NO: 288607 - RNA, 19 nt, Homo sapiens
acaaagaccucuauuacau

SEQ ID NO: 288608 - RNA, 19 nt, Homo sapiens
ucagaaccaugguggaaua

SEQ ID NO: 288609 - RNA, 19 nt, Homo sapiens
ggaaggagccuggacguuu

SEQ ID NO: 288610 - RNA, 19 nt, Homo sapiens
ggacagugcugcccaggau

SEQ ID NO: 288611 - RNA, 19 nt, Homo sapiens
agacacaaaugaagaagaa

SEQ ID NO: 288612 - RNA, 19 nt, Homo sapiens
gcuguaagcuucggucauu

SEQ ID NO: 288613 - RNA, 19 nt, Homo sapiens
caacacagccggucacuca

SEQ ID NO: 288614 - RNA, 19 nt, Homo sapiens
gaaaggacacugccaagau

SEQ ID NO: 288615 - RNA, 19 nt, Homo sapiens
gaaccaugguggaauaaag

SEQ ID NO: 288616 - RNA, 19 nt, Homo sapiens
gcagccagauuuccaaugu

SEQ ID NO: 288617 - RNA, 19 nt, Homo sapiens
gaacgagugugagcuuaug

SEQ ID NO: 288618 - RNA, 19 nt, Homo sapiens
gaugggagaugcgucaauu

SEQ ID NO: 288619 - RNA, 19 nt, Homo sapiens
gccaagauaucaacgaaug

SEQ ID NO: 288620 - RNA, 19 nt, Homo sapiens
gagcccagcuggaguagga

SEQ ID NO: 288621 - RNA, 19 nt, Homo sapiens
gugaagauguggaugaaug

SEQ ID NO: 288622 - RNA, 19 nt, Homo sapiens
caaagaccucuauuacaua

SEQ ID NO: 288623 - RNA, 19 nt, Homo sapiens
caacguggcucgcauugag

SEQ ID NO: 288624 - RNA, 19 nt, Homo sapiens
ccacgggucuuucuucugu

SEQ ID NO: 288625 - RNA, 19 nt, Homo sapiens
gaagcaaggcugauauuag

SEQ ID NO: 288626 - RNA, 19 nt, Homo sapiens
uuucaucucucccagcuua

SEQ ID NO: 288627 - RNA, 19 nt, Homo sapiens
acacuugucuggccuguga

SEQ ID NO: 288628 - RNA, 19 nt, Homo sapiens
gaggagcucugaggucuau

SEQ ID NO: 288629 - RNA, 19 nt, Homo sapiens
acauaaacacugcuucuua

SEQ ID NO: 288630 - RNA, 19 nt, Homo sapiens
gcuaugggaugcuuaccaa

SEQ ID NO: 288631 - RNA, 19 nt, Homo sapiens
ccacauggccugcguagau

SEQ ID NO: 288632 - RNA, 19 nt, Homo sapiens
cauaaacacugcuucuuac

SEQ ID NO: 288633 - RNA, 19 nt, Homo sapiens
cuagggagguccuucagaa

SEQ ID NO: 288634 - RNA, 19 nt, Homo sapiens
ucaacaccgugccugguua

SEQ ID NO: 288635 - RNA, 19 nt, Homo sapiens
gagacugcauugacauaga

SEQ ID NO: 288636 - RNA, 19 nt, Homo sapiens
gaaagugcaccaaccuaga

SEQ ID NO: 288637 - RNA, 19 nt, Homo sapiens
gcagcuaccugugcacaug

SEQ ID NO: 288638 - RNA, 19 nt, Homo sapiens
caaagagccugagaaagca

SEQ ID NO: 288639 - RNA, 19 nt, Homo sapiens
gguacugggugaaugaaga

SEQ ID NO: 288640 - RNA, 19 nt, Homo sapiens
guagccagcucucuuccaa

SEQ ID NO: 288641 - RNA, 19 nt, Homo sapiens
ggaccuggccugugagaau

SEQ ID NO: 288642 - RNA, 19 nt, Homo sapiens
gacagaccauguacacaga

SEQ ID NO: 288643 - RNA, 19 nt, Homo sapiens
gaacggagacugcauugac

SEQ ID NO: 288644 - RNA, 19 nt, Homo sapiens
acagaggccuucagagaga

SEQ ID NO: 288645 - RNA, 19 nt, Homo sapiens
gagaagcaaggcugauauu

SEQ ID NO: 288646 - RNA, 19 nt, Homo sapiens
gcaaggacgcggagugugu

SEQ ID NO: 288647 - RNA, 19 nt, Homo sapiens
cuacaaagaccucuauuac

SEQ ID NO: 288648 - RNA, 19 nt, Homo sapiens
uaagagacacaaaugaaga

SEQ ID NO: 288649 - RNA, 19 nt, Homo sapiens
gaauguaagagacacaaau

SEQ ID NO: 288650 - RNA, 19 nt, Homo sapiens
ggaugagugugugauauuc

SEQ ID NO: 288651 - RNA, 19 nt, Homo sapiens
gcaagaggacaugaugaaa

SEQ ID NO: 288652 - RNA, 19 nt, Homo sapiens
gaccagggcuucgagaucu

SEQ ID NO: 288653 - RNA, 19 nt, Homo sapiens
ggagggcacugugucaaca

SEQ ID NO: 288654 - RNA, 19 nt, Homo sapiens
ggaaaggacacugccaaga

SEQ ID NO: 288655 - RNA, 19 nt, Homo sapiens
acaaagagccugagaaagc

SEQ ID NO: 288656 - RNA, 19 nt, Homo sapiens
ggaagacaccgugacauca

SEQ ID NO: 288657 - RNA, 19 nt, Homo sapiens
gaaagcagcaagaggacau

SEQ ID NO: 288658 - RNA, 19 nt, Homo sapiens
ccacucagccaaucuguuc

SEQ ID NO: 288659 - RNA, 19 nt, Homo sapiens
gugaacgagugugagcuua

SEQ ID NO: 288660 - RNA, 19 nt, Homo sapiens
gggcagcgagugugagaaa

SEQ ID NO: 288661 - RNA, 19 nt, Homo sapiens
gggagguccuucagaaucu

SEQ ID NO: 288662 - RNA, 19 nt, Homo sapiens
gcaggggccuugaggauga

SEQ ID NO: 288663 - RNA, 19 nt, Homo sapiens
guacacagaugcggaugag

SEQ ID NO: 288664 - RNA, 19 nt, Homo sapiens
ucuacaaagaccucuauua

SEQ ID NO: 288665 - RNA, 19 nt, Homo sapiens
caagggcugccaugggaua

SEQ ID NO: 288666 - RNA, 19 nt, Homo sapiens
gcagcaagaggacaugaug

SEQ ID NO: 288667 - RNA, 19 nt, Homo sapiens
accaaucgcuuuaaugcuu

SEQ ID NO: 288668 - RNA, 19 nt, Homo sapiens
gaccuggccugugagaaug

SEQ ID NO: 288669 - RNA, 19 nt, Homo sapiens
gcggaugagugugugauau

SEQ ID NO: 288670 - RNA, 19 nt, Homo sapiens
cagagaagcaaggcugaua

SEQ ID NO: 288671 - RNA, 19 nt, Homo sapiens
uugcagagauacaggaaga

SEQ ID NO: 288672 - RNA, 19 nt, Homo sapiens
ggcugaaccucacggagaa

SEQ ID NO: 288673 - RNA, 19 nt, Homo sapiens
aagcaaggcugauauuagc

SEQ ID NO: 288674 - RNA, 19 nt, Homo sapiens
cuacgaugcuucccacaag

SEQ ID NO: 288675 - RNA, 19 nt, Homo sapiens
cagccaagguguacagucu

SEQ ID NO: 288676 - RNA, 19 nt, Homo sapiens
gcaccugcacccugccuuu

SEQ ID NO: 288677 - RNA, 19 nt, Homo sapiens
guaagagacacaaaugaag

SEQ ID NO: 288678 - RNA, 19 nt, Homo sapiens
gcaaggcugauauuagcuu

SEQ ID NO: 288679 - RNA, 19 nt, Homo sapiens
aaucagccuugccugcuuu

SEQ ID NO: 288680 - RNA, 19 nt, Homo sapiens
gggaagacaccgugacauc

SEQ ID NO: 288681 - RNA, 19 nt, Homo sapiens
gaucugcccuaguggaaaa

SEQ ID NO: 288682 - RNA, 19 nt, Homo sapiens
ccaauggcaccguguguga

SEQ ID NO: 288683 - RNA, 19 nt, Homo sapiens
ggaggcgagugcaagaaca

SEQ ID NO: 288684 - RNA, 19 nt, Homo sapiens
gaacggguacugggugaau

SEQ ID NO: 288685 - RNA, 19 nt, Homo sapiens
gaagggcugccaagaugug

SEQ ID NO: 288686 - RNA, 19 nt, Homo sapiens
ggacacugccaagauauca

SEQ ID NO: 288687 - RNA, 19 nt, Homo sapiens
gcagcgagugugagaaaug

SEQ ID NO: 288688 - RNA, 19 nt, Homo sapiens
aggcauuccucugaguuua

SEQ ID NO: 288689 - RNA, 19 nt, Homo sapiens
gaagcagccagauuuccaa

SEQ ID NO: 288690 - RNA, 19 nt, Homo sapiens
uguaagagacacaaaugaa

SEQ ID NO: 288691 - RNA, 19 nt, Homo sapiens
agaagcaaggcugauauua

SEQ ID NO: 288692 - RNA, 19 nt, Homo sapiens
gagaucugcccuaguggaa

SEQ ID NO: 288693 - RNA, 19 nt, Homo sapiens
ugacgagugugaggacuau

SEQ ID NO: 288694 - RNA, 19 nt, Homo sapiens
guucagaagcagccagauu

SEQ ID NO: 288695 - RNA, 19 nt, Homo sapiens
ccaaggcuuuauacgucua

SEQ ID NO: 288696 - RNA, 19 nt, Homo sapiens
caaucagccuugccugcuu

SEQ ID NO: 288697 - RNA, 19 nt, Homo sapiens
caacaacccuggcuccuau

SEQ ID NO: 288698 - RNA, 19 nt, Homo sapiens
cagcagggcuccaacauga

SEQ ID NO: 288699 - RNA, 19 nt, Homo sapiens
ggacagaucucagcagaag

SEQ ID NO: 288700 - RNA, 19 nt, Homo sapiens
ggugaucacugagggauuu

SEQ ID NO: 288701 - RNA, 19 nt, Homo sapiens
acaacaacaucgucaacua

SEQ ID NO: 288702 - RNA, 19 nt, Homo sapiens
ggacacagaggaagagaga

SEQ ID NO: 288703 - RNA, 19 nt, Homo sapiens
gccaggaucuuuccagugu

SEQ ID NO: 288704 - RNA, 19 nt, Homo sapiens
caggaaaugccaagacaua

SEQ ID NO: 288705 - RNA, 19 nt, Homo sapiens
gggaagggauaccacauuc

SEQ ID NO: 288706 - RNA, 19 nt, Homo sapiens
ggucggagauuugcaagga

SEQ ID NO: 288707 - RNA, 19 nt, Homo sapiens
ggaaaugccaagacauaga

SEQ ID NO: 288708 - RNA, 19 nt, Homo sapiens
cagaggguguuuccuagaa

SEQ ID NO: 288709 - RNA, 19 nt, Homo sapiens
gaaaugccaagacauagau

SEQ ID NO: 288710 - RNA, 19 nt, Homo sapiens
gagagugacuuuucccuuu

SEQ ID NO: 288711 - RNA, 19 nt, Homo sapiens
aaucagaucgugccucuuu

SEQ ID NO: 288712 - RNA, 19 nt, Homo sapiens
gagaagagccuguguuucc

SEQ ID NO: 288713 - RNA, 19 nt, Homo sapiens
gcguggaccugaacgaaug

SEQ ID NO: 288714 - RNA, 19 nt, Homo sapiens
cuucagggcuccuaugugu

SEQ ID NO: 288715 - RNA, 19 nt, Homo sapiens
ggaagugggcgcugacugu

SEQ ID NO: 288716 - RNA, 19 nt, Homo sapiens
gcccagaccucggugauca

SEQ ID NO: 288717 - RNA, 19 nt, Homo sapiens
gcaacacgccaggaucuuu

SEQ ID NO: 288718 - RNA, 19 nt, Homo sapiens
agaccucggugaucacuga

SEQ ID NO: 288719 - RNA, 19 nt, Homo sapiens
caagagaugaggacaguuc

SEQ ID NO: 288720 - RNA, 19 nt, Homo sapiens
gcugguggguggcaggaaa

SEQ ID NO: 288721 - RNA, 19 nt, Homo sapiens
ggaacggagugugugagaa

SEQ ID NO: 288722 - RNA, 19 nt, Homo sapiens
ucaagugcaucgccuguca

SEQ ID NO: 288723 - RNA, 19 nt, Homo sapiens
gagcaagugccacaagugu

SEQ ID NO: 288724 - RNA, 19 nt, Homo sapiens
guucagaggaggauucaga

SEQ ID NO: 288725 - RNA, 19 nt, Homo sapiens
gaacggagugugugagaac

SEQ ID NO: 288726 - RNA, 19 nt, Homo sapiens
gaagggauaccacauucuc

SEQ ID NO: 288727 - RNA, 19 nt, Homo sapiens
gagaugaggacaguucaga

SEQ ID NO: 288728 - RNA, 19 nt, Homo sapiens
cagcagagccacccaacug

SEQ ID NO: 288729 - RNA, 19 nt, Homo sapiens
gcucgugcguggaccugaa

SEQ ID NO: 288730 - RNA, 19 nt, Homo sapiens
cauggugacugccucaaca

SEQ ID NO: 288731 - RNA, 19 nt, Homo sapiens
caacaacaucgucaacuac

SEQ ID NO: 288732 - RNA, 19 nt, Homo sapiens
ccagcaagcacgccaucua

SEQ ID NO: 288733 - RNA, 19 nt, Homo sapiens
cgaggacauugaugagugu

SEQ ID NO: 288734 - RNA, 19 nt, Homo sapiens
caggaucuuuccaguguca

SEQ ID NO: 288735 - RNA, 19 nt, Homo sapiens
cgacugaaccagaacaucu

SEQ ID NO: 288736 - RNA, 19 nt, Homo sapiens
cagacaaaccggaggagaa

SEQ ID NO: 288737 - RNA, 19 nt, Homo sapiens
caauggcuccuacagaugu

SEQ ID NO: 288738 - RNA, 19 nt, Homo sapiens
caacacgccaggaucuuuc

SEQ ID NO: 288739 - RNA, 19 nt, Homo sapiens
gcuacugcguggaugugaa

SEQ ID NO: 288740 - RNA, 19 nt, Homo sapiens
gcaccgcugcguucaagga

SEQ ID NO: 288741 - RNA, 19 nt, Homo sapiens
ggacaacaacaucgucaac

SEQ ID NO: 288742 - RNA, 19 nt, Homo sapiens
accaauggcuccuacagau

SEQ ID NO: 288743 - RNA, 19 nt, Homo sapiens
ugucagcgcugcccaacag

SEQ ID NO: 288744 - RNA, 19 nt, Homo sapiens
gaggagaagagccuguguu

SEQ ID NO: 288745 - RNA, 19 nt, Homo sapiens
caucaacgagugcgcaaug

SEQ ID NO: 288746 - RNA, 19 nt, Homo sapiens
cagagcaagugccacaagu

SEQ ID NO: 288747 - RNA, 19 nt, Homo sapiens
acgggaaccugcuggaaug

SEQ ID NO: 288748 - RNA, 19 nt, Homo sapiens
caucgacgagugcauguug

SEQ ID NO: 288749 - RNA, 19 nt, Homo sapiens
guucugcgacagcguauug

SEQ ID NO: 288750 - RNA, 19 nt, Homo sapiens
gaaggagugcuaccugaac

SEQ ID NO: 288751 - RNA, 19 nt, Homo sapiens
uaccugaacuucgaugaca

SEQ ID NO: 288752 - RNA, 19 nt, Homo sapiens
gauggcaaaugcgagaaca

SEQ ID NO: 288753 - RNA, 19 nt, Homo sapiens
caacuuucccggucacuac

SEQ ID NO: 288754 - RNA, 19 nt, Homo sapiens
cuacagcucagccgaguuc

SEQ ID NO: 288755 - RNA, 19 nt, Homo sapiens
acugaugagugccgacuga

SEQ ID NO: 288756 - RNA, 19 nt, Homo sapiens
accagacgcucaccauuca

SEQ ID NO: 288757 - RNA, 19 nt, Homo sapiens
aggagaagagccuguguuu

SEQ ID NO: 288758 - RNA, 19 nt, Homo sapiens
ccaccuggccauaguuuag

SEQ ID NO: 288759 - RNA, 19 nt, Homo sapiens
gagcucggccucacuucug

SEQ ID NO: 288760 - RNA, 19 nt, Homo sapiens
gacgggaaccugcuggaau

SEQ ID NO: 288761 - RNA, 19 nt, Homo sapiens
gugacugcaucaauaccaa

SEQ ID NO: 288762 - RNA, 19 nt, Homo sapiens
caccagacgcucaccauuc

SEQ ID NO: 288763 - RNA, 19 nt, Homo sapiens
ggaggauucagacgagugu

SEQ ID NO: 288764 - RNA, 19 nt, Homo sapiens
cccaagagaugaggacagu

SEQ ID NO: 288765 - RNA, 19 nt, Homo sapiens
aauggcaucugcagcaaca

SEQ ID NO: 288766 - RNA, 19 nt, Homo sapiens
gcgacucuguggccagcaa

SEQ ID NO: 288767 - RNA, 19 nt, Homo sapiens
gcugguuccugccggacuu

SEQ ID NO: 288768 - RNA, 19 nt, Homo sapiens
ggagaagagccuguguuuc

SEQ ID NO: 288769 - RNA, 19 nt, Homo sapiens
ucaacaacccuggcuccua

SEQ ID NO: 288770 - RNA, 19 nt, Homo sapiens
ggagugcuaccugaacuuc

SEQ ID NO: 288771 - RNA, 19 nt, Homo sapiens
ucagggcuccuaugugugu

SEQ ID NO: 288772 - RNA, 19 nt, Homo sapiens
ugaaugugcgcguccauca

SEQ ID NO: 288773 - RNA, 19 nt, Homo sapiens
acagaucucagcagaagug

SEQ ID NO: 288774 - RNA, 19 nt, Homo sapiens
ccucuuuacccuuggcuuu

SEQ ID NO: 288775 - RNA, 19 nt, Homo sapiens
caggugcaccgcauugaga

SEQ ID NO: 288776 - RNA, 19 nt, Homo sapiens
gagggcaagugcgugaaca

SEQ ID NO: 288777 - RNA, 19 nt, Homo sapiens
ccaauggcuccuacagaug

SEQ ID NO: 288778 - RNA, 19 nt, Homo sapiens
gcgaaaccagugccugugu

SEQ ID NO: 288779 - RNA, 19 nt, Homo sapiens
gcuucaagguggucuuugc

SEQ ID NO: 288780 - RNA, 19 nt, Homo sapiens
gggcgaccacugcgaaauc

SEQ ID NO: 288781 - RNA, 19 nt, Homo sapiens
gaaccuucagggcuccuau

SEQ ID NO: 288782 - RNA, 19 nt, Homo sapiens
ccacugcgaggacauugau

SEQ ID NO: 288783 - RNA, 19 nt, Homo sapiens
ccaccagacgcucaccauu

SEQ ID NO: 288784 - RNA, 19 nt, Homo sapiens
ggacaguucagaggaggau

SEQ ID NO: 288785 - RNA, 19 nt, Homo sapiens
gcuacacccaggacaacaa

SEQ ID NO: 288786 - RNA, 19 nt, Homo sapiens
acaauggcaucugcagcaa

SEQ ID NO: 288787 - RNA, 19 nt, Homo sapiens
gcaccgcuacugcguggau

SEQ ID NO: 288788 - RNA, 19 nt, Homo sapiens
ucagggcgagagugacuuu

SEQ ID NO: 288789 - RNA, 19 nt, Homo sapiens
ucccagaggguguuuccua

SEQ ID NO: 288790 - RNA, 19 nt, Homo sapiens
caagcggaccugucucaag

SEQ ID NO: 288791 - RNA, 19 nt, Homo sapiens
cggcuucugcaucaacuuu

SEQ ID NO: 288792 - RNA, 19 nt, Homo sapiens
gcgcuucaagguggucuuu

SEQ ID NO: 288793 - RNA, 19 nt, Homo sapiens
ccauucagggcgagaguga

SEQ ID NO: 288794 - RNA, 19 nt, Homo sapiens
ccgcugcguucaaggagau

SEQ ID NO: 288795 - RNA, 19 nt, Homo sapiens
guacacaggagugcagaag

SEQ ID NO: 288796 - RNA, 19 nt, Homo sapiens
ggaagggauaccacauucu

SEQ ID NO: 288797 - RNA, 19 nt, Homo sapiens
gcagggcacuuccagaaua

SEQ ID NO: 288798 - RNA, 19 nt, Homo sapiens
gaaagggagucauuaacaa

SEQ ID NO: 288799 - RNA, 19 nt, Homo sapiens
gcaccuaugucucagcuaa

SEQ ID NO: 288800 - RNA, 19 nt, Homo sapiens
guaaccacaugcaaauaaa

SEQ ID NO: 288801 - RNA, 19 nt, Homo sapiens
ggaaagggagucauuaaca

SEQ ID NO: 288802 - RNA, 19 nt, Homo sapiens
gguagacccugcaugaaga

SEQ ID NO: 288803 - RNA, 19 nt, Homo sapiens
aagccgagcucaaagauga

SEQ ID NO: 288804 - RNA, 19 nt, Homo sapiens
caucuacaauggaccagua

SEQ ID NO: 288805 - RNA, 19 nt, Homo sapiens
gaggaaagggagucauuaa

SEQ ID NO: 288806 - RNA, 19 nt, Homo sapiens
ccaaggaaccaauuuauca

SEQ ID NO: 288807 - RNA, 19 nt, Homo sapiens
auacuucccugacuuggua

SEQ ID NO: 288808 - RNA, 19 nt, Homo sapiens
gcacggacagggcacauga

SEQ ID NO: 288809 - RNA, 19 nt, Homo sapiens
gagaggaaagggagucauu

SEQ ID NO: 288810 - RNA, 19 nt, Homo sapiens
caacaucuacaucuacaau

SEQ ID NO: 288811 - RNA, 19 nt, Homo sapiens
ccacaugugccgagaauuc

SEQ ID NO: 288812 - RNA, 19 nt, Homo sapiens
ugagguagacccugcauga

SEQ ID NO: 288813 - RNA, 19 nt, Homo sapiens
gacuaucacuggcaacauc

SEQ ID NO: 288814 - RNA, 19 nt, Homo sapiens
ccacaggacucucccuacu

SEQ ID NO: 288815 - RNA, 19 nt, Homo sapiens
gcacugaagccgagcucaa

SEQ ID NO: 288816 - RNA, 19 nt, Homo sapiens
uguaaccacaugcaaauaa

SEQ ID NO: 288817 - RNA, 19 nt, Homo sapiens
gacccugcaugaagaugaa

SEQ ID NO: 288818 - RNA, 19 nt, Homo sapiens
ggaggaaaauggcaagugu

SEQ ID NO: 288819 - RNA, 19 nt, Homo sapiens
ggcaacaucuacaucuaca

SEQ ID NO: 288820 - RNA, 19 nt, Homo sapiens
gcccaaggaaccaauuuau

SEQ ID NO: 288821 - RNA, 19 nt, Homo sapiens
ggcccaaggaaccaauuua

SEQ ID NO: 288822 - RNA, 19 nt, Homo sapiens
gcagggagagggacccaau

SEQ ID NO: 288823 - RNA, 19 nt, Homo sapiens
ggagauguuuccccaguau

SEQ ID NO: 288824 - RNA, 19 nt, Homo sapiens
cgaaggcccauccauacuu

SEQ ID NO: 288825 - RNA, 19 nt, Homo sapiens
ugggaucgcugcucaagag

SEQ ID NO: 288826 - RNA, 19 nt, Homo sapiens
acugcgagcuacuuucuga

SEQ ID NO: 288827 - RNA, 19 nt, Homo sapiens
gggagucauuaacaacuag

SEQ ID NO: 288828 - RNA, 19 nt, Homo sapiens
ccagagaugucaggaacca

SEQ ID NO: 288829 - RNA, 19 nt, Homo sapiens
ggcaaguguauuuauauug

SEQ ID NO: 288830 - RNA, 19 nt, Homo sapiens
ggacagggcacaugauacc

SEQ ID NO: 288831 - RNA, 19 nt, Homo sapiens
agaggaaagggagucauua

SEQ ID NO: 288832 - RNA, 19 nt, Homo sapiens
ucacguggacugagguaga

SEQ ID NO: 288833 - RNA, 19 nt, Homo sapiens
agggagucauuaacaacua

SEQ ID NO: 288834 - RNA, 19 nt, Homo sapiens
gaagccgagcucaaagaug

SEQ ID NO: 288835 - RNA, 19 nt, Homo sapiens
gccaggcaccuaugucuca

SEQ ID NO: 288836 - RNA, 19 nt, Homo sapiens
gagguagacccugcaugaa

SEQ ID NO: 288837 - RNA, 19 nt, Homo sapiens
acaucuacaucuacaaugg

SEQ ID NO: 288838 - RNA, 19 nt, Homo sapiens
agagggacccaauccugua

SEQ ID NO: 288839 - RNA, 19 nt, Homo sapiens
gccacacggucaccugcaa

SEQ ID NO: 288840 - RNA, 19 nt, Homo sapiens
cagccacugcuacccauuu

SEQ ID NO: 288841 - RNA, 19 nt, Homo sapiens
caauuuaucacccaugacu

SEQ ID NO: 288842 - RNA, 19 nt, Homo sapiens
gaaccuccauaccccauuc

SEQ ID NO: 288843 - RNA, 19 nt, Homo sapiens
gaaguugggaaggguaaca

SEQ ID NO: 288844 - RNA, 19 nt, Homo sapiens
ugaugggccucgaggagau

SEQ ID NO: 288845 - RNA, 19 nt, Homo sapiens
accaauuuaucacccauga

SEQ ID NO: 288846 - RNA, 19 nt, Homo sapiens
cuggcaacaucuacaucua

SEQ ID NO: 288847 - RNA, 19 nt, Homo sapiens
acacacugcgagcuacuuu

SEQ ID NO: 288848 - RNA, 19 nt, Homo sapiens
acccauuucuggagauguu

SEQ ID NO: 288849 - RNA, 19 nt, Homo sapiens
uauuguaaccacaugcaaa

SEQ ID NO: 288850 - RNA, 19 nt, Homo sapiens
cugcaugaagaugaaauua

SEQ ID NO: 288851 - RNA, 19 nt, Homo sapiens
gugccgagaauuccuacaa

SEQ ID NO: 288852 - RNA, 19 nt, Homo sapiens
gggcacaugauaccaacug

SEQ ID NO: 288853 - RNA, 19 nt, Homo sapiens
ugccacaugugccgagaau

SEQ ID NO: 288854 - RNA, 19 nt, Homo sapiens
gggcccaaggaaccaauuu

SEQ ID NO: 288855 - RNA, 19 nt, Homo sapiens
cuccgaaggcccauccaua

SEQ ID NO: 288856 - RNA, 19 nt, Homo sapiens
cagggcacuuccagaauac

SEQ ID NO: 288857 - RNA, 19 nt, Homo sapiens
gcagggaccaggaaaagga

SEQ ID NO: 288858 - RNA, 19 nt, Homo sapiens
acggacagggcacaugaua

SEQ ID NO: 288859 - RNA, 19 nt, Homo sapiens
ccacugcuacccauuucug

SEQ ID NO: 288860 - RNA, 19 nt, Homo sapiens
aggcagggcacuuccagaa

SEQ ID NO: 288861 - RNA, 19 nt, Homo sapiens
gagcucaaagaugaaguug

SEQ ID NO: 288862 - RNA, 19 nt, Homo sapiens
ccuagucucuaucauuaaa

SEQ ID NO: 288863 - RNA, 19 nt, Homo sapiens
cgacggagccgggaaagaa

SEQ ID NO: 288864 - RNA, 19 nt, Homo sapiens
auccuagucucuaucauua

SEQ ID NO: 288865 - RNA, 19 nt, Homo sapiens
gaaggacgagguagcucua

SEQ ID NO: 288866 - RNA, 19 nt, Homo sapiens
gccggcaucuucuuucaug

SEQ ID NO: 288867 - RNA, 19 nt, Homo sapiens
gaacugcagcgaguacuuc

SEQ ID NO: 288868 - RNA, 19 nt, Homo sapiens
gcgaguacuucccgcuguu

SEQ ID NO: 288869 - RNA, 19 nt, Homo sapiens
cauccuagucucuaucauu

SEQ ID NO: 288870 - RNA, 19 nt, Homo sapiens
cagcucgccuucacacaca

SEQ ID NO: 288871 - RNA, 19 nt, Homo sapiens
cggcaucuucuuucaugaa

SEQ ID NO: 288872 - RNA, 19 nt, Homo sapiens
ccuagucucuaucauuaaa

SEQ ID NO: 288873 - RNA, 19 nt, Homo sapiens
cgacggagccgggaaagaa

SEQ ID NO: 288874 - RNA, 19 nt, Homo sapiens
auccuagucucuaucauua

SEQ ID NO: 288875 - RNA, 19 nt, Homo sapiens
gaaggacgagguagcucua

SEQ ID NO: 288876 - RNA, 19 nt, Homo sapiens
gccggcaucuucuuucaug

SEQ ID NO: 288877 - RNA, 19 nt, Homo sapiens
gaacugcagcgaguacuuc

SEQ ID NO: 288878 - RNA, 19 nt, Homo sapiens
gcgaguacuucccgcuguu

SEQ ID NO: 288879 - RNA, 19 nt, Homo sapiens
cauccuagucucuaucauu

SEQ ID NO: 288880 - RNA, 19 nt, Homo sapiens
cagcucgccuucacacaca

SEQ ID NO: 288881 - RNA, 19 nt, Homo sapiens
cggcaucuucuuucaugaa

SEQ ID NO: 288882 - RNA, 19 nt, Homo sapiens
gcuagaagcugccaucuug

SEQ ID NO: 288883 - RNA, 19 nt, Homo sapiens
gcagaacacugauggaaau

SEQ ID NO: 288884 - RNA, 19 nt, Homo sapiens
gcaaagcccugaauaaagg

SEQ ID NO: 288885 - RNA, 19 nt, Homo sapiens
caagaaagccucagccauu

SEQ ID NO: 288886 - RNA, 19 nt, Homo sapiens
agaaagaucugcuguucaa

SEQ ID NO: 288887 - RNA, 19 nt, Homo sapiens
gcagugacccugauccuaa

SEQ ID NO: 288888 - RNA, 19 nt, Homo sapiens
ggauagaccuguggaagga

SEQ ID NO: 288889 - RNA, 19 nt, Homo sapiens
ggaagccaguggacaaguu

SEQ ID NO: 288890 - RNA, 19 nt, Homo sapiens
gaacacugauggaaauaac

SEQ ID NO: 288891 - RNA, 19 nt, Homo sapiens
gccacgaacucacuauuau

SEQ ID NO: 288892 - RNA, 19 nt, Homo sapiens
gaguuuggauggaggauau

SEQ ID NO: 288893 - RNA, 19 nt, Homo sapiens
ugagaaugcuggagacguu

SEQ ID NO: 288894 - RNA, 19 nt, Homo sapiens
gaacuacaaaucccaacaa

SEQ ID NO: 288895 - RNA, 19 nt, Homo sapiens
ccugucagcugcauaaaga

SEQ ID NO: 288896 - RNA, 19 nt, Homo sapiens
acacuagccuuaccuggaa

SEQ ID NO: 288897 - RNA, 19 nt, Homo sapiens
ggacaagucaccgaaauuc

SEQ ID NO: 288898 - RNA, 19 nt, Homo sapiens
ggacaaguuuugcuuauuc

SEQ ID NO: 288899 - RNA, 19 nt, Homo sapiens
ccaccaacaggcuaaauuu

SEQ ID NO: 288900 - RNA, 19 nt, Homo sapiens
gacgggcuccugcaaauuu

SEQ ID NO: 288901 - RNA, 19 nt, Homo sapiens
cggcaaagcccugaauaaa

SEQ ID NO: 288902 - RNA, 19 nt, Homo sapiens
ucacugccauccagaacuu

SEQ ID NO: 288903 - RNA, 19 nt, Homo sapiens
ccugcaaauuugaugaaua

SEQ ID NO: 288904 - RNA, 19 nt, Homo sapiens
cagacgggcuccugcaaau

SEQ ID NO: 288905 - RNA, 19 nt, Homo sapiens
ccgcagacaugaaacuugu

SEQ ID NO: 288906 - RNA, 19 nt, Homo sapiens
caaccugugucgccugugu

SEQ ID NO: 288907 - RNA, 19 nt, Homo sapiens
ggcaaaggaauaugagaaa

SEQ ID NO: 288908 - RNA, 19 nt, Homo sapiens
ccuggaagccugugaauuc

SEQ ID NO: 288909 - RNA, 19 nt, Homo sapiens
ggacucugccauuggguuu

SEQ ID NO: 288910 - RNA, 19 nt, Homo sapiens
ugacugcccggacaaguuu

SEQ ID NO: 288911 - RNA, 19 nt, Homo sapiens
gaaagggacgaguaugagu

SEQ ID NO: 288912 - RNA, 19 nt, Homo sapiens
gaaagacagccacgaacuc

SEQ ID NO: 288913 - RNA, 19 nt, Homo sapiens
gcggcaaagcccugaauaa

SEQ ID NO: 288914 - RNA, 19 nt, Homo sapiens
ggcaugggcuaaggauuug

SEQ ID NO: 288915 - RNA, 19 nt, Homo sapiens
gaaccguacuucagcuacu

SEQ ID NO: 288916 - RNA, 19 nt, Homo sapiens
gaacugcaaggucugaagu

SEQ ID NO: 288917 - RNA, 19 nt, Homo sapiens
ccagaccgcagacaugaaa

SEQ ID NO: 288918 - RNA, 19 nt, Homo sapiens
cuacaaaucccaacaaagc

SEQ ID NO: 288919 - RNA, 19 nt, Homo sapiens
gcaaaggaauaugagaaaa

SEQ ID NO: 288920 - RNA, 19 nt, Homo sapiens
aagcugaugccaugaguuu

SEQ ID NO: 288921 - RNA, 19 nt, Homo sapiens
guucaaggacucugccauu

SEQ ID NO: 288922 - RNA, 19 nt, Homo sapiens
caggaccgcuggauggaau

SEQ ID NO: 288923 - RNA, 19 nt, Homo sapiens
gaaguaaaaccgaagaaga

SEQ ID NO: 288924 - RNA, 19 nt, Homo sapiens
ggcaaagcccugaauaaag

SEQ ID NO: 288925 - RNA, 19 nt, Homo sapiens
gagagagcacaguguuuga

SEQ ID NO: 288926 - RNA, 19 nt, Homo sapiens
ccauccaucugcuuacaau

SEQ ID NO: 288927 - RNA, 19 nt, Homo sapiens
aagaaagccucagccauuc

SEQ ID NO: 288928 - RNA, 19 nt, Homo sapiens
gugcagagccuucguuugc

SEQ ID NO: 288929 - RNA, 19 nt, Homo sapiens
caauggcaaaggaauauga

SEQ ID NO: 288930 - RNA, 19 nt, Homo sapiens
uaagguggaacgccugaaa

SEQ ID NO: 288931 - RNA, 19 nt, Homo sapiens
agacguggcuuuuaucaga

SEQ ID NO: 288932 - RNA, 19 nt, Homo sapiens
ccuugauggugguuucaua

SEQ ID NO: 288933 - RNA, 19 nt, Homo sapiens
aggcaugggcuaaggauuu

SEQ ID NO: 288934 - RNA, 19 nt, Homo sapiens
agacguugcauuugugaaa

SEQ ID NO: 288935 - RNA, 19 nt, Homo sapiens
ucuaaucucugugcucugu

SEQ ID NO: 288936 - RNA, 19 nt, Homo sapiens
ccaugggccugcucuucaa

SEQ ID NO: 288937 - RNA, 19 nt, Homo sapiens
ggacugcaggcuggaauau

SEQ ID NO: 288938 - RNA, 19 nt, Homo sapiens
auagaccuguggaaggaua

SEQ ID NO: 288939 - RNA, 19 nt, Homo sapiens
gauagauucugggcuguac

SEQ ID NO: 288940 - RNA, 19 nt, Homo sapiens
guucaaagacugccaucug

SEQ ID NO: 288941 - RNA, 19 nt, Homo sapiens
gacacuucguccauucuug

SEQ ID NO: 288942 - RNA, 19 nt, Homo sapiens
ccaacagcaacgagagaua

SEQ ID NO: 288943 - RNA, 19 nt, Homo sapiens
aagaucugcuguucaagga

SEQ ID NO: 288944 - RNA, 19 nt, Homo sapiens
acaaagcagugacccugau

SEQ ID NO: 288945 - RNA, 19 nt, Homo sapiens
ggauggaggauauguguac

SEQ ID NO: 288946 - RNA, 19 nt, Homo sapiens
aagggacgaguaugaguua

SEQ ID NO: 288947 - RNA, 19 nt, Homo sapiens
ucagagagagcacaguguu

SEQ ID NO: 288948 - RNA, 19 nt, Homo sapiens
ggagacguugcauuuguga

SEQ ID NO: 288949 - RNA, 19 nt, Homo sapiens
cuggagacguugcauuugu

SEQ ID NO: 288950 - RNA, 19 nt, Homo sapiens
ggauagauucugggcugua

SEQ ID NO: 288951 - RNA, 19 nt, Homo sapiens
ccgaugcugugacccuuga

SEQ ID NO: 288952 - RNA, 19 nt, Homo sapiens
uggcagagaacuacaaauc

SEQ ID NO: 288953 - RNA, 19 nt, Homo sapiens
aaggacaagucaccgaaau

SEQ ID NO: 288954 - RNA, 19 nt, Homo sapiens
aacggaagccugugacuga

SEQ ID NO: 288955 - RNA, 19 nt, Homo sapiens
gaagccaguggacaaguuc

SEQ ID NO: 288956 - RNA, 19 nt, Homo sapiens
agagagagcacaguguuug

SEQ ID NO: 288957 - RNA, 19 nt, Homo sapiens
gaagucuacgggaccgaaa

SEQ ID NO: 288958 - RNA, 19 nt, Homo sapiens
caguaugucgcaggcauua

SEQ ID NO: 288959 - RNA, 19 nt, Homo sapiens
gaauauuucagucaaagcu

SEQ ID NO: 288960 - RNA, 19 nt, Homo sapiens
cugaaagggacgaguauga

SEQ ID NO: 288961 - RNA, 19 nt, Homo sapiens
cagagagagcacaguguuu

SEQ ID NO: 288962 - RNA, 19 nt, Homo sapiens
gaaaacaaaugugccuucu

SEQ ID NO: 288963 - RNA, 19 nt, Homo sapiens
ccacgaacucacuauuaug

SEQ ID NO: 288964 - RNA, 19 nt, Homo sapiens
gauggugguuucauauacg

SEQ ID NO: 288965 - RNA, 19 nt, Homo sapiens
ugauggugguuucauauac

SEQ ID NO: 288966 - RNA, 19 nt, Homo sapiens
caacagcaacgagagauac

SEQ ID NO: 288967 - RNA, 19 nt, Homo sapiens
uaaucucugugcucugugu

SEQ ID NO: 288968 - RNA, 19 nt, Homo sapiens
aacuacaaaucccaacaaa

SEQ ID NO: 288969 - RNA, 19 nt, Homo sapiens
caggcuaaauuugggagaa

SEQ ID NO: 288970 - RNA, 19 nt, Homo sapiens
gagcagggugagaauaagu

SEQ ID NO: 288971 - RNA, 19 nt, Homo sapiens
ccagacgggcuccugcaaa

SEQ ID NO: 288972 - RNA, 19 nt, Homo sapiens
gaggaaaagugaggaggaa

SEQ ID NO: 288973 - RNA, 19 nt, Homo sapiens
aaagggacgaguaugaguu

SEQ ID NO: 288974 - RNA, 19 nt, Homo sapiens
acacuucguccauucuuga

SEQ ID NO: 288975 - RNA, 19 nt, Homo sapiens
gacccuugauggugguuuc

SEQ ID NO: 288976 - RNA, 19 nt, Homo sapiens
uggcaaaggaauaugagaa

SEQ ID NO: 288977 - RNA, 19 nt, Homo sapiens
acaaugaggcaugggcuaa

SEQ ID NO: 288978 - RNA, 19 nt, Homo sapiens
acgagcagggugagaauaa

SEQ ID NO: 288979 - RNA, 19 nt, Homo sapiens
ucucugugcucuguguauu

SEQ ID NO: 288980 - RNA, 19 nt, Homo sapiens
gcugaaaggagaagcugau

SEQ ID NO: 288981 - RNA, 19 nt, Homo sapiens
gaagugugaauggcaagga

SEQ ID NO: 288982 - RNA, 19 nt, Homo sapiens
aaaaugagcugucaacuuu

SEQ ID NO: 288983 - RNA, 19 nt, Homo sapiens
gcuccuggguggccuguua

SEQ ID NO: 288984 - RNA, 19 nt, Homo sapiens
cuggauugcuuucccauua

SEQ ID NO: 288985 - RNA, 19 nt, Homo sapiens
gcagaugcuucuaauaaaa

SEQ ID NO: 288986 - RNA, 19 nt, Homo sapiens
ugaauucacuccugccaau

SEQ ID NO: 288987 - RNA, 19 nt, Homo sapiens
cugcagaugcuucuaauaa

SEQ ID NO: 288988 - RNA, 19 nt, Homo sapiens
gcacuugccaugcuggaaa

SEQ ID NO: 288989 - RNA, 19 nt, Homo sapiens
guggcaaccucaacacuga

SEQ ID NO: 288990 - RNA, 19 nt, Homo sapiens
ggaacugaguccagagaag

SEQ ID NO: 288991 - RNA, 19 nt, Homo sapiens
acacugagccuccuuaugg

SEQ ID NO: 288992 - RNA, 19 nt, Homo sapiens
ggagcuagcuguggauaac

SEQ ID NO: 288993 - RNA, 19 nt, Homo sapiens
ggauugcuuucccauuaug

SEQ ID NO: 288994 - RNA, 19 nt, Homo sapiens
gaacugaguccagagaagu

SEQ ID NO: 288995 - RNA, 19 nt, Homo sapiens
gaggggacaugaagaguuu

SEQ ID NO: 288996 - RNA, 19 nt, Homo sapiens
gggcgacgcuucagagacu

SEQ ID NO: 288997 - RNA, 19 nt, Homo sapiens
ugcagaugcuucuaauaaa

SEQ ID NO: 288998 - RNA, 19 nt, Homo sapiens
gcaaguuucgccaucagaa

SEQ ID NO: 288999 - RNA, 19 nt, Homo sapiens
cgagaaccacggagaggua

SEQ ID NO: 289000 - RNA, 19 nt, Homo sapiens
ccucagaaccuuuggaauc

SEQ ID NO: 289001 - RNA, 19 nt, Homo sapiens
gcacucaggacccggaugu

SEQ ID NO: 289002 - RNA, 19 nt, Homo sapiens
gacaaccucugggcugaug

SEQ ID NO: 289003 - RNA, 19 nt, Homo sapiens
gagggcaucuucacaucca

SEQ ID NO: 289004 - RNA, 19 nt, Homo sapiens
ggaggaaaaucacuucauc

SEQ ID NO: 289005 - RNA, 19 nt, Homo sapiens
gcaaaggcgccaagaacca

SEQ ID NO: 289006 - RNA, 19 nt, Homo sapiens
ucaagacccugccagaacu

SEQ ID NO: 289007 - RNA, 19 nt, Homo sapiens
ggacccggaugugcugaau

SEQ ID NO: 289008 - RNA, 19 nt, Homo sapiens
aaugagcugucaacuuuag

SEQ ID NO: 289009 - RNA, 19 nt, Homo sapiens
gaaugccugugcccagaag

SEQ ID NO: 289010 - RNA, 19 nt, Homo sapiens
ccacggagagguagagauc

SEQ ID NO: 289011 - RNA, 19 nt, Homo sapiens
gccaucaccucuggucaug

SEQ ID NO: 289012 - RNA, 19 nt, Homo sapiens
gggagucgcuguacauccu

SEQ ID NO: 289013 - RNA, 19 nt, Homo sapiens
ggucuuggcuguuuucuac

SEQ ID NO: 289014 - RNA, 19 nt, Homo sapiens
ucacauccaagacagauuc

SEQ ID NO: 289015 - RNA, 19 nt, Homo sapiens
uaugagggacugguaauug

SEQ ID NO: 289016 - RNA, 19 nt, Homo sapiens
uggauugcuuucccauuau

SEQ ID NO: 289017 - RNA, 19 nt, Homo sapiens
cccagccacuuccagcuuu

SEQ ID NO: 289018 - RNA, 19 nt, Homo sapiens
ggauggcacgagauaucua

SEQ ID NO: 289019 - RNA, 19 nt, Homo sapiens
cuucgaaccucugccauca

SEQ ID NO: 289020 - RNA, 19 nt, Homo sapiens
agauggaguauccuucaua

SEQ ID NO: 289021 - RNA, 19 nt, Homo sapiens
auaaaaggcucuucucauc

SEQ ID NO: 289022 - RNA, 19 nt, Homo sapiens
gcgcugcacuugccaugcu

SEQ ID NO: 289023 - RNA, 19 nt, Homo sapiens
gggccuugcucccagucaa

SEQ ID NO: 289024 - RNA, 19 nt, Homo sapiens
ucaacacugagccuccuua

SEQ ID NO: 289025 - RNA, 19 nt, Homo sapiens
caaaaugagcugucaacuu

SEQ ID NO: 289026 - RNA, 19 nt, Homo sapiens
ucuguucccugcagucugu

SEQ ID NO: 289027 - RNA, 19 nt, Homo sapiens
ggccagaccagcuuuaggu

SEQ ID NO: 289028 - RNA, 19 nt, Homo sapiens
acccggaugugcugaauuc

SEQ ID NO: 289029 - RNA, 19 nt, Homo sapiens
gccacuaccuggaggaaaa

SEQ ID NO: 289030 - RNA, 19 nt, Homo sapiens
ccugggccauggugccuuu

SEQ ID NO: 289031 - RNA, 19 nt, Homo sapiens
caacacugagccuccuuau

SEQ ID NO: 289032 - RNA, 19 nt, Homo sapiens
gcuguccucuggccucaag

SEQ ID NO: 289033 - RNA, 19 nt, Homo sapiens
cggaugugcugaauucacu

SEQ ID NO: 289034 - RNA, 19 nt, Homo sapiens
gggaagauggaguauccuu

SEQ ID NO: 289035 - RNA, 19 nt, Homo sapiens
gcauggcgucuucgucuca

SEQ ID NO: 289036 - RNA, 19 nt, Homo sapiens
ucagcaaguuucgccauca

SEQ ID NO: 289037 - RNA, 19 nt, Homo sapiens
uaucaagacccugccagaa

SEQ ID NO: 289038 - RNA, 19 nt, Homo sapiens
ccuccaaccucagaaccuu

SEQ ID NO: 289039 - RNA, 19 nt, Homo sapiens
uugaaaagcuggggaggua

SEQ ID NO: 289040 - RNA, 19 nt, Homo sapiens
uagcuuugccagcaucuug

SEQ ID NO: 289041 - RNA, 19 nt, Homo sapiens
gcaucaugacccaguguug

SEQ ID NO: 289042 - RNA, 19 nt, Homo sapiens
caccucaacugcagucacu

SEQ ID NO: 289043 - RNA, 19 nt, Homo sapiens
ucuuggagcgucugcagua

SEQ ID NO: 289044 - RNA, 19 nt, Homo sapiens
gagcugucaacuuuagguu

SEQ ID NO: 289045 - RNA, 19 nt, Homo sapiens
ccucaucaucagcaaguuu

SEQ ID NO: 289046 - RNA, 19 nt, Homo sapiens
guaugagggacugguaauu

SEQ ID NO: 289047 - RNA, 19 nt, Homo sapiens
uggauaacgucaccugcau

SEQ ID NO: 289048 - RNA, 19 nt, Homo sapiens
gggccuguguaccgcauca

SEQ ID NO: 289049 - RNA, 19 nt, Homo sapiens
gguguaugagggacuggua

SEQ ID NO: 289050 - RNA, 19 nt, Homo sapiens
aaaugagcugucaacuuua

SEQ ID NO: 289051 - RNA, 19 nt, Homo sapiens
cgaggggucuuggcuguuu

SEQ ID NO: 289052 - RNA, 19 nt, Homo sapiens
gugcugcucugggagaucu

SEQ ID NO: 289053 - RNA, 19 nt, Homo sapiens
acagauuccuggucuuuug

SEQ ID NO: 289054 - RNA, 19 nt, Homo sapiens
uggagggcaucuucacauc

SEQ ID NO: 289055 - RNA, 19 nt, Homo sapiens
cggcaaaggcgccaagaac

SEQ ID NO: 289056 - RNA, 19 nt, Homo sapiens
ccagagaaguugaaaagcu

SEQ ID NO: 289057 - RNA, 19 nt, Homo sapiens
gaaccacggagagguagag

SEQ ID NO: 289058 - RNA, 19 nt, Homo sapiens
gaauaaaugcuguuuguca

SEQ ID NO: 289059 - RNA, 19 nt, Homo sapiens
gaacaagcgccaugucuuc

SEQ ID NO: 289060 - RNA, 19 nt, Homo sapiens
aaacucagcuggagccaau

SEQ ID NO: 289061 - RNA, 19 nt, Homo sapiens
ggaaggagacgaagucaca

SEQ ID NO: 289062 - RNA, 19 nt, Homo sapiens
gugcuuuccuuaccucuaa

SEQ ID NO: 289063 - RNA, 19 nt, Homo sapiens
gaggugcgcuugucuguac

SEQ ID NO: 289064 - RNA, 19 nt, Homo sapiens
gcuaaagacagcggaaaua

SEQ ID NO: 289065 - RNA, 19 nt, Homo sapiens
gcugcagaguggaggauua

SEQ ID NO: 289066 - RNA, 19 nt, Homo sapiens
uggaauaaaugcuguuugu

SEQ ID NO: 289067 - RNA, 19 nt, Homo sapiens
gagcagaccggccuucuca

SEQ ID NO: 289068 - RNA, 19 nt, Homo sapiens
gaacccacgaccauuauau

SEQ ID NO: 289069 - RNA, 19 nt, Homo sapiens
acacuggagucuggaauaa

SEQ ID NO: 289070 - RNA, 19 nt, Homo sapiens
gcagcucucugacccugaa

SEQ ID NO: 289071 - RNA, 19 nt, Homo sapiens
gaggaagugcugaauguga

SEQ ID NO: 289072 - RNA, 19 nt, Homo sapiens
ggaacaagcgccaugucuu

SEQ ID NO: 289073 - RNA, 19 nt, Homo sapiens
ggaggugcccguagagaug

SEQ ID NO: 289074 - RNA, 19 nt, Homo sapiens
gaacccagagggcuacaug

SEQ ID NO: 289075 - RNA, 19 nt, Homo sapiens
uaaagacagcggaaauaga

SEQ ID NO: 289076 - RNA, 19 nt, Homo sapiens
cgaggaaagucugucauuc

SEQ ID NO: 289077 - RNA, 19 nt, Homo sapiens
gcagaccggccuucucaug

SEQ ID NO: 289078 - RNA, 19 nt, Homo sapiens
gaggaaagucugucauucu

SEQ ID NO: 289079 - RNA, 19 nt, Homo sapiens
gcgaggaaagucugucauu

SEQ ID NO: 289080 - RNA, 19 nt, Homo sapiens
ggaacccacgaccauuaua

SEQ ID NO: 289081 - RNA, 19 nt, Homo sapiens
ucucugacccugaaaguga

SEQ ID NO: 289082 - RNA, 19 nt, Homo sapiens
caauggcaccuacguaugu

SEQ ID NO: 289083 - RNA, 19 nt, Homo sapiens
gacacuggagucuggaaua

SEQ ID NO: 289084 - RNA, 19 nt, Homo sapiens
gacgagugcugagccaaga

SEQ ID NO: 289085 - RNA, 19 nt, Homo sapiens
cgggaacccacgaccauua

SEQ ID NO: 289086 - RNA, 19 nt, Homo sapiens
aggaagugcugaaugugaa

SEQ ID NO: 289087 - RNA, 19 nt, Homo sapiens
aggaggaagugcugaaugu

SEQ ID NO: 289088 - RNA, 19 nt, Homo sapiens
gagacgaagucacacucau

SEQ ID NO: 289089 - RNA, 19 nt, Homo sapiens
aaagacagcggaaauagag

SEQ ID NO: 289090 - RNA, 19 nt, Homo sapiens
acuggagucuggaauaaau

SEQ ID NO: 289091 - RNA, 19 nt, Homo sapiens
uaaaugcuguuugucacau

SEQ ID NO: 289092 - RNA, 19 nt, Homo sapiens
gagccaagaaccuccuaga

SEQ ID NO: 289093 - RNA, 19 nt, Homo sapiens
cgucguugcugucuucuac

SEQ ID NO: 289094 - RNA, 19 nt, Homo sapiens
aggaaagucugucauucug

SEQ ID NO: 289095 - RNA, 19 nt, Homo sapiens
ccucgucguugcugucuuc

SEQ ID NO: 289096 - RNA, 19 nt, Homo sapiens
gggaacccacgaccauuau

SEQ ID NO: 289097 - RNA, 19 nt, Homo sapiens
gagggaaggagacgaaguc

SEQ ID NO: 289098 - RNA, 19 nt, Homo sapiens
ucaguucuaucaccuucga

SEQ ID NO: 289099 - RNA, 19 nt, Homo sapiens
gcagaguggaggauuacga

SEQ ID NO: 289100 - RNA, 19 nt, Homo sapiens
auuauaugcuggaaugguu

SEQ ID NO: 289101 - RNA, 19 nt, Homo sapiens
ggagacgaagucacacuca

SEQ ID NO: 289102 - RNA, 19 nt, Homo sapiens
gagcuaaagacagcggaaa

SEQ ID NO: 289103 - RNA, 19 nt, Homo sapiens
gagcugcaggcaucagaga

SEQ ID NO: 289104 - RNA, 19 nt, Homo sapiens
ggaggugcgcuugucugua

SEQ ID NO: 289105 - RNA, 19 nt, Homo sapiens
caaagccagaggccacuga

SEQ ID NO: 289106 - RNA, 19 nt, Homo sapiens
cuaaagacagcggaaauag

SEQ ID NO: 289107 - RNA, 19 nt, Homo sapiens
ccaauggcaccuacguaug

SEQ ID NO: 289108 - RNA, 19 nt, Homo sapiens
ggcucaacguguuugcaaa

SEQ ID NO: 289109 - RNA, 19 nt, Homo sapiens
ggacacuggagucuggaau

SEQ ID NO: 289110 - RNA, 19 nt, Homo sapiens
gaggugcccguagagauga

SEQ ID NO: 289111 - RNA, 19 nt, Homo sapiens
gggaacaagcgccaugucu

SEQ ID NO: 289112 - RNA, 19 nt, Homo sapiens
gcucaacguguuugcaaag

SEQ ID NO: 289113 - RNA, 19 nt, Homo sapiens
ggaagugcugaaugugaau

SEQ ID NO: 289114 - RNA, 19 nt, Homo sapiens
ggaauaaaugcuguuuguc

SEQ ID NO: 289115 - RNA, 19 nt, Homo sapiens
gaggugaugcgaggaaagu

SEQ ID NO: 289116 - RNA, 19 nt, Homo sapiens
gcaggaggaagugcugaau

SEQ ID NO: 289117 - RNA, 19 nt, Homo sapiens
gacgaagucacacucaucu

SEQ ID NO: 289118 - RNA, 19 nt, Homo sapiens
cccaugcugucgcucaguu

SEQ ID NO: 289119 - RNA, 19 nt, Homo sapiens
ggaggaagugcugaaugug

SEQ ID NO: 289120 - RNA, 19 nt, Homo sapiens
ccaccucacccugcacuau

SEQ ID NO: 289121 - RNA, 19 nt, Homo sapiens
ggacucugcccaggagauc

SEQ ID NO: 289122 - RNA, 19 nt, Homo sapiens
ggagggaaggagacgaagu

SEQ ID NO: 289123 - RNA, 19 nt, Homo sapiens
gagaucgccaccugcaaca

SEQ ID NO: 289124 - RNA, 19 nt, Homo sapiens
ugaagaagcugcauauaaa

SEQ ID NO: 289125 - RNA, 19 nt, Homo sapiens
gaauguaacugcccugaaa

SEQ ID NO: 289126 - RNA, 19 nt, Homo sapiens
cgaagucacucuuaauuaa

SEQ ID NO: 289127 - RNA, 19 nt, Homo sapiens
ugacagaguucacagcaua

SEQ ID NO: 289128 - RNA, 19 nt, Homo sapiens
gugaugagcugaaauugaa

SEQ ID NO: 289129 - RNA, 19 nt, Homo sapiens
auaaagagcuucugcaaga

SEQ ID NO: 289130 - RNA, 19 nt, Homo sapiens
gaauagacaucaaacucaa

SEQ ID NO: 289131 - RNA, 19 nt, Homo sapiens
ccucaaagcuuggauuaaa

SEQ ID NO: 289132 - RNA, 19 nt, Homo sapiens
gaucacaaccuucuagaaa

SEQ ID NO: 289133 - RNA, 19 nt, Homo sapiens
gcaucugcuuuaagaauua

SEQ ID NO: 289134 - RNA, 19 nt, Homo sapiens
ucaaguaucuuuaccuuag

SEQ ID NO: 289135 - RNA, 19 nt, Homo sapiens
acacacauauacacgaaua

SEQ ID NO: 289136 - RNA, 19 nt, Homo sapiens
ggauauguaugaaugucua

SEQ ID NO: 289137 - RNA, 19 nt, Homo sapiens
gaauuugcauacuuaccua

SEQ ID NO: 289138 - RNA, 19 nt, Homo sapiens
caagugccauguacuguga

SEQ ID NO: 289139 - RNA, 19 nt, Homo sapiens
ccaaaucucuggaggaucu

SEQ ID NO: 289140 - RNA, 19 nt, Homo sapiens
gaucugcagcuuacucaua

SEQ ID NO: 289141 - RNA, 19 nt, Homo sapiens
gaagcuucaugcacuuaaa

SEQ ID NO: 289142 - RNA, 19 nt, Homo sapiens
ggaaaucagccaaguuuua

SEQ ID NO: 289143 - RNA, 19 nt, Homo sapiens
ggucuuaaaucacucgaau

SEQ ID NO: 289144 - RNA, 19 nt, Homo sapiens
cuagaaaacuccaagauaa

SEQ ID NO: 289145 - RNA, 19 nt, Homo sapiens
cuaacgaagucacucuuaa

SEQ ID NO: 289146 - RNA, 19 nt, Homo sapiens
gaucaagcauuugcguuug

SEQ ID NO: 289147 - RNA, 19 nt, Homo sapiens
gaucugcaguggcucauuc

SEQ ID NO: 289148 - RNA, 19 nt, Homo sapiens
ucuucuaacucucuacuua

SEQ ID NO: 289149 - RNA, 19 nt, Homo sapiens
cagcauauauugguggauu

SEQ ID NO: 289150 - RNA, 19 nt, Homo sapiens
ugaaacaacugaagaagcu

SEQ ID NO: 289151 - RNA, 19 nt, Homo sapiens
ccugaaagcuacccaagug

SEQ ID NO: 289152 - RNA, 19 nt, Homo sapiens
gcaaucaucaccaaacugu

SEQ ID NO: 289153 - RNA, 19 nt, Homo sapiens
guaaggauucaaaccauuu

SEQ ID NO: 289154 - RNA, 19 nt, Homo sapiens
acuccaagaucaagcauuu

SEQ ID NO: 289155 - RNA, 19 nt, Homo sapiens
cauaccaacugucaaugaa

SEQ ID NO: 289156 - RNA, 19 nt, Homo sapiens
guacugugaugagcugaaa

SEQ ID NO: 289157 - RNA, 19 nt, Homo sapiens
caucaaacucaaugcuuua

SEQ ID NO: 289158 - RNA, 19 nt, Homo sapiens
acaucaaacucaaugcuuu

SEQ ID NO: 289159 - RNA, 19 nt, Homo sapiens
cugaagaagcugcauauaa

SEQ ID NO: 289160 - RNA, 19 nt, Homo sapiens
uaaccagauugaccauauu

SEQ ID NO: 289161 - RNA, 19 nt, Homo sapiens
ucacaagaacacacacaua

SEQ ID NO: 289162 - RNA, 19 nt, Homo sapiens
gcuaacgaagucacucuua

SEQ ID NO: 289163 - RNA, 19 nt, Homo sapiens
guaugaaugucuacguguu

SEQ ID NO: 289164 - RNA, 19 nt, Homo sapiens
cauagugcaucugcuuuaa

SEQ ID NO: 289165 - RNA, 19 nt, Homo sapiens
acaacgaacuggcugauag

SEQ ID NO: 289166 - RNA, 19 nt, Homo sapiens
ucauguauguuucucuuug

SEQ ID NO: 289167 - RNA, 19 nt, Homo sapiens
caacugaagaagcugcaua

SEQ ID NO: 289168 - RNA, 19 nt, Homo sapiens
caagaacacacacauauac

SEQ ID NO: 289169 - RNA, 19 nt, Homo sapiens
acaagaacacacacauaua

SEQ ID NO: 289170 - RNA, 19 nt, Homo sapiens
caccggauauguaugaaug

SEQ ID NO: 289171 - RNA, 19 nt, Homo sapiens
acacacacauauacacgaa

SEQ ID NO: 289172 - RNA, 19 nt, Homo sapiens
guuacucucuugcaccaaa

SEQ ID NO: 289173 - RNA, 19 nt, Homo sapiens
uaauaucuguauccuggaa

SEQ ID NO: 289174 - RNA, 19 nt, Homo sapiens
aaacauaccaacugucaau

SEQ ID NO: 289175 - RNA, 19 nt, Homo sapiens
gagcugaaauugaaaagug

SEQ ID NO: 289176 - RNA, 19 nt, Homo sapiens
cacaagaacacacacauau

SEQ ID NO: 289177 - RNA, 19 nt, Homo sapiens
ccauagugcaucugcuuua

SEQ ID NO: 289178 - RNA, 19 nt, Homo sapiens
cuugagaaguuugacauaa

SEQ ID NO: 289179 - RNA, 19 nt, Homo sapiens
gauaguggaauaccuggaa

SEQ ID NO: 289180 - RNA, 19 nt, Homo sapiens
acaauaagaucagcaacau

SEQ ID NO: 289181 - RNA, 19 nt, Homo sapiens
ucgaauaccuugacuugag

SEQ ID NO: 289182 - RNA, 19 nt, Homo sapiens
guaacugcccugaaagcua

SEQ ID NO: 289183 - RNA, 19 nt, Homo sapiens
ccaguacuaugauuaugau

SEQ ID NO: 289184 - RNA, 19 nt, Homo sapiens
uagugcaucugcuuuaaga

SEQ ID NO: 289185 - RNA, 19 nt, Homo sapiens
ucuguauccuggaacaaua

SEQ ID NO: 289186 - RNA, 19 nt, Homo sapiens
ugagaaguuugacauaaag

SEQ ID NO: 289187 - RNA, 19 nt, Homo sapiens
gcagcuuacucauaacaag

SEQ ID NO: 289188 - RNA, 19 nt, Homo sapiens
cgaauagacaucaaacuca

SEQ ID NO: 289189 - RNA, 19 nt, Homo sapiens
gagcuggaucuguccuaua

SEQ ID NO: 289190 - RNA, 19 nt, Homo sapiens
auaaccagauugaccauau

SEQ ID NO: 289191 - RNA, 19 nt, Homo sapiens
ccaguuccguccugacaga

SEQ ID NO: 289192 - RNA, 19 nt, Homo sapiens
cauguauguuucucuuuga

SEQ ID NO: 289193 - RNA, 19 nt, Homo sapiens
uaacgaagucacucuuaau

SEQ ID NO: 289194 - RNA, 19 nt, Homo sapiens
gauugaccauauugaugaa

SEQ ID NO: 289195 - RNA, 19 nt, Homo sapiens
ccaguggccaguacuauga

SEQ ID NO: 289196 - RNA, 19 nt, Homo sapiens
acgaagucacucuuaauua

SEQ ID NO: 289197 - RNA, 19 nt, Homo sapiens
agcuggaucuguccuauaa

SEQ ID NO: 289198 - RNA, 19 nt, Homo sapiens
gcauauaaaccacaacaac

SEQ ID NO: 289199 - RNA, 19 nt, Homo sapiens
uuaaaucacucgaauaccu

SEQ ID NO: 289200 - RNA, 19 nt, Homo sapiens
auacuuaccuagugaaacu

SEQ ID NO: 289201 - RNA, 19 nt, Homo sapiens
gcauggaaaucagccaagu

SEQ ID NO: 289202 - RNA, 19 nt, Homo sapiens
cuaagugcauuuacucucu

SEQ ID NO: 289203 - RNA, 19 nt, Homo sapiens
gcugaaagaggaugcuguu

SEQ ID NO: 289204 - RNA, 19 nt, Homo sapiens
gaagaagcugcauauaaac

SEQ ID NO: 289205 - RNA, 19 nt, Homo sapiens
gaaaucagccaaguuuuau

SEQ ID NO: 289206 - RNA, 19 nt, Homo sapiens
uaucugcguuuaucucaca

SEQ ID NO: 289207 - RNA, 19 nt, Homo sapiens
aaacugugcaccagaaugu

SEQ ID NO: 289208 - RNA, 19 nt, Homo sapiens
uaaagagcuucugcaagau

SEQ ID NO: 289209 - RNA, 19 nt, Homo sapiens
gccaguacuaugauuauga

SEQ ID NO: 289210 - RNA, 19 nt, Homo sapiens
cauucuagaucacaaccuu

SEQ ID NO: 289211 - RNA, 19 nt, Homo sapiens
gggcaaucaucaccaaacu

SEQ ID NO: 289212 - RNA, 19 nt, Homo sapiens
uaagugcauuuacucucuu

SEQ ID NO: 289213 - RNA, 19 nt, Homo sapiens
gaaugucuacguguugcua

SEQ ID NO: 289214 - RNA, 19 nt, Homo sapiens
auauauugguggauucuug

SEQ ID NO: 289215 - RNA, 19 nt, Homo sapiens
uaccuugacuugagcuuca

SEQ ID NO: 289216 - RNA, 19 nt, Homo sapiens
ugcaguggcucauucuaga

SEQ ID NO: 289217 - RNA, 19 nt, Homo sapiens
agauugaccauauugauga

SEQ ID NO: 289218 - RNA, 19 nt, Homo sapiens
gaguucacagcauauauug

SEQ ID NO: 289219 - RNA, 19 nt, Homo sapiens
gaacuggcugauaguggaa

SEQ ID NO: 289220 - RNA, 19 nt, Homo sapiens
cagauugaccauauugaug

SEQ ID NO: 289221 - RNA, 19 nt, Homo sapiens
ugcaucugcuuuaagaauu

SEQ ID NO: 289222 - RNA, 19 nt, Homo sapiens
ggaaucaaguaucuuuacc

SEQ ID NO: 289223 - RNA, 19 nt, Homo sapiens
caguaaggauucaaaccau

SEQ ID NO: 289224 - RNA, 19 nt, Homo sapiens
gccauccucuccagaauga

SEQ ID NO: 289225 - RNA, 19 nt, Homo sapiens
ccagaaggcgucaauguug

SEQ ID NO: 289226 - RNA, 19 nt, Homo sapiens
gggaaucucgugacauuug

SEQ ID NO: 289227 - RNA, 19 nt, Homo sapiens
ggacaggcugcuuugguuu

SEQ ID NO: 289228 - RNA, 19 nt, Homo sapiens
ggccacagccugagcaaga

SEQ ID NO: 289229 - RNA, 19 nt, Homo sapiens
uugggaaucucgugacauu

SEQ ID NO: 289230 - RNA, 19 nt, Homo sapiens
gcuccgaccaggacaacua

SEQ ID NO: 289231 - RNA, 19 nt, Homo sapiens
ggaaucucgugacauuugg

SEQ ID NO: 289232 - RNA, 19 nt, Homo sapiens
ggacaacuacugcgugacu

SEQ ID NO: 289233 - RNA, 19 nt, Homo sapiens
agagcuuucugugcaauuu

SEQ ID NO: 289234 - RNA, 19 nt, Homo sapiens
aggacaggcugcuuugguu

SEQ ID NO: 289235 - RNA, 19 nt, Homo sapiens
gagcccuccugcugcuuug

SEQ ID NO: 289236 - RNA, 19 nt, Homo sapiens
gcacagcugcaugcacuuc

SEQ ID NO: 289237 - RNA, 19 nt, Homo sapiens
ccagggagaccgugucagu

SEQ ID NO: 289238 - RNA, 19 nt, Homo sapiens
gacaggcugcuuugguuug

SEQ ID NO: 289239 - RNA, 19 nt, Homo sapiens
ccucaaauaaauacagaug

SEQ ID NO: 289240 - RNA, 19 nt, Homo sapiens
cccagaaggcgucaauguu

SEQ ID NO: 289241 - RNA, 19 nt, Homo sapiens
aggcugcuuugguuuguga

SEQ ID NO: 289242 - RNA, 19 nt, Homo sapiens
gcuugaaccagaagagcaa

SEQ ID NO: 289243 - RNA, 19 nt, Homo sapiens
ugccucaaauaaauacaga

SEQ ID NO: 289244 - RNA, 19 nt, Homo sapiens
cagggagaccgugucagua

SEQ ID NO: 289245 - RNA, 19 nt, Homo sapiens
cauugggaaucucgugaca

SEQ ID NO: 289246 - RNA, 19 nt, Homo sapiens
gagaaggauuugugcaaug

SEQ ID NO: 289247 - RNA, 19 nt, Homo sapiens
uauuaacucugggaucuua

SEQ ID NO: 289248 - RNA, 19 nt, Homo sapiens
cgagaaggauuugugcaau

SEQ ID NO: 289249 - RNA, 19 nt, Homo sapiens
gcccugaugucuccuccuu

SEQ ID NO: 289250 - RNA, 19 nt, Homo sapiens
gcgagaaggauuugugcaa

SEQ ID NO: 289251 - RNA, 19 nt, Homo sapiens
gcggagaaauaaagucacu

SEQ ID NO: 289252 - RNA, 19 nt, Homo sapiens
uaucugaugggguuuauua

SEQ ID NO: 289253 - RNA, 19 nt, Homo sapiens
ccacggggcuucugagcuu

SEQ ID NO: 289254 - RNA, 19 nt, Homo sapiens
agaaggauuugugcaaugg

SEQ ID NO: 289255 - RNA, 19 nt, Homo sapiens
ggacaucuccaggaaacca

SEQ ID NO: 289256 - RNA, 19 nt, Homo sapiens
acucugggaucuuaaaggu

SEQ ID NO: 289257 - RNA, 19 nt, Homo sapiens
uuuauuaacucugggaucu

SEQ ID NO: 289258 - RNA, 19 nt, Homo sapiens
gaggggaagugaagcaaca

SEQ ID NO: 289259 - RNA, 19 nt, Homo sapiens
ggacugcugcgagaaggau

SEQ ID NO: 289260 - RNA, 19 nt, Homo sapiens
ggagucagcugcaaauauu

SEQ ID NO: 289261 - RNA, 19 nt, Homo sapiens
gaagagagcucagccacaa

SEQ ID NO: 289262 - RNA, 19 nt, Homo sapiens
gcucacgccuggaguguua

SEQ ID NO: 289263 - RNA, 19 nt, Homo sapiens
gaagauaugagguguuuga

SEQ ID NO: 289264 - RNA, 19 nt, Homo sapiens
caaauauucucuucuguuc

SEQ ID NO: 289265 - RNA, 19 nt, Homo sapiens
cagaagcaccucagaauuu

SEQ ID NO: 289266 - RNA, 19 nt, Homo sapiens
gaaaauagaucaucauggu

SEQ ID NO: 289267 - RNA, 19 nt, Homo sapiens
gagagaaacacaaagcuuu

SEQ ID NO: 289268 - RNA, 19 nt, Homo sapiens
gacacaagauguacauaau

SEQ ID NO: 289269 - RNA, 19 nt, Homo sapiens
gaaaagaaccccaagagaa

SEQ ID NO: 289270 - RNA, 19 nt, Homo sapiens
gcaaauauucucuucuguu

SEQ ID NO: 289271 - RNA, 19 nt, Homo sapiens
gggaaacacugucauguac

SEQ ID NO: 289272 - RNA, 19 nt, Homo sapiens
caagacuggucaaauguug

SEQ ID NO: 289273 - RNA, 19 nt, Homo sapiens
ccaaacccauuaauaguuc

SEQ ID NO: 289274 - RNA, 19 nt, Homo sapiens
gcagauccacucauuaaau

SEQ ID NO: 289275 - RNA, 19 nt, Homo sapiens
caaagagucacacagauga

SEQ ID NO: 289276 - RNA, 19 nt, Homo sapiens
ccagggauccuuacaagaa

SEQ ID NO: 289277 - RNA, 19 nt, Homo sapiens
ucacggaaguugagucugu

SEQ ID NO: 289278 - RNA, 19 nt, Homo sapiens
gaacuucuguaacaucacu

SEQ ID NO: 289279 - RNA, 19 nt, Homo sapiens
gcaaucugacucugaauga

SEQ ID NO: 289280 - RNA, 19 nt, Homo sapiens
acacagagauugagaacgu

SEQ ID NO: 289281 - RNA, 19 nt, Homo sapiens
gaaaguccuaccuaugaaa

SEQ ID NO: 289282 - RNA, 19 nt, Homo sapiens
caagagaauugucacacau

SEQ ID NO: 289283 - RNA, 19 nt, Homo sapiens
uggaagauaugagguguuu

SEQ ID NO: 289284 - RNA, 19 nt, Homo sapiens
gcccaucaguggaagauau

SEQ ID NO: 289285 - RNA, 19 nt, Homo sapiens
acagcaaccucacaacuga

SEQ ID NO: 289286 - RNA, 19 nt, Homo sapiens
cagauaaaccaaaggaauu

SEQ ID NO: 289287 - RNA, 19 nt, Homo sapiens
ugacacaagauguacauaa

SEQ ID NO: 289288 - RNA, 19 nt, Homo sapiens
ugaaaguccuaccuaugaa

SEQ ID NO: 289289 - RNA, 19 nt, Homo sapiens
cagauccacucauuaaauc

SEQ ID NO: 289290 - RNA, 19 nt, Homo sapiens
ccaagagaauugucacaca

SEQ ID NO: 289291 - RNA, 19 nt, Homo sapiens
cggcagauccacucauuaa

SEQ ID NO: 289292 - RNA, 19 nt, Homo sapiens
acacauccaucauuagcaa

SEQ ID NO: 289293 - RNA, 19 nt, Homo sapiens
gacuagacaucaccaagug

SEQ ID NO: 289294 - RNA, 19 nt, Homo sapiens
gacagaagcaccucagaau

SEQ ID NO: 289295 - RNA, 19 nt, Homo sapiens
gagaacgucaucuggauug

SEQ ID NO: 289296 - RNA, 19 nt, Homo sapiens
gaaacacugucauguacac

SEQ ID NO: 289297 - RNA, 19 nt, Homo sapiens
cuaaacaucucaguagaca

SEQ ID NO: 289298 - RNA, 19 nt, Homo sapiens
gggaaucacaccucaaugu

SEQ ID NO: 289299 - RNA, 19 nt, Homo sapiens
ccaaagagucacacagaug

SEQ ID NO: 289300 - RNA, 19 nt, Homo sapiens
agagaauugucacacauga

SEQ ID NO: 289301 - RNA, 19 nt, Homo sapiens
agacacaggcuccuucuug

SEQ ID NO: 289302 - RNA, 19 nt, Homo sapiens
cgccuggaguguuauuuaa

SEQ ID NO: 289303 - RNA, 19 nt, Homo sapiens
cugaaaguccuaccuauga

SEQ ID NO: 289304 - RNA, 19 nt, Homo sapiens
ccucgaaauucuaccaaga

SEQ ID NO: 289305 - RNA, 19 nt, Homo sapiens
caacagaaugaucuugaga

SEQ ID NO: 289306 - RNA, 19 nt, Homo sapiens
gaccugagagaaacacaaa

SEQ ID NO: 289307 - RNA, 19 nt, Homo sapiens
ccagauaaaccaaaggaau

SEQ ID NO: 289308 - RNA, 19 nt, Homo sapiens
agaagcaccucagaauuuc

SEQ ID NO: 289309 - RNA, 19 nt, Homo sapiens
gcagaaggaagcuguugug

SEQ ID NO: 289310 - RNA, 19 nt, Homo sapiens
cuacaaagcccagauaaac

SEQ ID NO: 289311 - RNA, 19 nt, Homo sapiens
gaugcaggauccuacaaag

SEQ ID NO: 289312 - RNA, 19 nt, Homo sapiens
ccuaugggcuucagauguc

SEQ ID NO: 289313 - RNA, 19 nt, Homo sapiens
ggaaguugagucugugguu

SEQ ID NO: 289314 - RNA, 19 nt, Homo sapiens
acagaccucucuccucuuc

SEQ ID NO: 289315 - RNA, 19 nt, Homo sapiens
ccucagaauuuccuucagu

SEQ ID NO: 289316 - RNA, 19 nt, Homo sapiens
aaacaucucaguagacaca

SEQ ID NO: 289317 - RNA, 19 nt, Homo sapiens
ugacagaagcaccucagaa

SEQ ID NO: 289318 - RNA, 19 nt, Homo sapiens
aaagucagcuggaccucau

SEQ ID NO: 289319 - RNA, 19 nt, Homo sapiens
cacaaucuacugcuccaua

SEQ ID NO: 289320 - RNA, 19 nt, Homo sapiens
gagcucagccacaaucuac

SEQ ID NO: 289321 - RNA, 19 nt, Homo sapiens
ggaaucacaccucaauguc

SEQ ID NO: 289322 - RNA, 19 nt, Homo sapiens
ccagucacccugccacuug

SEQ ID NO: 289323 - RNA, 19 nt, Homo sapiens
caccaaagagucacacaga

SEQ ID NO: 289324 - RNA, 19 nt, Homo sapiens
ucacaacugaggaggauga

SEQ ID NO: 289325 - RNA, 19 nt, Homo sapiens
gccacacgcuauacucugu

SEQ ID NO: 289326 - RNA, 19 nt, Homo sapiens
cugcaaauauucucuucug

SEQ ID NO: 289327 - RNA, 19 nt, Homo sapiens
ggacucccaaacccauuaa

SEQ ID NO: 289328 - RNA, 19 nt, Homo sapiens
ggauuggguuguuccugau

SEQ ID NO: 289329 - RNA, 19 nt, Homo sapiens
caggaguucccaccaguuu

SEQ ID NO: 289330 - RNA, 19 nt, Homo sapiens
ggacugcucccugaagauc

SEQ ID NO: 289331 - RNA, 19 nt, Homo sapiens
ucaccucgcacacuuauag

SEQ ID NO: 289332 - RNA, 19 nt, Homo sapiens
gguuguuccugaugguuug

SEQ ID NO: 289333 - RNA, 19 nt, Homo sapiens
gaaucacaccucaaugucu

SEQ ID NO: 289334 - RNA, 19 nt, Homo sapiens
acagaagcaccucagaauu

SEQ ID NO: 289335 - RNA, 19 nt, Homo sapiens
caccguguaugcacaagug

SEQ ID NO: 289336 - RNA, 19 nt, Homo sapiens
gacagcaaccucacaacug

SEQ ID NO: 289337 - RNA, 19 nt, Homo sapiens
cagcuggccacacgcuaua

SEQ ID NO: 289338 - RNA, 19 nt, Homo sapiens
ucacacaugacacaagaug

SEQ ID NO: 289339 - RNA, 19 nt, Homo sapiens
gaccagcuguccuuuacac

SEQ ID NO: 289340 - RNA, 19 nt, Homo sapiens
cacaacagaaugaucuuga

SEQ ID NO: 289341 - RNA, 19 nt, Homo sapiens
ucauggagaagcagugaaa

SEQ ID NO: 289342 - RNA, 19 nt, Homo sapiens
ggaggaauucacccuguuc

SEQ ID NO: 289343 - RNA, 19 nt, Homo sapiens
ccaagacuggucaaauguu

SEQ ID NO: 289344 - RNA, 19 nt, Homo sapiens
cccaaacccauuaauaguu

SEQ ID NO: 289345 - RNA, 19 nt, Homo sapiens
gggccaagcagacuaugau

SEQ ID NO: 289346 - RNA, 19 nt, Homo sapiens
ggaaacacugucauguaca

SEQ ID NO: 289347 - RNA, 19 nt, Homo sapiens
ucuguaacaucacucuaau

SEQ ID NO: 289348 - RNA, 19 nt, Homo sapiens
ucacccuguucgucuauga

SEQ ID NO: 289349 - RNA, 19 nt, Homo sapiens
gaggagucagcugcaaaua

SEQ ID NO: 289350 - RNA, 19 nt, Homo sapiens
ucgcacacuuauagcguuu

SEQ ID NO: 289351 - RNA, 19 nt, Homo sapiens
ggaguucccaccaguuucu

SEQ ID NO: 289352 - RNA, 19 nt, Homo sapiens
aacggcagauccacucauu

SEQ ID NO: 289353 - RNA, 19 nt, Homo sapiens
guuuaacacauccaucauu

SEQ ID NO: 289354 - RNA, 19 nt, Homo sapiens
acccagaccugccauacau

SEQ ID NO: 289355 - RNA, 19 nt, Homo sapiens
ugagagaaacacaaagcuu

SEQ ID NO: 289356 - RNA, 19 nt, Homo sapiens
gcaggaguucccaccaguu

SEQ ID NO: 289357 - RNA, 19 nt, Homo sapiens
uaacacauccaucauuagc

SEQ ID NO: 289358 - RNA, 19 nt, Homo sapiens
cgacuagacaucaccaagu

SEQ ID NO: 289359 - RNA, 19 nt, Homo sapiens
cugugaaggugucugagaa

SEQ ID NO: 289360 - RNA, 19 nt, Homo sapiens
gaaauuaguucucagugua

SEQ ID NO: 289361 - RNA, 19 nt, Homo sapiens
gacaaagucucaauccuua

SEQ ID NO: 289362 - RNA, 19 nt, Homo sapiens
gcagaaacaucgcuuaaug

SEQ ID NO: 289363 - RNA, 19 nt, Homo sapiens
gaacaccgcuucucugaca

SEQ ID NO: 289364 - RNA, 19 nt, Homo sapiens
gaacuucaauggcaauaau

SEQ ID NO: 289365 - RNA, 19 nt, Homo sapiens
gaucagaugugcauugaga

SEQ ID NO: 289366 - RNA, 19 nt, Homo sapiens
gcagagcaccauuaauuua

SEQ ID NO: 289367 - RNA, 19 nt, Homo sapiens
caaagaauguccucagcua

SEQ ID NO: 289368 - RNA, 19 nt, Homo sapiens
uuaacuaggugccagauua

SEQ ID NO: 289369 - RNA, 19 nt, Homo sapiens
gggaaucacuuucaagaug

SEQ ID NO: 289370 - RNA, 19 nt, Homo sapiens
cagauuaacuggauacaug

SEQ ID NO: 289371 - RNA, 19 nt, Homo sapiens
gacagcaacucacuugaaa

SEQ ID NO: 289372 - RNA, 19 nt, Homo sapiens
cagcagagcaccauuaauu

SEQ ID NO: 289373 - RNA, 19 nt, Homo sapiens
gaucaauugugucaaauca

SEQ ID NO: 289374 - RNA, 19 nt, Homo sapiens
gcaguuaaauaccuucuca

SEQ ID NO: 289375 - RNA, 19 nt, Homo sapiens
ugaaaucccugacacucua

SEQ ID NO: 289376 - RNA, 19 nt, Homo sapiens
ggacaaagucucaauccuu

SEQ ID NO: 289377 - RNA, 19 nt, Homo sapiens
gaguuaagcuaucugaugu

SEQ ID NO: 289378 - RNA, 19 nt, Homo sapiens
gaauaaugcuauacacuac

SEQ ID NO: 289379 - RNA, 19 nt, Homo sapiens
aaccauauuuccuccauua

SEQ ID NO: 289380 - RNA, 19 nt, Homo sapiens
aaugagccauguagacuua

SEQ ID NO: 289381 - RNA, 19 nt, Homo sapiens
gaugaagggucugaacuug

SEQ ID NO: 289382 - RNA, 19 nt, Homo sapiens
uuggaaagcuuguaucuug

SEQ ID NO: 289383 - RNA, 19 nt, Homo sapiens
gcaaacccgccaucucuaa

SEQ ID NO: 289384 - RNA, 19 nt, Homo sapiens
gccagggccuucacaguuu

SEQ ID NO: 289385 - RNA, 19 nt, Homo sapiens
uauccaaucucgaguuuau

SEQ ID NO: 289386 - RNA, 19 nt, Homo sapiens
ucacccaacuccaagaauu

SEQ ID NO: 289387 - RNA, 19 nt, Homo sapiens
ugacgaagauauuaguuca

SEQ ID NO: 289388 - RNA, 19 nt, Homo sapiens
ggaguuaagcuaucugaug

SEQ ID NO: 289389 - RNA, 19 nt, Homo sapiens
gagcaggccaucaaccuaa

SEQ ID NO: 289390 - RNA, 19 nt, Homo sapiens
gcuauacacuacaucucua

SEQ ID NO: 289391 - RNA, 19 nt, Homo sapiens
uaagcuaucugaugucaag

SEQ ID NO: 289392 - RNA, 19 nt, Homo sapiens
ccacaaagucccuuccaaa

SEQ ID NO: 289393 - RNA, 19 nt, Homo sapiens
ccaagucacugaagcaucu

SEQ ID NO: 289394 - RNA, 19 nt, Homo sapiens
aaauuuaggucucagugaa

SEQ ID NO: 289395 - RNA, 19 nt, Homo sapiens
gggaucagaugugcauuga

SEQ ID NO: 289396 - RNA, 19 nt, Homo sapiens
gcugaagguuuccagagaa

SEQ ID NO: 289397 - RNA, 19 nt, Homo sapiens
acacuugauuuaagccaua

SEQ ID NO: 289398 - RNA, 19 nt, Homo sapiens
gaaagcuuguaucuuggaa

SEQ ID NO: 289399 - RNA, 19 nt, Homo sapiens
gaaagaagccaacaaaaca

SEQ ID NO: 289400 - RNA, 19 nt, Homo sapiens
ggucuggguucucaguaaa

SEQ ID NO: 289401 - RNA, 19 nt, Homo sapiens
caacacauuuagugcugaa

SEQ ID NO: 289402 - RNA, 19 nt, Homo sapiens
ugagaaagaagccaacaaa

SEQ ID NO: 289403 - RNA, 19 nt, Homo sapiens
caacagcauuaacaucauc

SEQ ID NO: 289404 - RNA, 19 nt, Homo sapiens
caaagucucaauccuuauu

SEQ ID NO: 289405 - RNA, 19 nt, Homo sapiens
aaucagugcugccaauuuc

SEQ ID NO: 289406 - RNA, 19 nt, Homo sapiens
ucaaaucagugcugccaau

SEQ ID NO: 289407 - RNA, 19 nt, Homo sapiens
cauauuuccuccauuaagu

SEQ ID NO: 289408 - RNA, 19 nt, Homo sapiens
gaacucuacuacucagucu

SEQ ID NO: 289409 - RNA, 19 nt, Homo sapiens
acuccaaauuugucuguua

SEQ ID NO: 289410 - RNA, 19 nt, Homo sapiens
uaacuaggugccagauuaa

SEQ ID NO: 289411 - RNA, 19 nt, Homo sapiens
acucaugaaucuuaccuuu

SEQ ID NO: 289412 - RNA, 19 nt, Homo sapiens
gcuccaagcauuagguaaa

SEQ ID NO: 289413 - RNA, 19 nt, Homo sapiens
uaucugaugucaagcuuuc

SEQ ID NO: 289414 - RNA, 19 nt, Homo sapiens
ucaauugugucaaaucagu

SEQ ID NO: 289415 - RNA, 19 nt, Homo sapiens
gggaacauuugaggacauu

SEQ ID NO: 289416 - RNA, 19 nt, Homo sapiens
guacuggauuuucagaaua

SEQ ID NO: 289417 - RNA, 19 nt, Homo sapiens
gcaaccauauuuccuccau

SEQ ID NO: 289418 - RNA, 19 nt, Homo sapiens
gaauauccaaucucgaguu

SEQ ID NO: 289419 - RNA, 19 nt, Homo sapiens
cauuaaugcuccacaaagu

SEQ ID NO: 289420 - RNA, 19 nt, Homo sapiens
ucauuucgaucaauugugu

SEQ ID NO: 289421 - RNA, 19 nt, Homo sapiens
ucaauggucugcagaacuc

SEQ ID NO: 289422 - RNA, 19 nt, Homo sapiens
caagaucacccuucugagu

SEQ ID NO: 289423 - RNA, 19 nt, Homo sapiens
gggucuggguucucaguaa

SEQ ID NO: 289424 - RNA, 19 nt, Homo sapiens
guggaaauaccaacacauu

SEQ ID NO: 289425 - RNA, 19 nt, Homo sapiens
gauuacagccauaggcauu

SEQ ID NO: 289426 - RNA, 19 nt, Homo sapiens
aagcuuuccugugggauua

SEQ ID NO: 289427 - RNA, 19 nt, Homo sapiens
gccaacagcauuaacauca

SEQ ID NO: 289428 - RNA, 19 nt, Homo sapiens
ucuccggcaucucaacuua

SEQ ID NO: 289429 - RNA, 19 nt, Homo sapiens
gauuuaagccauaaugaca

SEQ ID NO: 289430 - RNA, 19 nt, Homo sapiens
ccgcuucucugacaucuca

SEQ ID NO: 289431 - RNA, 19 nt, Homo sapiens
ucaagggacucugugaaau

SEQ ID NO: 289432 - RNA, 19 nt, Homo sapiens
ggcaauaauguuaaaggua

SEQ ID NO: 289433 - RNA, 19 nt, Homo sapiens
aauauccaaucucgaguuu

SEQ ID NO: 289434 - RNA, 19 nt, Homo sapiens
cgacagcauugauucucuu

SEQ ID NO: 289435 - RNA, 19 nt, Homo sapiens
uaggaaaccuucagacacu

SEQ ID NO: 289436 - RNA, 19 nt, Homo sapiens
ggaugaagggucugaacuu

SEQ ID NO: 289437 - RNA, 19 nt, Homo sapiens
caucucauccaccacauuu

SEQ ID NO: 289438 - RNA, 19 nt, Homo sapiens
caagggacucugugaaaug

SEQ ID NO: 289439 - RNA, 19 nt, Homo sapiens
gaacuccaaauuugucugu

SEQ ID NO: 289440 - RNA, 19 nt, Homo sapiens
gcaaguacaccgaaugacu

SEQ ID NO: 289441 - RNA, 19 nt, Homo sapiens
ugacgucagcugcuucuuu

SEQ ID NO: 289442 - RNA, 19 nt, Homo sapiens
gcacggaaucugaaaguac

SEQ ID NO: 289443 - RNA, 19 nt, Homo sapiens
gaugugcauugagaaagaa

SEQ ID NO: 289444 - RNA, 19 nt, Homo sapiens
gaggagaccacgugugcaa

SEQ ID NO: 289445 - RNA, 19 nt, Homo sapiens
agcuagaacuccucgauuu

SEQ ID NO: 289446 - RNA, 19 nt, Homo sapiens
cugcagaacucuacuacuc

SEQ ID NO: 289447 - RNA, 19 nt, Homo sapiens
ggagcaggccaucaaccua

SEQ ID NO: 289448 - RNA, 19 nt, Homo sapiens
ggaaauccccugauauuca

SEQ ID NO: 289449 - RNA, 19 nt, Homo sapiens
ggauacaugaagacacuuu

SEQ ID NO: 289450 - RNA, 19 nt, Homo sapiens
guuaagcuaucugauguca

SEQ ID NO: 289451 - RNA, 19 nt, Homo sapiens
gcuagaacuccucgauuug

SEQ ID NO: 289452 - RNA, 19 nt, Homo sapiens
ugacagcaacucacuugaa

SEQ ID NO: 289453 - RNA, 19 nt, Homo sapiens
gcagucaacagcauuucuu

SEQ ID NO: 289454 - RNA, 19 nt, Homo sapiens
aaacgggaauauccaaucu

SEQ ID NO: 289455 - RNA, 19 nt, Homo sapiens
gaccagacuuuucagauug

SEQ ID NO: 289456 - RNA, 19 nt, Homo sapiens
ggagaaacuaggaaaccuu

SEQ ID NO: 289457 - RNA, 19 nt, Homo sapiens
gaggcaacgugaagaaacu

SEQ ID NO: 289458 - RNA, 19 nt, Homo sapiens
ucugugaaaugucuguuga

SEQ ID NO: 289459 - RNA, 19 nt, Homo sapiens
ggaaagcuuguaucuugga

SEQ ID NO: 289460 - RNA, 19 nt, Homo sapiens
caacagugcugcugaauua

SEQ ID NO: 289461 - RNA, 19 nt, Homo sapiens
ggacagaagugguggauaa

SEQ ID NO: 289462 - RNA, 19 nt, Homo sapiens
ggaagaagcugaacgauuc

SEQ ID NO: 289463 - RNA, 19 nt, Homo sapiens
ggaaguugcuaccaauuua

SEQ ID NO: 289464 - RNA, 19 nt, Homo sapiens
gaaaguaauuccugggaua

SEQ ID NO: 289465 - RNA, 19 nt, Homo sapiens
ggagaaaccuguuacaaga

SEQ ID NO: 289466 - RNA, 19 nt, Homo sapiens
ggaacaaacugcaaucuga

SEQ ID NO: 289467 - RNA, 19 nt, Homo sapiens
cgaagacuguguaguauua

SEQ ID NO: 289468 - RNA, 19 nt, Homo sapiens
gaacugaaguccaaauugu

SEQ ID NO: 289469 - RNA, 19 nt, Homo sapiens
gaaggaaaguguaugaguu

SEQ ID NO: 289470 - RNA, 19 nt, Homo sapiens
gcaggaagaccaacuauaa

SEQ ID NO: 289471 - RNA, 19 nt, Homo sapiens
gcaggaaaccauuaaauaa

SEQ ID NO: 289472 - RNA, 19 nt, Homo sapiens
gaacuaagccaacuugaug

SEQ ID NO: 289473 - RNA, 19 nt, Homo sapiens
caacuguguuuccuacuua

SEQ ID NO: 289474 - RNA, 19 nt, Homo sapiens
gaucagaagugacauuugu

SEQ ID NO: 289475 - RNA, 19 nt, Homo sapiens
gcaaauauaucuggugaug

SEQ ID NO: 289476 - RNA, 19 nt, Homo sapiens
uaaaugagcugagaauguu

SEQ ID NO: 289477 - RNA, 19 nt, Homo sapiens
aaacauugcuuugugguua

SEQ ID NO: 289478 - RNA, 19 nt, Homo sapiens
gaaauuguguucucuugga

SEQ ID NO: 289479 - RNA, 19 nt, Homo sapiens
ccacaaaccauuaaacuuu

SEQ ID NO: 289480 - RNA, 19 nt, Homo sapiens
gcacuaaugugguuaugga

SEQ ID NO: 289481 - RNA, 19 nt, Homo sapiens
gaugguauuuacaguguua

SEQ ID NO: 289482 - RNA, 19 nt, Homo sapiens
gaaaggaggcucagaggaa

SEQ ID NO: 289483 - RNA, 19 nt, Homo sapiens
gcaacuaucguuuccauaa

SEQ ID NO: 289484 - RNA, 19 nt, Homo sapiens
gaagcuacuuuauggauug

SEQ ID NO: 289485 - RNA, 19 nt, Homo sapiens
ucaaggagcugauuuacug

SEQ ID NO: 289486 - RNA, 19 nt, Homo sapiens
gaaugaagaugagauuaug

SEQ ID NO: 289487 - RNA, 19 nt, Homo sapiens
ccaaacaucuccuggaaau

SEQ ID NO: 289488 - RNA, 19 nt, Homo sapiens
ugggagaccuugugaauuu

SEQ ID NO: 289489 - RNA, 19 nt, Homo sapiens
ugaaaugguugacuacaaa

SEQ ID NO: 289490 - RNA, 19 nt, Homo sapiens
gagcacaccuuucuagcuu

SEQ ID NO: 289491 - RNA, 19 nt, Homo sapiens
caaauguucccuacaauaa

SEQ ID NO: 289492 - RNA, 19 nt, Homo sapiens
gagcaagaauaccuaaaug

SEQ ID NO: 289493 - RNA, 19 nt, Homo sapiens
ucacaaaacuccauaauga

SEQ ID NO: 289494 - RNA, 19 nt, Homo sapiens
gaucucggcucacugcaaa

SEQ ID NO: 289495 - RNA, 19 nt, Homo sapiens
guaugaaugugauugguaa

SEQ ID NO: 289496 - RNA, 19 nt, Homo sapiens
gaucaggcauugcacaguu

SEQ ID NO: 289497 - RNA, 19 nt, Homo sapiens
gcagaaugcuucagaaacu

SEQ ID NO: 289498 - RNA, 19 nt, Homo sapiens
gaggaaugcuuguacaugu

SEQ ID NO: 289499 - RNA, 19 nt, Homo sapiens
gcacagcaaucucaaaugc

SEQ ID NO: 289500 - RNA, 19 nt, Homo sapiens
ucaauuauauggcuucaug

SEQ ID NO: 289501 - RNA, 19 nt, Homo sapiens
gccagaaacugaauccaaa

SEQ ID NO: 289502 - RNA, 19 nt, Homo sapiens
ucacaacucuuccuuaugg

SEQ ID NO: 289503 - RNA, 19 nt, Homo sapiens
gaaagucuguuggaaagug

SEQ ID NO: 289504 - RNA, 19 nt, Homo sapiens
gcuaucugcugguaaauga

SEQ ID NO: 289505 - RNA, 19 nt, Homo sapiens
caacuaucguuuccauaaa

SEQ ID NO: 289506 - RNA, 19 nt, Homo sapiens
ucucuuaugugguuugaua

SEQ ID NO: 289507 - RNA, 19 nt, Homo sapiens
ggaagugaauauugguuug

SEQ ID NO: 289508 - RNA, 19 nt, Homo sapiens
gugcugguauccacaguua

SEQ ID NO: 289509 - RNA, 19 nt, Homo sapiens
caacugcuguacuucaauu

SEQ ID NO: 289510 - RNA, 19 nt, Homo sapiens
ggaagcuacuuuauggauu

SEQ ID NO: 289511 - RNA, 19 nt, Homo sapiens
gcagacgacugugaugaaa

SEQ ID NO: 289512 - RNA, 19 nt, Homo sapiens
ggauauggaagcuacuuua

SEQ ID NO: 289513 - RNA, 19 nt, Homo sapiens
aaauauaucuggugaugga

SEQ ID NO: 289514 - RNA, 19 nt, Homo sapiens
gaccuccacuuauaauuga

SEQ ID NO: 289515 - RNA, 19 nt, Homo sapiens
gagaaucaacuagguauuu

SEQ ID NO: 289516 - RNA, 19 nt, Homo sapiens
gcagaaagaauuguaagaa

SEQ ID NO: 289517 - RNA, 19 nt, Homo sapiens
ggauaggccuuaagaacau

SEQ ID NO: 289518 - RNA, 19 nt, Homo sapiens
gcaaagccuucaguaguga

SEQ ID NO: 289519 - RNA, 19 nt, Homo sapiens
gguauuccaugcagaaaga

SEQ ID NO: 289520 - RNA, 19 nt, Homo sapiens
gaagagacauggagaaacc

SEQ ID NO: 289521 - RNA, 19 nt, Homo sapiens
ugagagauguagauucuug

SEQ ID NO: 289522 - RNA, 19 nt, Homo sapiens
agacagacguugcagaaug

SEQ ID NO: 289523 - RNA, 19 nt, Homo sapiens
gccaauagaugaucauuuu

SEQ ID NO: 289524 - RNA, 19 nt, Homo sapiens
cagaagugguggauaagaa

SEQ ID NO: 289525 - RNA, 19 nt, Homo sapiens
gagcccagauuuacaagga

SEQ ID NO: 289526 - RNA, 19 nt, Homo sapiens
gacuaucacuagcagauuu

SEQ ID NO: 289527 - RNA, 19 nt, Homo sapiens
uguaugaguugcauuugua

SEQ ID NO: 289528 - RNA, 19 nt, Homo sapiens
uaggugacaugucuacuuu

SEQ ID NO: 289529 - RNA, 19 nt, Homo sapiens
gauaguagcagacgacugu

SEQ ID NO: 289530 - RNA, 19 nt, Homo sapiens
ggagaaauuagucacuuaa

SEQ ID NO: 289531 - RNA, 19 nt, Homo sapiens
guacaagggucacuguuac

SEQ ID NO: 289532 - RNA, 19 nt, Homo sapiens
cgacuuagguaaaccaaca

SEQ ID NO: 289533 - RNA, 19 nt, Homo sapiens
cgaagaggcuggcauuucu

SEQ ID NO: 289534 - RNA, 19 nt, Homo sapiens
gcaagaauaccuaaaugau

SEQ ID NO: 289535 - RNA, 19 nt, Homo sapiens
ugugaucuguguacaauuu

SEQ ID NO: 289536 - RNA, 19 nt, Homo sapiens
ggccaaacaucuccuggaa

SEQ ID NO: 289537 - RNA, 19 nt, Homo sapiens
gcagacagacguugcagaa

SEQ ID NO: 289538 - RNA, 19 nt, Homo sapiens
cagcuaaagugcaauguuc

SEQ ID NO: 289539 - RNA, 19 nt, Homo sapiens
agacuuggcuuaucgacuu

SEQ ID NO: 289540 - RNA, 19 nt, Homo sapiens
ggacuggccugagagaugu

SEQ ID NO: 289541 - RNA, 19 nt, Homo sapiens
gaaaccuguuacaagauuu

SEQ ID NO: 289542 - RNA, 19 nt, Homo sapiens
ccaaauguucccuacaaua

SEQ ID NO: 289543 - RNA, 19 nt, Homo sapiens
gcacggcuguauauaaugg

SEQ ID NO: 289544 - RNA, 19 nt, Homo sapiens
uaagagugguguuggaaga

SEQ ID NO: 289545 - RNA, 19 nt, Homo sapiens
cuaccacugugcccuaaua

SEQ ID NO: 289546 - RNA, 19 nt, Homo sapiens
gcgcuggacugccuaugaa

SEQ ID NO: 289547 - RNA, 19 nt, Homo sapiens
guaaaugagcugagaaugu

SEQ ID NO: 289548 - RNA, 19 nt, Homo sapiens
ggaccuccacuuauaauug

SEQ ID NO: 289549 - RNA, 19 nt, Homo sapiens
gaaagugggaggugaagga

SEQ ID NO: 289550 - RNA, 19 nt, Homo sapiens
gaacauaaacauaccaacu

SEQ ID NO: 289551 - RNA, 19 nt, Homo sapiens
caaagaagaaguguggaua

SEQ ID NO: 289552 - RNA, 19 nt, Homo sapiens
caucaugauugcauucuug

SEQ ID NO: 289553 - RNA, 19 nt, Homo sapiens
caguuguccugauuucuua

SEQ ID NO: 289554 - RNA, 19 nt, Homo sapiens
caguaacuuucacccauua

SEQ ID NO: 289555 - RNA, 19 nt, Homo sapiens
ggaccuggcaucaugauug

SEQ ID NO: 289556 - RNA, 19 nt, Homo sapiens
uaaagagaaucaacuaggu

SEQ ID NO: 289557 - RNA, 19 nt, Homo sapiens
caugaucacucugcaacua

SEQ ID NO: 289558 - RNA, 19 nt, Homo sapiens
aaacaucuccuggaaauug

SEQ ID NO: 289559 - RNA, 19 nt, Homo sapiens
aacaugguaugaagcauua

SEQ ID NO: 289560 - RNA, 19 nt, Homo sapiens
gcagagcagucauaggaaa

SEQ ID NO: 289561 - RNA, 19 nt, Homo sapiens
gaagaaggaccagugaaga

SEQ ID NO: 289562 - RNA, 19 nt, Homo sapiens
ccacaacccucuggaagug

SEQ ID NO: 289563 - RNA, 19 nt, Homo sapiens
ccucaacagugucuacauu

SEQ ID NO: 289564 - RNA, 19 nt, Homo sapiens
ucaccaggcugcaagaaca

SEQ ID NO: 289565 - RNA, 19 nt, Homo sapiens
caacauggcagagcaguca

SEQ ID NO: 289566 - RNA, 19 nt, Homo sapiens
uggcagagcagucauagga

SEQ ID NO: 289567 - RNA, 19 nt, Homo sapiens
gaccggaagcugagcaaga

SEQ ID NO: 289568 - RNA, 19 nt, Homo sapiens
ggagaccaagccacuguga

SEQ ID NO: 289569 - RNA, 19 nt, Homo sapiens
gaacagugcuggggugagu

SEQ ID NO: 289570 - RNA, 19 nt, Homo sapiens
cgaagaaggaccagugaag

SEQ ID NO: 289571 - RNA, 19 nt, Homo sapiens
ucaacagugucuacauugg

SEQ ID NO: 289572 - RNA, 19 nt, Homo sapiens
ccacuuuggcccugcacua

SEQ ID NO: 289573 - RNA, 19 nt, Homo sapiens
ugacugagaaggcagagau

SEQ ID NO: 289574 - RNA, 19 nt, Homo sapiens
ccagggccgucaaggaaag

SEQ ID NO: 289575 - RNA, 19 nt, Homo sapiens
ccggaagggugaucaucga

SEQ ID NO: 289576 - RNA, 19 nt, Homo sapiens
ggcggcagcagaacguuaa

SEQ ID NO: 289577 - RNA, 19 nt, Homo sapiens
accggaagcugagcaagaa

SEQ ID NO: 289578 - RNA, 19 nt, Homo sapiens
ggacgugcugcgcauguuc

SEQ ID NO: 289579 - RNA, 19 nt, Homo sapiens
uuuagcaucuucccuagca

SEQ ID NO: 289580 - RNA, 19 nt, Homo sapiens
agauggagcaaaccgcuuu

SEQ ID NO: 289581 - RNA, 19 nt, Homo sapiens
gcggagaccaagccacugu

SEQ ID NO: 289582 - RNA, 19 nt, Homo sapiens
gggacccgcagacccuuaa

SEQ ID NO: 289583 - RNA, 19 nt, Homo sapiens
gaaggcagagauggugugu

SEQ ID NO: 289584 - RNA, 19 nt, Homo sapiens
gccuagccaugaaguacau

SEQ ID NO: 289585 - RNA, 19 nt, Homo sapiens
ggaagcugagcaagaacga

SEQ ID NO: 289586 - RNA, 19 nt, Homo sapiens
ccaacuagcucuauguuua

SEQ ID NO: 289587 - RNA, 19 nt, Homo sapiens
ggaaauaugggauguauaa

SEQ ID NO: 289588 - RNA, 19 nt, Homo sapiens
gcagauggcuugugcagaa

SEQ ID NO: 289589 - RNA, 19 nt, Homo sapiens
gcaaagugcugcuuccaaa

SEQ ID NO: 289590 - RNA, 19 nt, Homo sapiens
ggagaaggcuuguauuagu

SEQ ID NO: 289591 - RNA, 19 nt, Homo sapiens
gaagaacacccucuaaaug

SEQ ID NO: 289592 - RNA, 19 nt, Homo sapiens
ggacauaggacucaaaguu

SEQ ID NO: 289593 - RNA, 19 nt, Homo sapiens
gaagagagaccaacguuug

SEQ ID NO: 289594 - RNA, 19 nt, Homo sapiens
gaugagcucuaugacauua

SEQ ID NO: 289595 - RNA, 19 nt, Homo sapiens
ggugcuaaguucccuauua

SEQ ID NO: 289596 - RNA, 19 nt, Homo sapiens
gcaaucaacuuuggauguu

SEQ ID NO: 289597 - RNA, 19 nt, Homo sapiens
gcgacaugauuaaacauua

SEQ ID NO: 289598 - RNA, 19 nt, Homo sapiens
aaaggaagcuucucucugu

SEQ ID NO: 289599 - RNA, 19 nt, Homo sapiens
gugcuaaguucccuauuaa

SEQ ID NO: 289600 - RNA, 19 nt, Homo sapiens
ggaaagacagcuugaguga

SEQ ID NO: 289601 - RNA, 19 nt, Homo sapiens
ggaagaagccaaccucaug

SEQ ID NO: 289602 - RNA, 19 nt, Homo sapiens
gcuggagcuuuccuuauua

SEQ ID NO: 289603 - RNA, 19 nt, Homo sapiens
ggaagaacacccucuaaau

SEQ ID NO: 289604 - RNA, 19 nt, Homo sapiens
gagcuuuccuuauuagaga

SEQ ID NO: 289605 - RNA, 19 nt, Homo sapiens
ugaagacccugcagcauga

SEQ ID NO: 289606 - RNA, 19 nt, Homo sapiens
gugccuggauccugaaaua

SEQ ID NO: 289607 - RNA, 19 nt, Homo sapiens
aaacaucuauucucuccaa

SEQ ID NO: 289608 - RNA, 19 nt, Homo sapiens
cagaugagcucuaugacau

SEQ ID NO: 289609 - RNA, 19 nt, Homo sapiens
ggagaaugguggaaagcaa

SEQ ID NO: 289610 - RNA, 19 nt, Homo sapiens
gaccaacguuugacuacuu

SEQ ID NO: 289611 - RNA, 19 nt, Homo sapiens
gacauaggacucaaaguuu

SEQ ID NO: 289612 - RNA, 19 nt, Homo sapiens
gaagaagccaaccucauga

SEQ ID NO: 289613 - RNA, 19 nt, Homo sapiens
guaccaagguggcugugaa

SEQ ID NO: 289614 - RNA, 19 nt, Homo sapiens
gaaaggagagaagaugaaa

SEQ ID NO: 289615 - RNA, 19 nt, Homo sapiens
gcaaaggccaguuccagaa

SEQ ID NO: 289616 - RNA, 19 nt, Homo sapiens
ggauauauacauagcauga

SEQ ID NO: 289617 - RNA, 19 nt, Homo sapiens
gauaaugaguacacagcaa

SEQ ID NO: 289618 - RNA, 19 nt, Homo sapiens
ugacauuucuuugugcuuu

SEQ ID NO: 289619 - RNA, 19 nt, Homo sapiens
ggaaauagcgcuggagcuu

SEQ ID NO: 289620 - RNA, 19 nt, Homo sapiens
gcaacuauguggccaaacu

SEQ ID NO: 289621 - RNA, 19 nt, Homo sapiens
guggagaacugcccagaug

SEQ ID NO: 289622 - RNA, 19 nt, Homo sapiens
ggaauccuccuauacgaaa

SEQ ID NO: 289623 - RNA, 19 nt, Homo sapiens
ccagggaggagcccauuua

SEQ ID NO: 289624 - RNA, 19 nt, Homo sapiens
gagaaggcuuguauuaguc

SEQ ID NO: 289625 - RNA, 19 nt, Homo sapiens
ucaaggauauaaccaggaa

SEQ ID NO: 289626 - RNA, 19 nt, Homo sapiens
gagauccaacguccaauaa

SEQ ID NO: 289627 - RNA, 19 nt, Homo sapiens
uugcagaacuaaacucauu

SEQ ID NO: 289628 - RNA, 19 nt, Homo sapiens
cuaaauuacucaggaagaa

SEQ ID NO: 289629 - RNA, 19 nt, Homo sapiens
cgaugaagguggcaaagug

SEQ ID NO: 289630 - RNA, 19 nt, Homo sapiens
gaagccaaccucaugaaga

SEQ ID NO: 289631 - RNA, 19 nt, Homo sapiens
aaauagcgcuggagcuuuc

SEQ ID NO: 289632 - RNA, 19 nt, Homo sapiens
ggaggagcauggagaaugg

SEQ ID NO: 289633 - RNA, 19 nt, Homo sapiens
gaacuaaugccgacgugau

SEQ ID NO: 289634 - RNA, 19 nt, Homo sapiens
uuacaucucuccacgaauc

SEQ ID NO: 289635 - RNA, 19 nt, Homo sapiens
gaaauagcgcuggagcuuu

SEQ ID NO: 289636 - RNA, 19 nt, Homo sapiens
gauccaacguccaauaaac

SEQ ID NO: 289637 - RNA, 19 nt, Homo sapiens
gcacccaacuagcucuaug

SEQ ID NO: 289638 - RNA, 19 nt, Homo sapiens
uauacgaaauugucaccua

SEQ ID NO: 289639 - RNA, 19 nt, Homo sapiens
uuagaagucuggauaaugg

SEQ ID NO: 289640 - RNA, 19 nt, Homo sapiens
gaugugugguccuuuggaa

SEQ ID NO: 289641 - RNA, 19 nt, Homo sapiens
auacauagcaugacauuuc

SEQ ID NO: 289642 - RNA, 19 nt, Homo sapiens
gaaauagaggcuaaauuac

SEQ ID NO: 289643 - RNA, 19 nt, Homo sapiens
gggaggagcccauuuacau

SEQ ID NO: 289644 - RNA, 19 nt, Homo sapiens
aaacucaacaccuuagaaa

SEQ ID NO: 289645 - RNA, 19 nt, Homo sapiens
ggacucaaaguuucagaga

SEQ ID NO: 289646 - RNA, 19 nt, Homo sapiens
gagugacgauggaguagau

SEQ ID NO: 289647 - RNA, 19 nt, Homo sapiens
cagaagcaaucaacuuugg

SEQ ID NO: 289648 - RNA, 19 nt, Homo sapiens
uuccaaagcucauugacuu

SEQ ID NO: 289649 - RNA, 19 nt, Homo sapiens
uauuacaucucuccacgaa

SEQ ID NO: 289650 - RNA, 19 nt, Homo sapiens
gcgagcagcuaauguucug

SEQ ID NO: 289651 - RNA, 19 nt, Homo sapiens
gagaaugguggaaagcaaa

SEQ ID NO: 289652 - RNA, 19 nt, Homo sapiens
aaaaugugcuggaaagaaa

SEQ ID NO: 289653 - RNA, 19 nt, Homo sapiens
caaucaacuuuggauguuu

SEQ ID NO: 289654 - RNA, 19 nt, Homo sapiens
caagggaaggugcuaaguu

SEQ ID NO: 289655 - RNA, 19 nt, Homo sapiens
ucagcgacaugauuaaaca

SEQ ID NO: 289656 - RNA, 19 nt, Homo sapiens
gcauggugauguuauuaag

SEQ ID NO: 289657 - RNA, 19 nt, Homo sapiens
cgcuggagcuuuccuuauu

SEQ ID NO: 289658 - RNA, 19 nt, Homo sapiens
gcucuauguuuacaaaugg

SEQ ID NO: 289659 - RNA, 19 nt, Homo sapiens
gcccagaugagcucuauga

SEQ ID NO: 289660 - RNA, 19 nt, Homo sapiens
aagggaaggugcuaaguuc

SEQ ID NO: 289661 - RNA, 19 nt, Homo sapiens
caagaaaggagagaagaug

SEQ ID NO: 289662 - RNA, 19 nt, Homo sapiens
acauaggacucaaaguuuc

SEQ ID NO: 289663 - RNA, 19 nt, Homo sapiens
cuagcucuauguuuacaaa

SEQ ID NO: 289664 - RNA, 19 nt, Homo sapiens
gcuaaguucccuauuaagu

SEQ ID NO: 289665 - RNA, 19 nt, Homo sapiens
gaggagcccauuuacauca

SEQ ID NO: 289666 - RNA, 19 nt, Homo sapiens
cgacaugauuaaacauuac

SEQ ID NO: 289667 - RNA, 19 nt, Homo sapiens
gugauguuauuaagcacua

SEQ ID NO: 289668 - RNA, 19 nt, Homo sapiens
ugcuuuggcuuacuuguuu

SEQ ID NO: 289669 - RNA, 19 nt, Homo sapiens
gagugcagccguuugagaa

SEQ ID NO: 289670 - RNA, 19 nt, Homo sapiens
guuccagaaucucagcuuu

SEQ ID NO: 289671 - RNA, 19 nt, Homo sapiens
ggccaaacucaacaccuua

SEQ ID NO: 289672 - RNA, 19 nt, Homo sapiens
cagcaacuauguggccaaa

SEQ ID NO: 289673 - RNA, 19 nt, Homo sapiens
cauagcaugacauuucuuu

SEQ ID NO: 289674 - RNA, 19 nt, Homo sapiens
cuaaagauccagaggaaca

SEQ ID NO: 289675 - RNA, 19 nt, Homo sapiens
caucacugguugcacuuau

SEQ ID NO: 289676 - RNA, 19 nt, Homo sapiens
gaacuauuuaugugagaga

SEQ ID NO: 289677 - RNA, 19 nt, Homo sapiens
gaagcaaucaacuuuggau

SEQ ID NO: 289678 - RNA, 19 nt, Homo sapiens
gauuggagaaggcuuguau

SEQ ID NO: 289679 - RNA, 19 nt, Homo sapiens
cgggaaauaugggauguau

SEQ ID NO: 289680 - RNA, 19 nt, Homo sapiens
aacuaaagauccagaggaa

SEQ ID NO: 289681 - RNA, 19 nt, Homo sapiens
caaugaauccccaauaauu

SEQ ID NO: 289682 - RNA, 19 nt, Homo sapiens
auacgaaauugucaccuau

SEQ ID NO: 289683 - RNA, 19 nt, Homo sapiens
uuggagaaggcuuguauua

SEQ ID NO: 289684 - RNA, 19 nt, Homo sapiens
aauagaggcuaaauuacuc

SEQ ID NO: 289685 - RNA, 19 nt, Homo sapiens
gcaguuugcuggauuuccu

SEQ ID NO: 289686 - RNA, 19 nt, Homo sapiens
gaaccaagcuacuaaauug

SEQ ID NO: 289687 - RNA, 19 nt, Homo sapiens
caucaagucuuucacauuu

SEQ ID NO: 289688 - RNA, 19 nt, Homo sapiens
gagaagaaguccucagcua

SEQ ID NO: 289689 - RNA, 19 nt, Homo sapiens
ggcaagaccugauuucuga

SEQ ID NO: 289690 - RNA, 19 nt, Homo sapiens
cuacagggcucacagaauu

SEQ ID NO: 289691 - RNA, 19 nt, Homo sapiens
ggauuaaugucaauucuug

SEQ ID NO: 289692 - RNA, 19 nt, Homo sapiens
guaauaggcguaacuaauu

SEQ ID NO: 289693 - RNA, 19 nt, Homo sapiens
guagguagaucuggucuuu

SEQ ID NO: 289694 - RNA, 19 nt, Homo sapiens
aggcuaagcuucacuguaa

SEQ ID NO: 289695 - RNA, 19 nt, Homo sapiens
gcucaugaguaacugauuu

SEQ ID NO: 289696 - RNA, 19 nt, Homo sapiens
ugucaauucuugccaaaua

SEQ ID NO: 289697 - RNA, 19 nt, Homo sapiens
gaagccagaucaaggcauu

SEQ ID NO: 289698 - RNA, 19 nt, Homo sapiens
gaagaaguccucagcuaga

SEQ ID NO: 289699 - RNA, 19 nt, Homo sapiens
cacaugaacuuguaaagga

SEQ ID NO: 289700 - RNA, 19 nt, Homo sapiens
cauaauaaguugcauaggu

SEQ ID NO: 289701 - RNA, 19 nt, Homo sapiens
gaaaguugauaaguacaug

SEQ ID NO: 289702 - RNA, 19 nt, Homo sapiens
uaacaagccuccuuuuaaa

SEQ ID NO: 289703 - RNA, 19 nt, Homo sapiens
gaucgaaccaagcuacuaa

SEQ ID NO: 289704 - RNA, 19 nt, Homo sapiens
aaacaaagagugaaggauu

SEQ ID NO: 289705 - RNA, 19 nt, Homo sapiens
gaauuauguuugcauguuc

SEQ ID NO: 289706 - RNA, 19 nt, Homo sapiens
gaaauggacuuuuguacau

SEQ ID NO: 289707 - RNA, 19 nt, Homo sapiens
agacagagcuauucuccau

SEQ ID NO: 289708 - RNA, 19 nt, Homo sapiens
uacacgagauacagaauuu

SEQ ID NO: 289709 - RNA, 19 nt, Homo sapiens
gagugaaggauuuauguuu

SEQ ID NO: 289710 - RNA, 19 nt, Homo sapiens
caucuagcaugucgucaaa

SEQ ID NO: 289711 - RNA, 19 nt, Homo sapiens
uuagugaacugcugagaga

SEQ ID NO: 289712 - RNA, 19 nt, Homo sapiens
guucugauauuggacagua

SEQ ID NO: 289713 - RNA, 19 nt, Homo sapiens
ggcuugaguuuaaauugua

SEQ ID NO: 289714 - RNA, 19 nt, Homo sapiens
caaauccaaugaaaugagu

SEQ ID NO: 289715 - RNA, 19 nt, Homo sapiens
aacaaagagugaaggauuu

SEQ ID NO: 289716 - RNA, 19 nt, Homo sapiens
ccugauuucugagcauuua

SEQ ID NO: 289717 - RNA, 19 nt, Homo sapiens
gugaggagcuuugaaacga

SEQ ID NO: 289718 - RNA, 19 nt, Homo sapiens
guaucacgguuacauuuau

SEQ ID NO: 289719 - RNA, 19 nt, Homo sapiens
gcaucucccuugcacaguu

SEQ ID NO: 289720 - RNA, 19 nt, Homo sapiens
guaacaagccuccuuuuaa

SEQ ID NO: 289721 - RNA, 19 nt, Homo sapiens
cuaaauugcugagcucguu

SEQ ID NO: 289722 - RNA, 19 nt, Homo sapiens
gauaagagaagauccugau

SEQ ID NO: 289723 - RNA, 19 nt, Homo sapiens
gcuagaaguacacaaggua

SEQ ID NO: 289724 - RNA, 19 nt, Homo sapiens
gaucaaggcauuguaauac

SEQ ID NO: 289725 - RNA, 19 nt, Homo sapiens
aacaagcacuaaacaaaga

SEQ ID NO: 289726 - RNA, 19 nt, Homo sapiens
gaguguggccugaguaaug

SEQ ID NO: 289727 - RNA, 19 nt, Homo sapiens
gcuggugucccuugucuuu

SEQ ID NO: 289728 - RNA, 19 nt, Homo sapiens
acaagguacuacagggaua

SEQ ID NO: 289729 - RNA, 19 nt, Homo sapiens
ccagaucaaggcauuguaa

SEQ ID NO: 289730 - RNA, 19 nt, Homo sapiens
gauaaaagacagugaaaga

SEQ ID NO: 289731 - RNA, 19 nt, Homo sapiens
gauaaaagacagugaaaga

SEQ ID NO: 289732 - RNA, 19 nt, Homo sapiens
gcugagggcauagaaguaa

SEQ ID NO: 289733 - RNA, 19 nt, Homo sapiens
cgaaccaagcuacuaaauu

SEQ ID NO: 289734 - RNA, 19 nt, Homo sapiens
uaacugggaauucuggauu

SEQ ID NO: 289735 - RNA, 19 nt, Homo sapiens
auagauaggucagugcaaa

SEQ ID NO: 289736 - RNA, 19 nt, Homo sapiens
gauuauaugucacuuugcu

SEQ ID NO: 289737 - RNA, 19 nt, Homo sapiens
ggaaacaaaaggauaauga

SEQ ID NO: 289738 - RNA, 19 nt, Homo sapiens
acagagcuauucuccaugu

SEQ ID NO: 289739 - RNA, 19 nt, Homo sapiens
ggaauucuggauuguguau

SEQ ID NO: 289740 - RNA, 19 nt, Homo sapiens
cuacauggaagaccucauu

SEQ ID NO: 289741 - RNA, 19 nt, Homo sapiens
gcugagagacagagcuauu

SEQ ID NO: 289742 - RNA, 19 nt, Homo sapiens
acaaagagugaaggauuua

SEQ ID NO: 289743 - RNA, 19 nt, Homo sapiens
uaagagaagauccugaugu

SEQ ID NO: 289744 - RNA, 19 nt, Homo sapiens
cuacagggauaagagaaga

SEQ ID NO: 289745 - RNA, 19 nt, Homo sapiens
gaccugauuucugagcauu

SEQ ID NO: 289746 - RNA, 19 nt, Homo sapiens
gcuguauacugugugcuaa

SEQ ID NO: 289747 - RNA, 19 nt, Homo sapiens
aagagaagauccugauguc

SEQ ID NO: 289748 - RNA, 19 nt, Homo sapiens
ggacgcaguggcuguguau

SEQ ID NO: 289749 - RNA, 19 nt, Homo sapiens
gguaaaagcaucacaugaa

SEQ ID NO: 289750 - RNA, 19 nt, Homo sapiens
gaugcuacaggauuugaaa

SEQ ID NO: 289751 - RNA, 19 nt, Homo sapiens
aaacaagcacuaaacaaag

SEQ ID NO: 289752 - RNA, 19 nt, Homo sapiens
guacuggcaagaccugauu

SEQ ID NO: 289753 - RNA, 19 nt, Homo sapiens
caaguucuccacuagcuau

SEQ ID NO: 289754 - RNA, 19 nt, Homo sapiens
gccuaugugugcuguauca

SEQ ID NO: 289755 - RNA, 19 nt, Homo sapiens
uguaauaggcguaacuaau

SEQ ID NO: 289756 - RNA, 19 nt, Homo sapiens
gagcuauucuccauguacu

SEQ ID NO: 289757 - RNA, 19 nt, Homo sapiens
gucaauucuugccaaauau

SEQ ID NO: 289758 - RNA, 19 nt, Homo sapiens
guacauagugaggagcuuu

SEQ ID NO: 289759 - RNA, 19 nt, Homo sapiens
guacuacagggauaagaga

SEQ ID NO: 289760 - RNA, 19 nt, Homo sapiens
agaucaaggcauuguaaua

SEQ ID NO: 289761 - RNA, 19 nt, Homo sapiens
uggcuugaguuuaaauugu

SEQ ID NO: 289762 - RNA, 19 nt, Homo sapiens
acaugaacuuguaaaggaa

SEQ ID NO: 289763 - RNA, 19 nt, Homo sapiens
uccaagugauugaaaccua

SEQ ID NO: 289764 - RNA, 19 nt, Homo sapiens
uggaagaccucauuuugaa

SEQ ID NO: 289765 - RNA, 19 nt, Homo sapiens
cuaguguucugauauugga

SEQ ID NO: 289766 - RNA, 19 nt, Homo sapiens
ccugaugucugccugaaag

SEQ ID NO: 289767 - RNA, 19 nt, Homo sapiens
aagaaguccucagcuagaa

SEQ ID NO: 289768 - RNA, 19 nt, Homo sapiens
guguauggguguuggugaa

SEQ ID NO: 289769 - RNA, 19 nt, Homo sapiens
agguagaucuggucuuuag

SEQ ID NO: 289770 - RNA, 19 nt, Homo sapiens
auagggcgcugagggcaua

SEQ ID NO: 289771 - RNA, 19 nt, Homo sapiens
gugccuggcugcaguagca

SEQ ID NO: 289772 - RNA, 19 nt, Homo sapiens
caugaguaacugauuugua

SEQ ID NO: 289773 - RNA, 19 nt, Homo sapiens
ccaguuguuucuacuacau

SEQ ID NO: 289774 - RNA, 19 nt, Homo sapiens
uaucguauuugaugcuaca

SEQ ID NO: 289775 - RNA, 19 nt, Homo sapiens
uaaggcaaguagacaacau

SEQ ID NO: 289776 - RNA, 19 nt, Homo sapiens
gaaguccucagcuagaagu

SEQ ID NO: 289777 - RNA, 19 nt, Homo sapiens
cuggaaaguuuaugguugu

SEQ ID NO: 289778 - RNA, 19 nt, Homo sapiens
ucugaaagcaaccuucuug

SEQ ID NO: 289779 - RNA, 19 nt, Homo sapiens
ggacuuuuguacauaguga

SEQ ID NO: 289780 - RNA, 19 nt, Homo sapiens
ugccuaguguucugauauu

SEQ ID NO: 289781 - RNA, 19 nt, Homo sapiens
gcaucuagcaugucgucaa

SEQ ID NO: 289782 - RNA, 19 nt, Homo sapiens
gaaagccccaugaagaaaa

SEQ ID NO: 289783 - RNA, 19 nt, Homo sapiens
caagguacuacagggauaa

SEQ ID NO: 289784 - RNA, 19 nt, Homo sapiens
ccucugcaguauccaguug

SEQ ID NO: 289785 - RNA, 19 nt, Homo sapiens
gcagggaaaccggcgagaa

SEQ ID NO: 289786 - RNA, 19 nt, Homo sapiens
gaaacagacugccugaauu

SEQ ID NO: 289787 - RNA, 19 nt, Homo sapiens
cagaugagcuuacaaguau

SEQ ID NO: 289788 - RNA, 19 nt, Homo sapiens
cuaaauugcuguuccuuaa

SEQ ID NO: 289789 - RNA, 19 nt, Homo sapiens
gaaauaacccagacuuaau

SEQ ID NO: 289790 - RNA, 19 nt, Homo sapiens
ggaguagaauaccaaauga

SEQ ID NO: 289791 - RNA, 19 nt, Homo sapiens
gcagaugagcuuacaagua

SEQ ID NO: 289792 - RNA, 19 nt, Homo sapiens
gcaaauagaacuaauacug

SEQ ID NO: 289793 - RNA, 19 nt, Homo sapiens
aauauggccuuucuucuaa

SEQ ID NO: 289794 - RNA, 19 nt, Homo sapiens
gaguaggaauuaagugaaa

SEQ ID NO: 289795 - RNA, 19 nt, Homo sapiens
ucaaauacaucuccaguac

SEQ ID NO: 289796 - RNA, 19 nt, Homo sapiens
cuacaaugcuggagacaga

SEQ ID NO: 289797 - RNA, 19 nt, Homo sapiens
gaaguuaugcaugauguaa

SEQ ID NO: 289798 - RNA, 19 nt, Homo sapiens
ggagagugguuacaacaca

SEQ ID NO: 289799 - RNA, 19 nt, Homo sapiens
gagcuuacaaguauugaaa

SEQ ID NO: 289800 - RNA, 19 nt, Homo sapiens
cauuaagccuacaacauuu

SEQ ID NO: 289801 - RNA, 19 nt, Homo sapiens
ggagacagaagcacugauu

SEQ ID NO: 289802 - RNA, 19 nt, Homo sapiens
aaaggucacacuaccauua

SEQ ID NO: 289803 - RNA, 19 nt, Homo sapiens
acgauuaugcccaauauua

SEQ ID NO: 289804 - RNA, 19 nt, Homo sapiens
agaaauaacccagacuuaa

SEQ ID NO: 289805 - RNA, 19 nt, Homo sapiens
aaauauggccuuucuucua

SEQ ID NO: 289806 - RNA, 19 nt, Homo sapiens
ucaagguuguggaguguaa

SEQ ID NO: 289807 - RNA, 19 nt, Homo sapiens
aaugugaaguuaugcauga

SEQ ID NO: 289808 - RNA, 19 nt, Homo sapiens
acauuaagccuacaacauu

SEQ ID NO: 289809 - RNA, 19 nt, Homo sapiens
gagacagaagcacugauua

SEQ ID NO: 289810 - RNA, 19 nt, Homo sapiens
uaacccagacuuaaucuug

SEQ ID NO: 289811 - RNA, 19 nt, Homo sapiens
aaauacaucuccaguacau

SEQ ID NO: 289812 - RNA, 19 nt, Homo sapiens
acagagauguccgucagua

SEQ ID NO: 289813 - RNA, 19 nt, Homo sapiens
aaacagacugccugaauug

SEQ ID NO: 289814 - RNA, 19 nt, Homo sapiens
cgauuaugcccaauauuaa

SEQ ID NO: 289815 - RNA, 19 nt, Homo sapiens
ccaaagugcugggauuaca

SEQ ID NO: 289816 - RNA, 19 nt, Homo sapiens
ggucacacuaccauuauuu

SEQ ID NO: 289817 - RNA, 19 nt, Homo sapiens
uaugggauauuucagauca

SEQ ID NO: 289818 - RNA, 19 nt, Homo sapiens
ccaaaugggagagugguua

SEQ ID NO: 289819 - RNA, 19 nt, Homo sapiens
cagacugccugaauugaga

SEQ ID NO: 289820 - RNA, 19 nt, Homo sapiens
gauacgauuaugcccaaua

SEQ ID NO: 289821 - RNA, 19 nt, Homo sapiens
cagacuuaaucuugaauga

SEQ ID NO: 289822 - RNA, 19 nt, Homo sapiens
ggagugcaguggcgcaauc

SEQ ID NO: 289823 - RNA, 19 nt, Homo sapiens
gggaguaggaauuaaguga

SEQ ID NO: 289824 - RNA, 19 nt, Homo sapiens
aagcacugauuaugggaua

SEQ ID NO: 289825 - RNA, 19 nt, Homo sapiens
gaaucagccuagcaaacug

SEQ ID NO: 289826 - RNA, 19 nt, Homo sapiens
ggaaucagccuagcaaacu

SEQ ID NO: 289827 - RNA, 19 nt, Homo sapiens
ugaaggcucucauuguucu

SEQ ID NO: 289828 - RNA, 19 nt, Homo sapiens
ggaguaggaauuaagugaa

SEQ ID NO: 289829 - RNA, 19 nt, Homo sapiens
cuagcaaacuggauguguu

SEQ ID NO: 289830 - RNA, 19 nt, Homo sapiens
gaugagcuuacaaguauug

SEQ ID NO: 289831 - RNA, 19 nt, Homo sapiens
aagaaauaacccagacuua

SEQ ID NO: 289832 - RNA, 19 nt, Homo sapiens
uaaaggaguagaauaccaa

SEQ ID NO: 289833 - RNA, 19 nt, Homo sapiens
gaacuaauacuggugaaaa

SEQ ID NO: 289834 - RNA, 19 nt, Homo sapiens
gauuaugggauauuucaga

SEQ ID NO: 289835 - RNA, 19 nt, Homo sapiens
gugaaguuaugcaugaugu

SEQ ID NO: 289836 - RNA, 19 nt, Homo sapiens
gcuguuccuuaauuugauu

SEQ ID NO: 289837 - RNA, 19 nt, Homo sapiens
caaaauaccagcugaugaa

SEQ ID NO: 289838 - RNA, 19 nt, Homo sapiens
ccaguacauuccguucuuu

SEQ ID NO: 289839 - RNA, 19 nt, Homo sapiens
gaaaggucacacuaccauu

SEQ ID NO: 289840 - RNA, 19 nt, Homo sapiens
gcacugauuaugggauauu

SEQ ID NO: 289841 - RNA, 19 nt, Homo sapiens
gacagaagcacugauuaug

SEQ ID NO: 289842 - RNA, 19 nt, Homo sapiens
agaaacagacugccugaau

SEQ ID NO: 289843 - RNA, 19 nt, Homo sapiens
agacagaagcacugauuau

SEQ ID NO: 289844 - RNA, 19 nt, Homo sapiens
ccacaaggcauuagagcau

SEQ ID NO: 289845 - RNA, 19 nt, Homo sapiens
guugggcaauaugaaauuu

SEQ ID NO: 289846 - RNA, 19 nt, Homo sapiens
auacgauuaugcccaauau

SEQ ID NO: 289847 - RNA, 19 nt, Homo sapiens
cacauucaguucuuaucaa

SEQ ID NO: 289848 - RNA, 19 nt, Homo sapiens
guagaauaccaaaugauag

SEQ ID NO: 289849 - RNA, 19 nt, Homo sapiens
ccacauucaguucuuauca

SEQ ID NO: 289850 - RNA, 19 nt, Homo sapiens
gagauguccgucaguaugu

SEQ ID NO: 289851 - RNA, 19 nt, Homo sapiens
cacacgagcuacaaacuac

SEQ ID NO: 289852 - RNA, 19 nt, Homo sapiens
ucuaaauugcuguuccuua

SEQ ID NO: 289853 - RNA, 19 nt, Homo sapiens
acacacgagcuacaaacua

SEQ ID NO: 289854 - RNA, 19 nt, Homo sapiens
gccuucaucuguucaguca

SEQ ID NO: 289855 - RNA, 19 nt, Homo sapiens
aaagaaauaacccagacuu

SEQ ID NO: 289856 - RNA, 19 nt, Homo sapiens
aauguucacuaaugugguu

SEQ ID NO: 289857 - RNA, 19 nt, Homo sapiens
ggagaaaucguugucaaaa

SEQ ID NO: 289858 - RNA, 19 nt, Homo sapiens
aaagaggguuguccgugau

SEQ ID NO: 289859 - RNA, 19 nt, Homo sapiens
guucaagguuguggagugu

SEQ ID NO: 289860 - RNA, 19 nt, Homo sapiens
gaccuagcagucaacauga

SEQ ID NO: 289861 - RNA, 19 nt, Homo sapiens
aaauaacccagacuuaauc

SEQ ID NO: 289862 - RNA, 19 nt, Homo sapiens
gacaggguuucaccguguu

SEQ ID NO: 289863 - RNA, 19 nt, Homo sapiens
ggugugaguuggccagaac

SEQ ID NO: 289864 - RNA, 19 nt, Homo sapiens
cuucaucuguucagucauc

SEQ ID NO: 289865 - RNA, 19 nt, Homo sapiens
gauuaugcccaauauuaag

SEQ ID NO: 289866 - RNA, 19 nt, Homo sapiens
aacccagacuuaaucuuga

SEQ ID NO: 289867 - RNA, 19 nt, Homo sapiens
caaaauauggccuuucuuc

SEQ ID NO: 289868 - RNA, 19 nt, Homo sapiens
uuaaaggaguagaauacca

SEQ ID NO: 289869 - RNA, 19 nt, Homo sapiens
gguuacaacacacgagcua

SEQ ID NO: 289870 - RNA, 19 nt, Homo sapiens
gcaaaauaccagcugauga

SEQ ID NO: 289871 - RNA, 19 nt, Homo sapiens
cggccacauucaguucuua

SEQ ID NO: 289872 - RNA, 19 nt, Homo sapiens
auuaagggaguaggaauua

SEQ ID NO: 289873 - RNA, 19 nt, Homo sapiens
cauuaagggaguaggaauu

SEQ ID NO: 289874 - RNA, 19 nt, Homo sapiens
gcuguagcuugugcaaaga

SEQ ID NO: 289875 - RNA, 19 nt, Homo sapiens
aggaguagaauaccaaaug

SEQ ID NO: 289876 - RNA, 19 nt, Homo sapiens
cuuguccuccuuucuguua

SEQ ID NO: 289877 - RNA, 19 nt, Homo sapiens
auacaucuccaguacauuc

SEQ ID NO: 289878 - RNA, 19 nt, Homo sapiens
guucacuaaugugguuauu

SEQ ID NO: 289879 - RNA, 19 nt, Homo sapiens
agagauguccgucaguaug

SEQ ID NO: 289880 - RNA, 19 nt, Homo sapiens
agaaaucguugucaaaaca

SEQ ID NO: 289881 - RNA, 19 nt, Homo sapiens
gagcaguuaaugccuguca

SEQ ID NO: 289882 - RNA, 19 nt, Homo sapiens
ugaggcagaugagcuuaca

SEQ ID NO: 289883 - RNA, 19 nt, Homo sapiens
caaaugauagaaacagacu

SEQ ID NO: 289884 - RNA, 19 nt, Homo sapiens
gaaaagauugggaauggau

SEQ ID NO: 289885 - RNA, 19 nt, Homo sapiens
caacacacgagcuacaaac

SEQ ID NO: 289886 - RNA, 19 nt, Homo sapiens
gcaaaucacuuaacucaaa

SEQ ID NO: 289887 - RNA, 19 nt, Homo sapiens
gcaaguaacugaauccauu

SEQ ID NO: 289888 - RNA, 19 nt, Homo sapiens
guacauauguugucuuuga

SEQ ID NO: 289889 - RNA, 19 nt, Homo sapiens
gcacacaccagguuuaaua

SEQ ID NO: 289890 - RNA, 19 nt, Homo sapiens
aaacaaggcuuaucaccaa

SEQ ID NO: 289891 - RNA, 19 nt, Homo sapiens
uaacugggccuauguagua

SEQ ID NO: 289892 - RNA, 19 nt, Homo sapiens
gaaaggaaccgagcuugua

SEQ ID NO: 289893 - RNA, 19 nt, Homo sapiens
ucacuuuggucucuaauuu

SEQ ID NO: 289894 - RNA, 19 nt, Homo sapiens
gagaagaggaguuuguuaa

SEQ ID NO: 289895 - RNA, 19 nt, Homo sapiens
ggacaacgauggccucuac

SEQ ID NO: 289896 - RNA, 19 nt, Homo sapiens
cguuguggcucuaagauua

SEQ ID NO: 289897 - RNA, 19 nt, Homo sapiens
gagcaaaucacuuaacuca

SEQ ID NO: 289898 - RNA, 19 nt, Homo sapiens
acaaguaucuguaugacaa

SEQ ID NO: 289899 - RNA, 19 nt, Homo sapiens
gugguacuauuuccauuua

SEQ ID NO: 289900 - RNA, 19 nt, Homo sapiens
gaagucggcauuugugaaa

SEQ ID NO: 289901 - RNA, 19 nt, Homo sapiens
gagccacacuuugcaauga

SEQ ID NO: 289902 - RNA, 19 nt, Homo sapiens
caagagcuguaccuccuuu

SEQ ID NO: 289903 - RNA, 19 nt, Homo sapiens
ccacugauauugguaaugu

SEQ ID NO: 289904 - RNA, 19 nt, Homo sapiens
ggagaagaggaguuuguua

SEQ ID NO: 289905 - RNA, 19 nt, Homo sapiens
gaugagauaauguuuguga

SEQ ID NO: 289906 - RNA, 19 nt, Homo sapiens
ggaaauagcguuguuaucg

SEQ ID NO: 289907 - RNA, 19 nt, Homo sapiens
gaagagagggagugagaga

SEQ ID NO: 289908 - RNA, 19 nt, Homo sapiens
cggaaacucagucuauuua

SEQ ID NO: 289909 - RNA, 19 nt, Homo sapiens
acaagaagguggagaucaa

SEQ ID NO: 289910 - RNA, 19 nt, Homo sapiens
gaguuuagaugggaaauag

SEQ ID NO: 289911 - RNA, 19 nt, Homo sapiens
gcacgugucccaccaacaa

SEQ ID NO: 289912 - RNA, 19 nt, Homo sapiens
caaugaaacucuuuagacu

SEQ ID NO: 289913 - RNA, 19 nt, Homo sapiens
gaugggaaauagcguuguu

SEQ ID NO: 289914 - RNA, 19 nt, Homo sapiens
gcgcaaaggagacguuuau

SEQ ID NO: 289915 - RNA, 19 nt, Homo sapiens
gaaaagucccuccagauuu

SEQ ID NO: 289916 - RNA, 19 nt, Homo sapiens
gaacgcaguuuggaugucu

SEQ ID NO: 289917 - RNA, 19 nt, Homo sapiens
agaaguggguguuucaugu

SEQ ID NO: 289918 - RNA, 19 nt, Homo sapiens
cgggaucguuugcaaguaa

SEQ ID NO: 289919 - RNA, 19 nt, Homo sapiens
gauaauguuugugaacugu

SEQ ID NO: 289920 - RNA, 19 nt, Homo sapiens
ccagauuucuaucacuuug

SEQ ID NO: 289921 - RNA, 19 nt, Homo sapiens
ggaaaggcacaaaccagaa

SEQ ID NO: 289922 - RNA, 19 nt, Homo sapiens
guaguagccucauuuacca

SEQ ID NO: 289923 - RNA, 19 nt, Homo sapiens
ccaagugucugcugcucaa

SEQ ID NO: 289924 - RNA, 19 nt, Homo sapiens
gcaaugaaacucuuuagac

SEQ ID NO: 289925 - RNA, 19 nt, Homo sapiens
gagucacgcuuccugauuc

SEQ ID NO: 289926 - RNA, 19 nt, Homo sapiens
gcgacauugugaaggcuua

SEQ ID NO: 289927 - RNA, 19 nt, Homo sapiens
gcuccacgcugaccuccaa

SEQ ID NO: 289928 - RNA, 19 nt, Homo sapiens
gaguuccacuuguaucaug

SEQ ID NO: 289929 - RNA, 19 nt, Homo sapiens
ugugaaggcuuaaaugagu

SEQ ID NO: 289930 - RNA, 19 nt, Homo sapiens
agacguuuauccuuucaaa

SEQ ID NO: 289931 - RNA, 19 nt, Homo sapiens
caggucggguagaguauaa

SEQ ID NO: 289932 - RNA, 19 nt, Homo sapiens
gggcaggucggguagagua

SEQ ID NO: 289933 - RNA, 19 nt, Homo sapiens
cagcuucccuguucugauc

SEQ ID NO: 289934 - RNA, 19 nt, Homo sapiens
gagauaauguuugugaacu

SEQ ID NO: 289935 - RNA, 19 nt, Homo sapiens
ccauuuagccuuugagcaa

SEQ ID NO: 289936 - RNA, 19 nt, Homo sapiens
gaaguggguguuucauguu

SEQ ID NO: 289937 - RNA, 19 nt, Homo sapiens
cgccuuggguuuaaauuau

SEQ ID NO: 289938 - RNA, 19 nt, Homo sapiens
guuaucgccuuggguuuaa

SEQ ID NO: 289939 - RNA, 19 nt, Homo sapiens
ugacaacccgggaucguuu

SEQ ID NO: 289940 - RNA, 19 nt, Homo sapiens
ucuauuaccuggacgagau

SEQ ID NO: 289941 - RNA, 19 nt, Homo sapiens
ugugagaacuggaacaaag

SEQ ID NO: 289942 - RNA, 19 nt, Homo sapiens
caaaggcguuguggcucua

SEQ ID NO: 289943 - RNA, 19 nt, Homo sapiens
caaaucacuuaacucaaag

SEQ ID NO: 289944 - RNA, 19 nt, Homo sapiens
cugaauccauugcgacauu

SEQ ID NO: 289945 - RNA, 19 nt, Homo sapiens
gagggaagcauuucuaaaa

SEQ ID NO: 289946 - RNA, 19 nt, Homo sapiens
gaagguggagaucaaggaa

SEQ ID NO: 289947 - RNA, 19 nt, Homo sapiens
cuauuuccauuuagccuuu

SEQ ID NO: 289948 - RNA, 19 nt, Homo sapiens
gagagggagugagagaaau

SEQ ID NO: 289949 - RNA, 19 nt, Homo sapiens
gaacuggaacaaagaagag

SEQ ID NO: 289950 - RNA, 19 nt, Homo sapiens
ggagacguuuauccuuuca

SEQ ID NO: 289951 - RNA, 19 nt, Homo sapiens
agucuuuggucaucucuaa

SEQ ID NO: 289952 - RNA, 19 nt, Homo sapiens
gaaaggcacaaaccagaag

SEQ ID NO: 289953 - RNA, 19 nt, Homo sapiens
gcaguuuggaugucuuuga

SEQ ID NO: 289954 - RNA, 19 nt, Homo sapiens
gcagaacacgucucagaag

SEQ ID NO: 289955 - RNA, 19 nt, Homo sapiens
gagcuguaccuccuuugaa

SEQ ID NO: 289956 - RNA, 19 nt, Homo sapiens
uaucaccaauggagacaga

SEQ ID NO: 289957 - RNA, 19 nt, Homo sapiens
ggaaacucagucuauuuau

SEQ ID NO: 289958 - RNA, 19 nt, Homo sapiens
cucagggucuccuuucuuu

SEQ ID NO: 289959 - RNA, 19 nt, Homo sapiens
caagggcgagucucuauuc

SEQ ID NO: 289960 - RNA, 19 nt, Homo sapiens
ucuggugugucccaagaua

SEQ ID NO: 289961 - RNA, 19 nt, Homo sapiens
gacagacauugcccggaaa

SEQ ID NO: 289962 - RNA, 19 nt, Homo sapiens
cauuuaccaucguuuguau

SEQ ID NO: 289963 - RNA, 19 nt, Homo sapiens
caaagaagagagggaguga

SEQ ID NO: 289964 - RNA, 19 nt, Homo sapiens
caguguaaaugcuauucuu

SEQ ID NO: 289965 - RNA, 19 nt, Homo sapiens
aggaugagauaauguuugu

SEQ ID NO: 289966 - RNA, 19 nt, Homo sapiens
gacauugcccggaaacuca

SEQ ID NO: 289967 - RNA, 19 nt, Homo sapiens
gcuugucacugggaaagaa

SEQ ID NO: 289968 - RNA, 19 nt, Homo sapiens
gaggagaagaggaguuugu

SEQ ID NO: 289969 - RNA, 19 nt, Homo sapiens
gccuuggguuuaaauuauu

SEQ ID NO: 289970 - RNA, 19 nt, Homo sapiens
gcgcacacaccagguuuaa

SEQ ID NO: 289971 - RNA, 19 nt, Homo sapiens
gcaggucggguagaguaua

SEQ ID NO: 289972 - RNA, 19 nt, Homo sapiens
ggacugguguuaggaugag

SEQ ID NO: 289973 - RNA, 19 nt, Homo sapiens
gugaaggcuuaaaugaguu

SEQ ID NO: 289974 - RNA, 19 nt, Homo sapiens
gguguuaggaugagauaau

SEQ ID NO: 289975 - RNA, 19 nt, Homo sapiens
cacaccagguuuaauagau

SEQ ID NO: 289976 - RNA, 19 nt, Homo sapiens
uauguaguagccucauuua

SEQ ID NO: 289977 - RNA, 19 nt, Homo sapiens
ggucucuaauuucccaaga

SEQ ID NO: 289978 - RNA, 19 nt, Homo sapiens
caaaccagaagucggcauu

SEQ ID NO: 289979 - RNA, 19 nt, Homo sapiens
uuguauuacugaccacaua

SEQ ID NO: 289980 - RNA, 19 nt, Homo sapiens
gaaaagggagucgcguaua

SEQ ID NO: 289981 - RNA, 19 nt, Homo sapiens
gggaugugucacccaaaua

SEQ ID NO: 289982 - RNA, 19 nt, Homo sapiens
aaaagucccuccagauuuc

SEQ ID NO: 289983 - RNA, 19 nt, Homo sapiens
gcccggaaacucagucuau

SEQ ID NO: 289984 - RNA, 19 nt, Homo sapiens
gccacacuuugcaaugaaa

SEQ ID NO: 289985 - RNA, 19 nt, Homo sapiens
cguuuauccuuucaaauuc

SEQ ID NO: 289986 - RNA, 19 nt, Homo sapiens
gaauucaucuugugucuua

SEQ ID NO: 289987 - RNA, 19 nt, Homo sapiens
ucacugagcugaagacaaa

SEQ ID NO: 289988 - RNA, 19 nt, Homo sapiens
gaaauacccucaaaacuaa

SEQ ID NO: 289989 - RNA, 19 nt, Homo sapiens
ggacagagccacaaucuuc

SEQ ID NO: 289990 - RNA, 19 nt, Homo sapiens
ggaugucaguguuuaaauu

SEQ ID NO: 289991 - RNA, 19 nt, Homo sapiens
ggaccacuaugucuugauu

SEQ ID NO: 289992 - RNA, 19 nt, Homo sapiens
ccacaaucuuccucuauuu

SEQ ID NO: 289993 - RNA, 19 nt, Homo sapiens
ggaaauacccucaaaacua

SEQ ID NO: 289994 - RNA, 19 nt, Homo sapiens
ccaaaugaaugcaucacaa

SEQ ID NO: 289995 - RNA, 19 nt, Homo sapiens
gaugugcgaugcuuucuuc

SEQ ID NO: 289996 - RNA, 19 nt, Homo sapiens
gaugcuuucuucuguauug

SEQ ID NO: 289997 - RNA, 19 nt, Homo sapiens
uguauuggcugcucucauu

SEQ ID NO: 289998 - RNA, 19 nt, Homo sapiens
gaaggaccacuaugucuug

SEQ ID NO: 289999 - RNA, 19 nt, Homo sapiens
gccacaaucuuccucuauu

SEQ ID NO: 290000 - RNA, 19 nt, Homo sapiens
augaaugcaucacaacuua

SEQ ID NO: 290001 - RNA, 19 nt, Homo sapiens
ccgacaaccuggaaagauu

SEQ ID NO: 290002 - RNA, 19 nt, Homo sapiens
uggaaggacugauugagaa

SEQ ID NO: 290003 - RNA, 19 nt, Homo sapiens
gaauaaagcaguugaucag

SEQ ID NO: 290004 - RNA, 19 nt, Homo sapiens
gcacugaacccaagcacau

SEQ ID NO: 290005 - RNA, 19 nt, Homo sapiens
cacaggaugucaguguuua

SEQ ID NO: 290006 - RNA, 19 nt, Homo sapiens
caauaugacugcuaaaaga

SEQ ID NO: 290007 - RNA, 19 nt, Homo sapiens
ggaggaccacgaggaaaua

SEQ ID NO: 290008 - RNA, 19 nt, Homo sapiens
gcgaugcuuucuucuguau

SEQ ID NO: 290009 - RNA, 19 nt, Homo sapiens
cuagggaucauguguuuaa

SEQ ID NO: 290010 - RNA, 19 nt, Homo sapiens
ggaucuggcuacuguguca

SEQ ID NO: 290011 - RNA, 19 nt, Homo sapiens
gagaauguuccaauccaaa

SEQ ID NO: 290012 - RNA, 19 nt, Homo sapiens
gagccacaaucuuccucua
